United States Patent 10,655,128 (COMPOSITIONS AND METHODS FOR MODULATING MECP2 EXPRESSION) - sequence listing, part 2

SEQ ID NO: 30923 - DNA, 15 bp, Homo sapiens
caagcccaccagcag

SEQ ID NO: 30924 - DNA, 15 bp, Homo sapiens
acaagcccaccagca

SEQ ID NO: 30925 - DNA, 15 bp, Homo sapiens
gacaagcccaccagc

SEQ ID NO: 30926 - DNA, 15 bp, Homo sapiens
tgacaagcccaccag

SEQ ID NO: 30927 - DNA, 15 bp, Homo sapiens
atgacaagcccacca

SEQ ID NO: 30928 - DNA, 15 bp, Homo sapiens
tatgacaagcccacc

SEQ ID NO: 30929 - DNA, 15 bp, Homo sapiens
ctatgacaagcccac

SEQ ID NO: 30930 - DNA, 15 bp, Homo sapiens
gctatgacaagccca

SEQ ID NO: 30931 - DNA, 15 bp, Homo sapiens
ggctatgacaagccc

SEQ ID NO: 30932 - DNA, 15 bp, Homo sapiens
tggctatgacaagcc

SEQ ID NO: 30933 - DNA, 15 bp, Homo sapiens
ctggctatgacaagc

SEQ ID NO: 30934 - DNA, 15 bp, Homo sapiens
actggctatgacaag

SEQ ID NO: 30935 - DNA, 15 bp, Homo sapiens
cactggctatgacaa

SEQ ID NO: 30936 - DNA, 15 bp, Homo sapiens
ccactggctatgaca

SEQ ID NO: 30937 - DNA, 15 bp, Homo sapiens
cccactggctatgac

SEQ ID NO: 30938 - DNA, 15 bp, Homo sapiens
tcccactggctatga

SEQ ID NO: 30939 - DNA, 15 bp, Homo sapiens
atcccactggctatg

SEQ ID NO: 30940 - DNA, 15 bp, Homo sapiens
aatcccactggctat

SEQ ID NO: 30941 - DNA, 15 bp, Homo sapiens
caatcccactggcta

SEQ ID NO: 30942 - DNA, 15 bp, Homo sapiens
gcaatcccactggct

SEQ ID NO: 30943 - DNA, 15 bp, Homo sapiens
ggcaatcccactggc

SEQ ID NO: 30944 - DNA, 15 bp, Homo sapiens
cggcaatcccactgg

SEQ ID NO: 30945 - DNA, 15 bp, Homo sapiens
ccggcaatcccactg

SEQ ID NO: 30946 - DNA, 15 bp, Homo sapiens
accggcaatcccact

SEQ ID NO: 30947 - DNA, 15 bp, Homo sapiens
gaccggcaatcccac

SEQ ID NO: 30948 - DNA, 15 bp, Homo sapiens
agaccggcaatccca

SEQ ID NO: 30949 - DNA, 15 bp, Homo sapiens
aagaccggcaatccc

SEQ ID NO: 30950 - DNA, 15 bp, Homo sapiens
caagaccggcaatcc

SEQ ID NO: 30951 - DNA, 15 bp, Homo sapiens
tcaagaccggcaatc

SEQ ID NO: 30952 - DNA, 15 bp, Homo sapiens
gtcaagaccggcaat

SEQ ID NO: 30953 - DNA, 15 bp, Homo sapiens
tgtcaagaccggcaa

SEQ ID NO: 30954 - DNA, 15 bp, Homo sapiens
ctgtcaagaccggca

SEQ ID NO: 30955 - DNA, 15 bp, Homo sapiens
gctgtcaagaccggc

SEQ ID NO: 30956 - DNA, 15 bp, Homo sapiens
agctgtcaagaccgg

SEQ ID NO: 30957 - DNA, 15 bp, Homo sapiens
gagctgtcaagaccg

SEQ ID NO: 30958 - DNA, 15 bp, Homo sapiens
tgagctgtcaagacc

SEQ ID NO: 30959 - DNA, 15 bp, Homo sapiens
ctgagctgtcaagac

SEQ ID NO: 30960 - DNA, 15 bp, Homo sapiens
actgagctgtcaaga

SEQ ID NO: 30961 - DNA, 15 bp, Homo sapiens
cactgagctgtcaag

SEQ ID NO: 30962 - DNA, 15 bp, Homo sapiens
tcactgagctgtcaa

SEQ ID NO: 30963 - DNA, 15 bp, Homo sapiens
ctcactgagctgtca

SEQ ID NO: 30964 - DNA, 15 bp, Homo sapiens
gctcactgagctgtc

SEQ ID NO: 30965 - DNA, 15 bp, Homo sapiens
agctcactgagctgt

SEQ ID NO: 30966 - DNA, 15 bp, Homo sapiens
cagctcactgagctg

SEQ ID NO: 30967 - DNA, 15 bp, Homo sapiens
ccagctcactgagct

SEQ ID NO: 30968 - DNA, 15 bp, Homo sapiens
tccagctcactgagc

SEQ ID NO: 30969 - DNA, 15 bp, Homo sapiens
ctccagctcactgag

SEQ ID NO: 30970 - DNA, 15 bp, Homo sapiens
tctccagctcactga

SEQ ID NO: 30971 - DNA, 15 bp, Homo sapiens
atctccagctcactg

SEQ ID NO: 30972 - DNA, 15 bp, Homo sapiens
tatctccagctcact

SEQ ID NO: 30973 - DNA, 15 bp, Homo sapiens
gtatctccagctcac

SEQ ID NO: 30974 - DNA, 15 bp, Homo sapiens
agtatctccagctca

SEQ ID NO: 30975 - DNA, 15 bp, Homo sapiens
aagtatctccagctc

SEQ ID NO: 30976 - DNA, 15 bp, Homo sapiens
caagtatctccagct

SEQ ID NO: 30977 - DNA, 15 bp, Homo sapiens
ccaagtatctccagc

SEQ ID NO: 30978 - DNA, 15 bp, Homo sapiens
accaagtatctccag

SEQ ID NO: 30979 - DNA, 15 bp, Homo sapiens
gaccaagtatctcca

SEQ ID NO: 30980 - DNA, 15 bp, Homo sapiens
tgaccaagtatctcc

SEQ ID NO: 30981 - DNA, 15 bp, Homo sapiens
gtgaccaagtatctc

SEQ ID NO: 30982 - DNA, 15 bp, Homo sapiens
tgtgaccaagtatct

SEQ ID NO: 30983 - DNA, 15 bp, Homo sapiens
ctgtgaccaagtatc

SEQ ID NO: 30984 - DNA, 15 bp, Homo sapiens
gctgtgaccaagtat

SEQ ID NO: 30985 - DNA, 15 bp, Homo sapiens
ggctgtgaccaagta

SEQ ID NO: 30986 - DNA, 15 bp, Homo sapiens
tggctgtgaccaagt

SEQ ID NO: 30987 - DNA, 15 bp, Homo sapiens
ctggctgtgaccaag

SEQ ID NO: 30988 - DNA, 15 bp, Homo sapiens
cctggctgtgaccaa

SEQ ID NO: 30989 - DNA, 15 bp, Homo sapiens
gcctggctgtgacca

SEQ ID NO: 30990 - DNA, 15 bp, Homo sapiens
cgcctggctgtgacc

SEQ ID NO: 30991 - DNA, 15 bp, Homo sapiens
gcgcctggctgtgac

SEQ ID NO: 30992 - DNA, 15 bp, Homo sapiens
agcgcctggctgtga

SEQ ID NO: 30993 - DNA, 15 bp, Homo sapiens
tagcgcctggctgtg

SEQ ID NO: 30994 - DNA, 15 bp, Homo sapiens
ctagcgcctggctgt

SEQ ID NO: 30995 - DNA, 15 bp, Homo sapiens
gctagcgcctggctg

SEQ ID NO: 30996 - DNA, 15 bp, Homo sapiens
tgctagcgcctggct

SEQ ID NO: 30997 - DNA, 15 bp, Homo sapiens
gtgctagcgcctggc

SEQ ID NO: 30998 - DNA, 15 bp, Homo sapiens
tgtgctagcgcctgg

SEQ ID NO: 30999 - DNA, 15 bp, Homo sapiens
ctgtgctagcgcctg

SEQ ID NO: 31000 - DNA, 15 bp, Homo sapiens
gctgtgctagcgcct

SEQ ID NO: 31001 - DNA, 15 bp, Homo sapiens
agctgtgctagcgcc

SEQ ID NO: 31002 - DNA, 15 bp, Homo sapiens
gagctgtgctagcgc

SEQ ID NO: 31003 - DNA, 15 bp, Homo sapiens
ggagctgtgctagcg

SEQ ID NO: 31004 - DNA, 15 bp, Homo sapiens
gggagctgtgctagc

SEQ ID NO: 31005 - DNA, 15 bp, Homo sapiens
agggagctgtgctag

SEQ ID NO: 31006 - DNA, 15 bp, Homo sapiens
aagggagctgtgcta

SEQ ID NO: 31007 - DNA, 15 bp, Homo sapiens
gaagggagctgtgct

SEQ ID NO: 31008 - DNA, 15 bp, Homo sapiens
agaagggagctgtgc

SEQ ID NO: 31009 - DNA, 15 bp, Homo sapiens
cagaagggagctgtg

SEQ ID NO: 31010 - DNA, 15 bp, Homo sapiens
acagaagggagctgt

SEQ ID NO: 31011 - DNA, 15 bp, Homo sapiens
aacagaagggagctg

SEQ ID NO: 31012 - DNA, 15 bp, Homo sapiens
caacagaagggagct

SEQ ID NO: 31013 - DNA, 15 bp, Homo sapiens
tcaacagaagggagc

SEQ ID NO: 31014 - DNA, 15 bp, Homo sapiens
atcaacagaagggag

SEQ ID NO: 31015 - DNA, 15 bp, Homo sapiens
catcaacagaaggga

SEQ ID NO: 31016 - DNA, 15 bp, Homo sapiens
gcatcaacagaaggg

SEQ ID NO: 31017 - DNA, 15 bp, Homo sapiens
agcatcaacagaagg

SEQ ID NO: 31018 - DNA, 15 bp, Homo sapiens
cagcatcaacagaag

SEQ ID NO: 31019 - DNA, 15 bp, Homo sapiens
acagcatcaacagaa

SEQ ID NO: 31020 - DNA, 15 bp, Homo sapiens
tacagcatcaacaga

SEQ ID NO: 31021 - DNA, 15 bp, Homo sapiens
atacagcatcaacag

SEQ ID NO: 31022 - DNA, 15 bp, Homo sapiens
aatacagcatcaaca

SEQ ID NO: 31023 - DNA, 15 bp, Homo sapiens
gaatacagcatcaac

SEQ ID NO: 31024 - DNA, 15 bp, Homo sapiens
ggaatacagcatcaa

SEQ ID NO: 31025 - DNA, 15 bp, Homo sapiens
gggaatacagcatca

SEQ ID NO: 31026 - DNA, 15 bp, Homo sapiens
tgggaatacagcatc

SEQ ID NO: 31027 - DNA, 15 bp, Homo sapiens
atgggaatacagcat

SEQ ID NO: 31028 - DNA, 15 bp, Homo sapiens
tatgggaatacagca

SEQ ID NO: 31029 - DNA, 15 bp, Homo sapiens
atatgggaatacagc

SEQ ID NO: 31030 - DNA, 15 bp, Homo sapiens
gatatgggaatacag

SEQ ID NO: 31031 - DNA, 15 bp, Homo sapiens
tgatatgggaataca

SEQ ID NO: 31032 - DNA, 15 bp, Homo sapiens
ttgatatgggaatac

SEQ ID NO: 31033 - DNA, 15 bp, Homo sapiens
tttgatatgggaata

SEQ ID NO: 31034 - DNA, 15 bp, Homo sapiens
ttttgatatgggaat

SEQ ID NO: 31035 - DNA, 15 bp, Homo sapiens
cttttgatatgggaa

SEQ ID NO: 31036 - DNA, 15 bp, Homo sapiens
tcttttgatatggga

SEQ ID NO: 31037 - DNA, 15 bp, Homo sapiens
gtcttttgatatggg

SEQ ID NO: 31038 - DNA, 15 bp, Homo sapiens
tgtcttttgatatgg

SEQ ID NO: 31039 - DNA, 15 bp, Homo sapiens
gtgtcttttgatatg

SEQ ID NO: 31040 - DNA, 15 bp, Homo sapiens
tgtgtcttttgatat

SEQ ID NO: 31041 - DNA, 15 bp, Homo sapiens
ctgtgtcttttgata

SEQ ID NO: 31042 - DNA, 15 bp, Homo sapiens
cctgtgtcttttgat

SEQ ID NO: 31043 - DNA, 15 bp, Homo sapiens
ccctgtgtcttttga

SEQ ID NO: 31044 - DNA, 15 bp, Homo sapiens
cccctgtgtcttttg

SEQ ID NO: 31045 - DNA, 15 bp, Homo sapiens
tcccctgtgtctttt

SEQ ID NO: 31046 - DNA, 15 bp, Homo sapiens
gtcccctgtgtcttt

SEQ ID NO: 31047 - DNA, 15 bp, Homo sapiens
tgtcccctgtgtctt

SEQ ID NO: 31048 - DNA, 15 bp, Homo sapiens
gtgtcccctgtgtct

SEQ ID NO: 31049 - DNA, 15 bp, Homo sapiens
ggtgtcccctgtgtc

SEQ ID NO: 31050 - DNA, 15 bp, Homo sapiens
gggtgtcccctgtgt

SEQ ID NO: 31051 - DNA, 15 bp, Homo sapiens
tgggtgtcccctgtg

SEQ ID NO: 31052 - DNA, 15 bp, Homo sapiens
ctgggtgtcccctgt

SEQ ID NO: 31053 - DNA, 15 bp, Homo sapiens
tctgggtgtcccctg

SEQ ID NO: 31054 - DNA, 15 bp, Homo sapiens
ttctgggtgtcccct

SEQ ID NO: 31055 - DNA, 15 bp, Homo sapiens
tttctgggtgtcccc

SEQ ID NO: 31056 - DNA, 15 bp, Homo sapiens
gtttctgggtgtccc

SEQ ID NO: 31057 - DNA, 15 bp, Homo sapiens
cgtttctgggtgtcc

SEQ ID NO: 31058 - DNA, 15 bp, Homo sapiens
gcgtttctgggtgtc

SEQ ID NO: 31059 - DNA, 15 bp, Homo sapiens
ggcgtttctgggtgt

SEQ ID NO: 31060 - DNA, 15 bp, Homo sapiens
tggcgtttctgggtg

SEQ ID NO: 31061 - DNA, 15 bp, Homo sapiens
gtggcgtttctgggt

SEQ ID NO: 31062 - DNA, 15 bp, Homo sapiens
tgtggcgtttctggg

SEQ ID NO: 31063 - DNA, 15 bp, Homo sapiens
atgtggcgtttctgg

SEQ ID NO: 31064 - DNA, 15 bp, Homo sapiens
gatgtggcgtttctg

SEQ ID NO: 31065 - DNA, 15 bp, Homo sapiens
ggatgtggcgtttct

SEQ ID NO: 31066 - DNA, 15 bp, Homo sapiens
gggatgtggcgtttc

SEQ ID NO: 31067 - DNA, 15 bp, Homo sapiens
ggggatgtggcgttt

SEQ ID NO: 31068 - DNA, 15 bp, Homo sapiens
gggggatgtggcgtt

SEQ ID NO: 31069 - DNA, 15 bp, Homo sapiens
tgggggatgtggcgt

SEQ ID NO: 31070 - DNA, 15 bp, Homo sapiens
ttgggggatgtggcg

SEQ ID NO: 31071 - DNA, 15 bp, Homo sapiens
attgggggatgtggc

SEQ ID NO: 31072 - DNA, 15 bp, Homo sapiens
gattgggggatgtgg

SEQ ID NO: 31073 - DNA, 15 bp, Homo sapiens
ggattgggggatgtg

SEQ ID NO: 31074 - DNA, 15 bp, Homo sapiens
tggattgggggatgt

SEQ ID NO: 31075 - DNA, 15 bp, Homo sapiens
atggattgggggatg

SEQ ID NO: 31076 - DNA, 15 bp, Homo sapiens
gatggattgggggat

SEQ ID NO: 31077 - DNA, 15 bp, Homo sapiens
tgatggattggggga

SEQ ID NO: 31078 - DNA, 15 bp, Homo sapiens
ctgatggattggggg

SEQ ID NO: 31079 - DNA, 15 bp, Homo sapiens
actgatggattgggg

SEQ ID NO: 31080 - DNA, 15 bp, Homo sapiens
cactgatggattggg

SEQ ID NO: 31081 - DNA, 15 bp, Homo sapiens
gcactgatggattgg

SEQ ID NO: 31082 - DNA, 15 bp, Homo sapiens
ggcactgatggattg

SEQ ID NO: 31083 - DNA, 15 bp, Homo sapiens
tggcactgatggatt

SEQ ID NO: 31084 - DNA, 15 bp, Homo sapiens
ttggcactgatggat

SEQ ID NO: 31085 - DNA, 15 bp, Homo sapiens
tttggcactgatgga

SEQ ID NO: 31086 - DNA, 15 bp, Homo sapiens
gtttggcactgatgg

SEQ ID NO: 31087 - DNA, 15 bp, Homo sapiens
agtttggcactgatg

SEQ ID NO: 31088 - DNA, 15 bp, Homo sapiens
tagtttggcactgat

SEQ ID NO: 31089 - DNA, 15 bp, Homo sapiens
ctagtttggcactga

SEQ ID NO: 31090 - DNA, 15 bp, Homo sapiens
gctagtttggcactg

SEQ ID NO: 31091 - DNA, 15 bp, Homo sapiens
ggctagtttggcact

SEQ ID NO: 31092 - DNA, 15 bp, Homo sapiens
tggctagtttggcac

SEQ ID NO: 31093 - DNA, 15 bp, Homo sapiens
ttggctagtttggca

SEQ ID NO: 31094 - DNA, 15 bp, Homo sapiens
gttggctagtttggc

SEQ ID NO: 31095 - DNA, 15 bp, Homo sapiens
cgttggctagtttgg

SEQ ID NO: 31096 - DNA, 15 bp, Homo sapiens
ccgttggctagtttg

SEQ ID NO: 31097 - DNA, 15 bp, Homo sapiens
gccgttggctagttt

SEQ ID NO: 31098 - DNA, 15 bp, Homo sapiens
ggccgttggctagtt

SEQ ID NO: 31099 - DNA, 15 bp, Homo sapiens
gggccgttggctagt

SEQ ID NO: 31100 - DNA, 15 bp, Homo sapiens
ggggccgttggctag

SEQ ID NO: 31101 - DNA, 15 bp, Homo sapiens
tggggccgttggcta

SEQ ID NO: 31102 - DNA, 15 bp, Homo sapiens
ctggggccgttggct

SEQ ID NO: 31103 - DNA, 15 bp, Homo sapiens
gctggggccgttggc

SEQ ID NO: 31104 - DNA, 15 bp, Homo sapiens
agctggggccgttgg

SEQ ID NO: 31105 - DNA, 15 bp, Homo sapiens
aagctggggccgttg

SEQ ID NO: 31106 - DNA, 15 bp, Homo sapiens
gaagctggggccgtt

SEQ ID NO: 31107 - DNA, 15 bp, Homo sapiens
agaagctggggccgt

SEQ ID NO: 31108 - DNA, 15 bp, Homo sapiens
gagaagctggggccg

SEQ ID NO: 31109 - DNA, 15 bp, Homo sapiens
tgagaagctggggcc

SEQ ID NO: 31110 - DNA, 15 bp, Homo sapiens
ctgagaagctggggc

SEQ ID NO: 31111 - DNA, 15 bp, Homo sapiens
gctgagaagctgggg

SEQ ID NO: 31112 - DNA, 15 bp, Homo sapiens
agctgagaagctggg

SEQ ID NO: 31113 - DNA, 15 bp, Homo sapiens
gagctgagaagctgg

SEQ ID NO: 31114 - DNA, 15 bp, Homo sapiens
cgagctgagaagctg

SEQ ID NO: 31115 - DNA, 15 bp, Homo sapiens
gcgagctgagaagct

SEQ ID NO: 31116 - DNA, 15 bp, Homo sapiens
agcgagctgagaagc

SEQ ID NO: 31117 - DNA, 15 bp, Homo sapiens
cagcgagctgagaag

SEQ ID NO: 31118 - DNA, 15 bp, Homo sapiens
ccagcgagctgagaa

SEQ ID NO: 31119 - DNA, 15 bp, Homo sapiens
tccagcgagctgaga

SEQ ID NO: 31120 - DNA, 15 bp, Homo sapiens
atccagcgagctgag

SEQ ID NO: 31121 - DNA, 15 bp, Homo sapiens
catccagcgagctga

SEQ ID NO: 31122 - DNA, 15 bp, Homo sapiens
ccatccagcgagctg

SEQ ID NO: 31123 - DNA, 15 bp, Homo sapiens
gccatccagcgagct

SEQ ID NO: 31124 - DNA, 15 bp, Homo sapiens
cgccatccagcgagc

SEQ ID NO: 31125 - DNA, 15 bp, Homo sapiens
ccgccatccagcgag

SEQ ID NO: 31126 - DNA, 15 bp, Homo sapiens
tccgccatccagcga

SEQ ID NO: 31127 - DNA, 15 bp, Homo sapiens
ttccgccatccagcg

SEQ ID NO: 31128 - DNA, 15 bp, Homo sapiens
cttccgccatccagc

SEQ ID NO: 31129 - DNA, 15 bp, Homo sapiens
gcttccgccatccag

SEQ ID NO: 31130 - DNA, 15 bp, Homo sapiens
agcttccgccatcca

SEQ ID NO: 31131 - DNA, 15 bp, Homo sapiens
cagcttccgccatcc

SEQ ID NO: 31132 - DNA, 15 bp, Homo sapiens
gcagcttccgccatc

SEQ ID NO: 31133 - DNA, 15 bp, Homo sapiens
agcagcttccgccat

SEQ ID NO: 31134 - DNA, 15 bp, Homo sapiens
tagcagcttccgcca

SEQ ID NO: 31135 - DNA, 15 bp, Homo sapiens
gtagcagcttccgcc

SEQ ID NO: 31136 - DNA, 15 bp, Homo sapiens
agtagcagcttccgc

SEQ ID NO: 31137 - DNA, 15 bp, Homo sapiens
gagtagcagcttccg

SEQ ID NO: 31138 - DNA, 15 bp, Homo sapiens
cgagtagcagcttcc

SEQ ID NO: 31139 - DNA, 15 bp, Homo sapiens
acgagtagcagcttc

SEQ ID NO: 31140 - DNA, 15 bp, Homo sapiens
cacgagtagcagctt

SEQ ID NO: 31141 - DNA, 15 bp, Homo sapiens
tcacgagtagcagct

SEQ ID NO: 31142 - DNA, 15 bp, Homo sapiens
ctcacgagtagcagc

SEQ ID NO: 31143 - DNA, 15 bp, Homo sapiens
gctcacgagtagcag

SEQ ID NO: 31144 - DNA, 15 bp, Homo sapiens
cgctcacgagtagca

SEQ ID NO: 31145 - DNA, 15 bp, Homo sapiens
gcgctcacgagtagc

SEQ ID NO: 31146 - DNA, 15 bp, Homo sapiens
ggcgctcacgagtag

SEQ ID NO: 31147 - DNA, 15 bp, Homo sapiens
tggcgctcacgagta

SEQ ID NO: 31148 - DNA, 15 bp, Homo sapiens
ctggcgctcacgagt

SEQ ID NO: 31149 - DNA, 15 bp, Homo sapiens
actggcgctcacgag

SEQ ID NO: 31150 - DNA, 15 bp, Homo sapiens
cactggcgctcacga

SEQ ID NO: 31151 - DNA, 15 bp, Homo sapiens
gcactggcgctcacg

SEQ ID NO: 31152 - DNA, 15 bp, Homo sapiens
cgcactggcgctcac

SEQ ID NO: 31153 - DNA, 15 bp, Homo sapiens
ccgcactggcgctca

SEQ ID NO: 31154 - DNA, 15 bp, Homo sapiens
cccgcactggcgctc

SEQ ID NO: 31155 - DNA, 15 bp, Homo sapiens
acccgcactggcgct

SEQ ID NO: 31156 - DNA, 15 bp, Homo sapiens
cacccgcactggcgc

SEQ ID NO: 31157 - DNA, 15 bp, Homo sapiens
gcacccgcactggcg

SEQ ID NO: 31158 - DNA, 15 bp, Homo sapiens
tgcacccgcactggc

SEQ ID NO: 31159 - DNA, 15 bp, Homo sapiens
ctgcacccgcactgg

SEQ ID NO: 31160 - DNA, 15 bp, Homo sapiens
tctgcacccgcactg

SEQ ID NO: 31161 - DNA, 15 bp, Homo sapiens
gtctgcacccgcact

SEQ ID NO: 31162 - DNA, 15 bp, Homo sapiens
tgtctgcacccgcac

SEQ ID NO: 31163 - DNA, 15 bp, Homo sapiens
ttgtctgcacccgca

SEQ ID NO: 31164 - DNA, 15 bp, Homo sapiens
attgtctgcacccgc

SEQ ID NO: 31165 - DNA, 15 bp, Homo sapiens
gattgtctgcacccg

SEQ ID NO: 31166 - DNA, 15 bp, Homo sapiens
agattgtctgcaccc

SEQ ID NO: 31167 - DNA, 15 bp, Homo sapiens
aagattgtctgcacc

SEQ ID NO: 31168 - DNA, 15 bp, Homo sapiens
gaagattgtctgcac

SEQ ID NO: 31169 - DNA, 15 bp, Homo sapiens
agaagattgtctgca

SEQ ID NO: 31170 - DNA, 15 bp, Homo sapiens
cagaagattgtctgc

SEQ ID NO: 31171 - DNA, 15 bp, Homo sapiens
acagaagattgtctg

SEQ ID NO: 31172 - DNA, 15 bp, Homo sapiens
aacagaagattgtct

SEQ ID NO: 31173 - DNA, 15 bp, Homo sapiens
caacagaagattgtc

SEQ ID NO: 31174 - DNA, 15 bp, Homo sapiens
ccaacagaagattgt

SEQ ID NO: 31175 - DNA, 15 bp, Homo sapiens
cccaacagaagattg

SEQ ID NO: 31176 - DNA, 15 bp, Homo sapiens
acccaacagaagatt

SEQ ID NO: 31177 - DNA, 15 bp, Homo sapiens
cacccaacagaagat

SEQ ID NO: 31178 - DNA, 15 bp, Homo sapiens
ccacccaacagaaga

SEQ ID NO: 31179 - DNA, 15 bp, Homo sapiens
gccacccaacagaag

SEQ ID NO: 31180 - DNA, 15 bp, Homo sapiens
tgccacccaacagaa

SEQ ID NO: 31181 - DNA, 15 bp, Homo sapiens
atgccacccaacaga

SEQ ID NO: 31182 - DNA, 15 bp, Homo sapiens
gatgccacccaacag

SEQ ID NO: 31183 - DNA, 15 bp, Homo sapiens
tgatgccacccaaca

SEQ ID NO: 31184 - DNA, 15 bp, Homo sapiens
atgatgccacccaac

SEQ ID NO: 31185 - DNA, 15 bp, Homo sapiens
aatgatgccacccaa

SEQ ID NO: 31186 - DNA, 15 bp, Homo sapiens
gaatgatgccaccca

SEQ ID NO: 31187 - DNA, 15 bp, Homo sapiens
ggaatgatgccaccc

SEQ ID NO: 31188 - DNA, 15 bp, Homo sapiens
tggaatgatgccacc

SEQ ID NO: 31189 - DNA, 15 bp, Homo sapiens
ctggaatgatgccac

SEQ ID NO: 31190 - DNA, 15 bp, Homo sapiens
cctggaatgatgcca

SEQ ID NO: 31191 - DNA, 15 bp, Homo sapiens
gcctggaatgatgcc

SEQ ID NO: 31192 - DNA, 15 bp, Homo sapiens
ggcctggaatgatgc

SEQ ID NO: 31193 - DNA, 15 bp, Homo sapiens
gggcctggaatgatg

SEQ ID NO: 31194 - DNA, 15 bp, Homo sapiens
cgggcctggaatgat

SEQ ID NO: 31195 - DNA, 15 bp, Homo sapiens
tcgggcctggaatga

SEQ ID NO: 31196 - DNA, 15 bp, Homo sapiens
ttcgggcctggaatg

SEQ ID NO: 31197 - DNA, 15 bp, Homo sapiens
cttcgggcctggaat

SEQ ID NO: 31198 - DNA, 15 bp, Homo sapiens
gcttcgggcctggaa

SEQ ID NO: 31199 - DNA, 15 bp, Homo sapiens
tgcttcgggcctgga

SEQ ID NO: 31200 - DNA, 15 bp, Homo sapiens
atgcttcgggcctgg

SEQ ID NO: 31201 - DNA, 15 bp, Homo sapiens
catgcttcgggcctg

SEQ ID NO: 31202 - DNA, 15 bp, Homo sapiens
tcatgcttcgggcct

SEQ ID NO: 31203 - DNA, 15 bp, Homo sapiens
ttcatgcttcgggcc

SEQ ID NO: 31204 - DNA, 15 bp, Homo sapiens
gttcatgcttcgggc

SEQ ID NO: 31205 - DNA, 15 bp, Homo sapiens
tgttcatgcttcggg

SEQ ID NO: 31206 - DNA, 15 bp, Homo sapiens
ctgttcatgcttcgg

SEQ ID NO: 31207 - DNA, 15 bp, Homo sapiens
actgttcatgcttcg

SEQ ID NO: 31208 - DNA, 15 bp, Homo sapiens
cactgttcatgcttc

SEQ ID NO: 31209 - DNA, 15 bp, Homo sapiens
gcactgttcatgctt

SEQ ID NO: 31210 - DNA, 15 bp, Homo sapiens
tgcactgttcatgct

SEQ ID NO: 31211 - DNA, 15 bp, Homo sapiens
gtgcactgttcatgc

SEQ ID NO: 31212 - DNA, 15 bp, Homo sapiens
ggtgcactgttcatg

SEQ ID NO: 31213 - DNA, 15 bp, Homo sapiens
aggtgcactgttcat

SEQ ID NO: 31214 - DNA, 15 bp, Homo sapiens
caggtgcactgttca

SEQ ID NO: 31215 - DNA, 15 bp, Homo sapiens
ccaggtgcactgttc

SEQ ID NO: 31216 - DNA, 15 bp, Homo sapiens
cccaggtgcactgtt

SEQ ID NO: 31217 - DNA, 15 bp, Homo sapiens
tcccaggtgcactgt

SEQ ID NO: 31218 - DNA, 15 bp, Homo sapiens
gtcccaggtgcactg

SEQ ID NO: 31219 - DNA, 15 bp, Homo sapiens
tgtcccaggtgcact

SEQ ID NO: 31220 - DNA, 15 bp, Homo sapiens
ctgtcccaggtgcac

SEQ ID NO: 31221 - DNA, 15 bp, Homo sapiens
cctgtcccaggtgca

SEQ ID NO: 31222 - DNA, 15 bp, Homo sapiens
ccctgtcccaggtgc

SEQ ID NO: 31223 - DNA, 15 bp, Homo sapiens
tccctgtcccaggtg

SEQ ID NO: 31224 - DNA, 15 bp, Homo sapiens
ctccctgtcccaggt

SEQ ID NO: 31225 - DNA, 15 bp, Homo sapiens
gctccctgtcccagg

SEQ ID NO: 31226 - DNA, 15 bp, Homo sapiens
tgctccctgtcccag

SEQ ID NO: 31227 - DNA, 15 bp, Homo sapiens
ctgctccctgtccca

SEQ ID NO: 31228 - DNA, 15 bp, Homo sapiens
gctgctccctgtccc

SEQ ID NO: 31229 - DNA, 15 bp, Homo sapiens
ggctgctccctgtcc

SEQ ID NO: 31230 - DNA, 15 bp, Homo sapiens
gggctgctccctgtc

SEQ ID NO: 31231 - DNA, 15 bp, Homo sapiens
ggggctgctccctgt

SEQ ID NO: 31232 - DNA, 15 bp, Homo sapiens
tggggctgctccctg

SEQ ID NO: 31233 - DNA, 15 bp, Homo sapiens
ttggggctgctccct

SEQ ID NO: 31234 - DNA, 15 bp, Homo sapiens
tttggggctgctccc

SEQ ID NO: 31235 - DNA, 15 bp, Homo sapiens
atttggggctgctcc

SEQ ID NO: 31236 - DNA, 15 bp, Homo sapiens
aatttggggctgctc

SEQ ID NO: 31237 - DNA, 15 bp, Homo sapiens
caatttggggctgct

SEQ ID NO: 31238 - DNA, 15 bp, Homo sapiens
acaatttggggctgc

SEQ ID NO: 31239 - DNA, 15 bp, Homo sapiens
gacaatttggggctg

SEQ ID NO: 31240 - DNA, 15 bp, Homo sapiens
tgacaatttggggct

SEQ ID NO: 31241 - DNA, 15 bp, Homo sapiens
gtgacaatttggggc

SEQ ID NO: 31242 - DNA, 15 bp, Homo sapiens
ggtgacaatttgggg

SEQ ID NO: 31243 - DNA, 15 bp, Homo sapiens
aggtgacaatttggg

SEQ ID NO: 31244 - DNA, 15 bp, Homo sapiens
caggtgacaatttgg

SEQ ID NO: 31245 - DNA, 15 bp, Homo sapiens
gcaggtgacaatttg

SEQ ID NO: 31246 - DNA, 15 bp, Homo sapiens
agcaggtgacaattt

SEQ ID NO: 31247 - DNA, 15 bp, Homo sapiens
aagcaggtgacaatt

SEQ ID NO: 31248 - DNA, 15 bp, Homo sapiens
gaagcaggtgacaat

SEQ ID NO: 31249 - DNA, 15 bp, Homo sapiens
agaagcaggtgacaa

SEQ ID NO: 31250 - DNA, 15 bp, Homo sapiens
gagaagcaggtgaca

SEQ ID NO: 31251 - DNA, 15 bp, Homo sapiens
agagaagcaggtgac

SEQ ID NO: 31252 - DNA, 15 bp, Homo sapiens
cagagaagcaggtga

SEQ ID NO: 31253 - DNA, 15 bp, Homo sapiens
gcagagaagcaggtg

SEQ ID NO: 31254 - DNA, 15 bp, Homo sapiens
ggcagagaagcaggt

SEQ ID NO: 31255 - DNA, 15 bp, Homo sapiens
gggcagagaagcagg

SEQ ID NO: 31256 - DNA, 15 bp, Homo sapiens
tgggcagagaagcag

SEQ ID NO: 31257 - DNA, 15 bp, Homo sapiens
ctgggcagagaagca

SEQ ID NO: 31258 - DNA, 15 bp, Homo sapiens
gctgggcagagaagc

SEQ ID NO: 31259 - DNA, 15 bp, Homo sapiens
agctgggcagagaag

SEQ ID NO: 31260 - DNA, 15 bp, Homo sapiens
aagctgggcagagaa

SEQ ID NO: 31261 - DNA, 15 bp, Homo sapiens
aaagctgggcagaga

SEQ ID NO: 31262 - DNA, 15 bp, Homo sapiens
aaaagctgggcagag

SEQ ID NO: 31263 - DNA, 15 bp, Homo sapiens
gaaaagctgggcaga

SEQ ID NO: 31264 - DNA, 15 bp, Homo sapiens
tgaaaagctgggcag

SEQ ID NO: 31265 - DNA, 15 bp, Homo sapiens
atgaaaagctgggca

SEQ ID NO: 31266 - DNA, 15 bp, Homo sapiens
aatgaaaagctgggc

SEQ ID NO: 31267 - DNA, 15 bp, Homo sapiens
caatgaaaagctggg

SEQ ID NO: 31268 - DNA, 15 bp, Homo sapiens
gcaatgaaaagctgg

SEQ ID NO: 31269 - DNA, 15 bp, Homo sapiens
agcaatgaaaagctg

SEQ ID NO: 31270 - DNA, 15 bp, Homo sapiens
cagcaatgaaaagct

SEQ ID NO: 31271 - DNA, 15 bp, Homo sapiens
acagcaatgaaaagc

SEQ ID NO: 31272 - DNA, 15 bp, Homo sapiens
cacagcaatgaaaag

SEQ ID NO: 31273 - DNA, 15 bp, Homo sapiens
tcacagcaatgaaaa

SEQ ID NO: 31274 - DNA, 15 bp, Homo sapiens
gtcacagcaatgaaa

SEQ ID NO: 31275 - DNA, 15 bp, Homo sapiens
tgtcacagcaatgaa

SEQ ID NO: 31276 - DNA, 15 bp, Homo sapiens
ctgtcacagcaatga

SEQ ID NO: 31277 - DNA, 15 bp, Homo sapiens
actgtcacagcaatg

SEQ ID NO: 31278 - DNA, 15 bp, Homo sapiens
cactgtcacagcaat

SEQ ID NO: 31279 - DNA, 15 bp, Homo sapiens
tcactgtcacagcaa

SEQ ID NO: 31280 - DNA, 15 bp, Homo sapiens
atcactgtcacagca

SEQ ID NO: 31281 - DNA, 15 bp, Homo sapiens
catcactgtcacagc

SEQ ID NO: 31282 - DNA, 15 bp, Homo sapiens
ccatcactgtcacag

SEQ ID NO: 31283 - DNA, 15 bp, Homo sapiens
gccatcactgtcaca

SEQ ID NO: 31284 - DNA, 15 bp, Homo sapiens
cgccatcactgtcac

SEQ ID NO: 31285 - DNA, 15 bp, Homo sapiens
tcgccatcactgtca

SEQ ID NO: 31286 - DNA, 15 bp, Homo sapiens
ttcgccatcactgtc

SEQ ID NO: 31287 - DNA, 15 bp, Homo sapiens
tttcgccatcactgt

SEQ ID NO: 31288 - DNA, 15 bp, Homo sapiens
ctttcgccatcactg

SEQ ID NO: 31289 - DNA, 15 bp, Homo sapiens
tctttcgccatcact

SEQ ID NO: 31290 - DNA, 15 bp, Homo sapiens
ctctttcgccatcac

SEQ ID NO: 31291 - DNA, 15 bp, Homo sapiens
cctctttcgccatca

SEQ ID NO: 31292 - DNA, 15 bp, Homo sapiens
ccctctttcgccatc

SEQ ID NO: 31293 - DNA, 15 bp, Homo sapiens
accctctttcgccat

SEQ ID NO: 31294 - DNA, 15 bp, Homo sapiens
taccctctttcgcca

SEQ ID NO: 31295 - DNA, 15 bp, Homo sapiens
ttaccctctttcgcc

SEQ ID NO: 31296 - DNA, 15 bp, Homo sapiens
attaccctctttcgc

SEQ ID NO: 31297 - DNA, 15 bp, Homo sapiens
tattaccctctttcg

SEQ ID NO: 31298 - DNA, 15 bp, Homo sapiens
ttattaccctctttc

SEQ ID NO: 31299 - DNA, 15 bp, Homo sapiens
gttattaccctcttt

SEQ ID NO: 31300 - DNA, 15 bp, Homo sapiens
ggttattaccctctt

SEQ ID NO: 31301 - DNA, 15 bp, Homo sapiens
tggttattaccctct

SEQ ID NO: 31302 - DNA, 15 bp, Homo sapiens
ctggttattaccctc

SEQ ID NO: 31303 - DNA, 15 bp, Homo sapiens
tctggttattaccct

SEQ ID NO: 31304 - DNA, 15 bp, Homo sapiens
gtctggttattaccc

SEQ ID NO: 31305 - DNA, 15 bp, Homo sapiens
tgtctggttattacc

SEQ ID NO: 31306 - DNA, 15 bp, Homo sapiens
gtgtctggttattac

SEQ ID NO: 31307 - DNA, 15 bp, Homo sapiens
tgtgtctggttatta

SEQ ID NO: 31308 - DNA, 15 bp, Homo sapiens
ttgtgtctggttatt

SEQ ID NO: 31309 - DNA, 15 bp, Homo sapiens
tttgtgtctggttat

SEQ ID NO: 31310 - DNA, 15 bp, Homo sapiens
gtttgtgtctggtta

SEQ ID NO: 31311 - DNA, 15 bp, Homo sapiens
agtttgtgtctggtt

SEQ ID NO: 31312 - DNA, 15 bp, Homo sapiens
cagtttgtgtctggt

SEQ ID NO: 31313 - DNA, 15 bp, Homo sapiens
gcagtttgtgtctgg

SEQ ID NO: 31314 - DNA, 15 bp, Homo sapiens
ggcagtttgtgtctg

SEQ ID NO: 31315 - DNA, 15 bp, Homo sapiens
tggcagtttgtgtct

SEQ ID NO: 31316 - DNA, 15 bp, Homo sapiens
ttggcagtttgtgtc

SEQ ID NO: 31317 - DNA, 15 bp, Homo sapiens
cttggcagtttgtgt

SEQ ID NO: 31318 - DNA, 15 bp, Homo sapiens
acttggcagtttgtg

SEQ ID NO: 31319 - DNA, 15 bp, Homo sapiens
aacttggcagtttgt

SEQ ID NO: 31320 - DNA, 15 bp, Homo sapiens
caacttggcagtttg

SEQ ID NO: 31321 - DNA, 15 bp, Homo sapiens
ccaacttggcagttt

SEQ ID NO: 31322 - DNA, 15 bp, Homo sapiens
cccaacttggcagtt

SEQ ID NO: 31323 - DNA, 15 bp, Homo sapiens
acccaacttggcagt

SEQ ID NO: 31324 - DNA, 15 bp, Homo sapiens
cacccaacttggcag

SEQ ID NO: 31325 - DNA, 15 bp, Homo sapiens
ccacccaacttggca

SEQ ID NO: 31326 - DNA, 15 bp, Homo sapiens
tccacccaacttggc

SEQ ID NO: 31327 - DNA, 15 bp, Homo sapiens
ctccacccaacttgg

SEQ ID NO: 31328 - DNA, 15 bp, Homo sapiens
tctccacccaacttg

SEQ ID NO: 31329 - DNA, 15 bp, Homo sapiens
ttctccacccaactt

SEQ ID NO: 31330 - DNA, 15 bp, Homo sapiens
tttctccacccaact

SEQ ID NO: 31331 - DNA, 15 bp, Homo sapiens
ctttctccacccaac

SEQ ID NO: 31332 - DNA, 15 bp, Homo sapiens
cctttctccacccaa

SEQ ID NO: 31333 - DNA, 15 bp, Homo sapiens
tcctttctccaccca

SEQ ID NO: 31334 - DNA, 15 bp, Homo sapiens
ctcctttctccaccc

SEQ ID NO: 31335 - DNA, 15 bp, Homo sapiens
actcctttctccacc

SEQ ID NO: 31336 - DNA, 15 bp, Homo sapiens
aactcctttctccac

SEQ ID NO: 31337 - DNA, 15 bp, Homo sapiens
aaactcctttctcca

SEQ ID NO: 31338 - DNA, 15 bp, Homo sapiens
gaaactcctttctcc

SEQ ID NO: 31339 - DNA, 15 bp, Homo sapiens
agaaactcctttctc

SEQ ID NO: 31340 - DNA, 15 bp, Homo sapiens
aagaaactcctttct

SEQ ID NO: 31341 - DNA, 15 bp, Homo sapiens
aaagaaactcctttc

SEQ ID NO: 31342 - DNA, 15 bp, Homo sapiens
taaagaaactccttt

SEQ ID NO: 31343 - DNA, 15 bp, Homo sapiens
ctaaagaaactcctt

SEQ ID NO: 31344 - DNA, 15 bp, Homo sapiens
gctaaagaaactcct

SEQ ID NO: 31345 - DNA, 15 bp, Homo sapiens
agctaaagaaactcc

SEQ ID NO: 31346 - DNA, 15 bp, Homo sapiens
cagctaaagaaactc

SEQ ID NO: 31347 - DNA, 15 bp, Homo sapiens
tcagctaaagaaact

SEQ ID NO: 31348 - DNA, 15 bp, Homo sapiens
gtcagctaaagaaac

SEQ ID NO: 31349 - DNA, 15 bp, Homo sapiens
tgtcagctaaagaaa

SEQ ID NO: 31350 - DNA, 15 bp, Homo sapiens
ctgtcagctaaagaa

SEQ ID NO: 31351 - DNA, 15 bp, Homo sapiens
tctgtcagctaaaga

SEQ ID NO: 31352 - DNA, 15 bp, Homo sapiens
ttctgtcagctaaag

SEQ ID NO: 31353 - DNA, 15 bp, Homo sapiens
attctgtcagctaaa

SEQ ID NO: 31354 - DNA, 15 bp, Homo sapiens
gattctgtcagctaa

SEQ ID NO: 31355 - DNA, 15 bp, Homo sapiens
agattctgtcagcta

SEQ ID NO: 31356 - DNA, 15 bp, Homo sapiens
gagattctgtcagct

SEQ ID NO: 31357 - DNA, 15 bp, Homo sapiens
agagattctgtcagc

SEQ ID NO: 31358 - DNA, 15 bp, Homo sapiens
cagagattctgtcag

SEQ ID NO: 31359 - DNA, 15 bp, Homo sapiens
tcagagattctgtca

SEQ ID NO: 31360 - DNA, 15 bp, Homo sapiens
ttcagagattctgtc

SEQ ID NO: 31361 - DNA, 15 bp, Homo sapiens
attcagagattctgt

SEQ ID NO: 31362 - DNA, 15 bp, Homo sapiens
aattcagagattctg

SEQ ID NO: 31363 - DNA, 15 bp, Homo sapiens
aaattcagagattct

SEQ ID NO: 31364 - DNA, 15 bp, Homo sapiens
aaaattcagagattc

SEQ ID NO: 31365 - DNA, 15 bp, Homo sapiens
taaaattcagagatt

SEQ ID NO: 31366 - DNA, 15 bp, Homo sapiens
ttaaaattcagagat

SEQ ID NO: 31367 - DNA, 15 bp, Homo sapiens
tttaaaattcagaga

SEQ ID NO: 31368 - DNA, 15 bp, Homo sapiens
atttaaaattcagag

SEQ ID NO: 31369 - DNA, 15 bp, Homo sapiens
gatttaaaattcaga

SEQ ID NO: 31370 - DNA, 15 bp, Homo sapiens
tgatttaaaattcag

SEQ ID NO: 31371 - DNA, 15 bp, Homo sapiens
gtgatttaaaattca

SEQ ID NO: 31372 - DNA, 15 bp, Homo sapiens
agtgatttaaaattc

SEQ ID NO: 31373 - DNA, 15 bp, Homo sapiens
aagtgatttaaaatt

SEQ ID NO: 31374 - DNA, 15 bp, Homo sapiens
taagtgatttaaaat

SEQ ID NO: 31375 - DNA, 15 bp, Homo sapiens
ctaagtgatttaaaa

SEQ ID NO: 31376 - DNA, 15 bp, Homo sapiens
actaagtgatttaaa

SEQ ID NO: 31377 - DNA, 15 bp, Homo sapiens
tactaagtgatttaa

SEQ ID NO: 31378 - DNA, 15 bp, Homo sapiens
ttactaagtgattta

SEQ ID NO: 31379 - DNA, 15 bp, Homo sapiens
cttactaagtgattt

SEQ ID NO: 31380 - DNA, 15 bp, Homo sapiens
gcttactaagtgatt

SEQ ID NO: 31381 - DNA, 15 bp, Homo sapiens
cgcttactaagtgat

SEQ ID NO: 31382 - DNA, 15 bp, Homo sapiens
ccgcttactaagtga

SEQ ID NO: 31383 - DNA, 15 bp, Homo sapiens
gccgcttactaagtg

SEQ ID NO: 31384 - DNA, 15 bp, Homo sapiens
agccgcttactaagt

SEQ ID NO: 31385 - DNA, 15 bp, Homo sapiens
gagccgcttactaag

SEQ ID NO: 31386 - DNA, 15 bp, Homo sapiens
tgagccgcttactaa

SEQ ID NO: 31387 - DNA, 15 bp, Homo sapiens
ttgagccgcttacta

SEQ ID NO: 31388 - DNA, 15 bp, Homo sapiens
cttgagccgcttact

SEQ ID NO: 31389 - DNA, 15 bp, Homo sapiens
gcttgagccgcttac

SEQ ID NO: 31390 - DNA, 15 bp, Homo sapiens
ggcttgagccgctta

SEQ ID NO: 31391 - DNA, 15 bp, Homo sapiens
gggcttgagccgctt

SEQ ID NO: 31392 - DNA, 15 bp, Homo sapiens
tgggcttgagccgct

SEQ ID NO: 31393 - DNA, 15 bp, Homo sapiens
ctgggcttgagccgc

SEQ ID NO: 31394 - DNA, 15 bp, Homo sapiens
cctgggcttgagccg

SEQ ID NO: 31395 - DNA, 15 bp, Homo sapiens
tcctgggcttgagcc

SEQ ID NO: 31396 - DNA, 15 bp, Homo sapiens
ctcctgggcttgagc

SEQ ID NO: 31397 - DNA, 15 bp, Homo sapiens
cctcctgggcttgag

SEQ ID NO: 31398 - DNA, 15 bp, Homo sapiens
ccctcctgggcttga

SEQ ID NO: 31399 - DNA, 15 bp, Homo sapiens
tccctcctgggcttg

SEQ ID NO: 31400 - DNA, 15 bp, Homo sapiens
ctccctcctgggctt

SEQ ID NO: 31401 - DNA, 15 bp, Homo sapiens
gctccctcctgggct

SEQ ID NO: 31402 - DNA, 15 bp, Homo sapiens
tgctccctcctgggc

SEQ ID NO: 31403 - DNA, 15 bp, Homo sapiens
ctgctccctcctggg

SEQ ID NO: 31404 - DNA, 15 bp, Homo sapiens
tctgctccctcctgg

SEQ ID NO: 31405 - DNA, 15 bp, Homo sapiens
ctctgctccctcctg

SEQ ID NO: 31406 - DNA, 15 bp, Homo sapiens
cctctgctccctcct

SEQ ID NO: 31407 - DNA, 15 bp, Homo sapiens
ccctctgctccctcc

SEQ ID NO: 31408 - DNA, 15 bp, Homo sapiens
tccctctgctccctc

SEQ ID NO: 31409 - DNA, 15 bp, Homo sapiens
atccctctgctccct

SEQ ID NO: 31410 - DNA, 15 bp, Homo sapiens
tatccctctgctccc

SEQ ID NO: 31411 - DNA, 15 bp, Homo sapiens
gtatccctctgctcc

SEQ ID NO: 31412 - DNA, 15 bp, Homo sapiens
cgtatccctctgctc

SEQ ID NO: 31413 - DNA, 15 bp, Homo sapiens
tcgtatccctctgct

SEQ ID NO: 31414 - DNA, 15 bp, Homo sapiens
ctcgtatccctctgc

SEQ ID NO: 31415 - DNA, 15 bp, Homo sapiens
gctcgtatccctctg

SEQ ID NO: 31416 - DNA, 15 bp, Homo sapiens
cgctcgtatccctct

SEQ ID NO: 31417 - DNA, 15 bp, Homo sapiens
ccgctcgtatccctc

SEQ ID NO: 31418 - DNA, 15 bp, Homo sapiens
tccgctcgtatccct

SEQ ID NO: 31419 - DNA, 15 bp, Homo sapiens
ctccgctcgtatccc

SEQ ID NO: 31420 - DNA, 15 bp, Homo sapiens
actccgctcgtatcc

SEQ ID NO: 31421 - DNA, 15 bp, Homo sapiens
gactccgctcgtatc

SEQ ID NO: 31422 - DNA, 15 bp, Homo sapiens
ggactccgctcgtat

SEQ ID NO: 31423 - DNA, 15 bp, Homo sapiens
gggactccgctcgta

SEQ ID NO: 31424 - DNA, 15 bp, Homo sapiens
ggggactccgctcgt

SEQ ID NO: 31425 - DNA, 15 bp, Homo sapiens
aggggactccgctcg

SEQ ID NO: 31426 - DNA, 15 bp, Homo sapiens
caggggactccgctc

SEQ ID NO: 31427 - DNA, 15 bp, Homo sapiens
gcaggggactccgct

SEQ ID NO: 31428 - DNA, 15 bp, Homo sapiens
cgcaggggactccgc

SEQ ID NO: 31429 - DNA, 15 bp, Homo sapiens
gcgcaggggactccg

SEQ ID NO: 31430 - DNA, 15 bp, Homo sapiens
cgcgcaggggactcc

SEQ ID NO: 31431 - DNA, 15 bp, Homo sapiens
ccgcgcaggggactc

SEQ ID NO: 31432 - DNA, 15 bp, Homo sapiens
cccgcgcaggggact

SEQ ID NO: 31433 - DNA, 15 bp, Homo sapiens
tcccgcgcaggggac

SEQ ID NO: 31434 - DNA, 15 bp, Homo sapiens
gtcccgcgcagggga

SEQ ID NO: 31435 - DNA, 15 bp, Homo sapiens
ggtcccgcgcagggg

SEQ ID NO: 31436 - DNA, 15 bp, Homo sapiens
tggtcccgcgcaggg

SEQ ID NO: 31437 - DNA, 15 bp, Homo sapiens
atggtcccgcgcagg

SEQ ID NO: 31438 - DNA, 15 bp, Homo sapiens
gatggtcccgcgcag

SEQ ID NO: 31439 - DNA, 15 bp, Homo sapiens
agatggtcccgcgca

SEQ ID NO: 31440 - DNA, 15 bp, Homo sapiens
cagatggtcccgcgc

SEQ ID NO: 31441 - DNA, 15 bp, Homo sapiens
ccagatggtcccgcg

SEQ ID NO: 31442 - DNA, 15 bp, Homo sapiens
tccagatggtcccgc

SEQ ID NO: 31443 - DNA, 15 bp, Homo sapiens
ttccagatggtcccg

SEQ ID NO: 31444 - DNA, 15 bp, Homo sapiens
attccagatggtccc

SEQ ID NO: 31445 - DNA, 15 bp, Homo sapiens
aattccagatggtcc

SEQ ID NO: 31446 - DNA, 15 bp, Homo sapiens
caattccagatggtc

SEQ ID NO: 31447 - DNA, 15 bp, Homo sapiens
ccaattccagatggt

SEQ ID NO: 31448 - DNA, 15 bp, Homo sapiens
accaattccagatgg

SEQ ID NO: 31449 - DNA, 15 bp, Homo sapiens
aaccaattccagatg

SEQ ID NO: 31450 - DNA, 15 bp, Homo sapiens
aaaccaattccagat

SEQ ID NO: 31451 - DNA, 15 bp, Homo sapiens
taaaccaattccaga

SEQ ID NO: 31452 - DNA, 15 bp, Homo sapiens
ctaaaccaattccag

SEQ ID NO: 31453 - DNA, 15 bp, Homo sapiens
gctaaaccaattcca

SEQ ID NO: 31454 - DNA, 15 bp, Homo sapiens
ggctaaaccaattcc

SEQ ID NO: 31455 - DNA, 15 bp, Homo sapiens
gggctaaaccaattc

SEQ ID NO: 31456 - DNA, 15 bp, Homo sapiens
tgggctaaaccaatt

SEQ ID NO: 31457 - DNA, 15 bp, Homo sapiens
ttgggctaaaccaat

SEQ ID NO: 31458 - DNA, 15 bp, Homo sapiens
cttgggctaaaccaa

SEQ ID NO: 31459 - DNA, 15 bp, Homo sapiens
acttgggctaaacca

SEQ ID NO: 31460 - DNA, 15 bp, Homo sapiens
cacttgggctaaacc

SEQ ID NO: 31461 - DNA, 15 bp, Homo sapiens
ccacttgggctaaac

SEQ ID NO: 31462 - DNA, 15 bp, Homo sapiens
tccacttgggctaaa

SEQ ID NO: 31463 - DNA, 15 bp, Homo sapiens
ctccacttgggctaa

SEQ ID NO: 31464 - DNA, 15 bp, Homo sapiens
gctccacttgggcta

SEQ ID NO: 31465 - DNA, 15 bp, Homo sapiens
ggctccacttgggct

SEQ ID NO: 31466 - DNA, 15 bp, Homo sapiens
aggctccacttgggc

SEQ ID NO: 31467 - DNA, 15 bp, Homo sapiens
caggctccacttggg

SEQ ID NO: 31468 - DNA, 15 bp, Homo sapiens
tcaggctccacttgg

SEQ ID NO: 31469 - DNA, 15 bp, Homo sapiens
gtcaggctccacttg

SEQ ID NO: 31470 - DNA, 15 bp, Homo sapiens
tgtcaggctccactt

SEQ ID NO: 31471 - DNA, 15 bp, Homo sapiens
ctgtcaggctccact

SEQ ID NO: 31472 - DNA, 15 bp, Homo sapiens
gctgtcaggctccac

SEQ ID NO: 31473 - DNA, 15 bp, Homo sapiens
ggctgtcaggctcca

SEQ ID NO: 31474 - DNA, 15 bp, Homo sapiens
tggctgtcaggctcc

SEQ ID NO: 31475 - DNA, 15 bp, Homo sapiens
ctggctgtcaggctc

SEQ ID NO: 31476 - DNA, 15 bp, Homo sapiens
tctggctgtcaggct

SEQ ID NO: 31477 - DNA, 15 bp, Homo sapiens
ttctggctgtcaggc

SEQ ID NO: 31478 - DNA, 15 bp, Homo sapiens
gttctggctgtcagg

SEQ ID NO: 31479 - DNA, 15 bp, Homo sapiens
agttctggctgtcag

SEQ ID NO: 31480 - DNA, 15 bp, Homo sapiens
gagttctggctgtca

SEQ ID NO: 31481 - DNA, 15 bp, Homo sapiens
agagttctggctgtc

SEQ ID NO: 31482 - DNA, 15 bp, Homo sapiens
cagagttctggctgt

SEQ ID NO: 31483 - DNA, 15 bp, Homo sapiens
acagagttctggctg

SEQ ID NO: 31484 - DNA, 15 bp, Homo sapiens
cacagagttctggct

SEQ ID NO: 31485 - DNA, 15 bp, Homo sapiens
acacagagttctggc

SEQ ID NO: 31486 - DNA, 15 bp, Homo sapiens
gacacagagttctgg

SEQ ID NO: 31487 - DNA, 15 bp, Homo sapiens
ggacacagagttctg

SEQ ID NO: 31488 - DNA, 15 bp, Homo sapiens
gggacacagagttct

SEQ ID NO: 31489 - DNA, 15 bp, Homo sapiens
ggggacacagagttc

SEQ ID NO: 31490 - DNA, 15 bp, Homo sapiens
gggggacacagagtt

SEQ ID NO: 31491 - DNA, 15 bp, Homo sapiens
cgggggacacagagt

SEQ ID NO: 31492 - DNA, 15 bp, Homo sapiens
acgggggacacagag

SEQ ID NO: 31493 - DNA, 15 bp, Homo sapiens
gacgggggacacaga

SEQ ID NO: 31494 - DNA, 15 bp, Homo sapiens
agacgggggacacag

SEQ ID NO: 31495 - DNA, 15 bp, Homo sapiens
tagacgggggacaca

SEQ ID NO: 31496 - DNA, 15 bp, Homo sapiens
ttagacgggggacac

SEQ ID NO: 31497 - DNA, 15 bp, Homo sapiens
gttagacgggggaca

SEQ ID NO: 31498 - DNA, 15 bp, Homo sapiens
ggttagacgggggac

SEQ ID NO: 31499 - DNA, 15 bp, Homo sapiens
tggttagacggggga

SEQ ID NO: 31500 - DNA, 15 bp, Homo sapiens
gtggttagacggggg

SEQ ID NO: 31501 - DNA, 15 bp, Homo sapiens
tgtggttagacgggg

SEQ ID NO: 31502 - DNA, 15 bp, Homo sapiens
ctgtggttagacggg

SEQ ID NO: 31503 - DNA, 15 bp, Homo sapiens
gctgtggttagacgg

SEQ ID NO: 31504 - DNA, 15 bp, Homo sapiens
agctgtggttagacg

SEQ ID NO: 31505 - DNA, 15 bp, Homo sapiens
gagctgtggttagac

SEQ ID NO: 31506 - DNA, 15 bp, Homo sapiens
ggagctgtggttaga

SEQ ID NO: 31507 - DNA, 15 bp, Homo sapiens
aggagctgtggttag

SEQ ID NO: 31508 - DNA, 15 bp, Homo sapiens
aaggagctgtggtta

SEQ ID NO: 31509 - DNA, 15 bp, Homo sapiens
aaaggagctgtggtt

SEQ ID NO: 31510 - DNA, 15 bp, Homo sapiens
aaaaggagctgtggt

SEQ ID NO: 31511 - DNA, 15 bp, Homo sapiens
gaaaaggagctgtgg

SEQ ID NO: 31512 - DNA, 15 bp, Homo sapiens
ggaaaaggagctgtg

SEQ ID NO: 31513 - DNA, 15 bp, Homo sapiens
tggaaaaggagctgt

SEQ ID NO: 31514 - DNA, 15 bp, Homo sapiens
ctggaaaaggagctg

SEQ ID NO: 31515 - DNA, 15 bp, Homo sapiens
tctggaaaaggagct

SEQ ID NO: 31516 - DNA, 15 bp, Homo sapiens
ctctggaaaaggagc

SEQ ID NO: 31517 - DNA, 15 bp, Homo sapiens
gctctggaaaaggag

SEQ ID NO: 31518 - DNA, 15 bp, Homo sapiens
tgctctggaaaagga

SEQ ID NO: 31519 - DNA, 15 bp, Homo sapiens
atgctctggaaaagg

SEQ ID NO: 31520 - DNA, 15 bp, Homo sapiens
aatgctctggaaaag

SEQ ID NO: 31521 - DNA, 15 bp, Homo sapiens
gaatgctctggaaaa

SEQ ID NO: 31522 - DNA, 15 bp, Homo sapiens
ggaatgctctggaaa

SEQ ID NO: 31523 - DNA, 15 bp, Homo sapiens
tggaatgctctggaa

SEQ ID NO: 31524 - DNA, 15 bp, Homo sapiens
ctggaatgctctgga

SEQ ID NO: 31525 - DNA, 15 bp, Homo sapiens
actggaatgctctgg

SEQ ID NO: 31526 - DNA, 15 bp, Homo sapiens
gactggaatgctctg

SEQ ID NO: 31527 - DNA, 15 bp, Homo sapiens
tgactggaatgctct

SEQ ID NO: 31528 - DNA, 15 bp, Homo sapiens
ctgactggaatgctc

SEQ ID NO: 31529 - DNA, 15 bp, Homo sapiens
cctgactggaatgct

SEQ ID NO: 31530 - DNA, 15 bp, Homo sapiens
gcctgactggaatgc

SEQ ID NO: 31531 - DNA, 15 bp, Homo sapiens
agcctgactggaatg

SEQ ID NO: 31532 - DNA, 15 bp, Homo sapiens
gagcctgactggaat

SEQ ID NO: 31533 - DNA, 15 bp, Homo sapiens
agagcctgactggaa

SEQ ID NO: 31534 - DNA, 15 bp, Homo sapiens
gagagcctgactgga

SEQ ID NO: 31535 - DNA, 15 bp, Homo sapiens
agagagcctgactgg

SEQ ID NO: 31536 - DNA, 15 bp, Homo sapiens
cagagagcctgactg

SEQ ID NO: 31537 - DNA, 15 bp, Homo sapiens
ccagagagcctgact

SEQ ID NO: 31538 - DNA, 15 bp, Homo sapiens
cccagagagcctgac

SEQ ID NO: 31539 - DNA, 15 bp, Homo sapiens
gcccagagagcctga

SEQ ID NO: 31540 - DNA, 15 bp, Homo sapiens
agcccagagagcctg

SEQ ID NO: 31541 - DNA, 15 bp, Homo sapiens
cagcccagagagcct

SEQ ID NO: 31542 - DNA, 15 bp, Homo sapiens
tcagcccagagagcc

SEQ ID NO: 31543 - DNA, 15 bp, Homo sapiens
gtcagcccagagagc

SEQ ID NO: 31544 - DNA, 15 bp, Homo sapiens
agtcagcccagagag

SEQ ID NO: 31545 - DNA, 15 bp, Homo sapiens
cagtcagcccagaga

SEQ ID NO: 31546 - DNA, 15 bp, Homo sapiens
ccagtcagcccagag

SEQ ID NO: 31547 - DNA, 15 bp, Homo sapiens
cccagtcagcccaga

SEQ ID NO: 31548 - DNA, 15 bp, Homo sapiens
gcccagtcagcccag

SEQ ID NO: 31549 - DNA, 15 bp, Homo sapiens
ggcccagtcagccca

SEQ ID NO: 31550 - DNA, 15 bp, Homo sapiens
tggcccagtcagccc

SEQ ID NO: 31551 - DNA, 15 bp, Homo sapiens
ctggcccagtcagcc

SEQ ID NO: 31552 - DNA, 15 bp, Homo sapiens
cctggcccagtcagc

SEQ ID NO: 31553 - DNA, 15 bp, Homo sapiens
ccctggcccagtcag

SEQ ID NO: 31554 - DNA, 15 bp, Homo sapiens
cccctggcccagtca

SEQ ID NO: 31555 - DNA, 15 bp, Homo sapiens
tcccctggcccagtc

SEQ ID NO: 31556 - DNA, 15 bp, Homo sapiens
ctcccctggcccagt

SEQ ID NO: 31557 - DNA, 15 bp, Homo sapiens
cctcccctggcccag

SEQ ID NO: 31558 - DNA, 15 bp, Homo sapiens
acctcccctggccca

SEQ ID NO: 31559 - DNA, 15 bp, Homo sapiens
aacctcccctggccc

SEQ ID NO: 31560 - DNA, 15 bp, Homo sapiens
taacctcccctggcc

SEQ ID NO: 31561 - DNA, 15 bp, Homo sapiens
gtaacctcccctggc

SEQ ID NO: 31562 - DNA, 15 bp, Homo sapiens
tgtaacctcccctgg

SEQ ID NO: 31563 - DNA, 15 bp, Homo sapiens
ctgtaacctcccctg

SEQ ID NO: 31564 - DNA, 15 bp, Homo sapiens
cctgtaacctcccct

SEQ ID NO: 31565 - DNA, 15 bp, Homo sapiens
acctgtaacctcccc

SEQ ID NO: 31566 - DNA, 15 bp, Homo sapiens
tacctgtaacctccc

SEQ ID NO: 31567 - DNA, 15 bp, Homo sapiens
gtacctgtaacctcc

SEQ ID NO: 31568 - DNA, 15 bp, Homo sapiens
ggtacctgtaacctc

SEQ ID NO: 31569 - DNA, 15 bp, Homo sapiens
tggtacctgtaacct

SEQ ID NO: 31570 - DNA, 15 bp, Homo sapiens
ctggtacctgtaacc

SEQ ID NO: 31571 - DNA, 15 bp, Homo sapiens
actggtacctgtaac

SEQ ID NO: 31572 - DNA, 15 bp, Homo sapiens
aactggtacctgtaa

SEQ ID NO: 31573 - DNA, 15 bp, Homo sapiens
gaactggtacctgta

SEQ ID NO: 31574 - DNA, 15 bp, Homo sapiens
agaactggtacctgt

SEQ ID NO: 31575 - DNA, 15 bp, Homo sapiens
aagaactggtacctg

SEQ ID NO: 31576 - DNA, 15 bp, Homo sapiens
aaagaactggtacct

SEQ ID NO: 31577 - DNA, 15 bp, Homo sapiens
taaagaactggtacc

SEQ ID NO: 31578 - DNA, 15 bp, Homo sapiens
ttaaagaactggtac

SEQ ID NO: 31579 - DNA, 15 bp, Homo sapiens
cttaaagaactggta

SEQ ID NO: 31580 - DNA, 15 bp, Homo sapiens
tcttaaagaactggt

SEQ ID NO: 31581 - DNA, 15 bp, Homo sapiens
ttcttaaagaactgg

SEQ ID NO: 31582 - DNA, 15 bp, Homo sapiens
cttcttaaagaactg

SEQ ID NO: 31583 - DNA, 15 bp, Homo sapiens
tcttcttaaagaact

SEQ ID NO: 31584 - DNA, 15 bp, Homo sapiens
atcttcttaaagaac

SEQ ID NO: 31585 - DNA, 15 bp, Homo sapiens
gatcttcttaaagaa

SEQ ID NO: 31586 - DNA, 15 bp, Homo sapiens
agatcttcttaaaga

SEQ ID NO: 31587 - DNA, 15 bp, Homo sapiens
aagatcttcttaaag

SEQ ID NO: 31588 - DNA, 15 bp, Homo sapiens
aaagatcttcttaaa

SEQ ID NO: 31589 - DNA, 15 bp, Homo sapiens
caaagatcttcttaa

SEQ ID NO: 31590 - DNA, 15 bp, Homo sapiens
ccaaagatcttctta

SEQ ID NO: 31591 - DNA, 15 bp, Homo sapiens
cccaaagatcttctt

SEQ ID NO: 31592 - DNA, 15 bp, Homo sapiens
gcccaaagatcttct

SEQ ID NO: 31593 - DNA, 15 bp, Homo sapiens
tgcccaaagatcttc

SEQ ID NO: 31594 - DNA, 15 bp, Homo sapiens
atgcccaaagatctt

SEQ ID NO: 31595 - DNA, 15 bp, Homo sapiens
tatgcccaaagatct

SEQ ID NO: 31596 - DNA, 15 bp, Homo sapiens
atatgcccaaagatc

SEQ ID NO: 31597 - DNA, 15 bp, Homo sapiens
tatatgcccaaagat

SEQ ID NO: 31598 - DNA, 15 bp, Homo sapiens
gtatatgcccaaaga

SEQ ID NO: 31599 - DNA, 15 bp, Homo sapiens
tgtatatgcccaaag

SEQ ID NO: 31600 - DNA, 15 bp, Homo sapiens
atgtatatgcccaaa

SEQ ID NO: 31601 - DNA, 15 bp, Homo sapiens
aatgtatatgcccaa

SEQ ID NO: 31602 - DNA, 15 bp, Homo sapiens
aaatgtatatgccca

SEQ ID NO: 31603 - DNA, 15 bp, Homo sapiens
aaaatgtatatgccc

SEQ ID NO: 31604 - DNA, 15 bp, Homo sapiens
aaaaatgtatatgcc

SEQ ID NO: 31605 - DNA, 15 bp, Homo sapiens
taaaaatgtatatgc

SEQ ID NO: 31606 - DNA, 15 bp, Homo sapiens
ctaaaaatgtatatg

SEQ ID NO: 31607 - DNA, 15 bp, Homo sapiens
gctaaaaatgtatat

SEQ ID NO: 31608 - DNA, 15 bp, Homo sapiens
ggctaaaaatgtata

SEQ ID NO: 31609 - DNA, 15 bp, Homo sapiens
aggctaaaaatgtat

SEQ ID NO: 31610 - DNA, 15 bp, Homo sapiens
caggctaaaaatgta

SEQ ID NO: 31611 - DNA, 15 bp, Homo sapiens
acaggctaaaaatgt

SEQ ID NO: 31612 - DNA, 15 bp, Homo sapiens
cacaggctaaaaatg

SEQ ID NO: 31613 - DNA, 15 bp, Homo sapiens
acacaggctaaaaat

SEQ ID NO: 31614 - DNA, 15 bp, Homo sapiens
gacacaggctaaaaa

SEQ ID NO: 31615 - DNA, 15 bp, Homo sapiens
tgacacaggctaaaa

SEQ ID NO: 31616 - DNA, 15 bp, Homo sapiens
atgacacaggctaaa

SEQ ID NO: 31617 - DNA, 15 bp, Homo sapiens
aatgacacaggctaa

SEQ ID NO: 31618 - DNA, 15 bp, Homo sapiens
caatgacacaggcta

SEQ ID NO: 31619 - DNA, 15 bp, Homo sapiens
gcaatgacacaggct

SEQ ID NO: 31620 - DNA, 15 bp, Homo sapiens
ggcaatgacacaggc

SEQ ID NO: 31621 - DNA, 15 bp, Homo sapiens
gggcaatgacacagg

SEQ ID NO: 31622 - DNA, 15 bp, Homo sapiens
ggggcaatgacacag

SEQ ID NO: 31623 - DNA, 15 bp, Homo sapiens
tggggcaatgacaca

SEQ ID NO: 31624 - DNA, 15 bp, Homo sapiens
ttggggcaatgacac

SEQ ID NO: 31625 - DNA, 15 bp, Homo sapiens
tttggggcaatgaca

SEQ ID NO: 31626 - DNA, 15 bp, Homo sapiens
atttggggcaatgac

SEQ ID NO: 31627 - DNA, 15 bp, Homo sapiens
catttggggcaatga

SEQ ID NO: 31628 - DNA, 15 bp, Homo sapiens
ccatttggggcaatg

SEQ ID NO: 31629 - DNA, 15 bp, Homo sapiens
tccatttggggcaat

SEQ ID NO: 31630 - DNA, 15 bp, Homo sapiens
atccatttggggcaa

SEQ ID NO: 31631 - DNA, 15 bp, Homo sapiens
aatccatttggggca

SEQ ID NO: 31632 - DNA, 15 bp, Homo sapiens
gaatccatttggggc

SEQ ID NO: 31633 - DNA, 15 bp, Homo sapiens
ggaatccatttgggg

SEQ ID NO: 31634 - DNA, 15 bp, Homo sapiens
aggaatccatttggg

SEQ ID NO: 31635 - DNA, 15 bp, Homo sapiens
caggaatccatttgg

SEQ ID NO: 31636 - DNA, 15 bp, Homo sapiens
acaggaatccatttg

SEQ ID NO: 31637 - DNA, 15 bp, Homo sapiens
aacaggaatccattt

SEQ ID NO: 31638 - DNA, 15 bp, Homo sapiens
aaacaggaatccatt

SEQ ID NO: 31639 - DNA, 15 bp, Homo sapiens
gaaacaggaatccat

SEQ ID NO: 31640 - DNA, 15 bp, Homo sapiens
tgaaacaggaatcca

SEQ ID NO: 31641 - DNA, 15 bp, Homo sapiens
ttgaaacaggaatcc

SEQ ID NO: 31642 - DNA, 15 bp, Homo sapiens
cttgaaacaggaatc

SEQ ID NO: 31643 - DNA, 15 bp, Homo sapiens
acttgaaacaggaat

SEQ ID NO: 31644 - DNA, 15 bp, Homo sapiens
aacttgaaacaggaa

SEQ ID NO: 31645 - DNA, 15 bp, Homo sapiens
gaacttgaaacagga

SEQ ID NO: 31646 - DNA, 15 bp, Homo sapiens
tgaacttgaaacagg

SEQ ID NO: 31647 - DNA, 15 bp, Homo sapiens
gtgaacttgaaacag

SEQ ID NO: 31648 - DNA, 15 bp, Homo sapiens
tgtgaacttgaaaca

SEQ ID NO: 31649 - DNA, 15 bp, Homo sapiens
gtgtgaacttgaaac

SEQ ID NO: 31650 - DNA, 15 bp, Homo sapiens
ggtgtgaacttgaaa

SEQ ID NO: 31651 - DNA, 15 bp, Homo sapiens
aggtgtgaacttgaa

SEQ ID NO: 31652 - DNA, 15 bp, Homo sapiens
caggtgtgaacttga

SEQ ID NO: 31653 - DNA, 15 bp, Homo sapiens
gcaggtgtgaacttg

SEQ ID NO: 31654 - DNA, 15 bp, Homo sapiens
tgcaggtgtgaactt

SEQ ID NO: 31655 - DNA, 15 bp, Homo sapiens
ctgcaggtgtgaact

SEQ ID NO: 31656 - DNA, 15 bp, Homo sapiens
tctgcaggtgtgaac

SEQ ID NO: 31657 - DNA, 15 bp, Homo sapiens
atctgcaggtgtgaa

SEQ ID NO: 31658 - DNA, 15 bp, Homo sapiens
aatctgcaggtgtga

SEQ ID NO: 31659 - DNA, 15 bp, Homo sapiens
gaatctgcaggtgtg

SEQ ID NO: 31660 - DNA, 15 bp, Homo sapiens
agaatctgcaggtgt

SEQ ID NO: 31661 - DNA, 15 bp, Homo sapiens
tagaatctgcaggtg

SEQ ID NO: 31662 - DNA, 15 bp, Homo sapiens
ctagaatctgcaggt

SEQ ID NO: 31663 - DNA, 15 bp, Homo sapiens
cctagaatctgcagg

SEQ ID NO: 31664 - DNA, 15 bp, Homo sapiens
tcctagaatctgcag

SEQ ID NO: 31665 - DNA, 15 bp, Homo sapiens
gtcctagaatctgca

SEQ ID NO: 31666 - DNA, 15 bp, Homo sapiens
ggtcctagaatctgc

SEQ ID NO: 31667 - DNA, 15 bp, Homo sapiens
aggtcctagaatctg

SEQ ID NO: 31668 - DNA, 15 bp, Homo sapiens
caggtcctagaatct

SEQ ID NO: 31669 - DNA, 15 bp, Homo sapiens
acaggtcctagaatc

SEQ ID NO: 31670 - DNA, 15 bp, Homo sapiens
cacaggtcctagaat

SEQ ID NO: 31671 - DNA, 15 bp, Homo sapiens
acacaggtcctagaa

SEQ ID NO: 31672 - DNA, 15 bp, Homo sapiens
gacacaggtcctaga

SEQ ID NO: 31673 - DNA, 15 bp, Homo sapiens
ggacacaggtcctag

SEQ ID NO: 31674 - DNA, 15 bp, Homo sapiens
aggacacaggtccta

SEQ ID NO: 31675 - DNA, 15 bp, Homo sapiens
taggacacaggtcct

SEQ ID NO: 31676 - DNA, 15 bp, Homo sapiens
ctaggacacaggtcc

SEQ ID NO: 31677 - DNA, 15 bp, Homo sapiens
tctaggacacaggtc

SEQ ID NO: 31678 - DNA, 15 bp, Homo sapiens
gtctaggacacaggt

SEQ ID NO: 31679 - DNA, 15 bp, Homo sapiens
agtctaggacacagg

SEQ ID NO: 31680 - DNA, 15 bp, Homo sapiens
aagtctaggacacag

SEQ ID NO: 31681 - DNA, 15 bp, Homo sapiens
gaagtctaggacaca

SEQ ID NO: 31682 - DNA, 15 bp, Homo sapiens
tgaagtctaggacac

SEQ ID NO: 31683 - DNA, 15 bp, Homo sapiens
ctgaagtctaggaca

SEQ ID NO: 31684 - DNA, 15 bp, Homo sapiens
cctgaagtctaggac

SEQ ID NO: 31685 - DNA, 15 bp, Homo sapiens
ccctgaagtctagga

SEQ ID NO: 31686 - DNA, 15 bp, Homo sapiens
tccctgaagtctagg

SEQ ID NO: 31687 - DNA, 15 bp, Homo sapiens
ctccctgaagtctag

SEQ ID NO: 31688 - DNA, 15 bp, Homo sapiens
actccctgaagtcta

SEQ ID NO: 31689 - DNA, 15 bp, Homo sapiens
gactccctgaagtct

SEQ ID NO: 31690 - DNA, 15 bp, Homo sapiens
tgactccctgaagtc

SEQ ID NO: 31691 - DNA, 15 bp, Homo sapiens
ctgactccctgaagt

SEQ ID NO: 31692 - DNA, 15 bp, Homo sapiens
gctgactccctgaag

SEQ ID NO: 31693 - DNA, 15 bp, Homo sapiens
agctgactccctgaa

SEQ ID NO: 31694 - DNA, 15 bp, Homo sapiens
cagctgactccctga

SEQ ID NO: 31695 - DNA, 15 bp, Homo sapiens
acagctgactccctg

SEQ ID NO: 31696 - DNA, 15 bp, Homo sapiens
aacagctgactccct

SEQ ID NO: 31697 - DNA, 15 bp, Homo sapiens
aaacagctgactccc

SEQ ID NO: 31698 - DNA, 15 bp, Homo sapiens
gaaacagctgactcc

SEQ ID NO: 31699 - DNA, 15 bp, Homo sapiens
agaaacagctgactc

SEQ ID NO: 31700 - DNA, 15 bp, Homo sapiens
tagaaacagctgact

SEQ ID NO: 31701 - DNA, 15 bp, Homo sapiens
ctagaaacagctgac

SEQ ID NO: 31702 - DNA, 15 bp, Homo sapiens
tctagaaacagctga

SEQ ID NO: 31703 - DNA, 15 bp, Homo sapiens
ctctagaaacagctg

SEQ ID NO: 31704 - DNA, 15 bp, Homo sapiens
actctagaaacagct

SEQ ID NO: 31705 - DNA, 15 bp, Homo sapiens
aactctagaaacagc

SEQ ID NO: 31706 - DNA, 15 bp, Homo sapiens
gaactctagaaacag

SEQ ID NO: 31707 - DNA, 15 bp, Homo sapiens
ggaactctagaaaca

SEQ ID NO: 31708 - DNA, 15 bp, Homo sapiens
aggaactctagaaac

SEQ ID NO: 31709 - DNA, 15 bp, Homo sapiens
taggaactctagaaa

SEQ ID NO: 31710 - DNA, 15 bp, Homo sapiens
gtaggaactctagaa

SEQ ID NO: 31711 - DNA, 15 bp, Homo sapiens
ggtaggaactctaga

SEQ ID NO: 31712 - DNA, 15 bp, Homo sapiens
tggtaggaactctag

SEQ ID NO: 31713 - DNA, 15 bp, Homo sapiens
atggtaggaactcta

SEQ ID NO: 31714 - DNA, 15 bp, Homo sapiens
catggtaggaactct

SEQ ID NO: 31715 - DNA, 15 bp, Homo sapiens
ccatggtaggaactc

SEQ ID NO: 31716 - DNA, 15 bp, Homo sapiens
tccatggtaggaact

SEQ ID NO: 31717 - DNA, 15 bp, Homo sapiens
ctccatggtaggaac

SEQ ID NO: 31718 - DNA, 15 bp, Homo sapiens
actccatggtaggaa

SEQ ID NO: 31719 - DNA, 15 bp, Homo sapiens
cactccatggtagga

SEQ ID NO: 31720 - DNA, 15 bp, Homo sapiens
ccactccatggtagg

SEQ ID NO: 31721 - DNA, 15 bp, Homo sapiens
cccactccatggtag

SEQ ID NO: 31722 - DNA, 15 bp, Homo sapiens
acccactccatggta

SEQ ID NO: 31723 - DNA, 15 bp, Homo sapiens
gacccactccatggt

SEQ ID NO: 31724 - DNA, 15 bp, Homo sapiens
agacccactccatgg

SEQ ID NO: 31725 - DNA, 15 bp, Homo sapiens
cagacccactccatg

SEQ ID NO: 31726 - DNA, 15 bp, Homo sapiens
ccagacccactccat

SEQ ID NO: 31727 - DNA, 15 bp, Homo sapiens
tccagacccactcca

SEQ ID NO: 31728 - DNA, 15 bp, Homo sapiens
ctccagacccactcc

SEQ ID NO: 31729 - DNA, 15 bp, Homo sapiens
cctccagacccactc

SEQ ID NO: 31730 - DNA, 15 bp, Homo sapiens
tcctccagacccact

SEQ ID NO: 31731 - DNA, 15 bp, Homo sapiens
gtcctccagacccac

SEQ ID NO: 31732 - DNA, 15 bp, Homo sapiens
ggtcctccagaccca

SEQ ID NO: 31733 - DNA, 15 bp, Homo sapiens
aggtcctccagaccc

SEQ ID NO: 31734 - DNA, 15 bp, Homo sapiens
caggtcctccagacc

SEQ ID NO: 31735 - DNA, 15 bp, Homo sapiens
gcaggtcctccagac

SEQ ID NO: 31736 - DNA, 15 bp, Homo sapiens
ggcaggtcctccaga

SEQ ID NO: 31737 - DNA, 15 bp, Homo sapiens
gggcaggtcctccag

SEQ ID NO: 31738 - DNA, 15 bp, Homo sapiens
cgggcaggtcctcca

SEQ ID NO: 31739 - DNA, 15 bp, Homo sapiens
ccgggcaggtcctcc

SEQ ID NO: 31740 - DNA, 15 bp, Homo sapiens
accgggcaggtcctc

SEQ ID NO: 31741 - DNA, 15 bp, Homo sapiens
caccgggcaggtcct

SEQ ID NO: 31742 - DNA, 15 bp, Homo sapiens
ccaccgggcaggtcc

SEQ ID NO: 31743 - DNA, 15 bp, Homo sapiens
cccaccgggcaggtc

SEQ ID NO: 31744 - DNA, 15 bp, Homo sapiens
ccccaccgggcaggt

SEQ ID NO: 31745 - DNA, 15 bp, Homo sapiens
cccccaccgggcagg

SEQ ID NO: 31746 - DNA, 15 bp, Homo sapiens
ccccccaccgggcag

SEQ ID NO: 31747 - DNA, 15 bp, Homo sapiens
cccccccaccgggca

SEQ ID NO: 31748 - DNA, 15 bp, Homo sapiens
gcccccccaccgggc

SEQ ID NO: 31749 - DNA, 15 bp, Homo sapiens
tgcccccccaccggg

SEQ ID NO: 31750 - DNA, 15 bp, Homo sapiens
ctgcccccccaccgg

SEQ ID NO: 31751 - DNA, 15 bp, Homo sapiens
tctgcccccccaccg

SEQ ID NO: 31752 - DNA, 15 bp, Homo sapiens
ctctgcccccccacc

SEQ ID NO: 31753 - DNA, 15 bp, Homo sapiens
gctctgcccccccac

SEQ ID NO: 31754 - DNA, 15 bp, Homo sapiens
ggctctgccccccca

SEQ ID NO: 31755 - DNA, 15 bp, Homo sapiens
gggctctgccccccc

SEQ ID NO: 31756 - DNA, 15 bp, Homo sapiens
agggctctgcccccc

SEQ ID NO: 31757 - DNA, 15 bp, Homo sapiens
cagggctctgccccc

SEQ ID NO: 31758 - DNA, 15 bp, Homo sapiens
gcagggctctgcccc

SEQ ID NO: 31759 - DNA, 15 bp, Homo sapiens
agcagggctctgccc

SEQ ID NO: 31760 - DNA, 15 bp, Homo sapiens
gagcagggctctgcc

SEQ ID NO: 31761 - DNA, 15 bp, Homo sapiens
ggagcagggctctgc

SEQ ID NO: 31762 - DNA, 15 bp, Homo sapiens
gggagcagggctctg

SEQ ID NO: 31763 - DNA, 15 bp, Homo sapiens
agggagcagggctct

SEQ ID NO: 31764 - DNA, 15 bp, Homo sapiens
gagggagcagggctc

SEQ ID NO: 31765 - DNA, 15 bp, Homo sapiens
ggagggagcagggct

SEQ ID NO: 31766 - DNA, 15 bp, Homo sapiens
cggagggagcagggc

SEQ ID NO: 31767 - DNA, 15 bp, Homo sapiens
ccggagggagcaggg

SEQ ID NO: 31768 - DNA, 15 bp, Homo sapiens
cccggagggagcagg

SEQ ID NO: 31769 - DNA, 15 bp, Homo sapiens
acccggagggagcag

SEQ ID NO: 31770 - DNA, 15 bp, Homo sapiens
gacccggagggagca

SEQ ID NO: 31771 - DNA, 15 bp, Homo sapiens
agacccggagggagc

SEQ ID NO: 31772 - DNA, 15 bp, Homo sapiens
aagacccggagggag

SEQ ID NO: 31773 - DNA, 15 bp, Homo sapiens
gaagacccggaggga

SEQ ID NO: 31774 - DNA, 15 bp, Homo sapiens
ggaagacccggaggg

SEQ ID NO: 31775 - DNA, 15 bp, Homo sapiens
aggaagacccggagg

SEQ ID NO: 31776 - DNA, 15 bp, Homo sapiens
taggaagacccggag

SEQ ID NO: 31777 - DNA, 15 bp, Homo sapiens
gtaggaagacccgga

SEQ ID NO: 31778 - DNA, 15 bp, Homo sapiens
agtaggaagacccgg

SEQ ID NO: 31779 - DNA, 15 bp, Homo sapiens
gagtaggaagacccg

SEQ ID NO: 31780 - DNA, 15 bp, Homo sapiens
agagtaggaagaccc

SEQ ID NO: 31781 - DNA, 15 bp, Homo sapiens
aagagtaggaagacc

SEQ ID NO: 31782 - DNA, 15 bp, Homo sapiens
gaagagtaggaagac

SEQ ID NO: 31783 - DNA, 15 bp, Homo sapiens
agaagagtaggaaga

SEQ ID NO: 31784 - DNA, 15 bp, Homo sapiens
gagaagagtaggaag

SEQ ID NO: 31785 - DNA, 15 bp, Homo sapiens
agagaagagtaggaa

SEQ ID NO: 31786 - DNA, 15 bp, Homo sapiens
gagagaagagtagga

SEQ ID NO: 31787 - DNA, 15 bp, Homo sapiens
agagagaagagtagg

SEQ ID NO: 31788 - DNA, 15 bp, Homo sapiens
cagagagaagagtag

SEQ ID NO: 31789 - DNA, 15 bp, Homo sapiens
gcagagagaagagta

SEQ ID NO: 31790 - DNA, 15 bp, Homo sapiens
agcagagagaagagt

SEQ ID NO: 31791 - DNA, 15 bp, Homo sapiens
gagcagagagaagag

SEQ ID NO: 31792 - DNA, 15 bp, Homo sapiens
agagcagagagaaga

SEQ ID NO: 31793 - DNA, 15 bp, Homo sapiens
cagagcagagagaag

SEQ ID NO: 31794 - DNA, 15 bp, Homo sapiens
tcagagcagagagaa

SEQ ID NO: 31795 - DNA, 15 bp, Homo sapiens
gtcagagcagagaga

SEQ ID NO: 31796 - DNA, 15 bp, Homo sapiens
cgtcagagcagagag

SEQ ID NO: 31797 - DNA, 15 bp, Homo sapiens
ccgtcagagcagaga

SEQ ID NO: 31798 - DNA, 15 bp, Homo sapiens
cccgtcagagcagag

SEQ ID NO: 31799 - DNA, 15 bp, Homo sapiens
tcccgtcagagcaga

SEQ ID NO: 31800 - DNA, 15 bp, Homo sapiens
atcccgtcagagcag

SEQ ID NO: 31801 - DNA, 15 bp, Homo sapiens
aatcccgtcagagca

SEQ ID NO: 31802 - DNA, 15 bp, Homo sapiens
aaatcccgtcagagc

SEQ ID NO: 31803 - DNA, 15 bp, Homo sapiens
caaatcccgtcagag

SEQ ID NO: 31804 - DNA, 15 bp, Homo sapiens
acaaatcccgtcaga

SEQ ID NO: 31805 - DNA, 15 bp, Homo sapiens
aacaaatcccgtcag

SEQ ID NO: 31806 - DNA, 15 bp, Homo sapiens
caacaaatcccgtca

SEQ ID NO: 31807 - DNA, 15 bp, Homo sapiens
tcaacaaatcccgtc

SEQ ID NO: 31808 - DNA, 15 bp, Homo sapiens
atcaacaaatcccgt

SEQ ID NO: 31809 - DNA, 15 bp, Homo sapiens
aatcaacaaatcccg

SEQ ID NO: 31810 - DNA, 15 bp, Homo sapiens
gaatcaacaaatccc

SEQ ID NO: 31811 - DNA, 15 bp, Homo sapiens
agaatcaacaaatcc

SEQ ID NO: 31812 - DNA, 15 bp, Homo sapiens
gagaatcaacaaatc

SEQ ID NO: 31813 - DNA, 15 bp, Homo sapiens
agagaatcaacaaat

SEQ ID NO: 31814 - DNA, 15 bp, Homo sapiens
gagagaatcaacaaa

SEQ ID NO: 31815 - DNA, 15 bp, Homo sapiens
ggagagaatcaacaa

SEQ ID NO: 31816 - DNA, 15 bp, Homo sapiens
tggagagaatcaaca

SEQ ID NO: 31817 - DNA, 15 bp, Homo sapiens
atggagagaatcaac

SEQ ID NO: 31818 - DNA, 15 bp, Homo sapiens
aatggagagaatcaa

SEQ ID NO: 31819 - DNA, 15 bp, Homo sapiens
aaatggagagaatca

SEQ ID NO: 31820 - DNA, 15 bp, Homo sapiens
aaaatggagagaatc

SEQ ID NO: 31821 - DNA, 15 bp, Homo sapiens
caaaatggagagaat

SEQ ID NO: 31822 - DNA, 15 bp, Homo sapiens
ccaaaatggagagaa

SEQ ID NO: 31823 - DNA, 15 bp, Homo sapiens
accaaaatggagaga

SEQ ID NO: 31824 - DNA, 15 bp, Homo sapiens
caccaaaatggagag

SEQ ID NO: 31825 - DNA, 15 bp, Homo sapiens
acaccaaaatggaga

SEQ ID NO: 31826 - DNA, 15 bp, Homo sapiens
gacaccaaaatggag

SEQ ID NO: 31827 - DNA, 15 bp, Homo sapiens
agacaccaaaatgga

SEQ ID NO: 31828 - DNA, 15 bp, Homo sapiens
aagacaccaaaatgg

SEQ ID NO: 31829 - DNA, 15 bp, Homo sapiens
aaagacaccaaaatg

SEQ ID NO: 31830 - DNA, 15 bp, Homo sapiens
gaaagacaccaaaat

SEQ ID NO: 31831 - DNA, 15 bp, Homo sapiens
agaaagacaccaaaa

SEQ ID NO: 31832 - DNA, 15 bp, Homo sapiens
gagaaagacaccaaa

SEQ ID NO: 31833 - DNA, 15 bp, Homo sapiens
agagaaagacaccaa

SEQ ID NO: 31834 - DNA, 15 bp, Homo sapiens
aagagaaagacacca

SEQ ID NO: 31835 - DNA, 15 bp, Homo sapiens
aaagagaaagacacc

SEQ ID NO: 31836 - DNA, 15 bp, Homo sapiens
aaaagagaaagacac

SEQ ID NO: 31837 - DNA, 15 bp, Homo sapiens
taaaagagaaagaca

SEQ ID NO: 31838 - DNA, 15 bp, Homo sapiens
ctaaaagagaaagac

SEQ ID NO: 31839 - DNA, 15 bp, Homo sapiens
tctaaaagagaaaga

SEQ ID NO: 31840 - DNA, 15 bp, Homo sapiens
atctaaaagagaaag

SEQ ID NO: 31841 - DNA, 15 bp, Homo sapiens
tatctaaaagagaaa

SEQ ID NO: 31842 - DNA, 15 bp, Homo sapiens
atatctaaaagagaa

SEQ ID NO: 31843 - DNA, 15 bp, Homo sapiens
aatatctaaaagaga

SEQ ID NO: 31844 - DNA, 15 bp, Homo sapiens
caatatctaaaagag

SEQ ID NO: 31845 - DNA, 15 bp, Homo sapiens
acaatatctaaaaga

SEQ ID NO: 31846 - DNA, 15 bp, Homo sapiens
tacaatatctaaaag

SEQ ID NO: 31847 - DNA, 15 bp, Homo sapiens
atacaatatctaaaa

SEQ ID NO: 31848 - DNA, 15 bp, Homo sapiens
gatacaatatctaaa

SEQ ID NO: 31849 - DNA, 15 bp, Homo sapiens
tgatacaatatctaa

SEQ ID NO: 31850 - DNA, 15 bp, Homo sapiens
ttgatacaatatcta

SEQ ID NO: 31851 - DNA, 15 bp, Homo sapiens
attgatacaatatct

SEQ ID NO: 31852 - DNA, 15 bp, Homo sapiens
gattgatacaatatc

SEQ ID NO: 31853 - DNA, 15 bp, Homo sapiens
agattgatacaatat

SEQ ID NO: 31854 - DNA, 15 bp, Homo sapiens
aagattgatacaata

SEQ ID NO: 31855 - DNA, 15 bp, Homo sapiens
aaagattgatacaat

SEQ ID NO: 31856 - DNA, 15 bp, Homo sapiens
taaagattgatacaa

SEQ ID NO: 31857 - DNA, 15 bp, Homo sapiens
ctaaagattgataca

SEQ ID NO: 31858 - DNA, 15 bp, Homo sapiens
tctaaagattgatac

SEQ ID NO: 31859 - DNA, 15 bp, Homo sapiens
ttctaaagattgata

SEQ ID NO: 31860 - DNA, 15 bp, Homo sapiens
tttctaaagattgat

SEQ ID NO: 31861 - DNA, 15 bp, Homo sapiens
ttttctaaagattga

SEQ ID NO: 31862 - DNA, 15 bp, Homo sapiens
cttttctaaagattg

SEQ ID NO: 31863 - DNA, 15 bp, Homo sapiens
ccttttctaaagatt

SEQ ID NO: 31864 - DNA, 15 bp, Homo sapiens
gccttttctaaagat

SEQ ID NO: 31865 - DNA, 15 bp, Homo sapiens
tgccttttctaaaga

SEQ ID NO: 31866 - DNA, 15 bp, Homo sapiens
atgccttttctaaag

SEQ ID NO: 31867 - DNA, 15 bp, Homo sapiens
tatgccttttctaaa

SEQ ID NO: 31868 - DNA, 15 bp, Homo sapiens
ctatgccttttctaa

SEQ ID NO: 31869 - DNA, 15 bp, Homo sapiens
actatgccttttcta

SEQ ID NO: 31870 - DNA, 15 bp, Homo sapiens
gactatgccttttct

SEQ ID NO: 31871 - DNA, 15 bp, Homo sapiens
agactatgccttttc

SEQ ID NO: 31872 - DNA, 15 bp, Homo sapiens
tagactatgcctttt

SEQ ID NO: 31873 - DNA, 15 bp, Homo sapiens
gtagactatgccttt

SEQ ID NO: 31874 - DNA, 15 bp, Homo sapiens
agtagactatgcctt

SEQ ID NO: 31875 - DNA, 15 bp, Homo sapiens
aagtagactatgcct

SEQ ID NO: 31876 - DNA, 15 bp, Homo sapiens
caagtagactatgcc

SEQ ID NO: 31877 - DNA, 15 bp, Homo sapiens
acaagtagactatgc

SEQ ID NO: 31878 - DNA, 15 bp, Homo sapiens
aacaagtagactatg

SEQ ID NO: 31879 - DNA, 15 bp, Homo sapiens
taacaagtagactat

SEQ ID NO: 31880 - DNA, 15 bp, Homo sapiens
ataacaagtagacta

SEQ ID NO: 31881 - DNA, 15 bp, Homo sapiens
tataacaagtagact

SEQ ID NO: 31882 - DNA, 15 bp, Homo sapiens
ttataacaagtagac

SEQ ID NO: 31883 - DNA, 15 bp, Homo sapiens
tttataacaagtaga

SEQ ID NO: 31884 - DNA, 15 bp, Homo sapiens
atttataacaagtag

SEQ ID NO: 31885 - DNA, 15 bp, Homo sapiens
gatttataacaagta

SEQ ID NO: 31886 - DNA, 15 bp, Homo sapiens
cgatttataacaagt

SEQ ID NO: 31887 - DNA, 15 bp, Homo sapiens
acgatttataacaag

SEQ ID NO: 31888 - DNA, 15 bp, Homo sapiens
aacgatttataacaa

SEQ ID NO: 31889 - DNA, 15 bp, Homo sapiens
taacgatttataaca

SEQ ID NO: 31890 - DNA, 15 bp, Homo sapiens
ctaacgatttataac

SEQ ID NO: 31891 - DNA, 15 bp, Homo sapiens
cctaacgatttataa

SEQ ID NO: 31892 - DNA, 15 bp, Homo sapiens
tcctaacgatttata

SEQ ID NO: 31893 - DNA, 15 bp, Homo sapiens
atcctaacgatttat

SEQ ID NO: 31894 - DNA, 15 bp, Homo sapiens
tatcctaacgattta

SEQ ID NO: 31895 - DNA, 15 bp, Homo sapiens
gtatcctaacgattt

SEQ ID NO: 31896 - DNA, 15 bp, Homo sapiens
agtatcctaacgatt

SEQ ID NO: 31897 - DNA, 15 bp, Homo sapiens
cagtatcctaacgat

SEQ ID NO: 31898 - DNA, 15 bp, Homo sapiens
gcagtatcctaacga

SEQ ID NO: 31899 - DNA, 15 bp, Homo sapiens
ggcagtatcctaacg

SEQ ID NO: 31900 - DNA, 15 bp, Homo sapiens
aggcagtatcctaac

SEQ ID NO: 31901 - DNA, 15 bp, Homo sapiens
gaggcagtatcctaa

SEQ ID NO: 31902 - DNA, 15 bp, Homo sapiens
ggaggcagtatccta

SEQ ID NO: 31903 - DNA, 15 bp, Homo sapiens
gggaggcagtatcct

SEQ ID NO: 31904 - DNA, 15 bp, Homo sapiens
ggggaggcagtatcc

SEQ ID NO: 31905 - DNA, 15 bp, Homo sapiens
gggggaggcagtatc

SEQ ID NO: 31906 - DNA, 15 bp, Homo sapiens
tgggggaggcagtat

SEQ ID NO: 31907 - DNA, 15 bp, Homo sapiens
ctgggggaggcagta

SEQ ID NO: 31908 - DNA, 15 bp, Homo sapiens
cctgggggaggcagt

SEQ ID NO: 31909 - DNA, 15 bp, Homo sapiens
ccctgggggaggcag

SEQ ID NO: 31910 - DNA, 15 bp, Homo sapiens
accctgggggaggca

SEQ ID NO: 31911 - DNA, 15 bp, Homo sapiens
gaccctgggggaggc

SEQ ID NO: 31912 - DNA, 15 bp, Homo sapiens
agaccctgggggagg

SEQ ID NO: 31913 - DNA, 15 bp, Homo sapiens
tagaccctgggggag

SEQ ID NO: 31914 - DNA, 15 bp, Homo sapiens
ttagaccctggggga

SEQ ID NO: 31915 - DNA, 15 bp, Homo sapiens
tttagaccctggggg

SEQ ID NO: 31916 - DNA, 15 bp, Homo sapiens
ttttagaccctgggg

SEQ ID NO: 31917 - DNA, 15 bp, Homo sapiens
attttagaccctggg

SEQ ID NO: 31918 - DNA, 15 bp, Homo sapiens
aattttagaccctgg

SEQ ID NO: 31919 - DNA, 15 bp, Homo sapiens
taattttagaccctg

SEQ ID NO: 31920 - DNA, 15 bp, Homo sapiens
gtaattttagaccct

SEQ ID NO: 31921 - DNA, 15 bp, Homo sapiens
tgtaattttagaccc

SEQ ID NO: 31922 - DNA, 15 bp, Homo sapiens
atgtaattttagacc

SEQ ID NO: 31923 - DNA, 15 bp, Homo sapiens
tatgtaattttagac

SEQ ID NO: 31924 - DNA, 15 bp, Homo sapiens
atatgtaattttaga

SEQ ID NO: 31925 - DNA, 15 bp, Homo sapiens
aatatgtaattttag

SEQ ID NO: 31926 - DNA, 15 bp, Homo sapiens
taatatgtaatttta

SEQ ID NO: 31927 - DNA, 15 bp, Homo sapiens
ctaatatgtaatttt

SEQ ID NO: 31928 - DNA, 15 bp, Homo sapiens
tctaatatgtaattt

SEQ ID NO: 31929 - DNA, 15 bp, Homo sapiens
ctctaatatgtaatt

SEQ ID NO: 31930 - DNA, 15 bp, Homo sapiens
cctctaatatgtaat

SEQ ID NO: 31931 - DNA, 15 bp, Homo sapiens
ccctctaatatgtaa

SEQ ID NO: 31932 - DNA, 15 bp, Homo sapiens
cccctctaatatgta

SEQ ID NO: 31933 - DNA, 15 bp, Homo sapiens
tcccctctaatatgt

SEQ ID NO: 31934 - DNA, 15 bp, Homo sapiens
ttcccctctaatatg

SEQ ID NO: 31935 - DNA, 15 bp, Homo sapiens
tttcccctctaatat

SEQ ID NO: 31936 - DNA, 15 bp, Homo sapiens
ttttcccctctaata

SEQ ID NO: 31937 - DNA, 15 bp, Homo sapiens
cttttcccctctaat

SEQ ID NO: 31938 - DNA, 15 bp, Homo sapiens
gcttttcccctctaa

SEQ ID NO: 31939 - DNA, 15 bp, Homo sapiens
agcttttcccctcta

SEQ ID NO: 31940 - DNA, 15 bp, Homo sapiens
cagcttttcccctct

SEQ ID NO: 31941 - DNA, 15 bp, Homo sapiens
tcagcttttcccctc

SEQ ID NO: 31942 - DNA, 15 bp, Homo sapiens
ttcagcttttcccct

SEQ ID NO: 31943 - DNA, 15 bp, Homo sapiens
gttcagcttttcccc

SEQ ID NO: 31944 - DNA, 15 bp, Homo sapiens
tgttcagcttttccc

SEQ ID NO: 31945 - DNA, 15 bp, Homo sapiens
gtgttcagcttttcc

SEQ ID NO: 31946 - DNA, 15 bp, Homo sapiens
agtgttcagcttttc

SEQ ID NO: 31947 - DNA, 15 bp, Homo sapiens
cagtgttcagctttt

SEQ ID NO: 31948 - DNA, 15 bp, Homo sapiens
tcagtgttcagcttt

SEQ ID NO: 31949 - DNA, 15 bp, Homo sapiens
ttcagtgttcagctt

SEQ ID NO: 31950 - DNA, 15 bp, Homo sapiens
cttcagtgttcagct

SEQ ID NO: 31951 - DNA, 15 bp, Homo sapiens
acttcagtgttcagc

SEQ ID NO: 31952 - DNA, 15 bp, Homo sapiens
gacttcagtgttcag

SEQ ID NO: 31953 - DNA, 15 bp, Homo sapiens
tgacttcagtgttca

SEQ ID NO: 31954 - DNA, 15 bp, Homo sapiens
ctgacttcagtgttc

SEQ ID NO: 31955 - DNA, 15 bp, Homo sapiens
actgacttcagtgtt

SEQ ID NO: 31956 - DNA, 15 bp, Homo sapiens
aactgacttcagtgt

SEQ ID NO: 31957 - DNA, 15 bp, Homo sapiens
gaactgacttcagtg

SEQ ID NO: 31958 - DNA, 15 bp, Homo sapiens
agaactgacttcagt

SEQ ID NO: 31959 - DNA, 15 bp, Homo sapiens
gagaactgacttcag

SEQ ID NO: 31960 - DNA, 15 bp, Homo sapiens
tgagaactgacttca

SEQ ID NO: 31961 - DNA, 15 bp, Homo sapiens
ttgagaactgacttc

SEQ ID NO: 31962 - DNA, 15 bp, Homo sapiens
gttgagaactgactt

SEQ ID NO: 31963 - DNA, 15 bp, Homo sapiens
tgttgagaactgact

SEQ ID NO: 31964 - DNA, 15 bp, Homo sapiens
ttgttgagaactgac

SEQ ID NO: 31965 - DNA, 15 bp, Homo sapiens
attgttgagaactga

SEQ ID NO: 31966 - DNA, 15 bp, Homo sapiens
aattgttgagaactg

SEQ ID NO: 31967 - DNA, 15 bp, Homo sapiens
aaattgttgagaact

SEQ ID NO: 31968 - DNA, 15 bp, Homo sapiens
taaattgttgagaac

SEQ ID NO: 31969 - DNA, 15 bp, Homo sapiens
ctaaattgttgagaa

SEQ ID NO: 31970 - DNA, 15 bp, Homo sapiens
tctaaattgttgaga

SEQ ID NO: 31971 - DNA, 15 bp, Homo sapiens
ttctaaattgttgag

SEQ ID NO: 31972 - DNA, 15 bp, Homo sapiens
cttctaaattgttga

SEQ ID NO: 31973 - DNA, 15 bp, Homo sapiens
ccttctaaattgttg

SEQ ID NO: 31974 - DNA, 15 bp, Homo sapiens
tccttctaaattgtt

SEQ ID NO: 31975 - DNA, 15 bp, Homo sapiens
ttccttctaaattgt

SEQ ID NO: 31976 - DNA, 15 bp, Homo sapiens
tttccttctaaattg

SEQ ID NO: 31977 - DNA, 15 bp, Homo sapiens
ttttccttctaaatt

SEQ ID NO: 31978 - DNA, 15 bp, Homo sapiens
gttttccttctaaat

SEQ ID NO: 31979 - DNA, 15 bp, Homo sapiens
ggttttccttctaaa

SEQ ID NO: 31980 - DNA, 15 bp, Homo sapiens
aggttttccttctaa

SEQ ID NO: 31981 - DNA, 15 bp, Homo sapiens
taggttttccttcta

SEQ ID NO: 31982 - DNA, 15 bp, Homo sapiens
ctaggttttccttct

SEQ ID NO: 31983 - DNA, 15 bp, Homo sapiens
tctaggttttccttc

SEQ ID NO: 31984 - DNA, 15 bp, Homo sapiens
ttctaggttttcctt

SEQ ID NO: 31985 - DNA, 15 bp, Homo sapiens
tttctaggttttcct

SEQ ID NO: 31986 - DNA, 15 bp, Homo sapiens
ttttctaggttttcc

SEQ ID NO: 31987 - DNA, 15 bp, Homo sapiens
gttttctaggttttc

SEQ ID NO: 31988 - DNA, 15 bp, Homo sapiens
tgttttctaggtttt

SEQ ID NO: 31989 - DNA, 15 bp, Homo sapiens
atgttttctaggttt

SEQ ID NO: 31990 - DNA, 15 bp, Homo sapiens
aatgttttctaggtt

SEQ ID NO: 31991 - DNA, 15 bp, Homo sapiens
aaatgttttctaggt

SEQ ID NO: 31992 - DNA, 15 bp, Homo sapiens
caaatgttttctagg

SEQ ID NO: 31993 - DNA, 15 bp, Homo sapiens
ccaaatgttttctag

SEQ ID NO: 31994 - DNA, 15 bp, Homo sapiens
gccaaatgttttcta

SEQ ID NO: 31995 - DNA, 15 bp, Homo sapiens
tgccaaatgttttct

SEQ ID NO: 31996 - DNA, 15 bp, Homo sapiens
ctgccaaatgttttc

SEQ ID NO: 31997 - DNA, 15 bp, Homo sapiens
tctgccaaatgtttt

SEQ ID NO: 31998 - DNA, 15 bp, Homo sapiens
ttctgccaaatgttt

SEQ ID NO: 31999 - DNA, 15 bp, Homo sapiens
tttctgccaaatgtt

SEQ ID NO: 32000 - DNA, 15 bp, Homo sapiens
ttttctgccaaatgt

SEQ ID NO: 32001 - DNA, 15 bp, Homo sapiens
attttctgccaaatg

SEQ ID NO: 32002 - DNA, 15 bp, Homo sapiens
aattttctgccaaat

SEQ ID NO: 32003 - DNA, 15 bp, Homo sapiens
taattttctgccaaa

SEQ ID NO: 32004 - DNA, 15 bp, Homo sapiens
gtaattttctgccaa

SEQ ID NO: 32005 - DNA, 15 bp, Homo sapiens
tgtaattttctgcca

SEQ ID NO: 32006 - DNA, 15 bp, Homo sapiens
atgtaattttctgcc

SEQ ID NO: 32007 - DNA, 15 bp, Homo sapiens
aatgtaattttctgc

SEQ ID NO: 32008 - DNA, 15 bp, Homo sapiens
aaatgtaattttctg

SEQ ID NO: 32009 - DNA, 15 bp, Homo sapiens
gaaatgtaattttct

SEQ ID NO: 32010 - DNA, 15 bp, Homo sapiens
cgaaatgtaattttc

SEQ ID NO: 32011 - DNA, 15 bp, Homo sapiens
tcgaaatgtaatttt

SEQ ID NO: 32012 - DNA, 15 bp, Homo sapiens
atcgaaatgtaattt

SEQ ID NO: 32013 - DNA, 15 bp, Homo sapiens
catcgaaatgtaatt

SEQ ID NO: 32014 - DNA, 15 bp, Homo sapiens
acatcgaaatgtaat

SEQ ID NO: 32015 - DNA, 15 bp, Homo sapiens
aacatcgaaatgtaa

SEQ ID NO: 32016 - DNA, 15 bp, Homo sapiens
aaacatcgaaatgta

SEQ ID NO: 32017 - DNA, 15 bp, Homo sapiens
aaaacatcgaaatgt

SEQ ID NO: 32018 - DNA, 15 bp, Homo sapiens
aaaaacatcgaaatg

SEQ ID NO: 32019 - DNA, 15 bp, Homo sapiens
caaaaacatcgaaat

SEQ ID NO: 32020 - DNA, 15 bp, Homo sapiens
tcaaaaacatcgaaa

SEQ ID NO: 32021 - DNA, 15 bp, Homo sapiens
ttcaaaaacatcgaa

SEQ ID NO: 32022 - DNA, 15 bp, Homo sapiens
attcaaaaacatcga

SEQ ID NO: 32023 - DNA, 15 bp, Homo sapiens
cattcaaaaacatcg

SEQ ID NO: 32024 - DNA, 15 bp, Homo sapiens
tcattcaaaaacatc

SEQ ID NO: 32025 - DNA, 15 bp, Homo sapiens
ttcattcaaaaacat

SEQ ID NO: 32026 - DNA, 15 bp, Homo sapiens
attcattcaaaaaca

SEQ ID NO: 32027 - DNA, 15 bp, Homo sapiens
tattcattcaaaaac

SEQ ID NO: 32028 - DNA, 15 bp, Homo sapiens
gtattcattcaaaaa

SEQ ID NO: 32029 - DNA, 15 bp, Homo sapiens
cgtattcattcaaaa

SEQ ID NO: 32030 - DNA, 15 bp, Homo sapiens
tcgtattcattcaaa

SEQ ID NO: 32031 - DNA, 15 bp, Homo sapiens
ctcgtattcattcaa

SEQ ID NO: 32032 - DNA, 15 bp, Homo sapiens
gctcgtattcattca

SEQ ID NO: 32033 - DNA, 15 bp, Homo sapiens
tgctcgtattcattc

SEQ ID NO: 32034 - DNA, 15 bp, Homo sapiens
ttgctcgtattcatt

SEQ ID NO: 32035 - DNA, 15 bp, Homo sapiens
cttgctcgtattcat

SEQ ID NO: 32036 - DNA, 15 bp, Homo sapiens
gcttgctcgtattca

SEQ ID NO: 32037 - DNA, 15 bp, Homo sapiens
agcttgctcgtattc

SEQ ID NO: 32038 - DNA, 15 bp, Homo sapiens
aagcttgctcgtatt

SEQ ID NO: 32039 - DNA, 15 bp, Homo sapiens
aaagcttgctcgtat

SEQ ID NO: 32040 - DNA, 15 bp, Homo sapiens
aaaagcttgctcgta

SEQ ID NO: 32041 - DNA, 15 bp, Homo sapiens
taaaagcttgctcgt

SEQ ID NO: 32042 - DNA, 15 bp, Homo sapiens
gtaaaagcttgctcg

SEQ ID NO: 32043 - DNA, 15 bp, Homo sapiens
tgtaaaagcttgctc

SEQ ID NO: 32044 - DNA, 15 bp, Homo sapiens
ttgtaaaagcttgct

SEQ ID NO: 32045 - DNA, 15 bp, Homo sapiens
gttgtaaaagcttgc

SEQ ID NO: 32046 - DNA, 15 bp, Homo sapiens
tgttgtaaaagcttg

SEQ ID NO: 32047 - DNA, 15 bp, Homo sapiens
ctgttgtaaaagctt

SEQ ID NO: 32048 - DNA, 15 bp, Homo sapiens
actgttgtaaaagct

SEQ ID NO: 32049 - DNA, 15 bp, Homo sapiens
cactgttgtaaaagc

SEQ ID NO: 32050 - DNA, 15 bp, Homo sapiens
gcactgttgtaaaag

SEQ ID NO: 32051 - DNA, 15 bp, Homo sapiens
agcactgttgtaaaa

SEQ ID NO: 32052 - DNA, 15 bp, Homo sapiens
cagcactgttgtaaa

SEQ ID NO: 32053 - DNA, 15 bp, Homo sapiens
tcagcactgttgtaa

SEQ ID NO: 32054 - DNA, 15 bp, Homo sapiens
atcagcactgttgta

SEQ ID NO: 32055 - DNA, 15 bp, Homo sapiens
gatcagcactgttgt

SEQ ID NO: 32056 - DNA, 15 bp, Homo sapiens
agatcagcactgttg

SEQ ID NO: 32057 - DNA, 15 bp, Homo sapiens
tagatcagcactgtt

SEQ ID NO: 32058 - DNA, 15 bp, Homo sapiens
ttagatcagcactgt

SEQ ID NO: 32059 - DNA, 15 bp, Homo sapiens
tttagatcagcactg

SEQ ID NO: 32060 - DNA, 15 bp, Homo sapiens
ttttagatcagcact

SEQ ID NO: 32061 - DNA, 15 bp, Homo sapiens
tttttagatcagcac

SEQ ID NO: 32062 - DNA, 15 bp, Homo sapiens
atttttagatcagca

SEQ ID NO: 32063 - DNA, 15 bp, Homo sapiens
tatttttagatcagc

SEQ ID NO: 32064 - DNA, 15 bp, Homo sapiens
gtatttttagatcag

SEQ ID NO: 32065 - DNA, 15 bp, Homo sapiens
agtatttttagatca

SEQ ID NO: 32066 - DNA, 15 bp, Homo sapiens
aagtatttttagatc

SEQ ID NO: 32067 - DNA, 15 bp, Homo sapiens
taagtatttttagat

SEQ ID NO: 32068 - DNA, 15 bp, Homo sapiens
ctaagtatttttaga

SEQ ID NO: 32069 - DNA, 15 bp, Homo sapiens
gctaagtatttttag

SEQ ID NO: 32070 - DNA, 15 bp, Homo sapiens
tgctaagtattttta

SEQ ID NO: 32071 - DNA, 15 bp, Homo sapiens
gtgctaagtattttt

SEQ ID NO: 32072 - DNA, 15 bp, Homo sapiens
agtgctaagtatttt

SEQ ID NO: 32073 - DNA, 15 bp, Homo sapiens
aagtgctaagtattt

SEQ ID NO: 32074 - DNA, 15 bp, Homo sapiens
caagtgctaagtatt

SEQ ID NO: 32075 - DNA, 15 bp, Homo sapiens
ccaagtgctaagtat

SEQ ID NO: 32076 - DNA, 15 bp, Homo sapiens
gccaagtgctaagta

SEQ ID NO: 32077 - DNA, 15 bp, Homo sapiens
ggccaagtgctaagt

SEQ ID NO: 32078 - DNA, 15 bp, Homo sapiens
aggccaagtgctaag

SEQ ID NO: 32079 - DNA, 15 bp, Homo sapiens
caggccaagtgctaa

SEQ ID NO: 32080 - DNA, 15 bp, Homo sapiens
tcaggccaagtgcta

SEQ ID NO: 32081 - DNA, 15 bp, Homo sapiens
ctcaggccaagtgct

SEQ ID NO: 32082 - DNA, 15 bp, Homo sapiens
tctcaggccaagtgc

SEQ ID NO: 32083 - DNA, 15 bp, Homo sapiens
atctcaggccaagtg

SEQ ID NO: 32084 - DNA, 15 bp, Homo sapiens
catctcaggccaagt

SEQ ID NO: 32085 - DNA, 15 bp, Homo sapiens
gcatctcaggccaag

SEQ ID NO: 32086 - DNA, 15 bp, Homo sapiens
ggcatctcaggccaa

SEQ ID NO: 32087 - DNA, 15 bp, Homo sapiens
aggcatctcaggcca

SEQ ID NO: 32088 - DNA, 15 bp, Homo sapiens
caggcatctcaggcc

SEQ ID NO: 32089 - DNA, 15 bp, Homo sapiens
ccaggcatctcaggc

SEQ ID NO: 32090 - DNA, 15 bp, Homo sapiens
accaggcatctcagg

SEQ ID NO: 32091 - DNA, 15 bp, Homo sapiens
caccaggcatctcag

SEQ ID NO: 32092 - DNA, 15 bp, Homo sapiens
tcaccaggcatctca

SEQ ID NO: 32093 - DNA, 15 bp, Homo sapiens
ctcaccaggcatctc

SEQ ID NO: 32094 - DNA, 15 bp, Homo sapiens
gctcaccaggcatct

SEQ ID NO: 32095 - DNA, 15 bp, Homo sapiens
tgctcaccaggcatc

SEQ ID NO: 32096 - DNA, 15 bp, Homo sapiens
atgctcaccaggcat

SEQ ID NO: 32097 - DNA, 15 bp, Homo sapiens
aatgctcaccaggca

SEQ ID NO: 32098 - DNA, 15 bp, Homo sapiens
taatgctcaccaggc

SEQ ID NO: 32099 - DNA, 15 bp, Homo sapiens
gtaatgctcaccagg

SEQ ID NO: 32100 - DNA, 15 bp, Homo sapiens
tgtaatgctcaccag

SEQ ID NO: 32101 - DNA, 15 bp, Homo sapiens
ctgtaatgctcacca

SEQ ID NO: 32102 - DNA, 15 bp, Homo sapiens
cctgtaatgctcacc

SEQ ID NO: 32103 - DNA, 15 bp, Homo sapiens
gcctgtaatgctcac

SEQ ID NO: 32104 - DNA, 15 bp, Homo sapiens
tgcctgtaatgctca

SEQ ID NO: 32105 - DNA, 15 bp, Homo sapiens
ttgcctgtaatgctc

SEQ ID NO: 32106 - DNA, 15 bp, Homo sapiens
cttgcctgtaatgct

SEQ ID NO: 32107 - DNA, 15 bp, Homo sapiens
ccttgcctgtaatgc

SEQ ID NO: 32108 - DNA, 15 bp, Homo sapiens
cccttgcctgtaatg

SEQ ID NO: 32109 - DNA, 15 bp, Homo sapiens
ccccttgcctgtaat

SEQ ID NO: 32110 - DNA, 15 bp, Homo sapiens
tccccttgcctgtaa

SEQ ID NO: 32111 - DNA, 15 bp, Homo sapiens
ttccccttgcctgta

SEQ ID NO: 32112 - DNA, 15 bp, Homo sapiens
attccccttgcctgt

SEQ ID NO: 32113 - DNA, 15 bp, Homo sapiens
gattccccttgcctg

SEQ ID NO: 32114 - DNA, 15 bp, Homo sapiens
agattccccttgcct

SEQ ID NO: 32115 - DNA, 15 bp, Homo sapiens
cagattccccttgcc

SEQ ID NO: 32116 - DNA, 15 bp, Homo sapiens
ccagattccccttgc

SEQ ID NO: 32117 - DNA, 15 bp, Homo sapiens
tccagattccccttg

SEQ ID NO: 32118 - DNA, 15 bp, Homo sapiens
ctccagattcccctt

SEQ ID NO: 32119 - DNA, 15 bp, Homo sapiens
cctccagattcccct

SEQ ID NO: 32120 - DNA, 15 bp, Homo sapiens
acctccagattcccc

SEQ ID NO: 32121 - DNA, 15 bp, Homo sapiens
tacctccagattccc

SEQ ID NO: 32122 - DNA, 15 bp, Homo sapiens
ctacctccagattcc

SEQ ID NO: 32123 - DNA, 15 bp, Homo sapiens
gctacctccagattc

SEQ ID NO: 32124 - DNA, 15 bp, Homo sapiens
ggctacctccagatt

SEQ ID NO: 32125 - DNA, 15 bp, Homo sapiens
cggctacctccagat

SEQ ID NO: 32126 - DNA, 15 bp, Homo sapiens
tcggctacctccaga

SEQ ID NO: 32127 - DNA, 15 bp, Homo sapiens
gtcggctacctccag

SEQ ID NO: 32128 - DNA, 15 bp, Homo sapiens
ggtcggctacctcca

SEQ ID NO: 32129 - DNA, 15 bp, Homo sapiens
aggtcggctacctcc

SEQ ID NO: 32130 - DNA, 15 bp, Homo sapiens
caggtcggctacctc

SEQ ID NO: 32131 - DNA, 15 bp, Homo sapiens
tcaggtcggctacct

SEQ ID NO: 32132 - DNA, 15 bp, Homo sapiens
ctcaggtcggctacc

SEQ ID NO: 32133 - DNA, 15 bp, Homo sapiens
cctcaggtcggctac

SEQ ID NO: 32134 - DNA, 15 bp, Homo sapiens
tcctcaggtcggcta

SEQ ID NO: 32135 - DNA, 15 bp, Homo sapiens
gtcctcaggtcggct

SEQ ID NO: 32136 - DNA, 15 bp, Homo sapiens
tgtcctcaggtcggc

SEQ ID NO: 32137 - DNA, 15 bp, Homo sapiens
atgtcctcaggtcgg

SEQ ID NO: 32138 - DNA, 15 bp, Homo sapiens
catgtcctcaggtcg

SEQ ID NO: 32139 - DNA, 15 bp, Homo sapiens
ccatgtcctcaggtc

SEQ ID NO: 32140 - DNA, 15 bp, Homo sapiens
gccatgtcctcaggt

SEQ ID NO: 32141 - DNA, 15 bp, Homo sapiens
agccatgtcctcagg

SEQ ID NO: 32142 - DNA, 15 bp, Homo sapiens
aagccatgtcctcag

SEQ ID NO: 32143 - DNA, 15 bp, Homo sapiens
gaagccatgtcctca

SEQ ID NO: 32144 - DNA, 15 bp, Homo sapiens
agaagccatgtcctc

SEQ ID NO: 32145 - DNA, 15 bp, Homo sapiens
cagaagccatgtcct

SEQ ID NO: 32146 - DNA, 15 bp, Homo sapiens
tcagaagccatgtcc

SEQ ID NO: 32147 - DNA, 15 bp, Homo sapiens
ttcagaagccatgtc

SEQ ID NO: 32148 - DNA, 15 bp, Homo sapiens
gttcagaagccatgt

SEQ ID NO: 32149 - DNA, 15 bp, Homo sapiens
ggttcagaagccatg

SEQ ID NO: 32150 - DNA, 15 bp, Homo sapiens
aggttcagaagccat

SEQ ID NO: 32151 - DNA, 15 bp, Homo sapiens
caggttcagaagcca

SEQ ID NO: 32152 - DNA, 15 bp, Homo sapiens
acaggttcagaagcc

SEQ ID NO: 32153 - DNA, 15 bp, Homo sapiens
gacaggttcagaagc

SEQ ID NO: 32154 - DNA, 15 bp, Homo sapiens
agacaggttcagaag

SEQ ID NO: 32155 - DNA, 15 bp, Homo sapiens
aagacaggttcagaa

SEQ ID NO: 32156 - DNA, 15 bp, Homo sapiens
aaagacaggttcaga

SEQ ID NO: 32157 - DNA, 15 bp, Homo sapiens
aaaagacaggttcag

SEQ ID NO: 32158 - DNA, 15 bp, Homo sapiens
caaaagacaggttca

SEQ ID NO: 32159 - DNA, 15 bp, Homo sapiens
ccaaaagacaggttc

SEQ ID NO: 32160 - DNA, 15 bp, Homo sapiens
cccaaaagacaggtt

SEQ ID NO: 32161 - DNA, 15 bp, Homo sapiens
tcccaaaagacaggt

SEQ ID NO: 32162 - DNA, 15 bp, Homo sapiens
ctcccaaaagacagg

SEQ ID NO: 32163 - DNA, 15 bp, Homo sapiens
actcccaaaagacag

SEQ ID NO: 32164 - DNA, 15 bp, Homo sapiens
cactcccaaaagaca

SEQ ID NO: 32165 - DNA, 15 bp, Homo sapiens
ccactcccaaaagac

SEQ ID NO: 32166 - DNA, 15 bp, Homo sapiens
accactcccaaaaga

SEQ ID NO: 32167 - DNA, 15 bp, Homo sapiens
taccactcccaaaag

SEQ ID NO: 32168 - DNA, 15 bp, Homo sapiens
ataccactcccaaaa

SEQ ID NO: 32169 - DNA, 15 bp, Homo sapiens
cataccactcccaaa

SEQ ID NO: 32170 - DNA, 15 bp, Homo sapiens
ccataccactcccaa

SEQ ID NO: 32171 - DNA, 15 bp, Homo sapiens
tccataccactccca

SEQ ID NO: 32172 - DNA, 15 bp, Homo sapiens
ttccataccactccc

SEQ ID NO: 32173 - DNA, 15 bp, Homo sapiens
cttccataccactcc

SEQ ID NO: 32174 - DNA, 15 bp, Homo sapiens
ccttccataccactc

SEQ ID NO: 32175 - DNA, 15 bp, Homo sapiens
accttccataccact

SEQ ID NO: 32176 - DNA, 15 bp, Homo sapiens
caccttccataccac

SEQ ID NO: 32177 - DNA, 15 bp, Homo sapiens
ccaccttccatacca

SEQ ID NO: 32178 - DNA, 15 bp, Homo sapiens
tccaccttccatacc

SEQ ID NO: 32179 - DNA, 15 bp, Homo sapiens
ctccaccttccatac

SEQ ID NO: 32180 - DNA, 15 bp, Homo sapiens
gctccaccttccata

SEQ ID NO: 32181 - DNA, 15 bp, Homo sapiens
cgctccaccttccat

SEQ ID NO: 32182 - DNA, 15 bp, Homo sapiens
acgctccaccttcca

SEQ ID NO: 32183 - DNA, 15 bp, Homo sapiens
aacgctccaccttcc

SEQ ID NO: 32184 - DNA, 15 bp, Homo sapiens
gaacgctccaccttc

SEQ ID NO: 32185 - DNA, 15 bp, Homo sapiens
tgaacgctccacctt

SEQ ID NO: 32186 - DNA, 15 bp, Homo sapiens
gtgaacgctccacct

SEQ ID NO: 32187 - DNA, 15 bp, Homo sapiens
ggtgaacgctccacc

SEQ ID NO: 32188 - DNA, 15 bp, Homo sapiens
tggtgaacgctccac

SEQ ID NO: 32189 - DNA, 15 bp, Homo sapiens
ctggtgaacgctcca

SEQ ID NO: 32190 - DNA, 15 bp, Homo sapiens
actggtgaacgctcc

SEQ ID NO: 32191 - DNA, 15 bp, Homo sapiens
cactggtgaacgctc

SEQ ID NO: 32192 - DNA, 15 bp, Homo sapiens
tcactggtgaacgct

SEQ ID NO: 32193 - DNA, 15 bp, Homo sapiens
gtcactggtgaacgc

SEQ ID NO: 32194 - DNA, 15 bp, Homo sapiens
ggtcactggtgaacg

SEQ ID NO: 32195 - DNA, 15 bp, Homo sapiens
aggtcactggtgaac

SEQ ID NO: 32196 - DNA, 15 bp, Homo sapiens
caggtcactggtgaa

SEQ ID NO: 32197 - DNA, 15 bp, Homo sapiens
ccaggtcactggtga

SEQ ID NO: 32198 - DNA, 15 bp, Homo sapiens
tccaggtcactggtg

SEQ ID NO: 32199 - DNA, 15 bp, Homo sapiens
ttccaggtcactggt

SEQ ID NO: 32200 - DNA, 15 bp, Homo sapiens
cttccaggtcactgg

SEQ ID NO: 32201 - DNA, 15 bp, Homo sapiens
ccttccaggtcactg

SEQ ID NO: 32202 - DNA, 15 bp, Homo sapiens
gccttccaggtcact

SEQ ID NO: 32203 - DNA, 15 bp, Homo sapiens
ggccttccaggtcac

SEQ ID NO: 32204 - DNA, 15 bp, Homo sapiens
gggccttccaggtca

SEQ ID NO: 32205 - DNA, 15 bp, Homo sapiens
tgggccttccaggtc

SEQ ID NO: 32206 - DNA, 15 bp, Homo sapiens
ctgggccttccaggt

SEQ ID NO: 32207 - DNA, 15 bp, Homo sapiens
gctgggccttccagg

SEQ ID NO: 32208 - DNA, 15 bp, Homo sapiens
tgctgggccttccag

SEQ ID NO: 32209 - DNA, 15 bp, Homo sapiens
gtgctgggccttcca

SEQ ID NO: 32210 - DNA, 15 bp, Homo sapiens
ggtgctgggccttcc

SEQ ID NO: 32211 - DNA, 15 bp, Homo sapiens
tggtgctgggccttc

SEQ ID NO: 32212 - DNA, 15 bp, Homo sapiens
gtggtgctgggcctt

SEQ ID NO: 32213 - DNA, 15 bp, Homo sapiens
ggtggtgctgggcct

SEQ ID NO: 32214 - DNA, 15 bp, Homo sapiens
gggtggtgctgggcc

SEQ ID NO: 32215 - DNA, 15 bp, Homo sapiens
agggtggtgctgggc

SEQ ID NO: 32216 - DNA, 15 bp, Homo sapiens
gagggtggtgctggg

SEQ ID NO: 32217 - DNA, 15 bp, Homo sapiens
ggagggtggtgctgg

SEQ ID NO: 32218 - DNA, 15 bp, Homo sapiens
aggagggtggtgctg

SEQ ID NO: 32219 - DNA, 15 bp, Homo sapiens
aaggagggtggtgct

SEQ ID NO: 32220 - DNA, 15 bp, Homo sapiens
gaaggagggtggtgc

SEQ ID NO: 32221 - DNA, 15 bp, Homo sapiens
ggaaggagggtggtg

SEQ ID NO: 32222 - DNA, 15 bp, Homo sapiens
gggaaggagggtggt

SEQ ID NO: 32223 - DNA, 15 bp, Homo sapiens
tgggaaggagggtgg

SEQ ID NO: 32224 - DNA, 15 bp, Homo sapiens
gtgggaaggagggtg

SEQ ID NO: 32225 - DNA, 15 bp, Homo sapiens
agtgggaaggagggt

SEQ ID NO: 32226 - DNA, 15 bp, Homo sapiens
gagtgggaaggaggg

SEQ ID NO: 32227 - DNA, 15 bp, Homo sapiens
agagtgggaaggagg

SEQ ID NO: 32228 - DNA, 15 bp, Homo sapiens
aagagtgggaaggag

SEQ ID NO: 32229 - DNA, 15 bp, Homo sapiens
gaagagtgggaagga

SEQ ID NO: 32230 - DNA, 15 bp, Homo sapiens
agaagagtgggaagg

SEQ ID NO: 32231 - DNA, 15 bp, Homo sapiens
gagaagagtgggaag

SEQ ID NO: 32232 - DNA, 15 bp, Homo sapiens
tgagaagagtgggaa

SEQ ID NO: 32233 - DNA, 15 bp, Homo sapiens
atgagaagagtggga

SEQ ID NO: 32234 - DNA, 15 bp, Homo sapiens
gatgagaagagtggg

SEQ ID NO: 32235 - DNA, 15 bp, Homo sapiens
agatgagaagagtgg

SEQ ID NO: 32236 - DNA, 15 bp, Homo sapiens
aagatgagaagagtg

SEQ ID NO: 32237 - DNA, 15 bp, Homo sapiens
caagatgagaagagt

SEQ ID NO: 32238 - DNA, 15 bp, Homo sapiens
tcaagatgagaagag

SEQ ID NO: 32239 - DNA, 15 bp, Homo sapiens
gtcaagatgagaaga

SEQ ID NO: 32240 - DNA, 15 bp, Homo sapiens
tgtcaagatgagaag

SEQ ID NO: 32241 - DNA, 15 bp, Homo sapiens
ctgtcaagatgagaa

SEQ ID NO: 32242 - DNA, 15 bp, Homo sapiens
tctgtcaagatgaga

SEQ ID NO: 32243 - DNA, 15 bp, Homo sapiens
ctctgtcaagatgag

SEQ ID NO: 32244 - DNA, 15 bp, Homo sapiens
gctctgtcaagatga

SEQ ID NO: 32245 - DNA, 15 bp, Homo sapiens
ggctctgtcaagatg

SEQ ID NO: 32246 - DNA, 15 bp, Homo sapiens
aggctctgtcaagat

SEQ ID NO: 32247 - DNA, 15 bp, Homo sapiens
caggctctgtcaaga

SEQ ID NO: 32248 - DNA, 15 bp, Homo sapiens
gcaggctctgtcaag

SEQ ID NO: 32249 - DNA, 15 bp, Homo sapiens
ggcaggctctgtcaa

SEQ ID NO: 32250 - DNA, 15 bp, Homo sapiens
gggcaggctctgtca

SEQ ID NO: 32251 - DNA, 15 bp, Homo sapiens
ggggcaggctctgtc

SEQ ID NO: 32252 - DNA, 15 bp, Homo sapiens
tggggcaggctctgt

SEQ ID NO: 32253 - DNA, 15 bp, Homo sapiens
ctggggcaggctctg

SEQ ID NO: 32254 - DNA, 15 bp, Homo sapiens
gctggggcaggctct

SEQ ID NO: 32255 - DNA, 15 bp, Homo sapiens
cgctggggcaggctc

SEQ ID NO: 32256 - DNA, 15 bp, Homo sapiens
gcgctggggcaggct

SEQ ID NO: 32257 - DNA, 15 bp, Homo sapiens
agcgctggggcaggc

SEQ ID NO: 32258 - DNA, 15 bp, Homo sapiens
cagcgctggggcagg

SEQ ID NO: 32259 - DNA, 15 bp, Homo sapiens
tcagcgctggggcag

SEQ ID NO: 32260 - DNA, 15 bp, Homo sapiens
gtcagcgctggggca

SEQ ID NO: 32261 - DNA, 15 bp, Homo sapiens
cgtcagcgctggggc

SEQ ID NO: 32262 - DNA, 15 bp, Homo sapiens
acgtcagcgctgggg

SEQ ID NO: 32263 - DNA, 15 bp, Homo sapiens
cacgtcagcgctggg

SEQ ID NO: 32264 - DNA, 15 bp, Homo sapiens
acacgtcagcgctgg

SEQ ID NO: 32265 - DNA, 15 bp, Homo sapiens
gacacgtcagcgctg

SEQ ID NO: 32266 - DNA, 15 bp, Homo sapiens
tgacacgtcagcgct

SEQ ID NO: 32267 - DNA, 15 bp, Homo sapiens
ctgacacgtcagcgc

SEQ ID NO: 32268 - DNA, 15 bp, Homo sapiens
cctgacacgtcagcg

SEQ ID NO: 32269 - DNA, 15 bp, Homo sapiens
tcctgacacgtcagc

SEQ ID NO: 32270 - DNA, 15 bp, Homo sapiens
ttcctgacacgtcag

SEQ ID NO: 32271 - DNA, 15 bp, Homo sapiens
tttcctgacacgtca

SEQ ID NO: 32272 - DNA, 15 bp, Homo sapiens
ttttcctgacacgtc

SEQ ID NO: 32273 - DNA, 15 bp, Homo sapiens
gttttcctgacacgt

SEQ ID NO: 32274 - DNA, 15 bp, Homo sapiens
tgttttcctgacacg

SEQ ID NO: 32275 - DNA, 15 bp, Homo sapiens
gtgttttcctgacac

SEQ ID NO: 32276 - DNA, 15 bp, Homo sapiens
ggtgttttcctgaca

SEQ ID NO: 32277 - DNA, 15 bp, Homo sapiens
gggtgttttcctgac

SEQ ID NO: 32278 - DNA, 15 bp, Homo sapiens
tgggtgttttcctga

SEQ ID NO: 32279 - DNA, 15 bp, Homo sapiens
ctgggtgttttcctg

SEQ ID NO: 32280 - DNA, 15 bp, Homo sapiens
cctgggtgttttcct

SEQ ID NO: 32281 - DNA, 15 bp, Homo sapiens
ccctgggtgttttcc

SEQ ID NO: 32282 - DNA, 15 bp, Homo sapiens
tccctgggtgttttc

SEQ ID NO: 32283 - DNA, 15 bp, Homo sapiens
ttccctgggtgtttt

SEQ ID NO: 32284 - DNA, 15 bp, Homo sapiens
gttccctgggtgttt

SEQ ID NO: 32285 - DNA, 15 bp, Homo sapiens
agttccctgggtgtt

SEQ ID NO: 32286 - DNA, 15 bp, Homo sapiens
tagttccctgggtgt

SEQ ID NO: 32287 - DNA, 15 bp, Homo sapiens
ctagttccctgggtg

SEQ ID NO: 32288 - DNA, 15 bp, Homo sapiens
cctagttccctgggt

SEQ ID NO: 32289 - DNA, 15 bp, Homo sapiens
tcctagttccctggg

SEQ ID NO: 32290 - DNA, 15 bp, Homo sapiens
ttcctagttccctgg

SEQ ID NO: 32291 - DNA, 15 bp, Homo sapiens
cttcctagttccctg

SEQ ID NO: 32292 - DNA, 15 bp, Homo sapiens
ccttcctagttccct

SEQ ID NO: 32293 - DNA, 15 bp, Homo sapiens
gccttcctagttccc

SEQ ID NO: 32294 - DNA, 15 bp, Homo sapiens
tgccttcctagttcc

SEQ ID NO: 32295 - DNA, 15 bp, Homo sapiens
gtgccttcctagttc

SEQ ID NO: 32296 - DNA, 15 bp, Homo sapiens
agtgccttcctagtt

SEQ ID NO: 32297 - DNA, 15 bp, Homo sapiens
aagtgccttcctagt

SEQ ID NO: 32298 - DNA, 15 bp, Homo sapiens
gaagtgccttcctag

SEQ ID NO: 32299 - DNA, 15 bp, Homo sapiens
agaagtgccttccta

SEQ ID NO: 32300 - DNA, 15 bp, Homo sapiens
cagaagtgccttcct

SEQ ID NO: 32301 - DNA, 15 bp, Homo sapiens
gcagaagtgccttcc

SEQ ID NO: 32302 - DNA, 15 bp, Homo sapiens
ggcagaagtgccttc

SEQ ID NO: 32303 - DNA, 15 bp, Homo sapiens
aggcagaagtgcctt

SEQ ID NO: 32304 - DNA, 15 bp, Homo sapiens
caggcagaagtgcct

SEQ ID NO: 32305 - DNA, 15 bp, Homo sapiens
tcaggcagaagtgcc

SEQ ID NO: 32306 - DNA, 15 bp, Homo sapiens
ctcaggcagaagtgc

SEQ ID NO: 32307 - DNA, 15 bp, Homo sapiens
cctcaggcagaagtg

SEQ ID NO: 32308 - DNA, 15 bp, Homo sapiens
ccctcaggcagaagt

SEQ ID NO: 32309 - DNA, 15 bp, Homo sapiens
cccctcaggcagaag

SEQ ID NO: 32310 - DNA, 15 bp, Homo sapiens
gcccctcaggcagaa

SEQ ID NO: 32311 - DNA, 15 bp, Homo sapiens
tgcccctcaggcaga

SEQ ID NO: 32312 - DNA, 15 bp, Homo sapiens
ctgcccctcaggcag

SEQ ID NO: 32313 - DNA, 15 bp, Homo sapiens
gctgcccctcaggca

SEQ ID NO: 32314 - DNA, 15 bp, Homo sapiens
ggctgcccctcaggc

SEQ ID NO: 32315 - DNA, 15 bp, Homo sapiens
aggctgcccctcagg

SEQ ID NO: 32316 - DNA, 15 bp, Homo sapiens
caggctgcccctcag

SEQ ID NO: 32317 - DNA, 15 bp, Homo sapiens
gcaggctgcccctca

SEQ ID NO: 32318 - DNA, 15 bp, Homo sapiens
ggcaggctgcccctc

SEQ ID NO: 32319 - DNA, 15 bp, Homo sapiens
aggcaggctgcccct

SEQ ID NO: 32320 - DNA, 15 bp, Homo sapiens
aaggcaggctgcccc

SEQ ID NO: 32321 - DNA, 15 bp, Homo sapiens
caaggcaggctgccc

SEQ ID NO: 32322 - DNA, 15 bp, Homo sapiens
gcaaggcaggctgcc

SEQ ID NO: 32323 - DNA, 15 bp, Homo sapiens
ggcaaggcaggctgc

SEQ ID NO: 32324 - DNA, 15 bp, Homo sapiens
gggcaaggcaggctg

SEQ ID NO: 32325 - DNA, 15 bp, Homo sapiens
tgggcaaggcaggct

SEQ ID NO: 32326 - DNA, 15 bp, Homo sapiens
gtgggcaaggcaggc

SEQ ID NO: 32327 - DNA, 15 bp, Homo sapiens
agtgggcaaggcagg

SEQ ID NO: 32328 - DNA, 15 bp, Homo sapiens
gagtgggcaaggcag

SEQ ID NO: 32329 - DNA, 15 bp, Homo sapiens
ggagtgggcaaggca

SEQ ID NO: 32330 - DNA, 15 bp, Homo sapiens
aggagtgggcaaggc

SEQ ID NO: 32331 - DNA, 15 bp, Homo sapiens
caggagtgggcaagg

SEQ ID NO: 32332 - DNA, 15 bp, Homo sapiens
gcaggagtgggcaag

SEQ ID NO: 32333 - DNA, 15 bp, Homo sapiens
agcaggagtgggcaa

SEQ ID NO: 32334 - DNA, 15 bp, Homo sapiens
gagcaggagtgggca

SEQ ID NO: 32335 - DNA, 15 bp, Homo sapiens
agagcaggagtgggc

SEQ ID NO: 32336 - DNA, 15 bp, Homo sapiens
cagagcaggagtggg

SEQ ID NO: 32337 - DNA, 15 bp, Homo sapiens
gcagagcaggagtgg

SEQ ID NO: 32338 - DNA, 15 bp, Homo sapiens
agcagagcaggagtg

SEQ ID NO: 32339 - DNA, 15 bp, Homo sapiens
gagcagagcaggagt

SEQ ID NO: 32340 - DNA, 15 bp, Homo sapiens
cgagcagagcaggag

SEQ ID NO: 32341 - DNA, 15 bp, Homo sapiens
gcgagcagagcagga

SEQ ID NO: 32342 - DNA, 15 bp, Homo sapiens
ggcgagcagagcagg

SEQ ID NO: 32343 - DNA, 15 bp, Homo sapiens
aggcgagcagagcag

SEQ ID NO: 32344 - DNA, 15 bp, Homo sapiens
gaggcgagcagagca

SEQ ID NO: 32345 - DNA, 15 bp, Homo sapiens
cgaggcgagcagagc

SEQ ID NO: 32346 - DNA, 15 bp, Homo sapiens
ccgaggcgagcagag

SEQ ID NO: 32347 - DNA, 15 bp, Homo sapiens
tccgaggcgagcaga

SEQ ID NO: 32348 - DNA, 15 bp, Homo sapiens
atccgaggcgagcag

SEQ ID NO: 32349 - DNA, 15 bp, Homo sapiens
gatccgaggcgagca

SEQ ID NO: 32350 - DNA, 15 bp, Homo sapiens
tgatccgaggcgagc

SEQ ID NO: 32351 - DNA, 15 bp, Homo sapiens
ctgatccgaggcgag

SEQ ID NO: 32352 - DNA, 15 bp, Homo sapiens
gctgatccgaggcga

SEQ ID NO: 32353 - DNA, 15 bp, Homo sapiens
agctgatccgaggcg

SEQ ID NO: 32354 - DNA, 15 bp, Homo sapiens
cagctgatccgaggc

SEQ ID NO: 32355 - DNA, 15 bp, Homo sapiens
tcagctgatccgagg

SEQ ID NO: 32356 - DNA, 15 bp, Homo sapiens
ctcagctgatccgag

SEQ ID NO: 32357 - DNA, 15 bp, Homo sapiens
gctcagctgatccga

SEQ ID NO: 32358 - DNA, 15 bp, Homo sapiens
ggctcagctgatccg

SEQ ID NO: 32359 - DNA, 15 bp, Homo sapiens
aggctcagctgatcc

SEQ ID NO: 32360 - DNA, 15 bp, Homo sapiens
aaggctcagctgatc

SEQ ID NO: 32361 - DNA, 15 bp, Homo sapiens
gaaggctcagctgat

SEQ ID NO: 32362 - DNA, 15 bp, Homo sapiens
agaaggctcagctga

SEQ ID NO: 32363 - DNA, 15 bp, Homo sapiens
cagaaggctcagctg

SEQ ID NO: 32364 - DNA, 15 bp, Homo sapiens
tcagaaggctcagct

SEQ ID NO: 32365 - DNA, 15 bp, Homo sapiens
ctcagaaggctcagc

SEQ ID NO: 32366 - DNA, 15 bp, Homo sapiens
gctcagaaggctcag

SEQ ID NO: 32367 - DNA, 15 bp, Homo sapiens
agctcagaaggctca

SEQ ID NO: 32368 - DNA, 15 bp, Homo sapiens
cagctcagaaggctc

SEQ ID NO: 32369 - DNA, 15 bp, Homo sapiens
ccagctcagaaggct

SEQ ID NO: 32370 - DNA, 15 bp, Homo sapiens
gccagctcagaaggc

SEQ ID NO: 32371 - DNA, 15 bp, Homo sapiens
ggccagctcagaagg

SEQ ID NO: 32372 - DNA, 15 bp, Homo sapiens
aggccagctcagaag

SEQ ID NO: 32373 - DNA, 15 bp, Homo sapiens
gaggccagctcagaa

SEQ ID NO: 32374 - DNA, 15 bp, Homo sapiens
agaggccagctcaga

SEQ ID NO: 32375 - DNA, 15 bp, Homo sapiens
gagaggccagctcag

SEQ ID NO: 32376 - DNA, 15 bp, Homo sapiens
tgagaggccagctca

SEQ ID NO: 32377 - DNA, 15 bp, Homo sapiens
gtgagaggccagctc

SEQ ID NO: 32378 - DNA, 15 bp, Homo sapiens
agtgagaggccagct

SEQ ID NO: 32379 - DNA, 15 bp, Homo sapiens
cagtgagaggccagc

SEQ ID NO: 32380 - DNA, 15 bp, Homo sapiens
gcagtgagaggccag

SEQ ID NO: 32381 - DNA, 15 bp, Homo sapiens
ggcagtgagaggcca

SEQ ID NO: 32382 - DNA, 15 bp, Homo sapiens
aggcagtgagaggcc

SEQ ID NO: 32383 - DNA, 15 bp, Homo sapiens
gaggcagtgagaggc

SEQ ID NO: 32384 - DNA, 15 bp, Homo sapiens
ggaggcagtgagagg

SEQ ID NO: 32385 - DNA, 15 bp, Homo sapiens
gggaggcagtgagag

SEQ ID NO: 32386 - DNA, 15 bp, Homo sapiens
ggggaggcagtgaga

SEQ ID NO: 32387 - DNA, 15 bp, Homo sapiens
tggggaggcagtgag

SEQ ID NO: 32388 - DNA, 15 bp, Homo sapiens
ttggggaggcagtga

SEQ ID NO: 32389 - DNA, 15 bp, Homo sapiens
cttggggaggcagtg

SEQ ID NO: 32390 - DNA, 15 bp, Homo sapiens
ccttggggaggcagt

SEQ ID NO: 32391 - DNA, 15 bp, Homo sapiens
gccttggggaggcag

SEQ ID NO: 32392 - DNA, 15 bp, Homo sapiens
ggccttggggaggca

SEQ ID NO: 32393 - DNA, 15 bp, Homo sapiens
gggccttggggaggc

SEQ ID NO: 32394 - DNA, 15 bp, Homo sapiens
ggggccttggggagg

SEQ ID NO: 32395 - DNA, 15 bp, Homo sapiens
gggggccttggggag

SEQ ID NO: 32396 - DNA, 15 bp, Homo sapiens
agggggccttgggga

SEQ ID NO: 32397 - DNA, 15 bp, Homo sapiens
cagggggccttgggg

SEQ ID NO: 32398 - DNA, 15 bp, Homo sapiens
gcagggggccttggg

SEQ ID NO: 32399 - DNA, 15 bp, Homo sapiens
ggcagggggccttgg

SEQ ID NO: 32400 - DNA, 15 bp, Homo sapiens
aggcagggggccttg

SEQ ID NO: 32401 - DNA, 15 bp, Homo sapiens
caggcagggggcctt

SEQ ID NO: 32402 - DNA, 15 bp, Homo sapiens
gcaggcagggggcct

SEQ ID NO: 32403 - DNA, 15 bp, Homo sapiens
ggcaggcagggggcc

SEQ ID NO: 32404 - DNA, 15 bp, Homo sapiens
gggcaggcagggggc

SEQ ID NO: 32405 - DNA, 15 bp, Homo sapiens
agggcaggcaggggg

SEQ ID NO: 32406 - DNA, 15 bp, Homo sapiens
cagggcaggcagggg

SEQ ID NO: 32407 - DNA, 15 bp, Homo sapiens
acagggcaggcaggg

SEQ ID NO: 32408 - DNA, 15 bp, Homo sapiens
gacagggcaggcagg

SEQ ID NO: 32409 - DNA, 15 bp, Homo sapiens
tgacagggcaggcag

SEQ ID NO: 32410 - DNA, 15 bp, Homo sapiens
ctgacagggcaggca

SEQ ID NO: 32411 - DNA, 15 bp, Homo sapiens
cctgacagggcaggc

SEQ ID NO: 32412 - DNA, 15 bp, Homo sapiens
tcctgacagggcagg

SEQ ID NO: 32413 - DNA, 15 bp, Homo sapiens
ctcctgacagggcag

SEQ ID NO: 32414 - DNA, 15 bp, Homo sapiens
cctcctgacagggca

SEQ ID NO: 32415 - DNA, 15 bp, Homo sapiens
gcctcctgacagggc

SEQ ID NO: 32416 - DNA, 15 bp, Homo sapiens
tgcctcctgacaggg

SEQ ID NO: 32417 - DNA, 15 bp, Homo sapiens
ctgcctcctgacagg

SEQ ID NO: 32418 - DNA, 15 bp, Homo sapiens
tctgcctcctgacag

SEQ ID NO: 32419 - DNA, 15 bp, Homo sapiens
ttctgcctcctgaca

SEQ ID NO: 32420 - DNA, 15 bp, Homo sapiens
cttctgcctcctgac

SEQ ID NO: 32421 - DNA, 15 bp, Homo sapiens
ccttctgcctcctga

SEQ ID NO: 32422 - DNA, 15 bp, Homo sapiens
tccttctgcctcctg

SEQ ID NO: 32423 - DNA, 15 bp, Homo sapiens
ttccttctgcctcct

SEQ ID NO: 32424 - DNA, 15 bp, Homo sapiens
cttccttctgcctcc

SEQ ID NO: 32425 - DNA, 15 bp, Homo sapiens
gcttccttctgcctc

SEQ ID NO: 32426 - DNA, 15 bp, Homo sapiens
tgcttccttctgcct

SEQ ID NO: 32427 - DNA, 15 bp, Homo sapiens
ctgcttccttctgcc

SEQ ID NO: 32428 - DNA, 15 bp, Homo sapiens
cctgcttccttctgc

SEQ ID NO: 32429 - DNA, 15 bp, Homo sapiens
acctgcttccttctg

SEQ ID NO: 32430 - DNA, 15 bp, Homo sapiens
cacctgcttccttct

SEQ ID NO: 32431 - DNA, 15 bp, Homo sapiens
acacctgcttccttc

SEQ ID NO: 32432 - DNA, 15 bp, Homo sapiens
cacacctgcttcctt

SEQ ID NO: 32433 - DNA, 15 bp, Homo sapiens
tcacacctgcttcct

SEQ ID NO: 32434 - DNA, 15 bp, Homo sapiens
ctcacacctgcttcc

SEQ ID NO: 32435 - DNA, 15 bp, Homo sapiens
cctcacacctgcttc

SEQ ID NO: 32436 - DNA, 15 bp, Homo sapiens
ccctcacacctgctt

SEQ ID NO: 32437 - DNA, 15 bp, Homo sapiens
gccctcacacctgct

SEQ ID NO: 32438 - DNA, 15 bp, Homo sapiens
tgccctcacacctgc

SEQ ID NO: 32439 - DNA, 15 bp, Homo sapiens
ctgccctcacacctg

SEQ ID NO: 32440 - DNA, 15 bp, Homo sapiens
actgccctcacacct

SEQ ID NO: 32441 - DNA, 15 bp, Homo sapiens
cactgccctcacacc

SEQ ID NO: 32442 - DNA, 15 bp, Homo sapiens
gcactgccctcacac

SEQ ID NO: 32443 - DNA, 15 bp, Homo sapiens
tgcactgccctcaca

SEQ ID NO: 32444 - DNA, 15 bp, Homo sapiens
ttgcactgccctcac

SEQ ID NO: 32445 - DNA, 15 bp, Homo sapiens
cttgcactgccctca

SEQ ID NO: 32446 - DNA, 15 bp, Homo sapiens
ccttgcactgccctc

SEQ ID NO: 32447 - DNA, 15 bp, Homo sapiens
tccttgcactgccct

SEQ ID NO: 32448 - DNA, 15 bp, Homo sapiens
ctccttgcactgccc

SEQ ID NO: 32449 - DNA, 15 bp, Homo sapiens
cctccttgcactgcc

SEQ ID NO: 32450 - DNA, 15 bp, Homo sapiens
ccctccttgcactgc

SEQ ID NO: 32451 - DNA, 15 bp, Homo sapiens
tccctccttgcactg

SEQ ID NO: 32452 - DNA, 15 bp, Homo sapiens
ctccctccttgcact

SEQ ID NO: 32453 - DNA, 15 bp, Homo sapiens
gctccctccttgcac

SEQ ID NO: 32454 - DNA, 15 bp, Homo sapiens
tgctccctccttgca

SEQ ID NO: 32455 - DNA, 15 bp, Homo sapiens
gtgctccctccttgc

SEQ ID NO: 32456 - DNA, 15 bp, Homo sapiens
tgtgctccctccttg

SEQ ID NO: 32457 - DNA, 15 bp, Homo sapiens
ttgtgctccctcctt

SEQ ID NO: 32458 - DNA, 15 bp, Homo sapiens
gttgtgctccctcct

SEQ ID NO: 32459 - DNA, 15 bp, Homo sapiens
ggttgtgctccctcc

SEQ ID NO: 32460 - DNA, 15 bp, Homo sapiens
gggttgtgctccctc

SEQ ID NO: 32461 - DNA, 15 bp, Homo sapiens
ggggttgtgctccct

SEQ ID NO: 32462 - DNA, 15 bp, Homo sapiens
gggggttgtgctccc

SEQ ID NO: 32463 - DNA, 15 bp, Homo sapiens
tgggggttgtgctcc

SEQ ID NO: 32464 - DNA, 15 bp, Homo sapiens
ctgggggttgtgctc

SEQ ID NO: 32465 - DNA, 15 bp, Homo sapiens
gctgggggttgtgct

SEQ ID NO: 32466 - DNA, 15 bp, Homo sapiens
agctgggggttgtgc

SEQ ID NO: 32467 - DNA, 15 bp, Homo sapiens
gagctgggggttgtg

SEQ ID NO: 32468 - DNA, 15 bp, Homo sapiens
ggagctgggggttgt

SEQ ID NO: 32469 - DNA, 15 bp, Homo sapiens
gggagctgggggttg

SEQ ID NO: 32470 - DNA, 15 bp, Homo sapiens
cgggagctgggggtt

SEQ ID NO: 32471 - DNA, 15 bp, Homo sapiens
gcgggagctgggggt

SEQ ID NO: 32472 - DNA, 15 bp, Homo sapiens
agcgggagctggggg

SEQ ID NO: 32473 - DNA, 15 bp, Homo sapiens
gagcgggagctgggg

SEQ ID NO: 32474 - DNA, 15 bp, Homo sapiens
ggagcgggagctggg

SEQ ID NO: 32475 - DNA, 15 bp, Homo sapiens
cggagcgggagctgg

SEQ ID NO: 32476 - DNA, 15 bp, Homo sapiens
ccggagcgggagctg

SEQ ID NO: 32477 - DNA, 15 bp, Homo sapiens
cccggagcgggagct

SEQ ID NO: 32478 - DNA, 15 bp, Homo sapiens
gcccggagcgggagc

SEQ ID NO: 32479 - DNA, 15 bp, Homo sapiens
agcccggagcgggag

SEQ ID NO: 32480 - DNA, 15 bp, Homo sapiens
gagcccggagcggga

SEQ ID NO: 32481 - DNA, 15 bp, Homo sapiens
ggagcccggagcggg

SEQ ID NO: 32482 - DNA, 15 bp, Homo sapiens
cggagcccggagcgg

SEQ ID NO: 32483 - DNA, 15 bp, Homo sapiens
tcggagcccggagcg

SEQ ID NO: 32484 - DNA, 15 bp, Homo sapiens
gtcggagcccggagc

SEQ ID NO: 32485 - DNA, 15 bp, Homo sapiens
agtcggagcccggag

SEQ ID NO: 32486 - DNA, 15 bp, Homo sapiens
aagtcggagcccgga

SEQ ID NO: 32487 - DNA, 15 bp, Homo sapiens
caagtcggagcccgg

SEQ ID NO: 32488 - DNA, 15 bp, Homo sapiens
acaagtcggagcccg

SEQ ID NO: 32489 - DNA, 15 bp, Homo sapiens
cacaagtcggagccc

SEQ ID NO: 32490 - DNA, 15 bp, Homo sapiens
gcacaagtcggagcc

SEQ ID NO: 32491 - DNA, 15 bp, Homo sapiens
tgcacaagtcggagc

SEQ ID NO: 32492 - DNA, 15 bp, Homo sapiens
gtgcacaagtcggag

SEQ ID NO: 32493 - DNA, 15 bp, Homo sapiens
tgtgcacaagtcgga

SEQ ID NO: 32494 - DNA, 15 bp, Homo sapiens
ctgtgcacaagtcgg

SEQ ID NO: 32495 - DNA, 15 bp, Homo sapiens
cctgtgcacaagtcg

SEQ ID NO: 32496 - DNA, 15 bp, Homo sapiens
gcctgtgcacaagtc

SEQ ID NO: 32497 - DNA, 15 bp, Homo sapiens
tgcctgtgcacaagt

SEQ ID NO: 32498 - DNA, 15 bp, Homo sapiens
ctgcctgtgcacaag

SEQ ID NO: 32499 - DNA, 15 bp, Homo sapiens
tctgcctgtgcacaa

SEQ ID NO: 32500 - DNA, 15 bp, Homo sapiens
ctctgcctgtgcaca

SEQ ID NO: 32501 - DNA, 15 bp, Homo sapiens
gctctgcctgtgcac

SEQ ID NO: 32502 - DNA, 15 bp, Homo sapiens
ggctctgcctgtgca

SEQ ID NO: 32503 - DNA, 15 bp, Homo sapiens
gggctctgcctgtgc

SEQ ID NO: 32504 - DNA, 15 bp, Homo sapiens
tgggctctgcctgtg

SEQ ID NO: 32505 - DNA, 15 bp, Homo sapiens
ctgggctctgcctgt

SEQ ID NO: 32506 - DNA, 15 bp, Homo sapiens
tctgggctctgcctg

SEQ ID NO: 32507 - DNA, 15 bp, Homo sapiens
gtctgggctctgcct

SEQ ID NO: 32508 - DNA, 15 bp, Homo sapiens
ggtctgggctctgcc

SEQ ID NO: 32509 - DNA, 15 bp, Homo sapiens
gggtctgggctctgc

SEQ ID NO: 32510 - DNA, 15 bp, Homo sapiens
agggtctgggctctg

SEQ ID NO: 32511 - DNA, 15 bp, Homo sapiens
cagggtctgggctct

SEQ ID NO: 32512 - DNA, 15 bp, Homo sapiens
ccagggtctgggctc

SEQ ID NO: 32513 - DNA, 15 bp, Homo sapiens
tccagggtctgggct

SEQ ID NO: 32514 - DNA, 15 bp, Homo sapiens
ctccagggtctgggc

SEQ ID NO: 32515 - DNA, 15 bp, Homo sapiens
cctccagggtctggg

SEQ ID NO: 32516 - DNA, 15 bp, Homo sapiens
tcctccagggtctgg

SEQ ID NO: 32517 - DNA, 15 bp, Homo sapiens
ttcctccagggtctg

SEQ ID NO: 32518 - DNA, 15 bp, Homo sapiens
tttcctccagggtct

SEQ ID NO: 32519 - DNA, 15 bp, Homo sapiens
atttcctccagggtc

SEQ ID NO: 32520 - DNA, 15 bp, Homo sapiens
gatttcctccagggt

SEQ ID NO: 32521 - DNA, 15 bp, Homo sapiens
ggatttcctccaggg

SEQ ID NO: 32522 - DNA, 15 bp, Homo sapiens
aggatttcctccagg

SEQ ID NO: 32523 - DNA, 15 bp, Homo sapiens
taggatttcctccag

SEQ ID NO: 32524 - DNA, 15 bp, Homo sapiens
gtaggatttcctcca

SEQ ID NO: 32525 - DNA, 15 bp, Homo sapiens
ggtaggatttcctcc

SEQ ID NO: 32526 - DNA, 15 bp, Homo sapiens
aggtaggatttcctc

SEQ ID NO: 32527 - DNA, 15 bp, Homo sapiens
aaggtaggatttcct

SEQ ID NO: 32528 - DNA, 15 bp, Homo sapiens
aaaggtaggatttcc

SEQ ID NO: 32529 - DNA, 15 bp, Homo sapiens
caaaggtaggatttc

SEQ ID NO: 32530 - DNA, 15 bp, Homo sapiens
tcaaaggtaggattt

SEQ ID NO: 32531 - DNA, 15 bp, Homo sapiens
ttcaaaggtaggatt

SEQ ID NO: 32532 - DNA, 15 bp, Homo sapiens
attcaaaggtaggat

SEQ ID NO: 32533 - DNA, 15 bp, Homo sapiens
aattcaaaggtagga

SEQ ID NO: 32534 - DNA, 15 bp, Homo sapiens
gaattcaaaggtagg

SEQ ID NO: 32535 - DNA, 15 bp, Homo sapiens
tgaattcaaaggtag

SEQ ID NO: 32536 - DNA, 15 bp, Homo sapiens
ttgaattcaaaggta

SEQ ID NO: 32537 - DNA, 15 bp, Homo sapiens
cttgaattcaaaggt

SEQ ID NO: 32538 - DNA, 15 bp, Homo sapiens
tcttgaattcaaagg

SEQ ID NO: 32539 - DNA, 15 bp, Homo sapiens
ttcttgaattcaaag

SEQ ID NO: 32540 - DNA, 15 bp, Homo sapiens
gttcttgaattcaaa

SEQ ID NO: 32541 - DNA, 15 bp, Homo sapiens
tgttcttgaattcaa

SEQ ID NO: 32542 - DNA, 15 bp, Homo sapiens
atgttcttgaattca

SEQ ID NO: 32543 - DNA, 15 bp, Homo sapiens
aatgttcttgaattc

SEQ ID NO: 32544 - DNA, 15 bp, Homo sapiens
aaatgttcttgaatt

SEQ ID NO: 32545 - DNA, 15 bp, Homo sapiens
caaatgttcttgaat

SEQ ID NO: 32546 - DNA, 15 bp, Homo sapiens
ccaaatgttcttgaa

SEQ ID NO: 32547 - DNA, 15 bp, Homo sapiens
cccaaatgttcttga

SEQ ID NO: 32548 - DNA, 15 bp, Homo sapiens
ccccaaatgttcttg

SEQ ID NO: 32549 - DNA, 15 bp, Homo sapiens
tccccaaatgttctt

SEQ ID NO: 32550 - DNA, 15 bp, Homo sapiens
ttccccaaatgttct

SEQ ID NO: 32551 - DNA, 15 bp, Homo sapiens
attccccaaatgttc

SEQ ID NO: 32552 - DNA, 15 bp, Homo sapiens
aattccccaaatgtt

SEQ ID NO: 32553 - DNA, 15 bp, Homo sapiens
aaattccccaaatgt

SEQ ID NO: 32554 - DNA, 15 bp, Homo sapiens
caaattccccaaatg

SEQ ID NO: 32555 - DNA, 15 bp, Homo sapiens
ccaaattccccaaat

SEQ ID NO: 32556 - DNA, 15 bp, Homo sapiens
tccaaattccccaaa

SEQ ID NO: 32557 - DNA, 15 bp, Homo sapiens
ttccaaattccccaa

SEQ ID NO: 32558 - DNA, 15 bp, Homo sapiens
tttccaaattcccca

SEQ ID NO: 32559 - DNA, 15 bp, Homo sapiens
atttccaaattcccc

SEQ ID NO: 32560 - DNA, 15 bp, Homo sapiens
gatttccaaattccc

SEQ ID NO: 32561 - DNA, 15 bp, Homo sapiens
agatttccaaattcc

SEQ ID NO: 32562 - DNA, 15 bp, Homo sapiens
gagatttccaaattc

SEQ ID NO: 32563 - DNA, 15 bp, Homo sapiens
agagatttccaaatt

SEQ ID NO: 32564 - DNA, 15 bp, Homo sapiens
aagagatttccaaat

SEQ ID NO: 32565 - DNA, 15 bp, Homo sapiens
aaagagatttccaaa

SEQ ID NO: 32566 - DNA, 15 bp, Homo sapiens
caaagagatttccaa

SEQ ID NO: 32567 - DNA, 15 bp, Homo sapiens
gcaaagagatttcca

SEQ ID NO: 32568 - DNA, 15 bp, Homo sapiens
ggcaaagagatttcc

SEQ ID NO: 32569 - DNA, 15 bp, Homo sapiens
gggcaaagagatttc

SEQ ID NO: 32570 - DNA, 15 bp, Homo sapiens
ggggcaaagagattt

SEQ ID NO: 32571 - DNA, 15 bp, Homo sapiens
gggggcaaagagatt

SEQ ID NO: 32572 - DNA, 15 bp, Homo sapiens
tgggggcaaagagat

SEQ ID NO: 32573 - DNA, 15 bp, Homo sapiens
ttgggggcaaagaga

SEQ ID NO: 32574 - DNA, 15 bp, Homo sapiens
tttgggggcaaagag

SEQ ID NO: 32575 - DNA, 15 bp, Homo sapiens
gtttgggggcaaaga

SEQ ID NO: 32576 - DNA, 15 bp, Homo sapiens
ggtttgggggcaaag

SEQ ID NO: 32577 - DNA, 15 bp, Homo sapiens
gggtttgggggcaaa

SEQ ID NO: 32578 - DNA, 15 bp, Homo sapiens
ggggtttgggggcaa

SEQ ID NO: 32579 - DNA, 15 bp, Homo sapiens
gggggtttgggggca

SEQ ID NO: 32580 - DNA, 15 bp, Homo sapiens
tgggggtttgggggc

SEQ ID NO: 32581 - DNA, 15 bp, Homo sapiens
atgggggtttggggg

SEQ ID NO: 32582 - DNA, 15 bp, Homo sapiens
aatgggggtttgggg

SEQ ID NO: 32583 - DNA, 15 bp, Homo sapiens
gaatgggggtttggg

SEQ ID NO: 32584 - DNA, 15 bp, Homo sapiens
agaatgggggtttgg

SEQ ID NO: 32585 - DNA, 15 bp, Homo sapiens
cagaatgggggtttg

SEQ ID NO: 32586 - DNA, 15 bp, Homo sapiens
acagaatgggggttt

SEQ ID NO: 32587 - DNA, 15 bp, Homo sapiens
gacagaatgggggtt

SEQ ID NO: 32588 - DNA, 15 bp, Homo sapiens
ggacagaatgggggt

SEQ ID NO: 32589 - DNA, 15 bp, Homo sapiens
aggacagaatggggg

SEQ ID NO: 32590 - DNA, 15 bp, Homo sapiens
taggacagaatgggg

SEQ ID NO: 32591 - DNA, 15 bp, Homo sapiens
gtaggacagaatggg

SEQ ID NO: 32592 - DNA, 15 bp, Homo sapiens
ggtaggacagaatgg

SEQ ID NO: 32593 - DNA, 15 bp, Homo sapiens
aggtaggacagaatg

SEQ ID NO: 32594 - DNA, 15 bp, Homo sapiens
aaggtaggacagaat

SEQ ID NO: 32595 - DNA, 15 bp, Homo sapiens
aaaggtaggacagaa

SEQ ID NO: 32596 - DNA, 15 bp, Homo sapiens
taaaggtaggacaga

SEQ ID NO: 32597 - DNA, 15 bp, Homo sapiens
ttaaaggtaggacag

SEQ ID NO: 32598 - DNA, 15 bp, Homo sapiens
attaaaggtaggaca

SEQ ID NO: 32599 - DNA, 15 bp, Homo sapiens
gattaaaggtaggac

SEQ ID NO: 32600 - DNA, 15 bp, Homo sapiens
tgattaaaggtagga

SEQ ID NO: 32601 - DNA, 15 bp, Homo sapiens
ctgattaaaggtagg

SEQ ID NO: 32602 - DNA, 15 bp, Homo sapiens
cctgattaaaggtag

SEQ ID NO: 32603 - DNA, 15 bp, Homo sapiens
acctgattaaaggta

SEQ ID NO: 32604 - DNA, 15 bp, Homo sapiens
gacctgattaaaggt

SEQ ID NO: 32605 - DNA, 15 bp, Homo sapiens
ggacctgattaaagg

SEQ ID NO: 32606 - DNA, 15 bp, Homo sapiens
aggacctgattaaag

SEQ ID NO: 32607 - DNA, 15 bp, Homo sapiens
caggacctgattaaa

SEQ ID NO: 32608 - DNA, 15 bp, Homo sapiens
gcaggacctgattaa

SEQ ID NO: 32609 - DNA, 15 bp, Homo sapiens
agcaggacctgatta

SEQ ID NO: 32610 - DNA, 15 bp, Homo sapiens
gagcaggacctgatt

SEQ ID NO: 32611 - DNA, 15 bp, Homo sapiens
tgagcaggacctgat

SEQ ID NO: 32612 - DNA, 15 bp, Homo sapiens
ctgagcaggacctga

SEQ ID NO: 32613 - DNA, 15 bp, Homo sapiens
gctgagcaggacctg

SEQ ID NO: 32614 - DNA, 15 bp, Homo sapiens
tgctgagcaggacct

SEQ ID NO: 32615 - DNA, 15 bp, Homo sapiens
ctgctgagcaggacc

SEQ ID NO: 32616 - DNA, 15 bp, Homo sapiens
actgctgagcaggac

SEQ ID NO: 32617 - DNA, 15 bp, Homo sapiens
cactgctgagcagga

SEQ ID NO: 32618 - DNA, 15 bp, Homo sapiens
tcactgctgagcagg

SEQ ID NO: 32619 - DNA, 15 bp, Homo sapiens
ctcactgctgagcag

SEQ ID NO: 32620 - DNA, 15 bp, Homo sapiens
tctcactgctgagca

SEQ ID NO: 32621 - DNA, 15 bp, Homo sapiens
ctctcactgctgagc

SEQ ID NO: 32622 - DNA, 15 bp, Homo sapiens
gctctcactgctgag

SEQ ID NO: 32623 - DNA, 15 bp, Homo sapiens
tgctctcactgctga

SEQ ID NO: 32624 - DNA, 15 bp, Homo sapiens
ctgctctcactgctg

SEQ ID NO: 32625 - DNA, 15 bp, Homo sapiens
tctgctctcactgct

SEQ ID NO: 32626 - DNA, 15 bp, Homo sapiens
atctgctctcactgc

SEQ ID NO: 32627 - DNA, 15 bp, Homo sapiens
catctgctctcactg

SEQ ID NO: 32628 - DNA, 15 bp, Homo sapiens
tcatctgctctcact

SEQ ID NO: 32629 - DNA, 15 bp, Homo sapiens
ctcatctgctctcac

SEQ ID NO: 32630 - DNA, 15 bp, Homo sapiens
cctcatctgctctca

SEQ ID NO: 32631 - DNA, 15 bp, Homo sapiens
acctcatctgctctc

SEQ ID NO: 32632 - DNA, 15 bp, Homo sapiens
cacctcatctgctct

SEQ ID NO: 32633 - DNA, 15 bp, Homo sapiens
tcacctcatctgctc

SEQ ID NO: 32634 - DNA, 15 bp, Homo sapiens
ttcacctcatctgct

SEQ ID NO: 32635 - DNA, 15 bp, Homo sapiens
tttcacctcatctgc

SEQ ID NO: 32636 - DNA, 15 bp, Homo sapiens
ttttcacctcatctg

SEQ ID NO: 32637 - DNA, 15 bp, Homo sapiens
cttttcacctcatct

SEQ ID NO: 32638 - DNA, 15 bp, Homo sapiens
ccttttcacctcatc

SEQ ID NO: 32639 - DNA, 15 bp, Homo sapiens
gccttttcacctcat

SEQ ID NO: 32640 - DNA, 15 bp, Homo sapiens
ggccttttcacctca

SEQ ID NO: 32641 - DNA, 15 bp, Homo sapiens
tggccttttcacctc

SEQ ID NO: 32642 - DNA, 15 bp, Homo sapiens
ttggccttttcacct

SEQ ID NO: 32643 - DNA, 15 bp, Homo sapiens
cttggccttttcacc

SEQ ID NO: 32644 - DNA, 15 bp, Homo sapiens
tcttggccttttcac

SEQ ID NO: 32645 - DNA, 15 bp, Homo sapiens
ctcttggccttttca

SEQ ID NO: 32646 - DNA, 15 bp, Homo sapiens
cctcttggccttttc

SEQ ID NO: 32647 - DNA, 15 bp, Homo sapiens
acctcttggcctttt

SEQ ID NO: 32648 - DNA, 15 bp, Homo sapiens
aacctcttggccttt

SEQ ID NO: 32649 - DNA, 15 bp, Homo sapiens
aaacctcttggcctt

SEQ ID NO: 32650 - DNA, 15 bp, Homo sapiens
caaacctcttggcct

SEQ ID NO: 32651 - DNA, 15 bp, Homo sapiens
ccaaacctcttggcc

SEQ ID NO: 32652 - DNA, 15 bp, Homo sapiens
gccaaacctcttggc

SEQ ID NO: 32653 - DNA, 15 bp, Homo sapiens
agccaaacctcttgg

SEQ ID NO: 32654 - DNA, 15 bp, Homo sapiens
gagccaaacctcttg

SEQ ID NO: 32655 - DNA, 15 bp, Homo sapiens
ggagccaaacctctt

SEQ ID NO: 32656 - DNA, 15 bp, Homo sapiens
aggagccaaacctct

SEQ ID NO: 32657 - DNA, 15 bp, Homo sapiens
caggagccaaacctc

SEQ ID NO: 32658 - DNA, 15 bp, Homo sapiens
gcaggagccaaacct

SEQ ID NO: 32659 - DNA, 15 bp, Homo sapiens
ggcaggagccaaacc

SEQ ID NO: 32660 - DNA, 15 bp, Homo sapiens
gggcaggagccaaac

SEQ ID NO: 32661 - DNA, 15 bp, Homo sapiens
tgggcaggagccaaa

SEQ ID NO: 32662 - DNA, 15 bp, Homo sapiens
gtgggcaggagccaa

SEQ ID NO: 32663 - DNA, 15 bp, Homo sapiens
agtgggcaggagcca

SEQ ID NO: 32664 - DNA, 15 bp, Homo sapiens
cagtgggcaggagcc

SEQ ID NO: 32665 - DNA, 15 bp, Homo sapiens
tcagtgggcaggagc

SEQ ID NO: 32666 - DNA, 15 bp, Homo sapiens
atcagtgggcaggag

SEQ ID NO: 32667 - DNA, 15 bp, Homo sapiens
tatcagtgggcagga

SEQ ID NO: 32668 - DNA, 15 bp, Homo sapiens
ctatcagtgggcagg

SEQ ID NO: 32669 - DNA, 15 bp, Homo sapiens
gctatcagtgggcag

SEQ ID NO: 32670 - DNA, 15 bp, Homo sapiens
ggctatcagtgggca

SEQ ID NO: 32671 - DNA, 15 bp, Homo sapiens
gggctatcagtgggc

SEQ ID NO: 32672 - DNA, 15 bp, Homo sapiens
ggggctatcagtggg

SEQ ID NO: 32673 - DNA, 15 bp, Homo sapiens
aggggctatcagtgg

SEQ ID NO: 32674 - DNA, 15 bp, Homo sapiens
gaggggctatcagtg

SEQ ID NO: 32675 - DNA, 15 bp, Homo sapiens
agaggggctatcagt

SEQ ID NO: 32676 - DNA, 15 bp, Homo sapiens
gagaggggctatcag

SEQ ID NO: 32677 - DNA, 15 bp, Homo sapiens
ggagaggggctatca

SEQ ID NO: 32678 - DNA, 15 bp, Homo sapiens
gggagaggggctatc

SEQ ID NO: 32679 - DNA, 15 bp, Homo sapiens
ggggagaggggctat

SEQ ID NO: 32680 - DNA, 15 bp, Homo sapiens
cggggagaggggcta

SEQ ID NO: 32681 - DNA, 15 bp, Homo sapiens
gcggggagaggggct

SEQ ID NO: 32682 - DNA, 15 bp, Homo sapiens
tgcggggagaggggc

SEQ ID NO: 32683 - DNA, 15 bp, Homo sapiens
ctgcggggagagggg

SEQ ID NO: 32684 - DNA, 15 bp, Homo sapiens
actgcggggagaggg

SEQ ID NO: 32685 - DNA, 15 bp, Homo sapiens
cactgcggggagagg

SEQ ID NO: 32686 - DNA, 15 bp, Homo sapiens
acactgcggggagag

SEQ ID NO: 32687 - DNA, 15 bp, Homo sapiens
aacactgcggggaga

SEQ ID NO: 32688 - DNA, 15 bp, Homo sapiens
aaacactgcggggag

SEQ ID NO: 32689 - DNA, 15 bp, Homo sapiens
caaacactgcgggga

SEQ ID NO: 32690 - DNA, 15 bp, Homo sapiens
acaaacactgcgggg

SEQ ID NO: 32691 - DNA, 15 bp, Homo sapiens
cacaaacactgcggg

SEQ ID NO: 32692 - DNA, 15 bp, Homo sapiens
acacaaacactgcgg

SEQ ID NO: 32693 - DNA, 15 bp, Homo sapiens
cacacaaacactgcg

SEQ ID NO: 32694 - DNA, 15 bp, Homo sapiens
acacacaaacactgc

SEQ ID NO: 32695 - DNA, 15 bp, Homo sapiens
gacacacaaacactg

SEQ ID NO: 32696 - DNA, 15 bp, Homo sapiens
tgacacacaaacact

SEQ ID NO: 32697 - DNA, 15 bp, Homo sapiens
ttgacacacaaacac

SEQ ID NO: 32698 - DNA, 15 bp, Homo sapiens
cttgacacacaaaca

SEQ ID NO: 32699 - DNA, 15 bp, Homo sapiens
acttgacacacaaac

SEQ ID NO: 32700 - DNA, 15 bp, Homo sapiens
cacttgacacacaaa

SEQ ID NO: 32701 - DNA, 15 bp, Homo sapiens
ccacttgacacacaa

SEQ ID NO: 32702 - DNA, 15 bp, Homo sapiens
gccacttgacacaca

SEQ ID NO: 32703 - DNA, 15 bp, Homo sapiens
tgccacttgacacac

SEQ ID NO: 32704 - DNA, 15 bp, Homo sapiens
ttgccacttgacaca

SEQ ID NO: 32705 - DNA, 15 bp, Homo sapiens
tttgccacttgacac

SEQ ID NO: 32706 - DNA, 15 bp, Homo sapiens
ctttgccacttgaca

SEQ ID NO: 32707 - DNA, 15 bp, Homo sapiens
gctttgccacttgac

SEQ ID NO: 32708 - DNA, 15 bp, Homo sapiens
agctttgccacttga

SEQ ID NO: 32709 - DNA, 15 bp, Homo sapiens
cagctttgccacttg

SEQ ID NO: 32710 - DNA, 15 bp, Homo sapiens
acagctttgccactt

SEQ ID NO: 32711 - DNA, 15 bp, Homo sapiens
aacagctttgccact

SEQ ID NO: 32712 - DNA, 15 bp, Homo sapiens
gaacagctttgccac

SEQ ID NO: 32713 - DNA, 15 bp, Homo sapiens
agaacagctttgcca

SEQ ID NO: 32714 - DNA, 15 bp, Homo sapiens
aagaacagctttgcc

SEQ ID NO: 32715 - DNA, 15 bp, Homo sapiens
gaagaacagctttgc

SEQ ID NO: 32716 - DNA, 15 bp, Homo sapiens
ggaagaacagctttg

SEQ ID NO: 32717 - DNA, 15 bp, Homo sapiens
aggaagaacagcttt

SEQ ID NO: 32718 - DNA, 15 bp, Homo sapiens
caggaagaacagctt

SEQ ID NO: 32719 - DNA, 15 bp, Homo sapiens
ccaggaagaacagct

SEQ ID NO: 32720 - DNA, 15 bp, Homo sapiens
accaggaagaacagc

SEQ ID NO: 32721 - DNA, 15 bp, Homo sapiens
caccaggaagaacag

SEQ ID NO: 32722 - DNA, 15 bp, Homo sapiens
tcaccaggaagaaca

SEQ ID NO: 32723 - DNA, 15 bp, Homo sapiens
gtcaccaggaagaac

SEQ ID NO: 32724 - DNA, 15 bp, Homo sapiens
ggtcaccaggaagaa

SEQ ID NO: 32725 - DNA, 15 bp, Homo sapiens
gggtcaccaggaaga

SEQ ID NO: 32726 - DNA, 15 bp, Homo sapiens
agggtcaccaggaag

SEQ ID NO: 32727 - DNA, 15 bp, Homo sapiens
cagggtcaccaggaa

SEQ ID NO: 32728 - DNA, 15 bp, Homo sapiens
tcagggtcaccagga

SEQ ID NO: 32729 - DNA, 15 bp, Homo sapiens
atcagggtcaccagg

SEQ ID NO: 32730 - DNA, 15 bp, Homo sapiens
aatcagggtcaccag

SEQ ID NO: 32731 - DNA, 15 bp, Homo sapiens
taatcagggtcacca

SEQ ID NO: 32732 - DNA, 15 bp, Homo sapiens
ataatcagggtcacc

SEQ ID NO: 32733 - DNA, 15 bp, Homo sapiens
tataatcagggtcac

SEQ ID NO: 32734 - DNA, 15 bp, Homo sapiens
atataatcagggtca

SEQ ID NO: 32735 - DNA, 15 bp, Homo sapiens
gatataatcagggtc

SEQ ID NO: 32736 - DNA, 15 bp, Homo sapiens
ggatataatcagggt

SEQ ID NO: 32737 - DNA, 15 bp, Homo sapiens
tggatataatcaggg

SEQ ID NO: 32738 - DNA, 15 bp, Homo sapiens
ctggatataatcagg

SEQ ID NO: 32739 - DNA, 15 bp, Homo sapiens
actggatataatcag

SEQ ID NO: 32740 - DNA, 15 bp, Homo sapiens
tactggatataatca

SEQ ID NO: 32741 - DNA, 15 bp, Homo sapiens
ttactggatataatc

SEQ ID NO: 32742 - DNA, 15 bp, Homo sapiens
gttactggatataat

SEQ ID NO: 32743 - DNA, 15 bp, Homo sapiens
tgttactggatataa

SEQ ID NO: 32744 - DNA, 15 bp, Homo sapiens
gtgttactggatata

SEQ ID NO: 32745 - DNA, 15 bp, Homo sapiens
tgtgttactggatat

SEQ ID NO: 32746 - DNA, 15 bp, Homo sapiens
atgtgttactggata

SEQ ID NO: 32747 - DNA, 15 bp, Homo sapiens
tatgtgttactggat

SEQ ID NO: 32748 - DNA, 15 bp, Homo sapiens
ctatgtgttactgga

SEQ ID NO: 32749 - DNA, 15 bp, Homo sapiens
tctatgtgttactgg

SEQ ID NO: 32750 - DNA, 15 bp, Homo sapiens
gtctatgtgttactg

SEQ ID NO: 32751 - DNA, 15 bp, Homo sapiens
agtctatgtgttact

SEQ ID NO: 32752 - DNA, 15 bp, Homo sapiens
cagtctatgtgttac

SEQ ID NO: 32753 - DNA, 15 bp, Homo sapiens
acagtctatgtgtta

SEQ ID NO: 32754 - DNA, 15 bp, Homo sapiens
cacagtctatgtgtt

SEQ ID NO: 32755 - DNA, 15 bp, Homo sapiens
gcacagtctatgtgt

SEQ ID NO: 32756 - DNA, 15 bp, Homo sapiens
cgcacagtctatgtg

SEQ ID NO: 32757 - DNA, 15 bp, Homo sapiens
gcgcacagtctatgt

SEQ ID NO: 32758 - DNA, 15 bp, Homo sapiens
tgcgcacagtctatg

SEQ ID NO: 32759 - DNA, 15 bp, Homo sapiens
atgcgcacagtctat

SEQ ID NO: 32760 - DNA, 15 bp, Homo sapiens
tatgcgcacagtcta

SEQ ID NO: 32761 - DNA, 15 bp, Homo sapiens
ctatgcgcacagtct

SEQ ID NO: 32762 - DNA, 15 bp, Homo sapiens
cctatgcgcacagtc

SEQ ID NO: 32763 - DNA, 15 bp, Homo sapiens
gcctatgcgcacagt

SEQ ID NO: 32764 - DNA, 15 bp, Homo sapiens
ggcctatgcgcacag

SEQ ID NO: 32765 - DNA, 15 bp, Homo sapiens
aggcctatgcgcaca

SEQ ID NO: 32766 - DNA, 15 bp, Homo sapiens
caggcctatgcgcac

SEQ ID NO: 32767 - DNA, 15 bp, Homo sapiens
gcaggcctatgcgca

SEQ ID NO: 32768 - DNA, 15 bp, Homo sapiens
agcaggcctatgcgc

SEQ ID NO: 32769 - DNA, 15 bp, Homo sapiens
aagcaggcctatgcg

SEQ ID NO: 32770 - DNA, 15 bp, Homo sapiens
aaagcaggcctatgc

SEQ ID NO: 32771 - DNA, 15 bp, Homo sapiens
caaagcaggcctatg

SEQ ID NO: 32772 - DNA, 15 bp, Homo sapiens
acaaagcaggcctat

SEQ ID NO: 32773 - DNA, 15 bp, Homo sapiens
gacaaagcaggccta

SEQ ID NO: 32774 - DNA, 15 bp, Homo sapiens
agacaaagcaggcct

SEQ ID NO: 32775 - DNA, 15 bp, Homo sapiens
gagacaaagcaggcc

SEQ ID NO: 32776 - DNA, 15 bp, Homo sapiens
ggagacaaagcaggc

SEQ ID NO: 32777 - DNA, 15 bp, Homo sapiens
aggagacaaagcagg

SEQ ID NO: 32778 - DNA, 15 bp, Homo sapiens
gaggagacaaagcag

SEQ ID NO: 32779 - DNA, 15 bp, Homo sapiens
agaggagacaaagca

SEQ ID NO: 32780 - DNA, 15 bp, Homo sapiens
tagaggagacaaagc

SEQ ID NO: 32781 - DNA, 15 bp, Homo sapiens
atagaggagacaaag

SEQ ID NO: 32782 - DNA, 15 bp, Homo sapiens
gatagaggagacaaa

SEQ ID NO: 32783 - DNA, 15 bp, Homo sapiens
ggatagaggagacaa

SEQ ID NO: 32784 - DNA, 15 bp, Homo sapiens
aggatagaggagaca

SEQ ID NO: 32785 - DNA, 15 bp, Homo sapiens
caggatagaggagac

SEQ ID NO: 32786 - DNA, 15 bp, Homo sapiens
ccaggatagaggaga

SEQ ID NO: 32787 - DNA, 15 bp, Homo sapiens
cccaggatagaggag

SEQ ID NO: 32788 - DNA, 15 bp, Homo sapiens
gcccaggatagagga

SEQ ID NO: 32789 - DNA, 15 bp, Homo sapiens
agcccaggatagagg

SEQ ID NO: 32790 - DNA, 15 bp, Homo sapiens
aagcccaggatagag

SEQ ID NO: 32791 - DNA, 15 bp, Homo sapiens
aaagcccaggataga

SEQ ID NO: 32792 - DNA, 15 bp, Homo sapiens
aaaagcccaggatag

SEQ ID NO: 32793 - DNA, 15 bp, Homo sapiens
caaaagcccaggata

SEQ ID NO: 32794 - DNA, 15 bp, Homo sapiens
acaaaagcccaggat

SEQ ID NO: 32795 - DNA, 15 bp, Homo sapiens
aacaaaagcccagga

SEQ ID NO: 32796 - DNA, 15 bp, Homo sapiens
aaacaaaagcccagg

SEQ ID NO: 32797 - DNA, 15 bp, Homo sapiens
aaaacaaaagcccag

SEQ ID NO: 32798 - DNA, 15 bp, Homo sapiens
caaaacaaaagccca

SEQ ID NO: 32799 - DNA, 15 bp, Homo sapiens
gcaaaacaaaagccc

SEQ ID NO: 32800 - DNA, 15 bp, Homo sapiens
agcaaaacaaaagcc

SEQ ID NO: 32801 - DNA, 15 bp, Homo sapiens
aagcaaaacaaaagc

SEQ ID NO: 32802 - DNA, 15 bp, Homo sapiens
aaagcaaaacaaaag

SEQ ID NO: 32803 - DNA, 15 bp, Homo sapiens
aaaagcaaaacaaaa

SEQ ID NO: 32804 - DNA, 15 bp, Homo sapiens
aaaaagcaaaacaaa

SEQ ID NO: 32805 - DNA, 15 bp, Homo sapiens
taaaaagcaaaacaa

SEQ ID NO: 32806 - DNA, 15 bp, Homo sapiens
ctaaaaagcaaaaca

SEQ ID NO: 32807 - DNA, 15 bp, Homo sapiens
actaaaaagcaaaac

SEQ ID NO: 32808 - DNA, 15 bp, Homo sapiens
aactaaaaagcaaaa

SEQ ID NO: 32809 - DNA, 15 bp, Homo sapiens
aaactaaaaagcaaa

SEQ ID NO: 32810 - DNA, 15 bp, Homo sapiens
aaaactaaaaagcaa

SEQ ID NO: 32811 - DNA, 15 bp, Homo sapiens
caaaactaaaaagca

SEQ ID NO: 32812 - DNA, 15 bp, Homo sapiens
gcaaaactaaaaagc

SEQ ID NO: 32813 - DNA, 15 bp, Homo sapiens
agcaaaactaaaaag

SEQ ID NO: 32814 - DNA, 15 bp, Homo sapiens
aagcaaaactaaaaa

SEQ ID NO: 32815 - DNA, 15 bp, Homo sapiens
aaagcaaaactaaaa

SEQ ID NO: 32816 - DNA, 15 bp, Homo sapiens
aaaagcaaaactaaa

SEQ ID NO: 32817 - DNA, 15 bp, Homo sapiens
taaaagcaaaactaa

SEQ ID NO: 32818 - DNA, 15 bp, Homo sapiens
ctaaaagcaaaacta

SEQ ID NO: 32819 - DNA, 15 bp, Homo sapiens
actaaaagcaaaact

SEQ ID NO: 32820 - DNA, 15 bp, Homo sapiens
aactaaaagcaaaac

SEQ ID NO: 32821 - DNA, 15 bp, Homo sapiens
aaactaaaagcaaaa

SEQ ID NO: 32822 - DNA, 15 bp, Homo sapiens
aaaactaaaagcaaa

SEQ ID NO: 32823 - DNA, 15 bp, Homo sapiens
aaaaactaaaagcaa

SEQ ID NO: 32824 - DNA, 15 bp, Homo sapiens
gaaaaactaaaagca

SEQ ID NO: 32825 - DNA, 15 bp, Homo sapiens
agaaaaactaaaagc

SEQ ID NO: 32826 - DNA, 15 bp, Homo sapiens
cagaaaaactaaaag

SEQ ID NO: 32827 - DNA, 15 bp, Homo sapiens
acagaaaaactaaaa

SEQ ID NO: 32828 - DNA, 15 bp, Homo sapiens
gacagaaaaactaaa

SEQ ID NO: 32829 - DNA, 15 bp, Homo sapiens
ggacagaaaaactaa

SEQ ID NO: 32830 - DNA, 15 bp, Homo sapiens
gggacagaaaaacta

SEQ ID NO: 32831 - DNA, 15 bp, Homo sapiens
agggacagaaaaact

SEQ ID NO: 32832 - DNA, 15 bp, Homo sapiens
aagggacagaaaaac

SEQ ID NO: 32833 - DNA, 15 bp, Homo sapiens
aaagggacagaaaaa

SEQ ID NO: 32834 - DNA, 15 bp, Homo sapiens
aaaagggacagaaaa

SEQ ID NO: 32835 - DNA, 15 bp, Homo sapiens
taaaagggacagaaa

SEQ ID NO: 32836 - DNA, 15 bp, Homo sapiens
ataaaagggacagaa

SEQ ID NO: 32837 - DNA, 15 bp, Homo sapiens
aataaaagggacaga

SEQ ID NO: 32838 - DNA, 15 bp, Homo sapiens
aaataaaagggacag

SEQ ID NO: 32839 - DNA, 15 bp, Homo sapiens
taaataaaagggaca

SEQ ID NO: 32840 - DNA, 15 bp, Homo sapiens
ttaaataaaagggac

SEQ ID NO: 32841 - DNA, 15 bp, Homo sapiens
gttaaataaaaggga

SEQ ID NO: 32842 - DNA, 15 bp, Homo sapiens
cgttaaataaaaggg

SEQ ID NO: 32843 - DNA, 15 bp, Homo sapiens
gcgttaaataaaagg

SEQ ID NO: 32844 - DNA, 15 bp, Homo sapiens
tgcgttaaataaaag

SEQ ID NO: 32845 - DNA, 15 bp, Homo sapiens
gtgcgttaaataaaa

SEQ ID NO: 32846 - DNA, 15 bp, Homo sapiens
ggtgcgttaaataaa

SEQ ID NO: 32847 - DNA, 15 bp, Homo sapiens
cggtgcgttaaataa

SEQ ID NO: 32848 - DNA, 15 bp, Homo sapiens
tcggtgcgttaaata

SEQ ID NO: 32849 - DNA, 15 bp, Homo sapiens
gtcggtgcgttaaat

SEQ ID NO: 32850 - DNA, 15 bp, Homo sapiens
agtcggtgcgttaaa

SEQ ID NO: 32851 - DNA, 15 bp, Homo sapiens
tagtcggtgcgttaa

SEQ ID NO: 32852 - DNA, 15 bp, Homo sapiens
ctagtcggtgcgtta

SEQ ID NO: 32853 - DNA, 15 bp, Homo sapiens
tctagtcggtgcgtt

SEQ ID NO: 32854 - DNA, 15 bp, Homo sapiens
gtctagtcggtgcgt

SEQ ID NO: 32855 - DNA, 15 bp, Homo sapiens
tgtctagtcggtgcg

SEQ ID NO: 32856 - DNA, 15 bp, Homo sapiens
gtgtctagtcggtgc

SEQ ID NO: 32857 - DNA, 15 bp, Homo sapiens
tgtgtctagtcggtg

SEQ ID NO: 32858 - DNA, 15 bp, Homo sapiens
gtgtgtctagtcggt

SEQ ID NO: 32859 - DNA, 15 bp, Homo sapiens
tgtgtgtctagtcgg

SEQ ID NO: 32860 - DNA, 15 bp, Homo sapiens
ttgtgtgtctagtcg

SEQ ID NO: 32861 - DNA, 15 bp, Homo sapiens
tttgtgtgtctagtc

SEQ ID NO: 32862 - DNA, 15 bp, Homo sapiens
ctttgtgtgtctagt

SEQ ID NO: 32863 - DNA, 15 bp, Homo sapiens
gctttgtgtgtctag

SEQ ID NO: 32864 - DNA, 15 bp, Homo sapiens
tgctttgtgtgtcta

SEQ ID NO: 32865 - DNA, 15 bp, Homo sapiens
ctgctttgtgtgtct

SEQ ID NO: 32866 - DNA, 15 bp, Homo sapiens
actgctttgtgtgtc

SEQ ID NO: 32867 - DNA, 15 bp, Homo sapiens
aactgctttgtgtgt

SEQ ID NO: 32868 - DNA, 15 bp, Homo sapiens
caactgctttgtgtg

SEQ ID NO: 32869 - DNA, 15 bp, Homo sapiens
tcaactgctttgtgt

SEQ ID NO: 32870 - DNA, 15 bp, Homo sapiens
ttcaactgctttgtg

SEQ ID NO: 32871 - DNA, 15 bp, Homo sapiens
attcaactgctttgt

SEQ ID NO: 32872 - DNA, 15 bp, Homo sapiens
aattcaactgctttg

SEQ ID NO: 32873 - DNA, 15 bp, Homo sapiens
aaattcaactgcttt

SEQ ID NO: 32874 - DNA, 15 bp, Homo sapiens
aaaattcaactgctt

SEQ ID NO: 32875 - DNA, 15 bp, Homo sapiens
aaaaattcaactgct

SEQ ID NO: 32876 - DNA, 15 bp, Homo sapiens
taaaaattcaactgc

SEQ ID NO: 32877 - DNA, 15 bp, Homo sapiens
ataaaaattcaactg

SEQ ID NO: 32878 - DNA, 15 bp, Homo sapiens
tataaaaattcaact

SEQ ID NO: 32879 - DNA, 15 bp, Homo sapiens
atataaaaattcaac

SEQ ID NO: 32880 - DNA, 15 bp, Homo sapiens
tatataaaaattcaa

SEQ ID NO: 32881 - DNA, 15 bp, Homo sapiens
atatataaaaattca

SEQ ID NO: 32882 - DNA, 15 bp, Homo sapiens
tatatataaaaattc

SEQ ID NO: 32883 - DNA, 15 bp, Homo sapiens
atatatataaaaatt

SEQ ID NO: 32884 - DNA, 15 bp, Homo sapiens
tatatatataaaaat

SEQ ID NO: 32885 - DNA, 15 bp, Homo sapiens
atatatatataaaaa

SEQ ID NO: 32886 - DNA, 15 bp, Homo sapiens
gatatatatataaaa

SEQ ID NO: 32887 - DNA, 15 bp, Homo sapiens
agatatatatataaa

SEQ ID NO: 32888 - DNA, 15 bp, Homo sapiens
cagatatatatataa

SEQ ID NO: 32889 - DNA, 15 bp, Homo sapiens
acagatatatatata

SEQ ID NO: 32890 - DNA, 15 bp, Homo sapiens
tacagatatatatat

SEQ ID NO: 32891 - DNA, 15 bp, Homo sapiens
atacagatatatata

SEQ ID NO: 32892 - DNA, 15 bp, Homo sapiens
tatacagatatatat

SEQ ID NO: 32893 - DNA, 15 bp, Homo sapiens
atatacagatatata

SEQ ID NO: 32894 - DNA, 15 bp, Homo sapiens
aatatacagatatat

SEQ ID NO: 32895 - DNA, 15 bp, Homo sapiens
caatatacagatata

SEQ ID NO: 32896 - DNA, 15 bp, Homo sapiens
gcaatatacagatat

SEQ ID NO: 32897 - DNA, 15 bp, Homo sapiens
tgcaatatacagata

SEQ ID NO: 32898 - DNA, 15 bp, Homo sapiens
gtgcaatatacagat

SEQ ID NO: 32899 - DNA, 15 bp, Homo sapiens
tgtgcaatatacaga

SEQ ID NO: 32900 - DNA, 15 bp, Homo sapiens
ttgtgcaatatacag

SEQ ID NO: 32901 - DNA, 15 bp, Homo sapiens
attgtgcaatataca

SEQ ID NO: 32902 - DNA, 15 bp, Homo sapiens
aattgtgcaatatac

SEQ ID NO: 32903 - DNA, 15 bp, Homo sapiens
taattgtgcaatata

SEQ ID NO: 32904 - DNA, 15 bp, Homo sapiens
ataattgtgcaatat

SEQ ID NO: 32905 - DNA, 15 bp, Homo sapiens
tataattgtgcaata

SEQ ID NO: 32906 - DNA, 15 bp, Homo sapiens
ttataattgtgcaat

SEQ ID NO: 32907 - DNA, 15 bp, Homo sapiens
tttataattgtgcaa

SEQ ID NO: 32908 - DNA, 15 bp, Homo sapiens
gtttataattgtgca

SEQ ID NO: 32909 - DNA, 15 bp, Homo sapiens
agtttataattgtgc

SEQ ID NO: 32910 - DNA, 15 bp, Homo sapiens
gagtttataattgtg

SEQ ID NO: 32911 - DNA, 15 bp, Homo sapiens
tgagtttataattgt

SEQ ID NO: 32912 - DNA, 15 bp, Homo sapiens
atgagtttataattg

SEQ ID NO: 32913 - DNA, 15 bp, Homo sapiens
aatgagtttataatt

SEQ ID NO: 32914 - DNA, 15 bp, Homo sapiens
aaatgagtttataat

SEQ ID NO: 32915 - DNA, 15 bp, Homo sapiens
aaaatgagtttataa

SEQ ID NO: 32916 - DNA, 15 bp, Homo sapiens
caaaatgagtttata

SEQ ID NO: 32917 - DNA, 15 bp, Homo sapiens
gcaaaatgagtttat

SEQ ID NO: 32918 - DNA, 15 bp, Homo sapiens
agcaaaatgagttta

SEQ ID NO: 32919 - DNA, 15 bp, Homo sapiens
aagcaaaatgagttt

SEQ ID NO: 32920 - DNA, 15 bp, Homo sapiens
caagcaaaatgagtt

SEQ ID NO: 32921 - DNA, 15 bp, Homo sapiens
acaagcaaaatgagt

SEQ ID NO: 32922 - DNA, 15 bp, Homo sapiens
cacaagcaaaatgag

SEQ ID NO: 32923 - DNA, 15 bp, Homo sapiens
ccacaagcaaaatga

SEQ ID NO: 32924 - DNA, 15 bp, Homo sapiens
gccacaagcaaaatg

SEQ ID NO: 32925 - DNA, 15 bp, Homo sapiens
agccacaagcaaaat

SEQ ID NO: 32926 - DNA, 15 bp, Homo sapiens
gagccacaagcaaaa

SEQ ID NO: 32927 - DNA, 15 bp, Homo sapiens
ggagccacaagcaaa

SEQ ID NO: 32928 - DNA, 15 bp, Homo sapiens
tggagccacaagcaa

SEQ ID NO: 32929 - DNA, 15 bp, Homo sapiens
gtggagccacaagca

SEQ ID NO: 32930 - DNA, 15 bp, Homo sapiens
tgtggagccacaagc

SEQ ID NO: 32931 - DNA, 15 bp, Homo sapiens
gtgtggagccacaag

SEQ ID NO: 32932 - DNA, 15 bp, Homo sapiens
tgtgtggagccacaa

SEQ ID NO: 32933 - DNA, 15 bp, Homo sapiens
gtgtgtggagccaca

SEQ ID NO: 32934 - DNA, 15 bp, Homo sapiens
tgtgtgtggagccac

SEQ ID NO: 32935 - DNA, 15 bp, Homo sapiens
gtgtgtgtggagcca

SEQ ID NO: 32936 - DNA, 15 bp, Homo sapiens
tgtgtgtgtggagcc

SEQ ID NO: 32937 - DNA, 15 bp, Homo sapiens
ttgtgtgtgtggagc

SEQ ID NO: 32938 - DNA, 15 bp, Homo sapiens
tttgtgtgtgtggag

SEQ ID NO: 32939 - DNA, 15 bp, Homo sapiens
ttttgtgtgtgtgga

SEQ ID NO: 32940 - DNA, 15 bp, Homo sapiens
tttttgtgtgtgtgg

SEQ ID NO: 32941 - DNA, 15 bp, Homo sapiens
ttttttgtgtgtgtg

SEQ ID NO: 32942 - DNA, 15 bp, Homo sapiens
tttttttgtgtgtgt

SEQ ID NO: 32943 - DNA, 15 bp, Homo sapiens
ctttttttgtgtgtg

SEQ ID NO: 32944 - DNA, 15 bp, Homo sapiens
tctttttttgtgtgt

SEQ ID NO: 32945 - DNA, 15 bp, Homo sapiens
gtctttttttgtgtg

SEQ ID NO: 32946 - DNA, 15 bp, Homo sapiens
ggtctttttttgtgt

SEQ ID NO: 32947 - DNA, 15 bp, Homo sapiens
aggtctttttttgtg

SEQ ID NO: 32948 - DNA, 15 bp, Homo sapiens
caggtctttttttgt

SEQ ID NO: 32949 - DNA, 15 bp, Homo sapiens
acaggtctttttttg

SEQ ID NO: 32950 - DNA, 15 bp, Homo sapiens
aacaggtcttttttt

SEQ ID NO: 32951 - DNA, 15 bp, Homo sapiens
taacaggtctttttt

SEQ ID NO: 32952 - DNA, 15 bp, Homo sapiens
ttaacaggtcttttt

SEQ ID NO: 32953 - DNA, 15 bp, Homo sapiens
tttaacaggtctttt

SEQ ID NO: 32954 - DNA, 15 bp, Homo sapiens
ttttaacaggtcttt

SEQ ID NO: 32955 - DNA, 15 bp, Homo sapiens
attttaacaggtctt

SEQ ID NO: 32956 - DNA, 15 bp, Homo sapiens
aattttaacaggtct

SEQ ID NO: 32957 - DNA, 15 bp, Homo sapiens
taattttaacaggtc

SEQ ID NO: 32958 - DNA, 15 bp, Homo sapiens
ataattttaacaggt

SEQ ID NO: 32959 - DNA, 15 bp, Homo sapiens
tataattttaacagg

SEQ ID NO: 32960 - DNA, 15 bp, Homo sapiens
gtataattttaacag

SEQ ID NO: 32961 - DNA, 15 bp, Homo sapiens
ggtataattttaaca

SEQ ID NO: 32962 - DNA, 15 bp, Homo sapiens
aggtataattttaac

SEQ ID NO: 32963 - DNA, 15 bp, Homo sapiens
caggtataattttaa

SEQ ID NO: 32964 - DNA, 15 bp, Homo sapiens
acaggtataatttta

SEQ ID NO: 32965 - DNA, 15 bp, Homo sapiens
aacaggtataatttt

SEQ ID NO: 32966 - DNA, 15 bp, Homo sapiens
caacaggtataattt

SEQ ID NO: 32967 - DNA, 15 bp, Homo sapiens
gcaacaggtataatt

SEQ ID NO: 32968 - DNA, 15 bp, Homo sapiens
agcaacaggtataat

SEQ ID NO: 32969 - DNA, 15 bp, Homo sapiens
aagcaacaggtataa

SEQ ID NO: 32970 - DNA, 15 bp, Homo sapiens
taagcaacaggtata

SEQ ID NO: 32971 - DNA, 15 bp, Homo sapiens
ttaagcaacaggtat

SEQ ID NO: 32972 - DNA, 15 bp, Homo sapiens
attaagcaacaggta

SEQ ID NO: 32973 - DNA, 15 bp, Homo sapiens
aattaagcaacaggt

SEQ ID NO: 32974 - DNA, 15 bp, Homo sapiens
taattaagcaacagg

SEQ ID NO: 32975 - DNA, 15 bp, Homo sapiens
gtaattaagcaacag

SEQ ID NO: 32976 - DNA, 15 bp, Homo sapiens
tgtaattaagcaaca

SEQ ID NO: 32977 - DNA, 15 bp, Homo sapiens
ttgtaattaagcaac

SEQ ID NO: 32978 - DNA, 15 bp, Homo sapiens
attgtaattaagcaa

SEQ ID NO: 32979 - DNA, 15 bp, Homo sapiens
tattgtaattaagca

SEQ ID NO: 32980 - DNA, 15 bp, Homo sapiens
atattgtaattaagc

SEQ ID NO: 32981 - DNA, 15 bp, Homo sapiens
aatattgtaattaag

SEQ ID NO: 32982 - DNA, 15 bp, Homo sapiens
aaatattgtaattaa

SEQ ID NO: 32983 - DNA, 15 bp, Homo sapiens
gaaatattgtaatta

SEQ ID NO: 32984 - DNA, 15 bp, Homo sapiens
agaaatattgtaatt

SEQ ID NO: 32985 - DNA, 15 bp, Homo sapiens
cagaaatattgtaat

SEQ ID NO: 32986 - DNA, 15 bp, Homo sapiens
tcagaaatattgtaa

SEQ ID NO: 32987 - DNA, 15 bp, Homo sapiens
atcagaaatattgta

SEQ ID NO: 32988 - DNA, 15 bp, Homo sapiens
tatcagaaatattgt

SEQ ID NO: 32989 - DNA, 15 bp, Homo sapiens
ttatcagaaatattg

SEQ ID NO: 32990 - DNA, 15 bp, Homo sapiens
gttatcagaaatatt

SEQ ID NO: 32991 - DNA, 15 bp, Homo sapiens
ggttatcagaaatat

SEQ ID NO: 32992 - DNA, 15 bp, Homo sapiens
tggttatcagaaata

SEQ ID NO: 32993 - DNA, 15 bp, Homo sapiens
atggttatcagaaat

SEQ ID NO: 32994 - DNA, 15 bp, Homo sapiens
tatggttatcagaaa

SEQ ID NO: 32995 - DNA, 15 bp, Homo sapiens
ctatggttatcagaa

SEQ ID NO: 32996 - DNA, 15 bp, Homo sapiens
gctatggttatcaga

SEQ ID NO: 32997 - DNA, 15 bp, Homo sapiens
tgctatggttatcag

SEQ ID NO: 32998 - DNA, 15 bp, Homo sapiens
atgctatggttatca

SEQ ID NO: 32999 - DNA, 15 bp, Homo sapiens
tatgctatggttatc

SEQ ID NO: 33000 - DNA, 15 bp, Homo sapiens
ctatgctatggttat

SEQ ID NO: 33001 - DNA, 15 bp, Homo sapiens
cctatgctatggtta

SEQ ID NO: 33002 - DNA, 15 bp, Homo sapiens
tcctatgctatggtt

SEQ ID NO: 33003 - DNA, 15 bp, Homo sapiens
gtcctatgctatggt

SEQ ID NO: 33004 - DNA, 15 bp, Homo sapiens
tgtcctatgctatgg

SEQ ID NO: 33005 - DNA, 15 bp, Homo sapiens
ttgtcctatgctatg

SEQ ID NO: 33006 - DNA, 15 bp, Homo sapiens
cttgtcctatgctat

SEQ ID NO: 33007 - DNA, 15 bp, Homo sapiens
ccttgtcctatgcta

SEQ ID NO: 33008 - DNA, 15 bp, Homo sapiens
cccttgtcctatgct

SEQ ID NO: 33009 - DNA, 15 bp, Homo sapiens
tcccttgtcctatgc

SEQ ID NO: 33010 - DNA, 15 bp, Homo sapiens
ttcccttgtcctatg

SEQ ID NO: 33011 - DNA, 15 bp, Homo sapiens
tttcccttgtcctat

SEQ ID NO: 33012 - DNA, 15 bp, Homo sapiens
ttttcccttgtccta

SEQ ID NO: 33013 - DNA, 15 bp, Homo sapiens
attttcccttgtcct

SEQ ID NO: 33014 - DNA, 15 bp, Homo sapiens
tattttcccttgtcc

SEQ ID NO: 33015 - DNA, 15 bp, Homo sapiens
ttattttcccttgtc

SEQ ID NO: 33016 - DNA, 15 bp, Homo sapiens
tttattttcccttgt

SEQ ID NO: 33017 - DNA, 15 bp, Homo sapiens
ttttattttcccttg

SEQ ID NO: 33018 - DNA, 15 bp, Homo sapiens
tttttattttccctt

SEQ ID NO: 33019 - DNA, 15 bp, Homo sapiens
ttttttattttccct

SEQ ID NO: 33020 - DNA, 15 bp, Homo sapiens
tttttttattttccc

SEQ ID NO: 33021 - DNA, 15 bp, Homo sapiens
ctttttttattttcc

SEQ ID NO: 33022 - DNA, 15 bp, Homo sapiens
tctttttttattttc

SEQ ID NO: 33023 - DNA, 15 bp, Homo sapiens
ttctttttttatttt

SEQ ID NO: 33024 - DNA, 15 bp, Homo sapiens
tttctttttttattt

SEQ ID NO: 33025 - DNA, 15 bp, Homo sapiens
ttttctttttttatt

SEQ ID NO: 33026 - DNA, 15 bp, Homo sapiens
tttttctttttttat

SEQ ID NO: 33027 - DNA, 15 bp, Homo sapiens
ttttttcttttttta

SEQ ID NO: 33028 - DNA, 15 bp, Homo sapiens
ttttttttctttttt

SEQ ID NO: 33029 - DNA, 15 bp, Homo sapiens
cttttttttcttttt

SEQ ID NO: 33030 - DNA, 15 bp, Homo sapiens
tcttttttttctttt

SEQ ID NO: 33031 - DNA, 15 bp, Homo sapiens
ttcttttttttcttt

SEQ ID NO: 33032 - DNA, 15 bp, Homo sapiens
tttcttttttttctt

SEQ ID NO: 33033 - DNA, 15 bp, Homo sapiens
ttttcttttttttct

SEQ ID NO: 33034 - DNA, 15 bp, Homo sapiens
tttttcttttttttc

SEQ ID NO: 33035 - DNA, 15 bp, Homo sapiens
gtttttttttctttt

SEQ ID NO: 33036 - DNA, 15 bp, Homo sapiens
cgtttttttttcttt

SEQ ID NO: 33037 - DNA, 15 bp, Homo sapiens
tcgtttttttttctt

SEQ ID NO: 33038 - DNA, 15 bp, Homo sapiens
gtcgtttttttttct

SEQ ID NO: 33039 - DNA, 15 bp, Homo sapiens
tgtcgtttttttttc

SEQ ID NO: 33040 - DNA, 15 bp, Homo sapiens
ttgtcgttttttttt

SEQ ID NO: 33041 - DNA, 15 bp, Homo sapiens
tttgtcgtttttttt

SEQ ID NO: 33042 - DNA, 15 bp, Homo sapiens
atttgtcgttttttt

SEQ ID NO: 33043 - DNA, 15 bp, Homo sapiens
gatttgtcgtttttt

SEQ ID NO: 33044 - DNA, 15 bp, Homo sapiens
agatttgtcgttttt

SEQ ID NO: 33045 - DNA, 15 bp, Homo sapiens
cagatttgtcgtttt

SEQ ID NO: 33046 - DNA, 15 bp, Homo sapiens
acagatttgtcgttt

SEQ ID NO: 33047 - DNA, 15 bp, Homo sapiens
gacagatttgtcgtt

SEQ ID NO: 33048 - DNA, 15 bp, Homo sapiens
agacagatttgtcgt

SEQ ID NO: 33049 - DNA, 15 bp, Homo sapiens
cagacagatttgtcg

SEQ ID NO: 33050 - DNA, 15 bp, Homo sapiens
gcagacagatttgtc

SEQ ID NO: 33051 - DNA, 15 bp, Homo sapiens
agcagacagatttgt

SEQ ID NO: 33052 - DNA, 15 bp, Homo sapiens
cagcagacagatttg

SEQ ID NO: 33053 - DNA, 15 bp, Homo sapiens
ccagcagacagattt

SEQ ID NO: 33054 - DNA, 15 bp, Homo sapiens
accagcagacagatt

SEQ ID NO: 33055 - DNA, 15 bp, Homo sapiens
gaccagcagacagat

SEQ ID NO: 33056 - DNA, 15 bp, Homo sapiens
tgaccagcagacaga

SEQ ID NO: 33057 - DNA, 15 bp, Homo sapiens
gtgaccagcagacag

SEQ ID NO: 33058 - DNA, 15 bp, Homo sapiens
agtgaccagcagaca

SEQ ID NO: 33059 - DNA, 15 bp, Homo sapiens
aagtgaccagcagac

SEQ ID NO: 33060 - DNA, 15 bp, Homo sapiens
gaagtgaccagcaga

SEQ ID NO: 33061 - DNA, 15 bp, Homo sapiens
agaagtgaccagcag

SEQ ID NO: 33062 - DNA, 15 bp, Homo sapiens
aagaagtgaccagca

SEQ ID NO: 33063 - DNA, 15 bp, Homo sapiens
gaagaagtgaccagc

SEQ ID NO: 33064 - DNA, 15 bp, Homo sapiens
agaagaagtgaccag

SEQ ID NO: 33065 - DNA, 15 bp, Homo sapiens
cagaagaagtgacca

SEQ ID NO: 33066 - DNA, 15 bp, Homo sapiens
acagaagaagtgacc

SEQ ID NO: 33067 - DNA, 15 bp, Homo sapiens
gacagaagaagtgac

SEQ ID NO: 33068 - DNA, 15 bp, Homo sapiens
ggacagaagaagtga

SEQ ID NO: 33069 - DNA, 15 bp, Homo sapiens
tggacagaagaagtg

SEQ ID NO: 33070 - DNA, 15 bp, Homo sapiens
ttggacagaagaagt

SEQ ID NO: 33071 - DNA, 15 bp, Homo sapiens
cttggacagaagaag

SEQ ID NO: 33072 - DNA, 15 bp, Homo sapiens
gcttggacagaagaa

SEQ ID NO: 33073 - DNA, 15 bp, Homo sapiens
tgcttggacagaaga

SEQ ID NO: 33074 - DNA, 15 bp, Homo sapiens
ctgcttggacagaag

SEQ ID NO: 33075 - DNA, 15 bp, Homo sapiens
tctgcttggacagaa

SEQ ID NO: 33076 - DNA, 15 bp, Homo sapiens
atctgcttggacaga

SEQ ID NO: 33077 - DNA, 15 bp, Homo sapiens
aatctgcttggacag

SEQ ID NO: 33078 - DNA, 15 bp, Homo sapiens
gaatctgcttggaca

SEQ ID NO: 33079 - DNA, 15 bp, Homo sapiens
cgaatctgcttggac

SEQ ID NO: 33080 - DNA, 15 bp, Homo sapiens
acgaatctgcttgga

SEQ ID NO: 33081 - DNA, 15 bp, Homo sapiens
cacgaatctgcttgg

SEQ ID NO: 33082 - DNA, 15 bp, Homo sapiens
ccacgaatctgcttg

SEQ ID NO: 33083 - DNA, 15 bp, Homo sapiens
accacgaatctgctt

SEQ ID NO: 33084 - DNA, 15 bp, Homo sapiens
gaccacgaatctgct

SEQ ID NO: 33085 - DNA, 15 bp, Homo sapiens
agaccacgaatctgc

SEQ ID NO: 33086 - DNA, 15 bp, Homo sapiens
aagaccacgaatctg

SEQ ID NO: 33087 - DNA, 15 bp, Homo sapiens
aaagaccacgaatct

SEQ ID NO: 33088 - DNA, 15 bp, Homo sapiens
aaaagaccacgaatc

SEQ ID NO: 33089 - DNA, 15 bp, Homo sapiens
gaaaagaccacgaat

SEQ ID NO: 33090 - DNA, 15 bp, Homo sapiens
ggaaaagaccacgaa

SEQ ID NO: 33091 - DNA, 15 bp, Homo sapiens
aggaaaagaccacga

SEQ ID NO: 33092 - DNA, 15 bp, Homo sapiens
gaggaaaagaccacg

SEQ ID NO: 33093 - DNA, 15 bp, Homo sapiens
cgaggaaaagaccac

SEQ ID NO: 33094 - DNA, 15 bp, Homo sapiens
gcgaggaaaagacca

SEQ ID NO: 33095 - DNA, 15 bp, Homo sapiens
agcgaggaaaagacc

SEQ ID NO: 33096 - DNA, 15 bp, Homo sapiens
aagcgaggaaaagac

SEQ ID NO: 33097 - DNA, 15 bp, Homo sapiens
gaagcgaggaaaaga

SEQ ID NO: 33098 - DNA, 15 bp, Homo sapiens
agaagcgaggaaaag

SEQ ID NO: 33099 - DNA, 15 bp, Homo sapiens
aagaagcgaggaaaa

SEQ ID NO: 33100 - DNA, 15 bp, Homo sapiens
aaagaagcgaggaaa

SEQ ID NO: 33101 - DNA, 15 bp, Homo sapiens
gaaagaagcgaggaa

SEQ ID NO: 33102 - DNA, 15 bp, Homo sapiens
tgaaagaagcgagga

SEQ ID NO: 33103 - DNA, 15 bp, Homo sapiens
ttgaaagaagcgagg

SEQ ID NO: 33104 - DNA, 15 bp, Homo sapiens
cttgaaagaagcgag

SEQ ID NO: 33105 - DNA, 15 bp, Homo sapiens
ccttgaaagaagcga

SEQ ID NO: 33106 - DNA, 15 bp, Homo sapiens
cccttgaaagaagcg

SEQ ID NO: 33107 - DNA, 15 bp, Homo sapiens
gcccttgaaagaagc

SEQ ID NO: 33108 - DNA, 15 bp, Homo sapiens
agcccttgaaagaag

SEQ ID NO: 33109 - DNA, 15 bp, Homo sapiens
aagcccttgaaagaa

SEQ ID NO: 33110 - DNA, 15 bp, Homo sapiens
aaagcccttgaaaga

SEQ ID NO: 33111 - DNA, 15 bp, Homo sapiens
gaaagcccttgaaag

SEQ ID NO: 33112 - DNA, 15 bp, Homo sapiens
ggaaagcccttgaaa

SEQ ID NO: 33113 - DNA, 15 bp, Homo sapiens
aggaaagcccttgaa

SEQ ID NO: 33114 - DNA, 15 bp, Homo sapiens
caggaaagcccttga

SEQ ID NO: 33115 - DNA, 15 bp, Homo sapiens
acaggaaagcccttg

SEQ ID NO: 33116 - DNA, 15 bp, Homo sapiens
cacaggaaagccctt

SEQ ID NO: 33117 - DNA, 15 bp, Homo sapiens
gcacaggaaagccct

SEQ ID NO: 33118 - DNA, 15 bp, Homo sapiens
ggcacaggaaagccc

SEQ ID NO: 33119 - DNA, 15 bp, Homo sapiens
tggcacaggaaagcc

SEQ ID NO: 33120 - DNA, 15 bp, Homo sapiens
ctggcacaggaaagc

SEQ ID NO: 33121 - DNA, 15 bp, Homo sapiens
cctggcacaggaaag

SEQ ID NO: 33122 - DNA, 15 bp, Homo sapiens
acctggcacaggaaa

SEQ ID NO: 33123 - DNA, 15 bp, Homo sapiens
cacctggcacaggaa

SEQ ID NO: 33124 - DNA, 15 bp, Homo sapiens
tcacctggcacagga

SEQ ID NO: 33125 - DNA, 15 bp, Homo sapiens
ttcacctggcacagg

SEQ ID NO: 33126 - DNA, 15 bp, Homo sapiens
cttcacctggcacag

SEQ ID NO: 33127 - DNA, 15 bp, Homo sapiens
ccttcacctggcaca

SEQ ID NO: 33128 - DNA, 15 bp, Homo sapiens
tccttcacctggcac

SEQ ID NO: 33129 - DNA, 15 bp, Homo sapiens
ctccttcacctggca

SEQ ID NO: 33130 - DNA, 15 bp, Homo sapiens
cctccttcacctggc

SEQ ID NO: 33131 - DNA, 15 bp, Homo sapiens
gcctccttcacctgg

SEQ ID NO: 33132 - DNA, 15 bp, Homo sapiens
agcctccttcacctg

SEQ ID NO: 33133 - DNA, 15 bp, Homo sapiens
gagcctccttcacct

SEQ ID NO: 33134 - DNA, 15 bp, Homo sapiens
ggagcctccttcacc

SEQ ID NO: 33135 - DNA, 15 bp, Homo sapiens
tggagcctccttcac

SEQ ID NO: 33136 - DNA, 15 bp, Homo sapiens
ctggagcctccttca

SEQ ID NO: 33137 - DNA, 15 bp, Homo sapiens
cctggagcctccttc

SEQ ID NO: 33138 - DNA, 15 bp, Homo sapiens
gcctggagcctcctt

SEQ ID NO: 33139 - DNA, 15 bp, Homo sapiens
tgcctggagcctcct

SEQ ID NO: 33140 - DNA, 15 bp, Homo sapiens
ctgcctggagcctcc

SEQ ID NO: 33141 - DNA, 15 bp, Homo sapiens
gctgcctggagcctc

SEQ ID NO: 33142 - DNA, 15 bp, Homo sapiens
tgctgcctggagcct

SEQ ID NO: 33143 - DNA, 15 bp, Homo sapiens
gtgctgcctggagcc

SEQ ID NO: 33144 - DNA, 15 bp, Homo sapiens
ggtgctgcctggagc

SEQ ID NO: 33145 - DNA, 15 bp, Homo sapiens
gggtgctgcctggag

SEQ ID NO: 33146 - DNA, 15 bp, Homo sapiens
tgggtgctgcctgga

SEQ ID NO: 33147 - DNA, 15 bp, Homo sapiens
ctgggtgctgcctgg

SEQ ID NO: 33148 - DNA, 15 bp, Homo sapiens
cctgggtgctgcctg

SEQ ID NO: 33149 - DNA, 15 bp, Homo sapiens
acctgggtgctgcct

SEQ ID NO: 33150 - DNA, 15 bp, Homo sapiens
aacctgggtgctgcc

SEQ ID NO: 33151 - DNA, 15 bp, Homo sapiens
aaacctgggtgctgc

SEQ ID NO: 33152 - DNA, 15 bp, Homo sapiens
aaaacctgggtgctg

SEQ ID NO: 33153 - DNA, 15 bp, Homo sapiens
caaaacctgggtgct

SEQ ID NO: 33154 - DNA, 15 bp, Homo sapiens
gcaaaacctgggtgc

SEQ ID NO: 33155 - DNA, 15 bp, Homo sapiens
tgcaaaacctgggtg

SEQ ID NO: 33156 - DNA, 15 bp, Homo sapiens
gtgcaaaacctgggt

SEQ ID NO: 33157 - DNA, 15 bp, Homo sapiens
agtgcaaaacctggg

SEQ ID NO: 33158 - DNA, 15 bp, Homo sapiens
gagtgcaaaacctgg

SEQ ID NO: 33159 - DNA, 15 bp, Homo sapiens
agagtgcaaaacctg

SEQ ID NO: 33160 - DNA, 15 bp, Homo sapiens
aagagtgcaaaacct

SEQ ID NO: 33161 - DNA, 15 bp, Homo sapiens
caagagtgcaaaacc

SEQ ID NO: 33162 - DNA, 15 bp, Homo sapiens
acaagagtgcaaaac

SEQ ID NO: 33163 - DNA, 15 bp, Homo sapiens
aacaagagtgcaaaa

SEQ ID NO: 33164 - DNA, 15 bp, Homo sapiens
aaacaagagtgcaaa

SEQ ID NO: 33165 - DNA, 15 bp, Homo sapiens
gaaacaagagtgcaa

SEQ ID NO: 33166 - DNA, 15 bp, Homo sapiens
agaaacaagagtgca

SEQ ID NO: 33167 - DNA, 15 bp, Homo sapiens
gagaaacaagagtgc

SEQ ID NO: 33168 - DNA, 15 bp, Homo sapiens
ggagaaacaagagtg

SEQ ID NO: 33169 - DNA, 15 bp, Homo sapiens
gggagaaacaagagt

SEQ ID NO: 33170 - DNA, 15 bp, Homo sapiens
cgggagaaacaagag

SEQ ID NO: 33171 - DNA, 15 bp, Homo sapiens
acgggagaaacaaga

SEQ ID NO: 33172 - DNA, 15 bp, Homo sapiens
cacgggagaaacaag

SEQ ID NO: 33173 - DNA, 15 bp, Homo sapiens
gcacgggagaaacaa

SEQ ID NO: 33174 - DNA, 15 bp, Homo sapiens
agcacgggagaaaca

SEQ ID NO: 33175 - DNA, 15 bp, Homo sapiens
aagcacgggagaaac

SEQ ID NO: 33176 - DNA, 15 bp, Homo sapiens
caagcacgggagaaa

SEQ ID NO: 33177 - DNA, 15 bp, Homo sapiens
acaagcacgggagaa

SEQ ID NO: 33178 - DNA, 15 bp, Homo sapiens
cacaagcacgggaga

SEQ ID NO: 33179 - DNA, 15 bp, Homo sapiens
tcacaagcacgggag

SEQ ID NO: 33180 - DNA, 15 bp, Homo sapiens
ttcacaagcacggga

SEQ ID NO: 33181 - DNA, 15 bp, Homo sapiens
tttcacaagcacggg

SEQ ID NO: 33182 - DNA, 15 bp, Homo sapiens
ctttcacaagcacgg

SEQ ID NO: 33183 - DNA, 15 bp, Homo sapiens
tctttcacaagcacg

SEQ ID NO: 33184 - DNA, 15 bp, Homo sapiens
ctctttcacaagcac

SEQ ID NO: 33185 - DNA, 15 bp, Homo sapiens
cctctttcacaagca

SEQ ID NO: 33186 - DNA, 15 bp, Homo sapiens
acctctttcacaagc

SEQ ID NO: 33187 - DNA, 15 bp, Homo sapiens
gacctctttcacaag

SEQ ID NO: 33188 - DNA, 15 bp, Homo sapiens
ggacctctttcacaa

SEQ ID NO: 33189 - DNA, 15 bp, Homo sapiens
gggacctctttcaca

SEQ ID NO: 33190 - DNA, 15 bp, Homo sapiens
tgggacctctttcac

SEQ ID NO: 33191 - DNA, 15 bp, Homo sapiens
ttgggacctctttca

SEQ ID NO: 33192 - DNA, 15 bp, Homo sapiens
cttgggacctctttc

SEQ ID NO: 33193 - DNA, 15 bp, Homo sapiens
ccttgggacctcttt

SEQ ID NO: 33194 - DNA, 15 bp, Homo sapiens
accttgggacctctt

SEQ ID NO: 33195 - DNA, 15 bp, Homo sapiens
aaccttgggacctct

SEQ ID NO: 33196 - DNA, 15 bp, Homo sapiens
gaaccttgggacctc

SEQ ID NO: 33197 - DNA, 15 bp, Homo sapiens
agaaccttgggacct

SEQ ID NO: 33198 - DNA, 15 bp, Homo sapiens
cagaaccttgggacc

SEQ ID NO: 33199 - DNA, 15 bp, Homo sapiens
ccagaaccttgggac

SEQ ID NO: 33200 - DNA, 15 bp, Homo sapiens
cccagaaccttggga

SEQ ID NO: 33201 - DNA, 15 bp, Homo sapiens
acccagaaccttggg

SEQ ID NO: 33202 - DNA, 15 bp, Homo sapiens
cacccagaaccttgg

SEQ ID NO: 33203 - DNA, 15 bp, Homo sapiens
gcacccagaaccttg

SEQ ID NO: 33204 - DNA, 15 bp, Homo sapiens
tgcacccagaacctt

SEQ ID NO: 33205 - DNA, 15 bp, Homo sapiens
ctgcacccagaacct

SEQ ID NO: 33206 - DNA, 15 bp, Homo sapiens
cctgcacccagaacc

SEQ ID NO: 33207 - DNA, 15 bp, Homo sapiens
tcctgcacccagaac

SEQ ID NO: 33208 - DNA, 15 bp, Homo sapiens
ctcctgcacccagaa

SEQ ID NO: 33209 - DNA, 15 bp, Homo sapiens
gctcctgcacccaga

SEQ ID NO: 33210 - DNA, 15 bp, Homo sapiens
cgctcctgcacccag

SEQ ID NO: 33211 - DNA, 15 bp, Homo sapiens
gcgctcctgcaccca

SEQ ID NO: 33212 - DNA, 15 bp, Homo sapiens
agcgctcctgcaccc

SEQ ID NO: 33213 - DNA, 15 bp, Homo sapiens
gagcgctcctgcacc

SEQ ID NO: 33214 - DNA, 15 bp, Homo sapiens
ggagcgctcctgcac

SEQ ID NO: 33215 - DNA, 15 bp, Homo sapiens
gggagcgctcctgca

SEQ ID NO: 33216 - DNA, 15 bp, Homo sapiens
agggagcgctcctgc

SEQ ID NO: 33217 - DNA, 15 bp, Homo sapiens
aagggagcgctcctg

SEQ ID NO: 33218 - DNA, 15 bp, Homo sapiens
caagggagcgctcct

SEQ ID NO: 33219 - DNA, 15 bp, Homo sapiens
tcaagggagcgctcc

SEQ ID NO: 33220 - DNA, 15 bp, Homo sapiens
gtcaagggagcgctc

SEQ ID NO: 33221 - DNA, 15 bp, Homo sapiens
ggtcaagggagcgct

SEQ ID NO: 33222 - DNA, 15 bp, Homo sapiens
aggtcaagggagcgc

SEQ ID NO: 33223 - DNA, 15 bp, Homo sapiens
caggtcaagggagcg

SEQ ID NO: 33224 - DNA, 15 bp, Homo sapiens
gcaggtcaagggagc

SEQ ID NO: 33225 - DNA, 15 bp, Homo sapiens
agcaggtcaagggag

SEQ ID NO: 33226 - DNA, 15 bp, Homo sapiens
cagcaggtcaaggga

SEQ ID NO: 33227 - DNA, 15 bp, Homo sapiens
tcagcaggtcaaggg

SEQ ID NO: 33228 - DNA, 15 bp, Homo sapiens
ttcagcaggtcaagg

SEQ ID NO: 33229 - DNA, 15 bp, Homo sapiens
cttcagcaggtcaag

SEQ ID NO: 33230 - DNA, 15 bp, Homo sapiens
acttcagcaggtcaa

SEQ ID NO: 33231 - DNA, 15 bp, Homo sapiens
gacttcagcaggtca

SEQ ID NO: 33232 - DNA, 15 bp, Homo sapiens
ggacttcagcaggtc

SEQ ID NO: 33233 - DNA, 15 bp, Homo sapiens
cggacttcagcaggt

SEQ ID NO: 33234 - DNA, 15 bp, Homo sapiens
ccggacttcagcagg

SEQ ID NO: 33235 - DNA, 15 bp, Homo sapiens
tccggacttcagcag

SEQ ID NO: 33236 - DNA, 15 bp, Homo sapiens
ttccggacttcagca

SEQ ID NO: 33237 - DNA, 15 bp, Homo sapiens
gttccggacttcagc

SEQ ID NO: 33238 - DNA, 15 bp, Homo sapiens
cgttccggacttcag

SEQ ID NO: 33239 - DNA, 15 bp, Homo sapiens
acgttccggacttca

SEQ ID NO: 33240 - DNA, 15 bp, Homo sapiens
tacgttccggacttc

SEQ ID NO: 33241 - DNA, 15 bp, Homo sapiens
ctacgttccggactt

SEQ ID NO: 33242 - DNA, 15 bp, Homo sapiens
actacgttccggact

SEQ ID NO: 33243 - DNA, 15 bp, Homo sapiens
gactacgttccggac

SEQ ID NO: 33244 - DNA, 15 bp, Homo sapiens
cgactacgttccgga

SEQ ID NO: 33245 - DNA, 15 bp, Homo sapiens
ccgactacgttccgg

SEQ ID NO: 33246 - DNA, 15 bp, Homo sapiens
gccgactacgttccg

SEQ ID NO: 33247 - DNA, 15 bp, Homo sapiens
tgccgactacgttcc

SEQ ID NO: 33248 - DNA, 15 bp, Homo sapiens
gtgccgactacgttc

SEQ ID NO: 33249 - DNA, 15 bp, Homo sapiens
tgtgccgactacgtt

SEQ ID NO: 33250 - DNA, 15 bp, Homo sapiens
ctgtgccgactacgt

SEQ ID NO: 33251 - DNA, 15 bp, Homo sapiens
gctgtgccgactacg

SEQ ID NO: 33252 - DNA, 15 bp, Homo sapiens
ggctgtgccgactac

SEQ ID NO: 33253 - DNA, 15 bp, Homo sapiens
aggctgtgccgacta

SEQ ID NO: 33254 - DNA, 15 bp, Homo sapiens
caggctgtgccgact

SEQ ID NO: 33255 - DNA, 15 bp, Homo sapiens
ccaggctgtgccgac

SEQ ID NO: 33256 - DNA, 15 bp, Homo sapiens
accaggctgtgccga

SEQ ID NO: 33257 - DNA, 15 bp, Homo sapiens
gaccaggctgtgccg

SEQ ID NO: 33258 - DNA, 15 bp, Homo sapiens
cgaccaggctgtgcc

SEQ ID NO: 33259 - DNA, 15 bp, Homo sapiens
gcgaccaggctgtgc

SEQ ID NO: 33260 - DNA, 15 bp, Homo sapiens
ggcgaccaggctgtg

SEQ ID NO: 33261 - DNA, 15 bp, Homo sapiens
aggcgaccaggctgt

SEQ ID NO: 33262 - DNA, 15 bp, Homo sapiens
aaggcgaccaggctg

SEQ ID NO: 33263 - DNA, 15 bp, Homo sapiens
gaaggcgaccaggct

SEQ ID NO: 33264 - DNA, 15 bp, Homo sapiens
ggaaggcgaccaggc

SEQ ID NO: 33265 - DNA, 15 bp, Homo sapiens
tggaaggcgaccagg

SEQ ID NO: 33266 - DNA, 15 bp, Homo sapiens
gtggaaggcgaccag

SEQ ID NO: 33267 - DNA, 15 bp, Homo sapiens
ggtggaaggcgacca

SEQ ID NO: 33268 - DNA, 15 bp, Homo sapiens
aggtggaaggcgacc

SEQ ID NO: 33269 - DNA, 15 bp, Homo sapiens
gaggtggaaggcgac

SEQ ID NO: 33270 - DNA, 15 bp, Homo sapiens
agaggtggaaggcga

SEQ ID NO: 33271 - DNA, 15 bp, Homo sapiens
cagaggtggaaggcg

SEQ ID NO: 33272 - DNA, 15 bp, Homo sapiens
ccagaggtggaaggc

SEQ ID NO: 33273 - DNA, 15 bp, Homo sapiens
cccagaggtggaagg

SEQ ID NO: 33274 - DNA, 15 bp, Homo sapiens
tcccagaggtggaag

SEQ ID NO: 33275 - DNA, 15 bp, Homo sapiens
ctcccagaggtggaa

SEQ ID NO: 33276 - DNA, 15 bp, Homo sapiens
gctcccagaggtgga

SEQ ID NO: 33277 - DNA, 15 bp, Homo sapiens
agctcccagaggtgg

SEQ ID NO: 33278 - DNA, 15 bp, Homo sapiens
cagctcccagaggtg

SEQ ID NO: 33279 - DNA, 15 bp, Homo sapiens
ccagctcccagaggt

SEQ ID NO: 33280 - DNA, 15 bp, Homo sapiens
tccagctcccagagg

SEQ ID NO: 33281 - DNA, 15 bp, Homo sapiens
ctccagctcccagag

SEQ ID NO: 33282 - DNA, 15 bp, Homo sapiens
actccagctcccaga

SEQ ID NO: 33283 - DNA, 15 bp, Homo sapiens
gactccagctcccag

SEQ ID NO: 33284 - DNA, 15 bp, Homo sapiens
ggactccagctccca

SEQ ID NO: 33285 - DNA, 15 bp, Homo sapiens
tggactccagctccc

SEQ ID NO: 33286 - DNA, 15 bp, Homo sapiens
gtggactccagctcc

SEQ ID NO: 33287 - DNA, 15 bp, Homo sapiens
agtggactccagctc

SEQ ID NO: 33288 - DNA, 15 bp, Homo sapiens
cagtggactccagct

SEQ ID NO: 33289 - DNA, 15 bp, Homo sapiens
ccagtggactccagc

SEQ ID NO: 33290 - DNA, 15 bp, Homo sapiens
cccagtggactccag

SEQ ID NO: 33291 - DNA, 15 bp, Homo sapiens
ccccagtggactcca

SEQ ID NO: 33292 - DNA, 15 bp, Homo sapiens
accccagtggactcc

SEQ ID NO: 33293 - DNA, 15 bp, Homo sapiens
caccccagtggactc

SEQ ID NO: 33294 - DNA, 15 bp, Homo sapiens
ccaccccagtggact

SEQ ID NO: 33295 - DNA, 15 bp, Homo sapiens
gccaccccagtggac

SEQ ID NO: 33296 - DNA, 15 bp, Homo sapiens
ggccaccccagtgga

SEQ ID NO: 33297 - DNA, 15 bp, Homo sapiens
aggccaccccagtgg

SEQ ID NO: 33298 - DNA, 15 bp, Homo sapiens
caggccaccccagtg

SEQ ID NO: 33299 - DNA, 15 bp, Homo sapiens
tcaggccaccccagt

SEQ ID NO: 33300 - DNA, 15 bp, Homo sapiens
gtcaggccaccccag

SEQ ID NO: 33301 - DNA, 15 bp, Homo sapiens
agtcaggccacccca

SEQ ID NO: 33302 - DNA, 15 bp, Homo sapiens
gagtcaggccacccc

SEQ ID NO: 33303 - DNA, 15 bp, Homo sapiens
ggagtcaggccaccc

SEQ ID NO: 33304 - DNA, 15 bp, Homo sapiens
gggagtcaggccacc

SEQ ID NO: 33305 - DNA, 15 bp, Homo sapiens
ggggagtcaggccac

SEQ ID NO: 33306 - DNA, 15 bp, Homo sapiens
gggggagtcaggcca

SEQ ID NO: 33307 - DNA, 15 bp, Homo sapiens
tgggggagtcaggcc

SEQ ID NO: 33308 - DNA, 15 bp, Homo sapiens
ctgggggagtcaggc

SEQ ID NO: 33309 - DNA, 15 bp, Homo sapiens
actgggggagtcagg

SEQ ID NO: 33310 - DNA, 15 bp, Homo sapiens
gactgggggagtcag

SEQ ID NO: 33311 - DNA, 15 bp, Homo sapiens
ggactgggggagtca

SEQ ID NO: 33312 - DNA, 15 bp, Homo sapiens
gggactgggggagtc

SEQ ID NO: 33313 - DNA, 15 bp, Homo sapiens
ggggactgggggagt

SEQ ID NO: 33314 - DNA, 15 bp, Homo sapiens
aggggactgggggag

SEQ ID NO: 33315 - DNA, 15 bp, Homo sapiens
aaggggactggggga

SEQ ID NO: 33316 - DNA, 15 bp, Homo sapiens
gaaggggactggggg

SEQ ID NO: 33317 - DNA, 15 bp, Homo sapiens
ggaaggggactgggg

SEQ ID NO: 33318 - DNA, 15 bp, Homo sapiens
gggaaggggactggg

SEQ ID NO: 33319 - DNA, 15 bp, Homo sapiens
cgggaaggggactgg

SEQ ID NO: 33320 - DNA, 15 bp, Homo sapiens
acgggaaggggactg

SEQ ID NO: 33321 - DNA, 15 bp, Homo sapiens
cacgggaaggggact

SEQ ID NO: 33322 - DNA, 15 bp, Homo sapiens
tcacgggaaggggac

SEQ ID NO: 33323 - DNA, 15 bp, Homo sapiens
gtcacgggaagggga

SEQ ID NO: 33324 - DNA, 15 bp, Homo sapiens
ggtcacgggaagggg

SEQ ID NO: 33325 - DNA, 15 bp, Homo sapiens
aggtcacgggaaggg

SEQ ID NO: 33326 - DNA, 15 bp, Homo sapiens
caggtcacgggaagg

SEQ ID NO: 33327 - DNA, 15 bp, Homo sapiens
ccaggtcacgggaag

SEQ ID NO: 33328 - DNA, 15 bp, Homo sapiens
accaggtcacgggaa

SEQ ID NO: 33329 - DNA, 15 bp, Homo sapiens
gaccaggtcacggga

SEQ ID NO: 33330 - DNA, 15 bp, Homo sapiens
tgaccaggtcacggg

SEQ ID NO: 33331 - DNA, 15 bp, Homo sapiens
ctgaccaggtcacgg

SEQ ID NO: 33332 - DNA, 15 bp, Homo sapiens
cctgaccaggtcacg

SEQ ID NO: 33333 - DNA, 15 bp, Homo sapiens
ccctgaccaggtcac

SEQ ID NO: 33334 - DNA, 15 bp, Homo sapiens
accctgaccaggtca

SEQ ID NO: 33335 - DNA, 15 bp, Homo sapiens
caccctgaccaggtc

SEQ ID NO: 33336 - DNA, 15 bp, Homo sapiens
tcaccctgaccaggt

SEQ ID NO: 33337 - DNA, 15 bp, Homo sapiens
ctcaccctgaccagg

SEQ ID NO: 33338 - DNA, 15 bp, Homo sapiens
gctcaccctgaccag

SEQ ID NO: 33339 - DNA, 15 bp, Homo sapiens
ggctcaccctgacca

SEQ ID NO: 33340 - DNA, 15 bp, Homo sapiens
gggctcaccctgacc

SEQ ID NO: 33341 - DNA, 15 bp, Homo sapiens
tgggctcaccctgac

SEQ ID NO: 33342 - DNA, 15 bp, Homo sapiens
atgggctcaccctga

SEQ ID NO: 33343 - DNA, 15 bp, Homo sapiens
catgggctcaccctg

SEQ ID NO: 33344 - DNA, 15 bp, Homo sapiens
acatgggctcaccct

SEQ ID NO: 33345 - DNA, 15 bp, Homo sapiens
cacatgggctcaccc

SEQ ID NO: 33346 - DNA, 15 bp, Homo sapiens
ccacatgggctcacc

SEQ ID NO: 33347 - DNA, 15 bp, Homo sapiens
tccacatgggctcac

SEQ ID NO: 33348 - DNA, 15 bp, Homo sapiens
ctccacatgggctca

SEQ ID NO: 33349 - DNA, 15 bp, Homo sapiens
actccacatgggctc

SEQ ID NO: 33350 - DNA, 15 bp, Homo sapiens
gactccacatgggct

SEQ ID NO: 33351 - DNA, 15 bp, Homo sapiens
tgactccacatgggc

SEQ ID NO: 33352 - DNA, 15 bp, Homo sapiens
ctgactccacatggg

SEQ ID NO: 33353 - DNA, 15 bp, Homo sapiens
gctgactccacatgg

SEQ ID NO: 33354 - DNA, 15 bp, Homo sapiens
ggctgactccacatg

SEQ ID NO: 33355 - DNA, 15 bp, Homo sapiens
aggctgactccacat

SEQ ID NO: 33356 - DNA, 15 bp, Homo sapiens
gaggctgactccaca

SEQ ID NO: 33357 - DNA, 15 bp, Homo sapiens
cgaggctgactccac

SEQ ID NO: 33358 - DNA, 15 bp, Homo sapiens
gcgaggctgactcca

SEQ ID NO: 33359 - DNA, 15 bp, Homo sapiens
tgcgaggctgactcc

SEQ ID NO: 33360 - DNA, 15 bp, Homo sapiens
ctgcgaggctgactc

SEQ ID NO: 33361 - DNA, 15 bp, Homo sapiens
cctgcgaggctgact

SEQ ID NO: 33362 - DNA, 15 bp, Homo sapiens
gcctgcgaggctgac

SEQ ID NO: 33363 - DNA, 15 bp, Homo sapiens
ggcctgcgaggctga

SEQ ID NO: 33364 - DNA, 15 bp, Homo sapiens
aggcctgcgaggctg

SEQ ID NO: 33365 - DNA, 15 bp, Homo sapiens
gaggcctgcgaggct

SEQ ID NO: 33366 - DNA, 15 bp, Homo sapiens
ggaggcctgcgaggc

SEQ ID NO: 33367 - DNA, 15 bp, Homo sapiens
gggaggcctgcgagg

SEQ ID NO: 33368 - DNA, 15 bp, Homo sapiens
agggaggcctgcgag

SEQ ID NO: 33369 - DNA, 15 bp, Homo sapiens
cagggaggcctgcga

SEQ ID NO: 33370 - DNA, 15 bp, Homo sapiens
gcagggaggcctgcg

SEQ ID NO: 33371 - DNA, 15 bp, Homo sapiens
ggcagggaggcctgc

SEQ ID NO: 33372 - DNA, 15 bp, Homo sapiens
tggcagggaggcctg

SEQ ID NO: 33373 - DNA, 15 bp, Homo sapiens
ctggcagggaggcct

SEQ ID NO: 33374 - DNA, 15 bp, Homo sapiens
actggcagggaggcc

SEQ ID NO: 33375 - DNA, 15 bp, Homo sapiens
tactggcagggaggc

SEQ ID NO: 33376 - DNA, 15 bp, Homo sapiens
ctactggcagggagg

SEQ ID NO: 33377 - DNA, 15 bp, Homo sapiens
cctactggcagggag

SEQ ID NO: 33378 - DNA, 15 bp, Homo sapiens
ccctactggcaggga

SEQ ID NO: 33379 - DNA, 15 bp, Homo sapiens
accctactggcaggg

SEQ ID NO: 33380 - DNA, 15 bp, Homo sapiens
gaccctactggcagg

SEQ ID NO: 33381 - DNA, 15 bp, Homo sapiens
ggaccctactggcag

SEQ ID NO: 33382 - DNA, 15 bp, Homo sapiens
cggaccctactggca

SEQ ID NO: 33383 - DNA, 15 bp, Homo sapiens
tcggaccctactggc

SEQ ID NO: 33384 - DNA, 15 bp, Homo sapiens
ctcggaccctactgg

SEQ ID NO: 33385 - DNA, 15 bp, Homo sapiens
actcggaccctactg

SEQ ID NO: 33386 - DNA, 15 bp, Homo sapiens
cactcggaccctact

SEQ ID NO: 33387 - DNA, 15 bp, Homo sapiens
acactcggaccctac

SEQ ID NO: 33388 - DNA, 15 bp, Homo sapiens
cacactcggacccta

SEQ ID NO: 33389 - DNA, 15 bp, Homo sapiens
acacactcggaccct

SEQ ID NO: 33390 - DNA, 15 bp, Homo sapiens
aacacactcggaccc

SEQ ID NO: 33391 - DNA, 15 bp, Homo sapiens
aaacacactcggacc

SEQ ID NO: 33392 - DNA, 15 bp, Homo sapiens
gaaacacactcggac

SEQ ID NO: 33393 - DNA, 15 bp, Homo sapiens
tgaaacacactcgga

SEQ ID NO: 33394 - DNA, 15 bp, Homo sapiens
atgaaacacactcgg

SEQ ID NO: 33395 - DNA, 15 bp, Homo sapiens
gatgaaacacactcg

SEQ ID NO: 33396 - DNA, 15 bp, Homo sapiens
ggatgaaacacactc

SEQ ID NO: 33397 - DNA, 15 bp, Homo sapiens
aggatgaaacacact

SEQ ID NO: 33398 - DNA, 15 bp, Homo sapiens
aaggatgaaacacac

SEQ ID NO: 33399 - DNA, 15 bp, Homo sapiens
gaaggatgaaacaca

SEQ ID NO: 33400 - DNA, 15 bp, Homo sapiens
ggaaggatgaaacac

SEQ ID NO: 33401 - DNA, 15 bp, Homo sapiens
gggaaggatgaaaca

SEQ ID NO: 33402 - DNA, 15 bp, Homo sapiens
tgggaaggatgaaac

SEQ ID NO: 33403 - DNA, 15 bp, Homo sapiens
gtgggaaggatgaaa

SEQ ID NO: 33404 - DNA, 15 bp, Homo sapiens
agtgggaaggatgaa

SEQ ID NO: 33405 - DNA, 15 bp, Homo sapiens
gagtgggaaggatga

SEQ ID NO: 33406 - DNA, 15 bp, Homo sapiens
agagtgggaaggatg

SEQ ID NO: 33407 - DNA, 15 bp, Homo sapiens
cagagtgggaaggat

SEQ ID NO: 33408 - DNA, 15 bp, Homo sapiens
acagagtgggaagga

SEQ ID NO: 33409 - DNA, 15 bp, Homo sapiens
gacagagtgggaagg

SEQ ID NO: 33410 - DNA, 15 bp, Homo sapiens
cgacagagtgggaag

SEQ ID NO: 33411 - DNA, 15 bp, Homo sapiens
tcgacagagtgggaa

SEQ ID NO: 33412 - DNA, 15 bp, Homo sapiens
ctcgacagagtggga

SEQ ID NO: 33413 - DNA, 15 bp, Homo sapiens
gctcgacagagtggg

SEQ ID NO: 33414 - DNA, 15 bp, Homo sapiens
ggctcgacagagtgg

SEQ ID NO: 33415 - DNA, 15 bp, Homo sapiens
aggctcgacagagtg

SEQ ID NO: 33416 - DNA, 15 bp, Homo sapiens
caggctcgacagagt

SEQ ID NO: 33417 - DNA, 15 bp, Homo sapiens
ccaggctcgacagag

SEQ ID NO: 33418 - DNA, 15 bp, Homo sapiens
cccaggctcgacaga

SEQ ID NO: 33419 - DNA, 15 bp, Homo sapiens
ccccaggctcgacag

SEQ ID NO: 33420 - DNA, 15 bp, Homo sapiens
cccccaggctcgaca

SEQ ID NO: 33421 - DNA, 15 bp, Homo sapiens
gcccccaggctcgac

SEQ ID NO: 33422 - DNA, 15 bp, Homo sapiens
agcccccaggctcga

SEQ ID NO: 33423 - DNA, 15 bp, Homo sapiens
cagcccccaggctcg

SEQ ID NO: 33424 - DNA, 15 bp, Homo sapiens
ccagcccccaggctc

SEQ ID NO: 33425 - DNA, 15 bp, Homo sapiens
tccagcccccaggct

SEQ ID NO: 33426 - DNA, 15 bp, Homo sapiens
ctccagcccccaggc

SEQ ID NO: 33427 - DNA, 15 bp, Homo sapiens
gctccagcccccagg

SEQ ID NO: 33428 - DNA, 15 bp, Homo sapiens
cgctccagcccccag

SEQ ID NO: 33429 - DNA, 15 bp, Homo sapiens
ccgctccagccccca

SEQ ID NO: 33430 - DNA, 15 bp, Homo sapiens
tccgctccagccccc

SEQ ID NO: 33431 - DNA, 15 bp, Homo sapiens
ctccgctccagcccc

SEQ ID NO: 33432 - DNA, 15 bp, Homo sapiens
tctccgctccagccc

SEQ ID NO: 33433 - DNA, 15 bp, Homo sapiens
gtctccgctccagcc

SEQ ID NO: 33434 - DNA, 15 bp, Homo sapiens
cgtctccgctccagc

SEQ ID NO: 33435 - DNA, 15 bp, Homo sapiens
ccgtctccgctccag

SEQ ID NO: 33436 - DNA, 15 bp, Homo sapiens
cccgtctccgctcca

SEQ ID NO: 33437 - DNA, 15 bp, Homo sapiens
tcccgtctccgctcc

SEQ ID NO: 33438 - DNA, 15 bp, Homo sapiens
ctcccgtctccgctc

SEQ ID NO: 33439 - DNA, 15 bp, Homo sapiens
cctcccgtctccgct

SEQ ID NO: 33440 - DNA, 15 bp, Homo sapiens
gcctcccgtctccgc

SEQ ID NO: 33441 - DNA, 15 bp, Homo sapiens
ggcctcccgtctccg

SEQ ID NO: 33442 - DNA, 15 bp, Homo sapiens
aggcctcccgtctcc

SEQ ID NO: 33443 - DNA, 15 bp, Homo sapiens
caggcctcccgtctc

SEQ ID NO: 33444 - DNA, 15 bp, Homo sapiens
ccaggcctcccgtct

SEQ ID NO: 33445 - DNA, 15 bp, Homo sapiens
gccaggcctcccgtc

SEQ ID NO: 33446 - DNA, 15 bp, Homo sapiens
ggccaggcctcccgt

SEQ ID NO: 33447 - DNA, 15 bp, Homo sapiens
aggccaggcctcccg

SEQ ID NO: 33448 - DNA, 15 bp, Homo sapiens
caggccaggcctccc

SEQ ID NO: 33449 - DNA, 15 bp, Homo sapiens
acaggccaggcctcc

SEQ ID NO: 33450 - DNA, 15 bp, Homo sapiens
gacaggccaggcctc

SEQ ID NO: 33451 - DNA, 15 bp, Homo sapiens
agacaggccaggcct

SEQ ID NO: 33452 - DNA, 15 bp, Homo sapiens
gagacaggccaggcc

SEQ ID NO: 33453 - DNA, 15 bp, Homo sapiens
cgagacaggccaggc

SEQ ID NO: 33454 - DNA, 15 bp, Homo sapiens
ccgagacaggccagg

SEQ ID NO: 33455 - DNA, 15 bp, Homo sapiens
tccgagacaggccag

SEQ ID NO: 33456 - DNA, 15 bp, Homo sapiens
ttccgagacaggcca

SEQ ID NO: 33457 - DNA, 15 bp, Homo sapiens
gttccgagacaggcc

SEQ ID NO: 33458 - DNA, 15 bp, Homo sapiens
ggttccgagacaggc

SEQ ID NO: 33459 - DNA, 15 bp, Homo sapiens
aggttccgagacagg

SEQ ID NO: 33460 - DNA, 15 bp, Homo sapiens
caggttccgagacag

SEQ ID NO: 33461 - DNA, 15 bp, Homo sapiens
acaggttccgagaca

SEQ ID NO: 33462 - DNA, 15 bp, Homo sapiens
cacaggttccgagac

SEQ ID NO: 33463 - DNA, 15 bp, Homo sapiens
tcacaggttccgaga

SEQ ID NO: 33464 - DNA, 15 bp, Homo sapiens
ctcacaggttccgag

SEQ ID NO: 33465 - DNA, 15 bp, Homo sapiens
gctcacaggttccga

SEQ ID NO: 33466 - DNA, 15 bp, Homo sapiens
agctcacaggttccg

SEQ ID NO: 33467 - DNA, 15 bp, Homo sapiens
cagctcacaggttcc

SEQ ID NO: 33468 - DNA, 15 bp, Homo sapiens
gcagctcacaggttc

SEQ ID NO: 33469 - DNA, 15 bp, Homo sapiens
tgcagctcacaggtt

SEQ ID NO: 33470 - DNA, 15 bp, Homo sapiens
gtgcagctcacaggt

SEQ ID NO: 33471 - DNA, 15 bp, Homo sapiens
ggtgcagctcacagg

SEQ ID NO: 33472 - DNA, 15 bp, Homo sapiens
tggtgcagctcacag

SEQ ID NO: 33473 - DNA, 15 bp, Homo sapiens
ctggtgcagctcaca

SEQ ID NO: 33474 - DNA, 15 bp, Homo sapiens
cctggtgcagctcac

SEQ ID NO: 33475 - DNA, 15 bp, Homo sapiens
acctggtgcagctca

SEQ ID NO: 33476 - DNA, 15 bp, Homo sapiens
tacctggtgcagctc

SEQ ID NO: 33477 - DNA, 15 bp, Homo sapiens
ctacctggtgcagct

SEQ ID NO: 33478 - DNA, 15 bp, Homo sapiens
tctacctggtgcagc

SEQ ID NO: 33479 - DNA, 15 bp, Homo sapiens
ttctacctggtgcag

SEQ ID NO: 33480 - DNA, 15 bp, Homo sapiens
gttctacctggtgca

SEQ ID NO: 33481 - DNA, 15 bp, Homo sapiens
cgttctacctggtgc

SEQ ID NO: 33482 - DNA, 15 bp, Homo sapiens
gcgttctacctggtg

SEQ ID NO: 33483 - DNA, 15 bp, Homo sapiens
ggcgttctacctggt

SEQ ID NO: 33484 - DNA, 15 bp, Homo sapiens
tggcgttctacctgg

SEQ ID NO: 33485 - DNA, 15 bp, Homo sapiens
ctggcgttctacctg

SEQ ID NO: 33486 - DNA, 15 bp, Homo sapiens
cctggcgttctacct

SEQ ID NO: 33487 - DNA, 15 bp, Homo sapiens
ccctggcgttctacc

SEQ ID NO: 33488 - DNA, 15 bp, Homo sapiens
tccctggcgttctac

SEQ ID NO: 33489 - DNA, 15 bp, Homo sapiens
gtccctggcgttcta

SEQ ID NO: 33490 - DNA, 15 bp, Homo sapiens
ggtccctggcgttct

SEQ ID NO: 33491 - DNA, 15 bp, Homo sapiens
gggtccctggcgttc

SEQ ID NO: 33492 - DNA, 15 bp, Homo sapiens
ggggtccctggcgtt

SEQ ID NO: 33493 - DNA, 15 bp, Homo sapiens
tggggtccctggcgt

SEQ ID NO: 33494 - DNA, 15 bp, Homo sapiens
ctggggtccctggcg

SEQ ID NO: 33495 - DNA, 15 bp, Homo sapiens
tctggggtccctggc

SEQ ID NO: 33496 - DNA, 15 bp, Homo sapiens
ttctggggtccctgg

SEQ ID NO: 33497 - DNA, 15 bp, Homo sapiens
attctggggtccctg

SEQ ID NO: 33498 - DNA, 15 bp, Homo sapiens
gattctggggtccct

SEQ ID NO: 33499 - DNA, 15 bp, Homo sapiens
tgattctggggtccc

SEQ ID NO: 33500 - DNA, 15 bp, Homo sapiens
atgattctggggtcc

SEQ ID NO: 33501 - DNA, 15 bp, Homo sapiens
catgattctggggtc

SEQ ID NO: 33502 - DNA, 15 bp, Homo sapiens
acatgattctggggt

SEQ ID NO: 33503 - DNA, 15 bp, Homo sapiens
cacatgattctgggg

SEQ ID NO: 33504 - DNA, 15 bp, Homo sapiens
gcacatgattctggg

SEQ ID NO: 33505 - DNA, 15 bp, Homo sapiens
cgcacatgattctgg

SEQ ID NO: 33506 - DNA, 15 bp, Homo sapiens
acgcacatgattctg

SEQ ID NO: 33507 - DNA, 15 bp, Homo sapiens
gacgcacatgattct

SEQ ID NO: 33508 - DNA, 15 bp, Homo sapiens
tgacgcacatgattc

SEQ ID NO: 33509 - DNA, 15 bp, Homo sapiens
ctgacgcacatgatt

SEQ ID NO: 33510 - DNA, 15 bp, Homo sapiens
actgacgcacatgat

SEQ ID NO: 33511 - DNA, 15 bp, Homo sapiens
gactgacgcacatga

SEQ ID NO: 33512 - DNA, 15 bp, Homo sapiens
ggactgacgcacatg

SEQ ID NO: 33513 - DNA, 15 bp, Homo sapiens
tggactgacgcacat

SEQ ID NO: 33514 - DNA, 15 bp, Homo sapiens
ttggactgacgcaca

SEQ ID NO: 33515 - DNA, 15 bp, Homo sapiens
cttggactgacgcac

SEQ ID NO: 33516 - DNA, 15 bp, Homo sapiens
ccttggactgacgca

SEQ ID NO: 33517 - DNA, 15 bp, Homo sapiens
cccttggactgacgc

SEQ ID NO: 33518 - DNA, 15 bp, Homo sapiens
ccccttggactgacg

SEQ ID NO: 33519 - DNA, 15 bp, Homo sapiens
accccttggactgac

SEQ ID NO: 33520 - DNA, 15 bp, Homo sapiens
gaccccttggactga

SEQ ID NO: 33521 - DNA, 15 bp, Homo sapiens
ggaccccttggactg

SEQ ID NO: 33522 - DNA, 15 bp, Homo sapiens
gggaccccttggact

SEQ ID NO: 33523 - DNA, 15 bp, Homo sapiens
ggggaccccttggac

SEQ ID NO: 33524 - DNA, 15 bp, Homo sapiens
aggggaccccttgga

SEQ ID NO: 33525 - DNA, 15 bp, Homo sapiens
gaggggaccccttgg

SEQ ID NO: 33526 - DNA, 15 bp, Homo sapiens
ggaggggaccccttg

SEQ ID NO: 33527 - DNA, 15 bp, Homo sapiens
tggaggggacccctt

SEQ ID NO: 33528 - DNA, 15 bp, Homo sapiens
ctggaggggacccct

SEQ ID NO: 33529 - DNA, 15 bp, Homo sapiens
cctggaggggacccc

SEQ ID NO: 33530 - DNA, 15 bp, Homo sapiens
tcctggaggggaccc

SEQ ID NO: 33531 - DNA, 15 bp, Homo sapiens
ctcctggaggggacc

SEQ ID NO: 33532 - DNA, 15 bp, Homo sapiens
actcctggaggggac

SEQ ID NO: 33533 - DNA, 15 bp, Homo sapiens
tactcctggagggga

SEQ ID NO: 33534 - DNA, 15 bp, Homo sapiens
ctactcctggagggg

SEQ ID NO: 33535 - DNA, 15 bp, Homo sapiens
actactcctggaggg

SEQ ID NO: 33536 - DNA, 15 bp, Homo sapiens
cactactcctggagg

SEQ ID NO: 33537 - DNA, 15 bp, Homo sapiens
tcactactcctggag

SEQ ID NO: 33538 - DNA, 15 bp, Homo sapiens
ttcactactcctgga

SEQ ID NO: 33539 - DNA, 15 bp, Homo sapiens
cttcactactcctgg

SEQ ID NO: 33540 - DNA, 15 bp, Homo sapiens
tcttcactactcctg

SEQ ID NO: 33541 - DNA, 15 bp, Homo sapiens
gtcttcactactcct

SEQ ID NO: 33542 - DNA, 15 bp, Homo sapiens
agtcttcactactcc

SEQ ID NO: 33543 - DNA, 15 bp, Homo sapiens
gagtcttcactactc

SEQ ID NO: 33544 - DNA, 15 bp, Homo sapiens
ggagtcttcactact

SEQ ID NO: 33545 - DNA, 15 bp, Homo sapiens
tggagtcttcactac

SEQ ID NO: 33546 - DNA, 15 bp, Homo sapiens
ctggagtcttcacta

SEQ ID NO: 33547 - DNA, 15 bp, Homo sapiens
tctggagtcttcact

SEQ ID NO: 33548 - DNA, 15 bp, Homo sapiens
ttctggagtcttcac

SEQ ID NO: 33549 - DNA, 15 bp, Homo sapiens
tttctggagtcttca

SEQ ID NO: 33550 - DNA, 15 bp, Homo sapiens
atttctggagtcttc

SEQ ID NO: 33551 - DNA, 15 bp, Homo sapiens
catttctggagtctt

SEQ ID NO: 33552 - DNA, 15 bp, Homo sapiens
acatttctggagtct

SEQ ID NO: 33553 - DNA, 15 bp, Homo sapiens
gacatttctggagtc

SEQ ID NO: 33554 - DNA, 15 bp, Homo sapiens
ggacatttctggagt

SEQ ID NO: 33555 - DNA, 15 bp, Homo sapiens
gggacatttctggag

SEQ ID NO: 33556 - DNA, 15 bp, Homo sapiens
agggacatttctgga

SEQ ID NO: 33557 - DNA, 15 bp, Homo sapiens
aagggacatttctgg

SEQ ID NO: 33558 - DNA, 15 bp, Homo sapiens
aaagggacatttctg

SEQ ID NO: 33559 - DNA, 15 bp, Homo sapiens
gaaagggacatttct

SEQ ID NO: 33560 - DNA, 15 bp, Homo sapiens
agaaagggacatttc

SEQ ID NO: 33561 - DNA, 15 bp, Homo sapiens
aagaaagggacattt

SEQ ID NO: 33562 - DNA, 15 bp, Homo sapiens
gaagaaagggacatt

SEQ ID NO: 33563 - DNA, 15 bp, Homo sapiens
agaagaaagggacat

SEQ ID NO: 33564 - DNA, 15 bp, Homo sapiens
gagaagaaagggaca

SEQ ID NO: 33565 - DNA, 15 bp, Homo sapiens
ggagaagaaagggac

SEQ ID NO: 33566 - DNA, 15 bp, Homo sapiens
gggagaagaaaggga

SEQ ID NO: 33567 - DNA, 15 bp, Homo sapiens
ggggagaagaaaggg

SEQ ID NO: 33568 - DNA, 15 bp, Homo sapiens
gggggagaagaaagg

SEQ ID NO: 33569 - DNA, 15 bp, Homo sapiens
tgggggagaagaaag

SEQ ID NO: 33570 - DNA, 15 bp, Homo sapiens
atgggggagaagaaa

SEQ ID NO: 33571 - DNA, 15 bp, Homo sapiens
gatgggggagaagaa

SEQ ID NO: 33572 - DNA, 15 bp, Homo sapiens
ggatgggggagaaga

SEQ ID NO: 33573 - DNA, 15 bp, Homo sapiens
aggatgggggagaag

SEQ ID NO: 33574 - DNA, 15 bp, Homo sapiens
taggatgggggagaa

SEQ ID NO: 33575 - DNA, 15 bp, Homo sapiens
gtaggatgggggaga

SEQ ID NO: 33576 - DNA, 15 bp, Homo sapiens
cgtaggatgggggag

SEQ ID NO: 33577 - DNA, 15 bp, Homo sapiens
tcgtaggatggggga

SEQ ID NO: 33578 - DNA, 15 bp, Homo sapiens
ctcgtaggatggggg

SEQ ID NO: 33579 - DNA, 15 bp, Homo sapiens
actcgtaggatgggg

SEQ ID NO: 33580 - DNA, 15 bp, Homo sapiens
tactcgtaggatggg

SEQ ID NO: 33581 - DNA, 15 bp, Homo sapiens
ttactcgtaggatgg

SEQ ID NO: 33582 - DNA, 15 bp, Homo sapiens
attactcgtaggatg

SEQ ID NO: 33583 - DNA, 15 bp, Homo sapiens
aattactcgtaggat

SEQ ID NO: 33584 - DNA, 15 bp, Homo sapiens
caattactcgtagga

SEQ ID NO: 33585 - DNA, 15 bp, Homo sapiens
gcaattactcgtagg

SEQ ID NO: 33586 - DNA, 15 bp, Homo sapiens
tgcaattactcgtag

SEQ ID NO: 33587 - DNA, 15 bp, Homo sapiens
atgcaattactcgta

SEQ ID NO: 33588 - DNA, 15 bp, Homo sapiens
aatgcaattactcgt

SEQ ID NO: 33589 - DNA, 15 bp, Homo sapiens
aaatgcaattactcg

SEQ ID NO: 33590 - DNA, 15 bp, Homo sapiens
caaatgcaattactc

SEQ ID NO: 33591 - DNA, 15 bp, Homo sapiens
gcaaatgcaattact

SEQ ID NO: 33592 - DNA, 15 bp, Homo sapiens
agcaaatgcaattac

SEQ ID NO: 33593 - DNA, 15 bp, Homo sapiens
aagcaaatgcaatta

SEQ ID NO: 33594 - DNA, 15 bp, Homo sapiens
aaagcaaatgcaatt

SEQ ID NO: 33595 - DNA, 15 bp, Homo sapiens
aaaagcaaatgcaat

SEQ ID NO: 33596 - DNA, 15 bp, Homo sapiens
caaaagcaaatgcaa

SEQ ID NO: 33597 - DNA, 15 bp, Homo sapiens
acaaaagcaaatgca

SEQ ID NO: 33598 - DNA, 15 bp, Homo sapiens
tacaaaagcaaatgc

SEQ ID NO: 33599 - DNA, 15 bp, Homo sapiens
ttacaaaagcaaatg

SEQ ID NO: 33600 - DNA, 15 bp, Homo sapiens
attacaaaagcaaat

SEQ ID NO: 33601 - DNA, 15 bp, Homo sapiens
aattacaaaagcaaa

SEQ ID NO: 33602 - DNA, 15 bp, Homo sapiens
gaattacaaaagcaa

SEQ ID NO: 33603 - DNA, 15 bp, Homo sapiens
agaattacaaaagca

SEQ ID NO: 33604 - DNA, 15 bp, Homo sapiens
aagaattacaaaagc

SEQ ID NO: 33605 - DNA, 15 bp, Homo sapiens
taagaattacaaaag

SEQ ID NO: 33606 - DNA, 15 bp, Homo sapiens
ttaagaattacaaaa

SEQ ID NO: 33607 - DNA, 15 bp, Homo sapiens
attaagaattacaaa

SEQ ID NO: 33608 - DNA, 15 bp, Homo sapiens
cattaagaattacaa

SEQ ID NO: 33609 - DNA, 15 bp, Homo sapiens
tcattaagaattaca

SEQ ID NO: 33610 - DNA, 15 bp, Homo sapiens
ctcattaagaattac

SEQ ID NO: 33611 - DNA, 15 bp, Homo sapiens
gctcattaagaatta

SEQ ID NO: 33612 - DNA, 15 bp, Homo sapiens
tgctcattaagaatt

SEQ ID NO: 33613 - DNA, 15 bp, Homo sapiens
ttgctcattaagaat

SEQ ID NO: 33614 - DNA, 15 bp, Homo sapiens
attgctcattaagaa

SEQ ID NO: 33615 - DNA, 15 bp, Homo sapiens
tattgctcattaaga

SEQ ID NO: 33616 - DNA, 15 bp, Homo sapiens
atattgctcattaag

SEQ ID NO: 33617 - DNA, 15 bp, Homo sapiens
gatattgctcattaa

SEQ ID NO: 33618 - DNA, 15 bp, Homo sapiens
agatattgctcatta

SEQ ID NO: 33619 - DNA, 15 bp, Homo sapiens
cagatattgctcatt

SEQ ID NO: 33620 - DNA, 15 bp, Homo sapiens
gcagatattgctcat

SEQ ID NO: 33621 - DNA, 15 bp, Homo sapiens
agcagatattgctca

SEQ ID NO: 33622 - DNA, 15 bp, Homo sapiens
tagcagatattgctc

SEQ ID NO: 33623 - DNA, 15 bp, Homo sapiens
ctagcagatattgct

SEQ ID NO: 33624 - DNA, 15 bp, Homo sapiens
tctagcagatattgc

SEQ ID NO: 33625 - DNA, 15 bp, Homo sapiens
ctctagcagatattg

SEQ ID NO: 33626 - DNA, 15 bp, Homo sapiens
tctctagcagatatt

SEQ ID NO: 33627 - DNA, 15 bp, Homo sapiens
ctctctagcagatat

SEQ ID NO: 33628 - DNA, 15 bp, Homo sapiens
actctctagcagata

SEQ ID NO: 33629 - DNA, 15 bp, Homo sapiens
aactctctagcagat

SEQ ID NO: 33630 - DNA, 15 bp, Homo sapiens
aaactctctagcaga

SEQ ID NO: 33631 - DNA, 15 bp, Homo sapiens
taaactctctagcag

SEQ ID NO: 33632 - DNA, 15 bp, Homo sapiens
ctaaactctctagca

SEQ ID NO: 33633 - DNA, 15 bp, Homo sapiens
gctaaactctctagc

SEQ ID NO: 33634 - DNA, 15 bp, Homo sapiens
agctaaactctctag

SEQ ID NO: 33635 - DNA, 15 bp, Homo sapiens
cagctaaactctcta

SEQ ID NO: 33636 - DNA, 15 bp, Homo sapiens
acagctaaactctct

SEQ ID NO: 33637 - DNA, 15 bp, Homo sapiens
tacagctaaactctc

SEQ ID NO: 33638 - DNA, 15 bp, Homo sapiens
ttacagctaaactct

SEQ ID NO: 33639 - DNA, 15 bp, Homo sapiens
gttacagctaaactc

SEQ ID NO: 33640 - DNA, 15 bp, Homo sapiens
tgttacagctaaact

SEQ ID NO: 33641 - DNA, 15 bp, Homo sapiens
ctgttacagctaaac

SEQ ID NO: 33642 - DNA, 15 bp, Homo sapiens
actgttacagctaaa

SEQ ID NO: 33643 - DNA, 15 bp, Homo sapiens
aactgttacagctaa

SEQ ID NO: 33644 - DNA, 15 bp, Homo sapiens
gaactgttacagcta

SEQ ID NO: 33645 - DNA, 15 bp, Homo sapiens
agaactgttacagct

SEQ ID NO: 33646 - DNA, 15 bp, Homo sapiens
aagaactgttacagc

SEQ ID NO: 33647 - DNA, 15 bp, Homo sapiens
aaagaactgttacag

SEQ ID NO: 33648 - DNA, 15 bp, Homo sapiens
aaaagaactgttaca

SEQ ID NO: 33649 - DNA, 15 bp, Homo sapiens
aaaaagaactgttac

SEQ ID NO: 33650 - DNA, 15 bp, Homo sapiens
caaaaagaactgtta

SEQ ID NO: 33651 - DNA, 15 bp, Homo sapiens
tcaaaaagaactgtt

SEQ ID NO: 33652 - DNA, 15 bp, Homo sapiens
atcaaaaagaactgt

SEQ ID NO: 33653 - DNA, 15 bp, Homo sapiens
gatcaaaaagaactg

SEQ ID NO: 33654 - DNA, 15 bp, Homo sapiens
tgatcaaaaagaact

SEQ ID NO: 33655 - DNA, 15 bp, Homo sapiens
atgatcaaaaagaac

SEQ ID NO: 33656 - DNA, 15 bp, Homo sapiens
gatgatcaaaaagaa

SEQ ID NO: 33657 - DNA, 15 bp, Homo sapiens
agatgatcaaaaaga

SEQ ID NO: 33658 - DNA, 15 bp, Homo sapiens
aagatgatcaaaaag

SEQ ID NO: 33659 - DNA, 15 bp, Homo sapiens
aaagatgatcaaaaa

SEQ ID NO: 33660 - DNA, 15 bp, Homo sapiens
aaaagatgatcaaaa

SEQ ID NO: 33661 - DNA, 15 bp, Homo sapiens
aaaaagatgatcaaa

SEQ ID NO: 33662 - DNA, 15 bp, Homo sapiens
aaaaaagatgatcaa

SEQ ID NO: 33663 - DNA, 15 bp, Homo sapiens
aaaaaaagatgatca

SEQ ID NO: 33664 - DNA, 15 bp, Homo sapiens
taaaaaaagatgatc

SEQ ID NO: 33665 - DNA, 15 bp, Homo sapiens
ttaaaaaaagatgat

SEQ ID NO: 33666 - DNA, 15 bp, Homo sapiens
attaaaaaaagatga

SEQ ID NO: 33667 - DNA, 15 bp, Homo sapiens
tattaaaaaaagatg

SEQ ID NO: 33668 - DNA, 15 bp, Homo sapiens
ttattaaaaaaagat

SEQ ID NO: 33669 - DNA, 15 bp, Homo sapiens
attattaaaaaaaga

SEQ ID NO: 33670 - DNA, 15 bp, Homo sapiens
aattattaaaaaaag

SEQ ID NO: 33671 - DNA, 15 bp, Homo sapiens
taattattaaaaaaa

SEQ ID NO: 33672 - DNA, 15 bp, Homo sapiens
ctaattattaaaaaa

SEQ ID NO: 33673 - DNA, 15 bp, Homo sapiens
tctaattattaaaaa

SEQ ID NO: 33674 - DNA, 15 bp, Homo sapiens
ttctaattattaaaa

SEQ ID NO: 33675 - DNA, 15 bp, Homo sapiens
tttctaattattaaa

SEQ ID NO: 33676 - DNA, 15 bp, Homo sapiens
gtttctaattattaa

SEQ ID NO: 33677 - DNA, 15 bp, Homo sapiens
tgtttctaattatta

SEQ ID NO: 33678 - DNA, 15 bp, Homo sapiens
gtgtttctaattatt

SEQ ID NO: 33679 - DNA, 15 bp, Homo sapiens
ggtgtttctaattat

SEQ ID NO: 33680 - DNA, 15 bp, Homo sapiens
tggtgtttctaatta

SEQ ID NO: 33681 - DNA, 15 bp, Homo sapiens
ttggtgtttctaatt

SEQ ID NO: 33682 - DNA, 15 bp, Homo sapiens
tttggtgtttctaat

SEQ ID NO: 33683 - DNA, 15 bp, Homo sapiens
ttttggtgtttctaa

SEQ ID NO: 33684 - DNA, 15 bp, Homo sapiens
tttttggtgtttcta

SEQ ID NO: 33685 - DNA, 15 bp, Homo sapiens
ttttttggtgtttct

SEQ ID NO: 33686 - DNA, 15 bp, Homo sapiens
tttttttggtgtttc

SEQ ID NO: 33687 - DNA, 15 bp, Homo sapiens
atttttttggtgttt

SEQ ID NO: 33688 - DNA, 15 bp, Homo sapiens
gatttttttggtgtt

SEQ ID NO: 33689 - DNA, 15 bp, Homo sapiens
ggatttttttggtgt

SEQ ID NO: 33690 - DNA, 15 bp, Homo sapiens
tggatttttttggtg

SEQ ID NO: 33691 - DNA, 15 bp, Homo sapiens
ctggatttttttggt

SEQ ID NO: 33692 - DNA, 15 bp, Homo sapiens
tctggatttttttgg

SEQ ID NO: 33693 - DNA, 15 bp, Homo sapiens
ttctggatttttttg

SEQ ID NO: 33694 - DNA, 15 bp, Homo sapiens
tttctggattttttt

SEQ ID NO: 33695 - DNA, 15 bp, Homo sapiens
gtttctggatttttt

SEQ ID NO: 33696 - DNA, 15 bp, Homo sapiens
agtttctggattttt

SEQ ID NO: 33697 - DNA, 15 bp, Homo sapiens
aagtttctggatttt

SEQ ID NO: 33698 - DNA, 15 bp, Homo sapiens
caagtttctggattt

SEQ ID NO: 33699 - DNA, 15 bp, Homo sapiens
acaagtttctggatt

SEQ ID NO: 33700 - DNA, 15 bp, Homo sapiens
aacaagtttctggat

SEQ ID NO: 33701 - DNA, 15 bp, Homo sapiens
gaacaagtttctgga

SEQ ID NO: 33702 - DNA, 15 bp, Homo sapiens
agaacaagtttctgg

SEQ ID NO: 33703 - DNA, 15 bp, Homo sapiens
aagaacaagtttctg

SEQ ID NO: 33704 - DNA, 15 bp, Homo sapiens
gaagaacaagtttct

SEQ ID NO: 33705 - DNA, 15 bp, Homo sapiens
ggaagaacaagtttc

SEQ ID NO: 33706 - DNA, 15 bp, Homo sapiens
tggaagaacaagttt

SEQ ID NO: 33707 - DNA, 15 bp, Homo sapiens
ttggaagaacaagtt

SEQ ID NO: 33708 - DNA, 15 bp, Homo sapiens
tttggaagaacaagt

SEQ ID NO: 33709 - DNA, 15 bp, Homo sapiens
ctttggaagaacaag

SEQ ID NO: 33710 - DNA, 15 bp, Homo sapiens
gctttggaagaacaa

SEQ ID NO: 33711 - DNA, 15 bp, Homo sapiens
tgctttggaagaaca

SEQ ID NO: 33712 - DNA, 15 bp, Homo sapiens
ctgctttggaagaac

SEQ ID NO: 33713 - DNA, 15 bp, Homo sapiens
tctgctttggaagaa

SEQ ID NO: 33714 - DNA, 15 bp, Homo sapiens
ctctgctttggaaga

SEQ ID NO: 33715 - DNA, 15 bp, Homo sapiens
tctctgctttggaag

SEQ ID NO: 33716 - DNA, 15 bp, Homo sapiens
ctctctgctttggaa

SEQ ID NO: 33717 - DNA, 15 bp, Homo sapiens
gctctctgctttgga

SEQ ID NO: 33718 - DNA, 15 bp, Homo sapiens
tgctctctgctttgg

SEQ ID NO: 33719 - DNA, 15 bp, Homo sapiens
atgctctctgctttg

SEQ ID NO: 33720 - DNA, 15 bp, Homo sapiens
aatgctctctgcttt

SEQ ID NO: 33721 - DNA, 15 bp, Homo sapiens
taatgctctctgctt

SEQ ID NO: 33722 - DNA, 15 bp, Homo sapiens
ataatgctctctgct

SEQ ID NO: 33723 - DNA, 15 bp, Homo sapiens
tataatgctctctgc

SEQ ID NO: 33724 - DNA, 15 bp, Homo sapiens
ttataatgctctctg

SEQ ID NO: 33725 - DNA, 15 bp, Homo sapiens
attataatgctctct

SEQ ID NO: 33726 - DNA, 15 bp, Homo sapiens
gattataatgctctc

SEQ ID NO: 33727 - DNA, 15 bp, Homo sapiens
tgattataatgctct

SEQ ID NO: 33728 - DNA, 15 bp, Homo sapiens
gtgattataatgctc

SEQ ID NO: 33729 - DNA, 15 bp, Homo sapiens
ggtgattataatgct

SEQ ID NO: 33730 - DNA, 15 bp, Homo sapiens
tggtgattataatgc

SEQ ID NO: 33731 - DNA, 15 bp, Homo sapiens
ctggtgattataatg

SEQ ID NO: 33732 - DNA, 15 bp, Homo sapiens
cctggtgattataat

SEQ ID NO: 33733 - DNA, 15 bp, Homo sapiens
ccctggtgattataa

SEQ ID NO: 33734 - DNA, 15 bp, Homo sapiens
gccctggtgattata

SEQ ID NO: 33735 - DNA, 15 bp, Homo sapiens
ggccctggtgattat

SEQ ID NO: 33736 - DNA, 15 bp, Homo sapiens
tggccctggtgatta

SEQ ID NO: 33737 - DNA, 15 bp, Homo sapiens
ttggccctggtgatt

SEQ ID NO: 33738 - DNA, 15 bp, Homo sapiens
tttggccctggtgat

SEQ ID NO: 33739 - DNA, 15 bp, Homo sapiens
ttttggccctggtga

SEQ ID NO: 33740 - DNA, 15 bp, Homo sapiens
cttttggccctggtg

SEQ ID NO: 33741 - DNA, 15 bp, Homo sapiens
gcttttggccctggt

SEQ ID NO: 33742 - DNA, 15 bp, Homo sapiens
agcttttggccctgg

SEQ ID NO: 33743 - DNA, 15 bp, Homo sapiens
aagcttttggccctg

SEQ ID NO: 33744 - DNA, 15 bp, Homo sapiens
gaagcttttggccct

SEQ ID NO: 33745 - DNA, 15 bp, Homo sapiens
ggaagcttttggccc

SEQ ID NO: 33746 - DNA, 15 bp, Homo sapiens
gggaagcttttggcc

SEQ ID NO: 33747 - DNA, 15 bp, Homo sapiens
agggaagcttttggc

SEQ ID NO: 33748 - DNA, 15 bp, Homo sapiens
gagggaagcttttgg

SEQ ID NO: 33749 - DNA, 15 bp, Homo sapiens
ggagggaagcttttg

SEQ ID NO: 33750 - DNA, 15 bp, Homo sapiens
gggagggaagctttt

SEQ ID NO: 33751 - DNA, 15 bp, Homo sapiens
agggagggaagcttt

SEQ ID NO: 33752 - DNA, 15 bp, Homo sapiens
cagggagggaagctt

SEQ ID NO: 33753 - DNA, 15 bp, Homo sapiens
gcagggagggaagct

SEQ ID NO: 33754 - DNA, 15 bp, Homo sapiens
agcagggagggaagc

SEQ ID NO: 33755 - DNA, 15 bp, Homo sapiens
cagcagggagggaag

SEQ ID NO: 33756 - DNA, 15 bp, Homo sapiens
acagcagggagggaa

SEQ ID NO: 33757 - DNA, 15 bp, Homo sapiens
gacagcagggaggga

SEQ ID NO: 33758 - DNA, 15 bp, Homo sapiens
tgacagcagggaggg

SEQ ID NO: 33759 - DNA, 15 bp, Homo sapiens
atgacagcagggagg

SEQ ID NO: 33760 - DNA, 15 bp, Homo sapiens
aatgacagcagggag

SEQ ID NO: 33761 - DNA, 15 bp, Homo sapiens
caatgacagcaggga

SEQ ID NO: 33762 - DNA, 15 bp, Homo sapiens
gcaatgacagcaggg

SEQ ID NO: 33763 - DNA, 15 bp, Homo sapiens
agcaatgacagcagg

SEQ ID NO: 33764 - DNA, 15 bp, Homo sapiens
aagcaatgacagcag

SEQ ID NO: 33765 - DNA, 15 bp, Homo sapiens
gaagcaatgacagca

SEQ ID NO: 33766 - DNA, 15 bp, Homo sapiens
agaagcaatgacagc

SEQ ID NO: 33767 - DNA, 15 bp, Homo sapiens
aagaagcaatgacag

SEQ ID NO: 33768 - DNA, 15 bp, Homo sapiens
gaagaagcaatgaca

SEQ ID NO: 33769 - DNA, 15 bp, Homo sapiens
agaagaagcaatgac

SEQ ID NO: 33770 - DNA, 15 bp, Homo sapiens
cagaagaagcaatga

SEQ ID NO: 33771 - DNA, 15 bp, Homo sapiens
tcagaagaagcaatg

SEQ ID NO: 33772 - DNA, 15 bp, Homo sapiens
ctcagaagaagcaat

SEQ ID NO: 33773 - DNA, 15 bp, Homo sapiens
cctcagaagaagcaa

SEQ ID NO: 33774 - DNA, 15 bp, Homo sapiens
gcctcagaagaagca

SEQ ID NO: 33775 - DNA, 15 bp, Homo sapiens
ggcctcagaagaagc

SEQ ID NO: 33776 - DNA, 15 bp, Homo sapiens
aggcctcagaagaag

SEQ ID NO: 33777 - DNA, 15 bp, Homo sapiens
caggcctcagaagaa

SEQ ID NO: 33778 - DNA, 15 bp, Homo sapiens
tcaggcctcagaaga

SEQ ID NO: 33779 - DNA, 15 bp, Homo sapiens
ttcaggcctcagaag

SEQ ID NO: 33780 - DNA, 15 bp, Homo sapiens
attcaggcctcagaa

SEQ ID NO: 33781 - DNA, 15 bp, Homo sapiens
gattcaggcctcaga

SEQ ID NO: 33782 - DNA, 15 bp, Homo sapiens
ggattcaggcctcag

SEQ ID NO: 33783 - DNA, 15 bp, Homo sapiens
tggattcaggcctca

SEQ ID NO: 33784 - DNA, 15 bp, Homo sapiens
ttggattcaggcctc

SEQ ID NO: 33785 - DNA, 15 bp, Homo sapiens
tttggattcaggcct

SEQ ID NO: 33786 - DNA, 15 bp, Homo sapiens
ttttggattcaggcc

SEQ ID NO: 33787 - DNA, 15 bp, Homo sapiens
cttttggattcaggc

SEQ ID NO: 33788 - DNA, 15 bp, Homo sapiens
tcttttggattcagg

SEQ ID NO: 33789 - DNA, 15 bp, Homo sapiens
ttcttttggattcag

SEQ ID NO: 33790 - DNA, 15 bp, Homo sapiens
tttcttttggattca

SEQ ID NO: 33791 - DNA, 15 bp, Homo sapiens
ttttcttttggattc

SEQ ID NO: 33792 - DNA, 15 bp, Homo sapiens
tttttcttttggatt

SEQ ID NO: 33793 - DNA, 15 bp, Homo sapiens
gtttttcttttggat

SEQ ID NO: 33794 - DNA, 15 bp, Homo sapiens
tgtttttcttttgga

SEQ ID NO: 33795 - DNA, 15 bp, Homo sapiens
ctgtttttcttttgg

SEQ ID NO: 33796 - DNA, 15 bp, Homo sapiens
gctgtttttcttttg

SEQ ID NO: 33797 - DNA, 15 bp, Homo sapiens
ggctgtttttctttt

SEQ ID NO: 33798 - DNA, 15 bp, Homo sapiens
tggctgtttttcttt

SEQ ID NO: 33799 - DNA, 15 bp, Homo sapiens
atggctgtttttctt

SEQ ID NO: 33800 - DNA, 15 bp, Homo sapiens
tatggctgtttttct

SEQ ID NO: 33801 - DNA, 15 bp, Homo sapiens
ctatggctgtttttc

SEQ ID NO: 33802 - DNA, 15 bp, Homo sapiens
cctatggctgttttt

SEQ ID NO: 33803 - DNA, 15 bp, Homo sapiens
gcctatggctgtttt

SEQ ID NO: 33804 - DNA, 15 bp, Homo sapiens
ggcctatggctgttt

SEQ ID NO: 33805 - DNA, 15 bp, Homo sapiens
gggcctatggctgtt

SEQ ID NO: 33806 - DNA, 15 bp, Homo sapiens
agggcctatggctgt

SEQ ID NO: 33807 - DNA, 15 bp, Homo sapiens
aagggcctatggctg

SEQ ID NO: 33808 - DNA, 15 bp, Homo sapiens
aaagggcctatggct

SEQ ID NO: 33809 - DNA, 15 bp, Homo sapiens
gaaagggcctatggc

SEQ ID NO: 33810 - DNA, 15 bp, Homo sapiens
tgaaagggcctatgg

SEQ ID NO: 33811 - DNA, 15 bp, Homo sapiens
ctgaaagggcctatg

SEQ ID NO: 33812 - DNA, 15 bp, Homo sapiens
actgaaagggcctat

SEQ ID NO: 33813 - DNA, 15 bp, Homo sapiens
cactgaaagggccta

SEQ ID NO: 33814 - DNA, 15 bp, Homo sapiens
ccactgaaagggcct

SEQ ID NO: 33815 - DNA, 15 bp, Homo sapiens
gccactgaaagggcc

SEQ ID NO: 33816 - DNA, 15 bp, Homo sapiens
ggccactgaaagggc

SEQ ID NO: 33817 - DNA, 15 bp, Homo sapiens
cggccactgaaaggg

SEQ ID NO: 33818 - DNA, 15 bp, Homo sapiens
ccggccactgaaagg

SEQ ID NO: 33819 - DNA, 15 bp, Homo sapiens
cccggccactgaaag

SEQ ID NO: 33820 - DNA, 15 bp, Homo sapiens
gcccggccactgaaa

SEQ ID NO: 33821 - DNA, 15 bp, Homo sapiens
agcccggccactgaa

SEQ ID NO: 33822 - DNA, 15 bp, Homo sapiens
tagcccggccactga

SEQ ID NO: 33823 - DNA, 15 bp, Homo sapiens
gtagcccggccactg

SEQ ID NO: 33824 - DNA, 15 bp, Homo sapiens
ggtagcccggccact

SEQ ID NO: 33825 - DNA, 15 bp, Homo sapiens
gggtagcccggccac

SEQ ID NO: 33826 - DNA, 15 bp, Homo sapiens
cgggtagcccggcca

SEQ ID NO: 33827 - DNA, 15 bp, Homo sapiens
acgggtagcccggcc

SEQ ID NO: 33828 - DNA, 15 bp, Homo sapiens
cacgggtagcccggc

SEQ ID NO: 33829 - DNA, 15 bp, Homo sapiens
tcacgggtagcccgg

SEQ ID NO: 33830 - DNA, 15 bp, Homo sapiens
ctcacgggtagcccg

SEQ ID NO: 33831 - DNA, 15 bp, Homo sapiens
gctcacgggtagccc

SEQ ID NO: 33832 - DNA, 15 bp, Homo sapiens
ggctcacgggtagcc

SEQ ID NO: 33833 - DNA, 15 bp, Homo sapiens
gggctcacgggtagc

SEQ ID NO: 33834 - DNA, 15 bp, Homo sapiens
agggctcacgggtag

SEQ ID NO: 33835 - DNA, 15 bp, Homo sapiens
aagggctcacgggta

SEQ ID NO: 33836 - DNA, 15 bp, Homo sapiens
gaagggctcacgggt

SEQ ID NO: 33837 - DNA, 15 bp, Homo sapiens
cgaagggctcacggg

SEQ ID NO: 33838 - DNA, 15 bp, Homo sapiens
ccgaagggctcacgg

SEQ ID NO: 33839 - DNA, 15 bp, Homo sapiens
tccgaagggctcacg

SEQ ID NO: 33840 - DNA, 15 bp, Homo sapiens
ctccgaagggctcac

SEQ ID NO: 33841 - DNA, 15 bp, Homo sapiens
cctccgaagggctca

SEQ ID NO: 33842 - DNA, 15 bp, Homo sapiens
tcctccgaagggctc

SEQ ID NO: 33843 - DNA, 15 bp, Homo sapiens
gtcctccgaagggct

SEQ ID NO: 33844 - DNA, 15 bp, Homo sapiens
ggtcctccgaagggc

SEQ ID NO: 33845 - DNA, 15 bp, Homo sapiens
tggtcctccgaaggg

SEQ ID NO: 33846 - DNA, 15 bp, Homo sapiens
ctggtcctccgaagg

SEQ ID NO: 33847 - DNA, 15 bp, Homo sapiens
cctggtcctccgaag

SEQ ID NO: 33848 - DNA, 15 bp, Homo sapiens
ccctggtcctccgaa

SEQ ID NO: 33849 - DNA, 15 bp, Homo sapiens
gccctggtcctccga

SEQ ID NO: 33850 - DNA, 15 bp, Homo sapiens
agccctggtcctccg

SEQ ID NO: 33851 - DNA, 15 bp, Homo sapiens
cagccctggtcctcc

SEQ ID NO: 33852 - DNA, 15 bp, Homo sapiens
ccagccctggtcctc

SEQ ID NO: 33853 - DNA, 15 bp, Homo sapiens
cccagccctggtcct

SEQ ID NO: 33854 - DNA, 15 bp, Homo sapiens
ccccagccctggtcc

SEQ ID NO: 33855 - DNA, 15 bp, Homo sapiens
gccccagccctggtc

SEQ ID NO: 33856 - DNA, 15 bp, Homo sapiens
tgccccagccctggt

SEQ ID NO: 33857 - DNA, 15 bp, Homo sapiens
ctgccccagccctgg

SEQ ID NO: 33858 - DNA, 15 bp, Homo sapiens
gctgccccagccctg

SEQ ID NO: 33859 - DNA, 15 bp, Homo sapiens
ggctgccccagccct

SEQ ID NO: 33860 - DNA, 15 bp, Homo sapiens
aggctgccccagccc

SEQ ID NO: 33861 - DNA, 15 bp, Homo sapiens
gaggctgccccagcc

SEQ ID NO: 33862 - DNA, 15 bp, Homo sapiens
agaggctgccccagc

SEQ ID NO: 33863 - DNA, 15 bp, Homo sapiens
cagaggctgccccag

SEQ ID NO: 33864 - DNA, 15 bp, Homo sapiens
ccagaggctgcccca

SEQ ID NO: 33865 - DNA, 15 bp, Homo sapiens
cccagaggctgcccc

SEQ ID NO: 33866 - DNA, 15 bp, Homo sapiens
gcccagaggctgccc

SEQ ID NO: 33867 - DNA, 15 bp, Homo sapiens
ggcccagaggctgcc

SEQ ID NO: 33868 - DNA, 15 bp, Homo sapiens
gggcccagaggctgc

SEQ ID NO: 33869 - DNA, 15 bp, Homo sapiens
tgggcccagaggctg

SEQ ID NO: 33870 - DNA, 15 bp, Homo sapiens
gtgggcccagaggct

SEQ ID NO: 33871 - DNA, 15 bp, Homo sapiens
tgtgggcccagaggc

SEQ ID NO: 33872 - DNA, 15 bp, Homo sapiens
atgtgggcccagagg

SEQ ID NO: 33873 - DNA, 15 bp, Homo sapiens
gatgtgggcccagag

SEQ ID NO: 33874 - DNA, 15 bp, Homo sapiens
ggatgtgggcccaga

SEQ ID NO: 33875 - DNA, 15 bp, Homo sapiens
cggatgtgggcccag

SEQ ID NO: 33876 - DNA, 15 bp, Homo sapiens
ccggatgtgggccca

SEQ ID NO: 33877 - DNA, 15 bp, Homo sapiens
cccggatgtgggccc

SEQ ID NO: 33878 - DNA, 15 bp, Homo sapiens
ccccggatgtgggcc

SEQ ID NO: 33879 - DNA, 15 bp, Homo sapiens
gccccggatgtgggc

SEQ ID NO: 33880 - DNA, 15 bp, Homo sapiens
ggccccggatgtggg

SEQ ID NO: 33881 - DNA, 15 bp, Homo sapiens
tggccccggatgtgg

SEQ ID NO: 33882 - DNA, 15 bp, Homo sapiens
ctggccccggatgtg

SEQ ID NO: 33883 - DNA, 15 bp, Homo sapiens
gctggccccggatgt

SEQ ID NO: 33884 - DNA, 15 bp, Homo sapiens
agctggccccggatg

SEQ ID NO: 33885 - DNA, 15 bp, Homo sapiens
gagctggccccggat

SEQ ID NO: 33886 - DNA, 15 bp, Homo sapiens
ggagctggccccgga

SEQ ID NO: 33887 - DNA, 15 bp, Homo sapiens
cggagctggccccgg

SEQ ID NO: 33888 - DNA, 15 bp, Homo sapiens
ccggagctggccccg

SEQ ID NO: 33889 - DNA, 15 bp, Homo sapiens
gccggagctggcccc

SEQ ID NO: 33890 - DNA, 15 bp, Homo sapiens
cgccggagctggccc

SEQ ID NO: 33891 - DNA, 15 bp, Homo sapiens
acgccggagctggcc

SEQ ID NO: 33892 - DNA, 15 bp, Homo sapiens
cacgccggagctggc

SEQ ID NO: 33893 - DNA, 15 bp, Homo sapiens
acacgccggagctgg

SEQ ID NO: 33894 - DNA, 15 bp, Homo sapiens
cacacgccggagctg

SEQ ID NO: 33895 - DNA, 15 bp, Homo sapiens
acacacgccggagct

SEQ ID NO: 33896 - DNA, 15 bp, Homo sapiens
aacacacgccggagc

SEQ ID NO: 33897 - DNA, 15 bp, Homo sapiens
gaacacacgccggag

SEQ ID NO: 33898 - DNA, 15 bp, Homo sapiens
tgaacacacgccgga

SEQ ID NO: 33899 - DNA, 15 bp, Homo sapiens
ctgaacacacgccgg

SEQ ID NO: 33900 - DNA, 15 bp, Homo sapiens
actgaacacacgccg

SEQ ID NO: 33901 - DNA, 15 bp, Homo sapiens
cactgaacacacgcc

SEQ ID NO: 33902 - DNA, 15 bp, Homo sapiens
acactgaacacacgc

SEQ ID NO: 33903 - DNA, 15 bp, Homo sapiens
aacactgaacacacg

SEQ ID NO: 33904 - DNA, 15 bp, Homo sapiens
taacactgaacacac

SEQ ID NO: 33905 - DNA, 15 bp, Homo sapiens
ctaacactgaacaca

SEQ ID NO: 33906 - DNA, 15 bp, Homo sapiens
gctaacactgaacac

SEQ ID NO: 33907 - DNA, 15 bp, Homo sapiens
tgctaacactgaaca

SEQ ID NO: 33908 - DNA, 15 bp, Homo sapiens
ctgctaacactgaac

SEQ ID NO: 33909 - DNA, 15 bp, Homo sapiens
actgctaacactgaa

SEQ ID NO: 33910 - DNA, 15 bp, Homo sapiens
cactgctaacactga

SEQ ID NO: 33911 - DNA, 15 bp, Homo sapiens
ccactgctaacactg

SEQ ID NO: 33912 - DNA, 15 bp, Homo sapiens
cccactgctaacact

SEQ ID NO: 33913 - DNA, 15 bp, Homo sapiens
acccactgctaacac

SEQ ID NO: 33914 - DNA, 15 bp, Homo sapiens
gacccactgctaaca

SEQ ID NO: 33915 - DNA, 15 bp, Homo sapiens
tgacccactgctaac

SEQ ID NO: 33916 - DNA, 15 bp, Homo sapiens
atgacccactgctaa

SEQ ID NO: 33917 - DNA, 15 bp, Homo sapiens
catgacccactgcta

SEQ ID NO: 33918 - DNA, 15 bp, Homo sapiens
tcatgacccactgct

SEQ ID NO: 33919 - DNA, 15 bp, Homo sapiens
atcatgacccactgc

SEQ ID NO: 33920 - DNA, 15 bp, Homo sapiens
catcatgacccactg

SEQ ID NO: 33921 - DNA, 15 bp, Homo sapiens
gcatcatgacccact

SEQ ID NO: 33922 - DNA, 15 bp, Homo sapiens
agcatcatgacccac

SEQ ID NO: 33923 - DNA, 15 bp, Homo sapiens
gagcatcatgaccca

SEQ ID NO: 33924 - DNA, 15 bp, Homo sapiens
agagcatcatgaccc

SEQ ID NO: 33925 - DNA, 15 bp, Homo sapiens
aagagcatcatgacc

SEQ ID NO: 33926 - DNA, 15 bp, Homo sapiens
aaagagcatcatgac

SEQ ID NO: 33927 - DNA, 15 bp, Homo sapiens
gaaagagcatcatga

SEQ ID NO: 33928 - DNA, 15 bp, Homo sapiens
ggaaagagcatcatg

SEQ ID NO: 33929 - DNA, 15 bp, Homo sapiens
gggaaagagcatcat

SEQ ID NO: 33930 - DNA, 15 bp, Homo sapiens
tgggaaagagcatca

SEQ ID NO: 33931 - DNA, 15 bp, Homo sapiens
gtgggaaagagcatc

SEQ ID NO: 33932 - DNA, 15 bp, Homo sapiens
ggtgggaaagagcat

SEQ ID NO: 33933 - DNA, 15 bp, Homo sapiens
gggtgggaaagagca

SEQ ID NO: 33934 - DNA, 15 bp, Homo sapiens
tgggtgggaaagagc

SEQ ID NO: 33935 - DNA, 15 bp, Homo sapiens
ctgggtgggaaagag

SEQ ID NO: 33936 - DNA, 15 bp, Homo sapiens
gctgggtgggaaaga

SEQ ID NO: 33937 - DNA, 15 bp, Homo sapiens
ggctgggtgggaaag

SEQ ID NO: 33938 - DNA, 15 bp, Homo sapiens
aggctgggtgggaaa

SEQ ID NO: 33939 - DNA, 15 bp, Homo sapiens
caggctgggtgggaa

SEQ ID NO: 33940 - DNA, 15 bp, Homo sapiens
ccaggctgggtggga

SEQ ID NO: 33941 - DNA, 15 bp, Homo sapiens
cccaggctgggtggg

SEQ ID NO: 33942 - DNA, 15 bp, Homo sapiens
tcccaggctgggtgg

SEQ ID NO: 33943 - DNA, 15 bp, Homo sapiens
atcccaggctgggtg

SEQ ID NO: 33944 - DNA, 15 bp, Homo sapiens
tatcccaggctgggt

SEQ ID NO: 33945 - DNA, 15 bp, Homo sapiens
ctatcccaggctggg

SEQ ID NO: 33946 - DNA, 15 bp, Homo sapiens
cctatcccaggctgg

SEQ ID NO: 33947 - DNA, 15 bp, Homo sapiens
ccctatcccaggctg

SEQ ID NO: 33948 - DNA, 15 bp, Homo sapiens
cccctatcccaggct

SEQ ID NO: 33949 - DNA, 15 bp, Homo sapiens
gcccctatcccaggc

SEQ ID NO: 33950 - DNA, 15 bp, Homo sapiens
tgcccctatcccagg

SEQ ID NO: 33951 - DNA, 15 bp, Homo sapiens
ctgcccctatcccag

SEQ ID NO: 33952 - DNA, 15 bp, Homo sapiens
tctgcccctatccca

SEQ ID NO: 33953 - DNA, 15 bp, Homo sapiens
ctctgcccctatccc

SEQ ID NO: 33954 - DNA, 15 bp, Homo sapiens
cctctgcccctatcc

SEQ ID NO: 33955 - DNA, 15 bp, Homo sapiens
tcctctgcccctatc

SEQ ID NO: 33956 - DNA, 15 bp, Homo sapiens
ctcctctgcccctat

SEQ ID NO: 33957 - DNA, 15 bp, Homo sapiens
cctcctctgccccta

SEQ ID NO: 33958 - DNA, 15 bp, Homo sapiens
gcctcctctgcccct

SEQ ID NO: 33959 - DNA, 15 bp, Homo sapiens
cgcctcctctgcccc

SEQ ID NO: 33960 - DNA, 15 bp, Homo sapiens
tcgcctcctctgccc

SEQ ID NO: 33961 - DNA, 15 bp, Homo sapiens
ctcgcctcctctgcc

SEQ ID NO: 33962 - DNA, 15 bp, Homo sapiens
cctcgcctcctctgc

SEQ ID NO: 33963 - DNA, 15 bp, Homo sapiens
tcctcgcctcctctg

SEQ ID NO: 33964 - DNA, 15 bp, Homo sapiens
ctcctcgcctcctct

SEQ ID NO: 33965 - DNA, 15 bp, Homo sapiens
gcctcctcgcctcct

SEQ ID NO: 33966 - DNA, 15 bp, Homo sapiens
ggcctcctcgcctcc

SEQ ID NO: 33967 - DNA, 15 bp, Homo sapiens
cggcctcctcgcctc

SEQ ID NO: 33968 - DNA, 15 bp, Homo sapiens
acggcctcctcgcct

SEQ ID NO: 33969 - DNA, 15 bp, Homo sapiens
aacggcctcctcgcc

SEQ ID NO: 33970 - DNA, 15 bp, Homo sapiens
caacggcctcctcgc

SEQ ID NO: 33971 - DNA, 15 bp, Homo sapiens
gcaacggcctcctcg

SEQ ID NO: 33972 - DNA, 15 bp, Homo sapiens
ggcaacggcctcctc

SEQ ID NO: 33973 - DNA, 15 bp, Homo sapiens
cggcaacggcctcct

SEQ ID NO: 33974 - DNA, 15 bp, Homo sapiens
gcggcaacggcctcc

SEQ ID NO: 33975 - DNA, 15 bp, Homo sapiens
agcggcaacggcctc

SEQ ID NO: 33976 - DNA, 15 bp, Homo sapiens
cagcggcaacggcct

SEQ ID NO: 33977 - DNA, 15 bp, Homo sapiens
tcagcggcaacggcc

SEQ ID NO: 33978 - DNA, 15 bp, Homo sapiens
atcagcggcaacggc

SEQ ID NO: 33979 - DNA, 15 bp, Homo sapiens
catcagcggcaacgg

SEQ ID NO: 33980 - DNA, 15 bp, Homo sapiens
acatcagcggcaacg

SEQ ID NO: 33981 - DNA, 15 bp, Homo sapiens
aacatcagcggcaac

SEQ ID NO: 33982 - DNA, 15 bp, Homo sapiens
aaacatcagcggcaa

SEQ ID NO: 33983 - DNA, 15 bp, Homo sapiens
caaacatcagcggca

SEQ ID NO: 33984 - DNA, 15 bp, Homo sapiens
ccaaacatcagcggc

SEQ ID NO: 33985 - DNA, 15 bp, Homo sapiens
gccaaacatcagcgg

SEQ ID NO: 33986 - DNA, 15 bp, Homo sapiens
ggccaaacatcagcg

SEQ ID NO: 33987 - DNA, 15 bp, Homo sapiens
cggccaaacatcagc

SEQ ID NO: 33988 - DNA, 15 bp, Homo sapiens
acggccaaacatcag

SEQ ID NO: 33989 - DNA, 15 bp, Homo sapiens
cacggccaaacatca

SEQ ID NO: 33990 - DNA, 15 bp, Homo sapiens
tcacggccaaacatc

SEQ ID NO: 33991 - DNA, 15 bp, Homo sapiens
ttcacggccaaacat

SEQ ID NO: 33992 - DNA, 15 bp, Homo sapiens
gttcacggccaaaca

SEQ ID NO: 33993 - DNA, 15 bp, Homo sapiens
tgttcacggccaaac

SEQ ID NO: 33994 - DNA, 15 bp, Homo sapiens
ctgttcacggccaaa

SEQ ID NO: 33995 - DNA, 15 bp, Homo sapiens
cctgttcacggccaa

SEQ ID NO: 33996 - DNA, 15 bp, Homo sapiens
acctgttcacggcca

SEQ ID NO: 33997 - DNA, 15 bp, Homo sapiens
cacctgttcacggcc

SEQ ID NO: 33998 - DNA, 15 bp, Homo sapiens
ccacctgttcacggc

SEQ ID NO: 33999 - DNA, 15 bp, Homo sapiens
cccacctgttcacgg

SEQ ID NO: 34000 - DNA, 15 bp, Homo sapiens
acccacctgttcacg

SEQ ID NO: 34001 - DNA, 15 bp, Homo sapiens
cacccacctgttcac

SEQ ID NO: 34002 - DNA, 15 bp, Homo sapiens
acacccacctgttca

SEQ ID NO: 34003 - DNA, 15 bp, Homo sapiens
gacacccacctgttc

SEQ ID NO: 34004 - DNA, 15 bp, Homo sapiens
agacacccacctgtt

SEQ ID NO: 34005 - DNA, 15 bp, Homo sapiens
cagacacccacctgt

SEQ ID NO: 34006 - DNA, 15 bp, Homo sapiens
gcagacacccacctg

SEQ ID NO: 34007 - DNA, 15 bp, Homo sapiens
cgcagacacccacct

SEQ ID NO: 34008 - DNA, 15 bp, Homo sapiens
acgcagacacccacc

SEQ ID NO: 34009 - DNA, 15 bp, Homo sapiens
cacgcagacacccac

SEQ ID NO: 34010 - DNA, 15 bp, Homo sapiens
gcacgcagacaccca

SEQ ID NO: 34011 - DNA, 15 bp, Homo sapiens
cgcacgcagacaccc

SEQ ID NO: 34012 - DNA, 15 bp, Homo sapiens
acgcacgcagacacc

SEQ ID NO: 34013 - DNA, 15 bp, Homo sapiens
gacgcacgcagacac

SEQ ID NO: 34014 - DNA, 15 bp, Homo sapiens
ggacgcacgcagaca

SEQ ID NO: 34015 - DNA, 15 bp, Homo sapiens
tggacgcacgcagac

SEQ ID NO: 34016 - DNA, 15 bp, Homo sapiens
gtggacgcacgcaga

SEQ ID NO: 34017 - DNA, 15 bp, Homo sapiens
cgtggacgcacgcag

SEQ ID NO: 34018 - DNA, 15 bp, Homo sapiens
acgtggacgcacgca

SEQ ID NO: 34019 - DNA, 15 bp, Homo sapiens
cacgtggacgcacgc

SEQ ID NO: 34020 - DNA, 15 bp, Homo sapiens
gcacgtggacgcacg

SEQ ID NO: 34021 - DNA, 15 bp, Homo sapiens
cgcacgtggacgcac

SEQ ID NO: 34022 - DNA, 15 bp, Homo sapiens
acgcacgtggacgca

SEQ ID NO: 34023 - DNA, 15 bp, Homo sapiens
cacgcacgtggacgc

SEQ ID NO: 34024 - DNA, 15 bp, Homo sapiens
acacgcacgtggacg

SEQ ID NO: 34025 - DNA, 15 bp, Homo sapiens
aacacgcacgtggac

SEQ ID NO: 34026 - DNA, 15 bp, Homo sapiens
aaacacgcacgtgga

SEQ ID NO: 34027 - DNA, 15 bp, Homo sapiens
aaaacacgcacgtgg

SEQ ID NO: 34028 - DNA, 15 bp, Homo sapiens
gaaaacacgcacgtg

SEQ ID NO: 34029 - DNA, 15 bp, Homo sapiens
agaaaacacgcacgt

SEQ ID NO: 34030 - DNA, 15 bp, Homo sapiens
cagaaaacacgcacg

SEQ ID NO: 34031 - DNA, 15 bp, Homo sapiens
tcagaaaacacgcac

SEQ ID NO: 34032 - DNA, 15 bp, Homo sapiens
gtcagaaaacacgca

SEQ ID NO: 34033 - DNA, 15 bp, Homo sapiens
agtcagaaaacacgc

SEQ ID NO: 34034 - DNA, 15 bp, Homo sapiens
cagtcagaaaacacg

SEQ ID NO: 34035 - DNA, 15 bp, Homo sapiens
tcagtcagaaaacac

SEQ ID NO: 34036 - DNA, 15 bp, Homo sapiens
gtcagtcagaaaaca

SEQ ID NO: 34037 - DNA, 15 bp, Homo sapiens
tgtcagtcagaaaac

SEQ ID NO: 34038 - DNA, 15 bp, Homo sapiens
atgtcagtcagaaaa

SEQ ID NO: 34039 - DNA, 15 bp, Homo sapiens
catgtcagtcagaaa

SEQ ID NO: 34040 - DNA, 15 bp, Homo sapiens
tcatgtcagtcagaa

SEQ ID NO: 34041 - DNA, 15 bp, Homo sapiens
ttcatgtcagtcaga

SEQ ID NO: 34042 - DNA, 15 bp, Homo sapiens
tttcatgtcagtcag

SEQ ID NO: 34043 - DNA, 15 bp, Homo sapiens
atttcatgtcagtca

SEQ ID NO: 34044 - DNA, 15 bp, Homo sapiens
gatttcatgtcagtc

SEQ ID NO: 34045 - DNA, 15 bp, Homo sapiens
cgatttcatgtcagt

SEQ ID NO: 34046 - DNA, 15 bp, Homo sapiens
tcgatttcatgtcag

SEQ ID NO: 34047 - DNA, 15 bp, Homo sapiens
gtcgatttcatgtca

SEQ ID NO: 34048 - DNA, 15 bp, Homo sapiens
cgtcgatttcatgtc

SEQ ID NO: 34049 - DNA, 15 bp, Homo sapiens
gcgtcgatttcatgt

SEQ ID NO: 34050 - DNA, 15 bp, Homo sapiens
ggcgtcgatttcatg

SEQ ID NO: 34051 - DNA, 15 bp, Homo sapiens
gggcgtcgatttcat

SEQ ID NO: 34052 - DNA, 15 bp, Homo sapiens
cgggcgtcgatttca

SEQ ID NO: 34053 - DNA, 15 bp, Homo sapiens
tcgggcgtcgatttc

SEQ ID NO: 34054 - DNA, 15 bp, Homo sapiens
ctcgggcgtcgattt

SEQ ID NO: 34055 - DNA, 15 bp, Homo sapiens
actcgggcgtcgatt

SEQ ID NO: 34056 - DNA, 15 bp, Homo sapiens
aactcgggcgtcgat

SEQ ID NO: 34057 - DNA, 15 bp, Homo sapiens
taactcgggcgtcga

SEQ ID NO: 34058 - DNA, 15 bp, Homo sapiens
ctaactcgggcgtcg

SEQ ID NO: 34059 - DNA, 15 bp, Homo sapiens
gctaactcgggcgtc

SEQ ID NO: 34060 - DNA, 15 bp, Homo sapiens
ggctaactcgggcgt

SEQ ID NO: 34061 - DNA, 15 bp, Homo sapiens
aggctaactcgggcg

SEQ ID NO: 34062 - DNA, 15 bp, Homo sapiens
gaggctaactcgggc

SEQ ID NO: 34063 - DNA, 15 bp, Homo sapiens
tgaggctaactcggg

SEQ ID NO: 34064 - DNA, 15 bp, Homo sapiens
gtgaggctaactcgg

SEQ ID NO: 34065 - DNA, 15 bp, Homo sapiens
ggtgaggctaactcg

SEQ ID NO: 34066 - DNA, 15 bp, Homo sapiens
gggtgaggctaactc

SEQ ID NO: 34067 - DNA, 15 bp, Homo sapiens
cgggtgaggctaact

SEQ ID NO: 34068 - DNA, 15 bp, Homo sapiens
ccgggtgaggctaac

SEQ ID NO: 34069 - DNA, 15 bp, Homo sapiens
accgggtgaggctaa

SEQ ID NO: 34070 - DNA, 15 bp, Homo sapiens
caccgggtgaggcta

SEQ ID NO: 34071 - DNA, 15 bp, Homo sapiens
tcaccgggtgaggct

SEQ ID NO: 34072 - DNA, 15 bp, Homo sapiens
gtcaccgggtgaggc

SEQ ID NO: 34073 - DNA, 15 bp, Homo sapiens
ggtcaccgggtgagg

SEQ ID NO: 34074 - DNA, 15 bp, Homo sapiens
aggtcaccgggtgag

SEQ ID NO: 34075 - DNA, 15 bp, Homo sapiens
gaggtcaccgggtga

SEQ ID NO: 34076 - DNA, 15 bp, Homo sapiens
agaggtcaccgggtg

SEQ ID NO: 34077 - DNA, 15 bp, Homo sapiens
tagaggtcaccgggt

SEQ ID NO: 34078 - DNA, 15 bp, Homo sapiens
ctagaggtcaccggg

SEQ ID NO: 34079 - DNA, 15 bp, Homo sapiens
gctagaggtcaccgg

SEQ ID NO: 34080 - DNA, 15 bp, Homo sapiens
ggctagaggtcaccg

SEQ ID NO: 34081 - DNA, 15 bp, Homo sapiens
gggctagaggtcacc

SEQ ID NO: 34082 - DNA, 15 bp, Homo sapiens
agggctagaggtcac

SEQ ID NO: 34083 - DNA, 15 bp, Homo sapiens
cagggctagaggtca

SEQ ID NO: 34084 - DNA, 15 bp, Homo sapiens
gcagggctagaggtc

SEQ ID NO: 34085 - DNA, 15 bp, Homo sapiens
ggcagggctagaggt

SEQ ID NO: 34086 - DNA, 15 bp, Homo sapiens
gggcagggctagagg

SEQ ID NO: 34087 - DNA, 15 bp, Homo sapiens
cgggcagggctagag

SEQ ID NO: 34088 - DNA, 15 bp, Homo sapiens
ccgggcagggctaga

SEQ ID NO: 34089 - DNA, 15 bp, Homo sapiens
tccgggcagggctag

SEQ ID NO: 34090 - DNA, 15 bp, Homo sapiens
atccgggcagggcta

SEQ ID NO: 34091 - DNA, 15 bp, Homo sapiens
catccgggcagggct

SEQ ID NO: 34092 - DNA, 15 bp, Homo sapiens
ccatccgggcagggc

SEQ ID NO: 34093 - DNA, 15 bp, Homo sapiens
tccatccgggcaggg

SEQ ID NO: 34094 - DNA, 15 bp, Homo sapiens
ctccatccgggcagg

SEQ ID NO: 34095 - DNA, 15 bp, Homo sapiens
gctccatccgggcag

SEQ ID NO: 34096 - DNA, 15 bp, Homo sapiens
cgctccatccgggca

SEQ ID NO: 34097 - DNA, 15 bp, Homo sapiens
ccgctccatccgggc

SEQ ID NO: 34098 - DNA, 15 bp, Homo sapiens
cccgctccatccggg

SEQ ID NO: 34099 - DNA, 15 bp, Homo sapiens
ccccgctccatccgg

SEQ ID NO: 34100 - DNA, 15 bp, Homo sapiens
gccccgctccatccg

SEQ ID NO: 34101 - DNA, 15 bp, Homo sapiens
ggccccgctccatcc

SEQ ID NO: 34102 - DNA, 15 bp, Homo sapiens
gggccccgctccatc

SEQ ID NO: 34103 - DNA, 15 bp, Homo sapiens
tgggccccgctccat

SEQ ID NO: 34104 - DNA, 15 bp, Homo sapiens
gtgggccccgctcca

SEQ ID NO: 34105 - DNA, 15 bp, Homo sapiens
ggtgggccccgctcc

SEQ ID NO: 34106 - DNA, 15 bp, Homo sapiens
gggtgggccccgctc

SEQ ID NO: 34107 - DNA, 15 bp, Homo sapiens
cgggtgggccccgct

SEQ ID NO: 34108 - DNA, 15 bp, Homo sapiens
ccgggtgggccccgc

SEQ ID NO: 34109 - DNA, 15 bp, Homo sapiens
accgggtgggccccg

SEQ ID NO: 34110 - DNA, 15 bp, Homo sapiens
aaccgggtgggcccc

SEQ ID NO: 34111 - DNA, 15 bp, Homo sapiens
gaaccgggtgggccc

SEQ ID NO: 34112 - DNA, 15 bp, Homo sapiens
tgaaccgggtgggcc

SEQ ID NO: 34113 - DNA, 15 bp, Homo sapiens
ctgaaccgggtgggc

SEQ ID NO: 34114 - DNA, 15 bp, Homo sapiens
actgaaccgggtggg

SEQ ID NO: 34115 - DNA, 15 bp, Homo sapiens
cactgaaccgggtgg

SEQ ID NO: 34116 - DNA, 15 bp, Homo sapiens
acactgaaccgggtg

SEQ ID NO: 34117 - DNA, 15 bp, Homo sapiens
aacactgaaccgggt

SEQ ID NO: 34118 - DNA, 15 bp, Homo sapiens
aaacactgaaccggg

SEQ ID NO: 34119 - DNA, 15 bp, Homo sapiens
gaaacactgaaccgg

SEQ ID NO: 34120 - DNA, 15 bp, Homo sapiens
agaaacactgaaccg

SEQ ID NO: 34121 - DNA, 15 bp, Homo sapiens
cagaaacactgaacc

SEQ ID NO: 34122 - DNA, 15 bp, Homo sapiens
ccagaaacactgaac

SEQ ID NO: 34123 - DNA, 15 bp, Homo sapiens
cccagaaacactgaa

SEQ ID NO: 34124 - DNA, 15 bp, Homo sapiens
ccccagaaacactga

SEQ ID NO: 34125 - DNA, 15 bp, Homo sapiens
tccccagaaacactg

SEQ ID NO: 34126 - DNA, 15 bp, Homo sapiens
ctccccagaaacact

SEQ ID NO: 34127 - DNA, 15 bp, Homo sapiens
gctccccagaaacac

SEQ ID NO: 34128 - DNA, 15 bp, Homo sapiens
agctccccagaaaca

SEQ ID NO: 34129 - DNA, 15 bp, Homo sapiens
cagctccccagaaac

SEQ ID NO: 34130 - DNA, 15 bp, Homo sapiens
ccagctccccagaaa

SEQ ID NO: 34131 - DNA, 15 bp, Homo sapiens
tccagctccccagaa

SEQ ID NO: 34132 - DNA, 15 bp, Homo sapiens
gtccagctccccaga

SEQ ID NO: 34133 - DNA, 15 bp, Homo sapiens
tgtccagctccccag

SEQ ID NO: 34134 - DNA, 15 bp, Homo sapiens
ctgtccagctcccca

SEQ ID NO: 34135 - DNA, 15 bp, Homo sapiens
actgtccagctcccc

SEQ ID NO: 34136 - DNA, 15 bp, Homo sapiens
cactgtccagctccc

SEQ ID NO: 34137 - DNA, 15 bp, Homo sapiens
ccactgtccagctcc

SEQ ID NO: 34138 - DNA, 15 bp, Homo sapiens
tccactgtccagctc

SEQ ID NO: 34139 - DNA, 15 bp, Homo sapiens
ctccactgtccagct

SEQ ID NO: 34140 - DNA, 15 bp, Homo sapiens
actccactgtccagc

SEQ ID NO: 34141 - DNA, 15 bp, Homo sapiens
cactccactgtccag

SEQ ID NO: 34142 - DNA, 15 bp, Homo sapiens
gcactccactgtcca

SEQ ID NO: 34143 - DNA, 15 bp, Homo sapiens
tgcactccactgtcc

SEQ ID NO: 34144 - DNA, 15 bp, Homo sapiens
ttgcactccactgtc

SEQ ID NO: 34145 - DNA, 15 bp, Homo sapiens
tttgcactccactgt

SEQ ID NO: 34146 - DNA, 15 bp, Homo sapiens
ttttgcactccactg

SEQ ID NO: 34147 - DNA, 15 bp, Homo sapiens
cttttgcactccact

SEQ ID NO: 34148 - DNA, 15 bp, Homo sapiens
ccttttgcactccac

SEQ ID NO: 34149 - DNA, 15 bp, Homo sapiens
gccttttgcactcca

SEQ ID NO: 34150 - DNA, 15 bp, Homo sapiens
agccttttgcactcc

SEQ ID NO: 34151 - DNA, 15 bp, Homo sapiens
aagccttttgcactc

SEQ ID NO: 34152 - DNA, 15 bp, Homo sapiens
caagccttttgcact

SEQ ID NO: 34153 - DNA, 15 bp, Homo sapiens
gcaagccttttgcac

SEQ ID NO: 34154 - DNA, 15 bp, Homo sapiens
tgcaagccttttgca

SEQ ID NO: 34155 - DNA, 15 bp, Homo sapiens
ctgcaagccttttgc

SEQ ID NO: 34156 - DNA, 15 bp, Homo sapiens
tctgcaagccttttg

SEQ ID NO: 34157 - DNA, 15 bp, Homo sapiens
ttctgcaagcctttt

SEQ ID NO: 34158 - DNA, 15 bp, Homo sapiens
gttctgcaagccttt

SEQ ID NO: 34159 - DNA, 15 bp, Homo sapiens
agttctgcaagcctt

SEQ ID NO: 34160 - DNA, 15 bp, Homo sapiens
aagttctgcaagcct

SEQ ID NO: 34161 - DNA, 15 bp, Homo sapiens
caagttctgcaagcc

SEQ ID NO: 34162 - DNA, 15 bp, Homo sapiens
tcaagttctgcaagc

SEQ ID NO: 34163 - DNA, 15 bp, Homo sapiens
ttcaagttctgcaag

SEQ ID NO: 34164 - DNA, 15 bp, Homo sapiens
cttcaagttctgcaa

SEQ ID NO: 34165 - DNA, 15 bp, Homo sapiens
gcttcaagttctgca

SEQ ID NO: 34166 - DNA, 15 bp, Homo sapiens
ggcttcaagttctgc

SEQ ID NO: 34167 - DNA, 15 bp, Homo sapiens
aggcttcaagttctg

SEQ ID NO: 34168 - DNA, 15 bp, Homo sapiens
caggcttcaagttct

SEQ ID NO: 34169 - DNA, 15 bp, Homo sapiens
gcaggcttcaagttc

SEQ ID NO: 34170 - DNA, 15 bp, Homo sapiens
agcaggcttcaagtt

SEQ ID NO: 34171 - DNA, 15 bp, Homo sapiens
gagcaggcttcaagt

SEQ ID NO: 34172 - DNA, 15 bp, Homo sapiens
ggagcaggcttcaag

SEQ ID NO: 34173 - DNA, 15 bp, Homo sapiens
aggagcaggcttcaa

SEQ ID NO: 34174 - DNA, 15 bp, Homo sapiens
aaggagcaggcttca

SEQ ID NO: 34175 - DNA, 15 bp, Homo sapiens
gaaggagcaggcttc

SEQ ID NO: 34176 - DNA, 15 bp, Homo sapiens
ggaaggagcaggctt

SEQ ID NO: 34177 - DNA, 15 bp, Homo sapiens
gggaaggagcaggct

SEQ ID NO: 34178 - DNA, 15 bp, Homo sapiens
agggaaggagcaggc

SEQ ID NO: 34179 - DNA, 15 bp, Homo sapiens
aagggaaggagcagg

SEQ ID NO: 34180 - DNA, 15 bp, Homo sapiens
caagggaaggagcag

SEQ ID NO: 34181 - DNA, 15 bp, Homo sapiens
gcaagggaaggagca

SEQ ID NO: 34182 - DNA, 15 bp, Homo sapiens
agcaagggaaggagc

SEQ ID NO: 34183 - DNA, 15 bp, Homo sapiens
tagcaagggaaggag

SEQ ID NO: 34184 - DNA, 15 bp, Homo sapiens
gtagcaagggaagga

SEQ ID NO: 34185 - DNA, 15 bp, Homo sapiens
ggtagcaagggaagg

SEQ ID NO: 34186 - DNA, 15 bp, Homo sapiens
tggtagcaagggaag

SEQ ID NO: 34187 - DNA, 15 bp, Homo sapiens
gtggtagcaagggaa

SEQ ID NO: 34188 - DNA, 15 bp, Homo sapiens
cgtggtagcaaggga

SEQ ID NO: 34189 - DNA, 15 bp, Homo sapiens
ccgtggtagcaaggg

SEQ ID NO: 34190 - DNA, 15 bp, Homo sapiens
gccgtggtagcaagg

SEQ ID NO: 34191 - DNA, 15 bp, Homo sapiens
ggccgtggtagcaag

SEQ ID NO: 34192 - DNA, 15 bp, Homo sapiens
aggccgtggtagcaa

SEQ ID NO: 34193 - DNA, 15 bp, Homo sapiens
gaggccgtggtagca

SEQ ID NO: 34194 - DNA, 15 bp, Homo sapiens
ggaggccgtggtagc

SEQ ID NO: 34195 - DNA, 15 bp, Homo sapiens
aggaggccgtggtag

SEQ ID NO: 34196 - DNA, 15 bp, Homo sapiens
aaggaggccgtggta

SEQ ID NO: 34197 - DNA, 15 bp, Homo sapiens
aaaggaggccgtggt

SEQ ID NO: 34198 - DNA, 15 bp, Homo sapiens
gaaaggaggccgtgg

SEQ ID NO: 34199 - DNA, 15 bp, Homo sapiens
ggaaaggaggccgtg

SEQ ID NO: 34200 - DNA, 15 bp, Homo sapiens
cggaaaggaggccgt

SEQ ID NO: 34201 - DNA, 15 bp, Homo sapiens
acggaaaggaggccg

SEQ ID NO: 34202 - DNA, 15 bp, Homo sapiens
aacggaaaggaggcc

SEQ ID NO: 34203 - DNA, 15 bp, Homo sapiens
aaacggaaaggaggc

SEQ ID NO: 34204 - DNA, 15 bp, Homo sapiens
caaacggaaaggagg

SEQ ID NO: 34205 - DNA, 15 bp, Homo sapiens
tcaaacggaaaggag

SEQ ID NO: 34206 - DNA, 15 bp, Homo sapiens
atcaaacggaaagga

SEQ ID NO: 34207 - DNA, 15 bp, Homo sapiens
aatcaaacggaaagg

SEQ ID NO: 34208 - DNA, 15 bp, Homo sapiens
aaatcaaacggaaag

SEQ ID NO: 34209 - DNA, 15 bp, Homo sapiens
caaatcaaacggaaa

SEQ ID NO: 34210 - DNA, 15 bp, Homo sapiens
acaaatcaaacggaa

SEQ ID NO: 34211 - DNA, 15 bp, Homo sapiens
gacaaatcaaacgga

SEQ ID NO: 34212 - DNA, 15 bp, Homo sapiens
tgacaaatcaaacgg

SEQ ID NO: 34213 - DNA, 15 bp, Homo sapiens
gtgacaaatcaaacg

SEQ ID NO: 34214 - DNA, 15 bp, Homo sapiens
agtgacaaatcaaac

SEQ ID NO: 34215 - DNA, 15 bp, Homo sapiens
cagtgacaaatcaaa

SEQ ID NO: 34216 - DNA, 15 bp, Homo sapiens
gcagtgacaaatcaa

SEQ ID NO: 34217 - DNA, 15 bp, Homo sapiens
agcagtgacaaatca

SEQ ID NO: 34218 - DNA, 15 bp, Homo sapiens
aagcagtgacaaatc

SEQ ID NO: 34219 - DNA, 15 bp, Homo sapiens
gaagcagtgacaaat

SEQ ID NO: 34220 - DNA, 15 bp, Homo sapiens
tgaagcagtgacaaa

SEQ ID NO: 34221 - DNA, 15 bp, Homo sapiens
ttgaagcagtgacaa

SEQ ID NO: 34222 - DNA, 15 bp, Homo sapiens
attgaagcagtgaca

SEQ ID NO: 34223 - DNA, 15 bp, Homo sapiens
gattgaagcagtgac

SEQ ID NO: 34224 - DNA, 15 bp, Homo sapiens
tgattgaagcagtga

SEQ ID NO: 34225 - DNA, 15 bp, Homo sapiens
ttgattgaagcagtg

SEQ ID NO: 34226 - DNA, 15 bp, Homo sapiens
attgattgaagcagt

SEQ ID NO: 34227 - DNA, 15 bp, Homo sapiens
tattgattgaagcag

SEQ ID NO: 34228 - DNA, 15 bp, Homo sapiens
ttattgattgaagca

SEQ ID NO: 34229 - DNA, 15 bp, Homo sapiens
gttattgattgaagc

SEQ ID NO: 34230 - DNA, 15 bp, Homo sapiens
tgttattgattgaag

SEQ ID NO: 34231 - DNA, 15 bp, Homo sapiens
ctgttattgattgaa

SEQ ID NO: 34232 - DNA, 15 bp, Homo sapiens
gctgttattgattga

SEQ ID NO: 34233 - DNA, 15 bp, Homo sapiens
ggctgttattgattg

SEQ ID NO: 34234 - DNA, 15 bp, Homo sapiens
cggctgttattgatt

SEQ ID NO: 34235 - DNA, 15 bp, Homo sapiens
gcggctgttattgat

SEQ ID NO: 34236 - DNA, 15 bp, Homo sapiens
agcggctgttattga

SEQ ID NO: 34237 - DNA, 15 bp, Homo sapiens
gagcggctgttattg

SEQ ID NO: 34238 - DNA, 15 bp, Homo sapiens
ggagcggctgttatt

SEQ ID NO: 34239 - DNA, 15 bp, Homo sapiens
tggagcggctgttat

SEQ ID NO: 34240 - DNA, 15 bp, Homo sapiens
ctggagcggctgtta

SEQ ID NO: 34241 - DNA, 15 bp, Homo sapiens
tctggagcggctgtt

SEQ ID NO: 34242 - DNA, 15 bp, Homo sapiens
ctctggagcggctgt

SEQ ID NO: 34243 - DNA, 15 bp, Homo sapiens
actctggagcggctg

SEQ ID NO: 34244 - DNA, 15 bp, Homo sapiens
gactctggagcggct

SEQ ID NO: 34245 - DNA, 15 bp, Homo sapiens
tgactctggagcggc

SEQ ID NO: 34246 - DNA, 15 bp, Homo sapiens
ctgactctggagcgg

SEQ ID NO: 34247 - DNA, 15 bp, Homo sapiens
actgactctggagcg

SEQ ID NO: 34248 - DNA, 15 bp, Homo sapiens
tactgactctggagc

SEQ ID NO: 34249 - DNA, 15 bp, Homo sapiens
ctactgactctggag

SEQ ID NO: 34250 - DNA, 15 bp, Homo sapiens
actactgactctgga

SEQ ID NO: 34251 - DNA, 15 bp, Homo sapiens
gactactgactctgg

SEQ ID NO: 34252 - DNA, 15 bp, Homo sapiens
tgactactgactctg

SEQ ID NO: 34253 - DNA, 15 bp, Homo sapiens
ttgactactgactct

SEQ ID NO: 34254 - DNA, 15 bp, Homo sapiens
attgactactgactc

SEQ ID NO: 34255 - DNA, 15 bp, Homo sapiens
cattgactactgact

SEQ ID NO: 34256 - DNA, 15 bp, Homo sapiens
tcattgactactgac

SEQ ID NO: 34257 - DNA, 15 bp, Homo sapiens
ttcattgactactga

SEQ ID NO: 34258 - DNA, 15 bp, Homo sapiens
attcattgactactg

SEQ ID NO: 34259 - DNA, 15 bp, Homo sapiens
tattcattgactact

SEQ ID NO: 34260 - DNA, 15 bp, Homo sapiens
atattcattgactac

SEQ ID NO: 34261 - DNA, 15 bp, Homo sapiens
tatattcattgacta

SEQ ID NO: 34262 - DNA, 15 bp, Homo sapiens
atatattcattgact

SEQ ID NO: 34263 - DNA, 15 bp, Homo sapiens
catatattcattgac

SEQ ID NO: 34264 - DNA, 15 bp, Homo sapiens
tcatatattcattga

SEQ ID NO: 34265 - DNA, 15 bp, Homo sapiens
gtcatatattcattg

SEQ ID NO: 34266 - DNA, 15 bp, Homo sapiens
ggtcatatattcatt

SEQ ID NO: 34267 - DNA, 15 bp, Homo sapiens
tggtcatatattcat

SEQ ID NO: 34268 - DNA, 15 bp, Homo sapiens
ttggtcatatattca

SEQ ID NO: 34269 - DNA, 15 bp, Homo sapiens
tttggtcatatattc

SEQ ID NO: 34270 - DNA, 15 bp, Homo sapiens
atttggtcatatatt

SEQ ID NO: 34271 - DNA, 15 bp, Homo sapiens
tatttggtcatatat

SEQ ID NO: 34272 - DNA, 15 bp, Homo sapiens
atatttggtcatata

SEQ ID NO: 34273 - DNA, 15 bp, Homo sapiens
gatatttggtcatat

SEQ ID NO: 34274 - DNA, 15 bp, Homo sapiens
tgatatttggtcata

SEQ ID NO: 34275 - DNA, 15 bp, Homo sapiens
gtgatatttggtcat

SEQ ID NO: 34276 - DNA, 15 bp, Homo sapiens
ggtgatatttggtca

SEQ ID NO: 34277 - DNA, 15 bp, Homo sapiens
tggtgatatttggtc

SEQ ID NO: 34278 - DNA, 15 bp, Homo sapiens
ctggtgatatttggt

SEQ ID NO: 34279 - DNA, 15 bp, Homo sapiens
cctggtgatatttgg

SEQ ID NO: 34280 - DNA, 15 bp, Homo sapiens
tcctggtgatatttg

SEQ ID NO: 34281 - DNA, 15 bp, Homo sapiens
gtcctggtgatattt

SEQ ID NO: 34282 - DNA, 15 bp, Homo sapiens
agtcctggtgatatt

SEQ ID NO: 34283 - DNA, 15 bp, Homo sapiens
cagtcctggtgatat

SEQ ID NO: 34284 - DNA, 15 bp, Homo sapiens
acagtcctggtgata

SEQ ID NO: 34285 - DNA, 15 bp, Homo sapiens
aacagtcctggtgat

SEQ ID NO: 34286 - DNA, 15 bp, Homo sapiens
taacagtcctggtga

SEQ ID NO: 34287 - DNA, 15 bp, Homo sapiens
gtaacagtcctggtg

SEQ ID NO: 34288 - DNA, 15 bp, Homo sapiens
agtaacagtcctggt

SEQ ID NO: 34289 - DNA, 15 bp, Homo sapiens
gagtaacagtcctgg

SEQ ID NO: 34290 - DNA, 15 bp, Homo sapiens
tgagtaacagtcctg

SEQ ID NO: 34291 - DNA, 15 bp, Homo sapiens
ttgagtaacagtcct

SEQ ID NO: 34292 - DNA, 15 bp, Homo sapiens
attgagtaacagtcc

SEQ ID NO: 34293 - DNA, 15 bp, Homo sapiens
cattgagtaacagtc

SEQ ID NO: 34294 - DNA, 15 bp, Homo sapiens
acattgagtaacagt

SEQ ID NO: 34295 - DNA, 15 bp, Homo sapiens
cacattgagtaacag

SEQ ID NO: 34296 - DNA, 15 bp, Homo sapiens
acacattgagtaaca

SEQ ID NO: 34297 - DNA, 15 bp, Homo sapiens
cacacattgagtaac

SEQ ID NO: 34298 - DNA, 15 bp, Homo sapiens
gcacacattgagtaa

SEQ ID NO: 34299 - DNA, 15 bp, Homo sapiens
ggcacacattgagta

SEQ ID NO: 34300 - DNA, 15 bp, Homo sapiens
cggcacacattgagt

SEQ ID NO: 34301 - DNA, 15 bp, Homo sapiens
tcggcacacattgag

SEQ ID NO: 34302 - DNA, 15 bp, Homo sapiens
ctcggcacacattga

SEQ ID NO: 34303 - DNA, 15 bp, Homo sapiens
gctcggcacacattg

SEQ ID NO: 34304 - DNA, 15 bp, Homo sapiens
ggctcggcacacatt

SEQ ID NO: 34305 - DNA, 15 bp, Homo sapiens
gggctcggcacacat

SEQ ID NO: 34306 - DNA, 15 bp, Homo sapiens
agggctcggcacaca

SEQ ID NO: 34307 - DNA, 15 bp, Homo sapiens
aagggctcggcacac

SEQ ID NO: 34308 - DNA, 15 bp, Homo sapiens
caagggctcggcaca

SEQ ID NO: 34309 - DNA, 15 bp, Homo sapiens
gcaagggctcggcac

SEQ ID NO: 34310 - DNA, 15 bp, Homo sapiens
ggcaagggctcggca

SEQ ID NO: 34311 - DNA, 15 bp, Homo sapiens
gggcaagggctcggc

SEQ ID NO: 34312 - DNA, 15 bp, Homo sapiens
tgggcaagggctcgg

SEQ ID NO: 34313 - DNA, 15 bp, Homo sapiens
atgggcaagggctcg

SEQ ID NO: 34314 - DNA, 15 bp, Homo sapiens
catgggcaagggctc

SEQ ID NO: 34315 - DNA, 15 bp, Homo sapiens
gcatgggcaagggct

SEQ ID NO: 34316 - DNA, 15 bp, Homo sapiens
agcatgggcaagggc

SEQ ID NO: 34317 - DNA, 15 bp, Homo sapiens
cagcatgggcaaggg

SEQ ID NO: 34318 - DNA, 15 bp, Homo sapiens
ccagcatgggcaagg

SEQ ID NO: 34319 - DNA, 15 bp, Homo sapiens
cccagcatgggcaag

SEQ ID NO: 34320 - DNA, 15 bp, Homo sapiens
gcccagcatgggcaa

SEQ ID NO: 34321 - DNA, 15 bp, Homo sapiens
agcccagcatgggca

SEQ ID NO: 34322 - DNA, 15 bp, Homo sapiens
gagcccagcatgggc

SEQ ID NO: 34323 - DNA, 15 bp, Homo sapiens
ggagcccagcatggg

SEQ ID NO: 34324 - DNA, 15 bp, Homo sapiens
gggagcccagcatgg

SEQ ID NO: 34325 - DNA, 15 bp, Homo sapiens
cgggagcccagcatg

SEQ ID NO: 34326 - DNA, 15 bp, Homo sapiens
acgggagcccagcat

SEQ ID NO: 34327 - DNA, 15 bp, Homo sapiens
cacgggagcccagca

SEQ ID NO: 34328 - DNA, 15 bp, Homo sapiens
acacgggagcccagc

SEQ ID NO: 34329 - DNA, 15 bp, Homo sapiens
tacacgggagcccag

SEQ ID NO: 34330 - DNA, 15 bp, Homo sapiens
atacacgggagccca

SEQ ID NO: 34331 - DNA, 15 bp, Homo sapiens
gatacacgggagccc

SEQ ID NO: 34332 - DNA, 15 bp, Homo sapiens
agatacacgggagcc

SEQ ID NO: 34333 - DNA, 15 bp, Homo sapiens
cagatacacgggagc

SEQ ID NO: 34334 - DNA, 15 bp, Homo sapiens
ccagatacacgggag

SEQ ID NO: 34335 - DNA, 15 bp, Homo sapiens
tccagatacacggga

SEQ ID NO: 34336 - DNA, 15 bp, Homo sapiens
gtccagatacacggg

SEQ ID NO: 34337 - DNA, 15 bp, Homo sapiens
tgtccagatacacgg

SEQ ID NO: 34338 - DNA, 15 bp, Homo sapiens
gtgtccagatacacg

SEQ ID NO: 34339 - DNA, 15 bp, Homo sapiens
agtgtccagatacac

SEQ ID NO: 34340 - DNA, 15 bp, Homo sapiens
cagtgtccagataca

SEQ ID NO: 34341 - DNA, 15 bp, Homo sapiens
acagtgtccagatac

SEQ ID NO: 34342 - DNA, 15 bp, Homo sapiens
tacagtgtccagata

SEQ ID NO: 34343 - DNA, 15 bp, Homo sapiens
ttacagtgtccagat

SEQ ID NO: 34344 - DNA, 15 bp, Homo sapiens
gttacagtgtccaga

SEQ ID NO: 34345 - DNA, 15 bp, Homo sapiens
cgttacagtgtccag

SEQ ID NO: 34346 - DNA, 15 bp, Homo sapiens
acgttacagtgtcca

SEQ ID NO: 34347 - DNA, 15 bp, Homo sapiens
cacgttacagtgtcc

SEQ ID NO: 34348 - DNA, 15 bp, Homo sapiens
acacgttacagtgtc

SEQ ID NO: 34349 - DNA, 15 bp, Homo sapiens
cacacgttacagtgt

SEQ ID NO: 34350 - DNA, 15 bp, Homo sapiens
gcacacgttacagtg

SEQ ID NO: 34351 - DNA, 15 bp, Homo sapiens
agcacacgttacagt

SEQ ID NO: 34352 - DNA, 15 bp, Homo sapiens
cagcacacgttacag

SEQ ID NO: 34353 - DNA, 15 bp, Homo sapiens
acagcacacgttaca

SEQ ID NO: 34354 - DNA, 15 bp, Homo sapiens
cacagcacacgttac

SEQ ID NO: 34355 - DNA, 15 bp, Homo sapiens
acacagcacacgtta

SEQ ID NO: 34356 - DNA, 15 bp, Homo sapiens
aacacagcacacgtt

SEQ ID NO: 34357 - DNA, 15 bp, Homo sapiens
aaacacagcacacgt

SEQ ID NO: 34358 - DNA, 15 bp, Homo sapiens
caaacacagcacacg

SEQ ID NO: 34359 - DNA, 15 bp, Homo sapiens
gcaaacacagcacac

SEQ ID NO: 34360 - DNA, 15 bp, Homo sapiens
agcaaacacagcaca

SEQ ID NO: 34361 - DNA, 15 bp, Homo sapiens
gagcaaacacagcac

SEQ ID NO: 34362 - DNA, 15 bp, Homo sapiens
ggagcaaacacagca

SEQ ID NO: 34363 - DNA, 15 bp, Homo sapiens
gggagcaaacacagc

SEQ ID NO: 34364 - DNA, 15 bp, Homo sapiens
ggggagcaaacacag

SEQ ID NO: 34365 - DNA, 15 bp, Homo sapiens
aggggagcaaacaca

SEQ ID NO: 34366 - DNA, 15 bp, Homo sapiens
aaggggagcaaacac

SEQ ID NO: 34367 - DNA, 15 bp, Homo sapiens
gaaggggagcaaaca

SEQ ID NO: 34368 - DNA, 15 bp, Homo sapiens
ggaaggggagcaaac

SEQ ID NO: 34369 - DNA, 15 bp, Homo sapiens
gggaaggggagcaaa

SEQ ID NO: 34370 - DNA, 15 bp, Homo sapiens
ggggaaggggagcaa

SEQ ID NO: 34371 - DNA, 15 bp, Homo sapiens
aggggaaggggagca

SEQ ID NO: 34372 - DNA, 15 bp, Homo sapiens
aaggggaaggggagc

SEQ ID NO: 34373 - DNA, 15 bp, Homo sapiens
gaaggggaaggggag

SEQ ID NO: 34374 - DNA, 15 bp, Homo sapiens
ggaaggggaagggga

SEQ ID NO: 34375 - DNA, 15 bp, Homo sapiens
aggaaggggaagggg

SEQ ID NO: 34376 - DNA, 15 bp, Homo sapiens
aaggaaggggaaggg

SEQ ID NO: 34377 - DNA, 15 bp, Homo sapiens
gaaggaaggggaagg

SEQ ID NO: 34378 - DNA, 15 bp, Homo sapiens
agaaggaaggggaag

SEQ ID NO: 34379 - DNA, 15 bp, Homo sapiens
aagaaggaaggggaa

SEQ ID NO: 34380 - DNA, 15 bp, Homo sapiens
aaagaaggaagggga

SEQ ID NO: 34381 - DNA, 15 bp, Homo sapiens
caaagaaggaagggg

SEQ ID NO: 34382 - DNA, 15 bp, Homo sapiens
gcaaagaaggaaggg

SEQ ID NO: 34383 - DNA, 15 bp, Homo sapiens
ggcaaagaaggaagg

SEQ ID NO: 34384 - DNA, 15 bp, Homo sapiens
gggcaaagaaggaag

SEQ ID NO: 34385 - DNA, 15 bp, Homo sapiens
agggcaaagaaggaa

SEQ ID NO: 34386 - DNA, 15 bp, Homo sapiens
aagggcaaagaagga

SEQ ID NO: 34387 - DNA, 15 bp, Homo sapiens
aaagggcaaagaagg

SEQ ID NO: 34388 - DNA, 15 bp, Homo sapiens
taaagggcaaagaag

SEQ ID NO: 34389 - DNA, 15 bp, Homo sapiens
gtaaagggcaaagaa

SEQ ID NO: 34390 - DNA, 15 bp, Homo sapiens
agtaaagggcaaaga

SEQ ID NO: 34391 - DNA, 15 bp, Homo sapiens
aagtaaagggcaaag

SEQ ID NO: 34392 - DNA, 15 bp, Homo sapiens
caagtaaagggcaaa

SEQ ID NO: 34393 - DNA, 15 bp, Homo sapiens
acaagtaaagggcaa

SEQ ID NO: 34394 - DNA, 15 bp, Homo sapiens
gacaagtaaagggca

SEQ ID NO: 34395 - DNA, 15 bp, Homo sapiens
agacaagtaaagggc

SEQ ID NO: 34396 - DNA, 15 bp, Homo sapiens
aagacaagtaaaggg

SEQ ID NO: 34397 - DNA, 15 bp, Homo sapiens
aaagacaagtaaagg

SEQ ID NO: 34398 - DNA, 15 bp, Homo sapiens
gaaagacaagtaaag

SEQ ID NO: 34399 - DNA, 15 bp, Homo sapiens
agaaagacaagtaaa

SEQ ID NO: 34400 - DNA, 15 bp, Homo sapiens
cagaaagacaagtaa

SEQ ID NO: 34401 - DNA, 15 bp, Homo sapiens
ccagaaagacaagta

SEQ ID NO: 34402 - DNA, 15 bp, Homo sapiens
cccagaaagacaagt

SEQ ID NO: 34403 - DNA, 15 bp, Homo sapiens
ccccagaaagacaag

SEQ ID NO: 34404 - DNA, 15 bp, Homo sapiens
accccagaaagacaa

SEQ ID NO: 34405 - DNA, 15 bp, Homo sapiens
aaccccagaaagaca

SEQ ID NO: 34406 - DNA, 15 bp, Homo sapiens
aaaccccagaaagac

SEQ ID NO: 34407 - DNA, 15 bp, Homo sapiens
aaaaccccagaaaga

SEQ ID NO: 34408 - DNA, 15 bp, Homo sapiens
aaaaaccccagaaag

SEQ ID NO: 34409 - DNA, 15 bp, Homo sapiens
gaaaaaccccagaaa

SEQ ID NO: 34410 - DNA, 15 bp, Homo sapiens
agaaaaaccccagaa

SEQ ID NO: 34411 - DNA, 15 bp, Homo sapiens
cagaaaaaccccaga

SEQ ID NO: 34412 - DNA, 15 bp, Homo sapiens
acagaaaaaccccag

SEQ ID NO: 34413 - DNA, 15 bp, Homo sapiens
aacagaaaaacccca

SEQ ID NO: 34414 - DNA, 15 bp, Homo sapiens
aaacagaaaaacccc

SEQ ID NO: 34415 - DNA, 15 bp, Homo sapiens
caaacagaaaaaccc

SEQ ID NO: 34416 - DNA, 15 bp, Homo sapiens
ccaaacagaaaaacc

SEQ ID NO: 34417 - DNA, 15 bp, Homo sapiens
cccaaacagaaaaac

SEQ ID NO: 34418 - DNA, 15 bp, Homo sapiens
acccaaacagaaaaa

SEQ ID NO: 34419 - DNA, 15 bp, Homo sapiens
aacccaaacagaaaa

SEQ ID NO: 34420 - DNA, 15 bp, Homo sapiens
aaacccaaacagaaa

SEQ ID NO: 34421 - DNA, 15 bp, Homo sapiens
caaacccaaacagaa

SEQ ID NO: 34422 - DNA, 15 bp, Homo sapiens
ccaaacccaaacaga

SEQ ID NO: 34423 - DNA, 15 bp, Homo sapiens
accaaacccaaacag

SEQ ID NO: 34424 - DNA, 15 bp, Homo sapiens
aaccaaacccaaaca

SEQ ID NO: 34425 - DNA, 15 bp, Homo sapiens
aaaccaaacccaaac

SEQ ID NO: 34426 - DNA, 15 bp, Homo sapiens
caaaccaaacccaaa

SEQ ID NO: 34427 - DNA, 15 bp, Homo sapiens
ccaaaccaaacccaa

SEQ ID NO: 34428 - DNA, 15 bp, Homo sapiens
accaaaccaaaccca

SEQ ID NO: 34429 - DNA, 15 bp, Homo sapiens
aaccaaaccaaaccc

SEQ ID NO: 34430 - DNA, 15 bp, Homo sapiens
aaaccaaaccaaacc

SEQ ID NO: 34431 - DNA, 15 bp, Homo sapiens
aaaaccaaaccaaac

SEQ ID NO: 34432 - DNA, 15 bp, Homo sapiens
aaaaaccaaaccaaa

SEQ ID NO: 34433 - DNA, 15 bp, Homo sapiens
taaaaaccaaaccaa

SEQ ID NO: 34434 - DNA, 15 bp, Homo sapiens
ataaaaaccaaacca

SEQ ID NO: 34435 - DNA, 15 bp, Homo sapiens
aataaaaaccaaacc

SEQ ID NO: 34436 - DNA, 15 bp, Homo sapiens
aaataaaaaccaaac

SEQ ID NO: 34437 - DNA, 15 bp, Homo sapiens
gaaataaaaaccaaa

SEQ ID NO: 34438 - DNA, 15 bp, Homo sapiens
agaaataaaaaccaa

SEQ ID NO: 34439 - DNA, 15 bp, Homo sapiens
gagaaataaaaacca

SEQ ID NO: 34440 - DNA, 15 bp, Homo sapiens
ggagaaataaaaacc

SEQ ID NO: 34441 - DNA, 15 bp, Homo sapiens
aggagaaataaaaac

SEQ ID NO: 34442 - DNA, 15 bp, Homo sapiens
aaggagaaataaaaa

SEQ ID NO: 34443 - DNA, 15 bp, Homo sapiens
aaaggagaaataaaa

SEQ ID NO: 34444 - DNA, 15 bp, Homo sapiens
aaaaggagaaataaa

SEQ ID NO: 34445 - DNA, 15 bp, Homo sapiens
caaaaggagaaataa

SEQ ID NO: 34446 - DNA, 15 bp, Homo sapiens
acaaaaggagaaata

SEQ ID NO: 34447 - DNA, 15 bp, Homo sapiens
cacaaaaggagaaat

SEQ ID NO: 34448 - DNA, 15 bp, Homo sapiens
acacaaaaggagaaa

SEQ ID NO: 34449 - DNA, 15 bp, Homo sapiens
aacacaaaaggagaa

SEQ ID NO: 34450 - DNA, 15 bp, Homo sapiens
gaacacaaaaggaga

SEQ ID NO: 34451 - DNA, 15 bp, Homo sapiens
ggaacacaaaaggag

SEQ ID NO: 34452 - DNA, 15 bp, Homo sapiens
tggaacacaaaagga

SEQ ID NO: 34453 - DNA, 15 bp, Homo sapiens
ttggaacacaaaagg

SEQ ID NO: 34454 - DNA, 15 bp, Homo sapiens
tttggaacacaaaag

SEQ ID NO: 34455 - DNA, 15 bp, Homo sapiens
gtttggaacacaaaa

SEQ ID NO: 34456 - DNA, 15 bp, Homo sapiens
tgtttggaacacaaa

SEQ ID NO: 34457 - DNA, 15 bp, Homo sapiens
atgtttggaacacaa

SEQ ID NO: 34458 - DNA, 15 bp, Homo sapiens
catgtttggaacaca

SEQ ID NO: 34459 - DNA, 15 bp, Homo sapiens
tcatgtttggaacac

SEQ ID NO: 34460 - DNA, 15 bp, Homo sapiens
ctcatgtttggaaca

SEQ ID NO: 34461 - DNA, 15 bp, Homo sapiens
cctcatgtttggaac

SEQ ID NO: 34462 - DNA, 15 bp, Homo sapiens
acctcatgtttggaa

SEQ ID NO: 34463 - DNA, 15 bp, Homo sapiens
aacctcatgtttgga

SEQ ID NO: 34464 - DNA, 15 bp, Homo sapiens
gaacctcatgtttgg

SEQ ID NO: 34465 - DNA, 15 bp, Homo sapiens
agaacctcatgtttg

SEQ ID NO: 34466 - DNA, 15 bp, Homo sapiens
gagaacctcatgttt

SEQ ID NO: 34467 - DNA, 15 bp, Homo sapiens
agagaacctcatgtt

SEQ ID NO: 34468 - DNA, 15 bp, Homo sapiens
gagagaacctcatgt

SEQ ID NO: 34469 - DNA, 15 bp, Homo sapiens
agagagaacctcatg

SEQ ID NO: 34470 - DNA, 15 bp, Homo sapiens
tagagagaacctcat

SEQ ID NO: 34471 - DNA, 15 bp, Homo sapiens
gtagagagaacctca

SEQ ID NO: 34472 - DNA, 15 bp, Homo sapiens
agtagagagaacctc

SEQ ID NO: 34473 - DNA, 15 bp, Homo sapiens
cagtagagagaacct

SEQ ID NO: 34474 - DNA, 15 bp, Homo sapiens
ccagtagagagaacc

SEQ ID NO: 34475 - DNA, 15 bp, Homo sapiens
accagtagagagaac

SEQ ID NO: 34476 - DNA, 15 bp, Homo sapiens
gaccagtagagagaa

SEQ ID NO: 34477 - DNA, 15 bp, Homo sapiens
ggaccagtagagaga

SEQ ID NO: 34478 - DNA, 15 bp, Homo sapiens
aggaccagtagagag

SEQ ID NO: 34479 - DNA, 15 bp, Homo sapiens
gaggaccagtagaga

SEQ ID NO: 34480 - DNA, 15 bp, Homo sapiens
agaggaccagtagag

SEQ ID NO: 34481 - DNA, 15 bp, Homo sapiens
aagaggaccagtaga

SEQ ID NO: 34482 - DNA, 15 bp, Homo sapiens
taagaggaccagtag

SEQ ID NO: 34483 - DNA, 15 bp, Homo sapiens
ttaagaggaccagta

SEQ ID NO: 34484 - DNA, 15 bp, Homo sapiens
gttaagaggaccagt

SEQ ID NO: 34485 - DNA, 15 bp, Homo sapiens
agttaagaggaccag

SEQ ID NO: 34486 - DNA, 15 bp, Homo sapiens
cagttaagaggacca

SEQ ID NO: 34487 - DNA, 15 bp, Homo sapiens
acagttaagaggacc

SEQ ID NO: 34488 - DNA, 15 bp, Homo sapiens
cacagttaagaggac

SEQ ID NO: 34489 - DNA, 15 bp, Homo sapiens
ccacagttaagagga

SEQ ID NO: 34490 - DNA, 15 bp, Homo sapiens
accacagttaagagg

SEQ ID NO: 34491 - DNA, 15 bp, Homo sapiens
caccacagttaagag

SEQ ID NO: 34492 - DNA, 15 bp, Homo sapiens
acaccacagttaaga

SEQ ID NO: 34493 - DNA, 15 bp, Homo sapiens
aacaccacagttaag

SEQ ID NO: 34494 - DNA, 15 bp, Homo sapiens
caacaccacagttaa

SEQ ID NO: 34495 - DNA, 15 bp, Homo sapiens
tcaacaccacagtta

SEQ ID NO: 34496 - DNA, 15 bp, Homo sapiens
ctcaacaccacagtt

SEQ ID NO: 34497 - DNA, 15 bp, Homo sapiens
cctcaacaccacagt

SEQ ID NO: 34498 - DNA, 15 bp, Homo sapiens
gcctcaacaccacag

SEQ ID NO: 34499 - DNA, 15 bp, Homo sapiens
agcctcaacaccaca

SEQ ID NO: 34500 - DNA, 15 bp, Homo sapiens
aagcctcaacaccac

SEQ ID NO: 34501 - DNA, 15 bp, Homo sapiens
taagcctcaacacca

SEQ ID NO: 34502 - DNA, 15 bp, Homo sapiens
ataagcctcaacacc

SEQ ID NO: 34503 - DNA, 15 bp, Homo sapiens
tataagcctcaacac

SEQ ID NO: 34504 - DNA, 15 bp, Homo sapiens
atataagcctcaaca

SEQ ID NO: 34505 - DNA, 15 bp, Homo sapiens
aatataagcctcaac

SEQ ID NO: 34506 - DNA, 15 bp, Homo sapiens
aaatataagcctcaa

SEQ ID NO: 34507 - DNA, 15 bp, Homo sapiens
caaatataagcctca

SEQ ID NO: 34508 - DNA, 15 bp, Homo sapiens
acaaatataagcctc

SEQ ID NO: 34509 - DNA, 15 bp, Homo sapiens
cacaaatataagcct

SEQ ID NO: 34510 - DNA, 15 bp, Homo sapiens
acacaaatataagcc

SEQ ID NO: 34511 - DNA, 15 bp, Homo sapiens
tacacaaatataagc

SEQ ID NO: 34512 - DNA, 15 bp, Homo sapiens
ttacacaaatataag

SEQ ID NO: 34513 - DNA, 15 bp, Homo sapiens
attacacaaatataa

SEQ ID NO: 34514 - DNA, 15 bp, Homo sapiens
aattacacaaatata

SEQ ID NO: 34515 - DNA, 15 bp, Homo sapiens
aaattacacaaatat

SEQ ID NO: 34516 - DNA, 15 bp, Homo sapiens
aaaattacacaaata

SEQ ID NO: 34517 - DNA, 15 bp, Homo sapiens
aaaaattacacaaat

SEQ ID NO: 34518 - DNA, 15 bp, Homo sapiens
caaaaattacacaaa

SEQ ID NO: 34519 - DNA, 15 bp, Homo sapiens
ccaaaaattacacaa

SEQ ID NO: 34520 - DNA, 15 bp, Homo sapiens
accaaaaattacaca

SEQ ID NO: 34521 - DNA, 15 bp, Homo sapiens
caccaaaaattacac

SEQ ID NO: 34522 - DNA, 15 bp, Homo sapiens
ccaccaaaaattaca

SEQ ID NO: 34523 - DNA, 15 bp, Homo sapiens
cccaccaaaaattac

SEQ ID NO: 34524 - DNA, 15 bp, Homo sapiens
acccaccaaaaatta

SEQ ID NO: 34525 - DNA, 15 bp, Homo sapiens
cacccaccaaaaatt

SEQ ID NO: 34526 - DNA, 15 bp, Homo sapiens
tcacccaccaaaaat

SEQ ID NO: 34527 - DNA, 15 bp, Homo sapiens
ttcacccaccaaaaa

SEQ ID NO: 34528 - DNA, 15 bp, Homo sapiens
tttcacccaccaaaa

SEQ ID NO: 34529 - DNA, 15 bp, Homo sapiens
ctttcacccaccaaa

SEQ ID NO: 34530 - DNA, 15 bp, Homo sapiens
cctttcacccaccaa

SEQ ID NO: 34531 - DNA, 15 bp, Homo sapiens
tcctttcacccacca

SEQ ID NO: 34532 - DNA, 15 bp, Homo sapiens
ttcctttcacccacc

SEQ ID NO: 34533 - DNA, 15 bp, Homo sapiens
attcctttcacccac

SEQ ID NO: 34534 - DNA, 15 bp, Homo sapiens
aattcctttcaccca

SEQ ID NO: 34535 - DNA, 15 bp, Homo sapiens
aaattcctttcaccc

SEQ ID NO: 34536 - DNA, 15 bp, Homo sapiens
aaaattcctttcacc

SEQ ID NO: 34537 - DNA, 15 bp, Homo sapiens
caaaattcctttcac

SEQ ID NO: 34538 - DNA, 15 bp, Homo sapiens
gcaaaattcctttca

SEQ ID NO: 34539 - DNA, 15 bp, Homo sapiens
agcaaaattcctttc

SEQ ID NO: 34540 - DNA, 15 bp, Homo sapiens
tagcaaaattccttt

SEQ ID NO: 34541 - DNA, 15 bp, Homo sapiens
ttagcaaaattcctt

SEQ ID NO: 34542 - DNA, 15 bp, Homo sapiens
cttagcaaaattcct

SEQ ID NO: 34543 - DNA, 15 bp, Homo sapiens
acttagcaaaattcc

SEQ ID NO: 34544 - DNA, 15 bp, Homo sapiens
tacttagcaaaattc

SEQ ID NO: 34545 - DNA, 15 bp, Homo sapiens
ttacttagcaaaatt

SEQ ID NO: 34546 - DNA, 15 bp, Homo sapiens
tttacttagcaaaat

SEQ ID NO: 34547 - DNA, 15 bp, Homo sapiens
atttacttagcaaaa

SEQ ID NO: 34548 - DNA, 15 bp, Homo sapiens
gatttacttagcaaa

SEQ ID NO: 34549 - DNA, 15 bp, Homo sapiens
agatttacttagcaa

SEQ ID NO: 34550 - DNA, 15 bp, Homo sapiens
gagatttacttagca

SEQ ID NO: 34551 - DNA, 15 bp, Homo sapiens
agagatttacttagc

SEQ ID NO: 34552 - DNA, 15 bp, Homo sapiens
aagagatttacttag

SEQ ID NO: 34553 - DNA, 15 bp, Homo sapiens
gaagagatttactta

SEQ ID NO: 34554 - DNA, 15 bp, Homo sapiens
agaagagatttactt

SEQ ID NO: 34555 - DNA, 15 bp, Homo sapiens
cagaagagatttact

SEQ ID NO: 34556 - DNA, 15 bp, Homo sapiens
acagaagagatttac

SEQ ID NO: 34557 - DNA, 15 bp, Homo sapiens
cacagaagagattta

SEQ ID NO: 34558 - DNA, 15 bp, Homo sapiens
acacagaagagattt

SEQ ID NO: 34559 - DNA, 15 bp, Homo sapiens
aacacagaagagatt

SEQ ID NO: 34560 - DNA, 15 bp, Homo sapiens
aaacacagaagagat

SEQ ID NO: 34561 - DNA, 15 bp, Homo sapiens
caaacacagaagaga

SEQ ID NO: 34562 - DNA, 15 bp, Homo sapiens
tcaaacacagaagag

SEQ ID NO: 34563 - DNA, 15 bp, Homo sapiens
ttcaaacacagaaga

SEQ ID NO: 34564 - DNA, 15 bp, Homo sapiens
gttcaaacacagaag

SEQ ID NO: 34565 - DNA, 15 bp, Homo sapiens
agttcaaacacagaa

SEQ ID NO: 34566 - DNA, 15 bp, Homo sapiens
cagttcaaacacaga

SEQ ID NO: 34567 - DNA, 15 bp, Homo sapiens
tcagttcaaacacag

SEQ ID NO: 34568 - DNA, 15 bp, Homo sapiens
ttcagttcaaacaca

SEQ ID NO: 34569 - DNA, 15 bp, Homo sapiens
cttcagttcaaacac

SEQ ID NO: 34570 - DNA, 15 bp, Homo sapiens
acttcagttcaaaca

SEQ ID NO: 34571 - DNA, 15 bp, Homo sapiens
gacttcagttcaaac

SEQ ID NO: 34572 - DNA, 15 bp, Homo sapiens
agacttcagttcaaa

SEQ ID NO: 34573 - DNA, 15 bp, Homo sapiens
cagacttcagttcaa

SEQ ID NO: 34574 - DNA, 15 bp, Homo sapiens
acagacttcagttca

SEQ ID NO: 34575 - DNA, 15 bp, Homo sapiens
tacagacttcagttc

SEQ ID NO: 34576 - DNA, 15 bp, Homo sapiens
atacagacttcagtt

SEQ ID NO: 34577 - DNA, 15 bp, Homo sapiens
aatacagacttcagt

SEQ ID NO: 34578 - DNA, 15 bp, Homo sapiens
caatacagacttcag

SEQ ID NO: 34579 - DNA, 15 bp, Homo sapiens
acaatacagacttca

SEQ ID NO: 34580 - DNA, 15 bp, Homo sapiens
tacaatacagacttc

SEQ ID NO: 34581 - DNA, 15 bp, Homo sapiens
ttacaatacagactt

SEQ ID NO: 34582 - DNA, 15 bp, Homo sapiens
gttacaatacagact

SEQ ID NO: 34583 - DNA, 15 bp, Homo sapiens
agttacaatacagac

SEQ ID NO: 34584 - DNA, 15 bp, Homo sapiens
tagttacaatacaga

SEQ ID NO: 34585 - DNA, 15 bp, Homo sapiens
atagttacaatacag

SEQ ID NO: 34586 - DNA, 15 bp, Homo sapiens
catagttacaataca

SEQ ID NO: 34587 - DNA, 15 bp, Homo sapiens
acatagttacaatac

SEQ ID NO: 34588 - DNA, 15 bp, Homo sapiens
aacatagttacaata

SEQ ID NO: 34589 - DNA, 15 bp, Homo sapiens
aaacatagttacaat

SEQ ID NO: 34590 - DNA, 15 bp, Homo sapiens
taaacatagttacaa

SEQ ID NO: 34591 - DNA, 15 bp, Homo sapiens
ttaaacatagttaca

SEQ ID NO: 34592 - DNA, 15 bp, Homo sapiens
tttaaacatagttac

SEQ ID NO: 34593 - DNA, 15 bp, Homo sapiens
ctttaaacatagtta

SEQ ID NO: 34594 - DNA, 15 bp, Homo sapiens
actttaaacatagtt

SEQ ID NO: 34595 - DNA, 15 bp, Homo sapiens
tactttaaacatagt

SEQ ID NO: 34596 - DNA, 15 bp, Homo sapiens
ttactttaaacatag

SEQ ID NO: 34597 - DNA, 15 bp, Homo sapiens
attactttaaacata

SEQ ID NO: 34598 - DNA, 15 bp, Homo sapiens
aattactttaaacat

SEQ ID NO: 34599 - DNA, 15 bp, Homo sapiens
caattactttaaaca

SEQ ID NO: 34600 - DNA, 15 bp, Homo sapiens
acaattactttaaac

SEQ ID NO: 34601 - DNA, 15 bp, Homo sapiens
aacaattactttaaa

SEQ ID NO: 34602 - DNA, 15 bp, Homo sapiens
gaacaattactttaa

SEQ ID NO: 34603 - DNA, 15 bp, Homo sapiens
ggaacaattacttta

SEQ ID NO: 34604 - DNA, 15 bp, Homo sapiens
tggaacaattacttt

SEQ ID NO: 34605 - DNA, 15 bp, Homo sapiens
ctggaacaattactt

SEQ ID NO: 34606 - DNA, 15 bp, Homo sapiens
tctggaacaattact

SEQ ID NO: 34607 - DNA, 15 bp, Homo sapiens
ctctggaacaattac

SEQ ID NO: 34608 - DNA, 15 bp, Homo sapiens
tctctggaacaatta

SEQ ID NO: 34609 - DNA, 15 bp, Homo sapiens
gtctctggaacaatt

SEQ ID NO: 34610 - DNA, 15 bp, Homo sapiens
tgtctctggaacaat

SEQ ID NO: 34611 - DNA, 15 bp, Homo sapiens
ttgtctctggaacaa

SEQ ID NO: 34612 - DNA, 15 bp, Homo sapiens
tttgtctctggaaca

SEQ ID NO: 34613 - DNA, 15 bp, Homo sapiens
atttgtctctggaac

SEQ ID NO: 34614 - DNA, 15 bp, Homo sapiens
tatttgtctctggaa

SEQ ID NO: 34615 - DNA, 15 bp, Homo sapiens
atatttgtctctgga

SEQ ID NO: 34616 - DNA, 15 bp, Homo sapiens
aatatttgtctctgg

SEQ ID NO: 34617 - DNA, 15 bp, Homo sapiens
aaatatttgtctctg

SEQ ID NO: 34618 - DNA, 15 bp, Homo sapiens
gaaatatttgtctct

SEQ ID NO: 34619 - DNA, 15 bp, Homo sapiens
agaaatatttgtctc

SEQ ID NO: 34620 - DNA, 15 bp, Homo sapiens
tagaaatatttgtct

SEQ ID NO: 34621 - DNA, 15 bp, Homo sapiens
ctagaaatatttgtc

SEQ ID NO: 34622 - DNA, 15 bp, Homo sapiens
tctagaaatatttgt

SEQ ID NO: 34623 - DNA, 15 bp, Homo sapiens
gtctagaaatatttg

SEQ ID NO: 34624 - DNA, 15 bp, Homo sapiens
tgtctagaaatattt

SEQ ID NO: 34625 - DNA, 15 bp, Homo sapiens
gtgtctagaaatatt

SEQ ID NO: 34626 - DNA, 15 bp, Homo sapiens
agtgtctagaaatat

SEQ ID NO: 34627 - DNA, 15 bp, Homo sapiens
aagtgtctagaaata

SEQ ID NO: 34628 - DNA, 15 bp, Homo sapiens
aaagtgtctagaaat

SEQ ID NO: 34629 - DNA, 15 bp, Homo sapiens
aaaagtgtctagaaa

SEQ ID NO: 34630 - DNA, 15 bp, Homo sapiens
aaaaagtgtctagaa

SEQ ID NO: 34631 - DNA, 15 bp, Homo sapiens
gaaaaagtgtctaga

SEQ ID NO: 34632 - DNA, 15 bp, Homo sapiens
agaaaaagtgtctag

SEQ ID NO: 34633 - DNA, 15 bp, Homo sapiens
aagaaaaagtgtcta

SEQ ID NO: 34634 - DNA, 15 bp, Homo sapiens
aaagaaaaagtgtct

SEQ ID NO: 34635 - DNA, 15 bp, Homo sapiens
taaagaaaaagtgtc

SEQ ID NO: 34636 - DNA, 15 bp, Homo sapiens
gtaaagaaaaagtgt

SEQ ID NO: 34637 - DNA, 15 bp, Homo sapiens
tgtaaagaaaaagtg

SEQ ID NO: 34638 - DNA, 15 bp, Homo sapiens
ttgtaaagaaaaagt

SEQ ID NO: 34639 - DNA, 15 bp, Homo sapiens
tttgtaaagaaaaag

SEQ ID NO: 34640 - DNA, 15 bp, Homo sapiens
gtttgtaaagaaaaa

SEQ ID NO: 34641 - DNA, 15 bp, Homo sapiens
tgtttgtaaagaaaa

SEQ ID NO: 34642 - DNA, 15 bp, Homo sapiens
ttgtttgtaaagaaa

SEQ ID NO: 34643 - DNA, 15 bp, Homo sapiens
tttgtttgtaaagaa

SEQ ID NO: 34644 - DNA, 15 bp, Homo sapiens
ttttgtttgtaaaga

SEQ ID NO: 34645 - DNA, 15 bp, Homo sapiens
cttttgtttgtaaag

SEQ ID NO: 34646 - DNA, 15 bp, Homo sapiens
gcttttgtttgtaaa

SEQ ID NO: 34647 - DNA, 15 bp, Homo sapiens
tgcttttgtttgtaa

SEQ ID NO: 34648 - DNA, 15 bp, Homo sapiens
atgcttttgtttgta

SEQ ID NO: 34649 - DNA, 15 bp, Homo sapiens
aatgcttttgtttgt

SEQ ID NO: 34650 - DNA, 15 bp, Homo sapiens
gaatgcttttgtttg

SEQ ID NO: 34651 - DNA, 15 bp, Homo sapiens
cgaatgcttttgttt

SEQ ID NO: 34652 - DNA, 15 bp, Homo sapiens
ccgaatgcttttgtt

SEQ ID NO: 34653 - DNA, 15 bp, Homo sapiens
tccgaatgcttttgt

SEQ ID NO: 34654 - DNA, 15 bp, Homo sapiens
ctccgaatgcttttg

SEQ ID NO: 34655 - DNA, 15 bp, Homo sapiens
cctccgaatgctttt

SEQ ID NO: 34656 - DNA, 15 bp, Homo sapiens
ccctccgaatgcttt

SEQ ID NO: 34657 - DNA, 15 bp, Homo sapiens
tccctccgaatgctt

SEQ ID NO: 34658 - DNA, 15 bp, Homo sapiens
ctccctccgaatgct

SEQ ID NO: 34659 - DNA, 15 bp, Homo sapiens
cctccctccgaatgc

SEQ ID NO: 34660 - DNA, 15 bp, Homo sapiens
ccctccctccgaatg

SEQ ID NO: 34661 - DNA, 15 bp, Homo sapiens
cccctccctccgaat

SEQ ID NO: 34662 - DNA, 15 bp, Homo sapiens
ccccctccctccgaa

SEQ ID NO: 34663 - DNA, 15 bp, Homo sapiens
atccccctccctccg

SEQ ID NO: 34664 - DNA, 15 bp, Homo sapiens
catccccctccctcc

SEQ ID NO: 34665 - DNA, 15 bp, Homo sapiens
ccatccccctccctc

SEQ ID NO: 34666 - DNA, 15 bp, Homo sapiens
accatccccctccct

SEQ ID NO: 34667 - DNA, 15 bp, Homo sapiens
caccatccccctccc

SEQ ID NO: 34668 - DNA, 15 bp, Homo sapiens
tcaccatccccctcc

SEQ ID NO: 34669 - DNA, 15 bp, Homo sapiens
gtcaccatccccctc

SEQ ID NO: 34670 - DNA, 15 bp, Homo sapiens
agtcaccatccccct

SEQ ID NO: 34671 - DNA, 15 bp, Homo sapiens
cagtcaccatccccc

SEQ ID NO: 34672 - DNA, 15 bp, Homo sapiens
tcagtcaccatcccc

SEQ ID NO: 34673 - DNA, 15 bp, Homo sapiens
ctcagtcaccatccc

SEQ ID NO: 34674 - DNA, 15 bp, Homo sapiens
tctcagtcaccatcc

SEQ ID NO: 34675 - DNA, 15 bp, Homo sapiens
atctcagtcaccatc

SEQ ID NO: 34676 - DNA, 15 bp, Homo sapiens
catctcagtcaccat

SEQ ID NO: 34677 - DNA, 15 bp, Homo sapiens
tcatctcagtcacca

SEQ ID NO: 34678 - DNA, 15 bp, Homo sapiens
ctcatctcagtcacc

SEQ ID NO: 34679 - DNA, 15 bp, Homo sapiens
tctcatctcagtcac

SEQ ID NO: 34680 - DNA, 15 bp, Homo sapiens
ctctcatctcagtca

SEQ ID NO: 34681 - DNA, 15 bp, Homo sapiens
cctctcatctcagtc

SEQ ID NO: 34682 - DNA, 15 bp, Homo sapiens
ccctctcatctcagt

SEQ ID NO: 34683 - DNA, 15 bp, Homo sapiens
cccctctcatctcag

SEQ ID NO: 34684 - DNA, 15 bp, Homo sapiens
tcccctctcatctca

SEQ ID NO: 34685 - DNA, 15 bp, Homo sapiens
ctcccctctcatctc

SEQ ID NO: 34686 - DNA, 15 bp, Homo sapiens
tctcccctctcatct

SEQ ID NO: 34687 - DNA, 15 bp, Homo sapiens
ctctcccctctcatc

SEQ ID NO: 34688 - DNA, 15 bp, Homo sapiens
gctctcccctctcat

SEQ ID NO: 34689 - DNA, 15 bp, Homo sapiens
agctctcccctctca

SEQ ID NO: 34690 - DNA, 15 bp, Homo sapiens
cagctctcccctctc

SEQ ID NO: 34691 - DNA, 15 bp, Homo sapiens
tcagctctcccctct

SEQ ID NO: 34692 - DNA, 15 bp, Homo sapiens
ttcagctctcccctc

SEQ ID NO: 34693 - DNA, 15 bp, Homo sapiens
gttcagctctcccct

SEQ ID NO: 34694 - DNA, 15 bp, Homo sapiens
tgttcagctctcccc

SEQ ID NO: 34695 - DNA, 15 bp, Homo sapiens
ctgttcagctctccc

SEQ ID NO: 34696 - DNA, 15 bp, Homo sapiens
tctgttcagctctcc

SEQ ID NO: 34697 - DNA, 15 bp, Homo sapiens
atctgttcagctctc

SEQ ID NO: 34698 - DNA, 15 bp, Homo sapiens
catctgttcagctct

SEQ ID NO: 34699 - DNA, 15 bp, Homo sapiens
tcatctgttcagctc

SEQ ID NO: 34700 - DNA, 15 bp, Homo sapiens
gtcatctgttcagct

SEQ ID NO: 34701 - DNA, 15 bp, Homo sapiens
ggtcatctgttcagc

SEQ ID NO: 34702 - DNA, 15 bp, Homo sapiens
gggtcatctgttcag

SEQ ID NO: 34703 - DNA, 15 bp, Homo sapiens
ggggtcatctgttca

SEQ ID NO: 34704 - DNA, 15 bp, Homo sapiens
aggggtcatctgttc

SEQ ID NO: 34705 - DNA, 15 bp, Homo sapiens
caggggtcatctgtt

SEQ ID NO: 34706 - DNA, 15 bp, Homo sapiens
gcaggggtcatctgt

SEQ ID NO: 34707 - DNA, 15 bp, Homo sapiens
ggcaggggtcatctg

SEQ ID NO: 34708 - DNA, 15 bp, Homo sapiens
gggcaggggtcatct

SEQ ID NO: 34709 - DNA, 15 bp, Homo sapiens
tgggcaggggtcatc

SEQ ID NO: 34710 - DNA, 15 bp, Homo sapiens
ctgggcaggggtcat

SEQ ID NO: 34711 - DNA, 15 bp, Homo sapiens
tctgggcaggggtca

SEQ ID NO: 34712 - DNA, 15 bp, Homo sapiens
atctgggcaggggtc

SEQ ID NO: 34713 - DNA, 15 bp, Homo sapiens
gatctgggcaggggt

SEQ ID NO: 34714 - DNA, 15 bp, Homo sapiens
tgatctgggcagggg

SEQ ID NO: 34715 - DNA, 15 bp, Homo sapiens
ctgatctgggcaggg

SEQ ID NO: 34716 - DNA, 15 bp, Homo sapiens
gctgatctgggcagg

SEQ ID NO: 34717 - DNA, 15 bp, Homo sapiens
ggctgatctgggcag

SEQ ID NO: 34718 - DNA, 15 bp, Homo sapiens
tggctgatctgggca

SEQ ID NO: 34719 - DNA, 15 bp, Homo sapiens
ctggctgatctgggc

SEQ ID NO: 34720 - DNA, 15 bp, Homo sapiens
tctggctgatctggg

SEQ ID NO: 34721 - DNA, 15 bp, Homo sapiens
ttctggctgatctgg

SEQ ID NO: 34722 - DNA, 15 bp, Homo sapiens
cttctggctgatctg

SEQ ID NO: 34723 - DNA, 15 bp, Homo sapiens
gcttctggctgatct

SEQ ID NO: 34724 - DNA, 15 bp, Homo sapiens
ggcttctggctgatc

SEQ ID NO: 34725 - DNA, 15 bp, Homo sapiens
tggcttctggctgat

SEQ ID NO: 34726 - DNA, 15 bp, Homo sapiens
gtggcttctggctga

SEQ ID NO: 34727 - DNA, 15 bp, Homo sapiens
ggtggcttctggctg

SEQ ID NO: 34728 - DNA, 15 bp, Homo sapiens
gggtggcttctggct

SEQ ID NO: 34729 - DNA, 15 bp, Homo sapiens
tgggtggcttctggc

SEQ ID NO: 34730 - DNA, 15 bp, Homo sapiens
ttgggtggcttctgg

SEQ ID NO: 34731 - DNA, 15 bp, Homo sapiens
tttgggtggcttctg

SEQ ID NO: 34732 - DNA, 15 bp, Homo sapiens
ctttgggtggcttct

SEQ ID NO: 34733 - DNA, 15 bp, Homo sapiens
gctttgggtggcttc

SEQ ID NO: 34734 - DNA, 15 bp, Homo sapiens
tgctttgggtggctt

SEQ ID NO: 34735 - DNA, 15 bp, Homo sapiens
ctgctttgggtggct

SEQ ID NO: 34736 - DNA, 15 bp, Homo sapiens
actgctttgggtggc

SEQ ID NO: 34737 - DNA, 15 bp, Homo sapiens
cactgctttgggtgg

SEQ ID NO: 34738 - DNA, 15 bp, Homo sapiens
ccactgctttgggtg

SEQ ID NO: 34739 - DNA, 15 bp, Homo sapiens
tccactgctttgggt

SEQ ID NO: 34740 - DNA, 15 bp, Homo sapiens
ctccactgctttggg

SEQ ID NO: 34741 - DNA, 15 bp, Homo sapiens
gctccactgctttgg

SEQ ID NO: 34742 - DNA, 15 bp, Homo sapiens
ggctccactgctttg

SEQ ID NO: 34743 - DNA, 15 bp, Homo sapiens
gggctccactgcttt

SEQ ID NO: 34744 - DNA, 15 bp, Homo sapiens
tgggctccactgctt

SEQ ID NO: 34745 - DNA, 15 bp, Homo sapiens
ctgggctccactgct

SEQ ID NO: 34746 - DNA, 15 bp, Homo sapiens
cctgggctccactgc

SEQ ID NO: 34747 - DNA, 15 bp, Homo sapiens
tcctgggctccactg

SEQ ID NO: 34748 - DNA, 15 bp, Homo sapiens
ctcctgggctccact

SEQ ID NO: 34749 - DNA, 15 bp, Homo sapiens
actcctgggctccac

SEQ ID NO: 34750 - DNA, 15 bp, Homo sapiens
gactcctgggctcca

SEQ ID NO: 34751 - DNA, 15 bp, Homo sapiens
ggactcctgggctcc

SEQ ID NO: 34752 - DNA, 15 bp, Homo sapiens
gggactcctgggctc

SEQ ID NO: 34753 - DNA, 15 bp, Homo sapiens
tgggactcctgggct

SEQ ID NO: 34754 - DNA, 15 bp, Homo sapiens
gtgggactcctgggc

SEQ ID NO: 34755 - DNA, 15 bp, Homo sapiens
agtgggactcctggg

SEQ ID NO: 34756 - DNA, 15 bp, Homo sapiens
gagtgggactcctgg

SEQ ID NO: 34757 - DNA, 15 bp, Homo sapiens
ggagtgggactcctg

SEQ ID NO: 34758 - DNA, 15 bp, Homo sapiens
tggagtgggactcct

SEQ ID NO: 34759 - DNA, 15 bp, Homo sapiens
ttggagtgggactcc

SEQ ID NO: 34760 - DNA, 15 bp, Homo sapiens
cttggagtgggactc

SEQ ID NO: 34761 - DNA, 15 bp, Homo sapiens
gcttggagtgggact

SEQ ID NO: 34762 - DNA, 15 bp, Homo sapiens
ggcttggagtgggac

SEQ ID NO: 34763 - DNA, 15 bp, Homo sapiens
tggcttggagtggga

SEQ ID NO: 34764 - DNA, 15 bp, Homo sapiens
ctggcttggagtggg

SEQ ID NO: 34765 - DNA, 15 bp, Homo sapiens
gctggcttggagtgg

SEQ ID NO: 34766 - DNA, 15 bp, Homo sapiens
tgctggcttggagtg

SEQ ID NO: 34767 - DNA, 15 bp, Homo sapiens
ttgctggcttggagt

SEQ ID NO: 34768 - DNA, 15 bp, Homo sapiens
cttgctggcttggag

SEQ ID NO: 34769 - DNA, 15 bp, Homo sapiens
gcttgctggcttgga

SEQ ID NO: 34770 - DNA, 15 bp, Homo sapiens
ggcttgctggcttgg

SEQ ID NO: 34771 - DNA, 15 bp, Homo sapiens
cggcttgctggcttg

SEQ ID NO: 34772 - DNA, 15 bp, Homo sapiens
tcggcttgctggctt

SEQ ID NO: 34773 - DNA, 15 bp, Homo sapiens
ttcggcttgctggct

SEQ ID NO: 34774 - DNA, 15 bp, Homo sapiens
attcggcttgctggc

SEQ ID NO: 34775 - DNA, 15 bp, Homo sapiens
tattcggcttgctgg

SEQ ID NO: 34776 - DNA, 15 bp, Homo sapiens
ctattcggcttgctg

SEQ ID NO: 34777 - DNA, 15 bp, Homo sapiens
gctattcggcttgct

SEQ ID NO: 34778 - DNA, 15 bp, Homo sapiens
agctattcggcttgc

SEQ ID NO: 34779 - DNA, 15 bp, Homo sapiens
cagctattcggcttg

SEQ ID NO: 34780 - DNA, 15 bp, Homo sapiens
tcagctattcggctt

SEQ ID NO: 34781 - DNA, 15 bp, Homo sapiens
atcagctattcggct

SEQ ID NO: 34782 - DNA, 15 bp, Homo sapiens
catcagctattcggc

SEQ ID NO: 34783 - DNA, 15 bp, Homo sapiens
acatcagctattcgg

SEQ ID NO: 34784 - DNA, 15 bp, Homo sapiens
cacatcagctattcg

SEQ ID NO: 34785 - DNA, 15 bp, Homo sapiens
acacatcagctattc

SEQ ID NO: 34786 - DNA, 15 bp, Homo sapiens
aacacatcagctatt

SEQ ID NO: 34787 - DNA, 15 bp, Homo sapiens
caacacatcagctat

SEQ ID NO: 34788 - DNA, 15 bp, Homo sapiens
gcaacacatcagcta

SEQ ID NO: 34789 - DNA, 15 bp, Homo sapiens
ggcaacacatcagct

SEQ ID NO: 34790 - DNA, 15 bp, Homo sapiens
tggcaacacatcagc

SEQ ID NO: 34791 - DNA, 15 bp, Homo sapiens
gtggcaacacatcag

SEQ ID NO: 34792 - DNA, 15 bp, Homo sapiens
agtggcaacacatca

SEQ ID NO: 34793 - DNA, 15 bp, Homo sapiens
aagtggcaacacatc

SEQ ID NO: 34794 - DNA, 15 bp, Homo sapiens
aaagtggcaacacat

SEQ ID NO: 34795 - DNA, 15 bp, Homo sapiens
gaaagtggcaacaca

SEQ ID NO: 34796 - DNA, 15 bp, Homo sapiens
ggaaagtggcaacac

SEQ ID NO: 34797 - DNA, 15 bp, Homo sapiens
tggaaagtggcaaca

SEQ ID NO: 34798 - DNA, 15 bp, Homo sapiens
ttggaaagtggcaac

SEQ ID NO: 34799 - DNA, 15 bp, Homo sapiens
cttggaaagtggcaa

SEQ ID NO: 34800 - DNA, 15 bp, Homo sapiens
acttggaaagtggca

SEQ ID NO: 34801 - DNA, 15 bp, Homo sapiens
gacttggaaagtggc

SEQ ID NO: 34802 - DNA, 15 bp, Homo sapiens
tgacttggaaagtgg

SEQ ID NO: 34803 - DNA, 15 bp, Homo sapiens
gtgacttggaaagtg

SEQ ID NO: 34804 - DNA, 15 bp, Homo sapiens
agtgacttggaaagt

SEQ ID NO: 34805 - DNA, 15 bp, Homo sapiens
cagtgacttggaaag

SEQ ID NO: 34806 - DNA, 15 bp, Homo sapiens
gcagtgacttggaaa

SEQ ID NO: 34807 - DNA, 15 bp, Homo sapiens
tgcagtgacttggaa

SEQ ID NO: 34808 - DNA, 15 bp, Homo sapiens
ttgcagtgacttgga

SEQ ID NO: 34809 - DNA, 15 bp, Homo sapiens
tttgcagtgacttgg

SEQ ID NO: 34810 - DNA, 15 bp, Homo sapiens
ttttgcagtgacttg

SEQ ID NO: 34811 - DNA, 15 bp, Homo sapiens
gttttgcagtgactt

SEQ ID NO: 34812 - DNA, 15 bp, Homo sapiens
ggttttgcagtgact

SEQ ID NO: 34813 - DNA, 15 bp, Homo sapiens
tggttttgcagtgac

SEQ ID NO: 34814 - DNA, 15 bp, Homo sapiens
ctggttttgcagtga

SEQ ID NO: 34815 - DNA, 15 bp, Homo sapiens
cctggttttgcagtg

SEQ ID NO: 34816 - DNA, 15 bp, Homo sapiens
acctggttttgcagt

SEQ ID NO: 34817 - DNA, 15 bp, Homo sapiens
aacctggttttgcag

SEQ ID NO: 34818 - DNA, 15 bp, Homo sapiens
aaacctggttttgca

SEQ ID NO: 34819 - DNA, 15 bp, Homo sapiens
aaaacctggttttgc

SEQ ID NO: 34820 - DNA, 15 bp, Homo sapiens
caaaacctggttttg

SEQ ID NO: 34821 - DNA, 15 bp, Homo sapiens
acaaaacctggtttt

SEQ ID NO: 34822 - DNA, 15 bp, Homo sapiens
aacaaaacctggttt

SEQ ID NO: 34823 - DNA, 15 bp, Homo sapiens
gaacaaaacctggtt

SEQ ID NO: 34824 - DNA, 15 bp, Homo sapiens
ggaacaaaacctggt

SEQ ID NO: 34825 - DNA, 15 bp, Homo sapiens
cggaacaaaacctgg

SEQ ID NO: 34826 - DNA, 15 bp, Homo sapiens
gcggaacaaaacctg

SEQ ID NO: 34827 - DNA, 15 bp, Homo sapiens
ggcggaacaaaacct

SEQ ID NO: 34828 - DNA, 15 bp, Homo sapiens
gggcggaacaaaacc

SEQ ID NO: 34829 - DNA, 15 bp, Homo sapiens
tgggcggaacaaaac

SEQ ID NO: 34830 - DNA, 15 bp, Homo sapiens
ctgggcggaacaaaa

SEQ ID NO: 34831 - DNA, 15 bp, Homo sapiens
actgggcggaacaaa

SEQ ID NO: 34832 - DNA, 15 bp, Homo sapiens
cactgggcggaacaa

SEQ ID NO: 34833 - DNA, 15 bp, Homo sapiens
ccactgggcggaaca

SEQ ID NO: 34834 - DNA, 15 bp, Homo sapiens
tccactgggcggaac

SEQ ID NO: 34835 - DNA, 15 bp, Homo sapiens
atccactgggcggaa

SEQ ID NO: 34836 - DNA, 15 bp, Homo sapiens
aatccactgggcgga

SEQ ID NO: 34837 - DNA, 15 bp, Homo sapiens
gaatccactgggcgg

SEQ ID NO: 34838 - DNA, 15 bp, Homo sapiens
agaatccactgggcg

SEQ ID NO: 34839 - DNA, 15 bp, Homo sapiens
aagaatccactgggc

SEQ ID NO: 34840 - DNA, 15 bp, Homo sapiens
caagaatccactggg

SEQ ID NO: 34841 - DNA, 15 bp, Homo sapiens
acaagaatccactgg

SEQ ID NO: 34842 - DNA, 15 bp, Homo sapiens
aacaagaatccactg

SEQ ID NO: 34843 - DNA, 15 bp, Homo sapiens
aaacaagaatccact

SEQ ID NO: 34844 - DNA, 15 bp, Homo sapiens
aaaacaagaatccac

SEQ ID NO: 34845 - DNA, 15 bp, Homo sapiens
caaaacaagaatcca

SEQ ID NO: 34846 - DNA, 15 bp, Homo sapiens
gcaaaacaagaatcc

SEQ ID NO: 34847 - DNA, 15 bp, Homo sapiens
agcaaaacaagaatc

SEQ ID NO: 34848 - DNA, 15 bp, Homo sapiens
aagcaaaacaagaat

SEQ ID NO: 34849 - DNA, 15 bp, Homo sapiens
gaagcaaaacaagaa

SEQ ID NO: 34850 - DNA, 15 bp, Homo sapiens
ggaagcaaaacaaga

SEQ ID NO: 34851 - DNA, 15 bp, Homo sapiens
gggaagcaaaacaag

SEQ ID NO: 34852 - DNA, 15 bp, Homo sapiens
ggggaagcaaaacaa

SEQ ID NO: 34853 - DNA, 15 bp, Homo sapiens
aggggaagcaaaaca

SEQ ID NO: 34854 - DNA, 15 bp, Homo sapiens
gaggggaagcaaaac

SEQ ID NO: 34855 - DNA, 15 bp, Homo sapiens
ggaggggaagcaaaa

SEQ ID NO: 34856 - DNA, 15 bp, Homo sapiens
gggaggggaagcaaa

SEQ ID NO: 34857 - DNA, 15 bp, Homo sapiens
ggggaggggaagcaa

SEQ ID NO: 34858 - DNA, 15 bp, Homo sapiens
gggggaggggaagca

SEQ ID NO: 34859 - DNA, 15 bp, Homo sapiens
ggggggaggggaagc

SEQ ID NO: 34860 - DNA, 15 bp, Homo sapiens
cggggggaggggaag

SEQ ID NO: 34861 - DNA, 15 bp, Homo sapiens
tcggggggaggggaa

SEQ ID NO: 34862 - DNA, 15 bp, Homo sapiens
ctcggggggagggga

SEQ ID NO: 34863 - DNA, 15 bp, Homo sapiens
tctcggggggagggg

SEQ ID NO: 34864 - DNA, 15 bp, Homo sapiens
atctcggggggaggg

SEQ ID NO: 34865 - DNA, 15 bp, Homo sapiens
aatctcggggggagg

SEQ ID NO: 34866 - DNA, 15 bp, Homo sapiens
taatctcggggggag

SEQ ID NO: 34867 - DNA, 15 bp, Homo sapiens
ataatctcgggggga

SEQ ID NO: 34868 - DNA, 15 bp, Homo sapiens
aataatctcgggggg

SEQ ID NO: 34869 - DNA, 15 bp, Homo sapiens
taataatctcggggg

SEQ ID NO: 34870 - DNA, 15 bp, Homo sapiens
gtaataatctcgggg

SEQ ID NO: 34871 - DNA, 15 bp, Homo sapiens
ggtaataatctcggg

SEQ ID NO: 34872 - DNA, 15 bp, Homo sapiens
tggtaataatctcgg

SEQ ID NO: 34873 - DNA, 15 bp, Homo sapiens
gtggtaataatctcg

SEQ ID NO: 34874 - DNA, 15 bp, Homo sapiens
ggtggtaataatctc

SEQ ID NO: 34875 - DNA, 15 bp, Homo sapiens
tggtggtaataatct

SEQ ID NO: 34876 - DNA, 15 bp, Homo sapiens
atggtggtaataatc

SEQ ID NO: 34877 - DNA, 15 bp, Homo sapiens
gatggtggtaataat

SEQ ID NO: 34878 - DNA, 15 bp, Homo sapiens
ggatggtggtaataa

SEQ ID NO: 34879 - DNA, 15 bp, Homo sapiens
gggatggtggtaata

SEQ ID NO: 34880 - DNA, 15 bp, Homo sapiens
cgggatggtggtaat

SEQ ID NO: 34881 - DNA, 15 bp, Homo sapiens
acgggatggtggtaa

SEQ ID NO: 34882 - DNA, 15 bp, Homo sapiens
cacgggatggtggta

SEQ ID NO: 34883 - DNA, 15 bp, Homo sapiens
gcacgggatggtggt

SEQ ID NO: 34884 - DNA, 15 bp, Homo sapiens
agcacgggatggtgg

SEQ ID NO: 34885 - DNA, 15 bp, Homo sapiens
aagcacgggatggtg

SEQ ID NO: 34886 - DNA, 15 bp, Homo sapiens
aaagcacgggatggt

SEQ ID NO: 34887 - DNA, 15 bp, Homo sapiens
aaaagcacgggatgg

SEQ ID NO: 34888 - DNA, 15 bp, Homo sapiens
taaaagcacgggatg

SEQ ID NO: 34889 - DNA, 15 bp, Homo sapiens
ttaaaagcacgggat

SEQ ID NO: 34890 - DNA, 15 bp, Homo sapiens
cttaaaagcacggga

SEQ ID NO: 34891 - DNA, 15 bp, Homo sapiens
ccttaaaagcacggg

SEQ ID NO: 34892 - DNA, 15 bp, Homo sapiens
tccttaaaagcacgg

SEQ ID NO: 34893 - DNA, 15 bp, Homo sapiens
ttccttaaaagcacg

SEQ ID NO: 34894 - DNA, 15 bp, Homo sapiens
tttccttaaaagcac

SEQ ID NO: 34895 - DNA, 15 bp, Homo sapiens
ctttccttaaaagca

SEQ ID NO: 34896 - DNA, 15 bp, Homo sapiens
cctttccttaaaagc

SEQ ID NO: 34897 - DNA, 15 bp, Homo sapiens
gcctttccttaaaag

SEQ ID NO: 34898 - DNA, 15 bp, Homo sapiens
tgcctttccttaaaa

SEQ ID NO: 34899 - DNA, 15 bp, Homo sapiens
ttgcctttccttaaa

SEQ ID NO: 34900 - DNA, 15 bp, Homo sapiens
cttgcctttccttaa

SEQ ID NO: 34901 - DNA, 15 bp, Homo sapiens
tcttgcctttcctta

SEQ ID NO: 34902 - DNA, 15 bp, Homo sapiens
atcttgcctttcctt

SEQ ID NO: 34903 - DNA, 15 bp, Homo sapiens
aatcttgcctttcct

SEQ ID NO: 34904 - DNA, 15 bp, Homo sapiens
caatcttgcctttcc

SEQ ID NO: 34905 - DNA, 15 bp, Homo sapiens
tcaatcttgcctttc

SEQ ID NO: 34906 - DNA, 15 bp, Homo sapiens
atcaatcttgccttt

SEQ ID NO: 34907 - DNA, 15 bp, Homo sapiens
catcaatcttgcctt

SEQ ID NO: 34908 - DNA, 15 bp, Homo sapiens
acatcaatcttgcct

SEQ ID NO: 34909 - DNA, 15 bp, Homo sapiens
aacatcaatcttgcc

SEQ ID NO: 34910 - DNA, 15 bp, Homo sapiens
aaacatcaatcttgc

SEQ ID NO: 34911 - DNA, 15 bp, Homo sapiens
gaaacatcaatcttg

SEQ ID NO: 34912 - DNA, 15 bp, Homo sapiens
ggaaacatcaatctt

SEQ ID NO: 34913 - DNA, 15 bp, Homo sapiens
aggaaacatcaatct

SEQ ID NO: 34914 - DNA, 15 bp, Homo sapiens
aaggaaacatcaatc

SEQ ID NO: 34915 - DNA, 15 bp, Homo sapiens
caaggaaacatcaat

SEQ ID NO: 34916 - DNA, 15 bp, Homo sapiens
tcaaggaaacatcaa

SEQ ID NO: 34917 - DNA, 15 bp, Homo sapiens
ctcaaggaaacatca

SEQ ID NO: 34918 - DNA, 15 bp, Homo sapiens
cctcaaggaaacatc

SEQ ID NO: 34919 - DNA, 15 bp, Homo sapiens
ccctcaaggaaacat

SEQ ID NO: 34920 - DNA, 15 bp, Homo sapiens
cccctcaaggaaaca

SEQ ID NO: 34921 - DNA, 15 bp, Homo sapiens
tcccctcaaggaaac

SEQ ID NO: 34922 - DNA, 15 bp, Homo sapiens
ctcccctcaaggaaa

SEQ ID NO: 34923 - DNA, 15 bp, Homo sapiens
gctcccctcaaggaa

SEQ ID NO: 34924 - DNA, 15 bp, Homo sapiens
ggctcccctcaagga

SEQ ID NO: 34925 - DNA, 15 bp, Homo sapiens
tggctcccctcaagg

SEQ ID NO: 34926 - DNA, 15 bp, Homo sapiens
ctggctcccctcaag

SEQ ID NO: 34927 - DNA, 15 bp, Homo sapiens
cctggctcccctcaa

SEQ ID NO: 34928 - DNA, 15 bp, Homo sapiens
tcctggctcccctca

SEQ ID NO: 34929 - DNA, 15 bp, Homo sapiens
ctcctggctcccctc

SEQ ID NO: 34930 - DNA, 15 bp, Homo sapiens
cctcctggctcccct

SEQ ID NO: 34931 - DNA, 15 bp, Homo sapiens
ccctcctggctcccc

SEQ ID NO: 34932 - DNA, 15 bp, Homo sapiens
cccctcctggctccc

SEQ ID NO: 34933 - DNA, 15 bp, Homo sapiens
tcccctcctggctcc

SEQ ID NO: 34934 - DNA, 15 bp, Homo sapiens
atcccctcctggctc

SEQ ID NO: 34935 - DNA, 15 bp, Homo sapiens
catcccctcctggct

SEQ ID NO: 34936 - DNA, 15 bp, Homo sapiens
acatcccctcctggc

SEQ ID NO: 34937 - DNA, 15 bp, Homo sapiens
cacatcccctcctgg

SEQ ID NO: 34938 - DNA, 15 bp, Homo sapiens
acacatcccctcctg

SEQ ID NO: 34939 - DNA, 15 bp, Homo sapiens
cacacatcccctcct

SEQ ID NO: 34940 - DNA, 15 bp, Homo sapiens
acacacatcccctcc

SEQ ID NO: 34941 - DNA, 15 bp, Homo sapiens
cacacacatcccctc

SEQ ID NO: 34942 - DNA, 15 bp, Homo sapiens
acacacacatcccct

SEQ ID NO: 34943 - DNA, 15 bp, Homo sapiens
cacacacacatcccc

SEQ ID NO: 34944 - DNA, 15 bp, Homo sapiens
gcacacacacatccc

SEQ ID NO: 34945 - DNA, 15 bp, Homo sapiens
tgcacacacacatcc

SEQ ID NO: 34946 - DNA, 15 bp, Homo sapiens
ctgcacacacacatc

SEQ ID NO: 34947 - DNA, 15 bp, Homo sapiens
tctgcacacacacat

SEQ ID NO: 34948 - DNA, 15 bp, Homo sapiens
ctctgcacacacaca

SEQ ID NO: 34949 - DNA, 15 bp, Homo sapiens
gctctgcacacacac

SEQ ID NO: 34950 - DNA, 15 bp, Homo sapiens
agctctgcacacaca

SEQ ID NO: 34951 - DNA, 15 bp, Homo sapiens
cagctctgcacacac

SEQ ID NO: 34952 - DNA, 15 bp, Homo sapiens
tcagctctgcacaca

SEQ ID NO: 34953 - DNA, 15 bp, Homo sapiens
ttcagctctgcacac

SEQ ID NO: 34954 - DNA, 15 bp, Homo sapiens
cttcagctctgcaca

SEQ ID NO: 34955 - DNA, 15 bp, Homo sapiens
tcttcagctctgcac

SEQ ID NO: 34956 - DNA, 15 bp, Homo sapiens
ctcttcagctctgca

SEQ ID NO: 34957 - DNA, 15 bp, Homo sapiens
gctcttcagctctgc

SEQ ID NO: 34958 - DNA, 15 bp, Homo sapiens
agctcttcagctctg

SEQ ID NO: 34959 - DNA, 15 bp, Homo sapiens
cagctcttcagctct

SEQ ID NO: 34960 - DNA, 15 bp, Homo sapiens
ccagctcttcagctc

SEQ ID NO: 34961 - DNA, 15 bp, Homo sapiens
cccagctcttcagct

SEQ ID NO: 34962 - DNA, 15 bp, Homo sapiens
ccccagctcttcagc

SEQ ID NO: 34963 - DNA, 15 bp, Homo sapiens
tccccagctcttcag

SEQ ID NO: 34964 - DNA, 15 bp, Homo sapiens
ctccccagctcttca

SEQ ID NO: 34965 - DNA, 15 bp, Homo sapiens
tctccccagctcttc

SEQ ID NO: 34966 - DNA, 15 bp, Homo sapiens
ttctccccagctctt

SEQ ID NO: 34967 - DNA, 15 bp, Homo sapiens
attctccccagctct

SEQ ID NO: 34968 - DNA, 15 bp, Homo sapiens
cattctccccagctc

SEQ ID NO: 34969 - DNA, 15 bp, Homo sapiens
ccattctccccagct

SEQ ID NO: 34970 - DNA, 15 bp, Homo sapiens
cccattctccccagc

SEQ ID NO: 34971 - DNA, 15 bp, Homo sapiens
ccccattctccccag

SEQ ID NO: 34972 - DNA, 15 bp, Homo sapiens
gccccattctcccca

SEQ ID NO: 34973 - DNA, 15 bp, Homo sapiens
agccccattctcccc

SEQ ID NO: 34974 - DNA, 15 bp, Homo sapiens
cagccccattctccc

SEQ ID NO: 34975 - DNA, 15 bp, Homo sapiens
ccagccccattctcc

SEQ ID NO: 34976 - DNA, 15 bp, Homo sapiens
cccagccccattctc

SEQ ID NO: 34977 - DNA, 15 bp, Homo sapiens
gcccagccccattct

SEQ ID NO: 34978 - DNA, 15 bp, Homo sapiens
ggcccagccccattc

SEQ ID NO: 34979 - DNA, 15 bp, Homo sapiens
gggcccagccccatt

SEQ ID NO: 34980 - DNA, 15 bp, Homo sapiens
tgggcccagccccat

SEQ ID NO: 34981 - DNA, 15 bp, Homo sapiens
gtgggcccagcccca

SEQ ID NO: 34982 - DNA, 15 bp, Homo sapiens
ggtgggcccagcccc

SEQ ID NO: 34983 - DNA, 15 bp, Homo sapiens
gggtgggcccagccc

SEQ ID NO: 34984 - DNA, 15 bp, Homo sapiens
tgggtgggcccagcc

SEQ ID NO: 34985 - DNA, 15 bp, Homo sapiens
ttgggtgggcccagc

SEQ ID NO: 34986 - DNA, 15 bp, Homo sapiens
cttgggtgggcccag

SEQ ID NO: 34987 - DNA, 15 bp, Homo sapiens
gcttgggtgggccca

SEQ ID NO: 34988 - DNA, 15 bp, Homo sapiens
tgcttgggtgggccc

SEQ ID NO: 34989 - DNA, 15 bp, Homo sapiens
ctgcttgggtgggcc

SEQ ID NO: 34990 - DNA, 15 bp, Homo sapiens
cctgcttgggtgggc

SEQ ID NO: 34991 - DNA, 15 bp, Homo sapiens
tcctgcttgggtggg

SEQ ID NO: 34992 - DNA, 15 bp, Homo sapiens
ctcctgcttgggtgg

SEQ ID NO: 34993 - DNA, 15 bp, Homo sapiens
cctcctgcttgggtg

SEQ ID NO: 34994 - DNA, 15 bp, Homo sapiens
gcctcctgcttgggt

SEQ ID NO: 34995 - DNA, 15 bp, Homo sapiens
agcctcctgcttggg

SEQ ID NO: 34996 - DNA, 15 bp, Homo sapiens
cagcctcctgcttgg

SEQ ID NO: 34997 - DNA, 15 bp, Homo sapiens
ccagcctcctgcttg

SEQ ID NO: 34998 - DNA, 15 bp, Homo sapiens
cccagcctcctgctt

SEQ ID NO: 34999 - DNA, 15 bp, Homo sapiens
tcccagcctcctgct

SEQ ID NO: 35000 - DNA, 15 bp, Homo sapiens
gtcccagcctcctgc

SEQ ID NO: 35001 - DNA, 15 bp, Homo sapiens
cgtcccagcctcctg

SEQ ID NO: 35002 - DNA, 15 bp, Homo sapiens
gcgtcccagcctcct

SEQ ID NO: 35003 - DNA, 15 bp, Homo sapiens
agcgtcccagcctcc

SEQ ID NO: 35004 - DNA, 15 bp, Homo sapiens
gagcgtcccagcctc

SEQ ID NO: 35005 - DNA, 15 bp, Homo sapiens
agagcgtcccagcct

SEQ ID NO: 35006 - DNA, 15 bp, Homo sapiens
cagagcgtcccagcc

SEQ ID NO: 35007 - DNA, 15 bp, Homo sapiens
gcagagcgtcccagc

SEQ ID NO: 35008 - DNA, 15 bp, Homo sapiens
agcagagcgtcccag

SEQ ID NO: 35009 - DNA, 15 bp, Homo sapiens
cagcagagcgtccca

SEQ ID NO: 35010 - DNA, 15 bp, Homo sapiens
acagcagagcgtccc

SEQ ID NO: 35011 - DNA, 15 bp, Homo sapiens
cacagcagagcgtcc

SEQ ID NO: 35012 - DNA, 15 bp, Homo sapiens
ccacagcagagcgtc

SEQ ID NO: 35013 - DNA, 15 bp, Homo sapiens
cccacagcagagcgt

SEQ ID NO: 35014 - DNA, 15 bp, Homo sapiens
gcccacagcagagcg

SEQ ID NO: 35015 - DNA, 15 bp, Homo sapiens
tgcccacagcagagc

SEQ ID NO: 35016 - DNA, 15 bp, Homo sapiens
gtgcccacagcagag

SEQ ID NO: 35017 - DNA, 15 bp, Homo sapiens
tgtgcccacagcaga

SEQ ID NO: 35018 - DNA, 15 bp, Homo sapiens
ctgtgcccacagcag

SEQ ID NO: 35019 - DNA, 15 bp, Homo sapiens
cctgtgcccacagca

SEQ ID NO: 35020 - DNA, 15 bp, Homo sapiens
acctgtgcccacagc

SEQ ID NO: 35021 - DNA, 15 bp, Homo sapiens
gacctgtgcccacag

SEQ ID NO: 35022 - DNA, 15 bp, Homo sapiens
tgacctgtgcccaca

SEQ ID NO: 35023 - DNA, 15 bp, Homo sapiens
ctgacctgtgcccac

SEQ ID NO: 35024 - DNA, 15 bp, Homo sapiens
cctgacctgtgccca

SEQ ID NO: 35025 - DNA, 15 bp, Homo sapiens
gcctgacctgtgccc

SEQ ID NO: 35026 - DNA, 15 bp, Homo sapiens
agcctgacctgtgcc

SEQ ID NO: 35027 - DNA, 15 bp, Homo sapiens
tagcctgacctgtgc

SEQ ID NO: 35028 - DNA, 15 bp, Homo sapiens
ttagcctgacctgtg

SEQ ID NO: 35029 - DNA, 15 bp, Homo sapiens
attagcctgacctgt

SEQ ID NO: 35030 - DNA, 15 bp, Homo sapiens
cattagcctgacctg

SEQ ID NO: 35031 - DNA, 15 bp, Homo sapiens
acattagcctgacct

SEQ ID NO: 35032 - DNA, 15 bp, Homo sapiens
aacattagcctgacc

SEQ ID NO: 35033 - DNA, 15 bp, Homo sapiens
caacattagcctgac

SEQ ID NO: 35034 - DNA, 15 bp, Homo sapiens
ccaacattagcctga

SEQ ID NO: 35035 - DNA, 15 bp, Homo sapiens
gccaacattagcctg

SEQ ID NO: 35036 - DNA, 15 bp, Homo sapiens
tgccaacattagcct

SEQ ID NO: 35037 - DNA, 15 bp, Homo sapiens
ctgccaacattagcc

SEQ ID NO: 35038 - DNA, 15 bp, Homo sapiens
tctgccaacattagc

SEQ ID NO: 35039 - DNA, 15 bp, Homo sapiens
atctgccaacattag

SEQ ID NO: 35040 - DNA, 15 bp, Homo sapiens
catctgccaacatta

SEQ ID NO: 35041 - DNA, 15 bp, Homo sapiens
gcatctgccaacatt

SEQ ID NO: 35042 - DNA, 15 bp, Homo sapiens
tgcatctgccaacat

SEQ ID NO: 35043 - DNA, 15 bp, Homo sapiens
ctgcatctgccaaca

SEQ ID NO: 35044 - DNA, 15 bp, Homo sapiens
gctgcatctgccaac

SEQ ID NO: 35045 - DNA, 15 bp, Homo sapiens
agctgcatctgccaa

SEQ ID NO: 35046 - DNA, 15 bp, Homo sapiens
gagctgcatctgcca

SEQ ID NO: 35047 - DNA, 15 bp, Homo sapiens
agagctgcatctgcc

SEQ ID NO: 35048 - DNA, 15 bp, Homo sapiens
aagagctgcatctgc

SEQ ID NO: 35049 - DNA, 15 bp, Homo sapiens
gaagagctgcatctg

SEQ ID NO: 35050 - DNA, 15 bp, Homo sapiens
ggaagagctgcatct

SEQ ID NO: 35051 - DNA, 15 bp, Homo sapiens
aggaagagctgcatc

SEQ ID NO: 35052 - DNA, 15 bp, Homo sapiens
caggaagagctgcat

SEQ ID NO: 35053 - DNA, 15 bp, Homo sapiens
ccaggaagagctgca

SEQ ID NO: 35054 - DNA, 15 bp, Homo sapiens
tccaggaagagctgc

SEQ ID NO: 35055 - DNA, 15 bp, Homo sapiens
gtccaggaagagctg

SEQ ID NO: 35056 - DNA, 15 bp, Homo sapiens
tgtccaggaagagct

SEQ ID NO: 35057 - DNA, 15 bp, Homo sapiens
ctgtccaggaagagc

SEQ ID NO: 35058 - DNA, 15 bp, Homo sapiens
cctgtccaggaagag

SEQ ID NO: 35059 - DNA, 15 bp, Homo sapiens
gcctgtccaggaaga

SEQ ID NO: 35060 - DNA, 15 bp, Homo sapiens
ggcctgtccaggaag

SEQ ID NO: 35061 - DNA, 15 bp, Homo sapiens
tggcctgtccaggaa

SEQ ID NO: 35062 - DNA, 15 bp, Homo sapiens
ctggcctgtccagga

SEQ ID NO: 35063 - DNA, 15 bp, Homo sapiens
cctggcctgtccagg

SEQ ID NO: 35064 - DNA, 15 bp, Homo sapiens
acctggcctgtccag

SEQ ID NO: 35065 - DNA, 15 bp, Homo sapiens
cacctggcctgtcca

SEQ ID NO: 35066 - DNA, 15 bp, Homo sapiens
ccacctggcctgtcc

SEQ ID NO: 35067 - DNA, 15 bp, Homo sapiens
accacctggcctgtc

SEQ ID NO: 35068 - DNA, 15 bp, Homo sapiens
caccacctggcctgt

SEQ ID NO: 35069 - DNA, 15 bp, Homo sapiens
ccaccacctggcctg

SEQ ID NO: 35070 - DNA, 15 bp, Homo sapiens
cccaccacctggcct

SEQ ID NO: 35071 - DNA, 15 bp, Homo sapiens
gcccaccacctggcc

SEQ ID NO: 35072 - DNA, 15 bp, Homo sapiens
tgcccaccacctggc

SEQ ID NO: 35073 - DNA, 15 bp, Homo sapiens
atgcccaccacctgg

SEQ ID NO: 35074 - DNA, 15 bp, Homo sapiens
aatgcccaccacctg

SEQ ID NO: 35075 - DNA, 15 bp, Homo sapiens
gaatgcccaccacct

SEQ ID NO: 35076 - DNA, 15 bp, Homo sapiens
agaatgcccaccacc

SEQ ID NO: 35077 - DNA, 15 bp, Homo sapiens
gagaatgcccaccac

SEQ ID NO: 35078 - DNA, 15 bp, Homo sapiens
agagaatgcccacca

SEQ ID NO: 35079 - DNA, 15 bp, Homo sapiens
gagagaatgcccacc

SEQ ID NO: 35080 - DNA, 15 bp, Homo sapiens
agagagaatgcccac

SEQ ID NO: 35081 - DNA, 15 bp, Homo sapiens
gagagagaatgccca

SEQ ID NO: 35082 - DNA, 15 bp, Homo sapiens
ggagagagaatgccc

SEQ ID NO: 35083 - DNA, 15 bp, Homo sapiens
tggagagagaatgcc

SEQ ID NO: 35084 - DNA, 15 bp, Homo sapiens
ttggagagagaatgc

SEQ ID NO: 35085 - DNA, 15 bp, Homo sapiens
cttggagagagaatg

SEQ ID NO: 35086 - DNA, 15 bp, Homo sapiens
ccttggagagagaat

SEQ ID NO: 35087 - DNA, 15 bp, Homo sapiens
accttggagagagaa

SEQ ID NO: 35088 - DNA, 15 bp, Homo sapiens
caccttggagagaga

SEQ ID NO: 35089 - DNA, 15 bp, Homo sapiens
acaccttggagagag

SEQ ID NO: 35090 - DNA, 15 bp, Homo sapiens
cacaccttggagaga

SEQ ID NO: 35091 - DNA, 15 bp, Homo sapiens
gcacaccttggagag

SEQ ID NO: 35092 - DNA, 15 bp, Homo sapiens
ggcacaccttggaga

SEQ ID NO: 35093 - DNA, 15 bp, Homo sapiens
gggcacaccttggag

SEQ ID NO: 35094 - DNA, 15 bp, Homo sapiens
ggggcacaccttgga

SEQ ID NO: 35095 - DNA, 15 bp, Homo sapiens
cggggcacaccttgg

SEQ ID NO: 35096 - DNA, 15 bp, Homo sapiens
acggggcacaccttg

SEQ ID NO: 35097 - DNA, 15 bp, Homo sapiens
cacggggcacacctt

SEQ ID NO: 35098 - DNA, 15 bp, Homo sapiens
ccacggggcacacct

SEQ ID NO: 35099 - DNA, 15 bp, Homo sapiens
cccacggggcacacc

SEQ ID NO: 35100 - DNA, 15 bp, Homo sapiens
gcccacggggcacac

SEQ ID NO: 35101 - DNA, 15 bp, Homo sapiens
tgcccacggggcaca

SEQ ID NO: 35102 - DNA, 15 bp, Homo sapiens
atgcccacggggcac

SEQ ID NO: 35103 - DNA, 15 bp, Homo sapiens
aatgcccacggggca

SEQ ID NO: 35104 - DNA, 15 bp, Homo sapiens
taatgcccacggggc

SEQ ID NO: 35105 - DNA, 15 bp, Homo sapiens
gtaatgcccacgggg

SEQ ID NO: 35106 - DNA, 15 bp, Homo sapiens
agtaatgcccacggg

SEQ ID NO: 35107 - DNA, 15 bp, Homo sapiens
cagtaatgcccacgg

SEQ ID NO: 35108 - DNA, 15 bp, Homo sapiens
acagtaatgcccacg

SEQ ID NO: 35109 - DNA, 15 bp, Homo sapiens
aacagtaatgcccac

SEQ ID NO: 35110 - DNA, 15 bp, Homo sapiens
aaacagtaatgccca

SEQ ID NO: 35111 - DNA, 15 bp, Homo sapiens
taaacagtaatgccc

SEQ ID NO: 35112 - DNA, 15 bp, Homo sapiens
ttaaacagtaatgcc

SEQ ID NO: 35113 - DNA, 15 bp, Homo sapiens
cttaaacagtaatgc

SEQ ID NO: 35114 - DNA, 15 bp, Homo sapiens
tcttaaacagtaatg

SEQ ID NO: 35115 - DNA, 15 bp, Homo sapiens
gtcttaaacagtaat

SEQ ID NO: 35116 - DNA, 15 bp, Homo sapiens
tgtcttaaacagtaa

SEQ ID NO: 35117 - DNA, 15 bp, Homo sapiens
gtgtcttaaacagta

SEQ ID NO: 35118 - DNA, 15 bp, Homo sapiens
agtgtcttaaacagt

SEQ ID NO: 35119 - DNA, 15 bp, Homo sapiens
aagtgtcttaaacag

SEQ ID NO: 35120 - DNA, 15 bp, Homo sapiens
gaagtgtcttaaaca

SEQ ID NO: 35121 - DNA, 15 bp, Homo sapiens
ggaagtgtcttaaac

SEQ ID NO: 35122 - DNA, 15 bp, Homo sapiens
cggaagtgtcttaaa

SEQ ID NO: 35123 - DNA, 15 bp, Homo sapiens
acggaagtgtcttaa

SEQ ID NO: 35124 - DNA, 15 bp, Homo sapiens
gacggaagtgtctta

SEQ ID NO: 35125 - DNA, 15 bp, Homo sapiens
tgacggaagtgtctt

SEQ ID NO: 35126 - DNA, 15 bp, Homo sapiens
gtgacggaagtgtct

SEQ ID NO: 35127 - DNA, 15 bp, Homo sapiens
tgtgacggaagtgtc

SEQ ID NO: 35128 - DNA, 15 bp, Homo sapiens
atgtgacggaagtgt

SEQ ID NO: 35129 - DNA, 15 bp, Homo sapiens
gatgtgacggaagtg

SEQ ID NO: 35130 - DNA, 15 bp, Homo sapiens
ggatgtgacggaagt

SEQ ID NO: 35131 - DNA, 15 bp, Homo sapiens
gggatgtgacggaag

SEQ ID NO: 35132 - DNA, 15 bp, Homo sapiens
tgggatgtgacggaa

SEQ ID NO: 35133 - DNA, 15 bp, Homo sapiens
gtgggatgtgacgga

SEQ ID NO: 35134 - DNA, 15 bp, Homo sapiens
ggtgggatgtgacgg

SEQ ID NO: 35135 - DNA, 15 bp, Homo sapiens
gggtgggatgtgacg

SEQ ID NO: 35136 - DNA, 15 bp, Homo sapiens
ggggtgggatgtgac

SEQ ID NO: 35137 - DNA, 15 bp, Homo sapiens
tggggtgggatgtga

SEQ ID NO: 35138 - DNA, 15 bp, Homo sapiens
atggggtgggatgtg

SEQ ID NO: 35139 - DNA, 15 bp, Homo sapiens
gatggggtgggatgt

SEQ ID NO: 35140 - DNA, 15 bp, Homo sapiens
ggatggggtgggatg

SEQ ID NO: 35141 - DNA, 15 bp, Homo sapiens
aggatggggtgggat

SEQ ID NO: 35142 - DNA, 15 bp, Homo sapiens
gaggatggggtggga

SEQ ID NO: 35143 - DNA, 15 bp, Homo sapiens
ggaggatggggtggg

SEQ ID NO: 35144 - DNA, 15 bp, Homo sapiens
tggaggatggggtgg

SEQ ID NO: 35145 - DNA, 15 bp, Homo sapiens
ctggaggatggggtg

SEQ ID NO: 35146 - DNA, 15 bp, Homo sapiens
cctggaggatggggt

SEQ ID NO: 35147 - DNA, 15 bp, Homo sapiens
ccctggaggatgggg

SEQ ID NO: 35148 - DNA, 15 bp, Homo sapiens
gccctggaggatggg

SEQ ID NO: 35149 - DNA, 15 bp, Homo sapiens
agccctggaggatgg

SEQ ID NO: 35150 - DNA, 15 bp, Homo sapiens
gagccctggaggatg

SEQ ID NO: 35151 - DNA, 15 bp, Homo sapiens
tgagccctggaggat

SEQ ID NO: 35152 - DNA, 15 bp, Homo sapiens
ttgagccctggagga

SEQ ID NO: 35153 - DNA, 15 bp, Homo sapiens
gttgagccctggagg

SEQ ID NO: 35154 - DNA, 15 bp, Homo sapiens
tgttgagccctggag

SEQ ID NO: 35155 - DNA, 15 bp, Homo sapiens
gtgttgagccctgga

SEQ ID NO: 35156 - DNA, 15 bp, Homo sapiens
agtgttgagccctgg

SEQ ID NO: 35157 - DNA, 15 bp, Homo sapiens
cagtgttgagccctg

SEQ ID NO: 35158 - DNA, 15 bp, Homo sapiens
acagtgttgagccct

SEQ ID NO: 35159 - DNA, 15 bp, Homo sapiens
cacagtgttgagccc

SEQ ID NO: 35160 - DNA, 15 bp, Homo sapiens
tcacagtgttgagcc

SEQ ID NO: 35161 - DNA, 15 bp, Homo sapiens
gtcacagtgttgagc

SEQ ID NO: 35162 - DNA, 15 bp, Homo sapiens
tgtcacagtgttgag

SEQ ID NO: 35163 - DNA, 15 bp, Homo sapiens
atgtcacagtgttga

SEQ ID NO: 35164 - DNA, 15 bp, Homo sapiens
gatgtcacagtgttg

SEQ ID NO: 35165 - DNA, 15 bp, Homo sapiens
agatgtcacagtgtt

SEQ ID NO: 35166 - DNA, 15 bp, Homo sapiens
gagatgtcacagtgt

SEQ ID NO: 35167 - DNA, 15 bp, Homo sapiens
agagatgtcacagtg

SEQ ID NO: 35168 - DNA, 15 bp, Homo sapiens
tagagatgtcacagt

SEQ ID NO: 35169 - DNA, 15 bp, Homo sapiens
atagagatgtcacag

SEQ ID NO: 35170 - DNA, 15 bp, Homo sapiens
aatagagatgtcaca

SEQ ID NO: 35171 - DNA, 15 bp, Homo sapiens
gaatagagatgtcac

SEQ ID NO: 35172 - DNA, 15 bp, Homo sapiens
ggaatagagatgtca

SEQ ID NO: 35173 - DNA, 15 bp, Homo sapiens
gggaatagagatgtc

SEQ ID NO: 35174 - DNA, 15 bp, Homo sapiens
ggggaatagagatgt

SEQ ID NO: 35175 - DNA, 15 bp, Homo sapiens
tggggaatagagatg

SEQ ID NO: 35176 - DNA, 15 bp, Homo sapiens
gtggggaatagagat

SEQ ID NO: 35177 - DNA, 15 bp, Homo sapiens
ggtggggaatagaga

SEQ ID NO: 35178 - DNA, 15 bp, Homo sapiens
gggtggggaatagag

SEQ ID NO: 35179 - DNA, 15 bp, Homo sapiens
agggtggggaataga

SEQ ID NO: 35180 - DNA, 15 bp, Homo sapiens
gagggtggggaatag

SEQ ID NO: 35181 - DNA, 15 bp, Homo sapiens
ggagggtggggaata

SEQ ID NO: 35182 - DNA, 15 bp, Homo sapiens
gggagggtggggaat

SEQ ID NO: 35183 - DNA, 15 bp, Homo sapiens
ggggagggtggggaa

SEQ ID NO: 35184 - DNA, 15 bp, Homo sapiens
aggggagggtgggga

SEQ ID NO: 35185 - DNA, 15 bp, Homo sapiens
aaggggagggtgggg

SEQ ID NO: 35186 - DNA, 15 bp, Homo sapiens
gaaggggagggtggg

SEQ ID NO: 35187 - DNA, 15 bp, Homo sapiens
ggaaggggagggtgg

SEQ ID NO: 35188 - DNA, 15 bp, Homo sapiens
gggaaggggagggtg

SEQ ID NO: 35189 - DNA, 15 bp, Homo sapiens
tgggaaggggagggt

SEQ ID NO: 35190 - DNA, 15 bp, Homo sapiens
ctgggaaggggaggg

SEQ ID NO: 35191 - DNA, 15 bp, Homo sapiens
cctgggaaggggagg

SEQ ID NO: 35192 - DNA, 15 bp, Homo sapiens
ccctgggaaggggag

SEQ ID NO: 35193 - DNA, 15 bp, Homo sapiens
gccctgggaagggga

SEQ ID NO: 35194 - DNA, 15 bp, Homo sapiens
tgccctgggaagggg

SEQ ID NO: 35195 - DNA, 15 bp, Homo sapiens
ttgccctgggaaggg

SEQ ID NO: 35196 - DNA, 15 bp, Homo sapiens
attgccctgggaagg

SEQ ID NO: 35197 - DNA, 15 bp, Homo sapiens
tattgccctgggaag

SEQ ID NO: 35198 - DNA, 15 bp, Homo sapiens
ttattgccctgggaa

SEQ ID NO: 35199 - DNA, 15 bp, Homo sapiens
tttattgccctggga

SEQ ID NO: 35200 - DNA, 15 bp, Homo sapiens
ttttattgccctggg

SEQ ID NO: 35201 - DNA, 15 bp, Homo sapiens
attttattgccctgg

SEQ ID NO: 35202 - DNA, 15 bp, Homo sapiens
cattttattgccctg

SEQ ID NO: 35203 - DNA, 15 bp, Homo sapiens
tcattttattgccct

SEQ ID NO: 35204 - DNA, 15 bp, Homo sapiens
gtcattttattgccc

SEQ ID NO: 35205 - DNA, 15 bp, Homo sapiens
ggtcattttattgcc

SEQ ID NO: 35206 - DNA, 15 bp, Homo sapiens
tggtcattttattgc

SEQ ID NO: 35207 - DNA, 15 bp, Homo sapiens
atggtcattttattg

SEQ ID NO: 35208 - DNA, 15 bp, Homo sapiens
catggtcattttatt

SEQ ID NO: 35209 - DNA, 15 bp, Homo sapiens
ccatggtcattttat

SEQ ID NO: 35210 - DNA, 15 bp, Homo sapiens
tccatggtcatttta

SEQ ID NO: 35211 - DNA, 15 bp, Homo sapiens
ctccatggtcatttt

SEQ ID NO: 35212 - DNA, 15 bp, Homo sapiens
cctccatggtcattt

SEQ ID NO: 35213 - DNA, 15 bp, Homo sapiens
ccctccatggtcatt

SEQ ID NO: 35214 - DNA, 15 bp, Homo sapiens
cccctccatggtcat

SEQ ID NO: 35215 - DNA, 15 bp, Homo sapiens
ccccctccatggtca

SEQ ID NO: 35216 - DNA, 15 bp, Homo sapiens
gccccctccatggtc

SEQ ID NO: 35217 - DNA, 15 bp, Homo sapiens
agccccctccatggt

SEQ ID NO: 35218 - DNA, 15 bp, Homo sapiens
aagccccctccatgg

SEQ ID NO: 35219 - DNA, 15 bp, Homo sapiens
caagccccctccatg

SEQ ID NO: 35220 - DNA, 15 bp, Homo sapiens
gcaagccccctccat

SEQ ID NO: 35221 - DNA, 15 bp, Homo sapiens
tgcaagccccctcca

SEQ ID NO: 35222 - DNA, 15 bp, Homo sapiens
gtgcaagccccctcc

SEQ ID NO: 35223 - DNA, 15 bp, Homo sapiens
agtgcaagccccctc

SEQ ID NO: 35224 - DNA, 15 bp, Homo sapiens
gagtgcaagccccct

SEQ ID NO: 35225 - DNA, 15 bp, Homo sapiens
agagtgcaagccccc

SEQ ID NO: 35226 - DNA, 15 bp, Homo sapiens
gagagtgcaagcccc

SEQ ID NO: 35227 - DNA, 15 bp, Homo sapiens
agagagtgcaagccc

SEQ ID NO: 35228 - DNA, 15 bp, Homo sapiens
aagagagtgcaagcc

SEQ ID NO: 35229 - DNA, 15 bp, Homo sapiens
caagagagtgcaagc

SEQ ID NO: 35230 - DNA, 15 bp, Homo sapiens
ccaagagagtgcaag

SEQ ID NO: 35231 - DNA, 15 bp, Homo sapiens
gccaagagagtgcaa

SEQ ID NO: 35232 - DNA, 15 bp, Homo sapiens
agccaagagagtgca

SEQ ID NO: 35233 - DNA, 15 bp, Homo sapiens
cagccaagagagtgc

SEQ ID NO: 35234 - DNA, 15 bp, Homo sapiens
acagccaagagagtg

SEQ ID NO: 35235 - DNA, 15 bp, Homo sapiens
gacagccaagagagt

SEQ ID NO: 35236 - DNA, 15 bp, Homo sapiens
tgacagccaagagag

SEQ ID NO: 35237 - DNA, 15 bp, Homo sapiens
gtgacagccaagaga

SEQ ID NO: 35238 - DNA, 15 bp, Homo sapiens
ggtgacagccaagag

SEQ ID NO: 35239 - DNA, 15 bp, Homo sapiens
gggtgacagccaaga

SEQ ID NO: 35240 - DNA, 15 bp, Homo sapiens
cgggtgacagccaag

SEQ ID NO: 35241 - DNA, 15 bp, Homo sapiens
tcgggtgacagccaa

SEQ ID NO: 35242 - DNA, 15 bp, Homo sapiens
atcgggtgacagcca

SEQ ID NO: 35243 - DNA, 15 bp, Homo sapiens
gatcgggtgacagcc

SEQ ID NO: 35244 - DNA, 15 bp, Homo sapiens
cgatcgggtgacagc

SEQ ID NO: 35245 - DNA, 15 bp, Homo sapiens
gcgatcgggtgacag

SEQ ID NO: 35246 - DNA, 15 bp, Homo sapiens
ggcgatcgggtgaca

SEQ ID NO: 35247 - DNA, 15 bp, Homo sapiens
tggcgatcgggtgac

SEQ ID NO: 35248 - DNA, 15 bp, Homo sapiens
ctggcgatcgggtga

SEQ ID NO: 35249 - DNA, 15 bp, Homo sapiens
gctggcgatcgggtg

SEQ ID NO: 35250 - DNA, 15 bp, Homo sapiens
tgctggcgatcgggt

SEQ ID NO: 35251 - DNA, 15 bp, Homo sapiens
ttgctggcgatcggg

SEQ ID NO: 35252 - DNA, 15 bp, Homo sapiens
tttgctggcgatcgg

SEQ ID NO: 35253 - DNA, 15 bp, Homo sapiens
ttttgctggcgatcg

SEQ ID NO: 35254 - DNA, 15 bp, Homo sapiens
gttttgctggcgatc

SEQ ID NO: 35255 - DNA, 15 bp, Homo sapiens
agttttgctggcgat

SEQ ID NO: 35256 - DNA, 15 bp, Homo sapiens
aagttttgctggcga

SEQ ID NO: 35257 - DNA, 15 bp, Homo sapiens
taagttttgctggcg

SEQ ID NO: 35258 - DNA, 15 bp, Homo sapiens
ctaagttttgctggc

SEQ ID NO: 35259 - DNA, 15 bp, Homo sapiens
tctaagttttgctgg

SEQ ID NO: 35260 - DNA, 15 bp, Homo sapiens
atctaagttttgctg

SEQ ID NO: 35261 - DNA, 15 bp, Homo sapiens
catctaagttttgct

SEQ ID NO: 35262 - DNA, 15 bp, Homo sapiens
acatctaagttttgc

SEQ ID NO: 35263 - DNA, 15 bp, Homo sapiens
cacatctaagttttg

SEQ ID NO: 35264 - DNA, 15 bp, Homo sapiens
tcacatctaagtttt

SEQ ID NO: 35265 - DNA, 15 bp, Homo sapiens
ctcacatctaagttt

SEQ ID NO: 35266 - DNA, 15 bp, Homo sapiens
tctcacatctaagtt

SEQ ID NO: 35267 - DNA, 15 bp, Homo sapiens
ttctcacatctaagt

SEQ ID NO: 35268 - DNA, 15 bp, Homo sapiens
tttctcacatctaag

SEQ ID NO: 35269 - DNA, 15 bp, Homo sapiens
ttttctcacatctaa

SEQ ID NO: 35270 - DNA, 15 bp, Homo sapiens
gttttctcacatcta

SEQ ID NO: 35271 - DNA, 15 bp, Homo sapiens
ggttttctcacatct

SEQ ID NO: 35272 - DNA, 15 bp, Homo sapiens
gggttttctcacatc

SEQ ID NO: 35273 - DNA, 15 bp, Homo sapiens
ggggttttctcacat

SEQ ID NO: 35274 - DNA, 15 bp, Homo sapiens
aggggttttctcaca

SEQ ID NO: 35275 - DNA, 15 bp, Homo sapiens
aaggggttttctcac

SEQ ID NO: 35276 - DNA, 15 bp, Homo sapiens
gaaggggttttctca

SEQ ID NO: 35277 - DNA, 15 bp, Homo sapiens
ggaaggggttttctc

SEQ ID NO: 35278 - DNA, 15 bp, Homo sapiens
gggaaggggttttct

SEQ ID NO: 35279 - DNA, 15 bp, Homo sapiens
tgggaaggggttttc

SEQ ID NO: 35280 - DNA, 15 bp, Homo sapiens
atgggaaggggtttt

SEQ ID NO: 35281 - DNA, 15 bp, Homo sapiens
aatgggaaggggttt

SEQ ID NO: 35282 - DNA, 15 bp, Homo sapiens
gaatgggaaggggtt

SEQ ID NO: 35283 - DNA, 15 bp, Homo sapiens
ggaatgggaaggggt

SEQ ID NO: 35284 - DNA, 15 bp, Homo sapiens
tggaatgggaagggg

SEQ ID NO: 35285 - DNA, 15 bp, Homo sapiens
atggaatgggaaggg

SEQ ID NO: 35286 - DNA, 15 bp, Homo sapiens
catggaatgggaagg

SEQ ID NO: 35287 - DNA, 15 bp, Homo sapiens
ccatggaatgggaag

SEQ ID NO: 35288 - DNA, 15 bp, Homo sapiens
gccatggaatgggaa

SEQ ID NO: 35289 - DNA, 15 bp, Homo sapiens
cgccatggaatggga

SEQ ID NO: 35290 - DNA, 15 bp, Homo sapiens
tcgccatggaatggg

SEQ ID NO: 35291 - DNA, 15 bp, Homo sapiens
ttcgccatggaatgg

SEQ ID NO: 35292 - DNA, 15 bp, Homo sapiens
tttcgccatggaatg

SEQ ID NO: 35293 - DNA, 15 bp, Homo sapiens
ttttcgccatggaat

SEQ ID NO: 35294 - DNA, 15 bp, Homo sapiens
gttttcgccatggaa

SEQ ID NO: 35295 - DNA, 15 bp, Homo sapiens
tgttttcgccatgga

SEQ ID NO: 35296 - DNA, 15 bp, Homo sapiens
atgttttcgccatgg

SEQ ID NO: 35297 - DNA, 15 bp, Homo sapiens
gatgttttcgccatg

SEQ ID NO: 35298 - DNA, 15 bp, Homo sapiens
agatgttttcgccat

SEQ ID NO: 35299 - DNA, 15 bp, Homo sapiens
gagatgttttcgcca

SEQ ID NO: 35300 - DNA, 15 bp, Homo sapiens
ggagatgttttcgcc

SEQ ID NO: 35301 - DNA, 15 bp, Homo sapiens
aggagatgttttcgc

SEQ ID NO: 35302 - DNA, 15 bp, Homo sapiens
aaggagatgttttcg

SEQ ID NO: 35303 - DNA, 15 bp, Homo sapiens
taaggagatgttttc

SEQ ID NO: 35304 - DNA, 15 bp, Homo sapiens
ctaaggagatgtttt

SEQ ID NO: 35305 - DNA, 15 bp, Homo sapiens
tctaaggagatgttt

SEQ ID NO: 35306 - DNA, 15 bp, Homo sapiens
ttctaaggagatgtt

SEQ ID NO: 35307 - DNA, 15 bp, Homo sapiens
tttctaaggagatgt

SEQ ID NO: 35308 - DNA, 15 bp, Homo sapiens
ttttctaaggagatg

SEQ ID NO: 35309 - DNA, 15 bp, Homo sapiens
cttttctaaggagat

SEQ ID NO: 35310 - DNA, 15 bp, Homo sapiens
gcttttctaaggaga

SEQ ID NO: 35311 - DNA, 15 bp, Homo sapiens
ggcttttctaaggag

SEQ ID NO: 35312 - DNA, 15 bp, Homo sapiens
tggcttttctaagga

SEQ ID NO: 35313 - DNA, 15 bp, Homo sapiens
atggcttttctaagg

SEQ ID NO: 35314 - DNA, 15 bp, Homo sapiens
aatggcttttctaag

SEQ ID NO: 35315 - DNA, 15 bp, Homo sapiens
taatggcttttctaa

SEQ ID NO: 35316 - DNA, 15 bp, Homo sapiens
gtaatggcttttcta

SEQ ID NO: 35317 - DNA, 15 bp, Homo sapiens
ggtaatggcttttct

SEQ ID NO: 35318 - DNA, 15 bp, Homo sapiens
gggtaatggcttttc

SEQ ID NO: 35319 - DNA, 15 bp, Homo sapiens
agggtaatggctttt

SEQ ID NO: 35320 - DNA, 15 bp, Homo sapiens
gagggtaatggcttt

SEQ ID NO: 35321 - DNA, 15 bp, Homo sapiens
tgagggtaatggctt

SEQ ID NO: 35322 - DNA, 15 bp, Homo sapiens
atgagggtaatggct

SEQ ID NO: 35323 - DNA, 15 bp, Homo sapiens
aatgagggtaatggc

SEQ ID NO: 35324 - DNA, 15 bp, Homo sapiens
taatgagggtaatgg

SEQ ID NO: 35325 - DNA, 15 bp, Homo sapiens
ctaatgagggtaatg

SEQ ID NO: 35326 - DNA, 15 bp, Homo sapiens
cctaatgagggtaat

SEQ ID NO: 35327 - DNA, 15 bp, Homo sapiens
gcctaatgagggtaa

SEQ ID NO: 35328 - DNA, 15 bp, Homo sapiens
tgcctaatgagggta

SEQ ID NO: 35329 - DNA, 15 bp, Homo sapiens
atgcctaatgagggt

SEQ ID NO: 35330 - DNA, 15 bp, Homo sapiens
catgcctaatgaggg

SEQ ID NO: 35331 - DNA, 15 bp, Homo sapiens
ccatgcctaatgagg

SEQ ID NO: 35332 - DNA, 15 bp, Homo sapiens
accatgcctaatgag

SEQ ID NO: 35333 - DNA, 15 bp, Homo sapiens
aaccatgcctaatga

SEQ ID NO: 35334 - DNA, 15 bp, Homo sapiens
aaaccatgcctaatg

SEQ ID NO: 35335 - DNA, 15 bp, Homo sapiens
aaaaccatgcctaat

SEQ ID NO: 35336 - DNA, 15 bp, Homo sapiens
caaaaccatgcctaa

SEQ ID NO: 35337 - DNA, 15 bp, Homo sapiens
ccaaaaccatgccta

SEQ ID NO: 35338 - DNA, 15 bp, Homo sapiens
cccaaaaccatgcct

SEQ ID NO: 35339 - DNA, 15 bp, Homo sapiens
gcccaaaaccatgcc

SEQ ID NO: 35340 - DNA, 15 bp, Homo sapiens
agcccaaaaccatgc

SEQ ID NO: 35341 - DNA, 15 bp, Homo sapiens
gagcccaaaaccatg

SEQ ID NO: 35342 - DNA, 15 bp, Homo sapiens
ggagcccaaaaccat

SEQ ID NO: 35343 - DNA, 15 bp, Homo sapiens
gggagcccaaaacca

SEQ ID NO: 35344 - DNA, 15 bp, Homo sapiens
tgggagcccaaaacc

SEQ ID NO: 35345 - DNA, 15 bp, Homo sapiens
ttgggagcccaaaac

SEQ ID NO: 35346 - DNA, 15 bp, Homo sapiens
tttgggagcccaaaa

SEQ ID NO: 35347 - DNA, 15 bp, Homo sapiens
ttttgggagcccaaa

SEQ ID NO: 35348 - DNA, 15 bp, Homo sapiens
gttttgggagcccaa

SEQ ID NO: 35349 - DNA, 15 bp, Homo sapiens
tgttttgggagccca

SEQ ID NO: 35350 - DNA, 15 bp, Homo sapiens
gtgttttgggagccc

SEQ ID NO: 35351 - DNA, 15 bp, Homo sapiens
ggtgttttgggagcc

SEQ ID NO: 35352 - DNA, 15 bp, Homo sapiens
aggtgttttgggagc

SEQ ID NO: 35353 - DNA, 15 bp, Homo sapiens
caggtgttttgggag

SEQ ID NO: 35354 - DNA, 15 bp, Homo sapiens
tcaggtgttttggga

SEQ ID NO: 35355 - DNA, 15 bp, Homo sapiens
gtcaggtgttttggg

SEQ ID NO: 35356 - DNA, 15 bp, Homo sapiens
tgtcaggtgttttgg

SEQ ID NO: 35357 - DNA, 15 bp, Homo sapiens
ctgtcaggtgttttg

SEQ ID NO: 35358 - DNA, 15 bp, Homo sapiens
gctgtcaggtgtttt

SEQ ID NO: 35359 - DNA, 15 bp, Homo sapiens
ggctgtcaggtgttt

SEQ ID NO: 35360 - DNA, 15 bp, Homo sapiens
gggctgtcaggtgtt

SEQ ID NO: 35361 - DNA, 15 bp, Homo sapiens
ggggctgtcaggtgt

SEQ ID NO: 35362 - DNA, 15 bp, Homo sapiens
aggggctgtcaggtg

SEQ ID NO: 35363 - DNA, 15 bp, Homo sapiens
gaggggctgtcaggt

SEQ ID NO: 35364 - DNA, 15 bp, Homo sapiens
ggaggggctgtcagg

SEQ ID NO: 35365 - DNA, 15 bp, Homo sapiens
gggaggggctgtcag

SEQ ID NO: 35366 - DNA, 15 bp, Homo sapiens
agggaggggctgtca

SEQ ID NO: 35367 - DNA, 15 bp, Homo sapiens
gagggaggggctgtc

SEQ ID NO: 35368 - DNA, 15 bp, Homo sapiens
ggagggaggggctgt

SEQ ID NO: 35369 - DNA, 15 bp, Homo sapiens
aggagggaggggctg

SEQ ID NO: 35370 - DNA, 15 bp, Homo sapiens
gaggagggaggggct

SEQ ID NO: 35371 - DNA, 15 bp, Homo sapiens
agaggagggaggggc

SEQ ID NO: 35372 - DNA, 15 bp, Homo sapiens
cagaggagggagggg

SEQ ID NO: 35373 - DNA, 15 bp, Homo sapiens
tcagaggagggaggg

SEQ ID NO: 35374 - DNA, 15 bp, Homo sapiens
ctcagaggagggagg

SEQ ID NO: 35375 - DNA, 15 bp, Homo sapiens
tctcagaggagggag

SEQ ID NO: 35376 - DNA, 15 bp, Homo sapiens
ctctcagaggaggga

SEQ ID NO: 35377 - DNA, 15 bp, Homo sapiens
cctctcagaggaggg

SEQ ID NO: 35378 - DNA, 15 bp, Homo sapiens
gcctctcagaggagg

SEQ ID NO: 35379 - DNA, 15 bp, Homo sapiens
cgcctctcagaggag

SEQ ID NO: 35380 - DNA, 15 bp, Homo sapiens
ccgcctctcagagga

SEQ ID NO: 35381 - DNA, 15 bp, Homo sapiens
tccgcctctcagagg

SEQ ID NO: 35382 - DNA, 15 bp, Homo sapiens
ctccgcctctcagag

SEQ ID NO: 35383 - DNA, 15 bp, Homo sapiens
tctccgcctctcaga

SEQ ID NO: 35384 - DNA, 15 bp, Homo sapiens
ctctccgcctctcag

SEQ ID NO: 35385 - DNA, 15 bp, Homo sapiens
actctccgcctctca

SEQ ID NO: 35386 - DNA, 15 bp, Homo sapiens
cactctccgcctctc

SEQ ID NO: 35387 - DNA, 15 bp, Homo sapiens
gcactctccgcctct

SEQ ID NO: 35388 - DNA, 15 bp, Homo sapiens
agcactctccgcctc

SEQ ID NO: 35389 - DNA, 15 bp, Homo sapiens
cagcactctccgcct

SEQ ID NO: 35390 - DNA, 15 bp, Homo sapiens
tcagcactctccgcc

SEQ ID NO: 35391 - DNA, 15 bp, Homo sapiens
gtcagcactctccgc

SEQ ID NO: 35392 - DNA, 15 bp, Homo sapiens
agtcagcactctccg

SEQ ID NO: 35393 - DNA, 15 bp, Homo sapiens
cagtcagcactctcc

SEQ ID NO: 35394 - DNA, 15 bp, Homo sapiens
acagtcagcactctc

SEQ ID NO: 35395 - DNA, 15 bp, Homo sapiens
tacagtcagcactct

SEQ ID NO: 35396 - DNA, 15 bp, Homo sapiens
ctacagtcagcactc

SEQ ID NO: 35397 - DNA, 15 bp, Homo sapiens
actacagtcagcact

SEQ ID NO: 35398 - DNA, 15 bp, Homo sapiens
cactacagtcagcac

SEQ ID NO: 35399 - DNA, 15 bp, Homo sapiens
tcactacagtcagca

SEQ ID NO: 35400 - DNA, 15 bp, Homo sapiens
gtcactacagtcagc

SEQ ID NO: 35401 - DNA, 15 bp, Homo sapiens
ggtcactacagtcag

SEQ ID NO: 35402 - DNA, 15 bp, Homo sapiens
tggtcactacagtca

SEQ ID NO: 35403 - DNA, 15 bp, Homo sapiens
atggtcactacagtc

SEQ ID NO: 35404 - DNA, 15 bp, Homo sapiens
aatggtcactacagt

SEQ ID NO: 35405 - DNA, 15 bp, Homo sapiens
caatggtcactacag

SEQ ID NO: 35406 - DNA, 15 bp, Homo sapiens
gcaatggtcactaca

SEQ ID NO: 35407 - DNA, 15 bp, Homo sapiens
tgcaatggtcactac

SEQ ID NO: 35408 - DNA, 15 bp, Homo sapiens
atgcaatggtcacta

SEQ ID NO: 35409 - DNA, 15 bp, Homo sapiens
catgcaatggtcact

SEQ ID NO: 35410 - DNA, 15 bp, Homo sapiens
gcatgcaatggtcac

SEQ ID NO: 35411 - DNA, 15 bp, Homo sapiens
ggcatgcaatggtca

SEQ ID NO: 35412 - DNA, 15 bp, Homo sapiens
cggcatgcaatggtc

SEQ ID NO: 35413 - DNA, 15 bp, Homo sapiens
ccggcatgcaatggt

SEQ ID NO: 35414 - DNA, 15 bp, Homo sapiens
cccggcatgcaatgg

SEQ ID NO: 35415 - DNA, 15 bp, Homo sapiens
acccggcatgcaatg

SEQ ID NO: 35416 - DNA, 15 bp, Homo sapiens
cacccggcatgcaat

SEQ ID NO: 35417 - DNA, 15 bp, Homo sapiens
gcacccggcatgcaa

SEQ ID NO: 35418 - DNA, 15 bp, Homo sapiens
tgcacccggcatgca

SEQ ID NO: 35419 - DNA, 15 bp, Homo sapiens
ctgcacccggcatgc

SEQ ID NO: 35420 - DNA, 15 bp, Homo sapiens
gctgcacccggcatg

SEQ ID NO: 35421 - DNA, 15 bp, Homo sapiens
tgctgcacccggcat

SEQ ID NO: 35422 - DNA, 15 bp, Homo sapiens
atgctgcacccggca

SEQ ID NO: 35423 - DNA, 15 bp, Homo sapiens
gatgctgcacccggc

SEQ ID NO: 35424 - DNA, 15 bp, Homo sapiens
agatgctgcacccgg

SEQ ID NO: 35425 - DNA, 15 bp, Homo sapiens
cagatgctgcacccg

SEQ ID NO: 35426 - DNA, 15 bp, Homo sapiens
ccagatgctgcaccc

SEQ ID NO: 35427 - DNA, 15 bp, Homo sapiens
tccagatgctgcacc

SEQ ID NO: 35428 - DNA, 15 bp, Homo sapiens
ttccagatgctgcac

SEQ ID NO: 35429 - DNA, 15 bp, Homo sapiens
cttccagatgctgca

SEQ ID NO: 35430 - DNA, 15 bp, Homo sapiens
tcttccagatgctgc

SEQ ID NO: 35431 - DNA, 15 bp, Homo sapiens
ctcttccagatgctg

SEQ ID NO: 35432 - DNA, 15 bp, Homo sapiens
gctcttccagatgct

SEQ ID NO: 35433 - DNA, 15 bp, Homo sapiens
agctcttccagatgc

SEQ ID NO: 35434 - DNA, 15 bp, Homo sapiens
tagctcttccagatg

SEQ ID NO: 35435 - DNA, 15 bp, Homo sapiens
ctagctcttccagat

SEQ ID NO: 35436 - DNA, 15 bp, Homo sapiens
cctagctcttccaga

SEQ ID NO: 35437 - DNA, 15 bp, Homo sapiens
gcctagctcttccag

SEQ ID NO: 35438 - DNA, 15 bp, Homo sapiens
tgcctagctcttcca

SEQ ID NO: 35439 - DNA, 15 bp, Homo sapiens
ctgcctagctcttcc

SEQ ID NO: 35440 - DNA, 15 bp, Homo sapiens
cctgcctagctcttc

SEQ ID NO: 35441 - DNA, 15 bp, Homo sapiens
ccctgcctagctctt

SEQ ID NO: 35442 - DNA, 15 bp, Homo sapiens
accctgcctagctct

SEQ ID NO: 35443 - DNA, 15 bp, Homo sapiens
caccctgcctagctc

SEQ ID NO: 35444 - DNA, 15 bp, Homo sapiens
acaccctgcctagct

SEQ ID NO: 35445 - DNA, 15 bp, Homo sapiens
gacaccctgcctagc

SEQ ID NO: 35446 - DNA, 15 bp, Homo sapiens
agacaccctgcctag

SEQ ID NO: 35447 - DNA, 15 bp, Homo sapiens
cagacaccctgccta

SEQ ID NO: 35448 - DNA, 15 bp, Homo sapiens
gcagacaccctgcct

SEQ ID NO: 35449 - DNA, 15 bp, Homo sapiens
ggcagacaccctgcc

SEQ ID NO: 35450 - DNA, 15 bp, Homo sapiens
gggcagacaccctgc

SEQ ID NO: 35451 - DNA, 15 bp, Homo sapiens
ggggcagacaccctg

SEQ ID NO: 35452 - DNA, 15 bp, Homo sapiens
gggggcagacaccct

SEQ ID NO: 35453 - DNA, 15 bp, Homo sapiens
agggggcagacaccc

SEQ ID NO: 35454 - DNA, 15 bp, Homo sapiens
gagggggcagacacc

SEQ ID NO: 35455 - DNA, 15 bp, Homo sapiens
ggagggggcagacac

SEQ ID NO: 35456 - DNA, 15 bp, Homo sapiens
aggagggggcagaca

SEQ ID NO: 35457 - DNA, 15 bp, Homo sapiens
caggagggggcagac

SEQ ID NO: 35458 - DNA, 15 bp, Homo sapiens
tcaggagggggcaga

SEQ ID NO: 35459 - DNA, 15 bp, Homo sapiens
ctcaggagggggcag

SEQ ID NO: 35460 - DNA, 15 bp, Homo sapiens
actcaggagggggca

SEQ ID NO: 35461 - DNA, 15 bp, Homo sapiens
aactcaggagggggc

SEQ ID NO: 35462 - DNA, 15 bp, Homo sapiens
caactcaggaggggg

SEQ ID NO: 35463 - DNA, 15 bp, Homo sapiens
tcaactcaggagggg

SEQ ID NO: 35464 - DNA, 15 bp, Homo sapiens
ttcaactcaggaggg

SEQ ID NO: 35465 - DNA, 15 bp, Homo sapiens
cttcaactcaggagg

SEQ ID NO: 35466 - DNA, 15 bp, Homo sapiens
acttcaactcaggag

SEQ ID NO: 35467 - DNA, 15 bp, Homo sapiens
gacttcaactcagga

SEQ ID NO: 35468 - DNA, 15 bp, Homo sapiens
tgacttcaactcagg

SEQ ID NO: 35469 - DNA, 15 bp, Homo sapiens
atgacttcaactcag

SEQ ID NO: 35470 - DNA, 15 bp, Homo sapiens
catgacttcaactca

SEQ ID NO: 35471 - DNA, 15 bp, Homo sapiens
gcatgacttcaactc

SEQ ID NO: 35472 - DNA, 15 bp, Homo sapiens
agcatgacttcaact

SEQ ID NO: 35473 - DNA, 15 bp, Homo sapiens
gagcatgacttcaac

SEQ ID NO: 35474 - DNA, 15 bp, Homo sapiens
ggagcatgacttcaa

SEQ ID NO: 35475 - DNA, 15 bp, Homo sapiens
gggagcatgacttca

SEQ ID NO: 35476 - DNA, 15 bp, Homo sapiens
ggggagcatgacttc

SEQ ID NO: 35477 - DNA, 15 bp, Homo sapiens
aggggagcatgactt

SEQ ID NO: 35478 - DNA, 15 bp, Homo sapiens
caggggagcatgact

SEQ ID NO: 35479 - DNA, 15 bp, Homo sapiens
acaggggagcatgac

SEQ ID NO: 35480 - DNA, 15 bp, Homo sapiens
cacaggggagcatga

SEQ ID NO: 35481 - DNA, 15 bp, Homo sapiens
gcacaggggagcatg

SEQ ID NO: 35482 - DNA, 15 bp, Homo sapiens
ggcacaggggagcat

SEQ ID NO: 35483 - DNA, 15 bp, Homo sapiens
tggcacaggggagca

SEQ ID NO: 35484 - DNA, 15 bp, Homo sapiens
ctggcacaggggagc

SEQ ID NO: 35485 - DNA, 15 bp, Homo sapiens
gctggcacaggggag

SEQ ID NO: 35486 - DNA, 15 bp, Homo sapiens
ggctggcacagggga

SEQ ID NO: 35487 - DNA, 15 bp, Homo sapiens
gggctggcacagggg

SEQ ID NO: 35488 - DNA, 15 bp, Homo sapiens
tgggctggcacaggg

SEQ ID NO: 35489 - DNA, 15 bp, Homo sapiens
ctgggctggcacagg

SEQ ID NO: 35490 - DNA, 15 bp, Homo sapiens
tctgggctggcacag

SEQ ID NO: 35491 - DNA, 15 bp, Homo sapiens
ctctgggctggcaca

SEQ ID NO: 35492 - DNA, 15 bp, Homo sapiens
cctctgggctggcac

SEQ ID NO: 35493 - DNA, 15 bp, Homo sapiens
gcctctgggctggca

SEQ ID NO: 35494 - DNA, 15 bp, Homo sapiens
ggcctctgggctggc

SEQ ID NO: 35495 - DNA, 15 bp, Homo sapiens
cggcctctgggctgg

SEQ ID NO: 35496 - DNA, 15 bp, Homo sapiens
tcggcctctgggctg

SEQ ID NO: 35497 - DNA, 15 bp, Homo sapiens
ctcggcctctgggct

SEQ ID NO: 35498 - DNA, 15 bp, Homo sapiens
tctcggcctctgggc

SEQ ID NO: 35499 - DNA, 15 bp, Homo sapiens
ctctcggcctctggg

SEQ ID NO: 35500 - DNA, 15 bp, Homo sapiens
gctctcggcctctgg

SEQ ID NO: 35501 - DNA, 15 bp, Homo sapiens
agctctcggcctctg

SEQ ID NO: 35502 - DNA, 15 bp, Homo sapiens
tagctctcggcctct

SEQ ID NO: 35503 - DNA, 15 bp, Homo sapiens
atagctctcggcctc

SEQ ID NO: 35504 - DNA, 15 bp, Homo sapiens
catagctctcggcct

SEQ ID NO: 35505 - DNA, 15 bp, Homo sapiens
ccatagctctcggcc

SEQ ID NO: 35506 - DNA, 15 bp, Homo sapiens
tccatagctctcggc

SEQ ID NO: 35507 - DNA, 15 bp, Homo sapiens
gtccatagctctcgg

SEQ ID NO: 35508 - DNA, 15 bp, Homo sapiens
tgtccatagctctcg

SEQ ID NO: 35509 - DNA, 15 bp, Homo sapiens
ctgtccatagctctc

SEQ ID NO: 35510 - DNA, 15 bp, Homo sapiens
gctgtccatagctct

SEQ ID NO: 35511 - DNA, 15 bp, Homo sapiens
tgctgtccatagctc

SEQ ID NO: 35512 - DNA, 15 bp, Homo sapiens
atgctgtccatagct

SEQ ID NO: 35513 - DNA, 15 bp, Homo sapiens
aatgctgtccatagc

SEQ ID NO: 35514 - DNA, 15 bp, Homo sapiens
caatgctgtccatag

SEQ ID NO: 35515 - DNA, 15 bp, Homo sapiens
gcaatgctgtccata

SEQ ID NO: 35516 - DNA, 15 bp, Homo sapiens
ggcaatgctgtccat

SEQ ID NO: 35517 - DNA, 15 bp, Homo sapiens
tggcaatgctgtcca

SEQ ID NO: 35518 - DNA, 15 bp, Homo sapiens
ctggcaatgctgtcc

SEQ ID NO: 35519 - DNA, 15 bp, Homo sapiens
actggcaatgctgtc

SEQ ID NO: 35520 - DNA, 15 bp, Homo sapiens
tactggcaatgctgt

SEQ ID NO: 35521 - DNA, 15 bp, Homo sapiens
ttactggcaatgctg

SEQ ID NO: 35522 - DNA, 15 bp, Homo sapiens
gttactggcaatgct

SEQ ID NO: 35523 - DNA, 15 bp, Homo sapiens
tgttactggcaatgc

SEQ ID NO: 35524 - DNA, 15 bp, Homo sapiens
gtgttactggcaatg

SEQ ID NO: 35525 - DNA, 15 bp, Homo sapiens
tgtgttactggcaat

SEQ ID NO: 35526 - DNA, 15 bp, Homo sapiens
ctgtgttactggcaa

SEQ ID NO: 35527 - DNA, 15 bp, Homo sapiens
cctgtgttactggca

SEQ ID NO: 35528 - DNA, 15 bp, Homo sapiens
gcctgtgttactggc

SEQ ID NO: 35529 - DNA, 15 bp, Homo sapiens
ggcctgtgttactgg

SEQ ID NO: 35530 - DNA, 15 bp, Homo sapiens
tggcctgtgttactg

SEQ ID NO: 35531 - DNA, 15 bp, Homo sapiens
gtggcctgtgttact

SEQ ID NO: 35532 - DNA, 15 bp, Homo sapiens
ggtggcctgtgttac

SEQ ID NO: 35533 - DNA, 15 bp, Homo sapiens
gggtggcctgtgtta

SEQ ID NO: 35534 - DNA, 15 bp, Homo sapiens
agggtggcctgtgtt

SEQ ID NO: 35535 - DNA, 15 bp, Homo sapiens
cagggtggcctgtgt

SEQ ID NO: 35536 - DNA, 15 bp, Homo sapiens
acagggtggcctgtg

SEQ ID NO: 35537 - DNA, 15 bp, Homo sapiens
cacagggtggcctgt

SEQ ID NO: 35538 - DNA, 15 bp, Homo sapiens
gcacagggtggcctg

SEQ ID NO: 35539 - DNA, 15 bp, Homo sapiens
tgcacagggtggcct

SEQ ID NO: 35540 - DNA, 15 bp, Homo sapiens
ctgcacagggtggcc

SEQ ID NO: 35541 - DNA, 15 bp, Homo sapiens
tctgcacagggtggc

SEQ ID NO: 35542 - DNA, 15 bp, Homo sapiens
ttctgcacagggtgg

SEQ ID NO: 35543 - DNA, 15 bp, Homo sapiens
cttctgcacagggtg

SEQ ID NO: 35544 - DNA, 15 bp, Homo sapiens
ccttctgcacagggt

SEQ ID NO: 35545 - DNA, 15 bp, Homo sapiens
cccttctgcacaggg

SEQ ID NO: 35546 - DNA, 15 bp, Homo sapiens
tcccttctgcacagg

SEQ ID NO: 35547 - DNA, 15 bp, Homo sapiens
ctcccttctgcacag

SEQ ID NO: 35548 - DNA, 15 bp, Homo sapiens
gctcccttctgcaca

SEQ ID NO: 35549 - DNA, 15 bp, Homo sapiens
agctcccttctgcac

SEQ ID NO: 35550 - DNA, 15 bp, Homo sapiens
cagctcccttctgca

SEQ ID NO: 35551 - DNA, 15 bp, Homo sapiens
ccagctcccttctgc

SEQ ID NO: 35552 - DNA, 15 bp, Homo sapiens
gccagctcccttctg

SEQ ID NO: 35553 - DNA, 15 bp, Homo sapiens
agccagctcccttct

SEQ ID NO: 35554 - DNA, 15 bp, Homo sapiens
gagccagctcccttc

SEQ ID NO: 35555 - DNA, 15 bp, Homo sapiens
ggagccagctccctt

SEQ ID NO: 35556 - DNA, 15 bp, Homo sapiens
tggagccagctccct

SEQ ID NO: 35557 - DNA, 15 bp, Homo sapiens
ctggagccagctccc

SEQ ID NO: 35558 - DNA, 15 bp, Homo sapiens
gctggagccagctcc

SEQ ID NO: 35559 - DNA, 15 bp, Homo sapiens
ggctggagccagctc

SEQ ID NO: 35560 - DNA, 15 bp, Homo sapiens
aggctggagccagct

SEQ ID NO: 35561 - DNA, 15 bp, Homo sapiens
caggctggagccagc

SEQ ID NO: 35562 - DNA, 15 bp, Homo sapiens
ccaggctggagccag

SEQ ID NO: 35563 - DNA, 15 bp, Homo sapiens
tccaggctggagcca

SEQ ID NO: 35564 - DNA, 15 bp, Homo sapiens
ttccaggctggagcc

SEQ ID NO: 35565 - DNA, 15 bp, Homo sapiens
tttccaggctggagc

SEQ ID NO: 35566 - DNA, 15 bp, Homo sapiens
gtttccaggctggag

SEQ ID NO: 35567 - DNA, 15 bp, Homo sapiens
ggtttccaggctgga

SEQ ID NO: 35568 - DNA, 15 bp, Homo sapiens
aggtttccaggctgg

SEQ ID NO: 35569 - DNA, 15 bp, Homo sapiens
caggtttccaggctg

SEQ ID NO: 35570 - DNA, 15 bp, Homo sapiens
acaggtttccaggct

SEQ ID NO: 35571 - DNA, 15 bp, Homo sapiens
gacaggtttccaggc

SEQ ID NO: 35572 - DNA, 15 bp, Homo sapiens
agacaggtttccagg

SEQ ID NO: 35573 - DNA, 15 bp, Homo sapiens
cagacaggtttccag

SEQ ID NO: 35574 - DNA, 15 bp, Homo sapiens
tcagacaggtttcca

SEQ ID NO: 35575 - DNA, 15 bp, Homo sapiens
ctcagacaggtttcc

SEQ ID NO: 35576 - DNA, 15 bp, Homo sapiens
cctcagacaggtttc

SEQ ID NO: 35577 - DNA, 15 bp, Homo sapiens
acctcagacaggttt

SEQ ID NO: 35578 - DNA, 15 bp, Homo sapiens
aacctcagacaggtt

SEQ ID NO: 35579 - DNA, 15 bp, Homo sapiens
caacctcagacaggt

SEQ ID NO: 35580 - DNA, 15 bp, Homo sapiens
ccaacctcagacagg

SEQ ID NO: 35581 - DNA, 15 bp, Homo sapiens
cccaacctcagacag

SEQ ID NO: 35582 - DNA, 15 bp, Homo sapiens
tcccaacctcagaca

SEQ ID NO: 35583 - DNA, 15 bp, Homo sapiens
ctcccaacctcagac

SEQ ID NO: 35584 - DNA, 15 bp, Homo sapiens
tctcccaacctcaga

SEQ ID NO: 35585 - DNA, 15 bp, Homo sapiens
ctctcccaacctcag

SEQ ID NO: 35586 - DNA, 15 bp, Homo sapiens
cctctcccaacctca

SEQ ID NO: 35587 - DNA, 15 bp, Homo sapiens
acctctcccaacctc

SEQ ID NO: 35588 - DNA, 15 bp, Homo sapiens
cacctctcccaacct

SEQ ID NO: 35589 - DNA, 15 bp, Homo sapiens
gcacctctcccaacc

SEQ ID NO: 35590 - DNA, 15 bp, Homo sapiens
tgcacctctcccaac

SEQ ID NO: 35591 - DNA, 15 bp, Homo sapiens
gtgcacctctcccaa

SEQ ID NO: 35592 - DNA, 15 bp, Homo sapiens
agtgcacctctccca

SEQ ID NO: 35593 - DNA, 15 bp, Homo sapiens
aagtgcacctctccc

SEQ ID NO: 35594 - DNA, 15 bp, Homo sapiens
caagtgcacctctcc

SEQ ID NO: 35595 - DNA, 15 bp, Homo sapiens
ccaagtgcacctctc

SEQ ID NO: 35596 - DNA, 15 bp, Homo sapiens
cccaagtgcacctct

SEQ ID NO: 35597 - DNA, 15 bp, Homo sapiens
ccccaagtgcacctc

SEQ ID NO: 35598 - DNA, 15 bp, Homo sapiens
gccccaagtgcacct

SEQ ID NO: 35599 - DNA, 15 bp, Homo sapiens
tgccccaagtgcacc

SEQ ID NO: 35600 - DNA, 15 bp, Homo sapiens
gtgccccaagtgcac

SEQ ID NO: 35601 - DNA, 15 bp, Homo sapiens
tgtgccccaagtgca

SEQ ID NO: 35602 - DNA, 15 bp, Homo sapiens
ctgtgccccaagtgc

SEQ ID NO: 35603 - DNA, 15 bp, Homo sapiens
cctgtgccccaagtg

SEQ ID NO: 35604 - DNA, 15 bp, Homo sapiens
ccctgtgccccaagt

SEQ ID NO: 35605 - DNA, 15 bp, Homo sapiens
tccctgtgccccaag

SEQ ID NO: 35606 - DNA, 15 bp, Homo sapiens
ctccctgtgccccaa

SEQ ID NO: 35607 - DNA, 15 bp, Homo sapiens
tctccctgtgcccca

SEQ ID NO: 35608 - DNA, 15 bp, Homo sapiens
ctctccctgtgcccc

SEQ ID NO: 35609 - DNA, 15 bp, Homo sapiens
cctctccctgtgccc

SEQ ID NO: 35610 - DNA, 15 bp, Homo sapiens
gcctctccctgtgcc

SEQ ID NO: 35611 - DNA, 15 bp, Homo sapiens
ggcctctccctgtgc

SEQ ID NO: 35612 - DNA, 15 bp, Homo sapiens
cggcctctccctgtg

SEQ ID NO: 35613 - DNA, 15 bp, Homo sapiens
ccggcctctccctgt

SEQ ID NO: 35614 - DNA, 15 bp, Homo sapiens
cccggcctctccctg

SEQ ID NO: 35615 - DNA, 15 bp, Homo sapiens
tcccggcctctccct

SEQ ID NO: 35616 - DNA, 15 bp, Homo sapiens
gtcccggcctctccc

SEQ ID NO: 35617 - DNA, 15 bp, Homo sapiens
tgtcccggcctctcc

SEQ ID NO: 35618 - DNA, 15 bp, Homo sapiens
gtgtcccggcctctc

SEQ ID NO: 35619 - DNA, 15 bp, Homo sapiens
tgtgtcccggcctct

SEQ ID NO: 35620 - DNA, 15 bp, Homo sapiens
gtgtgtcccggcctc

SEQ ID NO: 35621 - DNA, 15 bp, Homo sapiens
agtgtgtcccggcct

SEQ ID NO: 35622 - DNA, 15 bp, Homo sapiens
aagtgtgtcccggcc

SEQ ID NO: 35623 - DNA, 15 bp, Homo sapiens
taagtgtgtcccggc

SEQ ID NO: 35624 - DNA, 15 bp, Homo sapiens
ctaagtgtgtcccgg

SEQ ID NO: 35625 - DNA, 15 bp, Homo sapiens
gctaagtgtgtcccg

SEQ ID NO: 35626 - DNA, 15 bp, Homo sapiens
agctaagtgtgtccc

SEQ ID NO: 35627 - DNA, 15 bp, Homo sapiens
cagctaagtgtgtcc

SEQ ID NO: 35628 - DNA, 15 bp, Homo sapiens
ccagctaagtgtgtc

SEQ ID NO: 35629 - DNA, 15 bp, Homo sapiens
tccagctaagtgtgt

SEQ ID NO: 35630 - DNA, 15 bp, Homo sapiens
ctccagctaagtgtg

SEQ ID NO: 35631 - DNA, 15 bp, Homo sapiens
tctccagctaagtgt

SEQ ID NO: 35632 - DNA, 15 bp, Homo sapiens
atctccagctaagtg

SEQ ID NO: 35633 - DNA, 15 bp, Homo sapiens
catctccagctaagt

SEQ ID NO: 35634 - DNA, 15 bp, Homo sapiens
acatctccagctaag

SEQ ID NO: 35635 - DNA, 15 bp, Homo sapiens
gacatctccagctaa

SEQ ID NO: 35636 - DNA, 15 bp, Homo sapiens
agacatctccagcta

SEQ ID NO: 35637 - DNA, 15 bp, Homo sapiens
gagacatctccagct

SEQ ID NO: 35638 - DNA, 15 bp, Homo sapiens
agagacatctccagc

SEQ ID NO: 35639 - DNA, 15 bp, Homo sapiens
tagagacatctccag

SEQ ID NO: 35640 - DNA, 15 bp, Homo sapiens
ttagagacatctcca

SEQ ID NO: 35641 - DNA, 15 bp, Homo sapiens
tttagagacatctcc

SEQ ID NO: 35642 - DNA, 15 bp, Homo sapiens
ttttagagacatctc

SEQ ID NO: 35643 - DNA, 15 bp, Homo sapiens
cttttagagacatct

SEQ ID NO: 35644 - DNA, 15 bp, Homo sapiens
gcttttagagacatc

SEQ ID NO: 35645 - DNA, 15 bp, Homo sapiens
ggcttttagagacat

SEQ ID NO: 35646 - DNA, 15 bp, Homo sapiens
gggcttttagagaca

SEQ ID NO: 35647 - DNA, 15 bp, Homo sapiens
agggcttttagagac

SEQ ID NO: 35648 - DNA, 15 bp, Homo sapiens
cagggcttttagaga

SEQ ID NO: 35649 - DNA, 15 bp, Homo sapiens
acagggcttttagag

SEQ ID NO: 35650 - DNA, 15 bp, Homo sapiens
tacagggcttttaga

SEQ ID NO: 35651 - DNA, 15 bp, Homo sapiens
atacagggcttttag

SEQ ID NO: 35652 - DNA, 15 bp, Homo sapiens
gatacagggctttta

SEQ ID NO: 35653 - DNA, 15 bp, Homo sapiens
cgatacagggctttt

SEQ ID NO: 35654 - DNA, 15 bp, Homo sapiens
acgatacagggcttt

SEQ ID NO: 35655 - DNA, 15 bp, Homo sapiens
tacgatacagggctt

SEQ ID NO: 35656 - DNA, 15 bp, Homo sapiens
atacgatacagggct

SEQ ID NO: 35657 - DNA, 15 bp, Homo sapiens
aatacgatacagggc

SEQ ID NO: 35658 - DNA, 15 bp, Homo sapiens
gaatacgatacaggg

SEQ ID NO: 35659 - DNA, 15 bp, Homo sapiens
tgaatacgatacagg

SEQ ID NO: 35660 - DNA, 15 bp, Homo sapiens
gtgaatacgatacag

SEQ ID NO: 35661 - DNA, 15 bp, Homo sapiens
ggtgaatacgataca

SEQ ID NO: 35662 - DNA, 15 bp, Homo sapiens
aggtgaatacgatac

SEQ ID NO: 35663 - DNA, 15 bp, Homo sapiens
aaggtgaatacgata

SEQ ID NO: 35664 - DNA, 15 bp, Homo sapiens
gaaggtgaatacgat

SEQ ID NO: 35665 - DNA, 15 bp, Homo sapiens
tgaaggtgaatacga

SEQ ID NO: 35666 - DNA, 15 bp, Homo sapiens
ctgaaggtgaatacg

SEQ ID NO: 35667 - DNA, 15 bp, Homo sapiens
actgaaggtgaatac

SEQ ID NO: 35668 - DNA, 15 bp, Homo sapiens
aactgaaggtgaata

SEQ ID NO: 35669 - DNA, 15 bp, Homo sapiens
aaactgaaggtgaat

SEQ ID NO: 35670 - DNA, 15 bp, Homo sapiens
aaaactgaaggtgaa

SEQ ID NO: 35671 - DNA, 15 bp, Homo sapiens
aaaaactgaaggtga

SEQ ID NO: 35672 - DNA, 15 bp, Homo sapiens
caaaaactgaaggtg

SEQ ID NO: 35673 - DNA, 15 bp, Homo sapiens
acaaaaactgaaggt

SEQ ID NO: 35674 - DNA, 15 bp, Homo sapiens
cacaaaaactgaagg

SEQ ID NO: 35675 - DNA, 15 bp, Homo sapiens
acacaaaaactgaag

SEQ ID NO: 35676 - DNA, 15 bp, Homo sapiens
aacacaaaaactgaa

SEQ ID NO: 35677 - DNA, 15 bp, Homo sapiens
aaacacaaaaactga

SEQ ID NO: 35678 - DNA, 15 bp, Homo sapiens
aaaacacaaaaactg

SEQ ID NO: 35679 - DNA, 15 bp, Homo sapiens
caaaacacaaaaact

SEQ ID NO: 35680 - DNA, 15 bp, Homo sapiens
ccaaaacacaaaaac

SEQ ID NO: 35681 - DNA, 15 bp, Homo sapiens
cccaaaacacaaaaa

SEQ ID NO: 35682 - DNA, 15 bp, Homo sapiens
tcccaaaacacaaaa

SEQ ID NO: 35683 - DNA, 15 bp, Homo sapiens
gtcccaaaacacaaa

SEQ ID NO: 35684 - DNA, 15 bp, Homo sapiens
tgtcccaaaacacaa

SEQ ID NO: 35685 - DNA, 15 bp, Homo sapiens
ttgtcccaaaacaca

SEQ ID NO: 35686 - DNA, 15 bp, Homo sapiens
attgtcccaaaacac

SEQ ID NO: 35687 - DNA, 15 bp, Homo sapiens
aattgtcccaaaaca

SEQ ID NO: 35688 - DNA, 15 bp, Homo sapiens
taattgtcccaaaac

SEQ ID NO: 35689 - DNA, 15 bp, Homo sapiens
gtaattgtcccaaaa

SEQ ID NO: 35690 - DNA, 15 bp, Homo sapiens
agtaattgtcccaaa

SEQ ID NO: 35691 - DNA, 15 bp, Homo sapiens
aagtaattgtcccaa

SEQ ID NO: 35692 - DNA, 15 bp, Homo sapiens
aaagtaattgtccca

SEQ ID NO: 35693 - DNA, 15 bp, Homo sapiens
taaagtaattgtccc

SEQ ID NO: 35694 - DNA, 15 bp, Homo sapiens
ctaaagtaattgtcc

SEQ ID NO: 35695 - DNA, 15 bp, Homo sapiens
tctaaagtaattgtc

SEQ ID NO: 35696 - DNA, 15 bp, Homo sapiens
ttctaaagtaattgt

SEQ ID NO: 35697 - DNA, 15 bp, Homo sapiens
tttctaaagtaattg

SEQ ID NO: 35698 - DNA, 15 bp, Homo sapiens
ttttctaaagtaatt

SEQ ID NO: 35699 - DNA, 15 bp, Homo sapiens
attttctaaagtaat

SEQ ID NO: 35700 - DNA, 15 bp, Homo sapiens
tattttctaaagtaa

SEQ ID NO: 35701 - DNA, 15 bp, Homo sapiens
ttattttctaaagta

SEQ ID NO: 35702 - DNA, 15 bp, Homo sapiens
cttattttctaaagt

SEQ ID NO: 35703 - DNA, 15 bp, Homo sapiens
acttattttctaaag

SEQ ID NO: 35704 - DNA, 15 bp, Homo sapiens
tacttattttctaaa

SEQ ID NO: 35705 - DNA, 15 bp, Homo sapiens
ctacttattttctaa

SEQ ID NO: 35706 - DNA, 15 bp, Homo sapiens
cctacttattttcta

SEQ ID NO: 35707 - DNA, 15 bp, Homo sapiens
acctacttattttct

SEQ ID NO: 35708 - DNA, 15 bp, Homo sapiens
gacctacttattttc

SEQ ID NO: 35709 - DNA, 15 bp, Homo sapiens
cgacctacttatttt

SEQ ID NO: 35710 - DNA, 15 bp, Homo sapiens
acgacctacttattt

SEQ ID NO: 35711 - DNA, 15 bp, Homo sapiens
aacgacctacttatt

SEQ ID NO: 35712 - DNA, 15 bp, Homo sapiens
aaacgacctacttat

SEQ ID NO: 35713 - DNA, 15 bp, Homo sapiens
aaaacgacctactta

SEQ ID NO: 35714 - DNA, 15 bp, Homo sapiens
taaaacgacctactt

SEQ ID NO: 35715 - DNA, 15 bp, Homo sapiens
ttaaaacgacctact

SEQ ID NO: 35716 - DNA, 15 bp, Homo sapiens
tttaaaacgacctac

SEQ ID NO: 35717 - DNA, 15 bp, Homo sapiens
ttttaaaacgaccta

SEQ ID NO: 35718 - DNA, 15 bp, Homo sapiens
tttttaaaacgacct

SEQ ID NO: 35719 - DNA, 15 bp, Homo sapiens
gtttttaaaacgacc

SEQ ID NO: 35720 - DNA, 15 bp, Homo sapiens
tgtttttaaaacgac

SEQ ID NO: 35721 - DNA, 15 bp, Homo sapiens
ttgtttttaaaacga

SEQ ID NO: 35722 - DNA, 15 bp, Homo sapiens
tttgtttttaaaacg

SEQ ID NO: 35723 - DNA, 15 bp, Homo sapiens
ttttgtttttaaaac

SEQ ID NO: 35724 - DNA, 15 bp, Homo sapiens
tttttgtttttaaaa

SEQ ID NO: 35725 - DNA, 15 bp, Homo sapiens
atttttgtttttaaa

SEQ ID NO: 35726 - DNA, 15 bp, Homo sapiens
aatttttgtttttaa

SEQ ID NO: 35727 - DNA, 15 bp, Homo sapiens
taatttttgttttta

SEQ ID NO: 35728 - DNA, 15 bp, Homo sapiens
ataatttttgttttt

SEQ ID NO: 35729 - DNA, 15 bp, Homo sapiens
aataatttttgtttt

SEQ ID NO: 35730 - DNA, 15 bp, Homo sapiens
caataatttttgttt

SEQ ID NO: 35731 - DNA, 15 bp, Homo sapiens
tcaataatttttgtt

SEQ ID NO: 35732 - DNA, 15 bp, Homo sapiens
atcaataatttttgt

SEQ ID NO: 35733 - DNA, 15 bp, Homo sapiens
aatcaataatttttg

SEQ ID NO: 35734 - DNA, 15 bp, Homo sapiens
caatcaataattttt

SEQ ID NO: 35735 - DNA, 15 bp, Homo sapiens
gcaatcaataatttt

SEQ ID NO: 35736 - DNA, 15 bp, Homo sapiens
agcaatcaataattt

SEQ ID NO: 35737 - DNA, 15 bp, Homo sapiens
aagcaatcaataatt

SEQ ID NO: 35738 - DNA, 15 bp, Homo sapiens
aaagcaatcaataat

SEQ ID NO: 35739 - DNA, 15 bp, Homo sapiens
aaaagcaatcaataa

SEQ ID NO: 35740 - DNA, 15 bp, Homo sapiens
aaaaagcaatcaata

SEQ ID NO: 35741 - DNA, 15 bp, Homo sapiens
aaaaaagcaatcaat

SEQ ID NO: 35742 - DNA, 15 bp, Homo sapiens
caaaaaagcaatcaa

SEQ ID NO: 35743 - DNA, 15 bp, Homo sapiens
acaaaaaagcaatca

SEQ ID NO: 35744 - DNA, 15 bp, Homo sapiens
tacaaaaaagcaatc

SEQ ID NO: 35745 - DNA, 15 bp, Homo sapiens
ctacaaaaaagcaat

SEQ ID NO: 35746 - DNA, 15 bp, Homo sapiens
actacaaaaaagcaa

SEQ ID NO: 35747 - DNA, 15 bp, Homo sapiens
cactacaaaaaagca

SEQ ID NO: 35748 - DNA, 15 bp, Homo sapiens
acactacaaaaaagc

SEQ ID NO: 35749 - DNA, 15 bp, Homo sapiens
aacactacaaaaaag

SEQ ID NO: 35750 - DNA, 15 bp, Homo sapiens
gaacactacaaaaaa

SEQ ID NO: 35751 - DNA, 15 bp, Homo sapiens
tgaacactacaaaaa

SEQ ID NO: 35752 - DNA, 15 bp, Homo sapiens
ctgaacactacaaaa

SEQ ID NO: 35753 - DNA, 15 bp, Homo sapiens
tctgaacactacaaa

SEQ ID NO: 35754 - DNA, 15 bp, Homo sapiens
ttctgaacactacaa

SEQ ID NO: 35755 - DNA, 15 bp, Homo sapiens
tttctgaacactaca

SEQ ID NO: 35756 - DNA, 15 bp, Homo sapiens
ttttctgaacactac

SEQ ID NO: 35757 - DNA, 15 bp, Homo sapiens
tttttctgaacacta

SEQ ID NO: 35758 - DNA, 15 bp, Homo sapiens
ttttttctgaacact

SEQ ID NO: 35759 - DNA, 15 bp, Homo sapiens
cttttttctgaacac

SEQ ID NO: 35760 - DNA, 15 bp, Homo sapiens
ccttttttctgaaca

SEQ ID NO: 35761 - DNA, 15 bp, Homo sapiens
accttttttctgaac

SEQ ID NO: 35762 - DNA, 15 bp, Homo sapiens
aaccttttttctgaa

SEQ ID NO: 35763 - DNA, 15 bp, Homo sapiens
gaaccttttttctga

SEQ ID NO: 35764 - DNA, 15 bp, Homo sapiens
agaaccttttttctg

SEQ ID NO: 35765 - DNA, 15 bp, Homo sapiens
aagaaccttttttct

SEQ ID NO: 35766 - DNA, 15 bp, Homo sapiens
aaagaaccttttttc

SEQ ID NO: 35767 - DNA, 15 bp, Homo sapiens
caaagaacctttttt

SEQ ID NO: 35768 - DNA, 15 bp, Homo sapiens
acaaagaaccttttt

SEQ ID NO: 35769 - DNA, 15 bp, Homo sapiens
cacaaagaacctttt

SEQ ID NO: 35770 - DNA, 15 bp, Homo sapiens
acacaaagaaccttt

SEQ ID NO: 35771 - DNA, 15 bp, Homo sapiens
tacacaaagaacctt

SEQ ID NO: 35772 - DNA, 15 bp, Homo sapiens
atacacaaagaacct

SEQ ID NO: 35773 - DNA, 15 bp, Homo sapiens
tatacacaaagaacc

SEQ ID NO: 35774 - DNA, 15 bp, Homo sapiens
ctatacacaaagaac

SEQ ID NO: 35775 - DNA, 15 bp, Homo sapiens
gctatacacaaagaa

SEQ ID NO: 35776 - DNA, 15 bp, Homo sapiens
ggctatacacaaaga

SEQ ID NO: 35777 - DNA, 15 bp, Homo sapiens
tggctatacacaaag

SEQ ID NO: 35778 - DNA, 15 bp, Homo sapiens
ttggctatacacaaa

SEQ ID NO: 35779 - DNA, 15 bp, Homo sapiens
tttggctatacacaa

SEQ ID NO: 35780 - DNA, 15 bp, Homo sapiens
atttggctatacaca

SEQ ID NO: 35781 - DNA, 15 bp, Homo sapiens
catttggctatacac

SEQ ID NO: 35782 - DNA, 15 bp, Homo sapiens
tcatttggctataca

SEQ ID NO: 35783 - DNA, 15 bp, Homo sapiens
gtcatttggctatac

SEQ ID NO: 35784 - DNA, 15 bp, Homo sapiens
agtcatttggctata

SEQ ID NO: 35785 - DNA, 15 bp, Homo sapiens
cagtcatttggctat

SEQ ID NO: 35786 - DNA, 15 bp, Homo sapiens
tcagtcatttggcta

SEQ ID NO: 35787 - DNA, 15 bp, Homo sapiens
ttcagtcatttggct

SEQ ID NO: 35788 - DNA, 15 bp, Homo sapiens
tttcagtcatttggc

SEQ ID NO: 35789 - DNA, 15 bp, Homo sapiens
ctttcagtcatttgg

SEQ ID NO: 35790 - DNA, 15 bp, Homo sapiens
gctttcagtcatttg

SEQ ID NO: 35791 - DNA, 15 bp, Homo sapiens
tgctttcagtcattt

SEQ ID NO: 35792 - DNA, 15 bp, Homo sapiens
gtgctttcagtcatt

SEQ ID NO: 35793 - DNA, 15 bp, Homo sapiens
agtgctttcagtcat

SEQ ID NO: 35794 - DNA, 15 bp, Homo sapiens
cagtgctttcagtca

SEQ ID NO: 35795 - DNA, 15 bp, Homo sapiens
tcagtgctttcagtc

SEQ ID NO: 35796 - DNA, 15 bp, Homo sapiens
atcagtgctttcagt

SEQ ID NO: 35797 - DNA, 15 bp, Homo sapiens
tatcagtgctttcag

SEQ ID NO: 35798 - DNA, 15 bp, Homo sapiens
atatcagtgctttca

SEQ ID NO: 35799 - DNA, 15 bp, Homo sapiens
tatatcagtgctttc

SEQ ID NO: 35800 - DNA, 15 bp, Homo sapiens
atatatcagtgcttt

SEQ ID NO: 35801 - DNA, 15 bp, Homo sapiens
aatatatcagtgctt

SEQ ID NO: 35802 - DNA, 15 bp, Homo sapiens
aaatatatcagtgct

SEQ ID NO: 35803 - DNA, 15 bp, Homo sapiens
taaatatatcagtgc

SEQ ID NO: 35804 - DNA, 15 bp, Homo sapiens
ttaaatatatcagtg

SEQ ID NO: 35805 - DNA, 15 bp, Homo sapiens
tttaaatatatcagt

SEQ ID NO: 35806 - DNA, 15 bp, Homo sapiens
ttttaaatatatcag

SEQ ID NO: 35807 - DNA, 15 bp, Homo sapiens
tttttaaatatatca

SEQ ID NO: 35808 - DNA, 15 bp, Homo sapiens
gtttttaaatatatc

SEQ ID NO: 35809 - DNA, 15 bp, Homo sapiens
tgtttttaaatatat

SEQ ID NO: 35810 - DNA, 15 bp, Homo sapiens
ttgtttttaaatata

SEQ ID NO: 35811 - DNA, 15 bp, Homo sapiens
tttgtttttaaatat

SEQ ID NO: 35812 - DNA, 15 bp, Homo sapiens
ttttgtttttaaata

SEQ ID NO: 35813 - DNA, 15 bp, Homo sapiens
cttttgtttttaaat

SEQ ID NO: 35814 - DNA, 15 bp, Homo sapiens
ccttttgtttttaaa

SEQ ID NO: 35815 - DNA, 15 bp, Homo sapiens
gccttttgtttttaa

SEQ ID NO: 35816 - DNA, 15 bp, Homo sapiens
tgccttttgttttta

SEQ ID NO: 35817 - DNA, 15 bp, Homo sapiens
ttgccttttgttttt

SEQ ID NO: 35818 - DNA, 15 bp, Homo sapiens
attgccttttgtttt

SEQ ID NO: 35819 - DNA, 15 bp, Homo sapiens
aattgccttttgttt

SEQ ID NO: 35820 - DNA, 15 bp, Homo sapiens
aaattgccttttgtt

SEQ ID NO: 35821 - DNA, 15 bp, Homo sapiens
taaattgccttttgt

SEQ ID NO: 35822 - DNA, 15 bp, Homo sapiens
ataaattgccttttg

SEQ ID NO: 35823 - DNA, 15 bp, Homo sapiens
aataaattgcctttt

SEQ ID NO: 35824 - DNA, 15 bp, Homo sapiens
taataaattgccttt

SEQ ID NO: 35825 - DNA, 15 bp, Homo sapiens
ttaataaattgcctt

SEQ ID NO: 35826 - DNA, 15 bp, Homo sapiens
cttaataaattgcct

SEQ ID NO: 35827 - DNA, 15 bp, Homo sapiens
ccttaataaattgcc

SEQ ID NO: 35828 - DNA, 15 bp, Homo sapiens
tccttaataaattgc

SEQ ID NO: 35829 - DNA, 15 bp, Homo sapiens
ttccttaataaattg

SEQ ID NO: 35830 - DNA, 15 bp, Homo sapiens
tttccttaataaatt

SEQ ID NO: 35831 - DNA, 15 bp, Homo sapiens
atttccttaataaat

SEQ ID NO: 35832 - DNA, 15 bp, Homo sapiens
aatttccttaataaa

SEQ ID NO: 35833 - DNA, 15 bp, Homo sapiens
aaatttccttaataa

SEQ ID NO: 35834 - DNA, 15 bp, Homo sapiens
caaatttccttaata

SEQ ID NO: 35835 - DNA, 15 bp, Homo sapiens
acaaatttccttaat

SEQ ID NO: 35836 - DNA, 15 bp, Homo sapiens
tacaaatttccttaa

SEQ ID NO: 35837 - DNA, 15 bp, Homo sapiens
gtacaaatttcctta

SEQ ID NO: 35838 - DNA, 15 bp, Homo sapiens
ggtacaaatttcctt

SEQ ID NO: 35839 - DNA, 15 bp, Homo sapiens
tggtacaaatttcct

SEQ ID NO: 35840 - DNA, 15 bp, Homo sapiens
atggtacaaatttcc

SEQ ID NO: 35841 - DNA, 15 bp, Homo sapiens
aatggtacaaatttc

SEQ ID NO: 35842 - DNA, 15 bp, Homo sapiens
aaatggtacaaattt

SEQ ID NO: 35843 - DNA, 15 bp, Homo sapiens
gaaatggtacaaatt

SEQ ID NO: 35844 - DNA, 15 bp, Homo sapiens
tgaaatggtacaaat

SEQ ID NO: 35845 - DNA, 15 bp, Homo sapiens
ctgaaatggtacaaa

SEQ ID NO: 35846 - DNA, 15 bp, Homo sapiens
actgaaatggtacaa

SEQ ID NO: 35847 - DNA, 15 bp, Homo sapiens
tactgaaatggtaca

SEQ ID NO: 35848 - DNA, 15 bp, Homo sapiens
ttactgaaatggtac

SEQ ID NO: 35849 - DNA, 15 bp, Homo sapiens
tttactgaaatggta

SEQ ID NO: 35850 - DNA, 15 bp, Homo sapiens
gtttactgaaatggt

SEQ ID NO: 35851 - DNA, 15 bp, Homo sapiens
ggtttactgaaatgg

SEQ ID NO: 35852 - DNA, 15 bp, Homo sapiens
aggtttactgaaatg

SEQ ID NO: 35853 - DNA, 15 bp, Homo sapiens
caggtttactgaaat

SEQ ID NO: 35854 - DNA, 15 bp, Homo sapiens
acaggtttactgaaa

SEQ ID NO: 35855 - DNA, 15 bp, Homo sapiens
gacaggtttactgaa

SEQ ID NO: 35856 - DNA, 15 bp, Homo sapiens
agacaggtttactga

SEQ ID NO: 35857 - DNA, 15 bp, Homo sapiens
cagacaggtttactg

SEQ ID NO: 35858 - DNA, 15 bp, Homo sapiens
tcagacaggtttact

SEQ ID NO: 35859 - DNA, 15 bp, Homo sapiens
ttcagacaggtttac

SEQ ID NO: 35860 - DNA, 15 bp, Homo sapiens
attcagacaggttta

SEQ ID NO: 35861 - DNA, 15 bp, Homo sapiens
cattcagacaggttt

SEQ ID NO: 35862 - DNA, 15 bp, Homo sapiens
acattcagacaggtt

SEQ ID NO: 35863 - DNA, 15 bp, Homo sapiens
tacattcagacaggt

SEQ ID NO: 35864 - DNA, 15 bp, Homo sapiens
gtacattcagacagg

SEQ ID NO: 35865 - DNA, 15 bp, Homo sapiens
ggtacattcagacag

SEQ ID NO: 35866 - DNA, 15 bp, Homo sapiens
aggtacattcagaca

SEQ ID NO: 35867 - DNA, 15 bp, Homo sapiens
caggtacattcagac

SEQ ID NO: 35868 - DNA, 15 bp, Homo sapiens
acaggtacattcaga

SEQ ID NO: 35869 - DNA, 15 bp, Homo sapiens
tacaggtacattcag

SEQ ID NO: 35870 - DNA, 15 bp, Homo sapiens
atacaggtacattca

SEQ ID NO: 35871 - DNA, 15 bp, Homo sapiens
tatacaggtacattc

SEQ ID NO: 35872 - DNA, 15 bp, Homo sapiens
gtatacaggtacatt

SEQ ID NO: 35873 - DNA, 15 bp, Homo sapiens
cgtatacaggtacat

SEQ ID NO: 35874 - DNA, 15 bp, Homo sapiens
acgtatacaggtaca

SEQ ID NO: 35875 - DNA, 15 bp, Homo sapiens
aacgtatacaggtac

SEQ ID NO: 35876 - DNA, 15 bp, Homo sapiens
aaacgtatacaggta

SEQ ID NO: 35877 - DNA, 15 bp, Homo sapiens
gaaacgtatacaggt

SEQ ID NO: 35878 - DNA, 15 bp, Homo sapiens
tgaaacgtatacagg

SEQ ID NO: 35879 - DNA, 15 bp, Homo sapiens
ttgaaacgtatacag

SEQ ID NO: 35880 - DNA, 15 bp, Homo sapiens
tttgaaacgtataca

SEQ ID NO: 35881 - DNA, 15 bp, Homo sapiens
ttttgaaacgtatac

SEQ ID NO: 35882 - DNA, 15 bp, Homo sapiens
tttttgaaacgtata

SEQ ID NO: 35883 - DNA, 15 bp, Homo sapiens
gtttttgaaacgtat

SEQ ID NO: 35884 - DNA, 15 bp, Homo sapiens
tgtttttgaaacgta

SEQ ID NO: 35885 - DNA, 15 bp, Homo sapiens
gtgtttttgaaacgt

SEQ ID NO: 35886 - DNA, 15 bp, Homo sapiens
ggtgtttttgaaacg

SEQ ID NO: 35887 - DNA, 15 bp, Homo sapiens
gggtgtttttgaaac

SEQ ID NO: 35888 - DNA, 15 bp, Homo sapiens
ggggtgtttttgaaa

SEQ ID NO: 35889 - DNA, 15 bp, Homo sapiens
gggggtgtttttgaa

SEQ ID NO: 35890 - DNA, 15 bp, Homo sapiens
ggggggtgtttttga

SEQ ID NO: 35891 - DNA, 15 bp, Homo sapiens
gggggggtgtttttg

SEQ ID NO: 35892 - DNA, 15 bp, Homo sapiens
ggggggggtgttttt

SEQ ID NO: 35893 - DNA, 15 bp, Homo sapiens
gggggggggtgtttt

SEQ ID NO: 35894 - DNA, 15 bp, Homo sapiens
ggggggggggtgttt

SEQ ID NO: 35895 - DNA, 15 bp, Homo sapiens
tggggggggggtgtt

SEQ ID NO: 35896 - DNA, 15 bp, Homo sapiens
gtggggggggggtgt

SEQ ID NO: 35897 - DNA, 15 bp, Homo sapiens
agtggggggggggtg

SEQ ID NO: 35898 - DNA, 15 bp, Homo sapiens
cagtggggggggggt

SEQ ID NO: 35899 - DNA, 15 bp, Homo sapiens
tcagtgggggggggg

SEQ ID NO: 35900 - DNA, 15 bp, Homo sapiens
ttcagtggggggggg

SEQ ID NO: 35901 - DNA, 15 bp, Homo sapiens
attcagtgggggggg

SEQ ID NO: 35902 - DNA, 15 bp, Homo sapiens
gattcagtggggggg

SEQ ID NO: 35903 - DNA, 15 bp, Homo sapiens
ggattcagtgggggg

SEQ ID NO: 35904 - DNA, 15 bp, Homo sapiens
gggattcagtggggg

SEQ ID NO: 35905 - DNA, 15 bp, Homo sapiens
agggattcagtgggg

SEQ ID NO: 35906 - DNA, 15 bp, Homo sapiens
cagggattcagtggg

SEQ ID NO: 35907 - DNA, 15 bp, Homo sapiens
acagggattcagtgg

SEQ ID NO: 35908 - DNA, 15 bp, Homo sapiens
tacagggattcagtg

SEQ ID NO: 35909 - DNA, 15 bp, Homo sapiens
ttacagggattcagt

SEQ ID NO: 35910 - DNA, 15 bp, Homo sapiens
gttacagggattcag

SEQ ID NO: 35911 - DNA, 15 bp, Homo sapiens
ggttacagggattca

SEQ ID NO: 35912 - DNA, 15 bp, Homo sapiens
aggttacagggattc

SEQ ID NO: 35913 - DNA, 15 bp, Homo sapiens
taggttacagggatt

SEQ ID NO: 35914 - DNA, 15 bp, Homo sapiens
ataggttacagggat

SEQ ID NO: 35915 - DNA, 15 bp, Homo sapiens
aataggttacaggga

SEQ ID NO: 35916 - DNA, 15 bp, Homo sapiens
aaataggttacaggg

SEQ ID NO: 35917 - DNA, 15 bp, Homo sapiens
taaataggttacagg

SEQ ID NO: 35918 - DNA, 15 bp, Homo sapiens
ataaataggttacag

SEQ ID NO: 35919 - DNA, 15 bp, Homo sapiens
aataaataggttaca

SEQ ID NO: 35920 - DNA, 15 bp, Homo sapiens
taataaataggttac

SEQ ID NO: 35921 - DNA, 15 bp, Homo sapiens
ataataaataggtta

SEQ ID NO: 35922 - DNA, 15 bp, Homo sapiens
tataataaataggtt

SEQ ID NO: 35923 - DNA, 15 bp, Homo sapiens
atataataaataggt

SEQ ID NO: 35924 - DNA, 15 bp, Homo sapiens
tatataataaatagg

SEQ ID NO: 35925 - DNA, 15 bp, Homo sapiens
ttatataataaatag

SEQ ID NO: 35926 - DNA, 15 bp, Homo sapiens
tttatataataaata

SEQ ID NO: 35927 - DNA, 15 bp, Homo sapiens
ctttatataataaat

SEQ ID NO: 35928 - DNA, 15 bp, Homo sapiens
tctttatataataaa

SEQ ID NO: 35929 - DNA, 15 bp, Homo sapiens
ctctttatataataa

SEQ ID NO: 35930 - DNA, 15 bp, Homo sapiens
actctttatataata

SEQ ID NO: 35931 - DNA, 15 bp, Homo sapiens
aactctttatataat

SEQ ID NO: 35932 - DNA, 15 bp, Homo sapiens
aaactctttatataa

SEQ ID NO: 35933 - DNA, 15 bp, Homo sapiens
caaactctttatata

SEQ ID NO: 35934 - DNA, 15 bp, Homo sapiens
gcaaactctttatat

SEQ ID NO: 35935 - DNA, 15 bp, Homo sapiens
ggcaaactctttata

SEQ ID NO: 35936 - DNA, 15 bp, Homo sapiens
aggcaaactctttat

SEQ ID NO: 35937 - DNA, 15 bp, Homo sapiens
aaggcaaactcttta

SEQ ID NO: 35938 - DNA, 15 bp, Homo sapiens
taaggcaaactcttt

SEQ ID NO: 35939 - DNA, 15 bp, Homo sapiens
ataaggcaaactctt

SEQ ID NO: 35940 - DNA, 15 bp, Homo sapiens
tataaggcaaactct

SEQ ID NO: 35941 - DNA, 15 bp, Homo sapiens
ttataaggcaaactc

SEQ ID NO: 35942 - DNA, 15 bp, Homo sapiens
tttataaggcaaact

SEQ ID NO: 35943 - DNA, 15 bp, Homo sapiens
atttataaggcaaac

SEQ ID NO: 35944 - DNA, 15 bp, Homo sapiens
aatttataaggcaaa

SEQ ID NO: 35945 - DNA, 15 bp, Homo sapiens
aaatttataaggcaa

SEQ ID NO: 35946 - DNA, 15 bp, Homo sapiens
taaatttataaggca

SEQ ID NO: 35947 - DNA, 15 bp, Homo sapiens
gtaaatttataaggc

SEQ ID NO: 35948 - DNA, 15 bp, Homo sapiens
tgtaaatttataagg

SEQ ID NO: 35949 - DNA, 15 bp, Homo sapiens
atgtaaatttataag

SEQ ID NO: 35950 - DNA, 15 bp, Homo sapiens
tatgtaaatttataa

SEQ ID NO: 35951 - DNA, 15 bp, Homo sapiens
ttatgtaaatttata

SEQ ID NO: 35952 - DNA, 15 bp, Homo sapiens
tttatgtaaatttat

SEQ ID NO: 35953 - DNA, 15 bp, Homo sapiens
ttttatgtaaattta

SEQ ID NO: 35954 - DNA, 15 bp, Homo sapiens
tttttatgtaaattt

SEQ ID NO: 35955 - DNA, 15 bp, Homo sapiens
atttttatgtaaatt

SEQ ID NO: 35956 - DNA, 15 bp, Homo sapiens
catttttatgtaaat

SEQ ID NO: 35957 - DNA, 15 bp, Homo sapiens
acatttttatgtaaa

SEQ ID NO: 35958 - DNA, 15 bp, Homo sapiens
gacatttttatgtaa

SEQ ID NO: 35959 - DNA, 15 bp, Homo sapiens
ggacatttttatgta

SEQ ID NO: 35960 - DNA, 15 bp, Homo sapiens
cggacatttttatgt

SEQ ID NO: 35961 - DNA, 15 bp, Homo sapiens
acggacatttttatg

SEQ ID NO: 35962 - DNA, 15 bp, Homo sapiens
aacggacatttttat

SEQ ID NO: 35963 - DNA, 15 bp, Homo sapiens
aaacggacattttta

SEQ ID NO: 35964 - DNA, 15 bp, Homo sapiens
caaacggacattttt

SEQ ID NO: 35965 - DNA, 15 bp, Homo sapiens
acaaacggacatttt

SEQ ID NO: 35966 - DNA, 15 bp, Homo sapiens
cacaaacggacattt

SEQ ID NO: 35967 - DNA, 15 bp, Homo sapiens
acacaaacggacatt

SEQ ID NO: 35968 - DNA, 15 bp, Homo sapiens
gacacaaacggacat

SEQ ID NO: 35969 - DNA, 15 bp, Homo sapiens
agacacaaacggaca

SEQ ID NO: 35970 - DNA, 15 bp, Homo sapiens
aagacacaaacggac

SEQ ID NO: 35971 - DNA, 15 bp, Homo sapiens
aaagacacaaacgga

SEQ ID NO: 35972 - DNA, 15 bp, Homo sapiens
aaaagacacaaacgg

SEQ ID NO: 35973 - DNA, 15 bp, Homo sapiens
caaaagacacaaacg

SEQ ID NO: 35974 - DNA, 15 bp, Homo sapiens
acaaaagacacaaac

SEQ ID NO: 35975 - DNA, 15 bp, Homo sapiens
aacaaaagacacaaa

SEQ ID NO: 35976 - DNA, 15 bp, Homo sapiens
caacaaaagacacaa

SEQ ID NO: 35977 - DNA, 15 bp, Homo sapiens
acaacaaaagacaca

SEQ ID NO: 35978 - DNA, 15 bp, Homo sapiens
tacaacaaaagacac

SEQ ID NO: 35979 - DNA, 15 bp, Homo sapiens
ttacaacaaaagaca

SEQ ID NO: 35980 - DNA, 15 bp, Homo sapiens
tttacaacaaaagac

SEQ ID NO: 35981 - DNA, 15 bp, Homo sapiens
ttttacaacaaaaga

SEQ ID NO: 35982 - DNA, 15 bp, Homo sapiens
tttttacaacaaaag

SEQ ID NO: 35983 - DNA, 15 bp, Homo sapiens
atttttacaacaaaa

SEQ ID NO: 35984 - DNA, 15 bp, Homo sapiens
gatttttacaacaaa

SEQ ID NO: 35985 - DNA, 15 bp, Homo sapiens
tgatttttacaacaa

SEQ ID NO: 35986 - DNA, 15 bp, Homo sapiens
ttgatttttacaaca

SEQ ID NO: 35987 - DNA, 15 bp, Homo sapiens
cttgatttttacaac

SEQ ID NO: 35988 - DNA, 15 bp, Homo sapiens
acttgatttttacaa

SEQ ID NO: 35989 - DNA, 15 bp, Homo sapiens
cacttgatttttaca

SEQ ID NO: 35990 - DNA, 15 bp, Homo sapiens
tcacttgatttttac

SEQ ID NO: 35991 - DNA, 15 bp, Homo sapiens
atcacttgattttta

SEQ ID NO: 35992 - DNA, 15 bp, Homo sapiens
aatcacttgattttt

SEQ ID NO: 35993 - DNA, 15 bp, Homo sapiens
aaatcacttgatttt

SEQ ID NO: 35994 - DNA, 15 bp, Homo sapiens
aaaatcacttgattt

SEQ ID NO: 35995 - DNA, 15 bp, Homo sapiens
aaaaatcacttgatt

SEQ ID NO: 35996 - DNA, 15 bp, Homo sapiens
aaaaaatcacttgat

SEQ ID NO: 35997 - DNA, 15 bp, Homo sapiens
gaaaaaatcacttga

SEQ ID NO: 35998 - DNA, 15 bp, Homo sapiens
tgaaaaaatcacttg

SEQ ID NO: 35999 - DNA, 15 bp, Homo sapiens
atgaaaaaatcactt

SEQ ID NO: 36000 - DNA, 15 bp, Homo sapiens
tatgaaaaaatcact

SEQ ID NO: 36001 - DNA, 15 bp, Homo sapiens
ttatgaaaaaatcac

SEQ ID NO: 36002 - DNA, 15 bp, Homo sapiens
cttatgaaaaaatca

SEQ ID NO: 36003 - DNA, 15 bp, Homo sapiens
ccttatgaaaaaatc

SEQ ID NO: 36004 - DNA, 15 bp, Homo sapiens
accttatgaaaaaat

SEQ ID NO: 36005 - DNA, 15 bp, Homo sapiens
aaccttatgaaaaaa

SEQ ID NO: 36006 - DNA, 15 bp, Homo sapiens
gaaccttatgaaaaa

SEQ ID NO: 36007 - DNA, 15 bp, Homo sapiens
agaaccttatgaaaa

SEQ ID NO: 36008 - DNA, 15 bp, Homo sapiens
aagaaccttatgaaa

SEQ ID NO: 36009 - DNA, 15 bp, Homo sapiens
aaagaaccttatgaa

SEQ ID NO: 36010 - DNA, 15 bp, Homo sapiens
aaaagaaccttatga

SEQ ID NO: 36011 - DNA, 15 bp, Homo sapiens
taaaagaaccttatg

SEQ ID NO: 36012 - DNA, 15 bp, Homo sapiens
gtaaaagaaccttat

SEQ ID NO: 36013 - DNA, 15 bp, Homo sapiens
agtaaaagaacctta

SEQ ID NO: 36014 - DNA, 15 bp, Homo sapiens
tagtaaaagaacctt

SEQ ID NO: 36015 - DNA, 15 bp, Homo sapiens
atagtaaaagaacct

SEQ ID NO: 36016 - DNA, 15 bp, Homo sapiens
aatagtaaaagaacc

SEQ ID NO: 36017 - DNA, 15 bp, Homo sapiens
caatagtaaaagaac

SEQ ID NO: 36018 - DNA, 15 bp, Homo sapiens
ccaatagtaaaagaa

SEQ ID NO: 36019 - DNA, 15 bp, Homo sapiens
tccaatagtaaaaga

SEQ ID NO: 36020 - DNA, 15 bp, Homo sapiens
ttccaatagtaaaag

SEQ ID NO: 36021 - DNA, 15 bp, Homo sapiens
tttccaatagtaaaa

SEQ ID NO: 36022 - DNA, 15 bp, Homo sapiens
ttttccaatagtaaa

SEQ ID NO: 36023 - DNA, 15 bp, Homo sapiens
cttttccaatagtaa

SEQ ID NO: 36024 - DNA, 15 bp, Homo sapiens
tcttttccaatagta

SEQ ID NO: 36025 - DNA, 15 bp, Homo sapiens
atcttttccaatagt

SEQ ID NO: 36026 - DNA, 15 bp, Homo sapiens
catcttttccaatag

SEQ ID NO: 36027 - DNA, 15 bp, Homo sapiens
ccatcttttccaata

SEQ ID NO: 36028 - DNA, 15 bp, Homo sapiens
cccatcttttccaat

SEQ ID NO: 36029 - DNA, 15 bp, Homo sapiens
gcccatcttttccaa

SEQ ID NO: 36030 - DNA, 15 bp, Homo sapiens
tgcccatcttttcca

SEQ ID NO: 36031 - DNA, 15 bp, Homo sapiens
ctgcccatcttttcc

SEQ ID NO: 36032 - DNA, 15 bp, Homo sapiens
gctgcccatcttttc

SEQ ID NO: 36033 - DNA, 15 bp, Homo sapiens
tgctgcccatctttt

SEQ ID NO: 36034 - DNA, 15 bp, Homo sapiens
gtgctgcccatcttt

SEQ ID NO: 36035 - DNA, 15 bp, Homo sapiens
cgtgctgcccatctt

SEQ ID NO: 36036 - DNA, 15 bp, Homo sapiens
gcgtgctgcccatct

SEQ ID NO: 36037 - DNA, 15 bp, Homo sapiens
tgcgtgctgcccatc

SEQ ID NO: 36038 - DNA, 15 bp, Homo sapiens
ctgcgtgctgcccat

SEQ ID NO: 36039 - DNA, 15 bp, Homo sapiens
actgcgtgctgccca

SEQ ID NO: 36040 - DNA, 15 bp, Homo sapiens
aactgcgtgctgccc

SEQ ID NO: 36041 - DNA, 15 bp, Homo sapiens
aaactgcgtgctgcc

SEQ ID NO: 36042 - DNA, 15 bp, Homo sapiens
aaaactgcgtgctgc

SEQ ID NO: 36043 - DNA, 15 bp, Homo sapiens
taaaactgcgtgctg

SEQ ID NO: 36044 - DNA, 15 bp, Homo sapiens
ataaaactgcgtgct

SEQ ID NO: 36045 - DNA, 15 bp, Homo sapiens
aataaaactgcgtgc

SEQ ID NO: 36046 - DNA, 15 bp, Homo sapiens
aaataaaactgcgtg

SEQ ID NO: 36047 - DNA, 15 bp, Homo sapiens
aaaataaaactgcgt

SEQ ID NO: 36048 - DNA, 15 bp, Homo sapiens
taaaataaaactgcg

SEQ ID NO: 36049 - DNA, 15 bp, Homo sapiens
ataaaataaaactgc

SEQ ID NO: 36050 - DNA, 15 bp, Homo sapiens
aataaaataaaactg

SEQ ID NO: 36051 - DNA, 15 bp, Homo sapiens
aaataaaataaaact

SEQ ID NO: 36052 - DNA, 15 bp, Homo sapiens
aaaataaaataaaac

SEQ ID NO: 36053 - DNA, 15 bp, Homo sapiens
aaaaataaaataaaa

SEQ ID NO: 36054 - DNA, 15 bp, Homo sapiens
caaaaataaaataaa

SEQ ID NO: 36055 - DNA, 15 bp, Homo sapiens
acaaaaataaaataa

SEQ ID NO: 36056 - DNA, 15 bp, Homo sapiens
tacaaaaataaaata

SEQ ID NO: 36057 - DNA, 15 bp, Homo sapiens
ttacaaaaataaaat

SEQ ID NO: 36058 - DNA, 15 bp, Homo sapiens
cttacaaaaataaaa

SEQ ID NO: 36059 - DNA, 15 bp, Homo sapiens
acttacaaaaataaa

SEQ ID NO: 36060 - DNA, 15 bp, Homo sapiens
aacttacaaaaataa

SEQ ID NO: 36061 - DNA, 15 bp, Homo sapiens
aaacttacaaaaata

SEQ ID NO: 36062 - DNA, 15 bp, Homo sapiens
aaaacttacaaaaat

SEQ ID NO: 36063 - DNA, 15 bp, Homo sapiens
aaaaacttacaaaaa

SEQ ID NO: 36064 - DNA, 15 bp, Homo sapiens
aaaaaacttacaaaa

SEQ ID NO: 36065 - DNA, 15 bp, Homo sapiens
taaaaaacttacaaa

SEQ ID NO: 36066 - DNA, 15 bp, Homo sapiens
ttaaaaaacttacaa

SEQ ID NO: 36067 - DNA, 15 bp, Homo sapiens
attaaaaaacttaca

SEQ ID NO: 36068 - DNA, 15 bp, Homo sapiens
tattaaaaaacttac

SEQ ID NO: 36069 - DNA, 15 bp, Homo sapiens
gtattaaaaaactta

SEQ ID NO: 36070 - DNA, 15 bp, Homo sapiens
tgtattaaaaaactt

SEQ ID NO: 36071 - DNA, 15 bp, Homo sapiens
atgtattaaaaaact

SEQ ID NO: 36072 - DNA, 15 bp, Homo sapiens
catgtattaaaaaac

SEQ ID NO: 36073 - DNA, 15 bp, Homo sapiens
acatgtattaaaaaa

SEQ ID NO: 36074 - DNA, 15 bp, Homo sapiens
cacatgtattaaaaa

SEQ ID NO: 36075 - DNA, 15 bp, Homo sapiens
tcacatgtattaaaa

SEQ ID NO: 36076 - DNA, 15 bp, Homo sapiens
ttcacatgtattaaa

SEQ ID NO: 36077 - DNA, 15 bp, Homo sapiens
tttcacatgtattaa

SEQ ID NO: 36078 - DNA, 15 bp, Homo sapiens
ctttcacatgtatta

SEQ ID NO: 36079 - DNA, 15 bp, Homo sapiens
gctttcacatgtatt

SEQ ID NO: 36080 - DNA, 15 bp, Homo sapiens
tgctttcacatgtat

SEQ ID NO: 36081 - DNA, 15 bp, Homo sapiens
ttgctttcacatgta

SEQ ID NO: 36082 - DNA, 15 bp, Homo sapiens
tttgctttcacatgt

SEQ ID NO: 36083 - DNA, 15 bp, Homo sapiens
ctttgctttcacatg

SEQ ID NO: 36084 - DNA, 15 bp, Homo sapiens
tctttgctttcacat

SEQ ID NO: 36085 - DNA, 15 bp, Homo sapiens
ttctttgctttcaca

SEQ ID NO: 36086 - DNA, 15 bp, Homo sapiens
attctttgctttcac

SEQ ID NO: 36087 - DNA, 15 bp, Homo sapiens
tattctttgctttca

SEQ ID NO: 36088 - DNA, 15 bp, Homo sapiens
gtattctttgctttc

SEQ ID NO: 36089 - DNA, 15 bp, Homo sapiens
agtattctttgcttt

SEQ ID NO: 36090 - DNA, 15 bp, Homo sapiens
gagtattctttgctt

SEQ ID NO: 36091 - DNA, 15 bp, Homo sapiens
tgagtattctttgct

SEQ ID NO: 36092 - DNA, 15 bp, Homo sapiens
ctgagtattctttgc

SEQ ID NO: 36093 - DNA, 15 bp, Homo sapiens
gctgagtattctttg

SEQ ID NO: 36094 - DNA, 15 bp, Homo sapiens
tgctgagtattcttt

SEQ ID NO: 36095 - DNA, 15 bp, Homo sapiens
atgctgagtattctt

SEQ ID NO: 36096 - DNA, 15 bp, Homo sapiens
catgctgagtattct

SEQ ID NO: 36097 - DNA, 15 bp, Homo sapiens
gcatgctgagtattc

SEQ ID NO: 36098 - DNA, 15 bp, Homo sapiens
ggcatgctgagtatt

SEQ ID NO: 36099 - DNA, 15 bp, Homo sapiens
aggcatgctgagtat

SEQ ID NO: 36100 - DNA, 15 bp, Homo sapiens
aaggcatgctgagta

SEQ ID NO: 36101 - DNA, 15 bp, Homo sapiens
aaaggcatgctgagt

SEQ ID NO: 36102 - DNA, 15 bp, Homo sapiens
gaaaggcatgctgag

SEQ ID NO: 36103 - DNA, 15 bp, Homo sapiens
agaaaggcatgctga

SEQ ID NO: 36104 - DNA, 15 bp, Homo sapiens
tagaaaggcatgctg

SEQ ID NO: 36105 - DNA, 15 bp, Homo sapiens
ttagaaaggcatgct

SEQ ID NO: 36106 - DNA, 15 bp, Homo sapiens
cttagaaaggcatgc

SEQ ID NO: 36107 - DNA, 15 bp, Homo sapiens
acttagaaaggcatg

SEQ ID NO: 36108 - DNA, 15 bp, Homo sapiens
cacttagaaaggcat

SEQ ID NO: 36109 - DNA, 15 bp, Homo sapiens
tcacttagaaaggca

SEQ ID NO: 36110 - DNA, 15 bp, Homo sapiens
gtcacttagaaaggc

SEQ ID NO: 36111 - DNA, 15 bp, Homo sapiens
cgtcacttagaaagg

SEQ ID NO: 36112 - DNA, 15 bp, Homo sapiens
gcgtcacttagaaag

SEQ ID NO: 36113 - DNA, 15 bp, Homo sapiens
cgcgtcacttagaaa

SEQ ID NO: 36114 - DNA, 15 bp, Homo sapiens
acgcgtcacttagaa

SEQ ID NO: 36115 - DNA, 15 bp, Homo sapiens
aacgcgtcacttaga

SEQ ID NO: 36116 - DNA, 15 bp, Homo sapiens
aaacgcgtcacttag

SEQ ID NO: 36117 - DNA, 15 bp, Homo sapiens
caaacgcgtcactta

SEQ ID NO: 36118 - DNA, 15 bp, Homo sapiens
gcaaacgcgtcactt

SEQ ID NO: 36119 - DNA, 15 bp, Homo sapiens
tgcaaacgcgtcact

SEQ ID NO: 36120 - DNA, 15 bp, Homo sapiens
gtgcaaacgcgtcac

SEQ ID NO: 36121 - DNA, 15 bp, Homo sapiens
ggtgcaaacgcgtca

SEQ ID NO: 36122 - DNA, 15 bp, Homo sapiens
aggtgcaaacgcgtc

SEQ ID NO: 36123 - DNA, 15 bp, Homo sapiens
aaggtgcaaacgcgt

SEQ ID NO: 36124 - DNA, 15 bp, Homo sapiens
aaaggtgcaaacgcg

SEQ ID NO: 36125 - DNA, 15 bp, Homo sapiens
aaaaggtgcaaacgc

SEQ ID NO: 36126 - DNA, 15 bp, Homo sapiens
caaaaggtgcaaacg

SEQ ID NO: 36127 - DNA, 15 bp, Homo sapiens
acaaaaggtgcaaac

SEQ ID NO: 36128 - DNA, 15 bp, Homo sapiens
aacaaaaggtgcaaa

SEQ ID NO: 36129 - DNA, 15 bp, Homo sapiens
caacaaaaggtgcaa

SEQ ID NO: 36130 - DNA, 15 bp, Homo sapiens
ccaacaaaaggtgca

SEQ ID NO: 36131 - DNA, 15 bp, Homo sapiens
cccaacaaaaggtgc

SEQ ID NO: 36132 - DNA, 15 bp, Homo sapiens
tcccaacaaaaggtg

SEQ ID NO: 36133 - DNA, 15 bp, Homo sapiens
ttcccaacaaaaggt

SEQ ID NO: 36134 - DNA, 15 bp, Homo sapiens
cttcccaacaaaagg

SEQ ID NO: 36135 - DNA, 15 bp, Homo sapiens
acttcccaacaaaag

SEQ ID NO: 36136 - DNA, 15 bp, Homo sapiens
tacttcccaacaaaa

SEQ ID NO: 36137 - DNA, 15 bp, Homo sapiens
gtacttcccaacaaa

SEQ ID NO: 36138 - DNA, 15 bp, Homo sapiens
agtacttcccaacaa

SEQ ID NO: 36139 - DNA, 15 bp, Homo sapiens
cagtacttcccaaca

SEQ ID NO: 36140 - DNA, 15 bp, Homo sapiens
acagtacttcccaac

SEQ ID NO: 36141 - DNA, 15 bp, Homo sapiens
tacagtacttcccaa

SEQ ID NO: 36142 - DNA, 15 bp, Homo sapiens
atacagtacttccca

SEQ ID NO: 36143 - DNA, 15 bp, Homo sapiens
gatacagtacttccc

SEQ ID NO: 36144 - DNA, 15 bp, Homo sapiens
ggatacagtacttcc

SEQ ID NO: 36145 - DNA, 15 bp, Homo sapiens
aggatacagtacttc

SEQ ID NO: 36146 - DNA, 15 bp, Homo sapiens
caggatacagtactt

SEQ ID NO: 36147 - DNA, 15 bp, Homo sapiens
acaggatacagtact

SEQ ID NO: 36148 - DNA, 15 bp, Homo sapiens
cacaggatacagtac

SEQ ID NO: 36149 - DNA, 15 bp, Homo sapiens
gcacaggatacagta

SEQ ID NO: 36150 - DNA, 15 bp, Homo sapiens
agcacaggatacagt

SEQ ID NO: 36151 - DNA, 15 bp, Homo sapiens
cagcacaggatacag

SEQ ID NO: 36152 - DNA, 15 bp, Homo sapiens
acagcacaggataca

SEQ ID NO: 36153 - DNA, 15 bp, Homo sapiens
aacagcacaggatac

SEQ ID NO: 36154 - DNA, 15 bp, Homo sapiens
taacagcacaggata

SEQ ID NO: 36155 - DNA, 15 bp, Homo sapiens
ctaacagcacaggat

SEQ ID NO: 36156 - DNA, 15 bp, Homo sapiens
gctaacagcacagga

SEQ ID NO: 36157 - DNA, 15 bp, Homo sapiens
tgctaacagcacagg

SEQ ID NO: 36158 - DNA, 15 bp, Homo sapiens
atgctaacagcacag

SEQ ID NO: 36159 - DNA, 15 bp, Homo sapiens
aatgctaacagcaca

SEQ ID NO: 36160 - DNA, 15 bp, Homo sapiens
gaatgctaacagcac

SEQ ID NO: 36161 - DNA, 15 bp, Homo sapiens
agaatgctaacagca

SEQ ID NO: 36162 - DNA, 15 bp, Homo sapiens
gagaatgctaacagc

SEQ ID NO: 36163 - DNA, 15 bp, Homo sapiens
cgagaatgctaacag

SEQ ID NO: 36164 - DNA, 15 bp, Homo sapiens
tcgagaatgctaaca

SEQ ID NO: 36165 - DNA, 15 bp, Homo sapiens
atcgagaatgctaac

SEQ ID NO: 36166 - DNA, 15 bp, Homo sapiens
tatcgagaatgctaa

SEQ ID NO: 36167 - DNA, 15 bp, Homo sapiens
ttatcgagaatgcta

SEQ ID NO: 36168 - DNA, 15 bp, Homo sapiens
tttatcgagaatgct

SEQ ID NO: 36169 - DNA, 15 bp, Homo sapiens
atttatcgagaatgc

SEQ ID NO: 36170 - DNA, 15 bp, Homo sapiens
gatttatcgagaatg

SEQ ID NO: 36171 - DNA, 15 bp, Homo sapiens
agatttatcgagaat

SEQ ID NO: 36172 - DNA, 15 bp, Homo sapiens
gagatttatcgagaa

SEQ ID NO: 36173 - DNA, 15 bp, Homo sapiens
agagatttatcgaga

SEQ ID NO: 36174 - DNA, 15 bp, Homo sapiens
gagagatttatcgag

SEQ ID NO: 36175 - DNA, 15 bp, Homo sapiens
agagagatttatcga

SEQ ID NO: 36176 - DNA, 15 bp, Homo sapiens
cagagagatttatcg

SEQ ID NO: 36177 - DNA, 15 bp, Homo sapiens
acagagagatttatc

SEQ ID NO: 36178 - DNA, 15 bp, Homo sapiens
cacagagagatttat

SEQ ID NO: 36179 - DNA, 15 bp, Homo sapiens
tcacagagagattta

SEQ ID NO: 36180 - DNA, 15 bp, Homo sapiens
ttcacagagagattt

SEQ ID NO: 36181 - DNA, 15 bp, Homo sapiens
tttcacagagagatt

SEQ ID NO: 36182 - DNA, 15 bp, Homo sapiens
ctttcacagagagat

SEQ ID NO: 36183 - DNA, 15 bp, Homo sapiens
actttcacagagaga

SEQ ID NO: 36184 - DNA, 15 bp, Homo sapiens
cactttcacagagag

SEQ ID NO: 36185 - DNA, 15 bp, Homo sapiens
tcactttcacagaga

SEQ ID NO: 36186 - DNA, 15 bp, Homo sapiens
gtcactttcacagag

SEQ ID NO: 36187 - DNA, 15 bp, Homo sapiens
agtcactttcacaga

SEQ ID NO: 36188 - DNA, 15 bp, Homo sapiens
gagtcactttcacag

SEQ ID NO: 36189 - DNA, 15 bp, Homo sapiens
tgagtcactttcaca

SEQ ID NO: 36190 - DNA, 15 bp, Homo sapiens
ttgagtcactttcac

SEQ ID NO: 36191 - DNA, 15 bp, Homo sapiens
cttgagtcactttca

SEQ ID NO: 36192 - DNA, 15 bp, Homo sapiens
ccttgagtcactttc

SEQ ID NO: 36193 - DNA, 15 bp, Homo sapiens
accttgagtcacttt

SEQ ID NO: 36194 - DNA, 15 bp, Homo sapiens
gaccttgagtcactt

SEQ ID NO: 36195 - DNA, 15 bp, Homo sapiens
agaccttgagtcact

SEQ ID NO: 36196 - DNA, 15 bp, Homo sapiens
cagaccttgagtcac

SEQ ID NO: 36197 - DNA, 15 bp, Homo sapiens
ccagaccttgagtca

SEQ ID NO: 36198 - DNA, 15 bp, Homo sapiens
cccagaccttgagtc

SEQ ID NO: 36199 - DNA, 15 bp, Homo sapiens
gcccagaccttgagt

SEQ ID NO: 36200 - DNA, 15 bp, Homo sapiens
agcccagaccttgag

SEQ ID NO: 36201 - DNA, 15 bp, Homo sapiens
aagcccagaccttga

SEQ ID NO: 36202 - DNA, 15 bp, Homo sapiens
aaagcccagaccttg

SEQ ID NO: 36203 - DNA, 15 bp, Homo sapiens
gaaagcccagacctt

SEQ ID NO: 36204 - DNA, 15 bp, Homo sapiens
tgaaagcccagacct

SEQ ID NO: 36205 - DNA, 15 bp, Homo sapiens
atgaaagcccagacc

SEQ ID NO: 36206 - DNA, 15 bp, Homo sapiens
aatgaaagcccagac

SEQ ID NO: 36207 - DNA, 15 bp, Homo sapiens
taatgaaagcccaga

SEQ ID NO: 36208 - DNA, 15 bp, Homo sapiens
ataatgaaagcccag

SEQ ID NO: 36209 - DNA, 15 bp, Homo sapiens
tataatgaaagccca

SEQ ID NO: 36210 - DNA, 15 bp, Homo sapiens
ttataatgaaagccc

SEQ ID NO: 36211 - DNA, 15 bp, Homo sapiens
cttataatgaaagcc

SEQ ID NO: 36212 - DNA, 15 bp, Homo sapiens
tcttataatgaaagc

SEQ ID NO: 36213 - DNA, 15 bp, Homo sapiens
gtcttataatgaaag

SEQ ID NO: 36214 - DNA, 15 bp, Homo sapiens
tgtcttataatgaaa

SEQ ID NO: 36215 - DNA, 15 bp, Homo sapiens
ctgtcttataatgaa

SEQ ID NO: 36216 - DNA, 15 bp, Homo sapiens
tctgtcttataatga

SEQ ID NO: 36217 - DNA, 15 bp, Homo sapiens
ttctgtcttataatg

SEQ ID NO: 36218 - DNA, 15 bp, Homo sapiens
cttctgtcttataat

SEQ ID NO: 36219 - DNA, 15 bp, Homo sapiens
acttctgtcttataa

SEQ ID NO: 36220 - DNA, 15 bp, Homo sapiens
gacttctgtcttata

SEQ ID NO: 36221 - DNA, 15 bp, Homo sapiens
ggacttctgtcttat

SEQ ID NO: 36222 - DNA, 15 bp, Homo sapiens
gggacttctgtctta

SEQ ID NO: 36223 - DNA, 15 bp, Homo sapiens
ggggacttctgtctt

SEQ ID NO: 36224 - DNA, 15 bp, Homo sapiens
gggggacttctgtct

SEQ ID NO: 36225 - DNA, 15 bp, Homo sapiens
agggggacttctgtc

SEQ ID NO: 36226 - DNA, 15 bp, Homo sapiens
gagggggacttctgt

SEQ ID NO: 36227 - DNA, 15 bp, Homo sapiens
ggagggggacttctg

SEQ ID NO: 36228 - DNA, 15 bp, Homo sapiens
tggagggggacttct

SEQ ID NO: 36229 - DNA, 15 bp, Homo sapiens
ctggagggggacttc

SEQ ID NO: 36230 - DNA, 15 bp, Homo sapiens
gctggagggggactt

SEQ ID NO: 36231 - DNA, 15 bp, Homo sapiens
agctggagggggact

SEQ ID NO: 36232 - DNA, 15 bp, Homo sapiens
gagctggagggggac

SEQ ID NO: 36233 - DNA, 15 bp, Homo sapiens
tgagctggaggggga

SEQ ID NO: 36234 - DNA, 15 bp, Homo sapiens
gtgagctggaggggg

SEQ ID NO: 36235 - DNA, 15 bp, Homo sapiens
tgtgagctggagggg

SEQ ID NO: 36236 - DNA, 15 bp, Homo sapiens
atgtgagctggaggg

SEQ ID NO: 36237 - DNA, 15 bp, Homo sapiens
catgtgagctggagg

SEQ ID NO: 36238 - DNA, 15 bp, Homo sapiens
tcatgtgagctggag

SEQ ID NO: 36239 - DNA, 15 bp, Homo sapiens
gtcatgtgagctgga

SEQ ID NO: 36240 - DNA, 15 bp, Homo sapiens
tgtcatgtgagctgg

SEQ ID NO: 36241 - DNA, 15 bp, Homo sapiens
ctgtcatgtgagctg

SEQ ID NO: 36242 - DNA, 15 bp, Homo sapiens
gctgtcatgtgagct

SEQ ID NO: 36243 - DNA, 15 bp, Homo sapiens
tgctgtcatgtgagc

SEQ ID NO: 36244 - DNA, 15 bp, Homo sapiens
atgctgtcatgtgag

SEQ ID NO: 36245 - DNA, 15 bp, Homo sapiens
catgctgtcatgtga

SEQ ID NO: 36246 - DNA, 15 bp, Homo sapiens
ccatgctgtcatgtg

SEQ ID NO: 36247 - DNA, 15 bp, Homo sapiens
accatgctgtcatgt

SEQ ID NO: 36248 - DNA, 15 bp, Homo sapiens
caccatgctgtcatg

SEQ ID NO: 36249 - DNA, 15 bp, Homo sapiens
gcaccatgctgtcat

SEQ ID NO: 36250 - DNA, 15 bp, Homo sapiens
agcaccatgctgtca

SEQ ID NO: 36251 - DNA, 15 bp, Homo sapiens
cagcaccatgctgtc

SEQ ID NO: 36252 - DNA, 15 bp, Homo sapiens
gcagcaccatgctgt

SEQ ID NO: 36253 - DNA, 15 bp, Homo sapiens
cgcagcaccatgctg

SEQ ID NO: 36254 - DNA, 15 bp, Homo sapiens
acgcagcaccatgct

SEQ ID NO: 36255 - DNA, 15 bp, Homo sapiens
aacgcagcaccatgc

SEQ ID NO: 36256 - DNA, 15 bp, Homo sapiens
aaacgcagcaccatg

SEQ ID NO: 36257 - DNA, 15 bp, Homo sapiens
gaaacgcagcaccat

SEQ ID NO: 36258 - DNA, 15 bp, Homo sapiens
ggaaacgcagcacca

SEQ ID NO: 36259 - DNA, 15 bp, Homo sapiens
aggaaacgcagcacc

SEQ ID NO: 36260 - DNA, 15 bp, Homo sapiens
gaggaaacgcagcac

SEQ ID NO: 36261 - DNA, 15 bp, Homo sapiens
tgaggaaacgcagca

SEQ ID NO: 36262 - DNA, 15 bp, Homo sapiens
atgaggaaacgcagc

SEQ ID NO: 36263 - DNA, 15 bp, Homo sapiens
aatgaggaaacgcag

SEQ ID NO: 36264 - DNA, 15 bp, Homo sapiens
caatgaggaaacgca

SEQ ID NO: 36265 - DNA, 15 bp, Homo sapiens
ccaatgaggaaacgc

SEQ ID NO: 36266 - DNA, 15 bp, Homo sapiens
tccaatgaggaaacg

SEQ ID NO: 36267 - DNA, 15 bp, Homo sapiens
atccaatgaggaaac

SEQ ID NO: 36268 - DNA, 15 bp, Homo sapiens
gatccaatgaggaaa

SEQ ID NO: 36269 - DNA, 15 bp, Homo sapiens
agatccaatgaggaa

SEQ ID NO: 36270 - DNA, 15 bp, Homo sapiens
cagatccaatgagga

SEQ ID NO: 36271 - DNA, 15 bp, Homo sapiens
ccagatccaatgagg

SEQ ID NO: 36272 - DNA, 15 bp, Homo sapiens
gccagatccaatgag

SEQ ID NO: 36273 - DNA, 15 bp, Homo sapiens
agccagatccaatga

SEQ ID NO: 36274 - DNA, 15 bp, Homo sapiens
cagccagatccaatg

SEQ ID NO: 36275 - DNA, 15 bp, Homo sapiens
acagccagatccaat

SEQ ID NO: 36276 - DNA, 15 bp, Homo sapiens
gacagccagatccaa

SEQ ID NO: 36277 - DNA, 15 bp, Homo sapiens
ggacagccagatcca

SEQ ID NO: 36278 - DNA, 15 bp, Homo sapiens
gggacagccagatcc

SEQ ID NO: 36279 - DNA, 15 bp, Homo sapiens
agggacagccagatc

SEQ ID NO: 36280 - DNA, 15 bp, Homo sapiens
cagggacagccagat

SEQ ID NO: 36281 - DNA, 15 bp, Homo sapiens
ccagggacagccaga

SEQ ID NO: 36282 - DNA, 15 bp, Homo sapiens
tccagggacagccag

SEQ ID NO: 36283 - DNA, 15 bp, Homo sapiens
gtccagggacagcca

SEQ ID NO: 36284 - DNA, 15 bp, Homo sapiens
tgtccagggacagcc

SEQ ID NO: 36285 - DNA, 15 bp, Homo sapiens
gtgtccagggacagc

SEQ ID NO: 36286 - DNA, 15 bp, Homo sapiens
tgtgtccagggacag

SEQ ID NO: 36287 - DNA, 15 bp, Homo sapiens
ctgtgtccagggaca

SEQ ID NO: 36288 - DNA, 15 bp, Homo sapiens
cctgtgtccagggac

SEQ ID NO: 36289 - DNA, 15 bp, Homo sapiens
acctgtgtccaggga

SEQ ID NO: 36290 - DNA, 15 bp, Homo sapiens
tacctgtgtccaggg

SEQ ID NO: 36291 - DNA, 15 bp, Homo sapiens
ctacctgtgtccagg

SEQ ID NO: 36292 - DNA, 15 bp, Homo sapiens
gctacctgtgtccag

SEQ ID NO: 36293 - DNA, 15 bp, Homo sapiens
agctacctgtgtcca

SEQ ID NO: 36294 - DNA, 15 bp, Homo sapiens
cagctacctgtgtcc

SEQ ID NO: 36295 - DNA, 15 bp, Homo sapiens
gcagctacctgtgtc

SEQ ID NO: 36296 - DNA, 15 bp, Homo sapiens
ggcagctacctgtgt

SEQ ID NO: 36297 - DNA, 15 bp, Homo sapiens
aggcagctacctgtg

SEQ ID NO: 36298 - DNA, 15 bp, Homo sapiens
aaggcagctacctgt

SEQ ID NO: 36299 - DNA, 15 bp, Homo sapiens
gaaggcagctacctg

SEQ ID NO: 36300 - DNA, 15 bp, Homo sapiens
tgaaggcagctacct

SEQ ID NO: 36301 - DNA, 15 bp, Homo sapiens
ctgaaggcagctacc

SEQ ID NO: 36302 - DNA, 15 bp, Homo sapiens
cctgaaggcagctac

SEQ ID NO: 36303 - DNA, 15 bp, Homo sapiens
gcctgaaggcagcta

SEQ ID NO: 36304 - DNA, 15 bp, Homo sapiens
ggcctgaaggcagct

SEQ ID NO: 36305 - DNA, 15 bp, Homo sapiens
aggcctgaaggcagc

SEQ ID NO: 36306 - DNA, 15 bp, Homo sapiens
caggcctgaaggcag

SEQ ID NO: 36307 - DNA, 15 bp, Homo sapiens
gcaggcctgaaggca

SEQ ID NO: 36308 - DNA, 15 bp, Homo sapiens
ggcaggcctgaaggc

SEQ ID NO: 36309 - DNA, 15 bp, Homo sapiens
tggcaggcctgaagg

SEQ ID NO: 36310 - DNA, 15 bp, Homo sapiens
gtggcaggcctgaag

SEQ ID NO: 36311 - DNA, 15 bp, Homo sapiens
cgtggcaggcctgaa

SEQ ID NO: 36312 - DNA, 15 bp, Homo sapiens
tcgtggcaggcctga

SEQ ID NO: 36313 - DNA, 15 bp, Homo sapiens
ctcgtggcaggcctg

SEQ ID NO: 36314 - DNA, 15 bp, Homo sapiens
gctcgtggcaggcct

SEQ ID NO: 36315 - DNA, 15 bp, Homo sapiens
cgctcgtggcaggcc

SEQ ID NO: 36316 - DNA, 15 bp, Homo sapiens
ccgctcgtggcaggc

SEQ ID NO: 36317 - DNA, 15 bp, Homo sapiens
gccgctcgtggcagg

SEQ ID NO: 36318 - DNA, 15 bp, Homo sapiens
ggccgctcgtggcag

SEQ ID NO: 36319 - DNA, 15 bp, Homo sapiens
tggccgctcgtggca

SEQ ID NO: 36320 - DNA, 15 bp, Homo sapiens
ttggccgctcgtggc

SEQ ID NO: 36321 - DNA, 15 bp, Homo sapiens
cttggccgctcgtgg

SEQ ID NO: 36322 - DNA, 15 bp, Homo sapiens
ccttggccgctcgtg

SEQ ID NO: 36323 - DNA, 15 bp, Homo sapiens
cccttggccgctcgt

SEQ ID NO: 36324 - DNA, 15 bp, Homo sapiens
tcccttggccgctcg

SEQ ID NO: 36325 - DNA, 15 bp, Homo sapiens
ttcccttggccgctc

SEQ ID NO: 36326 - DNA, 15 bp, Homo sapiens
cttcccttggccgct

SEQ ID NO: 36327 - DNA, 15 bp, Homo sapiens
gcttcccttggccgc

SEQ ID NO: 36328 - DNA, 15 bp, Homo sapiens
ggcttcccttggccg

SEQ ID NO: 36329 - DNA, 15 bp, Homo sapiens
aggcttcccttggcc

SEQ ID NO: 36330 - DNA, 15 bp, Homo sapiens
gaggcttcccttggc

SEQ ID NO: 36331 - DNA, 15 bp, Homo sapiens
ggaggcttcccttgg

SEQ ID NO: 36332 - DNA, 15 bp, Homo sapiens
aggaggcttcccttg

SEQ ID NO: 36333 - DNA, 15 bp, Homo sapiens
gaggaggcttccctt

SEQ ID NO: 36334 - DNA, 15 bp, Homo sapiens
ggaggaggcttccct

SEQ ID NO: 36335 - DNA, 15 bp, Homo sapiens
tggaggaggcttccc

SEQ ID NO: 36336 - DNA, 15 bp, Homo sapiens
atggaggaggcttcc

SEQ ID NO: 36337 - DNA, 15 bp, Homo sapiens
tatggaggaggcttc

SEQ ID NO: 36338 - DNA, 15 bp, Homo sapiens
atatggaggaggctt

SEQ ID NO: 36339 - DNA, 15 bp, Homo sapiens
catatggaggaggct

SEQ ID NO: 36340 - DNA, 15 bp, Homo sapiens
gcatatggaggaggc

SEQ ID NO: 36341 - DNA, 15 bp, Homo sapiens
agcatatggaggagg

SEQ ID NO: 36342 - DNA, 15 bp, Homo sapiens
cagcatatggaggag

SEQ ID NO: 36343 - DNA, 15 bp, Homo sapiens
ccagcatatggagga

SEQ ID NO: 36344 - DNA, 15 bp, Homo sapiens
gccagcatatggagg

SEQ ID NO: 36345 - DNA, 15 bp, Homo sapiens
ggccagcatatggag

SEQ ID NO: 36346 - DNA, 15 bp, Homo sapiens
aggccagcatatgga

SEQ ID NO: 36347 - DNA, 15 bp, Homo sapiens
gaggccagcatatgg

SEQ ID NO: 36348 - DNA, 15 bp, Homo sapiens
cgaggccagcatatg

SEQ ID NO: 36349 - DNA, 15 bp, Homo sapiens
gcgaggccagcatat

SEQ ID NO: 36350 - DNA, 15 bp, Homo sapiens
agcgaggccagcata

SEQ ID NO: 36351 - DNA, 15 bp, Homo sapiens
cagcgaggccagcat

SEQ ID NO: 36352 - DNA, 15 bp, Homo sapiens
ccagcgaggccagca

SEQ ID NO: 36353 - DNA, 15 bp, Homo sapiens
gccagcgaggccagc

SEQ ID NO: 36354 - DNA, 15 bp, Homo sapiens
ggccagcgaggccag

SEQ ID NO: 36355 - DNA, 15 bp, Homo sapiens
gggccagcgaggcca

SEQ ID NO: 36356 - DNA, 15 bp, Homo sapiens
ggggccagcgaggcc

SEQ ID NO: 36357 - DNA, 15 bp, Homo sapiens
aggggccagcgaggc

SEQ ID NO: 36358 - DNA, 15 bp, Homo sapiens
gaggggccagcgagg

SEQ ID NO: 36359 - DNA, 15 bp, Homo sapiens
tgaggggccagcgag

SEQ ID NO: 36360 - DNA, 15 bp, Homo sapiens
ctgaggggccagcga

SEQ ID NO: 36361 - DNA, 15 bp, Homo sapiens
gctgaggggccagcg

SEQ ID NO: 36362 - DNA, 15 bp, Homo sapiens
agctgaggggccagc

SEQ ID NO: 36363 - DNA, 15 bp, Homo sapiens
aagctgaggggccag

SEQ ID NO: 36364 - DNA, 15 bp, Homo sapiens
gaagctgaggggcca

SEQ ID NO: 36365 - DNA, 15 bp, Homo sapiens
agaagctgaggggcc

SEQ ID NO: 36366 - DNA, 15 bp, Homo sapiens
aagaagctgaggggc

SEQ ID NO: 36367 - DNA, 15 bp, Homo sapiens
gaagaagctgagggg

SEQ ID NO: 36368 - DNA, 15 bp, Homo sapiens
ggaagaagctgaggg

SEQ ID NO: 36369 - DNA, 15 bp, Homo sapiens
tggaagaagctgagg

SEQ ID NO: 36370 - DNA, 15 bp, Homo sapiens
ttggaagaagctgag

SEQ ID NO: 36371 - DNA, 15 bp, Homo sapiens
cttggaagaagctga

SEQ ID NO: 36372 - DNA, 15 bp, Homo sapiens
gcttggaagaagctg

SEQ ID NO: 36373 - DNA, 15 bp, Homo sapiens
ggcttggaagaagct

SEQ ID NO: 36374 - DNA, 15 bp, Homo sapiens
tggcttggaagaagc

SEQ ID NO: 36375 - DNA, 15 bp, Homo sapiens
ctggcttggaagaag

SEQ ID NO: 36376 - DNA, 15 bp, Homo sapiens
actggcttggaagaa

SEQ ID NO: 36377 - DNA, 15 bp, Homo sapiens
cactggcttggaaga

SEQ ID NO: 36378 - DNA, 15 bp, Homo sapiens
gcactggcttggaag

SEQ ID NO: 36379 - DNA, 15 bp, Homo sapiens
agcactggcttggaa

SEQ ID NO: 36380 - DNA, 15 bp, Homo sapiens
gagcactggcttgga

SEQ ID NO: 36381 - DNA, 15 bp, Homo sapiens
agagcactggcttgg

SEQ ID NO: 36382 - DNA, 15 bp, Homo sapiens
gagagcactggcttg

SEQ ID NO: 36383 - DNA, 15 bp, Homo sapiens
ggagagcactggctt

SEQ ID NO: 36384 - DNA, 15 bp, Homo sapiens
tggagagcactggct

SEQ ID NO: 36385 - DNA, 15 bp, Homo sapiens
ctggagagcactggc

SEQ ID NO: 36386 - DNA, 15 bp, Homo sapiens
cctggagagcactgg

SEQ ID NO: 36387 - DNA, 15 bp, Homo sapiens
gcctggagagcactg

SEQ ID NO: 36388 - DNA, 15 bp, Homo sapiens
tgcctggagagcact

SEQ ID NO: 36389 - DNA, 15 bp, Homo sapiens
gtgcctggagagcac

SEQ ID NO: 36390 - DNA, 15 bp, Homo sapiens
tgtgcctggagagca

SEQ ID NO: 36391 - DNA, 15 bp, Homo sapiens
gtgtgcctggagagc

SEQ ID NO: 36392 - DNA, 15 bp, Homo sapiens
agtgtgcctggagag

SEQ ID NO: 36393 - DNA, 15 bp, Homo sapiens
cagtgtgcctggaga

SEQ ID NO: 36394 - DNA, 15 bp, Homo sapiens
gcagtgtgcctggag

SEQ ID NO: 36395 - DNA, 15 bp, Homo sapiens
agcagtgtgcctgga

SEQ ID NO: 36396 - DNA, 15 bp, Homo sapiens
gagcagtgtgcctgg

SEQ ID NO: 36397 - DNA, 15 bp, Homo sapiens
ggagcagtgtgcctg

SEQ ID NO: 36398 - DNA, 15 bp, Homo sapiens
tggagcagtgtgcct

SEQ ID NO: 36399 - DNA, 15 bp, Homo sapiens
ctggagcagtgtgcc

SEQ ID NO: 36400 - DNA, 15 bp, Homo sapiens
gctggagcagtgtgc

SEQ ID NO: 36401 - DNA, 15 bp, Homo sapiens
cgctggagcagtgtg

SEQ ID NO: 36402 - DNA, 15 bp, Homo sapiens
acgctggagcagtgt

SEQ ID NO: 36403 - DNA, 15 bp, Homo sapiens
cacgctggagcagtg

SEQ ID NO: 36404 - DNA, 15 bp, Homo sapiens
acacgctggagcagt

SEQ ID NO: 36405 - DNA, 15 bp, Homo sapiens
cacacgctggagcag

SEQ ID NO: 36406 - DNA, 15 bp, Homo sapiens
tcacacgctggagca

SEQ ID NO: 36407 - DNA, 15 bp, Homo sapiens
gtcacacgctggagc

SEQ ID NO: 36408 - DNA, 15 bp, Homo sapiens
cgtcacacgctggag

SEQ ID NO: 36409 - DNA, 15 bp, Homo sapiens
ccgtcacacgctgga

SEQ ID NO: 36410 - DNA, 15 bp, Homo sapiens
cccgtcacacgctgg

SEQ ID NO: 36411 - DNA, 15 bp, Homo sapiens
tcccgtcacacgctg

SEQ ID NO: 36412 - DNA, 15 bp, Homo sapiens
ttcccgtcacacgct

SEQ ID NO: 36413 - DNA, 15 bp, Homo sapiens
cttcccgtcacacgc

SEQ ID NO: 36414 - DNA, 15 bp, Homo sapiens
ccttcccgtcacacg

SEQ ID NO: 36415 - DNA, 15 bp, Homo sapiens
cccttcccgtcacac

SEQ ID NO: 36416 - DNA, 15 bp, Homo sapiens
gcccttcccgtcaca

SEQ ID NO: 36417 - DNA, 15 bp, Homo sapiens
ggcccttcccgtcac

SEQ ID NO: 36418 - DNA, 15 bp, Homo sapiens
aggcccttcccgtca

SEQ ID NO: 36419 - DNA, 15 bp, Homo sapiens
caggcccttcccgtc

SEQ ID NO: 36420 - DNA, 15 bp, Homo sapiens
ccaggcccttcccgt

SEQ ID NO: 36421 - DNA, 15 bp, Homo sapiens
gccaggcccttcccg

SEQ ID NO: 36422 - DNA, 15 bp, Homo sapiens
tgccaggcccttccc

SEQ ID NO: 36423 - DNA, 15 bp, Homo sapiens
atgccaggcccttcc

SEQ ID NO: 36424 - DNA, 15 bp, Homo sapiens
catgccaggcccttc

SEQ ID NO: 36425 - DNA, 15 bp, Homo sapiens
tcatgccaggccctt

SEQ ID NO: 36426 - DNA, 15 bp, Homo sapiens
ctcatgccaggccct

SEQ ID NO: 36427 - DNA, 15 bp, Homo sapiens
actcatgccaggccc

SEQ ID NO: 36428 - DNA, 15 bp, Homo sapiens
gactcatgccaggcc

SEQ ID NO: 36429 - DNA, 15 bp, Homo sapiens
tgactcatgccaggc

SEQ ID NO: 36430 - DNA, 15 bp, Homo sapiens
ctgactcatgccagg

SEQ ID NO: 36431 - DNA, 15 bp, Homo sapiens
gctgactcatgccag

SEQ ID NO: 36432 - DNA, 15 bp, Homo sapiens
ggctgactcatgcca

SEQ ID NO: 36433 - DNA, 15 bp, Homo sapiens
aggctgactcatgcc

SEQ ID NO: 36434 - DNA, 15 bp, Homo sapiens
caggctgactcatgc

SEQ ID NO: 36435 - DNA, 15 bp, Homo sapiens
gcaggctgactcatg

SEQ ID NO: 36436 - DNA, 15 bp, Homo sapiens
tgcaggctgactcat

SEQ ID NO: 36437 - DNA, 15 bp, Homo sapiens
ctgcaggctgactca

SEQ ID NO: 36438 - DNA, 15 bp, Homo sapiens
gctgcaggctgactc

SEQ ID NO: 36439 - DNA, 15 bp, Homo sapiens
tgctgcaggctgact

SEQ ID NO: 36440 - DNA, 15 bp, Homo sapiens
gtgctgcaggctgac

SEQ ID NO: 36441 - DNA, 15 bp, Homo sapiens
tgtgctgcaggctga

SEQ ID NO: 36442 - DNA, 15 bp, Homo sapiens
ttgtgctgcaggctg

SEQ ID NO: 36443 - DNA, 15 bp, Homo sapiens
gttgtgctgcaggct

SEQ ID NO: 36444 - DNA, 15 bp, Homo sapiens
ggttgtgctgcaggc

SEQ ID NO: 36445 - DNA, 15 bp, Homo sapiens
aggttgtgctgcagg

SEQ ID NO: 36446 - DNA, 15 bp, Homo sapiens
gaggttgtgctgcag

SEQ ID NO: 36447 - DNA, 15 bp, Homo sapiens
ggaggttgtgctgca

SEQ ID NO: 36448 - DNA, 15 bp, Homo sapiens
gggaggttgtgctgc

SEQ ID NO: 36449 - DNA, 15 bp, Homo sapiens
agggaggttgtgctg

SEQ ID NO: 36450 - DNA, 15 bp, Homo sapiens
cagggaggttgtgct

SEQ ID NO: 36451 - DNA, 15 bp, Homo sapiens
gcagggaggttgtgc

SEQ ID NO: 36452 - DNA, 15 bp, Homo sapiens
agcagggaggttgtg

SEQ ID NO: 36453 - DNA, 15 bp, Homo sapiens
gagcagggaggttgt

SEQ ID NO: 36454 - DNA, 15 bp, Homo sapiens
ggagcagggaggttg

SEQ ID NO: 36455 - DNA, 15 bp, Homo sapiens
tggagcagggaggtt

SEQ ID NO: 36456 - DNA, 15 bp, Homo sapiens
ctggagcagggaggt

SEQ ID NO: 36457 - DNA, 15 bp, Homo sapiens
tctggagcagggagg

SEQ ID NO: 36458 - DNA, 15 bp, Homo sapiens
gtctggagcagggag

SEQ ID NO: 36459 - DNA, 15 bp, Homo sapiens
ggtctggagcaggga

SEQ ID NO: 36460 - DNA, 15 bp, Homo sapiens
gggtctggagcaggg

SEQ ID NO: 36461 - DNA, 15 bp, Homo sapiens
cgggtctggagcagg

SEQ ID NO: 36462 - DNA, 15 bp, Homo sapiens
acgggtctggagcag

SEQ ID NO: 36463 - DNA, 15 bp, Homo sapiens
tacgggtctggagca

SEQ ID NO: 36464 - DNA, 15 bp, Homo sapiens
atacgggtctggagc

SEQ ID NO: 36465 - DNA, 15 bp, Homo sapiens
catacgggtctggag

SEQ ID NO: 36466 - DNA, 15 bp, Homo sapiens
ccatacgggtctgga

SEQ ID NO: 36467 - DNA, 15 bp, Homo sapiens
accatacgggtctgg

SEQ ID NO: 36468 - DNA, 15 bp, Homo sapiens
taccatacgggtctg

SEQ ID NO: 36469 - DNA, 15 bp, Homo sapiens
ctaccatacgggtct

SEQ ID NO: 36470 - DNA, 15 bp, Homo sapiens
cctaccatacgggtc

SEQ ID NO: 36471 - DNA, 15 bp, Homo sapiens
ccctaccatacgggt

SEQ ID NO: 36472 - DNA, 15 bp, Homo sapiens
cccctaccatacggg

SEQ ID NO: 36473 - DNA, 15 bp, Homo sapiens
gcccctaccatacgg

SEQ ID NO: 36474 - DNA, 15 bp, Homo sapiens
tgcccctaccatacg

SEQ ID NO: 36475 - DNA, 15 bp, Homo sapiens
gtgcccctaccatac

SEQ ID NO: 36476 - DNA, 15 bp, Homo sapiens
ggtgcccctaccata

SEQ ID NO: 36477 - DNA, 15 bp, Homo sapiens
gggtgcccctaccat

SEQ ID NO: 36478 - DNA, 15 bp, Homo sapiens
ggggtgcccctacca

SEQ ID NO: 36479 - DNA, 15 bp, Homo sapiens
gggggtgcccctacc

SEQ ID NO: 36480 - DNA, 15 bp, Homo sapiens
agggggtgcccctac

SEQ ID NO: 36481 - DNA, 15 bp, Homo sapiens
tagggggtgccccta

SEQ ID NO: 36482 - DNA, 15 bp, Homo sapiens
ctagggggtgcccct

SEQ ID NO: 36483 - DNA, 15 bp, Homo sapiens
cctagggggtgcccc

SEQ ID NO: 36484 - DNA, 15 bp, Homo sapiens
acctagggggtgccc

SEQ ID NO: 36485 - DNA, 15 bp, Homo sapiens
gacctagggggtgcc

SEQ ID NO: 36486 - DNA, 15 bp, Homo sapiens
agacctagggggtgc

SEQ ID NO: 36487 - DNA, 15 bp, Homo sapiens
cagacctagggggtg

SEQ ID NO: 36488 - DNA, 15 bp, Homo sapiens
ccagacctagggggt

SEQ ID NO: 36489 - DNA, 15 bp, Homo sapiens
tccagacctaggggg

SEQ ID NO: 36490 - DNA, 15 bp, Homo sapiens
atccagacctagggg

SEQ ID NO: 36491 - DNA, 15 bp, Homo sapiens
catccagacctaggg

SEQ ID NO: 36492 - DNA, 15 bp, Homo sapiens
acatccagacctagg

SEQ ID NO: 36493 - DNA, 15 bp, Homo sapiens
cacatccagacctag

SEQ ID NO: 36494 - DNA, 15 bp, Homo sapiens
gcacatccagaccta

SEQ ID NO: 36495 - DNA, 15 bp, Homo sapiens
agcacatccagacct

SEQ ID NO: 36496 - DNA, 15 bp, Homo sapiens
cagcacatccagacc

SEQ ID NO: 36497 - DNA, 15 bp, Homo sapiens
acagcacatccagac

SEQ ID NO: 36498 - DNA, 15 bp, Homo sapiens
cacagcacatccaga

SEQ ID NO: 36499 - DNA, 15 bp, Homo sapiens
ccacagcacatccag

SEQ ID NO: 36500 - DNA, 15 bp, Homo sapiens
accacagcacatcca

SEQ ID NO: 36501 - DNA, 15 bp, Homo sapiens
caccacagcacatcc

SEQ ID NO: 36502 - DNA, 15 bp, Homo sapiens
gcaccacagcacatc

SEQ ID NO: 36503 - DNA, 15 bp, Homo sapiens
agcaccacagcacat

SEQ ID NO: 36504 - DNA, 15 bp, Homo sapiens
aagcaccacagcaca

SEQ ID NO: 36505 - DNA, 15 bp, Homo sapiens
aaagcaccacagcac

SEQ ID NO: 36506 - DNA, 15 bp, Homo sapiens
aaaagcaccacagca

SEQ ID NO: 36507 - DNA, 15 bp, Homo sapiens
caaaagcaccacagc

SEQ ID NO: 36508 - DNA, 15 bp, Homo sapiens
ccaaaagcaccacag

SEQ ID NO: 36509 - DNA, 15 bp, Homo sapiens
tccaaaagcaccaca

SEQ ID NO: 36510 - DNA, 15 bp, Homo sapiens
gtccaaaagcaccac

SEQ ID NO: 36511 - DNA, 15 bp, Homo sapiens
tgtccaaaagcacca

SEQ ID NO: 36512 - DNA, 15 bp, Homo sapiens
gtgtccaaaagcacc

SEQ ID NO: 36513 - DNA, 15 bp, Homo sapiens
ggtgtccaaaagcac

SEQ ID NO: 36514 - DNA, 15 bp, Homo sapiens
gggtgtccaaaagca

SEQ ID NO: 36515 - DNA, 15 bp, Homo sapiens
ggggtgtccaaaagc

SEQ ID NO: 36516 - DNA, 15 bp, Homo sapiens
gggggtgtccaaaag

SEQ ID NO: 36517 - DNA, 15 bp, Homo sapiens
tgggggtgtccaaaa

SEQ ID NO: 36518 - DNA, 15 bp, Homo sapiens
gtgggggtgtccaaa

SEQ ID NO: 36519 - DNA, 15 bp, Homo sapiens
ggtgggggtgtccaa

SEQ ID NO: 36520 - DNA, 15 bp, Homo sapiens
gggtgggggtgtcca

SEQ ID NO: 36521 - DNA, 15 bp, Homo sapiens
ggggtgggggtgtcc

SEQ ID NO: 36522 - DNA, 15 bp, Homo sapiens
gggggtgggggtgtc

SEQ ID NO: 36523 - DNA, 15 bp, Homo sapiens
cgggggtgggggtgt

SEQ ID NO: 36524 - DNA, 15 bp, Homo sapiens
gcgggggtgggggtg

SEQ ID NO: 36525 - DNA, 15 bp, Homo sapiens
tgcgggggtgggggt

SEQ ID NO: 36526 - DNA, 15 bp, Homo sapiens
ctgcgggggtggggg

SEQ ID NO: 36527 - DNA, 15 bp, Homo sapiens
cctgcgggggtgggg

SEQ ID NO: 36528 - DNA, 15 bp, Homo sapiens
gcctgcgggggtggg

SEQ ID NO: 36529 - DNA, 15 bp, Homo sapiens
agcctgcgggggtgg

SEQ ID NO: 36530 - DNA, 15 bp, Homo sapiens
cagcctgcgggggtg

SEQ ID NO: 36531 - DNA, 15 bp, Homo sapiens
acagcctgcgggggt

SEQ ID NO: 36532 - DNA, 15 bp, Homo sapiens
cacagcctgcggggg

SEQ ID NO: 36533 - DNA, 15 bp, Homo sapiens
ccacagcctgcgggg

SEQ ID NO: 36534 - DNA, 15 bp, Homo sapiens
gccacagcctgcggg

SEQ ID NO: 36535 - DNA, 15 bp, Homo sapiens
agccacagcctgcgg

SEQ ID NO: 36536 - DNA, 15 bp, Homo sapiens
gagccacagcctgcg

SEQ ID NO: 36537 - DNA, 15 bp, Homo sapiens
ggagccacagcctgc

SEQ ID NO: 36538 - DNA, 15 bp, Homo sapiens
aggagccacagcctg

SEQ ID NO: 36539 - DNA, 15 bp, Homo sapiens
gaggagccacagcct

SEQ ID NO: 36540 - DNA, 15 bp, Homo sapiens
ggaggagccacagcc

SEQ ID NO: 36541 - DNA, 15 bp, Homo sapiens
aggaggagccacagc

SEQ ID NO: 36542 - DNA, 15 bp, Homo sapiens
caggaggagccacag

SEQ ID NO: 36543 - DNA, 15 bp, Homo sapiens
acaggaggagccaca

SEQ ID NO: 36544 - DNA, 15 bp, Homo sapiens
cacaggaggagccac

SEQ ID NO: 36545 - DNA, 15 bp, Homo sapiens
acacaggaggagcca

SEQ ID NO: 36546 - DNA, 15 bp, Homo sapiens
gacacaggaggagcc

SEQ ID NO: 36547 - DNA, 15 bp, Homo sapiens
agacacaggaggagc

SEQ ID NO: 36548 - DNA, 15 bp, Homo sapiens
gagacacaggaggag

SEQ ID NO: 36549 - DNA, 15 bp, Homo sapiens
tgagacacaggagga

SEQ ID NO: 36550 - DNA, 15 bp, Homo sapiens
atgagacacaggagg

SEQ ID NO: 36551 - DNA, 15 bp, Homo sapiens
aatgagacacaggag

SEQ ID NO: 36552 - DNA, 15 bp, Homo sapiens
gaatgagacacagga

SEQ ID NO: 36553 - DNA, 15 bp, Homo sapiens
agaatgagacacagg

SEQ ID NO: 36554 - DNA, 15 bp, Homo sapiens
cagaatgagacacag

SEQ ID NO: 36555 - DNA, 15 bp, Homo sapiens
ccagaatgagacaca

SEQ ID NO: 36556 - DNA, 15 bp, Homo sapiens
gccagaatgagacac

SEQ ID NO: 36557 - DNA, 15 bp, Homo sapiens
ggccagaatgagaca

SEQ ID NO: 36558 - DNA, 15 bp, Homo sapiens
tggccagaatgagac

SEQ ID NO: 36559 - DNA, 15 bp, Homo sapiens
ctggccagaatgaga

SEQ ID NO: 36560 - DNA, 15 bp, Homo sapiens
cctggccagaatgag

SEQ ID NO: 36561 - DNA, 15 bp, Homo sapiens
tcctggccagaatga

SEQ ID NO: 36562 - DNA, 15 bp, Homo sapiens
gtcctggccagaatg

SEQ ID NO: 36563 - DNA, 15 bp, Homo sapiens
ggtcctggccagaat

SEQ ID NO: 36564 - DNA, 15 bp, Homo sapiens
gggtcctggccagaa

SEQ ID NO: 36565 - DNA, 15 bp, Homo sapiens
agggtcctggccaga

SEQ ID NO: 36566 - DNA, 15 bp, Homo sapiens
gagggtcctggccag

SEQ ID NO: 36567 - DNA, 15 bp, Homo sapiens
tgagggtcctggcca

SEQ ID NO: 36568 - DNA, 15 bp, Homo sapiens
gtgagggtcctggcc

SEQ ID NO: 36569 - DNA, 15 bp, Homo sapiens
cgtgagggtcctggc

SEQ ID NO: 36570 - DNA, 15 bp, Homo sapiens
acgtgagggtcctgg

SEQ ID NO: 36571 - DNA, 15 bp, Homo sapiens
cacgtgagggtcctg

SEQ ID NO: 36572 - DNA, 15 bp, Homo sapiens
gcacgtgagggtcct

SEQ ID NO: 36573 - DNA, 15 bp, Homo sapiens
ggcacgtgagggtcc

SEQ ID NO: 36574 - DNA, 15 bp, Homo sapiens
gggcacgtgagggtc

SEQ ID NO: 36575 - DNA, 15 bp, Homo sapiens
agggcacgtgagggt

SEQ ID NO: 36576 - DNA, 15 bp, Homo sapiens
gagggcacgtgaggg

SEQ ID NO: 36577 - DNA, 15 bp, Homo sapiens
agagggcacgtgagg

SEQ ID NO: 36578 - DNA, 15 bp, Homo sapiens
cagagggcacgtgag

SEQ ID NO: 36579 - DNA, 15 bp, Homo sapiens
acagagggcacgtga

SEQ ID NO: 36580 - DNA, 15 bp, Homo sapiens
aacagagggcacgtg

SEQ ID NO: 36581 - DNA, 15 bp, Homo sapiens
caacagagggcacgt

SEQ ID NO: 36582 - DNA, 15 bp, Homo sapiens
tcaacagagggcacg

SEQ ID NO: 36583 - DNA, 15 bp, Homo sapiens
gtcaacagagggcac

SEQ ID NO: 36584 - DNA, 15 bp, Homo sapiens
agtcaacagagggca

SEQ ID NO: 36585 - DNA, 15 bp, Homo sapiens
cagtcaacagagggc

SEQ ID NO: 36586 - DNA, 15 bp, Homo sapiens
gcagtcaacagaggg

SEQ ID NO: 36587 - DNA, 15 bp, Homo sapiens
agcagtcaacagagg

SEQ ID NO: 36588 - DNA, 15 bp, Homo sapiens
tagcagtcaacagag

SEQ ID NO: 36589 - DNA, 15 bp, Homo sapiens
ttagcagtcaacaga

SEQ ID NO: 36590 - DNA, 15 bp, Homo sapiens
gttagcagtcaacag

SEQ ID NO: 36591 - DNA, 15 bp, Homo sapiens
cgttagcagtcaaca

SEQ ID NO: 36592 - DNA, 15 bp, Homo sapiens
acgttagcagtcaac

SEQ ID NO: 36593 - DNA, 15 bp, Homo sapiens
cacgttagcagtcaa

SEQ ID NO: 36594 - DNA, 15 bp, Homo sapiens
ccacgttagcagtca

SEQ ID NO: 36595 - DNA, 15 bp, Homo sapiens
accacgttagcagtc

SEQ ID NO: 36596 - DNA, 15 bp, Homo sapiens
aaccacgttagcagt

SEQ ID NO: 36597 - DNA, 15 bp, Homo sapiens
gaaccacgttagcag

SEQ ID NO: 36598 - DNA, 15 bp, Homo sapiens
agaaccacgttagca

SEQ ID NO: 36599 - DNA, 15 bp, Homo sapiens
gagaaccacgttagc

SEQ ID NO: 36600 - DNA, 15 bp, Homo sapiens
agagaaccacgttag

SEQ ID NO: 36601 - DNA, 15 bp, Homo sapiens
cagagaaccacgtta

SEQ ID NO: 36602 - DNA, 15 bp, Homo sapiens
tcagagaaccacgtt

SEQ ID NO: 36603 - DNA, 15 bp, Homo sapiens
gtcagagaaccacgt

SEQ ID NO: 36604 - DNA, 15 bp, Homo sapiens
ggtcagagaaccacg

SEQ ID NO: 36605 - DNA, 15 bp, Homo sapiens
tggtcagagaaccac

SEQ ID NO: 36606 - DNA, 15 bp, Homo sapiens
ctggtcagagaacca

SEQ ID NO: 36607 - DNA, 15 bp, Homo sapiens
cctggtcagagaacc

SEQ ID NO: 36608 - DNA, 15 bp, Homo sapiens
gcctggtcagagaac

SEQ ID NO: 36609 - DNA, 15 bp, Homo sapiens
tgcctggtcagagaa

SEQ ID NO: 36610 - DNA, 15 bp, Homo sapiens
ttgcctggtcagaga

SEQ ID NO: 36611 - DNA, 15 bp, Homo sapiens
cttgcctggtcagag

SEQ ID NO: 36612 - DNA, 15 bp, Homo sapiens
ccttgcctggtcaga

SEQ ID NO: 36613 - DNA, 15 bp, Homo sapiens
cccttgcctggtcag

SEQ ID NO: 36614 - DNA, 15 bp, Homo sapiens
gcccttgcctggtca

SEQ ID NO: 36615 - DNA, 15 bp, Homo sapiens
tgcccttgcctggtc

SEQ ID NO: 36616 - DNA, 15 bp, Homo sapiens
ctgcccttgcctggt

SEQ ID NO: 36617 - DNA, 15 bp, Homo sapiens
cctgcccttgcctgg

SEQ ID NO: 36618 - DNA, 15 bp, Homo sapiens
gcctgcccttgcctg

SEQ ID NO: 36619 - DNA, 15 bp, Homo sapiens
agcctgcccttgcct

SEQ ID NO: 36620 - DNA, 15 bp, Homo sapiens
cagcctgcccttgcc

SEQ ID NO: 36621 - DNA, 15 bp, Homo sapiens
tcagcctgcccttgc

SEQ ID NO: 36622 - DNA, 15 bp, Homo sapiens
ctcagcctgcccttg

SEQ ID NO: 36623 - DNA, 15 bp, Homo sapiens
cctcagcctgccctt

SEQ ID NO: 36624 - DNA, 15 bp, Homo sapiens
ccctcagcctgccct

SEQ ID NO: 36625 - DNA, 15 bp, Homo sapiens
cccctcagcctgccc

SEQ ID NO: 36626 - DNA, 15 bp, Homo sapiens
acccctcagcctgcc

SEQ ID NO: 36627 - DNA, 15 bp, Homo sapiens
aacccctcagcctgc

SEQ ID NO: 36628 - DNA, 15 bp, Homo sapiens
aaacccctcagcctg

SEQ ID NO: 36629 - DNA, 15 bp, Homo sapiens
caaacccctcagcct

SEQ ID NO: 36630 - DNA, 15 bp, Homo sapiens
gcaaacccctcagcc

SEQ ID NO: 36631 - DNA, 15 bp, Homo sapiens
ggcaaacccctcagc

SEQ ID NO: 36632 - DNA, 15 bp, Homo sapiens
gggcaaacccctcag

SEQ ID NO: 36633 - DNA, 15 bp, Homo sapiens
tgggcaaacccctca

SEQ ID NO: 36634 - DNA, 15 bp, Homo sapiens
ttgggcaaacccctc

SEQ ID NO: 36635 - DNA, 15 bp, Homo sapiens
tttgggcaaacccct

SEQ ID NO: 36636 - DNA, 15 bp, Homo sapiens
ctttgggcaaacccc

SEQ ID NO: 36637 - DNA, 15 bp, Homo sapiens
cctttgggcaaaccc

SEQ ID NO: 36638 - DNA, 15 bp, Homo sapiens
ccctttgggcaaacc

SEQ ID NO: 36639 - DNA, 15 bp, Homo sapiens
cccctttgggcaaac

SEQ ID NO: 36640 - DNA, 15 bp, Homo sapiens
ccccctttgggcaaa

SEQ ID NO: 36641 - DNA, 15 bp, Homo sapiens
gccccctttgggcaa

SEQ ID NO: 36642 - DNA, 15 bp, Homo sapiens
ggccccctttgggca

SEQ ID NO: 36643 - DNA, 15 bp, Homo sapiens
gggccccctttgggc

SEQ ID NO: 36644 - DNA, 15 bp, Homo sapiens
ggggccccctttggg

SEQ ID NO: 36645 - DNA, 15 bp, Homo sapiens
gggggccccctttgg

SEQ ID NO: 36646 - DNA, 15 bp, Homo sapiens
agggggccccctttg

SEQ ID NO: 36647 - DNA, 15 bp, Homo sapiens
aagggggcccccttt

SEQ ID NO: 36648 - DNA, 15 bp, Homo sapiens
caagggggccccctt

SEQ ID NO: 36649 - DNA, 15 bp, Homo sapiens
acaagggggccccct

SEQ ID NO: 36650 - DNA, 15 bp, Homo sapiens
aacaagggggccccc

SEQ ID NO: 36651 - DNA, 15 bp, Homo sapiens
taacaagggggcccc

SEQ ID NO: 36652 - DNA, 15 bp, Homo sapiens
gtaacaagggggccc

SEQ ID NO: 36653 - DNA, 15 bp, Homo sapiens
agtaacaagggggcc

SEQ ID NO: 36654 - DNA, 15 bp, Homo sapiens
cagtaacaagggggc

SEQ ID NO: 36655 - DNA, 15 bp, Homo sapiens
ccagtaacaaggggg

SEQ ID NO: 36656 - DNA, 15 bp, Homo sapiens
gccagtaacaagggg

SEQ ID NO: 36657 - DNA, 15 bp, Homo sapiens
agccagtaacaaggg

SEQ ID NO: 36658 - DNA, 15 bp, Homo sapiens
aagccagtaacaagg

SEQ ID NO: 36659 - DNA, 15 bp, Homo sapiens
gaagccagtaacaag

SEQ ID NO: 36660 - DNA, 15 bp, Homo sapiens
ggaagccagtaacaa

SEQ ID NO: 36661 - DNA, 15 bp, Homo sapiens
aggaagccagtaaca

SEQ ID NO: 36662 - DNA, 15 bp, Homo sapiens
aaggaagccagtaac

SEQ ID NO: 36663 - DNA, 15 bp, Homo sapiens
caaggaagccagtaa

SEQ ID NO: 36664 - DNA, 15 bp, Homo sapiens
ccaaggaagccagta

SEQ ID NO: 36665 - DNA, 15 bp, Homo sapiens
gccaaggaagccagt

SEQ ID NO: 36666 - DNA, 15 bp, Homo sapiens
agccaaggaagccag

SEQ ID NO: 36667 - DNA, 15 bp, Homo sapiens
gagccaaggaagcca

SEQ ID NO: 36668 - DNA, 15 bp, Homo sapiens
agagccaaggaagcc

SEQ ID NO: 36669 - DNA, 15 bp, Homo sapiens
gagagccaaggaagc

SEQ ID NO: 36670 - DNA, 15 bp, Homo sapiens
tgagagccaaggaag

SEQ ID NO: 36671 - DNA, 15 bp, Homo sapiens
ctgagagccaaggaa

SEQ ID NO: 36672 - DNA, 15 bp, Homo sapiens
cctgagagccaagga

SEQ ID NO: 36673 - DNA, 15 bp, Homo sapiens
tcctgagagccaagg

SEQ ID NO: 36674 - DNA, 15 bp, Homo sapiens
ctcctgagagccaag

SEQ ID NO: 36675 - DNA, 15 bp, Homo sapiens
gctcctgagagccaa

SEQ ID NO: 36676 - DNA, 15 bp, Homo sapiens
tgctcctgagagcca

SEQ ID NO: 36677 - DNA, 15 bp, Homo sapiens
ctgctcctgagagcc

SEQ ID NO: 36678 - DNA, 15 bp, Homo sapiens
gctgctcctgagagc

SEQ ID NO: 36679 - DNA, 15 bp, Homo sapiens
ggctgctcctgagag

SEQ ID NO: 36680 - DNA, 15 bp, Homo sapiens
aggctgctcctgaga

SEQ ID NO: 36681 - DNA, 15 bp, Homo sapiens
gaggctgctcctgag

SEQ ID NO: 36682 - DNA, 15 bp, Homo sapiens
tgaggctgctcctga

SEQ ID NO: 36683 - DNA, 15 bp, Homo sapiens
gtgaggctgctcctg

SEQ ID NO: 36684 - DNA, 15 bp, Homo sapiens
ggtgaggctgctcct

SEQ ID NO: 36685 - DNA, 15 bp, Homo sapiens
tggtgaggctgctcc

SEQ ID NO: 36686 - DNA, 15 bp, Homo sapiens
ctggtgaggctgctc

SEQ ID NO: 36687 - DNA, 15 bp, Homo sapiens
cctggtgaggctgct

SEQ ID NO: 36688 - DNA, 15 bp, Homo sapiens
acctggtgaggctgc

SEQ ID NO: 36689 - DNA, 15 bp, Homo sapiens
aacctggtgaggctg

SEQ ID NO: 36690 - DNA, 15 bp, Homo sapiens
caacctggtgaggct

SEQ ID NO: 36691 - DNA, 15 bp, Homo sapiens
ccaacctggtgaggc

SEQ ID NO: 36692 - DNA, 15 bp, Homo sapiens
accaacctggtgagg

SEQ ID NO: 36693 - DNA, 15 bp, Homo sapiens
taccaacctggtgag

SEQ ID NO: 36694 - DNA, 15 bp, Homo sapiens
ttaccaacctggtga

SEQ ID NO: 36695 - DNA, 15 bp, Homo sapiens
cttaccaacctggtg

SEQ ID NO: 36696 - DNA, 15 bp, Homo sapiens
ccttaccaacctggt

SEQ ID NO: 36697 - DNA, 15 bp, Homo sapiens
cccttaccaacctgg

SEQ ID NO: 36698 - DNA, 15 bp, Homo sapiens
ccccttaccaacctg

SEQ ID NO: 36699 - DNA, 15 bp, Homo sapiens
gccccttaccaacct

SEQ ID NO: 36700 - DNA, 15 bp, Homo sapiens
agccccttaccaacc

SEQ ID NO: 36701 - DNA, 15 bp, Homo sapiens
cagccccttaccaac

SEQ ID NO: 36702 - DNA, 15 bp, Homo sapiens
ccagccccttaccaa

SEQ ID NO: 36703 - DNA, 15 bp, Homo sapiens
tccagccccttacca

SEQ ID NO: 36704 - DNA, 15 bp, Homo sapiens
ctccagccccttacc

SEQ ID NO: 36705 - DNA, 15 bp, Homo sapiens
cctccagccccttac

SEQ ID NO: 36706 - DNA, 15 bp, Homo sapiens
tcctccagcccctta

SEQ ID NO: 36707 - DNA, 15 bp, Homo sapiens
ctcctccagcccctt

SEQ ID NO: 36708 - DNA, 15 bp, Homo sapiens
tctcctccagcccct

SEQ ID NO: 36709 - DNA, 15 bp, Homo sapiens
gtctcctccagcccc

SEQ ID NO: 36710 - DNA, 15 bp, Homo sapiens
tgtctcctccagccc

SEQ ID NO: 36711 - DNA, 15 bp, Homo sapiens
ttgtctcctccagcc

SEQ ID NO: 36712 - DNA, 15 bp, Homo sapiens
gttgtctcctccagc

SEQ ID NO: 36713 - DNA, 15 bp, Homo sapiens
agttgtctcctccag

SEQ ID NO: 36714 - DNA, 15 bp, Homo sapiens
cagttgtctcctcca

SEQ ID NO: 36715 - DNA, 15 bp, Homo sapiens
gcagttgtctcctcc

SEQ ID NO: 36716 - DNA, 15 bp, Homo sapiens
agcagttgtctcctc

SEQ ID NO: 36717 - DNA, 15 bp, Homo sapiens
gagcagttgtctcct

SEQ ID NO: 36718 - DNA, 15 bp, Homo sapiens
tgagcagttgtctcc

SEQ ID NO: 36719 - DNA, 15 bp, Homo sapiens
ttgagcagttgtctc

SEQ ID NO: 36720 - DNA, 15 bp, Homo sapiens
tttgagcagttgtct

SEQ ID NO: 36721 - DNA, 15 bp, Homo sapiens
ctttgagcagttgtc

SEQ ID NO: 36722 - DNA, 15 bp, Homo sapiens
cctttgagcagttgt

SEQ ID NO: 36723 - DNA, 15 bp, Homo sapiens
tcctttgagcagttg

SEQ ID NO: 36724 - DNA, 15 bp, Homo sapiens
ctcctttgagcagtt

SEQ ID NO: 36725 - DNA, 15 bp, Homo sapiens
actcctttgagcagt

SEQ ID NO: 36726 - DNA, 15 bp, Homo sapiens
gactcctttgagcag

SEQ ID NO: 36727 - DNA, 15 bp, Homo sapiens
ggactcctttgagca

SEQ ID NO: 36728 - DNA, 15 bp, Homo sapiens
tggactcctttgagc

SEQ ID NO: 36729 - DNA, 15 bp, Homo sapiens
ctggactcctttgag

SEQ ID NO: 36730 - DNA, 15 bp, Homo sapiens
gctggactcctttga

SEQ ID NO: 36731 - DNA, 15 bp, Homo sapiens
agctggactcctttg

SEQ ID NO: 36732 - DNA, 15 bp, Homo sapiens
aagctggactccttt

SEQ ID NO: 36733 - DNA, 15 bp, Homo sapiens
gaagctggactcctt

SEQ ID NO: 36734 - DNA, 15 bp, Homo sapiens
tgaagctggactcct

SEQ ID NO: 36735 - DNA, 15 bp, Homo sapiens
gtgaagctggactcc

SEQ ID NO: 36736 - DNA, 15 bp, Homo sapiens
tgtgaagctggactc

SEQ ID NO: 36737 - DNA, 15 bp, Homo sapiens
atgtgaagctggact

SEQ ID NO: 36738 - DNA, 15 bp, Homo sapiens
catgtgaagctggac

SEQ ID NO: 36739 - DNA, 15 bp, Homo sapiens
gcatgtgaagctgga

SEQ ID NO: 36740 - DNA, 15 bp, Homo sapiens
tgcatgtgaagctgg

SEQ ID NO: 36741 - DNA, 15 bp, Homo sapiens
gtgcatgtgaagctg

SEQ ID NO: 36742 - DNA, 15 bp, Homo sapiens
tgtgcatgtgaagct

SEQ ID NO: 36743 - DNA, 15 bp, Homo sapiens
atgtgcatgtgaagc

SEQ ID NO: 36744 - DNA, 15 bp, Homo sapiens
catgtgcatgtgaag

SEQ ID NO: 36745 - DNA, 15 bp, Homo sapiens
gcatgtgcatgtgaa

SEQ ID NO: 36746 - DNA, 15 bp, Homo sapiens
agcatgtgcatgtga

SEQ ID NO: 36747 - DNA, 15 bp, Homo sapiens
tagcatgtgcatgtg

SEQ ID NO: 36748 - DNA, 15 bp, Homo sapiens
ctagcatgtgcatgt

SEQ ID NO: 36749 - DNA, 15 bp, Homo sapiens
tctagcatgtgcatg

SEQ ID NO: 36750 - DNA, 15 bp, Homo sapiens
ttctagcatgtgcat

SEQ ID NO: 36751 - DNA, 15 bp, Homo sapiens
cttctagcatgtgca

SEQ ID NO: 36752 - DNA, 15 bp, Homo sapiens
ccttctagcatgtgc

SEQ ID NO: 36753 - DNA, 15 bp, Homo sapiens
accttctagcatgtg

SEQ ID NO: 36754 - DNA, 15 bp, Homo sapiens
taccttctagcatgt

SEQ ID NO: 36755 - DNA, 15 bp, Homo sapiens
gtaccttctagcatg

SEQ ID NO: 36756 - DNA, 15 bp, Homo sapiens
ggtaccttctagcat

SEQ ID NO: 36757 - DNA, 15 bp, Homo sapiens
gggtaccttctagca

SEQ ID NO: 36758 - DNA, 15 bp, Homo sapiens
agggtaccttctagc

SEQ ID NO: 36759 - DNA, 15 bp, Homo sapiens
gagggtaccttctag

SEQ ID NO: 36760 - DNA, 15 bp, Homo sapiens
cgagggtaccttcta

SEQ ID NO: 36761 - DNA, 15 bp, Homo sapiens
ccgagggtaccttct

SEQ ID NO: 36762 - DNA, 15 bp, Homo sapiens
tccgagggtaccttc

SEQ ID NO: 36763 - DNA, 15 bp, Homo sapiens
ttccgagggtacctt

SEQ ID NO: 36764 - DNA, 15 bp, Homo sapiens
cttccgagggtacct

SEQ ID NO: 36765 - DNA, 15 bp, Homo sapiens
ccttccgagggtacc

SEQ ID NO: 36766 - DNA, 15 bp, Homo sapiens
gccttccgagggtac

SEQ ID NO: 36767 - DNA, 15 bp, Homo sapiens
ggccttccgagggta

SEQ ID NO: 36768 - DNA, 15 bp, Homo sapiens
aggccttccgagggt

SEQ ID NO: 36769 - DNA, 15 bp, Homo sapiens
caggccttccgaggg

SEQ ID NO: 36770 - DNA, 15 bp, Homo sapiens
ccaggccttccgagg

SEQ ID NO: 36771 - DNA, 15 bp, Homo sapiens
gccaggccttccgag

SEQ ID NO: 36772 - DNA, 15 bp, Homo sapiens
ggccaggccttccga

SEQ ID NO: 36773 - DNA, 15 bp, Homo sapiens
aggccaggccttccg

SEQ ID NO: 36774 - DNA, 15 bp, Homo sapiens
aaggccaggccttcc

SEQ ID NO: 36775 - DNA, 15 bp, Homo sapiens
gaaggccaggccttc

SEQ ID NO: 36776 - DNA, 15 bp, Homo sapiens
tgaaggccaggcctt

SEQ ID NO: 36777 - DNA, 15 bp, Homo sapiens
ttgaaggccaggcct

SEQ ID NO: 36778 - DNA, 15 bp, Homo sapiens
tttgaaggccaggcc

SEQ ID NO: 36779 - DNA, 15 bp, Homo sapiens
ctttgaaggccaggc

SEQ ID NO: 36780 - DNA, 15 bp, Homo sapiens
cctttgaaggccagg

SEQ ID NO: 36781 - DNA, 15 bp, Homo sapiens
acctttgaaggccag

SEQ ID NO: 36782 - DNA, 15 bp, Homo sapiens
tacctttgaaggcca

SEQ ID NO: 36783 - DNA, 15 bp, Homo sapiens
ctacctttgaaggcc

SEQ ID NO: 36784 - DNA, 15 bp, Homo sapiens
tctacctttgaaggc

SEQ ID NO: 36785 - DNA, 15 bp, Homo sapiens
atctacctttgaagg

SEQ ID NO: 36786 - DNA, 15 bp, Homo sapiens
gatctacctttgaag

SEQ ID NO: 36787 - DNA, 15 bp, Homo sapiens
ggatctacctttgaa

SEQ ID NO: 36788 - DNA, 15 bp, Homo sapiens
gggatctacctttga

SEQ ID NO: 36789 - DNA, 15 bp, Homo sapiens
tgggatctacctttg

SEQ ID NO: 36790 - DNA, 15 bp, Homo sapiens
ctgggatctaccttt

SEQ ID NO: 36791 - DNA, 15 bp, Homo sapiens
cctgggatctacctt

SEQ ID NO: 36792 - DNA, 15 bp, Homo sapiens
ccctgggatctacct

SEQ ID NO: 36793 - DNA, 15 bp, Homo sapiens
accctgggatctacc

SEQ ID NO: 36794 - DNA, 15 bp, Homo sapiens
aaccctgggatctac

SEQ ID NO: 36795 - DNA, 15 bp, Homo sapiens
caaccctgggatcta

SEQ ID NO: 36796 - DNA, 15 bp, Homo sapiens
tcaaccctgggatct

SEQ ID NO: 36797 - DNA, 15 bp, Homo sapiens
ttcaaccctgggatc

SEQ ID NO: 36798 - DNA, 15 bp, Homo sapiens
tttcaaccctgggat

SEQ ID NO: 36799 - DNA, 15 bp, Homo sapiens
ttttcaaccctggga

SEQ ID NO: 36800 - DNA, 15 bp, Homo sapiens
cttttcaaccctggg

SEQ ID NO: 36801 - DNA, 15 bp, Homo sapiens
acttttcaaccctgg

SEQ ID NO: 36802 - DNA, 15 bp, Homo sapiens
gacttttcaaccctg

SEQ ID NO: 36803 - DNA, 15 bp, Homo sapiens
tgacttttcaaccct

SEQ ID NO: 36804 - DNA, 15 bp, Homo sapiens
ttgacttttcaaccc

SEQ ID NO: 36805 - DNA, 15 bp, Homo sapiens
gttgacttttcaacc

SEQ ID NO: 36806 - DNA, 15 bp, Homo sapiens
agttgacttttcaac

SEQ ID NO: 36807 - DNA, 15 bp, Homo sapiens
aagttgacttttcaa

SEQ ID NO: 36808 - DNA, 15 bp, Homo sapiens
caagttgacttttca

SEQ ID NO: 36809 - DNA, 15 bp, Homo sapiens
acaagttgacttttc

SEQ ID NO: 36810 - DNA, 15 bp, Homo sapiens
tacaagttgactttt

SEQ ID NO: 36811 - DNA, 15 bp, Homo sapiens
atacaagttgacttt

SEQ ID NO: 36812 - DNA, 15 bp, Homo sapiens
catacaagttgactt

SEQ ID NO: 36813 - DNA, 15 bp, Homo sapiens
gcatacaagttgact

SEQ ID NO: 36814 - DNA, 15 bp, Homo sapiens
tgcatacaagttgac

SEQ ID NO: 36815 - DNA, 15 bp, Homo sapiens
atgcatacaagttga

SEQ ID NO: 36816 - DNA, 15 bp, Homo sapiens
aatgcatacaagttg

SEQ ID NO: 36817 - DNA, 15 bp, Homo sapiens
caatgcatacaagtt

SEQ ID NO: 36818 - DNA, 15 bp, Homo sapiens
tcaatgcatacaagt

SEQ ID NO: 36819 - DNA, 15 bp, Homo sapiens
ctcaatgcatacaag

SEQ ID NO: 36820 - DNA, 15 bp, Homo sapiens
gctcaatgcatacaa

SEQ ID NO: 36821 - DNA, 15 bp, Homo sapiens
tgctcaatgcataca

SEQ ID NO: 36822 - DNA, 15 bp, Homo sapiens
atgctcaatgcatac

SEQ ID NO: 36823 - DNA, 15 bp, Homo sapiens
gatgctcaatgcata

SEQ ID NO: 36824 - DNA, 15 bp, Homo sapiens
agatgctcaatgcat

SEQ ID NO: 36825 - DNA, 15 bp, Homo sapiens
gagatgctcaatgca

SEQ ID NO: 36826 - DNA, 15 bp, Homo sapiens
cgagatgctcaatgc

SEQ ID NO: 36827 - DNA, 15 bp, Homo sapiens
acgagatgctcaatg

SEQ ID NO: 36828 - DNA, 15 bp, Homo sapiens
tacgagatgctcaat

SEQ ID NO: 36829 - DNA, 15 bp, Homo sapiens
atacgagatgctcaa

SEQ ID NO: 36830 - DNA, 15 bp, Homo sapiens
catacgagatgctca

SEQ ID NO: 36831 - DNA, 15 bp, Homo sapiens
gcatacgagatgctc

SEQ ID NO: 36832 - DNA, 15 bp, Homo sapiens
ggcatacgagatgct

SEQ ID NO: 36833 - DNA, 15 bp, Homo sapiens
tggcatacgagatgc

SEQ ID NO: 36834 - DNA, 15 bp, Homo sapiens
ctggcatacgagatg

SEQ ID NO: 36835 - DNA, 15 bp, Homo sapiens
gctggcatacgagat

SEQ ID NO: 36836 - DNA, 15 bp, Homo sapiens
ggctggcatacgaga

SEQ ID NO: 36837 - DNA, 15 bp, Homo sapiens
gggctggcatacgag

SEQ ID NO: 36838 - DNA, 15 bp, Homo sapiens
agggctggcatacga

SEQ ID NO: 36839 - DNA, 15 bp, Homo sapiens
cagggctggcatacg

SEQ ID NO: 36840 - DNA, 15 bp, Homo sapiens
acagggctggcatac

SEQ ID NO: 36841 - DNA, 15 bp, Homo sapiens
aacagggctggcata

SEQ ID NO: 36842 - DNA, 15 bp, Homo sapiens
gaacagggctggcat

SEQ ID NO: 36843 - DNA, 15 bp, Homo sapiens
ggaacagggctggca

SEQ ID NO: 36844 - DNA, 15 bp, Homo sapiens
cggaacagggctggc

SEQ ID NO: 36845 - DNA, 15 bp, Homo sapiens
acggaacagggctgg

SEQ ID NO: 36846 - DNA, 15 bp, Homo sapiens
cacggaacagggctg

SEQ ID NO: 36847 - DNA, 15 bp, Homo sapiens
tcacggaacagggct

SEQ ID NO: 36848 - DNA, 15 bp, Homo sapiens
ctcacggaacagggc

SEQ ID NO: 36849 - DNA, 15 bp, Homo sapiens
gctcacggaacaggg

SEQ ID NO: 36850 - DNA, 15 bp, Homo sapiens
agctcacggaacagg

SEQ ID NO: 36851 - DNA, 15 bp, Homo sapiens
cagctcacggaacag

SEQ ID NO: 36852 - DNA, 15 bp, Homo sapiens
tcagctcacggaaca

SEQ ID NO: 36853 - DNA, 15 bp, Homo sapiens
atcagctcacggaac

SEQ ID NO: 36854 - DNA, 15 bp, Homo sapiens
catcagctcacggaa

SEQ ID NO: 36855 - DNA, 15 bp, Homo sapiens
ccatcagctcacgga

SEQ ID NO: 36856 - DNA, 15 bp, Homo sapiens
cccatcagctcacgg

SEQ ID NO: 36857 - DNA, 15 bp, Homo sapiens
gcccatcagctcacg

SEQ ID NO: 36858 - DNA, 15 bp, Homo sapiens
ggcccatcagctcac

SEQ ID NO: 36859 - DNA, 15 bp, Homo sapiens
aggcccatcagctca

SEQ ID NO: 36860 - DNA, 15 bp, Homo sapiens
aaggcccatcagctc

SEQ ID NO: 36861 - DNA, 15 bp, Homo sapiens
aaaggcccatcagct

SEQ ID NO: 36862 - DNA, 15 bp, Homo sapiens
caaaggcccatcagc

SEQ ID NO: 36863 - DNA, 15 bp, Homo sapiens
acaaaggcccatcag

SEQ ID NO: 36864 - DNA, 15 bp, Homo sapiens
cacaaaggcccatca

SEQ ID NO: 36865 - DNA, 15 bp, Homo sapiens
acacaaaggcccatc

SEQ ID NO: 36866 - DNA, 15 bp, Homo sapiens
cacacaaaggcccat

SEQ ID NO: 36867 - DNA, 15 bp, Homo sapiens
acacacaaaggccca

SEQ ID NO: 36868 - DNA, 15 bp, Homo sapiens
tacacacaaaggccc

SEQ ID NO: 36869 - DNA, 15 bp, Homo sapiens
ttacacacaaaggcc

SEQ ID NO: 36870 - DNA, 15 bp, Homo sapiens
cttacacacaaaggc

SEQ ID NO: 36871 - DNA, 15 bp, Homo sapiens
acttacacacaaagg

SEQ ID NO: 36872 - DNA, 15 bp, Homo sapiens
tacttacacacaaag

SEQ ID NO: 36873 - DNA, 15 bp, Homo sapiens
ctacttacacacaaa

SEQ ID NO: 36874 - DNA, 15 bp, Homo sapiens
cctacttacacacaa

SEQ ID NO: 36875 - DNA, 15 bp, Homo sapiens
tcctacttacacaca

SEQ ID NO: 36876 - DNA, 15 bp, Homo sapiens
gtcctacttacacac

SEQ ID NO: 36877 - DNA, 15 bp, Homo sapiens
ggtcctacttacaca

SEQ ID NO: 36878 - DNA, 15 bp, Homo sapiens
tggtcctacttacac

SEQ ID NO: 36879 - DNA, 15 bp, Homo sapiens
ttggtcctacttaca

SEQ ID NO: 36880 - DNA, 15 bp, Homo sapiens
cttggtcctacttac

SEQ ID NO: 36881 - DNA, 15 bp, Homo sapiens
acttggtcctactta

SEQ ID NO: 36882 - DNA, 15 bp, Homo sapiens
cacttggtcctactt

SEQ ID NO: 36883 - DNA, 15 bp, Homo sapiens
gcacttggtcctact

SEQ ID NO: 36884 - DNA, 15 bp, Homo sapiens
ggcacttggtcctac

SEQ ID NO: 36885 - DNA, 15 bp, Homo sapiens
gggcacttggtccta

SEQ ID NO: 36886 - DNA, 15 bp, Homo sapiens
ggggcacttggtcct

SEQ ID NO: 36887 - DNA, 15 bp, Homo sapiens
gggggcacttggtcc

SEQ ID NO: 36888 - DNA, 15 bp, Homo sapiens
cgggggcacttggtc

SEQ ID NO: 36889 - DNA, 15 bp, Homo sapiens
acgggggcacttggt

SEQ ID NO: 36890 - DNA, 15 bp, Homo sapiens
cacgggggcacttgg

SEQ ID NO: 36891 - DNA, 15 bp, Homo sapiens
ccacgggggcacttg

SEQ ID NO: 36892 - DNA, 15 bp, Homo sapiens
tccacgggggcactt

SEQ ID NO: 36893 - DNA, 15 bp, Homo sapiens
ctccacgggggcact

SEQ ID NO: 36894 - DNA, 15 bp, Homo sapiens
cctccacgggggcac

SEQ ID NO: 36895 - DNA, 15 bp, Homo sapiens
acctccacgggggca

SEQ ID NO: 36896 - DNA, 15 bp, Homo sapiens
aacctccacgggggc

SEQ ID NO: 36897 - DNA, 15 bp, Homo sapiens
taacctccacggggg

SEQ ID NO: 36898 - DNA, 15 bp, Homo sapiens
ctaacctccacgggg

SEQ ID NO: 36899 - DNA, 15 bp, Homo sapiens
gctaacctccacggg

SEQ ID NO: 36900 - DNA, 15 bp, Homo sapiens
tgctaacctccacgg

SEQ ID NO: 36901 - DNA, 15 bp, Homo sapiens
atgctaacctccacg

SEQ ID NO: 36902 - DNA, 15 bp, Homo sapiens
catgctaacctccac

SEQ ID NO: 36903 - DNA, 15 bp, Homo sapiens
ccatgctaacctcca

SEQ ID NO: 36904 - DNA, 15 bp, Homo sapiens
cccatgctaacctcc

SEQ ID NO: 36905 - DNA, 15 bp, Homo sapiens
acccatgctaacctc

SEQ ID NO: 36906 - DNA, 15 bp, Homo sapiens
cacccatgctaacct

SEQ ID NO: 36907 - DNA, 15 bp, Homo sapiens
acacccatgctaacc

SEQ ID NO: 36908 - DNA, 15 bp, Homo sapiens
cacacccatgctaac

SEQ ID NO: 36909 - DNA, 15 bp, Homo sapiens
gcacacccatgctaa

SEQ ID NO: 36910 - DNA, 15 bp, Homo sapiens
tgcacacccatgcta

SEQ ID NO: 36911 - DNA, 15 bp, Homo sapiens
ctgcacacccatgct

SEQ ID NO: 36912 - DNA, 15 bp, Homo sapiens
actgcacacccatgc

SEQ ID NO: 36913 - DNA, 15 bp, Homo sapiens
gactgcacacccatg

SEQ ID NO: 36914 - DNA, 15 bp, Homo sapiens
tgactgcacacccat

SEQ ID NO: 36915 - DNA, 15 bp, Homo sapiens
atgactgcacaccca

SEQ ID NO: 36916 - DNA, 15 bp, Homo sapiens
aatgactgcacaccc

SEQ ID NO: 36917 - DNA, 15 bp, Homo sapiens
aaatgactgcacacc

SEQ ID NO: 36918 - DNA, 15 bp, Homo sapiens
gaaatgactgcacac

SEQ ID NO: 36919 - DNA, 15 bp, Homo sapiens
tgaaatgactgcaca

SEQ ID NO: 36920 - DNA, 15 bp, Homo sapiens
ctgaaatgactgcac

SEQ ID NO: 36921 - DNA, 15 bp, Homo sapiens
tctgaaatgactgca

SEQ ID NO: 36922 - DNA, 15 bp, Homo sapiens
atctgaaatgactgc

SEQ ID NO: 36923 - DNA, 15 bp, Homo sapiens
tatctgaaatgactg

SEQ ID NO: 36924 - DNA, 15 bp, Homo sapiens
gtatctgaaatgact

SEQ ID NO: 36925 - DNA, 15 bp, Homo sapiens
agtatctgaaatgac

SEQ ID NO: 36926 - DNA, 15 bp, Homo sapiens
aagtatctgaaatga

SEQ ID NO: 36927 - DNA, 15 bp, Homo sapiens
caagtatctgaaatg

SEQ ID NO: 36928 - DNA, 15 bp, Homo sapiens
tcaagtatctgaaat

SEQ ID NO: 36929 - DNA, 15 bp, Homo sapiens
ctcaagtatctgaaa

SEQ ID NO: 36930 - DNA, 15 bp, Homo sapiens
actcaagtatctgaa

SEQ ID NO: 36931 - DNA, 15 bp, Homo sapiens
aactcaagtatctga

SEQ ID NO: 36932 - DNA, 15 bp, Homo sapiens
caactcaagtatctg

SEQ ID NO: 36933 - DNA, 15 bp, Homo sapiens
ccaactcaagtatct

SEQ ID NO: 36934 - DNA, 15 bp, Homo sapiens
accaactcaagtatc

SEQ ID NO: 36935 - DNA, 15 bp, Homo sapiens
taccaactcaagtat

SEQ ID NO: 36936 - DNA, 15 bp, Homo sapiens
gtaccaactcaagta

SEQ ID NO: 36937 - DNA, 15 bp, Homo sapiens
tgtaccaactcaagt

SEQ ID NO: 36938 - DNA, 15 bp, Homo sapiens
atgtaccaactcaag

SEQ ID NO: 36939 - DNA, 15 bp, Homo sapiens
gatgtaccaactcaa

SEQ ID NO: 36940 - DNA, 15 bp, Homo sapiens
agatgtaccaactca

SEQ ID NO: 36941 - DNA, 15 bp, Homo sapiens
gagatgtaccaactc

SEQ ID NO: 36942 - DNA, 15 bp, Homo sapiens
tgagatgtaccaact

SEQ ID NO: 36943 - DNA, 15 bp, Homo sapiens
ctgagatgtaccaac

SEQ ID NO: 36944 - DNA, 15 bp, Homo sapiens
actgagatgtaccaa

SEQ ID NO: 36945 - DNA, 15 bp, Homo sapiens
tactgagatgtacca

SEQ ID NO: 36946 - DNA, 15 bp, Homo sapiens
ttactgagatgtacc

SEQ ID NO: 36947 - DNA, 15 bp, Homo sapiens
tttactgagatgtac

SEQ ID NO: 36948 - DNA, 15 bp, Homo sapiens
ctttactgagatgta

SEQ ID NO: 36949 - DNA, 15 bp, Homo sapiens
actttactgagatgt

SEQ ID NO: 36950 - DNA, 15 bp, Homo sapiens
gactttactgagatg

SEQ ID NO: 36951 - DNA, 15 bp, Homo sapiens
agactttactgagat

SEQ ID NO: 36952 - DNA, 15 bp, Homo sapiens
cagactttactgaga

SEQ ID NO: 36953 - DNA, 15 bp, Homo sapiens
acagactttactgag

SEQ ID NO: 36954 - DNA, 15 bp, Homo sapiens
gacagactttactga

SEQ ID NO: 36955 - DNA, 15 bp, Homo sapiens
ggacagactttactg

SEQ ID NO: 36956 - DNA, 15 bp, Homo sapiens
gggacagactttact

SEQ ID NO: 36957 - DNA, 15 bp, Homo sapiens
cgggacagactttac

SEQ ID NO: 36958 - DNA, 15 bp, Homo sapiens
acgggacagacttta

SEQ ID NO: 36959 - DNA, 15 bp, Homo sapiens
cacgggacagacttt

SEQ ID NO: 36960 - DNA, 15 bp, Homo sapiens
tcacgggacagactt

SEQ ID NO: 36961 - DNA, 15 bp, Homo sapiens
ctcacgggacagact

SEQ ID NO: 36962 - DNA, 15 bp, Homo sapiens
tctcacgggacagac

SEQ ID NO: 36963 - DNA, 15 bp, Homo sapiens
ttctcacgggacaga

SEQ ID NO: 36964 - DNA, 15 bp, Homo sapiens
cttctcacgggacag

SEQ ID NO: 36965 - DNA, 15 bp, Homo sapiens
gcttctcacgggaca

SEQ ID NO: 36966 - DNA, 15 bp, Homo sapiens
ggcttctcacgggac

SEQ ID NO: 36967 - DNA, 15 bp, Homo sapiens
tggcttctcacggga

SEQ ID NO: 36968 - DNA, 15 bp, Homo sapiens
atggcttctcacggg

SEQ ID NO: 36969 - DNA, 15 bp, Homo sapiens
catggcttctcacgg

SEQ ID NO: 36970 - DNA, 15 bp, Homo sapiens
ccatggcttctcacg

SEQ ID NO: 36971 - DNA, 15 bp, Homo sapiens
cccatggcttctcac

SEQ ID NO: 36972 - DNA, 15 bp, Homo sapiens
acccatggcttctca

SEQ ID NO: 36973 - DNA, 15 bp, Homo sapiens
aacccatggcttctc

SEQ ID NO: 36974 - DNA, 15 bp, Homo sapiens
aaacccatggcttct

SEQ ID NO: 36975 - DNA, 15 bp, Homo sapiens
gaaacccatggcttc

SEQ ID NO: 36976 - DNA, 15 bp, Homo sapiens
tgaaacccatggctt

SEQ ID NO: 36977 - DNA, 15 bp, Homo sapiens
atgaaacccatggct

SEQ ID NO: 36978 - DNA, 15 bp, Homo sapiens
catgaaacccatggc

SEQ ID NO: 36979 - DNA, 15 bp, Homo sapiens
ccatgaaacccatgg

SEQ ID NO: 36980 - DNA, 15 bp, Homo sapiens
accatgaaacccatg

SEQ ID NO: 36981 - DNA, 15 bp, Homo sapiens
taccatgaaacccat

SEQ ID NO: 36982 - DNA, 15 bp, Homo sapiens
ataccatgaaaccca

SEQ ID NO: 36983 - DNA, 15 bp, Homo sapiens
cataccatgaaaccc

SEQ ID NO: 36984 - DNA, 15 bp, Homo sapiens
ccataccatgaaacc

SEQ ID NO: 36985 - DNA, 15 bp, Homo sapiens
accataccatgaaac

SEQ ID NO: 36986 - DNA, 15 bp, Homo sapiens
aaccataccatgaaa

SEQ ID NO: 36987 - DNA, 15 bp, Homo sapiens
caaccataccatgaa

SEQ ID NO: 36988 - DNA, 15 bp, Homo sapiens
ccaaccataccatga

SEQ ID NO: 36989 - DNA, 15 bp, Homo sapiens
gccaaccataccatg

SEQ ID NO: 36990 - DNA, 15 bp, Homo sapiens
tgccaaccataccat

SEQ ID NO: 36991 - DNA, 15 bp, Homo sapiens
atgccaaccatacca

SEQ ID NO: 36992 - DNA, 15 bp, Homo sapiens
gatgccaaccatacc

SEQ ID NO: 36993 - DNA, 15 bp, Homo sapiens
agatgccaaccatac

SEQ ID NO: 36994 - DNA, 15 bp, Homo sapiens
aagatgccaaccata

SEQ ID NO: 36995 - DNA, 15 bp, Homo sapiens
gaagatgccaaccat

SEQ ID NO: 36996 - DNA, 15 bp, Homo sapiens
ggaagatgccaacca

SEQ ID NO: 36997 - DNA, 15 bp, Homo sapiens
aggaagatgccaacc

SEQ ID NO: 36998 - DNA, 15 bp, Homo sapiens
aaggaagatgccaac

SEQ ID NO: 36999 - DNA, 15 bp, Homo sapiens
caaggaagatgccaa

SEQ ID NO: 37000 - DNA, 15 bp, Homo sapiens
ccaaggaagatgcca

SEQ ID NO: 37001 - DNA, 15 bp, Homo sapiens
cccaaggaagatgcc

SEQ ID NO: 37002 - DNA, 15 bp, Homo sapiens
tcccaaggaagatgc

SEQ ID NO: 37003 - DNA, 15 bp, Homo sapiens
ctcccaaggaagatg

SEQ ID NO: 37004 - DNA, 15 bp, Homo sapiens
actcccaaggaagat

SEQ ID NO: 37005 - DNA, 15 bp, Homo sapiens
cactcccaaggaaga

SEQ ID NO: 37006 - DNA, 15 bp, Homo sapiens
ccactcccaaggaag

SEQ ID NO: 37007 - DNA, 15 bp, Homo sapiens
gccactcccaaggaa

SEQ ID NO: 37008 - DNA, 15 bp, Homo sapiens
ggccactcccaagga

SEQ ID NO: 37009 - DNA, 15 bp, Homo sapiens
tggccactcccaagg

SEQ ID NO: 37010 - DNA, 15 bp, Homo sapiens
gtggccactcccaag

SEQ ID NO: 37011 - DNA, 15 bp, Homo sapiens
tgtggccactcccaa

SEQ ID NO: 37012 - DNA, 15 bp, Homo sapiens
ctgtggccactccca

SEQ ID NO: 37013 - DNA, 15 bp, Homo sapiens
actgtggccactccc

SEQ ID NO: 37014 - DNA, 15 bp, Homo sapiens
cactgtggccactcc

SEQ ID NO: 37015 - DNA, 15 bp, Homo sapiens
ccactgtggccactc

SEQ ID NO: 37016 - DNA, 15 bp, Homo sapiens
accactgtggccact

SEQ ID NO: 37017 - DNA, 15 bp, Homo sapiens
caccactgtggccac

SEQ ID NO: 37018 - DNA, 15 bp, Homo sapiens
ccaccactgtggcca

SEQ ID NO: 37019 - DNA, 15 bp, Homo sapiens
accaccactgtggcc

SEQ ID NO: 37020 - DNA, 15 bp, Homo sapiens
caccaccactgtggc

SEQ ID NO: 37021 - DNA, 15 bp, Homo sapiens
ccaccaccactgtgg

SEQ ID NO: 37022 - DNA, 15 bp, Homo sapiens
gccaccaccactgtg

SEQ ID NO: 37023 - DNA, 15 bp, Homo sapiens
agccaccaccactgt

SEQ ID NO: 37024 - DNA, 15 bp, Homo sapiens
aagccaccaccactg

SEQ ID NO: 37025 - DNA, 15 bp, Homo sapiens
gaagccaccaccact

SEQ ID NO: 37026 - DNA, 15 bp, Homo sapiens
tgaagccaccaccac

SEQ ID NO: 37027 - DNA, 15 bp, Homo sapiens
ctgaagccaccacca

SEQ ID NO: 37028 - DNA, 15 bp, Homo sapiens
cctgaagccaccacc

SEQ ID NO: 37029 - DNA, 15 bp, Homo sapiens
tcctgaagccaccac

SEQ ID NO: 37030 - DNA, 15 bp, Homo sapiens
ttcctgaagccacca

SEQ ID NO: 37031 - DNA, 15 bp, Homo sapiens
tttcctgaagccacc

SEQ ID NO: 37032 - DNA, 15 bp, Homo sapiens
ctttcctgaagccac

SEQ ID NO: 37033 - DNA, 15 bp, Homo sapiens
tctttcctgaagcca

SEQ ID NO: 37034 - DNA, 15 bp, Homo sapiens
ctctttcctgaagcc

SEQ ID NO: 37035 - DNA, 15 bp, Homo sapiens
tctctttcctgaagc

SEQ ID NO: 37036 - DNA, 15 bp, Homo sapiens
gtctctttcctgaag

SEQ ID NO: 37037 - DNA, 15 bp, Homo sapiens
agtctctttcctgaa

SEQ ID NO: 37038 - DNA, 15 bp, Homo sapiens
gagtctctttcctga

SEQ ID NO: 37039 - DNA, 15 bp, Homo sapiens
ggagtctctttcctg

SEQ ID NO: 37040 - DNA, 15 bp, Homo sapiens
tggagtctctttcct

SEQ ID NO: 37041 - DNA, 15 bp, Homo sapiens
ttggagtctctttcc

SEQ ID NO: 37042 - DNA, 15 bp, Homo sapiens
gttggagtctctttc

SEQ ID NO: 37043 - DNA, 15 bp, Homo sapiens
tgttggagtctcttt

SEQ ID NO: 37044 - DNA, 15 bp, Homo sapiens
ctgttggagtctctt

SEQ ID NO: 37045 - DNA, 15 bp, Homo sapiens
cctgttggagtctct

SEQ ID NO: 37046 - DNA, 15 bp, Homo sapiens
ccctgttggagtctc

SEQ ID NO: 37047 - DNA, 15 bp, Homo sapiens
cccctgttggagtct

SEQ ID NO: 37048 - DNA, 15 bp, Homo sapiens
gcccctgttggagtc

SEQ ID NO: 37049 - DNA, 15 bp, Homo sapiens
ggcccctgttggagt

SEQ ID NO: 37050 - DNA, 15 bp, Homo sapiens
tggcccctgttggag

SEQ ID NO: 37051 - DNA, 15 bp, Homo sapiens
ctggcccctgttgga

SEQ ID NO: 37052 - DNA, 15 bp, Homo sapiens
gctggcccctgttgg

SEQ ID NO: 37053 - DNA, 15 bp, Homo sapiens
agctggcccctgttg

SEQ ID NO: 37054 - DNA, 15 bp, Homo sapiens
cagctggcccctgtt

SEQ ID NO: 37055 - DNA, 15 bp, Homo sapiens
acagctggcccctgt

SEQ ID NO: 37056 - DNA, 15 bp, Homo sapiens
cacagctggcccctg

SEQ ID NO: 37057 - DNA, 15 bp, Homo sapiens
ccacagctggcccct

SEQ ID NO: 37058 - DNA, 15 bp, Homo sapiens
cccacagctggcccc

SEQ ID NO: 37059 - DNA, 15 bp, Homo sapiens
gcccacagctggccc

SEQ ID NO: 37060 - DNA, 15 bp, Homo sapiens
ggcccacagctggcc

SEQ ID NO: 37061 - DNA, 15 bp, Homo sapiens
aggcccacagctggc

SEQ ID NO: 37062 - DNA, 15 bp, Homo sapiens
aaggcccacagctgg

SEQ ID NO: 37063 - DNA, 15 bp, Homo sapiens
caaggcccacagctg

SEQ ID NO: 37064 - DNA, 15 bp, Homo sapiens
ccaaggcccacagct

SEQ ID NO: 37065 - DNA, 15 bp, Homo sapiens
cccaaggcccacagc

SEQ ID NO: 37066 - DNA, 15 bp, Homo sapiens
gcccaaggcccacag

SEQ ID NO: 37067 - DNA, 15 bp, Homo sapiens
tgcccaaggcccaca

SEQ ID NO: 37068 - DNA, 15 bp, Homo sapiens
gtgcccaaggcccac

SEQ ID NO: 37069 - DNA, 15 bp, Homo sapiens
agtgcccaaggccca

SEQ ID NO: 37070 - DNA, 15 bp, Homo sapiens
aagtgcccaaggccc

SEQ ID NO: 37071 - DNA, 15 bp, Homo sapiens
gaagtgcccaaggcc

SEQ ID NO: 37072 - DNA, 15 bp, Homo sapiens
agaagtgcccaaggc

SEQ ID NO: 37073 - DNA, 15 bp, Homo sapiens
gagaagtgcccaagg

SEQ ID NO: 37074 - DNA, 15 bp, Homo sapiens
cgagaagtgcccaag

SEQ ID NO: 37075 - DNA, 15 bp, Homo sapiens
acgagaagtgcccaa

SEQ ID NO: 37076 - DNA, 15 bp, Homo sapiens
aacgagaagtgccca

SEQ ID NO: 37077 - DNA, 15 bp, Homo sapiens
aaacgagaagtgccc

SEQ ID NO: 37078 - DNA, 15 bp, Homo sapiens
gaaacgagaagtgcc

SEQ ID NO: 37079 - DNA, 15 bp, Homo sapiens
agaaacgagaagtgc

SEQ ID NO: 37080 - DNA, 15 bp, Homo sapiens
tagaaacgagaagtg

SEQ ID NO: 37081 - DNA, 15 bp, Homo sapiens
ctagaaacgagaagt

SEQ ID NO: 37082 - DNA, 15 bp, Homo sapiens
cctagaaacgagaag

SEQ ID NO: 37083 - DNA, 15 bp, Homo sapiens
tcctagaaacgagaa

SEQ ID NO: 37084 - DNA, 15 bp, Homo sapiens
ttcctagaaacgaga

SEQ ID NO: 37085 - DNA, 15 bp, Homo sapiens
tttcctagaaacgag

SEQ ID NO: 37086 - DNA, 15 bp, Homo sapiens
ttttcctagaaacga

SEQ ID NO: 37087 - DNA, 15 bp, Homo sapiens
cttttcctagaaacg

SEQ ID NO: 37088 - DNA, 15 bp, Homo sapiens
acttttcctagaaac

SEQ ID NO: 37089 - DNA, 15 bp, Homo sapiens
gacttttcctagaaa

SEQ ID NO: 37090 - DNA, 15 bp, Homo sapiens
ggacttttcctagaa

SEQ ID NO: 37091 - DNA, 15 bp, Homo sapiens
aggacttttcctaga

SEQ ID NO: 37092 - DNA, 15 bp, Homo sapiens
taggacttttcctag

SEQ ID NO: 37093 - DNA, 15 bp, Homo sapiens
ttaggacttttccta

SEQ ID NO: 37094 - DNA, 15 bp, Homo sapiens
cttaggacttttcct

SEQ ID NO: 37095 - DNA, 15 bp, Homo sapiens
acttaggacttttcc

SEQ ID NO: 37096 - DNA, 15 bp, Homo sapiens
gacttaggacttttc

SEQ ID NO: 37097 - DNA, 15 bp, Homo sapiens
agacttaggactttt

SEQ ID NO: 37098 - DNA, 15 bp, Homo sapiens
cagacttaggacttt

SEQ ID NO: 37099 - DNA, 15 bp, Homo sapiens
acagacttaggactt

SEQ ID NO: 37100 - DNA, 15 bp, Homo sapiens
tacagacttaggact

SEQ ID NO: 37101 - DNA, 15 bp, Homo sapiens
ctacagacttaggac

SEQ ID NO: 37102 - DNA, 15 bp, Homo sapiens
cctacagacttagga

SEQ ID NO: 37103 - DNA, 15 bp, Homo sapiens
ccctacagacttagg

SEQ ID NO: 37104 - DNA, 15 bp, Homo sapiens
gccctacagacttag

SEQ ID NO: 37105 - DNA, 15 bp, Homo sapiens
agccctacagactta

SEQ ID NO: 37106 - DNA, 15 bp, Homo sapiens
tagccctacagactt

SEQ ID NO: 37107 - DNA, 15 bp, Homo sapiens
ctagccctacagact

SEQ ID NO: 37108 - DNA, 15 bp, Homo sapiens
cctagccctacagac

SEQ ID NO: 37109 - DNA, 15 bp, Homo sapiens
ccctagccctacaga

SEQ ID NO: 37110 - DNA, 15 bp, Homo sapiens
cccctagccctacag

SEQ ID NO: 37111 - DNA, 15 bp, Homo sapiens
acccctagccctaca

SEQ ID NO: 37112 - DNA, 15 bp, Homo sapiens
cacccctagccctac

SEQ ID NO: 37113 - DNA, 15 bp, Homo sapiens
ccacccctagcccta

SEQ ID NO: 37114 - DNA, 15 bp, Homo sapiens
cccacccctagccct

SEQ ID NO: 37115 - DNA, 15 bp, Homo sapiens
ccccacccctagccc

SEQ ID NO: 37116 - DNA, 15 bp, Homo sapiens
tccccacccctagcc

SEQ ID NO: 37117 - DNA, 15 bp, Homo sapiens
ttccccacccctagc

SEQ ID NO: 37118 - DNA, 15 bp, Homo sapiens
gttccccacccctag

SEQ ID NO: 37119 - DNA, 15 bp, Homo sapiens
ggttccccaccccta

SEQ ID NO: 37120 - DNA, 15 bp, Homo sapiens
gggttccccacccct

SEQ ID NO: 37121 - DNA, 15 bp, Homo sapiens
ggggttccccacccc

SEQ ID NO: 37122 - DNA, 15 bp, Homo sapiens
aggggttccccaccc

SEQ ID NO: 37123 - DNA, 15 bp, Homo sapiens
aaggggttccccacc

SEQ ID NO: 37124 - DNA, 15 bp, Homo sapiens
gaaggggttccccac

SEQ ID NO: 37125 - DNA, 15 bp, Homo sapiens
cgaaggggttcccca

SEQ ID NO: 37126 - DNA, 15 bp, Homo sapiens
gcgaaggggttcccc

SEQ ID NO: 37127 - DNA, 15 bp, Homo sapiens
agcgaaggggttccc

SEQ ID NO: 37128 - DNA, 15 bp, Homo sapiens
cagcgaaggggttcc

SEQ ID NO: 37129 - DNA, 15 bp, Homo sapiens
acagcgaaggggttc

SEQ ID NO: 37130 - DNA, 15 bp, Homo sapiens
gacagcgaaggggtt

SEQ ID NO: 37131 - DNA, 15 bp, Homo sapiens
tgacagcgaaggggt

SEQ ID NO: 37132 - DNA, 15 bp, Homo sapiens
ctgacagcgaagggg

SEQ ID NO: 37133 - DNA, 15 bp, Homo sapiens
cctgacagcgaaggg

SEQ ID NO: 37134 - DNA, 15 bp, Homo sapiens
tcctgacagcgaagg

SEQ ID NO: 37135 - DNA, 15 bp, Homo sapiens
atcctgacagcgaag

SEQ ID NO: 37136 - DNA, 15 bp, Homo sapiens
gatcctgacagcgaa

SEQ ID NO: 37137 - DNA, 15 bp, Homo sapiens
tgatcctgacagcga

SEQ ID NO: 37138 - DNA, 15 bp, Homo sapiens
ttgatcctgacagcg

SEQ ID NO: 37139 - DNA, 15 bp, Homo sapiens
cttgatcctgacagc

SEQ ID NO: 37140 - DNA, 15 bp, Homo sapiens
tcttgatcctgacag

SEQ ID NO: 37141 - DNA, 15 bp, Homo sapiens
ctcttgatcctgaca

SEQ ID NO: 37142 - DNA, 15 bp, Homo sapiens
cctcttgatcctgac

SEQ ID NO: 37143 - DNA, 15 bp, Homo sapiens
ccctcttgatcctga

SEQ ID NO: 37144 - DNA, 15 bp, Homo sapiens
gccctcttgatcctg

SEQ ID NO: 37145 - DNA, 15 bp, Homo sapiens
tgccctcttgatcct

SEQ ID NO: 37146 - DNA, 15 bp, Homo sapiens
ttgccctcttgatcc

SEQ ID NO: 37147 - DNA, 15 bp, Homo sapiens
cttgccctcttgatc

SEQ ID NO: 37148 - DNA, 15 bp, Homo sapiens
ccttgccctcttgat

SEQ ID NO: 37149 - DNA, 15 bp, Homo sapiens
cccttgccctcttga

SEQ ID NO: 37150 - DNA, 15 bp, Homo sapiens
ccccttgccctcttg

SEQ ID NO: 37151 - DNA, 15 bp, Homo sapiens
tccccttgccctctt

SEQ ID NO: 37152 - DNA, 15 bp, Homo sapiens
ttccccttgccctct

SEQ ID NO: 37153 - DNA, 15 bp, Homo sapiens
gttccccttgccctc

SEQ ID NO: 37154 - DNA, 15 bp, Homo sapiens
agttccccttgccct

SEQ ID NO: 37155 - DNA, 15 bp, Homo sapiens
cagttccccttgccc

SEQ ID NO: 37156 - DNA, 15 bp, Homo sapiens
acagttccccttgcc

SEQ ID NO: 37157 - DNA, 15 bp, Homo sapiens
gacagttccccttgc

SEQ ID NO: 37158 - DNA, 15 bp, Homo sapiens
cgacagttccccttg

SEQ ID NO: 37159 - DNA, 15 bp, Homo sapiens
gcgacagttcccctt

SEQ ID NO: 37160 - DNA, 15 bp, Homo sapiens
agcgacagttcccct

SEQ ID NO: 37161 - DNA, 15 bp, Homo sapiens
cagcgacagttcccc

SEQ ID NO: 37162 - DNA, 15 bp, Homo sapiens
ccagcgacagttccc

SEQ ID NO: 37163 - DNA, 15 bp, Homo sapiens
tccagcgacagttcc

SEQ ID NO: 37164 - DNA, 15 bp, Homo sapiens
ctccagcgacagttc

SEQ ID NO: 37165 - DNA, 15 bp, Homo sapiens
cctccagcgacagtt

SEQ ID NO: 37166 - DNA, 15 bp, Homo sapiens
tcctccagcgacagt

SEQ ID NO: 37167 - DNA, 15 bp, Homo sapiens
ctcctccagcgacag

SEQ ID NO: 37168 - DNA, 15 bp, Homo sapiens
tctcctccagcgaca

SEQ ID NO: 37169 - DNA, 15 bp, Homo sapiens
gtctcctccagcgac

SEQ ID NO: 37170 - DNA, 15 bp, Homo sapiens
tgtctcctccagcga

SEQ ID NO: 37171 - DNA, 15 bp, Homo sapiens
atgtctcctccagcg

SEQ ID NO: 37172 - DNA, 15 bp, Homo sapiens
gatgtctcctccagc

SEQ ID NO: 37173 - DNA, 15 bp, Homo sapiens
ggatgtctcctccag

SEQ ID NO: 37174 - DNA, 15 bp, Homo sapiens
tggatgtctcctcca

SEQ ID NO: 37175 - DNA, 15 bp, Homo sapiens
ctggatgtctcctcc

SEQ ID NO: 37176 - DNA, 15 bp, Homo sapiens
gctggatgtctcctc

SEQ ID NO: 37177 - DNA, 15 bp, Homo sapiens
agctggatgtctcct

SEQ ID NO: 37178 - DNA, 15 bp, Homo sapiens
cagctggatgtctcc

SEQ ID NO: 37179 - DNA, 15 bp, Homo sapiens
ccagctggatgtctc

SEQ ID NO: 37180 - DNA, 15 bp, Homo sapiens
tccagctggatgtct

SEQ ID NO: 37181 - DNA, 15 bp, Homo sapiens
ctccagctggatgtc

SEQ ID NO: 37182 - DNA, 15 bp, Homo sapiens
tctccagctggatgt

SEQ ID NO: 37183 - DNA, 15 bp, Homo sapiens
ttctccagctggatg

SEQ ID NO: 37184 - DNA, 15 bp, Homo sapiens
tttctccagctggat

SEQ ID NO: 37185 - DNA, 15 bp, Homo sapiens
gtttctccagctgga

SEQ ID NO: 37186 - DNA, 15 bp, Homo sapiens
tgtttctccagctgg

SEQ ID NO: 37187 - DNA, 15 bp, Homo sapiens
ttgtttctccagctg

SEQ ID NO: 37188 - DNA, 15 bp, Homo sapiens
tttgtttctccagct

SEQ ID NO: 37189 - DNA, 15 bp, Homo sapiens
ttttgtttctccagc

SEQ ID NO: 37190 - DNA, 15 bp, Homo sapiens
cttttgtttctccag

SEQ ID NO: 37191 - DNA, 15 bp, Homo sapiens
tcttttgtttctcca

SEQ ID NO: 37192 - DNA, 15 bp, Homo sapiens
ctcttttgtttctcc

SEQ ID NO: 37193 - DNA, 15 bp, Homo sapiens
actcttttgtttctc

SEQ ID NO: 37194 - DNA, 15 bp, Homo sapiens
tactcttttgtttct

SEQ ID NO: 37195 - DNA, 15 bp, Homo sapiens
ttactcttttgtttc

SEQ ID NO: 37196 - DNA, 15 bp, Homo sapiens
cttactcttttgttt

SEQ ID NO: 37197 - DNA, 15 bp, Homo sapiens
acttactcttttgtt

SEQ ID NO: 37198 - DNA, 15 bp, Homo sapiens
gacttactcttttgt

SEQ ID NO: 37199 - DNA, 15 bp, Homo sapiens
agacttactcttttg

SEQ ID NO: 37200 - DNA, 15 bp, Homo sapiens
cagacttactctttt

SEQ ID NO: 37201 - DNA, 15 bp, Homo sapiens
gcagacttactcttt

SEQ ID NO: 37202 - DNA, 15 bp, Homo sapiens
cgcagacttactctt

SEQ ID NO: 37203 - DNA, 15 bp, Homo sapiens
acgcagacttactct

SEQ ID NO: 37204 - DNA, 15 bp, Homo sapiens
aacgcagacttactc

SEQ ID NO: 37205 - DNA, 15 bp, Homo sapiens
caacgcagacttact

SEQ ID NO: 37206 - DNA, 15 bp, Homo sapiens
gcaacgcagacttac

SEQ ID NO: 37207 - DNA, 15 bp, Homo sapiens
agcaacgcagactta

SEQ ID NO: 37208 - DNA, 15 bp, Homo sapiens
cagcaacgcagactt

SEQ ID NO: 37209 - DNA, 15 bp, Homo sapiens
gcagcaacgcagact

SEQ ID NO: 37210 - DNA, 15 bp, Homo sapiens
agcagcaacgcagac

SEQ ID NO: 37211 - DNA, 15 bp, Homo sapiens
aagcagcaacgcaga

SEQ ID NO: 37212 - DNA, 15 bp, Homo sapiens
caagcagcaacgcag

SEQ ID NO: 37213 - DNA, 15 bp, Homo sapiens
acaagcagcaacgca

SEQ ID NO: 37214 - DNA, 15 bp, Homo sapiens
cacaagcagcaacgc

SEQ ID NO: 37215 - DNA, 15 bp, Homo sapiens
ccacaagcagcaacg

SEQ ID NO: 37216 - DNA, 15 bp, Homo sapiens
cccacaagcagcaac

SEQ ID NO: 37217 - DNA, 15 bp, Homo sapiens
ccccacaagcagcaa

SEQ ID NO: 37218 - DNA, 15 bp, Homo sapiens
accccacaagcagca

SEQ ID NO: 37219 - DNA, 15 bp, Homo sapiens
gaccccacaagcagc

SEQ ID NO: 37220 - DNA, 15 bp, Homo sapiens
agaccccacaagcag

SEQ ID NO: 37221 - DNA, 15 bp, Homo sapiens
aagaccccacaagca

SEQ ID NO: 37222 - DNA, 15 bp, Homo sapiens
gaagaccccacaagc

SEQ ID NO: 37223 - DNA, 15 bp, Homo sapiens
ggaagaccccacaag

SEQ ID NO: 37224 - DNA, 15 bp, Homo sapiens
gggaagaccccacaa

SEQ ID NO: 37225 - DNA, 15 bp, Homo sapiens
ggggaagaccccaca

SEQ ID NO: 37226 - DNA, 15 bp, Homo sapiens
tggggaagaccccac

SEQ ID NO: 37227 - DNA, 15 bp, Homo sapiens
atggggaagacccca

SEQ ID NO: 37228 - DNA, 15 bp, Homo sapiens
gatggggaagacccc

SEQ ID NO: 37229 - DNA, 15 bp, Homo sapiens
agatggggaagaccc

SEQ ID NO: 37230 - DNA, 15 bp, Homo sapiens
gagatggggaagacc

SEQ ID NO: 37231 - DNA, 15 bp, Homo sapiens
tgagatggggaagac

SEQ ID NO: 37232 - DNA, 15 bp, Homo sapiens
ctgagatggggaaga

SEQ ID NO: 37233 - DNA, 15 bp, Homo sapiens
cctgagatggggaag

SEQ ID NO: 37234 - DNA, 15 bp, Homo sapiens
ccctgagatggggaa

SEQ ID NO: 37235 - DNA, 15 bp, Homo sapiens
gccctgagatgggga

SEQ ID NO: 37236 - DNA, 15 bp, Homo sapiens
cgccctgagatgggg

SEQ ID NO: 37237 - DNA, 15 bp, Homo sapiens
ccgccctgagatggg

SEQ ID NO: 37238 - DNA, 15 bp, Homo sapiens
cccgccctgagatgg

SEQ ID NO: 37239 - DNA, 15 bp, Homo sapiens
ccccgccctgagatg

SEQ ID NO: 37240 - DNA, 15 bp, Homo sapiens
tccccgccctgagat

SEQ ID NO: 37241 - DNA, 15 bp, Homo sapiens
gtccccgccctgaga

SEQ ID NO: 37242 - DNA, 15 bp, Homo sapiens
ggtccccgccctgag

SEQ ID NO: 37243 - DNA, 15 bp, Homo sapiens
cggtccccgccctga

SEQ ID NO: 37244 - DNA, 15 bp, Homo sapiens
ccggtccccgccctg

SEQ ID NO: 37245 - DNA, 15 bp, Homo sapiens
cccggtccccgccct

SEQ ID NO: 37246 - DNA, 15 bp, Homo sapiens
ccccggtccccgccc

SEQ ID NO: 37247 - DNA, 15 bp, Homo sapiens
cccccggtccccgcc

SEQ ID NO: 37248 - DNA, 15 bp, Homo sapiens
acccccggtccccgc

SEQ ID NO: 37249 - DNA, 15 bp, Homo sapiens
cacccccggtccccg

SEQ ID NO: 37250 - DNA, 15 bp, Homo sapiens
ccacccccggtcccc

SEQ ID NO: 37251 - DNA, 15 bp, Homo sapiens
gccacccccggtccc

SEQ ID NO: 37252 - DNA, 15 bp, Homo sapiens
cgccacccccggtcc

SEQ ID NO: 37253 - DNA, 15 bp, Homo sapiens
ccgccacccccggtc

SEQ ID NO: 37254 - DNA, 15 bp, Homo sapiens
accgccacccccggt

SEQ ID NO: 37255 - DNA, 15 bp, Homo sapiens
gaccgccacccccgg

SEQ ID NO: 37256 - DNA, 15 bp, Homo sapiens
ggaccgccacccccg

SEQ ID NO: 37257 - DNA, 15 bp, Homo sapiens
tggaccgccaccccc

SEQ ID NO: 37258 - DNA, 15 bp, Homo sapiens
ctggaccgccacccc

SEQ ID NO: 37259 - DNA, 15 bp, Homo sapiens
tctggaccgccaccc

SEQ ID NO: 37260 - DNA, 15 bp, Homo sapiens
gtctggaccgccacc

SEQ ID NO: 37261 - DNA, 15 bp, Homo sapiens
tgtctggaccgccac

SEQ ID NO: 37262 - DNA, 15 bp, Homo sapiens
ttgtctggaccgcca

SEQ ID NO: 37263 - DNA, 15 bp, Homo sapiens
cttgtctggaccgcc

SEQ ID NO: 37264 - DNA, 15 bp, Homo sapiens
acttgtctggaccgc

SEQ ID NO: 37265 - DNA, 15 bp, Homo sapiens
tacttgtctggaccg

SEQ ID NO: 37266 - DNA, 15 bp, Homo sapiens
ttacttgtctggacc

SEQ ID NO: 37267 - DNA, 15 bp, Homo sapiens
attacttgtctggac

SEQ ID NO: 37268 - DNA, 15 bp, Homo sapiens
gattacttgtctgga

SEQ ID NO: 37269 - DNA, 15 bp, Homo sapiens
tgattacttgtctgg

SEQ ID NO: 37270 - DNA, 15 bp, Homo sapiens
ttgattacttgtctg

SEQ ID NO: 37271 - DNA, 15 bp, Homo sapiens
cttgattacttgtct

SEQ ID NO: 37272 - DNA, 15 bp, Homo sapiens
ccttgattacttgtc

SEQ ID NO: 37273 - DNA, 15 bp, Homo sapiens
tccttgattacttgt

SEQ ID NO: 37274 - DNA, 15 bp, Homo sapiens
gtccttgattacttg

SEQ ID NO: 37275 - DNA, 15 bp, Homo sapiens
cgtccttgattactt

SEQ ID NO: 37276 - DNA, 15 bp, Homo sapiens
tcgtccttgattact

SEQ ID NO: 37277 - DNA, 15 bp, Homo sapiens
atcgtccttgattac

SEQ ID NO: 37278 - DNA, 15 bp, Homo sapiens
catcgtccttgatta

SEQ ID NO: 37279 - DNA, 15 bp, Homo sapiens
gcatcgtccttgatt

SEQ ID NO: 37280 - DNA, 15 bp, Homo sapiens
ggcatcgtccttgat

SEQ ID NO: 37281 - DNA, 15 bp, Homo sapiens
gggcatcgtccttga

SEQ ID NO: 37282 - DNA, 15 bp, Homo sapiens
tgggcatcgtccttg

SEQ ID NO: 37283 - DNA, 15 bp, Homo sapiens
ctgggcatcgtcctt

SEQ ID NO: 37284 - DNA, 15 bp, Homo sapiens
cctgggcatcgtcct

SEQ ID NO: 37285 - DNA, 15 bp, Homo sapiens
tcctgggcatcgtcc

SEQ ID NO: 37286 - DNA, 15 bp, Homo sapiens
ctcctgggcatcgtc

SEQ ID NO: 37287 - DNA, 15 bp, Homo sapiens
cctcctgggcatcgt

SEQ ID NO: 37288 - DNA, 15 bp, Homo sapiens
ccctcctgggcatcg

SEQ ID NO: 37289 - DNA, 15 bp, Homo sapiens
cccctcctgggcatc

SEQ ID NO: 37290 - DNA, 15 bp, Homo sapiens
tcccctcctgggcat

SEQ ID NO: 37291 - DNA, 15 bp, Homo sapiens
gtcccctcctgggca

SEQ ID NO: 37292 - DNA, 15 bp, Homo sapiens
tgtcccctcctgggc

SEQ ID NO: 37293 - DNA, 15 bp, Homo sapiens
ctgtcccctcctggg

SEQ ID NO: 37294 - DNA, 15 bp, Homo sapiens
cctgtcccctcctgg

SEQ ID NO: 37295 - DNA, 15 bp, Homo sapiens
acctgtcccctcctg

SEQ ID NO: 37296 - DNA, 15 bp, Homo sapiens
tacctgtcccctcct

SEQ ID NO: 37297 - DNA, 15 bp, Homo sapiens
gtacctgtcccctcc

SEQ ID NO: 37298 - DNA, 15 bp, Homo sapiens
cgtacctgtcccctc

SEQ ID NO: 37299 - DNA, 15 bp, Homo sapiens
ccgtacctgtcccct

SEQ ID NO: 37300 - DNA, 15 bp, Homo sapiens
cccgtacctgtcccc

SEQ ID NO: 37301 - DNA, 15 bp, Homo sapiens
ccccgtacctgtccc

SEQ ID NO: 37302 - DNA, 15 bp, Homo sapiens
accccgtacctgtcc

SEQ ID NO: 37303 - DNA, 15 bp, Homo sapiens
caccccgtacctgtc

SEQ ID NO: 37304 - DNA, 15 bp, Homo sapiens
ccaccccgtacctgt

SEQ ID NO: 37305 - DNA, 15 bp, Homo sapiens
gccaccccgtacctg

SEQ ID NO: 37306 - DNA, 15 bp, Homo sapiens
tgccaccccgtacct

SEQ ID NO: 37307 - DNA, 15 bp, Homo sapiens
ctgccaccccgtacc

SEQ ID NO: 37308 - DNA, 15 bp, Homo sapiens
cctgccaccccgtac

SEQ ID NO: 37309 - DNA, 15 bp, Homo sapiens
tcctgccaccccgta

SEQ ID NO: 37310 - DNA, 15 bp, Homo sapiens
ctcctgccaccccgt

SEQ ID NO: 37311 - DNA, 15 bp, Homo sapiens
gctcctgccaccccg

SEQ ID NO: 37312 - DNA, 15 bp, Homo sapiens
agctcctgccacccc

SEQ ID NO: 37313 - DNA, 15 bp, Homo sapiens
gagctcctgccaccc

SEQ ID NO: 37314 - DNA, 15 bp, Homo sapiens
agagctcctgccacc

SEQ ID NO: 37315 - DNA, 15 bp, Homo sapiens
cagagctcctgccac

SEQ ID NO: 37316 - DNA, 15 bp, Homo sapiens
gcagagctcctgcca

SEQ ID NO: 37317 - DNA, 15 bp, Homo sapiens
ggcagagctcctgcc

SEQ ID NO: 37318 - DNA, 15 bp, Homo sapiens
cggcagagctcctgc

SEQ ID NO: 37319 - DNA, 15 bp, Homo sapiens
ccggcagagctcctg

SEQ ID NO: 37320 - DNA, 15 bp, Homo sapiens
gccggcagagctcct

SEQ ID NO: 37321 - DNA, 15 bp, Homo sapiens
cgccggcagagctcc

SEQ ID NO: 37322 - DNA, 15 bp, Homo sapiens
ccgccggcagagctc

SEQ ID NO: 37323 - DNA, 15 bp, Homo sapiens
cccgccggcagagct

SEQ ID NO: 37324 - DNA, 15 bp, Homo sapiens
gcccgccggcagagc

SEQ ID NO: 37325 - DNA, 15 bp, Homo sapiens
agcccgccggcagag

SEQ ID NO: 37326 - DNA, 15 bp, Homo sapiens
gagcccgccggcaga

SEQ ID NO: 37327 - DNA, 15 bp, Homo sapiens
tgagcccgccggcag

SEQ ID NO: 37328 - DNA, 15 bp, Homo sapiens
ctgagcccgccggca

SEQ ID NO: 37329 - DNA, 15 bp, Homo sapiens
cctgagcccgccggc

SEQ ID NO: 37330 - DNA, 15 bp, Homo sapiens
tcctgagcccgccgg

SEQ ID NO: 37331 - DNA, 15 bp, Homo sapiens
ttcctgagcccgccg

SEQ ID NO: 37332 - DNA, 15 bp, Homo sapiens
cttcctgagcccgcc

SEQ ID NO: 37333 - DNA, 15 bp, Homo sapiens
gcttcctgagcccgc

SEQ ID NO: 37334 - DNA, 15 bp, Homo sapiens
ggcttcctgagcccg

SEQ ID NO: 37335 - DNA, 15 bp, Homo sapiens
aggcttcctgagccc

SEQ ID NO: 37336 - DNA, 15 bp, Homo sapiens
aaggcttcctgagcc

SEQ ID NO: 37337 - DNA, 15 bp, Homo sapiens
gaaggcttcctgagc

SEQ ID NO: 37338 - DNA, 15 bp, Homo sapiens
tgaaggcttcctgag

SEQ ID NO: 37339 - DNA, 15 bp, Homo sapiens
gtgaaggcttcctga

SEQ ID NO: 37340 - DNA, 15 bp, Homo sapiens
ggtgaaggcttcctg

SEQ ID NO: 37341 - DNA, 15 bp, Homo sapiens
tggtgaaggcttcct

SEQ ID NO: 37342 - DNA, 15 bp, Homo sapiens
gtggtgaaggcttcc

SEQ ID NO: 37343 - DNA, 15 bp, Homo sapiens
tgtggtgaaggcttc

SEQ ID NO: 37344 - DNA, 15 bp, Homo sapiens
ctgtggtgaaggctt

SEQ ID NO: 37345 - DNA, 15 bp, Homo sapiens
gctgtggtgaaggct

SEQ ID NO: 37346 - DNA, 15 bp, Homo sapiens
agctgtggtgaaggc

SEQ ID NO: 37347 - DNA, 15 bp, Homo sapiens
cagctgtggtgaagg

SEQ ID NO: 37348 - DNA, 15 bp, Homo sapiens
gcagctgtggtgaag

SEQ ID NO: 37349 - DNA, 15 bp, Homo sapiens
ggcagctgtggtgaa

SEQ ID NO: 37350 - DNA, 15 bp, Homo sapiens
aggcagctgtggtga

SEQ ID NO: 37351 - DNA, 15 bp, Homo sapiens
caggcagctgtggtg

SEQ ID NO: 37352 - DNA, 15 bp, Homo sapiens
tcaggcagctgtggt

SEQ ID NO: 37353 - DNA, 15 bp, Homo sapiens
ctcaggcagctgtgg

SEQ ID NO: 37354 - DNA, 15 bp, Homo sapiens
gctcaggcagctgtg

SEQ ID NO: 37355 - DNA, 15 bp, Homo sapiens
agctcaggcagctgt

SEQ ID NO: 37356 - DNA, 15 bp, Homo sapiens
gagctcaggcagctg

SEQ ID NO: 37357 - DNA, 15 bp, Homo sapiens
tgagctcaggcagct

SEQ ID NO: 37358 - DNA, 15 bp, Homo sapiens
gtgagctcaggcagc

SEQ ID NO: 37359 - DNA, 15 bp, Homo sapiens
ggtgagctcaggcag

SEQ ID NO: 37360 - DNA, 15 bp, Homo sapiens
gggtgagctcaggca

SEQ ID NO: 37361 - DNA, 15 bp, Homo sapiens
agggtgagctcaggc

SEQ ID NO: 37362 - DNA, 15 bp, Homo sapiens
aagggtgagctcagg

SEQ ID NO: 37363 - DNA, 15 bp, Homo sapiens
caagggtgagctcag

SEQ ID NO: 37364 - DNA, 15 bp, Homo sapiens
gcaagggtgagctca

SEQ ID NO: 37365 - DNA, 15 bp, Homo sapiens
ggcaagggtgagctc

SEQ ID NO: 37366 - DNA, 15 bp, Homo sapiens
tggcaagggtgagct

SEQ ID NO: 37367 - DNA, 15 bp, Homo sapiens
ttggcaagggtgagc

SEQ ID NO: 37368 - DNA, 15 bp, Homo sapiens
tttggcaagggtgag

SEQ ID NO: 37369 - DNA, 15 bp, Homo sapiens
atttggcaagggtga

SEQ ID NO: 37370 - DNA, 15 bp, Homo sapiens
catttggcaagggtg

SEQ ID NO: 37371 - DNA, 15 bp, Homo sapiens
tcatttggcaagggt

SEQ ID NO: 37372 - DNA, 15 bp, Homo sapiens
ctcatttggcaaggg

SEQ ID NO: 37373 - DNA, 15 bp, Homo sapiens
cctcatttggcaagg

SEQ ID NO: 37374 - DNA, 15 bp, Homo sapiens
ccctcatttggcaag

SEQ ID NO: 37375 - DNA, 15 bp, Homo sapiens
gccctcatttggcaa

SEQ ID NO: 37376 - DNA, 15 bp, Homo sapiens
agccctcatttggca

SEQ ID NO: 37377 - DNA, 15 bp, Homo sapiens
cagccctcatttggc

SEQ ID NO: 37378 - DNA, 15 bp, Homo sapiens
ccagccctcatttgg

SEQ ID NO: 37379 - DNA, 15 bp, Homo sapiens
cccagccctcatttg

SEQ ID NO: 37380 - DNA, 15 bp, Homo sapiens
ccccagccctcattt

SEQ ID NO: 37381 - DNA, 15 bp, Homo sapiens
gccccagccctcatt

SEQ ID NO: 37382 - DNA, 15 bp, Homo sapiens
tgccccagccctcat

SEQ ID NO: 37383 - DNA, 15 bp, Homo sapiens
ctgccccagccctca

SEQ ID NO: 37384 - DNA, 15 bp, Homo sapiens
gctgccccagccctc

SEQ ID NO: 37385 - DNA, 15 bp, Homo sapiens
tgctgccccagccct

SEQ ID NO: 37386 - DNA, 15 bp, Homo sapiens
ctgctgccccagccc

SEQ ID NO: 37387 - DNA, 15 bp, Homo sapiens
gctgctgccccagcc

SEQ ID NO: 37388 - DNA, 15 bp, Homo sapiens
tgctgctgccccagc

SEQ ID NO: 37389 - DNA, 15 bp, Homo sapiens
ttgctgctgccccag

SEQ ID NO: 37390 - DNA, 15 bp, Homo sapiens
gttgctgctgcccca

SEQ ID NO: 37391 - DNA, 15 bp, Homo sapiens
cgttgctgctgcccc

SEQ ID NO: 37392 - DNA, 15 bp, Homo sapiens
gcgttgctgctgccc

SEQ ID NO: 37393 - DNA, 15 bp, Homo sapiens
tgcgttgctgctgcc

SEQ ID NO: 37394 - DNA, 15 bp, Homo sapiens
atgcgttgctgctgc

SEQ ID NO: 37395 - DNA, 15 bp, Homo sapiens
tatgcgttgctgctg

SEQ ID NO: 37396 - DNA, 15 bp, Homo sapiens
gtatgcgttgctgct

SEQ ID NO: 37397 - DNA, 15 bp, Homo sapiens
tgtatgcgttgctgc

SEQ ID NO: 37398 - DNA, 15 bp, Homo sapiens
gtgtatgcgttgctg

SEQ ID NO: 37399 - DNA, 15 bp, Homo sapiens
agtgtatgcgttgct

SEQ ID NO: 37400 - DNA, 15 bp, Homo sapiens
gagtgtatgcgttgc

SEQ ID NO: 37401 - DNA, 15 bp, Homo sapiens
tgagtgtatgcgttg

SEQ ID NO: 37402 - DNA, 15 bp, Homo sapiens
gtgagtgtatgcgtt

SEQ ID NO: 37403 - DNA, 15 bp, Homo sapiens
cgtgagtgtatgcgt

SEQ ID NO: 37404 - DNA, 15 bp, Homo sapiens
ccgtgagtgtatgcg

SEQ ID NO: 37405 - DNA, 15 bp, Homo sapiens
gccgtgagtgtatgc

SEQ ID NO: 37406 - DNA, 15 bp, Homo sapiens
agccgtgagtgtatg

SEQ ID NO: 37407 - DNA, 15 bp, Homo sapiens
cagccgtgagtgtat

SEQ ID NO: 37408 - DNA, 15 bp, Homo sapiens
acagccgtgagtgta

SEQ ID NO: 37409 - DNA, 15 bp, Homo sapiens
cacagccgtgagtgt

SEQ ID NO: 37410 - DNA, 15 bp, Homo sapiens
ccacagccgtgagtg

SEQ ID NO: 37411 - DNA, 15 bp, Homo sapiens
gccacagccgtgagt

SEQ ID NO: 37412 - DNA, 15 bp, Homo sapiens
cgccacagccgtgag

SEQ ID NO: 37413 - DNA, 15 bp, Homo sapiens
ccgccacagccgtga

SEQ ID NO: 37414 - DNA, 15 bp, Homo sapiens
cccgccacagccgtg

SEQ ID NO: 37415 - DNA, 15 bp, Homo sapiens
gcccgccacagccgt

SEQ ID NO: 37416 - DNA, 15 bp, Homo sapiens
tgcccgccacagccg

SEQ ID NO: 37417 - DNA, 15 bp, Homo sapiens
ctgcccgccacagcc

SEQ ID NO: 37418 - DNA, 15 bp, Homo sapiens
gctgcccgccacagc

SEQ ID NO: 37419 - DNA, 15 bp, Homo sapiens
cgctgcccgccacag

SEQ ID NO: 37420 - DNA, 15 bp, Homo sapiens
acgctgcccgccaca

SEQ ID NO: 37421 - DNA, 15 bp, Homo sapiens
aacgctgcccgccac

SEQ ID NO: 37422 - DNA, 15 bp, Homo sapiens
gaacgctgcccgcca

SEQ ID NO: 37423 - DNA, 15 bp, Homo sapiens
agaacgctgcccgcc

SEQ ID NO: 37424 - DNA, 15 bp, Homo sapiens
gagaacgctgcccgc

SEQ ID NO: 37425 - DNA, 15 bp, Homo sapiens
cgagaacgctgcccg

SEQ ID NO: 37426 - DNA, 15 bp, Homo sapiens
ccgagaacgctgccc

SEQ ID NO: 37427 - DNA, 15 bp, Homo sapiens
gccgagaacgctgcc

SEQ ID NO: 37428 - DNA, 15 bp, Homo sapiens
tgccgagaacgctgc

SEQ ID NO: 37429 - DNA, 15 bp, Homo sapiens
atgccgagaacgctg

SEQ ID NO: 37430 - DNA, 15 bp, Homo sapiens
tatgccgagaacgct

SEQ ID NO: 37431 - DNA, 15 bp, Homo sapiens
atatgccgagaacgc

SEQ ID NO: 37432 - DNA, 15 bp, Homo sapiens
aatatgccgagaacg

SEQ ID NO: 37433 - DNA, 15 bp, Homo sapiens
aaatatgccgagaac

SEQ ID NO: 37434 - DNA, 15 bp, Homo sapiens
gaaatatgccgagaa

SEQ ID NO: 37435 - DNA, 15 bp, Homo sapiens
tgaaatatgccgaga

SEQ ID NO: 37436 - DNA, 15 bp, Homo sapiens
ctgaaatatgccgag

SEQ ID NO: 37437 - DNA, 15 bp, Homo sapiens
cctgaaatatgccga

SEQ ID NO: 37438 - DNA, 15 bp, Homo sapiens
tcctgaaatatgccg

SEQ ID NO: 37439 - DNA, 15 bp, Homo sapiens
gtcctgaaatatgcc

SEQ ID NO: 37440 - DNA, 15 bp, Homo sapiens
tgtcctgaaatatgc

SEQ ID NO: 37441 - DNA, 15 bp, Homo sapiens
gtgtcctgaaatatg

SEQ ID NO: 37442 - DNA, 15 bp, Homo sapiens
ggtgtcctgaaatat

SEQ ID NO: 37443 - DNA, 15 bp, Homo sapiens
aggtgtcctgaaata

SEQ ID NO: 37444 - DNA, 15 bp, Homo sapiens
taggtgtcctgaaat

SEQ ID NO: 37445 - DNA, 15 bp, Homo sapiens
ttaggtgtcctgaaa

SEQ ID NO: 37446 - DNA, 15 bp, Homo sapiens
cttaggtgtcctgaa

SEQ ID NO: 37447 - DNA, 15 bp, Homo sapiens
ccttaggtgtcctga

SEQ ID NO: 37448 - DNA, 15 bp, Homo sapiens
tccttaggtgtcctg

SEQ ID NO: 37449 - DNA, 15 bp, Homo sapiens
ctccttaggtgtcct

SEQ ID NO: 37450 - DNA, 15 bp, Homo sapiens
tctccttaggtgtcc

SEQ ID NO: 37451 - DNA, 15 bp, Homo sapiens
gtctccttaggtgtc

SEQ ID NO: 37452 - DNA, 15 bp, Homo sapiens
agtctccttaggtgt

SEQ ID NO: 37453 - DNA, 15 bp, Homo sapiens
cagtctccttaggtg

SEQ ID NO: 37454 - DNA, 15 bp, Homo sapiens
tcagtctccttaggt

SEQ ID NO: 37455 - DNA, 15 bp, Homo sapiens
ttcagtctccttagg

SEQ ID NO: 37456 - DNA, 15 bp, Homo sapiens
attcagtctccttag

SEQ ID NO: 37457 - DNA, 15 bp, Homo sapiens
cattcagtctcctta

SEQ ID NO: 37458 - DNA, 15 bp, Homo sapiens
ccattcagtctcctt

SEQ ID NO: 37459 - DNA, 15 bp, Homo sapiens
gccattcagtctcct

SEQ ID NO: 37460 - DNA, 15 bp, Homo sapiens
agccattcagtctcc

SEQ ID NO: 37461 - DNA, 15 bp, Homo sapiens
gagccattcagtctc

SEQ ID NO: 37462 - DNA, 15 bp, Homo sapiens
tgagccattcagtct

SEQ ID NO: 37463 - DNA, 15 bp, Homo sapiens
ttgagccattcagtc

SEQ ID NO: 37464 - DNA, 15 bp, Homo sapiens
cttgagccattcagt

SEQ ID NO: 37465 - DNA, 15 bp, Homo sapiens
ccttgagccattcag

SEQ ID NO: 37466 - DNA, 15 bp, Homo sapiens
gccttgagccattca

SEQ ID NO: 37467 - DNA, 15 bp, Homo sapiens
agccttgagccattc

SEQ ID NO: 37468 - DNA, 15 bp, Homo sapiens
cagccttgagccatt

SEQ ID NO: 37469 - DNA, 15 bp, Homo sapiens
gcagccttgagccat

SEQ ID NO: 37470 - DNA, 15 bp, Homo sapiens
agcagccttgagcca

SEQ ID NO: 37471 - DNA, 15 bp, Homo sapiens
cagcagccttgagcc

SEQ ID NO: 37472 - DNA, 15 bp, Homo sapiens
gcagcagccttgagc

SEQ ID NO: 37473 - DNA, 15 bp, Homo sapiens
ggcagcagccttgag

SEQ ID NO: 37474 - DNA, 15 bp, Homo sapiens
cggcagcagccttga

SEQ ID NO: 37475 - DNA, 15 bp, Homo sapiens
acggcagcagccttg

SEQ ID NO: 37476 - DNA, 15 bp, Homo sapiens
cacggcagcagcctt

SEQ ID NO: 37477 - DNA, 15 bp, Homo sapiens
acacggcagcagcct

SEQ ID NO: 37478 - DNA, 15 bp, Homo sapiens
cacacggcagcagcc

SEQ ID NO: 37479 - DNA, 15 bp, Homo sapiens
gcacacggcagcagc

SEQ ID NO: 37480 - DNA, 15 bp, Homo sapiens
tgcacacggcagcag

SEQ ID NO: 37481 - DNA, 15 bp, Homo sapiens
ctgcacacggcagca

SEQ ID NO: 37482 - DNA, 15 bp, Homo sapiens
cctgcacacggcagc

SEQ ID NO: 37483 - DNA, 15 bp, Homo sapiens
ccctgcacacggcag

SEQ ID NO: 37484 - DNA, 15 bp, Homo sapiens
cccctgcacacggca

SEQ ID NO: 37485 - DNA, 15 bp, Homo sapiens
ccccctgcacacggc

SEQ ID NO: 37486 - DNA, 15 bp, Homo sapiens
gccccctgcacacgg

SEQ ID NO: 37487 - DNA, 15 bp, Homo sapiens
agccccctgcacacg

SEQ ID NO: 37488 - DNA, 15 bp, Homo sapiens
tagccccctgcacac

SEQ ID NO: 37489 - DNA, 15 bp, Homo sapiens
ctagccccctgcaca

SEQ ID NO: 37490 - DNA, 15 bp, Homo sapiens
tctagccccctgcac

SEQ ID NO: 37491 - DNA, 15 bp, Homo sapiens
gtctagccccctgca

SEQ ID NO: 37492 - DNA, 15 bp, Homo sapiens
cgtctagccccctgc

SEQ ID NO: 37493 - DNA, 15 bp, Homo sapiens
acgtctagccccctg

SEQ ID NO: 37494 - DNA, 15 bp, Homo sapiens
cacgtctagccccct

SEQ ID NO: 37495 - DNA, 15 bp, Homo sapiens
ccacgtctagccccc

SEQ ID NO: 37496 - DNA, 15 bp, Homo sapiens
cccacgtctagcccc

SEQ ID NO: 37497 - DNA, 15 bp, Homo sapiens
ccccacgtctagccc

SEQ ID NO: 37498 - DNA, 15 bp, Homo sapiens
gccccacgtctagcc

SEQ ID NO: 37499 - DNA, 15 bp, Homo sapiens
cgccccacgtctagc

SEQ ID NO: 37500 - DNA, 15 bp, Homo sapiens
ccgccccacgtctag

SEQ ID NO: 37501 - DNA, 15 bp, Homo sapiens
cccgccccacgtcta

SEQ ID NO: 37502 - DNA, 15 bp, Homo sapiens
gcccgccccacgtct

SEQ ID NO: 37503 - DNA, 15 bp, Homo sapiens
tgcccgccccacgtc

SEQ ID NO: 37504 - DNA, 15 bp, Homo sapiens
ctgcccgccccacgt

SEQ ID NO: 37505 - DNA, 15 bp, Homo sapiens
cctgcccgccccacg

SEQ ID NO: 37506 - DNA, 15 bp, Homo sapiens
gcctgcccgccccac

SEQ ID NO: 37507 - DNA, 15 bp, Homo sapiens
tgcctgcccgcccca

SEQ ID NO: 37508 - DNA, 15 bp, Homo sapiens
ctgcctgcccgcccc

SEQ ID NO: 37509 - DNA, 15 bp, Homo sapiens
cctgcctgcccgccc

SEQ ID NO: 37510 - DNA, 15 bp, Homo sapiens
ccctgcctgcccgcc

SEQ ID NO: 37511 - DNA, 15 bp, Homo sapiens
gccctgcctgcccgc

SEQ ID NO: 37512 - DNA, 15 bp, Homo sapiens
agccctgcctgcccg

SEQ ID NO: 37513 - DNA, 15 bp, Homo sapiens
gagccctgcctgccc

SEQ ID NO: 37514 - DNA, 15 bp, Homo sapiens
ggagccctgcctgcc

SEQ ID NO: 37515 - DNA, 15 bp, Homo sapiens
aggagccctgcctgc

SEQ ID NO: 37516 - DNA, 15 bp, Homo sapiens
caggagccctgcctg

SEQ ID NO: 37517 - DNA, 15 bp, Homo sapiens
ccaggagccctgcct

SEQ ID NO: 37518 - DNA, 15 bp, Homo sapiens
accaggagccctgcc

SEQ ID NO: 37519 - DNA, 15 bp, Homo sapiens
taccaggagccctgc

SEQ ID NO: 37520 - DNA, 15 bp, Homo sapiens
ttaccaggagccctg

SEQ ID NO: 37521 - DNA, 15 bp, Homo sapiens
gttaccaggagccct

SEQ ID NO: 37522 - DNA, 15 bp, Homo sapiens
tgttaccaggagccc

SEQ ID NO: 37523 - DNA, 15 bp, Homo sapiens
ctgttaccaggagcc

SEQ ID NO: 37524 - DNA, 15 bp, Homo sapiens
gctgttaccaggagc

SEQ ID NO: 37525 - DNA, 15 bp, Homo sapiens
ggctgttaccaggag

SEQ ID NO: 37526 - DNA, 15 bp, Homo sapiens
gggctgttaccagga

SEQ ID NO: 37527 - DNA, 15 bp, Homo sapiens
agggctgttaccagg

SEQ ID NO: 37528 - DNA, 15 bp, Homo sapiens
cagggctgttaccag

SEQ ID NO: 37529 - DNA, 15 bp, Homo sapiens
gcagggctgttacca

SEQ ID NO: 37530 - DNA, 15 bp, Homo sapiens
tgcagggctgttacc

SEQ ID NO: 37531 - DNA, 15 bp, Homo sapiens
ctgcagggctgttac

SEQ ID NO: 37532 - DNA, 15 bp, Homo sapiens
cctgcagggctgtta

SEQ ID NO: 37533 - DNA, 15 bp, Homo sapiens
gcctgcagggctgtt

SEQ ID NO: 37534 - DNA, 15 bp, Homo sapiens
ggcctgcagggctgt

SEQ ID NO: 37535 - DNA, 15 bp, Homo sapiens
cggcctgcagggctg

SEQ ID NO: 37536 - DNA, 15 bp, Homo sapiens
gcggcctgcagggct

SEQ ID NO: 37537 - DNA, 15 bp, Homo sapiens
tgcggcctgcagggc

SEQ ID NO: 37538 - DNA, 15 bp, Homo sapiens
ctgcggcctgcaggg

SEQ ID NO: 37539 - DNA, 15 bp, Homo sapiens
actgcggcctgcagg

SEQ ID NO: 37540 - DNA, 15 bp, Homo sapiens
cactgcggcctgcag

SEQ ID NO: 37541 - DNA, 15 bp, Homo sapiens
ccactgcggcctgca

SEQ ID NO: 37542 - DNA, 15 bp, Homo sapiens
tccactgcggcctgc

SEQ ID NO: 37543 - DNA, 15 bp, Homo sapiens
ctccactgcggcctg

SEQ ID NO: 37544 - DNA, 15 bp, Homo sapiens
tctccactgcggcct

SEQ ID NO: 37545 - DNA, 15 bp, Homo sapiens
ctctccactgcggcc

SEQ ID NO: 37546 - DNA, 15 bp, Homo sapiens
gctctccactgcggc

SEQ ID NO: 37547 - DNA, 15 bp, Homo sapiens
tgctctccactgcgg

SEQ ID NO: 37548 - DNA, 15 bp, Homo sapiens
ctgctctccactgcg

SEQ ID NO: 37549 - DNA, 15 bp, Homo sapiens
cctgctctccactgc

SEQ ID NO: 37550 - DNA, 15 bp, Homo sapiens
ccctgctctccactg

SEQ ID NO: 37551 - DNA, 15 bp, Homo sapiens
accctgctctccact

SEQ ID NO: 37552 - DNA, 15 bp, Homo sapiens
aaccctgctctccac

SEQ ID NO: 37553 - DNA, 15 bp, Homo sapiens
gaaccctgctctcca

SEQ ID NO: 37554 - DNA, 15 bp, Homo sapiens
ggaaccctgctctcc

SEQ ID NO: 37555 - DNA, 15 bp, Homo sapiens
cggaaccctgctctc

SEQ ID NO: 37556 - DNA, 15 bp, Homo sapiens
ccggaaccctgctct

SEQ ID NO: 37557 - DNA, 15 bp, Homo sapiens
gccggaaccctgctc

SEQ ID NO: 37558 - DNA, 15 bp, Homo sapiens
tgccggaaccctgct

SEQ ID NO: 37559 - DNA, 15 bp, Homo sapiens
ctgccggaaccctgc

SEQ ID NO: 37560 - DNA, 15 bp, Homo sapiens
cctgccggaaccctg

SEQ ID NO: 37561 - DNA, 15 bp, Homo sapiens
ccctgccggaaccct

SEQ ID NO: 37562 - DNA, 15 bp, Homo sapiens
gccctgccggaaccc

SEQ ID NO: 37563 - DNA, 15 bp, Homo sapiens
ggccctgccggaacc

SEQ ID NO: 37564 - DNA, 15 bp, Homo sapiens
cggccctgccggaac

SEQ ID NO: 37565 - DNA, 15 bp, Homo sapiens
gcggccctgccggaa

SEQ ID NO: 37566 - DNA, 15 bp, Homo sapiens
ggcggccctgccgga

SEQ ID NO: 37567 - DNA, 15 bp, Homo sapiens
gggcggccctgccgg

SEQ ID NO: 37568 - DNA, 15 bp, Homo sapiens
tgggcggccctgccg

SEQ ID NO: 37569 - DNA, 15 bp, Homo sapiens
ctgggcggccctgcc

SEQ ID NO: 37570 - DNA, 15 bp, Homo sapiens
cctgggcggccctgc

SEQ ID NO: 37571 - DNA, 15 bp, Homo sapiens
tcctgggcggccctg

SEQ ID NO: 37572 - DNA, 15 bp, Homo sapiens
ctcctgggcggccct

SEQ ID NO: 37573 - DNA, 15 bp, Homo sapiens
gctcctgggcggccc

SEQ ID NO: 37574 - DNA, 15 bp, Homo sapiens
agctcctgggcggcc

SEQ ID NO: 37575 - DNA, 15 bp, Homo sapiens
aagctcctgggcggc

SEQ ID NO: 37576 - DNA, 15 bp, Homo sapiens
aaagctcctgggcgg

SEQ ID NO: 37577 - DNA, 15 bp, Homo sapiens
gaaagctcctgggcg

SEQ ID NO: 37578 - DNA, 15 bp, Homo sapiens
cgaaagctcctgggc

SEQ ID NO: 37579 - DNA, 15 bp, Homo sapiens
ccgaaagctcctggg

SEQ ID NO: 37580 - DNA, 15 bp, Homo sapiens
tccgaaagctcctgg

SEQ ID NO: 37581 - DNA, 15 bp, Homo sapiens
ttccgaaagctcctg

SEQ ID NO: 37582 - DNA, 15 bp, Homo sapiens
cttccgaaagctcct

SEQ ID NO: 37583 - DNA, 15 bp, Homo sapiens
ccttccgaaagctcc

SEQ ID NO: 37584 - DNA, 15 bp, Homo sapiens
gccttccgaaagctc

SEQ ID NO: 37585 - DNA, 15 bp, Homo sapiens
ggccttccgaaagct

SEQ ID NO: 37586 - DNA, 15 bp, Homo sapiens
gggccttccgaaagc

SEQ ID NO: 37587 - DNA, 15 bp, Homo sapiens
cgggccttccgaaag

SEQ ID NO: 37588 - DNA, 15 bp, Homo sapiens
ccgggccttccgaaa

SEQ ID NO: 37589 - DNA, 15 bp, Homo sapiens
gccgggccttccgaa

SEQ ID NO: 37590 - DNA, 15 bp, Homo sapiens
ggccgggccttccga

SEQ ID NO: 37591 - DNA, 15 bp, Homo sapiens
gggccgggccttccg

SEQ ID NO: 37592 - DNA, 15 bp, Homo sapiens
ggggccgggccttcc

SEQ ID NO: 37593 - DNA, 15 bp, Homo sapiens
cggggccgggccttc

SEQ ID NO: 37594 - DNA, 15 bp, Homo sapiens
ccggggccgggcctt

SEQ ID NO: 37595 - DNA, 15 bp, Homo sapiens
gccggggccgggcct

SEQ ID NO: 37596 - DNA, 15 bp, Homo sapiens
ggccggggccgggcc

SEQ ID NO: 37597 - DNA, 15 bp, Homo sapiens
gggccggggccgggc

SEQ ID NO: 37598 - DNA, 15 bp, Homo sapiens
ggggccggggccggg

SEQ ID NO: 37599 - DNA, 15 bp, Homo sapiens
aggggccggggccgg

SEQ ID NO: 37600 - DNA, 15 bp, Homo sapiens
aaggggccggggccg

SEQ ID NO: 37601 - DNA, 15 bp, Homo sapiens
aaaggggccggggcc

SEQ ID NO: 37602 - DNA, 15 bp, Homo sapiens
gaaaggggccggggc

SEQ ID NO: 37603 - DNA, 15 bp, Homo sapiens
ggaaaggggccgggg

SEQ ID NO: 37604 - DNA, 15 bp, Homo sapiens
cggaaaggggccggg

SEQ ID NO: 37605 - DNA, 15 bp, Homo sapiens
tcggaaaggggccgg

SEQ ID NO: 37606 - DNA, 15 bp, Homo sapiens
ctcggaaaggggccg

SEQ ID NO: 37607 - DNA, 15 bp, Homo sapiens
gctcggaaaggggcc

SEQ ID NO: 37608 - DNA, 15 bp, Homo sapiens
tgctcggaaaggggc

SEQ ID NO: 37609 - DNA, 15 bp, Homo sapiens
ctgctcggaaagggg

SEQ ID NO: 37610 - DNA, 15 bp, Homo sapiens
gctgctcggaaaggg

SEQ ID NO: 37611 - DNA, 15 bp, Homo sapiens
ggctgctcggaaagg

SEQ ID NO: 37612 - DNA, 15 bp, Homo sapiens
gggctgctcggaaag

SEQ ID NO: 37613 - DNA, 15 bp, Homo sapiens
cgggctgctcggaaa

SEQ ID NO: 37614 - DNA, 15 bp, Homo sapiens
ccgggctgctcggaa

SEQ ID NO: 37615 - DNA, 15 bp, Homo sapiens
cccgggctgctcgga

SEQ ID NO: 37616 - DNA, 15 bp, Homo sapiens
gcccgggctgctcgg

SEQ ID NO: 37617 - DNA, 15 bp, Homo sapiens
ggcccgggctgctcg

SEQ ID NO: 37618 - DNA, 15 bp, Homo sapiens
aggcccgggctgctc

SEQ ID NO: 37619 - DNA, 15 bp, Homo sapiens
gaggcccgggctgct

SEQ ID NO: 37620 - DNA, 15 bp, Homo sapiens
ggaggcccgggctgc

SEQ ID NO: 37621 - DNA, 15 bp, Homo sapiens
cggaggcccgggctg

SEQ ID NO: 37622 - DNA, 15 bp, Homo sapiens
gcggaggcccgggct

SEQ ID NO: 37623 - DNA, 15 bp, Homo sapiens
ggcggaggcccgggc

SEQ ID NO: 37624 - DNA, 15 bp, Homo sapiens
gggcggaggcccggg

SEQ ID NO: 37625 - DNA, 15 bp, Homo sapiens
agggcggaggcccgg

SEQ ID NO: 37626 - DNA, 15 bp, Homo sapiens
cagggcggaggcccg

SEQ ID NO: 37627 - DNA, 15 bp, Homo sapiens
gcagggcggaggccc

SEQ ID NO: 37628 - DNA, 15 bp, Homo sapiens
ggcagggcggaggcc

SEQ ID NO: 37629 - DNA, 15 bp, Homo sapiens
gggcagggcggaggc

SEQ ID NO: 37630 - DNA, 15 bp, Homo sapiens
agggcagggcggagg

SEQ ID NO: 37631 - DNA, 15 bp, Homo sapiens
gagggcagggcggag

SEQ ID NO: 37632 - DNA, 15 bp, Homo sapiens
agagggcagggcgga

SEQ ID NO: 37633 - DNA, 15 bp, Homo sapiens
cagagggcagggcgg

SEQ ID NO: 37634 - DNA, 15 bp, Homo sapiens
acagagggcagggcg

SEQ ID NO: 37635 - DNA, 15 bp, Homo sapiens
gacagagggcagggc

SEQ ID NO: 37636 - DNA, 15 bp, Homo sapiens
ggacagagggcaggg

SEQ ID NO: 37637 - DNA, 15 bp, Homo sapiens
gggacagagggcagg

SEQ ID NO: 37638 - DNA, 15 bp, Homo sapiens
ggggacagagggcag

SEQ ID NO: 37639 - DNA, 15 bp, Homo sapiens
tggggacagagggca

SEQ ID NO: 37640 - DNA, 15 bp, Homo sapiens
ttggggacagagggc

SEQ ID NO: 37641 - DNA, 15 bp, Homo sapiens
gttggggacagaggg

SEQ ID NO: 37642 - DNA, 15 bp, Homo sapiens
cgttggggacagagg

SEQ ID NO: 37643 - DNA, 15 bp, Homo sapiens
gcgttggggacagag

SEQ ID NO: 37644 - DNA, 15 bp, Homo sapiens
ggcgttggggacaga

SEQ ID NO: 37645 - DNA, 15 bp, Homo sapiens
cggcgttggggacag

SEQ ID NO: 37646 - DNA, 15 bp, Homo sapiens
ccggcgttggggaca

SEQ ID NO: 37647 - DNA, 15 bp, Homo sapiens
cccggcgttggggac

SEQ ID NO: 37648 - DNA, 15 bp, Homo sapiens
tcccggcgttgggga

SEQ ID NO: 37649 - DNA, 15 bp, Homo sapiens
ctcccggcgttgggg

SEQ ID NO: 37650 - DNA, 15 bp, Homo sapiens
gctcccggcgttggg

SEQ ID NO: 37651 - DNA, 15 bp, Homo sapiens
ggctcccggcgttgg

SEQ ID NO: 37652 - DNA, 15 bp, Homo sapiens
cggctcccggcgttg

SEQ ID NO: 37653 - DNA, 15 bp, Homo sapiens
gcggctcccggcgtt

SEQ ID NO: 37654 - DNA, 15 bp, Homo sapiens
ggcggctcccggcgt

SEQ ID NO: 37655 - DNA, 15 bp, Homo sapiens
cggcggctcccggcg

SEQ ID NO: 37656 - DNA, 15 bp, Homo sapiens
acggcggctcccggc

SEQ ID NO: 37657 - DNA, 15 bp, Homo sapiens
aacggcggctcccgg

SEQ ID NO: 37658 - DNA, 15 bp, Homo sapiens
gaacggcggctcccg

SEQ ID NO: 37659 - DNA, 15 bp, Homo sapiens
cgaacggcggctccc

SEQ ID NO: 37660 - DNA, 15 bp, Homo sapiens
acgaacggcggctcc

SEQ ID NO: 37661 - DNA, 15 bp, Homo sapiens
gacgaacggcggctc

SEQ ID NO: 37662 - DNA, 15 bp, Homo sapiens
ggacgaacggcggct

SEQ ID NO: 37663 - DNA, 15 bp, Homo sapiens
aggacgaacggcggc

SEQ ID NO: 37664 - DNA, 15 bp, Homo sapiens
gaggacgaacggcgg

SEQ ID NO: 37665 - DNA, 15 bp, Homo sapiens
ggaggacgaacggcg

SEQ ID NO: 37666 - DNA, 15 bp, Homo sapiens
tggaggacgaacggc

SEQ ID NO: 37667 - DNA, 15 bp, Homo sapiens
ctggaggacgaacgg

SEQ ID NO: 37668 - DNA, 15 bp, Homo sapiens
tctggaggacgaacg

SEQ ID NO: 37669 - DNA, 15 bp, Homo sapiens
ctctggaggacgaac

SEQ ID NO: 37670 - DNA, 15 bp, Homo sapiens
gctctggaggacgaa

SEQ ID NO: 37671 - DNA, 15 bp, Homo sapiens
ggctctggaggacga

SEQ ID NO: 37672 - DNA, 15 bp, Homo sapiens
gggctctggaggacg

SEQ ID NO: 37673 - DNA, 15 bp, Homo sapiens
ggggctctggaggac

SEQ ID NO: 37674 - DNA, 15 bp, Homo sapiens
cggggctctggagga

SEQ ID NO: 37675 - DNA, 15 bp, Homo sapiens
gcggggctctggagg

SEQ ID NO: 37676 - DNA, 15 bp, Homo sapiens
ggcggggctctggag

SEQ ID NO: 37677 - DNA, 15 bp, Homo sapiens
gggcggggctctgga

SEQ ID NO: 37678 - DNA, 15 bp, Homo sapiens
cgggcggggctctgg

SEQ ID NO: 37679 - DNA, 15 bp, Homo sapiens
ccgggcggggctctg

SEQ ID NO: 37680 - DNA, 15 bp, Homo sapiens
cccgggcggggctct

SEQ ID NO: 37681 - DNA, 15 bp, Homo sapiens
gcccgggcggggctc

SEQ ID NO: 37682 - DNA, 15 bp, Homo sapiens
cgcccgggcggggct

SEQ ID NO: 37683 - DNA, 15 bp, Homo sapiens
tcgcccgggcggggc

SEQ ID NO: 37684 - DNA, 15 bp, Homo sapiens
ctcgcccgggcgggg

SEQ ID NO: 37685 - DNA, 15 bp, Homo sapiens
gctcgcccgggcggg

SEQ ID NO: 37686 - DNA, 15 bp, Homo sapiens
ggctcgcccgggcgg

SEQ ID NO: 37687 - DNA, 15 bp, Homo sapiens
gggctcgcccgggcg

SEQ ID NO: 37688 - DNA, 15 bp, Homo sapiens
cgggctcgcccgggc

SEQ ID NO: 37689 - DNA, 15 bp, Homo sapiens
ccgggctcgcccggg

SEQ ID NO: 37690 - DNA, 15 bp, Homo sapiens
cccgggctcgcccgg

SEQ ID NO: 37691 - DNA, 15 bp, Homo sapiens
tcccgggctcgcccg

SEQ ID NO: 37692 - DNA, 15 bp, Homo sapiens
ctcccgggctcgccc

SEQ ID NO: 37693 - DNA, 15 bp, Homo sapiens
cctcccgggctcgcc

SEQ ID NO: 37694 - DNA, 15 bp, Homo sapiens
gcctcccgggctcgc

SEQ ID NO: 37695 - DNA, 15 bp, Homo sapiens
ggcctcccgggctcg

SEQ ID NO: 37696 - DNA, 15 bp, Homo sapiens
cggcctcccgggctc

SEQ ID NO: 37697 - DNA, 15 bp, Homo sapiens
tcggcctcccgggct

SEQ ID NO: 37698 - DNA, 15 bp, Homo sapiens
atcggcctcccgggc

SEQ ID NO: 37699 - DNA, 15 bp, Homo sapiens
gatcggcctcccggg

SEQ ID NO: 37700 - DNA, 15 bp, Homo sapiens
cgatcggcctcccgg

SEQ ID NO: 37701 - DNA, 15 bp, Homo sapiens
gcgatcggcctcccg

SEQ ID NO: 37702 - DNA, 15 bp, Homo sapiens
ggcgatcggcctccc

SEQ ID NO: 37703 - DNA, 15 bp, Homo sapiens
cggcgatcggcctcc

SEQ ID NO: 37704 - DNA, 15 bp, Homo sapiens
gcggcgatcggcctc

SEQ ID NO: 37705 - DNA, 15 bp, Homo sapiens
agcggcgatcggcct

SEQ ID NO: 37706 - DNA, 15 bp, Homo sapiens
gagcggcgatcggcc

SEQ ID NO: 37707 - DNA, 15 bp, Homo sapiens
cgagcggcgatcggc

SEQ ID NO: 37708 - DNA, 15 bp, Homo sapiens
gcgagcggcgatcgg

SEQ ID NO: 37709 - DNA, 15 bp, Homo sapiens
cgcgagcggcgatcg

SEQ ID NO: 37710 - DNA, 15 bp, Homo sapiens
ccgcgagcggcgatc

SEQ ID NO: 37711 - DNA, 15 bp, Homo sapiens
tccgcgagcggcgat

SEQ ID NO: 37712 - DNA, 15 bp, Homo sapiens
ttccgcgagcggcga

SEQ ID NO: 37713 - DNA, 15 bp, Homo sapiens
gttccgcgagcggcg

SEQ ID NO: 37714 - DNA, 15 bp, Homo sapiens
ggttccgcgagcggc

SEQ ID NO: 37715 - DNA, 15 bp, Homo sapiens
gggttccgcgagcgg

SEQ ID NO: 37716 - DNA, 15 bp, Homo sapiens
cgggttccgcgagcg

SEQ ID NO: 37717 - DNA, 15 bp, Homo sapiens
gcgggttccgcgagc

SEQ ID NO: 37718 - DNA, 15 bp, Homo sapiens
ggcgggttccgcgag

SEQ ID NO: 37719 - DNA, 15 bp, Homo sapiens
cggcgggttccgcga

SEQ ID NO: 37720 - DNA, 15 bp, Homo sapiens
ccggcgggttccgcg

SEQ ID NO: 37721 - DNA, 15 bp, Homo sapiens
cccggcgggttccgc

SEQ ID NO: 37722 - DNA, 15 bp, Homo sapiens
tcccggcgggttccg

SEQ ID NO: 37723 - DNA, 15 bp, Homo sapiens
gtcccggcgggttcc

SEQ ID NO: 37724 - DNA, 15 bp, Homo sapiens
ggtcccggcgggttc

SEQ ID NO: 37725 - DNA, 15 bp, Homo sapiens
gggtcccggcgggtt

SEQ ID NO: 37726 - DNA, 15 bp, Homo sapiens
cgggtcccggcgggt

SEQ ID NO: 37727 - DNA, 15 bp, Homo sapiens
ccgggtcccggcggg

SEQ ID NO: 37728 - DNA, 15 bp, Homo sapiens
cccgggtcccggcgg

SEQ ID NO: 37729 - DNA, 15 bp, Homo sapiens
gcccgggtcccggcg

SEQ ID NO: 37730 - DNA, 15 bp, Homo sapiens
ggcccgggtcccggc

SEQ ID NO: 37731 - DNA, 15 bp, Homo sapiens
gggcccgggtcccgg

SEQ ID NO: 37732 - DNA, 15 bp, Homo sapiens
agggcccgggtcccg

SEQ ID NO: 37733 - DNA, 15 bp, Homo sapiens
gagggcccgggtccc

SEQ ID NO: 37734 - DNA, 15 bp, Homo sapiens
ggagggcccgggtcc

SEQ ID NO: 37735 - DNA, 15 bp, Homo sapiens
gggagggcccgggtc

SEQ ID NO: 37736 - DNA, 15 bp, Homo sapiens
ggggagggcccgggt

SEQ ID NO: 37737 - DNA, 15 bp, Homo sapiens
cggggagggcccggg

SEQ ID NO: 37738 - DNA, 15 bp, Homo sapiens
ccggggagggcccgg

SEQ ID NO: 37739 - DNA, 15 bp, Homo sapiens
gccggggagggcccg

SEQ ID NO: 37740 - DNA, 15 bp, Homo sapiens
cgccggggagggccc

SEQ ID NO: 37741 - DNA, 15 bp, Homo sapiens
gcgccggggagggcc

SEQ ID NO: 37742 - DNA, 15 bp, Homo sapiens
cgcgccggggagggc

SEQ ID NO: 37743 - DNA, 15 bp, Homo sapiens
ccgcgccggggaggg

SEQ ID NO: 37744 - DNA, 15 bp, Homo sapiens
cccgcgccggggagg

SEQ ID NO: 37745 - DNA, 15 bp, Homo sapiens
ccccgcgccggggag

SEQ ID NO: 37746 - DNA, 15 bp, Homo sapiens
gccccgcgccgggga

SEQ ID NO: 37747 - DNA, 15 bp, Homo sapiens
cgccccgcgccgggg

SEQ ID NO: 37748 - DNA, 15 bp, Homo sapiens
gcgccccgcgccggg

SEQ ID NO: 37749 - DNA, 15 bp, Homo sapiens
ggcgccccgcgccgg

SEQ ID NO: 37750 - DNA, 15 bp, Homo sapiens
gggcgccccgcgccg

SEQ ID NO: 37751 - DNA, 15 bp, Homo sapiens
ggggcgccccgcgcc

SEQ ID NO: 37752 - DNA, 15 bp, Homo sapiens
gggggcgccccgcgc

SEQ ID NO: 37753 - DNA, 15 bp, Homo sapiens
cgggggcgccccgcg

SEQ ID NO: 37754 - DNA, 15 bp, Homo sapiens
acgggggcgccccgc

SEQ ID NO: 37755 - DNA, 15 bp, Homo sapiens
cacgggggcgccccg

SEQ ID NO: 37756 - DNA, 15 bp, Homo sapiens
acacgggggcgcccc

SEQ ID NO: 37757 - DNA, 15 bp, Homo sapiens
cacacgggggcgccc

SEQ ID NO: 37758 - DNA, 15 bp, Homo sapiens
tcacacgggggcgcc

SEQ ID NO: 37759 - DNA, 15 bp, Homo sapiens
gtcacacgggggcgc

SEQ ID NO: 37760 - DNA, 15 bp, Homo sapiens
ggtcacacgggggcg

SEQ ID NO: 37761 - DNA, 15 bp, Homo sapiens
gggtcacacgggggc

SEQ ID NO: 37762 - DNA, 15 bp, Homo sapiens
tgggtcacacggggg

SEQ ID NO: 37763 - DNA, 15 bp, Homo sapiens
ctgggtcacacgggg

SEQ ID NO: 37764 - DNA, 15 bp, Homo sapiens
gctgggtcacacggg

SEQ ID NO: 37765 - DNA, 15 bp, Homo sapiens
cgctgggtcacacgg

SEQ ID NO: 37766 - DNA, 15 bp, Homo sapiens
gcgctgggtcacacg

SEQ ID NO: 37767 - DNA, 15 bp, Homo sapiens
cgcgctgggtcacac

SEQ ID NO: 37768 - DNA, 15 bp, Homo sapiens
gcgcgctgggtcaca

SEQ ID NO: 37769 - DNA, 15 bp, Homo sapiens
cgcgcgctgggtcac

SEQ ID NO: 37770 - DNA, 15 bp, Homo sapiens
ccgcgcgctgggtca

SEQ ID NO: 37771 - DNA, 15 bp, Homo sapiens
gccgcgcgctgggtc

SEQ ID NO: 37772 - DNA, 15 bp, Homo sapiens
ggccgcgcgctgggt

SEQ ID NO: 37773 - DNA, 15 bp, Homo sapiens
cggccgcgcgctggg

SEQ ID NO: 37774 - DNA, 15 bp, Homo sapiens
gcggccgcgcgctgg

SEQ ID NO: 37775 - DNA, 15 bp, Homo sapiens
cgcggccgcgcgctg

SEQ ID NO: 37776 - DNA, 15 bp, Homo sapiens
ccgcggccgcgcgct

SEQ ID NO: 37777 - DNA, 15 bp, Homo sapiens
gccgcggccgcgcgc

SEQ ID NO: 37778 - DNA, 15 bp, Homo sapiens
cgccgcggccgcgcg

SEQ ID NO: 37779 - DNA, 15 bp, Homo sapiens
gcgccgcggccgcgc

SEQ ID NO: 37780 - DNA, 15 bp, Homo sapiens
cgcgccgcggccgcg

SEQ ID NO: 37781 - DNA, 15 bp, Homo sapiens
gcgcgccgcggccgc

SEQ ID NO: 37782 - DNA, 15 bp, Homo sapiens
tgcgcgccgcggccg

SEQ ID NO: 37783 - DNA, 15 bp, Homo sapiens
ttgcgcgccgcggcc

SEQ ID NO: 37784 - DNA, 15 bp, Homo sapiens
cttgcgcgccgcggc

SEQ ID NO: 37785 - DNA, 15 bp, Homo sapiens
tcttgcgcgccgcgg

SEQ ID NO: 37786 - DNA, 15 bp, Homo sapiens
atcttgcgcgccgcg

SEQ ID NO: 37787 - DNA, 15 bp, Homo sapiens
catcttgcgcgccgc

SEQ ID NO: 37788 - DNA, 15 bp, Homo sapiens
ccatcttgcgcgccg

SEQ ID NO: 37789 - DNA, 15 bp, Homo sapiens
gccatcttgcgcgcc

SEQ ID NO: 37790 - DNA, 15 bp, Homo sapiens
cgccatcttgcgcgc

SEQ ID NO: 37791 - DNA, 15 bp, Homo sapiens
ccgccatcttgcgcg

SEQ ID NO: 37792 - DNA, 15 bp, Homo sapiens
gccgccatcttgcgc

SEQ ID NO: 37793 - DNA, 15 bp, Homo sapiens
cgccgccatcttgcg

SEQ ID NO: 37794 - DNA, 15 bp, Homo sapiens
ccgccgccatcttgc

SEQ ID NO: 37795 - DNA, 15 bp, Homo sapiens
cccgccgccatcttg

SEQ ID NO: 37796 - DNA, 15 bp, Homo sapiens
gcccgccgccatctt

SEQ ID NO: 37797 - DNA, 15 bp, Homo sapiens
ggcccgccgccatct

SEQ ID NO: 37798 - DNA, 15 bp, Homo sapiens
gggcccgccgccatc

SEQ ID NO: 37799 - DNA, 15 bp, Homo sapiens
cgggcccgccgccat

SEQ ID NO: 37800 - DNA, 15 bp, Homo sapiens
ccgggcccgccgcca

SEQ ID NO: 37801 - DNA, 15 bp, Homo sapiens
cccgggcccgccgcc

SEQ ID NO: 37802 - DNA, 15 bp, Homo sapiens
gcccgggcccgccgc

SEQ ID NO: 37803 - DNA, 15 bp, Homo sapiens
tgcccgggcccgccg

SEQ ID NO: 37804 - DNA, 15 bp, Homo sapiens
gtgcccgggcccgcc

SEQ ID NO: 37805 - DNA, 15 bp, Homo sapiens
ggtgcccgggcccgc

SEQ ID NO: 37806 - DNA, 15 bp, Homo sapiens
cggtgcccgggcccg

SEQ ID NO: 37807 - DNA, 15 bp, Homo sapiens
gcggtgcccgggccc

SEQ ID NO: 37808 - DNA, 15 bp, Homo sapiens
ggcggtgcccgggcc

SEQ ID NO: 37809 - DNA, 15 bp, Homo sapiens
gggcggtgcccgggc

SEQ ID NO: 37810 - DNA, 15 bp, Homo sapiens
ggggcggtgcccggg

SEQ ID NO: 37811 - DNA, 15 bp, Homo sapiens
aggggcggtgcccgg

SEQ ID NO: 37812 - DNA, 15 bp, Homo sapiens
aaggggcggtgcccg

SEQ ID NO: 37813 - DNA, 15 bp, Homo sapiens
gaaggggcggtgccc

SEQ ID NO: 37814 - DNA, 15 bp, Homo sapiens
ggaaggggcggtgcc

SEQ ID NO: 37815 - DNA, 15 bp, Homo sapiens
cggaaggggcggtgc

SEQ ID NO: 37816 - DNA, 15 bp, Homo sapiens
gcggaaggggcggtg

SEQ ID NO: 37817 - DNA, 15 bp, Homo sapiens
ggcggaaggggcggt

SEQ ID NO: 37818 - DNA, 15 bp, Homo sapiens
gggcggaaggggcgg

SEQ ID NO: 37819 - DNA, 15 bp, Homo sapiens
ggggcggaaggggcg

SEQ ID NO: 37820 - DNA, 15 bp, Homo sapiens
cggggcggaaggggc

SEQ ID NO: 37821 - DNA, 15 bp, Homo sapiens
gcggggcggaagggg

SEQ ID NO: 37822 - DNA, 15 bp, Homo sapiens
ggcggggcggaaggg

SEQ ID NO: 37823 - DNA, 15 bp, Homo sapiens
cggcggggcggaagg

SEQ ID NO: 37824 - DNA, 15 bp, Homo sapiens
ccggcggggcggaag

SEQ ID NO: 37825 - DNA, 15 bp, Homo sapiens
cccggcggggcggaa

SEQ ID NO: 37826 - DNA, 15 bp, Homo sapiens
gcccggcggggcgga

SEQ ID NO: 37827 - DNA, 15 bp, Homo sapiens
cgcccggcggggcgg

SEQ ID NO: 37828 - DNA, 15 bp, Homo sapiens
acgcccggcggggcg

SEQ ID NO: 37829 - DNA, 15 bp, Homo sapiens
gacgcccggcggggc

SEQ ID NO: 37830 - DNA, 15 bp, Homo sapiens
cgacgcccggcgggg

SEQ ID NO: 37831 - DNA, 15 bp, Homo sapiens
gcgacgcccggcggg

SEQ ID NO: 37832 - DNA, 15 bp, Homo sapiens
tgcgacgcccggcgg

SEQ ID NO: 37833 - DNA, 15 bp, Homo sapiens
gtgcgacgcccggcg

SEQ ID NO: 37834 - DNA, 15 bp, Homo sapiens
cgtgcgacgcccggc

SEQ ID NO: 37835 - DNA, 15 bp, Homo sapiens
tcgtgcgacgcccgg

SEQ ID NO: 37836 - DNA, 15 bp, Homo sapiens
ctcgtgcgacgcccg

SEQ ID NO: 37837 - DNA, 15 bp, Homo sapiens
cctcgtgcgacgccc

SEQ ID NO: 37838 - DNA, 15 bp, Homo sapiens
gcctcgtgcgacgcc

SEQ ID NO: 37839 - DNA, 15 bp, Homo sapiens
ggcctcgtgcgacgc

SEQ ID NO: 37840 - DNA, 15 bp, Homo sapiens
cggcctcgtgcgacg

SEQ ID NO: 37841 - DNA, 15 bp, Homo sapiens
ccggcctcgtgcgac

SEQ ID NO: 37842 - DNA, 15 bp, Homo sapiens
gccggcctcgtgcga

SEQ ID NO: 37843 - DNA, 15 bp, Homo sapiens
agccggcctcgtgcg

SEQ ID NO: 37844 - DNA, 15 bp, Homo sapiens
gagccggcctcgtgc

SEQ ID NO: 37845 - DNA, 15 bp, Homo sapiens
cgagccggcctcgtg

SEQ ID NO: 37846 - DNA, 15 bp, Homo sapiens
tcgagccggcctcgt

SEQ ID NO: 37847 - DNA, 15 bp, Homo sapiens
ttcgagccggcctcg

SEQ ID NO: 37848 - DNA, 15 bp, Homo sapiens
cttcgagccggcctc

SEQ ID NO: 37849 - DNA, 15 bp, Homo sapiens
ccttcgagccggcct

SEQ ID NO: 37850 - DNA, 15 bp, Homo sapiens
cccttcgagccggcc

SEQ ID NO: 37851 - DNA, 15 bp, Homo sapiens
ccccttcgagccggc

SEQ ID NO: 37852 - DNA, 15 bp, Homo sapiens
tccccttcgagccgg

SEQ ID NO: 37853 - DNA, 15 bp, Homo sapiens
ttccccttcgagccg

SEQ ID NO: 37854 - DNA, 15 bp, Homo sapiens
cttccccttcgagcc

SEQ ID NO: 37855 - DNA, 15 bp, Homo sapiens
acttccccttcgagc

SEQ ID NO: 37856 - DNA, 15 bp, Homo sapiens
cacttccccttcgag

SEQ ID NO: 37857 - DNA, 15 bp, Homo sapiens
tcacttccccttcga

SEQ ID NO: 37858 - DNA, 15 bp, Homo sapiens
ctcacttccccttcg

SEQ ID NO: 37859 - DNA, 15 bp, Homo sapiens
actcacttccccttc

SEQ ID NO: 37860 - DNA, 15 bp, Homo sapiens
gactcacttcccctt

SEQ ID NO: 37861 - DNA, 15 bp, Homo sapiens
tgactcacttcccct

SEQ ID NO: 37862 - DNA, 15 bp, Homo sapiens
ctgactcacttcccc

SEQ ID NO: 37863 - DNA, 15 bp, Homo sapiens
actgactcacttccc

SEQ ID NO: 37864 - DNA, 15 bp, Homo sapiens
cactgactcacttcc

SEQ ID NO: 37865 - DNA, 15 bp, Homo sapiens
acactgactcacttc

SEQ ID NO: 37866 - DNA, 15 bp, Homo sapiens
gacactgactcactt

SEQ ID NO: 37867 - DNA, 15 bp, Homo sapiens
ggacactgactcact

SEQ ID NO: 37868 - DNA, 15 bp, Homo sapiens
cggacactgactcac

SEQ ID NO: 37869 - DNA, 15 bp, Homo sapiens
gcggacactgactca

SEQ ID NO: 37870 - DNA, 15 bp, Homo sapiens
cgcggacactgactc

SEQ ID NO: 37871 - DNA, 15 bp, Homo sapiens
ccgcggacactgact

SEQ ID NO: 37872 - DNA, 15 bp, Homo sapiens
tccgcggacactgac

SEQ ID NO: 37873 - DNA, 15 bp, Homo sapiens
gtccgcggacactga

SEQ ID NO: 37874 - DNA, 15 bp, Homo sapiens
ggtccgcggacactg

SEQ ID NO: 37875 - DNA, 15 bp, Homo sapiens
gggtccgcggacact

SEQ ID NO: 37876 - DNA, 15 bp, Homo sapiens
cgggtccgcggacac

SEQ ID NO: 37877 - DNA, 15 bp, Homo sapiens
ccgggtccgcggaca

SEQ ID NO: 37878 - DNA, 15 bp, Homo sapiens
gccgggtccgcggac

SEQ ID NO: 37879 - DNA, 15 bp, Homo sapiens
ggccgggtccgcgga

SEQ ID NO: 37880 - DNA, 15 bp, Homo sapiens
cggccgggtccgcgg

SEQ ID NO: 37881 - DNA, 15 bp, Homo sapiens
ccggccgggtccgcg

SEQ ID NO: 37882 - DNA, 15 bp, Homo sapiens
gccggccgggtccgc

SEQ ID NO: 37883 - DNA, 15 bp, Homo sapiens
ggccggccgggtccg

SEQ ID NO: 37884 - DNA, 15 bp, Homo sapiens
gggccggccgggtcc

SEQ ID NO: 37885 - DNA, 15 bp, Homo sapiens
tgggccggccgggtc

SEQ ID NO: 37886 - DNA, 15 bp, Homo sapiens
ctgggccggccgggt

SEQ ID NO: 37887 - DNA, 15 bp, Homo sapiens
cctgggccggccggg

SEQ ID NO: 37888 - DNA, 15 bp, Homo sapiens
gcctgggccggccgg

SEQ ID NO: 37889 - DNA, 15 bp, Homo sapiens
ggcctgggccggccg

SEQ ID NO: 37890 - DNA, 15 bp, Homo sapiens
gggcctgggccggcc

SEQ ID NO: 37891 - DNA, 15 bp, Homo sapiens
cgggcctgggccggc

SEQ ID NO: 37892 - DNA, 15 bp, Homo sapiens
gcgggcctgggccgg

SEQ ID NO: 37893 - DNA, 15 bp, Homo sapiens
cgcgggcctgggccg

SEQ ID NO: 37894 - DNA, 15 bp, Homo sapiens
gcgcgggcctgggcc

SEQ ID NO: 37895 - DNA, 15 bp, Homo sapiens
ggcgcgggcctgggc

SEQ ID NO: 37896 - DNA, 15 bp, Homo sapiens
gggcgcgggcctggg

SEQ ID NO: 37897 - DNA, 15 bp, Homo sapiens
cgggcgcgggcctgg

SEQ ID NO: 37898 - DNA, 15 bp, Homo sapiens
gcgggcgcgggcctg

SEQ ID NO: 37899 - DNA, 15 bp, Homo sapiens
ggcgggcgcgggcct

SEQ ID NO: 37900 - DNA, 15 bp, Homo sapiens
cggcgggcgcgggcc

SEQ ID NO: 37901 - DNA, 15 bp, Homo sapiens
gcggcgggcgcgggc

SEQ ID NO: 37902 - DNA, 15 bp, Homo sapiens
cgcggcgggcgcggg

SEQ ID NO: 37903 - DNA, 15 bp, Homo sapiens
ccgcggcgggcgcgg

SEQ ID NO: 37904 - DNA, 15 bp, Homo sapiens
gccgcggcgggcgcg

SEQ ID NO: 37905 - DNA, 15 bp, Homo sapiens
ggccgcggcgggcgc

SEQ ID NO: 37906 - DNA, 15 bp, Homo sapiens
gggccgcggcgggcg

SEQ ID NO: 37907 - DNA, 15 bp, Homo sapiens
agggccgcggcgggc

SEQ ID NO: 37908 - DNA, 15 bp, Homo sapiens
cagggccgcggcggg

SEQ ID NO: 37909 - DNA, 15 bp, Homo sapiens
tcagggccgcggcgg

SEQ ID NO: 37910 - DNA, 15 bp, Homo sapiens
ctcagggccgcggcg

SEQ ID NO: 37911 - DNA, 15 bp, Homo sapiens
tctcagggccgcggc

SEQ ID NO: 37912 - DNA, 15 bp, Homo sapiens
ctctcagggccgcgg

SEQ ID NO: 37913 - DNA, 15 bp, Homo sapiens
cctctcagggccgcg

SEQ ID NO: 37914 - DNA, 15 bp, Homo sapiens
gcctctcagggccgc

SEQ ID NO: 37915 - DNA, 15 bp, Homo sapiens
ggcctctcagggccg

SEQ ID NO: 37916 - DNA, 15 bp, Homo sapiens
gggcctctcagggcc

SEQ ID NO: 37917 - DNA, 15 bp, Homo sapiens
ggggcctctcagggc

SEQ ID NO: 37918 - DNA, 15 bp, Homo sapiens
cggggcctctcaggg

SEQ ID NO: 37919 - DNA, 15 bp, Homo sapiens
ccggggcctctcagg

SEQ ID NO: 37920 - DNA, 15 bp, Homo sapiens
gccggggcctctcag

SEQ ID NO: 37921 - DNA, 15 bp, Homo sapiens
tgccggggcctctca

SEQ ID NO: 37922 - DNA, 15 bp, Homo sapiens
ctgccggggcctctc

SEQ ID NO: 37923 - DNA, 15 bp, Homo sapiens
cctgccggggcctct

SEQ ID NO: 37924 - DNA, 15 bp, Homo sapiens
acctgccggggcctc

SEQ ID NO: 37925 - DNA, 15 bp, Homo sapiens
gacctgccggggcct

SEQ ID NO: 37926 - DNA, 15 bp, Homo sapiens
ggacctgccggggcc

SEQ ID NO: 37927 - DNA, 15 bp, Homo sapiens
gggacctgccggggc

SEQ ID NO: 37928 - DNA, 15 bp, Homo sapiens
cgggacctgccgggg

SEQ ID NO: 37929 - DNA, 15 bp, Homo sapiens
ccgggacctgccggg

SEQ ID NO: 37930 - DNA, 15 bp, Homo sapiens
gccgggacctgccgg

SEQ ID NO: 37931 - DNA, 15 bp, Homo sapiens
ggccgggacctgccg

SEQ ID NO: 37932 - DNA, 15 bp, Homo sapiens
gggccgggacctgcc

SEQ ID NO: 37933 - DNA, 15 bp, Homo sapiens
cgggccgggacctgc

SEQ ID NO: 37934 - DNA, 15 bp, Homo sapiens
ccgggccgggacctg

SEQ ID NO: 37935 - DNA, 15 bp, Homo sapiens
gccgggccgggacct

SEQ ID NO: 37936 - DNA, 15 bp, Homo sapiens
cgccgggccgggacc

SEQ ID NO: 37937 - DNA, 15 bp, Homo sapiens
ccgccgggccgggac

SEQ ID NO: 37938 - DNA, 15 bp, Homo sapiens
gccgccgggccggga

SEQ ID NO: 37939 - DNA, 15 bp, Homo sapiens
cgccgccgggccggg

SEQ ID NO: 37940 - DNA, 15 bp, Homo sapiens
ccgccgccgggccgg

SEQ ID NO: 37941 - DNA, 15 bp, Homo sapiens
gccgccgccgggccg

SEQ ID NO: 37942 - DNA, 15 bp, Homo sapiens
tgccgccgccgggcc

SEQ ID NO: 37943 - DNA, 15 bp, Homo sapiens
ctgccgccgccgggc

SEQ ID NO: 37944 - DNA, 15 bp, Homo sapiens
gctgccgccgccggg

SEQ ID NO: 37945 - DNA, 15 bp, Homo sapiens
ggctgccgccgccgg

SEQ ID NO: 37946 - DNA, 15 bp, Homo sapiens
tggctgccgccgccg

SEQ ID NO: 37947 - DNA, 15 bp, Homo sapiens
atggctgccgccgcc

SEQ ID NO: 37948 - DNA, 15 bp, Homo sapiens
catggctgccgccgc

SEQ ID NO: 37949 - DNA, 15 bp, Homo sapiens
ccatggctgccgccg

SEQ ID NO: 37950 - DNA, 15 bp, Homo sapiens
gccatggctgccgcc

SEQ ID NO: 37951 - DNA, 15 bp, Homo sapiens
ggccatggctgccgc

SEQ ID NO: 37952 - DNA, 15 bp, Homo sapiens
cggccatggctgccg

SEQ ID NO: 37953 - DNA, 15 bp, Homo sapiens
ccggccatggctgcc

SEQ ID NO: 37954 - DNA, 15 bp, Homo sapiens
cccggccatggctgc

SEQ ID NO: 37955 - DNA, 15 bp, Homo sapiens
ccccggccatggctg

SEQ ID NO: 37956 - DNA, 15 bp, Homo sapiens
cccccggccatggct

SEQ ID NO: 37957 - DNA, 15 bp, Homo sapiens
ccccccggccatggc

SEQ ID NO: 37958 - DNA, 15 bp, Homo sapiens
gccccccggccatgg

SEQ ID NO: 37959 - DNA, 15 bp, Homo sapiens
ggccccccggccatg

SEQ ID NO: 37960 - DNA, 15 bp, Homo sapiens
cggccccccggccat

SEQ ID NO: 37961 - DNA, 15 bp, Homo sapiens
ccggccccccggcca

SEQ ID NO: 37962 - DNA, 15 bp, Homo sapiens
cccggccccccggcc

SEQ ID NO: 37963 - DNA, 15 bp, Homo sapiens
gcccggccccccggc

SEQ ID NO: 37964 - DNA, 15 bp, Homo sapiens
ggcccggccccccgg

SEQ ID NO: 37965 - DNA, 15 bp, Homo sapiens
gggcccggccccccg

SEQ ID NO: 37966 - DNA, 15 bp, Homo sapiens
cgggcccggcccccc

SEQ ID NO: 37967 - DNA, 15 bp, Homo sapiens
ccgggcccggccccc

SEQ ID NO: 37968 - DNA, 15 bp, Homo sapiens
cccgggcccggcccc

SEQ ID NO: 37969 - DNA, 15 bp, Homo sapiens
ccccgggcccggccc

SEQ ID NO: 37970 - DNA, 15 bp, Homo sapiens
cccccgggcccggcc

SEQ ID NO: 37971 - DNA, 15 bp, Homo sapiens
tcccccgggcccggc

SEQ ID NO: 37972 - DNA, 15 bp, Homo sapiens
ctcccccgggcccgg

SEQ ID NO: 37973 - DNA, 15 bp, Homo sapiens
gctcccccgggcccg

SEQ ID NO: 37974 - DNA, 15 bp, Homo sapiens
ggctcccccgggccc

SEQ ID NO: 37975 - DNA, 15 bp, Homo sapiens
gggctcccccgggcc

SEQ ID NO: 37976 - DNA, 15 bp, Homo sapiens
cgggctcccccgggc

SEQ ID NO: 37977 - DNA, 15 bp, Homo sapiens
gcgggctcccccggg

SEQ ID NO: 37978 - DNA, 15 bp, Homo sapiens
tgcgggctcccccgg

SEQ ID NO: 37979 - DNA, 15 bp, Homo sapiens
ctgcgggctcccccg

SEQ ID NO: 37980 - DNA, 15 bp, Homo sapiens
gctgcgggctccccc

SEQ ID NO: 37981 - DNA, 15 bp, Homo sapiens
ggctgcgggctcccc

SEQ ID NO: 37982 - DNA, 15 bp, Homo sapiens
gggctgcgggctccc

SEQ ID NO: 37983 - DNA, 15 bp, Homo sapiens
ggggctgcgggctcc

SEQ ID NO: 37984 - DNA, 15 bp, Homo sapiens
gggggctgcgggctc

SEQ ID NO: 37985 - DNA, 15 bp, Homo sapiens
cgggggctgcgggct

SEQ ID NO: 37986 - DNA, 15 bp, Homo sapiens
ccgggggctgcgggc

SEQ ID NO: 37987 - DNA, 15 bp, Homo sapiens
gccgggggctgcggg

SEQ ID NO: 37988 - DNA, 15 bp, Homo sapiens
cgccgggggctgcgg

SEQ ID NO: 37989 - DNA, 15 bp, Homo sapiens
gcgccgggggctgcg

SEQ ID NO: 37990 - DNA, 15 bp, Homo sapiens
ggcgccgggggctgc

SEQ ID NO: 37991 - DNA, 15 bp, Homo sapiens
gggcgccgggggctg

SEQ ID NO: 37992 - DNA, 15 bp, Homo sapiens
tgggcgccgggggct

SEQ ID NO: 37993 - DNA, 15 bp, Homo sapiens
ctgggcgccgggggc

SEQ ID NO: 37994 - DNA, 15 bp, Homo sapiens
gctgggcgccggggg

SEQ ID NO: 37995 - DNA, 15 bp, Homo sapiens
tgctgggcgccgggg

SEQ ID NO: 37996 - DNA, 15 bp, Homo sapiens
gtgctgggcgccggg

SEQ ID NO: 37997 - DNA, 15 bp, Homo sapiens
agtgctgggcgccgg

SEQ ID NO: 37998 - DNA, 15 bp, Homo sapiens
aagtgctgggcgccg

SEQ ID NO: 37999 - DNA, 15 bp, Homo sapiens
gaagtgctgggcgcc

SEQ ID NO: 38000 - DNA, 15 bp, Homo sapiens
agaagtgctgggcgc

SEQ ID NO: 38001 - DNA, 15 bp, Homo sapiens
aagaagtgctgggcg

SEQ ID NO: 38002 - DNA, 15 bp, Homo sapiens
caagaagtgctgggc

SEQ ID NO: 38003 - DNA, 15 bp, Homo sapiens
acaagaagtgctggg

SEQ ID NO: 38004 - DNA, 15 bp, Homo sapiens
tacaagaagtgctgg

SEQ ID NO: 38005 - DNA, 15 bp, Homo sapiens
gtacaagaagtgctg

SEQ ID NO: 38006 - DNA, 15 bp, Homo sapiens
cgtacaagaagtgct

SEQ ID NO: 38007 - DNA, 15 bp, Homo sapiens
tcgtacaagaagtgc

SEQ ID NO: 38008 - DNA, 15 bp, Homo sapiens
ctcgtacaagaagtg

SEQ ID NO: 38009 - DNA, 15 bp, Homo sapiens
cctcgtacaagaagt

SEQ ID NO: 38010 - DNA, 15 bp, Homo sapiens
acctcgtacaagaag

SEQ ID NO: 38011 - DNA, 15 bp, Homo sapiens
cacctcgtacaagaa

SEQ ID NO: 38012 - DNA, 15 bp, Homo sapiens
gcacctcgtacaaga

SEQ ID NO: 38013 - DNA, 15 bp, Homo sapiens
ggcacctcgtacaag

SEQ ID NO: 38014 - DNA, 15 bp, Homo sapiens
cggcacctcgtacaa

SEQ ID NO: 38015 - DNA, 15 bp, Homo sapiens
gcggcacctcgtaca

SEQ ID NO: 38016 - DNA, 15 bp, Homo sapiens
ggcggcacctcgtac

SEQ ID NO: 38017 - DNA, 15 bp, Homo sapiens
gggcggcacctcgta

SEQ ID NO: 38018 - DNA, 15 bp, Homo sapiens
agggcggcacctcgt

SEQ ID NO: 38019 - DNA, 15 bp, Homo sapiens
cagggcggcacctcg

SEQ ID NO: 38020 - DNA, 15 bp, Homo sapiens
ccagggcggcacctc

SEQ ID NO: 38021 - DNA, 15 bp, Homo sapiens
cccagggcggcacct

SEQ ID NO: 38022 - DNA, 15 bp, Homo sapiens
acccagggcggcacc

SEQ ID NO: 38023 - DNA, 15 bp, Homo sapiens
gacccagggcggcac

SEQ ID NO: 38024 - DNA, 15 bp, Homo sapiens
tgacccagggcggca

SEQ ID NO: 38025 - DNA, 15 bp, Homo sapiens
atgacccagggcggc

SEQ ID NO: 38026 - DNA, 15 bp, Homo sapiens
catgacccagggcgg

SEQ ID NO: 38027 - DNA, 15 bp, Homo sapiens
acatgacccagggcg

SEQ ID NO: 38028 - DNA, 15 bp, Homo sapiens
cacatgacccagggc

SEQ ID NO: 38029 - DNA, 15 bp, Homo sapiens
gcacatgacccaggg

SEQ ID NO: 38030 - DNA, 15 bp, Homo sapiens
ggcacatgacccagg

SEQ ID NO: 38031 - DNA, 15 bp, Homo sapiens
cggcacatgacccag

SEQ ID NO: 38032 - DNA, 15 bp, Homo sapiens
gcggcacatgaccca

SEQ ID NO: 38033 - DNA, 15 bp, Homo sapiens
agcggcacatgaccc

SEQ ID NO: 38034 - DNA, 15 bp, Homo sapiens
aagcggcacatgacc

SEQ ID NO: 38035 - DNA, 15 bp, Homo sapiens
gaagcggcacatgac

SEQ ID NO: 38036 - DNA, 15 bp, Homo sapiens
agaagcggcacatga

SEQ ID NO: 38037 - DNA, 15 bp, Homo sapiens
tagaagcggcacatg

SEQ ID NO: 38038 - DNA, 15 bp, Homo sapiens
gtagaagcggcacat

SEQ ID NO: 38039 - DNA, 15 bp, Homo sapiens
tgtagaagcggcaca

SEQ ID NO: 38040 - DNA, 15 bp, Homo sapiens
ttgtagaagcggcac

SEQ ID NO: 38041 - DNA, 15 bp, Homo sapiens
tttgtagaagcggca

SEQ ID NO: 38042 - DNA, 15 bp, Homo sapiens
ctttgtagaagcggc

SEQ ID NO: 38043 - DNA, 15 bp, Homo sapiens
actttgtagaagcgg

SEQ ID NO: 38044 - DNA, 15 bp, Homo sapiens
cactttgtagaagcg

SEQ ID NO: 38045 - DNA, 15 bp, Homo sapiens
tcactttgtagaagc

SEQ ID NO: 38046 - DNA, 15 bp, Homo sapiens
atcactttgtagaag

SEQ ID NO: 38047 - DNA, 15 bp, Homo sapiens
catcactttgtagaa

SEQ ID NO: 38048 - DNA, 15 bp, Homo sapiens
ccatcactttgtaga

SEQ ID NO: 38049 - DNA, 15 bp, Homo sapiens
tccatcactttgtag

SEQ ID NO: 38050 - DNA, 15 bp, Homo sapiens
gtccatcactttgta

SEQ ID NO: 38051 - DNA, 15 bp, Homo sapiens
cgtccatcactttgt

SEQ ID NO: 38052 - DNA, 15 bp, Homo sapiens
gcgtccatcactttg

SEQ ID NO: 38053 - DNA, 15 bp, Homo sapiens
ggcgtccatcacttt

SEQ ID NO: 38054 - DNA, 15 bp, Homo sapiens
gggcgtccatcactt

SEQ ID NO: 38055 - DNA, 15 bp, Homo sapiens
agggcgtccatcact

SEQ ID NO: 38056 - DNA, 15 bp, Homo sapiens
cagggcgtccatcac

SEQ ID NO: 38057 - DNA, 15 bp, Homo sapiens
ccagggcgtccatca

SEQ ID NO: 38058 - DNA, 15 bp, Homo sapiens
tccagggcgtccatc

SEQ ID NO: 38059 - DNA, 15 bp, Homo sapiens
ctccagggcgtccat

SEQ ID NO: 38060 - DNA, 15 bp, Homo sapiens
gctccagggcgtcca

SEQ ID NO: 38061 - DNA, 15 bp, Homo sapiens
ggctccagggcgtcc

SEQ ID NO: 38062 - DNA, 15 bp, Homo sapiens
gggctccagggcgtc

SEQ ID NO: 38063 - DNA, 15 bp, Homo sapiens
cgggctccagggcgt

SEQ ID NO: 38064 - DNA, 15 bp, Homo sapiens
gcgggctccagggcg

SEQ ID NO: 38065 - DNA, 15 bp, Homo sapiens
ggcgggctccagggc

SEQ ID NO: 38066 - DNA, 15 bp, Homo sapiens
cggcgggctccaggg

SEQ ID NO: 38067 - DNA, 15 bp, Homo sapiens
tcggcgggctccagg

SEQ ID NO: 38068 - DNA, 15 bp, Homo sapiens
gtcggcgggctccag

SEQ ID NO: 38069 - DNA, 15 bp, Homo sapiens
agtcggcgggctcca

SEQ ID NO: 38070 - DNA, 15 bp, Homo sapiens
cagtcggcgggctcc

SEQ ID NO: 38071 - DNA, 15 bp, Homo sapiens
ccagtcggcgggctc

SEQ ID NO: 38072 - DNA, 15 bp, Homo sapiens
accagtcggcgggct

SEQ ID NO: 38073 - DNA, 15 bp, Homo sapiens
caccagtcggcgggc

SEQ ID NO: 38074 - DNA, 15 bp, Homo sapiens
gcaccagtcggcggg

SEQ ID NO: 38075 - DNA, 15 bp, Homo sapiens
ggcaccagtcggcgg

SEQ ID NO: 38076 - DNA, 15 bp, Homo sapiens
tggcaccagtcggcg

SEQ ID NO: 38077 - DNA, 15 bp, Homo sapiens
ctggcaccagtcggc

SEQ ID NO: 38078 - DNA, 15 bp, Homo sapiens
actggcaccagtcgg

SEQ ID NO: 38079 - DNA, 15 bp, Homo sapiens
aactggcaccagtcg

SEQ ID NO: 38080 - DNA, 15 bp, Homo sapiens
gaactggcaccagtc

SEQ ID NO: 38081 - DNA, 15 bp, Homo sapiens
cgaactggcaccagt

SEQ ID NO: 38082 - DNA, 15 bp, Homo sapiens
ccgaactggcaccag

SEQ ID NO: 38083 - DNA, 15 bp, Homo sapiens
accgaactggcacca

SEQ ID NO: 38084 - DNA, 15 bp, Homo sapiens
caccgaactggcacc

SEQ ID NO: 38085 - DNA, 15 bp, Homo sapiens
ccaccgaactggcac

SEQ ID NO: 38086 - DNA, 15 bp, Homo sapiens
cccaccgaactggca

SEQ ID NO: 38087 - DNA, 15 bp, Homo sapiens
acccaccgaactggc

SEQ ID NO: 38088 - DNA, 15 bp, Homo sapiens
cacccaccgaactgg

SEQ ID NO: 38089 - DNA, 15 bp, Homo sapiens
ccacccaccgaactg

SEQ ID NO: 38090 - DNA, 15 bp, Homo sapiens
gccacccaccgaact

SEQ ID NO: 38091 - DNA, 15 bp, Homo sapiens
cgccacccaccgaac

SEQ ID NO: 38092 - DNA, 15 bp, Homo sapiens
ccgccacccaccgaa

SEQ ID NO: 38093 - DNA, 15 bp, Homo sapiens
gccgccacccaccga

SEQ ID NO: 38094 - DNA, 15 bp, Homo sapiens
cgccgccacccaccg

SEQ ID NO: 38095 - DNA, 15 bp, Homo sapiens
ccgccgccacccacc

SEQ ID NO: 38096 - DNA, 15 bp, Homo sapiens
cccgccgccacccac

SEQ ID NO: 38097 - DNA, 15 bp, Homo sapiens
gcccgccgccaccca

SEQ ID NO: 38098 - DNA, 15 bp, Homo sapiens
agcccgccgccaccc

SEQ ID NO: 38099 - DNA, 15 bp, Homo sapiens
cagcccgccgccacc

SEQ ID NO: 38100 - DNA, 15 bp, Homo sapiens
gcagcccgccgccac

SEQ ID NO: 38101 - DNA, 15 bp, Homo sapiens
ggcagcccgccgcca

SEQ ID NO: 38102 - DNA, 15 bp, Homo sapiens
cggcagcccgccgcc

SEQ ID NO: 38103 - DNA, 15 bp, Homo sapiens
ccggcagcccgccgc

SEQ ID NO: 38104 - DNA, 15 bp, Homo sapiens
cccggcagcccgccg

SEQ ID NO: 38105 - DNA, 15 bp, Homo sapiens
ccccggcagcccgcc

SEQ ID NO: 38106 - DNA, 15 bp, Homo sapiens
cccccggcagcccgc

SEQ ID NO: 38107 - DNA, 15 bp, Homo sapiens
ccccccggcagcccg

SEQ ID NO: 38108 - DNA, 15 bp, Homo sapiens
gccccccggcagccc

SEQ ID NO: 38109 - DNA, 15 bp, Homo sapiens
cgccccccggcagcc

SEQ ID NO: 38110 - DNA, 15 bp, Homo sapiens
ccgccccccggcagc

SEQ ID NO: 38111 - DNA, 15 bp, Homo sapiens
cccgccccccggcag

SEQ ID NO: 38112 - DNA, 15 bp, Homo sapiens
tcccgccccccggca

SEQ ID NO: 38113 - DNA, 15 bp, Homo sapiens
ctcccgccccccggc

SEQ ID NO: 38114 - DNA, 15 bp, Homo sapiens
cctcccgccccccgg

SEQ ID NO: 38115 - DNA, 15 bp, Homo sapiens
gcctcccgccccccg

SEQ ID NO: 38116 - DNA, 15 bp, Homo sapiens
cgcctcccgcccccc

SEQ ID NO: 38117 - DNA, 15 bp, Homo sapiens
gcgcctcccgccccc

SEQ ID NO: 38118 - DNA, 15 bp, Homo sapiens
cgcgcctcccgcccc

SEQ ID NO: 38119 - DNA, 15 bp, Homo sapiens
gcgcgcctcccgccc

SEQ ID NO: 38120 - DNA, 15 bp, Homo sapiens
cgcgcgcctcccgcc

SEQ ID NO: 38121 - DNA, 15 bp, Homo sapiens
ccgcgcgcctcccgc

SEQ ID NO: 38122 - DNA, 15 bp, Homo sapiens
cccgcgcgcctcccg

SEQ ID NO: 38123 - DNA, 15 bp, Homo sapiens
gcccgcgcgcctccc

SEQ ID NO: 38124 - DNA, 15 bp, Homo sapiens
agcccgcgcgcctcc

SEQ ID NO: 38125 - DNA, 15 bp, Homo sapiens
gagcccgcgcgcctc

SEQ ID NO: 38126 - DNA, 15 bp, Homo sapiens
ggagcccgcgcgcct

SEQ ID NO: 38127 - DNA, 15 bp, Homo sapiens
aggagcccgcgcgcc

SEQ ID NO: 38128 - DNA, 15 bp, Homo sapiens
caggagcccgcgcgc

SEQ ID NO: 38129 - DNA, 15 bp, Homo sapiens
ccaggagcccgcgcg

SEQ ID NO: 38130 - DNA, 15 bp, Homo sapiens
gccaggagcccgcgc

SEQ ID NO: 38131 - DNA, 15 bp, Homo sapiens
cgccaggagcccgcg

SEQ ID NO: 38132 - DNA, 15 bp, Homo sapiens
gcgccaggagcccgc

SEQ ID NO: 38133 - DNA, 15 bp, Homo sapiens
ggcgccaggagcccg

SEQ ID NO: 38134 - DNA, 15 bp, Homo sapiens
cggcgccaggagccc

SEQ ID NO: 38135 - DNA, 15 bp, Homo sapiens
tcggcgccaggagcc

SEQ ID NO: 38136 - DNA, 15 bp, Homo sapiens
gtcggcgccaggagc

SEQ ID NO: 38137 - DNA, 15 bp, Homo sapiens
cgtcggcgccaggag

SEQ ID NO: 38138 - DNA, 15 bp, Homo sapiens
gcgtcggcgccagga

SEQ ID NO: 38139 - DNA, 15 bp, Homo sapiens
ggcgtcggcgccagg

SEQ ID NO: 38140 - DNA, 15 bp, Homo sapiens
aggcgtcggcgccag

SEQ ID NO: 38141 - DNA, 15 bp, Homo sapiens
caggcgtcggcgcca

SEQ ID NO: 38142 - DNA, 15 bp, Homo sapiens
tcaggcgtcggcgcc

SEQ ID NO: 38143 - DNA, 15 bp, Homo sapiens
gtcaggcgtcggcgc

SEQ ID NO: 38144 - DNA, 15 bp, Homo sapiens
cgtcaggcgtcggcg

SEQ ID NO: 38145 - DNA, 15 bp, Homo sapiens
gcgtcaggcgtcggc

SEQ ID NO: 38146 - DNA, 15 bp, Homo sapiens
ggcgtcaggcgtcgg

SEQ ID NO: 38147 - DNA, 15 bp, Homo sapiens
gggcgtcaggcgtcg

SEQ ID NO: 38148 - DNA, 15 bp, Homo sapiens
ggggcgtcaggcgtc

SEQ ID NO: 38149 - DNA, 15 bp, Homo sapiens
gggggcgtcaggcgt

SEQ ID NO: 38150 - DNA, 15 bp, Homo sapiens
ggggggcgtcaggcg

SEQ ID NO: 38151 - DNA, 15 bp, Homo sapiens
cggggggcgtcaggc

SEQ ID NO: 38152 - DNA, 15 bp, Homo sapiens
gcggggggcgtcagg

SEQ ID NO: 38153 - DNA, 15 bp, Homo sapiens
ggcggggggcgtcag

SEQ ID NO: 38154 - DNA, 15 bp, Homo sapiens
gggcggggggcgtca

SEQ ID NO: 38155 - DNA, 15 bp, Homo sapiens
ggggcggggggcgtc

SEQ ID NO: 38156 - DNA, 15 bp, Homo sapiens
cggggcggggggcgt

SEQ ID NO: 38157 - DNA, 15 bp, Homo sapiens
gcggggcggggggcg

SEQ ID NO: 38158 - DNA, 15 bp, Homo sapiens
tgcggggcggggggc

SEQ ID NO: 38159 - DNA, 15 bp, Homo sapiens
ctgcggggcgggggg

SEQ ID NO: 38160 - DNA, 15 bp, Homo sapiens
gctgcggggcggggg

SEQ ID NO: 38161 - DNA, 15 bp, Homo sapiens
ggctgcggggcgggg

SEQ ID NO: 38162 - DNA, 15 bp, Homo sapiens
cggctgcggggcggg

SEQ ID NO: 38163 - DNA, 15 bp, Homo sapiens
gcggctgcggggcgg

SEQ ID NO: 38164 - DNA, 15 bp, Homo sapiens
ggcggctgcggggcg

SEQ ID NO: 38165 - DNA, 15 bp, Homo sapiens
gggcggctgcggggc

SEQ ID NO: 38166 - DNA, 15 bp, Homo sapiens
agggcggctgcgggg

SEQ ID NO: 38167 - DNA, 15 bp, Homo sapiens
cagggcggctgcggg

SEQ ID NO: 38168 - DNA, 15 bp, Homo sapiens
tcagggcggctgcgg

SEQ ID NO: 38169 - DNA, 15 bp, Homo sapiens
atcagggcggctgcg

SEQ ID NO: 38170 - DNA, 15 bp, Homo sapiens
gatcagggcggctgc

SEQ ID NO: 38171 - DNA, 15 bp, Homo sapiens
cgatcagggcggctg

SEQ ID NO: 38172 - DNA, 15 bp, Homo sapiens
acgatcagggcggct

SEQ ID NO: 38173 - DNA, 15 bp, Homo sapiens
cacgatcagggcggc

SEQ ID NO: 38174 - DNA, 15 bp, Homo sapiens
gcacgatcagggcgg

SEQ ID NO: 38175 - DNA, 15 bp, Homo sapiens
cgcacgatcagggcg

SEQ ID NO: 38176 - DNA, 15 bp, Homo sapiens
gcgcacgatcagggc

SEQ ID NO: 38177 - DNA, 15 bp, Homo sapiens
cgcgcacgatcaggg

SEQ ID NO: 38178 - DNA, 15 bp, Homo sapiens
tcgcgcacgatcagg

SEQ ID NO: 38179 - DNA, 15 bp, Homo sapiens
gtcgcgcacgatcag

SEQ ID NO: 38180 - DNA, 15 bp, Homo sapiens
ggtcgcgcacgatca

SEQ ID NO: 38181 - DNA, 15 bp, Homo sapiens
tggtcgcgcacgatc

SEQ ID NO: 38182 - DNA, 15 bp, Homo sapiens
ctggtcgcgcacgat

SEQ ID NO: 38183 - DNA, 15 bp, Homo sapiens
tctggtcgcgcacga

SEQ ID NO: 38184 - DNA, 15 bp, Homo sapiens
gtctggtcgcgcacg

SEQ ID NO: 38185 - DNA, 15 bp, Homo sapiens
ggtctggtcgcgcac

SEQ ID NO: 38186 - DNA, 15 bp, Homo sapiens
cggtctggtcgcgca

SEQ ID NO: 38187 - DNA, 15 bp, Homo sapiens
tcggtctggtcgcgc

SEQ ID NO: 38188 - DNA, 15 bp, Homo sapiens
ctcggtctggtcgcg

SEQ ID NO: 38189 - DNA, 15 bp, Homo sapiens
gctcggtctggtcgc

SEQ ID NO: 38190 - DNA, 15 bp, Homo sapiens
agctcggtctggtcg

SEQ ID NO: 38191 - DNA, 15 bp, Homo sapiens
cagctcggtctggtc

SEQ ID NO: 38192 - DNA, 15 bp, Homo sapiens
gcagctcggtctggt

SEQ ID NO: 38193 - DNA, 15 bp, Homo sapiens
cgcagctcggtctgg

SEQ ID NO: 38194 - DNA, 15 bp, Homo sapiens
ccgcagctcggtctg

SEQ ID NO: 38195 - DNA, 15 bp, Homo sapiens
gccgcagctcggtct

SEQ ID NO: 38196 - DNA, 15 bp, Homo sapiens
agccgcagctcggtc

SEQ ID NO: 38197 - DNA, 15 bp, Homo sapiens
cagccgcagctcggt

SEQ ID NO: 38198 - DNA, 15 bp, Homo sapiens
acagccgcagctcgg

SEQ ID NO: 38199 - DNA, 15 bp, Homo sapiens
cacagccgcagctcg

SEQ ID NO: 38200 - DNA, 15 bp, Homo sapiens
gcacagccgcagctc

SEQ ID NO: 38201 - DNA, 15 bp, Homo sapiens
cgcacagccgcagct

SEQ ID NO: 38202 - DNA, 15 bp, Homo sapiens
tcgcacagccgcagc

SEQ ID NO: 38203 - DNA, 15 bp, Homo sapiens
ctcgcacagccgcag

SEQ ID NO: 38204 - DNA, 15 bp, Homo sapiens
gctcgcacagccgca

SEQ ID NO: 38205 - DNA, 15 bp, Homo sapiens
cgctcgcacagccgc

SEQ ID NO: 38206 - DNA, 15 bp, Homo sapiens
gcgctcgcacagccg

SEQ ID NO: 38207 - DNA, 15 bp, Homo sapiens
agcgctcgcacagcc

SEQ ID NO: 38208 - DNA, 15 bp, Homo sapiens
gagcgctcgcacagc

SEQ ID NO: 38209 - DNA, 15 bp, Homo sapiens
ggagcgctcgcacag

SEQ ID NO: 38210 - DNA, 15 bp, Homo sapiens
cggagcgctcgcaca

SEQ ID NO: 38211 - DNA, 15 bp, Homo sapiens
ccggagcgctcgcac

SEQ ID NO: 38212 - DNA, 15 bp, Homo sapiens
cccggagcgctcgca

SEQ ID NO: 38213 - DNA, 15 bp, Homo sapiens
gcccggagcgctcgc

SEQ ID NO: 38214 - DNA, 15 bp, Homo sapiens
tgcccggagcgctcg

SEQ ID NO: 38215 - DNA, 15 bp, Homo sapiens
ctgcccggagcgctc

SEQ ID NO: 38216 - DNA, 15 bp, Homo sapiens
gctgcccggagcgct

SEQ ID NO: 38217 - DNA, 15 bp, Homo sapiens
cgctgcccggagcgc

SEQ ID NO: 38218 - DNA, 15 bp, Homo sapiens
gcgctgcccggagcg

SEQ ID NO: 38219 - DNA, 15 bp, Homo sapiens
tgcgctgcccggagc

SEQ ID NO: 38220 - DNA, 15 bp, Homo sapiens
gtgcgctgcccggag

SEQ ID NO: 38221 - DNA, 15 bp, Homo sapiens
cgtgcgctgcccgga

SEQ ID NO: 38222 - DNA, 15 bp, Homo sapiens
ccgtgcgctgcccgg

SEQ ID NO: 38223 - DNA, 15 bp, Homo sapiens
gccgtgcgctgcccg

SEQ ID NO: 38224 - DNA, 15 bp, Homo sapiens
ggccgtgcgctgccc

SEQ ID NO: 38225 - DNA, 15 bp, Homo sapiens
tggccgtgcgctgcc

SEQ ID NO: 38226 - DNA, 15 bp, Homo sapiens
ctggccgtgcgctgc

SEQ ID NO: 38227 - DNA, 15 bp, Homo sapiens
gctggccgtgcgctg

SEQ ID NO: 38228 - DNA, 15 bp, Homo sapiens
cgctggccgtgcgct

SEQ ID NO: 38229 - DNA, 15 bp, Homo sapiens
acgctggccgtgcgc

SEQ ID NO: 38230 - DNA, 15 bp, Homo sapiens
gacgctggccgtgcg

SEQ ID NO: 38231 - DNA, 15 bp, Homo sapiens
ggacgctggccgtgc

SEQ ID NO: 38232 - DNA, 15 bp, Homo sapiens
aggacgctggccgtg

SEQ ID NO: 38233 - DNA, 15 bp, Homo sapiens
caggacgctggccgt

SEQ ID NO: 38234 - DNA, 15 bp, Homo sapiens
acaggacgctggccg

SEQ ID NO: 38235 - DNA, 15 bp, Homo sapiens
cacaggacgctggcc

SEQ ID NO: 38236 - DNA, 15 bp, Homo sapiens
ccacaggacgctggc

SEQ ID NO: 38237 - DNA, 15 bp, Homo sapiens
gccacaggacgctgg

SEQ ID NO: 38238 - DNA, 15 bp, Homo sapiens
ggccacaggacgctg

SEQ ID NO: 38239 - DNA, 15 bp, Homo sapiens
gggccacaggacgct

SEQ ID NO: 38240 - DNA, 15 bp, Homo sapiens
agggccacaggacgc

SEQ ID NO: 38241 - DNA, 15 bp, Homo sapiens
cagggccacaggacg

SEQ ID NO: 38242 - DNA, 15 bp, Homo sapiens
ccagggccacaggac

SEQ ID NO: 38243 - DNA, 15 bp, Homo sapiens
tccagggccacagga

SEQ ID NO: 38244 - DNA, 15 bp, Homo sapiens
atccagggccacagg

SEQ ID NO: 38245 - DNA, 15 bp, Homo sapiens
gatccagggccacag

SEQ ID NO: 38246 - DNA, 15 bp, Homo sapiens
tgatccagggccaca

SEQ ID NO: 38247 - DNA, 15 bp, Homo sapiens
ttgatccagggccac

SEQ ID NO: 38248 - DNA, 15 bp, Homo sapiens
gttgatccagggcca

SEQ ID NO: 38249 - DNA, 15 bp, Homo sapiens
ggttgatccagggcc

SEQ ID NO: 38250 - DNA, 15 bp, Homo sapiens
cggttgatccagggc

SEQ ID NO: 38251 - DNA, 15 bp, Homo sapiens
gcggttgatccaggg

SEQ ID NO: 38252 - DNA, 15 bp, Homo sapiens
tgcggttgatccagg

SEQ ID NO: 38253 - DNA, 15 bp, Homo sapiens
ttgcggttgatccag

SEQ ID NO: 38254 - DNA, 15 bp, Homo sapiens
gttgcggttgatcca

SEQ ID NO: 38255 - DNA, 15 bp, Homo sapiens
cgttgcggttgatcc

SEQ ID NO: 38256 - DNA, 15 bp, Homo sapiens
gcgttgcggttgatc

SEQ ID NO: 38257 - DNA, 15 bp, Homo sapiens
ggcgttgcggttgat

SEQ ID NO: 38258 - DNA, 15 bp, Homo sapiens
gggcgttgcggttga

SEQ ID NO: 38259 - DNA, 15 bp, Homo sapiens
cgggcgttgcggttg

SEQ ID NO: 38260 - DNA, 15 bp, Homo sapiens
acgggcgttgcggtt

SEQ ID NO: 38261 - DNA, 15 bp, Homo sapiens
cacgggcgttgcggt

SEQ ID NO: 38262 - DNA, 15 bp, Homo sapiens
acacgggcgttgcgg

SEQ ID NO: 38263 - DNA, 15 bp, Homo sapiens
cacacgggcgttgcg

SEQ ID NO: 38264 - DNA, 15 bp, Homo sapiens
ccacacgggcgttgc

SEQ ID NO: 38265 - DNA, 15 bp, Homo sapiens
gccacacgggcgttg

SEQ ID NO: 38266 - DNA, 15 bp, Homo sapiens
ggccacacgggcgtt

SEQ ID NO: 38267 - DNA, 15 bp, Homo sapiens
cggccacacgggcgt

SEQ ID NO: 38268 - DNA, 15 bp, Homo sapiens
tcggccacacgggcg

SEQ ID NO: 38269 - DNA, 15 bp, Homo sapiens
gtcggccacacgggc

SEQ ID NO: 38270 - DNA, 15 bp, Homo sapiens
ggtcggccacacggg

SEQ ID NO: 38271 - DNA, 15 bp, Homo sapiens
aggtcggccacacgg

SEQ ID NO: 38272 - DNA, 15 bp, Homo sapiens
gaggtcggccacacg

SEQ ID NO: 38273 - DNA, 15 bp, Homo sapiens
cgaggtcggccacac

SEQ ID NO: 38274 - DNA, 15 bp, Homo sapiens
acgaggtcggccaca

SEQ ID NO: 38275 - DNA, 15 bp, Homo sapiens
cacgaggtcggccac

SEQ ID NO: 38276 - DNA, 15 bp, Homo sapiens
gcacgaggtcggcca

SEQ ID NO: 38277 - DNA, 15 bp, Homo sapiens
tgcacgaggtcggcc

SEQ ID NO: 38278 - DNA, 15 bp, Homo sapiens
gtgcacgaggtcggc

SEQ ID NO: 38279 - DNA, 15 bp, Homo sapiens
tgtgcacgaggtcgg

SEQ ID NO: 38280 - DNA, 15 bp, Homo sapiens
atgtgcacgaggtcg

SEQ ID NO: 38281 - DNA, 15 bp, Homo sapiens
gatgtgcacgaggtc

SEQ ID NO: 38282 - DNA, 15 bp, Homo sapiens
ggatgtgcacgaggt

SEQ ID NO: 38283 - DNA, 15 bp, Homo sapiens
aggatgtgcacgagg

SEQ ID NO: 38284 - DNA, 15 bp, Homo sapiens
gaggatgtgcacgag

SEQ ID NO: 38285 - DNA, 15 bp, Homo sapiens
tgaggatgtgcacga

SEQ ID NO: 38286 - DNA, 15 bp, Homo sapiens
gtgaggatgtgcacg

SEQ ID NO: 38287 - DNA, 15 bp, Homo sapiens
cgtgaggatgtgcac

SEQ ID NO: 38288 - DNA, 15 bp, Homo sapiens
gcgtgaggatgtgca

SEQ ID NO: 38289 - DNA, 15 bp, Homo sapiens
tgcgtgaggatgtgc

SEQ ID NO: 38290 - DNA, 15 bp, Homo sapiens
gtgcgtgaggatgtg

SEQ ID NO: 38291 - DNA, 15 bp, Homo sapiens
ggtgcgtgaggatgt

SEQ ID NO: 38292 - DNA, 15 bp, Homo sapiens
aggtgcgtgaggatg

SEQ ID NO: 38293 - DNA, 15 bp, Homo sapiens
caggtgcgtgaggat

SEQ ID NO: 38294 - DNA, 15 bp, Homo sapiens
gcaggtgcgtgagga

SEQ ID NO: 38295 - DNA, 15 bp, Homo sapiens
tgcaggtgcgtgagg

SEQ ID NO: 38296 - DNA, 15 bp, Homo sapiens
ctgcaggtgcgtgag

SEQ ID NO: 38297 - DNA, 15 bp, Homo sapiens
gctgcaggtgcgtga

SEQ ID NO: 38298 - DNA, 15 bp, Homo sapiens
agctgcaggtgcgtg

SEQ ID NO: 38299 - DNA, 15 bp, Homo sapiens
cagctgcaggtgcgt

SEQ ID NO: 38300 - DNA, 15 bp, Homo sapiens
gcagctgcaggtgcg

SEQ ID NO: 38301 - DNA, 15 bp, Homo sapiens
agcagctgcaggtgc

SEQ ID NO: 38302 - DNA, 15 bp, Homo sapiens
gagcagctgcaggtg

SEQ ID NO: 38303 - DNA, 15 bp, Homo sapiens
ggagcagctgcaggt

SEQ ID NO: 38304 - DNA, 15 bp, Homo sapiens
cggagcagctgcagg

SEQ ID NO: 38305 - DNA, 15 bp, Homo sapiens
acggagcagctgcag

SEQ ID NO: 38306 - DNA, 15 bp, Homo sapiens
cacggagcagctgca

SEQ ID NO: 38307 - DNA, 15 bp, Homo sapiens
gcacggagcagctgc

SEQ ID NO: 38308 - DNA, 15 bp, Homo sapiens
cgcacggagcagctg

SEQ ID NO: 38309 - DNA, 15 bp, Homo sapiens
gcgcacggagcagct

SEQ ID NO: 38310 - DNA, 15 bp, Homo sapiens
cgcgcacggagcagc

SEQ ID NO: 38311 - DNA, 15 bp, Homo sapiens
ccgcgcacggagcag

SEQ ID NO: 38312 - DNA, 15 bp, Homo sapiens
cccgcgcacggagca

SEQ ID NO: 38313 - DNA, 15 bp, Homo sapiens
tcccgcgcacggagc

SEQ ID NO: 38314 - DNA, 15 bp, Homo sapiens
gtcccgcgcacggag

SEQ ID NO: 38315 - DNA, 15 bp, Homo sapiens
tgtcccgcgcacgga

SEQ ID NO: 38316 - DNA, 15 bp, Homo sapiens
atgtcccgcgcacgg

SEQ ID NO: 38317 - DNA, 15 bp, Homo sapiens
gatgtcccgcgcacg

SEQ ID NO: 38318 - DNA, 15 bp, Homo sapiens
tgatgtcccgcgcac

SEQ ID NO: 38319 - DNA, 15 bp, Homo sapiens
atgatgtcccgcgca

SEQ ID NO: 38320 - DNA, 15 bp, Homo sapiens
gatgatgtcccgcgc

SEQ ID NO: 38321 - DNA, 15 bp, Homo sapiens
tgatgatgtcccgcg

SEQ ID NO: 38322 - DNA, 15 bp, Homo sapiens
gtgatgatgtcccgc

SEQ ID NO: 38323 - DNA, 15 bp, Homo sapiens
tgtgatgatgtcccg

SEQ ID NO: 38324 - DNA, 15 bp, Homo sapiens
ctgtgatgatgtccc

SEQ ID NO: 38325 - DNA, 15 bp, Homo sapiens
gctgtgatgatgtcc

SEQ ID NO: 38326 - DNA, 15 bp, Homo sapiens
ggctgtgatgatgtc

SEQ ID NO: 38327 - DNA, 15 bp, Homo sapiens
aggctgtgatgatgt

SEQ ID NO: 38328 - DNA, 15 bp, Homo sapiens
caggctgtgatgatg

SEQ ID NO: 38329 - DNA, 15 bp, Homo sapiens
acaggctgtgatgat

SEQ ID NO: 38330 - DNA, 15 bp, Homo sapiens
cacaggctgtgatga

SEQ ID NO: 38331 - DNA, 15 bp, Homo sapiens
tcacaggctgtgatg

SEQ ID NO: 38332 - DNA, 15 bp, Homo sapiens
ctcacaggctgtgat

SEQ ID NO: 38333 - DNA, 15 bp, Homo sapiens
gctcacaggctgtga

SEQ ID NO: 38334 - DNA, 15 bp, Homo sapiens
cgctcacaggctgtg

SEQ ID NO: 38335 - DNA, 15 bp, Homo sapiens
gcgctcacaggctgt

SEQ ID NO: 38336 - DNA, 15 bp, Homo sapiens
cgcgctcacaggctg

SEQ ID NO: 38337 - DNA, 15 bp, Homo sapiens
ccgcgctcacaggct

SEQ ID NO: 38338 - DNA, 15 bp, Homo sapiens
cccgcgctcacaggc

SEQ ID NO: 38339 - DNA, 15 bp, Homo sapiens
tcccgcgctcacagg

SEQ ID NO: 38340 - DNA, 15 bp, Homo sapiens
gtcccgcgctcacag

SEQ ID NO: 38341 - DNA, 15 bp, Homo sapiens
agtcccgcgctcaca

SEQ ID NO: 38342 - DNA, 15 bp, Homo sapiens
gagtcccgcgctcac

SEQ ID NO: 38343 - DNA, 15 bp, Homo sapiens
ggagtcccgcgctca

SEQ ID NO: 38344 - DNA, 15 bp, Homo sapiens
cggagtcccgcgctc

SEQ ID NO: 38345 - DNA, 15 bp, Homo sapiens
ccggagtcccgcgct

SEQ ID NO: 38346 - DNA, 15 bp, Homo sapiens
cccggagtcccgcgc

SEQ ID NO: 38347 - DNA, 15 bp, Homo sapiens
gcccggagtcccgcg

SEQ ID NO: 38348 - DNA, 15 bp, Homo sapiens
tgcccggagtcccgc

SEQ ID NO: 38349 - DNA, 15 bp, Homo sapiens
gtgcccggagtcccg

SEQ ID NO: 38350 - DNA, 15 bp, Homo sapiens
ggtgcccggagtccc

SEQ ID NO: 38351 - DNA, 15 bp, Homo sapiens
gggtgcccggagtcc

SEQ ID NO: 38352 - DNA, 15 bp, Homo sapiens
ggggtgcccggagtc

SEQ ID NO: 38353 - DNA, 15 bp, Homo sapiens
tggggtgcccggagt

SEQ ID NO: 38354 - DNA, 15 bp, Homo sapiens
gtggggtgcccggag

SEQ ID NO: 38355 - DNA, 15 bp, Homo sapiens
cgtggggtgcccgga

SEQ ID NO: 38356 - DNA, 15 bp, Homo sapiens
ccgtggggtgcccgg

SEQ ID NO: 38357 - DNA, 15 bp, Homo sapiens
gccgtggggtgcccg

SEQ ID NO: 38358 - DNA, 15 bp, Homo sapiens
agccgtggggtgccc

SEQ ID NO: 38359 - DNA, 15 bp, Homo sapiens
cagccgtggggtgcc

SEQ ID NO: 38360 - DNA, 15 bp, Homo sapiens
ccagccgtggggtgc

SEQ ID NO: 38361 - DNA, 15 bp, Homo sapiens
cccagccgtggggtg

SEQ ID NO: 38362 - DNA, 15 bp, Homo sapiens
tcccagccgtggggt

SEQ ID NO: 38363 - DNA, 15 bp, Homo sapiens
ctcccagccgtgggg

SEQ ID NO: 38364 - DNA, 15 bp, Homo sapiens
cctcccagccgtggg

SEQ ID NO: 38365 - DNA, 15 bp, Homo sapiens
gcctcccagccgtgg

SEQ ID NO: 38366 - DNA, 15 bp, Homo sapiens
ggcctcccagccgtg

SEQ ID NO: 38367 - DNA, 15 bp, Homo sapiens
cggcctcccagccgt

SEQ ID NO: 38368 - DNA, 15 bp, Homo sapiens
ccggcctcccagccg

SEQ ID NO: 38369 - DNA, 15 bp, Homo sapiens
gccggcctcccagcc

SEQ ID NO: 38370 - DNA, 15 bp, Homo sapiens
cgccggcctcccagc

SEQ ID NO: 38371 - DNA, 15 bp, Homo sapiens
ccgccggcctcccag

SEQ ID NO: 38372 - DNA, 15 bp, Homo sapiens
cccgccggcctccca

SEQ ID NO: 38373 - DNA, 15 bp, Homo sapiens
gcccgccggcctccc

SEQ ID NO: 38374 - DNA, 15 bp, Homo sapiens
ggcccgccggcctcc

SEQ ID NO: 38375 - DNA, 15 bp, Homo sapiens
gggcccgccggcctc

SEQ ID NO: 38376 - DNA, 15 bp, Homo sapiens
ggggcccgccggcct

SEQ ID NO: 38377 - DNA, 15 bp, Homo sapiens
tggggcccgccggcc

SEQ ID NO: 38378 - DNA, 15 bp, Homo sapiens
gtggggcccgccggc

SEQ ID NO: 38379 - DNA, 15 bp, Homo sapiens
cgtggggcccgccgg

SEQ ID NO: 38380 - DNA, 15 bp, Homo sapiens
ccgtggggcccgccg

SEQ ID NO: 38381 - DNA, 15 bp, Homo sapiens
cccgtggggcccgcc

SEQ ID NO: 38382 - DNA, 15 bp, Homo sapiens
ccccgtggggcccgc

SEQ ID NO: 38383 - DNA, 15 bp, Homo sapiens
gccccgtggggcccg

SEQ ID NO: 38384 - DNA, 15 bp, Homo sapiens
agccccgtggggccc

SEQ ID NO: 38385 - DNA, 15 bp, Homo sapiens
gagccccgtggggcc

SEQ ID NO: 38386 - DNA, 15 bp, Homo sapiens
ggagccccgtggggc

SEQ ID NO: 38387 - DNA, 15 bp, Homo sapiens
gggagccccgtgggg

SEQ ID NO: 38388 - DNA, 15 bp, Homo sapiens
ggggagccccgtggg

SEQ ID NO: 38389 - DNA, 15 bp, Homo sapiens
gggggagccccgtgg

SEQ ID NO: 38390 - DNA, 15 bp, Homo sapiens
tgggggagccccgtg

SEQ ID NO: 38391 - DNA, 15 bp, Homo sapiens
gtgggggagccccgt

SEQ ID NO: 38392 - DNA, 15 bp, Homo sapiens
ggtgggggagccccg

SEQ ID NO: 38393 - DNA, 15 bp, Homo sapiens
gggtgggggagcccc

SEQ ID NO: 38394 - DNA, 15 bp, Homo sapiens
cgggtgggggagccc

SEQ ID NO: 38395 - DNA, 15 bp, Homo sapiens
ccgggtgggggagcc

SEQ ID NO: 38396 - DNA, 15 bp, Homo sapiens
cccgggtgggggagc

SEQ ID NO: 38397 - DNA, 15 bp, Homo sapiens
gcccgggtgggggag

SEQ ID NO: 38398 - DNA, 15 bp, Homo sapiens
ggcccgggtggggga

SEQ ID NO: 38399 - DNA, 15 bp, Homo sapiens
aggcccgggtggggg

SEQ ID NO: 38400 - DNA, 15 bp, Homo sapiens
gaggcccgggtgggg

SEQ ID NO: 38401 - DNA, 15 bp, Homo sapiens
tgaggcccgggtggg

SEQ ID NO: 38402 - DNA, 15 bp, Homo sapiens
ttgaggcccgggtgg

SEQ ID NO: 38403 - DNA, 15 bp, Homo sapiens
gttgaggcccgggtg

SEQ ID NO: 38404 - DNA, 15 bp, Homo sapiens
ggttgaggcccgggt

SEQ ID NO: 38405 - DNA, 15 bp, Homo sapiens
aggttgaggcccggg

SEQ ID NO: 38406 - DNA, 15 bp, Homo sapiens
aaggttgaggcccgg

SEQ ID NO: 38407 - DNA, 15 bp, Homo sapiens
gaaggttgaggcccg

SEQ ID NO: 38408 - DNA, 15 bp, Homo sapiens
ggaaggttgaggccc

SEQ ID NO: 38409 - DNA, 15 bp, Homo sapiens
aggaaggttgaggcc

SEQ ID NO: 38410 - DNA, 15 bp, Homo sapiens
aaggaaggttgaggc

SEQ ID NO: 38411 - DNA, 15 bp, Homo sapiens
aaaggaaggttgagg

SEQ ID NO: 38412 - DNA, 15 bp, Homo sapiens
gaaaggaaggttgag

SEQ ID NO: 38413 - DNA, 15 bp, Homo sapiens
ggaaaggaaggttga

SEQ ID NO: 38414 - DNA, 15 bp, Homo sapiens
aggaaaggaaggttg

SEQ ID NO: 38415 - DNA, 15 bp, Homo sapiens
aaggaaaggaaggtt

SEQ ID NO: 38416 - DNA, 15 bp, Homo sapiens
gaaggaaaggaaggt

SEQ ID NO: 38417 - DNA, 15 bp, Homo sapiens
ggaaggaaaggaagg

SEQ ID NO: 38418 - DNA, 15 bp, Homo sapiens
aggaaggaaaggaag

SEQ ID NO: 38419 - DNA, 15 bp, Homo sapiens
aaggaaggaaaggaa

SEQ ID NO: 38420 - DNA, 15 bp, Homo sapiens
caaggaaggaaagga

SEQ ID NO: 38421 - DNA, 15 bp, Homo sapiens
ccaaggaaggaaagg

SEQ ID NO: 38422 - DNA, 15 bp, Homo sapiens
gccaaggaaggaaag

SEQ ID NO: 38423 - DNA, 15 bp, Homo sapiens
cgccaaggaaggaaa

SEQ ID NO: 38424 - DNA, 15 bp, Homo sapiens
acgccaaggaaggaa

SEQ ID NO: 38425 - DNA, 15 bp, Homo sapiens
gacgccaaggaagga

SEQ ID NO: 38426 - DNA, 15 bp, Homo sapiens
ggacgccaaggaagg

SEQ ID NO: 38427 - DNA, 15 bp, Homo sapiens
gggacgccaaggaag

SEQ ID NO: 38428 - DNA, 15 bp, Homo sapiens
tgggacgccaaggaa

SEQ ID NO: 38429 - DNA, 15 bp, Homo sapiens
ctgggacgccaagga

SEQ ID NO: 38430 - DNA, 15 bp, Homo sapiens
cctgggacgccaagg

SEQ ID NO: 38431 - DNA, 15 bp, Homo sapiens
ccctgggacgccaag

SEQ ID NO: 38432 - DNA, 15 bp, Homo sapiens
gccctgggacgccaa

SEQ ID NO: 38433 - DNA, 15 bp, Homo sapiens
tgccctgggacgcca

SEQ ID NO: 38434 - DNA, 15 bp, Homo sapiens
gtgccctgggacgcc

SEQ ID NO: 38435 - DNA, 15 bp, Homo sapiens
ggtgccctgggacgc

SEQ ID NO: 38436 - DNA, 15 bp, Homo sapiens
gggtgccctgggacg

SEQ ID NO: 38437 - DNA, 15 bp, Homo sapiens
agggtgccctgggac

SEQ ID NO: 38438 - DNA, 15 bp, Homo sapiens
gagggtgccctggga

SEQ ID NO: 38439 - DNA, 15 bp, Homo sapiens
ggagggtgccctggg

SEQ ID NO: 38440 - DNA, 15 bp, Homo sapiens
gggagggtgccctgg

SEQ ID NO: 38441 - DNA, 15 bp, Homo sapiens
cgggagggtgccctg

SEQ ID NO: 38442 - DNA, 15 bp, Homo sapiens
gcgggagggtgccct

SEQ ID NO: 38443 - DNA, 15 bp, Homo sapiens
ggcgggagggtgccc

SEQ ID NO: 38444 - DNA, 15 bp, Homo sapiens
gggcgggagggtgcc

SEQ ID NO: 38445 - DNA, 15 bp, Homo sapiens
ggggcgggagggtgc

SEQ ID NO: 38446 - DNA, 15 bp, Homo sapiens
cggggcgggagggtg

SEQ ID NO: 38447 - DNA, 15 bp, Homo sapiens
gcggggcgggagggt

SEQ ID NO: 38448 - DNA, 15 bp, Homo sapiens
agcggggcgggaggg

SEQ ID NO: 38449 - DNA, 15 bp, Homo sapiens
aagcggggcgggagg

SEQ ID NO: 38450 - DNA, 15 bp, Homo sapiens
gaagcggggcgggag

SEQ ID NO: 38451 - DNA, 15 bp, Homo sapiens
ggaagcggggcggga

SEQ ID NO: 38452 - DNA, 15 bp, Homo sapiens
cggaagcggggcggg

SEQ ID NO: 38453 - DNA, 15 bp, Homo sapiens
acggaagcggggcgg

SEQ ID NO: 38454 - DNA, 15 bp, Homo sapiens
gacggaagcggggcg

SEQ ID NO: 38455 - DNA, 15 bp, Homo sapiens
ggacggaagcggggc

SEQ ID NO: 38456 - DNA, 15 bp, Homo sapiens
gggacggaagcgggg

SEQ ID NO: 38457 - DNA, 15 bp, Homo sapiens
ggggacggaagcggg

SEQ ID NO: 38458 - DNA, 15 bp, Homo sapiens
tggggacggaagcgg

SEQ ID NO: 38459 - DNA, 15 bp, Homo sapiens
ctggggacggaagcg

SEQ ID NO: 38460 - DNA, 15 bp, Homo sapiens
cctggggacggaagc

SEQ ID NO: 38461 - DNA, 15 bp, Homo sapiens
gcctggggacggaag

SEQ ID NO: 38462 - DNA, 15 bp, Homo sapiens
tgcctggggacggaa

SEQ ID NO: 38463 - DNA, 15 bp, Homo sapiens
gtgcctggggacgga

SEQ ID NO: 38464 - DNA, 15 bp, Homo sapiens
ggtgcctggggacgg

SEQ ID NO: 38465 - DNA, 15 bp, Homo sapiens
tggtgcctggggacg

SEQ ID NO: 38466 - DNA, 15 bp, Homo sapiens
gtggtgcctggggac

SEQ ID NO: 38467 - DNA, 15 bp, Homo sapiens
agtggtgcctgggga

SEQ ID NO: 38468 - DNA, 15 bp, Homo sapiens
cagtggtgcctgggg

SEQ ID NO: 38469 - DNA, 15 bp, Homo sapiens
gcagtggtgcctggg

SEQ ID NO: 38470 - DNA, 15 bp, Homo sapiens
ggcagtggtgcctgg

SEQ ID NO: 38471 - DNA, 15 bp, Homo sapiens
gggcagtggtgcctg

SEQ ID NO: 38472 - DNA, 15 bp, Homo sapiens
ggggcagtggtgcct

SEQ ID NO: 38473 - DNA, 15 bp, Homo sapiens
cggggcagtggtgcc

SEQ ID NO: 38474 - DNA, 15 bp, Homo sapiens
tcggggcagtggtgc

SEQ ID NO: 38475 - DNA, 15 bp, Homo sapiens
ctcggggcagtggtg

SEQ ID NO: 38476 - DNA, 15 bp, Homo sapiens
cctcggggcagtggt

SEQ ID NO: 38477 - DNA, 15 bp, Homo sapiens
gcctcggggcagtgg

SEQ ID NO: 38478 - DNA, 15 bp, Homo sapiens
ggcctcggggcagtg

SEQ ID NO: 38479 - DNA, 15 bp, Homo sapiens
gggcctcggggcagt

SEQ ID NO: 38480 - DNA, 15 bp, Homo sapiens
tgggcctcggggcag

SEQ ID NO: 38481 - DNA, 15 bp, Homo sapiens
ctgggcctcggggca

SEQ ID NO: 38482 - DNA, 15 bp, Homo sapiens
gctgggcctcggggc

SEQ ID NO: 38483 - DNA, 15 bp, Homo sapiens
tgctgggcctcgggg

SEQ ID NO: 38484 - DNA, 15 bp, Homo sapiens
ctgctgggcctcggg

SEQ ID NO: 38485 - DNA, 15 bp, Homo sapiens
gctgctgggcctcgg

SEQ ID NO: 38486 - DNA, 15 bp, Homo sapiens
tgctgctgggcctcg

SEQ ID NO: 38487 - DNA, 15 bp, Homo sapiens
atgctgctgggcctc

SEQ ID NO: 38488 - DNA, 15 bp, Homo sapiens
gatgctgctgggcct

SEQ ID NO: 38489 - DNA, 15 bp, Homo sapiens
ggatgctgctgggcc

SEQ ID NO: 38490 - DNA, 15 bp, Homo sapiens
gggatgctgctgggc

SEQ ID NO: 38491 - DNA, 15 bp, Homo sapiens
agggatgctgctggg

SEQ ID NO: 38492 - DNA, 15 bp, Homo sapiens
cagggatgctgctgg

SEQ ID NO: 38493 - DNA, 15 bp, Homo sapiens
gcagggatgctgctg

SEQ ID NO: 38494 - DNA, 15 bp, Homo sapiens
tgcagggatgctgct

SEQ ID NO: 38495 - DNA, 15 bp, Homo sapiens
gtgcagggatgctgc

SEQ ID NO: 38496 - DNA, 15 bp, Homo sapiens
ggtgcagggatgctg

SEQ ID NO: 38497 - DNA, 15 bp, Homo sapiens
gggtgcagggatgct

SEQ ID NO: 38498 - DNA, 15 bp, Homo sapiens
cgggtgcagggatgc

SEQ ID NO: 38499 - DNA, 15 bp, Homo sapiens
gcgggtgcagggatg

SEQ ID NO: 38500 - DNA, 15 bp, Homo sapiens
ggcgggtgcagggat

SEQ ID NO: 38501 - DNA, 15 bp, Homo sapiens
cggcgggtgcaggga

SEQ ID NO: 38502 - DNA, 15 bp, Homo sapiens
tcggcgggtgcaggg

SEQ ID NO: 38503 - DNA, 15 bp, Homo sapiens
ctcggcgggtgcagg

SEQ ID NO: 38504 - DNA, 15 bp, Homo sapiens
cctcggcgggtgcag

SEQ ID NO: 38505 - DNA, 15 bp, Homo sapiens
gcctcggcgggtgca

SEQ ID NO: 38506 - DNA, 15 bp, Homo sapiens
ggcctcggcgggtgc

SEQ ID NO: 38507 - DNA, 15 bp, Homo sapiens
cggcctcggcgggtg

SEQ ID NO: 38508 - DNA, 15 bp, Homo sapiens
tcggcctcggcgggt

SEQ ID NO: 38509 - DNA, 15 bp, Homo sapiens
ctcggcctcggcggg

SEQ ID NO: 38510 - DNA, 15 bp, Homo sapiens
cctcggcctcggcgg

SEQ ID NO: 38511 - DNA, 15 bp, Homo sapiens
gcctcggcctcggcg

SEQ ID NO: 38512 - DNA, 15 bp, Homo sapiens
ggcctcggcctcggc

SEQ ID NO: 38513 - DNA, 15 bp, Homo sapiens
aggcctcggcctcgg

SEQ ID NO: 38514 - DNA, 15 bp, Homo sapiens
caggcctcggcctcg

SEQ ID NO: 38515 - DNA, 15 bp, Homo sapiens
ccaggcctcggcctc

SEQ ID NO: 38516 - DNA, 15 bp, Homo sapiens
tccaggcctcggcct

SEQ ID NO: 38517 - DNA, 15 bp, Homo sapiens
ctccaggcctcggcc

SEQ ID NO: 38518 - DNA, 15 bp, Homo sapiens
gctccaggcctcggc

SEQ ID NO: 38519 - DNA, 15 bp, Homo sapiens
ggctccaggcctcgg

SEQ ID NO: 38520 - DNA, 15 bp, Homo sapiens
gggctccaggcctcg

SEQ ID NO: 38521 - DNA, 15 bp, Homo sapiens
ggggctccaggcctc

SEQ ID NO: 38522 - DNA, 15 bp, Homo sapiens
gggggctccaggcct

SEQ ID NO: 38523 - DNA, 15 bp, Homo sapiens
cgggggctccaggcc

SEQ ID NO: 38524 - DNA, 15 bp, Homo sapiens
ccgggggctccaggc

SEQ ID NO: 38525 - DNA, 15 bp, Homo sapiens
tccgggggctccagg

SEQ ID NO: 38526 - DNA, 15 bp, Homo sapiens
ttccgggggctccag

SEQ ID NO: 38527 - DNA, 15 bp, Homo sapiens
cttccgggggctcca

SEQ ID NO: 38528 - DNA, 15 bp, Homo sapiens
acttccgggggctcc

SEQ ID NO: 38529 - DNA, 15 bp, Homo sapiens
aacttccgggggctc

SEQ ID NO: 38530 - DNA, 15 bp, Homo sapiens
caacttccgggggct

SEQ ID NO: 38531 - DNA, 15 bp, Homo sapiens
gcaacttccgggggc

SEQ ID NO: 38532 - DNA, 15 bp, Homo sapiens
ggcaacttccggggg

SEQ ID NO: 38533 - DNA, 15 bp, Homo sapiens
tggcaacttccgggg

SEQ ID NO: 38534 - DNA, 15 bp, Homo sapiens
atggcaacttccggg

SEQ ID NO: 38535 - DNA, 15 bp, Homo sapiens
gatggcaacttccgg

SEQ ID NO: 38536 - DNA, 15 bp, Homo sapiens
ggatggcaacttccg

SEQ ID NO: 38537 - DNA, 15 bp, Homo sapiens
aggatggcaacttcc

SEQ ID NO: 38538 - DNA, 15 bp, Homo sapiens
gaggatggcaacttc

SEQ ID NO: 38539 - DNA, 15 bp, Homo sapiens
tgaggatggcaactt

SEQ ID NO: 38540 - DNA, 15 bp, Homo sapiens
ctgaggatggcaact

SEQ ID NO: 38541 - DNA, 15 bp, Homo sapiens
gctgaggatggcaac

SEQ ID NO: 38542 - DNA, 15 bp, Homo sapiens
ggctgaggatggcaa

SEQ ID NO: 38543 - DNA, 15 bp, Homo sapiens
aggctgaggatggca

SEQ ID NO: 38544 - DNA, 15 bp, Homo sapiens
gaggctgaggatggc

SEQ ID NO: 38545 - DNA, 15 bp, Homo sapiens
ggaggctgaggatgg

SEQ ID NO: 38546 - DNA, 15 bp, Homo sapiens
tggaggctgaggatg

SEQ ID NO: 38547 - DNA, 15 bp, Homo sapiens
gtggaggctgaggat

SEQ ID NO: 38548 - DNA, 15 bp, Homo sapiens
ggtggaggctgagga

SEQ ID NO: 38549 - DNA, 15 bp, Homo sapiens
aggtggaggctgagg

SEQ ID NO: 38550 - DNA, 15 bp, Homo sapiens
aaggtggaggctgag

SEQ ID NO: 38551 - DNA, 15 bp, Homo sapiens
gaaggtggaggctga

SEQ ID NO: 38552 - DNA, 15 bp, Homo sapiens
ggaaggtggaggctg

SEQ ID NO: 38553 - DNA, 15 bp, Homo sapiens
aggaaggtggaggct

SEQ ID NO: 38554 - DNA, 15 bp, Homo sapiens
gaggaaggtggaggc

SEQ ID NO: 38555 - DNA, 15 bp, Homo sapiens
agaggaaggtggagg

SEQ ID NO: 38556 - DNA, 15 bp, Homo sapiens
gagaggaaggtggag

SEQ ID NO: 38557 - DNA, 15 bp, Homo sapiens
ggagaggaaggtgga

SEQ ID NO: 38558 - DNA, 15 bp, Homo sapiens
gggagaggaaggtgg

SEQ ID NO: 38559 - DNA, 15 bp, Homo sapiens
ggggagaggaaggtg

SEQ ID NO: 38560 - DNA, 15 bp, Homo sapiens
tggggagaggaaggt

SEQ ID NO: 38561 - DNA, 15 bp, Homo sapiens
ctggggagaggaagg

SEQ ID NO: 38562 - DNA, 15 bp, Homo sapiens
cctggggagaggaag

SEQ ID NO: 38563 - DNA, 15 bp, Homo sapiens
acctggggagaggaa

SEQ ID NO: 38564 - DNA, 15 bp, Homo sapiens
tacctggggagagga

SEQ ID NO: 38565 - DNA, 15 bp, Homo sapiens
ttacctggggagagg

SEQ ID NO: 38566 - DNA, 15 bp, Homo sapiens
cttacctggggagag

SEQ ID NO: 38567 - DNA, 15 bp, Homo sapiens
tcttacctggggaga

SEQ ID NO: 38568 - DNA, 15 bp, Homo sapiens
ctcttacctggggag

SEQ ID NO: 38569 - DNA, 15 bp, Homo sapiens
cctcttacctgggga

SEQ ID NO: 38570 - DNA, 15 bp, Homo sapiens
ccctcttacctgggg

SEQ ID NO: 38571 - DNA, 15 bp, Homo sapiens
gccctcttacctggg

SEQ ID NO: 38572 - DNA, 15 bp, Homo sapiens
ggccctcttacctgg

SEQ ID NO: 38573 - DNA, 15 bp, Homo sapiens
gggccctcttacctg

SEQ ID NO: 38574 - DNA, 15 bp, Homo sapiens
cgggccctcttacct

SEQ ID NO: 38575 - DNA, 15 bp, Homo sapiens
ccgggccctcttacc

SEQ ID NO: 38576 - DNA, 15 bp, Homo sapiens
accgggccctcttac

SEQ ID NO: 38577 - DNA, 15 bp, Homo sapiens
aaccgggccctctta

SEQ ID NO: 38578 - DNA, 15 bp, Homo sapiens
caaccgggccctctt

SEQ ID NO: 38579 - DNA, 15 bp, Homo sapiens
acaaccgggccctct

SEQ ID NO: 38580 - DNA, 15 bp, Homo sapiens
aacaaccgggccctc

SEQ ID NO: 38581 - DNA, 15 bp, Homo sapiens
taacaaccgggccct

SEQ ID NO: 38582 - DNA, 15 bp, Homo sapiens
ctaacaaccgggccc

SEQ ID NO: 38583 - DNA, 15 bp, Homo sapiens
cctaacaaccgggcc

SEQ ID NO: 38584 - DNA, 15 bp, Homo sapiens
gcctaacaaccgggc

SEQ ID NO: 38585 - DNA, 15 bp, Homo sapiens
agcctaacaaccggg

SEQ ID NO: 38586 - DNA, 15 bp, Homo sapiens
gagcctaacaaccgg

SEQ ID NO: 38587 - DNA, 15 bp, Homo sapiens
cgagcctaacaaccg

SEQ ID NO: 38588 - DNA, 15 bp, Homo sapiens
ccgagcctaacaacc

SEQ ID NO: 38589 - DNA, 15 bp, Homo sapiens
accgagcctaacaac

SEQ ID NO: 38590 - DNA, 15 bp, Homo sapiens
caccgagcctaacaa

SEQ ID NO: 38591 - DNA, 15 bp, Homo sapiens
ccaccgagcctaaca

SEQ ID NO: 38592 - DNA, 15 bp, Homo sapiens
tccaccgagcctaac

SEQ ID NO: 38593 - DNA, 15 bp, Homo sapiens
gtccaccgagcctaa

SEQ ID NO: 38594 - DNA, 15 bp, Homo sapiens
ggtccaccgagccta

SEQ ID NO: 38595 - DNA, 15 bp, Homo sapiens
gggtccaccgagcct

SEQ ID NO: 38596 - DNA, 15 bp, Homo sapiens
tgggtccaccgagcc

SEQ ID NO: 38597 - DNA, 15 bp, Homo sapiens
ttgggtccaccgagc

SEQ ID NO: 38598 - DNA, 15 bp, Homo sapiens
tttgggtccaccgag

SEQ ID NO: 38599 - DNA, 15 bp, Homo sapiens
ctttgggtccaccga

SEQ ID NO: 38600 - DNA, 15 bp, Homo sapiens
tctttgggtccaccg

SEQ ID NO: 38601 - DNA, 15 bp, Homo sapiens
ttctttgggtccacc

SEQ ID NO: 38602 - DNA, 15 bp, Homo sapiens
cttctttgggtccac

SEQ ID NO: 38603 - DNA, 15 bp, Homo sapiens
tcttctttgggtcca

SEQ ID NO: 38604 - DNA, 15 bp, Homo sapiens
ctcttctttgggtcc

SEQ ID NO: 38605 - DNA, 15 bp, Homo sapiens
gctcttctttgggtc

SEQ ID NO: 38606 - DNA, 15 bp, Homo sapiens
ggctcttctttgggt

SEQ ID NO: 38607 - DNA, 15 bp, Homo sapiens
gggctcttctttggg

SEQ ID NO: 38608 - DNA, 15 bp, Homo sapiens
tgggctcttctttgg

SEQ ID NO: 38609 - DNA, 15 bp, Homo sapiens
gtgggctcttctttg

SEQ ID NO: 38610 - DNA, 15 bp, Homo sapiens
ggtgggctcttcttt

SEQ ID NO: 38611 - DNA, 15 bp, Homo sapiens
aggtgggctcttctt

SEQ ID NO: 38612 - DNA, 15 bp, Homo sapiens
aaggtgggctcttct

SEQ ID NO: 38613 - DNA, 15 bp, Homo sapiens
caaggtgggctcttc

SEQ ID NO: 38614 - DNA, 15 bp, Homo sapiens
tcaaggtgggctctt

SEQ ID NO: 38615 - DNA, 15 bp, Homo sapiens
gtcaaggtgggctct

SEQ ID NO: 38616 - DNA, 15 bp, Homo sapiens
ggtcaaggtgggctc

SEQ ID NO: 38617 - DNA, 15 bp, Homo sapiens
tggtcaaggtgggct

SEQ ID NO: 38618 - DNA, 15 bp, Homo sapiens
gtggtcaaggtgggc

SEQ ID NO: 38619 - DNA, 15 bp, Homo sapiens
cgtggtcaaggtggg

SEQ ID NO: 38620 - DNA, 15 bp, Homo sapiens
ccgtggtcaaggtgg

SEQ ID NO: 38621 - DNA, 15 bp, Homo sapiens
gccgtggtcaaggtg

SEQ ID NO: 38622 - DNA, 15 bp, Homo sapiens
ggccgtggtcaaggt

SEQ ID NO: 38623 - DNA, 15 bp, Homo sapiens
tggccgtggtcaagg

SEQ ID NO: 38624 - DNA, 15 bp, Homo sapiens
gtggccgtggtcaag

SEQ ID NO: 38625 - DNA, 15 bp, Homo sapiens
cgtggccgtggtcaa

SEQ ID NO: 38626 - DNA, 15 bp, Homo sapiens
ccgtggccgtggtca

SEQ ID NO: 38627 - DNA, 15 bp, Homo sapiens
gccgtggccgtggtc

SEQ ID NO: 38628 - DNA, 15 bp, Homo sapiens
agccgtggccgtggt

SEQ ID NO: 38629 - DNA, 15 bp, Homo sapiens
cagccgtggccgtgg

SEQ ID NO: 38630 - DNA, 15 bp, Homo sapiens
acagccgtggccgtg

SEQ ID NO: 38631 - DNA, 15 bp, Homo sapiens
tacagccgtggccgt

SEQ ID NO: 38632 - DNA, 15 bp, Homo sapiens
ctacagccgtggccg

SEQ ID NO: 38633 - DNA, 15 bp, Homo sapiens
tctacagccgtggcc

SEQ ID NO: 38634 - DNA, 15 bp, Homo sapiens
gtctacagccgtggc

SEQ ID NO: 38635 - DNA, 15 bp, Homo sapiens
ggtctacagccgtgg

SEQ ID NO: 38636 - DNA, 15 bp, Homo sapiens
gggtctacagccgtg

SEQ ID NO: 38637 - DNA, 15 bp, Homo sapiens
agggtctacagccgt

SEQ ID NO: 38638 - DNA, 15 bp, Homo sapiens
cagggtctacagccg

SEQ ID NO: 38639 - DNA, 15 bp, Homo sapiens
gcagggtctacagcc

SEQ ID NO: 38640 - DNA, 15 bp, Homo sapiens
agcagggtctacagc

SEQ ID NO: 38641 - DNA, 15 bp, Homo sapiens
cagcagggtctacag

SEQ ID NO: 38642 - DNA, 15 bp, Homo sapiens
gcagcagggtctaca

SEQ ID NO: 38643 - DNA, 15 bp, Homo sapiens
agcagcagggtctac

SEQ ID NO: 38644 - DNA, 15 bp, Homo sapiens
cagcagcagggtcta

SEQ ID NO: 38645 - DNA, 15 bp, Homo sapiens
ccagcagcagggtct

SEQ ID NO: 38646 - DNA, 15 bp, Homo sapiens
accagcagcagggtc

SEQ ID NO: 38647 - DNA, 15 bp, Homo sapiens
gaccagcagcagggt

SEQ ID NO: 38648 - DNA, 15 bp, Homo sapiens
agaccagcagcaggg

SEQ ID NO: 38649 - DNA, 15 bp, Homo sapiens
gagaccagcagcagg

SEQ ID NO: 38650 - DNA, 15 bp, Homo sapiens
agagaccagcagcag

SEQ ID NO: 38651 - DNA, 15 bp, Homo sapiens
cagagaccagcagca

SEQ ID NO: 38652 - DNA, 15 bp, Homo sapiens
gcagagaccagcagc

SEQ ID NO: 38653 - DNA, 15 bp, Homo sapiens
ggcagagaccagcag

SEQ ID NO: 38654 - DNA, 15 bp, Homo sapiens
aggcagagaccagca

SEQ ID NO: 38655 - DNA, 15 bp, Homo sapiens
caggcagagaccagc

SEQ ID NO: 38656 - DNA, 15 bp, Homo sapiens
gcaggcagagaccag

SEQ ID NO: 38657 - DNA, 15 bp, Homo sapiens
ggcaggcagagacca

SEQ ID NO: 38658 - DNA, 15 bp, Homo sapiens
aggcaggcagagacc

SEQ ID NO: 38659 - DNA, 15 bp, Homo sapiens
gaggcaggcagagac

SEQ ID NO: 38660 - DNA, 15 bp, Homo sapiens
agaggcaggcagaga

SEQ ID NO: 38661 - DNA, 15 bp, Homo sapiens
gagaggcaggcagag

SEQ ID NO: 38662 - DNA, 15 bp, Homo sapiens
tgagaggcaggcaga

SEQ ID NO: 38663 - DNA, 15 bp, Homo sapiens
gtgagaggcaggcag

SEQ ID NO: 38664 - DNA, 15 bp, Homo sapiens
agtgagaggcaggca

SEQ ID NO: 38665 - DNA, 15 bp, Homo sapiens
cagtgagaggcaggc

SEQ ID NO: 38666 - DNA, 15 bp, Homo sapiens
ccagtgagaggcagg

SEQ ID NO: 38667 - DNA, 15 bp, Homo sapiens
accagtgagaggcag

SEQ ID NO: 38668 - DNA, 15 bp, Homo sapiens
caccagtgagaggca

SEQ ID NO: 38669 - DNA, 15 bp, Homo sapiens
acaccagtgagaggc

SEQ ID NO: 38670 - DNA, 15 bp, Homo sapiens
gacaccagtgagagg

SEQ ID NO: 38671 - DNA, 15 bp, Homo sapiens
agacaccagtgagag

SEQ ID NO: 38672 - DNA, 15 bp, Homo sapiens
aagacaccagtgaga

SEQ ID NO: 38673 - DNA, 15 bp, Homo sapiens
aaagacaccagtgag

SEQ ID NO: 38674 - DNA, 15 bp, Homo sapiens
taaagacaccagtga

SEQ ID NO: 38675 - DNA, 15 bp, Homo sapiens
ataaagacaccagtg

SEQ ID NO: 38676 - DNA, 15 bp, Homo sapiens
cataaagacaccagt

SEQ ID NO: 38677 - DNA, 15 bp, Homo sapiens
tcataaagacaccag

SEQ ID NO: 38678 - DNA, 15 bp, Homo sapiens
ttcataaagacacca

SEQ ID NO: 38679 - DNA, 15 bp, Homo sapiens
cttcataaagacacc

SEQ ID NO: 38680 - DNA, 15 bp, Homo sapiens
gcttcataaagacac

SEQ ID NO: 38681 - DNA, 15 bp, Homo sapiens
agcttcataaagaca

SEQ ID NO: 38682 - DNA, 15 bp, Homo sapiens
aagcttcataaagac

SEQ ID NO: 38683 - DNA, 15 bp, Homo sapiens
aaagcttcataaaga

SEQ ID NO: 38684 - DNA, 15 bp, Homo sapiens
aaaagcttcataaag

SEQ ID NO: 38685 - DNA, 15 bp, Homo sapiens
gaaaagcttcataaa

SEQ ID NO: 38686 - DNA, 15 bp, Homo sapiens
ggaaaagcttcataa

SEQ ID NO: 38687 - DNA, 15 bp, Homo sapiens
tggaaaagcttcata

SEQ ID NO: 38688 - DNA, 15 bp, Homo sapiens
ctggaaaagcttcat

SEQ ID NO: 38689 - DNA, 15 bp, Homo sapiens
cctggaaaagcttca

SEQ ID NO: 38690 - DNA, 15 bp, Homo sapiens
gcctggaaaagcttc

SEQ ID NO: 38691 - DNA, 15 bp, Homo sapiens
agcctggaaaagctt

SEQ ID NO: 38692 - DNA, 15 bp, Homo sapiens
gagcctggaaaagct

SEQ ID NO: 38693 - DNA, 15 bp, Homo sapiens
ggagcctggaaaagc

SEQ ID NO: 38694 - DNA, 15 bp, Homo sapiens
gggagcctggaaaag

SEQ ID NO: 38695 - DNA, 15 bp, Homo sapiens
tgggagcctggaaaa

SEQ ID NO: 38696 - DNA, 15 bp, Homo sapiens
ctgggagcctggaaa

SEQ ID NO: 38697 - DNA, 15 bp, Homo sapiens
tctgggagcctggaa

SEQ ID NO: 38698 - DNA, 15 bp, Homo sapiens
gtctgggagcctgga

SEQ ID NO: 38699 - DNA, 15 bp, Homo sapiens
ggtctgggagcctgg

SEQ ID NO: 38700 - DNA, 15 bp, Homo sapiens
gggtctgggagcctg

SEQ ID NO: 38701 - DNA, 15 bp, Homo sapiens
tgggtctgggagcct

SEQ ID NO: 38702 - DNA, 15 bp, Homo sapiens
atgggtctgggagcc

SEQ ID NO: 38703 - DNA, 15 bp, Homo sapiens
aatgggtctgggagc

SEQ ID NO: 38704 - DNA, 15 bp, Homo sapiens
gaatgggtctgggag

SEQ ID NO: 38705 - DNA, 15 bp, Homo sapiens
tgaatgggtctggga

SEQ ID NO: 38706 - DNA, 15 bp, Homo sapiens
ctgaatgggtctggg

SEQ ID NO: 38707 - DNA, 15 bp, Homo sapiens
cctgaatgggtctgg

SEQ ID NO: 38708 - DNA, 15 bp, Homo sapiens
ccctgaatgggtctg

SEQ ID NO: 38709 - DNA, 15 bp, Homo sapiens
gccctgaatgggtct

SEQ ID NO: 38710 - DNA, 15 bp, Homo sapiens
ggccctgaatgggtc

SEQ ID NO: 38711 - DNA, 15 bp, Homo sapiens
aggccctgaatgggt

SEQ ID NO: 38712 - DNA, 15 bp, Homo sapiens
caggccctgaatggg

SEQ ID NO: 38713 - DNA, 15 bp, Homo sapiens
tcaggccctgaatgg

SEQ ID NO: 38714 - DNA, 15 bp, Homo sapiens
ctcaggccctgaatg

SEQ ID NO: 38715 - DNA, 15 bp, Homo sapiens
gctcaggccctgaat

SEQ ID NO: 38716 - DNA, 15 bp, Homo sapiens
agctcaggccctgaa

SEQ ID NO: 38717 - DNA, 15 bp, Homo sapiens
gagctcaggccctga

SEQ ID NO: 38718 - DNA, 15 bp, Homo sapiens
cgagctcaggccctg

SEQ ID NO: 38719 - DNA, 15 bp, Homo sapiens
ccgagctcaggccct

SEQ ID NO: 38720 - DNA, 15 bp, Homo sapiens
gccgagctcaggccc

SEQ ID NO: 38721 - DNA, 15 bp, Homo sapiens
ggccgagctcaggcc

SEQ ID NO: 38722 - DNA, 15 bp, Homo sapiens
aggccgagctcaggc

SEQ ID NO: 38723 - DNA, 15 bp, Homo sapiens
caggccgagctcagg

SEQ ID NO: 38724 - DNA, 15 bp, Homo sapiens
ccaggccgagctcag

SEQ ID NO: 38725 - DNA, 15 bp, Homo sapiens
accaggccgagctca

SEQ ID NO: 38726 - DNA, 15 bp, Homo sapiens
gaccaggccgagctc

SEQ ID NO: 38727 - DNA, 15 bp, Homo sapiens
ggaccaggccgagct

SEQ ID NO: 38728 - DNA, 15 bp, Homo sapiens
gggaccaggccgagc

SEQ ID NO: 38729 - DNA, 15 bp, Homo sapiens
tgggaccaggccgag

SEQ ID NO: 38730 - DNA, 15 bp, Homo sapiens
ttgggaccaggccga

SEQ ID NO: 38731 - DNA, 15 bp, Homo sapiens
cttgggaccaggccg

SEQ ID NO: 38732 - DNA, 15 bp, Homo sapiens
gcttgggaccaggcc

SEQ ID NO: 38733 - DNA, 15 bp, Homo sapiens
ggcttgggaccaggc

SEQ ID NO: 38734 - DNA, 15 bp, Homo sapiens
gggcttgggaccagg

SEQ ID NO: 38735 - DNA, 15 bp, Homo sapiens
agggcttgggaccag

SEQ ID NO: 38736 - DNA, 15 bp, Homo sapiens
cagggcttgggacca

SEQ ID NO: 38737 - DNA, 15 bp, Homo sapiens
gcagggcttgggacc

SEQ ID NO: 38738 - DNA, 15 bp, Homo sapiens
agcagggcttgggac

SEQ ID NO: 38739 - DNA, 15 bp, Homo sapiens
aagcagggcttggga

SEQ ID NO: 38740 - DNA, 15 bp, Homo sapiens
gaagcagggcttggg

SEQ ID NO: 38741 - DNA, 15 bp, Homo sapiens
ggaagcagggcttgg

SEQ ID NO: 38742 - DNA, 15 bp, Homo sapiens
gggaagcagggcttg

SEQ ID NO: 38743 - DNA, 15 bp, Homo sapiens
agggaagcagggctt

SEQ ID NO: 38744 - DNA, 15 bp, Homo sapiens
cagggaagcagggct

SEQ ID NO: 38745 - DNA, 15 bp, Homo sapiens
acagggaagcagggc

SEQ ID NO: 38746 - DNA, 15 bp, Homo sapiens
cacagggaagcaggg

SEQ ID NO: 38747 - DNA, 15 bp, Homo sapiens
ccacagggaagcagg

SEQ ID NO: 38748 - DNA, 15 bp, Homo sapiens
gccacagggaagcag

SEQ ID NO: 38749 - DNA, 15 bp, Homo sapiens
ggccacagggaagca

SEQ ID NO: 38750 - DNA, 15 bp, Homo sapiens
aggccacagggaagc

SEQ ID NO: 38751 - DNA, 15 bp, Homo sapiens
gaggccacagggaag

SEQ ID NO: 38752 - DNA, 15 bp, Homo sapiens
ggaggccacagggaa

SEQ ID NO: 38753 - DNA, 15 bp, Homo sapiens
tggaggccacaggga

SEQ ID NO: 38754 - DNA, 15 bp, Homo sapiens
gtggaggccacaggg

SEQ ID NO: 38755 - DNA, 15 bp, Homo sapiens
ggtggaggccacagg

SEQ ID NO: 38756 - DNA, 15 bp, Homo sapiens
cggtggaggccacag

SEQ ID NO: 38757 - DNA, 15 bp, Homo sapiens
gcggtggaggccaca

SEQ ID NO: 38758 - DNA, 15 bp, Homo sapiens
ggcggtggaggccac

SEQ ID NO: 38759 - DNA, 15 bp, Homo sapiens
tggcggtggaggcca

SEQ ID NO: 38760 - DNA, 15 bp, Homo sapiens
atggcggtggaggcc

SEQ ID NO: 38761 - DNA, 15 bp, Homo sapiens
gatggcggtggaggc

SEQ ID NO: 38762 - DNA, 15 bp, Homo sapiens
agatggcggtggagg

SEQ ID NO: 38763 - DNA, 15 bp, Homo sapiens
gagatggcggtggag

SEQ ID NO: 38764 - DNA, 15 bp, Homo sapiens
ggagatggcggtgga

SEQ ID NO: 38765 - DNA, 15 bp, Homo sapiens
tggagatggcggtgg

SEQ ID NO: 38766 - DNA, 15 bp, Homo sapiens
ctggagatggcggtg

SEQ ID NO: 38767 - DNA, 15 bp, Homo sapiens
gctggagatggcggt

SEQ ID NO: 38768 - DNA, 15 bp, Homo sapiens
ggctggagatggcgg

SEQ ID NO: 38769 - DNA, 15 bp, Homo sapiens
gggctggagatggcg

SEQ ID NO: 38770 - DNA, 15 bp, Homo sapiens
ggggctggagatggc

SEQ ID NO: 38771 - DNA, 15 bp, Homo sapiens
aggggctggagatgg

SEQ ID NO: 38772 - DNA, 15 bp, Homo sapiens
aaggggctggagatg

SEQ ID NO: 38773 - DNA, 15 bp, Homo sapiens
gaaggggctggagat

SEQ ID NO: 38774 - DNA, 15 bp, Homo sapiens
agaaggggctggaga

SEQ ID NO: 38775 - DNA, 15 bp, Homo sapiens
aagaaggggctggag

SEQ ID NO: 38776 - DNA, 15 bp, Homo sapiens
gaagaaggggctgga

SEQ ID NO: 38777 - DNA, 15 bp, Homo sapiens
agaagaaggggctgg

SEQ ID NO: 38778 - DNA, 15 bp, Homo sapiens
tagaagaaggggctg

SEQ ID NO: 38779 - DNA, 15 bp, Homo sapiens
gtagaagaaggggct

SEQ ID NO: 38780 - DNA, 15 bp, Homo sapiens
ggtagaagaaggggc

SEQ ID NO: 38781 - DNA, 15 bp, Homo sapiens
tggtagaagaagggg

SEQ ID NO: 38782 - DNA, 15 bp, Homo sapiens
ttggtagaagaaggg

SEQ ID NO: 38783 - DNA, 15 bp, Homo sapiens
cttggtagaagaagg

SEQ ID NO: 38784 - DNA, 15 bp, Homo sapiens
ccttggtagaagaag

SEQ ID NO: 38785 - DNA, 15 bp, Homo sapiens
accttggtagaagaa

SEQ ID NO: 38786 - DNA, 15 bp, Homo sapiens
taccttggtagaaga

SEQ ID NO: 38787 - DNA, 15 bp, Homo sapiens
ctaccttggtagaag

SEQ ID NO: 38788 - DNA, 15 bp, Homo sapiens
cctaccttggtagaa

SEQ ID NO: 38789 - DNA, 15 bp, Homo sapiens
acctaccttggtaga

SEQ ID NO: 38790 - DNA, 15 bp, Homo sapiens
cacctaccttggtag

SEQ ID NO: 38791 - DNA, 15 bp, Homo sapiens
acacctaccttggta

SEQ ID NO: 38792 - DNA, 15 bp, Homo sapiens
gacacctaccttggt

SEQ ID NO: 38793 - DNA, 15 bp, Homo sapiens
ggacacctaccttgg

SEQ ID NO: 38794 - DNA, 15 bp, Homo sapiens
gggacacctaccttg

SEQ ID NO: 38795 - DNA, 15 bp, Homo sapiens
ggggacacctacctt

SEQ ID NO: 38796 - DNA, 15 bp, Homo sapiens
aggggacacctacct

SEQ ID NO: 38797 - DNA, 15 bp, Homo sapiens
caggggacacctacc

SEQ ID NO: 38798 - DNA, 15 bp, Homo sapiens
gcaggggacacctac

SEQ ID NO: 38799 - DNA, 15 bp, Homo sapiens
ggcaggggacaccta

SEQ ID NO: 38800 - DNA, 15 bp, Homo sapiens
gggcaggggacacct

SEQ ID NO: 38801 - DNA, 15 bp, Homo sapiens
ggggcaggggacacc

SEQ ID NO: 38802 - DNA, 15 bp, Homo sapiens
gggggcaggggacac

SEQ ID NO: 38803 - DNA, 15 bp, Homo sapiens
ggggggcaggggaca

SEQ ID NO: 38804 - DNA, 15 bp, Homo sapiens
tggggggcaggggac

SEQ ID NO: 38805 - DNA, 15 bp, Homo sapiens
ctggggggcagggga

SEQ ID NO: 38806 - DNA, 15 bp, Homo sapiens
cctggggggcagggg

SEQ ID NO: 38807 - DNA, 15 bp, Homo sapiens
ccctggggggcaggg

SEQ ID NO: 38808 - DNA, 15 bp, Homo sapiens
tccctggggggcagg

SEQ ID NO: 38809 - DNA, 15 bp, Homo sapiens
ttccctggggggcag

SEQ ID NO: 38810 - DNA, 15 bp, Homo sapiens
cttccctggggggca

SEQ ID NO: 38811 - DNA, 15 bp, Homo sapiens
tcttccctggggggc

SEQ ID NO: 38812 - DNA, 15 bp, Homo sapiens
atcttccctgggggg

SEQ ID NO: 38813 - DNA, 15 bp, Homo sapiens
aatcttccctggggg

SEQ ID NO: 38814 - DNA, 15 bp, Homo sapiens
gaatcttccctgggg

SEQ ID NO: 38815 - DNA, 15 bp, Homo sapiens
cgaatcttccctggg

SEQ ID NO: 38816 - DNA, 15 bp, Homo sapiens
tcgaatcttccctgg

SEQ ID NO: 38817 - DNA, 15 bp, Homo sapiens
ctcgaatcttccctg

SEQ ID NO: 38818 - DNA, 15 bp, Homo sapiens
tctcgaatcttccct

SEQ ID NO: 38819 - DNA, 15 bp, Homo sapiens
gtctcgaatcttccc

SEQ ID NO: 38820 - DNA, 15 bp, Homo sapiens
tgtctcgaatcttcc

SEQ ID NO: 38821 - DNA, 15 bp, Homo sapiens
ttgtctcgaatcttc

SEQ ID NO: 38822 - DNA, 15 bp, Homo sapiens
cttgtctcgaatctt

SEQ ID NO: 38823 - DNA, 15 bp, Homo sapiens
ccttgtctcgaatct

SEQ ID NO: 38824 - DNA, 15 bp, Homo sapiens
tccttgtctcgaatc

SEQ ID NO: 38825 - DNA, 15 bp, Homo sapiens
ctccttgtctcgaat

SEQ ID NO: 38826 - DNA, 15 bp, Homo sapiens
cctccttgtctcgaa

SEQ ID NO: 38827 - DNA, 15 bp, Homo sapiens
tcctccttgtctcga

SEQ ID NO: 38828 - DNA, 15 bp, Homo sapiens
ttcctccttgtctcg

SEQ ID NO: 38829 - DNA, 15 bp, Homo sapiens
cttcctccttgtctc

SEQ ID NO: 38830 - DNA, 15 bp, Homo sapiens
ccttcctccttgtct

SEQ ID NO: 38831 - DNA, 15 bp, Homo sapiens
tccttcctccttgtc

SEQ ID NO: 38832 - DNA, 15 bp, Homo sapiens
ttccttcctccttgt

SEQ ID NO: 38833 - DNA, 15 bp, Homo sapiens
attccttcctccttg

SEQ ID NO: 38834 - DNA, 15 bp, Homo sapiens
aattccttcctcctt

SEQ ID NO: 38835 - DNA, 15 bp, Homo sapiens
gaattccttcctcct

SEQ ID NO: 38836 - DNA, 15 bp, Homo sapiens
tgaattccttcctcc

SEQ ID NO: 38837 - DNA, 15 bp, Homo sapiens
ctgaattccttcctc

SEQ ID NO: 38838 - DNA, 15 bp, Homo sapiens
gctgaattccttcct

SEQ ID NO: 38839 - DNA, 15 bp, Homo sapiens
ggctgaattccttcc

SEQ ID NO: 38840 - DNA, 15 bp, Homo sapiens
aggctgaattccttc

SEQ ID NO: 38841 - DNA, 15 bp, Homo sapiens
aaggctgaattcctt

SEQ ID NO: 38842 - DNA, 15 bp, Homo sapiens
aaaggctgaattcct

SEQ ID NO: 38843 - DNA, 15 bp, Homo sapiens
caaaggctgaattcc

SEQ ID NO: 38844 - DNA, 15 bp, Homo sapiens
tcaaaggctgaattc

SEQ ID NO: 38845 - DNA, 15 bp, Homo sapiens
atcaaaggctgaatt

SEQ ID NO: 38846 - DNA, 15 bp, Homo sapiens
catcaaaggctgaat

SEQ ID NO: 38847 - DNA, 15 bp, Homo sapiens
acatcaaaggctgaa

SEQ ID NO: 38848 - DNA, 15 bp, Homo sapiens
tacatcaaaggctga

SEQ ID NO: 38849 - DNA, 15 bp, Homo sapiens
ctacatcaaaggctg

SEQ ID NO: 38850 - DNA, 15 bp, Homo sapiens
gctacatcaaaggct

SEQ ID NO: 38851 - DNA, 15 bp, Homo sapiens
cgctacatcaaaggc

SEQ ID NO: 38852 - DNA, 15 bp, Homo sapiens
gcgctacatcaaagg

SEQ ID NO: 38853 - DNA, 15 bp, Homo sapiens
tgcgctacatcaaag

SEQ ID NO: 38854 - DNA, 15 bp, Homo sapiens
ctgcgctacatcaaa

SEQ ID NO: 38855 - DNA, 15 bp, Homo sapiens
tctgcgctacatcaa

SEQ ID NO: 38856 - DNA, 15 bp, Homo sapiens
ctctgcgctacatca

SEQ ID NO: 38857 - DNA, 15 bp, Homo sapiens
gctctgcgctacatc

SEQ ID NO: 38858 - DNA, 15 bp, Homo sapiens
ggctctgcgctacat

SEQ ID NO: 38859 - DNA, 15 bp, Homo sapiens
gggctctgcgctaca

SEQ ID NO: 38860 - DNA, 15 bp, Homo sapiens
ggggctctgcgctac

SEQ ID NO: 38861 - DNA, 15 bp, Homo sapiens
tggggctctgcgcta

SEQ ID NO: 38862 - DNA, 15 bp, Homo sapiens
ctggggctctgcgct

SEQ ID NO: 38863 - DNA, 15 bp, Homo sapiens
actggggctctgcgc

SEQ ID NO: 38864 - DNA, 15 bp, Homo sapiens
gactggggctctgcg

SEQ ID NO: 38865 - DNA, 15 bp, Homo sapiens
tgactggggctctgc

SEQ ID NO: 38866 - DNA, 15 bp, Homo sapiens
ctgactggggctctg

SEQ ID NO: 38867 - DNA, 15 bp, Homo sapiens
gctgactggggctct

SEQ ID NO: 38868 - DNA, 15 bp, Homo sapiens
ggctgactggggctc

SEQ ID NO: 38869 - DNA, 15 bp, Homo sapiens
tggctgactggggct

SEQ ID NO: 38870 - DNA, 15 bp, Homo sapiens
ttggctgactggggc

SEQ ID NO: 38871 - DNA, 15 bp, Homo sapiens
cttggctgactgggg

SEQ ID NO: 38872 - DNA, 15 bp, Homo sapiens
gcttggctgactggg

SEQ ID NO: 38873 - DNA, 15 bp, Homo sapiens
agcttggctgactgg

SEQ ID NO: 38874 - DNA, 15 bp, Homo sapiens
cagcttggctgactg

SEQ ID NO: 38875 - DNA, 15 bp, Homo sapiens
ccagcttggctgact

SEQ ID NO: 38876 - DNA, 15 bp, Homo sapiens
cccagcttggctgac

SEQ ID NO: 38877 - DNA, 15 bp, Homo sapiens
acccagcttggctga

SEQ ID NO: 38878 - DNA, 15 bp, Homo sapiens
gacccagcttggctg

SEQ ID NO: 38879 - DNA, 15 bp, Homo sapiens
tgacccagcttggct

SEQ ID NO: 38880 - DNA, 15 bp, Homo sapiens
ctgacccagcttggc

SEQ ID NO: 38881 - DNA, 15 bp, Homo sapiens
gctgacccagcttgg

SEQ ID NO: 38882 - DNA, 15 bp, Homo sapiens
agctgacccagcttg

SEQ ID NO: 38883 - DNA, 15 bp, Homo sapiens
cagctgacccagctt

SEQ ID NO: 38884 - DNA, 15 bp, Homo sapiens
ccagctgacccagct

SEQ ID NO: 38885 - DNA, 15 bp, Homo sapiens
cccagctgacccagc

SEQ ID NO: 38886 - DNA, 15 bp, Homo sapiens
tcccagctgacccag

SEQ ID NO: 38887 - DNA, 15 bp, Homo sapiens
ctcccagctgaccca

SEQ ID NO: 38888 - DNA, 15 bp, Homo sapiens
cctcccagctgaccc

SEQ ID NO: 38889 - DNA, 15 bp, Homo sapiens
gcctcccagctgacc

SEQ ID NO: 38890 - DNA, 15 bp, Homo sapiens
tgcctcccagctgac

SEQ ID NO: 38891 - DNA, 15 bp, Homo sapiens
ctgcctcccagctga

SEQ ID NO: 38892 - DNA, 15 bp, Homo sapiens
gctgcctcccagctg

SEQ ID NO: 38893 - DNA, 15 bp, Homo sapiens
agctgcctcccagct

SEQ ID NO: 38894 - DNA, 15 bp, Homo sapiens
cagctgcctcccagc

SEQ ID NO: 38895 - DNA, 15 bp, Homo sapiens
acagctgcctcccag

SEQ ID NO: 38896 - DNA, 15 bp, Homo sapiens
cacagctgcctccca

SEQ ID NO: 38897 - DNA, 15 bp, Homo sapiens
ccacagctgcctccc

SEQ ID NO: 38898 - DNA, 15 bp, Homo sapiens
accacagctgcctcc

SEQ ID NO: 38899 - DNA, 15 bp, Homo sapiens
caccacagctgcctc

SEQ ID NO: 38900 - DNA, 15 bp, Homo sapiens
ccaccacagctgcct

SEQ ID NO: 38901 - DNA, 15 bp, Homo sapiens
cccaccacagctgcc

SEQ ID NO: 38902 - DNA, 15 bp, Homo sapiens
ccccaccacagctgc

SEQ ID NO: 38903 - DNA, 15 bp, Homo sapiens
tccccaccacagctg

SEQ ID NO: 38904 - DNA, 15 bp, Homo sapiens
ctccccaccacagct

SEQ ID NO: 38905 - DNA, 15 bp, Homo sapiens
tctccccaccacagc

SEQ ID NO: 38906 - DNA, 15 bp, Homo sapiens
ctctccccaccacag

SEQ ID NO: 38907 - DNA, 15 bp, Homo sapiens
gctctccccaccaca

SEQ ID NO: 38908 - DNA, 15 bp, Homo sapiens
ggctctccccaccac

SEQ ID NO: 38909 - DNA, 15 bp, Homo sapiens
aggctctccccacca

SEQ ID NO: 38910 - DNA, 15 bp, Homo sapiens
caggctctccccacc

SEQ ID NO: 38911 - DNA, 15 bp, Homo sapiens
ccaggctctccccac

SEQ ID NO: 38912 - DNA, 15 bp, Homo sapiens
tccaggctctcccca

SEQ ID NO: 38913 - DNA, 15 bp, Homo sapiens
ctccaggctctcccc

SEQ ID NO: 38914 - DNA, 15 bp, Homo sapiens
gctccaggctctccc

SEQ ID NO: 38915 - DNA, 15 bp, Homo sapiens
ggctccaggctctcc

SEQ ID NO: 38916 - DNA, 15 bp, Homo sapiens
aggctccaggctctc

SEQ ID NO: 38917 - DNA, 15 bp, Homo sapiens
aaggctccaggctct

SEQ ID NO: 38918 - DNA, 15 bp, Homo sapiens
caaggctccaggctc

SEQ ID NO: 38919 - DNA, 15 bp, Homo sapiens
ccaaggctccaggct

SEQ ID NO: 38920 - DNA, 15 bp, Homo sapiens
cccaaggctccaggc

SEQ ID NO: 38921 - DNA, 15 bp, Homo sapiens
gcccaaggctccagg

SEQ ID NO: 38922 - DNA, 15 bp, Homo sapiens
tgcccaaggctccag

SEQ ID NO: 38923 - DNA, 15 bp, Homo sapiens
ctgcccaaggctcca

SEQ ID NO: 38924 - DNA, 15 bp, Homo sapiens
tctgcccaaggctcc

SEQ ID NO: 38925 - DNA, 15 bp, Homo sapiens
ttctgcccaaggctc

SEQ ID NO: 38926 - DNA, 15 bp, Homo sapiens
cttctgcccaaggct

SEQ ID NO: 38927 - DNA, 15 bp, Homo sapiens
ccttctgcccaaggc

SEQ ID NO: 38928 - DNA, 15 bp, Homo sapiens
cccttctgcccaagg

SEQ ID NO: 38929 - DNA, 15 bp, Homo sapiens
tcccttctgcccaag

SEQ ID NO: 38930 - DNA, 15 bp, Homo sapiens
ttcccttctgcccaa

SEQ ID NO: 38931 - DNA, 15 bp, Homo sapiens
cttcccttctgccca

SEQ ID NO: 38932 - DNA, 15 bp, Homo sapiens
tcttcccttctgccc

SEQ ID NO: 38933 - DNA, 15 bp, Homo sapiens
ctcttcccttctgcc

SEQ ID NO: 38934 - DNA, 15 bp, Homo sapiens
tctcttcccttctgc

SEQ ID NO: 38935 - DNA, 15 bp, Homo sapiens
gtctcttcccttctg

SEQ ID NO: 38936 - DNA, 15 bp, Homo sapiens
tgtctcttcccttct

SEQ ID NO: 38937 - DNA, 15 bp, Homo sapiens
ctgtctcttcccttc

SEQ ID NO: 38938 - DNA, 15 bp, Homo sapiens
cctgtctcttccctt

SEQ ID NO: 38939 - DNA, 15 bp, Homo sapiens
ccctgtctcttccct

SEQ ID NO: 38940 - DNA, 15 bp, Homo sapiens
tccctgtctcttccc

SEQ ID NO: 38941 - DNA, 15 bp, Homo sapiens
gtccctgtctcttcc

SEQ ID NO: 38942 - DNA, 15 bp, Homo sapiens
ggtccctgtctcttc

SEQ ID NO: 38943 - DNA, 15 bp, Homo sapiens
gggtccctgtctctt

SEQ ID NO: 38944 - DNA, 15 bp, Homo sapiens
ggggtccctgtctct

SEQ ID NO: 38945 - DNA, 15 bp, Homo sapiens
tggggtccctgtctc

SEQ ID NO: 38946 - DNA, 15 bp, Homo sapiens
gtggggtccctgtct

SEQ ID NO: 38947 - DNA, 15 bp, Homo sapiens
ggtggggtccctgtc

SEQ ID NO: 38948 - DNA, 15 bp, Homo sapiens
aggtggggtccctgt

SEQ ID NO: 38949 - DNA, 15 bp, Homo sapiens
caggtggggtccctg

SEQ ID NO: 38950 - DNA, 15 bp, Homo sapiens
tcaggtggggtccct

SEQ ID NO: 38951 - DNA, 15 bp, Homo sapiens
atcaggtggggtccc

SEQ ID NO: 38952 - DNA, 15 bp, Homo sapiens
gatcaggtggggtcc

SEQ ID NO: 38953 - DNA, 15 bp, Homo sapiens
ggatcaggtggggtc

SEQ ID NO: 38954 - DNA, 15 bp, Homo sapiens
tggatcaggtggggt

SEQ ID NO: 38955 - DNA, 15 bp, Homo sapiens
ctggatcaggtgggg

SEQ ID NO: 38956 - DNA, 15 bp, Homo sapiens
cctggatcaggtggg

SEQ ID NO: 38957 - DNA, 15 bp, Homo sapiens
gcctggatcaggtgg

SEQ ID NO: 38958 - DNA, 15 bp, Homo sapiens
agcctggatcaggtg

SEQ ID NO: 38959 - DNA, 15 bp, Homo sapiens
gagcctggatcaggt

SEQ ID NO: 38960 - DNA, 15 bp, Homo sapiens
agagcctggatcagg

SEQ ID NO: 38961 - DNA, 15 bp, Homo sapiens
gagagcctggatcag

SEQ ID NO: 38962 - DNA, 15 bp, Homo sapiens
agagagcctggatca

SEQ ID NO: 38963 - DNA, 15 bp, Homo sapiens
aagagagcctggatc

SEQ ID NO: 38964 - DNA, 15 bp, Homo sapiens
gaagagagcctggat

SEQ ID NO: 38965 - DNA, 15 bp, Homo sapiens
ggaagagagcctgga

SEQ ID NO: 38966 - DNA, 15 bp, Homo sapiens
gggaagagagcctgg

SEQ ID NO: 38967 - DNA, 15 bp, Homo sapiens
tgggaagagagcctg

SEQ ID NO: 38968 - DNA, 15 bp, Homo sapiens
gtgggaagagagcct

SEQ ID NO: 38969 - DNA, 15 bp, Homo sapiens
tgtgggaagagagcc

SEQ ID NO: 38970 - DNA, 15 bp, Homo sapiens
ctgtgggaagagagc

SEQ ID NO: 38971 - DNA, 15 bp, Homo sapiens
gctgtgggaagagag

SEQ ID NO: 38972 - DNA, 15 bp, Homo sapiens
ggctgtgggaagaga

SEQ ID NO: 38973 - DNA, 15 bp, Homo sapiens
tggctgtgggaagag

SEQ ID NO: 38974 - DNA, 15 bp, Homo sapiens
ctggctgtgggaaga

SEQ ID NO: 38975 - DNA, 15 bp, Homo sapiens
cctggctgtgggaag

SEQ ID NO: 38976 - DNA, 15 bp, Homo sapiens
gcctggctgtgggaa

SEQ ID NO: 38977 - DNA, 15 bp, Homo sapiens
ggcctggctgtggga

SEQ ID NO: 38978 - DNA, 15 bp, Homo sapiens
gggcctggctgtggg

SEQ ID NO: 38979 - DNA, 15 bp, Homo sapiens
tgggcctggctgtgg

SEQ ID NO: 38980 - DNA, 15 bp, Homo sapiens
ctgggcctggctgtg

SEQ ID NO: 38981 - DNA, 15 bp, Homo sapiens
tctgggcctggctgt

SEQ ID NO: 38982 - DNA, 15 bp, Homo sapiens
ctctgggcctggctg

SEQ ID NO: 38983 - DNA, 15 bp, Homo sapiens
tctctgggcctggct

SEQ ID NO: 38984 - DNA, 15 bp, Homo sapiens
ctctctgggcctggc

SEQ ID NO: 38985 - DNA, 15 bp, Homo sapiens
gctctctgggcctgg

SEQ ID NO: 38986 - DNA, 15 bp, Homo sapiens
agctctctgggcctg

SEQ ID NO: 38987 - DNA, 15 bp, Homo sapiens
gagctctctgggcct

SEQ ID NO: 38988 - DNA, 15 bp, Homo sapiens
tgagctctctgggcc

SEQ ID NO: 38989 - DNA, 15 bp, Homo sapiens
ctgagctctctgggc

SEQ ID NO: 38990 - DNA, 15 bp, Homo sapiens
actgagctctctggg

SEQ ID NO: 38991 - DNA, 15 bp, Homo sapiens
cactgagctctctgg

SEQ ID NO: 38992 - DNA, 15 bp, Homo sapiens
acactgagctctctg

SEQ ID NO: 38993 - DNA, 15 bp, Homo sapiens
gacactgagctctct

SEQ ID NO: 38994 - DNA, 15 bp, Homo sapiens
ggacactgagctctc

SEQ ID NO: 38995 - DNA, 15 bp, Homo sapiens
gggacactgagctct

SEQ ID NO: 38996 - DNA, 15 bp, Homo sapiens
agggacactgagctc

SEQ ID NO: 38997 - DNA, 15 bp, Homo sapiens
gagggacactgagct

SEQ ID NO: 38998 - DNA, 15 bp, Homo sapiens
ggagggacactgagc

SEQ ID NO: 38999 - DNA, 15 bp, Homo sapiens
aggagggacactgag

SEQ ID NO: 39000 - DNA, 15 bp, Homo sapiens
caggagggacactga

SEQ ID NO: 39001 - DNA, 15 bp, Homo sapiens
gcaggagggacactg

SEQ ID NO: 39002 - DNA, 15 bp, Homo sapiens
tgcaggagggacact

SEQ ID NO: 39003 - DNA, 15 bp, Homo sapiens
ctgcaggagggacac

SEQ ID NO: 39004 - DNA, 15 bp, Homo sapiens
cctgcaggagggaca

SEQ ID NO: 39005 - DNA, 15 bp, Homo sapiens
ccctgcaggagggac

SEQ ID NO: 39006 - DNA, 15 bp, Homo sapiens
tccctgcaggaggga

SEQ ID NO: 39007 - DNA, 15 bp, Homo sapiens
ctccctgcaggaggg

SEQ ID NO: 39008 - DNA, 15 bp, Homo sapiens
gctccctgcaggagg

SEQ ID NO: 39009 - DNA, 15 bp, Homo sapiens
ggctccctgcaggag

SEQ ID NO: 39010 - DNA, 15 bp, Homo sapiens
gggctccctgcagga

SEQ ID NO: 39011 - DNA, 15 bp, Homo sapiens
cgggctccctgcagg

SEQ ID NO: 39012 - DNA, 15 bp, Homo sapiens
gcgggctccctgcag

SEQ ID NO: 39013 - DNA, 15 bp, Homo sapiens
ggcgggctccctgca

SEQ ID NO: 39014 - DNA, 15 bp, Homo sapiens
gggcgggctccctgc

SEQ ID NO: 39015 - DNA, 15 bp, Homo sapiens
ggggcgggctccctg

SEQ ID NO: 39016 - DNA, 15 bp, Homo sapiens
aggggcgggctccct

SEQ ID NO: 39017 - DNA, 15 bp, Homo sapiens
aaggggcgggctccc

SEQ ID NO: 39018 - DNA, 15 bp, Homo sapiens
aaaggggcgggctcc

SEQ ID NO: 39019 - DNA, 15 bp, Homo sapiens
gaaaggggcgggctc

SEQ ID NO: 39020 - DNA, 15 bp, Homo sapiens
ggaaaggggcgggct

SEQ ID NO: 39021 - DNA, 15 bp, Homo sapiens
cggaaaggggcgggc

SEQ ID NO: 39022 - DNA, 15 bp, Homo sapiens
acggaaaggggcggg

SEQ ID NO: 39023 - DNA, 15 bp, Homo sapiens
aacggaaaggggcgg

SEQ ID NO: 39024 - DNA, 15 bp, Homo sapiens
aaacggaaaggggcg

SEQ ID NO: 39025 - DNA, 15 bp, Homo sapiens
aaaacggaaaggggc

SEQ ID NO: 39026 - DNA, 15 bp, Homo sapiens
caaaacggaaagggg

SEQ ID NO: 39027 - DNA, 15 bp, Homo sapiens
gcaaaacggaaaggg

SEQ ID NO: 39028 - DNA, 15 bp, Homo sapiens
agcaaaacggaaagg

SEQ ID NO: 39029 - DNA, 15 bp, Homo sapiens
cagcaaaacggaaag

SEQ ID NO: 39030 - DNA, 15 bp, Homo sapiens
ccagcaaaacggaaa

SEQ ID NO: 39031 - DNA, 15 bp, Homo sapiens
gccagcaaaacggaa

SEQ ID NO: 39032 - DNA, 15 bp, Homo sapiens
ggccagcaaaacgga

SEQ ID NO: 39033 - DNA, 15 bp, Homo sapiens
gggccagcaaaacgg

SEQ ID NO: 39034 - DNA, 15 bp, Homo sapiens
ggggccagcaaaacg

SEQ ID NO: 39035 - DNA, 15 bp, Homo sapiens
aggggccagcaaaac

SEQ ID NO: 39036 - DNA, 15 bp, Homo sapiens
gaggggccagcaaaa

SEQ ID NO: 39037 - DNA, 15 bp, Homo sapiens
agaggggccagcaaa

SEQ ID NO: 39038 - DNA, 15 bp, Homo sapiens
cagaggggccagcaa

SEQ ID NO: 39039 - DNA, 15 bp, Homo sapiens
acagaggggccagca

SEQ ID NO: 39040 - DNA, 15 bp, Homo sapiens
cacagaggggccagc

SEQ ID NO: 39041 - DNA, 15 bp, Homo sapiens
tcacagaggggccag

SEQ ID NO: 39042 - DNA, 15 bp, Homo sapiens
ctcacagaggggcca

SEQ ID NO: 39043 - DNA, 15 bp, Homo sapiens
tctcacagaggggcc

SEQ ID NO: 39044 - DNA, 15 bp, Homo sapiens
atctcacagaggggc

SEQ ID NO: 39045 - DNA, 15 bp, Homo sapiens
aatctcacagagggg

SEQ ID NO: 39046 - DNA, 15 bp, Homo sapiens
aaatctcacagaggg

SEQ ID NO: 39047 - DNA, 15 bp, Homo sapiens
gaaatctcacagagg

SEQ ID NO: 39048 - DNA, 15 bp, Homo sapiens
ggaaatctcacagag

SEQ ID NO: 39049 - DNA, 15 bp, Homo sapiens
gggaaatctcacaga

SEQ ID NO: 39050 - DNA, 15 bp, Homo sapiens
cgggaaatctcacag

SEQ ID NO: 39051 - DNA, 15 bp, Homo sapiens
ccgggaaatctcaca

SEQ ID NO: 39052 - DNA, 15 bp, Homo sapiens
cccgggaaatctcac

SEQ ID NO: 39053 - DNA, 15 bp, Homo sapiens
ccccgggaaatctca

SEQ ID NO: 39054 - DNA, 15 bp, Homo sapiens
gccccgggaaatctc

SEQ ID NO: 39055 - DNA, 15 bp, Homo sapiens
tgccccgggaaatct

SEQ ID NO: 39056 - DNA, 15 bp, Homo sapiens
gtgccccgggaaatc

SEQ ID NO: 39057 - DNA, 15 bp, Homo sapiens
ggtgccccgggaaat

SEQ ID NO: 39058 - DNA, 15 bp, Homo sapiens
gggtgccccgggaaa

SEQ ID NO: 39059 - DNA, 15 bp, Homo sapiens
tgggtgccccgggaa

SEQ ID NO: 39060 - DNA, 15 bp, Homo sapiens
gtgggtgccccggga

SEQ ID NO: 39061 - DNA, 15 bp, Homo sapiens
tgtgggtgccccggg

SEQ ID NO: 39062 - DNA, 15 bp, Homo sapiens
ttgtgggtgccccgg

SEQ ID NO: 39063 - DNA, 15 bp, Homo sapiens
gttgtgggtgccccg

SEQ ID NO: 39064 - DNA, 15 bp, Homo sapiens
agttgtgggtgcccc

SEQ ID NO: 39065 - DNA, 15 bp, Homo sapiens
aagttgtgggtgccc

SEQ ID NO: 39066 - DNA, 15 bp, Homo sapiens
gaagttgtgggtgcc

SEQ ID NO: 39067 - DNA, 15 bp, Homo sapiens
agaagttgtgggtgc

SEQ ID NO: 39068 - DNA, 15 bp, Homo sapiens
gagaagttgtgggtg

SEQ ID NO: 39069 - DNA, 15 bp, Homo sapiens
cgagaagttgtgggt

SEQ ID NO: 39070 - DNA, 15 bp, Homo sapiens
ccgagaagttgtggg

SEQ ID NO: 39071 - DNA, 15 bp, Homo sapiens
tccgagaagttgtgg

SEQ ID NO: 39072 - DNA, 15 bp, Homo sapiens
ctccgagaagttgtg

SEQ ID NO: 39073 - DNA, 15 bp, Homo sapiens
cctccgagaagttgt

SEQ ID NO: 39074 - DNA, 15 bp, Homo sapiens
tcctccgagaagttg

SEQ ID NO: 39075 - DNA, 15 bp, Homo sapiens
ctcctccgagaagtt

SEQ ID NO: 39076 - DNA, 15 bp, Homo sapiens
gctcctccgagaagt

SEQ ID NO: 39077 - DNA, 15 bp, Homo sapiens
agctcctccgagaag

SEQ ID NO: 39078 - DNA, 15 bp, Homo sapiens
gagctcctccgagaa

SEQ ID NO: 39079 - DNA, 15 bp, Homo sapiens
tgagctcctccgaga

SEQ ID NO: 39080 - DNA, 15 bp, Homo sapiens
ttgagctcctccgag

SEQ ID NO: 39081 - DNA, 15 bp, Homo sapiens
cttgagctcctccga

SEQ ID NO: 39082 - DNA, 15 bp, Homo sapiens
tcttgagctcctccg

SEQ ID NO: 39083 - DNA, 15 bp, Homo sapiens
atcttgagctcctcc

SEQ ID NO: 39084 - DNA, 15 bp, Homo sapiens
gatcttgagctcctc

SEQ ID NO: 39085 - DNA, 15 bp, Homo sapiens
cgatcttgagctcct

SEQ ID NO: 39086 - DNA, 15 bp, Homo sapiens
ccgatcttgagctcc

SEQ ID NO: 39087 - DNA, 15 bp, Homo sapiens
cccgatcttgagctc

SEQ ID NO: 39088 - DNA, 15 bp, Homo sapiens
ccccgatcttgagct

SEQ ID NO: 39089 - DNA, 15 bp, Homo sapiens
tccccgatcttgagc

SEQ ID NO: 39090 - DNA, 15 bp, Homo sapiens
ctccccgatcttgag

SEQ ID NO: 39091 - DNA, 15 bp, Homo sapiens
cctccccgatcttga

SEQ ID NO: 39092 - DNA, 15 bp, Homo sapiens
ccctccccgatcttg

SEQ ID NO: 39093 - DNA, 15 bp, Homo sapiens
accctccccgatctt

SEQ ID NO: 39094 - DNA, 15 bp, Homo sapiens
caccctccccgatct

SEQ ID NO: 39095 - DNA, 15 bp, Homo sapiens
ccaccctccccgatc

SEQ ID NO: 39096 - DNA, 15 bp, Homo sapiens
gccaccctccccgat

SEQ ID NO: 39097 - DNA, 15 bp, Homo sapiens
agccaccctccccga

SEQ ID NO: 39098 - DNA, 15 bp, Homo sapiens
aagccaccctccccg

SEQ ID NO: 39099 - DNA, 15 bp, Homo sapiens
aaagccaccctcccc

SEQ ID NO: 39100 - DNA, 15 bp, Homo sapiens
caaagccaccctccc

SEQ ID NO: 39101 - DNA, 15 bp, Homo sapiens
ccaaagccaccctcc

SEQ ID NO: 39102 - DNA, 15 bp, Homo sapiens
cccaaagccaccctc

SEQ ID NO: 39103 - DNA, 15 bp, Homo sapiens
acccaaagccaccct

SEQ ID NO: 39104 - DNA, 15 bp, Homo sapiens
cacccaaagccaccc

SEQ ID NO: 39105 - DNA, 15 bp, Homo sapiens
gcacccaaagccacc

SEQ ID NO: 39106 - DNA, 15 bp, Homo sapiens
cgcacccaaagccac

SEQ ID NO: 39107 - DNA, 15 bp, Homo sapiens
acgcacccaaagcca

SEQ ID NO: 39108 - DNA, 15 bp, Homo sapiens
cacgcacccaaagcc

SEQ ID NO: 39109 - DNA, 15 bp, Homo sapiens
acacgcacccaaagc

SEQ ID NO: 39110 - DNA, 15 bp, Homo sapiens
tacacgcacccaaag

SEQ ID NO: 39111 - DNA, 15 bp, Homo sapiens
gtacacgcacccaaa

SEQ ID NO: 39112 - DNA, 15 bp, Homo sapiens
ggtacacgcacccaa

SEQ ID NO: 39113 - DNA, 15 bp, Homo sapiens
cggtacacgcaccca

SEQ ID NO: 39114 - DNA, 15 bp, Homo sapiens
ccggtacacgcaccc

SEQ ID NO: 39115 - DNA, 15 bp, Homo sapiens
cccggtacacgcacc

SEQ ID NO: 39116 - DNA, 15 bp, Homo sapiens
gcccggtacacgcac

SEQ ID NO: 39117 - DNA, 15 bp, Homo sapiens
cgcccggtacacgca

SEQ ID NO: 39118 - DNA, 15 bp, Homo sapiens
ccgcccggtacacgc

SEQ ID NO: 39119 - DNA, 15 bp, Homo sapiens
accgcccggtacacg

SEQ ID NO: 39120 - DNA, 15 bp, Homo sapiens
caccgcccggtacac

SEQ ID NO: 39121 - DNA, 15 bp, Homo sapiens
tcaccgcccggtaca

SEQ ID NO: 39122 - DNA, 15 bp, Homo sapiens
atcaccgcccggtac

SEQ ID NO: 39123 - DNA, 15 bp, Homo sapiens
catcaccgcccggta

SEQ ID NO: 39124 - DNA, 15 bp, Homo sapiens
tcatcaccgcccggt

SEQ ID NO: 39125 - DNA, 15 bp, Homo sapiens
ctcatcaccgcccgg

SEQ ID NO: 39126 - DNA, 15 bp, Homo sapiens
cctcatcaccgcccg

SEQ ID NO: 39127 - DNA, 15 bp, Homo sapiens
tcctcatcaccgccc

SEQ ID NO: 39128 - DNA, 15 bp, Homo sapiens
ttcctcatcaccgcc

SEQ ID NO: 39129 - DNA, 15 bp, Homo sapiens
gttcctcatcaccgc

SEQ ID NO: 39130 - DNA, 15 bp, Homo sapiens
tgttcctcatcaccg

SEQ ID NO: 39131 - DNA, 15 bp, Homo sapiens
gtgttcctcatcacc

SEQ ID NO: 39132 - DNA, 15 bp, Homo sapiens
cgtgttcctcatcac

SEQ ID NO: 39133 - DNA, 15 bp, Homo sapiens
ccgtgttcctcatca

SEQ ID NO: 39134 - DNA, 15 bp, Homo sapiens
accgtgttcctcatc

SEQ ID NO: 39135 - DNA, 15 bp, Homo sapiens
caccgtgttcctcat

SEQ ID NO: 39136 - DNA, 15 bp, Homo sapiens
acaccgtgttcctca

SEQ ID NO: 39137 - DNA, 15 bp, Homo sapiens
tacaccgtgttcctc

SEQ ID NO: 39138 - DNA, 15 bp, Homo sapiens
atacaccgtgttcct

SEQ ID NO: 39139 - DNA, 15 bp, Homo sapiens
catacaccgtgttcc

SEQ ID NO: 39140 - DNA, 15 bp, Homo sapiens
gcatacaccgtgttc

SEQ ID NO: 39141 - DNA, 15 bp, Homo sapiens
agcatacaccgtgtt

SEQ ID NO: 39142 - DNA, 15 bp, Homo sapiens
cagcatacaccgtgt

SEQ ID NO: 39143 - DNA, 15 bp, Homo sapiens
acagcatacaccgtg

SEQ ID NO: 39144 - DNA, 15 bp, Homo sapiens
cacagcatacaccgt

SEQ ID NO: 39145 - DNA, 15 bp, Homo sapiens
tcacagcatacaccg

SEQ ID NO: 39146 - DNA, 15 bp, Homo sapiens
ttcacagcatacacc

SEQ ID NO: 39147 - DNA, 15 bp, Homo sapiens
cttcacagcatacac

SEQ ID NO: 39148 - DNA, 15 bp, Homo sapiens
tcttcacagcataca

SEQ ID NO: 39149 - DNA, 15 bp, Homo sapiens
ctcttcacagcatac

SEQ ID NO: 39150 - DNA, 15 bp, Homo sapiens
cctcttcacagcata

SEQ ID NO: 39151 - DNA, 15 bp, Homo sapiens
gcctcttcacagcat

SEQ ID NO: 39152 - DNA, 15 bp, Homo sapiens
agcctcttcacagca

SEQ ID NO: 39153 - DNA, 15 bp, Homo sapiens
cagcctcttcacagc

SEQ ID NO: 39154 - DNA, 15 bp, Homo sapiens
tcagcctcttcacag

SEQ ID NO: 39155 - DNA, 15 bp, Homo sapiens
ttcagcctcttcaca

SEQ ID NO: 39156 - DNA, 15 bp, Homo sapiens
cttcagcctcttcac

SEQ ID NO: 39157 - DNA, 15 bp, Homo sapiens
ccttcagcctcttca

SEQ ID NO: 39158 - DNA, 15 bp, Homo sapiens
tccttcagcctcttc

SEQ ID NO: 39159 - DNA, 15 bp, Homo sapiens
ctccttcagcctctt

SEQ ID NO: 39160 - DNA, 15 bp, Homo sapiens
cctccttcagcctct

SEQ ID NO: 39161 - DNA, 15 bp, Homo sapiens
acctccttcagcctc

SEQ ID NO: 39162 - DNA, 15 bp, Homo sapiens
cacctccttcagcct

SEQ ID NO: 39163 - DNA, 15 bp, Homo sapiens
tcacctccttcagcc

SEQ ID NO: 39164 - DNA, 15 bp, Homo sapiens
ctcacctccttcagc

SEQ ID NO: 39165 - DNA, 15 bp, Homo sapiens
actcacctccttcag

SEQ ID NO: 39166 - DNA, 15 bp, Homo sapiens
cactcacctccttca

SEQ ID NO: 39167 - DNA, 15 bp, Homo sapiens
acactcacctccttc

SEQ ID NO: 39168 - DNA, 15 bp, Homo sapiens
gacactcacctcctt

SEQ ID NO: 39169 - DNA, 15 bp, Homo sapiens
cgacactcacctcct

SEQ ID NO: 39170 - DNA, 15 bp, Homo sapiens
gcgacactcacctcc

SEQ ID NO: 39171 - DNA, 15 bp, Homo sapiens
tgcgacactcacctc

SEQ ID NO: 39172 - DNA, 15 bp, Homo sapiens
gtgcgacactcacct

SEQ ID NO: 39173 - DNA, 15 bp, Homo sapiens
ggtgcgacactcacc

SEQ ID NO: 39174 - DNA, 15 bp, Homo sapiens
gggtgcgacactcac

SEQ ID NO: 39175 - DNA, 15 bp, Homo sapiens
agggtgcgacactca

SEQ ID NO: 39176 - DNA, 15 bp, Homo sapiens
cagggtgcgacactc

SEQ ID NO: 39177 - DNA, 15 bp, Homo sapiens
ccagggtgcgacact

SEQ ID NO: 39178 - DNA, 15 bp, Homo sapiens
gccagggtgcgacac

SEQ ID NO: 39179 - DNA, 15 bp, Homo sapiens
tgccagggtgcgaca

SEQ ID NO: 39180 - DNA, 15 bp, Homo sapiens
ctgccagggtgcgac

SEQ ID NO: 39181 - DNA, 15 bp, Homo sapiens
cctgccagggtgcga

SEQ ID NO: 39182 - DNA, 15 bp, Homo sapiens
ccctgccagggtgcg

SEQ ID NO: 39183 - DNA, 15 bp, Homo sapiens
tccctgccagggtgc

SEQ ID NO: 39184 - DNA, 15 bp, Homo sapiens
gtccctgccagggtg

SEQ ID NO: 39185 - DNA, 15 bp, Homo sapiens
ggtccctgccagggt

SEQ ID NO: 39186 - DNA, 15 bp, Homo sapiens
gggtccctgccaggg

SEQ ID NO: 39187 - DNA, 15 bp, Homo sapiens
agggtccctgccagg

SEQ ID NO: 39188 - DNA, 15 bp, Homo sapiens
cagggtccctgccag

SEQ ID NO: 39189 - DNA, 15 bp, Homo sapiens
ccagggtccctgcca

SEQ ID NO: 39190 - DNA, 15 bp, Homo sapiens
tccagggtccctgcc

SEQ ID NO: 39191 - DNA, 15 bp, Homo sapiens
ttccagggtccctgc

SEQ ID NO: 39192 - DNA, 15 bp, Homo sapiens
cttccagggtccctg

SEQ ID NO: 39193 - DNA, 15 bp, Homo sapiens
ccttccagggtccct

SEQ ID NO: 39194 - DNA, 15 bp, Homo sapiens
gccttccagggtccc

SEQ ID NO: 39195 - DNA, 15 bp, Homo sapiens
ggccttccagggtcc

SEQ ID NO: 39196 - DNA, 15 bp, Homo sapiens
tggccttccagggtc

SEQ ID NO: 39197 - DNA, 15 bp, Homo sapiens
atggccttccagggt

SEQ ID NO: 39198 - DNA, 15 bp, Homo sapiens
gatggccttccaggg

SEQ ID NO: 39199 - DNA, 15 bp, Homo sapiens
tgatggccttccagg

SEQ ID NO: 39200 - DNA, 15 bp, Homo sapiens
ctgatggccttccag

SEQ ID NO: 39201 - DNA, 15 bp, Homo sapiens
tctgatggccttcca

SEQ ID NO: 39202 - DNA, 15 bp, Homo sapiens
atctgatggccttcc

SEQ ID NO: 39203 - DNA, 15 bp, Homo sapiens
tatctgatggccttc

SEQ ID NO: 39204 - DNA, 15 bp, Homo sapiens
ttatctgatggcctt

SEQ ID NO: 39205 - DNA, 15 bp, Homo sapiens
gttatctgatggcct

SEQ ID NO: 39206 - DNA, 15 bp, Homo sapiens
ggttatctgatggcc

SEQ ID NO: 39207 - DNA, 15 bp, Homo sapiens
gggttatctgatggc

SEQ ID NO: 39208 - DNA, 15 bp, Homo sapiens
agggttatctgatgg

SEQ ID NO: 39209 - DNA, 15 bp, Homo sapiens
gagggttatctgatg

SEQ ID NO: 39210 - DNA, 15 bp, Homo sapiens
tgagggttatctgat

SEQ ID NO: 39211 - DNA, 15 bp, Homo sapiens
gtgagggttatctga

SEQ ID NO: 39212 - DNA, 15 bp, Homo sapiens
ggtgagggttatctg

SEQ ID NO: 39213 - DNA, 15 bp, Homo sapiens
tggtgagggttatct

SEQ ID NO: 39214 - DNA, 15 bp, Homo sapiens
gtggtgagggttatc

SEQ ID NO: 39215 - DNA, 15 bp, Homo sapiens
agtggtgagggttat

SEQ ID NO: 39216 - DNA, 15 bp, Homo sapiens
aagtggtgagggtta

SEQ ID NO: 39217 - DNA, 15 bp, Homo sapiens
gaagtggtgagggtt

SEQ ID NO: 39218 - DNA, 15 bp, Homo sapiens
agaagtggtgagggt

SEQ ID NO: 39219 - DNA, 15 bp, Homo sapiens
gagaagtggtgaggg

SEQ ID NO: 39220 - DNA, 15 bp, Homo sapiens
ggagaagtggtgagg

SEQ ID NO: 39221 - DNA, 15 bp, Homo sapiens
tggagaagtggtgag

SEQ ID NO: 39222 - DNA, 15 bp, Homo sapiens
ctggagaagtggtga

SEQ ID NO: 39223 - DNA, 15 bp, Homo sapiens
gctggagaagtggtg

SEQ ID NO: 39224 - DNA, 15 bp, Homo sapiens
ggctggagaagtggt

SEQ ID NO: 39225 - DNA, 15 bp, Homo sapiens
aggctggagaagtgg

SEQ ID NO: 39226 - DNA, 15 bp, Homo sapiens
aaggctggagaagtg

SEQ ID NO: 39227 - DNA, 15 bp, Homo sapiens
aaaggctggagaagt

SEQ ID NO: 39228 - DNA, 15 bp, Homo sapiens
gaaaggctggagaag

SEQ ID NO: 39229 - DNA, 15 bp, Homo sapiens
ggaaaggctggagaa

SEQ ID NO: 39230 - DNA, 15 bp, Homo sapiens
gggaaaggctggaga

SEQ ID NO: 39231 - DNA, 15 bp, Homo sapiens
ggggaaaggctggag

SEQ ID NO: 39232 - DNA, 15 bp, Homo sapiens
gggggaaaggctgga

SEQ ID NO: 39233 - DNA, 15 bp, Homo sapiens
agggggaaaggctgg

SEQ ID NO: 39234 - DNA, 15 bp, Homo sapiens
gagggggaaaggctg

SEQ ID NO: 39235 - DNA, 15 bp, Homo sapiens
cgagggggaaaggct

SEQ ID NO: 39236 - DNA, 15 bp, Homo sapiens
gcgagggggaaaggc

SEQ ID NO: 39237 - DNA, 15 bp, Homo sapiens
agcgagggggaaagg

SEQ ID NO: 39238 - DNA, 15 bp, Homo sapiens
aagcgagggggaaag

SEQ ID NO: 39239 - DNA, 15 bp, Homo sapiens
gaagcgagggggaaa

SEQ ID NO: 39240 - DNA, 15 bp, Homo sapiens
ggaagcgagggggaa

SEQ ID NO: 39241 - DNA, 15 bp, Homo sapiens
gggaagcgaggggga

SEQ ID NO: 39242 - DNA, 15 bp, Homo sapiens
ggggaagcgaggggg

SEQ ID NO: 39243 - DNA, 15 bp, Homo sapiens
tggggaagcgagggg

SEQ ID NO: 39244 - DNA, 15 bp, Homo sapiens
gtggggaagcgaggg

SEQ ID NO: 39245 - DNA, 15 bp, Homo sapiens
tgtggggaagcgagg

SEQ ID NO: 39246 - DNA, 15 bp, Homo sapiens
gtgtggggaagcgag

SEQ ID NO: 39247 - DNA, 15 bp, Homo sapiens
tgtgtggggaagcga

SEQ ID NO: 39248 - DNA, 15 bp, Homo sapiens
ttgtgtggggaagcg

SEQ ID NO: 39249 - DNA, 15 bp, Homo sapiens
gttgtgtggggaagc

SEQ ID NO: 39250 - DNA, 15 bp, Homo sapiens
agttgtgtggggaag

SEQ ID NO: 39251 - DNA, 15 bp, Homo sapiens
gagttgtgtggggaa

SEQ ID NO: 39252 - DNA, 15 bp, Homo sapiens
ggagttgtgtgggga

SEQ ID NO: 39253 - DNA, 15 bp, Homo sapiens
aggagttgtgtgggg

SEQ ID NO: 39254 - DNA, 15 bp, Homo sapiens
aaggagttgtgtggg

SEQ ID NO: 39255 - DNA, 15 bp, Homo sapiens
gaaggagttgtgtgg

SEQ ID NO: 39256 - DNA, 15 bp, Homo sapiens
tgaaggagttgtgtg

SEQ ID NO: 39257 - DNA, 15 bp, Homo sapiens
ctgaaggagttgtgt

SEQ ID NO: 39258 - DNA, 15 bp, Homo sapiens
gctgaaggagttgtg

SEQ ID NO: 39259 - DNA, 15 bp, Homo sapiens
ggctgaaggagttgt

SEQ ID NO: 39260 - DNA, 15 bp, Homo sapiens
gggctgaaggagttg

SEQ ID NO: 39261 - DNA, 15 bp, Homo sapiens
agggctgaaggagtt

SEQ ID NO: 39262 - DNA, 15 bp, Homo sapiens
gagggctgaaggagt

SEQ ID NO: 39263 - DNA, 15 bp, Homo sapiens
tgagggctgaaggag

SEQ ID NO: 39264 - DNA, 15 bp, Homo sapiens
atgagggctgaagga

SEQ ID NO: 39265 - DNA, 15 bp, Homo sapiens
aatgagggctgaagg

SEQ ID NO: 39266 - DNA, 15 bp, Homo sapiens
gaatgagggctgaag

SEQ ID NO: 39267 - DNA, 15 bp, Homo sapiens
agaatgagggctgaa

SEQ ID NO: 39268 - DNA, 15 bp, Homo sapiens
cagaatgagggctga

SEQ ID NO: 39269 - DNA, 15 bp, Homo sapiens
ccagaatgagggctg

SEQ ID NO: 39270 - DNA, 15 bp, Homo sapiens
gccagaatgagggct

SEQ ID NO: 39271 - DNA, 15 bp, Homo sapiens
cgccagaatgagggc

SEQ ID NO: 39272 - DNA, 15 bp, Homo sapiens
acgccagaatgaggg

SEQ ID NO: 39273 - DNA, 15 bp, Homo sapiens
tacgccagaatgagg

SEQ ID NO: 39274 - DNA, 15 bp, Homo sapiens
ctacgccagaatgag

SEQ ID NO: 39275 - DNA, 15 bp, Homo sapiens
cctacgccagaatga

SEQ ID NO: 39276 - DNA, 15 bp, Homo sapiens
ccctacgccagaatg

SEQ ID NO: 39277 - DNA, 15 bp, Homo sapiens
accctacgccagaat

SEQ ID NO: 39278 - DNA, 15 bp, Homo sapiens
gaccctacgccagaa

SEQ ID NO: 39279 - DNA, 15 bp, Homo sapiens
ggaccctacgccaga

SEQ ID NO: 39280 - DNA, 15 bp, Homo sapiens
gggaccctacgccag

SEQ ID NO: 39281 - DNA, 15 bp, Homo sapiens
agggaccctacgcca

SEQ ID NO: 39282 - DNA, 15 bp, Homo sapiens
cagggaccctacgcc

SEQ ID NO: 39283 - DNA, 15 bp, Homo sapiens
ccagggaccctacgc

SEQ ID NO: 39284 - DNA, 15 bp, Homo sapiens
gccagggaccctacg

SEQ ID NO: 39285 - DNA, 15 bp, Homo sapiens
ggccagggaccctac

SEQ ID NO: 39286 - DNA, 15 bp, Homo sapiens
gggccagggacccta

SEQ ID NO: 39287 - DNA, 15 bp, Homo sapiens
ggggccagggaccct

SEQ ID NO: 39288 - DNA, 15 bp, Homo sapiens
aggggccagggaccc

SEQ ID NO: 39289 - DNA, 15 bp, Homo sapiens
aaggggccagggacc

SEQ ID NO: 39290 - DNA, 15 bp, Homo sapiens
caaggggccagggac

SEQ ID NO: 39291 - DNA, 15 bp, Homo sapiens
ccaaggggccaggga

SEQ ID NO: 39292 - DNA, 15 bp, Homo sapiens
accaaggggccaggg

SEQ ID NO: 39293 - DNA, 15 bp, Homo sapiens
caccaaggggccagg

SEQ ID NO: 39294 - DNA, 15 bp, Homo sapiens
ccaccaaggggccag

SEQ ID NO: 39295 - DNA, 15 bp, Homo sapiens
accaccaaggggcca

SEQ ID NO: 39296 - DNA, 15 bp, Homo sapiens
aaccaccaaggggcc

SEQ ID NO: 39297 - DNA, 15 bp, Homo sapiens
gaaccaccaaggggc

SEQ ID NO: 39298 - DNA, 15 bp, Homo sapiens
agaaccaccaagggg

SEQ ID NO: 39299 - DNA, 15 bp, Homo sapiens
cagaaccaccaaggg

SEQ ID NO: 39300 - DNA, 15 bp, Homo sapiens
ccagaaccaccaagg

SEQ ID NO: 39301 - DNA, 15 bp, Homo sapiens
cccagaaccaccaag

SEQ ID NO: 39302 - DNA, 15 bp, Homo sapiens
gcccagaaccaccaa

SEQ ID NO: 39303 - DNA, 15 bp, Homo sapiens
ggcccagaaccacca

SEQ ID NO: 39304 - DNA, 15 bp, Homo sapiens
aggcccagaaccacc

SEQ ID NO: 39305 - DNA, 15 bp, Homo sapiens
gaggcccagaaccac

SEQ ID NO: 39306 - DNA, 15 bp, Homo sapiens
cgaggcccagaacca

SEQ ID NO: 39307 - DNA, 15 bp, Homo sapiens
ccgaggcccagaacc

SEQ ID NO: 39308 - DNA, 15 bp, Homo sapiens
cccgaggcccagaac

SEQ ID NO: 39309 - DNA, 15 bp, Homo sapiens
acccgaggcccagaa

SEQ ID NO: 39310 - DNA, 15 bp, Homo sapiens
tacccgaggcccaga

SEQ ID NO: 39311 - DNA, 15 bp, Homo sapiens
ctacccgaggcccag

SEQ ID NO: 39312 - DNA, 15 bp, Homo sapiens
cctacccgaggccca

SEQ ID NO: 39313 - DNA, 15 bp, Homo sapiens
acctacccgaggccc

SEQ ID NO: 39314 - DNA, 15 bp, Homo sapiens
cacctacccgaggcc

SEQ ID NO: 39315 - DNA, 15 bp, Homo sapiens
ccacctacccgaggc

SEQ ID NO: 39316 - DNA, 15 bp, Homo sapiens
gccacctacccgagg

SEQ ID NO: 39317 - DNA, 15 bp, Homo sapiens
tgccacctacccgag

SEQ ID NO: 39318 - DNA, 15 bp, Homo sapiens
gtgccacctacccga

SEQ ID NO: 39319 - DNA, 15 bp, Homo sapiens
agtgccacctacccg

SEQ ID NO: 39320 - DNA, 15 bp, Homo sapiens
cagtgccacctaccc

SEQ ID NO: 39321 - DNA, 15 bp, Homo sapiens
ccagtgccacctacc

SEQ ID NO: 39322 - DNA, 15 bp, Homo sapiens
accagtgccacctac

SEQ ID NO: 39323 - DNA, 15 bp, Homo sapiens
caccagtgccaccta

SEQ ID NO: 39324 - DNA, 15 bp, Homo sapiens
ccaccagtgccacct

SEQ ID NO: 39325 - DNA, 15 bp, Homo sapiens
gccaccagtgccacc

SEQ ID NO: 39326 - DNA, 15 bp, Homo sapiens
ggccaccagtgccac

SEQ ID NO: 39327 - DNA, 15 bp, Homo sapiens
gggccaccagtgcca

SEQ ID NO: 39328 - DNA, 15 bp, Homo sapiens
cgggccaccagtgcc

SEQ ID NO: 39329 - DNA, 15 bp, Homo sapiens
tcgggccaccagtgc

SEQ ID NO: 39330 - DNA, 15 bp, Homo sapiens
ttcgggccaccagtg

SEQ ID NO: 39331 - DNA, 15 bp, Homo sapiens
cttcgggccaccagt

SEQ ID NO: 39332 - DNA, 15 bp, Homo sapiens
ccttcgggccaccag

SEQ ID NO: 39333 - DNA, 15 bp, Homo sapiens
gccttcgggccacca

SEQ ID NO: 39334 - DNA, 15 bp, Homo sapiens
ggccttcgggccacc

SEQ ID NO: 39335 - DNA, 15 bp, Homo sapiens
aggccttcgggccac

SEQ ID NO: 39336 - DNA, 15 bp, Homo sapiens
aaggccttcgggcca

SEQ ID NO: 39337 - DNA, 15 bp, Homo sapiens
gaaggccttcgggcc

SEQ ID NO: 39338 - DNA, 15 bp, Homo sapiens
cgaaggccttcgggc

SEQ ID NO: 39339 - DNA, 15 bp, Homo sapiens
gcgaaggccttcggg

SEQ ID NO: 39340 - DNA, 15 bp, Homo sapiens
agcgaaggccttcgg

SEQ ID NO: 39341 - DNA, 15 bp, Homo sapiens
aagcgaaggccttcg

SEQ ID NO: 39342 - DNA, 15 bp, Homo sapiens
gaagcgaaggccttc

SEQ ID NO: 39343 - DNA, 15 bp, Homo sapiens
cgaagcgaaggcctt

SEQ ID NO: 39344 - DNA, 15 bp, Homo sapiens
tcgaagcgaaggcct

SEQ ID NO: 39345 - DNA, 15 bp, Homo sapiens
ctcgaagcgaaggcc

SEQ ID NO: 39346 - DNA, 15 bp, Homo sapiens
tctcgaagcgaaggc

SEQ ID NO: 39347 - DNA, 15 bp, Homo sapiens
ctctcgaagcgaagg

SEQ ID NO: 39348 - DNA, 15 bp, Homo sapiens
gctctcgaagcgaag

SEQ ID NO: 39349 - DNA, 15 bp, Homo sapiens
ggctctcgaagcgaa

SEQ ID NO: 39350 - DNA, 15 bp, Homo sapiens
aggctctcgaagcga

SEQ ID NO: 39351 - DNA, 15 bp, Homo sapiens
gaggctctcgaagcg

SEQ ID NO: 39352 - DNA, 15 bp, Homo sapiens
tgaggctctcgaagc

SEQ ID NO: 39353 - DNA, 15 bp, Homo sapiens
gtgaggctctcgaag

SEQ ID NO: 39354 - DNA, 15 bp, Homo sapiens
cgtgaggctctcgaa

SEQ ID NO: 39355 - DNA, 15 bp, Homo sapiens
gcgtgaggctctcga

SEQ ID NO: 39356 - DNA, 15 bp, Homo sapiens
agcgtgaggctctcg

SEQ ID NO: 39357 - DNA, 15 bp, Homo sapiens
cagcgtgaggctctc

SEQ ID NO: 39358 - DNA, 15 bp, Homo sapiens
gcagcgtgaggctct

SEQ ID NO: 39359 - DNA, 15 bp, Homo sapiens
ggcagcgtgaggctc

SEQ ID NO: 39360 - DNA, 15 bp, Homo sapiens
gggcagcgtgaggct

SEQ ID NO: 39361 - DNA, 15 bp, Homo sapiens
cgggcagcgtgaggc

SEQ ID NO: 39362 - DNA, 15 bp, Homo sapiens
acgggcagcgtgagg

SEQ ID NO: 39363 - DNA, 15 bp, Homo sapiens
gacgggcagcgtgag

SEQ ID NO: 39364 - DNA, 15 bp, Homo sapiens
agacgggcagcgtga

SEQ ID NO: 39365 - DNA, 15 bp, Homo sapiens
aagacgggcagcgtg

SEQ ID NO: 39366 - DNA, 15 bp, Homo sapiens
gaagacgggcagcgt

SEQ ID NO: 39367 - DNA, 15 bp, Homo sapiens
ggaagacgggcagcg

SEQ ID NO: 39368 - DNA, 15 bp, Homo sapiens
gggaagacgggcagc

SEQ ID NO: 39369 - DNA, 15 bp, Homo sapiens
agggaagacgggcag

SEQ ID NO: 39370 - DNA, 15 bp, Homo sapiens
cagggaagacgggca

SEQ ID NO: 39371 - DNA, 15 bp, Homo sapiens
gcagggaagacgggc

SEQ ID NO: 39372 - DNA, 15 bp, Homo sapiens
ggcagggaagacggg

SEQ ID NO: 39373 - DNA, 15 bp, Homo sapiens
gggcagggaagacgg

SEQ ID NO: 39374 - DNA, 15 bp, Homo sapiens
ggggcagggaagacg

SEQ ID NO: 39375 - DNA, 15 bp, Homo sapiens
aggggcagggaagac

SEQ ID NO: 39376 - DNA, 15 bp, Homo sapiens
aaggggcagggaaga

SEQ ID NO: 39377 - DNA, 15 bp, Homo sapiens
gaaggggcagggaag

SEQ ID NO: 39378 - DNA, 15 bp, Homo sapiens
ggaaggggcagggaa

SEQ ID NO: 39379 - DNA, 15 bp, Homo sapiens
gggaaggggcaggga

SEQ ID NO: 39380 - DNA, 15 bp, Homo sapiens
ggggaaggggcaggg

SEQ ID NO: 39381 - DNA, 15 bp, Homo sapiens
gggggaaggggcagg

SEQ ID NO: 39382 - DNA, 15 bp, Homo sapiens
tgggggaaggggcag

SEQ ID NO: 39383 - DNA, 15 bp, Homo sapiens
gtgggggaaggggca

SEQ ID NO: 39384 - DNA, 15 bp, Homo sapiens
ggtgggggaaggggc

SEQ ID NO: 39385 - DNA, 15 bp, Homo sapiens
cggtgggggaagggg

SEQ ID NO: 39386 - DNA, 15 bp, Homo sapiens
gcggtgggggaaggg

SEQ ID NO: 39387 - DNA, 15 bp, Homo sapiens
tgcggtgggggaagg

SEQ ID NO: 39388 - DNA, 15 bp, Homo sapiens
gtgcggtgggggaag

SEQ ID NO: 39389 - DNA, 15 bp, Homo sapiens
ggtgcggtgggggaa

SEQ ID NO: 39390 - DNA, 15 bp, Homo sapiens
gggtgcggtggggga

SEQ ID NO: 39391 - DNA, 15 bp, Homo sapiens
agggtgcggtggggg

SEQ ID NO: 39392 - DNA, 15 bp, Homo sapiens
cagggtgcggtgggg

SEQ ID NO: 39393 - DNA, 15 bp, Homo sapiens
ccagggtgcggtggg

SEQ ID NO: 39394 - DNA, 15 bp, Homo sapiens
cccagggtgcggtgg

SEQ ID NO: 39395 - DNA, 15 bp, Homo sapiens
ccccagggtgcggtg

SEQ ID NO: 39396 - DNA, 15 bp, Homo sapiens
cccccagggtgcggt

SEQ ID NO: 39397 - DNA, 15 bp, Homo sapiens
gcccccagggtgcgg

SEQ ID NO: 39398 - DNA, 15 bp, Homo sapiens
agcccccagggtgcg

SEQ ID NO: 39399 - DNA, 15 bp, Homo sapiens
cagcccccagggtgc

SEQ ID NO: 39400 - DNA, 15 bp, Homo sapiens
gcagcccccagggtg

SEQ ID NO: 39401 - DNA, 15 bp, Homo sapiens
tgcagcccccagggt

SEQ ID NO: 39402 - DNA, 15 bp, Homo sapiens
ctgcagcccccaggg

SEQ ID NO: 39403 - DNA, 15 bp, Homo sapiens
tctgcagcccccagg

SEQ ID NO: 39404 - DNA, 15 bp, Homo sapiens
ttctgcagcccccag

SEQ ID NO: 39405 - DNA, 15 bp, Homo sapiens
gttctgcagccccca

SEQ ID NO: 39406 - DNA, 15 bp, Homo sapiens
cgttctgcagccccc

SEQ ID NO: 39407 - DNA, 15 bp, Homo sapiens
gcgttctgcagcccc

SEQ ID NO: 39408 - DNA, 15 bp, Homo sapiens
agcgttctgcagccc

SEQ ID NO: 39409 - DNA, 15 bp, Homo sapiens
cagcgttctgcagcc

SEQ ID NO: 39410 - DNA, 15 bp, Homo sapiens
tcagcgttctgcagc

SEQ ID NO: 39411 - DNA, 15 bp, Homo sapiens
gtcagcgttctgcag

SEQ ID NO: 39412 - DNA, 15 bp, Homo sapiens
ggtcagcgttctgca

SEQ ID NO: 39413 - DNA, 15 bp, Homo sapiens
aggtcagcgttctgc

SEQ ID NO: 39414 - DNA, 15 bp, Homo sapiens
caggtcagcgttctg

SEQ ID NO: 39415 - DNA, 15 bp, Homo sapiens
ccaggtcagcgttct

SEQ ID NO: 39416 - DNA, 15 bp, Homo sapiens
tccaggtcagcgttc

SEQ ID NO: 39417 - DNA, 15 bp, Homo sapiens
ctccaggtcagcgtt

SEQ ID NO: 39418 - DNA, 15 bp, Homo sapiens
actccaggtcagcgt

SEQ ID NO: 39419 - DNA, 15 bp, Homo sapiens
cactccaggtcagcg

SEQ ID NO: 39420 - DNA, 15 bp, Homo sapiens
ccactccaggtcagc

SEQ ID NO: 39421 - DNA, 15 bp, Homo sapiens
tccactccaggtcag

SEQ ID NO: 39422 - DNA, 15 bp, Homo sapiens
gtccactccaggtca

SEQ ID NO: 39423 - DNA, 15 bp, Homo sapiens
agtccactccaggtc

SEQ ID NO: 39424 - DNA, 15 bp, Homo sapiens
cagtccactccaggt

SEQ ID NO: 39425 - DNA, 15 bp, Homo sapiens
gcagtccactccagg

SEQ ID NO: 39426 - DNA, 15 bp, Homo sapiens
tgcagtccactccag

SEQ ID NO: 39427 - DNA, 15 bp, Homo sapiens
ctgcagtccactcca

SEQ ID NO: 39428 - DNA, 15 bp, Homo sapiens
actgcagtccactcc

SEQ ID NO: 39429 - DNA, 15 bp, Homo sapiens
cactgcagtccactc

SEQ ID NO: 39430 - DNA, 15 bp, Homo sapiens
tcactgcagtccact

SEQ ID NO: 39431 - DNA, 15 bp, Homo sapiens
ttcactgcagtccac

SEQ ID NO: 39432 - DNA, 15 bp, Homo sapiens
cttcactgcagtcca

SEQ ID NO: 39433 - DNA, 15 bp, Homo sapiens
gcttcactgcagtcc

SEQ ID NO: 39434 - DNA, 15 bp, Homo sapiens
tgcttcactgcagtc

SEQ ID NO: 39435 - DNA, 15 bp, Homo sapiens
ctgcttcactgcagt

SEQ ID NO: 39436 - DNA, 15 bp, Homo sapiens
tctgcttcactgcag

SEQ ID NO: 39437 - DNA, 15 bp, Homo sapiens
ctctgcttcactgca

SEQ ID NO: 39438 - DNA, 15 bp, Homo sapiens
gctctgcttcactgc

SEQ ID NO: 39439 - DNA, 15 bp, Homo sapiens
agctctgcttcactg

SEQ ID NO: 39440 - DNA, 15 bp, Homo sapiens
aagctctgcttcact

SEQ ID NO: 39441 - DNA, 15 bp, Homo sapiens
gaagctctgcttcac

SEQ ID NO: 39442 - DNA, 15 bp, Homo sapiens
ggaagctctgcttca

SEQ ID NO: 39443 - DNA, 15 bp, Homo sapiens
aggaagctctgcttc

SEQ ID NO: 39444 - DNA, 15 bp, Homo sapiens
caggaagctctgctt

SEQ ID NO: 39445 - DNA, 15 bp, Homo sapiens
tcaggaagctctgct

SEQ ID NO: 39446 - DNA, 15 bp, Homo sapiens
gtcaggaagctctgc

SEQ ID NO: 39447 - DNA, 15 bp, Homo sapiens
ggtcaggaagctctg

SEQ ID NO: 39448 - DNA, 15 bp, Homo sapiens
cggtcaggaagctct

SEQ ID NO: 39449 - DNA, 15 bp, Homo sapiens
tcggtcaggaagctc

SEQ ID NO: 39450 - DNA, 15 bp, Homo sapiens
ctcggtcaggaagct

SEQ ID NO: 39451 - DNA, 15 bp, Homo sapiens
cctcggtcaggaagc

SEQ ID NO: 39452 - DNA, 15 bp, Homo sapiens
acctcggtcaggaag

SEQ ID NO: 39453 - DNA, 15 bp, Homo sapiens
cacctcggtcaggaa

SEQ ID NO: 39454 - DNA, 15 bp, Homo sapiens
ccacctcggtcagga

SEQ ID NO: 39455 - DNA, 15 bp, Homo sapiens
tccacctcggtcagg

SEQ ID NO: 39456 - DNA, 15 bp, Homo sapiens
ctccacctcggtcag

SEQ ID NO: 39457 - DNA, 15 bp, Homo sapiens
gctccacctcggtca

SEQ ID NO: 39458 - DNA, 15 bp, Homo sapiens
tgctccacctcggtc

SEQ ID NO: 39459 - DNA, 15 bp, Homo sapiens
ctgctccacctcggt

SEQ ID NO: 39460 - DNA, 15 bp, Homo sapiens
gctgctccacctcgg

SEQ ID NO: 39461 - DNA, 15 bp, Homo sapiens
agctgctccacctcg

SEQ ID NO: 39462 - DNA, 15 bp, Homo sapiens
cagctgctccacctc

SEQ ID NO: 39463 - DNA, 15 bp, Homo sapiens
acagctgctccacct

SEQ ID NO: 39464 - DNA, 15 bp, Homo sapiens
gacagctgctccacc

SEQ ID NO: 39465 - DNA, 15 bp, Homo sapiens
ggacagctgctccac

SEQ ID NO: 39466 - DNA, 15 bp, Homo sapiens
tggacagctgctcca

SEQ ID NO: 39467 - DNA, 15 bp, Homo sapiens
ctggacagctgctcc

SEQ ID NO: 39468 - DNA, 15 bp, Homo sapiens
cctggacagctgctc

SEQ ID NO: 39469 - DNA, 15 bp, Homo sapiens
acctggacagctgct

SEQ ID NO: 39470 - DNA, 15 bp, Homo sapiens
cacctggacagctgc

SEQ ID NO: 39471 - DNA, 15 bp, Homo sapiens
tcacctggacagctg

SEQ ID NO: 39472 - DNA, 15 bp, Homo sapiens
ctcacctggacagct

SEQ ID NO: 39473 - DNA, 15 bp, Homo sapiens
cctcacctggacagc

SEQ ID NO: 39474 - DNA, 15 bp, Homo sapiens
gcctcacctggacag

SEQ ID NO: 39475 - DNA, 15 bp, Homo sapiens
ggcctcacctggaca

SEQ ID NO: 39476 - DNA, 15 bp, Homo sapiens
tggcctcacctggac

SEQ ID NO: 39477 - DNA, 15 bp, Homo sapiens
ctggcctcacctgga

SEQ ID NO: 39478 - DNA, 15 bp, Homo sapiens
tctggcctcacctgg

SEQ ID NO: 39479 - DNA, 15 bp, Homo sapiens
ctctggcctcacctg

SEQ ID NO: 39480 - DNA, 15 bp, Homo sapiens
cctctggcctcacct

SEQ ID NO: 39481 - DNA, 15 bp, Homo sapiens
ccctctggcctcacc

SEQ ID NO: 39482 - DNA, 15 bp, Homo sapiens
cccctctggcctcac

SEQ ID NO: 39483 - DNA, 15 bp, Homo sapiens
ccccctctggcctca

SEQ ID NO: 39484 - DNA, 15 bp, Homo sapiens
tccccctctggcctc

SEQ ID NO: 39485 - DNA, 15 bp, Homo sapiens
ctccccctctggcct

SEQ ID NO: 39486 - DNA, 15 bp, Homo sapiens
gctccccctctggcc

SEQ ID NO: 39487 - DNA, 15 bp, Homo sapiens
ggctccccctctggc

SEQ ID NO: 39488 - DNA, 15 bp, Homo sapiens
tggctccccctctgg

SEQ ID NO: 39489 - DNA, 15 bp, Homo sapiens
gtggctccccctctg

SEQ ID NO: 39490 - DNA, 15 bp, Homo sapiens
tgtggctccccctct

SEQ ID NO: 39491 - DNA, 15 bp, Homo sapiens
gtgtggctccccctc

SEQ ID NO: 39492 - DNA, 15 bp, Homo sapiens
ggtgtggctccccct

SEQ ID NO: 39493 - DNA, 15 bp, Homo sapiens
tggtgtggctccccc

SEQ ID NO: 39494 - DNA, 15 bp, Homo sapiens
ctggtgtggctcccc

SEQ ID NO: 39495 - DNA, 15 bp, Homo sapiens
cctggtgtggctccc

SEQ ID NO: 39496 - DNA, 15 bp, Homo sapiens
acctggtgtggctcc

SEQ ID NO: 39497 - DNA, 15 bp, Homo sapiens
gacctggtgtggctc

SEQ ID NO: 39498 - DNA, 15 bp, Homo sapiens
ggacctggtgtggct

SEQ ID NO: 39499 - DNA, 15 bp, Homo sapiens
gggacctggtgtggc

SEQ ID NO: 39500 - DNA, 15 bp, Homo sapiens
cgggacctggtgtgg

SEQ ID NO: 39501 - DNA, 15 bp, Homo sapiens
acgggacctggtgtg

SEQ ID NO: 39502 - DNA, 15 bp, Homo sapiens
cacgggacctggtgt

SEQ ID NO: 39503 - DNA, 15 bp, Homo sapiens
ccacgggacctggtg

SEQ ID NO: 39504 - DNA, 15 bp, Homo sapiens
cccacgggacctggt

SEQ ID NO: 39505 - DNA, 15 bp, Homo sapiens
ccccacgggacctgg

SEQ ID NO: 39506 - DNA, 15 bp, Homo sapiens
gccccacgggacctg

SEQ ID NO: 39507 - DNA, 15 bp, Homo sapiens
agccccacgggacct

SEQ ID NO: 39508 - DNA, 15 bp, Homo sapiens
aagccccacgggacc

SEQ ID NO: 39509 - DNA, 15 bp, Homo sapiens
gaagccccacgggac

SEQ ID NO: 39510 - DNA, 15 bp, Homo sapiens
tgaagccccacggga

SEQ ID NO: 39511 - DNA, 15 bp, Homo sapiens
ctgaagccccacggg

SEQ ID NO: 39512 - DNA, 15 bp, Homo sapiens
tctgaagccccacgg

SEQ ID NO: 39513 - DNA, 15 bp, Homo sapiens
gtctgaagccccacg

SEQ ID NO: 39514 - DNA, 15 bp, Homo sapiens
ggtctgaagccccac

SEQ ID NO: 39515 - DNA, 15 bp, Homo sapiens
cggtctgaagcccca

SEQ ID NO: 39516 - DNA, 15 bp, Homo sapiens
gcggtctgaagcccc

SEQ ID NO: 39517 - DNA, 15 bp, Homo sapiens
tgcggtctgaagccc

SEQ ID NO: 39518 - DNA, 15 bp, Homo sapiens
gtgcggtctgaagcc

SEQ ID NO: 39519 - DNA, 15 bp, Homo sapiens
tgtgcggtctgaagc

SEQ ID NO: 39520 - DNA, 15 bp, Homo sapiens
gtgtgcggtctgaag

SEQ ID NO: 39521 - DNA, 15 bp, Homo sapiens
ggtgtgcggtctgaa

SEQ ID NO: 39522 - DNA, 15 bp, Homo sapiens
tggtgtgcggtctga

SEQ ID NO: 39523 - DNA, 15 bp, Homo sapiens
gtggtgtgcggtctg

SEQ ID NO: 39524 - DNA, 15 bp, Homo sapiens
tgtggtgtgcggtct

SEQ ID NO: 39525 - DNA, 15 bp, Homo sapiens
ctgtggtgtgcggtc

SEQ ID NO: 39526 - DNA, 15 bp, Homo sapiens
cctgtggtgtgcggt

SEQ ID NO: 39527 - DNA, 15 bp, Homo sapiens
tcctgtggtgtgcgg

SEQ ID NO: 39528 - DNA, 15 bp, Homo sapiens
gtcctgtggtgtgcg

SEQ ID NO: 39529 - DNA, 15 bp, Homo sapiens
ggtcctgtggtgtgc

SEQ ID NO: 39530 - DNA, 15 bp, Homo sapiens
aggtcctgtggtgtg

SEQ ID NO: 39531 - DNA, 15 bp, Homo sapiens
caggtcctgtggtgt

SEQ ID NO: 39532 - DNA, 15 bp, Homo sapiens
ccaggtcctgtggtg

SEQ ID NO: 39533 - DNA, 15 bp, Homo sapiens
gccaggtcctgtggt

SEQ ID NO: 39534 - DNA, 15 bp, Homo sapiens
agccaggtcctgtgg

SEQ ID NO: 39535 - DNA, 15 bp, Homo sapiens
gagccaggtcctgtg

SEQ ID NO: 39536 - DNA, 15 bp, Homo sapiens
ggagccaggtcctgt

SEQ ID NO: 39537 - DNA, 15 bp, Homo sapiens
gggagccaggtcctg

SEQ ID NO: 39538 - DNA, 15 bp, Homo sapiens
agggagccaggtcct

SEQ ID NO: 39539 - DNA, 15 bp, Homo sapiens
aagggagccaggtcc

SEQ ID NO: 39540 - DNA, 15 bp, Homo sapiens
caagggagccaggtc

SEQ ID NO: 39541 - DNA, 15 bp, Homo sapiens
ccaagggagccaggt

SEQ ID NO: 39542 - DNA, 15 bp, Homo sapiens
cccaagggagccagg

SEQ ID NO: 39543 - DNA, 15 bp, Homo sapiens
gcccaagggagccag

SEQ ID NO: 39544 - DNA, 15 bp, Homo sapiens
tgcccaagggagcca

SEQ ID NO: 39545 - DNA, 15 bp, Homo sapiens
gtgcccaagggagcc

SEQ ID NO: 39546 - DNA, 15 bp, Homo sapiens
ggtgcccaagggagc

SEQ ID NO: 39547 - DNA, 15 bp, Homo sapiens
aggtgcccaagggag

SEQ ID NO: 39548 - DNA, 15 bp, Homo sapiens
caggtgcccaaggga

SEQ ID NO: 39549 - DNA, 15 bp, Homo sapiens
tcaggtgcccaaggg

SEQ ID NO: 39550 - DNA, 15 bp, Homo sapiens
ctcaggtgcccaagg

SEQ ID NO: 39551 - DNA, 15 bp, Homo sapiens
cctcaggtgcccaag

SEQ ID NO: 39552 - DNA, 15 bp, Homo sapiens
gcctcaggtgcccaa

SEQ ID NO: 39553 - DNA, 15 bp, Homo sapiens
ggcctcaggtgccca

SEQ ID NO: 39554 - DNA, 15 bp, Homo sapiens
aggcctcaggtgccc

SEQ ID NO: 39555 - DNA, 15 bp, Homo sapiens
caggcctcaggtgcc

SEQ ID NO: 39556 - DNA, 15 bp, Homo sapiens
ccaggcctcaggtgc

SEQ ID NO: 39557 - DNA, 15 bp, Homo sapiens
gccaggcctcaggtg

SEQ ID NO: 39558 - DNA, 15 bp, Homo sapiens
tgccaggcctcaggt

SEQ ID NO: 39559 - DNA, 15 bp, Homo sapiens
ctgccaggcctcagg

SEQ ID NO: 39560 - DNA, 15 bp, Homo sapiens
cctgccaggcctcag

SEQ ID NO: 39561 - DNA, 15 bp, Homo sapiens
gcctgccaggcctca

SEQ ID NO: 39562 - DNA, 15 bp, Homo sapiens
ggcctgccaggcctc

SEQ ID NO: 39563 - DNA, 15 bp, Homo sapiens
gggcctgccaggcct

SEQ ID NO: 39564 - DNA, 15 bp, Homo sapiens
cgggcctgccaggcc

SEQ ID NO: 39565 - DNA, 15 bp, Homo sapiens
ccgggcctgccaggc

SEQ ID NO: 39566 - DNA, 15 bp, Homo sapiens
cccgggcctgccagg

SEQ ID NO: 39567 - DNA, 15 bp, Homo sapiens
gcccgggcctgccag

SEQ ID NO: 39568 - DNA, 15 bp, Homo sapiens
cgcccgggcctgcca

SEQ ID NO: 39569 - DNA, 15 bp, Homo sapiens
tcgcccgggcctgcc

SEQ ID NO: 39570 - DNA, 15 bp, Homo sapiens
ctcgcccgggcctgc

SEQ ID NO: 39571 - DNA, 15 bp, Homo sapiens
gctcgcccgggcctg

SEQ ID NO: 39572 - DNA, 15 bp, Homo sapiens
agctcgcccgggcct

SEQ ID NO: 39573 - DNA, 15 bp, Homo sapiens
cagctcgcccgggcc

SEQ ID NO: 39574 - DNA, 15 bp, Homo sapiens
tcagctcgcccgggc

SEQ ID NO: 39575 - DNA, 15 bp, Homo sapiens
ctcagctcgcccggg

SEQ ID NO: 39576 - DNA, 15 bp, Homo sapiens
cctcagctcgcccgg

SEQ ID NO: 39577 - DNA, 15 bp, Homo sapiens
gcctcagctcgcccg

SEQ ID NO: 39578 - DNA, 15 bp, Homo sapiens
ggcctcagctcgccc

SEQ ID NO: 39579 - DNA, 15 bp, Homo sapiens
gggcctcagctcgcc

SEQ ID NO: 39580 - DNA, 15 bp, Homo sapiens
ggggcctcagctcgc

SEQ ID NO: 39581 - DNA, 15 bp, Homo sapiens
tggggcctcagctcg

SEQ ID NO: 39582 - DNA, 15 bp, Homo sapiens
ctggggcctcagctc

SEQ ID NO: 39583 - DNA, 15 bp, Homo sapiens
gctggggcctcagct

SEQ ID NO: 39584 - DNA, 15 bp, Homo sapiens
ggctggggcctcagc

SEQ ID NO: 39585 - DNA, 15 bp, Homo sapiens
tggctggggcctcag

SEQ ID NO: 39586 - DNA, 15 bp, Homo sapiens
ctggctggggcctca

SEQ ID NO: 39587 - DNA, 15 bp, Homo sapiens
cctggctggggcctc

SEQ ID NO: 39588 - DNA, 15 bp, Homo sapiens
ccctggctggggcct

SEQ ID NO: 39589 - DNA, 15 bp, Homo sapiens
gccctggctggggcc

SEQ ID NO: 39590 - DNA, 15 bp, Homo sapiens
agccctggctggggc

SEQ ID NO: 39591 - DNA, 15 bp, Homo sapiens
cagccctggctgggg

SEQ ID NO: 39592 - DNA, 15 bp, Homo sapiens
gcagccctggctggg

SEQ ID NO: 39593 - DNA, 15 bp, Homo sapiens
ggcagccctggctgg

SEQ ID NO: 39594 - DNA, 15 bp, Homo sapiens
gggcagccctggctg

SEQ ID NO: 39595 - DNA, 15 bp, Homo sapiens
tgggcagccctggct

SEQ ID NO: 39596 - DNA, 15 bp, Homo sapiens
gtgggcagccctggc

SEQ ID NO: 39597 - DNA, 15 bp, Homo sapiens
ggtgggcagccctgg

SEQ ID NO: 39598 - DNA, 15 bp, Homo sapiens
gggtgggcagccctg

SEQ ID NO: 39599 - DNA, 15 bp, Homo sapiens
tgggtgggcagccct

SEQ ID NO: 39600 - DNA, 15 bp, Homo sapiens
ctgggtgggcagccc

SEQ ID NO: 39601 - DNA, 15 bp, Homo sapiens
actgggtgggcagcc

SEQ ID NO: 39602 - DNA, 15 bp, Homo sapiens
gactgggtgggcagc

SEQ ID NO: 39603 - DNA, 15 bp, Homo sapiens
agactgggtgggcag

SEQ ID NO: 39604 - DNA, 15 bp, Homo sapiens
cagactgggtgggca

SEQ ID NO: 39605 - DNA, 15 bp, Homo sapiens
ccagactgggtgggc

SEQ ID NO: 39606 - DNA, 15 bp, Homo sapiens
gccagactgggtggg

SEQ ID NO: 39607 - DNA, 15 bp, Homo sapiens
ggccagactgggtgg

SEQ ID NO: 39608 - DNA, 15 bp, Homo sapiens
aggccagactgggtg

SEQ ID NO: 39609 - DNA, 15 bp, Homo sapiens
caggccagactgggt

SEQ ID NO: 39610 - DNA, 15 bp, Homo sapiens
tcaggccagactggg

SEQ ID NO: 39611 - DNA, 15 bp, Homo sapiens
atcaggccagactgg

SEQ ID NO: 39612 - DNA, 15 bp, Homo sapiens
catcaggccagactg

SEQ ID NO: 39613 - DNA, 15 bp, Homo sapiens
ccatcaggccagact

SEQ ID NO: 39614 - DNA, 15 bp, Homo sapiens
tccatcaggccagac

SEQ ID NO: 39615 - DNA, 15 bp, Homo sapiens
ttccatcaggccaga

SEQ ID NO: 39616 - DNA, 15 bp, Homo sapiens
tttccatcaggccag

SEQ ID NO: 39617 - DNA, 15 bp, Homo sapiens
ctttccatcaggcca

SEQ ID NO: 39618 - DNA, 15 bp, Homo sapiens
actttccatcaggcc

SEQ ID NO: 39619 - DNA, 15 bp, Homo sapiens
cactttccatcaggc

SEQ ID NO: 39620 - DNA, 15 bp, Homo sapiens
gcactttccatcagg

SEQ ID NO: 39621 - DNA, 15 bp, Homo sapiens
agcactttccatcag

SEQ ID NO: 39622 - DNA, 15 bp, Homo sapiens
gagcactttccatca

SEQ ID NO: 39623 - DNA, 15 bp, Homo sapiens
ggagcactttccatc

SEQ ID NO: 39624 - DNA, 15 bp, Homo sapiens
gggagcactttccat

SEQ ID NO: 39625 - DNA, 15 bp, Homo sapiens
ggggagcactttcca

SEQ ID NO: 39626 - DNA, 15 bp, Homo sapiens
aggggagcactttcc

SEQ ID NO: 39627 - DNA, 15 bp, Homo sapiens
aaggggagcactttc

SEQ ID NO: 39628 - DNA, 15 bp, Homo sapiens
aaaggggagcacttt

SEQ ID NO: 39629 - DNA, 15 bp, Homo sapiens
aaaaggggagcactt

SEQ ID NO: 39630 - DNA, 15 bp, Homo sapiens
aaaaaggggagcact

SEQ ID NO: 39631 - DNA, 15 bp, Homo sapiens
gaaaaaggggagcac

SEQ ID NO: 39632 - DNA, 15 bp, Homo sapiens
tgaaaaaggggagca

SEQ ID NO: 39633 - DNA, 15 bp, Homo sapiens
ttgaaaaaggggagc

SEQ ID NO: 39634 - DNA, 15 bp, Homo sapiens
tttgaaaaaggggag

SEQ ID NO: 39635 - DNA, 15 bp, Homo sapiens
gtttgaaaaagggga

SEQ ID NO: 39636 - DNA, 15 bp, Homo sapiens
tgtttgaaaaagggg

SEQ ID NO: 39637 - DNA, 15 bp, Homo sapiens
ctgtttgaaaaaggg

SEQ ID NO: 39638 - DNA, 15 bp, Homo sapiens
cctgtttgaaaaagg

SEQ ID NO: 39639 - DNA, 15 bp, Homo sapiens
acctgtttgaaaaag

SEQ ID NO: 39640 - DNA, 15 bp, Homo sapiens
aacctgtttgaaaaa

SEQ ID NO: 39641 - DNA, 15 bp, Homo sapiens
aaacctgtttgaaaa

SEQ ID NO: 39642 - DNA, 15 bp, Homo sapiens
gaaacctgtttgaaa

SEQ ID NO: 39643 - DNA, 15 bp, Homo sapiens
cgaaacctgtttgaa

SEQ ID NO: 39644 - DNA, 15 bp, Homo sapiens
acgaaacctgtttga

SEQ ID NO: 39645 - DNA, 15 bp, Homo sapiens
gacgaaacctgtttg

SEQ ID NO: 39646 - DNA, 15 bp, Homo sapiens
tgacgaaacctgttt

SEQ ID NO: 39647 - DNA, 15 bp, Homo sapiens
gtgacgaaacctgtt

SEQ ID NO: 39648 - DNA, 15 bp, Homo sapiens
ggtgacgaaacctgt

SEQ ID NO: 39649 - DNA, 15 bp, Homo sapiens
gggtgacgaaacctg

SEQ ID NO: 39650 - DNA, 15 bp, Homo sapiens
tgggtgacgaaacct

SEQ ID NO: 39651 - DNA, 15 bp, Homo sapiens
ttgggtgacgaaacc

SEQ ID NO: 39652 - DNA, 15 bp, Homo sapiens
tttgggtgacgaaac

SEQ ID NO: 39653 - DNA, 15 bp, Homo sapiens
gtttgggtgacgaaa

SEQ ID NO: 39654 - DNA, 15 bp, Homo sapiens
tgtttgggtgacgaa

SEQ ID NO: 39655 - DNA, 15 bp, Homo sapiens
atgtttgggtgacga

SEQ ID NO: 39656 - DNA, 15 bp, Homo sapiens
aatgtttgggtgacg

SEQ ID NO: 39657 - DNA, 15 bp, Homo sapiens
caatgtttgggtgac

SEQ ID NO: 39658 - DNA, 15 bp, Homo sapiens
acaatgtttgggtga

SEQ ID NO: 39659 - DNA, 15 bp, Homo sapiens
cacaatgtttgggtg

SEQ ID NO: 39660 - DNA, 15 bp, Homo sapiens
ccacaatgtttgggt

SEQ ID NO: 39661 - DNA, 15 bp, Homo sapiens
tccacaatgtttggg

SEQ ID NO: 39662 - DNA, 15 bp, Homo sapiens
gtccacaatgtttgg

SEQ ID NO: 39663 - DNA, 15 bp, Homo sapiens
agtccacaatgtttg

SEQ ID NO: 39664 - DNA, 15 bp, Homo sapiens
aagtccacaatgttt

SEQ ID NO: 39665 - DNA, 15 bp, Homo sapiens
aaagtccacaatgtt

SEQ ID NO: 39666 - DNA, 15 bp, Homo sapiens
caaagtccacaatgt

SEQ ID NO: 39667 - DNA, 15 bp, Homo sapiens
gcaaagtccacaatg

SEQ ID NO: 39668 - DNA, 15 bp, Homo sapiens
agcaaagtccacaat

SEQ ID NO: 39669 - DNA, 15 bp, Homo sapiens
cagcaaagtccacaa

SEQ ID NO: 39670 - DNA, 15 bp, Homo sapiens
ccagcaaagtccaca

SEQ ID NO: 39671 - DNA, 15 bp, Homo sapiens
gccagcaaagtccac

SEQ ID NO: 39672 - DNA, 15 bp, Homo sapiens
agccagcaaagtcca

SEQ ID NO: 39673 - DNA, 15 bp, Homo sapiens
tagccagcaaagtcc

SEQ ID NO: 39674 - DNA, 15 bp, Homo sapiens
gtagccagcaaagtc

SEQ ID NO: 39675 - DNA, 15 bp, Homo sapiens
agtagccagcaaagt

SEQ ID NO: 39676 - DNA, 15 bp, Homo sapiens
cagtagccagcaaag

SEQ ID NO: 39677 - DNA, 15 bp, Homo sapiens
acagtagccagcaaa

SEQ ID NO: 39678 - DNA, 15 bp, Homo sapiens
cacagtagccagcaa

SEQ ID NO: 39679 - DNA, 15 bp, Homo sapiens
gcacagtagccagca

SEQ ID NO: 39680 - DNA, 15 bp, Homo sapiens
agcacagtagccagc

SEQ ID NO: 39681 - DNA, 15 bp, Homo sapiens
gagcacagtagccag

SEQ ID NO: 39682 - DNA, 15 bp, Homo sapiens
tgagcacagtagcca

SEQ ID NO: 39683 - DNA, 15 bp, Homo sapiens
ctgagcacagtagcc

SEQ ID NO: 39684 - DNA, 15 bp, Homo sapiens
tctgagcacagtagc

SEQ ID NO: 39685 - DNA, 15 bp, Homo sapiens
ttctgagcacagtag

SEQ ID NO: 39686 - DNA, 15 bp, Homo sapiens
gttctgagcacagta

SEQ ID NO: 39687 - DNA, 15 bp, Homo sapiens
cgttctgagcacagt

SEQ ID NO: 39688 - DNA, 15 bp, Homo sapiens
ccgttctgagcacag

SEQ ID NO: 39689 - DNA, 15 bp, Homo sapiens
gccgttctgagcaca

SEQ ID NO: 39690 - DNA, 15 bp, Homo sapiens
agccgttctgagcac

SEQ ID NO: 39691 - DNA, 15 bp, Homo sapiens
aagccgttctgagca

SEQ ID NO: 39692 - DNA, 15 bp, Homo sapiens
gaagccgttctgagc

SEQ ID NO: 39693 - DNA, 15 bp, Homo sapiens
agaagccgttctgag

SEQ ID NO: 39694 - DNA, 15 bp, Homo sapiens
tagaagccgttctga

SEQ ID NO: 39695 - DNA, 15 bp, Homo sapiens
gtagaagccgttctg

SEQ ID NO: 39696 - DNA, 15 bp, Homo sapiens
agtagaagccgttct

SEQ ID NO: 39697 - DNA, 15 bp, Homo sapiens
cagtagaagccgttc

SEQ ID NO: 39698 - DNA, 15 bp, Homo sapiens
gcagtagaagccgtt

SEQ ID NO: 39699 - DNA, 15 bp, Homo sapiens
ggcagtagaagccgt

SEQ ID NO: 39700 - DNA, 15 bp, Homo sapiens
aggcagtagaagccg

SEQ ID NO: 39701 - DNA, 15 bp, Homo sapiens
caggcagtagaagcc

SEQ ID NO: 39702 - DNA, 15 bp, Homo sapiens
ccaggcagtagaagc

SEQ ID NO: 39703 - DNA, 15 bp, Homo sapiens
accaggcagtagaag

SEQ ID NO: 39704 - DNA, 15 bp, Homo sapiens
caccaggcagtagaa

SEQ ID NO: 39705 - DNA, 15 bp, Homo sapiens
acaccaggcagtaga

SEQ ID NO: 39706 - DNA, 15 bp, Homo sapiens
tacaccaggcagtag

SEQ ID NO: 39707 - DNA, 15 bp, Homo sapiens
gtacaccaggcagta

SEQ ID NO: 39708 - DNA, 15 bp, Homo sapiens
cgtacaccaggcagt

SEQ ID NO: 39709 - DNA, 15 bp, Homo sapiens
ccgtacaccaggcag

SEQ ID NO: 39710 - DNA, 15 bp, Homo sapiens
gccgtacaccaggca

SEQ ID NO: 39711 - DNA, 15 bp, Homo sapiens
agccgtacaccaggc

SEQ ID NO: 39712 - DNA, 15 bp, Homo sapiens
aagccgtacaccagg

SEQ ID NO: 39713 - DNA, 15 bp, Homo sapiens
gaagccgtacaccag

SEQ ID NO: 39714 - DNA, 15 bp, Homo sapiens
ggaagccgtacacca

SEQ ID NO: 39715 - DNA, 15 bp, Homo sapiens
aggaagccgtacacc

SEQ ID NO: 39716 - DNA, 15 bp, Homo sapiens
caggaagccgtacac

SEQ ID NO: 39717 - DNA, 15 bp, Homo sapiens
gcaggaagccgtaca

SEQ ID NO: 39718 - DNA, 15 bp, Homo sapiens
ggcaggaagccgtac

SEQ ID NO: 39719 - DNA, 15 bp, Homo sapiens
gggcaggaagccgta

SEQ ID NO: 39720 - DNA, 15 bp, Homo sapiens
tgggcaggaagccgt

SEQ ID NO: 39721 - DNA, 15 bp, Homo sapiens
ttgggcaggaagccg

SEQ ID NO: 39722 - DNA, 15 bp, Homo sapiens
gttgggcaggaagcc

SEQ ID NO: 39723 - DNA, 15 bp, Homo sapiens
cgttgggcaggaagc

SEQ ID NO: 39724 - DNA, 15 bp, Homo sapiens
ccgttgggcaggaag

SEQ ID NO: 39725 - DNA, 15 bp, Homo sapiens
gccgttgggcaggaa

SEQ ID NO: 39726 - DNA, 15 bp, Homo sapiens
agccgttgggcagga

SEQ ID NO: 39727 - DNA, 15 bp, Homo sapiens
gagccgttgggcagg

SEQ ID NO: 39728 - DNA, 15 bp, Homo sapiens
ggagccgttgggcag

SEQ ID NO: 39729 - DNA, 15 bp, Homo sapiens
gggagccgttgggca

SEQ ID NO: 39730 - DNA, 15 bp, Homo sapiens
agggagccgttgggc

SEQ ID NO: 39731 - DNA, 15 bp, Homo sapiens
cagggagccgttggg

SEQ ID NO: 39732 - DNA, 15 bp, Homo sapiens
ccagggagccgttgg

SEQ ID NO: 39733 - DNA, 15 bp, Homo sapiens
tccagggagccgttg

SEQ ID NO: 39734 - DNA, 15 bp, Homo sapiens
ctccagggagccgtt

SEQ ID NO: 39735 - DNA, 15 bp, Homo sapiens
cctccagggagccgt

SEQ ID NO: 39736 - DNA, 15 bp, Homo sapiens
tcctccagggagccg

SEQ ID NO: 39737 - DNA, 15 bp, Homo sapiens
gtcctccagggagcc

SEQ ID NO: 39738 - DNA, 15 bp, Homo sapiens
ggtcctccagggagc

SEQ ID NO: 39739 - DNA, 15 bp, Homo sapiens
cggtcctccagggag

SEQ ID NO: 39740 - DNA, 15 bp, Homo sapiens
acggtcctccaggga

SEQ ID NO: 39741 - DNA, 15 bp, Homo sapiens
gacggtcctccaggg

SEQ ID NO: 39742 - DNA, 15 bp, Homo sapiens
agacggtcctccagg

SEQ ID NO: 39743 - DNA, 15 bp, Homo sapiens
gagacggtcctccag

SEQ ID NO: 39744 - DNA, 15 bp, Homo sapiens
ggagacggtcctcca

SEQ ID NO: 39745 - DNA, 15 bp, Homo sapiens
tggagacggtcctcc

SEQ ID NO: 39746 - DNA, 15 bp, Homo sapiens
gtggagacggtcctc

SEQ ID NO: 39747 - DNA, 15 bp, Homo sapiens
agtggagacggtcct

SEQ ID NO: 39748 - DNA, 15 bp, Homo sapiens
cagtggagacggtcc

SEQ ID NO: 39749 - DNA, 15 bp, Homo sapiens
gcagtggagacggtc

SEQ ID NO: 39750 - DNA, 15 bp, Homo sapiens
ggcagtggagacggt

SEQ ID NO: 39751 - DNA, 15 bp, Homo sapiens
tggcagtggagacgg

SEQ ID NO: 39752 - DNA, 15 bp, Homo sapiens
ctggcagtggagacg

SEQ ID NO: 39753 - DNA, 15 bp, Homo sapiens
cctggcagtggagac

SEQ ID NO: 39754 - DNA, 15 bp, Homo sapiens
acctggcagtggaga

SEQ ID NO: 39755 - DNA, 15 bp, Homo sapiens
tacctggcagtggag

SEQ ID NO: 39756 - DNA, 15 bp, Homo sapiens
ctacctggcagtgga

SEQ ID NO: 39757 - DNA, 15 bp, Homo sapiens
cctacctggcagtgg

SEQ ID NO: 39758 - DNA, 15 bp, Homo sapiens
gcctacctggcagtg

SEQ ID NO: 39759 - DNA, 15 bp, Homo sapiens
agcctacctggcagt

SEQ ID NO: 39760 - DNA, 15 bp, Homo sapiens
gagcctacctggcag

SEQ ID NO: 39761 - DNA, 15 bp, Homo sapiens
tgagcctacctggca

SEQ ID NO: 39762 - DNA, 15 bp, Homo sapiens
gtgagcctacctggc

SEQ ID NO: 39763 - DNA, 15 bp, Homo sapiens
ggtgagcctacctgg

SEQ ID NO: 39764 - DNA, 15 bp, Homo sapiens
aggtgagcctacctg

SEQ ID NO: 39765 - DNA, 15 bp, Homo sapiens
caggtgagcctacct

SEQ ID NO: 39766 - DNA, 15 bp, Homo sapiens
ccaggtgagcctacc

SEQ ID NO: 39767 - DNA, 15 bp, Homo sapiens
gccaggtgagcctac

SEQ ID NO: 39768 - DNA, 15 bp, Homo sapiens
ggccaggtgagccta

SEQ ID NO: 39769 - DNA, 15 bp, Homo sapiens
gggccaggtgagcct

SEQ ID NO: 39770 - DNA, 15 bp, Homo sapiens
cgggccaggtgagcc

SEQ ID NO: 39771 - DNA, 15 bp, Homo sapiens
ccgggccaggtgagc

SEQ ID NO: 39772 - DNA, 15 bp, Homo sapiens
gccgggccaggtgag

SEQ ID NO: 39773 - DNA, 15 bp, Homo sapiens
tgccgggccaggtga

SEQ ID NO: 39774 - DNA, 15 bp, Homo sapiens
gtgccgggccaggtg

SEQ ID NO: 39775 - DNA, 15 bp, Homo sapiens
cgtgccgggccaggt

SEQ ID NO: 39776 - DNA, 15 bp, Homo sapiens
gcgtgccgggccagg

SEQ ID NO: 39777 - DNA, 15 bp, Homo sapiens
agcgtgccgggccag

SEQ ID NO: 39778 - DNA, 15 bp, Homo sapiens
aagcgtgccgggcca

SEQ ID NO: 39779 - DNA, 15 bp, Homo sapiens
gaagcgtgccgggcc

SEQ ID NO: 39780 - DNA, 15 bp, Homo sapiens
ggaagcgtgccgggc

SEQ ID NO: 39781 - DNA, 15 bp, Homo sapiens
gggaagcgtgccggg

SEQ ID NO: 39782 - DNA, 15 bp, Homo sapiens
tgggaagcgtgccgg

SEQ ID NO: 39783 - DNA, 15 bp, Homo sapiens
ctgggaagcgtgccg

SEQ ID NO: 39784 - DNA, 15 bp, Homo sapiens
cctgggaagcgtgcc

SEQ ID NO: 39785 - DNA, 15 bp, Homo sapiens
tcctgggaagcgtgc

SEQ ID NO: 39786 - DNA, 15 bp, Homo sapiens
gtcctgggaagcgtg

SEQ ID NO: 39787 - DNA, 15 bp, Homo sapiens
ggtcctgggaagcgt

SEQ ID NO: 39788 - DNA, 15 bp, Homo sapiens
gggtcctgggaagcg

SEQ ID NO: 39789 - DNA, 15 bp, Homo sapiens
tgggtcctgggaagc

SEQ ID NO: 39790 - DNA, 15 bp, Homo sapiens
ttgggtcctgggaag

SEQ ID NO: 39791 - DNA, 15 bp, Homo sapiens
tttgggtcctgggaa

SEQ ID NO: 39792 - DNA, 15 bp, Homo sapiens
ctttgggtcctggga

SEQ ID NO: 39793 - DNA, 15 bp, Homo sapiens
gctttgggtcctggg

SEQ ID NO: 39794 - DNA, 15 bp, Homo sapiens
tgctttgggtcctgg

SEQ ID NO: 39795 - DNA, 15 bp, Homo sapiens
gtgctttgggtcctg

SEQ ID NO: 39796 - DNA, 15 bp, Homo sapiens
agtgctttgggtcct

SEQ ID NO: 39797 - DNA, 15 bp, Homo sapiens
gagtgctttgggtcc

SEQ ID NO: 39798 - DNA, 15 bp, Homo sapiens
ggagtgctttgggtc

SEQ ID NO: 39799 - DNA, 15 bp, Homo sapiens
aggagtgctttgggt

SEQ ID NO: 39800 - DNA, 15 bp, Homo sapiens
caggagtgctttggg

SEQ ID NO: 39801 - DNA, 15 bp, Homo sapiens
tcaggagtgctttgg

SEQ ID NO: 39802 - DNA, 15 bp, Homo sapiens
gtcaggagtgctttg

SEQ ID NO: 39803 - DNA, 15 bp, Homo sapiens
tgtcaggagtgcttt

SEQ ID NO: 39804 - DNA, 15 bp, Homo sapiens
gtgtcaggagtgctt

SEQ ID NO: 39805 - DNA, 15 bp, Homo sapiens
ggtgtcaggagtgct

SEQ ID NO: 39806 - DNA, 15 bp, Homo sapiens
aggtgtcaggagtgc

SEQ ID NO: 39807 - DNA, 15 bp, Homo sapiens
caggtgtcaggagtg

SEQ ID NO: 39808 - DNA, 15 bp, Homo sapiens
ccaggtgtcaggagt

SEQ ID NO: 39809 - DNA, 15 bp, Homo sapiens
gccaggtgtcaggag

SEQ ID NO: 39810 - DNA, 15 bp, Homo sapiens
agccaggtgtcagga

SEQ ID NO: 39811 - DNA, 15 bp, Homo sapiens
cagccaggtgtcagg

SEQ ID NO: 39812 - DNA, 15 bp, Homo sapiens
ccagccaggtgtcag

SEQ ID NO: 39813 - DNA, 15 bp, Homo sapiens
tccagccaggtgtca

SEQ ID NO: 39814 - DNA, 15 bp, Homo sapiens
ctccagccaggtgtc

SEQ ID NO: 39815 - DNA, 15 bp, Homo sapiens
gctccagccaggtgt

SEQ ID NO: 39816 - DNA, 15 bp, Homo sapiens
ggctccagccaggtg

SEQ ID NO: 39817 - DNA, 15 bp, Homo sapiens
cggctccagccaggt

SEQ ID NO: 39818 - DNA, 15 bp, Homo sapiens
ccggctccagccagg

SEQ ID NO: 39819 - DNA, 15 bp, Homo sapiens
cccggctccagccag

SEQ ID NO: 39820 - DNA, 15 bp, Homo sapiens
gcccggctccagcca

SEQ ID NO: 39821 - DNA, 15 bp, Homo sapiens
cgcccggctccagcc

SEQ ID NO: 39822 - DNA, 15 bp, Homo sapiens
gcgcccggctccagc

SEQ ID NO: 39823 - DNA, 15 bp, Homo sapiens
cgcgcccggctccag

SEQ ID NO: 39824 - DNA, 15 bp, Homo sapiens
ccgcgcccggctcca

SEQ ID NO: 39825 - DNA, 15 bp, Homo sapiens
cccgcgcccggctcc

SEQ ID NO: 39826 - DNA, 15 bp, Homo sapiens
ccccgcgcccggctc

SEQ ID NO: 39827 - DNA, 15 bp, Homo sapiens
gccccgcgcccggct

SEQ ID NO: 39828 - DNA, 15 bp, Homo sapiens
ggccccgcgcccggc

SEQ ID NO: 39829 - DNA, 15 bp, Homo sapiens
aggccccgcgcccgg

SEQ ID NO: 39830 - DNA, 15 bp, Homo sapiens
taggccccgcgcccg

SEQ ID NO: 39831 - DNA, 15 bp, Homo sapiens
ctaggccccgcgccc

SEQ ID NO: 39832 - DNA, 15 bp, Homo sapiens
cctaggccccgcgcc

SEQ ID NO: 39833 - DNA, 15 bp, Homo sapiens
ccctaggccccgcgc

SEQ ID NO: 39834 - DNA, 15 bp, Homo sapiens
gccctaggccccgcg

SEQ ID NO: 39835 - DNA, 15 bp, Homo sapiens
agccctaggccccgc

SEQ ID NO: 39836 - DNA, 15 bp, Homo sapiens
aagccctaggccccg

SEQ ID NO: 39837 - DNA, 15 bp, Homo sapiens
aaagccctaggcccc

SEQ ID NO: 39838 - DNA, 15 bp, Homo sapiens
gaaagccctaggccc

SEQ ID NO: 39839 - DNA, 15 bp, Homo sapiens
tgaaagccctaggcc

SEQ ID NO: 39840 - DNA, 15 bp, Homo sapiens
ctgaaagccctaggc

SEQ ID NO: 39841 - DNA, 15 bp, Homo sapiens
gctgaaagccctagg

SEQ ID NO: 39842 - DNA, 15 bp, Homo sapiens
ggctgaaagccctag

SEQ ID NO: 39843 - DNA, 15 bp, Homo sapiens
aggctgaaagcccta

SEQ ID NO: 39844 - DNA, 15 bp, Homo sapiens
caggctgaaagccct

SEQ ID NO: 39845 - DNA, 15 bp, Homo sapiens
acaggctgaaagccc

SEQ ID NO: 39846 - DNA, 15 bp, Homo sapiens
cacaggctgaaagcc

SEQ ID NO: 39847 - DNA, 15 bp, Homo sapiens
acacaggctgaaagc

SEQ ID NO: 39848 - DNA, 15 bp, Homo sapiens
cacacaggctgaaag

SEQ ID NO: 39849 - DNA, 15 bp, Homo sapiens
tcacacaggctgaaa

SEQ ID NO: 39850 - DNA, 15 bp, Homo sapiens
ctcacacaggctgaa

SEQ ID NO: 39851 - DNA, 15 bp, Homo sapiens
actcacacaggctga

SEQ ID NO: 39852 - DNA, 15 bp, Homo sapiens
cactcacacaggctg

SEQ ID NO: 39853 - DNA, 15 bp, Homo sapiens
ccactcacacaggct

SEQ ID NO: 39854 - DNA, 15 bp, Homo sapiens
cccactcacacaggc

SEQ ID NO: 39855 - DNA, 15 bp, Homo sapiens
acccactcacacagg

SEQ ID NO: 39856 - DNA, 15 bp, Homo sapiens
gacccactcacacag

SEQ ID NO: 39857 - DNA, 15 bp, Homo sapiens
ggacccactcacaca

SEQ ID NO: 39858 - DNA, 15 bp, Homo sapiens
aggacccactcacac

SEQ ID NO: 39859 - DNA, 15 bp, Homo sapiens
caggacccactcaca

SEQ ID NO: 39860 - DNA, 15 bp, Homo sapiens
gcaggacccactcac

SEQ ID NO: 39861 - DNA, 15 bp, Homo sapiens
ggcaggacccactca

SEQ ID NO: 39862 - DNA, 15 bp, Homo sapiens
tggcaggacccactc

SEQ ID NO: 39863 - DNA, 15 bp, Homo sapiens
ctggcaggacccact

SEQ ID NO: 39864 - DNA, 15 bp, Homo sapiens
gctggcaggacccac

SEQ ID NO: 39865 - DNA, 15 bp, Homo sapiens
tgctggcaggaccca

SEQ ID NO: 39866 - DNA, 15 bp, Homo sapiens
ctgctggcaggaccc

SEQ ID NO: 39867 - DNA, 15 bp, Homo sapiens
cctgctggcaggacc

SEQ ID NO: 39868 - DNA, 15 bp, Homo sapiens
gcctgctggcaggac

SEQ ID NO: 39869 - DNA, 15 bp, Homo sapiens
ggcctgctggcagga

SEQ ID NO: 39870 - DNA, 15 bp, Homo sapiens
tggcctgctggcagg

SEQ ID NO: 39871 - DNA, 15 bp, Homo sapiens
ctggcctgctggcag

SEQ ID NO: 39872 - DNA, 15 bp, Homo sapiens
cctggcctgctggca

SEQ ID NO: 39873 - DNA, 15 bp, Homo sapiens
gcctggcctgctggc

SEQ ID NO: 39874 - DNA, 15 bp, Homo sapiens
ggcctggcctgctgg

SEQ ID NO: 39875 - DNA, 15 bp, Homo sapiens
aggcctggcctgctg

SEQ ID NO: 39876 - DNA, 15 bp, Homo sapiens
caggcctggcctgct

SEQ ID NO: 39877 - DNA, 15 bp, Homo sapiens
gcaggcctggcctgc

SEQ ID NO: 39878 - DNA, 15 bp, Homo sapiens
tgcaggcctggcctg

SEQ ID NO: 39879 - DNA, 15 bp, Homo sapiens
gtgcaggcctggcct

SEQ ID NO: 39880 - DNA, 15 bp, Homo sapiens
agtgcaggcctggcc

SEQ ID NO: 39881 - DNA, 15 bp, Homo sapiens
aagtgcaggcctggc

SEQ ID NO: 39882 - DNA, 15 bp, Homo sapiens
gaagtgcaggcctgg

SEQ ID NO: 39883 - DNA, 15 bp, Homo sapiens
ggaagtgcaggcctg

SEQ ID NO: 39884 - DNA, 15 bp, Homo sapiens
tggaagtgcaggcct

SEQ ID NO: 39885 - DNA, 15 bp, Homo sapiens
ctggaagtgcaggcc

SEQ ID NO: 39886 - DNA, 15 bp, Homo sapiens
gctggaagtgcaggc

SEQ ID NO: 39887 - DNA, 15 bp, Homo sapiens
agctggaagtgcagg

SEQ ID NO: 39888 - DNA, 15 bp, Homo sapiens
gagctggaagtgcag

SEQ ID NO: 39889 - DNA, 15 bp, Homo sapiens
ggagctggaagtgca

SEQ ID NO: 39890 - DNA, 15 bp, Homo sapiens
gggagctggaagtgc

SEQ ID NO: 39891 - DNA, 15 bp, Homo sapiens
ggggagctggaagtg

SEQ ID NO: 39892 - DNA, 15 bp, Homo sapiens
tggggagctggaagt

SEQ ID NO: 39893 - DNA, 15 bp, Homo sapiens
ctggggagctggaag

SEQ ID NO: 39894 - DNA, 15 bp, Homo sapiens
gctggggagctggaa

SEQ ID NO: 39895 - DNA, 15 bp, Homo sapiens
tgctggggagctgga

SEQ ID NO: 39896 - DNA, 15 bp, Homo sapiens
ctgctggggagctgg

SEQ ID NO: 39897 - DNA, 15 bp, Homo sapiens
gctgctggggagctg

SEQ ID NO: 39898 - DNA, 15 bp, Homo sapiens
tgctgctggggagct

SEQ ID NO: 39899 - DNA, 15 bp, Homo sapiens
gtgctgctggggagc

SEQ ID NO: 39900 - DNA, 15 bp, Homo sapiens
ggtgctgctggggag

SEQ ID NO: 39901 - DNA, 15 bp, Homo sapiens
gggtgctgctgggga

SEQ ID NO: 39902 - DNA, 15 bp, Homo sapiens
cgggtgctgctgggg

SEQ ID NO: 39903 - DNA, 15 bp, Homo sapiens
ccgggtgctgctggg

SEQ ID NO: 39904 - DNA, 15 bp, Homo sapiens
gccgggtgctgctgg

SEQ ID NO: 39905 - DNA, 15 bp, Homo sapiens
agccgggtgctgctg

SEQ ID NO: 39906 - DNA, 15 bp, Homo sapiens
gagccgggtgctgct

SEQ ID NO: 39907 - DNA, 15 bp, Homo sapiens
tgagccgggtgctgc

SEQ ID NO: 39908 - DNA, 15 bp, Homo sapiens
ctgagccgggtgctg

SEQ ID NO: 39909 - DNA, 15 bp, Homo sapiens
cctgagccgggtgct

SEQ ID NO: 39910 - DNA, 15 bp, Homo sapiens
tcctgagccgggtgc

SEQ ID NO: 39911 - DNA, 15 bp, Homo sapiens
atcctgagccgggtg

SEQ ID NO: 39912 - DNA, 15 bp, Homo sapiens
aatcctgagccgggt

SEQ ID NO: 39913 - DNA, 15 bp, Homo sapiens
aaatcctgagccggg

SEQ ID NO: 39914 - DNA, 15 bp, Homo sapiens
caaatcctgagccgg

SEQ ID NO: 39915 - DNA, 15 bp, Homo sapiens
ccaaatcctgagccg

SEQ ID NO: 39916 - DNA, 15 bp, Homo sapiens
gccaaatcctgagcc

SEQ ID NO: 39917 - DNA, 15 bp, Homo sapiens
ggccaaatcctgagc

SEQ ID NO: 39918 - DNA, 15 bp, Homo sapiens
gggccaaatcctgag

SEQ ID NO: 39919 - DNA, 15 bp, Homo sapiens
tgggccaaatcctga

SEQ ID NO: 39920 - DNA, 15 bp, Homo sapiens
gtgggccaaatcctg

SEQ ID NO: 39921 - DNA, 15 bp, Homo sapiens
cgtgggccaaatcct

SEQ ID NO: 39922 - DNA, 15 bp, Homo sapiens
ccgtgggccaaatcc

SEQ ID NO: 39923 - DNA, 15 bp, Homo sapiens
accgtgggccaaatc

SEQ ID NO: 39924 - DNA, 15 bp, Homo sapiens
caccgtgggccaaat

SEQ ID NO: 39925 - DNA, 15 bp, Homo sapiens
ccaccgtgggccaaa

SEQ ID NO: 39926 - DNA, 15 bp, Homo sapiens
cccaccgtgggccaa

SEQ ID NO: 39927 - DNA, 15 bp, Homo sapiens
ccccaccgtgggcca

SEQ ID NO: 39928 - DNA, 15 bp, Homo sapiens
accccaccgtgggcc

SEQ ID NO: 39929 - DNA, 15 bp, Homo sapiens
gaccccaccgtgggc

SEQ ID NO: 39930 - DNA, 15 bp, Homo sapiens
tgaccccaccgtggg

SEQ ID NO: 39931 - DNA, 15 bp, Homo sapiens
ttgaccccaccgtgg

SEQ ID NO: 39932 - DNA, 15 bp, Homo sapiens
attgaccccaccgtg

SEQ ID NO: 39933 - DNA, 15 bp, Homo sapiens
aattgaccccaccgt

SEQ ID NO: 39934 - DNA, 15 bp, Homo sapiens
aaattgaccccaccg

SEQ ID NO: 39935 - DNA, 15 bp, Homo sapiens
aaaattgaccccacc

SEQ ID NO: 39936 - DNA, 15 bp, Homo sapiens
aaaaattgaccccac

SEQ ID NO: 39937 - DNA, 15 bp, Homo sapiens
aaaaaattgacccca

SEQ ID NO: 39938 - DNA, 15 bp, Homo sapiens
aaaaaaattgacccc

SEQ ID NO: 39939 - DNA, 15 bp, Homo sapiens
aaaaaaaattgaccc

SEQ ID NO: 39940 - DNA, 15 bp, Homo sapiens
aaaaaaaaattgacc

SEQ ID NO: 39941 - DNA, 15 bp, Homo sapiens
aaaaaaaaaattgac

SEQ ID NO: 39942 - DNA, 15 bp, Homo sapiens
aaaaaaaaaaattga

SEQ ID NO: 39943 - DNA, 15 bp, Homo sapiens
cctcaaaaaaaaaaa

SEQ ID NO: 39944 - DNA, 15 bp, Homo sapiens
acctcaaaaaaaaaa

SEQ ID NO: 39945 - DNA, 15 bp, Homo sapiens
cacctcaaaaaaaaa

SEQ ID NO: 39946 - DNA, 15 bp, Homo sapiens
ccacctcaaaaaaaa

SEQ ID NO: 39947 - DNA, 15 bp, Homo sapiens
tccacctcaaaaaaa

SEQ ID NO: 39948 - DNA, 15 bp, Homo sapiens
ctccacctcaaaaaa

SEQ ID NO: 39949 - DNA, 15 bp, Homo sapiens
actccacctcaaaaa

SEQ ID NO: 39950 - DNA, 15 bp, Homo sapiens
gactccacctcaaaa

SEQ ID NO: 39951 - DNA, 15 bp, Homo sapiens
agactccacctcaaa

SEQ ID NO: 39952 - DNA, 15 bp, Homo sapiens
aagactccacctcaa

SEQ ID NO: 39953 - DNA, 15 bp, Homo sapiens
caagactccacctca

SEQ ID NO: 39954 - DNA, 15 bp, Homo sapiens
gcaagactccacctc

SEQ ID NO: 39955 - DNA, 15 bp, Homo sapiens
agcaagactccacct

SEQ ID NO: 39956 - DNA, 15 bp, Homo sapiens
gagcaagactccacc

SEQ ID NO: 39957 - DNA, 15 bp, Homo sapiens
agagcaagactccac

SEQ ID NO: 39958 - DNA, 15 bp, Homo sapiens
gtggtgagctgagat

SEQ ID NO: 39959 - DNA, 15 bp, Homo sapiens
tgtggtgagctgaga

SEQ ID NO: 39960 - DNA, 15 bp, Homo sapiens
ttgtggtgagctgag

SEQ ID NO: 39961 - DNA, 15 bp, Homo sapiens
gttgtggtgagctga

SEQ ID NO: 39962 - DNA, 15 bp, Homo sapiens
ggttgtggtgagctg

SEQ ID NO: 39963 - DNA, 15 bp, Homo sapiens
aggttgtggtgagct

SEQ ID NO: 39964 - DNA, 15 bp, Homo sapiens
gaggttgtggtgagc

SEQ ID NO: 39965 - DNA, 15 bp, Homo sapiens
ggaggttgtggtgag

SEQ ID NO: 39966 - DNA, 15 bp, Homo sapiens
tggaggttgtggtga

SEQ ID NO: 39967 - DNA, 15 bp, Homo sapiens
gtggaggttgtggtg

SEQ ID NO: 39968 - DNA, 15 bp, Homo sapiens
ggtggaggttgtggt

SEQ ID NO: 39969 - DNA, 15 bp, Homo sapiens
aggtggaggttgtgg

SEQ ID NO: 39970 - DNA, 15 bp, Homo sapiens
gaggtggaggttgtg

SEQ ID NO: 39971 - DNA, 15 bp, Homo sapiens
ggaggtggaggttgt

SEQ ID NO: 39972 - DNA, 15 bp, Homo sapiens
cgggaggtggaggtt

SEQ ID NO: 39973 - DNA, 15 bp, Homo sapiens
ccgggaggtggaggt

SEQ ID NO: 39974 - DNA, 15 bp, Homo sapiens
cccgggaggtggagg

SEQ ID NO: 39975 - DNA, 15 bp, Homo sapiens
acccgggaggtggag

SEQ ID NO: 39976 - DNA, 15 bp, Homo sapiens
aacccgggaggtgga

SEQ ID NO: 39977 - DNA, 15 bp, Homo sapiens
gaacccgggaggtgg

SEQ ID NO: 39978 - DNA, 15 bp, Homo sapiens
tgaacccgggaggtg

SEQ ID NO: 39979 - DNA, 15 bp, Homo sapiens
ctgaacccgggaggt

SEQ ID NO: 39980 - DNA, 15 bp, Homo sapiens
cctgaacccgggagg

SEQ ID NO: 39981 - DNA, 15 bp, Homo sapiens
gcctgaacccgggag

SEQ ID NO: 39982 - DNA, 15 bp, Homo sapiens
cgcctgaacccggga

SEQ ID NO: 39983 - DNA, 15 bp, Homo sapiens
tcgcctgaacccggg

SEQ ID NO: 39984 - DNA, 15 bp, Homo sapiens
atcgcctgaacccgg

SEQ ID NO: 39985 - DNA, 15 bp, Homo sapiens
gatcgcctgaacccg

SEQ ID NO: 39986 - DNA, 15 bp, Homo sapiens
ggatcgcctgaaccc

SEQ ID NO: 39987 - DNA, 15 bp, Homo sapiens
aggatcgcctgaacc

SEQ ID NO: 39988 - DNA, 15 bp, Homo sapiens
gaggatcgcctgaac

SEQ ID NO: 39989 - DNA, 15 bp, Homo sapiens
ggaggatcgcctgaa

SEQ ID NO: 39990 - DNA, 15 bp, Homo sapiens
aggaggatcgcctga

SEQ ID NO: 39991 - DNA, 15 bp, Homo sapiens
caggaggatcgcctg

SEQ ID NO: 39992 - DNA, 15 bp, Homo sapiens
gcaggaggatcgcct

SEQ ID NO: 39993 - DNA, 15 bp, Homo sapiens
ggcaggaggatcgcc

SEQ ID NO: 39994 - DNA, 15 bp, Homo sapiens
cggcaggaggatcgc

SEQ ID NO: 39995 - DNA, 15 bp, Homo sapiens
gcggcaggaggatcg

SEQ ID NO: 39996 - DNA, 15 bp, Homo sapiens
tgcggcaggaggatc

SEQ ID NO: 39997 - DNA, 15 bp, Homo sapiens
ctgcggcaggaggat

SEQ ID NO: 39998 - DNA, 15 bp, Homo sapiens
gctgcggcaggagga

SEQ ID NO: 39999 - DNA, 15 bp, Homo sapiens
ggctgcggcaggagg

SEQ ID NO: 40000 - DNA, 15 bp, Homo sapiens
gggaggctgcggcag

SEQ ID NO: 40001 - DNA, 15 bp, Homo sapiens
cgggaggctgcggca

SEQ ID NO: 40002 - DNA, 15 bp, Homo sapiens
tcgggaggctgcggc

SEQ ID NO: 40003 - DNA, 15 bp, Homo sapiens
ctcgggaggctgcgg

SEQ ID NO: 40004 - DNA, 15 bp, Homo sapiens
actcgggaggctgcg

SEQ ID NO: 40005 - DNA, 15 bp, Homo sapiens
tactcgggaggctgc

SEQ ID NO: 40006 - DNA, 15 bp, Homo sapiens
gcatgcctgtagtcc

SEQ ID NO: 40007 - DNA, 15 bp, Homo sapiens
tgcatgcctgtagtc

SEQ ID NO: 40008 - DNA, 15 bp, Homo sapiens
gtgcatgcctgtagt

SEQ ID NO: 40009 - DNA, 15 bp, Homo sapiens
ggtgcatgcctgtag

SEQ ID NO: 40010 - DNA, 15 bp, Homo sapiens
tgtggtggtgcatgc

SEQ ID NO: 40011 - DNA, 15 bp, Homo sapiens
gtgtggtggtgcatg

SEQ ID NO: 40012 - DNA, 15 bp, Homo sapiens
gcaggtgtggtggtg

SEQ ID NO: 40013 - DNA, 15 bp, Homo sapiens
ggcaggtgtggtggt

SEQ ID NO: 40014 - DNA, 15 bp, Homo sapiens
aggcaggtgtggtgg

SEQ ID NO: 40015 - DNA, 15 bp, Homo sapiens
taggcaggtgtggtg

SEQ ID NO: 40016 - DNA, 15 bp, Homo sapiens
ttaggcaggtgtggt

SEQ ID NO: 40017 - DNA, 15 bp, Homo sapiens
attaggcaggtgtgg

SEQ ID NO: 40018 - DNA, 15 bp, Homo sapiens
aattaggcaggtgtg

SEQ ID NO: 40019 - DNA, 15 bp, Homo sapiens
aaattaggcaggtgt

SEQ ID NO: 40020 - DNA, 15 bp, Homo sapiens
aaaattaggcaggtg

SEQ ID NO: 40021 - DNA, 15 bp, Homo sapiens
aaaaattaggcaggt

SEQ ID NO: 40022 - DNA, 15 bp, Homo sapiens
caaaaattaggcagg

SEQ ID NO: 40023 - DNA, 15 bp, Homo sapiens
acaaaaattaggcag

SEQ ID NO: 40024 - DNA, 15 bp, Homo sapiens
tacaaaaattaggca

SEQ ID NO: 40025 - DNA, 15 bp, Homo sapiens
atacaaaaattaggc

SEQ ID NO: 40026 - DNA, 15 bp, Homo sapiens
aatacaaaaattagg

SEQ ID NO: 40027 - DNA, 15 bp, Homo sapiens
tcatctctactaaaa

SEQ ID NO: 40028 - DNA, 15 bp, Homo sapiens
ctcatctctactaaa

SEQ ID NO: 40029 - DNA, 15 bp, Homo sapiens
cctcatctctactaa

SEQ ID NO: 40030 - DNA, 15 bp, Homo sapiens
acctcatctctacta

SEQ ID NO: 40031 - DNA, 15 bp, Homo sapiens
aacctcatctctact

SEQ ID NO: 40032 - DNA, 15 bp, Homo sapiens
aaacctcatctctac

SEQ ID NO: 40033 - DNA, 15 bp, Homo sapiens
aaaacctcatctcta

SEQ ID NO: 40034 - DNA, 15 bp, Homo sapiens
caaaacctcatctct

SEQ ID NO: 40035 - DNA, 15 bp, Homo sapiens
gcaaaacctcatctc

SEQ ID NO: 40036 - DNA, 15 bp, Homo sapiens
ggcaaaacctcatct

SEQ ID NO: 40037 - DNA, 15 bp, Homo sapiens
tggcaaaacctcatc

SEQ ID NO: 40038 - DNA, 15 bp, Homo sapiens
gtggcaaaacctcat

SEQ ID NO: 40039 - DNA, 15 bp, Homo sapiens
tgtggcaaaacctca

SEQ ID NO: 40040 - DNA, 15 bp, Homo sapiens
atgtggcaaaacctc

SEQ ID NO: 40041 - DNA, 15 bp, Homo sapiens
aatgtggcaaaacct

SEQ ID NO: 40042 - DNA, 15 bp, Homo sapiens
caatgtggcaaaacc

SEQ ID NO: 40043 - DNA, 15 bp, Homo sapiens
ccaatgtggcaaaac

SEQ ID NO: 40044 - DNA, 15 bp, Homo sapiens
gccaatgtggcaaaa

SEQ ID NO: 40045 - DNA, 15 bp, Homo sapiens
ggccaatgtggcaaa

SEQ ID NO: 40046 - DNA, 15 bp, Homo sapiens
tggccaatgtggcaa

SEQ ID NO: 40047 - DNA, 15 bp, Homo sapiens
ctggccaatgtggca

SEQ ID NO: 40048 - DNA, 15 bp, Homo sapiens
cctggccaatgtggc

SEQ ID NO: 40049 - DNA, 15 bp, Homo sapiens
gcctggccaatgtgg

SEQ ID NO: 40050 - DNA, 15 bp, Homo sapiens
agcctggccaatgtg

SEQ ID NO: 40051 - DNA, 15 bp, Homo sapiens
tagcctggccaatgt

SEQ ID NO: 40052 - DNA, 15 bp, Homo sapiens
ctagcctggccaatg

SEQ ID NO: 40053 - DNA, 15 bp, Homo sapiens
actagcctggccaat

SEQ ID NO: 40054 - DNA, 15 bp, Homo sapiens
gactagcctggccaa

SEQ ID NO: 40055 - DNA, 15 bp, Homo sapiens
agactagcctggcca

SEQ ID NO: 40056 - DNA, 15 bp, Homo sapiens
gagactagcctggcc

SEQ ID NO: 40057 - DNA, 15 bp, Homo sapiens
cgagactagcctggc

SEQ ID NO: 40058 - DNA, 15 bp, Homo sapiens
tcgagactagcctgg

SEQ ID NO: 40059 - DNA, 15 bp, Homo sapiens
ttcgagactagcctg

SEQ ID NO: 40060 - DNA, 15 bp, Homo sapiens
gttcgagactagcct

SEQ ID NO: 40061 - DNA, 15 bp, Homo sapiens
agttcgagactagcc

SEQ ID NO: 40062 - DNA, 15 bp, Homo sapiens
gagttcgagactagc

SEQ ID NO: 40063 - DNA, 15 bp, Homo sapiens
ggagttcgagactag

SEQ ID NO: 40064 - DNA, 15 bp, Homo sapiens
aggagttcgagacta

SEQ ID NO: 40065 - DNA, 15 bp, Homo sapiens
caggagttcgagact

SEQ ID NO: 40066 - DNA, 15 bp, Homo sapiens
gggtcaggagttcga

SEQ ID NO: 40067 - DNA, 15 bp, Homo sapiens
ggggtcaggagttcg

SEQ ID NO: 40068 - DNA, 15 bp, Homo sapiens
tggggtcaggagttc

SEQ ID NO: 40069 - DNA, 15 bp, Homo sapiens
ctggggtcaggagtt

SEQ ID NO: 40070 - DNA, 15 bp, Homo sapiens
cctggggtcaggagt

SEQ ID NO: 40071 - DNA, 15 bp, Homo sapiens
acctggggtcaggag

SEQ ID NO: 40072 - DNA, 15 bp, Homo sapiens
cacctggggtcagga

SEQ ID NO: 40073 - DNA, 15 bp, Homo sapiens
ccacctggggtcagg

SEQ ID NO: 40074 - DNA, 15 bp, Homo sapiens
accacctggggtcag

SEQ ID NO: 40075 - DNA, 15 bp, Homo sapiens
gaccacctggggtca

SEQ ID NO: 40076 - DNA, 15 bp, Homo sapiens
agaccacctggggtc

SEQ ID NO: 40077 - DNA, 15 bp, Homo sapiens
cagaccacctggggt

SEQ ID NO: 40078 - DNA, 15 bp, Homo sapiens
gcagaccacctgggg

SEQ ID NO: 40079 - DNA, 15 bp, Homo sapiens
cgcagaccacctggg

SEQ ID NO: 40080 - DNA, 15 bp, Homo sapiens
gcgcagaccacctgg

SEQ ID NO: 40081 - DNA, 15 bp, Homo sapiens
cgcgcagaccacctg

SEQ ID NO: 40082 - DNA, 15 bp, Homo sapiens
gcgcgcagaccacct

SEQ ID NO: 40083 - DNA, 15 bp, Homo sapiens
ggcgcgcagaccacc

SEQ ID NO: 40084 - DNA, 15 bp, Homo sapiens
aggcgcgcagaccac

SEQ ID NO: 40085 - DNA, 15 bp, Homo sapiens
gaggcgcgcagacca

SEQ ID NO: 40086 - DNA, 15 bp, Homo sapiens
tgaggcgcgcagacc

SEQ ID NO: 40087 - DNA, 15 bp, Homo sapiens
ctgaggcgcgcagac

SEQ ID NO: 40088 - DNA, 15 bp, Homo sapiens
gctgaggcgcgcaga

SEQ ID NO: 40089 - DNA, 15 bp, Homo sapiens
ggctgaggcgcgcag

SEQ ID NO: 40090 - DNA, 15 bp, Homo sapiens
aggctgaggcgcgca

SEQ ID NO: 40091 - DNA, 15 bp, Homo sapiens
gaggctgaggcgcgc

SEQ ID NO: 40092 - DNA, 15 bp, Homo sapiens
ggaggctgaggcgcg

SEQ ID NO: 40093 - DNA, 15 bp, Homo sapiens
gggaggctgaggcgc

SEQ ID NO: 40094 - DNA, 15 bp, Homo sapiens
cgtggtggctcacgc

SEQ ID NO: 40095 - DNA, 15 bp, Homo sapiens
gcgtggtggctcacg

SEQ ID NO: 40096 - DNA, 15 bp, Homo sapiens
cgggccaggcgtggt

SEQ ID NO: 40097 - DNA, 15 bp, Homo sapiens
tcgggccaggcgtgg

SEQ ID NO: 40098 - DNA, 15 bp, Homo sapiens
gtcgggccaggcgtg

SEQ ID NO: 40099 - DNA, 15 bp, Homo sapiens
ggtcgggccaggcgt

SEQ ID NO: 40100 - DNA, 15 bp, Homo sapiens
gggtcgggccaggcg

SEQ ID NO: 40101 - DNA, 15 bp, Homo sapiens
tgggtcgggccaggc

SEQ ID NO: 40102 - DNA, 15 bp, Homo sapiens
ttgggtcgggccagg

SEQ ID NO: 40103 - DNA, 15 bp, Homo sapiens
attgggtcgggccag

SEQ ID NO: 40104 - DNA, 15 bp, Homo sapiens
cattgggtcgggcca

SEQ ID NO: 40105 - DNA, 15 bp, Homo sapiens
acattgggtcgggcc

SEQ ID NO: 40106 - DNA, 15 bp, Homo sapiens
aacattgggtcgggc

SEQ ID NO: 40107 - DNA, 15 bp, Homo sapiens
aaacattgggtcggg

SEQ ID NO: 40108 - DNA, 15 bp, Homo sapiens
aaaacattgggtcgg

SEQ ID NO: 40109 - DNA, 15 bp, Homo sapiens
gaaaacattgggtcg

SEQ ID NO: 40110 - DNA, 15 bp, Homo sapiens
agaaaacattgggtc

SEQ ID NO: 40111 - DNA, 15 bp, Homo sapiens
tagaaaacattgggt

SEQ ID NO: 40112 - DNA, 15 bp, Homo sapiens
atagaaaacattggg

SEQ ID NO: 40113 - DNA, 15 bp, Homo sapiens
tatagaaaacattgg

SEQ ID NO: 40114 - DNA, 15 bp, Homo sapiens
ctatagaaaacattg

SEQ ID NO: 40115 - DNA, 15 bp, Homo sapiens
tctatagaaaacatt

SEQ ID NO: 40116 - DNA, 15 bp, Homo sapiens
ctctatagaaaacat

SEQ ID NO: 40117 - DNA, 15 bp, Homo sapiens
gctctatagaaaaca

SEQ ID NO: 40118 - DNA, 15 bp, Homo sapiens
agctctatagaaaac

SEQ ID NO: 40119 - DNA, 15 bp, Homo sapiens
gagctctatagaaaa

SEQ ID NO: 40120 - DNA, 15 bp, Homo sapiens
agagctctatagaaa

SEQ ID NO: 40121 - DNA, 15 bp, Homo sapiens
aagagctctatagaa

SEQ ID NO: 40122 - DNA, 15 bp, Homo sapiens
aaagagctctataga

SEQ ID NO: 40123 - DNA, 15 bp, Homo sapiens
gaaagagctctatag

SEQ ID NO: 40124 - DNA, 15 bp, Homo sapiens
ggaaagagctctata

SEQ ID NO: 40125 - DNA, 15 bp, Homo sapiens
gggaaagagctctat

SEQ ID NO: 40126 - DNA, 15 bp, Homo sapiens
tgggaaagagctcta

SEQ ID NO: 40127 - DNA, 15 bp, Homo sapiens
ctgggaaagagctct

SEQ ID NO: 40128 - DNA, 15 bp, Homo sapiens
cctgggaaagagctc

SEQ ID NO: 40129 - DNA, 15 bp, Homo sapiens
gcctgggaaagagct

SEQ ID NO: 40130 - DNA, 15 bp, Homo sapiens
ggcctgggaaagagc

SEQ ID NO: 40131 - DNA, 15 bp, Homo sapiens
aggcctgggaaagag

SEQ ID NO: 40132 - DNA, 15 bp, Homo sapiens
gaggcctgggaaaga

SEQ ID NO: 40133 - DNA, 15 bp, Homo sapiens
agaggcctgggaaag

SEQ ID NO: 40134 - DNA, 15 bp, Homo sapiens
gagaggcctgggaaa

SEQ ID NO: 40135 - DNA, 15 bp, Homo sapiens
ggagaggcctgggaa

SEQ ID NO: 40136 - DNA, 15 bp, Homo sapiens
gggagaggcctggga

SEQ ID NO: 40137 - DNA, 15 bp, Homo sapiens
ggggagaggcctggg

SEQ ID NO: 40138 - DNA, 15 bp, Homo sapiens
aggggagaggcctgg

SEQ ID NO: 40139 - DNA, 15 bp, Homo sapiens
aaggggagaggcctg

SEQ ID NO: 40140 - DNA, 15 bp, Homo sapiens
aaaggggagaggcct

SEQ ID NO: 40141 - DNA, 15 bp, Homo sapiens
caaaggggagaggcc

SEQ ID NO: 40142 - DNA, 15 bp, Homo sapiens
gcaaaggggagaggc

SEQ ID NO: 40143 - DNA, 15 bp, Homo sapiens
tgcaaaggggagagg

SEQ ID NO: 40144 - DNA, 15 bp, Homo sapiens
ttgcaaaggggagag

SEQ ID NO: 40145 - DNA, 15 bp, Homo sapiens
cttgcaaaggggaga

SEQ ID NO: 40146 - DNA, 15 bp, Homo sapiens
gcttgcaaaggggag

SEQ ID NO: 40147 - DNA, 15 bp, Homo sapiens
tgcttgcaaagggga

SEQ ID NO: 40148 - DNA, 15 bp, Homo sapiens
ctgcttgcaaagggg

SEQ ID NO: 40149 - DNA, 15 bp, Homo sapiens
gctgcttgcaaaggg

SEQ ID NO: 40150 - DNA, 15 bp, Homo sapiens
cgctgcttgcaaagg

SEQ ID NO: 40151 - DNA, 15 bp, Homo sapiens
acgctgcttgcaaag

SEQ ID NO: 40152 - DNA, 15 bp, Homo sapiens
tacgctgcttgcaaa

SEQ ID NO: 40153 - DNA, 15 bp, Homo sapiens
ctacgctgcttgcaa

SEQ ID NO: 40154 - DNA, 15 bp, Homo sapiens
gctacgctgcttgca

SEQ ID NO: 40155 - DNA, 15 bp, Homo sapiens
agctacgctgcttgc

SEQ ID NO: 40156 - DNA, 15 bp, Homo sapiens
cagctacgctgcttg

SEQ ID NO: 40157 - DNA, 15 bp, Homo sapiens
ccagctacgctgctt

SEQ ID NO: 40158 - DNA, 15 bp, Homo sapiens
tccagctacgctgct

SEQ ID NO: 40159 - DNA, 15 bp, Homo sapiens
ctccagctacgctgc

SEQ ID NO: 40160 - DNA, 15 bp, Homo sapiens
cctccagctacgctg

SEQ ID NO: 40161 - DNA, 15 bp, Homo sapiens
ccctccagctacgct

SEQ ID NO: 40162 - DNA, 15 bp, Homo sapiens
accctccagctacgc

SEQ ID NO: 40163 - DNA, 15 bp, Homo sapiens
gaccctccagctacg

SEQ ID NO: 40164 - DNA, 15 bp, Homo sapiens
agaccctccagctac

SEQ ID NO: 40165 - DNA, 15 bp, Homo sapiens
gagaccctccagcta

SEQ ID NO: 40166 - DNA, 15 bp, Homo sapiens
tgagaccctccagct

SEQ ID NO: 40167 - DNA, 15 bp, Homo sapiens
atgagaccctccagc

SEQ ID NO: 40168 - DNA, 15 bp, Homo sapiens
gatgagaccctccag

SEQ ID NO: 40169 - DNA, 15 bp, Homo sapiens
tgatgagaccctcca

SEQ ID NO: 40170 - DNA, 15 bp, Homo sapiens
ctgatgagaccctcc

SEQ ID NO: 40171 - DNA, 15 bp, Homo sapiens
gctgatgagaccctc

SEQ ID NO: 40172 - DNA, 15 bp, Homo sapiens
tgctgatgagaccct

SEQ ID NO: 40173 - DNA, 15 bp, Homo sapiens
ttgctgatgagaccc

SEQ ID NO: 40174 - DNA, 15 bp, Homo sapiens
cttgctgatgagacc

SEQ ID NO: 40175 - DNA, 15 bp, Homo sapiens
gcttgctgatgagac

SEQ ID NO: 40176 - DNA, 15 bp, Homo sapiens
ggcttgctgatgaga

SEQ ID NO: 40177 - DNA, 15 bp, Homo sapiens
gggcttgctgatgag

SEQ ID NO: 40178 - DNA, 15 bp, Homo sapiens
ggggcttgctgatga

SEQ ID NO: 40179 - DNA, 15 bp, Homo sapiens
cggggcttgctgatg

SEQ ID NO: 40180 - DNA, 15 bp, Homo sapiens
ccggggcttgctgat

SEQ ID NO: 40181 - DNA, 15 bp, Homo sapiens
tccggggcttgctga

SEQ ID NO: 40182 - DNA, 15 bp, Homo sapiens
ctccggggcttgctg

SEQ ID NO: 40183 - DNA, 15 bp, Homo sapiens
cctccggggcttgct

SEQ ID NO: 40184 - DNA, 15 bp, Homo sapiens
gcctccggggcttgc

SEQ ID NO: 40185 - DNA, 15 bp, Homo sapiens
cgcctccggggcttg

SEQ ID NO: 40186 - DNA, 15 bp, Homo sapiens
tcgcctccggggctt

SEQ ID NO: 40187 - DNA, 15 bp, Homo sapiens
ctcgcctccggggct

SEQ ID NO: 40188 - DNA, 15 bp, Homo sapiens
cctcgcctccggggc

SEQ ID NO: 40189 - DNA, 15 bp, Homo sapiens
ccctcgcctccgggg

SEQ ID NO: 40190 - DNA, 15 bp, Homo sapiens
cccctcgcctccggg

SEQ ID NO: 40191 - DNA, 15 bp, Homo sapiens
ccccctcgcctccgg

SEQ ID NO: 40192 - DNA, 15 bp, Homo sapiens
accccctcgcctccg

SEQ ID NO: 40193 - DNA, 15 bp, Homo sapiens
gaccccctcgcctcc

SEQ ID NO: 40194 - DNA, 15 bp, Homo sapiens
agaccccctcgcctc

SEQ ID NO: 40195 - DNA, 15 bp, Homo sapiens
cagaccccctcgcct

SEQ ID NO: 40196 - DNA, 15 bp, Homo sapiens
ccagaccccctcgcc

SEQ ID NO: 40197 - DNA, 15 bp, Homo sapiens
cccagaccccctcgc

SEQ ID NO: 40198 - DNA, 15 bp, Homo sapiens
ccccagaccccctcg

SEQ ID NO: 40199 - DNA, 15 bp, Homo sapiens
gccccagaccccctc

SEQ ID NO: 40200 - DNA, 15 bp, Homo sapiens
agccccagaccccct

SEQ ID NO: 40201 - DNA, 15 bp, Homo sapiens
tagccccagaccccc

SEQ ID NO: 40202 - DNA, 15 bp, Homo sapiens
gtagccccagacccc

SEQ ID NO: 40203 - DNA, 15 bp, Homo sapiens
ggtagccccagaccc

SEQ ID NO: 40204 - DNA, 15 bp, Homo sapiens
tggtagccccagacc

SEQ ID NO: 40205 - DNA, 15 bp, Homo sapiens
ctggtagccccagac

SEQ ID NO: 40206 - DNA, 15 bp, Homo sapiens
gctggtagccccaga

SEQ ID NO: 40207 - DNA, 15 bp, Homo sapiens
agctggtagccccag

SEQ ID NO: 40208 - DNA, 15 bp, Homo sapiens
cagctggtagcccca

SEQ ID NO: 40209 - DNA, 15 bp, Homo sapiens
ccagctggtagcccc

SEQ ID NO: 40210 - DNA, 15 bp, Homo sapiens
tccagctggtagccc

SEQ ID NO: 40211 - DNA, 15 bp, Homo sapiens
gtccagctggtagcc

SEQ ID NO: 40212 - DNA, 15 bp, Homo sapiens
ggtccagctggtagc

SEQ ID NO: 40213 - DNA, 15 bp, Homo sapiens
tggtccagctggtag

SEQ ID NO: 40214 - DNA, 15 bp, Homo sapiens
gtggtccagctggta

SEQ ID NO: 40215 - DNA, 15 bp, Homo sapiens
ggtggtccagctggt

SEQ ID NO: 40216 - DNA, 15 bp, Homo sapiens
aggtggtccagctgg

SEQ ID NO: 40217 - DNA, 15 bp, Homo sapiens
taggtggtccagctg

SEQ ID NO: 40218 - DNA, 15 bp, Homo sapiens
gtaggtggtccagct

SEQ ID NO: 40219 - DNA, 15 bp, Homo sapiens
tgtaggtggtccagc

SEQ ID NO: 40220 - DNA, 15 bp, Homo sapiens
ctgtaggtggtccag

SEQ ID NO: 40221 - DNA, 15 bp, Homo sapiens
gctgtaggtggtcca

SEQ ID NO: 40222 - DNA, 15 bp, Homo sapiens
agctgtaggtggtcc

SEQ ID NO: 40223 - DNA, 15 bp, Homo sapiens
cagctgtaggtggtc

SEQ ID NO: 40224 - DNA, 15 bp, Homo sapiens
tcagctgtaggtggt

SEQ ID NO: 40225 - DNA, 15 bp, Homo sapiens
ctcagctgtaggtgg

SEQ ID NO: 40226 - DNA, 15 bp, Homo sapiens
cctcagctgtaggtg

SEQ ID NO: 40227 - DNA, 15 bp, Homo sapiens
ccctcagctgtaggt

SEQ ID NO: 40228 - DNA, 15 bp, Homo sapiens
tccctcagctgtagg

SEQ ID NO: 40229 - DNA, 15 bp, Homo sapiens
ctccctcagctgtag

SEQ ID NO: 40230 - DNA, 15 bp, Homo sapiens
cctccctcagctgta

SEQ ID NO: 40231 - DNA, 15 bp, Homo sapiens
ccctccctcagctgt

SEQ ID NO: 40232 - DNA, 15 bp, Homo sapiens
gccctccctcagctg

SEQ ID NO: 40233 - DNA, 15 bp, Homo sapiens
ggccctccctcagct

SEQ ID NO: 40234 - DNA, 15 bp, Homo sapiens
gggccctccctcagc

SEQ ID NO: 40235 - DNA, 15 bp, Homo sapiens
ggggccctccctcag

SEQ ID NO: 40236 - DNA, 15 bp, Homo sapiens
gggggccctccctca

SEQ ID NO: 40237 - DNA, 15 bp, Homo sapiens
agggggccctccctc

SEQ ID NO: 40238 - DNA, 15 bp, Homo sapiens
aagggggccctccct

SEQ ID NO: 40239 - DNA, 15 bp, Homo sapiens
caagggggccctccc

SEQ ID NO: 40240 - DNA, 15 bp, Homo sapiens
gcaagggggccctcc

SEQ ID NO: 40241 - DNA, 15 bp, Homo sapiens
ggcaagggggccctc

SEQ ID NO: 40242 - DNA, 15 bp, Homo sapiens
aggcaagggggccct

SEQ ID NO: 40243 - DNA, 15 bp, Homo sapiens
gaggcaagggggccc

SEQ ID NO: 40244 - DNA, 15 bp, Homo sapiens
ggaggcaagggggcc

SEQ ID NO: 40245 - DNA, 15 bp, Homo sapiens
aggaggcaagggggc

SEQ ID NO: 40246 - DNA, 15 bp, Homo sapiens
gaggaggcaaggggg

SEQ ID NO: 40247 - DNA, 15 bp, Homo sapiens
ggaggaggcaagggg

SEQ ID NO: 40248 - DNA, 15 bp, Homo sapiens
aggaggaggcaaggg

SEQ ID NO: 40249 - DNA, 15 bp, Homo sapiens
caggaggaggcaagg

SEQ ID NO: 40250 - DNA, 15 bp, Homo sapiens
gcaggaggaggcaag

SEQ ID NO: 40251 - DNA, 15 bp, Homo sapiens
tgcaggaggaggcaa

SEQ ID NO: 40252 - DNA, 15 bp, Homo sapiens
atgcaggaggaggca

SEQ ID NO: 40253 - DNA, 15 bp, Homo sapiens
catgcaggaggaggc

SEQ ID NO: 40254 - DNA, 15 bp, Homo sapiens
gcatgcaggaggagg

SEQ ID NO: 40255 - DNA, 15 bp, Homo sapiens
agcatgcaggaggag

SEQ ID NO: 40256 - DNA, 15 bp, Homo sapiens
cagcatgcaggagga

SEQ ID NO: 40257 - DNA, 15 bp, Homo sapiens
gcagcatgcaggagg

SEQ ID NO: 40258 - DNA, 15 bp, Homo sapiens
cgcagcatgcaggag

SEQ ID NO: 40259 - DNA, 15 bp, Homo sapiens
acgcagcatgcagga

SEQ ID NO: 40260 - DNA, 15 bp, Homo sapiens
aacgcagcatgcagg

SEQ ID NO: 40261 - DNA, 15 bp, Homo sapiens
aaacgcagcatgcag

SEQ ID NO: 40262 - DNA, 15 bp, Homo sapiens
caaacgcagcatgca

SEQ ID NO: 40263 - DNA, 15 bp, Homo sapiens
ccaaacgcagcatgc

SEQ ID NO: 40264 - DNA, 15 bp, Homo sapiens
cccaaacgcagcatg

SEQ ID NO: 40265 - DNA, 15 bp, Homo sapiens
ccccaaacgcagcat

SEQ ID NO: 40266 - DNA, 15 bp, Homo sapiens
tccccaaacgcagca

SEQ ID NO: 40267 - DNA, 15 bp, Homo sapiens
ctccccaaacgcagc

SEQ ID NO: 40268 - DNA, 15 bp, Homo sapiens
tctccccaaacgcag

SEQ ID NO: 40269 - DNA, 15 bp, Homo sapiens
ctctccccaaacgca

SEQ ID NO: 40270 - DNA, 15 bp, Homo sapiens
gctctccccaaacgc

SEQ ID NO: 40271 - DNA, 15 bp, Homo sapiens
cgctctccccaaacg

SEQ ID NO: 40272 - DNA, 15 bp, Homo sapiens
ccgctctccccaaac

SEQ ID NO: 40273 - DNA, 15 bp, Homo sapiens
cccgctctccccaaa

SEQ ID NO: 40274 - DNA, 15 bp, Homo sapiens
tcccgctctccccaa

SEQ ID NO: 40275 - DNA, 15 bp, Homo sapiens
ttcccgctctcccca

SEQ ID NO: 40276 - DNA, 15 bp, Homo sapiens
cttcccgctctcccc

SEQ ID NO: 40277 - DNA, 15 bp, Homo sapiens
tcttcccgctctccc

SEQ ID NO: 40278 - DNA, 15 bp, Homo sapiens
ttcttcccgctctcc

SEQ ID NO: 40279 - DNA, 15 bp, Homo sapiens
attcttcccgctctc

SEQ ID NO: 40280 - DNA, 15 bp, Homo sapiens
cattcttcccgctct

SEQ ID NO: 40281 - DNA, 15 bp, Homo sapiens
gcattcttcccgctc

SEQ ID NO: 40282 - DNA, 15 bp, Homo sapiens
ggcattcttcccgct

SEQ ID NO: 40283 - DNA, 15 bp, Homo sapiens
aggcattcttcccgc

SEQ ID NO: 40284 - DNA, 15 bp, Homo sapiens
aaggcattcttcccg

SEQ ID NO: 40285 - DNA, 15 bp, Homo sapiens
gaaggcattcttccc

SEQ ID NO: 40286 - DNA, 15 bp, Homo sapiens
tgaaggcattcttcc

SEQ ID NO: 40287 - DNA, 15 bp, Homo sapiens
ttgaaggcattcttc

SEQ ID NO: 40288 - DNA, 15 bp, Homo sapiens
cttgaaggcattctt

SEQ ID NO: 40289 - DNA, 15 bp, Homo sapiens
ccttgaaggcattct

SEQ ID NO: 40290 - DNA, 15 bp, Homo sapiens
tccttgaaggcattc

SEQ ID NO: 40291 - DNA, 15 bp, Homo sapiens
gtccttgaaggcatt

SEQ ID NO: 40292 - DNA, 15 bp, Homo sapiens
agtccttgaaggcat

SEQ ID NO: 40293 - DNA, 15 bp, Homo sapiens
aagtccttgaaggca

SEQ ID NO: 40294 - DNA, 15 bp, Homo sapiens
gaagtccttgaaggc

SEQ ID NO: 40295 - DNA, 15 bp, Homo sapiens
ggaagtccttgaagg

SEQ ID NO: 40296 - DNA, 15 bp, Homo sapiens
gggaagtccttgaag

SEQ ID NO: 40297 - DNA, 15 bp, Homo sapiens
cgggaagtccttgaa

SEQ ID NO: 40298 - DNA, 15 bp, Homo sapiens
tcgggaagtccttga

SEQ ID NO: 40299 - DNA, 15 bp, Homo sapiens
gtcgggaagtccttg

SEQ ID NO: 40300 - DNA, 15 bp, Homo sapiens
ggtcgggaagtcctt

SEQ ID NO: 40301 - DNA, 15 bp, Homo sapiens
tggtcgggaagtcct

SEQ ID NO: 40302 - DNA, 15 bp, Homo sapiens
gtggtcgggaagtcc

SEQ ID NO: 40303 - DNA, 15 bp, Homo sapiens
ggtggtcgggaagtc

SEQ ID NO: 40304 - DNA, 15 bp, Homo sapiens
tggtggtcgggaagt

SEQ ID NO: 40305 - DNA, 15 bp, Homo sapiens
ctggtggtcgggaag

SEQ ID NO: 40306 - DNA, 15 bp, Homo sapiens
cctggtggtcgggaa

SEQ ID NO: 40307 - DNA, 15 bp, Homo sapiens
ccctggtggtcggga

SEQ ID NO: 40308 - DNA, 15 bp, Homo sapiens
tccctggtggtcggg

SEQ ID NO: 40309 - DNA, 15 bp, Homo sapiens
gtccctggtggtcgg

SEQ ID NO: 40310 - DNA, 15 bp, Homo sapiens
tgtccctggtggtcg

SEQ ID NO: 40311 - DNA, 15 bp, Homo sapiens
ttgtccctggtggtc

SEQ ID NO: 40312 - DNA, 15 bp, Homo sapiens
tttgtccctggtggt

SEQ ID NO: 40313 - DNA, 15 bp, Homo sapiens
ctttgtccctggtgg

SEQ ID NO: 40314 - DNA, 15 bp, Homo sapiens
cctttgtccctggtg

SEQ ID NO: 40315 - DNA, 15 bp, Homo sapiens
ccctttgtccctggt

SEQ ID NO: 40316 - DNA, 15 bp, Homo sapiens
tccctttgtccctgg

SEQ ID NO: 40317 - DNA, 15 bp, Homo sapiens
atccctttgtccctg

SEQ ID NO: 40318 - DNA, 15 bp, Homo sapiens
catccctttgtccct

SEQ ID NO: 40319 - DNA, 15 bp, Homo sapiens
tcatccctttgtccc

SEQ ID NO: 40320 - DNA, 15 bp, Homo sapiens
ctcatccctttgtcc

SEQ ID NO: 40321 - DNA, 15 bp, Homo sapiens
gctcatccctttgtc

SEQ ID NO: 40322 - DNA, 15 bp, Homo sapiens
ggctcatccctttgt

SEQ ID NO: 40323 - DNA, 15 bp, Homo sapiens
gggctcatccctttg

SEQ ID NO: 40324 - DNA, 15 bp, Homo sapiens
agggctcatcccttt

SEQ ID NO: 40325 - DNA, 15 bp, Homo sapiens
cagggctcatccctt

SEQ ID NO: 40326 - DNA, 15 bp, Homo sapiens
ccagggctcatccct

SEQ ID NO: 40327 - DNA, 15 bp, Homo sapiens
cccagggctcatccc

SEQ ID NO: 40328 - DNA, 15 bp, Homo sapiens
tcccagggctcatcc

SEQ ID NO: 40329 - DNA, 15 bp, Homo sapiens
ctcccagggctcatc

SEQ ID NO: 40330 - DNA, 15 bp, Homo sapiens
gctcccagggctcat

SEQ ID NO: 40331 - DNA, 15 bp, Homo sapiens
ggctcccagggctca

SEQ ID NO: 40332 - DNA, 15 bp, Homo sapiens
cggctcccagggctc

SEQ ID NO: 40333 - DNA, 15 bp, Homo sapiens
tcggctcccagggct

SEQ ID NO: 40334 - DNA, 15 bp, Homo sapiens
ttcggctcccagggc

SEQ ID NO: 40335 - DNA, 15 bp, Homo sapiens
cttcggctcccaggg

SEQ ID NO: 40336 - DNA, 15 bp, Homo sapiens
gcttcggctcccagg

SEQ ID NO: 40337 - DNA, 15 bp, Homo sapiens
ggcttcggctcccag

SEQ ID NO: 40338 - DNA, 15 bp, Homo sapiens
gggcttcggctccca

SEQ ID NO: 40339 - DNA, 15 bp, Homo sapiens
tgggcttcggctccc

SEQ ID NO: 40340 - DNA, 15 bp, Homo sapiens
ctgggcttcggctcc

SEQ ID NO: 40341 - DNA, 15 bp, Homo sapiens
gctgggcttcggctc

SEQ ID NO: 40342 - DNA, 15 bp, Homo sapiens
tgctgggcttcggct

SEQ ID NO: 40343 - DNA, 15 bp, Homo sapiens
ctgctgggcttcggc

SEQ ID NO: 40344 - DNA, 15 bp, Homo sapiens
tctgctgggcttcgg

SEQ ID NO: 40345 - DNA, 15 bp, Homo sapiens
atctgctgggcttcg

SEQ ID NO: 40346 - DNA, 15 bp, Homo sapiens
aatctgctgggcttc

SEQ ID NO: 40347 - DNA, 15 bp, Homo sapiens
gaatctgctgggctt

SEQ ID NO: 40348 - DNA, 15 bp, Homo sapiens
agaatctgctgggct

SEQ ID NO: 40349 - DNA, 15 bp, Homo sapiens
tagaatctgctgggc

SEQ ID NO: 40350 - DNA, 15 bp, Homo sapiens
atagaatctgctggg

SEQ ID NO: 40351 - DNA, 15 bp, Homo sapiens
aatagaatctgctgg

SEQ ID NO: 40352 - DNA, 15 bp, Homo sapiens
caatagaatctgctg

SEQ ID NO: 40353 - DNA, 15 bp, Homo sapiens
tcaatagaatctgct

SEQ ID NO: 40354 - DNA, 15 bp, Homo sapiens
ttcaatagaatctgc

SEQ ID NO: 40355 - DNA, 15 bp, Homo sapiens
gttcaatagaatctg

SEQ ID NO: 40356 - DNA, 15 bp, Homo sapiens
cgttcaatagaatct

SEQ ID NO: 40357 - DNA, 15 bp, Homo sapiens
acgttcaatagaatc

SEQ ID NO: 40358 - DNA, 15 bp, Homo sapiens
cacgttcaatagaat

SEQ ID NO: 40359 - DNA, 15 bp, Homo sapiens
acacgttcaatagaa

SEQ ID NO: 40360 - DNA, 15 bp, Homo sapiens
gacacgttcaataga

SEQ ID NO: 40361 - DNA, 15 bp, Homo sapiens
ggacacgttcaatag

SEQ ID NO: 40362 - DNA, 15 bp, Homo sapiens
gggacacgttcaata

SEQ ID NO: 40363 - DNA, 15 bp, Homo sapiens
ggggacacgttcaat

SEQ ID NO: 40364 - DNA, 15 bp, Homo sapiens
tggggacacgttcaa

SEQ ID NO: 40365 - DNA, 15 bp, Homo sapiens
ctggggacacgttca

SEQ ID NO: 40366 - DNA, 15 bp, Homo sapiens
gctggggacacgttc

SEQ ID NO: 40367 - DNA, 15 bp, Homo sapiens
ggctggggacacgtt

SEQ ID NO: 40368 - DNA, 15 bp, Homo sapiens
tggctggggacacgt

SEQ ID NO: 40369 - DNA, 15 bp, Homo sapiens
atggctggggacacg

SEQ ID NO: 40370 - DNA, 15 bp, Homo sapiens
aatggctggggacac

SEQ ID NO: 40371 - DNA, 15 bp, Homo sapiens
caatggctggggaca

SEQ ID NO: 40372 - DNA, 15 bp, Homo sapiens
gcaatggctggggac

SEQ ID NO: 40373 - DNA, 15 bp, Homo sapiens
agcaatggctgggga

SEQ ID NO: 40374 - DNA, 15 bp, Homo sapiens
aagcaatggctgggg

SEQ ID NO: 40375 - DNA, 15 bp, Homo sapiens
taagcaatggctggg

SEQ ID NO: 40376 - DNA, 15 bp, Homo sapiens
ttaagcaatggctgg

SEQ ID NO: 40377 - DNA, 15 bp, Homo sapiens
cttaagcaatggctg

SEQ ID NO: 40378 - DNA, 15 bp, Homo sapiens
tcttaagcaatggct

SEQ ID NO: 40379 - DNA, 15 bp, Homo sapiens
ttcttaagcaatggc

SEQ ID NO: 40380 - DNA, 15 bp, Homo sapiens
cttcttaagcaatgg

SEQ ID NO: 40381 - DNA, 15 bp, Homo sapiens
acttcttaagcaatg

SEQ ID NO: 40382 - DNA, 15 bp, Homo sapiens
cacttcttaagcaat

SEQ ID NO: 40383 - DNA, 15 bp, Homo sapiens
gcacttcttaagcaa

SEQ ID NO: 40384 - DNA, 15 bp, Homo sapiens
tgcacttcttaagca

SEQ ID NO: 40385 - DNA, 15 bp, Homo sapiens
ctgcacttcttaagc

SEQ ID NO: 40386 - DNA, 15 bp, Homo sapiens
cctgcacttcttaag

SEQ ID NO: 40387 - DNA, 15 bp, Homo sapiens
acctgcacttcttaa

SEQ ID NO: 40388 - DNA, 15 bp, Homo sapiens
gacctgcacttctta

SEQ ID NO: 40389 - DNA, 15 bp, Homo sapiens
tgacctgcacttctt

SEQ ID NO: 40390 - DNA, 15 bp, Homo sapiens
gtgacctgcacttct

SEQ ID NO: 40391 - DNA, 15 bp, Homo sapiens
cgtgacctgcacttc

SEQ ID NO: 40392 - DNA, 15 bp, Homo sapiens
ccgtgacctgcactt

SEQ ID NO: 40393 - DNA, 15 bp, Homo sapiens
tccgtgacctgcact

SEQ ID NO: 40394 - DNA, 15 bp, Homo sapiens
ctccgtgacctgcac

SEQ ID NO: 40395 - DNA, 15 bp, Homo sapiens
tctccgtgacctgca

SEQ ID NO: 40396 - DNA, 15 bp, Homo sapiens
gtctccgtgacctgc

SEQ ID NO: 40397 - DNA, 15 bp, Homo sapiens
agtctccgtgacctg

SEQ ID NO: 40398 - DNA, 15 bp, Homo sapiens
aagtctccgtgacct

SEQ ID NO: 40399 - DNA, 15 bp, Homo sapiens
aaagtctccgtgacc

SEQ ID NO: 40400 - DNA, 15 bp, Homo sapiens
caaagtctccgtgac

SEQ ID NO: 40401 - DNA, 15 bp, Homo sapiens
gcaaagtctccgtga

SEQ ID NO: 40402 - DNA, 15 bp, Homo sapiens
agcaaagtctccgtg

SEQ ID NO: 40403 - DNA, 15 bp, Homo sapiens
gagcaaagtctccgt

SEQ ID NO: 40404 - DNA, 15 bp, Homo sapiens
ggagcaaagtctccg

SEQ ID NO: 40405 - DNA, 15 bp, Homo sapiens
aggagcaaagtctcc

SEQ ID NO: 40406 - DNA, 15 bp, Homo sapiens
gaggagcaaagtctc

SEQ ID NO: 40407 - DNA, 15 bp, Homo sapiens
cgaggagcaaagtct

SEQ ID NO: 40408 - DNA, 15 bp, Homo sapiens
acgaggagcaaagtc

SEQ ID NO: 40409 - DNA, 15 bp, Homo sapiens
aacgaggagcaaagt

SEQ ID NO: 40410 - DNA, 15 bp, Homo sapiens
aaacgaggagcaaag

SEQ ID NO: 40411 - DNA, 15 bp, Homo sapiens
aaaacgaggagcaaa

SEQ ID NO: 40412 - DNA, 15 bp, Homo sapiens
gaaaacgaggagcaa

SEQ ID NO: 40413 - DNA, 15 bp, Homo sapiens
ggaaaacgaggagca

SEQ ID NO: 40414 - DNA, 15 bp, Homo sapiens
tggaaaacgaggagc

SEQ ID NO: 40415 - DNA, 15 bp, Homo sapiens
ctggaaaacgaggag

SEQ ID NO: 40416 - DNA, 15 bp, Homo sapiens
tctggaaaacgagga

SEQ ID NO: 40417 - DNA, 15 bp, Homo sapiens
ttctggaaaacgagg

SEQ ID NO: 40418 - DNA, 15 bp, Homo sapiens
cttctggaaaacgag

SEQ ID NO: 40419 - DNA, 15 bp, Homo sapiens
ccttctggaaaacga

SEQ ID NO: 40420 - DNA, 15 bp, Homo sapiens
cccttctggaaaacg

SEQ ID NO: 40421 - DNA, 15 bp, Homo sapiens
ccccttctggaaaac

SEQ ID NO: 40422 - DNA, 15 bp, Homo sapiens
cccccttctggaaaa

SEQ ID NO: 40423 - DNA, 15 bp, Homo sapiens
tcccccttctggaaa

SEQ ID NO: 40424 - DNA, 15 bp, Homo sapiens
ttcccccttctggaa

SEQ ID NO: 40425 - DNA, 15 bp, Homo sapiens
tttcccccttctgga

SEQ ID NO: 40426 - DNA, 15 bp, Homo sapiens
gtttcccccttctgg

SEQ ID NO: 40427 - DNA, 15 bp, Homo sapiens
agtttcccccttctg

SEQ ID NO: 40428 - DNA, 15 bp, Homo sapiens
cagtttcccccttct

SEQ ID NO: 40429 - DNA, 15 bp, Homo sapiens
tcagtttcccccttc

SEQ ID NO: 40430 - DNA, 15 bp, Homo sapiens
ctcagtttccccctt

SEQ ID NO: 40431 - DNA, 15 bp, Homo sapiens
cctcagtttccccct

SEQ ID NO: 40432 - DNA, 15 bp, Homo sapiens
gcctcagtttccccc

SEQ ID NO: 40433 - DNA, 15 bp, Homo sapiens
ggcctcagtttcccc

SEQ ID NO: 40434 - DNA, 15 bp, Homo sapiens
aggcctcagtttccc

SEQ ID NO: 40435 - DNA, 15 bp, Homo sapiens
taggcctcagtttcc

SEQ ID NO: 40436 - DNA, 15 bp, Homo sapiens
ctaggcctcagtttc

SEQ ID NO: 40437 - DNA, 15 bp, Homo sapiens
tctaggcctcagttt

SEQ ID NO: 40438 - DNA, 15 bp, Homo sapiens
ctctaggcctcagtt

SEQ ID NO: 40439 - DNA, 15 bp, Homo sapiens
tctctaggcctcagt

SEQ ID NO: 40440 - DNA, 15 bp, Homo sapiens
ctctctaggcctcag

SEQ ID NO: 40441 - DNA, 15 bp, Homo sapiens
actctctaggcctca

SEQ ID NO: 40442 - DNA, 15 bp, Homo sapiens
cactctctaggcctc

SEQ ID NO: 40443 - DNA, 15 bp, Homo sapiens
tcactctctaggcct

SEQ ID NO: 40444 - DNA, 15 bp, Homo sapiens
ttcactctctaggcc

SEQ ID NO: 40445 - DNA, 15 bp, Homo sapiens
cttcactctctaggc

SEQ ID NO: 40446 - DNA, 15 bp, Homo sapiens
acttcactctctagg

SEQ ID NO: 40447 - DNA, 15 bp, Homo sapiens
cacttcactctctag

SEQ ID NO: 40448 - DNA, 15 bp, Homo sapiens
ccacttcactctcta

SEQ ID NO: 40449 - DNA, 15 bp, Homo sapiens
gccacttcactctct

SEQ ID NO: 40450 - DNA, 15 bp, Homo sapiens
agccacttcactctc

SEQ ID NO: 40451 - DNA, 15 bp, Homo sapiens
cagccacttcactct

SEQ ID NO: 40452 - DNA, 15 bp, Homo sapiens
acagccacttcactc

SEQ ID NO: 40453 - DNA, 15 bp, Homo sapiens
aacagccacttcact

SEQ ID NO: 40454 - DNA, 15 bp, Homo sapiens
gaacagccacttcac

SEQ ID NO: 40455 - DNA, 15 bp, Homo sapiens
ggaacagccacttca

SEQ ID NO: 40456 - DNA, 15 bp, Homo sapiens
tggaacagccacttc

SEQ ID NO: 40457 - DNA, 15 bp, Homo sapiens
ctggaacagccactt

SEQ ID NO: 40458 - DNA, 15 bp, Homo sapiens
cctggaacagccact

SEQ ID NO: 40459 - DNA, 15 bp, Homo sapiens
gcctggaacagccac

SEQ ID NO: 40460 - DNA, 15 bp, Homo sapiens
agcctggaacagcca

SEQ ID NO: 40461 - DNA, 15 bp, Homo sapiens
cagcctggaacagcc

SEQ ID NO: 40462 - DNA, 15 bp, Homo sapiens
gcagcctggaacagc

SEQ ID NO: 40463 - DNA, 15 bp, Homo sapiens
tgcagcctggaacag

SEQ ID NO: 40464 - DNA, 15 bp, Homo sapiens
gtgcagcctggaaca

SEQ ID NO: 40465 - DNA, 15 bp, Homo sapiens
cgtgcagcctggaac

SEQ ID NO: 40466 - DNA, 15 bp, Homo sapiens
ccgtgcagcctggaa

SEQ ID NO: 40467 - DNA, 15 bp, Homo sapiens
accgtgcagcctgga

SEQ ID NO: 40468 - DNA, 15 bp, Homo sapiens
caccgtgcagcctgg

SEQ ID NO: 40469 - DNA, 15 bp, Homo sapiens
tcaccgtgcagcctg

SEQ ID NO: 40470 - DNA, 15 bp, Homo sapiens
gtcaccgtgcagcct

SEQ ID NO: 40471 - DNA, 15 bp, Homo sapiens
tgtcaccgtgcagcc

SEQ ID NO: 40472 - DNA, 15 bp, Homo sapiens
ctgtcaccgtgcagc

SEQ ID NO: 40473 - DNA, 15 bp, Homo sapiens
cctgtcaccgtgcag

SEQ ID NO: 40474 - DNA, 15 bp, Homo sapiens
acctgtcaccgtgca

SEQ ID NO: 40475 - DNA, 15 bp, Homo sapiens
tacctgtcaccgtgc

SEQ ID NO: 40476 - DNA, 15 bp, Homo sapiens
ctacctgtcaccgtg

SEQ ID NO: 40477 - DNA, 15 bp, Homo sapiens
tctacctgtcaccgt

SEQ ID NO: 40478 - DNA, 15 bp, Homo sapiens
ttctacctgtcaccg

SEQ ID NO: 40479 - DNA, 15 bp, Homo sapiens
cttctacctgtcacc

SEQ ID NO: 40480 - DNA, 15 bp, Homo sapiens
ccttctacctgtcac

SEQ ID NO: 40481 - DNA, 15 bp, Homo sapiens
tccttctacctgtca

SEQ ID NO: 40482 - DNA, 15 bp, Homo sapiens
atccttctacctgtc

SEQ ID NO: 40483 - DNA, 15 bp, Homo sapiens
catccttctacctgt

SEQ ID NO: 40484 - DNA, 15 bp, Homo sapiens
ccatccttctacctg

SEQ ID NO: 40485 - DNA, 15 bp, Homo sapiens
accatccttctacct

SEQ ID NO: 40486 - DNA, 15 bp, Homo sapiens
aaccatccttctacc

SEQ ID NO: 40487 - DNA, 15 bp, Homo sapiens
caaccatccttctac

SEQ ID NO: 40488 - DNA, 15 bp, Homo sapiens
ccaaccatccttcta

SEQ ID NO: 40489 - DNA, 15 bp, Homo sapiens
cccaaccatccttct

SEQ ID NO: 40490 - DNA, 15 bp, Homo sapiens
tcccaaccatccttc

SEQ ID NO: 40491 - DNA, 15 bp, Homo sapiens
atcccaaccatcctt

SEQ ID NO: 40492 - DNA, 15 bp, Homo sapiens
gatcccaaccatcct

SEQ ID NO: 40493 - DNA, 15 bp, Homo sapiens
tgatcccaaccatcc

SEQ ID NO: 40494 - DNA, 15 bp, Homo sapiens
ttgatcccaaccatc

SEQ ID NO: 40495 - DNA, 15 bp, Homo sapiens
cttgatcccaaccat

SEQ ID NO: 40496 - DNA, 15 bp, Homo sapiens
ccttgatcccaacca

SEQ ID NO: 40497 - DNA, 15 bp, Homo sapiens
tccttgatcccaacc

SEQ ID NO: 40498 - DNA, 15 bp, Homo sapiens
ttccttgatcccaac

SEQ ID NO: 40499 - DNA, 15 bp, Homo sapiens
gttccttgatcccaa

SEQ ID NO: 40500 - DNA, 15 bp, Homo sapiens
cgttccttgatccca

SEQ ID NO: 40501 - DNA, 15 bp, Homo sapiens
ccgttccttgatccc

SEQ ID NO: 40502 - DNA, 15 bp, Homo sapiens
gccgttccttgatcc

SEQ ID NO: 40503 - DNA, 15 bp, Homo sapiens
ggccgttccttgatc

SEQ ID NO: 40504 - DNA, 15 bp, Homo sapiens
tggccgttccttgat

SEQ ID NO: 40505 - DNA, 15 bp, Homo sapiens
atggccgttccttga

SEQ ID NO: 40506 - DNA, 15 bp, Homo sapiens
gatggccgttccttg

SEQ ID NO: 40507 - DNA, 15 bp, Homo sapiens
ggatggccgttcctt

SEQ ID NO: 40508 - DNA, 15 bp, Homo sapiens
tggatggccgttcct

SEQ ID NO: 40509 - DNA, 15 bp, Homo sapiens
ctggatggccgttcc

SEQ ID NO: 40510 - DNA, 15 bp, Homo sapiens
gctggatggccgttc

SEQ ID NO: 40511 - DNA, 15 bp, Homo sapiens
tgctggatggccgtt

SEQ ID NO: 40512 - DNA, 15 bp, Homo sapiens
ttgctggatggccgt

SEQ ID NO: 40513 - DNA, 15 bp, Homo sapiens
gttgctggatggccg

SEQ ID NO: 40514 - DNA, 15 bp, Homo sapiens
ggttgctggatggcc

SEQ ID NO: 40515 - DNA, 15 bp, Homo sapiens
aggttgctggatggc

SEQ ID NO: 40516 - DNA, 15 bp, Homo sapiens
gaggttgctggatgg

SEQ ID NO: 40517 - DNA, 15 bp, Homo sapiens
ggaggttgctggatg

SEQ ID NO: 40518 - DNA, 15 bp, Homo sapiens
gggaggttgctggat

SEQ ID NO: 40519 - DNA, 15 bp, Homo sapiens
ggggaggttgctgga

SEQ ID NO: 40520 - DNA, 15 bp, Homo sapiens
aggggaggttgctgg

SEQ ID NO: 40521 - DNA, 15 bp, Homo sapiens
caggggaggttgctg

SEQ ID NO: 40522 - DNA, 15 bp, Homo sapiens
acaggggaggttgct

SEQ ID NO: 40523 - DNA, 15 bp, Homo sapiens
gacaggggaggttgc

SEQ ID NO: 40524 - DNA, 15 bp, Homo sapiens
ggacaggggaggttg

SEQ ID NO: 40525 - DNA, 15 bp, Homo sapiens
gggacaggggaggtt

SEQ ID NO: 40526 - DNA, 15 bp, Homo sapiens
ggggacaggggaggt

SEQ ID NO: 40527 - DNA, 15 bp, Homo sapiens
gggggacaggggagg

SEQ ID NO: 40528 - DNA, 15 bp, Homo sapiens
agggggacaggggag

SEQ ID NO: 40529 - DNA, 15 bp, Homo sapiens
aagggggacagggga

SEQ ID NO: 40530 - DNA, 15 bp, Homo sapiens
aaagggggacagggg

SEQ ID NO: 40531 - DNA, 15 bp, Homo sapiens
caaagggggacaggg

SEQ ID NO: 40532 - DNA, 15 bp, Homo sapiens
gcaaagggggacagg

SEQ ID NO: 40533 - DNA, 15 bp, Homo sapiens
ggcaaagggggacag

SEQ ID NO: 40534 - DNA, 15 bp, Homo sapiens
tggcaaagggggaca

SEQ ID NO: 40535 - DNA, 15 bp, Homo sapiens
gtggcaaagggggac

SEQ ID NO: 40536 - DNA, 15 bp, Homo sapiens
ggtggcaaaggggga

SEQ ID NO: 40537 - DNA, 15 bp, Homo sapiens
gggtggcaaaggggg

SEQ ID NO: 40538 - DNA, 15 bp, Homo sapiens
ggggtggcaaagggg

SEQ ID NO: 40539 - DNA, 15 bp, Homo sapiens
tggggtggcaaaggg

SEQ ID NO: 40540 - DNA, 15 bp, Homo sapiens
ctggggtggcaaagg

SEQ ID NO: 40541 - DNA, 15 bp, Homo sapiens
tctggggtggcaaag

SEQ ID NO: 40542 - DNA, 15 bp, Homo sapiens
gtctggggtggcaaa

SEQ ID NO: 40543 - DNA, 15 bp, Homo sapiens
ggtctggggtggcaa

SEQ ID NO: 40544 - DNA, 15 bp, Homo sapiens
gggtctggggtggca

SEQ ID NO: 40545 - DNA, 15 bp, Homo sapiens
tgggtctggggtggc

SEQ ID NO: 40546 - DNA, 15 bp, Homo sapiens
ctgggtctggggtgg

SEQ ID NO: 40547 - DNA, 15 bp, Homo sapiens
cctgggtctggggtg

SEQ ID NO: 40548 - DNA, 15 bp, Homo sapiens
gcctgggtctggggt

SEQ ID NO: 40549 - DNA, 15 bp, Homo sapiens
ggcctgggtctgggg

SEQ ID NO: 40550 - DNA, 15 bp, Homo sapiens
aggcctgggtctggg

SEQ ID NO: 40551 - DNA, 15 bp, Homo sapiens
caggcctgggtctgg

SEQ ID NO: 40552 - DNA, 15 bp, Homo sapiens
gcaggcctgggtctg

SEQ ID NO: 40553 - DNA, 15 bp, Homo sapiens
ggcaggcctgggtct

SEQ ID NO: 40554 - DNA, 15 bp, Homo sapiens
gggcaggcctgggtc

SEQ ID NO: 40555 - DNA, 15 bp, Homo sapiens
tgggcaggcctgggt

SEQ ID NO: 40556 - DNA, 15 bp, Homo sapiens
gtgggcaggcctggg

SEQ ID NO: 40557 - DNA, 15 bp, Homo sapiens
ggtgggcaggcctgg

SEQ ID NO: 40558 - DNA, 15 bp, Homo sapiens
aggtgggcaggcctg

SEQ ID NO: 40559 - DNA, 15 bp, Homo sapiens
gaggtgggcaggcct

SEQ ID NO: 40560 - DNA, 15 bp, Homo sapiens
agaggtgggcaggcc

SEQ ID NO: 40561 - DNA, 15 bp, Homo sapiens
gagaggtgggcaggc

SEQ ID NO: 40562 - DNA, 15 bp, Homo sapiens
agagaggtgggcagg

SEQ ID NO: 40563 - DNA, 15 bp, Homo sapiens
gagagaggtgggcag

SEQ ID NO: 40564 - DNA, 15 bp, Homo sapiens
ggagagaggtgggca

SEQ ID NO: 40565 - DNA, 15 bp, Homo sapiens
aggagagaggtgggc

SEQ ID NO: 40566 - DNA, 15 bp, Homo sapiens
caggagagaggtggg

SEQ ID NO: 40567 - DNA, 15 bp, Homo sapiens
ccaggagagaggtgg

SEQ ID NO: 40568 - DNA, 15 bp, Homo sapiens
gccaggagagaggtg

SEQ ID NO: 40569 - DNA, 15 bp, Homo sapiens
ggccaggagagaggt

SEQ ID NO: 40570 - DNA, 15 bp, Homo sapiens
aggccaggagagagg

SEQ ID NO: 40571 - DNA, 15 bp, Homo sapiens
gaggccaggagagag

SEQ ID NO: 40572 - DNA, 15 bp, Homo sapiens
tgaggccaggagaga

SEQ ID NO: 40573 - DNA, 15 bp, Homo sapiens
ctgaggccaggagag

SEQ ID NO: 40574 - DNA, 15 bp, Homo sapiens
gctgaggccaggaga

SEQ ID NO: 40575 - DNA, 15 bp, Homo sapiens
cgctgaggccaggag

SEQ ID NO: 40576 - DNA, 15 bp, Homo sapiens
tcgctgaggccagga

SEQ ID NO: 40577 - DNA, 15 bp, Homo sapiens
gtcgctgaggccagg

SEQ ID NO: 40578 - DNA, 15 bp, Homo sapiens
agtcgctgaggccag

SEQ ID NO: 40579 - DNA, 15 bp, Homo sapiens
cagtcgctgaggcca

SEQ ID NO: 40580 - DNA, 15 bp, Homo sapiens
ccagtcgctgaggcc

SEQ ID NO: 40581 - DNA, 15 bp, Homo sapiens
tccagtcgctgaggc

SEQ ID NO: 40582 - DNA, 15 bp, Homo sapiens
gtccagtcgctgagg

SEQ ID NO: 40583 - DNA, 15 bp, Homo sapiens
tgtccagtcgctgag

SEQ ID NO: 40584 - DNA, 15 bp, Homo sapiens
atgtccagtcgctga

SEQ ID NO: 40585 - DNA, 15 bp, Homo sapiens
gatgtccagtcgctg

SEQ ID NO: 40586 - DNA, 15 bp, Homo sapiens
ggatgtccagtcgct

SEQ ID NO: 40587 - DNA, 15 bp, Homo sapiens
aggatgtccagtcgc

SEQ ID NO: 40588 - DNA, 15 bp, Homo sapiens
aaggatgtccagtcg

SEQ ID NO: 40589 - DNA, 15 bp, Homo sapiens
gaaggatgtccagtc

SEQ ID NO: 40590 - DNA, 15 bp, Homo sapiens
agaaggatgtccagt

SEQ ID NO: 40591 - DNA, 15 bp, Homo sapiens
cagaaggatgtccag

SEQ ID NO: 40592 - DNA, 15 bp, Homo sapiens
ccagaaggatgtcca

SEQ ID NO: 40593 - DNA, 15 bp, Homo sapiens
cccagaaggatgtcc

SEQ ID NO: 40594 - DNA, 15 bp, Homo sapiens
acccagaaggatgtc

SEQ ID NO: 40595 - DNA, 15 bp, Homo sapiens
tacccagaaggatgt

SEQ ID NO: 40596 - DNA, 15 bp, Homo sapiens
gtacccagaaggatg

SEQ ID NO: 40597 - DNA, 15 bp, Homo sapiens
tgtacccagaaggat

SEQ ID NO: 40598 - DNA, 15 bp, Homo sapiens
ctgtacccagaagga

SEQ ID NO: 40599 - DNA, 15 bp, Homo sapiens
gctgtacccagaagg

SEQ ID NO: 40600 - DNA, 15 bp, Homo sapiens
ggctgtacccagaag

SEQ ID NO: 40601 - DNA, 15 bp, Homo sapiens
gggctgtacccagaa

SEQ ID NO: 40602 - DNA, 15 bp, Homo sapiens
cgggctgtacccaga

SEQ ID NO: 40603 - DNA, 15 bp, Homo sapiens
ccgggctgtacccag

SEQ ID NO: 40604 - DNA, 15 bp, Homo sapiens
cccgggctgtaccca

SEQ ID NO: 40605 - DNA, 15 bp, Homo sapiens
gcccgggctgtaccc

SEQ ID NO: 40606 - DNA, 15 bp, Homo sapiens
tgcccgggctgtacc

SEQ ID NO: 40607 - DNA, 15 bp, Homo sapiens
ttgcccgggctgtac

SEQ ID NO: 40608 - DNA, 15 bp, Homo sapiens
attgcccgggctgta

SEQ ID NO: 40609 - DNA, 15 bp, Homo sapiens
aattgcccgggctgt

SEQ ID NO: 40610 - DNA, 15 bp, Homo sapiens
gaattgcccgggctg

SEQ ID NO: 40611 - DNA, 15 bp, Homo sapiens
tgaattgcccgggct

SEQ ID NO: 40612 - DNA, 15 bp, Homo sapiens
ctgaattgcccgggc

SEQ ID NO: 40613 - DNA, 15 bp, Homo sapiens
actgaattgcccggg

SEQ ID NO: 40614 - DNA, 15 bp, Homo sapiens
aactgaattgcccgg

SEQ ID NO: 40615 - DNA, 15 bp, Homo sapiens
aaactgaattgcccg

SEQ ID NO: 40616 - DNA, 15 bp, Homo sapiens
gaaactgaattgccc

SEQ ID NO: 40617 - DNA, 15 bp, Homo sapiens
agaaactgaattgcc

SEQ ID NO: 40618 - DNA, 15 bp, Homo sapiens
tagaaactgaattgc

SEQ ID NO: 40619 - DNA, 15 bp, Homo sapiens
gtagaaactgaattg

SEQ ID NO: 40620 - DNA, 15 bp, Homo sapiens
tgtagaaactgaatt

SEQ ID NO: 40621 - DNA, 15 bp, Homo sapiens
atgtagaaactgaat

SEQ ID NO: 40622 - DNA, 15 bp, Homo sapiens
gatgtagaaactgaa

SEQ ID NO: 40623 - DNA, 15 bp, Homo sapiens
tgatgtagaaactga

SEQ ID NO: 40624 - DNA, 15 bp, Homo sapiens
ctgatgtagaaactg

SEQ ID NO: 40625 - DNA, 15 bp, Homo sapiens
cctgatgtagaaact

SEQ ID NO: 40626 - DNA, 15 bp, Homo sapiens
tcctgatgtagaaac

SEQ ID NO: 40627 - DNA, 15 bp, Homo sapiens
gtcctgatgtagaaa

SEQ ID NO: 40628 - DNA, 15 bp, Homo sapiens
tgtcctgatgtagaa

SEQ ID NO: 40629 - DNA, 15 bp, Homo sapiens
ctgtcctgatgtaga

SEQ ID NO: 40630 - DNA, 15 bp, Homo sapiens
gctgtcctgatgtag

SEQ ID NO: 40631 - DNA, 15 bp, Homo sapiens
ggctgtcctgatgta

SEQ ID NO: 40632 - DNA, 15 bp, Homo sapiens
gggctgtcctgatgt

SEQ ID NO: 40633 - DNA, 15 bp, Homo sapiens
ggggctgtcctgatg

SEQ ID NO: 40634 - DNA, 15 bp, Homo sapiens
tggggctgtcctgat

SEQ ID NO: 40635 - DNA, 15 bp, Homo sapiens
ctggggctgtcctga

SEQ ID NO: 40636 - DNA, 15 bp, Homo sapiens
gctggggctgtcctg

SEQ ID NO: 40637 - DNA, 15 bp, Homo sapiens
ggctggggctgtcct

SEQ ID NO: 40638 - DNA, 15 bp, Homo sapiens
aggctggggctgtcc

SEQ ID NO: 40639 - DNA, 15 bp, Homo sapiens
gaggctggggctgtc

SEQ ID NO: 40640 - DNA, 15 bp, Homo sapiens
tgaggctggggctgt

SEQ ID NO: 40641 - DNA, 15 bp, Homo sapiens
atgaggctggggctg

SEQ ID NO: 40642 - DNA, 15 bp, Homo sapiens
gatgaggctggggct

SEQ ID NO: 40643 - DNA, 15 bp, Homo sapiens
ggatgaggctggggc

SEQ ID NO: 40644 - DNA, 15 bp, Homo sapiens
tggatgaggctgggg

SEQ ID NO: 40645 - DNA, 15 bp, Homo sapiens
atggatgaggctggg

SEQ ID NO: 40646 - DNA, 15 bp, Homo sapiens
catggatgaggctgg

SEQ ID NO: 40647 - DNA, 15 bp, Homo sapiens
ccatggatgaggctg

SEQ ID NO: 40648 - DNA, 15 bp, Homo sapiens
tccatggatgaggct

SEQ ID NO: 40649 - DNA, 15 bp, Homo sapiens
ctccatggatgaggc

SEQ ID NO: 40650 - DNA, 15 bp, Homo sapiens
tctccatggatgagg

SEQ ID NO: 40651 - DNA, 15 bp, Homo sapiens
gtctccatggatgag

SEQ ID NO: 40652 - DNA, 15 bp, Homo sapiens
tgtctccatggatga

SEQ ID NO: 40653 - DNA, 15 bp, Homo sapiens
atgtctccatggatg

SEQ ID NO: 40654 - DNA, 15 bp, Homo sapiens
gatgtctccatggat

SEQ ID NO: 40655 - DNA, 15 bp, Homo sapiens
tgatgtctccatgga

SEQ ID NO: 40656 - DNA, 15 bp, Homo sapiens
ttgatgtctccatgg

SEQ ID NO: 40657 - DNA, 15 bp, Homo sapiens
cttgatgtctccatg

SEQ ID NO: 40658 - DNA, 15 bp, Homo sapiens
tcttgatgtctccat

SEQ ID NO: 40659 - DNA, 15 bp, Homo sapiens
ctcttgatgtctcca

SEQ ID NO: 40660 - DNA, 15 bp, Homo sapiens
cctcttgatgtctcc

SEQ ID NO: 40661 - DNA, 15 bp, Homo sapiens
acctcttgatgtctc

SEQ ID NO: 40662 - DNA, 15 bp, Homo sapiens
cacctcttgatgtct

SEQ ID NO: 40663 - DNA, 15 bp, Homo sapiens
tcacctcttgatgtc

SEQ ID NO: 40664 - DNA, 15 bp, Homo sapiens
ctcacctcttgatgt

SEQ ID NO: 40665 - DNA, 15 bp, Homo sapiens
cctcacctcttgatg

SEQ ID NO: 40666 - DNA, 15 bp, Homo sapiens
tcctcacctcttgat

SEQ ID NO: 40667 - DNA, 15 bp, Homo sapiens
ctcctcacctcttga

SEQ ID NO: 40668 - DNA, 15 bp, Homo sapiens
cctcctcacctcttg

SEQ ID NO: 40669 - DNA, 15 bp, Homo sapiens
ccctcctcacctctt

SEQ ID NO: 40670 - DNA, 15 bp, Homo sapiens
cccctcctcacctct

SEQ ID NO: 40671 - DNA, 15 bp, Homo sapiens
gcccctcctcacctc

SEQ ID NO: 40672 - DNA, 15 bp, Homo sapiens
ggcccctcctcacct

SEQ ID NO: 40673 - DNA, 15 bp, Homo sapiens
gggcccctcctcacc

SEQ ID NO: 40674 - DNA, 15 bp, Homo sapiens
agggcccctcctcac

SEQ ID NO: 40675 - DNA, 15 bp, Homo sapiens
aagggcccctcctca

SEQ ID NO: 40676 - DNA, 15 bp, Homo sapiens
caagggcccctcctc

SEQ ID NO: 40677 - DNA, 15 bp, Homo sapiens
tcaagggcccctcct

SEQ ID NO: 40678 - DNA, 15 bp, Homo sapiens
ctcaagggcccctcc

SEQ ID NO: 40679 - DNA, 15 bp, Homo sapiens
tctcaagggcccctc

SEQ ID NO: 40680 - DNA, 15 bp, Homo sapiens
ttctcaagggcccct

SEQ ID NO: 40681 - DNA, 15 bp, Homo sapiens
gttctcaagggcccc

SEQ ID NO: 40682 - DNA, 15 bp, Homo sapiens
agttctcaagggccc

SEQ ID NO: 40683 - DNA, 15 bp, Homo sapiens
cagttctcaagggcc

SEQ ID NO: 40684 - DNA, 15 bp, Homo sapiens
gcagttctcaagggc

SEQ ID NO: 40685 - DNA, 15 bp, Homo sapiens
ggcagttctcaaggg

SEQ ID NO: 40686 - DNA, 15 bp, Homo sapiens
cggcagttctcaagg

SEQ ID NO: 40687 - DNA, 15 bp, Homo sapiens
ccggcagttctcaag

SEQ ID NO: 40688 - DNA, 15 bp, Homo sapiens
cccggcagttctcaa

SEQ ID NO: 40689 - DNA, 15 bp, Homo sapiens
ccccggcagttctca

SEQ ID NO: 40690 - DNA, 15 bp, Homo sapiens
gccccggcagttctc

SEQ ID NO: 40691 - DNA, 15 bp, Homo sapiens
tgccccggcagttct

SEQ ID NO: 40692 - DNA, 15 bp, Homo sapiens
ctgccccggcagttc

SEQ ID NO: 40693 - DNA, 15 bp, Homo sapiens
cctgccccggcagtt

SEQ ID NO: 40694 - DNA, 15 bp, Homo sapiens
ccctgccccggcagt

SEQ ID NO: 40695 - DNA, 15 bp, Homo sapiens
gccctgccccggcag

SEQ ID NO: 40696 - DNA, 15 bp, Homo sapiens
ggccctgccccggca

SEQ ID NO: 40697 - DNA, 15 bp, Homo sapiens
aggccctgccccggc

SEQ ID NO: 40698 - DNA, 15 bp, Homo sapiens
caggccctgccccgg

SEQ ID NO: 40699 - DNA, 15 bp, Homo sapiens
gcaggccctgccccg

SEQ ID NO: 40700 - DNA, 15 bp, Homo sapiens
tgcaggccctgcccc

SEQ ID NO: 40701 - DNA, 15 bp, Homo sapiens
ctgcaggccctgccc

SEQ ID NO: 40702 - DNA, 15 bp, Homo sapiens
gctgcaggccctgcc

SEQ ID NO: 40703 - DNA, 15 bp, Homo sapiens
tgctgcaggccctgc

SEQ ID NO: 40704 - DNA, 15 bp, Homo sapiens
ttgctgcaggccctg

SEQ ID NO: 40705 - DNA, 15 bp, Homo sapiens
cttgctgcaggccct

SEQ ID NO: 40706 - DNA, 15 bp, Homo sapiens
ccttgctgcaggccc

SEQ ID NO: 40707 - DNA, 15 bp, Homo sapiens
cccttgctgcaggcc

SEQ ID NO: 40708 - DNA, 15 bp, Homo sapiens
ccccttgctgcaggc

SEQ ID NO: 40709 - DNA, 15 bp, Homo sapiens
cccccttgctgcagg

SEQ ID NO: 40710 - DNA, 15 bp, Homo sapiens
ccccccttgctgcag

SEQ ID NO: 40711 - DNA, 15 bp, Homo sapiens
gccccccttgctgca

SEQ ID NO: 40712 - DNA, 15 bp, Homo sapiens
ggccccccttgctgc

SEQ ID NO: 40713 - DNA, 15 bp, Homo sapiens
gggccccccttgctg

SEQ ID NO: 40714 - DNA, 15 bp, Homo sapiens
ggggccccccttgct

SEQ ID NO: 40715 - DNA, 15 bp, Homo sapiens
cggggccccccttgc

SEQ ID NO: 40716 - DNA, 15 bp, Homo sapiens
gcggggccccccttg

SEQ ID NO: 40717 - DNA, 15 bp, Homo sapiens
cgcggggcccccctt

SEQ ID NO: 40718 - DNA, 15 bp, Homo sapiens
acgcggggcccccct

SEQ ID NO: 40719 - DNA, 15 bp, Homo sapiens
gacgcggggcccccc

SEQ ID NO: 40720 - DNA, 15 bp, Homo sapiens
ggacgcggggccccc

SEQ ID NO: 40721 - DNA, 15 bp, Homo sapiens
aggacgcggggcccc

SEQ ID NO: 40722 - DNA, 15 bp, Homo sapiens
taggacgcggggccc

SEQ ID NO: 40723 - DNA, 15 bp, Homo sapiens
ataggacgcggggcc

SEQ ID NO: 40724 - DNA, 15 bp, Homo sapiens
gataggacgcggggc

SEQ ID NO: 40725 - DNA, 15 bp, Homo sapiens
tgataggacgcgggg

SEQ ID NO: 40726 - DNA, 15 bp, Homo sapiens
ttgataggacgcggg

SEQ ID NO: 40727 - DNA, 15 bp, Homo sapiens
attgataggacgcgg

SEQ ID NO: 40728 - DNA, 15 bp, Homo sapiens
cattgataggacgcg

SEQ ID NO: 40729 - DNA, 15 bp, Homo sapiens
acattgataggacgc

SEQ ID NO: 40730 - DNA, 15 bp, Homo sapiens
cacattgataggacg

SEQ ID NO: 40731 - DNA, 15 bp, Homo sapiens
ccacattgataggac

SEQ ID NO: 40732 - DNA, 15 bp, Homo sapiens
cccacattgatagga

SEQ ID NO: 40733 - DNA, 15 bp, Homo sapiens
ccccacattgatagg

SEQ ID NO: 40734 - DNA, 15 bp, Homo sapiens
tccccacattgatag

SEQ ID NO: 40735 - DNA, 15 bp, Homo sapiens
atccccacattgata

SEQ ID NO: 40736 - DNA, 15 bp, Homo sapiens
gatccccacattgat

SEQ ID NO: 40737 - DNA, 15 bp, Homo sapiens
tgatccccacattga

SEQ ID NO: 40738 - DNA, 15 bp, Homo sapiens
ctgatccccacattg

SEQ ID NO: 40739 - DNA, 15 bp, Homo sapiens
cctgatccccacatt

SEQ ID NO: 40740 - DNA, 15 bp, Homo sapiens
gcctgatccccacat

SEQ ID NO: 40741 - DNA, 15 bp, Homo sapiens
tgcctgatccccaca

SEQ ID NO: 40742 - DNA, 15 bp, Homo sapiens
atgcctgatccccac

SEQ ID NO: 40743 - DNA, 15 bp, Homo sapiens
catgcctgatcccca

SEQ ID NO: 40744 - DNA, 15 bp, Homo sapiens
ccatgcctgatcccc

SEQ ID NO: 40745 - DNA, 15 bp, Homo sapiens
gccatgcctgatccc

SEQ ID NO: 40746 - DNA, 15 bp, Homo sapiens
ggccatgcctgatcc

SEQ ID NO: 40747 - DNA, 15 bp, Homo sapiens
aggccatgcctgatc

SEQ ID NO: 40748 - DNA, 15 bp, Homo sapiens
caggccatgcctgat

SEQ ID NO: 40749 - DNA, 15 bp, Homo sapiens
ccaggccatgcctga

SEQ ID NO: 40750 - DNA, 15 bp, Homo sapiens
cccaggccatgcctg

SEQ ID NO: 40751 - DNA, 15 bp, Homo sapiens
tcccaggccatgcct

SEQ ID NO: 40752 - DNA, 15 bp, Homo sapiens
gtcccaggccatgcc

SEQ ID NO: 40753 - DNA, 15 bp, Homo sapiens
ggtcccaggccatgc

SEQ ID NO: 40754 - DNA, 15 bp, Homo sapiens
aggtcccaggccatg

SEQ ID NO: 40755 - DNA, 15 bp, Homo sapiens
gaggtcccaggccat

SEQ ID NO: 40756 - DNA, 15 bp, Homo sapiens
tgaggtcccaggcca

SEQ ID NO: 40757 - DNA, 15 bp, Homo sapiens
ttgaggtcccaggcc

SEQ ID NO: 40758 - DNA, 15 bp, Homo sapiens
gttgaggtcccaggc

SEQ ID NO: 40759 - DNA, 15 bp, Homo sapiens
tgttgaggtcccagg

SEQ ID NO: 40760 - DNA, 15 bp, Homo sapiens
gtgttgaggtcccag

SEQ ID NO: 40761 - DNA, 15 bp, Homo sapiens
ggtgttgaggtccca

SEQ ID NO: 40762 - DNA, 15 bp, Homo sapiens
gggtgttgaggtccc

SEQ ID NO: 40763 - DNA, 15 bp, Homo sapiens
ggggtgttgaggtcc

SEQ ID NO: 40764 - DNA, 15 bp, Homo sapiens
cggggtgttgaggtc

SEQ ID NO: 40765 - DNA, 15 bp, Homo sapiens
ccggggtgttgaggt

SEQ ID NO: 40766 - DNA, 15 bp, Homo sapiens
gccggggtgttgagg

SEQ ID NO: 40767 - DNA, 15 bp, Homo sapiens
tgccggggtgttgag

SEQ ID NO: 40768 - DNA, 15 bp, Homo sapiens
atgccggggtgttga

SEQ ID NO: 40769 - DNA, 15 bp, Homo sapiens
gatgccggggtgttg

SEQ ID NO: 40770 - DNA, 15 bp, Homo sapiens
cgatgccggggtgtt

SEQ ID NO: 40771 - DNA, 15 bp, Homo sapiens
gcgatgccggggtgt

SEQ ID NO: 40772 - DNA, 15 bp, Homo sapiens
tgcgatgccggggtg

SEQ ID NO: 40773 - DNA, 15 bp, Homo sapiens
gtgcgatgccggggt

SEQ ID NO: 40774 - DNA, 15 bp, Homo sapiens
tgtgcgatgccgggg

SEQ ID NO: 40775 - DNA, 15 bp, Homo sapiens
ctgtgcgatgccggg

SEQ ID NO: 40776 - DNA, 15 bp, Homo sapiens
cctgtgcgatgccgg

SEQ ID NO: 40777 - DNA, 15 bp, Homo sapiens
acctgtgcgatgccg

SEQ ID NO: 40778 - DNA, 15 bp, Homo sapiens
cacctgtgcgatgcc

SEQ ID NO: 40779 - DNA, 15 bp, Homo sapiens
acacctgtgcgatgc

SEQ ID NO: 40780 - DNA, 15 bp, Homo sapiens
cacacctgtgcgatg

SEQ ID NO: 40781 - DNA, 15 bp, Homo sapiens
ccacacctgtgcgat

SEQ ID NO: 40782 - DNA, 15 bp, Homo sapiens
cccacacctgtgcga

SEQ ID NO: 40783 - DNA, 15 bp, Homo sapiens
tcccacacctgtgcg

SEQ ID NO: 40784 - DNA, 15 bp, Homo sapiens
ttcccacacctgtgc

SEQ ID NO: 40785 - DNA, 15 bp, Homo sapiens
gttcccacacctgtg

SEQ ID NO: 40786 - DNA, 15 bp, Homo sapiens
cgttcccacacctgt

SEQ ID NO: 40787 - DNA, 15 bp, Homo sapiens
ccgttcccacacctg

SEQ ID NO: 40788 - DNA, 15 bp, Homo sapiens
cccgttcccacacct

SEQ ID NO: 40789 - DNA, 15 bp, Homo sapiens
gcccgttcccacacc

SEQ ID NO: 40790 - DNA, 15 bp, Homo sapiens
ggcccgttcccacac

SEQ ID NO: 40791 - DNA, 15 bp, Homo sapiens
tggcccgttcccaca

SEQ ID NO: 40792 - DNA, 15 bp, Homo sapiens
ttggcccgttcccac

SEQ ID NO: 40793 - DNA, 15 bp, Homo sapiens
cttggcccgttccca

SEQ ID NO: 40794 - DNA, 15 bp, Homo sapiens
ccttggcccgttccc

SEQ ID NO: 40795 - DNA, 15 bp, Homo sapiens
tccttggcccgttcc

SEQ ID NO: 40796 - DNA, 15 bp, Homo sapiens
atccttggcccgttc

SEQ ID NO: 40797 - DNA, 15 bp, Homo sapiens
catccttggcccgtt

SEQ ID NO: 40798 - DNA, 15 bp, Homo sapiens
ccatccttggcccgt

SEQ ID NO: 40799 - DNA, 15 bp, Homo sapiens
cccatccttggcccg

SEQ ID NO: 40800 - DNA, 15 bp, Homo sapiens
gcccatccttggccc

SEQ ID NO: 40801 - DNA, 15 bp, Homo sapiens
ggcccatccttggcc

SEQ ID NO: 40802 - DNA, 15 bp, Homo sapiens
gggcccatccttggc

SEQ ID NO: 40803 - DNA, 15 bp, Homo sapiens
agggcccatccttgg

SEQ ID NO: 40804 - DNA, 15 bp, Homo sapiens
tagggcccatccttg

SEQ ID NO: 40805 - DNA, 15 bp, Homo sapiens
gtagggcccatcctt

SEQ ID NO: 40806 - DNA, 15 bp, Homo sapiens
agtagggcccatcct

SEQ ID NO: 40807 - DNA, 15 bp, Homo sapiens
cagtagggcccatcc

SEQ ID NO: 40808 - DNA, 15 bp, Homo sapiens
tcagtagggcccatc

SEQ ID NO: 40809 - DNA, 15 bp, Homo sapiens
atcagtagggcccat

SEQ ID NO: 40810 - DNA, 15 bp, Homo sapiens
catcagtagggccca

SEQ ID NO: 40811 - DNA, 15 bp, Homo sapiens
tcatcagtagggccc

SEQ ID NO: 40812 - DNA, 15 bp, Homo sapiens
ctcatcagtagggcc

SEQ ID NO: 40813 - DNA, 15 bp, Homo sapiens
gctcatcagtagggc

SEQ ID NO: 40814 - DNA, 15 bp, Homo sapiens
tgctcatcagtaggg

SEQ ID NO: 40815 - DNA, 15 bp, Homo sapiens
ctgctcatcagtagg

SEQ ID NO: 40816 - DNA, 15 bp, Homo sapiens
tctgctcatcagtag

SEQ ID NO: 40817 - DNA, 15 bp, Homo sapiens
ctctgctcatcagta

SEQ ID NO: 40818 - DNA, 15 bp, Homo sapiens
cctctgctcatcagt

SEQ ID NO: 40819 - DNA, 15 bp, Homo sapiens
gcctctgctcatcag

SEQ ID NO: 40820 - DNA, 15 bp, Homo sapiens
ggcctctgctcatca

SEQ ID NO: 40821 - DNA, 15 bp, Homo sapiens
gggcctctgctcatc

SEQ ID NO: 40822 - DNA, 15 bp, Homo sapiens
ggggcctctgctcat

SEQ ID NO: 40823 - DNA, 15 bp, Homo sapiens
gggggcctctgctca

SEQ ID NO: 40824 - DNA, 15 bp, Homo sapiens
tgggggcctctgctc

SEQ ID NO: 40825 - DNA, 15 bp, Homo sapiens
ctgggggcctctgct

SEQ ID NO: 40826 - DNA, 15 bp, Homo sapiens
cctgggggcctctgc

SEQ ID NO: 40827 - DNA, 15 bp, Homo sapiens
gcctgggggcctctg

SEQ ID NO: 40828 - DNA, 15 bp, Homo sapiens
tgcctgggggcctct

SEQ ID NO: 40829 - DNA, 15 bp, Homo sapiens
ctgcctgggggcctc

SEQ ID NO: 40830 - DNA, 15 bp, Homo sapiens
gctgcctgggggcct

SEQ ID NO: 40831 - DNA, 15 bp, Homo sapiens
agctgcctgggggcc

SEQ ID NO: 40832 - DNA, 15 bp, Homo sapiens
cagctgcctgggggc

SEQ ID NO: 40833 - DNA, 15 bp, Homo sapiens
ccagctgcctggggg

SEQ ID NO: 40834 - DNA, 15 bp, Homo sapiens
tccagctgcctgggg

SEQ ID NO: 40835 - DNA, 15 bp, Homo sapiens
ctccagctgcctggg

SEQ ID NO: 40836 - DNA, 15 bp, Homo sapiens
gctccagctgcctgg

SEQ ID NO: 40837 - DNA, 15 bp, Homo sapiens
cgctccagctgcctg

SEQ ID NO: 40838 - DNA, 15 bp, Homo sapiens
gcgctccagctgcct

SEQ ID NO: 40839 - DNA, 15 bp, Homo sapiens
agcgctccagctgcc

SEQ ID NO: 40840 - DNA, 15 bp, Homo sapiens
gagcgctccagctgc

SEQ ID NO: 40841 - DNA, 15 bp, Homo sapiens
tgagcgctccagctg

SEQ ID NO: 40842 - DNA, 15 bp, Homo sapiens
ctgagcgctccagct

SEQ ID NO: 40843 - DNA, 15 bp, Homo sapiens
cctgagcgctccagc

SEQ ID NO: 40844 - DNA, 15 bp, Homo sapiens
ccctgagcgctccag

SEQ ID NO: 40845 - DNA, 15 bp, Homo sapiens
gccctgagcgctcca

SEQ ID NO: 40846 - DNA, 15 bp, Homo sapiens
tgccctgagcgctcc

SEQ ID NO: 40847 - DNA, 15 bp, Homo sapiens
ctgccctgagcgctc

SEQ ID NO: 40848 - DNA, 15 bp, Homo sapiens
actgccctgagcgct

SEQ ID NO: 40849 - DNA, 15 bp, Homo sapiens
cactgccctgagcgc

SEQ ID NO: 40850 - DNA, 15 bp, Homo sapiens
gcactgccctgagcg

SEQ ID NO: 40851 - DNA, 15 bp, Homo sapiens
ggcactgccctgagc

SEQ ID NO: 40852 - DNA, 15 bp, Homo sapiens
tggcactgccctgag

SEQ ID NO: 40853 - DNA, 15 bp, Homo sapiens
ctggcactgccctga

SEQ ID NO: 40854 - DNA, 15 bp, Homo sapiens
gctggcactgccctg

SEQ ID NO: 40855 - DNA, 15 bp, Homo sapiens
cgctggcactgccct

SEQ ID NO: 40856 - DNA, 15 bp, Homo sapiens
gcgctggcactgccc

SEQ ID NO: 40857 - DNA, 15 bp, Homo sapiens
agcgctggcactgcc

SEQ ID NO: 40858 - DNA, 15 bp, Homo sapiens
aagcgctggcactgc

SEQ ID NO: 40859 - DNA, 15 bp, Homo sapiens
aaagcgctggcactg

SEQ ID NO: 40860 - DNA, 15 bp, Homo sapiens
gaaagcgctggcact

SEQ ID NO: 40861 - DNA, 15 bp, Homo sapiens
agaaagcgctggcac

SEQ ID NO: 40862 - DNA, 15 bp, Homo sapiens
cagaaagcgctggca

SEQ ID NO: 40863 - DNA, 15 bp, Homo sapiens
acagaaagcgctggc

SEQ ID NO: 40864 - DNA, 15 bp, Homo sapiens
cacagaaagcgctgg

SEQ ID NO: 40865 - DNA, 15 bp, Homo sapiens
ccacagaaagcgctg

SEQ ID NO: 40866 - DNA, 15 bp, Homo sapiens
cccacagaaagcgct

SEQ ID NO: 40867 - DNA, 15 bp, Homo sapiens
gcccacagaaagcgc

SEQ ID NO: 40868 - DNA, 15 bp, Homo sapiens
tgcccacagaaagcg

SEQ ID NO: 40869 - DNA, 15 bp, Homo sapiens
ttgcccacagaaagc

SEQ ID NO: 40870 - DNA, 15 bp, Homo sapiens
cttgcccacagaaag

SEQ ID NO: 40871 - DNA, 15 bp, Homo sapiens
ccttgcccacagaaa

SEQ ID NO: 40872 - DNA, 15 bp, Homo sapiens
gccttgcccacagaa

SEQ ID NO: 40873 - DNA, 15 bp, Homo sapiens
tgccttgcccacaga

SEQ ID NO: 40874 - DNA, 15 bp, Homo sapiens
gtgccttgcccacag

SEQ ID NO: 40875 - DNA, 15 bp, Homo sapiens
ggtgccttgcccaca

SEQ ID NO: 40876 - DNA, 15 bp, Homo sapiens
cggtgccttgcccac

SEQ ID NO: 40877 - DNA, 15 bp, Homo sapiens
ccggtgccttgccca

SEQ ID NO: 40878 - DNA, 15 bp, Homo sapiens
cccggtgccttgccc

SEQ ID NO: 40879 - DNA, 15 bp, Homo sapiens
gcccggtgccttgcc

SEQ ID NO: 40880 - DNA, 15 bp, Homo sapiens
agcccggtgccttgc

SEQ ID NO: 40881 - DNA, 15 bp, Homo sapiens
cagcccggtgccttg

SEQ ID NO: 40882 - DNA, 15 bp, Homo sapiens
ccagcccggtgcctt

SEQ ID NO: 40883 - DNA, 15 bp, Homo sapiens
gccagcccggtgcct

SEQ ID NO: 40884 - DNA, 15 bp, Homo sapiens
tgccagcccggtgcc

SEQ ID NO: 40885 - DNA, 15 bp, Homo sapiens
ctgccagcccggtgc

SEQ ID NO: 40886 - DNA, 15 bp, Homo sapiens
gctgccagcccggtg

SEQ ID NO: 40887 - DNA, 15 bp, Homo sapiens
ggctgccagcccggt

SEQ ID NO: 40888 - DNA, 15 bp, Homo sapiens
aggctgccagcccgg

SEQ ID NO: 40889 - DNA, 15 bp, Homo sapiens
gaggctgccagcccg

SEQ ID NO: 40890 - DNA, 15 bp, Homo sapiens
cgaggctgccagccc

SEQ ID NO: 40891 - DNA, 15 bp, Homo sapiens
tcgaggctgccagcc

SEQ ID NO: 40892 - DNA, 15 bp, Homo sapiens
ctcgaggctgccagc

SEQ ID NO: 40893 - DNA, 15 bp, Homo sapiens
actcgaggctgccag

SEQ ID NO: 40894 - DNA, 15 bp, Homo sapiens
gactcgaggctgcca

SEQ ID NO: 40895 - DNA, 15 bp, Homo sapiens
ggactcgaggctgcc

SEQ ID NO: 40896 - DNA, 15 bp, Homo sapiens
tggactcgaggctgc

SEQ ID NO: 40897 - DNA, 15 bp, Homo sapiens
ctggactcgaggctg

SEQ ID NO: 40898 - DNA, 15 bp, Homo sapiens
gctggactcgaggct

SEQ ID NO: 40899 - DNA, 15 bp, Homo sapiens
ggctggactcgaggc

SEQ ID NO: 40900 - DNA, 15 bp, Homo sapiens
aggctggactcgagg

SEQ ID NO: 40901 - DNA, 15 bp, Homo sapiens
aaggctggactcgag

SEQ ID NO: 40902 - DNA, 15 bp, Homo sapiens
taaggctggactcga

SEQ ID NO: 40903 - DNA, 15 bp, Homo sapiens
ataaggctggactcg

SEQ ID NO: 40904 - DNA, 15 bp, Homo sapiens
gataaggctggactc

SEQ ID NO: 40905 - DNA, 15 bp, Homo sapiens
agataaggctggact

SEQ ID NO: 40906 - DNA, 15 bp, Homo sapiens
tagataaggctggac

SEQ ID NO: 40907 - DNA, 15 bp, Homo sapiens
ttagataaggctgga

SEQ ID NO: 40908 - DNA, 15 bp, Homo sapiens
cttagataaggctgg

SEQ ID NO: 40909 - DNA, 15 bp, Homo sapiens
gcttagataaggctg

SEQ ID NO: 40910 - DNA, 15 bp, Homo sapiens
ggcttagataaggct

SEQ ID NO: 40911 - DNA, 15 bp, Homo sapiens
cggcttagataaggc

SEQ ID NO: 40912 - DNA, 15 bp, Homo sapiens
ccggcttagataagg

SEQ ID NO: 40913 - DNA, 15 bp, Homo sapiens
cccggcttagataag

SEQ ID NO: 40914 - DNA, 15 bp, Homo sapiens
gcccggcttagataa

SEQ ID NO: 40915 - DNA, 15 bp, Homo sapiens
tgcccggcttagata

SEQ ID NO: 40916 - DNA, 15 bp, Homo sapiens
ctgcccggcttagat

SEQ ID NO: 40917 - DNA, 15 bp, Homo sapiens
cctgcccggcttaga

SEQ ID NO: 40918 - DNA, 15 bp, Homo sapiens
acctgcccggcttag

SEQ ID NO: 40919 - DNA, 15 bp, Homo sapiens
cacctgcccggctta

SEQ ID NO: 40920 - DNA, 15 bp, Homo sapiens
acacctgcccggctt

SEQ ID NO: 40921 - DNA, 15 bp, Homo sapiens
tacacctgcccggct

SEQ ID NO: 40922 - DNA, 15 bp, Homo sapiens
ctacacctgcccggc

SEQ ID NO: 40923 - DNA, 15 bp, Homo sapiens
cctacacctgcccgg

SEQ ID NO: 40924 - DNA, 15 bp, Homo sapiens
tcctacacctgcccg

SEQ ID NO: 40925 - DNA, 15 bp, Homo sapiens
ctcctacacctgccc

SEQ ID NO: 40926 - DNA, 15 bp, Homo sapiens
gctcctacacctgcc

SEQ ID NO: 40927 - DNA, 15 bp, Homo sapiens
agctcctacacctgc

SEQ ID NO: 40928 - DNA, 15 bp, Homo sapiens
tagctcctacacctg

SEQ ID NO: 40929 - DNA, 15 bp, Homo sapiens
ctagctcctacacct

SEQ ID NO: 40930 - DNA, 15 bp, Homo sapiens
cctagctcctacacc

SEQ ID NO: 40931 - DNA, 15 bp, Homo sapiens
tcctagctcctacac

SEQ ID NO: 40932 - DNA, 15 bp, Homo sapiens
gtcctagctcctaca

SEQ ID NO: 40933 - DNA, 15 bp, Homo sapiens
ggtcctagctcctac

SEQ ID NO: 40934 - DNA, 15 bp, Homo sapiens
cggtcctagctccta

SEQ ID NO: 40935 - DNA, 15 bp, Homo sapiens
ccggtcctagctcct

SEQ ID NO: 40936 - DNA, 15 bp, Homo sapiens
cccggtcctagctcc

SEQ ID NO: 40937 - DNA, 15 bp, Homo sapiens
gcccggtcctagctc

SEQ ID NO: 40938 - DNA, 15 bp, Homo sapiens
agcccggtcctagct

SEQ ID NO: 40939 - DNA, 15 bp, Homo sapiens
cagcccggtcctagc

SEQ ID NO: 40940 - DNA, 15 bp, Homo sapiens
tcagcccggtcctag

SEQ ID NO: 40941 - DNA, 15 bp, Homo sapiens
gtcagcccggtccta

SEQ ID NO: 40942 - DNA, 15 bp, Homo sapiens
cgtcagcccggtcct

SEQ ID NO: 40943 - DNA, 15 bp, Homo sapiens
gcgtcagcccggtcc

SEQ ID NO: 40944 - DNA, 15 bp, Homo sapiens
ggcgtcagcccggtc

SEQ ID NO: 40945 - DNA, 15 bp, Homo sapiens
tggcgtcagcccggt

SEQ ID NO: 40946 - DNA, 15 bp, Homo sapiens
gtggcgtcagcccgg

SEQ ID NO: 40947 - DNA, 15 bp, Homo sapiens
agtggcgtcagcccg

SEQ ID NO: 40948 - DNA, 15 bp, Homo sapiens
cagtggcgtcagccc

SEQ ID NO: 40949 - DNA, 15 bp, Homo sapiens
acagtggcgtcagcc

SEQ ID NO: 40950 - DNA, 15 bp, Homo sapiens
gacagtggcgtcagc

SEQ ID NO: 40951 - DNA, 15 bp, Homo sapiens
agacagtggcgtcag

SEQ ID NO: 40952 - DNA, 15 bp, Homo sapiens
aagacagtggcgtca

SEQ ID NO: 40953 - DNA, 15 bp, Homo sapiens
gaagacagtggcgtc

SEQ ID NO: 40954 - DNA, 15 bp, Homo sapiens
agaagacagtggcgt

SEQ ID NO: 40955 - DNA, 15 bp, Homo sapiens
gagaagacagtggcg

SEQ ID NO: 40956 - DNA, 15 bp, Homo sapiens
agagaagacagtggc

SEQ ID NO: 40957 - DNA, 15 bp, Homo sapiens
gagagaagacagtgg

SEQ ID NO: 40958 - DNA, 15 bp, Homo sapiens
ggagagaagacagtg

SEQ ID NO: 40959 - DNA, 15 bp, Homo sapiens
gggagagaagacagt

SEQ ID NO: 40960 - DNA, 15 bp, Homo sapiens
ggggagagaagacag

SEQ ID NO: 40961 - DNA, 15 bp, Homo sapiens
tggggagagaagaca

SEQ ID NO: 40962 - DNA, 15 bp, Homo sapiens
ttggggagagaagac

SEQ ID NO: 40963 - DNA, 15 bp, Homo sapiens
cttggggagagaaga

SEQ ID NO: 40964 - DNA, 15 bp, Homo sapiens
acttggggagagaag

SEQ ID NO: 40965 - DNA, 15 bp, Homo sapiens
aacttggggagagaa

SEQ ID NO: 40966 - DNA, 15 bp, Homo sapiens
gaacttggggagaga

SEQ ID NO: 40967 - DNA, 15 bp, Homo sapiens
ggaacttggggagag

SEQ ID NO: 40968 - DNA, 15 bp, Homo sapiens
tggaacttggggaga

SEQ ID NO: 40969 - DNA, 15 bp, Homo sapiens
ttggaacttggggag

SEQ ID NO: 40970 - DNA, 15 bp, Homo sapiens
gttggaacttgggga

SEQ ID NO: 40971 - DNA, 15 bp, Homo sapiens
cgttggaacttgggg

SEQ ID NO: 40972 - DNA, 15 bp, Homo sapiens
acgttggaacttggg

SEQ ID NO: 40973 - DNA, 15 bp, Homo sapiens
gacgttggaacttgg

SEQ ID NO: 40974 - DNA, 15 bp, Homo sapiens
ggacgttggaacttg

SEQ ID NO: 40975 - DNA, 15 bp, Homo sapiens
aggacgttggaactt

SEQ ID NO: 40976 - DNA, 15 bp, Homo sapiens
aaggacgttggaact

SEQ ID NO: 40977 - DNA, 15 bp, Homo sapiens
gaaggacgttggaac

SEQ ID NO: 40978 - DNA, 15 bp, Homo sapiens
agaaggacgttggaa

SEQ ID NO: 40979 - DNA, 15 bp, Homo sapiens
cagaaggacgttgga

SEQ ID NO: 40980 - DNA, 15 bp, Homo sapiens
ccagaaggacgttgg

SEQ ID NO: 40981 - DNA, 15 bp, Homo sapiens
tccagaaggacgttg

SEQ ID NO: 40982 - DNA, 15 bp, Homo sapiens
atccagaaggacgtt

SEQ ID NO: 40983 - DNA, 15 bp, Homo sapiens
catccagaaggacgt

SEQ ID NO: 40984 - DNA, 15 bp, Homo sapiens
tcatccagaaggacg

SEQ ID NO: 40985 - DNA, 15 bp, Homo sapiens
ctcatccagaaggac

SEQ ID NO: 40986 - DNA, 15 bp, Homo sapiens
tctcatccagaagga

SEQ ID NO: 40987 - DNA, 15 bp, Homo sapiens
ctctcatccagaagg

SEQ ID NO: 40988 - DNA, 15 bp, Homo sapiens
cctctcatccagaag

SEQ ID NO: 40989 - DNA, 15 bp, Homo sapiens
gcctctcatccagaa

SEQ ID NO: 40990 - DNA, 15 bp, Homo sapiens
agcctctcatccaga

SEQ ID NO: 40991 - DNA, 15 bp, Homo sapiens
cagcctctcatccag

SEQ ID NO: 40992 - DNA, 15 bp, Homo sapiens
tcagcctctcatcca

SEQ ID NO: 40993 - DNA, 15 bp, Homo sapiens
gtcagcctctcatcc

SEQ ID NO: 40994 - DNA, 15 bp, Homo sapiens
tgtcagcctctcatc

SEQ ID NO: 40995 - DNA, 15 bp, Homo sapiens
gtgtcagcctctcat

SEQ ID NO: 40996 - DNA, 15 bp, Homo sapiens
ggtgtcagcctctca

SEQ ID NO: 40997 - DNA, 15 bp, Homo sapiens
gggtgtcagcctctc

SEQ ID NO: 40998 - DNA, 15 bp, Homo sapiens
tgggtgtcagcctct

SEQ ID NO: 40999 - DNA, 15 bp, Homo sapiens
ttgggtgtcagcctc

SEQ ID NO: 41000 - DNA, 15 bp, Homo sapiens
cttgggtgtcagcct

SEQ ID NO: 41001 - DNA, 15 bp, Homo sapiens
gcttgggtgtcagcc

SEQ ID NO: 41002 - DNA, 15 bp, Homo sapiens
agcttgggtgtcagc

SEQ ID NO: 41003 - DNA, 15 bp, Homo sapiens
cagcttgggtgtcag

SEQ ID NO: 41004 - DNA, 15 bp, Homo sapiens
ccagcttgggtgtca

SEQ ID NO: 41005 - DNA, 15 bp, Homo sapiens
cccagcttgggtgtc

SEQ ID NO: 41006 - DNA, 15 bp, Homo sapiens
tcccagcttgggtgt

SEQ ID NO: 41007 - DNA, 15 bp, Homo sapiens
ctcccagcttgggtg

SEQ ID NO: 41008 - DNA, 15 bp, Homo sapiens
tctcccagcttgggt

SEQ ID NO: 41009 - DNA, 15 bp, Homo sapiens
gtctcccagcttggg

SEQ ID NO: 41010 - DNA, 15 bp, Homo sapiens
agtctcccagcttgg

SEQ ID NO: 41011 - DNA, 15 bp, Homo sapiens
aagtctcccagcttg

SEQ ID NO: 41012 - DNA, 15 bp, Homo sapiens
aaagtctcccagctt

SEQ ID NO: 41013 - DNA, 15 bp, Homo sapiens
caaagtctcccagct

SEQ ID NO: 41014 - DNA, 15 bp, Homo sapiens
ccaaagtctcccagc

SEQ ID NO: 41015 - DNA, 15 bp, Homo sapiens
gccaaagtctcccag

SEQ ID NO: 41016 - DNA, 15 bp, Homo sapiens
ggccaaagtctccca

SEQ ID NO: 41017 - DNA, 15 bp, Homo sapiens
aggccaaagtctccc

SEQ ID NO: 41018 - DNA, 15 bp, Homo sapiens
caggccaaagtctcc

SEQ ID NO: 41019 - DNA, 15 bp, Homo sapiens
ccaggccaaagtctc

SEQ ID NO: 41020 - DNA, 15 bp, Homo sapiens
gccaggccaaagtct

SEQ ID NO: 41021 - DNA, 15 bp, Homo sapiens
ggccaggccaaagtc

SEQ ID NO: 41022 - DNA, 15 bp, Homo sapiens
gggccaggccaaagt

SEQ ID NO: 41023 - DNA, 15 bp, Homo sapiens
cgggccaggccaaag

SEQ ID NO: 41024 - DNA, 15 bp, Homo sapiens
ccgggccaggccaaa

SEQ ID NO: 41025 - DNA, 15 bp, Homo sapiens
accgggccaggccaa

SEQ ID NO: 41026 - DNA, 15 bp, Homo sapiens
aaccgggccaggcca

SEQ ID NO: 41027 - DNA, 15 bp, Homo sapiens
gaaccgggccaggcc

SEQ ID NO: 41028 - DNA, 15 bp, Homo sapiens
tgaaccgggccaggc

SEQ ID NO: 41029 - DNA, 15 bp, Homo sapiens
ctgaaccgggccagg

SEQ ID NO: 41030 - DNA, 15 bp, Homo sapiens
gctgaaccgggccag

SEQ ID NO: 41031 - DNA, 15 bp, Homo sapiens
ggctgaaccgggcca

SEQ ID NO: 41032 - DNA, 15 bp, Homo sapiens
cggctgaaccgggcc

SEQ ID NO: 41033 - DNA, 15 bp, Homo sapiens
gcggctgaaccgggc

SEQ ID NO: 41034 - DNA, 15 bp, Homo sapiens
agcggctgaaccggg

SEQ ID NO: 41035 - DNA, 15 bp, Homo sapiens
aagcggctgaaccgg

SEQ ID NO: 41036 - DNA, 15 bp, Homo sapiens
aaagcggctgaaccg

SEQ ID NO: 41037 - DNA, 15 bp, Homo sapiens
caaagcggctgaacc

SEQ ID NO: 41038 - DNA, 15 bp, Homo sapiens
gcaaagcggctgaac

SEQ ID NO: 41039 - DNA, 15 bp, Homo sapiens
ggcaaagcggctgaa

SEQ ID NO: 41040 - DNA, 15 bp, Homo sapiens
cggcaaagcggctga

SEQ ID NO: 41041 - DNA, 15 bp, Homo sapiens
ccggcaaagcggctg

SEQ ID NO: 41042 - DNA, 15 bp, Homo sapiens
cccggcaaagcggct

SEQ ID NO: 41043 - DNA, 15 bp, Homo sapiens
acccggcaaagcggc

SEQ ID NO: 41044 - DNA, 15 bp, Homo sapiens
gacccggcaaagcgg

SEQ ID NO: 41045 - DNA, 15 bp, Homo sapiens
ggacccggcaaagcg

SEQ ID NO: 41046 - DNA, 15 bp, Homo sapiens
tggacccggcaaagc

SEQ ID NO: 41047 - DNA, 15 bp, Homo sapiens
ctggacccggcaaag

SEQ ID NO: 41048 - DNA, 15 bp, Homo sapiens
gctggacccggcaaa

SEQ ID NO: 41049 - DNA, 15 bp, Homo sapiens
ggctggacccggcaa

SEQ ID NO: 41050 - DNA, 15 bp, Homo sapiens
gggctggacccggca

SEQ ID NO: 41051 - DNA, 15 bp, Homo sapiens
ggggctggacccggc

SEQ ID NO: 41052 - DNA, 15 bp, Homo sapiens
tggggctggacccgg

SEQ ID NO: 41053 - DNA, 15 bp, Homo sapiens
ctggggctggacccg

SEQ ID NO: 41054 - DNA, 15 bp, Homo sapiens
gctggggctggaccc

SEQ ID NO: 41055 - DNA, 15 bp, Homo sapiens
ggctggggctggacc

SEQ ID NO: 41056 - DNA, 15 bp, Homo sapiens
tggctggggctggac

SEQ ID NO: 41057 - DNA, 15 bp, Homo sapiens
ctggctggggctgga

SEQ ID NO: 41058 - DNA, 15 bp, Homo sapiens
tctggctggggctgg

SEQ ID NO: 41059 - DNA, 15 bp, Homo sapiens
ctctggctggggctg

SEQ ID NO: 41060 - DNA, 15 bp, Homo sapiens
gctctggctggggct

SEQ ID NO: 41061 - DNA, 15 bp, Homo sapiens
tgctctggctggggc

SEQ ID NO: 41062 - DNA, 15 bp, Homo sapiens
ctgctctggctgggg

SEQ ID NO: 41063 - DNA, 15 bp, Homo sapiens
gctgctctggctggg

SEQ ID NO: 41064 - DNA, 15 bp, Homo sapiens
tgctgctctggctgg

SEQ ID NO: 41065 - DNA, 15 bp, Homo sapiens
atgctgctctggctg

SEQ ID NO: 41066 - DNA, 15 bp, Homo sapiens
catgctgctctggct

SEQ ID NO: 41067 - DNA, 15 bp, Homo sapiens
ccatgctgctctggc

SEQ ID NO: 41068 - DNA, 15 bp, Homo sapiens
accatgctgctctgg

SEQ ID NO: 41069 - DNA, 15 bp, Homo sapiens
caccatgctgctctg

SEQ ID NO: 41070 - DNA, 15 bp, Homo sapiens
ccaccatgctgctct

SEQ ID NO: 41071 - DNA, 15 bp, Homo sapiens
gccaccatgctgctc

SEQ ID NO: 41072 - DNA, 15 bp, Homo sapiens
ggccaccatgctgct

SEQ ID NO: 41073 - DNA, 15 bp, Homo sapiens
gggccaccatgctgc

SEQ ID NO: 41074 - DNA, 15 bp, Homo sapiens
cgggccaccatgctg

SEQ ID NO: 41075 - DNA, 15 bp, Homo sapiens
ccgggccaccatgct

SEQ ID NO: 41076 - DNA, 15 bp, Homo sapiens
tccgggccaccatgc

SEQ ID NO: 41077 - DNA, 15 bp, Homo sapiens
gtccgggccaccatg

SEQ ID NO: 41078 - DNA, 15 bp, Homo sapiens
tgtccgggccaccat

SEQ ID NO: 41079 - DNA, 15 bp, Homo sapiens
gtgtccgggccacca

SEQ ID NO: 41080 - DNA, 15 bp, Homo sapiens
tgtgtccgggccacc

SEQ ID NO: 41081 - DNA, 15 bp, Homo sapiens
ctgtgtccgggccac

SEQ ID NO: 41082 - DNA, 15 bp, Homo sapiens
tctgtgtccgggcca

SEQ ID NO: 41083 - DNA, 15 bp, Homo sapiens
gtctgtgtccgggcc

SEQ ID NO: 41084 - DNA, 15 bp, Homo sapiens
tgtctgtgtccgggc

SEQ ID NO: 41085 - DNA, 15 bp, Homo sapiens
ctgtctgtgtccggg

SEQ ID NO: 41086 - DNA, 15 bp, Homo sapiens
actgtctgtgtccgg

SEQ ID NO: 41087 - DNA, 15 bp, Homo sapiens
cactgtctgtgtccg

SEQ ID NO: 41088 - DNA, 15 bp, Homo sapiens
gcactgtctgtgtcc

SEQ ID NO: 41089 - DNA, 15 bp, Homo sapiens
cgcactgtctgtgtc

SEQ ID NO: 41090 - DNA, 15 bp, Homo sapiens
ccgcactgtctgtgt

SEQ ID NO: 41091 - DNA, 15 bp, Homo sapiens
cccgcactgtctgtg

SEQ ID NO: 41092 - DNA, 15 bp, Homo sapiens
ccccgcactgtctgt

SEQ ID NO: 41093 - DNA, 15 bp, Homo sapiens
gccccgcactgtctg

SEQ ID NO: 41094 - DNA, 15 bp, Homo sapiens
tgccccgcactgtct

SEQ ID NO: 41095 - DNA, 15 bp, Homo sapiens
gtgccccgcactgtc

SEQ ID NO: 41096 - DNA, 15 bp, Homo sapiens
ggtgccccgcactgt

SEQ ID NO: 41097 - DNA, 15 bp, Homo sapiens
gggtgccccgcactg

SEQ ID NO: 41098 - DNA, 15 bp, Homo sapiens
agggtgccccgcact

SEQ ID NO: 41099 - DNA, 15 bp, Homo sapiens
cagggtgccccgcac

SEQ ID NO: 41100 - DNA, 15 bp, Homo sapiens
ccagggtgccccgca

SEQ ID NO: 41101 - DNA, 15 bp, Homo sapiens
gccagggtgccccgc

SEQ ID NO: 41102 - DNA, 15 bp, Homo sapiens
ggccagggtgccccg

SEQ ID NO: 41103 - DNA, 15 bp, Homo sapiens
aggccagggtgcccc

SEQ ID NO: 41104 - DNA, 15 bp, Homo sapiens
taggccagggtgccc

SEQ ID NO: 41105 - DNA, 15 bp, Homo sapiens
gtaggccagggtgcc

SEQ ID NO: 41106 - DNA, 15 bp, Homo sapiens
ggtaggccagggtgc

SEQ ID NO: 41107 - DNA, 15 bp, Homo sapiens
aggtaggccagggtg

SEQ ID NO: 41108 - DNA, 15 bp, Homo sapiens
caggtaggccagggt

SEQ ID NO: 41109 - DNA, 15 bp, Homo sapiens
gcaggtaggccaggg

SEQ ID NO: 41110 - DNA, 15 bp, Homo sapiens
ggcaggtaggccagg

SEQ ID NO: 41111 - DNA, 15 bp, Homo sapiens
gggcaggtaggccag

SEQ ID NO: 41112 - DNA, 15 bp, Homo sapiens
cgggcaggtaggcca

SEQ ID NO: 41113 - DNA, 15 bp, Homo sapiens
tcgggcaggtaggcc

SEQ ID NO: 41114 - DNA, 15 bp, Homo sapiens
ctcgggcaggtaggc

SEQ ID NO: 41115 - DNA, 15 bp, Homo sapiens
cctcgggcaggtagg

SEQ ID NO: 41116 - DNA, 15 bp, Homo sapiens
tcctcgggcaggtag

SEQ ID NO: 41117 - DNA, 15 bp, Homo sapiens
ctcctcgggcaggta

SEQ ID NO: 41118 - DNA, 15 bp, Homo sapiens
actcctcgggcaggt

SEQ ID NO: 41119 - DNA, 15 bp, Homo sapiens
tactcctcgggcagg

SEQ ID NO: 41120 - DNA, 15 bp, Homo sapiens
gtactcctcgggcag

SEQ ID NO: 41121 - DNA, 15 bp, Homo sapiens
tgtactcctcgggca

SEQ ID NO: 41122 - DNA, 15 bp, Homo sapiens
atgtactcctcgggc

SEQ ID NO: 41123 - DNA, 15 bp, Homo sapiens
gatgtactcctcggg

SEQ ID NO: 41124 - DNA, 15 bp, Homo sapiens
tgatgtactcctcgg

SEQ ID NO: 41125 - DNA, 15 bp, Homo sapiens
ttgatgtactcctcg

SEQ ID NO: 41126 - DNA, 15 bp, Homo sapiens
cttgatgtactcctc

SEQ ID NO: 41127 - DNA, 15 bp, Homo sapiens
tcttgatgtactcct

SEQ ID NO: 41128 - DNA, 15 bp, Homo sapiens
gtcttgatgtactcc

SEQ ID NO: 41129 - DNA, 15 bp, Homo sapiens
cgtcttgatgtactc

SEQ ID NO: 41130 - DNA, 15 bp, Homo sapiens
ccgtcttgatgtact

SEQ ID NO: 41131 - DNA, 15 bp, Homo sapiens
cccgtcttgatgtac

SEQ ID NO: 41132 - DNA, 15 bp, Homo sapiens
tcccgtcttgatgta

SEQ ID NO: 41133 - DNA, 15 bp, Homo sapiens
ttcccgtcttgatgt

SEQ ID NO: 41134 - DNA, 15 bp, Homo sapiens
cttcccgtcttgatg

SEQ ID NO: 41135 - DNA, 15 bp, Homo sapiens
ccttcccgtcttgat

SEQ ID NO: 41136 - DNA, 15 bp, Homo sapiens
gccttcccgtcttga

SEQ ID NO: 41137 - DNA, 15 bp, Homo sapiens
agccttcccgtcttg

SEQ ID NO: 41138 - DNA, 15 bp, Homo sapiens
cagccttcccgtctt

SEQ ID NO: 41139 - DNA, 15 bp, Homo sapiens
ccagccttcccgtct

SEQ ID NO: 41140 - DNA, 15 bp, Homo sapiens
gccagccttcccgtc

SEQ ID NO: 41141 - DNA, 15 bp, Homo sapiens
agccagccttcccgt

SEQ ID NO: 41142 - DNA, 15 bp, Homo sapiens
cagccagccttcccg

SEQ ID NO: 41143 - DNA, 15 bp, Homo sapiens
acagccagccttccc

SEQ ID NO: 41144 - DNA, 15 bp, Homo sapiens
cacagccagccttcc

SEQ ID NO: 41145 - DNA, 15 bp, Homo sapiens
ccacagccagccttc

SEQ ID NO: 41146 - DNA, 15 bp, Homo sapiens
tccacagccagcctt

SEQ ID NO: 41147 - DNA, 15 bp, Homo sapiens
gtccacagccagcct

SEQ ID NO: 41148 - DNA, 15 bp, Homo sapiens
tgtccacagccagcc

SEQ ID NO: 41149 - DNA, 15 bp, Homo sapiens
gtgtccacagccagc

SEQ ID NO: 41150 - DNA, 15 bp, Homo sapiens
cgtgtccacagccag

SEQ ID NO: 41151 - DNA, 15 bp, Homo sapiens
ccgtgtccacagcca

SEQ ID NO: 41152 - DNA, 15 bp, Homo sapiens
tccgtgtccacagcc

SEQ ID NO: 41153 - DNA, 15 bp, Homo sapiens
gtccgtgtccacagc

SEQ ID NO: 41154 - DNA, 15 bp, Homo sapiens
tgtccgtgtccacag

SEQ ID NO: 41155 - DNA, 15 bp, Homo sapiens
gtgtccgtgtccaca

SEQ ID NO: 41156 - DNA, 15 bp, Homo sapiens
ggtgtccgtgtccac

SEQ ID NO: 41157 - DNA, 15 bp, Homo sapiens
aggtgtccgtgtcca

SEQ ID NO: 41158 - DNA, 15 bp, Homo sapiens
aaggtgtccgtgtcc

SEQ ID NO: 41159 - DNA, 15 bp, Homo sapiens
gaaggtgtccgtgtc

SEQ ID NO: 41160 - DNA, 15 bp, Homo sapiens
tgaaggtgtccgtgt

SEQ ID NO: 41161 - DNA, 15 bp, Homo sapiens
ctgaaggtgtccgtg

SEQ ID NO: 41162 - DNA, 15 bp, Homo sapiens
gctgaaggtgtccgt

SEQ ID NO: 41163 - DNA, 15 bp, Homo sapiens
agctgaaggtgtccg

SEQ ID NO: 41164 - DNA, 15 bp, Homo sapiens
aagctgaaggtgtcc

SEQ ID NO: 41165 - DNA, 15 bp, Homo sapiens
aaagctgaaggtgtc

SEQ ID NO: 41166 - DNA, 15 bp, Homo sapiens
caaagctgaaggtgt

SEQ ID NO: 41167 - DNA, 15 bp, Homo sapiens
ccaaagctgaaggtg

SEQ ID NO: 41168 - DNA, 15 bp, Homo sapiens
cccaaagctgaaggt

SEQ ID NO: 41169 - DNA, 15 bp, Homo sapiens
ccccaaagctgaagg

SEQ ID NO: 41170 - DNA, 15 bp, Homo sapiens
accccaaagctgaag

SEQ ID NO: 41171 - DNA, 15 bp, Homo sapiens
caccccaaagctgaa

SEQ ID NO: 41172 - DNA, 15 bp, Homo sapiens
ccaccccaaagctga

SEQ ID NO: 41173 - DNA, 15 bp, Homo sapiens
accaccccaaagctg

SEQ ID NO: 41174 - DNA, 15 bp, Homo sapiens
caccaccccaaagct

SEQ ID NO: 41175 - DNA, 15 bp, Homo sapiens
tcaccaccccaaagc

SEQ ID NO: 41176 - DNA, 15 bp, Homo sapiens
ctcaccaccccaaag

SEQ ID NO: 41177 - DNA, 15 bp, Homo sapiens
gctcaccaccccaaa

SEQ ID NO: 41178 - DNA, 15 bp, Homo sapiens
ggctcaccaccccaa

SEQ ID NO: 41179 - DNA, 15 bp, Homo sapiens
tggctcaccacccca

SEQ ID NO: 41180 - DNA, 15 bp, Homo sapiens
gtggctcaccacccc

SEQ ID NO: 41181 - DNA, 15 bp, Homo sapiens
agtggctcaccaccc

SEQ ID NO: 41182 - DNA, 15 bp, Homo sapiens
cagtggctcaccacc

SEQ ID NO: 41183 - DNA, 15 bp, Homo sapiens
tcagtggctcaccac

SEQ ID NO: 41184 - DNA, 15 bp, Homo sapiens
gtcagtggctcacca

SEQ ID NO: 41185 - DNA, 15 bp, Homo sapiens
ggtcagtggctcacc

SEQ ID NO: 41186 - DNA, 15 bp, Homo sapiens
gggtcagtggctcac

SEQ ID NO: 41187 - DNA, 15 bp, Homo sapiens
ggggtcagtggctca

SEQ ID NO: 41188 - DNA, 15 bp, Homo sapiens
aggggtcagtggctc

SEQ ID NO: 41189 - DNA, 15 bp, Homo sapiens
gaggggtcagtggct

SEQ ID NO: 41190 - DNA, 15 bp, Homo sapiens
agaggggtcagtggc

SEQ ID NO: 41191 - DNA, 15 bp, Homo sapiens
cagaggggtcagtgg

SEQ ID NO: 41192 - DNA, 15 bp, Homo sapiens
gcagaggggtcagtg

SEQ ID NO: 41193 - DNA, 15 bp, Homo sapiens
agcagaggggtcagt

SEQ ID NO: 41194 - DNA, 15 bp, Homo sapiens
cagcagaggggtcag

SEQ ID NO: 41195 - DNA, 15 bp, Homo sapiens
ccagcagaggggtca

SEQ ID NO: 41196 - DNA, 15 bp, Homo sapiens
gccagcagaggggtc

SEQ ID NO: 41197 - DNA, 15 bp, Homo sapiens
agccagcagaggggt

SEQ ID NO: 41198 - DNA, 15 bp, Homo sapiens
gagccagcagagggg

SEQ ID NO: 41199 - DNA, 15 bp, Homo sapiens
tgagccagcagaggg

SEQ ID NO: 41200 - DNA, 15 bp, Homo sapiens
ctgagccagcagagg

SEQ ID NO: 41201 - DNA, 15 bp, Homo sapiens
tctgagccagcagag

SEQ ID NO: 41202 - DNA, 15 bp, Homo sapiens
ctctgagccagcaga

SEQ ID NO: 41203 - DNA, 15 bp, Homo sapiens
cctctgagccagcag

SEQ ID NO: 41204 - DNA, 15 bp, Homo sapiens
tcctctgagccagca

SEQ ID NO: 41205 - DNA, 15 bp, Homo sapiens
ctcctctgagccagc

SEQ ID NO: 41206 - DNA, 15 bp, Homo sapiens
cctcctctgagccag

SEQ ID NO: 41207 - DNA, 15 bp, Homo sapiens
tcctcctctgagcca

SEQ ID NO: 41208 - DNA, 15 bp, Homo sapiens
ctcctcctctgagcc

SEQ ID NO: 41209 - DNA, 15 bp, Homo sapiens
tctcctcctctgagc

SEQ ID NO: 41210 - DNA, 15 bp, Homo sapiens
ttctcctcctctgag

SEQ ID NO: 41211 - DNA, 15 bp, Homo sapiens
cttctcctcctctga

SEQ ID NO: 41212 - DNA, 15 bp, Homo sapiens
gcttctcctcctctg

SEQ ID NO: 41213 - DNA, 15 bp, Homo sapiens
ggcttctcctcctct

SEQ ID NO: 41214 - DNA, 15 bp, Homo sapiens
tggcttctcctcctc

SEQ ID NO: 41215 - DNA, 15 bp, Homo sapiens
gtggcttctcctcct

SEQ ID NO: 41216 - DNA, 15 bp, Homo sapiens
tgtggcttctcctcc

SEQ ID NO: 41217 - DNA, 15 bp, Homo sapiens
ctgtggcttctcctc

SEQ ID NO: 41218 - DNA, 15 bp, Homo sapiens
cctgtggcttctcct

SEQ ID NO: 41219 - DNA, 15 bp, Homo sapiens
gcctgtggcttctcc

SEQ ID NO: 41220 - DNA, 15 bp, Homo sapiens
tgcctgtggcttctc

SEQ ID NO: 41221 - DNA, 15 bp, Homo sapiens
ctgcctgtggcttct

SEQ ID NO: 41222 - DNA, 15 bp, Homo sapiens
cctgcctgtggcttc

SEQ ID NO: 41223 - DNA, 15 bp, Homo sapiens
gcctgcctgtggctt

SEQ ID NO: 41224 - DNA, 15 bp, Homo sapiens
tgcctgcctgtggct

SEQ ID NO: 41225 - DNA, 15 bp, Homo sapiens
ctgcctgcctgtggc

SEQ ID NO: 41226 - DNA, 15 bp, Homo sapiens
tctgcctgcctgtgg

SEQ ID NO: 41227 - DNA, 15 bp, Homo sapiens
ctctgcctgcctgtg

SEQ ID NO: 41228 - DNA, 15 bp, Homo sapiens
cctctgcctgcctgt

SEQ ID NO: 41229 - DNA, 15 bp, Homo sapiens
acctctgcctgcctg

SEQ ID NO: 41230 - DNA, 15 bp, Homo sapiens
cacctctgcctgcct

SEQ ID NO: 41231 - DNA, 15 bp, Homo sapiens
ccacctctgcctgcc

SEQ ID NO: 41232 - DNA, 15 bp, Homo sapiens
cccacctctgcctgc

SEQ ID NO: 41233 - DNA, 15 bp, Homo sapiens
ccccacctctgcctg

SEQ ID NO: 41234 - DNA, 15 bp, Homo sapiens
cccccacctctgcct

SEQ ID NO: 41235 - DNA, 15 bp, Homo sapiens
gcccccacctctgcc

SEQ ID NO: 41236 - DNA, 15 bp, Homo sapiens
agcccccacctctgc

SEQ ID NO: 41237 - DNA, 15 bp, Homo sapiens
cagcccccacctctg

SEQ ID NO: 41238 - DNA, 15 bp, Homo sapiens
gcagcccccacctct

SEQ ID NO: 41239 - DNA, 15 bp, Homo sapiens
tgcagcccccacctc

SEQ ID NO: 41240 - DNA, 15 bp, Homo sapiens
ctgcagcccccacct

SEQ ID NO: 41241 - DNA, 15 bp, Homo sapiens
tctgcagcccccacc

SEQ ID NO: 41242 - DNA, 15 bp, Homo sapiens
ctctgcagcccccac

SEQ ID NO: 41243 - DNA, 15 bp, Homo sapiens
actctgcagccccca

SEQ ID NO: 41244 - DNA, 15 bp, Homo sapiens
cactctgcagccccc

SEQ ID NO: 41245 - DNA, 15 bp, Homo sapiens
gcactctgcagcccc

SEQ ID NO: 41246 - DNA, 15 bp, Homo sapiens
tgcactctgcagccc

SEQ ID NO: 41247 - DNA, 15 bp, Homo sapiens
gtgcactctgcagcc

SEQ ID NO: 41248 - DNA, 15 bp, Homo sapiens
agtgcactctgcagc

SEQ ID NO: 41249 - DNA, 15 bp, Homo sapiens
cagtgcactctgcag

SEQ ID NO: 41250 - DNA, 15 bp, Homo sapiens
gcagtgcactctgca

SEQ ID NO: 41251 - DNA, 15 bp, Homo sapiens
cgcagtgcactctgc

SEQ ID NO: 41252 - DNA, 15 bp, Homo sapiens
ccgcagtgcactctg

SEQ ID NO: 41253 - DNA, 15 bp, Homo sapiens
cccgcagtgcactct

SEQ ID NO: 41254 - DNA, 15 bp, Homo sapiens
gcccgcagtgcactc

SEQ ID NO: 41255 - DNA, 15 bp, Homo sapiens
ggcccgcagtgcact

SEQ ID NO: 41256 - DNA, 15 bp, Homo sapiens
tggcccgcagtgcac

SEQ ID NO: 41257 - DNA, 15 bp, Homo sapiens
ctggcccgcagtgca

SEQ ID NO: 41258 - DNA, 15 bp, Homo sapiens
cctggcccgcagtgc

SEQ ID NO: 41259 - DNA, 15 bp, Homo sapiens
ccctggcccgcagtg

SEQ ID NO: 41260 - DNA, 15 bp, Homo sapiens
cccctggcccgcagt

SEQ ID NO: 41261 - DNA, 15 bp, Homo sapiens
gcccctggcccgcag

SEQ ID NO: 41262 - DNA, 15 bp, Homo sapiens
ggcccctggcccgca

SEQ ID NO: 41263 - DNA, 15 bp, Homo sapiens
tggcccctggcccgc

SEQ ID NO: 41264 - DNA, 15 bp, Homo sapiens
atggcccctggcccg

SEQ ID NO: 41265 - DNA, 15 bp, Homo sapiens
gatggcccctggccc

SEQ ID NO: 41266 - DNA, 15 bp, Homo sapiens
agatggcccctggcc

SEQ ID NO: 41267 - DNA, 15 bp, Homo sapiens
cagatggcccctggc

SEQ ID NO: 41268 - DNA, 15 bp, Homo sapiens
gcagatggcccctgg

SEQ ID NO: 41269 - DNA, 15 bp, Homo sapiens
ggcagatggcccctg

SEQ ID NO: 41270 - DNA, 15 bp, Homo sapiens
tggcagatggcccct

SEQ ID NO: 41271 - DNA, 15 bp, Homo sapiens
ttggcagatggcccc

SEQ ID NO: 41272 - DNA, 15 bp, Homo sapiens
cttggcagatggccc

SEQ ID NO: 41273 - DNA, 15 bp, Homo sapiens
tcttggcagatggcc

SEQ ID NO: 41274 - DNA, 15 bp, Homo sapiens
gtcttggcagatggc

SEQ ID NO: 41275 - DNA, 15 bp, Homo sapiens
ggtcttggcagatgg

SEQ ID NO: 41276 - DNA, 15 bp, Homo sapiens
gggtcttggcagatg

SEQ ID NO: 41277 - DNA, 15 bp, Homo sapiens
ggggtcttggcagat

SEQ ID NO: 41278 - DNA, 15 bp, Homo sapiens
tggggtcttggcaga

SEQ ID NO: 41279 - DNA, 15 bp, Homo sapiens
ctggggtcttggcag

SEQ ID NO: 41280 - DNA, 15 bp, Homo sapiens
cctggggtcttggca

SEQ ID NO: 41281 - DNA, 15 bp, Homo sapiens
tcctggggtcttggc

SEQ ID NO: 41282 - DNA, 15 bp, Homo sapiens
ctcctggggtcttgg

SEQ ID NO: 41283 - DNA, 15 bp, Homo sapiens
cctcctggggtcttg

SEQ ID NO: 41284 - DNA, 15 bp, Homo sapiens
gcctcctggggtctt

SEQ ID NO: 41285 - DNA, 15 bp, Homo sapiens
agcctcctggggtct

SEQ ID NO: 41286 - DNA, 15 bp, Homo sapiens
cagcctcctggggtc

SEQ ID NO: 41287 - DNA, 15 bp, Homo sapiens
gcagcctcctggggt

SEQ ID NO: 41288 - DNA, 15 bp, Homo sapiens
tgcagcctcctgggg

SEQ ID NO: 41289 - DNA, 15 bp, Homo sapiens
ctgcagcctcctggg

SEQ ID NO: 41290 - DNA, 15 bp, Homo sapiens
gctgcagcctcctgg

SEQ ID NO: 41291 - DNA, 15 bp, Homo sapiens
agctgcagcctcctg

SEQ ID NO: 41292 - DNA, 15 bp, Homo sapiens
gagctgcagcctcct

SEQ ID NO: 41293 - DNA, 15 bp, Homo sapiens
ggagctgcagcctcc

SEQ ID NO: 41294 - DNA, 15 bp, Homo sapiens
tggagctgcagcctc

SEQ ID NO: 41295 - DNA, 15 bp, Homo sapiens
ctggagctgcagcct

SEQ ID NO: 41296 - DNA, 15 bp, Homo sapiens
cctggagctgcagcc

SEQ ID NO: 41297 - DNA, 15 bp, Homo sapiens
ccctggagctgcagc

SEQ ID NO: 41298 - DNA, 15 bp, Homo sapiens
accctggagctgcag

SEQ ID NO: 41299 - DNA, 15 bp, Homo sapiens
gaccctggagctgca

SEQ ID NO: 41300 - DNA, 15 bp, Homo sapiens
ggaccctggagctgc

SEQ ID NO: 41301 - DNA, 15 bp, Homo sapiens
gggaccctggagctg

SEQ ID NO: 41302 - DNA, 15 bp, Homo sapiens
ggggaccctggagct

SEQ ID NO: 41303 - DNA, 15 bp, Homo sapiens
gggggaccctggagc

SEQ ID NO: 41304 - DNA, 15 bp, Homo sapiens
agggggaccctggag

SEQ ID NO: 41305 - DNA, 15 bp, Homo sapiens
gagggggaccctgga

SEQ ID NO: 41306 - DNA, 15 bp, Homo sapiens
ggagggggaccctgg

SEQ ID NO: 41307 - DNA, 15 bp, Homo sapiens
gggagggggaccctg

SEQ ID NO: 41308 - DNA, 15 bp, Homo sapiens
agggagggggaccct

SEQ ID NO: 41309 - DNA, 15 bp, Homo sapiens
gagggagggggaccc

SEQ ID NO: 41310 - DNA, 15 bp, Homo sapiens
ggagggagggggacc

SEQ ID NO: 41311 - DNA, 15 bp, Homo sapiens
cggagggagggggac

SEQ ID NO: 41312 - DNA, 15 bp, Homo sapiens
ctcggagggaggggg

SEQ ID NO: 41313 - DNA, 15 bp, Homo sapiens
cctcggagggagggg

SEQ ID NO: 41314 - DNA, 15 bp, Homo sapiens
gcctcggagggaggg

SEQ ID NO: 41315 - DNA, 15 bp, Homo sapiens
ggcctcggagggagg

SEQ ID NO: 41316 - DNA, 15 bp, Homo sapiens
gggcctcggagggag

SEQ ID NO: 41317 - DNA, 15 bp, Homo sapiens
agggcctcggaggga

SEQ ID NO: 41318 - DNA, 15 bp, Homo sapiens
gagggcctcggaggg

SEQ ID NO: 41319 - DNA, 15 bp, Homo sapiens
ggagggcctcggagg

SEQ ID NO: 41320 - DNA, 15 bp, Homo sapiens
aggagggcctcggag

SEQ ID NO: 41321 - DNA, 15 bp, Homo sapiens
gaggagggcctcgga

SEQ ID NO: 41322 - DNA, 15 bp, Homo sapiens
ggaggagggcctcgg

SEQ ID NO: 41323 - DNA, 15 bp, Homo sapiens
aggaggagggcctcg

SEQ ID NO: 41324 - DNA, 15 bp, Homo sapiens
gaggaggagggcctc

SEQ ID NO: 41325 - DNA, 15 bp, Homo sapiens
tgaggaggagggcct

SEQ ID NO: 41326 - DNA, 15 bp, Homo sapiens
gtgaggaggagggcc

SEQ ID NO: 41327 - DNA, 15 bp, Homo sapiens
ggtgaggaggagggc

SEQ ID NO: 41328 - DNA, 15 bp, Homo sapiens
gggtgaggaggaggg

SEQ ID NO: 41329 - DNA, 15 bp, Homo sapiens
agggtgaggaggagg

SEQ ID NO: 41330 - DNA, 15 bp, Homo sapiens
cagggtgaggaggag

SEQ ID NO: 41331 - DNA, 15 bp, Homo sapiens
gcagggtgaggagga

SEQ ID NO: 41332 - DNA, 15 bp, Homo sapiens
tgcagggtgaggagg

SEQ ID NO: 41333 - DNA, 15 bp, Homo sapiens
gtgcagggtgaggag

SEQ ID NO: 41334 - DNA, 15 bp, Homo sapiens
ggtgcagggtgagga

SEQ ID NO: 41335 - DNA, 15 bp, Homo sapiens
aggtgcagggtgagg

SEQ ID NO: 41336 - DNA, 15 bp, Homo sapiens
taggtgcagggtgag

SEQ ID NO: 41337 - DNA, 15 bp, Homo sapiens
ttaggtgcagggtga

SEQ ID NO: 41338 - DNA, 15 bp, Homo sapiens
gttaggtgcagggtg

SEQ ID NO: 41339 - DNA, 15 bp, Homo sapiens
agttaggtgcagggt

SEQ ID NO: 41340 - DNA, 15 bp, Homo sapiens
cagttaggtgcaggg

SEQ ID NO: 41341 - DNA, 15 bp, Homo sapiens
acagttaggtgcagg

SEQ ID NO: 41342 - DNA, 15 bp, Homo sapiens
cacagttaggtgcag

SEQ ID NO: 41343 - DNA, 15 bp, Homo sapiens
acacagttaggtgca

SEQ ID NO: 41344 - DNA, 15 bp, Homo sapiens
cacacagttaggtgc

SEQ ID NO: 41345 - DNA, 15 bp, Homo sapiens
acacacagttaggtg

SEQ ID NO: 41346 - DNA, 15 bp, Homo sapiens
aacacacagttaggt

SEQ ID NO: 41347 - DNA, 15 bp, Homo sapiens
aaacacacagttagg

SEQ ID NO: 41348 - DNA, 15 bp, Homo sapiens
caaacacacagttag

SEQ ID NO: 41349 - DNA, 15 bp, Homo sapiens
acaaacacacagtta

SEQ ID NO: 41350 - DNA, 15 bp, Homo sapiens
tacaaacacacagtt

SEQ ID NO: 41351 - DNA, 15 bp, Homo sapiens
ttacaaacacacagt

SEQ ID NO: 41352 - DNA, 15 bp, Homo sapiens
attacaaacacacag

SEQ ID NO: 41353 - DNA, 15 bp, Homo sapiens
aattacaaacacaca

SEQ ID NO: 41354 - DNA, 15 bp, Homo sapiens
aaattacaaacacac

SEQ ID NO: 41355 - DNA, 15 bp, Homo sapiens
caaattacaaacaca

SEQ ID NO: 41356 - DNA, 15 bp, Homo sapiens
acaaattacaaacac

SEQ ID NO: 41357 - DNA, 15 bp, Homo sapiens
gacaaattacaaaca

SEQ ID NO: 41358 - DNA, 15 bp, Homo sapiens
agacaaattacaaac

SEQ ID NO: 41359 - DNA, 15 bp, Homo sapiens
aagacaaattacaaa

SEQ ID NO: 41360 - DNA, 15 bp, Homo sapiens
gaagacaaattacaa

SEQ ID NO: 41361 - DNA, 15 bp, Homo sapiens
tgaagacaaattaca

SEQ ID NO: 41362 - DNA, 15 bp, Homo sapiens
ttgaagacaaattac

SEQ ID NO: 41363 - DNA, 15 bp, Homo sapiens
cttgaagacaaatta

SEQ ID NO: 41364 - DNA, 15 bp, Homo sapiens
acttgaagacaaatt

SEQ ID NO: 41365 - DNA, 15 bp, Homo sapiens
cacttgaagacaaat

SEQ ID NO: 41366 - DNA, 15 bp, Homo sapiens
ccacttgaagacaaa

SEQ ID NO: 41367 - DNA, 15 bp, Homo sapiens
cccacttgaagacaa

SEQ ID NO: 41368 - DNA, 15 bp, Homo sapiens
gcccacttgaagaca

SEQ ID NO: 41369 - DNA, 15 bp, Homo sapiens
agcccacttgaagac

SEQ ID NO: 41370 - DNA, 15 bp, Homo sapiens
gagcccacttgaaga

SEQ ID NO: 41371 - DNA, 15 bp, Homo sapiens
agagcccacttgaag

SEQ ID NO: 41372 - DNA, 15 bp, Homo sapiens
gagagcccacttgaa

SEQ ID NO: 41373 - DNA, 15 bp, Homo sapiens
ggagagcccacttga

SEQ ID NO: 41374 - DNA, 15 bp, Homo sapiens
cggagagcccacttg

SEQ ID NO: 41375 - DNA, 15 bp, Homo sapiens
tcggagagcccactt

SEQ ID NO: 41376 - DNA, 15 bp, Homo sapiens
ctcggagagcccact

SEQ ID NO: 41377 - DNA, 15 bp, Homo sapiens
actcggagagcccac

SEQ ID NO: 41378 - DNA, 15 bp, Homo sapiens
aactcggagagccca

SEQ ID NO: 41379 - DNA, 15 bp, Homo sapiens
caactcggagagccc

SEQ ID NO: 41380 - DNA, 15 bp, Homo sapiens
gcaactcggagagcc

SEQ ID NO: 41381 - DNA, 15 bp, Homo sapiens
ggcaactcggagagc

SEQ ID NO: 41382 - DNA, 15 bp, Homo sapiens
gggcaactcggagag

SEQ ID NO: 41383 - DNA, 15 bp, Homo sapiens
cgggcaactcggaga

SEQ ID NO: 41384 - DNA, 15 bp, Homo sapiens
tcgggcaactcggag

SEQ ID NO: 41385 - DNA, 15 bp, Homo sapiens
ctcgggcaactcgga

SEQ ID NO: 41386 - DNA, 15 bp, Homo sapiens
gctcgggcaactcgg

SEQ ID NO: 41387 - DNA, 15 bp, Homo sapiens
agctcgggcaactcg

SEQ ID NO: 41388 - DNA, 15 bp, Homo sapiens
aagctcgggcaactc

SEQ ID NO: 41389 - DNA, 15 bp, Homo sapiens
gaagctcgggcaact

SEQ ID NO: 41390 - DNA, 15 bp, Homo sapiens
tgaagctcgggcaac

SEQ ID NO: 41391 - DNA, 15 bp, Homo sapiens
ctgaagctcgggcaa

SEQ ID NO: 41392 - DNA, 15 bp, Homo sapiens
actgaagctcgggca

SEQ ID NO: 41393 - DNA, 15 bp, Homo sapiens
gactgaagctcgggc

SEQ ID NO: 41394 - DNA, 15 bp, Homo sapiens
ggactgaagctcggg

SEQ ID NO: 41395 - DNA, 15 bp, Homo sapiens
gggactgaagctcgg

SEQ ID NO: 41396 - DNA, 15 bp, Homo sapiens
tgggactgaagctcg

SEQ ID NO: 41397 - DNA, 15 bp, Homo sapiens
atgggactgaagctc

SEQ ID NO: 41398 - DNA, 15 bp, Homo sapiens
tatgggactgaagct

SEQ ID NO: 41399 - DNA, 15 bp, Homo sapiens
ttatgggactgaagc

SEQ ID NO: 41400 - DNA, 15 bp, Homo sapiens
gttatgggactgaag

SEQ ID NO: 41401 - DNA, 15 bp, Homo sapiens
tgttatgggactgaa

SEQ ID NO: 41402 - DNA, 15 bp, Homo sapiens
atgttatgggactga

SEQ ID NO: 41403 - DNA, 15 bp, Homo sapiens
gatgttatgggactg

SEQ ID NO: 41404 - DNA, 15 bp, Homo sapiens
agatgttatgggact

SEQ ID NO: 41405 - DNA, 15 bp, Homo sapiens
cagatgttatgggac

SEQ ID NO: 41406 - DNA, 15 bp, Homo sapiens
ccagatgttatggga

SEQ ID NO: 41407 - DNA, 15 bp, Homo sapiens
gccagatgttatggg

SEQ ID NO: 41408 - DNA, 15 bp, Homo sapiens
agccagatgttatgg

SEQ ID NO: 41409 - DNA, 15 bp, Homo sapiens
gagccagatgttatg

SEQ ID NO: 41410 - DNA, 15 bp, Homo sapiens
agagccagatgttat

SEQ ID NO: 41411 - DNA, 15 bp, Homo sapiens
cagagccagatgtta

SEQ ID NO: 41412 - DNA, 15 bp, Homo sapiens
gcagagccagatgtt

SEQ ID NO: 41413 - DNA, 15 bp, Homo sapiens
ggcagagccagatgt

SEQ ID NO: 41414 - DNA, 15 bp, Homo sapiens
aggcagagccagatg

SEQ ID NO: 41415 - DNA, 15 bp, Homo sapiens
aaggcagagccagat

SEQ ID NO: 41416 - DNA, 15 bp, Homo sapiens
aaaggcagagccaga

SEQ ID NO: 41417 - DNA, 15 bp, Homo sapiens
caaaggcagagccag

SEQ ID NO: 41418 - DNA, 15 bp, Homo sapiens
acaaaggcagagcca

SEQ ID NO: 41419 - DNA, 15 bp, Homo sapiens
gacaaaggcagagcc

SEQ ID NO: 41420 - DNA, 15 bp, Homo sapiens
ggacaaaggcagagc

SEQ ID NO: 41421 - DNA, 15 bp, Homo sapiens
tggacaaaggcagag

SEQ ID NO: 41422 - DNA, 15 bp, Homo sapiens
gtggacaaaggcaga

SEQ ID NO: 41423 - DNA, 15 bp, Homo sapiens
tgtggacaaaggcag

SEQ ID NO: 41424 - DNA, 15 bp, Homo sapiens
gtgtggacaaaggca

SEQ ID NO: 41425 - DNA, 15 bp, Homo sapiens
ggtgtggacaaaggc

SEQ ID NO: 41426 - DNA, 15 bp, Homo sapiens
gggtgtggacaaagg

SEQ ID NO: 41427 - DNA, 15 bp, Homo sapiens
agggtgtggacaaag

SEQ ID NO: 41428 - DNA, 15 bp, Homo sapiens
aagggtgtggacaaa

SEQ ID NO: 41429 - DNA, 15 bp, Homo sapiens
caagggtgtggacaa

SEQ ID NO: 41430 - DNA, 15 bp, Homo sapiens
acaagggtgtggaca

SEQ ID NO: 41431 - DNA, 15 bp, Homo sapiens
gacaagggtgtggac

SEQ ID NO: 41432 - DNA, 15 bp, Homo sapiens
tgacaagggtgtgga

SEQ ID NO: 41433 - DNA, 15 bp, Homo sapiens
ctgacaagggtgtgg

SEQ ID NO: 41434 - DNA, 15 bp, Homo sapiens
cctgacaagggtgtg

SEQ ID NO: 41435 - DNA, 15 bp, Homo sapiens
gcctgacaagggtgt

SEQ ID NO: 41436 - DNA, 15 bp, Homo sapiens
ggcctgacaagggtg

SEQ ID NO: 41437 - DNA, 15 bp, Homo sapiens
gggcctgacaagggt

SEQ ID NO: 41438 - DNA, 15 bp, Homo sapiens
tgggcctgacaaggg

SEQ ID NO: 41439 - DNA, 15 bp, Homo sapiens
ttgggcctgacaagg

SEQ ID NO: 41440 - DNA, 15 bp, Homo sapiens
attgggcctgacaag

SEQ ID NO: 41441 - DNA, 15 bp, Homo sapiens
gattgggcctgacaa

SEQ ID NO: 41442 - DNA, 15 bp, Homo sapiens
ggattgggcctgaca

SEQ ID NO: 41443 - DNA, 15 bp, Homo sapiens
tggattgggcctgac

SEQ ID NO: 41444 - DNA, 15 bp, Homo sapiens
atggattgggcctga

SEQ ID NO: 41445 - DNA, 15 bp, Homo sapiens
catggattgggcctg

SEQ ID NO: 41446 - DNA, 15 bp, Homo sapiens
acatggattgggcct

SEQ ID NO: 41447 - DNA, 15 bp, Homo sapiens
gacatggattgggcc

SEQ ID NO: 41448 - DNA, 15 bp, Homo sapiens
ggacatggattgggc

SEQ ID NO: 41449 - DNA, 15 bp, Homo sapiens
tggacatggattggg

SEQ ID NO: 41450 - DNA, 15 bp, Homo sapiens
gtggacatggattgg

SEQ ID NO: 41451 - DNA, 15 bp, Homo sapiens
tgtggacatggattg

SEQ ID NO: 41452 - DNA, 15 bp, Homo sapiens
gtgtggacatggatt

SEQ ID NO: 41453 - DNA, 15 bp, Homo sapiens
ggtgtggacatggat

SEQ ID NO: 41454 - DNA, 15 bp, Homo sapiens
tggtgtggacatgga

SEQ ID NO: 41455 - DNA, 15 bp, Homo sapiens
ctggtgtggacatgg

SEQ ID NO: 41456 - DNA, 15 bp, Homo sapiens
tctggtgtggacatg

SEQ ID NO: 41457 - DNA, 15 bp, Homo sapiens
ctctggtgtggacat

SEQ ID NO: 41458 - DNA, 15 bp, Homo sapiens
cctctggtgtggaca

SEQ ID NO: 41459 - DNA, 15 bp, Homo sapiens
gcctctggtgtggac

SEQ ID NO: 41460 - DNA, 15 bp, Homo sapiens
ggcctctggtgtgga

SEQ ID NO: 41461 - DNA, 15 bp, Homo sapiens
aggcctctggtgtgg

SEQ ID NO: 41462 - DNA, 15 bp, Homo sapiens
gaggcctctggtgtg

SEQ ID NO: 41463 - DNA, 15 bp, Homo sapiens
agaggcctctggtgt

SEQ ID NO: 41464 - DNA, 15 bp, Homo sapiens
aagaggcctctggtg

SEQ ID NO: 41465 - DNA, 15 bp, Homo sapiens
gaagaggcctctggt

SEQ ID NO: 41466 - DNA, 15 bp, Homo sapiens
ggaagaggcctctgg

SEQ ID NO: 41467 - DNA, 15 bp, Homo sapiens
gggaagaggcctctg

SEQ ID NO: 41468 - DNA, 15 bp, Homo sapiens
agggaagaggcctct

SEQ ID NO: 41469 - DNA, 15 bp, Homo sapiens
cagggaagaggcctc

SEQ ID NO: 41470 - DNA, 15 bp, Homo sapiens
gcagggaagaggcct

SEQ ID NO: 41471 - DNA, 15 bp, Homo sapiens
ggcagggaagaggcc

SEQ ID NO: 41472 - DNA, 15 bp, Homo sapiens
tggcagggaagaggc

SEQ ID NO: 41473 - DNA, 15 bp, Homo sapiens
ttggcagggaagagg

SEQ ID NO: 41474 - DNA, 15 bp, Homo sapiens
cttggcagggaagag

SEQ ID NO: 41475 - DNA, 15 bp, Homo sapiens
ccttggcagggaaga

SEQ ID NO: 41476 - DNA, 15 bp, Homo sapiens
gccttggcagggaag

SEQ ID NO: 41477 - DNA, 15 bp, Homo sapiens
ggccttggcagggaa

SEQ ID NO: 41478 - DNA, 15 bp, Homo sapiens
tggccttggcaggga

SEQ ID NO: 41479 - DNA, 15 bp, Homo sapiens
gtggccttggcaggg

SEQ ID NO: 41480 - DNA, 15 bp, Homo sapiens
agtggccttggcagg

SEQ ID NO: 41481 - DNA, 15 bp, Homo sapiens
cagtggccttggcag

SEQ ID NO: 41482 - DNA, 15 bp, Homo sapiens
gcagtggccttggca

SEQ ID NO: 41483 - DNA, 15 bp, Homo sapiens
ggcagtggccttggc

SEQ ID NO: 41484 - DNA, 15 bp, Homo sapiens
tggcagtggccttgg

SEQ ID NO: 41485 - DNA, 15 bp, Homo sapiens
atggcagtggccttg

SEQ ID NO: 41486 - DNA, 15 bp, Homo sapiens
catggcagtggcctt

SEQ ID NO: 41487 - DNA, 15 bp, Homo sapiens
gcatggcagtggcct

SEQ ID NO: 41488 - DNA, 15 bp, Homo sapiens
agcatggcagtggcc

SEQ ID NO: 41489 - DNA, 15 bp, Homo sapiens
gagcatggcagtggc

SEQ ID NO: 41490 - DNA, 15 bp, Homo sapiens
agagcatggcagtgg

SEQ ID NO: 41491 - DNA, 15 bp, Homo sapiens
gagagcatggcagtg

SEQ ID NO: 41492 - DNA, 15 bp, Homo sapiens
ggagagcatggcagt

SEQ ID NO: 41493 - DNA, 15 bp, Homo sapiens
gggagagcatggcag

SEQ ID NO: 41494 - DNA, 15 bp, Homo sapiens
agggagagcatggca

SEQ ID NO: 41495 - DNA, 15 bp, Homo sapiens
gagggagagcatggc

SEQ ID NO: 41496 - DNA, 15 bp, Homo sapiens
agagggagagcatgg

SEQ ID NO: 41497 - DNA, 15 bp, Homo sapiens
aagagggagagcatg

SEQ ID NO: 41498 - DNA, 15 bp, Homo sapiens
gaagagggagagcat

SEQ ID NO: 41499 - DNA, 15 bp, Homo sapiens
ggaagagggagagca

SEQ ID NO: 41500 - DNA, 15 bp, Homo sapiens
gggaagagggagagc

SEQ ID NO: 41501 - DNA, 15 bp, Homo sapiens
agggaagagggagag

SEQ ID NO: 41502 - DNA, 15 bp, Homo sapiens
gagggaagagggaga

SEQ ID NO: 41503 - DNA, 15 bp, Homo sapiens
agagggaagagggag

SEQ ID NO: 41504 - DNA, 15 bp, Homo sapiens
gagagggaagaggga

SEQ ID NO: 41505 - DNA, 15 bp, Homo sapiens
agagagggaagaggg

SEQ ID NO: 41506 - DNA, 15 bp, Homo sapiens
gagagagggaagagg

SEQ ID NO: 41507 - DNA, 15 bp, Homo sapiens
ggagagagggaagag

SEQ ID NO: 41508 - DNA, 15 bp, Homo sapiens
tggagagagggaaga

SEQ ID NO: 41509 - DNA, 15 bp, Homo sapiens
ctggagagagggaag

SEQ ID NO: 41510 - DNA, 15 bp, Homo sapiens
cctggagagagggaa

SEQ ID NO: 41511 - DNA, 15 bp, Homo sapiens
acctggagagaggga

SEQ ID NO: 41512 - DNA, 15 bp, Homo sapiens
tacctggagagaggg

SEQ ID NO: 41513 - DNA, 15 bp, Homo sapiens
ctacctggagagagg

SEQ ID NO: 41514 - DNA, 15 bp, Homo sapiens
actacctggagagag

SEQ ID NO: 41515 - DNA, 15 bp, Homo sapiens
cactacctggagaga

SEQ ID NO: 41516 - DNA, 15 bp, Homo sapiens
gcactacctggagag

SEQ ID NO: 41517 - DNA, 15 bp, Homo sapiens
agcactacctggaga

SEQ ID NO: 41518 - DNA, 15 bp, Homo sapiens
tagcactacctggag

SEQ ID NO: 41519 - DNA, 15 bp, Homo sapiens
ctagcactacctgga

SEQ ID NO: 41520 - DNA, 15 bp, Homo sapiens
tctagcactacctgg

SEQ ID NO: 41521 - DNA, 15 bp, Homo sapiens
ctctagcactacctg

SEQ ID NO: 41522 - DNA, 15 bp, Homo sapiens
tctctagcactacct

SEQ ID NO: 41523 - DNA, 15 bp, Homo sapiens
gtctctagcactacc

SEQ ID NO: 41524 - DNA, 15 bp, Homo sapiens
ggtctctagcactac

SEQ ID NO: 41525 - DNA, 15 bp, Homo sapiens
aggtctctagcacta

SEQ ID NO: 41526 - DNA, 15 bp, Homo sapiens
aaggtctctagcact

SEQ ID NO: 41527 - DNA, 15 bp, Homo sapiens
caaggtctctagcac

SEQ ID NO: 41528 - DNA, 15 bp, Homo sapiens
ccaaggtctctagca

SEQ ID NO: 41529 - DNA, 15 bp, Homo sapiens
gccaaggtctctagc

SEQ ID NO: 41530 - DNA, 15 bp, Homo sapiens
agccaaggtctctag

SEQ ID NO: 41531 - DNA, 15 bp, Homo sapiens
cagccaaggtctcta

SEQ ID NO: 41532 - DNA, 15 bp, Homo sapiens
ccagccaaggtctct

SEQ ID NO: 41533 - DNA, 15 bp, Homo sapiens
accagccaaggtctc

SEQ ID NO: 41534 - DNA, 15 bp, Homo sapiens
gaccagccaaggtct

SEQ ID NO: 41535 - DNA, 15 bp, Homo sapiens
tgaccagccaaggtc

SEQ ID NO: 41536 - DNA, 15 bp, Homo sapiens
ctgaccagccaaggt

SEQ ID NO: 41537 - DNA, 15 bp, Homo sapiens
tctgaccagccaagg

SEQ ID NO: 41538 - DNA, 15 bp, Homo sapiens
ctctgaccagccaag

SEQ ID NO: 41539 - DNA, 15 bp, Homo sapiens
cctctgaccagccaa

SEQ ID NO: 41540 - DNA, 15 bp, Homo sapiens
ccctctgaccagcca

SEQ ID NO: 41541 - DNA, 15 bp, Homo sapiens
gccctctgaccagcc

SEQ ID NO: 41542 - DNA, 15 bp, Homo sapiens
agccctctgaccagc

SEQ ID NO: 41543 - DNA, 15 bp, Homo sapiens
cagccctctgaccag

SEQ ID NO: 41544 - DNA, 15 bp, Homo sapiens
acagccctctgacca

SEQ ID NO: 41545 - DNA, 15 bp, Homo sapiens
cacagccctctgacc

SEQ ID NO: 41546 - DNA, 15 bp, Homo sapiens
tcacagccctctgac

SEQ ID NO: 41547 - DNA, 15 bp, Homo sapiens
ttcacagccctctga

SEQ ID NO: 41548 - DNA, 15 bp, Homo sapiens
cttcacagccctctg

SEQ ID NO: 41549 - DNA, 15 bp, Homo sapiens
tcttcacagccctct

SEQ ID NO: 41550 - DNA, 15 bp, Homo sapiens
gtcttcacagccctc

SEQ ID NO: 41551 - DNA, 15 bp, Homo sapiens
cgtcttcacagccct

SEQ ID NO: 41552 - DNA, 15 bp, Homo sapiens
gcgtcttcacagccc

SEQ ID NO: 41553 - DNA, 15 bp, Homo sapiens
tgcgtcttcacagcc

SEQ ID NO: 41554 - DNA, 15 bp, Homo sapiens
gtgcgtcttcacagc

SEQ ID NO: 41555 - DNA, 15 bp, Homo sapiens
cgtgcgtcttcacag

SEQ ID NO: 41556 - DNA, 15 bp, Homo sapiens
ccgtgcgtcttcaca

SEQ ID NO: 41557 - DNA, 15 bp, Homo sapiens
accgtgcgtcttcac

SEQ ID NO: 41558 - DNA, 15 bp, Homo sapiens
caccgtgcgtcttca

SEQ ID NO: 41559 - DNA, 15 bp, Homo sapiens
gcaccgtgcgtcttc

SEQ ID NO: 41560 - DNA, 15 bp, Homo sapiens
ggcaccgtgcgtctt

SEQ ID NO: 41561 - DNA, 15 bp, Homo sapiens
tggcaccgtgcgtct

SEQ ID NO: 41562 - DNA, 15 bp, Homo sapiens
ctggcaccgtgcgtc

SEQ ID NO: 41563 - DNA, 15 bp, Homo sapiens
cctggcaccgtgcgt

SEQ ID NO: 41564 - DNA, 15 bp, Homo sapiens
tcctggcaccgtgcg

SEQ ID NO: 41565 - DNA, 15 bp, Homo sapiens
gtcctggcaccgtgc

SEQ ID NO: 41566 - DNA, 15 bp, Homo sapiens
ggtcctggcaccgtg

SEQ ID NO: 41567 - DNA, 15 bp, Homo sapiens
tggtcctggcaccgt

SEQ ID NO: 41568 - DNA, 15 bp, Homo sapiens
ttggtcctggcaccg

SEQ ID NO: 41569 - DNA, 15 bp, Homo sapiens
cttggtcctggcacc

SEQ ID NO: 41570 - DNA, 15 bp, Homo sapiens
acttggtcctggcac

SEQ ID NO: 41571 - DNA, 15 bp, Homo sapiens
tacttggtcctggca

SEQ ID NO: 41572 - DNA, 15 bp, Homo sapiens
atacttggtcctggc

SEQ ID NO: 41573 - DNA, 15 bp, Homo sapiens
gatacttggtcctgg

SEQ ID NO: 41574 - DNA, 15 bp, Homo sapiens
agatacttggtcctg

SEQ ID NO: 41575 - DNA, 15 bp, Homo sapiens
cagatacttggtcct

SEQ ID NO: 41576 - DNA, 15 bp, Homo sapiens
ccagatacttggtcc

SEQ ID NO: 41577 - DNA, 15 bp, Homo sapiens
accagatacttggtc

SEQ ID NO: 41578 - DNA, 15 bp, Homo sapiens
caccagatacttggt

SEQ ID NO: 41579 - DNA, 15 bp, Homo sapiens
tcaccagatacttgg

SEQ ID NO: 41580 - DNA, 15 bp, Homo sapiens
ctcaccagatacttg

SEQ ID NO: 41581 - DNA, 15 bp, Homo sapiens
gctcaccagatactt

SEQ ID NO: 41582 - DNA, 15 bp, Homo sapiens
ggctcaccagatact

SEQ ID NO: 41583 - DNA, 15 bp, Homo sapiens
gggctcaccagatac

SEQ ID NO: 41584 - DNA, 15 bp, Homo sapiens
ggggctcaccagata

SEQ ID NO: 41585 - DNA, 15 bp, Homo sapiens
aggggctcaccagat

SEQ ID NO: 41586 - DNA, 15 bp, Homo sapiens
aaggggctcaccaga

SEQ ID NO: 41587 - DNA, 15 bp, Homo sapiens
caaggggctcaccag

SEQ ID NO: 41588 - DNA, 15 bp, Homo sapiens
tcaaggggctcacca

SEQ ID NO: 41589 - DNA, 15 bp, Homo sapiens
ctcaaggggctcacc

SEQ ID NO: 41590 - DNA, 15 bp, Homo sapiens
cctcaaggggctcac

SEQ ID NO: 41591 - DNA, 15 bp, Homo sapiens
gcctcaaggggctca

SEQ ID NO: 41592 - DNA, 15 bp, Homo sapiens
tgcctcaaggggctc

SEQ ID NO: 41593 - DNA, 15 bp, Homo sapiens
ctgcctcaaggggct

SEQ ID NO: 41594 - DNA, 15 bp, Homo sapiens
cctgcctcaaggggc

SEQ ID NO: 41595 - DNA, 15 bp, Homo sapiens
ccctgcctcaagggg

SEQ ID NO: 41596 - DNA, 15 bp, Homo sapiens
gccctgcctcaaggg

SEQ ID NO: 41597 - DNA, 15 bp, Homo sapiens
ggccctgcctcaagg

SEQ ID NO: 41598 - DNA, 15 bp, Homo sapiens
tggccctgcctcaag

SEQ ID NO: 41599 - DNA, 15 bp, Homo sapiens
ctggccctgcctcaa

SEQ ID NO: 41600 - DNA, 15 bp, Homo sapiens
cctggccctgcctca

SEQ ID NO: 41601 - DNA, 15 bp, Homo sapiens
tcctggccctgcctc

SEQ ID NO: 41602 - DNA, 15 bp, Homo sapiens
ctcctggccctgcct

SEQ ID NO: 41603 - DNA, 15 bp, Homo sapiens
cctcctggccctgcc

SEQ ID NO: 41604 - DNA, 15 bp, Homo sapiens
ccctcctggccctgc

SEQ ID NO: 41605 - DNA, 15 bp, Homo sapiens
tccctcctggccctg

SEQ ID NO: 41606 - DNA, 15 bp, Homo sapiens
gtccctcctggccct

SEQ ID NO: 41607 - DNA, 15 bp, Homo sapiens
tgtccctcctggccc

SEQ ID NO: 41608 - DNA, 15 bp, Homo sapiens
gtgtccctcctggcc

SEQ ID NO: 41609 - DNA, 15 bp, Homo sapiens
tgtgtccctcctggc

SEQ ID NO: 41610 - DNA, 15 bp, Homo sapiens
gtgtgtccctcctgg

SEQ ID NO: 41611 - DNA, 15 bp, Homo sapiens
tgtgtgtccctcctg

SEQ ID NO: 41612 - DNA, 15 bp, Homo sapiens
ctgtgtgtccctcct

SEQ ID NO: 41613 - DNA, 15 bp, Homo sapiens
gctgtgtgtccctcc

SEQ ID NO: 41614 - DNA, 15 bp, Homo sapiens
agctgtgtgtccctc

SEQ ID NO: 41615 - DNA, 15 bp, Homo sapiens
cagctgtgtgtccct

SEQ ID NO: 41616 - DNA, 15 bp, Homo sapiens
gcagctgtgtgtccc

SEQ ID NO: 41617 - DNA, 15 bp, Homo sapiens
agcagctgtgtgtcc

SEQ ID NO: 41618 - DNA, 15 bp, Homo sapiens
cagcagctgtgtgtc

SEQ ID NO: 41619 - DNA, 15 bp, Homo sapiens
ccagcagctgtgtgt

SEQ ID NO: 41620 - DNA, 15 bp, Homo sapiens
gccagcagctgtgtg

SEQ ID NO: 41621 - DNA, 15 bp, Homo sapiens
tgccagcagctgtgt

SEQ ID NO: 41622 - DNA, 15 bp, Homo sapiens
ctgccagcagctgtg

SEQ ID NO: 41623 - DNA, 15 bp, Homo sapiens
gctgccagcagctgt

SEQ ID NO: 41624 - DNA, 15 bp, Homo sapiens
ggctgccagcagctg

SEQ ID NO: 41625 - DNA, 15 bp, Homo sapiens
tggctgccagcagct

SEQ ID NO: 41626 - DNA, 15 bp, Homo sapiens
ctggctgccagcagc

SEQ ID NO: 41627 - DNA, 15 bp, Homo sapiens
gctggctgccagcag

SEQ ID NO: 41628 - DNA, 15 bp, Homo sapiens
tgctggctgccagca

SEQ ID NO: 41629 - DNA, 15 bp, Homo sapiens
ctgctggctgccagc

SEQ ID NO: 41630 - DNA, 15 bp, Homo sapiens
cctgctggctgccag

SEQ ID NO: 41631 - DNA, 15 bp, Homo sapiens
gcctgctggctgcca

SEQ ID NO: 41632 - DNA, 15 bp, Homo sapiens
tgcctgctggctgcc

SEQ ID NO: 41633 - DNA, 15 bp, Homo sapiens
gtgcctgctggctgc

SEQ ID NO: 41634 - DNA, 15 bp, Homo sapiens
tgtgcctgctggctg

SEQ ID NO: 41635 - DNA, 15 bp, Homo sapiens
ctgtgcctgctggct

SEQ ID NO: 41636 - DNA, 15 bp, Homo sapiens
gctgtgcctgctggc

SEQ ID NO: 41637 - DNA, 15 bp, Homo sapiens
ggctgtgcctgctgg

SEQ ID NO: 41638 - DNA, 15 bp, Homo sapiens
gggctgtgcctgctg

SEQ ID NO: 41639 - DNA, 15 bp, Homo sapiens
ggggctgtgcctgct

SEQ ID NO: 41640 - DNA, 15 bp, Homo sapiens
tggggctgtgcctgc

SEQ ID NO: 41641 - DNA, 15 bp, Homo sapiens
ctggggctgtgcctg

SEQ ID NO: 41642 - DNA, 15 bp, Homo sapiens
actggggctgtgcct

SEQ ID NO: 41643 - DNA, 15 bp, Homo sapiens
cactggggctgtgcc

SEQ ID NO: 41644 - DNA, 15 bp, Homo sapiens
ccactggggctgtgc

SEQ ID NO: 41645 - DNA, 15 bp, Homo sapiens
gccactggggctgtg

SEQ ID NO: 41646 - DNA, 15 bp, Homo sapiens
cgccactggggctgt

SEQ ID NO: 41647 - DNA, 15 bp, Homo sapiens
ccgccactggggctg

SEQ ID NO: 41648 - DNA, 15 bp, Homo sapiens
cccgccactggggct

SEQ ID NO: 41649 - DNA, 15 bp, Homo sapiens
ccccgccactggggc

SEQ ID NO: 41650 - DNA, 15 bp, Homo sapiens
tccccgccactgggg

SEQ ID NO: 41651 - DNA, 15 bp, Homo sapiens
atccccgccactggg

SEQ ID NO: 41652 - DNA, 15 bp, Homo sapiens
tatccccgccactgg

SEQ ID NO: 41653 - DNA, 15 bp, Homo sapiens
ttatccccgccactg

SEQ ID NO: 41654 - DNA, 15 bp, Homo sapiens
gttatccccgccact

SEQ ID NO: 41655 - DNA, 15 bp, Homo sapiens
agttatccccgccac

SEQ ID NO: 41656 - DNA, 15 bp, Homo sapiens
cagttatccccgcca

SEQ ID NO: 41657 - DNA, 15 bp, Homo sapiens
ccagttatccccgcc

SEQ ID NO: 41658 - DNA, 15 bp, Homo sapiens
cccagttatccccgc

SEQ ID NO: 41659 - DNA, 15 bp, Homo sapiens
ccccagttatccccg

SEQ ID NO: 41660 - DNA, 15 bp, Homo sapiens
gccccagttatcccc

SEQ ID NO: 41661 - DNA, 15 bp, Homo sapiens
cgccccagttatccc

SEQ ID NO: 41662 - DNA, 15 bp, Homo sapiens
gcgccccagttatcc

SEQ ID NO: 41663 - DNA, 15 bp, Homo sapiens
tgcgccccagttatc

SEQ ID NO: 41664 - DNA, 15 bp, Homo sapiens
ctgcgccccagttat

SEQ ID NO: 41665 - DNA, 15 bp, Homo sapiens
actgcgccccagtta

SEQ ID NO: 41666 - DNA, 15 bp, Homo sapiens
cactgcgccccagtt

SEQ ID NO: 41667 - DNA, 15 bp, Homo sapiens
gcactgcgccccagt

SEQ ID NO: 41668 - DNA, 15 bp, Homo sapiens
ggcactgcgccccag

SEQ ID NO: 41669 - DNA, 15 bp, Homo sapiens
gggcactgcgcccca

SEQ ID NO: 41670 - DNA, 15 bp, Homo sapiens
tgggcactgcgcccc

SEQ ID NO: 41671 - DNA, 15 bp, Homo sapiens
atgggcactgcgccc

SEQ ID NO: 41672 - DNA, 15 bp, Homo sapiens
catgggcactgcgcc

SEQ ID NO: 41673 - DNA, 15 bp, Homo sapiens
ccatgggcactgcgc

SEQ ID NO: 41674 - DNA, 15 bp, Homo sapiens
tccatgggcactgcg

SEQ ID NO: 41675 - DNA, 15 bp, Homo sapiens
atccatgggcactgc

SEQ ID NO: 41676 - DNA, 15 bp, Homo sapiens
catccatgggcactg

SEQ ID NO: 41677 - DNA, 15 bp, Homo sapiens
gcatccatgggcact

SEQ ID NO: 41678 - DNA, 15 bp, Homo sapiens
ggcatccatgggcac

SEQ ID NO: 41679 - DNA, 15 bp, Homo sapiens
aggcatccatgggca

SEQ ID NO: 41680 - DNA, 15 bp, Homo sapiens
gaggcatccatgggc

SEQ ID NO: 41681 - DNA, 15 bp, Homo sapiens
agaggcatccatggg

SEQ ID NO: 41682 - DNA, 15 bp, Homo sapiens
cagaggcatccatgg

SEQ ID NO: 41683 - DNA, 15 bp, Homo sapiens
gcagaggcatccatg

SEQ ID NO: 41684 - DNA, 15 bp, Homo sapiens
agcagaggcatccat

SEQ ID NO: 41685 - DNA, 15 bp, Homo sapiens
cagcagaggcatcca

SEQ ID NO: 41686 - DNA, 15 bp, Homo sapiens
gcagcagaggcatcc

SEQ ID NO: 41687 - DNA, 15 bp, Homo sapiens
ggcagcagaggcatc

SEQ ID NO: 41688 - DNA, 15 bp, Homo sapiens
tggcagcagaggcat

SEQ ID NO: 41689 - DNA, 15 bp, Homo sapiens
gtggcagcagaggca

SEQ ID NO: 41690 - DNA, 15 bp, Homo sapiens
tgtggcagcagaggc

SEQ ID NO: 41691 - DNA, 15 bp, Homo sapiens
ctgtggcagcagagg

SEQ ID NO: 41692 - DNA, 15 bp, Homo sapiens
actgtggcagcagag

SEQ ID NO: 41693 - DNA, 15 bp, Homo sapiens
cactgtggcagcaga

SEQ ID NO: 41694 - DNA, 15 bp, Homo sapiens
ccactgtggcagcag

SEQ ID NO: 41695 - DNA, 15 bp, Homo sapiens
gccactgtggcagca

SEQ ID NO: 41696 - DNA, 15 bp, Homo sapiens
ggccactgtggcagc

SEQ ID NO: 41697 - DNA, 15 bp, Homo sapiens
aggccactgtggcag

SEQ ID NO: 41698 - DNA, 15 bp, Homo sapiens
gaggccactgtggca

SEQ ID NO: 41699 - DNA, 15 bp, Homo sapiens
tgaggccactgtggc

SEQ ID NO: 41700 - DNA, 15 bp, Homo sapiens
atgaggccactgtgg

SEQ ID NO: 41701 - DNA, 15 bp, Homo sapiens
aatgaggccactgtg

SEQ ID NO: 41702 - DNA, 15 bp, Homo sapiens
aaatgaggccactgt

SEQ ID NO: 41703 - DNA, 15 bp, Homo sapiens
aaaatgaggccactg

SEQ ID NO: 41704 - DNA, 15 bp, Homo sapiens
aaaaatgaggccact

SEQ ID NO: 41705 - DNA, 15 bp, Homo sapiens
caaaaatgaggccac

SEQ ID NO: 41706 - DNA, 15 bp, Homo sapiens
tcaaaaatgaggcca

SEQ ID NO: 41707 - DNA, 15 bp, Homo sapiens
ttcaaaaatgaggcc

SEQ ID NO: 41708 - DNA, 15 bp, Homo sapiens
tttcaaaaatgaggc

SEQ ID NO: 41709 - DNA, 15 bp, Homo sapiens
ctttcaaaaatgagg

SEQ ID NO: 41710 - DNA, 15 bp, Homo sapiens
actttcaaaaatgag

SEQ ID NO: 41711 - DNA, 15 bp, Homo sapiens
tactttcaaaaatga

SEQ ID NO: 41712 - DNA, 15 bp, Homo sapiens
ctactttcaaaaatg

SEQ ID NO: 41713 - DNA, 15 bp, Homo sapiens
cctactttcaaaaat

SEQ ID NO: 41714 - DNA, 15 bp, Homo sapiens
gcctactttcaaaaa

SEQ ID NO: 41715 - DNA, 15 bp, Homo sapiens
tgcctactttcaaaa

SEQ ID NO: 41716 - DNA, 15 bp, Homo sapiens
ctgcctactttcaaa

SEQ ID NO: 41717 - DNA, 15 bp, Homo sapiens
cctgcctactttcaa

SEQ ID NO: 41718 - DNA, 15 bp, Homo sapiens
ccctgcctactttca

SEQ ID NO: 41719 - DNA, 15 bp, Homo sapiens
gccctgcctactttc

SEQ ID NO: 41720 - DNA, 15 bp, Homo sapiens
agccctgcctacttt

SEQ ID NO: 41721 - DNA, 15 bp, Homo sapiens
gagccctgcctactt

SEQ ID NO: 41722 - DNA, 15 bp, Homo sapiens
ggagccctgcctact

SEQ ID NO: 41723 - DNA, 15 bp, Homo sapiens
tggagccctgcctac

SEQ ID NO: 41724 - DNA, 15 bp, Homo sapiens
ttggagccctgccta

SEQ ID NO: 41725 - DNA, 15 bp, Homo sapiens
tttggagccctgcct

SEQ ID NO: 41726 - DNA, 15 bp, Homo sapiens
gtttggagccctgcc

SEQ ID NO: 41727 - DNA, 15 bp, Homo sapiens
tgtttggagccctgc

SEQ ID NO: 41728 - DNA, 15 bp, Homo sapiens
ttgtttggagccctg

SEQ ID NO: 41729 - DNA, 15 bp, Homo sapiens
gttgtttggagccct

SEQ ID NO: 41730 - DNA, 15 bp, Homo sapiens
agttgtttggagccc

SEQ ID NO: 41731 - DNA, 15 bp, Homo sapiens
aagttgtttggagcc

SEQ ID NO: 41732 - DNA, 15 bp, Homo sapiens
gaagttgtttggagc

SEQ ID NO: 41733 - DNA, 15 bp, Homo sapiens
cgaagttgtttggag

SEQ ID NO: 41734 - DNA, 15 bp, Homo sapiens
acgaagttgtttgga

SEQ ID NO: 41735 - DNA, 15 bp, Homo sapiens
aacgaagttgtttgg

SEQ ID NO: 41736 - DNA, 15 bp, Homo sapiens
aaacgaagttgtttg

SEQ ID NO: 41737 - DNA, 15 bp, Homo sapiens
taaacgaagttgttt

SEQ ID NO: 41738 - DNA, 15 bp, Homo sapiens
gtaaacgaagttgtt

SEQ ID NO: 41739 - DNA, 15 bp, Homo sapiens
ggtaaacgaagttgt

SEQ ID NO: 41740 - DNA, 15 bp, Homo sapiens
aggtaaacgaagttg

SEQ ID NO: 41741 - DNA, 15 bp, Homo sapiens
aaggtaaacgaagtt

SEQ ID NO: 41742 - DNA, 15 bp, Homo sapiens
caaggtaaacgaagt

SEQ ID NO: 41743 - DNA, 15 bp, Homo sapiens
gcaaggtaaacgaag

SEQ ID NO: 41744 - DNA, 15 bp, Homo sapiens
ggcaaggtaaacgaa

SEQ ID NO: 41745 - DNA, 15 bp, Homo sapiens
cggcaaggtaaacga

SEQ ID NO: 41746 - DNA, 15 bp, Homo sapiens
tcggcaaggtaaacg

SEQ ID NO: 41747 - DNA, 15 bp, Homo sapiens
ctcggcaaggtaaac

SEQ ID NO: 41748 - DNA, 15 bp, Homo sapiens
cctcggcaaggtaaa

SEQ ID NO: 41749 - DNA, 15 bp, Homo sapiens
tcctcggcaaggtaa

SEQ ID NO: 41750 - DNA, 15 bp, Homo sapiens
gtcctcggcaaggta

SEQ ID NO: 41751 - DNA, 15 bp, Homo sapiens
tgtcctcggcaaggt

SEQ ID NO: 41752 - DNA, 15 bp, Homo sapiens
ttgtcctcggcaagg

SEQ ID NO: 41753 - DNA, 15 bp, Homo sapiens
tttgtcctcggcaag

SEQ ID NO: 41754 - DNA, 15 bp, Homo sapiens
gtttgtcctcggcaa

SEQ ID NO: 41755 - DNA, 15 bp, Homo sapiens
ggtttgtcctcggca

SEQ ID NO: 41756 - DNA, 15 bp, Homo sapiens
aggtttgtcctcggc

SEQ ID NO: 41757 - DNA, 15 bp, Homo sapiens
caggtttgtcctcgg

SEQ ID NO: 41758 - DNA, 15 bp, Homo sapiens
acaggtttgtcctcg

SEQ ID NO: 41759 - DNA, 15 bp, Homo sapiens
gacaggtttgtcctc

SEQ ID NO: 41760 - DNA, 15 bp, Homo sapiens
agacaggtttgtcct

SEQ ID NO: 41761 - DNA, 15 bp, Homo sapiens
cagacaggtttgtcc

SEQ ID NO: 41762 - DNA, 15 bp, Homo sapiens
acagacaggtttgtc

SEQ ID NO: 41763 - DNA, 15 bp, Homo sapiens
gacagacaggtttgt

SEQ ID NO: 41764 - DNA, 15 bp, Homo sapiens
ggacagacaggtttg

SEQ ID NO: 41765 - DNA, 15 bp, Homo sapiens
aggacagacaggttt

SEQ ID NO: 41766 - DNA, 15 bp, Homo sapiens
caggacagacaggtt

SEQ ID NO: 41767 - DNA, 15 bp, Homo sapiens
gcaggacagacaggt

SEQ ID NO: 41768 - DNA, 15 bp, Homo sapiens
tgcaggacagacagg

SEQ ID NO: 41769 - DNA, 15 bp, Homo sapiens
ctgcaggacagacag

SEQ ID NO: 41770 - DNA, 15 bp, Homo sapiens
tctgcaggacagaca

SEQ ID NO: 41771 - DNA, 15 bp, Homo sapiens
gtctgcaggacagac

SEQ ID NO: 41772 - DNA, 15 bp, Homo sapiens
tgtctgcaggacaga

SEQ ID NO: 41773 - DNA, 15 bp, Homo sapiens
gtgtctgcaggacag

SEQ ID NO: 41774 - DNA, 15 bp, Homo sapiens
agtgtctgcaggaca

SEQ ID NO: 41775 - DNA, 15 bp, Homo sapiens
tagtgtctgcaggac

SEQ ID NO: 41776 - DNA, 15 bp, Homo sapiens
atagtgtctgcagga

SEQ ID NO: 41777 - DNA, 15 bp, Homo sapiens
catagtgtctgcagg

SEQ ID NO: 41778 - DNA, 15 bp, Homo sapiens
ccatagtgtctgcag

SEQ ID NO: 41779 - DNA, 15 bp, Homo sapiens
cccatagtgtctgca

SEQ ID NO: 41780 - DNA, 15 bp, Homo sapiens
gcccatagtgtctgc

SEQ ID NO: 41781 - DNA, 15 bp, Homo sapiens
ggcccatagtgtctg

SEQ ID NO: 41782 - DNA, 15 bp, Homo sapiens
aggcccatagtgtct

SEQ ID NO: 41783 - DNA, 15 bp, Homo sapiens
aaggcccatagtgtc

SEQ ID NO: 41784 - DNA, 15 bp, Homo sapiens
caaggcccatagtgt

SEQ ID NO: 41785 - DNA, 15 bp, Homo sapiens
acaaggcccatagtg

SEQ ID NO: 41786 - DNA, 15 bp, Homo sapiens
tacaaggcccatagt

SEQ ID NO: 41787 - DNA, 15 bp, Homo sapiens
gtacaaggcccatag

SEQ ID NO: 41788 - DNA, 15 bp, Homo sapiens
tgtacaaggcccata

SEQ ID NO: 41789 - DNA, 15 bp, Homo sapiens
ctgtacaaggcccat

SEQ ID NO: 41790 - DNA, 15 bp, Homo sapiens
tctgtacaaggccca

SEQ ID NO: 41791 - DNA, 15 bp, Homo sapiens
gtctgtacaaggccc

SEQ ID NO: 41792 - DNA, 15 bp, Homo sapiens
ggtctgtacaaggcc

SEQ ID NO: 41793 - DNA, 15 bp, Homo sapiens
gggtctgtacaaggc

SEQ ID NO: 41794 - DNA, 15 bp, Homo sapiens
ggggtctgtacaagg

SEQ ID NO: 41795 - DNA, 15 bp, Homo sapiens
tggggtctgtacaag

SEQ ID NO: 41796 - DNA, 15 bp, Homo sapiens
gtggggtctgtacaa

SEQ ID NO: 41797 - DNA, 15 bp, Homo sapiens
ggtggggtctgtaca

SEQ ID NO: 41798 - DNA, 15 bp, Homo sapiens
aggtggggtctgtac

SEQ ID NO: 41799 - DNA, 15 bp, Homo sapiens
caggtggggtctgta

SEQ ID NO: 41800 - DNA, 15 bp, Homo sapiens
ccaggtggggtctgt

SEQ ID NO: 41801 - DNA, 15 bp, Homo sapiens
cccaggtggggtctg

SEQ ID NO: 41802 - DNA, 15 bp, Homo sapiens
gcccaggtggggtct

SEQ ID NO: 41803 - DNA, 15 bp, Homo sapiens
agcccaggtggggtc

SEQ ID NO: 41804 - DNA, 15 bp, Homo sapiens
cagcccaggtggggt

SEQ ID NO: 41805 - DNA, 15 bp, Homo sapiens
ccagcccaggtgggg

SEQ ID NO: 41806 - DNA, 15 bp, Homo sapiens
cccagcccaggtggg

SEQ ID NO: 41807 - DNA, 15 bp, Homo sapiens
ccccagcccaggtgg

SEQ ID NO: 41808 - DNA, 15 bp, Homo sapiens
cccccagcccaggtg

SEQ ID NO: 41809 - DNA, 15 bp, Homo sapiens
gcccccagcccaggt

SEQ ID NO: 41810 - DNA, 15 bp, Homo sapiens
tgcccccagcccagg

SEQ ID NO: 41811 - DNA, 15 bp, Homo sapiens
ctgcccccagcccag

SEQ ID NO: 41812 - DNA, 15 bp, Homo sapiens
cctgcccccagccca

SEQ ID NO: 41813 - DNA, 15 bp, Homo sapiens
ccctgcccccagccc

SEQ ID NO: 41814 - DNA, 15 bp, Homo sapiens
cccctgcccccagcc

SEQ ID NO: 41815 - DNA, 15 bp, Homo sapiens
ccccctgcccccagc

SEQ ID NO: 41816 - DNA, 15 bp, Homo sapiens
tccccctgcccccag

SEQ ID NO: 41817 - DNA, 15 bp, Homo sapiens
ttccccctgccccca

SEQ ID NO: 41818 - DNA, 15 bp, Homo sapiens
cttccccctgccccc

SEQ ID NO: 41819 - DNA, 15 bp, Homo sapiens
ccttccccctgcccc

SEQ ID NO: 41820 - DNA, 15 bp, Homo sapiens
cccttccccctgccc

SEQ ID NO: 41821 - DNA, 15 bp, Homo sapiens
gcccttccccctgcc

SEQ ID NO: 41822 - DNA, 15 bp, Homo sapiens
cgcccttccccctgc

SEQ ID NO: 41823 - DNA, 15 bp, Homo sapiens
ccgcccttccccctg

SEQ ID NO: 41824 - DNA, 15 bp, Homo sapiens
accgcccttccccct

SEQ ID NO: 41825 - DNA, 15 bp, Homo sapiens
gaccgcccttccccc

SEQ ID NO: 41826 - DNA, 15 bp, Homo sapiens
ggaccgcccttcccc

SEQ ID NO: 41827 - DNA, 15 bp, Homo sapiens
gggaccgcccttccc

SEQ ID NO: 41828 - DNA, 15 bp, Homo sapiens
tgggaccgcccttcc

SEQ ID NO: 41829 - DNA, 15 bp, Homo sapiens
ctgggaccgcccttc

SEQ ID NO: 41830 - DNA, 15 bp, Homo sapiens
cctgggaccgccctt

SEQ ID NO: 41831 - DNA, 15 bp, Homo sapiens
ccctgggaccgccct

SEQ ID NO: 41832 - DNA, 15 bp, Homo sapiens
gccctgggaccgccc

SEQ ID NO: 41833 - DNA, 15 bp, Homo sapiens
tgccctgggaccgcc

SEQ ID NO: 41834 - DNA, 15 bp, Homo sapiens
gtgccctgggaccgc

SEQ ID NO: 41835 - DNA, 15 bp, Homo sapiens
agtgccctgggaccg

SEQ ID NO: 41836 - DNA, 15 bp, Homo sapiens
cagtgccctgggacc

SEQ ID NO: 41837 - DNA, 15 bp, Homo sapiens
tcagtgccctgggac

SEQ ID NO: 41838 - DNA, 15 bp, Homo sapiens
ctcagtgccctggga

SEQ ID NO: 41839 - DNA, 15 bp, Homo sapiens
tctcagtgccctggg

SEQ ID NO: 41840 - DNA, 15 bp, Homo sapiens
gtctcagtgccctgg

SEQ ID NO: 41841 - DNA, 15 bp, Homo sapiens
ggtctcagtgccctg

SEQ ID NO: 41842 - DNA, 15 bp, Homo sapiens
gggtctcagtgccct

SEQ ID NO: 41843 - DNA, 15 bp, Homo sapiens
tgggtctcagtgccc

SEQ ID NO: 41844 - DNA, 15 bp, Homo sapiens
ttgggtctcagtgcc

SEQ ID NO: 41845 - DNA, 15 bp, Homo sapiens
cttgggtctcagtgc

SEQ ID NO: 41846 - DNA, 15 bp, Homo sapiens
gcttgggtctcagtg

SEQ ID NO: 41847 - DNA, 15 bp, Homo sapiens
agcttgggtctcagt

SEQ ID NO: 41848 - DNA, 15 bp, Homo sapiens
cagcttgggtctcag

SEQ ID NO: 41849 - DNA, 15 bp, Homo sapiens
gcagcttgggtctca

SEQ ID NO: 41850 - DNA, 15 bp, Homo sapiens
tgcagcttgggtctc

SEQ ID NO: 41851 - DNA, 15 bp, Homo sapiens
ctgcagcttgggtct

SEQ ID NO: 41852 - DNA, 15 bp, Homo sapiens
actgcagcttgggtc

SEQ ID NO: 41853 - DNA, 15 bp, Homo sapiens
cactgcagcttgggt

SEQ ID NO: 41854 - DNA, 15 bp, Homo sapiens
ccactgcagcttggg

SEQ ID NO: 41855 - DNA, 15 bp, Homo sapiens
tccactgcagcttgg

SEQ ID NO: 41856 - DNA, 15 bp, Homo sapiens
ttccactgcagcttg

SEQ ID NO: 41857 - DNA, 15 bp, Homo sapiens
gttccactgcagctt

SEQ ID NO: 41858 - DNA, 15 bp, Homo sapiens
agttccactgcagct

SEQ ID NO: 41859 - DNA, 15 bp, Homo sapiens
gagttccactgcagc

SEQ ID NO: 41860 - DNA, 15 bp, Homo sapiens
tgagttccactgcag

SEQ ID NO: 41861 - DNA, 15 bp, Homo sapiens
ctgagttccactgca

SEQ ID NO: 41862 - DNA, 15 bp, Homo sapiens
tctgagttccactgc

SEQ ID NO: 41863 - DNA, 15 bp, Homo sapiens
ctctgagttccactg

SEQ ID NO: 41864 - DNA, 15 bp, Homo sapiens
cctctgagttccact

SEQ ID NO: 41865 - DNA, 15 bp, Homo sapiens
tcctctgagttccac

SEQ ID NO: 41866 - DNA, 15 bp, Homo sapiens
gtcctctgagttcca

SEQ ID NO: 41867 - DNA, 15 bp, Homo sapiens
agtcctctgagttcc

SEQ ID NO: 41868 - DNA, 15 bp, Homo sapiens
gagtcctctgagttc

SEQ ID NO: 41869 - DNA, 15 bp, Homo sapiens
agagtcctctgagtt

SEQ ID NO: 41870 - DNA, 15 bp, Homo sapiens
cagagtcctctgagt

SEQ ID NO: 41871 - DNA, 15 bp, Homo sapiens
ccagagtcctctgag

SEQ ID NO: 41872 - DNA, 15 bp, Homo sapiens
gccagagtcctctga

SEQ ID NO: 41873 - DNA, 15 bp, Homo sapiens
ggccagagtcctctg

SEQ ID NO: 41874 - DNA, 15 bp, Homo sapiens
cggccagagtcctct

SEQ ID NO: 41875 - DNA, 15 bp, Homo sapiens
ccggccagagtcctc

SEQ ID NO: 41876 - DNA, 15 bp, Homo sapiens
tccggccagagtcct

SEQ ID NO: 41877 - DNA, 15 bp, Homo sapiens
ctccggccagagtcc

SEQ ID NO: 41878 - DNA, 15 bp, Homo sapiens
tctccggccagagtc

SEQ ID NO: 41879 - DNA, 15 bp, Homo sapiens
ttctccggccagagt

SEQ ID NO: 41880 - DNA, 15 bp, Homo sapiens
tttctccggccagag

SEQ ID NO: 41881 - DNA, 15 bp, Homo sapiens
ctttctccggccaga

SEQ ID NO: 41882 - DNA, 15 bp, Homo sapiens
cctttctccggccag

SEQ ID NO: 41883 - DNA, 15 bp, Homo sapiens
gcctttctccggcca

SEQ ID NO: 41884 - DNA, 15 bp, Homo sapiens
cgcctttctccggcc

SEQ ID NO: 41885 - DNA, 15 bp, Homo sapiens
ccgcctttctccggc

SEQ ID NO: 41886 - DNA, 15 bp, Homo sapiens
accgcctttctccgg

SEQ ID NO: 41887 - DNA, 15 bp, Homo sapiens
caccgcctttctccg

SEQ ID NO: 41888 - DNA, 15 bp, Homo sapiens
ccaccgcctttctcc

SEQ ID NO: 41889 - DNA, 15 bp, Homo sapiens
accaccgcctttctc

SEQ ID NO: 41890 - DNA, 15 bp, Homo sapiens
taccaccgcctttct

SEQ ID NO: 41891 - DNA, 15 bp, Homo sapiens
ctaccaccgcctttc

SEQ ID NO: 41892 - DNA, 15 bp, Homo sapiens
tctaccaccgccttt

SEQ ID NO: 41893 - DNA, 15 bp, Homo sapiens
ctctaccaccgcctt

SEQ ID NO: 41894 - DNA, 15 bp, Homo sapiens
tctctaccaccgcct

SEQ ID NO: 41895 - DNA, 15 bp, Homo sapiens
ttctctaccaccgcc

SEQ ID NO: 41896 - DNA, 15 bp, Homo sapiens
cttctctaccaccgc

SEQ ID NO: 41897 - DNA, 15 bp, Homo sapiens
tcttctctaccaccg

SEQ ID NO: 41898 - DNA, 15 bp, Homo sapiens
ttcttctctaccacc

SEQ ID NO: 41899 - DNA, 15 bp, Homo sapiens
cttcttctctaccac

SEQ ID NO: 41900 - DNA, 15 bp, Homo sapiens
gcttcttctctacca

SEQ ID NO: 41901 - DNA, 15 bp, Homo sapiens
tgcttcttctctacc

SEQ ID NO: 41902 - DNA, 15 bp, Homo sapiens
ctgcttcttctctac

SEQ ID NO: 41903 - DNA, 15 bp, Homo sapiens
cctgcttcttctcta

SEQ ID NO: 41904 - DNA, 15 bp, Homo sapiens
gcctgcttcttctct

SEQ ID NO: 41905 - DNA, 15 bp, Homo sapiens
ggcctgcttcttctc

SEQ ID NO: 41906 - DNA, 15 bp, Homo sapiens
gggcctgcttcttct

SEQ ID NO: 41907 - DNA, 15 bp, Homo sapiens
ggggcctgcttcttc

SEQ ID NO: 41908 - DNA, 15 bp, Homo sapiens
cggggcctgcttctt

SEQ ID NO: 41909 - DNA, 15 bp, Homo sapiens
tcggggcctgcttct

SEQ ID NO: 41910 - DNA, 15 bp, Homo sapiens
ctcggggcctgcttc

SEQ ID NO: 41911 - DNA, 15 bp, Homo sapiens
cctcggggcctgctt

SEQ ID NO: 41912 - DNA, 15 bp, Homo sapiens
tcctcggggcctgct

SEQ ID NO: 41913 - DNA, 15 bp, Homo sapiens
ttcctcggggcctgc

SEQ ID NO: 41914 - DNA, 15 bp, Homo sapiens
gttcctcggggcctg

SEQ ID NO: 41915 - DNA, 15 bp, Homo sapiens
ggttcctcggggcct

SEQ ID NO: 41916 - DNA, 15 bp, Homo sapiens
aggttcctcggggcc

SEQ ID NO: 41917 - DNA, 15 bp, Homo sapiens
gaggttcctcggggc

SEQ ID NO: 41918 - DNA, 15 bp, Homo sapiens
ggaggttcctcgggg

SEQ ID NO: 41919 - DNA, 15 bp, Homo sapiens
aggaggttcctcggg

SEQ ID NO: 41920 - DNA, 15 bp, Homo sapiens
caggaggttcctcgg

SEQ ID NO: 41921 - DNA, 15 bp, Homo sapiens
ccaggaggttcctcg

SEQ ID NO: 41922 - DNA, 15 bp, Homo sapiens
cccaggaggttcctc

SEQ ID NO: 41923 - DNA, 15 bp, Homo sapiens
gcccaggaggttcct

SEQ ID NO: 41924 - DNA, 15 bp, Homo sapiens
ggcccaggaggttcc

SEQ ID NO: 41925 - DNA, 15 bp, Homo sapiens
gggcccaggaggttc

SEQ ID NO: 41926 - DNA, 15 bp, Homo sapiens
ggggcccaggaggtt

SEQ ID NO: 41927 - DNA, 15 bp, Homo sapiens
tggggcccaggaggt

SEQ ID NO: 41928 - DNA, 15 bp, Homo sapiens
ctggggcccaggagg

SEQ ID NO: 41929 - DNA, 15 bp, Homo sapiens
gctggggcccaggag

SEQ ID NO: 41930 - DNA, 15 bp, Homo sapiens
tgctggggcccagga

SEQ ID NO: 41931 - DNA, 15 bp, Homo sapiens
ctgctggggcccagg

SEQ ID NO: 41932 - DNA, 15 bp, Homo sapiens
cctgctggggcccag

SEQ ID NO: 41933 - DNA, 15 bp, Homo sapiens
gcctgctggggccca

SEQ ID NO: 41934 - DNA, 15 bp, Homo sapiens
agcctgctggggccc

SEQ ID NO: 41935 - DNA, 15 bp, Homo sapiens
cagcctgctggggcc

SEQ ID NO: 41936 - DNA, 15 bp, Homo sapiens
gcagcctgctggggc

SEQ ID NO: 41937 - DNA, 15 bp, Homo sapiens
tgcagcctgctgggg

SEQ ID NO: 41938 - DNA, 15 bp, Homo sapiens
ctgcagcctgctggg

SEQ ID NO: 41939 - DNA, 15 bp, Homo sapiens
gctgcagcctgctgg

SEQ ID NO: 41940 - DNA, 15 bp, Homo sapiens
agctgcagcctgctg

SEQ ID NO: 41941 - DNA, 15 bp, Homo sapiens
cagctgcagcctgct

SEQ ID NO: 41942 - DNA, 15 bp, Homo sapiens
tcagctgcagcctgc

SEQ ID NO: 41943 - DNA, 15 bp, Homo sapiens
ctcagctgcagcctg

SEQ ID NO: 41944 - DNA, 15 bp, Homo sapiens
gctcagctgcagcct

SEQ ID NO: 41945 - DNA, 15 bp, Homo sapiens
agctcagctgcagcc

SEQ ID NO: 41946 - DNA, 15 bp, Homo sapiens
gagctcagctgcagc

SEQ ID NO: 41947 - DNA, 15 bp, Homo sapiens
agagctcagctgcag

SEQ ID NO: 41948 - DNA, 15 bp, Homo sapiens
gagagctcagctgca

SEQ ID NO: 41949 - DNA, 15 bp, Homo sapiens
ggagagctcagctgc

SEQ ID NO: 41950 - DNA, 15 bp, Homo sapiens
cggagagctcagctg

SEQ ID NO: 41951 - DNA, 15 bp, Homo sapiens
gcggagagctcagct

SEQ ID NO: 41952 - DNA, 15 bp, Homo sapiens
tgcggagagctcagc

SEQ ID NO: 41953 - DNA, 15 bp, Homo sapiens
gtgcggagagctcag

SEQ ID NO: 41954 - DNA, 15 bp, Homo sapiens
ggtgcggagagctca

SEQ ID NO: 41955 - DNA, 15 bp, Homo sapiens
cggtgcggagagctc

SEQ ID NO: 41956 - DNA, 15 bp, Homo sapiens
acggtgcggagagct

SEQ ID NO: 41957 - DNA, 15 bp, Homo sapiens
cacggtgcggagagc

SEQ ID NO: 41958 - DNA, 15 bp, Homo sapiens
gcacggtgcggagag

SEQ ID NO: 41959 - DNA, 15 bp, Homo sapiens
tgcacggtgcggaga

SEQ ID NO: 41960 - DNA, 15 bp, Homo sapiens
ctgcacggtgcggag

SEQ ID NO: 41961 - DNA, 15 bp, Homo sapiens
cctgcacggtgcgga

SEQ ID NO: 41962 - DNA, 15 bp, Homo sapiens
ccctgcacggtgcgg

SEQ ID NO: 41963 - DNA, 15 bp, Homo sapiens
gccctgcacggtgcg

SEQ ID NO: 41964 - DNA, 15 bp, Homo sapiens
tgccctgcacggtgc

SEQ ID NO: 41965 - DNA, 15 bp, Homo sapiens
ctgccctgcacggtg

SEQ ID NO: 41966 - DNA, 15 bp, Homo sapiens
gctgccctgcacggt

SEQ ID NO: 41967 - DNA, 15 bp, Homo sapiens
ggctgccctgcacgg

SEQ ID NO: 41968 - DNA, 15 bp, Homo sapiens
aggctgccctgcacg

SEQ ID NO: 41969 - DNA, 15 bp, Homo sapiens
caggctgccctgcac

SEQ ID NO: 41970 - DNA, 15 bp, Homo sapiens
tcaggctgccctgca

SEQ ID NO: 41971 - DNA, 15 bp, Homo sapiens
ctcaggctgccctgc

SEQ ID NO: 41972 - DNA, 15 bp, Homo sapiens
gctcaggctgccctg

SEQ ID NO: 41973 - DNA, 15 bp, Homo sapiens
agctcaggctgccct

SEQ ID NO: 41974 - DNA, 15 bp, Homo sapiens
cagctcaggctgccc

SEQ ID NO: 41975 - DNA, 15 bp, Homo sapiens
gcagctcaggctgcc

SEQ ID NO: 41976 - DNA, 15 bp, Homo sapiens
ggcagctcaggctgc

SEQ ID NO: 41977 - DNA, 15 bp, Homo sapiens
aggcagctcaggctg

SEQ ID NO: 41978 - DNA, 15 bp, Homo sapiens
gaggcagctcaggct

SEQ ID NO: 41979 - DNA, 15 bp, Homo sapiens
tgaggcagctcaggc

SEQ ID NO: 41980 - DNA, 15 bp, Homo sapiens
gtgaggcagctcagg

SEQ ID NO: 41981 - DNA, 15 bp, Homo sapiens
cgtgaggcagctcag

SEQ ID NO: 41982 - DNA, 15 bp, Homo sapiens
ccgtgaggcagctca

SEQ ID NO: 41983 - DNA, 15 bp, Homo sapiens
accgtgaggcagctc

SEQ ID NO: 41984 - DNA, 15 bp, Homo sapiens
gaccgtgaggcagct

SEQ ID NO: 41985 - DNA, 15 bp, Homo sapiens
agaccgtgaggcagc

SEQ ID NO: 41986 - DNA, 15 bp, Homo sapiens
aagaccgtgaggcag

SEQ ID NO: 41987 - DNA, 15 bp, Homo sapiens
taagaccgtgaggca

SEQ ID NO: 41988 - DNA, 15 bp, Homo sapiens
gtaagaccgtgaggc

SEQ ID NO: 41989 - DNA, 15 bp, Homo sapiens
agtaagaccgtgagg

SEQ ID NO: 41990 - DNA, 15 bp, Homo sapiens
gagtaagaccgtgag

SEQ ID NO: 41991 - DNA, 15 bp, Homo sapiens
ggagtaagaccgtga

SEQ ID NO: 41992 - DNA, 15 bp, Homo sapiens
tggagtaagaccgtg

SEQ ID NO: 41993 - DNA, 15 bp, Homo sapiens
gtggagtaagaccgt

SEQ ID NO: 41994 - DNA, 15 bp, Homo sapiens
agtggagtaagaccg

SEQ ID NO: 41995 - DNA, 15 bp, Homo sapiens
gagtggagtaagacc

SEQ ID NO: 41996 - DNA, 15 bp, Homo sapiens
tgagtggagtaagac

SEQ ID NO: 41997 - DNA, 15 bp, Homo sapiens
ctgagtggagtaaga

SEQ ID NO: 41998 - DNA, 15 bp, Homo sapiens
actgagtggagtaag

SEQ ID NO: 41999 - DNA, 15 bp, Homo sapiens
gactgagtggagtaa

SEQ ID NO: 42000 - DNA, 15 bp, Homo sapiens
agactgagtggagta

SEQ ID NO: 42001 - DNA, 15 bp, Homo sapiens
cagactgagtggagt

SEQ ID NO: 42002 - DNA, 15 bp, Homo sapiens
gcagactgagtggag

SEQ ID NO: 42003 - DNA, 15 bp, Homo sapiens
ggcagactgagtgga

SEQ ID NO: 42004 - DNA, 15 bp, Homo sapiens
aggcagactgagtgg

SEQ ID NO: 42005 - DNA, 15 bp, Homo sapiens
gaggcagactgagtg

SEQ ID NO: 42006 - DNA, 15 bp, Homo sapiens
tgaggcagactgagt

SEQ ID NO: 42007 - DNA, 15 bp, Homo sapiens
gtgaggcagactgag

SEQ ID NO: 42008 - DNA, 15 bp, Homo sapiens
ggtgaggcagactga

SEQ ID NO: 42009 - DNA, 15 bp, Homo sapiens
cggtgaggcagactg

SEQ ID NO: 42010 - DNA, 15 bp, Homo sapiens
acggtgaggcagact

SEQ ID NO: 42011 - DNA, 15 bp, Homo sapiens
cacggtgaggcagac

SEQ ID NO: 42012 - DNA, 15 bp, Homo sapiens
ccacggtgaggcaga

SEQ ID NO: 42013 - DNA, 15 bp, Homo sapiens
tccacggtgaggcag

SEQ ID NO: 42014 - DNA, 15 bp, Homo sapiens
gtccacggtgaggca

SEQ ID NO: 42015 - DNA, 15 bp, Homo sapiens
agtccacggtgaggc

SEQ ID NO: 42016 - DNA, 15 bp, Homo sapiens
cagtccacggtgagg

SEQ ID NO: 42017 - DNA, 15 bp, Homo sapiens
acagtccacggtgag

SEQ ID NO: 42018 - DNA, 15 bp, Homo sapiens
cacagtccacggtga

SEQ ID NO: 42019 - DNA, 15 bp, Homo sapiens
ccacagtccacggtg

SEQ ID NO: 42020 - DNA, 15 bp, Homo sapiens
accacagtccacggt

SEQ ID NO: 42021 - DNA, 15 bp, Homo sapiens
caccacagtccacgg

SEQ ID NO: 42022 - DNA, 15 bp, Homo sapiens
ccaccacagtccacg

SEQ ID NO: 42023 - DNA, 15 bp, Homo sapiens
cccaccacagtccac

SEQ ID NO: 42024 - DNA, 15 bp, Homo sapiens
ccccaccacagtcca

SEQ ID NO: 42025 - DNA, 15 bp, Homo sapiens
gccccaccacagtcc

SEQ ID NO: 42026 - DNA, 15 bp, Homo sapiens
ggccccaccacagtc

SEQ ID NO: 42027 - DNA, 15 bp, Homo sapiens
tggccccaccacagt

SEQ ID NO: 42028 - DNA, 15 bp, Homo sapiens
ctggccccaccacag

SEQ ID NO: 42029 - DNA, 15 bp, Homo sapiens
cctggccccaccaca

SEQ ID NO: 42030 - DNA, 15 bp, Homo sapiens
tcctggccccaccac

SEQ ID NO: 42031 - DNA, 15 bp, Homo sapiens
ctcctggccccacca

SEQ ID NO: 42032 - DNA, 15 bp, Homo sapiens
tctcctggccccacc

SEQ ID NO: 42033 - DNA, 15 bp, Homo sapiens
gtctcctggccccac

SEQ ID NO: 42034 - DNA, 15 bp, Homo sapiens
agtctcctggcccca

SEQ ID NO: 42035 - DNA, 15 bp, Homo sapiens
tagtctcctggcccc

SEQ ID NO: 42036 - DNA, 15 bp, Homo sapiens
ctagtctcctggccc

SEQ ID NO: 42037 - DNA, 15 bp, Homo sapiens
tctagtctcctggcc

SEQ ID NO: 42038 - DNA, 15 bp, Homo sapiens
ctctagtctcctggc

SEQ ID NO: 42039 - DNA, 15 bp, Homo sapiens
tctctagtctcctgg

SEQ ID NO: 42040 - DNA, 15 bp, Homo sapiens
gtctctagtctcctg

SEQ ID NO: 42041 - DNA, 15 bp, Homo sapiens
ggtctctagtctcct

SEQ ID NO: 42042 - DNA, 15 bp, Homo sapiens
aggtctctagtctcc

SEQ ID NO: 42043 - DNA, 15 bp, Homo sapiens
caggtctctagtctc

SEQ ID NO: 42044 - DNA, 15 bp, Homo sapiens
ccaggtctctagtct

SEQ ID NO: 42045 - DNA, 15 bp, Homo sapiens
cccaggtctctagtc

SEQ ID NO: 42046 - DNA, 15 bp, Homo sapiens
acccaggtctctagt

SEQ ID NO: 42047 - DNA, 15 bp, Homo sapiens
aacccaggtctctag

SEQ ID NO: 42048 - DNA, 15 bp, Homo sapiens
aaacccaggtctcta

SEQ ID NO: 42049 - DNA, 15 bp, Homo sapiens
aaaacccaggtctct

SEQ ID NO: 42050 - DNA, 15 bp, Homo sapiens
taaaacccaggtctc

SEQ ID NO: 42051 - DNA, 15 bp, Homo sapiens
ctaaaacccaggtct

SEQ ID NO: 42052 - DNA, 15 bp, Homo sapiens
gctaaaacccaggtc

SEQ ID NO: 42053 - DNA, 15 bp, Homo sapiens
ggctaaaacccaggt

SEQ ID NO: 42054 - DNA, 15 bp, Homo sapiens
gggctaaaacccagg

SEQ ID NO: 42055 - DNA, 15 bp, Homo sapiens
ggggctaaaacccag

SEQ ID NO: 42056 - DNA, 15 bp, Homo sapiens
tggggctaaaaccca

SEQ ID NO: 42057 - DNA, 15 bp, Homo sapiens
ctggggctaaaaccc

SEQ ID NO: 42058 - DNA, 15 bp, Homo sapiens
gctggggctaaaacc

SEQ ID NO: 42059 - DNA, 15 bp, Homo sapiens
ggctggggctaaaac

SEQ ID NO: 42060 - DNA, 15 bp, Homo sapiens
aggctggggctaaaa

SEQ ID NO: 42061 - DNA, 15 bp, Homo sapiens
caggctggggctaaa

SEQ ID NO: 42062 - DNA, 15 bp, Homo sapiens
tcaggctggggctaa

SEQ ID NO: 42063 - DNA, 15 bp, Homo sapiens
gtcaggctggggcta

SEQ ID NO: 42064 - DNA, 15 bp, Homo sapiens
tgtcaggctggggct

SEQ ID NO: 42065 - DNA, 15 bp, Homo sapiens
ctgtcaggctggggc

SEQ ID NO: 42066 - DNA, 15 bp, Homo sapiens
actgtcaggctgggg

SEQ ID NO: 42067 - DNA, 15 bp, Homo sapiens
cactgtcaggctggg

SEQ ID NO: 42068 - DNA, 15 bp, Homo sapiens
ccactgtcaggctgg

SEQ ID NO: 42069 - DNA, 15 bp, Homo sapiens
gccactgtcaggctg

SEQ ID NO: 42070 - DNA, 15 bp, Homo sapiens
ggccactgtcaggct

SEQ ID NO: 42071 - DNA, 15 bp, Homo sapiens
aggccactgtcaggc

SEQ ID NO: 42072 - DNA, 15 bp, Homo sapiens
aaggccactgtcagg

SEQ ID NO: 42073 - DNA, 15 bp, Homo sapiens
gaaggccactgtcag

SEQ ID NO: 42074 - DNA, 15 bp, Homo sapiens
ggaaggccactgtca

SEQ ID NO: 42075 - DNA, 15 bp, Homo sapiens
tggaaggccactgtc

SEQ ID NO: 42076 - DNA, 15 bp, Homo sapiens
ctggaaggccactgt

SEQ ID NO: 42077 - DNA, 15 bp, Homo sapiens
gctggaaggccactg

SEQ ID NO: 42078 - DNA, 15 bp, Homo sapiens
tgctggaaggccact

SEQ ID NO: 42079 - DNA, 15 bp, Homo sapiens
ttgctggaaggccac

SEQ ID NO: 42080 - DNA, 15 bp, Homo sapiens
tttgctggaaggcca

SEQ ID NO: 42081 - DNA, 15 bp, Homo sapiens
atttgctggaaggcc

SEQ ID NO: 42082 - DNA, 15 bp, Homo sapiens
aatttgctggaaggc

SEQ ID NO: 42083 - DNA, 15 bp, Homo sapiens
gaatttgctggaagg

SEQ ID NO: 42084 - DNA, 15 bp, Homo sapiens
ggaatttgctggaag

SEQ ID NO: 42085 - DNA, 15 bp, Homo sapiens
aggaatttgctggaa

SEQ ID NO: 42086 - DNA, 15 bp, Homo sapiens
caggaatttgctgga

SEQ ID NO: 42087 - DNA, 15 bp, Homo sapiens
gcaggaatttgctgg

SEQ ID NO: 42088 - DNA, 15 bp, Homo sapiens
agcaggaatttgctg

SEQ ID NO: 42089 - DNA, 15 bp, Homo sapiens
gagcaggaatttgct

SEQ ID NO: 42090 - DNA, 15 bp, Homo sapiens
ggagcaggaatttgc

SEQ ID NO: 42091 - DNA, 15 bp, Homo sapiens
gggagcaggaatttg

SEQ ID NO: 42092 - DNA, 15 bp, Homo sapiens
ggggagcaggaattt

SEQ ID NO: 42093 - DNA, 15 bp, Homo sapiens
aggggagcaggaatt

SEQ ID NO: 42094 - DNA, 15 bp, Homo sapiens
caggggagcaggaat

SEQ ID NO: 42095 - DNA, 15 bp, Homo sapiens
acaggggagcaggaa

SEQ ID NO: 42096 - DNA, 15 bp, Homo sapiens
cacaggggagcagga

SEQ ID NO: 42097 - DNA, 15 bp, Homo sapiens
ccacaggggagcagg

SEQ ID NO: 42098 - DNA, 15 bp, Homo sapiens
cccacaggggagcag

SEQ ID NO: 42099 - DNA, 15 bp, Homo sapiens
gcccacaggggagca

SEQ ID NO: 42100 - DNA, 15 bp, Homo sapiens
ggcccacaggggagc

SEQ ID NO: 42101 - DNA, 15 bp, Homo sapiens
aggcccacaggggag

SEQ ID NO: 42102 - DNA, 15 bp, Homo sapiens
caggcccacagggga

SEQ ID NO: 42103 - DNA, 15 bp, Homo sapiens
acaggcccacagggg

SEQ ID NO: 42104 - DNA, 15 bp, Homo sapiens
aacaggcccacaggg

SEQ ID NO: 42105 - DNA, 15 bp, Homo sapiens
aaacaggcccacagg

SEQ ID NO: 42106 - DNA, 15 bp, Homo sapiens
aaaacaggcccacag

SEQ ID NO: 42107 - DNA, 15 bp, Homo sapiens
gaaaacaggcccaca

SEQ ID NO: 42108 - DNA, 15 bp, Homo sapiens
ggaaaacaggcccac

SEQ ID NO: 42109 - DNA, 15 bp, Homo sapiens
gggaaaacaggccca

SEQ ID NO: 42110 - DNA, 15 bp, Homo sapiens
tgggaaaacaggccc

SEQ ID NO: 42111 - DNA, 15 bp, Homo sapiens
atgggaaaacaggcc

SEQ ID NO: 42112 - DNA, 15 bp, Homo sapiens
tatgggaaaacaggc

SEQ ID NO: 42113 - DNA, 15 bp, Homo sapiens
atatgggaaaacagg

SEQ ID NO: 42114 - DNA, 15 bp, Homo sapiens
catatgggaaaacag

SEQ ID NO: 42115 - DNA, 15 bp, Homo sapiens
gcatatgggaaaaca

SEQ ID NO: 42116 - DNA, 15 bp, Homo sapiens
tgcatatgggaaaac

SEQ ID NO: 42117 - DNA, 15 bp, Homo sapiens
ttgcatatgggaaaa

SEQ ID NO: 42118 - DNA, 15 bp, Homo sapiens
tttgcatatgggaaa

SEQ ID NO: 42119 - DNA, 15 bp, Homo sapiens
ttttgcatatgggaa

SEQ ID NO: 42120 - DNA, 15 bp, Homo sapiens
gttttgcatatggga

SEQ ID NO: 42121 - DNA, 15 bp, Homo sapiens
tgttttgcatatggg

SEQ ID NO: 42122 - DNA, 15 bp, Homo sapiens
ctgttttgcatatgg

SEQ ID NO: 42123 - DNA, 15 bp, Homo sapiens
tctgttttgcatatg

SEQ ID NO: 42124 - DNA, 15 bp, Homo sapiens
gtctgttttgcatat

SEQ ID NO: 42125 - DNA, 15 bp, Homo sapiens
agtctgttttgcata

SEQ ID NO: 42126 - DNA, 15 bp, Homo sapiens
aagtctgttttgcat

SEQ ID NO: 42127 - DNA, 15 bp, Homo sapiens
gaagtctgttttgca

SEQ ID NO: 42128 - DNA, 15 bp, Homo sapiens
tgaagtctgttttgc

SEQ ID NO: 42129 - DNA, 15 bp, Homo sapiens
gtgaagtctgttttg

SEQ ID NO: 42130 - DNA, 15 bp, Homo sapiens
tgtgaagtctgtttt

SEQ ID NO: 42131 - DNA, 15 bp, Homo sapiens
ctgtgaagtctgttt

SEQ ID NO: 42132 - DNA, 15 bp, Homo sapiens
tctgtgaagtctgtt

SEQ ID NO: 42133 - DNA, 15 bp, Homo sapiens
ttctgtgaagtctgt

SEQ ID NO: 42134 - DNA, 15 bp, Homo sapiens
attctgtgaagtctg

SEQ ID NO: 42135 - DNA, 15 bp, Homo sapiens
cattctgtgaagtct

SEQ ID NO: 42136 - DNA, 15 bp, Homo sapiens
acattctgtgaagtc

SEQ ID NO: 42137 - DNA, 15 bp, Homo sapiens
cacattctgtgaagt

SEQ ID NO: 42138 - DNA, 15 bp, Homo sapiens
gcacattctgtgaag

SEQ ID NO: 42139 - DNA, 15 bp, Homo sapiens
agcacattctgtgaa

SEQ ID NO: 42140 - DNA, 15 bp, Homo sapiens
gagcacattctgtga

SEQ ID NO: 42141 - DNA, 15 bp, Homo sapiens
tgagcacattctgtg

SEQ ID NO: 42142 - DNA, 15 bp, Homo sapiens
ctgagcacattctgt

SEQ ID NO: 42143 - DNA, 15 bp, Homo sapiens
gctgagcacattctg

SEQ ID NO: 42144 - DNA, 15 bp, Homo sapiens
ggctgagcacattct

SEQ ID NO: 42145 - DNA, 15 bp, Homo sapiens
tggctgagcacattc

SEQ ID NO: 42146 - DNA, 15 bp, Homo sapiens
ctggctgagcacatt

SEQ ID NO: 42147 - DNA, 15 bp, Homo sapiens
actggctgagcacat

SEQ ID NO: 42148 - DNA, 15 bp, Homo sapiens
tactggctgagcaca

SEQ ID NO: 42149 - DNA, 15 bp, Homo sapiens
ttactggctgagcac

SEQ ID NO: 42150 - DNA, 15 bp, Homo sapiens
attactggctgagca

SEQ ID NO: 42151 - DNA, 15 bp, Homo sapiens
aattactggctgagc

SEQ ID NO: 42152 - DNA, 15 bp, Homo sapiens
caattactggctgag

SEQ ID NO: 42153 - DNA, 15 bp, Homo sapiens
gcaattactggctga

SEQ ID NO: 42154 - DNA, 15 bp, Homo sapiens
agcaattactggctg

SEQ ID NO: 42155 - DNA, 15 bp, Homo sapiens
aagcaattactggct

SEQ ID NO: 42156 - DNA, 15 bp, Homo sapiens
gaagcaattactggc

SEQ ID NO: 42157 - DNA, 15 bp, Homo sapiens
tgaagcaattactgg

SEQ ID NO: 42158 - DNA, 15 bp, Homo sapiens
gtgaagcaattactg

SEQ ID NO: 42159 - DNA, 15 bp, Homo sapiens
agtgaagcaattact

SEQ ID NO: 42160 - DNA, 15 bp, Homo sapiens
cagtgaagcaattac

SEQ ID NO: 42161 - DNA, 15 bp, Homo sapiens
gcagtgaagcaatta

SEQ ID NO: 42162 - DNA, 15 bp, Homo sapiens
agcagtgaagcaatt

SEQ ID NO: 42163 - DNA, 15 bp, Homo sapiens
aagcagtgaagcaat

SEQ ID NO: 42164 - DNA, 15 bp, Homo sapiens
gaagcagtgaagcaa

SEQ ID NO: 42165 - DNA, 15 bp, Homo sapiens
agaagcagtgaagca

SEQ ID NO: 42166 - DNA, 15 bp, Homo sapiens
gagaagcagtgaagc

SEQ ID NO: 42167 - DNA, 15 bp, Homo sapiens
ggagaagcagtgaag

SEQ ID NO: 42168 - DNA, 15 bp, Homo sapiens
aggagaagcagtgaa

SEQ ID NO: 42169 - DNA, 15 bp, Homo sapiens
gaggagaagcagtga

SEQ ID NO: 42170 - DNA, 15 bp, Homo sapiens
agaggagaagcagtg

SEQ ID NO: 42171 - DNA, 15 bp, Homo sapiens
aagaggagaagcagt

SEQ ID NO: 42172 - DNA, 15 bp, Homo sapiens
caagaggagaagcag

SEQ ID NO: 42173 - DNA, 15 bp, Homo sapiens
acaagaggagaagca

SEQ ID NO: 42174 - DNA, 15 bp, Homo sapiens
aacaagaggagaagc

SEQ ID NO: 42175 - DNA, 15 bp, Homo sapiens
aaacaagaggagaag

SEQ ID NO: 42176 - DNA, 15 bp, Homo sapiens
caaacaagaggagaa

SEQ ID NO: 42177 - DNA, 15 bp, Homo sapiens
ccaaacaagaggaga

SEQ ID NO: 42178 - DNA, 15 bp, Homo sapiens
cccaaacaagaggag

SEQ ID NO: 42179 - DNA, 15 bp, Homo sapiens
ccccaaacaagagga

SEQ ID NO: 42180 - DNA, 15 bp, Homo sapiens
gccccaaacaagagg

SEQ ID NO: 42181 - DNA, 15 bp, Homo sapiens
cgccccaaacaagag

SEQ ID NO: 42182 - DNA, 15 bp, Homo sapiens
ccgccccaaacaaga

SEQ ID NO: 42183 - DNA, 15 bp, Homo sapiens
accgccccaaacaag

SEQ ID NO: 42184 - DNA, 15 bp, Homo sapiens
aaccgccccaaacaa

SEQ ID NO: 42185 - DNA, 15 bp, Homo sapiens
gaaccgccccaaaca

SEQ ID NO: 42186 - DNA, 15 bp, Homo sapiens
ggaaccgccccaaac

SEQ ID NO: 42187 - DNA, 15 bp, Homo sapiens
aggaaccgccccaaa

SEQ ID NO: 42188 - DNA, 15 bp, Homo sapiens
caggaaccgccccaa

SEQ ID NO: 42189 - DNA, 15 bp, Homo sapiens
acaggaaccgcccca

SEQ ID NO: 42190 - DNA, 15 bp, Homo sapiens
cacaggaaccgcccc

SEQ ID NO: 42191 - DNA, 15 bp, Homo sapiens
acacaggaaccgccc

SEQ ID NO: 42192 - DNA, 15 bp, Homo sapiens
cacacaggaaccgcc

SEQ ID NO: 42193 - DNA, 15 bp, Homo sapiens
gcacacaggaaccgc

SEQ ID NO: 42194 - DNA, 15 bp, Homo sapiens
agcacacaggaaccg

SEQ ID NO: 42195 - DNA, 15 bp, Homo sapiens
cagcacacaggaacc

SEQ ID NO: 42196 - DNA, 15 bp, Homo sapiens
acagcacacaggaac

SEQ ID NO: 42197 - DNA, 15 bp, Homo sapiens
cacagcacacaggaa

SEQ ID NO: 42198 - DNA, 15 bp, Homo sapiens
ccacagcacacagga

SEQ ID NO: 42199 - DNA, 15 bp, Homo sapiens
cccacagcacacagg

SEQ ID NO: 42200 - DNA, 15 bp, Homo sapiens
ccccacagcacacag

SEQ ID NO: 42201 - DNA, 15 bp, Homo sapiens
accccacagcacaca

SEQ ID NO: 42202 - DNA, 15 bp, Homo sapiens
gaccccacagcacac

SEQ ID NO: 42203 - DNA, 15 bp, Homo sapiens
agaccccacagcaca

SEQ ID NO: 42204 - DNA, 15 bp, Homo sapiens
gagaccccacagcac

SEQ ID NO: 42205 - DNA, 15 bp, Homo sapiens
ggagaccccacagca

SEQ ID NO: 42206 - DNA, 15 bp, Homo sapiens
cggagaccccacagc

SEQ ID NO: 42207 - DNA, 15 bp, Homo sapiens
acggagaccccacag

SEQ ID NO: 42208 - DNA, 15 bp, Homo sapiens
gacggagaccccaca

SEQ ID NO: 42209 - DNA, 15 bp, Homo sapiens
tgacggagaccccac

SEQ ID NO: 42210 - DNA, 15 bp, Homo sapiens
ctgacggagacccca

SEQ ID NO: 42211 - DNA, 15 bp, Homo sapiens
cctgacggagacccc

SEQ ID NO: 42212 - DNA, 15 bp, Homo sapiens
tcctgacggagaccc

SEQ ID NO: 42213 - DNA, 15 bp, Homo sapiens
atcctgacggagacc

SEQ ID NO: 42214 - DNA, 15 bp, Homo sapiens
aatcctgacggagac

SEQ ID NO: 42215 - DNA, 15 bp, Homo sapiens
gaatcctgacggaga

SEQ ID NO: 42216 - DNA, 15 bp, Homo sapiens
tgaatcctgacggag

SEQ ID NO: 42217 - DNA, 15 bp, Homo sapiens
ctgaatcctgacgga

SEQ ID NO: 42218 - DNA, 15 bp, Homo sapiens
gctgaatcctgacgg

SEQ ID NO: 42219 - DNA, 15 bp, Homo sapiens
ggctgaatcctgacg

SEQ ID NO: 42220 - DNA, 15 bp, Homo sapiens
gggctgaatcctgac

SEQ ID NO: 42221 - DNA, 15 bp, Homo sapiens
ggggctgaatcctga

SEQ ID NO: 42222 - DNA, 15 bp, Homo sapiens
cggggctgaatcctg

SEQ ID NO: 42223 - DNA, 15 bp, Homo sapiens
gcggggctgaatcct

SEQ ID NO: 42224 - DNA, 15 bp, Homo sapiens
agcggggctgaatcc

SEQ ID NO: 42225 - DNA, 15 bp, Homo sapiens
cagcggggctgaatc

SEQ ID NO: 42226 - DNA, 15 bp, Homo sapiens
tcagcggggctgaat

SEQ ID NO: 42227 - DNA, 15 bp, Homo sapiens
ctcagcggggctgaa

SEQ ID NO: 42228 - DNA, 15 bp, Homo sapiens
tctcagcggggctga

SEQ ID NO: 42229 - DNA, 15 bp, Homo sapiens
ttctcagcggggctg

SEQ ID NO: 42230 - DNA, 15 bp, Homo sapiens
gttctcagcggggct

SEQ ID NO: 42231 - DNA, 15 bp, Homo sapiens
ggttctcagcggggc

SEQ ID NO: 42232 - DNA, 15 bp, Homo sapiens
gggttctcagcgggg

SEQ ID NO: 42233 - DNA, 15 bp, Homo sapiens
tgggttctcagcggg

SEQ ID NO: 42234 - DNA, 15 bp, Homo sapiens
ctgggttctcagcgg

SEQ ID NO: 42235 - DNA, 15 bp, Homo sapiens
cctgggttctcagcg

SEQ ID NO: 42236 - DNA, 15 bp, Homo sapiens
tcctgggttctcagc

SEQ ID NO: 42237 - DNA, 15 bp, Homo sapiens
ctcctgggttctcag

SEQ ID NO: 42238 - DNA, 15 bp, Homo sapiens
gctcctgggttctca

SEQ ID NO: 42239 - DNA, 15 bp, Homo sapiens
ggctcctgggttctc

SEQ ID NO: 42240 - DNA, 15 bp, Homo sapiens
cggctcctgggttct

SEQ ID NO: 42241 - DNA, 15 bp, Homo sapiens
ccggctcctgggttc

SEQ ID NO: 42242 - DNA, 15 bp, Homo sapiens
cccggctcctgggtt

SEQ ID NO: 42243 - DNA, 15 bp, Homo sapiens
gcccggctcctgggt

SEQ ID NO: 42244 - DNA, 15 bp, Homo sapiens
agcccggctcctggg

SEQ ID NO: 42245 - DNA, 15 bp, Homo sapiens
aagcccggctcctgg

SEQ ID NO: 42246 - DNA, 15 bp, Homo sapiens
caagcccggctcctg

SEQ ID NO: 42247 - DNA, 15 bp, Homo sapiens
tcaagcccggctcct

SEQ ID NO: 42248 - DNA, 15 bp, Homo sapiens
ctcaagcccggctcc

SEQ ID NO: 42249 - DNA, 15 bp, Homo sapiens
gctcaagcccggctc

SEQ ID NO: 42250 - DNA, 15 bp, Homo sapiens
ggctcaagcccggct

SEQ ID NO: 42251 - DNA, 15 bp, Homo sapiens
gggctcaagcccggc

SEQ ID NO: 42252 - DNA, 15 bp, Homo sapiens
agggctcaagcccgg

SEQ ID NO: 42253 - DNA, 15 bp, Homo sapiens
gagggctcaagcccg

SEQ ID NO: 42254 - DNA, 15 bp, Homo sapiens
ggagggctcaagccc

SEQ ID NO: 42255 - DNA, 15 bp, Homo sapiens
aggagggctcaagcc

SEQ ID NO: 42256 - DNA, 15 bp, Homo sapiens
aaggagggctcaagc

SEQ ID NO: 42257 - DNA, 15 bp, Homo sapiens
gaaggagggctcaag

SEQ ID NO: 42258 - DNA, 15 bp, Homo sapiens
ggaaggagggctcaa

SEQ ID NO: 42259 - DNA, 15 bp, Homo sapiens
aggaaggagggctca

SEQ ID NO: 42260 - DNA, 15 bp, Homo sapiens
aaggaaggagggctc

SEQ ID NO: 42261 - DNA, 15 bp, Homo sapiens
aaaggaaggagggct

SEQ ID NO: 42262 - DNA, 15 bp, Homo sapiens
gaaaggaaggagggc

SEQ ID NO: 42263 - DNA, 15 bp, Homo sapiens
ggaaaggaaggaggg

SEQ ID NO: 42264 - DNA, 15 bp, Homo sapiens
gggaaaggaaggagg

SEQ ID NO: 42265 - DNA, 15 bp, Homo sapiens
agggaaaggaaggag

SEQ ID NO: 42266 - DNA, 15 bp, Homo sapiens
aagggaaaggaagga

SEQ ID NO: 42267 - DNA, 15 bp, Homo sapiens
gaagggaaaggaagg

SEQ ID NO: 42268 - DNA, 15 bp, Homo sapiens
ggaagggaaaggaag

SEQ ID NO: 42269 - DNA, 15 bp, Homo sapiens
gggaagggaaaggaa

SEQ ID NO: 42270 - DNA, 15 bp, Homo sapiens
ggggaagggaaagga

SEQ ID NO: 42271 - DNA, 15 bp, Homo sapiens
cggggaagggaaagg

SEQ ID NO: 42272 - DNA, 15 bp, Homo sapiens
acggggaagggaaag

SEQ ID NO: 42273 - DNA, 15 bp, Homo sapiens
gacggggaagggaaa

SEQ ID NO: 42274 - DNA, 15 bp, Homo sapiens
ggacggggaagggaa

SEQ ID NO: 42275 - DNA, 15 bp, Homo sapiens
cggacggggaaggga

SEQ ID NO: 42276 - DNA, 15 bp, Homo sapiens
acggacggggaaggg

SEQ ID NO: 42277 - DNA, 15 bp, Homo sapiens
gacggacggggaagg

SEQ ID NO: 42278 - DNA, 15 bp, Homo sapiens
ggacggacggggaag

SEQ ID NO: 42279 - DNA, 15 bp, Homo sapiens
tggacggacggggaa

SEQ ID NO: 42280 - DNA, 15 bp, Homo sapiens
atggacggacgggga

SEQ ID NO: 42281 - DNA, 15 bp, Homo sapiens
gatggacggacgggg

SEQ ID NO: 42282 - DNA, 15 bp, Homo sapiens
ggatggacggacggg

SEQ ID NO: 42283 - DNA, 15 bp, Homo sapiens
tggatggacggacgg

SEQ ID NO: 42284 - DNA, 15 bp, Homo sapiens
atggatggacggacg

SEQ ID NO: 42285 - DNA, 15 bp, Homo sapiens
catggatggacggac

SEQ ID NO: 42286 - DNA, 15 bp, Homo sapiens
gcatggatggacgga

SEQ ID NO: 42287 - DNA, 15 bp, Homo sapiens
tgcatggatggacgg

SEQ ID NO: 42288 - DNA, 15 bp, Homo sapiens
atgcatggatggacg

SEQ ID NO: 42289 - DNA, 15 bp, Homo sapiens
gatgcatggatggac

SEQ ID NO: 42290 - DNA, 15 bp, Homo sapiens
ggatgcatggatgga

SEQ ID NO: 42291 - DNA, 15 bp, Homo sapiens
aggatgcatggatgg

SEQ ID NO: 42292 - DNA, 15 bp, Homo sapiens
caggatgcatggatg

SEQ ID NO: 42293 - DNA, 15 bp, Homo sapiens
gcaggatgcatggat

SEQ ID NO: 42294 - DNA, 15 bp, Homo sapiens
agcaggatgcatgga

SEQ ID NO: 42295 - DNA, 15 bp, Homo sapiens
cagcaggatgcatgg

SEQ ID NO: 42296 - DNA, 15 bp, Homo sapiens
tcagcaggatgcatg

SEQ ID NO: 42297 - DNA, 15 bp, Homo sapiens
ttcagcaggatgcat

SEQ ID NO: 42298 - DNA, 15 bp, Homo sapiens
cttcagcaggatgca

SEQ ID NO: 42299 - DNA, 15 bp, Homo sapiens
tcttcagcaggatgc

SEQ ID NO: 42300 - DNA, 15 bp, Homo sapiens
ttcttcagcaggatg

SEQ ID NO: 42301 - DNA, 15 bp, Homo sapiens
cttcttcagcaggat

SEQ ID NO: 42302 - DNA, 15 bp, Homo sapiens
gcttcttcagcagga

SEQ ID NO: 42303 - DNA, 15 bp, Homo sapiens
cgcttcttcagcagg

SEQ ID NO: 42304 - DNA, 15 bp, Homo sapiens
gcgcttcttcagcag

SEQ ID NO: 42305 - DNA, 15 bp, Homo sapiens
tgcgcttcttcagca

SEQ ID NO: 42306 - DNA, 15 bp, Homo sapiens
gtgcgcttcttcagc

SEQ ID NO: 42307 - DNA, 15 bp, Homo sapiens
ggtgcgcttcttcag

SEQ ID NO: 42308 - DNA, 15 bp, Homo sapiens
tggtgcgcttcttca

SEQ ID NO: 42309 - DNA, 15 bp, Homo sapiens
ctggtgcgcttcttc

SEQ ID NO: 42310 - DNA, 15 bp, Homo sapiens
cctggtgcgcttctt

SEQ ID NO: 42311 - DNA, 15 bp, Homo sapiens
gcctggtgcgcttct

SEQ ID NO: 42312 - DNA, 15 bp, Homo sapiens
agcctggtgcgcttc

SEQ ID NO: 42313 - DNA, 15 bp, Homo sapiens
gagcctggtgcgctt

SEQ ID NO: 42314 - DNA, 15 bp, Homo sapiens
ggagcctggtgcgct

SEQ ID NO: 42315 - DNA, 15 bp, Homo sapiens
aggagcctggtgcgc

SEQ ID NO: 42316 - DNA, 15 bp, Homo sapiens
aaggagcctggtgcg

SEQ ID NO: 42317 - DNA, 15 bp, Homo sapiens
caaggagcctggtgc

SEQ ID NO: 42318 - DNA, 15 bp, Homo sapiens
ccaaggagcctggtg

SEQ ID NO: 42319 - DNA, 15 bp, Homo sapiens
cccaaggagcctggt

SEQ ID NO: 42320 - DNA, 15 bp, Homo sapiens
ccccaaggagcctgg

SEQ ID NO: 42321 - DNA, 15 bp, Homo sapiens
cccccaaggagcctg

SEQ ID NO: 42322 - DNA, 15 bp, Homo sapiens
acccccaaggagcct

SEQ ID NO: 42323 - DNA, 15 bp, Homo sapiens
gacccccaaggagcc

SEQ ID NO: 42324 - DNA, 15 bp, Homo sapiens
ggacccccaaggagc

SEQ ID NO: 42325 - DNA, 15 bp, Homo sapiens
aggacccccaaggag

SEQ ID NO: 42326 - DNA, 15 bp, Homo sapiens
aaggacccccaagga

SEQ ID NO: 42327 - DNA, 15 bp, Homo sapiens
caaggacccccaagg

SEQ ID NO: 42328 - DNA, 15 bp, Homo sapiens
ccaaggacccccaag

SEQ ID NO: 42329 - DNA, 15 bp, Homo sapiens
tccaaggacccccaa

SEQ ID NO: 42330 - DNA, 15 bp, Homo sapiens
gtccaaggaccccca

SEQ ID NO: 42331 - DNA, 15 bp, Homo sapiens
agtccaaggaccccc

SEQ ID NO: 42332 - DNA, 15 bp, Homo sapiens
aagtccaaggacccc

SEQ ID NO: 42333 - DNA, 15 bp, Homo sapiens
gaagtccaaggaccc

SEQ ID NO: 42334 - DNA, 15 bp, Homo sapiens
ggaagtccaaggacc

SEQ ID NO: 42335 - DNA, 15 bp, Homo sapiens
gggaagtccaaggac

SEQ ID NO: 42336 - DNA, 15 bp, Homo sapiens
ggggaagtccaagga

SEQ ID NO: 42337 - DNA, 15 bp, Homo sapiens
tggggaagtccaagg

SEQ ID NO: 42338 - DNA, 15 bp, Homo sapiens
gtggggaagtccaag

SEQ ID NO: 42339 - DNA, 15 bp, Homo sapiens
agtggggaagtccaa

SEQ ID NO: 42340 - DNA, 15 bp, Homo sapiens
aagtggggaagtcca

SEQ ID NO: 42341 - DNA, 15 bp, Homo sapiens
caagtggggaagtcc

SEQ ID NO: 42342 - DNA, 15 bp, Homo sapiens
gcaagtggggaagtc

SEQ ID NO: 42343 - DNA, 15 bp, Homo sapiens
agcaagtggggaagt

SEQ ID NO: 42344 - DNA, 15 bp, Homo sapiens
gagcaagtggggaag

SEQ ID NO: 42345 - DNA, 15 bp, Homo sapiens
ggagcaagtggggaa

SEQ ID NO: 42346 - DNA, 15 bp, Homo sapiens
gggagcaagtgggga

SEQ ID NO: 42347 - DNA, 15 bp, Homo sapiens
ggggagcaagtgggg

SEQ ID NO: 42348 - DNA, 15 bp, Homo sapiens
tggggagcaagtggg

SEQ ID NO: 42349 - DNA, 15 bp, Homo sapiens
gtggggagcaagtgg

SEQ ID NO: 42350 - DNA, 15 bp, Homo sapiens
ggtggggagcaagtg

SEQ ID NO: 42351 - DNA, 15 bp, Homo sapiens
gggtggggagcaagt

SEQ ID NO: 42352 - DNA, 15 bp, Homo sapiens
agggtggggagcaag

SEQ ID NO: 42353 - DNA, 15 bp, Homo sapiens
cagggtggggagcaa

SEQ ID NO: 42354 - DNA, 15 bp, Homo sapiens
gcagggtggggagca

SEQ ID NO: 42355 - DNA, 15 bp, Homo sapiens
tgcagggtggggagc

SEQ ID NO: 42356 - DNA, 15 bp, Homo sapiens
ctgcagggtggggag

SEQ ID NO: 42357 - DNA, 15 bp, Homo sapiens
gctgcagggtgggga

SEQ ID NO: 42358 - DNA, 15 bp, Homo sapiens
ggctgcagggtgggg

SEQ ID NO: 42359 - DNA, 15 bp, Homo sapiens
tggctgcagggtggg

SEQ ID NO: 42360 - DNA, 15 bp, Homo sapiens
ttggctgcagggtgg

SEQ ID NO: 42361 - DNA, 15 bp, Homo sapiens
tttggctgcagggtg

SEQ ID NO: 42362 - DNA, 15 bp, Homo sapiens
ctttggctgcagggt

SEQ ID NO: 42363 - DNA, 15 bp, Homo sapiens
actttggctgcaggg

SEQ ID NO: 42364 - DNA, 15 bp, Homo sapiens
cactttggctgcagg

SEQ ID NO: 42365 - DNA, 15 bp, Homo sapiens
gcactttggctgcag

SEQ ID NO: 42366 - DNA, 15 bp, Homo sapiens
agcactttggctgca

SEQ ID NO: 42367 - DNA, 15 bp, Homo sapiens
gagcactttggctgc

SEQ ID NO: 42368 - DNA, 15 bp, Homo sapiens
agagcactttggctg

SEQ ID NO: 42369 - DNA, 15 bp, Homo sapiens
aagagcactttggct

SEQ ID NO: 42370 - DNA, 15 bp, Homo sapiens
aaagagcactttggc

SEQ ID NO: 42371 - DNA, 15 bp, Homo sapiens
aaaagagcactttgg

SEQ ID NO: 42372 - DNA, 15 bp, Homo sapiens
gaaaagagcactttg

SEQ ID NO: 42373 - DNA, 15 bp, Homo sapiens
tgaaaagagcacttt

SEQ ID NO: 42374 - DNA, 15 bp, Homo sapiens
ttgaaaagagcactt

SEQ ID NO: 42375 - DNA, 15 bp, Homo sapiens
tttgaaaagagcact

SEQ ID NO: 42376 - DNA, 15 bp, Homo sapiens
ctttgaaaagagcac

SEQ ID NO: 42377 - DNA, 15 bp, Homo sapiens
cctttgaaaagagca

SEQ ID NO: 42378 - DNA, 15 bp, Homo sapiens
gcctttgaaaagagc

SEQ ID NO: 42379 - DNA, 15 bp, Homo sapiens
ggcctttgaaaagag

SEQ ID NO: 42380 - DNA, 15 bp, Homo sapiens
gggcctttgaaaaga

SEQ ID NO: 42381 - DNA, 15 bp, Homo sapiens
ggggcctttgaaaag

SEQ ID NO: 42382 - DNA, 15 bp, Homo sapiens
aggggcctttgaaaa

SEQ ID NO: 42383 - DNA, 15 bp, Homo sapiens
aaggggcctttgaaa

SEQ ID NO: 42384 - DNA, 15 bp, Homo sapiens
aaaggggcctttgaa

SEQ ID NO: 42385 - DNA, 15 bp, Homo sapiens
caaaggggcctttga

SEQ ID NO: 42386 - DNA, 15 bp, Homo sapiens
gcaaaggggcctttg

SEQ ID NO: 42387 - DNA, 15 bp, Homo sapiens
ggcaaaggggccttt

SEQ ID NO: 42388 - DNA, 15 bp, Homo sapiens
aggcaaaggggcctt

SEQ ID NO: 42389 - DNA, 15 bp, Homo sapiens
aaggcaaaggggcct

SEQ ID NO: 42390 - DNA, 15 bp, Homo sapiens
aaaggcaaaggggcc

SEQ ID NO: 42391 - DNA, 15 bp, Homo sapiens
aaaaggcaaaggggc

SEQ ID NO: 42392 - DNA, 15 bp, Homo sapiens
gaaaaggcaaagggg

SEQ ID NO: 42393 - DNA, 15 bp, Homo sapiens
agaaaaggcaaaggg

SEQ ID NO: 42394 - DNA, 15 bp, Homo sapiens
gagaaaaggcaaagg

SEQ ID NO: 42395 - DNA, 15 bp, Homo sapiens
agagaaaaggcaaag

SEQ ID NO: 42396 - DNA, 15 bp, Homo sapiens
cagagaaaaggcaaa

SEQ ID NO: 42397 - DNA, 15 bp, Homo sapiens
gcagagaaaaggcaa

SEQ ID NO: 42398 - DNA, 15 bp, Homo sapiens
agcagagaaaaggca

SEQ ID NO: 42399 - DNA, 15 bp, Homo sapiens
gagcagagaaaaggc

SEQ ID NO: 42400 - DNA, 15 bp, Homo sapiens
agagcagagaaaagg

SEQ ID NO: 42401 - DNA, 15 bp, Homo sapiens
aagagcagagaaaag

SEQ ID NO: 42402 - DNA, 15 bp, Homo sapiens
caagagcagagaaaa

SEQ ID NO: 42403 - DNA, 15 bp, Homo sapiens
ccaagagcagagaaa

SEQ ID NO: 42404 - DNA, 15 bp, Homo sapiens
cccaagagcagagaa

SEQ ID NO: 42405 - DNA, 15 bp, Homo sapiens
ccccaagagcagaga

SEQ ID NO: 42406 - DNA, 15 bp, Homo sapiens
accccaagagcagag

SEQ ID NO: 42407 - DNA, 15 bp, Homo sapiens
caccccaagagcaga

SEQ ID NO: 42408 - DNA, 15 bp, Homo sapiens
tcaccccaagagcag

SEQ ID NO: 42409 - DNA, 15 bp, Homo sapiens
ttcaccccaagagca

SEQ ID NO: 42410 - DNA, 15 bp, Homo sapiens
cttcaccccaagagc

SEQ ID NO: 42411 - DNA, 15 bp, Homo sapiens
ccttcaccccaagag

SEQ ID NO: 42412 - DNA, 15 bp, Homo sapiens
gccttcaccccaaga

SEQ ID NO: 42413 - DNA, 15 bp, Homo sapiens
ggccttcaccccaag

SEQ ID NO: 42414 - DNA, 15 bp, Homo sapiens
gggccttcaccccaa

SEQ ID NO: 42415 - DNA, 15 bp, Homo sapiens
tgggccttcacccca

SEQ ID NO: 42416 - DNA, 15 bp, Homo sapiens
ctgggccttcacccc

SEQ ID NO: 42417 - DNA, 15 bp, Homo sapiens
actgggccttcaccc

SEQ ID NO: 42418 - DNA, 15 bp, Homo sapiens
gactgggccttcacc

SEQ ID NO: 42419 - DNA, 15 bp, Homo sapiens
ggactgggccttcac

SEQ ID NO: 42420 - DNA, 15 bp, Homo sapiens
gggactgggccttca

SEQ ID NO: 42421 - DNA, 15 bp, Homo sapiens
agggactgggccttc

SEQ ID NO: 42422 - DNA, 15 bp, Homo sapiens
aagggactgggcctt

SEQ ID NO: 42423 - DNA, 15 bp, Homo sapiens
taagggactgggcct

SEQ ID NO: 42424 - DNA, 15 bp, Homo sapiens
ataagggactgggcc

SEQ ID NO: 42425 - DNA, 15 bp, Homo sapiens
cataagggactgggc

SEQ ID NO: 42426 - DNA, 15 bp, Homo sapiens
acataagggactggg

SEQ ID NO: 42427 - DNA, 15 bp, Homo sapiens
cacataagggactgg

SEQ ID NO: 42428 - DNA, 15 bp, Homo sapiens
ccacataagggactg

SEQ ID NO: 42429 - DNA, 15 bp, Homo sapiens
accacataagggact

SEQ ID NO: 42430 - DNA, 15 bp, Homo sapiens
aaccacataagggac

SEQ ID NO: 42431 - DNA, 15 bp, Homo sapiens
caaccacataaggga

SEQ ID NO: 42432 - DNA, 15 bp, Homo sapiens
tcaaccacataaggg

SEQ ID NO: 42433 - DNA, 15 bp, Homo sapiens
gtcaaccacataagg

SEQ ID NO: 42434 - DNA, 15 bp, Homo sapiens
ggtcaaccacataag

SEQ ID NO: 42435 - DNA, 15 bp, Homo sapiens
gggtcaaccacataa

SEQ ID NO: 42436 - DNA, 15 bp, Homo sapiens
ggggtcaaccacata

SEQ ID NO: 42437 - DNA, 15 bp, Homo sapiens
gggggtcaaccacat

SEQ ID NO: 42438 - DNA, 15 bp, Homo sapiens
ggggggtcaaccaca

SEQ ID NO: 42439 - DNA, 15 bp, Homo sapiens
tggggggtcaaccac

SEQ ID NO: 42440 - DNA, 15 bp, Homo sapiens
ttggggggtcaacca

SEQ ID NO: 42441 - DNA, 15 bp, Homo sapiens
gttggggggtcaacc

SEQ ID NO: 42442 - DNA, 15 bp, Homo sapiens
cgttggggggtcaac

SEQ ID NO: 42443 - DNA, 15 bp, Homo sapiens
gcgttggggggtcaa

SEQ ID NO: 42444 - DNA, 15 bp, Homo sapiens
ggcgttggggggtca

SEQ ID NO: 42445 - DNA, 15 bp, Homo sapiens
gggcgttggggggtc

SEQ ID NO: 42446 - DNA, 15 bp, Homo sapiens
ggggcgttggggggt

SEQ ID NO: 42447 - DNA, 15 bp, Homo sapiens
tggggcgttgggggg

SEQ ID NO: 42448 - DNA, 15 bp, Homo sapiens
ctggggcgttggggg

SEQ ID NO: 42449 - DNA, 15 bp, Homo sapiens
cctggggcgttgggg

SEQ ID NO: 42450 - DNA, 15 bp, Homo sapiens
acctggggcgttggg

SEQ ID NO: 42451 - DNA, 15 bp, Homo sapiens
gacctggggcgttgg

SEQ ID NO: 42452 - DNA, 15 bp, Homo sapiens
ggacctggggcgttg

SEQ ID NO: 42453 - DNA, 15 bp, Homo sapiens
gggacctggggcgtt

SEQ ID NO: 42454 - DNA, 15 bp, Homo sapiens
agggacctggggcgt

SEQ ID NO: 42455 - DNA, 15 bp, Homo sapiens
cagggacctggggcg

SEQ ID NO: 42456 - DNA, 15 bp, Homo sapiens
ccagggacctggggc

SEQ ID NO: 42457 - DNA, 15 bp, Homo sapiens
cccagggacctgggg

SEQ ID NO: 42458 - DNA, 15 bp, Homo sapiens
tcccagggacctggg

SEQ ID NO: 42459 - DNA, 15 bp, Homo sapiens
gtcccagggacctgg

SEQ ID NO: 42460 - DNA, 15 bp, Homo sapiens
agtcccagggacctg

SEQ ID NO: 42461 - DNA, 15 bp, Homo sapiens
gagtcccagggacct

SEQ ID NO: 42462 - DNA, 15 bp, Homo sapiens
cgagtcccagggacc

SEQ ID NO: 42463 - DNA, 15 bp, Homo sapiens
ccgagtcccagggac

SEQ ID NO: 42464 - DNA, 15 bp, Homo sapiens
cccgagtcccaggga

SEQ ID NO: 42465 - DNA, 15 bp, Homo sapiens
ccccgagtcccaggg

SEQ ID NO: 42466 - DNA, 15 bp, Homo sapiens
gccccgagtcccagg

SEQ ID NO: 42467 - DNA, 15 bp, Homo sapiens
cgccccgagtcccag

SEQ ID NO: 42468 - DNA, 15 bp, Homo sapiens
gcgccccgagtccca

SEQ ID NO: 42469 - DNA, 15 bp, Homo sapiens
agcgccccgagtccc

SEQ ID NO: 42470 - DNA, 15 bp, Homo sapiens
gagcgccccgagtcc

SEQ ID NO: 42471 - DNA, 15 bp, Homo sapiens
ggagcgccccgagtc

SEQ ID NO: 42472 - DNA, 15 bp, Homo sapiens
gggagcgccccgagt

SEQ ID NO: 42473 - DNA, 15 bp, Homo sapiens
agggagcgccccgag

SEQ ID NO: 42474 - DNA, 15 bp, Homo sapiens
cagggagcgccccga

SEQ ID NO: 42475 - DNA, 15 bp, Homo sapiens
gcagggagcgccccg

SEQ ID NO: 42476 - DNA, 15 bp, Homo sapiens
agcagggagcgcccc

SEQ ID NO: 42477 - DNA, 15 bp, Homo sapiens
cagcagggagcgccc

SEQ ID NO: 42478 - DNA, 15 bp, Homo sapiens
gcagcagggagcgcc

SEQ ID NO: 42479 - DNA, 15 bp, Homo sapiens
ggcagcagggagcgc

SEQ ID NO: 42480 - DNA, 15 bp, Homo sapiens
aggcagcagggagcg

SEQ ID NO: 42481 - DNA, 15 bp, Homo sapiens
caggcagcagggagc

SEQ ID NO: 42482 - DNA, 15 bp, Homo sapiens
gcaggcagcagggag

SEQ ID NO: 42483 - DNA, 15 bp, Homo sapiens
agcaggcagcaggga

SEQ ID NO: 42484 - DNA, 15 bp, Homo sapiens
aagcaggcagcaggg

SEQ ID NO: 42485 - DNA, 15 bp, Homo sapiens
gaagcaggcagcagg

SEQ ID NO: 42486 - DNA, 15 bp, Homo sapiens
tgaagcaggcagcag

SEQ ID NO: 42487 - DNA, 15 bp, Homo sapiens
gtgaagcaggcagca

SEQ ID NO: 42488 - DNA, 15 bp, Homo sapiens
tgtgaagcaggcagc

SEQ ID NO: 42489 - DNA, 15 bp, Homo sapiens
ctgtgaagcaggcag

SEQ ID NO: 42490 - DNA, 15 bp, Homo sapiens
gctgtgaagcaggca

SEQ ID NO: 42491 - DNA, 15 bp, Homo sapiens
ggctgtgaagcaggc

SEQ ID NO: 42492 - DNA, 15 bp, Homo sapiens
aggctgtgaagcagg

SEQ ID NO: 42493 - DNA, 15 bp, Homo sapiens
aaggctgtgaagcag

SEQ ID NO: 42494 - DNA, 15 bp, Homo sapiens
taaggctgtgaagca

SEQ ID NO: 42495 - DNA, 15 bp, Homo sapiens
ctaaggctgtgaagc

SEQ ID NO: 42496 - DNA, 15 bp, Homo sapiens
actaaggctgtgaag

SEQ ID NO: 42497 - DNA, 15 bp, Homo sapiens
tactaaggctgtgaa

SEQ ID NO: 42498 - DNA, 15 bp, Homo sapiens
atactaaggctgtga

SEQ ID NO: 42499 - DNA, 15 bp, Homo sapiens
catactaaggctgtg

SEQ ID NO: 42500 - DNA, 15 bp, Homo sapiens
acatactaaggctgt

SEQ ID NO: 42501 - DNA, 15 bp, Homo sapiens
cacatactaaggctg

SEQ ID NO: 42502 - DNA, 15 bp, Homo sapiens
gcacatactaaggct

SEQ ID NO: 42503 - DNA, 15 bp, Homo sapiens
ggcacatactaaggc

SEQ ID NO: 42504 - DNA, 15 bp, Homo sapiens
cggcacatactaagg

SEQ ID NO: 42505 - DNA, 15 bp, Homo sapiens
acggcacatactaag

SEQ ID NO: 42506 - DNA, 15 bp, Homo sapiens
aacggcacatactaa

SEQ ID NO: 42507 - DNA, 15 bp, Homo sapiens
gaacggcacatacta

SEQ ID NO: 42508 - DNA, 15 bp, Homo sapiens
cgaacggcacatact

SEQ ID NO: 42509 - DNA, 15 bp, Homo sapiens
gcgaacggcacatac

SEQ ID NO: 42510 - DNA, 15 bp, Homo sapiens
agcgaacggcacata

SEQ ID NO: 42511 - DNA, 15 bp, Homo sapiens
gagcgaacggcacat

SEQ ID NO: 42512 - DNA, 15 bp, Homo sapiens
agagcgaacggcaca

SEQ ID NO: 42513 - DNA, 15 bp, Homo sapiens
cagagcgaacggcac

SEQ ID NO: 42514 - DNA, 15 bp, Homo sapiens
gcagagcgaacggca

SEQ ID NO: 42515 - DNA, 15 bp, Homo sapiens
cgcagagcgaacggc

SEQ ID NO: 42516 - DNA, 15 bp, Homo sapiens
tcgcagagcgaacgg

SEQ ID NO: 42517 - DNA, 15 bp, Homo sapiens
ctcgcagagcgaacg

SEQ ID NO: 42518 - DNA, 15 bp, Homo sapiens
tctcgcagagcgaac

SEQ ID NO: 42519 - DNA, 15 bp, Homo sapiens
ttctcgcagagcgaa

SEQ ID NO: 42520 - DNA, 15 bp, Homo sapiens
tttctcgcagagcga

SEQ ID NO: 42521 - DNA, 15 bp, Homo sapiens
ttttctcgcagagcg

SEQ ID NO: 42522 - DNA, 15 bp, Homo sapiens
cttttctcgcagagc

SEQ ID NO: 42523 - DNA, 15 bp, Homo sapiens
gcttttctcgcagag

SEQ ID NO: 42524 - DNA, 15 bp, Homo sapiens
ggcttttctcgcaga

SEQ ID NO: 42525 - DNA, 15 bp, Homo sapiens
tggcttttctcgcag

SEQ ID NO: 42526 - DNA, 15 bp, Homo sapiens
gtggcttttctcgca

SEQ ID NO: 42527 - DNA, 15 bp, Homo sapiens
ggtggcttttctcgc

SEQ ID NO: 42528 - DNA, 15 bp, Homo sapiens
cggtggcttttctcg

SEQ ID NO: 42529 - DNA, 15 bp, Homo sapiens
gcggtggcttttctc

SEQ ID NO: 42530 - DNA, 15 bp, Homo sapiens
ggcggtggcttttct

SEQ ID NO: 42531 - DNA, 15 bp, Homo sapiens
gggcggtggcttttc

SEQ ID NO: 42532 - DNA, 15 bp, Homo sapiens
tgggcggtggctttt

SEQ ID NO: 42533 - DNA, 15 bp, Homo sapiens
gtgggcggtggcttt

SEQ ID NO: 42534 - DNA, 15 bp, Homo sapiens
ggtgggcggtggctt

SEQ ID NO: 42535 - DNA, 15 bp, Homo sapiens
gggtgggcggtggct

SEQ ID NO: 42536 - DNA, 15 bp, Homo sapiens
tgggtgggcggtggc

SEQ ID NO: 42537 - DNA, 15 bp, Homo sapiens
ctgggtgggcggtgg

SEQ ID NO: 42538 - DNA, 15 bp, Homo sapiens
cctgggtgggcggtg

SEQ ID NO: 42539 - DNA, 15 bp, Homo sapiens
acctgggtgggcggt

SEQ ID NO: 42540 - DNA, 15 bp, Homo sapiens
cacctgggtgggcgg

SEQ ID NO: 42541 - DNA, 15 bp, Homo sapiens
ccacctgggtgggcg

SEQ ID NO: 42542 - DNA, 15 bp, Homo sapiens
accacctgggtgggc

SEQ ID NO: 42543 - DNA, 15 bp, Homo sapiens
aaccacctgggtggg

SEQ ID NO: 42544 - DNA, 15 bp, Homo sapiens
gaaccacctgggtgg

SEQ ID NO: 42545 - DNA, 15 bp, Homo sapiens
ggaaccacctgggtg

SEQ ID NO: 42546 - DNA, 15 bp, Homo sapiens
aggaaccacctgggt

SEQ ID NO: 42547 - DNA, 15 bp, Homo sapiens
gaggaaccacctggg

SEQ ID NO: 42548 - DNA, 15 bp, Homo sapiens
ggaggaaccacctgg

SEQ ID NO: 42549 - DNA, 15 bp, Homo sapiens
aggaggaaccacctg

SEQ ID NO: 42550 - DNA, 15 bp, Homo sapiens
caggaggaaccacct

SEQ ID NO: 42551 - DNA, 15 bp, Homo sapiens
ccaggaggaaccacc

SEQ ID NO: 42552 - DNA, 15 bp, Homo sapiens
accaggaggaaccac

SEQ ID NO: 42553 - DNA, 15 bp, Homo sapiens
gaccaggaggaacca

SEQ ID NO: 42554 - DNA, 15 bp, Homo sapiens
agaccaggaggaacc

SEQ ID NO: 42555 - DNA, 15 bp, Homo sapiens
cagaccaggaggaac

SEQ ID NO: 42556 - DNA, 15 bp, Homo sapiens
acagaccaggaggaa

SEQ ID NO: 42557 - DNA, 15 bp, Homo sapiens
gacagaccaggagga

SEQ ID NO: 42558 - DNA, 15 bp, Homo sapiens
agacagaccaggagg

SEQ ID NO: 42559 - DNA, 15 bp, Homo sapiens
cagacagaccaggag

SEQ ID NO: 42560 - DNA, 15 bp, Homo sapiens
tcagacagaccagga

SEQ ID NO: 42561 - DNA, 15 bp, Homo sapiens
atcagacagaccagg

SEQ ID NO: 42562 - DNA, 15 bp, Homo sapiens
aatcagacagaccag

SEQ ID NO: 42563 - DNA, 15 bp, Homo sapiens
aaatcagacagacca

SEQ ID NO: 42564 - DNA, 15 bp, Homo sapiens
gaaatcagacagacc

SEQ ID NO: 42565 - DNA, 15 bp, Homo sapiens
tgaaatcagacagac

SEQ ID NO: 42566 - DNA, 15 bp, Homo sapiens
ctgaaatcagacaga

SEQ ID NO: 42567 - DNA, 15 bp, Homo sapiens
tctgaaatcagacag

SEQ ID NO: 42568 - DNA, 15 bp, Homo sapiens
ttctgaaatcagaca

SEQ ID NO: 42569 - DNA, 15 bp, Homo sapiens
gttctgaaatcagac

SEQ ID NO: 42570 - DNA, 15 bp, Homo sapiens
agttctgaaatcaga

SEQ ID NO: 42571 - DNA, 15 bp, Homo sapiens
cagttctgaaatcag

SEQ ID NO: 42572 - DNA, 15 bp, Homo sapiens
ccagttctgaaatca

SEQ ID NO: 42573 - DNA, 15 bp, Homo sapiens
tccagttctgaaatc

SEQ ID NO: 42574 - DNA, 15 bp, Homo sapiens
ctccagttctgaaat

SEQ ID NO: 42575 - DNA, 15 bp, Homo sapiens
tctccagttctgaaa

SEQ ID NO: 42576 - DNA, 15 bp, Homo sapiens
atctccagttctgaa

SEQ ID NO: 42577 - DNA, 15 bp, Homo sapiens
catctccagttctga

SEQ ID NO: 42578 - DNA, 15 bp, Homo sapiens
ccatctccagttctg

SEQ ID NO: 42579 - DNA, 15 bp, Homo sapiens
gccatctccagttct

SEQ ID NO: 42580 - DNA, 15 bp, Homo sapiens
ggccatctccagttc

SEQ ID NO: 42581 - DNA, 15 bp, Homo sapiens
aggccatctccagtt

SEQ ID NO: 42582 - DNA, 15 bp, Homo sapiens
gaggccatctccagt

SEQ ID NO: 42583 - DNA, 15 bp, Homo sapiens
ggaggccatctccag

SEQ ID NO: 42584 - DNA, 15 bp, Homo sapiens
cggaggccatctcca

SEQ ID NO: 42585 - DNA, 15 bp, Homo sapiens
ccggaggccatctcc

SEQ ID NO: 42586 - DNA, 15 bp, Homo sapiens
accggaggccatctc

SEQ ID NO: 42587 - DNA, 15 bp, Homo sapiens
gaccggaggccatct

SEQ ID NO: 42588 - DNA, 15 bp, Homo sapiens
ggaccggaggccatc

SEQ ID NO: 42589 - DNA, 15 bp, Homo sapiens
aggaccggaggccat

SEQ ID NO: 42590 - DNA, 15 bp, Homo sapiens
caggaccggaggcca

SEQ ID NO: 42591 - DNA, 15 bp, Homo sapiens
acaggaccggaggcc

SEQ ID NO: 42592 - DNA, 15 bp, Homo sapiens
aacaggaccggaggc

SEQ ID NO: 42593 - DNA, 15 bp, Homo sapiens
aaacaggaccggagg

SEQ ID NO: 42594 - DNA, 15 bp, Homo sapiens
gaaacaggaccggag

SEQ ID NO: 42595 - DNA, 15 bp, Homo sapiens
ggaaacaggaccgga

SEQ ID NO: 42596 - DNA, 15 bp, Homo sapiens
tggaaacaggaccgg

SEQ ID NO: 42597 - DNA, 15 bp, Homo sapiens
gtggaaacaggaccg

SEQ ID NO: 42598 - DNA, 15 bp, Homo sapiens
ggtggaaacaggacc

SEQ ID NO: 42599 - DNA, 15 bp, Homo sapiens
gggtggaaacaggac

SEQ ID NO: 42600 - DNA, 15 bp, Homo sapiens
agggtggaaacagga

SEQ ID NO: 42601 - DNA, 15 bp, Homo sapiens
cagggtggaaacagg

SEQ ID NO: 42602 - DNA, 15 bp, Homo sapiens
ccagggtggaaacag

SEQ ID NO: 42603 - DNA, 15 bp, Homo sapiens
cccagggtggaaaca

SEQ ID NO: 42604 - DNA, 15 bp, Homo sapiens
ccccagggtggaaac

SEQ ID NO: 42605 - DNA, 15 bp, Homo sapiens
cccccagggtggaaa

SEQ ID NO: 42606 - DNA, 15 bp, Homo sapiens
gcccccagggtggaa

SEQ ID NO: 42607 - DNA, 15 bp, Homo sapiens
cgcccccagggtgga

SEQ ID NO: 42608 - DNA, 15 bp, Homo sapiens
gcgcccccagggtgg

SEQ ID NO: 42609 - DNA, 15 bp, Homo sapiens
ggcgcccccagggtg

SEQ ID NO: 42610 - DNA, 15 bp, Homo sapiens
aggcgcccccagggt

SEQ ID NO: 42611 - DNA, 15 bp, Homo sapiens
gaggcgcccccaggg

SEQ ID NO: 42612 - DNA, 15 bp, Homo sapiens
agaggcgcccccagg

SEQ ID NO: 42613 - DNA, 15 bp, Homo sapiens
gagaggcgcccccag

SEQ ID NO: 42614 - DNA, 15 bp, Homo sapiens
agagaggcgccccca

SEQ ID NO: 42615 - DNA, 15 bp, Homo sapiens
cagagaggcgccccc

SEQ ID NO: 42616 - DNA, 15 bp, Homo sapiens
gcagagaggcgcccc

SEQ ID NO: 42617 - DNA, 15 bp, Homo sapiens
cgcagagaggcgccc

SEQ ID NO: 42618 - DNA, 15 bp, Homo sapiens
ccgcagagaggcgcc

SEQ ID NO: 42619 - DNA, 15 bp, Homo sapiens
cccgcagagaggcgc

SEQ ID NO: 42620 - DNA, 15 bp, Homo sapiens
ccccgcagagaggcg

SEQ ID NO: 42621 - DNA, 15 bp, Homo sapiens
gccccgcagagaggc

SEQ ID NO: 42622 - DNA, 15 bp, Homo sapiens
cgccccgcagagagg

SEQ ID NO: 42623 - DNA, 15 bp, Homo sapiens
gcgccccgcagagag

SEQ ID NO: 42624 - DNA, 15 bp, Homo sapiens
ggcgccccgcagaga

SEQ ID NO: 42625 - DNA, 15 bp, Homo sapiens
aggcgccccgcagag

SEQ ID NO: 42626 - DNA, 15 bp, Homo sapiens
gaggcgccccgcaga

SEQ ID NO: 42627 - DNA, 15 bp, Homo sapiens
agaggcgccccgcag

SEQ ID NO: 42628 - DNA, 15 bp, Homo sapiens
gagaggcgccccgca

SEQ ID NO: 42629 - DNA, 15 bp, Homo sapiens
agagaggcgccccgc

SEQ ID NO: 42630 - DNA, 15 bp, Homo sapiens
gagagaggcgccccg

SEQ ID NO: 42631 - DNA, 15 bp, Homo sapiens
agagagaggcgcccc

SEQ ID NO: 42632 - DNA, 15 bp, Homo sapiens
gagagagaggcgccc

SEQ ID NO: 42633 - DNA, 15 bp, Homo sapiens
agagagagaggcgcc

SEQ ID NO: 42634 - DNA, 15 bp, Homo sapiens
cagagagagaggcgc

SEQ ID NO: 42635 - DNA, 15 bp, Homo sapiens
ccagagagagaggcg

SEQ ID NO: 42636 - DNA, 15 bp, Homo sapiens
cccagagagagaggc

SEQ ID NO: 42637 - DNA, 15 bp, Homo sapiens
ccccagagagagagg

SEQ ID NO: 42638 - DNA, 15 bp, Homo sapiens
accccagagagagag

SEQ ID NO: 42639 - DNA, 15 bp, Homo sapiens
taccccagagagaga

SEQ ID NO: 42640 - DNA, 15 bp, Homo sapiens
gtaccccagagagag

SEQ ID NO: 42641 - DNA, 15 bp, Homo sapiens
ggtaccccagagaga

SEQ ID NO: 42642 - DNA, 15 bp, Homo sapiens
aggtaccccagagag

SEQ ID NO: 42643 - DNA, 15 bp, Homo sapiens
gaggtaccccagaga

SEQ ID NO: 42644 - DNA, 15 bp, Homo sapiens
agaggtaccccagag

SEQ ID NO: 42645 - DNA, 15 bp, Homo sapiens
aagaggtaccccaga

SEQ ID NO: 42646 - DNA, 15 bp, Homo sapiens
aaagaggtaccccag

SEQ ID NO: 42647 - DNA, 15 bp, Homo sapiens
caaagaggtacccca

SEQ ID NO: 42648 - DNA, 15 bp, Homo sapiens
acaaagaggtacccc

SEQ ID NO: 42649 - DNA, 15 bp, Homo sapiens
gacaaagaggtaccc

SEQ ID NO: 42650 - DNA, 15 bp, Homo sapiens
agacaaagaggtacc

SEQ ID NO: 42651 - DNA, 15 bp, Homo sapiens
cagacaaagaggtac

SEQ ID NO: 42652 - DNA, 15 bp, Homo sapiens
acagacaaagaggta

SEQ ID NO: 42653 - DNA, 15 bp, Homo sapiens
cacagacaaagaggt

SEQ ID NO: 42654 - DNA, 15 bp, Homo sapiens
ccacagacaaagagg

SEQ ID NO: 42655 - DNA, 15 bp, Homo sapiens
cccacagacaaagag

SEQ ID NO: 42656 - DNA, 15 bp, Homo sapiens
ccccacagacaaaga

SEQ ID NO: 42657 - DNA, 15 bp, Homo sapiens
gccccacagacaaag

SEQ ID NO: 42658 - DNA, 15 bp, Homo sapiens
tgccccacagacaaa

SEQ ID NO: 42659 - DNA, 15 bp, Homo sapiens
gtgccccacagacaa

SEQ ID NO: 42660 - DNA, 15 bp, Homo sapiens
ggtgccccacagaca

SEQ ID NO: 42661 - DNA, 15 bp, Homo sapiens
aggtgccccacagac

SEQ ID NO: 42662 - DNA, 15 bp, Homo sapiens
gaggtgccccacaga

SEQ ID NO: 42663 - DNA, 15 bp, Homo sapiens
agaggtgccccacag

SEQ ID NO: 42664 - DNA, 15 bp, Homo sapiens
gagaggtgccccaca

SEQ ID NO: 42665 - DNA, 15 bp, Homo sapiens
agagaggtgccccac

SEQ ID NO: 42666 - DNA, 15 bp, Homo sapiens
cagagaggtgcccca

SEQ ID NO: 42667 - DNA, 15 bp, Homo sapiens
acagagaggtgcccc

SEQ ID NO: 42668 - DNA, 15 bp, Homo sapiens
cacagagaggtgccc

SEQ ID NO: 42669 - DNA, 15 bp, Homo sapiens
ccacagagaggtgcc

SEQ ID NO: 42670 - DNA, 15 bp, Homo sapiens
cccacagagaggtgc

SEQ ID NO: 42671 - DNA, 15 bp, Homo sapiens
ccccacagagaggtg

SEQ ID NO: 42672 - DNA, 15 bp, Homo sapiens
gccccacagagaggt

SEQ ID NO: 42673 - DNA, 15 bp, Homo sapiens
cgccccacagagagg

SEQ ID NO: 42674 - DNA, 15 bp, Homo sapiens
gcgccccacagagag

SEQ ID NO: 42675 - DNA, 15 bp, Homo sapiens
agcgccccacagaga

SEQ ID NO: 42676 - DNA, 15 bp, Homo sapiens
aagcgccccacagag

SEQ ID NO: 42677 - DNA, 15 bp, Homo sapiens
aaagcgccccacaga

SEQ ID NO: 42678 - DNA, 15 bp, Homo sapiens
gaaagcgccccacag

SEQ ID NO: 42679 - DNA, 15 bp, Homo sapiens
ggaaagcgccccaca

SEQ ID NO: 42680 - DNA, 15 bp, Homo sapiens
aggaaagcgccccac

SEQ ID NO: 42681 - DNA, 15 bp, Homo sapiens
aaggaaagcgcccca

SEQ ID NO: 42682 - DNA, 15 bp, Homo sapiens
gaaggaaagcgcccc

SEQ ID NO: 42683 - DNA, 15 bp, Homo sapiens
agaaggaaagcgccc

SEQ ID NO: 42684 - DNA, 15 bp, Homo sapiens
gagaaggaaagcgcc

SEQ ID NO: 42685 - DNA, 15 bp, Homo sapiens
cgagaaggaaagcgc

SEQ ID NO: 42686 - DNA, 15 bp, Homo sapiens
ccgagaaggaaagcg

SEQ ID NO: 42687 - DNA, 15 bp, Homo sapiens
gccgagaaggaaagc

SEQ ID NO: 42688 - DNA, 15 bp, Homo sapiens
agccgagaaggaaag

SEQ ID NO: 42689 - DNA, 15 bp, Homo sapiens
gagccgagaaggaaa

SEQ ID NO: 42690 - DNA, 15 bp, Homo sapiens
agagccgagaaggaa

SEQ ID NO: 42691 - DNA, 15 bp, Homo sapiens
cagagccgagaagga

SEQ ID NO: 42692 - DNA, 15 bp, Homo sapiens
gcagagccgagaagg

SEQ ID NO: 42693 - DNA, 15 bp, Homo sapiens
ggcagagccgagaag

SEQ ID NO: 42694 - DNA, 15 bp, Homo sapiens
gggcagagccgagaa

SEQ ID NO: 42695 - DNA, 15 bp, Homo sapiens
agggcagagccgaga

SEQ ID NO: 42696 - DNA, 15 bp, Homo sapiens
gagggcagagccgag

SEQ ID NO: 42697 - DNA, 15 bp, Homo sapiens
agagggcagagccga

SEQ ID NO: 42698 - DNA, 15 bp, Homo sapiens
gagagggcagagccg

SEQ ID NO: 42699 - DNA, 15 bp, Homo sapiens
tgagagggcagagcc

SEQ ID NO: 42700 - DNA, 15 bp, Homo sapiens
ctgagagggcagagc

SEQ ID NO: 42701 - DNA, 15 bp, Homo sapiens
cctgagagggcagag

SEQ ID NO: 42702 - DNA, 15 bp, Homo sapiens
gcctgagagggcaga

SEQ ID NO: 42703 - DNA, 15 bp, Homo sapiens
agcctgagagggcag

SEQ ID NO: 42704 - DNA, 15 bp, Homo sapiens
tagcctgagagggca

SEQ ID NO: 42705 - DNA, 15 bp, Homo sapiens
gtagcctgagagggc

SEQ ID NO: 42706 - DNA, 15 bp, Homo sapiens
agtagcctgagaggg

SEQ ID NO: 42707 - DNA, 15 bp, Homo sapiens
aagtagcctgagagg

SEQ ID NO: 42708 - DNA, 15 bp, Homo sapiens
gaagtagcctgagag

SEQ ID NO: 42709 - DNA, 15 bp, Homo sapiens
ggaagtagcctgaga

SEQ ID NO: 42710 - DNA, 15 bp, Homo sapiens
aggaagtagcctgag

SEQ ID NO: 42711 - DNA, 15 bp, Homo sapiens
caggaagtagcctga

SEQ ID NO: 42712 - DNA, 15 bp, Homo sapiens
gcaggaagtagcctg

SEQ ID NO: 42713 - DNA, 15 bp, Homo sapiens
ggcaggaagtagcct

SEQ ID NO: 42714 - DNA, 15 bp, Homo sapiens
aggcaggaagtagcc

SEQ ID NO: 42715 - DNA, 15 bp, Homo sapiens
aaggcaggaagtagc

SEQ ID NO: 42716 - DNA, 15 bp, Homo sapiens
gaaggcaggaagtag

SEQ ID NO: 42717 - DNA, 15 bp, Homo sapiens
tgaaggcaggaagta

SEQ ID NO: 42718 - DNA, 15 bp, Homo sapiens
ctgaaggcaggaagt

SEQ ID NO: 42719 - DNA, 15 bp, Homo sapiens
tctgaaggcaggaag

SEQ ID NO: 42720 - DNA, 15 bp, Homo sapiens
gtctgaaggcaggaa

SEQ ID NO: 42721 - DNA, 15 bp, Homo sapiens
ggtctgaaggcagga

SEQ ID NO: 42722 - DNA, 15 bp, Homo sapiens
gggtctgaaggcagg

SEQ ID NO: 42723 - DNA, 15 bp, Homo sapiens
ggggtctgaaggcag

SEQ ID NO: 42724 - DNA, 15 bp, Homo sapiens
tggggtctgaaggca

SEQ ID NO: 42725 - DNA, 15 bp, Homo sapiens
ctggggtctgaaggc

SEQ ID NO: 42726 - DNA, 15 bp, Homo sapiens
gctggggtctgaagg

SEQ ID NO: 42727 - DNA, 15 bp, Homo sapiens
agctggggtctgaag

SEQ ID NO: 42728 - DNA, 15 bp, Homo sapiens
gagctggggtctgaa

SEQ ID NO: 42729 - DNA, 15 bp, Homo sapiens
ggagctggggtctga

SEQ ID NO: 42730 - DNA, 15 bp, Homo sapiens
tggagctggggtctg

SEQ ID NO: 42731 - DNA, 15 bp, Homo sapiens
atggagctggggtct

SEQ ID NO: 42732 - DNA, 15 bp, Homo sapiens
catggagctggggtc

SEQ ID NO: 42733 - DNA, 15 bp, Homo sapiens
ccatggagctggggt

SEQ ID NO: 42734 - DNA, 15 bp, Homo sapiens
cccatggagctgggg

SEQ ID NO: 42735 - DNA, 15 bp, Homo sapiens
ccccatggagctggg

SEQ ID NO: 42736 - DNA, 15 bp, Homo sapiens
gccccatggagctgg

SEQ ID NO: 42737 - DNA, 15 bp, Homo sapiens
agccccatggagctg

SEQ ID NO: 42738 - DNA, 15 bp, Homo sapiens
gagccccatggagct

SEQ ID NO: 42739 - DNA, 15 bp, Homo sapiens
agagccccatggagc

SEQ ID NO: 42740 - DNA, 15 bp, Homo sapiens
gagagccccatggag

SEQ ID NO: 42741 - DNA, 15 bp, Homo sapiens
ggagagccccatgga

SEQ ID NO: 42742 - DNA, 15 bp, Homo sapiens
gggagagccccatgg

SEQ ID NO: 42743 - DNA, 15 bp, Homo sapiens
ggggagagccccatg

SEQ ID NO: 42744 - DNA, 15 bp, Homo sapiens
gggggagagccccat

SEQ ID NO: 42745 - DNA, 15 bp, Homo sapiens
tgggggagagcccca

SEQ ID NO: 42746 - DNA, 15 bp, Homo sapiens
gtgggggagagcccc

SEQ ID NO: 42747 - DNA, 15 bp, Homo sapiens
ggtgggggagagccc

SEQ ID NO: 42748 - DNA, 15 bp, Homo sapiens
tggtgggggagagcc

SEQ ID NO: 42749 - DNA, 15 bp, Homo sapiens
ctggtgggggagagc

SEQ ID NO: 42750 - DNA, 15 bp, Homo sapiens
cctggtgggggagag

SEQ ID NO: 42751 - DNA, 15 bp, Homo sapiens
tcctggtgggggaga

SEQ ID NO: 42752 - DNA, 15 bp, Homo sapiens
ttcctggtgggggag

SEQ ID NO: 42753 - DNA, 15 bp, Homo sapiens
cttcctggtggggga

SEQ ID NO: 42754 - DNA, 15 bp, Homo sapiens
acttcctggtggggg

SEQ ID NO: 42755 - DNA, 15 bp, Homo sapiens
gacttcctggtgggg

SEQ ID NO: 42756 - DNA, 15 bp, Homo sapiens
tgacttcctggtggg

SEQ ID NO: 42757 - DNA, 15 bp, Homo sapiens
ctgacttcctggtgg

SEQ ID NO: 42758 - DNA, 15 bp, Homo sapiens
gctgacttcctggtg

SEQ ID NO: 42759 - DNA, 15 bp, Homo sapiens
agctgacttcctggt

SEQ ID NO: 42760 - DNA, 15 bp, Homo sapiens
gagctgacttcctgg

SEQ ID NO: 42761 - DNA, 15 bp, Homo sapiens
agagctgacttcctg

SEQ ID NO: 42762 - DNA, 15 bp, Homo sapiens
cagagctgacttcct

SEQ ID NO: 42763 - DNA, 15 bp, Homo sapiens
acagagctgacttcc

SEQ ID NO: 42764 - DNA, 15 bp, Homo sapiens
gacagagctgacttc

SEQ ID NO: 42765 - DNA, 15 bp, Homo sapiens
tgacagagctgactt

SEQ ID NO: 42766 - DNA, 15 bp, Homo sapiens
ttgacagagctgact

SEQ ID NO: 42767 - DNA, 15 bp, Homo sapiens
tttgacagagctgac

SEQ ID NO: 42768 - DNA, 15 bp, Homo sapiens
gtttgacagagctga

SEQ ID NO: 42769 - DNA, 15 bp, Homo sapiens
ggtttgacagagctg

SEQ ID NO: 42770 - DNA, 15 bp, Homo sapiens
cggtttgacagagct

SEQ ID NO: 42771 - DNA, 15 bp, Homo sapiens
ccggtttgacagagc

SEQ ID NO: 42772 - DNA, 15 bp, Homo sapiens
cccggtttgacagag

SEQ ID NO: 42773 - DNA, 15 bp, Homo sapiens
acccggtttgacaga

SEQ ID NO: 42774 - DNA, 15 bp, Homo sapiens
gacccggtttgacag

SEQ ID NO: 42775 - DNA, 15 bp, Homo sapiens
ggacccggtttgaca

SEQ ID NO: 42776 - DNA, 15 bp, Homo sapiens
gggacccggtttgac

SEQ ID NO: 42777 - DNA, 15 bp, Homo sapiens
tgggacccggtttga

SEQ ID NO: 42778 - DNA, 15 bp, Homo sapiens
ctgggacccggtttg

SEQ ID NO: 42779 - DNA, 15 bp, Homo sapiens
cctgggacccggttt

SEQ ID NO: 42780 - DNA, 15 bp, Homo sapiens
ccctgggacccggtt

SEQ ID NO: 42781 - DNA, 15 bp, Homo sapiens
accctgggacccggt

SEQ ID NO: 42782 - DNA, 15 bp, Homo sapiens
aaccctgggacccgg

SEQ ID NO: 42783 - DNA, 15 bp, Homo sapiens
gaaccctgggacccg

SEQ ID NO: 42784 - DNA, 15 bp, Homo sapiens
agaaccctgggaccc

SEQ ID NO: 42785 - DNA, 15 bp, Homo sapiens
cagaaccctgggacc

SEQ ID NO: 42786 - DNA, 15 bp, Homo sapiens
acagaaccctgggac

SEQ ID NO: 42787 - DNA, 15 bp, Homo sapiens
aacagaaccctggga

SEQ ID NO: 42788 - DNA, 15 bp, Homo sapiens
aaacagaaccctggg

SEQ ID NO: 42789 - DNA, 15 bp, Homo sapiens
caaacagaaccctgg

SEQ ID NO: 42790 - DNA, 15 bp, Homo sapiens
acaaacagaaccctg

SEQ ID NO: 42791 - DNA, 15 bp, Homo sapiens
aacaaacagaaccct

SEQ ID NO: 42792 - DNA, 15 bp, Homo sapiens
gaacaaacagaaccc

SEQ ID NO: 42793 - DNA, 15 bp, Homo sapiens
ggaacaaacagaacc

SEQ ID NO: 42794 - DNA, 15 bp, Homo sapiens
aggaacaaacagaac

SEQ ID NO: 42795 - DNA, 15 bp, Homo sapiens
caggaacaaacagaa

SEQ ID NO: 42796 - DNA, 15 bp, Homo sapiens
acaggaacaaacaga

SEQ ID NO: 42797 - DNA, 15 bp, Homo sapiens
tacaggaacaaacag

SEQ ID NO: 42798 - DNA, 15 bp, Homo sapiens
atacaggaacaaaca

SEQ ID NO: 42799 - DNA, 15 bp, Homo sapiens
gatacaggaacaaac

SEQ ID NO: 42800 - DNA, 15 bp, Homo sapiens
ggatacaggaacaaa

SEQ ID NO: 42801 - DNA, 15 bp, Homo sapiens
gggatacaggaacaa

SEQ ID NO: 42802 - DNA, 15 bp, Homo sapiens
agggatacaggaaca

SEQ ID NO: 42803 - DNA, 15 bp, Homo sapiens
tagggatacaggaac

SEQ ID NO: 42804 - DNA, 15 bp, Homo sapiens
ctagggatacaggaa

SEQ ID NO: 42805 - DNA, 15 bp, Homo sapiens
cctagggatacagga

SEQ ID NO: 42806 - DNA, 15 bp, Homo sapiens
ccctagggatacagg

SEQ ID NO: 42807 - DNA, 15 bp, Homo sapiens
gccctagggatacag

SEQ ID NO: 42808 - DNA, 15 bp, Homo sapiens
ggccctagggataca

SEQ ID NO: 42809 - DNA, 15 bp, Homo sapiens
gggccctagggatac

SEQ ID NO: 42810 - DNA, 15 bp, Homo sapiens
tgggccctagggata

SEQ ID NO: 42811 - DNA, 15 bp, Homo sapiens
ctgggccctagggat

SEQ ID NO: 42812 - DNA, 15 bp, Homo sapiens
tctgggccctaggga

SEQ ID NO: 42813 - DNA, 15 bp, Homo sapiens
ctctgggccctaggg

SEQ ID NO: 42814 - DNA, 15 bp, Homo sapiens
gctctgggccctagg

SEQ ID NO: 42815 - DNA, 15 bp, Homo sapiens
tgctctgggccctag

SEQ ID NO: 42816 - DNA, 15 bp, Homo sapiens
gtgctctgggcccta

SEQ ID NO: 42817 - DNA, 15 bp, Homo sapiens
ggtgctctgggccct

SEQ ID NO: 42818 - DNA, 15 bp, Homo sapiens
tggtgctctgggccc

SEQ ID NO: 42819 - DNA, 15 bp, Homo sapiens
gtggtgctctgggcc

SEQ ID NO: 42820 - DNA, 15 bp, Homo sapiens
agtggtgctctgggc

SEQ ID NO: 42821 - DNA, 15 bp, Homo sapiens
cagtggtgctctggg

SEQ ID NO: 42822 - DNA, 15 bp, Homo sapiens
ccagtggtgctctgg

SEQ ID NO: 42823 - DNA, 15 bp, Homo sapiens
gccagtggtgctctg

SEQ ID NO: 42824 - DNA, 15 bp, Homo sapiens
ggccagtggtgctct

SEQ ID NO: 42825 - DNA, 15 bp, Homo sapiens
gggccagtggtgctc

SEQ ID NO: 42826 - DNA, 15 bp, Homo sapiens
tgggccagtggtgct

SEQ ID NO: 42827 - DNA, 15 bp, Homo sapiens
gtgggccagtggtgc

SEQ ID NO: 42828 - DNA, 15 bp, Homo sapiens
tgtgggccagtggtg

SEQ ID NO: 42829 - DNA, 15 bp, Homo sapiens
ctgtgggccagtggt

SEQ ID NO: 42830 - DNA, 15 bp, Homo sapiens
actgtgggccagtgg

SEQ ID NO: 42831 - DNA, 15 bp, Homo sapiens
tactgtgggccagtg

SEQ ID NO: 42832 - DNA, 15 bp, Homo sapiens
ctactgtgggccagt

SEQ ID NO: 42833 - DNA, 15 bp, Homo sapiens
cctactgtgggccag

SEQ ID NO: 42834 - DNA, 15 bp, Homo sapiens
acctactgtgggcca

SEQ ID NO: 42835 - DNA, 15 bp, Homo sapiens
cacctactgtgggcc

SEQ ID NO: 42836 - DNA, 15 bp, Homo sapiens
acacctactgtgggc

SEQ ID NO: 42837 - DNA, 15 bp, Homo sapiens
aacacctactgtggg

SEQ ID NO: 42838 - DNA, 15 bp, Homo sapiens
aaacacctactgtgg

SEQ ID NO: 42839 - DNA, 15 bp, Homo sapiens
taaacacctactgtg

SEQ ID NO: 42840 - DNA, 15 bp, Homo sapiens
ttaaacacctactgt

SEQ ID NO: 42841 - DNA, 15 bp, Homo sapiens
attaaacacctactg

SEQ ID NO: 42842 - DNA, 15 bp, Homo sapiens
tattaaacacctact

SEQ ID NO: 42843 - DNA, 15 bp, Homo sapiens
ttattaaacacctac

SEQ ID NO: 42844 - DNA, 15 bp, Homo sapiens
tttattaaacaccta

SEQ ID NO: 42845 - DNA, 15 bp, Homo sapiens
atttattaaacacct

SEQ ID NO: 42846 - DNA, 15 bp, Homo sapiens
gatttattaaacacc

SEQ ID NO: 42847 - DNA, 15 bp, Homo sapiens
agatttattaaacac

SEQ ID NO: 42848 - DNA, 15 bp, Homo sapiens
gagatttattaaaca

SEQ ID NO: 42849 - DNA, 15 bp, Homo sapiens
agagatttattaaac

SEQ ID NO: 42850 - DNA, 15 bp, Homo sapiens
tagagatttattaaa

SEQ ID NO: 42851 - DNA, 15 bp, Homo sapiens
ctagagatttattaa

SEQ ID NO: 42852 - DNA, 15 bp, Homo sapiens
tctagagatttatta

SEQ ID NO: 42853 - DNA, 15 bp, Homo sapiens
ttctagagatttatt

SEQ ID NO: 42854 - DNA, 15 bp, Homo sapiens
cttctagagatttat

SEQ ID NO: 42855 - DNA, 15 bp, Homo sapiens
gcttctagagattta

SEQ ID NO: 42856 - DNA, 15 bp, Homo sapiens
agcttctagagattt

SEQ ID NO: 42857 - DNA, 15 bp, Homo sapiens
tagcttctagagatt

SEQ ID NO: 42858 - DNA, 15 bp, Homo sapiens
gtagcttctagagat

SEQ ID NO: 42859 - DNA, 15 bp, Homo sapiens
agtagcttctagaga

SEQ ID NO: 42860 - DNA, 15 bp, Homo sapiens
gagtagcttctagag

SEQ ID NO: 42861 - DNA, 15 bp, Homo sapiens
cgagtagcttctaga

SEQ ID NO: 42862 - DNA, 15 bp, Homo sapiens
ccgagtagcttctag

SEQ ID NO: 42863 - DNA, 15 bp, Homo sapiens
cccgagtagcttcta

SEQ ID NO: 42864 - DNA, 15 bp, Homo sapiens
tcccgagtagcttct

SEQ ID NO: 42865 - DNA, 15 bp, Homo sapiens
ttcccgagtagcttc

SEQ ID NO: 42866 - DNA, 15 bp, Homo sapiens
attcccgagtagctt

SEQ ID NO: 42867 - DNA, 15 bp, Homo sapiens
gattcccgagtagct

SEQ ID NO: 42868 - DNA, 15 bp, Homo sapiens
agattcccgagtagc

SEQ ID NO: 42869 - DNA, 15 bp, Homo sapiens
cagattcccgagtag

SEQ ID NO: 42870 - DNA, 15 bp, Homo sapiens
tcagattcccgagta

SEQ ID NO: 42871 - DNA, 15 bp, Homo sapiens
ctcagattcccgagt

SEQ ID NO: 42872 - DNA, 15 bp, Homo sapiens
cctcagattcccgag

SEQ ID NO: 42873 - DNA, 15 bp, Homo sapiens
gcctcagattcccga

SEQ ID NO: 42874 - DNA, 15 bp, Homo sapiens
tgcctcagattcccg

SEQ ID NO: 42875 - DNA, 15 bp, Homo sapiens
ctgcctcagattccc

SEQ ID NO: 42876 - DNA, 15 bp, Homo sapiens
cctgcctcagattcc

SEQ ID NO: 42877 - DNA, 15 bp, Homo sapiens
tcctgcctcagattc

SEQ ID NO: 42878 - DNA, 15 bp, Homo sapiens
ctcctgcctcagatt

SEQ ID NO: 42879 - DNA, 15 bp, Homo sapiens
cctcctgcctcagat

SEQ ID NO: 42880 - DNA, 15 bp, Homo sapiens
tcctcctgcctcaga

SEQ ID NO: 42881 - DNA, 15 bp, Homo sapiens
aggctcaagcgatcc

SEQ ID NO: 42882 - DNA, 15 bp, Homo sapiens
caggctcaagcgatc

SEQ ID NO: 42883 - DNA, 15 bp, Homo sapiens
ccaggctcaagcgat

SEQ ID NO: 42884 - DNA, 15 bp, Homo sapiens
cccaggctcaagcga

SEQ ID NO: 42885 - DNA, 15 bp, Homo sapiens
tcccaggctcaagcg

SEQ ID NO: 42886 - DNA, 15 bp, Homo sapiens
ctcccaggctcaagc

SEQ ID NO: 42887 - DNA, 15 bp, Homo sapiens
actcccaggctcaag

SEQ ID NO: 42888 - DNA, 15 bp, Homo sapiens
aactcccaggctcaa

SEQ ID NO: 42889 - DNA, 15 bp, Homo sapiens
caactcccaggctca

SEQ ID NO: 42890 - DNA, 15 bp, Homo sapiens
ccaactcccaggctc

SEQ ID NO: 42891 - DNA, 15 bp, Homo sapiens
tccaactcccaggct

SEQ ID NO: 42892 - DNA, 15 bp, Homo sapiens
ctccaactcccaggc

SEQ ID NO: 42893 - DNA, 15 bp, Homo sapiens
tctccaactcccagg

SEQ ID NO: 42894 - DNA, 15 bp, Homo sapiens
gtctccaactcccag

SEQ ID NO: 42895 - DNA, 15 bp, Homo sapiens
ggtctccaactccca

SEQ ID NO: 42896 - DNA, 15 bp, Homo sapiens
tggtctccaactccc

SEQ ID NO: 42897 - DNA, 15 bp, Homo sapiens
ctggtctccaactcc

SEQ ID NO: 42898 - DNA, 15 bp, Homo sapiens
gctggtctccaactc

SEQ ID NO: 42899 - DNA, 15 bp, Homo sapiens
ggctggtctccaact

SEQ ID NO: 42900 - DNA, 15 bp, Homo sapiens
aggctggtctccaac

SEQ ID NO: 42901 - DNA, 15 bp, Homo sapiens
caggctggtctccaa

SEQ ID NO: 42902 - DNA, 15 bp, Homo sapiens
ccaggctggtctcca

SEQ ID NO: 42903 - DNA, 15 bp, Homo sapiens
cccaggctggtctcc

SEQ ID NO: 42904 - DNA, 15 bp, Homo sapiens
atcttgctatgttgc

SEQ ID NO: 42905 - DNA, 15 bp, Homo sapiens
tatcttgctatgttg

SEQ ID NO: 42906 - DNA, 15 bp, Homo sapiens
ctatcttgctatgtt

SEQ ID NO: 42907 - DNA, 15 bp, Homo sapiens
cctatcttgctatgt

SEQ ID NO: 42908 - DNA, 15 bp, Homo sapiens
gcctatcttgctatg

SEQ ID NO: 42909 - DNA, 15 bp, Homo sapiens
tgcctatcttgctat

SEQ ID NO: 42910 - DNA, 15 bp, Homo sapiens
atgcctatcttgcta

SEQ ID NO: 42911 - DNA, 15 bp, Homo sapiens
catgcctatcttgct

SEQ ID NO: 42912 - DNA, 15 bp, Homo sapiens
ccatgcctatcttgc

SEQ ID NO: 42913 - DNA, 15 bp, Homo sapiens
accatgcctatcttg

SEQ ID NO: 42914 - DNA, 15 bp, Homo sapiens
caccatgcctatctt

SEQ ID NO: 42915 - DNA, 15 bp, Homo sapiens
ccaccatgcctatct

SEQ ID NO: 42916 - DNA, 15 bp, Homo sapiens
accaccatgcctatc

SEQ ID NO: 42917 - DNA, 15 bp, Homo sapiens
taccaccatgcctat

SEQ ID NO: 42918 - DNA, 15 bp, Homo sapiens
gtaccaccatgccta

SEQ ID NO: 42919 - DNA, 15 bp, Homo sapiens
tgtaccaccatgcct

SEQ ID NO: 42920 - DNA, 15 bp, Homo sapiens
gtgtaccaccatgcc

SEQ ID NO: 42921 - DNA, 15 bp, Homo sapiens
tgtgtaccaccatgc

SEQ ID NO: 42922 - DNA, 15 bp, Homo sapiens
gtgtgtaccaccatg

SEQ ID NO: 42923 - DNA, 15 bp, Homo sapiens
ggtgtgtaccaccat

SEQ ID NO: 42924 - DNA, 15 bp, Homo sapiens
aggtgtgtaccacca

SEQ ID NO: 42925 - DNA, 15 bp, Homo sapiens
caggtgtgtaccacc

SEQ ID NO: 42926 - DNA, 15 bp, Homo sapiens
acaggtgtgtaccac

SEQ ID NO: 42927 - DNA, 15 bp, Homo sapiens
tacaggtgtgtacca

SEQ ID NO: 42928 - DNA, 15 bp, Homo sapiens
ttacaggtgtgtacc

SEQ ID NO: 42929 - DNA, 15 bp, Homo sapiens
attacaggtgtgtac

SEQ ID NO: 42930 - DNA, 15 bp, Homo sapiens
gattacaggtgtgta

SEQ ID NO: 42931 - DNA, 15 bp, Homo sapiens
cagctgggattacag

SEQ ID NO: 42932 - DNA, 15 bp, Homo sapiens
gcagctgggattaca

SEQ ID NO: 42933 - DNA, 15 bp, Homo sapiens
agcagctgggattac

SEQ ID NO: 42934 - DNA, 15 bp, Homo sapiens
gagcagctgggatta

SEQ ID NO: 42935 - DNA, 15 bp, Homo sapiens
cgagcagctgggatt

SEQ ID NO: 42936 - DNA, 15 bp, Homo sapiens
ccgagcagctgggat

SEQ ID NO: 42937 - DNA, 15 bp, Homo sapiens
cccgagcagctggga

SEQ ID NO: 42938 - DNA, 15 bp, Homo sapiens
tcccgagcagctggg

SEQ ID NO: 42939 - DNA, 15 bp, Homo sapiens
ctcccgagcagctgg

SEQ ID NO: 42940 - DNA, 15 bp, Homo sapiens
cctcccgagcagctg

SEQ ID NO: 42941 - DNA, 15 bp, Homo sapiens
gcctcccgagcagct

SEQ ID NO: 42942 - DNA, 15 bp, Homo sapiens
ggcctcccgagcagc

SEQ ID NO: 42943 - DNA, 15 bp, Homo sapiens
cggcctcccgagcag

SEQ ID NO: 42944 - DNA, 15 bp, Homo sapiens
tcggcctcccgagca

SEQ ID NO: 42945 - DNA, 15 bp, Homo sapiens
ctcggcctcccgagc

SEQ ID NO: 42946 - DNA, 15 bp, Homo sapiens
cctcggcctcccgag

SEQ ID NO: 42947 - DNA, 15 bp, Homo sapiens
acctcggcctcccga

SEQ ID NO: 42948 - DNA, 15 bp, Homo sapiens
cacctcggcctcccg

SEQ ID NO: 42949 - DNA, 15 bp, Homo sapiens
tcccacctcggcctc

SEQ ID NO: 42950 - DNA, 15 bp, Homo sapiens
ctcccacctcggcct

SEQ ID NO: 42951 - DNA, 15 bp, Homo sapiens
cctcccacctcggcc

SEQ ID NO: 42952 - DNA, 15 bp, Homo sapiens
tcctcccacctcggc

SEQ ID NO: 42953 - DNA, 15 bp, Homo sapiens
atcctcccacctcgg

SEQ ID NO: 42954 - DNA, 15 bp, Homo sapiens
gatcctcccacctcg

SEQ ID NO: 42955 - DNA, 15 bp, Homo sapiens
cgtgatcctcccacc

SEQ ID NO: 42956 - DNA, 15 bp, Homo sapiens
tcgtgatcctcccac

SEQ ID NO: 42957 - DNA, 15 bp, Homo sapiens
ctcgtgatcctccca

SEQ ID NO: 42958 - DNA, 15 bp, Homo sapiens
gctcgtgatcctccc

SEQ ID NO: 42959 - DNA, 15 bp, Homo sapiens
ggctcgtgatcctcc

SEQ ID NO: 42960 - DNA, 15 bp, Homo sapiens
aggctcgtgatcctc

SEQ ID NO: 42961 - DNA, 15 bp, Homo sapiens
caggctcgtgatcct

SEQ ID NO: 42962 - DNA, 15 bp, Homo sapiens
ccaggctcgtgatcc

SEQ ID NO: 42963 - DNA, 15 bp, Homo sapiens
cccaggctcgtgatc

SEQ ID NO: 42964 - DNA, 15 bp, Homo sapiens
tcccaggctcgtgat

SEQ ID NO: 42965 - DNA, 15 bp, Homo sapiens
ctcccaggctcgtga

SEQ ID NO: 42966 - DNA, 15 bp, Homo sapiens
cctcccaggctcgtg

SEQ ID NO: 42967 - DNA, 15 bp, Homo sapiens
acctcccaggctcgt

SEQ ID NO: 42968 - DNA, 15 bp, Homo sapiens
aacctcccaggctcg

SEQ ID NO: 42969 - DNA, 15 bp, Homo sapiens
caacctcccaggctc

SEQ ID NO: 42970 - DNA, 15 bp, Homo sapiens
tcaacctcccaggct

SEQ ID NO: 42971 - DNA, 15 bp, Homo sapiens
ctcaacctcccaggc

SEQ ID NO: 42972 - DNA, 15 bp, Homo sapiens
cctcaacctcccagg

SEQ ID NO: 42973 - DNA, 15 bp, Homo sapiens
gcctcaacctcccag

SEQ ID NO: 42974 - DNA, 15 bp, Homo sapiens
agcctcaacctccca

SEQ ID NO: 42975 - DNA, 15 bp, Homo sapiens
cagcctcaacctccc

SEQ ID NO: 42976 - DNA, 15 bp, Homo sapiens
gtgcagcctcaacct

SEQ ID NO: 42977 - DNA, 15 bp, Homo sapiens
agtgcagcctcaacc

SEQ ID NO: 42978 - DNA, 15 bp, Homo sapiens
cagtgcagcctcaac

SEQ ID NO: 42979 - DNA, 15 bp, Homo sapiens
tcagtgcagcctcaa

SEQ ID NO: 42980 - DNA, 15 bp, Homo sapiens
ctcagtgcagcctca

SEQ ID NO: 42981 - DNA, 15 bp, Homo sapiens
gctcagtgcagcctc

SEQ ID NO: 42982 - DNA, 15 bp, Homo sapiens
ggctcagtgcagcct

SEQ ID NO: 42983 - DNA, 15 bp, Homo sapiens
tggctcagtgcagcc

SEQ ID NO: 42984 - DNA, 15 bp, Homo sapiens
atggctcagtgcagc

SEQ ID NO: 42985 - DNA, 15 bp, Homo sapiens
catggctcagtgcag

SEQ ID NO: 42986 - DNA, 15 bp, Homo sapiens
tcatggctcagtgca

SEQ ID NO: 42987 - DNA, 15 bp, Homo sapiens
atcatggctcagtgc

SEQ ID NO: 42988 - DNA, 15 bp, Homo sapiens
aatcatggctcagtg

SEQ ID NO: 42989 - DNA, 15 bp, Homo sapiens
caatcatggctcagt

SEQ ID NO: 42990 - DNA, 15 bp, Homo sapiens
gcaatcatggctcag

SEQ ID NO: 42991 - DNA, 15 bp, Homo sapiens
tgcaatcatggctca

SEQ ID NO: 42992 - DNA, 15 bp, Homo sapiens
gtgcaatcatggctc

SEQ ID NO: 42993 - DNA, 15 bp, Homo sapiens
ggtgcaatcatggct

SEQ ID NO: 42994 - DNA, 15 bp, Homo sapiens
tggtgcaatcatggc

SEQ ID NO: 42995 - DNA, 15 bp, Homo sapiens
gtggtgcaatcatgg

SEQ ID NO: 42996 - DNA, 15 bp, Homo sapiens
agtggtgcaatcatg

SEQ ID NO: 42997 - DNA, 15 bp, Homo sapiens
cagtggtgcaatcat

SEQ ID NO: 42998 - DNA, 15 bp, Homo sapiens
gcagtggtgcaatca

SEQ ID NO: 42999 - DNA, 15 bp, Homo sapiens
actcattctgtcacc

SEQ ID NO: 43000 - DNA, 15 bp, Homo sapiens
gactcattctgtcac

SEQ ID NO: 43001 - DNA, 15 bp, Homo sapiens
ggactcattctgtca

SEQ ID NO: 43002 - DNA, 15 bp, Homo sapiens
gggactcattctgtc

SEQ ID NO: 43003 - DNA, 15 bp, Homo sapiens
agggactcattctgt

SEQ ID NO: 43004 - DNA, 15 bp, Homo sapiens
cagggactcattctg

SEQ ID NO: 43005 - DNA, 15 bp, Homo sapiens
acagggactcattct

SEQ ID NO: 43006 - DNA, 15 bp, Homo sapiens
gacagggactcattc

SEQ ID NO: 43007 - DNA, 15 bp, Homo sapiens
agacagggactcatt

SEQ ID NO: 43008 - DNA, 15 bp, Homo sapiens
gagacagggactcat

SEQ ID NO: 43009 - DNA, 15 bp, Homo sapiens
tgagacagggactca

SEQ ID NO: 43010 - DNA, 15 bp, Homo sapiens
ctgagacagggactc

SEQ ID NO: 43011 - DNA, 15 bp, Homo sapiens
tctgagacagggact

SEQ ID NO: 43012 - DNA, 15 bp, Homo sapiens
ttctgagacagggac

SEQ ID NO: 43013 - DNA, 15 bp, Homo sapiens
tttctgagacaggga

SEQ ID NO: 43014 - DNA, 15 bp, Homo sapiens
ttttctgagacaggg

SEQ ID NO: 43015 - DNA, 15 bp, Homo sapiens
tttttctgagacagg

SEQ ID NO: 43016 - DNA, 15 bp, Homo sapiens
ttttttctgagacag

SEQ ID NO: 43017 - DNA, 15 bp, Homo sapiens
tttttttctgagaca

SEQ ID NO: 43018 - DNA, 15 bp, Homo sapiens
ctttttttctgagac

SEQ ID NO: 43019 - DNA, 15 bp, Homo sapiens
actttttttctgaga

SEQ ID NO: 43020 - DNA, 15 bp, Homo sapiens
tactttttttctgag

SEQ ID NO: 43021 - DNA, 15 bp, Homo sapiens
ttactttttttctga

SEQ ID NO: 43022 - DNA, 15 bp, Homo sapiens
cttactttttttctg

SEQ ID NO: 43023 - DNA, 15 bp, Homo sapiens
acttactttttttct

SEQ ID NO: 43024 - DNA, 15 bp, Homo sapiens
aacttactttttttc

SEQ ID NO: 43025 - DNA, 15 bp, Homo sapiens
caacttacttttttt

SEQ ID NO: 43026 - DNA, 15 bp, Homo sapiens
acaacttactttttt

SEQ ID NO: 43027 - DNA, 15 bp, Homo sapiens
tacaacttacttttt

SEQ ID NO: 43028 - DNA, 15 bp, Homo sapiens
ctacaacttactttt

SEQ ID NO: 43029 - DNA, 15 bp, Homo sapiens
tctacaacttacttt

SEQ ID NO: 43030 - DNA, 15 bp, Homo sapiens
ttctacaacttactt

SEQ ID NO: 43031 - DNA, 15 bp, Homo sapiens
tttctacaacttact

SEQ ID NO: 43032 - DNA, 15 bp, Homo sapiens
ctttctacaacttac

SEQ ID NO: 43033 - DNA, 15 bp, Homo sapiens
tctttctacaactta

SEQ ID NO: 43034 - DNA, 15 bp, Homo sapiens
gtctttctacaactt

SEQ ID NO: 43035 - DNA, 15 bp, Homo sapiens
ggtctttctacaact

SEQ ID NO: 43036 - DNA, 15 bp, Homo sapiens
tggtctttctacaac

SEQ ID NO: 43037 - DNA, 15 bp, Homo sapiens
ttggtctttctacaa

SEQ ID NO: 43038 - DNA, 15 bp, Homo sapiens
cttggtctttctaca

SEQ ID NO: 43039 - DNA, 15 bp, Homo sapiens
tcttggtctttctac

SEQ ID NO: 43040 - DNA, 15 bp, Homo sapiens
ctcttggtctttcta

SEQ ID NO: 43041 - DNA, 15 bp, Homo sapiens
gctcttggtctttct

SEQ ID NO: 43042 - DNA, 15 bp, Homo sapiens
agctcttggtctttc

SEQ ID NO: 43043 - DNA, 15 bp, Homo sapiens
cagctcttggtcttt

SEQ ID NO: 43044 - DNA, 15 bp, Homo sapiens
acagctcttggtctt

SEQ ID NO: 43045 - DNA, 15 bp, Homo sapiens
cacagctcttggtct

SEQ ID NO: 43046 - DNA, 15 bp, Homo sapiens
ccacagctcttggtc

SEQ ID NO: 43047 - DNA, 15 bp, Homo sapiens
gccacagctcttggt

SEQ ID NO: 43048 - DNA, 15 bp, Homo sapiens
tgccacagctcttgg

SEQ ID NO: 43049 - DNA, 15 bp, Homo sapiens
gtgccacagctcttg

SEQ ID NO: 43050 - DNA, 15 bp, Homo sapiens
tgtgccacagctctt

SEQ ID NO: 43051 - DNA, 15 bp, Homo sapiens
ctgtgccacagctct

SEQ ID NO: 43052 - DNA, 15 bp, Homo sapiens
actgtgccacagctc

SEQ ID NO: 43053 - DNA, 15 bp, Homo sapiens
cactgtgccacagct

SEQ ID NO: 43054 - DNA, 15 bp, Homo sapiens
acactgtgccacagc

SEQ ID NO: 43055 - DNA, 15 bp, Homo sapiens
gacactgtgccacag

SEQ ID NO: 43056 - DNA, 15 bp, Homo sapiens
agacactgtgccaca

SEQ ID NO: 43057 - DNA, 15 bp, Homo sapiens
gagacactgtgccac

SEQ ID NO: 43058 - DNA, 15 bp, Homo sapiens
tgagacactgtgcca

SEQ ID NO: 43059 - DNA, 15 bp, Homo sapiens
gtgagacactgtgcc

SEQ ID NO: 43060 - DNA, 15 bp, Homo sapiens
tgtgagacactgtgc

SEQ ID NO: 43061 - DNA, 15 bp, Homo sapiens
gtgtgagacactgtg

SEQ ID NO: 43062 - DNA, 15 bp, Homo sapiens
ggtgtgagacactgt

SEQ ID NO: 43063 - DNA, 15 bp, Homo sapiens
aggtgtgagacactg

SEQ ID NO: 43064 - DNA, 15 bp, Homo sapiens
caggtgtgagacact

SEQ ID NO: 43065 - DNA, 15 bp, Homo sapiens
acaggtgtgagacac

SEQ ID NO: 43066 - DNA, 15 bp, Homo sapiens
tacaggtgtgagaca

SEQ ID NO: 43067 - DNA, 15 bp, Homo sapiens
ttacaggtgtgagac

SEQ ID NO: 43068 - DNA, 15 bp, Homo sapiens
gttacaggtgtgaga

SEQ ID NO: 43069 - DNA, 15 bp, Homo sapiens
tgttacaggtgtgag

SEQ ID NO: 43070 - DNA, 15 bp, Homo sapiens
gtgttacaggtgtga

SEQ ID NO: 43071 - DNA, 15 bp, Homo sapiens
ggtgttacaggtgtg

SEQ ID NO: 43072 - DNA, 15 bp, Homo sapiens
tggtgttacaggtgt

SEQ ID NO: 43073 - DNA, 15 bp, Homo sapiens
ctggtgttacaggtg

SEQ ID NO: 43074 - DNA, 15 bp, Homo sapiens
gctggtgttacaggt

SEQ ID NO: 43075 - DNA, 15 bp, Homo sapiens
tgctggtgttacagg

SEQ ID NO: 43076 - DNA, 15 bp, Homo sapiens
gtgctggtgttacag

SEQ ID NO: 43077 - DNA, 15 bp, Homo sapiens
agtgctggtgttaca

SEQ ID NO: 43078 - DNA, 15 bp, Homo sapiens
aagtgctggtgttac

SEQ ID NO: 43079 - DNA, 15 bp, Homo sapiens
aaagtgctggtgtta

SEQ ID NO: 43080 - DNA, 15 bp, Homo sapiens
caaagtgctggtgtt

SEQ ID NO: 43081 - DNA, 15 bp, Homo sapiens
ccaaagtgctggtgt

SEQ ID NO: 43082 - DNA, 15 bp, Homo sapiens
cccaaagtgctggtg

SEQ ID NO: 43083 - DNA, 15 bp, Homo sapiens
tcccgcctcagcctc

SEQ ID NO: 43084 - DNA, 15 bp, Homo sapiens
ctcccgcctcagcct

SEQ ID NO: 43085 - DNA, 15 bp, Homo sapiens
cctcccgcctcagcc

SEQ ID NO: 43086 - DNA, 15 bp, Homo sapiens
tcctcccgcctcagc

SEQ ID NO: 43087 - DNA, 15 bp, Homo sapiens
atcctcccgcctcag

SEQ ID NO: 43088 - DNA, 15 bp, Homo sapiens
gatcctcccgcctca

SEQ ID NO: 43089 - DNA, 15 bp, Homo sapiens
tgatcctcccgcctc

SEQ ID NO: 43090 - DNA, 15 bp, Homo sapiens
gtgatcctcccgcct

SEQ ID NO: 43091 - DNA, 15 bp, Homo sapiens
agtgatcctcccgcc

SEQ ID NO: 43092 - DNA, 15 bp, Homo sapiens
aagtgatcctcccgc

SEQ ID NO: 43093 - DNA, 15 bp, Homo sapiens
caagtgatcctcccg

SEQ ID NO: 43094 - DNA, 15 bp, Homo sapiens
tcaagtgatcctccc

SEQ ID NO: 43095 - DNA, 15 bp, Homo sapiens
gtaggctcaagtgat

SEQ ID NO: 43096 - DNA, 15 bp, Homo sapiens
agtaggctcaagtga

SEQ ID NO: 43097 - DNA, 15 bp, Homo sapiens
aagtaggctcaagtg

SEQ ID NO: 43098 - DNA, 15 bp, Homo sapiens
caagtaggctcaagt

SEQ ID NO: 43099 - DNA, 15 bp, Homo sapiens
ccaagtaggctcaag

SEQ ID NO: 43100 - DNA, 15 bp, Homo sapiens
tccaagtaggctcaa

SEQ ID NO: 43101 - DNA, 15 bp, Homo sapiens
ctccaagtaggctca

SEQ ID NO: 43102 - DNA, 15 bp, Homo sapiens
tctccaagtaggctc

SEQ ID NO: 43103 - DNA, 15 bp, Homo sapiens
gtctccaagtaggct

SEQ ID NO: 43104 - DNA, 15 bp, Homo sapiens
ggtctccaagtaggc

SEQ ID NO: 43105 - DNA, 15 bp, Homo sapiens
tggtctccaagtagg

SEQ ID NO: 43106 - DNA, 15 bp, Homo sapiens
ctggtctccaagtag

SEQ ID NO: 43107 - DNA, 15 bp, Homo sapiens
gctggtctccaagta

SEQ ID NO: 43108 - DNA, 15 bp, Homo sapiens
ggctggtctccaagt

SEQ ID NO: 43109 - DNA, 15 bp, Homo sapiens
tggctggtctccaag

SEQ ID NO: 43110 - DNA, 15 bp, Homo sapiens
ctggctggtctccaa

SEQ ID NO: 43111 - DNA, 15 bp, Homo sapiens
cctggctggtctcca

SEQ ID NO: 43112 - DNA, 15 bp, Homo sapiens
gcctggctggtctcc

SEQ ID NO: 43113 - DNA, 15 bp, Homo sapiens
ggcctggctggtctc

SEQ ID NO: 43114 - DNA, 15 bp, Homo sapiens
tggcctggctggtct

SEQ ID NO: 43115 - DNA, 15 bp, Homo sapiens
ttggcctggctggtc

SEQ ID NO: 43116 - DNA, 15 bp, Homo sapiens
gttggcctggctggt

SEQ ID NO: 43117 - DNA, 15 bp, Homo sapiens
tgttggcctggctgg

SEQ ID NO: 43118 - DNA, 15 bp, Homo sapiens
ttgttggcctggctg

SEQ ID NO: 43119 - DNA, 15 bp, Homo sapiens
tttgttggcctggct

SEQ ID NO: 43120 - DNA, 15 bp, Homo sapiens
ctttgttggcctggc

SEQ ID NO: 43121 - DNA, 15 bp, Homo sapiens
gctttgttggcctgg

SEQ ID NO: 43122 - DNA, 15 bp, Homo sapiens
cgctttgttggcctg

SEQ ID NO: 43123 - DNA, 15 bp, Homo sapiens
tcgctttgttggcct

SEQ ID NO: 43124 - DNA, 15 bp, Homo sapiens
ctcgctttgttggcc

SEQ ID NO: 43125 - DNA, 15 bp, Homo sapiens
tctcgctttgttggc

SEQ ID NO: 43126 - DNA, 15 bp, Homo sapiens
gtctcgctttgttgg

SEQ ID NO: 43127 - DNA, 15 bp, Homo sapiens
ggtctcgctttgttg

SEQ ID NO: 43128 - DNA, 15 bp, Homo sapiens
gggtctcgctttgtt

SEQ ID NO: 43129 - DNA, 15 bp, Homo sapiens
ggggtctcgctttgt

SEQ ID NO: 43130 - DNA, 15 bp, Homo sapiens
tggggtctcgctttg

SEQ ID NO: 43131 - DNA, 15 bp, Homo sapiens
atggggtctcgcttt

SEQ ID NO: 43132 - DNA, 15 bp, Homo sapiens
gatggggtctcgctt

SEQ ID NO: 43133 - DNA, 15 bp, Homo sapiens
agatggggtctcgct

SEQ ID NO: 43134 - DNA, 15 bp, Homo sapiens
gagatggggtctcgc

SEQ ID NO: 43135 - DNA, 15 bp, Homo sapiens
agagatggggtctcg

SEQ ID NO: 43136 - DNA, 15 bp, Homo sapiens
aagagatggggtctc

SEQ ID NO: 43137 - DNA, 15 bp, Homo sapiens
aaagagatggggtct

SEQ ID NO: 43138 - DNA, 15 bp, Homo sapiens
aaaagagatggggtc

SEQ ID NO: 43139 - DNA, 15 bp, Homo sapiens
aaaaagagatggggt

SEQ ID NO: 43140 - DNA, 15 bp, Homo sapiens
aaaaaagagatgggg

SEQ ID NO: 43141 - DNA, 15 bp, Homo sapiens
aaaaaaagagatggg

SEQ ID NO: 43142 - DNA, 15 bp, Homo sapiens
aaaaaaaagagatgg

SEQ ID NO: 43143 - DNA, 15 bp, Homo sapiens
aaaaaaaaagagatg

SEQ ID NO: 43144 - DNA, 15 bp, Homo sapiens
aaaaaaaaaagagat

SEQ ID NO: 43145 - DNA, 15 bp, Homo sapiens
ataaaaaaaaaaaaa

SEQ ID NO: 43146 - DNA, 15 bp, Homo sapiens
gataaaaaaaaaaaa

SEQ ID NO: 43147 - DNA, 15 bp, Homo sapiens
tgataaaaaaaaaaa

SEQ ID NO: 43148 - DNA, 15 bp, Homo sapiens
ttgataaaaaaaaaa

SEQ ID NO: 43149 - DNA, 15 bp, Homo sapiens
tttgataaaaaaaaa

SEQ ID NO: 43150 - DNA, 15 bp, Homo sapiens
ttttgataaaaaaaa

SEQ ID NO: 43151 - DNA, 15 bp, Homo sapiens
gttttgataaaaaaa

SEQ ID NO: 43152 - DNA, 15 bp, Homo sapiens
ggttttgataaaaaa

SEQ ID NO: 43153 - DNA, 15 bp, Homo sapiens
gggttttgataaaaa

SEQ ID NO: 43154 - DNA, 15 bp, Homo sapiens
tgggttttgataaaa

SEQ ID NO: 43155 - DNA, 15 bp, Homo sapiens
atgggttttgataaa

SEQ ID NO: 43156 - DNA, 15 bp, Homo sapiens
tatgggttttgataa

SEQ ID NO: 43157 - DNA, 15 bp, Homo sapiens
gtatgggttttgata

SEQ ID NO: 43158 - DNA, 15 bp, Homo sapiens
cgtatgggttttgat

SEQ ID NO: 43159 - DNA, 15 bp, Homo sapiens
tcgtatgggttttga

SEQ ID NO: 43160 - DNA, 15 bp, Homo sapiens
atcgtatgggttttg

SEQ ID NO: 43161 - DNA, 15 bp, Homo sapiens
aatcgtatgggtttt

SEQ ID NO: 43162 - DNA, 15 bp, Homo sapiens
caatcgtatgggttt

SEQ ID NO: 43163 - DNA, 15 bp, Homo sapiens
tcaatcgtatgggtt

SEQ ID NO: 43164 - DNA, 15 bp, Homo sapiens
ctcaatcgtatgggt

SEQ ID NO: 43165 - DNA, 15 bp, Homo sapiens
actcaatcgtatggg

SEQ ID NO: 43166 - DNA, 15 bp, Homo sapiens
cactcaatcgtatgg

SEQ ID NO: 43167 - DNA, 15 bp, Homo sapiens
tcactcaatcgtatg

SEQ ID NO: 43168 - DNA, 15 bp, Homo sapiens
gtcactcaatcgtat

SEQ ID NO: 43169 - DNA, 15 bp, Homo sapiens
tgtcactcaatcgta

SEQ ID NO: 43170 - DNA, 15 bp, Homo sapiens
ttgtcactcaatcgt

SEQ ID NO: 43171 - DNA, 15 bp, Homo sapiens
cttgtcactcaatcg

SEQ ID NO: 43172 - DNA, 15 bp, Homo sapiens
ccttgtcactcaatc

SEQ ID NO: 43173 - DNA, 15 bp, Homo sapiens
tccttgtcactcaat

SEQ ID NO: 43174 - DNA, 15 bp, Homo sapiens
gtccttgtcactcaa

SEQ ID NO: 43175 - DNA, 15 bp, Homo sapiens
ggtccttgtcactca

SEQ ID NO: 43176 - DNA, 15 bp, Homo sapiens
aggtccttgtcactc

SEQ ID NO: 43177 - DNA, 15 bp, Homo sapiens
caggtccttgtcact

SEQ ID NO: 43178 - DNA, 15 bp, Homo sapiens
tcaggtccttgtcac

SEQ ID NO: 43179 - DNA, 15 bp, Homo sapiens
ctcaggtccttgtca

SEQ ID NO: 43180 - DNA, 15 bp, Homo sapiens
cctcaggtccttgtc

SEQ ID NO: 43181 - DNA, 15 bp, Homo sapiens
tcctcaggtccttgt

SEQ ID NO: 43182 - DNA, 15 bp, Homo sapiens
gtcctcaggtccttg

SEQ ID NO: 43183 - DNA, 15 bp, Homo sapiens
agtcctcaggtcctt

SEQ ID NO: 43184 - DNA, 15 bp, Homo sapiens
cagtcctcaggtcct

SEQ ID NO: 43185 - DNA, 15 bp, Homo sapiens
gcagtcctcaggtcc

SEQ ID NO: 43186 - DNA, 15 bp, Homo sapiens
tgcagtcctcaggtc

SEQ ID NO: 43187 - DNA, 15 bp, Homo sapiens
ctgcagtcctcaggt

SEQ ID NO: 43188 - DNA, 15 bp, Homo sapiens
gctgcagtcctcagg

SEQ ID NO: 43189 - DNA, 15 bp, Homo sapiens
agctgcagtcctcag

SEQ ID NO: 43190 - DNA, 15 bp, Homo sapiens
cagctgcagtcctca

SEQ ID NO: 43191 - DNA, 15 bp, Homo sapiens
gcagctgcagtcctc

SEQ ID NO: 43192 - DNA, 15 bp, Homo sapiens
tgcagctgcagtcct

SEQ ID NO: 43193 - DNA, 15 bp, Homo sapiens
ctgcagctgcagtcc

SEQ ID NO: 43194 - DNA, 15 bp, Homo sapiens
cctgcagctgcagtc

SEQ ID NO: 43195 - DNA, 15 bp, Homo sapiens
acctgcagctgcagt

SEQ ID NO: 43196 - DNA, 15 bp, Homo sapiens
cacctgcagctgcag

SEQ ID NO: 43197 - DNA, 15 bp, Homo sapiens
acacctgcagctgca

SEQ ID NO: 43198 - DNA, 15 bp, Homo sapiens
cacacctgcagctgc

SEQ ID NO: 43199 - DNA, 15 bp, Homo sapiens
ccacacctgcagctg

SEQ ID NO: 43200 - DNA, 15 bp, Homo sapiens
gccacacctgcagct

SEQ ID NO: 43201 - DNA, 15 bp, Homo sapiens
ggccacacctgcagc

SEQ ID NO: 43202 - DNA, 15 bp, Homo sapiens
tggccacacctgcag

SEQ ID NO: 43203 - DNA, 15 bp, Homo sapiens
gtggccacacctgca

SEQ ID NO: 43204 - DNA, 15 bp, Homo sapiens
ggtggccacacctgc

SEQ ID NO: 43205 - DNA, 15 bp, Homo sapiens
aggtggccacacctg

SEQ ID NO: 43206 - DNA, 15 bp, Homo sapiens
caggtggccacacct

SEQ ID NO: 43207 - DNA, 15 bp, Homo sapiens
ccaggtggccacacc

SEQ ID NO: 43208 - DNA, 15 bp, Homo sapiens
accaggtggccacac

SEQ ID NO: 43209 - DNA, 15 bp, Homo sapiens
taccaggtggccaca

SEQ ID NO: 43210 - DNA, 15 bp, Homo sapiens
ctaccaggtggccac

SEQ ID NO: 43211 - DNA, 15 bp, Homo sapiens
gctaccaggtggcca

SEQ ID NO: 43212 - DNA, 15 bp, Homo sapiens
ggctaccaggtggcc

SEQ ID NO: 43213 - DNA, 15 bp, Homo sapiens
tggctaccaggtggc

SEQ ID NO: 43214 - DNA, 15 bp, Homo sapiens
atggctaccaggtgg

SEQ ID NO: 43215 - DNA, 15 bp, Homo sapiens
tatggctaccaggtg

SEQ ID NO: 43216 - DNA, 15 bp, Homo sapiens
gtatggctaccaggt

SEQ ID NO: 43217 - DNA, 15 bp, Homo sapiens
agtatggctaccagg

SEQ ID NO: 43218 - DNA, 15 bp, Homo sapiens
cagtatggctaccag

SEQ ID NO: 43219 - DNA, 15 bp, Homo sapiens
tcagtatggctacca

SEQ ID NO: 43220 - DNA, 15 bp, Homo sapiens
gtcagtatggctacc

SEQ ID NO: 43221 - DNA, 15 bp, Homo sapiens
tgtcagtatggctac

SEQ ID NO: 43222 - DNA, 15 bp, Homo sapiens
ctgtcagtatggcta

SEQ ID NO: 43223 - DNA, 15 bp, Homo sapiens
actgtcagtatggct

SEQ ID NO: 43224 - DNA, 15 bp, Homo sapiens
tactgtcagtatggc

SEQ ID NO: 43225 - DNA, 15 bp, Homo sapiens
atactgtcagtatgg

SEQ ID NO: 43226 - DNA, 15 bp, Homo sapiens
aatactgtcagtatg

SEQ ID NO: 43227 - DNA, 15 bp, Homo sapiens
aaatactgtcagtat

SEQ ID NO: 43228 - DNA, 15 bp, Homo sapiens
taaatactgtcagta

SEQ ID NO: 43229 - DNA, 15 bp, Homo sapiens
ataaatactgtcagt

SEQ ID NO: 43230 - DNA, 15 bp, Homo sapiens
gataaatactgtcag

SEQ ID NO: 43231 - DNA, 15 bp, Homo sapiens
ggataaatactgtca

SEQ ID NO: 43232 - DNA, 15 bp, Homo sapiens
gggataaatactgtc

SEQ ID NO: 43233 - DNA, 15 bp, Homo sapiens
tgggataaatactgt

SEQ ID NO: 43234 - DNA, 15 bp, Homo sapiens
gtgggataaatactg

SEQ ID NO: 43235 - DNA, 15 bp, Homo sapiens
tgtgggataaatact

SEQ ID NO: 43236 - DNA, 15 bp, Homo sapiens
ctgtgggataaatac

SEQ ID NO: 43237 - DNA, 15 bp, Homo sapiens
tctgtgggataaata

SEQ ID NO: 43238 - DNA, 15 bp, Homo sapiens
ttctgtgggataaat

SEQ ID NO: 43239 - DNA, 15 bp, Homo sapiens
tttctgtgggataaa

SEQ ID NO: 43240 - DNA, 15 bp, Homo sapiens
ctttctgtgggataa

SEQ ID NO: 43241 - DNA, 15 bp, Homo sapiens
tctttctgtgggata

SEQ ID NO: 43242 - DNA, 15 bp, Homo sapiens
gtctttctgtgggat

SEQ ID NO: 43243 - DNA, 15 bp, Homo sapiens
ggtctttctgtggga

SEQ ID NO: 43244 - DNA, 15 bp, Homo sapiens
aggtctttctgtggg

SEQ ID NO: 43245 - DNA, 15 bp, Homo sapiens
caggtctttctgtgg

SEQ ID NO: 43246 - DNA, 15 bp, Homo sapiens
ccaggtctttctgtg

SEQ ID NO: 43247 - DNA, 15 bp, Homo sapiens
accaggtctttctgt

SEQ ID NO: 43248 - DNA, 15 bp, Homo sapiens
caccaggtctttctg

SEQ ID NO: 43249 - DNA, 15 bp, Homo sapiens
ccaccaggtctttct

SEQ ID NO: 43250 - DNA, 15 bp, Homo sapiens
tccaccaggtctttc

SEQ ID NO: 43251 - DNA, 15 bp, Homo sapiens
ttccaccaggtcttt

SEQ ID NO: 43252 - DNA, 15 bp, Homo sapiens
cttccaccaggtctt

SEQ ID NO: 43253 - DNA, 15 bp, Homo sapiens
tcttccaccaggtct

SEQ ID NO: 43254 - DNA, 15 bp, Homo sapiens
ctcttccaccaggtc

SEQ ID NO: 43255 - DNA, 15 bp, Homo sapiens
cctcttccaccaggt

SEQ ID NO: 43256 - DNA, 15 bp, Homo sapiens
tcctcttccaccagg

SEQ ID NO: 43257 - DNA, 15 bp, Homo sapiens
ctcctcttccaccag

SEQ ID NO: 43258 - DNA, 15 bp, Homo sapiens
cctcctcttccacca

SEQ ID NO: 43259 - DNA, 15 bp, Homo sapiens
gcctcctcttccacc

SEQ ID NO: 43260 - DNA, 15 bp, Homo sapiens
agcctcctcttccac

SEQ ID NO: 43261 - DNA, 15 bp, Homo sapiens
cagcctcctcttcca

SEQ ID NO: 43262 - DNA, 15 bp, Homo sapiens
tcagcctcctcttcc

SEQ ID NO: 43263 - DNA, 15 bp, Homo sapiens
ctcagcctcctcttc

SEQ ID NO: 43264 - DNA, 15 bp, Homo sapiens
cctcagcctcctctt

SEQ ID NO: 43265 - DNA, 15 bp, Homo sapiens
tcctcagcctcctct

SEQ ID NO: 43266 - DNA, 15 bp, Homo sapiens
ctcctcagcctcctc

SEQ ID NO: 43267 - DNA, 15 bp, Homo sapiens
cctcctcagcctcct

SEQ ID NO: 43268 - DNA, 15 bp, Homo sapiens
gcctcctcagcctcc

SEQ ID NO: 43269 - DNA, 15 bp, Homo sapiens
agcctcctcagcctc

SEQ ID NO: 43270 - DNA, 15 bp, Homo sapiens
cagcctcctcagcct

SEQ ID NO: 43271 - DNA, 15 bp, Homo sapiens
ccagcctcctcagcc

SEQ ID NO: 43272 - DNA, 15 bp, Homo sapiens
tccagcctcctcagc

SEQ ID NO: 43273 - DNA, 15 bp, Homo sapiens
ctccagcctcctcag

SEQ ID NO: 43274 - DNA, 15 bp, Homo sapiens
actccagcctcctca

SEQ ID NO: 43275 - DNA, 15 bp, Homo sapiens
cactccagcctcctc

SEQ ID NO: 43276 - DNA, 15 bp, Homo sapiens
ccactccagcctcct

SEQ ID NO: 43277 - DNA, 15 bp, Homo sapiens
gccactccagcctcc

SEQ ID NO: 43278 - DNA, 15 bp, Homo sapiens
agccactccagcctc

SEQ ID NO: 43279 - DNA, 15 bp, Homo sapiens
aagccactccagcct

SEQ ID NO: 43280 - DNA, 15 bp, Homo sapiens
aaagccactccagcc

SEQ ID NO: 43281 - DNA, 15 bp, Homo sapiens
caaagccactccagc

SEQ ID NO: 43282 - DNA, 15 bp, Homo sapiens
tcaaagccactccag

SEQ ID NO: 43283 - DNA, 15 bp, Homo sapiens
ctcaaagccactcca

SEQ ID NO: 43284 - DNA, 15 bp, Homo sapiens
tctcaaagccactcc

SEQ ID NO: 43285 - DNA, 15 bp, Homo sapiens
ttctcaaagccactc

SEQ ID NO: 43286 - DNA, 15 bp, Homo sapiens
cttctcaaagccact

SEQ ID NO: 43287 - DNA, 15 bp, Homo sapiens
gcttctcaaagccac

SEQ ID NO: 43288 - DNA, 15 bp, Homo sapiens
tgcttctcaaagcca

SEQ ID NO: 43289 - DNA, 15 bp, Homo sapiens
gtgcttctcaaagcc

SEQ ID NO: 43290 - DNA, 15 bp, Homo sapiens
ggtgcttctcaaagc

SEQ ID NO: 43291 - DNA, 15 bp, Homo sapiens
gggtgcttctcaaag

SEQ ID NO: 43292 - DNA, 15 bp, Homo sapiens
tgggtgcttctcaaa

SEQ ID NO: 43293 - DNA, 15 bp, Homo sapiens
ctgggtgcttctcaa

SEQ ID NO: 43294 - DNA, 15 bp, Homo sapiens
tctgggtgcttctca

SEQ ID NO: 43295 - DNA, 15 bp, Homo sapiens
ctctgggtgcttctc

SEQ ID NO: 43296 - DNA, 15 bp, Homo sapiens
gctctgggtgcttct

SEQ ID NO: 43297 - DNA, 15 bp, Homo sapiens
tgctctgggtgcttc

SEQ ID NO: 43298 - DNA, 15 bp, Homo sapiens
gtgctctgggtgctt

SEQ ID NO: 43299 - DNA, 15 bp, Homo sapiens
tgtgctctgggtgct

SEQ ID NO: 43300 - DNA, 15 bp, Homo sapiens
gtgtgctctgggtgc

SEQ ID NO: 43301 - DNA, 15 bp, Homo sapiens
agtgtgctctgggtg

SEQ ID NO: 43302 - DNA, 15 bp, Homo sapiens
cagtgtgctctgggt

SEQ ID NO: 43303 - DNA, 15 bp, Homo sapiens
gcagtgtgctctggg

SEQ ID NO: 43304 - DNA, 15 bp, Homo sapiens
tgcagtgtgctctgg

SEQ ID NO: 43305 - DNA, 15 bp, Homo sapiens
ttgcagtgtgctctg

SEQ ID NO: 43306 - DNA, 15 bp, Homo sapiens
cttgcagtgtgctct

SEQ ID NO: 43307 - DNA, 15 bp, Homo sapiens
gcttgcagtgtgctc

SEQ ID NO: 43308 - DNA, 15 bp, Homo sapiens
tgcttgcagtgtgct

SEQ ID NO: 43309 - DNA, 15 bp, Homo sapiens
ctgcttgcagtgtgc

SEQ ID NO: 43310 - DNA, 15 bp, Homo sapiens
cctgcttgcagtgtg

SEQ ID NO: 43311 - DNA, 15 bp, Homo sapiens
acctgcttgcagtgt

SEQ ID NO: 43312 - DNA, 15 bp, Homo sapiens
gacctgcttgcagtg

SEQ ID NO: 43313 - DNA, 15 bp, Homo sapiens
agacctgcttgcagt

SEQ ID NO: 43314 - DNA, 15 bp, Homo sapiens
cagacctgcttgcag

SEQ ID NO: 43315 - DNA, 15 bp, Homo sapiens
ccagacctgcttgca

SEQ ID NO: 43316 - DNA, 15 bp, Homo sapiens
gccagacctgcttgc

SEQ ID NO: 43317 - DNA, 15 bp, Homo sapiens
agccagacctgcttg

SEQ ID NO: 43318 - DNA, 15 bp, Homo sapiens
cagccagacctgctt

SEQ ID NO: 43319 - DNA, 15 bp, Homo sapiens
gcagccagacctgct

SEQ ID NO: 43320 - DNA, 15 bp, Homo sapiens
tgcagccagacctgc

SEQ ID NO: 43321 - DNA, 15 bp, Homo sapiens
ctgcagccagacctg

SEQ ID NO: 43322 - DNA, 15 bp, Homo sapiens
tctgcagccagacct

SEQ ID NO: 43323 - DNA, 15 bp, Homo sapiens
atctgcagccagacc

SEQ ID NO: 43324 - DNA, 15 bp, Homo sapiens
catctgcagccagac

SEQ ID NO: 43325 - DNA, 15 bp, Homo sapiens
gcatctgcagccaga

SEQ ID NO: 43326 - DNA, 15 bp, Homo sapiens
ggcatctgcagccag

SEQ ID NO: 43327 - DNA, 15 bp, Homo sapiens
aggcatctgcagcca

SEQ ID NO: 43328 - DNA, 15 bp, Homo sapiens
caggcatctgcagcc

SEQ ID NO: 43329 - DNA, 15 bp, Homo sapiens
ccaggcatctgcagc

SEQ ID NO: 43330 - DNA, 15 bp, Homo sapiens
cccaggcatctgcag

SEQ ID NO: 43331 - DNA, 15 bp, Homo sapiens
gcccaggcatctgca

SEQ ID NO: 43332 - DNA, 15 bp, Homo sapiens
agcccaggcatctgc

SEQ ID NO: 43333 - DNA, 15 bp, Homo sapiens
cagcccaggcatctg

SEQ ID NO: 43334 - DNA, 15 bp, Homo sapiens
gcagcccaggcatct

SEQ ID NO: 43335 - DNA, 15 bp, Homo sapiens
agcagcccaggcatc

SEQ ID NO: 43336 - DNA, 15 bp, Homo sapiens
gagcagcccaggcat

SEQ ID NO: 43337 - DNA, 15 bp, Homo sapiens
ggagcagcccaggca

SEQ ID NO: 43338 - DNA, 15 bp, Homo sapiens
gggagcagcccaggc

SEQ ID NO: 43339 - DNA, 15 bp, Homo sapiens
tgggagcagcccagg

SEQ ID NO: 43340 - DNA, 15 bp, Homo sapiens
atgggagcagcccag

SEQ ID NO: 43341 - DNA, 15 bp, Homo sapiens
gatgggagcagccca

SEQ ID NO: 43342 - DNA, 15 bp, Homo sapiens
cgatgggagcagccc

SEQ ID NO: 43343 - DNA, 15 bp, Homo sapiens
gcgatgggagcagcc

SEQ ID NO: 43344 - DNA, 15 bp, Homo sapiens
ggcgatgggagcagc

SEQ ID NO: 43345 - DNA, 15 bp, Homo sapiens
tggcgatgggagcag

SEQ ID NO: 43346 - DNA, 15 bp, Homo sapiens
atggcgatgggagca

SEQ ID NO: 43347 - DNA, 15 bp, Homo sapiens
catggcgatgggagc

SEQ ID NO: 43348 - DNA, 15 bp, Homo sapiens
gcatggcgatgggag

SEQ ID NO: 43349 - DNA, 15 bp, Homo sapiens
tgcatggcgatggga

SEQ ID NO: 43350 - DNA, 15 bp, Homo sapiens
ctgcatggcgatggg

SEQ ID NO: 43351 - DNA, 15 bp, Homo sapiens
tctgcatggcgatgg

SEQ ID NO: 43352 - DNA, 15 bp, Homo sapiens
atctgcatggcgatg

SEQ ID NO: 43353 - DNA, 15 bp, Homo sapiens
gatctgcatggcgat

SEQ ID NO: 43354 - DNA, 15 bp, Homo sapiens
agatctgcatggcga

SEQ ID NO: 43355 - DNA, 15 bp, Homo sapiens
tagatctgcatggcg

SEQ ID NO: 43356 - DNA, 15 bp, Homo sapiens
gtagatctgcatggc

SEQ ID NO: 43357 - DNA, 15 bp, Homo sapiens
tgtagatctgcatgg

SEQ ID NO: 43358 - DNA, 15 bp, Homo sapiens
ttgtagatctgcatg

SEQ ID NO: 43359 - DNA, 15 bp, Homo sapiens
cttgtagatctgcat

SEQ ID NO: 43360 - DNA, 15 bp, Homo sapiens
tcttgtagatctgca

SEQ ID NO: 43361 - DNA, 15 bp, Homo sapiens
ttcttgtagatctgc

SEQ ID NO: 43362 - DNA, 15 bp, Homo sapiens
cttcttgtagatctg

SEQ ID NO: 43363 - DNA, 15 bp, Homo sapiens
gcttcttgtagatct

SEQ ID NO: 43364 - DNA, 15 bp, Homo sapiens
tgcttcttgtagatc

SEQ ID NO: 43365 - DNA, 15 bp, Homo sapiens
gtgcttcttgtagat

SEQ ID NO: 43366 - DNA, 15 bp, Homo sapiens
ggtgcttcttgtaga

SEQ ID NO: 43367 - DNA, 15 bp, Homo sapiens
aggtgcttcttgtag

SEQ ID NO: 43368 - DNA, 15 bp, Homo sapiens
caggtgcttcttgta

SEQ ID NO: 43369 - DNA, 15 bp, Homo sapiens
ccaggtgcttcttgt

SEQ ID NO: 43370 - DNA, 15 bp, Homo sapiens
tccaggtgcttcttg

SEQ ID NO: 43371 - DNA, 15 bp, Homo sapiens
gtccaggtgcttctt

SEQ ID NO: 43372 - DNA, 15 bp, Homo sapiens
ggtccaggtgcttct

SEQ ID NO: 43373 - DNA, 15 bp, Homo sapiens
gggtccaggtgcttc

SEQ ID NO: 43374 - DNA, 15 bp, Homo sapiens
ggggtccaggtgctt

SEQ ID NO: 43375 - DNA, 15 bp, Homo sapiens
tggggtccaggtgct

SEQ ID NO: 43376 - DNA, 15 bp, Homo sapiens
ctggggtccaggtgc

SEQ ID NO: 43377 - DNA, 15 bp, Homo sapiens
cctggggtccaggtg

SEQ ID NO: 43378 - DNA, 15 bp, Homo sapiens
gcctggggtccaggt

SEQ ID NO: 43379 - DNA, 15 bp, Homo sapiens
ggcctggggtccagg

SEQ ID NO: 43380 - DNA, 15 bp, Homo sapiens
gggcctggggtccag

SEQ ID NO: 43381 - DNA, 15 bp, Homo sapiens
cgggcctggggtcca

SEQ ID NO: 43382 - DNA, 15 bp, Homo sapiens
ccgggcctggggtcc

SEQ ID NO: 43383 - DNA, 15 bp, Homo sapiens
cccgggcctggggtc

SEQ ID NO: 43384 - DNA, 15 bp, Homo sapiens
gcccgggcctggggt

SEQ ID NO: 43385 - DNA, 15 bp, Homo sapiens
ggcccgggcctgggg

SEQ ID NO: 43386 - DNA, 15 bp, Homo sapiens
gggcccgggcctggg

SEQ ID NO: 43387 - DNA, 15 bp, Homo sapiens
agggcccgggcctgg

SEQ ID NO: 43388 - DNA, 15 bp, Homo sapiens
cagggcccgggcctg

SEQ ID NO: 43389 - DNA, 15 bp, Homo sapiens
gcagggcccgggcct

SEQ ID NO: 43390 - DNA, 15 bp, Homo sapiens
ggcagggcccgggcc

SEQ ID NO: 43391 - DNA, 15 bp, Homo sapiens
gggcagggcccgggc

SEQ ID NO: 43392 - DNA, 15 bp, Homo sapiens
tgggcagggcccggg

SEQ ID NO: 43393 - DNA, 15 bp, Homo sapiens
gtgggcagggcccgg

SEQ ID NO: 43394 - DNA, 15 bp, Homo sapiens
ggtgggcagggcccg

SEQ ID NO: 43395 - DNA, 15 bp, Homo sapiens
aggtgggcagggccc

SEQ ID NO: 43396 - DNA, 15 bp, Homo sapiens
caggtgggcagggcc

SEQ ID NO: 43397 - DNA, 15 bp, Homo sapiens
tcaggtgggcagggc

SEQ ID NO: 43398 - DNA, 15 bp, Homo sapiens
ctcaggtgggcaggg

SEQ ID NO: 43399 - DNA, 15 bp, Homo sapiens
gctcaggtgggcagg

SEQ ID NO: 43400 - DNA, 15 bp, Homo sapiens
agctcaggtgggcag

SEQ ID NO: 43401 - DNA, 15 bp, Homo sapiens
cagctcaggtgggca

SEQ ID NO: 43402 - DNA, 15 bp, Homo sapiens
ccagctcaggtgggc

SEQ ID NO: 43403 - DNA, 15 bp, Homo sapiens
cccagctcaggtggg

SEQ ID NO: 43404 - DNA, 15 bp, Homo sapiens
gcccagctcaggtgg

SEQ ID NO: 43405 - DNA, 15 bp, Homo sapiens
ggcccagctcaggtg

SEQ ID NO: 43406 - DNA, 15 bp, Homo sapiens
aggcccagctcaggt

SEQ ID NO: 43407 - DNA, 15 bp, Homo sapiens
caggcccagctcagg

SEQ ID NO: 43408 - DNA, 15 bp, Homo sapiens
ccaggcccagctcag

SEQ ID NO: 43409 - DNA, 15 bp, Homo sapiens
cccaggcccagctca

SEQ ID NO: 43410 - DNA, 15 bp, Homo sapiens
gcccaggcccagctc

SEQ ID NO: 43411 - DNA, 15 bp, Homo sapiens
ggcccaggcccagct

SEQ ID NO: 43412 - DNA, 15 bp, Homo sapiens
aggcccaggcccagc

SEQ ID NO: 43413 - DNA, 15 bp, Homo sapiens
caggcccaggcccag

SEQ ID NO: 43414 - DNA, 15 bp, Homo sapiens
ccaggcccaggccca

SEQ ID NO: 43415 - DNA, 15 bp, Homo sapiens
cccaggcccaggccc

SEQ ID NO: 43416 - DNA, 15 bp, Homo sapiens
gcccaggcccaggcc

SEQ ID NO: 43417 - DNA, 15 bp, Homo sapiens
ggcccaggcccaggc

SEQ ID NO: 43418 - DNA, 15 bp, Homo sapiens
tggcccaggcccagg

SEQ ID NO: 43419 - DNA, 15 bp, Homo sapiens
ctggcccaggcccag

SEQ ID NO: 43420 - DNA, 15 bp, Homo sapiens
gctggcccaggccca

SEQ ID NO: 43421 - DNA, 15 bp, Homo sapiens
agctggcccaggccc

SEQ ID NO: 43422 - DNA, 15 bp, Homo sapiens
cagctggcccaggcc

SEQ ID NO: 43423 - DNA, 15 bp, Homo sapiens
ccagctggcccaggc

SEQ ID NO: 43424 - DNA, 15 bp, Homo sapiens
gccagctggcccagg

SEQ ID NO: 43425 - DNA, 15 bp, Homo sapiens
ggccagctggcccag

SEQ ID NO: 43426 - DNA, 15 bp, Homo sapiens
aggccagctggccca

SEQ ID NO: 43427 - DNA, 15 bp, Homo sapiens
caggccagctggccc

SEQ ID NO: 43428 - DNA, 15 bp, Homo sapiens
gcaggccagctggcc

SEQ ID NO: 43429 - DNA, 15 bp, Homo sapiens
agcaggccagctggc

SEQ ID NO: 43430 - DNA, 15 bp, Homo sapiens
cagcaggccagctgg

SEQ ID NO: 43431 - DNA, 15 bp, Homo sapiens
gcagcaggccagctg

SEQ ID NO: 43432 - DNA, 15 bp, Homo sapiens
agcagcaggccagct

SEQ ID NO: 43433 - DNA, 15 bp, Homo sapiens
cagcagcaggccagc

SEQ ID NO: 43434 - DNA, 15 bp, Homo sapiens
gcagcagcaggccag

SEQ ID NO: 43435 - DNA, 15 bp, Homo sapiens
ggcagcagcaggcca

SEQ ID NO: 43436 - DNA, 15 bp, Homo sapiens
aggcagcagcaggcc

SEQ ID NO: 43437 - DNA, 15 bp, Homo sapiens
caggcagcagcaggc

SEQ ID NO: 43438 - DNA, 15 bp, Homo sapiens
gcaggcagcagcagg

SEQ ID NO: 43439 - DNA, 15 bp, Homo sapiens
tgcaggcagcagcag

SEQ ID NO: 43440 - DNA, 15 bp, Homo sapiens
gtgcaggcagcagca

SEQ ID NO: 43441 - DNA, 15 bp, Homo sapiens
ggtgcaggcagcagc

SEQ ID NO: 43442 - DNA, 15 bp, Homo sapiens
cggtgcaggcagcag

SEQ ID NO: 43443 - DNA, 15 bp, Homo sapiens
gcggtgcaggcagca

SEQ ID NO: 43444 - DNA, 15 bp, Homo sapiens
ggcggtgcaggcagc

SEQ ID NO: 43445 - DNA, 15 bp, Homo sapiens
cggcggtgcaggcag

SEQ ID NO: 43446 - DNA, 15 bp, Homo sapiens
ccggcggtgcaggca

SEQ ID NO: 43447 - DNA, 15 bp, Homo sapiens
cccggcggtgcaggc

SEQ ID NO: 43448 - DNA, 15 bp, Homo sapiens
gcccggcggtgcagg

SEQ ID NO: 43449 - DNA, 15 bp, Homo sapiens
ggcccggcggtgcag

SEQ ID NO: 43450 - DNA, 15 bp, Homo sapiens
tggcccggcggtgca

SEQ ID NO: 43451 - DNA, 15 bp, Homo sapiens
ttggcccggcggtgc

SEQ ID NO: 43452 - DNA, 15 bp, Homo sapiens
tttggcccggcggtg

SEQ ID NO: 43453 - DNA, 15 bp, Homo sapiens
ttttggcccggcggt

SEQ ID NO: 43454 - DNA, 15 bp, Homo sapiens
cttttggcccggcgg

SEQ ID NO: 43455 - DNA, 15 bp, Homo sapiens
ccttttggcccggcg

SEQ ID NO: 43456 - DNA, 15 bp, Homo sapiens
tccttttggcccggc

SEQ ID NO: 43457 - DNA, 15 bp, Homo sapiens
ctccttttggcccgg

SEQ ID NO: 43458 - DNA, 15 bp, Homo sapiens
cctccttttggcccg

SEQ ID NO: 43459 - DNA, 15 bp, Homo sapiens
gcctccttttggccc

SEQ ID NO: 43460 - DNA, 15 bp, Homo sapiens
ggcctccttttggcc

SEQ ID NO: 43461 - DNA, 15 bp, Homo sapiens
aggcctccttttggc

SEQ ID NO: 43462 - DNA, 15 bp, Homo sapiens
gaggcctccttttgg

SEQ ID NO: 43463 - DNA, 15 bp, Homo sapiens
ggaggcctccttttg

SEQ ID NO: 43464 - DNA, 15 bp, Homo sapiens
aggaggcctcctttt

SEQ ID NO: 43465 - DNA, 15 bp, Homo sapiens
taggaggcctccttt

SEQ ID NO: 43466 - DNA, 15 bp, Homo sapiens
ataggaggcctcctt

SEQ ID NO: 43467 - DNA, 15 bp, Homo sapiens
cataggaggcctcct

SEQ ID NO: 43468 - DNA, 15 bp, Homo sapiens
tcataggaggcctcc

SEQ ID NO: 43469 - DNA, 15 bp, Homo sapiens
gtcataggaggcctc

SEQ ID NO: 43470 - DNA, 15 bp, Homo sapiens
ggtcataggaggcct

SEQ ID NO: 43471 - DNA, 15 bp, Homo sapiens
gggtcataggaggcc

SEQ ID NO: 43472 - DNA, 15 bp, Homo sapiens
tgggtcataggaggc

SEQ ID NO: 43473 - DNA, 15 bp, Homo sapiens
ctgggtcataggagg

SEQ ID NO: 43474 - DNA, 15 bp, Homo sapiens
cctgggtcataggag

SEQ ID NO: 43475 - DNA, 15 bp, Homo sapiens
acctgggtcatagga

SEQ ID NO: 43476 - DNA, 15 bp, Homo sapiens
tacctgggtcatagg

SEQ ID NO: 43477 - DNA, 15 bp, Homo sapiens
ctacctgggtcatag

SEQ ID NO: 43478 - DNA, 15 bp, Homo sapiens
gctacctgggtcata

SEQ ID NO: 43479 - DNA, 15 bp, Homo sapiens
ggctacctgggtcat

SEQ ID NO: 43480 - DNA, 15 bp, Homo sapiens
tggctacctgggtca

SEQ ID NO: 43481 - DNA, 15 bp, Homo sapiens
ctggctacctgggtc

SEQ ID NO: 43482 - DNA, 15 bp, Homo sapiens
gctggctacctgggt

SEQ ID NO: 43483 - DNA, 15 bp, Homo sapiens
agctggctacctggg

SEQ ID NO: 43484 - DNA, 15 bp, Homo sapiens
cagctggctacctgg

SEQ ID NO: 43485 - DNA, 15 bp, Homo sapiens
gcagctggctacctg

SEQ ID NO: 43486 - DNA, 15 bp, Homo sapiens
cgcagctggctacct

SEQ ID NO: 43487 - DNA, 15 bp, Homo sapiens
gcgcagctggctacc

SEQ ID NO: 43488 - DNA, 15 bp, Homo sapiens
tgcgcagctggctac

SEQ ID NO: 43489 - DNA, 15 bp, Homo sapiens
gtgcgcagctggcta

SEQ ID NO: 43490 - DNA, 15 bp, Homo sapiens
agtgcgcagctggct

SEQ ID NO: 43491 - DNA, 15 bp, Homo sapiens
cagtgcgcagctggc

SEQ ID NO: 43492 - DNA, 15 bp, Homo sapiens
ccagtgcgcagctgg

SEQ ID NO: 43493 - DNA, 15 bp, Homo sapiens
cccagtgcgcagctg

SEQ ID NO: 43494 - DNA, 15 bp, Homo sapiens
tcccagtgcgcagct

SEQ ID NO: 43495 - DNA, 15 bp, Homo sapiens
gtcccagtgcgcagc

SEQ ID NO: 43496 - DNA, 15 bp, Homo sapiens
cgtcccagtgcgcag

SEQ ID NO: 43497 - DNA, 15 bp, Homo sapiens
ccgtcccagtgcgca

SEQ ID NO: 43498 - DNA, 15 bp, Homo sapiens
cccgtcccagtgcgc

SEQ ID NO: 43499 - DNA, 15 bp, Homo sapiens
ccccgtcccagtgcg

SEQ ID NO: 43500 - DNA, 15 bp, Homo sapiens
accccgtcccagtgc

SEQ ID NO: 43501 - DNA, 15 bp, Homo sapiens
caccccgtcccagtg

SEQ ID NO: 43502 - DNA, 15 bp, Homo sapiens
ccaccccgtcccagt

SEQ ID NO: 43503 - DNA, 15 bp, Homo sapiens
gccaccccgtcccag

SEQ ID NO: 43504 - DNA, 15 bp, Homo sapiens
ggccaccccgtccca

SEQ ID NO: 43505 - DNA, 15 bp, Homo sapiens
tggccaccccgtccc

SEQ ID NO: 43506 - DNA, 15 bp, Homo sapiens
ctggccaccccgtcc

SEQ ID NO: 43507 - DNA, 15 bp, Homo sapiens
tctggccaccccgtc

SEQ ID NO: 43508 - DNA, 15 bp, Homo sapiens
atctggccaccccgt

SEQ ID NO: 43509 - DNA, 15 bp, Homo sapiens
tatctggccaccccg

SEQ ID NO: 43510 - DNA, 15 bp, Homo sapiens
ctatctggccacccc

SEQ ID NO: 43511 - DNA, 15 bp, Homo sapiens
tctatctggccaccc

SEQ ID NO: 43512 - DNA, 15 bp, Homo sapiens
ttctatctggccacc

SEQ ID NO: 43513 - DNA, 15 bp, Homo sapiens
tttctatctggccac

SEQ ID NO: 43514 - DNA, 15 bp, Homo sapiens
ctttctatctggcca

SEQ ID NO: 43515 - DNA, 15 bp, Homo sapiens
gctttctatctggcc

SEQ ID NO: 43516 - DNA, 15 bp, Homo sapiens
ggctttctatctggc

SEQ ID NO: 43517 - DNA, 15 bp, Homo sapiens
gggctttctatctgg

SEQ ID NO: 43518 - DNA, 15 bp, Homo sapiens
cgggctttctatctg

SEQ ID NO: 43519 - DNA, 15 bp, Homo sapiens
gcgggctttctatct

SEQ ID NO: 43520 - DNA, 15 bp, Homo sapiens
tgcgggctttctatc

SEQ ID NO: 43521 - DNA, 15 bp, Homo sapiens
atgcgggctttctat

SEQ ID NO: 43522 - DNA, 15 bp, Homo sapiens
aatgcgggctttcta

SEQ ID NO: 43523 - DNA, 15 bp, Homo sapiens
gaatgcgggctttct

SEQ ID NO: 43524 - DNA, 15 bp, Homo sapiens
ggaatgcgggctttc

SEQ ID NO: 43525 - DNA, 15 bp, Homo sapiens
tggaatgcgggcttt

SEQ ID NO: 43526 - DNA, 15 bp, Homo sapiens
ctggaatgcgggctt

SEQ ID NO: 43527 - DNA, 15 bp, Homo sapiens
cctggaatgcgggct

SEQ ID NO: 43528 - DNA, 15 bp, Homo sapiens
gcctggaatgcgggc

SEQ ID NO: 43529 - DNA, 15 bp, Homo sapiens
ggcctggaatgcggg

SEQ ID NO: 43530 - DNA, 15 bp, Homo sapiens
aggcctggaatgcgg

SEQ ID NO: 43531 - DNA, 15 bp, Homo sapiens
aaggcctggaatgcg

SEQ ID NO: 43532 - DNA, 15 bp, Homo sapiens
caaggcctggaatgc

SEQ ID NO: 43533 - DNA, 15 bp, Homo sapiens
gcaaggcctggaatg

SEQ ID NO: 43534 - DNA, 15 bp, Homo sapiens
agcaaggcctggaat

SEQ ID NO: 43535 - DNA, 15 bp, Homo sapiens
gagcaaggcctggaa

SEQ ID NO: 43536 - DNA, 15 bp, Homo sapiens
agagcaaggcctgga

SEQ ID NO: 43537 - DNA, 15 bp, Homo sapiens
cagagcaaggcctgg

SEQ ID NO: 43538 - DNA, 15 bp, Homo sapiens
acagagcaaggcctg

SEQ ID NO: 43539 - DNA, 15 bp, Homo sapiens
tacagagcaaggcct

SEQ ID NO: 43540 - DNA, 15 bp, Homo sapiens
ctacagagcaaggcc

SEQ ID NO: 43541 - DNA, 15 bp, Homo sapiens
actacagagcaaggc

SEQ ID NO: 43542 - DNA, 15 bp, Homo sapiens
cactacagagcaagg

SEQ ID NO: 43543 - DNA, 15 bp, Homo sapiens
tcactacagagcaag

SEQ ID NO: 43544 - DNA, 15 bp, Homo sapiens
gtcactacagagcaa

SEQ ID NO: 43545 - DNA, 15 bp, Homo sapiens
ggtcactacagagca

SEQ ID NO: 43546 - DNA, 15 bp, Homo sapiens
gggtcactacagagc

SEQ ID NO: 43547 - DNA, 15 bp, Homo sapiens
ggggtcactacagag

SEQ ID NO: 43548 - DNA, 15 bp, Homo sapiens
tggggtcactacaga

SEQ ID NO: 43549 - DNA, 15 bp, Homo sapiens
atggggtcactacag

SEQ ID NO: 43550 - DNA, 15 bp, Homo sapiens
gatggggtcactaca

SEQ ID NO: 43551 - DNA, 15 bp, Homo sapiens
agatggggtcactac

SEQ ID NO: 43552 - DNA, 15 bp, Homo sapiens
gagatggggtcacta

SEQ ID NO: 43553 - DNA, 15 bp, Homo sapiens
tgagatggggtcact

SEQ ID NO: 43554 - DNA, 15 bp, Homo sapiens
ctgagatggggtcac

SEQ ID NO: 43555 - DNA, 15 bp, Homo sapiens
gctgagatggggtca

SEQ ID NO: 43556 - DNA, 15 bp, Homo sapiens
tgctgagatggggtc

SEQ ID NO: 43557 - DNA, 15 bp, Homo sapiens
gtgctgagatggggt

SEQ ID NO: 43558 - DNA, 15 bp, Homo sapiens
ggtgctgagatgggg

SEQ ID NO: 43559 - DNA, 15 bp, Homo sapiens
aggtgctgagatggg

SEQ ID NO: 43560 - DNA, 15 bp, Homo sapiens
caggtgctgagatgg

SEQ ID NO: 43561 - DNA, 15 bp, Homo sapiens
gcaggtgctgagatg

SEQ ID NO: 43562 - DNA, 15 bp, Homo sapiens
agcaggtgctgagat

SEQ ID NO: 43563 - DNA, 15 bp, Homo sapiens
tagcaggtgctgaga

SEQ ID NO: 43564 - DNA, 15 bp, Homo sapiens
ctagcaggtgctgag

SEQ ID NO: 43565 - DNA, 15 bp, Homo sapiens
cctagcaggtgctga

SEQ ID NO: 43566 - DNA, 15 bp, Homo sapiens
acctagcaggtgctg

SEQ ID NO: 43567 - DNA, 15 bp, Homo sapiens
gacctagcaggtgct

SEQ ID NO: 43568 - DNA, 15 bp, Homo sapiens
agacctagcaggtgc

SEQ ID NO: 43569 - DNA, 15 bp, Homo sapiens
gagacctagcaggtg

SEQ ID NO: 43570 - DNA, 15 bp, Homo sapiens
agagacctagcaggt

SEQ ID NO: 43571 - DNA, 15 bp, Homo sapiens
gagagacctagcagg

SEQ ID NO: 43572 - DNA, 15 bp, Homo sapiens
agagagacctagcag

SEQ ID NO: 43573 - DNA, 15 bp, Homo sapiens
cagagagacctagca

SEQ ID NO: 43574 - DNA, 15 bp, Homo sapiens
ccagagagacctagc

SEQ ID NO: 43575 - DNA, 15 bp, Homo sapiens
tccagagagacctag

SEQ ID NO: 43576 - DNA, 15 bp, Homo sapiens
ctccagagagaccta

SEQ ID NO: 43577 - DNA, 15 bp, Homo sapiens
actccagagagacct

SEQ ID NO: 43578 - DNA, 15 bp, Homo sapiens
gactccagagagacc

SEQ ID NO: 43579 - DNA, 15 bp, Homo sapiens
agactccagagagac

SEQ ID NO: 43580 - DNA, 15 bp, Homo sapiens
gagactccagagaga

SEQ ID NO: 43581 - DNA, 15 bp, Homo sapiens
ggagactccagagag

SEQ ID NO: 43582 - DNA, 15 bp, Homo sapiens
tggagactccagaga

SEQ ID NO: 43583 - DNA, 15 bp, Homo sapiens
gtggagactccagag

SEQ ID NO: 43584 - DNA, 15 bp, Homo sapiens
tgtggagactccaga

SEQ ID NO: 43585 - DNA, 15 bp, Homo sapiens
gtgtggagactccag

SEQ ID NO: 43586 - DNA, 15 bp, Homo sapiens
tgtgtggagactcca

SEQ ID NO: 43587 - DNA, 15 bp, Homo sapiens
atgtgtggagactcc

SEQ ID NO: 43588 - DNA, 15 bp, Homo sapiens
aatgtgtggagactc

SEQ ID NO: 43589 - DNA, 15 bp, Homo sapiens
aaatgtgtggagact

SEQ ID NO: 43590 - DNA, 15 bp, Homo sapiens
gaaatgtgtggagac

SEQ ID NO: 43591 - DNA, 15 bp, Homo sapiens
agaaatgtgtggaga

SEQ ID NO: 43592 - DNA, 15 bp, Homo sapiens
aagaaatgtgtggag

SEQ ID NO: 43593 - DNA, 15 bp, Homo sapiens
caagaaatgtgtgga

SEQ ID NO: 43594 - DNA, 15 bp, Homo sapiens
gcaagaaatgtgtgg

SEQ ID NO: 43595 - DNA, 15 bp, Homo sapiens
agcaagaaatgtgtg

SEQ ID NO: 43596 - DNA, 15 bp, Homo sapiens
aagcaagaaatgtgt

SEQ ID NO: 43597 - DNA, 15 bp, Homo sapiens
caagcaagaaatgtg

SEQ ID NO: 43598 - DNA, 15 bp, Homo sapiens
gcaagcaagaaatgt

SEQ ID NO: 43599 - DNA, 15 bp, Homo sapiens
ggcaagcaagaaatg

SEQ ID NO: 43600 - DNA, 15 bp, Homo sapiens
gggcaagcaagaaat

SEQ ID NO: 43601 - DNA, 15 bp, Homo sapiens
agggcaagcaagaaa

SEQ ID NO: 43602 - DNA, 15 bp, Homo sapiens
aagggcaagcaagaa

SEQ ID NO: 43603 - DNA, 15 bp, Homo sapiens
aaagggcaagcaaga

SEQ ID NO: 43604 - DNA, 15 bp, Homo sapiens
caaagggcaagcaag

SEQ ID NO: 43605 - DNA, 15 bp, Homo sapiens
ccaaagggcaagcaa

SEQ ID NO: 43606 - DNA, 15 bp, Homo sapiens
accaaagggcaagca

SEQ ID NO: 43607 - DNA, 15 bp, Homo sapiens
aaccaaagggcaagc

SEQ ID NO: 43608 - DNA, 15 bp, Homo sapiens
gaaccaaagggcaag

SEQ ID NO: 43609 - DNA, 15 bp, Homo sapiens
agaaccaaagggcaa

SEQ ID NO: 43610 - DNA, 15 bp, Homo sapiens
cagaaccaaagggca

SEQ ID NO: 43611 - DNA, 15 bp, Homo sapiens
acagaaccaaagggc

SEQ ID NO: 43612 - DNA, 15 bp, Homo sapiens
aacagaaccaaaggg

SEQ ID NO: 43613 - DNA, 15 bp, Homo sapiens
aaacagaaccaaagg

SEQ ID NO: 43614 - DNA, 15 bp, Homo sapiens
caaacagaaccaaag

SEQ ID NO: 43615 - DNA, 15 bp, Homo sapiens
ccaaacagaaccaaa

SEQ ID NO: 43616 - DNA, 15 bp, Homo sapiens
cccaaacagaaccaa

SEQ ID NO: 43617 - DNA, 15 bp, Homo sapiens
ccccaaacagaacca

SEQ ID NO: 43618 - DNA, 15 bp, Homo sapiens
gccccaaacagaacc

SEQ ID NO: 43619 - DNA, 15 bp, Homo sapiens
tgccccaaacagaac

SEQ ID NO: 43620 - DNA, 15 bp, Homo sapiens
ctgccccaaacagaa

SEQ ID NO: 43621 - DNA, 15 bp, Homo sapiens
gctgccccaaacaga

SEQ ID NO: 43622 - DNA, 15 bp, Homo sapiens
cgctgccccaaacag

SEQ ID NO: 43623 - DNA, 15 bp, Homo sapiens
gcgctgccccaaaca

SEQ ID NO: 43624 - DNA, 15 bp, Homo sapiens
ggcgctgccccaaac

SEQ ID NO: 43625 - DNA, 15 bp, Homo sapiens
gggcgctgccccaaa

SEQ ID NO: 43626 - DNA, 15 bp, Homo sapiens
ggggcgctgccccaa

SEQ ID NO: 43627 - DNA, 15 bp, Homo sapiens
aggggcgctgcccca

SEQ ID NO: 43628 - DNA, 15 bp, Homo sapiens
gaggggcgctgcccc

SEQ ID NO: 43629 - DNA, 15 bp, Homo sapiens
agaggggcgctgccc

SEQ ID NO: 43630 - DNA, 15 bp, Homo sapiens
cagaggggcgctgcc

SEQ ID NO: 43631 - DNA, 15 bp, Homo sapiens
tcagaggggcgctgc

SEQ ID NO: 43632 - DNA, 15 bp, Homo sapiens
ttcagaggggcgctg

SEQ ID NO: 43633 - DNA, 15 bp, Homo sapiens
gttcagaggggcgct

SEQ ID NO: 43634 - DNA, 15 bp, Homo sapiens
agttcagaggggcgc

SEQ ID NO: 43635 - DNA, 15 bp, Homo sapiens
cagttcagaggggcg

SEQ ID NO: 43636 - DNA, 15 bp, Homo sapiens
tcagttcagaggggc

SEQ ID NO: 43637 - DNA, 15 bp, Homo sapiens
ctcagttcagagggg

SEQ ID NO: 43638 - DNA, 15 bp, Homo sapiens
cctcagttcagaggg

SEQ ID NO: 43639 - DNA, 15 bp, Homo sapiens
ccctcagttcagagg

SEQ ID NO: 43640 - DNA, 15 bp, Homo sapiens
cccctcagttcagag

SEQ ID NO: 43641 - DNA, 15 bp, Homo sapiens
gcccctcagttcaga

SEQ ID NO: 43642 - DNA, 15 bp, Homo sapiens
ggcccctcagttcag

SEQ ID NO: 43643 - DNA, 15 bp, Homo sapiens
gggcccctcagttca

SEQ ID NO: 43644 - DNA, 15 bp, Homo sapiens
ggggcccctcagttc

SEQ ID NO: 43645 - DNA, 15 bp, Homo sapiens
cggggcccctcagtt

SEQ ID NO: 43646 - DNA, 15 bp, Homo sapiens
ccggggcccctcagt

SEQ ID NO: 43647 - DNA, 15 bp, Homo sapiens
cccggggcccctcag

SEQ ID NO: 43648 - DNA, 15 bp, Homo sapiens
gcccggggcccctca

SEQ ID NO: 43649 - DNA, 15 bp, Homo sapiens
tgcccggggcccctc

SEQ ID NO: 43650 - DNA, 15 bp, Homo sapiens
ctgcccggggcccct

SEQ ID NO: 43651 - DNA, 15 bp, Homo sapiens
actgcccggggcccc

SEQ ID NO: 43652 - DNA, 15 bp, Homo sapiens
gactgcccggggccc

SEQ ID NO: 43653 - DNA, 15 bp, Homo sapiens
ggactgcccggggcc

SEQ ID NO: 43654 - DNA, 15 bp, Homo sapiens
aggactgcccggggc

SEQ ID NO: 43655 - DNA, 15 bp, Homo sapiens
caggactgcccgggg

SEQ ID NO: 43656 - DNA, 15 bp, Homo sapiens
gcaggactgcccggg

SEQ ID NO: 43657 - DNA, 15 bp, Homo sapiens
agcaggactgcccgg

SEQ ID NO: 43658 - DNA, 15 bp, Homo sapiens
aagcaggactgcccg

SEQ ID NO: 43659 - DNA, 15 bp, Homo sapiens
aaagcaggactgccc

SEQ ID NO: 43660 - DNA, 15 bp, Homo sapiens
caaagcaggactgcc

SEQ ID NO: 43661 - DNA, 15 bp, Homo sapiens
gcaaagcaggactgc

SEQ ID NO: 43662 - DNA, 15 bp, Homo sapiens
cgcaaagcaggactg

SEQ ID NO: 43663 - DNA, 15 bp, Homo sapiens
ccgcaaagcaggact

SEQ ID NO: 43664 - DNA, 15 bp, Homo sapiens
tccgcaaagcaggac

SEQ ID NO: 43665 - DNA, 15 bp, Homo sapiens
ctccgcaaagcagga

SEQ ID NO: 43666 - DNA, 15 bp, Homo sapiens
gctccgcaaagcagg

SEQ ID NO: 43667 - DNA, 15 bp, Homo sapiens
ggctccgcaaagcag

SEQ ID NO: 43668 - DNA, 15 bp, Homo sapiens
gggctccgcaaagca

SEQ ID NO: 43669 - DNA, 15 bp, Homo sapiens
tgggctccgcaaagc

SEQ ID NO: 43670 - DNA, 15 bp, Homo sapiens
ctgggctccgcaaag

SEQ ID NO: 43671 - DNA, 15 bp, Homo sapiens
gctgggctccgcaaa

SEQ ID NO: 43672 - DNA, 15 bp, Homo sapiens
agctgggctccgcaa

SEQ ID NO: 43673 - DNA, 15 bp, Homo sapiens
gagctgggctccgca

SEQ ID NO: 43674 - DNA, 15 bp, Homo sapiens
ggagctgggctccgc

SEQ ID NO: 43675 - DNA, 15 bp, Homo sapiens
cggagctgggctccg

SEQ ID NO: 43676 - DNA, 15 bp, Homo sapiens
tcggagctgggctcc

SEQ ID NO: 43677 - DNA, 15 bp, Homo sapiens
gtcggagctgggctc

SEQ ID NO: 43678 - DNA, 15 bp, Homo sapiens
ggtcggagctgggct

SEQ ID NO: 43679 - DNA, 15 bp, Homo sapiens
gggtcggagctgggc

SEQ ID NO: 43680 - DNA, 15 bp, Homo sapiens
ggggtcggagctggg

SEQ ID NO: 43681 - DNA, 15 bp, Homo sapiens
gggggtcggagctgg

SEQ ID NO: 43682 - DNA, 15 bp, Homo sapiens
agggggtcggagctg

SEQ ID NO: 43683 - DNA, 15 bp, Homo sapiens
aagggggtcggagct

SEQ ID NO: 43684 - DNA, 15 bp, Homo sapiens
gaagggggtcggagc

SEQ ID NO: 43685 - DNA, 15 bp, Homo sapiens
tgaagggggtcggag

SEQ ID NO: 43686 - DNA, 15 bp, Homo sapiens
gtgaagggggtcgga

SEQ ID NO: 43687 - DNA, 15 bp, Homo sapiens
tgtgaagggggtcgg

SEQ ID NO: 43688 - DNA, 15 bp, Homo sapiens
atgtgaagggggtcg

SEQ ID NO: 43689 - DNA, 15 bp, Homo sapiens
tatgtgaagggggtc

SEQ ID NO: 43690 - DNA, 15 bp, Homo sapiens
ctatgtgaagggggt

SEQ ID NO: 43691 - DNA, 15 bp, Homo sapiens
tctatgtgaaggggg

SEQ ID NO: 43692 - DNA, 15 bp, Homo sapiens
ctctatgtgaagggg

SEQ ID NO: 43693 - DNA, 15 bp, Homo sapiens
tctctatgtgaaggg

SEQ ID NO: 43694 - DNA, 15 bp, Homo sapiens
ctctctatgtgaagg

SEQ ID NO: 43695 - DNA, 15 bp, Homo sapiens
tctctctatgtgaag

SEQ ID NO: 43696 - DNA, 15 bp, Homo sapiens
ttctctctatgtgaa

SEQ ID NO: 43697 - DNA, 15 bp, Homo sapiens
cttctctctatgtga

SEQ ID NO: 43698 - DNA, 15 bp, Homo sapiens
ccttctctctatgtg

SEQ ID NO: 43699 - DNA, 15 bp, Homo sapiens
tccttctctctatgt

SEQ ID NO: 43700 - DNA, 15 bp, Homo sapiens
ttccttctctctatg

SEQ ID NO: 43701 - DNA, 15 bp, Homo sapiens
tttccttctctctat

SEQ ID NO: 43702 - DNA, 15 bp, Homo sapiens
ctttccttctctcta

SEQ ID NO: 43703 - DNA, 15 bp, Homo sapiens
tctttccttctctct

SEQ ID NO: 43704 - DNA, 15 bp, Homo sapiens
ctctttccttctctc

SEQ ID NO: 43705 - DNA, 15 bp, Homo sapiens
gctctttccttctct

SEQ ID NO: 43706 - DNA, 15 bp, Homo sapiens
agctctttccttctc

SEQ ID NO: 43707 - DNA, 15 bp, Homo sapiens
cagctctttccttct

SEQ ID NO: 43708 - DNA, 15 bp, Homo sapiens
gcagctctttccttc

SEQ ID NO: 43709 - DNA, 15 bp, Homo sapiens
agcagctctttcctt

SEQ ID NO: 43710 - DNA, 15 bp, Homo sapiens
cagcagctctttcct

SEQ ID NO: 43711 - DNA, 15 bp, Homo sapiens
gcagcagctctttcc

SEQ ID NO: 43712 - DNA, 15 bp, Homo sapiens
ggcagcagctctttc

SEQ ID NO: 43713 - DNA, 15 bp, Homo sapiens
cggcagcagctcttt

SEQ ID NO: 43714 - DNA, 15 bp, Homo sapiens
gcggcagcagctctt

SEQ ID NO: 43715 - DNA, 15 bp, Homo sapiens
cgcggcagcagctct

SEQ ID NO: 43716 - DNA, 15 bp, Homo sapiens
gcgcggcagcagctc

SEQ ID NO: 43717 - DNA, 15 bp, Homo sapiens
ggcgcggcagcagct

SEQ ID NO: 43718 - DNA, 15 bp, Homo sapiens
gggcgcggcagcagc

SEQ ID NO: 43719 - DNA, 15 bp, Homo sapiens
ggggcgcggcagcag

SEQ ID NO: 43720 - DNA, 15 bp, Homo sapiens
gggggcgcggcagca

SEQ ID NO: 43721 - DNA, 15 bp, Homo sapiens
agggggcgcggcagc

SEQ ID NO: 43722 - DNA, 15 bp, Homo sapiens
cagggggcgcggcag

SEQ ID NO: 43723 - DNA, 15 bp, Homo sapiens
gcagggggcgcggca

SEQ ID NO: 43724 - DNA, 15 bp, Homo sapiens
agcagggggcgcggc

SEQ ID NO: 43725 - DNA, 15 bp, Homo sapiens
cagcagggggcgcgg

SEQ ID NO: 43726 - DNA, 15 bp, Homo sapiens
ccagcagggggcgcg

SEQ ID NO: 43727 - DNA, 15 bp, Homo sapiens
cccagcagggggcgc

SEQ ID NO: 43728 - DNA, 15 bp, Homo sapiens
gcccagcagggggcg

SEQ ID NO: 43729 - DNA, 15 bp, Homo sapiens
cgcccagcagggggc

SEQ ID NO: 43730 - DNA, 15 bp, Homo sapiens
gcgcccagcaggggg

SEQ ID NO: 43731 - DNA, 15 bp, Homo sapiens
tgcgcccagcagggg

SEQ ID NO: 43732 - DNA, 15 bp, Homo sapiens
gtgcgcccagcaggg

SEQ ID NO: 43733 - DNA, 15 bp, Homo sapiens
agtgcgcccagcagg

SEQ ID NO: 43734 - DNA, 15 bp, Homo sapiens
cagtgcgcccagcag

SEQ ID NO: 43735 - DNA, 15 bp, Homo sapiens
gcagtgcgcccagca

SEQ ID NO: 43736 - DNA, 15 bp, Homo sapiens
tgcagtgcgcccagc

SEQ ID NO: 43737 - DNA, 15 bp, Homo sapiens
gtgcagtgcgcccag

SEQ ID NO: 43738 - DNA, 15 bp, Homo sapiens
agtgcagtgcgccca

SEQ ID NO: 43739 - DNA, 15 bp, Homo sapiens
tagtgcagtgcgccc

SEQ ID NO: 43740 - DNA, 15 bp, Homo sapiens
gtagtgcagtgcgcc

SEQ ID NO: 43741 - DNA, 15 bp, Homo sapiens
agtagtgcagtgcgc

SEQ ID NO: 43742 - DNA, 15 bp, Homo sapiens
cagtagtgcagtgcg

SEQ ID NO: 43743 - DNA, 15 bp, Homo sapiens
gcagtagtgcagtgc

SEQ ID NO: 43744 - DNA, 15 bp, Homo sapiens
tgcagtagtgcagtg

SEQ ID NO: 43745 - DNA, 15 bp, Homo sapiens
atgcagtagtgcagt

SEQ ID NO: 43746 - DNA, 15 bp, Homo sapiens
gatgcagtagtgcag

SEQ ID NO: 43747 - DNA, 15 bp, Homo sapiens
agatgcagtagtgca

SEQ ID NO: 43748 - DNA, 15 bp, Homo sapiens
cagatgcagtagtgc

SEQ ID NO: 43749 - DNA, 15 bp, Homo sapiens
gcagatgcagtagtg

SEQ ID NO: 43750 - DNA, 15 bp, Homo sapiens
ggcagatgcagtagt

SEQ ID NO: 43751 - DNA, 15 bp, Homo sapiens
aggcagatgcagtag

SEQ ID NO: 43752 - DNA, 15 bp, Homo sapiens
aaggcagatgcagta

SEQ ID NO: 43753 - DNA, 15 bp, Homo sapiens
aaaggcagatgcagt

SEQ ID NO: 43754 - DNA, 15 bp, Homo sapiens
aaaaggcagatgcag

SEQ ID NO: 43755 - DNA, 15 bp, Homo sapiens
aaaaaggcagatgca

SEQ ID NO: 43756 - DNA, 15 bp, Homo sapiens
gaaaaaggcagatgc

SEQ ID NO: 43757 - DNA, 15 bp, Homo sapiens
agaaaaaggcagatg

SEQ ID NO: 43758 - DNA, 15 bp, Homo sapiens
cagaaaaaggcagat

SEQ ID NO: 43759 - DNA, 15 bp, Homo sapiens
acagaaaaaggcaga

SEQ ID NO: 43760 - DNA, 15 bp, Homo sapiens
gacagaaaaaggcag

SEQ ID NO: 43761 - DNA, 15 bp, Homo sapiens
ggacagaaaaaggca

SEQ ID NO: 43762 - DNA, 15 bp, Homo sapiens
gggacagaaaaaggc

SEQ ID NO: 43763 - DNA, 15 bp, Homo sapiens
ggggacagaaaaagg

SEQ ID NO: 43764 - DNA, 15 bp, Homo sapiens
aggggacagaaaaag

SEQ ID NO: 43765 - DNA, 15 bp, Homo sapiens
gaggggacagaaaaa

SEQ ID NO: 43766 - DNA, 15 bp, Homo sapiens
ggaggggacagaaaa

SEQ ID NO: 43767 - DNA, 15 bp, Homo sapiens
gggaggggacagaaa

SEQ ID NO: 43768 - DNA, 15 bp, Homo sapiens
agggaggggacagaa

SEQ ID NO: 43769 - DNA, 15 bp, Homo sapiens
tagggaggggacaga

SEQ ID NO: 43770 - DNA, 15 bp, Homo sapiens
ctagggaggggacag

SEQ ID NO: 43771 - DNA, 15 bp, Homo sapiens
actagggaggggaca

SEQ ID NO: 43772 - DNA, 15 bp, Homo sapiens
tactagggaggggac

SEQ ID NO: 43773 - DNA, 15 bp, Homo sapiens
gtactagggagggga

SEQ ID NO: 43774 - DNA, 15 bp, Homo sapiens
ggtactagggagggg

SEQ ID NO: 43775 - DNA, 15 bp, Homo sapiens
gggtactagggaggg

SEQ ID NO: 43776 - DNA, 15 bp, Homo sapiens
ggggtactagggagg

SEQ ID NO: 43777 - DNA, 15 bp, Homo sapiens
tggggtactagggag

SEQ ID NO: 43778 - DNA, 15 bp, Homo sapiens
gtggggtactaggga

SEQ ID NO: 43779 - DNA, 15 bp, Homo sapiens
ggtggggtactaggg

SEQ ID NO: 43780 - DNA, 15 bp, Homo sapiens
aggtggggtactagg

SEQ ID NO: 43781 - DNA, 15 bp, Homo sapiens
gaggtggggtactag

SEQ ID NO: 43782 - DNA, 15 bp, Homo sapiens
agaggtggggtacta

SEQ ID NO: 43783 - DNA, 15 bp, Homo sapiens
aagaggtggggtact

SEQ ID NO: 43784 - DNA, 15 bp, Homo sapiens
gaagaggtggggtac

SEQ ID NO: 43785 - DNA, 15 bp, Homo sapiens
agaagaggtggggta

SEQ ID NO: 43786 - DNA, 15 bp, Homo sapiens
gagaagaggtggggt

SEQ ID NO: 43787 - DNA, 15 bp, Homo sapiens
ggagaagaggtgggg

SEQ ID NO: 43788 - DNA, 15 bp, Homo sapiens
aggagaagaggtggg

SEQ ID NO: 43789 - DNA, 15 bp, Homo sapiens
gaggagaagaggtgg

SEQ ID NO: 43790 - DNA, 15 bp, Homo sapiens
agaggagaagaggtg

SEQ ID NO: 43791 - DNA, 15 bp, Homo sapiens
cagaggagaagaggt

SEQ ID NO: 43792 - DNA, 15 bp, Homo sapiens
ccagaggagaagagg

SEQ ID NO: 43793 - DNA, 15 bp, Homo sapiens
accagaggagaagag

SEQ ID NO: 43794 - DNA, 15 bp, Homo sapiens
caccagaggagaaga

SEQ ID NO: 43795 - DNA, 15 bp, Homo sapiens
tcaccagaggagaag

SEQ ID NO: 43796 - DNA, 15 bp, Homo sapiens
gtcaccagaggagaa

SEQ ID NO: 43797 - DNA, 15 bp, Homo sapiens
tgtcaccagaggaga

SEQ ID NO: 43798 - DNA, 15 bp, Homo sapiens
ctgtcaccagaggag

SEQ ID NO: 43799 - DNA, 15 bp, Homo sapiens
actgtcaccagagga

SEQ ID NO: 43800 - DNA, 15 bp, Homo sapiens
aactgtcaccagagg

SEQ ID NO: 43801 - DNA, 15 bp, Homo sapiens
caactgtcaccagag

SEQ ID NO: 43802 - DNA, 15 bp, Homo sapiens
tcaactgtcaccaga

SEQ ID NO: 43803 - DNA, 15 bp, Homo sapiens
ttcaactgtcaccag

SEQ ID NO: 43804 - DNA, 15 bp, Homo sapiens
tttcaactgtcacca

SEQ ID NO: 43805 - DNA, 15 bp, Homo sapiens
ttttcaactgtcacc

SEQ ID NO: 43806 - DNA, 15 bp, Homo sapiens
attttcaactgtcac

SEQ ID NO: 43807 - DNA, 15 bp, Homo sapiens
cattttcaactgtca

SEQ ID NO: 43808 - DNA, 15 bp, Homo sapiens
ccattttcaactgtc

SEQ ID NO: 43809 - DNA, 15 bp, Homo sapiens
tccattttcaactgt

SEQ ID NO: 43810 - DNA, 15 bp, Homo sapiens
ctccattttcaactg

SEQ ID NO: 43811 - DNA, 15 bp, Homo sapiens
tctccattttcaact

SEQ ID NO: 43812 - DNA, 15 bp, Homo sapiens
ctctccattttcaac

SEQ ID NO: 43813 - DNA, 15 bp, Homo sapiens
cctctccattttcaa

SEQ ID NO: 43814 - DNA, 15 bp, Homo sapiens
gcctctccattttca

SEQ ID NO: 43815 - DNA, 15 bp, Homo sapiens
ggcctctccattttc

SEQ ID NO: 43816 - DNA, 15 bp, Homo sapiens
gggcctctccatttt

SEQ ID NO: 43817 - DNA, 15 bp, Homo sapiens
ggggcctctccattt

SEQ ID NO: 43818 - DNA, 15 bp, Homo sapiens
cggggcctctccatt

SEQ ID NO: 43819 - DNA, 15 bp, Homo sapiens
acggggcctctccat

SEQ ID NO: 43820 - DNA, 15 bp, Homo sapiens
aacggggcctctcca

SEQ ID NO: 43821 - DNA, 15 bp, Homo sapiens
aaacggggcctctcc

SEQ ID NO: 43822 - DNA, 15 bp, Homo sapiens
caaacggggcctctc

SEQ ID NO: 43823 - DNA, 15 bp, Homo sapiens
tcaaacggggcctct

SEQ ID NO: 43824 - DNA, 15 bp, Homo sapiens
ctcaaacggggcctc

SEQ ID NO: 43825 - DNA, 15 bp, Homo sapiens
cctcaaacggggcct

SEQ ID NO: 43826 - DNA, 15 bp, Homo sapiens
ccctcaaacggggcc

SEQ ID NO: 43827 - DNA, 15 bp, Homo sapiens
gccctcaaacggggc

SEQ ID NO: 43828 - DNA, 15 bp, Homo sapiens
tgccctcaaacgggg

SEQ ID NO: 43829 - DNA, 15 bp, Homo sapiens
ctgccctcaaacggg

SEQ ID NO: 43830 - DNA, 15 bp, Homo sapiens
gctgccctcaaacgg

SEQ ID NO: 43831 - DNA, 15 bp, Homo sapiens
cgctgccctcaaacg

SEQ ID NO: 43832 - DNA, 15 bp, Homo sapiens
ccgctgccctcaaac

SEQ ID NO: 43833 - DNA, 15 bp, Homo sapiens
cccgctgccctcaaa

SEQ ID NO: 43834 - DNA, 15 bp, Homo sapiens
ccccgctgccctcaa

SEQ ID NO: 43835 - DNA, 15 bp, Homo sapiens
gccccgctgccctca

SEQ ID NO: 43836 - DNA, 15 bp, Homo sapiens
tgccccgctgccctc

SEQ ID NO: 43837 - DNA, 15 bp, Homo sapiens
ctgccccgctgccct

SEQ ID NO: 43838 - DNA, 15 bp, Homo sapiens
actgccccgctgccc

SEQ ID NO: 43839 - DNA, 15 bp, Homo sapiens
cactgccccgctgcc

SEQ ID NO: 43840 - DNA, 15 bp, Homo sapiens
tcactgccccgctgc

SEQ ID NO: 43841 - DNA, 15 bp, Homo sapiens
ctcactgccccgctg

SEQ ID NO: 43842 - DNA, 15 bp, Homo sapiens
tctcactgccccgct

SEQ ID NO: 43843 - DNA, 15 bp, Homo sapiens
atctcactgccccgc

SEQ ID NO: 43844 - DNA, 15 bp, Homo sapiens
aatctcactgccccg

SEQ ID NO: 43845 - DNA, 15 bp, Homo sapiens
gaatctcactgcccc

SEQ ID NO: 43846 - DNA, 15 bp, Homo sapiens
tgaatctcactgccc

SEQ ID NO: 43847 - DNA, 15 bp, Homo sapiens
atgaatctcactgcc

SEQ ID NO: 43848 - DNA, 15 bp, Homo sapiens
aatgaatctcactgc

SEQ ID NO: 43849 - DNA, 15 bp, Homo sapiens
aaatgaatctcactg

SEQ ID NO: 43850 - DNA, 15 bp, Homo sapiens
aaaatgaatctcact

SEQ ID NO: 43851 - DNA, 15 bp, Homo sapiens
caaaatgaatctcac

SEQ ID NO: 43852 - DNA, 15 bp, Homo sapiens
acaaaatgaatctca

SEQ ID NO: 43853 - DNA, 15 bp, Homo sapiens
tacaaaatgaatctc

SEQ ID NO: 43854 - DNA, 15 bp, Homo sapiens
ctacaaaatgaatct

SEQ ID NO: 43855 - DNA, 15 bp, Homo sapiens
tctacaaaatgaatc

SEQ ID NO: 43856 - DNA, 15 bp, Homo sapiens
ttctacaaaatgaat

SEQ ID NO: 43857 - DNA, 15 bp, Homo sapiens
tttctacaaaatgaa

SEQ ID NO: 43858 - DNA, 15 bp, Homo sapiens
ttttctacaaaatga

SEQ ID NO: 43859 - DNA, 15 bp, Homo sapiens
cttttctacaaaatg

SEQ ID NO: 43860 - DNA, 15 bp, Homo sapiens
tcttttctacaaaat

SEQ ID NO: 43861 - DNA, 15 bp, Homo sapiens
ttcttttctacaaaa

SEQ ID NO: 43862 - DNA, 15 bp, Homo sapiens
gttcttttctacaaa

SEQ ID NO: 43863 - DNA, 15 bp, Homo sapiens
cgttcttttctacaa

SEQ ID NO: 43864 - DNA, 15 bp, Homo sapiens
tcgttcttttctaca

SEQ ID NO: 43865 - DNA, 15 bp, Homo sapiens
ctcgttcttttctac

SEQ ID NO: 43866 - DNA, 15 bp, Homo sapiens
cctcgttcttttcta

SEQ ID NO: 43867 - DNA, 15 bp, Homo sapiens
gcctcgttcttttct

SEQ ID NO: 43868 - DNA, 15 bp, Homo sapiens
ggcctcgttcttttc

SEQ ID NO: 43869 - DNA, 15 bp, Homo sapiens
tggcctcgttctttt

SEQ ID NO: 43870 - DNA, 15 bp, Homo sapiens
atggcctcgttcttt

SEQ ID NO: 43871 - DNA, 15 bp, Homo sapiens
aatggcctcgttctt

SEQ ID NO: 43872 - DNA, 15 bp, Homo sapiens
gaatggcctcgttct

SEQ ID NO: 43873 - DNA, 15 bp, Homo sapiens
agaatggcctcgttc

SEQ ID NO: 43874 - DNA, 15 bp, Homo sapiens
gagaatggcctcgtt

SEQ ID NO: 43875 - DNA, 15 bp, Homo sapiens
tgagaatggcctcgt

SEQ ID NO: 43876 - DNA, 15 bp, Homo sapiens
ctgagaatggcctcg

SEQ ID NO: 43877 - DNA, 15 bp, Homo sapiens
actgagaatggcctc

SEQ ID NO: 43878 - DNA, 15 bp, Homo sapiens
gactgagaatggcct

SEQ ID NO: 43879 - DNA, 15 bp, Homo sapiens
ggactgagaatggcc

SEQ ID NO: 43880 - DNA, 15 bp, Homo sapiens
aggactgagaatggc

SEQ ID NO: 43881 - DNA, 15 bp, Homo sapiens
aaggactgagaatgg

SEQ ID NO: 43882 - DNA, 15 bp, Homo sapiens
caaggactgagaatg

SEQ ID NO: 43883 - DNA, 15 bp, Homo sapiens
gcaaggactgagaat

SEQ ID NO: 43884 - DNA, 15 bp, Homo sapiens
agcaaggactgagaa

SEQ ID NO: 43885 - DNA, 15 bp, Homo sapiens
aagcaaggactgaga

SEQ ID NO: 43886 - DNA, 15 bp, Homo sapiens
aaagcaaggactgag

SEQ ID NO: 43887 - DNA, 15 bp, Homo sapiens
aaaagcaaggactga

SEQ ID NO: 43888 - DNA, 15 bp, Homo sapiens
caaaagcaaggactg

SEQ ID NO: 43889 - DNA, 15 bp, Homo sapiens
ccaaaagcaaggact

SEQ ID NO: 43890 - DNA, 15 bp, Homo sapiens
gccaaaagcaaggac

SEQ ID NO: 43891 - DNA, 15 bp, Homo sapiens
tgccaaaagcaagga

SEQ ID NO: 43892 - DNA, 15 bp, Homo sapiens
ctgccaaaagcaagg

SEQ ID NO: 43893 - DNA, 15 bp, Homo sapiens
gctgccaaaagcaag

SEQ ID NO: 43894 - DNA, 15 bp, Homo sapiens
ggctgccaaaagcaa

SEQ ID NO: 43895 - DNA, 15 bp, Homo sapiens
cggctgccaaaagca

SEQ ID NO: 43896 - DNA, 15 bp, Homo sapiens
gcggctgccaaaagc

SEQ ID NO: 43897 - DNA, 15 bp, Homo sapiens
cgcggctgccaaaag

SEQ ID NO: 43898 - DNA, 15 bp, Homo sapiens
gcgcggctgccaaaa

SEQ ID NO: 43899 - DNA, 15 bp, Homo sapiens
agcgcggctgccaaa

SEQ ID NO: 43900 - DNA, 15 bp, Homo sapiens
aagcgcggctgccaa

SEQ ID NO: 43901 - DNA, 15 bp, Homo sapiens
gaagcgcggctgcca

SEQ ID NO: 43902 - DNA, 15 bp, Homo sapiens
agaagcgcggctgcc

SEQ ID NO: 43903 - DNA, 15 bp, Homo sapiens
gagaagcgcggctgc

SEQ ID NO: 43904 - DNA, 15 bp, Homo sapiens
tgagaagcgcggctg

SEQ ID NO: 43905 - DNA, 15 bp, Homo sapiens
ctgagaagcgcggct

SEQ ID NO: 43906 - DNA, 15 bp, Homo sapiens
gctgagaagcgcggc

SEQ ID NO: 43907 - DNA, 15 bp, Homo sapiens
tgctgagaagcgcgg

SEQ ID NO: 43908 - DNA, 15 bp, Homo sapiens
gtgctgagaagcgcg

SEQ ID NO: 43909 - DNA, 15 bp, Homo sapiens
agtgctgagaagcgc

SEQ ID NO: 43910 - DNA, 15 bp, Homo sapiens
gagtgctgagaagcg

SEQ ID NO: 43911 - DNA, 15 bp, Homo sapiens
ggagtgctgagaagc

SEQ ID NO: 43912 - DNA, 15 bp, Homo sapiens
gggagtgctgagaag

SEQ ID NO: 43913 - DNA, 15 bp, Homo sapiens
agggagtgctgagaa

SEQ ID NO: 43914 - DNA, 15 bp, Homo sapiens
cagggagtgctgaga

SEQ ID NO: 43915 - DNA, 15 bp, Homo sapiens
acagggagtgctgag

SEQ ID NO: 43916 - DNA, 15 bp, Homo sapiens
cacagggagtgctga

SEQ ID NO: 43917 - DNA, 15 bp, Homo sapiens
tcacagggagtgctg

SEQ ID NO: 43918 - DNA, 15 bp, Homo sapiens
atcacagggagtgct

SEQ ID NO: 43919 - DNA, 15 bp, Homo sapiens
catcacagggagtgc

SEQ ID NO: 43920 - DNA, 15 bp, Homo sapiens
ccatcacagggagtg

SEQ ID NO: 43921 - DNA, 15 bp, Homo sapiens
cccatcacagggagt

SEQ ID NO: 43922 - DNA, 15 bp, Homo sapiens
tcccatcacagggag

SEQ ID NO: 43923 - DNA, 15 bp, Homo sapiens
ttcccatcacaggga

SEQ ID NO: 43924 - DNA, 15 bp, Homo sapiens
gttcccatcacaggg

SEQ ID NO: 43925 - DNA, 15 bp, Homo sapiens
tgttcccatcacagg

SEQ ID NO: 43926 - DNA, 15 bp, Homo sapiens
ctgttcccatcacag

SEQ ID NO: 43927 - DNA, 15 bp, Homo sapiens
tctgttcccatcaca

SEQ ID NO: 43928 - DNA, 15 bp, Homo sapiens
ctctgttcccatcac

SEQ ID NO: 43929 - DNA, 15 bp, Homo sapiens
cctctgttcccatca

SEQ ID NO: 43930 - DNA, 15 bp, Homo sapiens
ccctctgttcccatc

SEQ ID NO: 43931 - DNA, 15 bp, Homo sapiens
cccctctgttcccat

SEQ ID NO: 43932 - DNA, 15 bp, Homo sapiens
gcccctctgttccca

SEQ ID NO: 43933 - DNA, 15 bp, Homo sapiens
cgcccctctgttccc

SEQ ID NO: 43934 - DNA, 15 bp, Homo sapiens
tcgcccctctgttcc

SEQ ID NO: 43935 - DNA, 15 bp, Homo sapiens
ctcgcccctctgttc

SEQ ID NO: 43936 - DNA, 15 bp, Homo sapiens
cctcgcccctctgtt

SEQ ID NO: 43937 - DNA, 15 bp, Homo sapiens
ccctcgcccctctgt

SEQ ID NO: 43938 - DNA, 15 bp, Homo sapiens
cccctcgcccctctg

SEQ ID NO: 43939 - DNA, 15 bp, Homo sapiens
gcccctcgcccctct

SEQ ID NO: 43940 - DNA, 15 bp, Homo sapiens
tgcccctcgcccctc

SEQ ID NO: 43941 - DNA, 15 bp, Homo sapiens
ctgcccctcgcccct

SEQ ID NO: 43942 - DNA, 15 bp, Homo sapiens
tctgcccctcgcccc

SEQ ID NO: 43943 - DNA, 15 bp, Homo sapiens
ctctgcccctcgccc

SEQ ID NO: 43944 - DNA, 15 bp, Homo sapiens
gctctgcccctcgcc

SEQ ID NO: 43945 - DNA, 15 bp, Homo sapiens
cgctctgcccctcgc

SEQ ID NO: 43946 - DNA, 15 bp, Homo sapiens
acgctctgcccctcg

SEQ ID NO: 43947 - DNA, 15 bp, Homo sapiens
aacgctctgcccctc

SEQ ID NO: 43948 - DNA, 15 bp, Homo sapiens
gaacgctctgcccct

SEQ ID NO: 43949 - DNA, 15 bp, Homo sapiens
ggaacgctctgcccc

SEQ ID NO: 43950 - DNA, 15 bp, Homo sapiens
gggaacgctctgccc

SEQ ID NO: 43951 - DNA, 15 bp, Homo sapiens
tgggaacgctctgcc

SEQ ID NO: 43952 - DNA, 15 bp, Homo sapiens
ctgggaacgctctgc

SEQ ID NO: 43953 - DNA, 15 bp, Homo sapiens
gctgggaacgctctg

SEQ ID NO: 43954 - DNA, 15 bp, Homo sapiens
agctgggaacgctct

SEQ ID NO: 43955 - DNA, 15 bp, Homo sapiens
cagctgggaacgctc

SEQ ID NO: 43956 - DNA, 15 bp, Homo sapiens
gcagctgggaacgct

SEQ ID NO: 43957 - DNA, 15 bp, Homo sapiens
tgcagctgggaacgc

SEQ ID NO: 43958 - DNA, 15 bp, Homo sapiens
ctgcagctgggaacg

SEQ ID NO: 43959 - DNA, 15 bp, Homo sapiens
cctgcagctgggaac

SEQ ID NO: 43960 - DNA, 15 bp, Homo sapiens
ccctgcagctgggaa

SEQ ID NO: 43961 - DNA, 15 bp, Homo sapiens
accctgcagctggga

SEQ ID NO: 43962 - DNA, 15 bp, Homo sapiens
taccctgcagctggg

SEQ ID NO: 43963 - DNA, 15 bp, Homo sapiens
ataccctgcagctgg

SEQ ID NO: 43964 - DNA, 15 bp, Homo sapiens
cataccctgcagctg

SEQ ID NO: 43965 - DNA, 15 bp, Homo sapiens
acataccctgcagct

SEQ ID NO: 43966 - DNA, 15 bp, Homo sapiens
gacataccctgcagc

SEQ ID NO: 43967 - DNA, 15 bp, Homo sapiens
tgacataccctgcag

SEQ ID NO: 43968 - DNA, 15 bp, Homo sapiens
atgacataccctgca

SEQ ID NO: 43969 - DNA, 15 bp, Homo sapiens
aatgacataccctgc

SEQ ID NO: 43970 - DNA, 15 bp, Homo sapiens
aaatgacataccctg

SEQ ID NO: 43971 - DNA, 15 bp, Homo sapiens
aaaatgacataccct

SEQ ID NO: 43972 - DNA, 15 bp, Homo sapiens
taaaatgacataccc

SEQ ID NO: 43973 - DNA, 15 bp, Homo sapiens
ctaaaatgacatacc

SEQ ID NO: 43974 - DNA, 15 bp, Homo sapiens
tctaaaatgacatac

SEQ ID NO: 43975 - DNA, 15 bp, Homo sapiens
ctctaaaatgacata

SEQ ID NO: 43976 - DNA, 15 bp, Homo sapiens
gctctaaaatgacat

SEQ ID NO: 43977 - DNA, 15 bp, Homo sapiens
ggctctaaaatgaca

SEQ ID NO: 43978 - DNA, 15 bp, Homo sapiens
gggctctaaaatgac

SEQ ID NO: 43979 - DNA, 15 bp, Homo sapiens
agggctctaaaatga

SEQ ID NO: 43980 - DNA, 15 bp, Homo sapiens
cagggctctaaaatg

SEQ ID NO: 43981 - DNA, 15 bp, Homo sapiens
ccagggctctaaaat

SEQ ID NO: 43982 - DNA, 15 bp, Homo sapiens
cccagggctctaaaa

SEQ ID NO: 43983 - DNA, 15 bp, Homo sapiens
ccccagggctctaaa

SEQ ID NO: 43984 - DNA, 15 bp, Homo sapiens
gccccagggctctaa

SEQ ID NO: 43985 - DNA, 15 bp, Homo sapiens
tgccccagggctcta

SEQ ID NO: 43986 - DNA, 15 bp, Homo sapiens
ctgccccagggctct

SEQ ID NO: 43987 - DNA, 15 bp, Homo sapiens
cctgccccagggctc

SEQ ID NO: 43988 - DNA, 15 bp, Homo sapiens
acctgccccagggct

SEQ ID NO: 43989 - DNA, 15 bp, Homo sapiens
gacctgccccagggc

SEQ ID NO: 43990 - DNA, 15 bp, Homo sapiens
tgacctgccccaggg

SEQ ID NO: 43991 - DNA, 15 bp, Homo sapiens
gtgacctgccccagg

SEQ ID NO: 43992 - DNA, 15 bp, Homo sapiens
cgtgacctgccccag

SEQ ID NO: 43993 - DNA, 15 bp, Homo sapiens
ccgtgacctgcccca

SEQ ID NO: 43994 - DNA, 15 bp, Homo sapiens
tccgtgacctgcccc

SEQ ID NO: 43995 - DNA, 15 bp, Homo sapiens
gtccgtgacctgccc

SEQ ID NO: 43996 - DNA, 15 bp, Homo sapiens
cgtccgtgacctgcc

SEQ ID NO: 43997 - DNA, 15 bp, Homo sapiens
ccgtccgtgacctgc

SEQ ID NO: 43998 - DNA, 15 bp, Homo sapiens
gccgtccgtgacctg

SEQ ID NO: 43999 - DNA, 15 bp, Homo sapiens
ggccgtccgtgacct

SEQ ID NO: 44000 - DNA, 15 bp, Homo sapiens
aggccgtccgtgacc

SEQ ID NO: 44001 - DNA, 15 bp, Homo sapiens
caggccgtccgtgac

SEQ ID NO: 44002 - DNA, 15 bp, Homo sapiens
ccaggccgtccgtga

SEQ ID NO: 44003 - DNA, 15 bp, Homo sapiens
tccaggccgtccgtg

SEQ ID NO: 44004 - DNA, 15 bp, Homo sapiens
ctccaggccgtccgt

SEQ ID NO: 44005 - DNA, 15 bp, Homo sapiens
gctccaggccgtccg

SEQ ID NO: 44006 - DNA, 15 bp, Homo sapiens
tgctccaggccgtcc

SEQ ID NO: 44007 - DNA, 15 bp, Homo sapiens
ctgctccaggccgtc

SEQ ID NO: 44008 - DNA, 15 bp, Homo sapiens
gctgctccaggccgt

SEQ ID NO: 44009 - DNA, 15 bp, Homo sapiens
ggctgctccaggccg

SEQ ID NO: 44010 - DNA, 15 bp, Homo sapiens
gggctgctccaggcc

SEQ ID NO: 44011 - DNA, 15 bp, Homo sapiens
agggctgctccaggc

SEQ ID NO: 44012 - DNA, 15 bp, Homo sapiens
cagggctgctccagg

SEQ ID NO: 44013 - DNA, 15 bp, Homo sapiens
acagggctgctccag

SEQ ID NO: 44014 - DNA, 15 bp, Homo sapiens
cacagggctgctcca

SEQ ID NO: 44015 - DNA, 15 bp, Homo sapiens
ccacagggctgctcc

SEQ ID NO: 44016 - DNA, 15 bp, Homo sapiens
accacagggctgctc

SEQ ID NO: 44017 - DNA, 15 bp, Homo sapiens
aaccacagggctgct

SEQ ID NO: 44018 - DNA, 15 bp, Homo sapiens
aaaccacagggctgc

SEQ ID NO: 44019 - DNA, 15 bp, Homo sapiens
caaaccacagggctg

SEQ ID NO: 44020 - DNA, 15 bp, Homo sapiens
gcaaaccacagggct

SEQ ID NO: 44021 - DNA, 15 bp, Homo sapiens
ggcaaaccacagggc

SEQ ID NO: 44022 - DNA, 15 bp, Homo sapiens
gggcaaaccacaggg

SEQ ID NO: 44023 - DNA, 15 bp, Homo sapiens
tgggcaaaccacagg

SEQ ID NO: 44024 - DNA, 15 bp, Homo sapiens
gtgggcaaaccacag

SEQ ID NO: 44025 - DNA, 15 bp, Homo sapiens
cgtgggcaaaccaca

SEQ ID NO: 44026 - DNA, 15 bp, Homo sapiens
ccgtgggcaaaccac

SEQ ID NO: 44027 - DNA, 15 bp, Homo sapiens
cccgtgggcaaacca

SEQ ID NO: 44028 - DNA, 15 bp, Homo sapiens
ccccgtgggcaaacc

SEQ ID NO: 44029 - DNA, 15 bp, Homo sapiens
accccgtgggcaaac

SEQ ID NO: 44030 - DNA, 15 bp, Homo sapiens
caccccgtgggcaaa

SEQ ID NO: 44031 - DNA, 15 bp, Homo sapiens
tcaccccgtgggcaa

SEQ ID NO: 44032 - DNA, 15 bp, Homo sapiens
gtcaccccgtgggca

SEQ ID NO: 44033 - DNA, 15 bp, Homo sapiens
ggtcaccccgtgggc

SEQ ID NO: 44034 - DNA, 15 bp, Homo sapiens
cggtcaccccgtggg

SEQ ID NO: 44035 - DNA, 15 bp, Homo sapiens
ccggtcaccccgtgg

SEQ ID NO: 44036 - DNA, 15 bp, Homo sapiens
gccggtcaccccgtg

SEQ ID NO: 44037 - DNA, 15 bp, Homo sapiens
ggccggtcaccccgt

SEQ ID NO: 44038 - DNA, 15 bp, Homo sapiens
tggccggtcaccccg

SEQ ID NO: 44039 - DNA, 15 bp, Homo sapiens
ctggccggtcacccc

SEQ ID NO: 44040 - DNA, 15 bp, Homo sapiens
cctggccggtcaccc

SEQ ID NO: 44041 - DNA, 15 bp, Homo sapiens
ccctggccggtcacc

SEQ ID NO: 44042 - DNA, 15 bp, Homo sapiens
gccctggccggtcac

SEQ ID NO: 44043 - DNA, 15 bp, Homo sapiens
agccctggccggtca

SEQ ID NO: 44044 - DNA, 15 bp, Homo sapiens
cagccctggccggtc

SEQ ID NO: 44045 - DNA, 15 bp, Homo sapiens
gcagccctggccggt

SEQ ID NO: 44046 - DNA, 15 bp, Homo sapiens
ggcagccctggccgg

SEQ ID NO: 44047 - DNA, 15 bp, Homo sapiens
tggcagccctggccg

SEQ ID NO: 44048 - DNA, 15 bp, Homo sapiens
atggcagccctggcc

SEQ ID NO: 44049 - DNA, 15 bp, Homo sapiens
gatggcagccctggc

SEQ ID NO: 44050 - DNA, 15 bp, Homo sapiens
agatggcagccctgg

SEQ ID NO: 44051 - DNA, 15 bp, Homo sapiens
gagatggcagccctg

SEQ ID NO: 44052 - DNA, 15 bp, Homo sapiens
tgagatggcagccct

SEQ ID NO: 44053 - DNA, 15 bp, Homo sapiens
gtgagatggcagccc

SEQ ID NO: 44054 - DNA, 15 bp, Homo sapiens
ggtgagatggcagcc

SEQ ID NO: 44055 - DNA, 15 bp, Homo sapiens
gggtgagatggcagc

SEQ ID NO: 44056 - DNA, 15 bp, Homo sapiens
agggtgagatggcag

SEQ ID NO: 44057 - DNA, 15 bp, Homo sapiens
cagggtgagatggca

SEQ ID NO: 44058 - DNA, 15 bp, Homo sapiens
tcagggtgagatggc

SEQ ID NO: 44059 - DNA, 15 bp, Homo sapiens
ctcagggtgagatgg

SEQ ID NO: 44060 - DNA, 15 bp, Homo sapiens
tctcagggtgagatg

SEQ ID NO: 44061 - DNA, 15 bp, Homo sapiens
ctctcagggtgagat

SEQ ID NO: 44062 - DNA, 15 bp, Homo sapiens
actctcagggtgaga

SEQ ID NO: 44063 - DNA, 15 bp, Homo sapiens
gactctcagggtgag

SEQ ID NO: 44064 - DNA, 15 bp, Homo sapiens
ggactctcagggtga

SEQ ID NO: 44065 - DNA, 15 bp, Homo sapiens
gggactctcagggtg

SEQ ID NO: 44066 - DNA, 15 bp, Homo sapiens
agggactctcagggt

SEQ ID NO: 44067 - DNA, 15 bp, Homo sapiens
gagggactctcaggg

SEQ ID NO: 44068 - DNA, 15 bp, Homo sapiens
agagggactctcagg

SEQ ID NO: 44069 - DNA, 15 bp, Homo sapiens
aagagggactctcag

SEQ ID NO: 44070 - DNA, 15 bp, Homo sapiens
aaagagggactctca

SEQ ID NO: 44071 - DNA, 15 bp, Homo sapiens
aaaagagggactctc

SEQ ID NO: 44072 - DNA, 15 bp, Homo sapiens
gaaaagagggactct

SEQ ID NO: 44073 - DNA, 15 bp, Homo sapiens
ggaaaagagggactc

SEQ ID NO: 44074 - DNA, 15 bp, Homo sapiens
tggaaaagagggact

SEQ ID NO: 44075 - DNA, 15 bp, Homo sapiens
gtggaaaagagggac

SEQ ID NO: 44076 - DNA, 15 bp, Homo sapiens
agtggaaaagaggga

SEQ ID NO: 44077 - DNA, 15 bp, Homo sapiens
aagtggaaaagaggg

SEQ ID NO: 44078 - DNA, 15 bp, Homo sapiens
caagtggaaaagagg

SEQ ID NO: 44079 - DNA, 15 bp, Homo sapiens
gcaagtggaaaagag

SEQ ID NO: 44080 - DNA, 15 bp, Homo sapiens
tgcaagtggaaaaga

SEQ ID NO: 44081 - DNA, 15 bp, Homo sapiens
ctgcaagtggaaaag

SEQ ID NO: 44082 - DNA, 15 bp, Homo sapiens
cctgcaagtggaaaa

SEQ ID NO: 44083 - DNA, 15 bp, Homo sapiens
acctgcaagtggaaa

SEQ ID NO: 44084 - DNA, 15 bp, Homo sapiens
cacctgcaagtggaa

SEQ ID NO: 44085 - DNA, 15 bp, Homo sapiens
acacctgcaagtgga

SEQ ID NO: 44086 - DNA, 15 bp, Homo sapiens
tacacctgcaagtgg

SEQ ID NO: 44087 - DNA, 15 bp, Homo sapiens
gtacacctgcaagtg

SEQ ID NO: 44088 - DNA, 15 bp, Homo sapiens
cgtacacctgcaagt

SEQ ID NO: 44089 - DNA, 15 bp, Homo sapiens
tcgtacacctgcaag

SEQ ID NO: 44090 - DNA, 15 bp, Homo sapiens
ctcgtacacctgcaa

SEQ ID NO: 44091 - DNA, 15 bp, Homo sapiens
tctcgtacacctgca

SEQ ID NO: 44092 - DNA, 15 bp, Homo sapiens
ctctcgtacacctgc

SEQ ID NO: 44093 - DNA, 15 bp, Homo sapiens
cctctcgtacacctg

SEQ ID NO: 44094 - DNA, 15 bp, Homo sapiens
gcctctcgtacacct

SEQ ID NO: 44095 - DNA, 15 bp, Homo sapiens
agcctctcgtacacc

SEQ ID NO: 44096 - DNA, 15 bp, Homo sapiens
tagcctctcgtacac

SEQ ID NO: 44097 - DNA, 15 bp, Homo sapiens
ctagcctctcgtaca

SEQ ID NO: 44098 - DNA, 15 bp, Homo sapiens
tctagcctctcgtac

SEQ ID NO: 44099 - DNA, 15 bp, Homo sapiens
ctctagcctctcgta

SEQ ID NO: 44100 - DNA, 15 bp, Homo sapiens
tctctagcctctcgt

SEQ ID NO: 44101 - DNA, 15 bp, Homo sapiens
ttctctagcctctcg

SEQ ID NO: 44102 - DNA, 15 bp, Homo sapiens
cttctctagcctctc

SEQ ID NO: 44103 - DNA, 15 bp, Homo sapiens
gcttctctagcctct

SEQ ID NO: 44104 - DNA, 15 bp, Homo sapiens
agcttctctagcctc

SEQ ID NO: 44105 - DNA, 15 bp, Homo sapiens
cagcttctctagcct

SEQ ID NO: 44106 - DNA, 15 bp, Homo sapiens
gcagcttctctagcc

SEQ ID NO: 44107 - DNA, 15 bp, Homo sapiens
tgcagcttctctagc

SEQ ID NO: 44108 - DNA, 15 bp, Homo sapiens
ctgcagcttctctag

SEQ ID NO: 44109 - DNA, 15 bp, Homo sapiens
cctgcagcttctcta

SEQ ID NO: 44110 - DNA, 15 bp, Homo sapiens
gcctgcagcttctct

SEQ ID NO: 44111 - DNA, 15 bp, Homo sapiens
tgcctgcagcttctc

SEQ ID NO: 44112 - DNA, 15 bp, Homo sapiens
ctgcctgcagcttct

SEQ ID NO: 44113 - DNA, 15 bp, Homo sapiens
actgcctgcagcttc

SEQ ID NO: 44114 - DNA, 15 bp, Homo sapiens
cactgcctgcagctt

SEQ ID NO: 44115 - DNA, 15 bp, Homo sapiens
ccactgcctgcagct

SEQ ID NO: 44116 - DNA, 15 bp, Homo sapiens
accactgcctgcagc

SEQ ID NO: 44117 - DNA, 15 bp, Homo sapiens
caccactgcctgcag

SEQ ID NO: 44118 - DNA, 15 bp, Homo sapiens
ccaccactgcctgca

SEQ ID NO: 44119 - DNA, 15 bp, Homo sapiens
gccaccactgcctgc

SEQ ID NO: 44120 - DNA, 15 bp, Homo sapiens
cgccaccactgcctg

SEQ ID NO: 44121 - DNA, 15 bp, Homo sapiens
ccgccaccactgcct

SEQ ID NO: 44122 - DNA, 15 bp, Homo sapiens
cccgccaccactgcc

SEQ ID NO: 44123 - DNA, 15 bp, Homo sapiens
ccccgccaccactgc

SEQ ID NO: 44124 - DNA, 15 bp, Homo sapiens
cccccgccaccactg

SEQ ID NO: 44125 - DNA, 15 bp, Homo sapiens
acccccgccaccact

SEQ ID NO: 44126 - DNA, 15 bp, Homo sapiens
cacccccgccaccac

SEQ ID NO: 44127 - DNA, 15 bp, Homo sapiens
gcacccccgccacca

SEQ ID NO: 44128 - DNA, 15 bp, Homo sapiens
ggcacccccgccacc

SEQ ID NO: 44129 - DNA, 15 bp, Homo sapiens
gggcacccccgccac

SEQ ID NO: 44130 - DNA, 15 bp, Homo sapiens
cgggcacccccgcca

SEQ ID NO: 44131 - DNA, 15 bp, Homo sapiens
ccgggcacccccgcc

SEQ ID NO: 44132 - DNA, 15 bp, Homo sapiens
cccgggcacccccgc

SEQ ID NO: 44133 - DNA, 15 bp, Homo sapiens
gcccgggcacccccg

SEQ ID NO: 44134 - DNA, 15 bp, Homo sapiens
tgcccgggcaccccc

SEQ ID NO: 44135 - DNA, 15 bp, Homo sapiens
atgcccgggcacccc

SEQ ID NO: 44136 - DNA, 15 bp, Homo sapiens
aatgcccgggcaccc

SEQ ID NO: 44137 - DNA, 15 bp, Homo sapiens
gaatgcccgggcacc

SEQ ID NO: 44138 - DNA, 15 bp, Homo sapiens
cgaatgcccgggcac

SEQ ID NO: 44139 - DNA, 15 bp, Homo sapiens
ccgaatgcccgggca

SEQ ID NO: 44140 - DNA, 15 bp, Homo sapiens
tccgaatgcccgggc

SEQ ID NO: 44141 - DNA, 15 bp, Homo sapiens
ctccgaatgcccggg

SEQ ID NO: 44142 - DNA, 15 bp, Homo sapiens
cctccgaatgcccgg

SEQ ID NO: 44143 - DNA, 15 bp, Homo sapiens
gcctccgaatgcccg

SEQ ID NO: 44144 - DNA, 15 bp, Homo sapiens
ggcctccgaatgccc

SEQ ID NO: 44145 - DNA, 15 bp, Homo sapiens
cggcctccgaatgcc

SEQ ID NO: 44146 - DNA, 15 bp, Homo sapiens
gcggcctccgaatgc

SEQ ID NO: 44147 - DNA, 15 bp, Homo sapiens
ggcggcctccgaatg

SEQ ID NO: 44148 - DNA, 15 bp, Homo sapiens
tggcggcctccgaat

SEQ ID NO: 44149 - DNA, 15 bp, Homo sapiens
ctggcggcctccgaa

SEQ ID NO: 44150 - DNA, 15 bp, Homo sapiens
gctggcggcctccga

SEQ ID NO: 44151 - DNA, 15 bp, Homo sapiens
agctggcggcctccg

SEQ ID NO: 44152 - DNA, 15 bp, Homo sapiens
cagctggcggcctcc

SEQ ID NO: 44153 - DNA, 15 bp, Homo sapiens
gcagctggcggcctc

SEQ ID NO: 44154 - DNA, 15 bp, Homo sapiens
tgcagctggcggcct

SEQ ID NO: 44155 - DNA, 15 bp, Homo sapiens
atgcagctggcggcc

SEQ ID NO: 44156 - DNA, 15 bp, Homo sapiens
gatgcagctggcggc

SEQ ID NO: 44157 - DNA, 15 bp, Homo sapiens
ggatgcagctggcgg

SEQ ID NO: 44158 - DNA, 15 bp, Homo sapiens
gggatgcagctggcg

SEQ ID NO: 44159 - DNA, 15 bp, Homo sapiens
ggggatgcagctggc

SEQ ID NO: 44160 - DNA, 15 bp, Homo sapiens
gggggatgcagctgg

SEQ ID NO: 44161 - DNA, 15 bp, Homo sapiens
ggggggatgcagctg

SEQ ID NO: 44162 - DNA, 15 bp, Homo sapiens
aggggggatgcagct

SEQ ID NO: 44163 - DNA, 15 bp, Homo sapiens
aaggggggatgcagc

SEQ ID NO: 44164 - DNA, 15 bp, Homo sapiens
gaaggggggatgcag

SEQ ID NO: 44165 - DNA, 15 bp, Homo sapiens
ggaaggggggatgca

SEQ ID NO: 44166 - DNA, 15 bp, Homo sapiens
gggaaggggggatgc

SEQ ID NO: 44167 - DNA, 15 bp, Homo sapiens
ggggaaggggggatg

SEQ ID NO: 44168 - DNA, 15 bp, Homo sapiens
cggggaaggggggat

SEQ ID NO: 44169 - DNA, 15 bp, Homo sapiens
gcggggaagggggga

SEQ ID NO: 44170 - DNA, 15 bp, Homo sapiens
tgcggggaagggggg

SEQ ID NO: 44171 - DNA, 15 bp, Homo sapiens
ctgcggggaaggggg

SEQ ID NO: 44172 - DNA, 15 bp, Homo sapiens
cctgcggggaagggg

SEQ ID NO: 44173 - DNA, 15 bp, Homo sapiens
tcctgcggggaaggg

SEQ ID NO: 44174 - DNA, 15 bp, Homo sapiens
ctcctgcggggaagg

SEQ ID NO: 44175 - DNA, 15 bp, Homo sapiens
tctcctgcggggaag

SEQ ID NO: 44176 - DNA, 15 bp, Homo sapiens
ttctcctgcggggaa

SEQ ID NO: 44177 - DNA, 15 bp, Homo sapiens
gttctcctgcgggga

SEQ ID NO: 44178 - DNA, 15 bp, Homo sapiens
agttctcctgcgggg

SEQ ID NO: 44179 - DNA, 15 bp, Homo sapiens
gagttctcctgcggg

SEQ ID NO: 44180 - DNA, 15 bp, Homo sapiens
ggagttctcctgcgg

SEQ ID NO: 44181 - DNA, 15 bp, Homo sapiens
aggagttctcctgcg

SEQ ID NO: 44182 - DNA, 15 bp, Homo sapiens
taggagttctcctgc

SEQ ID NO: 44183 - DNA, 15 bp, Homo sapiens
gtaggagttctcctg

SEQ ID NO: 44184 - DNA, 15 bp, Homo sapiens
cgtaggagttctcct

SEQ ID NO: 44185 - DNA, 15 bp, Homo sapiens
acgtaggagttctcc

SEQ ID NO: 44186 - DNA, 15 bp, Homo sapiens
cacgtaggagttctc

SEQ ID NO: 44187 - DNA, 15 bp, Homo sapiens
acacgtaggagttct

SEQ ID NO: 44188 - DNA, 15 bp, Homo sapiens
gacacgtaggagttc

SEQ ID NO: 44189 - DNA, 15 bp, Homo sapiens
ggacacgtaggagtt

SEQ ID NO: 44190 - DNA, 15 bp, Homo sapiens
tggacacgtaggagt

SEQ ID NO: 44191 - DNA, 15 bp, Homo sapiens
ctggacacgtaggag

SEQ ID NO: 44192 - DNA, 15 bp, Homo sapiens
gctggacacgtagga

SEQ ID NO: 44193 - DNA, 15 bp, Homo sapiens
tgctggacacgtagg

SEQ ID NO: 44194 - DNA, 15 bp, Homo sapiens
gtgctggacacgtag

SEQ ID NO: 44195 - DNA, 15 bp, Homo sapiens
agtgctggacacgta

SEQ ID NO: 44196 - DNA, 15 bp, Homo sapiens
cagtgctggacacgt

SEQ ID NO: 44197 - DNA, 15 bp, Homo sapiens
ccagtgctggacacg

SEQ ID NO: 44198 - DNA, 15 bp, Homo sapiens
gccagtgctggacac

SEQ ID NO: 44199 - DNA, 15 bp, Homo sapiens
tgccagtgctggaca

SEQ ID NO: 44200 - DNA, 15 bp, Homo sapiens
ctgccagtgctggac

SEQ ID NO: 44201 - DNA, 15 bp, Homo sapiens
tctgccagtgctgga

SEQ ID NO: 44202 - DNA, 15 bp, Homo sapiens
ctctgccagtgctgg

SEQ ID NO: 44203 - DNA, 15 bp, Homo sapiens
gctctgccagtgctg

SEQ ID NO: 44204 - DNA, 15 bp, Homo sapiens
ggctctgccagtgct

SEQ ID NO: 44205 - DNA, 15 bp, Homo sapiens
gggctctgccagtgc

SEQ ID NO: 44206 - DNA, 15 bp, Homo sapiens
tgggctctgccagtg

SEQ ID NO: 44207 - DNA, 15 bp, Homo sapiens
gtgggctctgccagt

SEQ ID NO: 44208 - DNA, 15 bp, Homo sapiens
tgtgggctctgccag

SEQ ID NO: 44209 - DNA, 15 bp, Homo sapiens
ctgtgggctctgcca

SEQ ID NO: 44210 - DNA, 15 bp, Homo sapiens
actgtgggctctgcc

SEQ ID NO: 44211 - DNA, 15 bp, Homo sapiens
cactgtgggctctgc

SEQ ID NO: 44212 - DNA, 15 bp, Homo sapiens
ccactgtgggctctg

SEQ ID NO: 44213 - DNA, 15 bp, Homo sapiens
cccactgtgggctct

SEQ ID NO: 44214 - DNA, 15 bp, Homo sapiens
ccccactgtgggctc

SEQ ID NO: 44215 - DNA, 15 bp, Homo sapiens
gccccactgtgggct

SEQ ID NO: 44216 - DNA, 15 bp, Homo sapiens
agccccactgtgggc

SEQ ID NO: 44217 - DNA, 15 bp, Homo sapiens
cagccccactgtggg

SEQ ID NO: 44218 - DNA, 15 bp, Homo sapiens
gcagccccactgtgg

SEQ ID NO: 44219 - DNA, 15 bp, Homo sapiens
agcagccccactgtg

SEQ ID NO: 44220 - DNA, 15 bp, Homo sapiens
gagcagccccactgt

SEQ ID NO: 44221 - DNA, 15 bp, Homo sapiens
ggagcagccccactg

SEQ ID NO: 44222 - DNA, 15 bp, Homo sapiens
tggagcagccccact

SEQ ID NO: 44223 - DNA, 15 bp, Homo sapiens
atggagcagccccac

SEQ ID NO: 44224 - DNA, 15 bp, Homo sapiens
catggagcagcccca

SEQ ID NO: 44225 - DNA, 15 bp, Homo sapiens
ccatggagcagcccc

SEQ ID NO: 44226 - DNA, 15 bp, Homo sapiens
gccatggagcagccc

SEQ ID NO: 44227 - DNA, 15 bp, Homo sapiens
tgccatggagcagcc

SEQ ID NO: 44228 - DNA, 15 bp, Homo sapiens
ctgccatggagcagc

SEQ ID NO: 44229 - DNA, 15 bp, Homo sapiens
gctgccatggagcag

SEQ ID NO: 44230 - DNA, 15 bp, Homo sapiens
ggctgccatggagca

SEQ ID NO: 44231 - DNA, 15 bp, Homo sapiens
gggctgccatggagc

SEQ ID NO: 44232 - DNA, 15 bp, Homo sapiens
ggggctgccatggag

SEQ ID NO: 44233 - DNA, 15 bp, Homo sapiens
aggggctgccatgga

SEQ ID NO: 44234 - DNA, 15 bp, Homo sapiens
caggggctgccatgg

SEQ ID NO: 44235 - DNA, 15 bp, Homo sapiens
ccaggggctgccatg

SEQ ID NO: 44236 - DNA, 15 bp, Homo sapiens
gccaggggctgccat

SEQ ID NO: 44237 - DNA, 15 bp, Homo sapiens
tgccaggggctgcca

SEQ ID NO: 44238 - DNA, 15 bp, Homo sapiens
ctgccaggggctgcc

SEQ ID NO: 44239 - DNA, 15 bp, Homo sapiens
gctgccaggggctgc

SEQ ID NO: 44240 - DNA, 15 bp, Homo sapiens
cgctgccaggggctg

SEQ ID NO: 44241 - DNA, 15 bp, Homo sapiens
gcgctgccaggggct

SEQ ID NO: 44242 - DNA, 15 bp, Homo sapiens
ggcgctgccaggggc

SEQ ID NO: 44243 - DNA, 15 bp, Homo sapiens
tggcgctgccagggg

SEQ ID NO: 44244 - DNA, 15 bp, Homo sapiens
atggcgctgccaggg

SEQ ID NO: 44245 - DNA, 15 bp, Homo sapiens
gatggcgctgccagg

SEQ ID NO: 44246 - DNA, 15 bp, Homo sapiens
tgatggcgctgccag

SEQ ID NO: 44247 - DNA, 15 bp, Homo sapiens
ctgatggcgctgcca

SEQ ID NO: 44248 - DNA, 15 bp, Homo sapiens
cctgatggcgctgcc

SEQ ID NO: 44249 - DNA, 15 bp, Homo sapiens
tcctgatggcgctgc

SEQ ID NO: 44250 - DNA, 15 bp, Homo sapiens
ctcctgatggcgctg

SEQ ID NO: 44251 - DNA, 15 bp, Homo sapiens
gctcctgatggcgct

SEQ ID NO: 44252 - DNA, 15 bp, Homo sapiens
ggctcctgatggcgc

SEQ ID NO: 44253 - DNA, 15 bp, Homo sapiens
tggctcctgatggcg

SEQ ID NO: 44254 - DNA, 15 bp, Homo sapiens
ctggctcctgatggc

SEQ ID NO: 44255 - DNA, 15 bp, Homo sapiens
actggctcctgatgg

SEQ ID NO: 44256 - DNA, 15 bp, Homo sapiens
cactggctcctgatg

SEQ ID NO: 44257 - DNA, 15 bp, Homo sapiens
gcactggctcctgat

SEQ ID NO: 44258 - DNA, 15 bp, Homo sapiens
ggcactggctcctga

SEQ ID NO: 44259 - DNA, 15 bp, Homo sapiens
gggcactggctcctg

SEQ ID NO: 44260 - DNA, 15 bp, Homo sapiens
tgggcactggctcct

SEQ ID NO: 44261 - DNA, 15 bp, Homo sapiens
ctgggcactggctcc

SEQ ID NO: 44262 - DNA, 15 bp, Homo sapiens
cctgggcactggctc

SEQ ID NO: 44263 - DNA, 15 bp, Homo sapiens
gcctgggcactggct

SEQ ID NO: 44264 - DNA, 15 bp, Homo sapiens
tgcctgggcactggc

SEQ ID NO: 44265 - DNA, 15 bp, Homo sapiens
ctgcctgggcactgg

SEQ ID NO: 44266 - DNA, 15 bp, Homo sapiens
gctgcctgggcactg

SEQ ID NO: 44267 - DNA, 15 bp, Homo sapiens
tgctgcctgggcact

SEQ ID NO: 44268 - DNA, 15 bp, Homo sapiens
ctgctgcctgggcac

SEQ ID NO: 44269 - DNA, 15 bp, Homo sapiens
tctgctgcctgggca

SEQ ID NO: 44270 - DNA, 15 bp, Homo sapiens
ctctgctgcctgggc

SEQ ID NO: 44271 - DNA, 15 bp, Homo sapiens
gctctgctgcctggg

SEQ ID NO: 44272 - DNA, 15 bp, Homo sapiens
tgctctgctgcctgg

SEQ ID NO: 44273 - DNA, 15 bp, Homo sapiens
ctgctctgctgcctg

SEQ ID NO: 44274 - DNA, 15 bp, Homo sapiens
gctgctctgctgcct

SEQ ID NO: 44275 - DNA, 15 bp, Homo sapiens
agctgctctgctgcc

SEQ ID NO: 44276 - DNA, 15 bp, Homo sapiens
cagctgctctgctgc

SEQ ID NO: 44277 - DNA, 15 bp, Homo sapiens
gcagctgctctgctg

SEQ ID NO: 44278 - DNA, 15 bp, Homo sapiens
tgcagctgctctgct

SEQ ID NO: 44279 - DNA, 15 bp, Homo sapiens
ctgcagctgctctgc

SEQ ID NO: 44280 - DNA, 15 bp, Homo sapiens
tctgcagctgctctg

SEQ ID NO: 44281 - DNA, 15 bp, Homo sapiens
ctctgcagctgctct

SEQ ID NO: 44282 - DNA, 15 bp, Homo sapiens
tctctgcagctgctc

SEQ ID NO: 44283 - DNA, 15 bp, Homo sapiens
ctctctgcagctgct

SEQ ID NO: 44284 - DNA, 15 bp, Homo sapiens
cctctctgcagctgc

SEQ ID NO: 44285 - DNA, 15 bp, Homo sapiens
gcctctctgcagctg

SEQ ID NO: 44286 - DNA, 15 bp, Homo sapiens
ggcctctctgcagct

SEQ ID NO: 44287 - DNA, 15 bp, Homo sapiens
gggcctctctgcagc

SEQ ID NO: 44288 - DNA, 15 bp, Homo sapiens
ggggcctctctgcag

SEQ ID NO: 44289 - DNA, 15 bp, Homo sapiens
tggggcctctctgca

SEQ ID NO: 44290 - DNA, 15 bp, Homo sapiens
ttggggcctctctgc

SEQ ID NO: 44291 - DNA, 15 bp, Homo sapiens
gttggggcctctctg

SEQ ID NO: 44292 - DNA, 15 bp, Homo sapiens
ggttggggcctctct

SEQ ID NO: 44293 - DNA, 15 bp, Homo sapiens
tggttggggcctctc

SEQ ID NO: 44294 - DNA, 15 bp, Homo sapiens
ctggttggggcctct

SEQ ID NO: 44295 - DNA, 15 bp, Homo sapiens
gctggttggggcctc

SEQ ID NO: 44296 - DNA, 15 bp, Homo sapiens
ggctggttggggcct

SEQ ID NO: 44297 - DNA, 15 bp, Homo sapiens
gggctggttggggcc

SEQ ID NO: 44298 - DNA, 15 bp, Homo sapiens
cgggctggttggggc

SEQ ID NO: 44299 - DNA, 15 bp, Homo sapiens
acgggctggttgggg

SEQ ID NO: 44300 - DNA, 15 bp, Homo sapiens
cacgggctggttggg

SEQ ID NO: 44301 - DNA, 15 bp, Homo sapiens
ccacgggctggttgg

SEQ ID NO: 44302 - DNA, 15 bp, Homo sapiens
tccacgggctggttg

SEQ ID NO: 44303 - DNA, 15 bp, Homo sapiens
ctccacgggctggtt

SEQ ID NO: 44304 - DNA, 15 bp, Homo sapiens
tctccacgggctggt

SEQ ID NO: 44305 - DNA, 15 bp, Homo sapiens
ctctccacgggctgg

SEQ ID NO: 44306 - DNA, 15 bp, Homo sapiens
actctccacgggctg

SEQ ID NO: 44307 - DNA, 15 bp, Homo sapiens
cactctccacgggct

SEQ ID NO: 44308 - DNA, 15 bp, Homo sapiens
tcactctccacgggc

SEQ ID NO: 44309 - DNA, 15 bp, Homo sapiens
gtcactctccacggg

SEQ ID NO: 44310 - DNA, 15 bp, Homo sapiens
cgtcactctccacgg

SEQ ID NO: 44311 - DNA, 15 bp, Homo sapiens
tcgtcactctccacg

SEQ ID NO: 44312 - DNA, 15 bp, Homo sapiens
ctcgtcactctccac

SEQ ID NO: 44313 - DNA, 15 bp, Homo sapiens
tctcgtcactctcca

SEQ ID NO: 44314 - DNA, 15 bp, Homo sapiens
ctctcgtcactctcc

SEQ ID NO: 44315 - DNA, 15 bp, Homo sapiens
gctctcgtcactctc

SEQ ID NO: 44316 - DNA, 15 bp, Homo sapiens
ggctctcgtcactct

SEQ ID NO: 44317 - DNA, 15 bp, Homo sapiens
aggctctcgtcactc

SEQ ID NO: 44318 - DNA, 15 bp, Homo sapiens
taggctctcgtcact

SEQ ID NO: 44319 - DNA, 15 bp, Homo sapiens
ctaggctctcgtcac

SEQ ID NO: 44320 - DNA, 15 bp, Homo sapiens
cctaggctctcgtca

SEQ ID NO: 44321 - DNA, 15 bp, Homo sapiens
gcctaggctctcgtc

SEQ ID NO: 44322 - DNA, 15 bp, Homo sapiens
cgcctaggctctcgt

SEQ ID NO: 44323 - DNA, 15 bp, Homo sapiens
ccgcctaggctctcg

SEQ ID NO: 44324 - DNA, 15 bp, Homo sapiens
gccgcctaggctctc

SEQ ID NO: 44325 - DNA, 15 bp, Homo sapiens
ggccgcctaggctct

SEQ ID NO: 44326 - DNA, 15 bp, Homo sapiens
aggccgcctaggctc

SEQ ID NO: 44327 - DNA, 15 bp, Homo sapiens
gaggccgcctaggct

SEQ ID NO: 44328 - DNA, 15 bp, Homo sapiens
agaggccgcctaggc

SEQ ID NO: 44329 - DNA, 15 bp, Homo sapiens
gagaggccgcctagg

SEQ ID NO: 44330 - DNA, 15 bp, Homo sapiens
agagaggccgcctag

SEQ ID NO: 44331 - DNA, 15 bp, Homo sapiens
cagagaggccgccta

SEQ ID NO: 44332 - DNA, 15 bp, Homo sapiens
gcagagaggccgcct

SEQ ID NO: 44333 - DNA, 15 bp, Homo sapiens
agcagagaggccgcc

SEQ ID NO: 44334 - DNA, 15 bp, Homo sapiens
cagcagagaggccgc

SEQ ID NO: 44335 - DNA, 15 bp, Homo sapiens
gcagcagagaggccg

SEQ ID NO: 44336 - DNA, 15 bp, Homo sapiens
ggcagcagagaggcc

SEQ ID NO: 44337 - DNA, 15 bp, Homo sapiens
gggcagcagagaggc

SEQ ID NO: 44338 - DNA, 15 bp, Homo sapiens
agggcagcagagagg

SEQ ID NO: 44339 - DNA, 15 bp, Homo sapiens
cagggcagcagagag

SEQ ID NO: 44340 - DNA, 15 bp, Homo sapiens
gcagggcagcagaga

SEQ ID NO: 44341 - DNA, 15 bp, Homo sapiens
cgcagggcagcagag

SEQ ID NO: 44342 - DNA, 15 bp, Homo sapiens
gcgcagggcagcaga

SEQ ID NO: 44343 - DNA, 15 bp, Homo sapiens
agcgcagggcagcag

SEQ ID NO: 44344 - DNA, 15 bp, Homo sapiens
gagcgcagggcagca

SEQ ID NO: 44345 - DNA, 15 bp, Homo sapiens
ggagcgcagggcagc

SEQ ID NO: 44346 - DNA, 15 bp, Homo sapiens
aggagcgcagggcag

SEQ ID NO: 44347 - DNA, 15 bp, Homo sapiens
caggagcgcagggca

SEQ ID NO: 44348 - DNA, 15 bp, Homo sapiens
ccaggagcgcagggc

SEQ ID NO: 44349 - DNA, 15 bp, Homo sapiens
gccaggagcgcaggg

SEQ ID NO: 44350 - DNA, 15 bp, Homo sapiens
tgccaggagcgcagg

SEQ ID NO: 44351 - DNA, 15 bp, Homo sapiens
gtgccaggagcgcag

SEQ ID NO: 44352 - DNA, 15 bp, Homo sapiens
agtgccaggagcgca

SEQ ID NO: 44353 - DNA, 15 bp, Homo sapiens
aagtgccaggagcgc

SEQ ID NO: 44354 - DNA, 15 bp, Homo sapiens
caagtgccaggagcg

SEQ ID NO: 44355 - DNA, 15 bp, Homo sapiens
tcaagtgccaggagc

SEQ ID NO: 44356 - DNA, 15 bp, Homo sapiens
gtcaagtgccaggag

SEQ ID NO: 44357 - DNA, 15 bp, Homo sapiens
agtcaagtgccagga

SEQ ID NO: 44358 - DNA, 15 bp, Homo sapiens
gagtcaagtgccagg

SEQ ID NO: 44359 - DNA, 15 bp, Homo sapiens
ggagtcaagtgccag

SEQ ID NO: 44360 - DNA, 15 bp, Homo sapiens
tggagtcaagtgcca

SEQ ID NO: 44361 - DNA, 15 bp, Homo sapiens
ttggagtcaagtgcc

SEQ ID NO: 44362 - DNA, 15 bp, Homo sapiens
cttggagtcaagtgc

SEQ ID NO: 44363 - DNA, 15 bp, Homo sapiens
gcttggagtcaagtg

SEQ ID NO: 44364 - DNA, 15 bp, Homo sapiens
agcttggagtcaagt

SEQ ID NO: 44365 - DNA, 15 bp, Homo sapiens
cagcttggagtcaag

SEQ ID NO: 44366 - DNA, 15 bp, Homo sapiens
gcagcttggagtcaa

SEQ ID NO: 44367 - DNA, 15 bp, Homo sapiens
ggcagcttggagtca

SEQ ID NO: 44368 - DNA, 15 bp, Homo sapiens
gggcagcttggagtc

SEQ ID NO: 44369 - DNA, 15 bp, Homo sapiens
agggcagcttggagt

SEQ ID NO: 44370 - DNA, 15 bp, Homo sapiens
gagggcagcttggag

SEQ ID NO: 44371 - DNA, 15 bp, Homo sapiens
agagggcagcttgga

SEQ ID NO: 44372 - DNA, 15 bp, Homo sapiens
cagagggcagcttgg

SEQ ID NO: 44373 - DNA, 15 bp, Homo sapiens
ccagagggcagcttg

SEQ ID NO: 44374 - DNA, 15 bp, Homo sapiens
tccagagggcagctt

SEQ ID NO: 44375 - DNA, 15 bp, Homo sapiens
gtccagagggcagct

SEQ ID NO: 44376 - DNA, 15 bp, Homo sapiens
ggtccagagggcagc

SEQ ID NO: 44377 - DNA, 15 bp, Homo sapiens
gggtccagagggcag

SEQ ID NO: 44378 - DNA, 15 bp, Homo sapiens
tgggtccagagggca

SEQ ID NO: 44379 - DNA, 15 bp, Homo sapiens
ctgggtccagagggc

SEQ ID NO: 44380 - DNA, 15 bp, Homo sapiens
gctgggtccagaggg

SEQ ID NO: 44381 - DNA, 15 bp, Homo sapiens
tgctgggtccagagg

SEQ ID NO: 44382 - DNA, 15 bp, Homo sapiens
gtgctgggtccagag

SEQ ID NO: 44383 - DNA, 15 bp, Homo sapiens
ggtgctgggtccaga

SEQ ID NO: 44384 - DNA, 15 bp, Homo sapiens
gggtgctgggtccag

SEQ ID NO: 44385 - DNA, 15 bp, Homo sapiens
ggggtgctgggtcca

SEQ ID NO: 44386 - DNA, 15 bp, Homo sapiens
aggggtgctgggtcc

SEQ ID NO: 44387 - DNA, 15 bp, Homo sapiens
gaggggtgctgggtc

SEQ ID NO: 44388 - DNA, 15 bp, Homo sapiens
tgaggggtgctgggt

SEQ ID NO: 44389 - DNA, 15 bp, Homo sapiens
ctgaggggtgctggg

SEQ ID NO: 44390 - DNA, 15 bp, Homo sapiens
cctgaggggtgctgg

SEQ ID NO: 44391 - DNA, 15 bp, Homo sapiens
ccctgaggggtgctg

SEQ ID NO: 44392 - DNA, 15 bp, Homo sapiens
tccctgaggggtgct

SEQ ID NO: 44393 - DNA, 15 bp, Homo sapiens
ctccctgaggggtgc

SEQ ID NO: 44394 - DNA, 15 bp, Homo sapiens
cctccctgaggggtg

SEQ ID NO: 44395 - DNA, 15 bp, Homo sapiens
gcctccctgaggggt

SEQ ID NO: 44396 - DNA, 15 bp, Homo sapiens
ggcctccctgagggg

SEQ ID NO: 44397 - DNA, 15 bp, Homo sapiens
cggcctccctgaggg

SEQ ID NO: 44398 - DNA, 15 bp, Homo sapiens
ccggcctccctgagg

SEQ ID NO: 44399 - DNA, 15 bp, Homo sapiens
gccggcctccctgag

SEQ ID NO: 44400 - DNA, 15 bp, Homo sapiens
agccggcctccctga

SEQ ID NO: 44401 - DNA, 15 bp, Homo sapiens
cagccggcctccctg

SEQ ID NO: 44402 - DNA, 15 bp, Homo sapiens
acagccggcctccct

SEQ ID NO: 44403 - DNA, 15 bp, Homo sapiens
gacagccggcctccc

SEQ ID NO: 44404 - DNA, 15 bp, Homo sapiens
ggacagccggcctcc

SEQ ID NO: 44405 - DNA, 15 bp, Homo sapiens
aggacagccggcctc

SEQ ID NO: 44406 - DNA, 15 bp, Homo sapiens
gaggacagccggcct

SEQ ID NO: 44407 - DNA, 15 bp, Homo sapiens
tgaggacagccggcc

SEQ ID NO: 44408 - DNA, 15 bp, Homo sapiens
ctgaggacagccggc

SEQ ID NO: 44409 - DNA, 15 bp, Homo sapiens
cctgaggacagccgg

SEQ ID NO: 44410 - DNA, 15 bp, Homo sapiens
ccctgaggacagccg

SEQ ID NO: 44411 - DNA, 15 bp, Homo sapiens
cccctgaggacagcc

SEQ ID NO: 44412 - DNA, 15 bp, Homo sapiens
ccccctgaggacagc

SEQ ID NO: 44413 - DNA, 15 bp, Homo sapiens
tccccctgaggacag

SEQ ID NO: 44414 - DNA, 15 bp, Homo sapiens
gtccccctgaggaca

SEQ ID NO: 44415 - DNA, 15 bp, Homo sapiens
tgtccccctgaggac

SEQ ID NO: 44416 - DNA, 15 bp, Homo sapiens
gtgtccccctgagga

SEQ ID NO: 44417 - DNA, 15 bp, Homo sapiens
cgtgtccccctgagg

SEQ ID NO: 44418 - DNA, 15 bp, Homo sapiens
ccgtgtccccctgag

SEQ ID NO: 44419 - DNA, 15 bp, Homo sapiens
gccgtgtccccctga

SEQ ID NO: 44420 - DNA, 15 bp, Homo sapiens
tgccgtgtccccctg

SEQ ID NO: 44421 - DNA, 15 bp, Homo sapiens
ctgccgtgtccccct

SEQ ID NO: 44422 - DNA, 15 bp, Homo sapiens
cctgccgtgtccccc

SEQ ID NO: 44423 - DNA, 15 bp, Homo sapiens
tcctgccgtgtcccc

SEQ ID NO: 44424 - DNA, 15 bp, Homo sapiens
ctcctgccgtgtccc

SEQ ID NO: 44425 - DNA, 15 bp, Homo sapiens
tctcctgccgtgtcc

SEQ ID NO: 44426 - DNA, 15 bp, Homo sapiens
ttctcctgccgtgtc

SEQ ID NO: 44427 - DNA, 15 bp, Homo sapiens
attctcctgccgtgt

SEQ ID NO: 44428 - DNA, 15 bp, Homo sapiens
gattctcctgccgtg

SEQ ID NO: 44429 - DNA, 15 bp, Homo sapiens
cgattctcctgccgt

SEQ ID NO: 44430 - DNA, 15 bp, Homo sapiens
tcgattctcctgccg

SEQ ID NO: 44431 - DNA, 15 bp, Homo sapiens
ctcgattctcctgcc

SEQ ID NO: 44432 - DNA, 15 bp, Homo sapiens
gctcgattctcctgc

SEQ ID NO: 44433 - DNA, 15 bp, Homo sapiens
agctcgattctcctg

SEQ ID NO: 44434 - DNA, 15 bp, Homo sapiens
cagctcgattctcct

SEQ ID NO: 44435 - DNA, 15 bp, Homo sapiens
ccagctcgattctcc

SEQ ID NO: 44436 - DNA, 15 bp, Homo sapiens
cccagctcgattctc

SEQ ID NO: 44437 - DNA, 15 bp, Homo sapiens
ccccagctcgattct

SEQ ID NO: 44438 - DNA, 15 bp, Homo sapiens
cccccagctcgattc

SEQ ID NO: 44439 - DNA, 15 bp, Homo sapiens
tcccccagctcgatt

SEQ ID NO: 44440 - DNA, 15 bp, Homo sapiens
ctcccccagctcgat

SEQ ID NO: 44441 - DNA, 15 bp, Homo sapiens
actcccccagctcga

SEQ ID NO: 44442 - DNA, 15 bp, Homo sapiens
cactcccccagctcg

SEQ ID NO: 44443 - DNA, 15 bp, Homo sapiens
ccactcccccagctc

SEQ ID NO: 44444 - DNA, 15 bp, Homo sapiens
gccactcccccagct

SEQ ID NO: 44445 - DNA, 15 bp, Homo sapiens
ggccactcccccagc

SEQ ID NO: 44446 - DNA, 15 bp, Homo sapiens
gggccactcccccag

SEQ ID NO: 44447 - DNA, 15 bp, Homo sapiens
tgggccactccccca

SEQ ID NO: 44448 - DNA, 15 bp, Homo sapiens
ctgggccactccccc

SEQ ID NO: 44449 - DNA, 15 bp, Homo sapiens
cctgggccactcccc

SEQ ID NO: 44450 - DNA, 15 bp, Homo sapiens
tcctgggccactccc

SEQ ID NO: 44451 - DNA, 15 bp, Homo sapiens
atcctgggccactcc

SEQ ID NO: 44452 - DNA, 15 bp, Homo sapiens
gatcctgggccactc

SEQ ID NO: 44453 - DNA, 15 bp, Homo sapiens
ggatcctgggccact

SEQ ID NO: 44454 - DNA, 15 bp, Homo sapiens
gggatcctgggccac

SEQ ID NO: 44455 - DNA, 15 bp, Homo sapiens
cgggatcctgggcca

SEQ ID NO: 44456 - DNA, 15 bp, Homo sapiens
ccgggatcctgggcc

SEQ ID NO: 44457 - DNA, 15 bp, Homo sapiens
gccgggatcctgggc

SEQ ID NO: 44458 - DNA, 15 bp, Homo sapiens
ggccgggatcctggg

SEQ ID NO: 44459 - DNA, 15 bp, Homo sapiens
gggccgggatcctgg

SEQ ID NO: 44460 - DNA, 15 bp, Homo sapiens
tgggccgggatcctg

SEQ ID NO: 44461 - DNA, 15 bp, Homo sapiens
gtgggccgggatcct

SEQ ID NO: 44462 - DNA, 15 bp, Homo sapiens
tgtgggccgggatcc

SEQ ID NO: 44463 - DNA, 15 bp, Homo sapiens
ctgtgggccgggatc

SEQ ID NO: 44464 - DNA, 15 bp, Homo sapiens
gctgtgggccgggat

SEQ ID NO: 44465 - DNA, 15 bp, Homo sapiens
ggctgtgggccggga

SEQ ID NO: 44466 - DNA, 15 bp, Homo sapiens
cggctgtgggccggg

SEQ ID NO: 44467 - DNA, 15 bp, Homo sapiens
acggctgtgggccgg

SEQ ID NO: 44468 - DNA, 15 bp, Homo sapiens
cacggctgtgggccg

SEQ ID NO: 44469 - DNA, 15 bp, Homo sapiens
ccacggctgtgggcc

SEQ ID NO: 44470 - DNA, 15 bp, Homo sapiens
tccacggctgtgggc

SEQ ID NO: 44471 - DNA, 15 bp, Homo sapiens
ttccacggctgtggg

SEQ ID NO: 44472 - DNA, 15 bp, Homo sapiens
cttccacggctgtgg

SEQ ID NO: 44473 - DNA, 15 bp, Homo sapiens
ccttccacggctgtg

SEQ ID NO: 44474 - DNA, 15 bp, Homo sapiens
accttccacggctgt

SEQ ID NO: 44475 - DNA, 15 bp, Homo sapiens
taccttccacggctg

SEQ ID NO: 44476 - DNA, 15 bp, Homo sapiens
ctaccttccacggct

SEQ ID NO: 44477 - DNA, 15 bp, Homo sapiens
gctaccttccacggc

SEQ ID NO: 44478 - DNA, 15 bp, Homo sapiens
agctaccttccacgg

SEQ ID NO: 44479 - DNA, 15 bp, Homo sapiens
cagctaccttccacg

SEQ ID NO: 44480 - DNA, 15 bp, Homo sapiens
ccagctaccttccac

SEQ ID NO: 44481 - DNA, 15 bp, Homo sapiens
cccagctaccttcca

SEQ ID NO: 44482 - DNA, 15 bp, Homo sapiens
ccccagctaccttcc

SEQ ID NO: 44483 - DNA, 15 bp, Homo sapiens
tccccagctaccttc

SEQ ID NO: 44484 - DNA, 15 bp, Homo sapiens
ctccccagctacctt

SEQ ID NO: 44485 - DNA, 15 bp, Homo sapiens
tctccccagctacct

SEQ ID NO: 44486 - DNA, 15 bp, Homo sapiens
gtctccccagctacc

SEQ ID NO: 44487 - DNA, 15 bp, Homo sapiens
cgtctccccagctac

SEQ ID NO: 44488 - DNA, 15 bp, Homo sapiens
ccgtctccccagcta

SEQ ID NO: 44489 - DNA, 15 bp, Homo sapiens
cccgtctccccagct

SEQ ID NO: 44490 - DNA, 15 bp, Homo sapiens
acccgtctccccagc

SEQ ID NO: 44491 - DNA, 15 bp, Homo sapiens
aacccgtctccccag

SEQ ID NO: 44492 - DNA, 15 bp, Homo sapiens
gaacccgtctcccca

SEQ ID NO: 44493 - DNA, 15 bp, Homo sapiens
ggaacccgtctcccc

SEQ ID NO: 44494 - DNA, 15 bp, Homo sapiens
gggaacccgtctccc

SEQ ID NO: 44495 - DNA, 15 bp, Homo sapiens
tgggaacccgtctcc

SEQ ID NO: 44496 - DNA, 15 bp, Homo sapiens
ctgggaacccgtctc

SEQ ID NO: 44497 - DNA, 15 bp, Homo sapiens
cctgggaacccgtct

SEQ ID NO: 44498 - DNA, 15 bp, Homo sapiens
tcctgggaacccgtc

SEQ ID NO: 44499 - DNA, 15 bp, Homo sapiens
ctcctgggaacccgt

SEQ ID NO: 44500 - DNA, 15 bp, Homo sapiens
tctcctgggaacccg

SEQ ID NO: 44501 - DNA, 15 bp, Homo sapiens
ctctcctgggaaccc

SEQ ID NO: 44502 - DNA, 15 bp, Homo sapiens
cctctcctgggaacc

SEQ ID NO: 44503 - DNA, 15 bp, Homo sapiens
ccctctcctgggaac

SEQ ID NO: 44504 - DNA, 15 bp, Homo sapiens
tccctctcctgggaa

SEQ ID NO: 44505 - DNA, 15 bp, Homo sapiens
gtccctctcctggga

SEQ ID NO: 44506 - DNA, 15 bp, Homo sapiens
ggtccctctcctggg

SEQ ID NO: 44507 - DNA, 15 bp, Homo sapiens
tggtccctctcctgg

SEQ ID NO: 44508 - DNA, 15 bp, Homo sapiens
ttggtccctctcctg

SEQ ID NO: 44509 - DNA, 15 bp, Homo sapiens
cttggtccctctcct

SEQ ID NO: 44510 - DNA, 15 bp, Homo sapiens
ccttggtccctctcc

SEQ ID NO: 44511 - DNA, 15 bp, Homo sapiens
gccttggtccctctc

SEQ ID NO: 44512 - DNA, 15 bp, Homo sapiens
ggccttggtccctct

SEQ ID NO: 44513 - DNA, 15 bp, Homo sapiens
aggccttggtccctc

SEQ ID NO: 44514 - DNA, 15 bp, Homo sapiens
gaggccttggtccct

SEQ ID NO: 44515 - DNA, 15 bp, Homo sapiens
agaggccttggtccc

SEQ ID NO: 44516 - DNA, 15 bp, Homo sapiens
aagaggccttggtcc

SEQ ID NO: 44517 - DNA, 15 bp, Homo sapiens
aaagaggccttggtc

SEQ ID NO: 44518 - DNA, 15 bp, Homo sapiens
caaagaggccttggt

SEQ ID NO: 44519 - DNA, 15 bp, Homo sapiens
ccaaagaggccttgg

SEQ ID NO: 44520 - DNA, 15 bp, Homo sapiens
cccaaagaggccttg

SEQ ID NO: 44521 - DNA, 15 bp, Homo sapiens
gcccaaagaggcctt

SEQ ID NO: 44522 - DNA, 15 bp, Homo sapiens
ggcccaaagaggcct

SEQ ID NO: 44523 - DNA, 15 bp, Homo sapiens
tggcccaaagaggcc

SEQ ID NO: 44524 - DNA, 15 bp, Homo sapiens
ttggcccaaagaggc

SEQ ID NO: 44525 - DNA, 15 bp, Homo sapiens
tttggcccaaagagg

SEQ ID NO: 44526 - DNA, 15 bp, Homo sapiens
ctttggcccaaagag

SEQ ID NO: 44527 - DNA, 15 bp, Homo sapiens
gctttggcccaaaga

SEQ ID NO: 44528 - DNA, 15 bp, Homo sapiens
ggctttggcccaaag

SEQ ID NO: 44529 - DNA, 15 bp, Homo sapiens
gggctttggcccaaa

SEQ ID NO: 44530 - DNA, 15 bp, Homo sapiens
ggggctttggcccaa

SEQ ID NO: 44531 - DNA, 15 bp, Homo sapiens
aggggctttggccca

SEQ ID NO: 44532 - DNA, 15 bp, Homo sapiens
caggggctttggccc

SEQ ID NO: 44533 - DNA, 15 bp, Homo sapiens
acaggggctttggcc

SEQ ID NO: 44534 - DNA, 15 bp, Homo sapiens
tacaggggctttggc

SEQ ID NO: 44535 - DNA, 15 bp, Homo sapiens
ttacaggggctttgg

SEQ ID NO: 44536 - DNA, 15 bp, Homo sapiens
cttacaggggctttg

SEQ ID NO: 44537 - DNA, 15 bp, Homo sapiens
acttacaggggcttt

SEQ ID NO: 44538 - DNA, 15 bp, Homo sapiens
gacttacaggggctt

SEQ ID NO: 44539 - DNA, 15 bp, Homo sapiens
ggacttacaggggct

SEQ ID NO: 44540 - DNA, 15 bp, Homo sapiens
gggacttacaggggc

SEQ ID NO: 44541 - DNA, 15 bp, Homo sapiens
ggggacttacagggg

SEQ ID NO: 44542 - DNA, 15 bp, Homo sapiens
tggggacttacaggg

SEQ ID NO: 44543 - DNA, 15 bp, Homo sapiens
gtggggacttacagg

SEQ ID NO: 44544 - DNA, 15 bp, Homo sapiens
ggtggggacttacag

SEQ ID NO: 44545 - DNA, 15 bp, Homo sapiens
gggtggggacttaca

SEQ ID NO: 44546 - DNA, 15 bp, Homo sapiens
ggggtggggacttac

SEQ ID NO: 44547 - DNA, 15 bp, Homo sapiens
tggggtggggactta

SEQ ID NO: 44548 - DNA, 15 bp, Homo sapiens
ctggggtggggactt

SEQ ID NO: 44549 - DNA, 15 bp, Homo sapiens
gctggggtggggact

SEQ ID NO: 44550 - DNA, 15 bp, Homo sapiens
ggctggggtggggac

SEQ ID NO: 44551 - DNA, 15 bp, Homo sapiens
aggctggggtgggga

SEQ ID NO: 44552 - DNA, 15 bp, Homo sapiens
aaggctggggtgggg

SEQ ID NO: 44553 - DNA, 15 bp, Homo sapiens
gaaggctggggtggg

SEQ ID NO: 44554 - DNA, 15 bp, Homo sapiens
agaaggctggggtgg

SEQ ID NO: 44555 - DNA, 15 bp, Homo sapiens
tagaaggctggggtg

SEQ ID NO: 44556 - DNA, 15 bp, Homo sapiens
ctagaaggctggggt

SEQ ID NO: 44557 - DNA, 15 bp, Homo sapiens
tctagaaggctgggg

SEQ ID NO: 44558 - DNA, 15 bp, Homo sapiens
ttctagaaggctggg

SEQ ID NO: 44559 - DNA, 15 bp, Homo sapiens
cttctagaaggctgg

SEQ ID NO: 44560 - DNA, 15 bp, Homo sapiens
tcttctagaaggctg

SEQ ID NO: 44561 - DNA, 15 bp, Homo sapiens
ctcttctagaaggct

SEQ ID NO: 44562 - DNA, 15 bp, Homo sapiens
tctcttctagaaggc

SEQ ID NO: 44563 - DNA, 15 bp, Homo sapiens
ttctcttctagaagg

SEQ ID NO: 44564 - DNA, 15 bp, Homo sapiens
gttctcttctagaag

SEQ ID NO: 44565 - DNA, 15 bp, Homo sapiens
ggttctcttctagaa

SEQ ID NO: 44566 - DNA, 15 bp, Homo sapiens
tggttctcttctaga

SEQ ID NO: 44567 - DNA, 15 bp, Homo sapiens
ctggttctcttctag

SEQ ID NO: 44568 - DNA, 15 bp, Homo sapiens
cctggttctcttcta

SEQ ID NO: 44569 - DNA, 15 bp, Homo sapiens
ccctggttctcttct

SEQ ID NO: 44570 - DNA, 15 bp, Homo sapiens
gccctggttctcttc

SEQ ID NO: 44571 - DNA, 15 bp, Homo sapiens
ggccctggttctctt

SEQ ID NO: 44572 - DNA, 15 bp, Homo sapiens
tggccctggttctct

SEQ ID NO: 44573 - DNA, 15 bp, Homo sapiens
ttggccctggttctc

SEQ ID NO: 44574 - DNA, 15 bp, Homo sapiens
tttggccctggttct

SEQ ID NO: 44575 - DNA, 15 bp, Homo sapiens
atttggccctggttc

SEQ ID NO: 44576 - DNA, 15 bp, Homo sapiens
catttggccctggtt

SEQ ID NO: 44577 - DNA, 15 bp, Homo sapiens
acatttggccctggt

SEQ ID NO: 44578 - DNA, 15 bp, Homo sapiens
aacatttggccctgg

SEQ ID NO: 44579 - DNA, 15 bp, Homo sapiens
gaacatttggccctg

SEQ ID NO: 44580 - DNA, 15 bp, Homo sapiens
tgaacatttggccct

SEQ ID NO: 44581 - DNA, 15 bp, Homo sapiens
ctgaacatttggccc

SEQ ID NO: 44582 - DNA, 15 bp, Homo sapiens
gctgaacatttggcc

SEQ ID NO: 44583 - DNA, 15 bp, Homo sapiens
agctgaacatttggc

SEQ ID NO: 44584 - DNA, 15 bp, Homo sapiens
gagctgaacatttgg

SEQ ID NO: 44585 - DNA, 15 bp, Homo sapiens
tgagctgaacatttg

SEQ ID NO: 44586 - DNA, 15 bp, Homo sapiens
gtgagctgaacattt

SEQ ID NO: 44587 - DNA, 15 bp, Homo sapiens
agtgagctgaacatt

SEQ ID NO: 44588 - DNA, 15 bp, Homo sapiens
cagtgagctgaacat

SEQ ID NO: 44589 - DNA, 15 bp, Homo sapiens
acagtgagctgaaca

SEQ ID NO: 44590 - DNA, 15 bp, Homo sapiens
cacagtgagctgaac

SEQ ID NO: 44591 - DNA, 15 bp, Homo sapiens
tcacagtgagctgaa

SEQ ID NO: 44592 - DNA, 15 bp, Homo sapiens
gtcacagtgagctga

SEQ ID NO: 44593 - DNA, 15 bp, Homo sapiens
ggtcacagtgagctg

SEQ ID NO: 44594 - DNA, 15 bp, Homo sapiens
aggtcacagtgagct

SEQ ID NO: 44595 - DNA, 15 bp, Homo sapiens
aaggtcacagtgagc

SEQ ID NO: 44596 - DNA, 15 bp, Homo sapiens
taaggtcacagtgag

SEQ ID NO: 44597 - DNA, 15 bp, Homo sapiens
ctaaggtcacagtga

SEQ ID NO: 44598 - DNA, 15 bp, Homo sapiens
gctaaggtcacagtg

SEQ ID NO: 44599 - DNA, 15 bp, Homo sapiens
tgctaaggtcacagt

SEQ ID NO: 44600 - DNA, 15 bp, Homo sapiens
ttgctaaggtcacag

SEQ ID NO: 44601 - DNA, 15 bp, Homo sapiens
gttgctaaggtcaca

SEQ ID NO: 44602 - DNA, 15 bp, Homo sapiens
ggttgctaaggtcac

SEQ ID NO: 44603 - DNA, 15 bp, Homo sapiens
gggttgctaaggtca

SEQ ID NO: 44604 - DNA, 15 bp, Homo sapiens
agggttgctaaggtc

SEQ ID NO: 44605 - DNA, 15 bp, Homo sapiens
cagggttgctaaggt

SEQ ID NO: 44606 - DNA, 15 bp, Homo sapiens
ccagggttgctaagg

SEQ ID NO: 44607 - DNA, 15 bp, Homo sapiens
accagggttgctaag

SEQ ID NO: 44608 - DNA, 15 bp, Homo sapiens
aaccagggttgctaa

SEQ ID NO: 44609 - DNA, 15 bp, Homo sapiens
aaaccagggttgcta

SEQ ID NO: 44610 - DNA, 15 bp, Homo sapiens
gaaaccagggttgct

SEQ ID NO: 44611 - DNA, 15 bp, Homo sapiens
ggaaaccagggttgc

SEQ ID NO: 44612 - DNA, 15 bp, Homo sapiens
gggaaaccagggttg

SEQ ID NO: 44613 - DNA, 15 bp, Homo sapiens
ggggaaaccagggtt

SEQ ID NO: 44614 - DNA, 15 bp, Homo sapiens
aggggaaaccagggt

SEQ ID NO: 44615 - DNA, 15 bp, Homo sapiens
gaggggaaaccaggg

SEQ ID NO: 44616 - DNA, 15 bp, Homo sapiens
ggaggggaaaccagg

SEQ ID NO: 44617 - DNA, 15 bp, Homo sapiens
gggaggggaaaccag

SEQ ID NO: 44618 - DNA, 15 bp, Homo sapiens
ggggaggggaaacca

SEQ ID NO: 44619 - DNA, 15 bp, Homo sapiens
tggggaggggaaacc

SEQ ID NO: 44620 - DNA, 15 bp, Homo sapiens
ctggggaggggaaac

SEQ ID NO: 44621 - DNA, 15 bp, Homo sapiens
cctggggaggggaaa

SEQ ID NO: 44622 - DNA, 15 bp, Homo sapiens
gcctggggaggggaa

SEQ ID NO: 44623 - DNA, 15 bp, Homo sapiens
ggcctggggagggga

SEQ ID NO: 44624 - DNA, 15 bp, Homo sapiens
tggcctggggagggg

SEQ ID NO: 44625 - DNA, 15 bp, Homo sapiens
gtggcctggggaggg

SEQ ID NO: 44626 - DNA, 15 bp, Homo sapiens
tgtggcctggggagg

SEQ ID NO: 44627 - DNA, 15 bp, Homo sapiens
atgtggcctggggag

SEQ ID NO: 44628 - DNA, 15 bp, Homo sapiens
gatgtggcctgggga

SEQ ID NO: 44629 - DNA, 15 bp, Homo sapiens
ggatgtggcctgggg

SEQ ID NO: 44630 - DNA, 15 bp, Homo sapiens
aggatgtggcctggg

SEQ ID NO: 44631 - DNA, 15 bp, Homo sapiens
aaggatgtggcctgg

SEQ ID NO: 44632 - DNA, 15 bp, Homo sapiens
gaaggatgtggcctg

SEQ ID NO: 44633 - DNA, 15 bp, Homo sapiens
ggaaggatgtggcct

SEQ ID NO: 44634 - DNA, 15 bp, Homo sapiens
gggaaggatgtggcc

SEQ ID NO: 44635 - DNA, 15 bp, Homo sapiens
tgggaaggatgtggc

SEQ ID NO: 44636 - DNA, 15 bp, Homo sapiens
ctgggaaggatgtgg

SEQ ID NO: 44637 - DNA, 15 bp, Homo sapiens
cctgggaaggatgtg

SEQ ID NO: 44638 - DNA, 15 bp, Homo sapiens
acctgggaaggatgt

SEQ ID NO: 44639 - DNA, 15 bp, Homo sapiens
cacctgggaaggatg

SEQ ID NO: 44640 - DNA, 15 bp, Homo sapiens
ccacctgggaaggat

SEQ ID NO: 44641 - DNA, 15 bp, Homo sapiens
tccacctgggaagga

SEQ ID NO: 44642 - DNA, 15 bp, Homo sapiens
ctccacctgggaagg

SEQ ID NO: 44643 - DNA, 15 bp, Homo sapiens
gctccacctgggaag

SEQ ID NO: 44644 - DNA, 15 bp, Homo sapiens
agctccacctgggaa

SEQ ID NO: 44645 - DNA, 15 bp, Homo sapiens
aagctccacctggga

SEQ ID NO: 44646 - DNA, 15 bp, Homo sapiens
caagctccacctggg

SEQ ID NO: 44647 - DNA, 15 bp, Homo sapiens
gcaagctccacctgg

SEQ ID NO: 44648 - DNA, 15 bp, Homo sapiens
agcaagctccacctg

SEQ ID NO: 44649 - DNA, 15 bp, Homo sapiens
gagcaagctccacct

SEQ ID NO: 44650 - DNA, 15 bp, Homo sapiens
agagcaagctccacc

SEQ ID NO: 44651 - DNA, 15 bp, Homo sapiens
gagagcaagctccac

SEQ ID NO: 44652 - DNA, 15 bp, Homo sapiens
ggagagcaagctcca

SEQ ID NO: 44653 - DNA, 15 bp, Homo sapiens
tggagagcaagctcc

SEQ ID NO: 44654 - DNA, 15 bp, Homo sapiens
ctggagagcaagctc

SEQ ID NO: 44655 - DNA, 15 bp, Homo sapiens
gctggagagcaagct

SEQ ID NO: 44656 - DNA, 15 bp, Homo sapiens
ggctggagagcaagc

SEQ ID NO: 44657 - DNA, 15 bp, Homo sapiens
gggctggagagcaag

SEQ ID NO: 44658 - DNA, 15 bp, Homo sapiens
agggctggagagcaa

SEQ ID NO: 44659 - DNA, 15 bp, Homo sapiens
gagggctggagagca

SEQ ID NO: 44660 - DNA, 15 bp, Homo sapiens
ggagggctggagagc

SEQ ID NO: 44661 - DNA, 15 bp, Homo sapiens
gggagggctggagag

SEQ ID NO: 44662 - DNA, 15 bp, Homo sapiens
ggggagggctggaga

SEQ ID NO: 44663 - DNA, 15 bp, Homo sapiens
gggggagggctggag

SEQ ID NO: 44664 - DNA, 15 bp, Homo sapiens
ggggggagggctgga

SEQ ID NO: 44665 - DNA, 15 bp, Homo sapiens
tggggggagggctgg

SEQ ID NO: 44666 - DNA, 15 bp, Homo sapiens
gtggggggagggctg

SEQ ID NO: 44667 - DNA, 15 bp, Homo sapiens
ggtggggggagggct

SEQ ID NO: 44668 - DNA, 15 bp, Homo sapiens
gggtggggggagggc

SEQ ID NO: 44669 - DNA, 15 bp, Homo sapiens
ggggtggggggaggg

SEQ ID NO: 44670 - DNA, 15 bp, Homo sapiens
tggggtggggggagg

SEQ ID NO: 44671 - DNA, 15 bp, Homo sapiens
atggggtggggggag

SEQ ID NO: 44672 - DNA, 15 bp, Homo sapiens
aatggggtgggggga

SEQ ID NO: 44673 - DNA, 15 bp, Homo sapiens
gaatggggtgggggg

SEQ ID NO: 44674 - DNA, 15 bp, Homo sapiens
ggaatggggtggggg

SEQ ID NO: 44675 - DNA, 15 bp, Homo sapiens
aggaatggggtgggg

SEQ ID NO: 44676 - DNA, 15 bp, Homo sapiens
caggaatggggtggg

SEQ ID NO: 44677 - DNA, 15 bp, Homo sapiens
tcaggaatggggtgg

SEQ ID NO: 44678 - DNA, 15 bp, Homo sapiens
ttcaggaatggggtg

SEQ ID NO: 44679 - DNA, 15 bp, Homo sapiens
cttcaggaatggggt

SEQ ID NO: 44680 - DNA, 15 bp, Homo sapiens
ccttcaggaatgggg

SEQ ID NO: 44681 - DNA, 15 bp, Homo sapiens
gccttcaggaatggg

SEQ ID NO: 44682 - DNA, 15 bp, Homo sapiens
agccttcaggaatgg

SEQ ID NO: 44683 - DNA, 15 bp, Homo sapiens
cagccttcaggaatg

SEQ ID NO: 44684 - DNA, 15 bp, Homo sapiens
ccagccttcaggaat

SEQ ID NO: 44685 - DNA, 15 bp, Homo sapiens
cccagccttcaggaa

SEQ ID NO: 44686 - DNA, 15 bp, Homo sapiens
tcccagccttcagga

SEQ ID NO: 44687 - DNA, 15 bp, Homo sapiens
ttcccagccttcagg

SEQ ID NO: 44688 - DNA, 15 bp, Homo sapiens
gttcccagccttcag

SEQ ID NO: 44689 - DNA, 15 bp, Homo sapiens
tgttcccagccttca

SEQ ID NO: 44690 - DNA, 15 bp, Homo sapiens
ttgttcccagccttc

SEQ ID NO: 44691 - DNA, 15 bp, Homo sapiens
cttgttcccagcctt

SEQ ID NO: 44692 - DNA, 15 bp, Homo sapiens
ccttgttcccagcct

SEQ ID NO: 44693 - DNA, 15 bp, Homo sapiens
tccttgttcccagcc

SEQ ID NO: 44694 - DNA, 15 bp, Homo sapiens
ctccttgttcccagc

SEQ ID NO: 44695 - DNA, 15 bp, Homo sapiens
cctccttgttcccag

SEQ ID NO: 44696 - DNA, 15 bp, Homo sapiens
ccctccttgttccca

SEQ ID NO: 44697 - DNA, 15 bp, Homo sapiens
gccctccttgttccc

SEQ ID NO: 44698 - DNA, 15 bp, Homo sapiens
agccctccttgttcc

SEQ ID NO: 44699 - DNA, 15 bp, Homo sapiens
gagccctccttgttc

SEQ ID NO: 44700 - DNA, 15 bp, Homo sapiens
agagccctccttgtt

SEQ ID NO: 44701 - DNA, 15 bp, Homo sapiens
cagagccctccttgt

SEQ ID NO: 44702 - DNA, 15 bp, Homo sapiens
acagagccctccttg

SEQ ID NO: 44703 - DNA, 15 bp, Homo sapiens
gacagagccctcctt

SEQ ID NO: 44704 - DNA, 15 bp, Homo sapiens
agacagagccctcct

SEQ ID NO: 44705 - DNA, 15 bp, Homo sapiens
cagacagagccctcc

SEQ ID NO: 44706 - DNA, 15 bp, Homo sapiens
ccagacagagccctc

SEQ ID NO: 44707 - DNA, 15 bp, Homo sapiens
accagacagagccct

SEQ ID NO: 44708 - DNA, 15 bp, Homo sapiens
taccagacagagccc

SEQ ID NO: 44709 - DNA, 15 bp, Homo sapiens
ctaccagacagagcc

SEQ ID NO: 44710 - DNA, 15 bp, Homo sapiens
gctaccagacagagc

SEQ ID NO: 44711 - DNA, 15 bp, Homo sapiens
ggctaccagacagag

SEQ ID NO: 44712 - DNA, 15 bp, Homo sapiens
aggctaccagacaga

SEQ ID NO: 44713 - DNA, 15 bp, Homo sapiens
caggctaccagacag

SEQ ID NO: 44714 - DNA, 15 bp, Homo sapiens
tcaggctaccagaca

SEQ ID NO: 44715 - DNA, 15 bp, Homo sapiens
ctcaggctaccagac

SEQ ID NO: 44716 - DNA, 15 bp, Homo sapiens
tctcaggctaccaga

SEQ ID NO: 44717 - DNA, 15 bp, Homo sapiens
ctctcaggctaccag

SEQ ID NO: 44718 - DNA, 15 bp, Homo sapiens
gctctcaggctacca

SEQ ID NO: 44719 - DNA, 15 bp, Homo sapiens
agctctcaggctacc

SEQ ID NO: 44720 - DNA, 15 bp, Homo sapiens
cagctctcaggctac

SEQ ID NO: 44721 - DNA, 15 bp, Homo sapiens
ccagctctcaggcta

SEQ ID NO: 44722 - DNA, 15 bp, Homo sapiens
cccagctctcaggct

SEQ ID NO: 44723 - DNA, 15 bp, Homo sapiens
gcccagctctcaggc

SEQ ID NO: 44724 - DNA, 15 bp, Homo sapiens
ggcccagctctcagg

SEQ ID NO: 44725 - DNA, 15 bp, Homo sapiens
gggcccagctctcag

SEQ ID NO: 44726 - DNA, 15 bp, Homo sapiens
agggcccagctctca

SEQ ID NO: 44727 - DNA, 15 bp, Homo sapiens
cagggcccagctctc

SEQ ID NO: 44728 - DNA, 15 bp, Homo sapiens
gcagggcccagctct

SEQ ID NO: 44729 - DNA, 15 bp, Homo sapiens
ggcagggcccagctc

SEQ ID NO: 44730 - DNA, 15 bp, Homo sapiens
gggcagggcccagct

SEQ ID NO: 44731 - DNA, 15 bp, Homo sapiens
agggcagggcccagc

SEQ ID NO: 44732 - DNA, 15 bp, Homo sapiens
aagggcagggcccag

SEQ ID NO: 44733 - DNA, 15 bp, Homo sapiens
caagggcagggccca

SEQ ID NO: 44734 - DNA, 15 bp, Homo sapiens
ccaagggcagggccc

SEQ ID NO: 44735 - DNA, 15 bp, Homo sapiens
tccaagggcagggcc

SEQ ID NO: 44736 - DNA, 15 bp, Homo sapiens
gtccaagggcagggc

SEQ ID NO: 44737 - DNA, 15 bp, Homo sapiens
agtccaagggcaggg

SEQ ID NO: 44738 - DNA, 15 bp, Homo sapiens
aagtccaagggcagg

SEQ ID NO: 44739 - DNA, 15 bp, Homo sapiens
gaagtccaagggcag

SEQ ID NO: 44740 - DNA, 15 bp, Homo sapiens
agaagtccaagggca

SEQ ID NO: 44741 - DNA, 15 bp, Homo sapiens
gagaagtccaagggc

SEQ ID NO: 44742 - DNA, 15 bp, Homo sapiens
agagaagtccaaggg

SEQ ID NO: 44743 - DNA, 15 bp, Homo sapiens
cagagaagtccaagg

SEQ ID NO: 44744 - DNA, 15 bp, Homo sapiens
tcagagaagtccaag

SEQ ID NO: 44745 - DNA, 15 bp, Homo sapiens
ctcagagaagtccaa

SEQ ID NO: 44746 - DNA, 15 bp, Homo sapiens
cctcagagaagtcca

SEQ ID NO: 44747 - DNA, 15 bp, Homo sapiens
tcctcagagaagtcc

SEQ ID NO: 44748 - DNA, 15 bp, Homo sapiens
ttcctcagagaagtc

SEQ ID NO: 44749 - DNA, 15 bp, Homo sapiens
attcctcagagaagt

SEQ ID NO: 44750 - DNA, 15 bp, Homo sapiens
aattcctcagagaag

SEQ ID NO: 44751 - DNA, 15 bp, Homo sapiens
gaattcctcagagaa

SEQ ID NO: 44752 - DNA, 15 bp, Homo sapiens
tgaattcctcagaga

SEQ ID NO: 44753 - DNA, 15 bp, Homo sapiens
ctgaattcctcagag

SEQ ID NO: 44754 - DNA, 15 bp, Homo sapiens
cctgaattcctcaga

SEQ ID NO: 44755 - DNA, 15 bp, Homo sapiens
gcctgaattcctcag

SEQ ID NO: 44756 - DNA, 15 bp, Homo sapiens
ggcctgaattcctca

SEQ ID NO: 44757 - DNA, 15 bp, Homo sapiens
aggcctgaattcctc

SEQ ID NO: 44758 - DNA, 15 bp, Homo sapiens
caggcctgaattcct

SEQ ID NO: 44759 - DNA, 15 bp, Homo sapiens
tcaggcctgaattcc

SEQ ID NO: 44760 - DNA, 15 bp, Homo sapiens
ctcaggcctgaattc

SEQ ID NO: 44761 - DNA, 15 bp, Homo sapiens
cctcaggcctgaatt

SEQ ID NO: 44762 - DNA, 15 bp, Homo sapiens
gcctcaggcctgaat

SEQ ID NO: 44763 - DNA, 15 bp, Homo sapiens
ggcctcaggcctgaa

SEQ ID NO: 44764 - DNA, 15 bp, Homo sapiens
tggcctcaggcctga

SEQ ID NO: 44765 - DNA, 15 bp, Homo sapiens
ctggcctcaggcctg

SEQ ID NO: 44766 - DNA, 15 bp, Homo sapiens
cctggcctcaggcct

SEQ ID NO: 44767 - DNA, 15 bp, Homo sapiens
ccctggcctcaggcc

SEQ ID NO: 44768 - DNA, 15 bp, Homo sapiens
tccctggcctcaggc

SEQ ID NO: 44769 - DNA, 15 bp, Homo sapiens
ctccctggcctcagg

SEQ ID NO: 44770 - DNA, 15 bp, Homo sapiens
cctccctggcctcag

SEQ ID NO: 44771 - DNA, 15 bp, Homo sapiens
gcctccctggcctca

SEQ ID NO: 44772 - DNA, 15 bp, Homo sapiens
tgcctccctggcctc

SEQ ID NO: 44773 - DNA, 15 bp, Homo sapiens
ctgcctccctggcct

SEQ ID NO: 44774 - DNA, 15 bp, Homo sapiens
cctgcctccctggcc

SEQ ID NO: 44775 - DNA, 15 bp, Homo sapiens
ccctgcctccctggc

SEQ ID NO: 44776 - DNA, 15 bp, Homo sapiens
accctgcctccctgg

SEQ ID NO: 44777 - DNA, 15 bp, Homo sapiens
caccctgcctccctg

SEQ ID NO: 44778 - DNA, 15 bp, Homo sapiens
gcaccctgcctccct

SEQ ID NO: 44779 - DNA, 15 bp, Homo sapiens
agcaccctgcctccc

SEQ ID NO: 44780 - DNA, 15 bp, Homo sapiens
tagcaccctgcctcc

SEQ ID NO: 44781 - DNA, 15 bp, Homo sapiens
ctagcaccctgcctc

SEQ ID NO: 44782 - DNA, 15 bp, Homo sapiens
cctagcaccctgcct

SEQ ID NO: 44783 - DNA, 15 bp, Homo sapiens
gcctagcaccctgcc

SEQ ID NO: 44784 - DNA, 15 bp, Homo sapiens
agcctagcaccctgc

SEQ ID NO: 44785 - DNA, 15 bp, Homo sapiens
cagcctagcaccctg

SEQ ID NO: 44786 - DNA, 15 bp, Homo sapiens
gcagcctagcaccct

SEQ ID NO: 44787 - DNA, 15 bp, Homo sapiens
cgcagcctagcaccc

SEQ ID NO: 44788 - DNA, 15 bp, Homo sapiens
ccgcagcctagcacc

SEQ ID NO: 44789 - DNA, 15 bp, Homo sapiens
cccgcagcctagcac

SEQ ID NO: 44790 - DNA, 15 bp, Homo sapiens
gcccgcagcctagca

SEQ ID NO: 44791 - DNA, 15 bp, Homo sapiens
agcccgcagcctagc

SEQ ID NO: 44792 - DNA, 15 bp, Homo sapiens
cagcccgcagcctag

SEQ ID NO: 44793 - DNA, 15 bp, Homo sapiens
ccagcccgcagccta

SEQ ID NO: 44794 - DNA, 15 bp, Homo sapiens
cccagcccgcagcct

SEQ ID NO: 44795 - DNA, 15 bp, Homo sapiens
ccccagcccgcagcc

SEQ ID NO: 44796 - DNA, 15 bp, Homo sapiens
tccccagcccgcagc

SEQ ID NO: 44797 - DNA, 15 bp, Homo sapiens
ctccccagcccgcag

SEQ ID NO: 44798 - DNA, 15 bp, Homo sapiens
gctccccagcccgca

SEQ ID NO: 44799 - DNA, 15 bp, Homo sapiens
ggctccccagcccgc

SEQ ID NO: 44800 - DNA, 15 bp, Homo sapiens
tggctccccagcccg

SEQ ID NO: 44801 - DNA, 15 bp, Homo sapiens
gtggctccccagccc

SEQ ID NO: 44802 - DNA, 15 bp, Homo sapiens
tgtggctccccagcc

SEQ ID NO: 44803 - DNA, 15 bp, Homo sapiens
ctgtggctccccagc

SEQ ID NO: 44804 - DNA, 15 bp, Homo sapiens
gctgtggctccccag

SEQ ID NO: 44805 - DNA, 15 bp, Homo sapiens
tgctgtggctcccca

SEQ ID NO: 44806 - DNA, 15 bp, Homo sapiens
atgctgtggctcccc

SEQ ID NO: 44807 - DNA, 15 bp, Homo sapiens
catgctgtggctccc

SEQ ID NO: 44808 - DNA, 15 bp, Homo sapiens
tcatgctgtggctcc

SEQ ID NO: 44809 - DNA, 15 bp, Homo sapiens
ctcatgctgtggctc

SEQ ID NO: 44810 - DNA, 15 bp, Homo sapiens
cctcatgctgtggct

SEQ ID NO: 44811 - DNA, 15 bp, Homo sapiens
gcctcatgctgtggc

SEQ ID NO: 44812 - DNA, 15 bp, Homo sapiens
agcctcatgctgtgg

SEQ ID NO: 44813 - DNA, 15 bp, Homo sapiens
tagcctcatgctgtg

SEQ ID NO: 44814 - DNA, 15 bp, Homo sapiens
ttagcctcatgctgt

SEQ ID NO: 44815 - DNA, 15 bp, Homo sapiens
cttagcctcatgctg

SEQ ID NO: 44816 - DNA, 15 bp, Homo sapiens
ccttagcctcatgct

SEQ ID NO: 44817 - DNA, 15 bp, Homo sapiens
cccttagcctcatgc

SEQ ID NO: 44818 - DNA, 15 bp, Homo sapiens
tcccttagcctcatg

SEQ ID NO: 44819 - DNA, 15 bp, Homo sapiens
ctcccttagcctcat

SEQ ID NO: 44820 - DNA, 15 bp, Homo sapiens
actcccttagcctca

SEQ ID NO: 44821 - DNA, 15 bp, Homo sapiens
cactcccttagcctc

SEQ ID NO: 44822 - DNA, 15 bp, Homo sapiens
gcactcccttagcct

SEQ ID NO: 44823 - DNA, 15 bp, Homo sapiens
ggcactcccttagcc

SEQ ID NO: 44824 - DNA, 15 bp, Homo sapiens
tggcactcccttagc

SEQ ID NO: 44825 - DNA, 15 bp, Homo sapiens
atggcactcccttag

SEQ ID NO: 44826 - DNA, 15 bp, Homo sapiens
gatggcactccctta

SEQ ID NO: 44827 - DNA, 15 bp, Homo sapiens
agatggcactccctt

SEQ ID NO: 44828 - DNA, 15 bp, Homo sapiens
gagatggcactccct

SEQ ID NO: 44829 - DNA, 15 bp, Homo sapiens
ggagatggcactccc

SEQ ID NO: 44830 - DNA, 15 bp, Homo sapiens
tggagatggcactcc

SEQ ID NO: 44831 - DNA, 15 bp, Homo sapiens
gtggagatggcactc

SEQ ID NO: 44832 - DNA, 15 bp, Homo sapiens
ggtggagatggcact

SEQ ID NO: 44833 - DNA, 15 bp, Homo sapiens
gggtggagatggcac

SEQ ID NO: 44834 - DNA, 15 bp, Homo sapiens
ggggtggagatggca

SEQ ID NO: 44835 - DNA, 15 bp, Homo sapiens
tggggtggagatggc

SEQ ID NO: 44836 - DNA, 15 bp, Homo sapiens
ctggggtggagatgg

SEQ ID NO: 44837 - DNA, 15 bp, Homo sapiens
cctggggtggagatg

SEQ ID NO: 44838 - DNA, 15 bp, Homo sapiens
tcctggggtggagat

SEQ ID NO: 44839 - DNA, 15 bp, Homo sapiens
gtcctggggtggaga

SEQ ID NO: 44840 - DNA, 15 bp, Homo sapiens
agtcctggggtggag

SEQ ID NO: 44841 - DNA, 15 bp, Homo sapiens
cagtcctggggtgga

SEQ ID NO: 44842 - DNA, 15 bp, Homo sapiens
ccagtcctggggtgg

SEQ ID NO: 44843 - DNA, 15 bp, Homo sapiens
gccagtcctggggtg

SEQ ID NO: 44844 - DNA, 15 bp, Homo sapiens
ggccagtcctggggt

SEQ ID NO: 44845 - DNA, 15 bp, Homo sapiens
gggccagtcctgggg

SEQ ID NO: 44846 - DNA, 15 bp, Homo sapiens
agggccagtcctggg

SEQ ID NO: 44847 - DNA, 15 bp, Homo sapiens
aagggccagtcctgg

SEQ ID NO: 44848 - DNA, 15 bp, Homo sapiens
caagggccagtcctg

SEQ ID NO: 44849 - DNA, 15 bp, Homo sapiens
ccaagggccagtcct

SEQ ID NO: 44850 - DNA, 15 bp, Homo sapiens
gccaagggccagtcc

SEQ ID NO: 44851 - DNA, 15 bp, Homo sapiens
tgccaagggccagtc

SEQ ID NO: 44852 - DNA, 15 bp, Homo sapiens
ctgccaagggccagt

SEQ ID NO: 44853 - DNA, 15 bp, Homo sapiens
gctgccaagggccag

SEQ ID NO: 44854 - DNA, 15 bp, Homo sapiens
agctgccaagggcca

SEQ ID NO: 44855 - DNA, 15 bp, Homo sapiens
gagctgccaagggcc

SEQ ID NO: 44856 - DNA, 15 bp, Homo sapiens
agagctgccaagggc

SEQ ID NO: 44857 - DNA, 15 bp, Homo sapiens
cagagctgccaaggg

SEQ ID NO: 44858 - DNA, 15 bp, Homo sapiens
gcagagctgccaagg

SEQ ID NO: 44859 - DNA, 15 bp, Homo sapiens
tgcagagctgccaag

SEQ ID NO: 44860 - DNA, 15 bp, Homo sapiens
atgcagagctgccaa

SEQ ID NO: 44861 - DNA, 15 bp, Homo sapiens
gatgcagagctgcca

SEQ ID NO: 44862 - DNA, 15 bp, Homo sapiens
tgatgcagagctgcc

SEQ ID NO: 44863 - DNA, 15 bp, Homo sapiens
atgatgcagagctgc

SEQ ID NO: 44864 - DNA, 15 bp, Homo sapiens
gatgatgcagagctg

SEQ ID NO: 44865 - DNA, 15 bp, Homo sapiens
cgatgatgcagagct

SEQ ID NO: 44866 - DNA, 15 bp, Homo sapiens
acgatgatgcagagc

SEQ ID NO: 44867 - DNA, 15 bp, Homo sapiens
gacgatgatgcagag

SEQ ID NO: 44868 - DNA, 15 bp, Homo sapiens
cgacgatgatgcaga

SEQ ID NO: 44869 - DNA, 15 bp, Homo sapiens
acgacgatgatgcag

SEQ ID NO: 44870 - DNA, 15 bp, Homo sapiens
gacgacgatgatgca

SEQ ID NO: 44871 - DNA, 15 bp, Homo sapiens
tgacgacgatgatgc

SEQ ID NO: 44872 - DNA, 15 bp, Homo sapiens
ctgacgacgatgatg

SEQ ID NO: 44873 - DNA, 15 bp, Homo sapiens
tctgacgacgatgat

SEQ ID NO: 44874 - DNA, 15 bp, Homo sapiens
ctctgacgacgatga

SEQ ID NO: 44875 - DNA, 15 bp, Homo sapiens
gctctgacgacgatg

SEQ ID NO: 44876 - DNA, 15 bp, Homo sapiens
ggctctgacgacgat

SEQ ID NO: 44877 - DNA, 15 bp, Homo sapiens
tggctctgacgacga

SEQ ID NO: 44878 - DNA, 15 bp, Homo sapiens
gtggctctgacgacg

SEQ ID NO: 44879 - DNA, 15 bp, Homo sapiens
ggtggctctgacgac

SEQ ID NO: 44880 - DNA, 15 bp, Homo sapiens
cggtggctctgacga

SEQ ID NO: 44881 - DNA, 15 bp, Homo sapiens
gcggtggctctgacg

SEQ ID NO: 44882 - DNA, 15 bp, Homo sapiens
tgcggtggctctgac

SEQ ID NO: 44883 - DNA, 15 bp, Homo sapiens
ctgcggtggctctga

SEQ ID NO: 44884 - DNA, 15 bp, Homo sapiens
tctgcggtggctctg

SEQ ID NO: 44885 - DNA, 15 bp, Homo sapiens
atctgcggtggctct

SEQ ID NO: 44886 - DNA, 15 bp, Homo sapiens
aatctgcggtggctc

SEQ ID NO: 44887 - DNA, 15 bp, Homo sapiens
taatctgcggtggct

SEQ ID NO: 44888 - DNA, 15 bp, Homo sapiens
ataatctgcggtggc

SEQ ID NO: 44889 - DNA, 15 bp, Homo sapiens
gataatctgcggtgg

SEQ ID NO: 44890 - DNA, 15 bp, Homo sapiens
tgataatctgcggtg

SEQ ID NO: 44891 - DNA, 15 bp, Homo sapiens
atgataatctgcggt

SEQ ID NO: 44892 - DNA, 15 bp, Homo sapiens
gatgataatctgcgg

SEQ ID NO: 44893 - DNA, 15 bp, Homo sapiens
tgatgataatctgcg

SEQ ID NO: 44894 - DNA, 15 bp, Homo sapiens
ttgatgataatctgc

SEQ ID NO: 44895 - DNA, 15 bp, Homo sapiens
gttgatgataatctg

SEQ ID NO: 44896 - DNA, 15 bp, Homo sapiens
ggttgatgataatct

SEQ ID NO: 44897 - DNA, 15 bp, Homo sapiens
gggttgatgataatc

SEQ ID NO: 44898 - DNA, 15 bp, Homo sapiens
agggttgatgataat

SEQ ID NO: 44899 - DNA, 15 bp, Homo sapiens
cagggttgatgataa

SEQ ID NO: 44900 - DNA, 15 bp, Homo sapiens
gcagggttgatgata

SEQ ID NO: 44901 - DNA, 15 bp, Homo sapiens
ggcagggttgatgat

SEQ ID NO: 44902 - DNA, 15 bp, Homo sapiens
gggcagggttgatga

SEQ ID NO: 44903 - DNA, 15 bp, Homo sapiens
cgggcagggttgatg

SEQ ID NO: 44904 - DNA, 15 bp, Homo sapiens
tcgggcagggttgat

SEQ ID NO: 44905 - DNA, 15 bp, Homo sapiens
gtcgggcagggttga

SEQ ID NO: 44906 - DNA, 15 bp, Homo sapiens
tgtcgggcagggttg

SEQ ID NO: 44907 - DNA, 15 bp, Homo sapiens
ctgtcgggcagggtt

SEQ ID NO: 44908 - DNA, 15 bp, Homo sapiens
tctgtcgggcagggt

SEQ ID NO: 44909 - DNA, 15 bp, Homo sapiens
ttctgtcgggcaggg

SEQ ID NO: 44910 - DNA, 15 bp, Homo sapiens
cttctgtcgggcagg

SEQ ID NO: 44911 - DNA, 15 bp, Homo sapiens
tcttctgtcgggcag

SEQ ID NO: 44912 - DNA, 15 bp, Homo sapiens
atcttctgtcgggca

SEQ ID NO: 44913 - DNA, 15 bp, Homo sapiens
catcttctgtcgggc

SEQ ID NO: 44914 - DNA, 15 bp, Homo sapiens
ccatcttctgtcggg

SEQ ID NO: 44915 - DNA, 15 bp, Homo sapiens
accatcttctgtcgg

SEQ ID NO: 44916 - DNA, 15 bp, Homo sapiens
gaccatcttctgtcg

SEQ ID NO: 44917 - DNA, 15 bp, Homo sapiens
ggaccatcttctgtc

SEQ ID NO: 44918 - DNA, 15 bp, Homo sapiens
tggaccatcttctgt

SEQ ID NO: 44919 - DNA, 15 bp, Homo sapiens
ctggaccatcttctg

SEQ ID NO: 44920 - DNA, 15 bp, Homo sapiens
tctggaccatcttct

SEQ ID NO: 44921 - DNA, 15 bp, Homo sapiens
ttctggaccatcttc

SEQ ID NO: 44922 - DNA, 15 bp, Homo sapiens
cttctggaccatctt

SEQ ID NO: 44923 - DNA, 15 bp, Homo sapiens
gcttctggaccatct

SEQ ID NO: 44924 - DNA, 15 bp, Homo sapiens
agcttctggaccatc

SEQ ID NO: 44925 - DNA, 15 bp, Homo sapiens
cagcttctggaccat

SEQ ID NO: 44926 - DNA, 15 bp, Homo sapiens
ccagcttctggacca

SEQ ID NO: 44927 - DNA, 15 bp, Homo sapiens
gccagcttctggacc

SEQ ID NO: 44928 - DNA, 15 bp, Homo sapiens
ggccagcttctggac

SEQ ID NO: 44929 - DNA, 15 bp, Homo sapiens
gggccagcttctgga

SEQ ID NO: 44930 - DNA, 15 bp, Homo sapiens
agggccagcttctgg

SEQ ID NO: 44931 - DNA, 15 bp, Homo sapiens
cagggccagcttctg

SEQ ID NO: 44932 - DNA, 15 bp, Homo sapiens
acagggccagcttct

SEQ ID NO: 44933 - DNA, 15 bp, Homo sapiens
tacagggccagcttc

SEQ ID NO: 44934 - DNA, 15 bp, Homo sapiens
gtacagggccagctt

SEQ ID NO: 44935 - DNA, 15 bp, Homo sapiens
cgtacagggccagct

SEQ ID NO: 44936 - DNA, 15 bp, Homo sapiens
tcgtacagggccagc

SEQ ID NO: 44937 - DNA, 15 bp, Homo sapiens
ctcgtacagggccag

SEQ ID NO: 44938 - DNA, 15 bp, Homo sapiens
cctcgtacagggcca

SEQ ID NO: 44939 - DNA, 15 bp, Homo sapiens
tcctcgtacagggcc

SEQ ID NO: 44940 - DNA, 15 bp, Homo sapiens
atcctcgtacagggc

SEQ ID NO: 44941 - DNA, 15 bp, Homo sapiens
catcctcgtacaggg

SEQ ID NO: 44942 - DNA, 15 bp, Homo sapiens
ccatcctcgtacagg

SEQ ID NO: 44943 - DNA, 15 bp, Homo sapiens
cccatcctcgtacag

SEQ ID NO: 44944 - DNA, 15 bp, Homo sapiens
ccccatcctcgtaca

SEQ ID NO: 44945 - DNA, 15 bp, Homo sapiens
gccccatcctcgtac

SEQ ID NO: 44946 - DNA, 15 bp, Homo sapiens
ggccccatcctcgta

SEQ ID NO: 44947 - DNA, 15 bp, Homo sapiens
gggccccatcctcgt

SEQ ID NO: 44948 - DNA, 15 bp, Homo sapiens
agggccccatcctcg

SEQ ID NO: 44949 - DNA, 15 bp, Homo sapiens
cagggccccatcctc

SEQ ID NO: 44950 - DNA, 15 bp, Homo sapiens
ccagggccccatcct

SEQ ID NO: 44951 - DNA, 15 bp, Homo sapiens
tccagggccccatcc

SEQ ID NO: 44952 - DNA, 15 bp, Homo sapiens
gtccagggccccatc

SEQ ID NO: 44953 - DNA, 15 bp, Homo sapiens
tgtccagggccccat

SEQ ID NO: 44954 - DNA, 15 bp, Homo sapiens
ctgtccagggcccca

SEQ ID NO: 44955 - DNA, 15 bp, Homo sapiens
gctgtccagggcccc

SEQ ID NO: 44956 - DNA, 15 bp, Homo sapiens
ggctgtccagggccc

SEQ ID NO: 44957 - DNA, 15 bp, Homo sapiens
aggctgtccagggcc

SEQ ID NO: 44958 - DNA, 15 bp, Homo sapiens
caggctgtccagggc

SEQ ID NO: 44959 - DNA, 15 bp, Homo sapiens
gcaggctgtccaggg

SEQ ID NO: 44960 - DNA, 15 bp, Homo sapiens
tgcaggctgtccagg

SEQ ID NO: 44961 - DNA, 15 bp, Homo sapiens
ctgcaggctgtccag

SEQ ID NO: 44962 - DNA, 15 bp, Homo sapiens
gctgcaggctgtcca

SEQ ID NO: 44963 - DNA, 15 bp, Homo sapiens
agctgcaggctgtcc

SEQ ID NO: 44964 - DNA, 15 bp, Homo sapiens
cagctgcaggctgtc

SEQ ID NO: 44965 - DNA, 15 bp, Homo sapiens
gcagctgcaggctgt

SEQ ID NO: 44966 - DNA, 15 bp, Homo sapiens
agcagctgcaggctg

SEQ ID NO: 44967 - DNA, 15 bp, Homo sapiens
cagcagctgcaggct

SEQ ID NO: 44968 - DNA, 15 bp, Homo sapiens
acagcagctgcaggc

SEQ ID NO: 44969 - DNA, 15 bp, Homo sapiens
gacagcagctgcagg

SEQ ID NO: 44970 - DNA, 15 bp, Homo sapiens
cgacagcagctgcag

SEQ ID NO: 44971 - DNA, 15 bp, Homo sapiens
acgacagcagctgca

SEQ ID NO: 44972 - DNA, 15 bp, Homo sapiens
gacgacagcagctgc

SEQ ID NO: 44973 - DNA, 15 bp, Homo sapiens
ggacgacagcagctg

SEQ ID NO: 44974 - DNA, 15 bp, Homo sapiens
tggacgacagcagct

SEQ ID NO: 44975 - DNA, 15 bp, Homo sapiens
ctggacgacagcagc

SEQ ID NO: 44976 - DNA, 15 bp, Homo sapiens
gctggacgacagcag

SEQ ID NO: 44977 - DNA, 15 bp, Homo sapiens
agctggacgacagca

SEQ ID NO: 44978 - DNA, 15 bp, Homo sapiens
gagctggacgacagc

SEQ ID NO: 44979 - DNA, 15 bp, Homo sapiens
ggagctggacgacag

SEQ ID NO: 44980 - DNA, 15 bp, Homo sapiens
gggagctggacgaca

SEQ ID NO: 44981 - DNA, 15 bp, Homo sapiens
agggagctggacgac

SEQ ID NO: 44982 - DNA, 15 bp, Homo sapiens
gagggagctggacga

SEQ ID NO: 44983 - DNA, 15 bp, Homo sapiens
ggagggagctggacg

SEQ ID NO: 44984 - DNA, 15 bp, Homo sapiens
gggagggagctggac

SEQ ID NO: 44985 - DNA, 15 bp, Homo sapiens
tgggagggagctgga

SEQ ID NO: 44986 - DNA, 15 bp, Homo sapiens
ctgggagggagctgg

SEQ ID NO: 44987 - DNA, 15 bp, Homo sapiens
cctgggagggagctg

SEQ ID NO: 44988 - DNA, 15 bp, Homo sapiens
acctgggagggagct

SEQ ID NO: 44989 - DNA, 15 bp, Homo sapiens
cacctgggagggagc

SEQ ID NO: 44990 - DNA, 15 bp, Homo sapiens
gcacctgggagggag

SEQ ID NO: 44991 - DNA, 15 bp, Homo sapiens
agcacctgggaggga

SEQ ID NO: 44992 - DNA, 15 bp, Homo sapiens
cagcacctgggaggg

SEQ ID NO: 44993 - DNA, 15 bp, Homo sapiens
gcagcacctgggagg

SEQ ID NO: 44994 - DNA, 15 bp, Homo sapiens
ggcagcacctgggag

SEQ ID NO: 44995 - DNA, 15 bp, Homo sapiens
cggcagcacctggga

SEQ ID NO: 44996 - DNA, 15 bp, Homo sapiens
gcggcagcacctggg

SEQ ID NO: 44997 - DNA, 15 bp, Homo sapiens
ggcggcagcacctgg

SEQ ID NO: 44998 - DNA, 15 bp, Homo sapiens
gggcggcagcacctg

SEQ ID NO: 44999 - DNA, 15 bp, Homo sapiens
tgggcggcagcacct

SEQ ID NO: 45000 - DNA, 15 bp, Homo sapiens
ctgggcggcagcacc

SEQ ID NO: 45001 - DNA, 15 bp, Homo sapiens
cctgggcggcagcac

SEQ ID NO: 45002 - DNA, 15 bp, Homo sapiens
gcctgggcggcagca

SEQ ID NO: 45003 - DNA, 15 bp, Homo sapiens
agcctgggcggcagc

SEQ ID NO: 45004 - DNA, 15 bp, Homo sapiens
cagcctgggcggcag

SEQ ID NO: 45005 - DNA, 15 bp, Homo sapiens
ccagcctgggcggca

SEQ ID NO: 45006 - DNA, 15 bp, Homo sapiens
gccagcctgggcggc

SEQ ID NO: 45007 - DNA, 15 bp, Homo sapiens
ggccagcctgggcgg

SEQ ID NO: 45008 - DNA, 15 bp, Homo sapiens
aggccagcctgggcg

SEQ ID NO: 45009 - DNA, 15 bp, Homo sapiens
agaggccagcctggg

SEQ ID NO: 45010 - DNA, 15 bp, Homo sapiens
cagaggccagcctgg

SEQ ID NO: 45011 - DNA, 15 bp, Homo sapiens
ccagaggccagcctg

SEQ ID NO: 45012 - DNA, 15 bp, Homo sapiens
cccagaggccagcct

SEQ ID NO: 45013 - DNA, 15 bp, Homo sapiens
ccccagaggccagcc

SEQ ID NO: 45014 - DNA, 15 bp, Homo sapiens
accccagaggccagc

SEQ ID NO: 45015 - DNA, 15 bp, Homo sapiens
caccccagaggccag

SEQ ID NO: 45016 - DNA, 15 bp, Homo sapiens
gcaccccagaggcca

SEQ ID NO: 45017 - DNA, 15 bp, Homo sapiens
agcaccccagaggcc

SEQ ID NO: 45018 - DNA, 15 bp, Homo sapiens
gagcaccccagaggc

SEQ ID NO: 45019 - DNA, 15 bp, Homo sapiens
tgagcaccccagagg

SEQ ID NO: 45020 - DNA, 15 bp, Homo sapiens
ctgagcaccccagag

SEQ ID NO: 45021 - DNA, 15 bp, Homo sapiens
cctgagcaccccaga

SEQ ID NO: 45022 - DNA, 15 bp, Homo sapiens
gcctgagcaccccag

SEQ ID NO: 45023 - DNA, 15 bp, Homo sapiens
cgcctgagcacccca

SEQ ID NO: 45024 - DNA, 15 bp, Homo sapiens
gcgcctgagcacccc

SEQ ID NO: 45025 - DNA, 15 bp, Homo sapiens
tgcgcctgagcaccc

SEQ ID NO: 45026 - DNA, 15 bp, Homo sapiens
atgcgcctgagcacc

SEQ ID NO: 45027 - DNA, 15 bp, Homo sapiens
gatgcgcctgagcac

SEQ ID NO: 45028 - DNA, 15 bp, Homo sapiens
ggatgcgcctgagca

SEQ ID NO: 45029 - DNA, 15 bp, Homo sapiens
cggatgcgcctgagc

SEQ ID NO: 45030 - DNA, 15 bp, Homo sapiens
acggatgcgcctgag

SEQ ID NO: 45031 - DNA, 15 bp, Homo sapiens
cacggatgcgcctga

SEQ ID NO: 45032 - DNA, 15 bp, Homo sapiens
acacggatgcgcctg

SEQ ID NO: 45033 - DNA, 15 bp, Homo sapiens
gacacggatgcgcct

SEQ ID NO: 45034 - DNA, 15 bp, Homo sapiens
tgacacggatgcgcc

SEQ ID NO: 45035 - DNA, 15 bp, Homo sapiens
ctgacacggatgcgc

SEQ ID NO: 45036 - DNA, 15 bp, Homo sapiens
gctgacacggatgcg

SEQ ID NO: 45037 - DNA, 15 bp, Homo sapiens
ggctgacacggatgc

SEQ ID NO: 45038 - DNA, 15 bp, Homo sapiens
gggctgacacggatg

SEQ ID NO: 45039 - DNA, 15 bp, Homo sapiens
ggggctgacacggat

SEQ ID NO: 45040 - DNA, 15 bp, Homo sapiens
tggggctgacacgga

SEQ ID NO: 45041 - DNA, 15 bp, Homo sapiens
ttggggctgacacgg

SEQ ID NO: 45042 - DNA, 15 bp, Homo sapiens
tttggggctgacacg

SEQ ID NO: 45043 - DNA, 15 bp, Homo sapiens
ctttggggctgacac

SEQ ID NO: 45044 - DNA, 15 bp, Homo sapiens
tctttggggctgaca

SEQ ID NO: 45045 - DNA, 15 bp, Homo sapiens
ctctttggggctgac

SEQ ID NO: 45046 - DNA, 15 bp, Homo sapiens
gctctttggggctga

SEQ ID NO: 45047 - DNA, 15 bp, Homo sapiens
tgctctttggggctg

SEQ ID NO: 45048 - DNA, 15 bp, Homo sapiens
ctgctctttggggct

SEQ ID NO: 45049 - DNA, 15 bp, Homo sapiens
tctgctctttggggc

SEQ ID NO: 45050 - DNA, 15 bp, Homo sapiens
ctctgctctttgggg

SEQ ID NO: 45051 - DNA, 15 bp, Homo sapiens
actctgctctttggg

SEQ ID NO: 45052 - DNA, 15 bp, Homo sapiens
cactctgctctttgg

SEQ ID NO: 45053 - DNA, 15 bp, Homo sapiens
acactctgctctttg

SEQ ID NO: 45054 - DNA, 15 bp, Homo sapiens
gacactctgctcttt

SEQ ID NO: 45055 - DNA, 15 bp, Homo sapiens
agacactctgctctt

SEQ ID NO: 45056 - DNA, 15 bp, Homo sapiens
cagacactctgctct

SEQ ID NO: 45057 - DNA, 15 bp, Homo sapiens
acagacactctgctc

SEQ ID NO: 45058 - DNA, 15 bp, Homo sapiens
gacagacactctgct

SEQ ID NO: 45059 - DNA, 15 bp, Homo sapiens
ggacagacactctgc

SEQ ID NO: 45060 - DNA, 15 bp, Homo sapiens
gggacagacactctg

SEQ ID NO: 45061 - DNA, 15 bp, Homo sapiens
cgggacagacactct

SEQ ID NO: 45062 - DNA, 15 bp, Homo sapiens
tcgggacagacactc

SEQ ID NO: 45063 - DNA, 15 bp, Homo sapiens
gtcgggacagacact

SEQ ID NO: 45064 - DNA, 15 bp, Homo sapiens
agtcgggacagacac

SEQ ID NO: 45065 - DNA, 15 bp, Homo sapiens
cagtcgggacagaca

SEQ ID NO: 45066 - DNA, 15 bp, Homo sapiens
gcagtcgggacagac

SEQ ID NO: 45067 - DNA, 15 bp, Homo sapiens
cgcagtcgggacaga

SEQ ID NO: 45068 - DNA, 15 bp, Homo sapiens
gcgcagtcgggacag

SEQ ID NO: 45069 - DNA, 15 bp, Homo sapiens
agcgcagtcgggaca

SEQ ID NO: 45070 - DNA, 15 bp, Homo sapiens
cagcgcagtcgggac

SEQ ID NO: 45071 - DNA, 15 bp, Homo sapiens
tcagcgcagtcggga

SEQ ID NO: 45072 - DNA, 15 bp, Homo sapiens
ctcagcgcagtcggg

SEQ ID NO: 45073 - DNA, 15 bp, Homo sapiens
cctcagcgcagtcgg

SEQ ID NO: 45074 - DNA, 15 bp, Homo sapiens
ccctcagcgcagtcg

SEQ ID NO: 45075 - DNA, 15 bp, Homo sapiens
gccctcagcgcagtc

SEQ ID NO: 45076 - DNA, 15 bp, Homo sapiens
cgccctcagcgcagt

SEQ ID NO: 45077 - DNA, 15 bp, Homo sapiens
acgccctcagcgcag

SEQ ID NO: 45078 - DNA, 15 bp, Homo sapiens
cacgccctcagcgca

SEQ ID NO: 45079 - DNA, 15 bp, Homo sapiens
ccacgccctcagcgc

SEQ ID NO: 45080 - DNA, 15 bp, Homo sapiens
cccacgccctcagcg

SEQ ID NO: 45081 - DNA, 15 bp, Homo sapiens
ccccacgccctcagc

SEQ ID NO: 45082 - DNA, 15 bp, Homo sapiens
gccccacgccctcag

SEQ ID NO: 45083 - DNA, 15 bp, Homo sapiens
tgccccacgccctca

SEQ ID NO: 45084 - DNA, 15 bp, Homo sapiens
ctgccccacgccctc

SEQ ID NO: 45085 - DNA, 15 bp, Homo sapiens
gctgccccacgccct

SEQ ID NO: 45086 - DNA, 15 bp, Homo sapiens
ggctgccccacgccc

SEQ ID NO: 45087 - DNA, 15 bp, Homo sapiens
cggctgccccacgcc

SEQ ID NO: 45088 - DNA, 15 bp, Homo sapiens
ccggctgccccacgc

SEQ ID NO: 45089 - DNA, 15 bp, Homo sapiens
cccggctgccccacg

SEQ ID NO: 45090 - DNA, 15 bp, Homo sapiens
gcccggctgccccac

SEQ ID NO: 45091 - DNA, 15 bp, Homo sapiens
tgcccggctgcccca

SEQ ID NO: 45092 - DNA, 15 bp, Homo sapiens
ctgcccggctgcccc

SEQ ID NO: 45093 - DNA, 15 bp, Homo sapiens
cctgcccggctgccc

SEQ ID NO: 45094 - DNA, 15 bp, Homo sapiens
gcctgcccggctgcc

SEQ ID NO: 45095 - DNA, 15 bp, Homo sapiens
ggcctgcccggctgc

SEQ ID NO: 45096 - DNA, 15 bp, Homo sapiens
tggcctgcccggctg

SEQ ID NO: 45097 - DNA, 15 bp, Homo sapiens
gtggcctgcccggct

SEQ ID NO: 45098 - DNA, 15 bp, Homo sapiens
agtggcctgcccggc

SEQ ID NO: 45099 - DNA, 15 bp, Homo sapiens
cagtggcctgcccgg

SEQ ID NO: 45100 - DNA, 15 bp, Homo sapiens
ccagtggcctgcccg

SEQ ID NO: 45101 - DNA, 15 bp, Homo sapiens
gccagtggcctgccc

SEQ ID NO: 45102 - DNA, 15 bp, Homo sapiens
agccagtggcctgcc

SEQ ID NO: 45103 - DNA, 15 bp, Homo sapiens
gagccagtggcctgc

SEQ ID NO: 45104 - DNA, 15 bp, Homo sapiens
agagccagtggcctg

SEQ ID NO: 45105 - DNA, 15 bp, Homo sapiens
cagagccagtggcct

SEQ ID NO: 45106 - DNA, 15 bp, Homo sapiens
ccagagccagtggcc

SEQ ID NO: 45107 - DNA, 15 bp, Homo sapiens
gccagagccagtggc

SEQ ID NO: 45108 - DNA, 15 bp, Homo sapiens
cgccagagccagtgg

SEQ ID NO: 45109 - DNA, 15 bp, Homo sapiens
tcgccagagccagtg

SEQ ID NO: 45110 - DNA, 15 bp, Homo sapiens
gtcgccagagccagt

SEQ ID NO: 45111 - DNA, 15 bp, Homo sapiens
ggtcgccagagccag

SEQ ID NO: 45112 - DNA, 15 bp, Homo sapiens
aggtcgccagagcca

SEQ ID NO: 45113 - DNA, 15 bp, Homo sapiens
gaggtcgccagagcc

SEQ ID NO: 45114 - DNA, 15 bp, Homo sapiens
agaggtcgccagagc

SEQ ID NO: 45115 - DNA, 15 bp, Homo sapiens
tagaggtcgccagag

SEQ ID NO: 45116 - DNA, 15 bp, Homo sapiens
ctagaggtcgccaga

SEQ ID NO: 45117 - DNA, 15 bp, Homo sapiens
tctagaggtcgccag

SEQ ID NO: 45118 - DNA, 15 bp, Homo sapiens
ttctagaggtcgcca

SEQ ID NO: 45119 - DNA, 15 bp, Homo sapiens
cttctagaggtcgcc

SEQ ID NO: 45120 - DNA, 15 bp, Homo sapiens
gcttctagaggtcgc

SEQ ID NO: 45121 - DNA, 15 bp, Homo sapiens
ggcttctagaggtcg

SEQ ID NO: 45122 - DNA, 15 bp, Homo sapiens
gggcttctagaggtc

SEQ ID NO: 45123 - DNA, 15 bp, Homo sapiens
tgggcttctagaggt

SEQ ID NO: 45124 - DNA, 15 bp, Homo sapiens
ctgggcttctagagg

SEQ ID NO: 45125 - DNA, 15 bp, Homo sapiens
gctgggcttctagag

SEQ ID NO: 45126 - DNA, 15 bp, Homo sapiens
ggctgggcttctaga

SEQ ID NO: 45127 - DNA, 15 bp, Homo sapiens
cggctgggcttctag

SEQ ID NO: 45128 - DNA, 15 bp, Homo sapiens
ccggctgggcttcta

SEQ ID NO: 45129 - DNA, 15 bp, Homo sapiens
gccggctgggcttct

SEQ ID NO: 45130 - DNA, 15 bp, Homo sapiens
ggccggctgggcttc

SEQ ID NO: 45131 - DNA, 15 bp, Homo sapiens
gggccggctgggctt

SEQ ID NO: 45132 - DNA, 15 bp, Homo sapiens
ggggccggctgggct

SEQ ID NO: 45133 - DNA, 15 bp, Homo sapiens
tggggccggctgggc

SEQ ID NO: 45134 - DNA, 15 bp, Homo sapiens
gtggggccggctggg

SEQ ID NO: 45135 - DNA, 15 bp, Homo sapiens
tgtggggccggctgg

SEQ ID NO: 45136 - DNA, 15 bp, Homo sapiens
atgtggggccggctg

SEQ ID NO: 45137 - DNA, 15 bp, Homo sapiens
catgtggggccggct

SEQ ID NO: 45138 - DNA, 15 bp, Homo sapiens
gcatgtggggccggc

SEQ ID NO: 45139 - DNA, 15 bp, Homo sapiens
ggcatgtggggccgg

SEQ ID NO: 45140 - DNA, 15 bp, Homo sapiens
aggcatgtggggccg

SEQ ID NO: 45141 - DNA, 15 bp, Homo sapiens
gaggcatgtggggcc

SEQ ID NO: 45142 - DNA, 15 bp, Homo sapiens
ggaggcatgtggggc

SEQ ID NO: 45143 - DNA, 15 bp, Homo sapiens
gggaggcatgtgggg

SEQ ID NO: 45144 - DNA, 15 bp, Homo sapiens
agggaggcatgtggg

SEQ ID NO: 45145 - DNA, 15 bp, Homo sapiens
aagggaggcatgtgg

SEQ ID NO: 45146 - DNA, 15 bp, Homo sapiens
taagggaggcatgtg

SEQ ID NO: 45147 - DNA, 15 bp, Homo sapiens
ctaagggaggcatgt

SEQ ID NO: 45148 - DNA, 15 bp, Homo sapiens
gctaagggaggcatg

SEQ ID NO: 45149 - DNA, 15 bp, Homo sapiens
tgctaagggaggcat

SEQ ID NO: 45150 - DNA, 15 bp, Homo sapiens
ttgctaagggaggca

SEQ ID NO: 45151 - DNA, 15 bp, Homo sapiens
cttgctaagggaggc

SEQ ID NO: 45152 - DNA, 15 bp, Homo sapiens
tcttgctaagggagg

SEQ ID NO: 45153 - DNA, 15 bp, Homo sapiens
gtcttgctaagggag

SEQ ID NO: 45154 - DNA, 15 bp, Homo sapiens
ggtcttgctaaggga

SEQ ID NO: 45155 - DNA, 15 bp, Homo sapiens
gggtcttgctaaggg

SEQ ID NO: 45156 - DNA, 15 bp, Homo sapiens
agggtcttgctaagg

SEQ ID NO: 45157 - DNA, 15 bp, Homo sapiens
cagggtcttgctaag

SEQ ID NO: 45158 - DNA, 15 bp, Homo sapiens
ccagggtcttgctaa

SEQ ID NO: 45159 - DNA, 15 bp, Homo sapiens
gccagggtcttgcta

SEQ ID NO: 45160 - DNA, 15 bp, Homo sapiens
ggccagggtcttgct

SEQ ID NO: 45161 - DNA, 15 bp, Homo sapiens
gggccagggtcttgc

SEQ ID NO: 45162 - DNA, 15 bp, Homo sapiens
tgggccagggtcttg

SEQ ID NO: 45163 - DNA, 15 bp, Homo sapiens
gtgggccagggtctt

SEQ ID NO: 45164 - DNA, 15 bp, Homo sapiens
agtgggccagggtct

SEQ ID NO: 45165 - DNA, 15 bp, Homo sapiens
gagtgggccagggtc

SEQ ID NO: 45166 - DNA, 15 bp, Homo sapiens
ggagtgggccagggt

SEQ ID NO: 45167 - DNA, 15 bp, Homo sapiens
aggagtgggccaggg

SEQ ID NO: 45168 - DNA, 15 bp, Homo sapiens
aaggagtgggccagg

SEQ ID NO: 45169 - DNA, 15 bp, Homo sapiens
gaaggagtgggccag

SEQ ID NO: 45170 - DNA, 15 bp, Homo sapiens
ggaaggagtgggcca

SEQ ID NO: 45171 - DNA, 15 bp, Homo sapiens
gggaaggagtgggcc

SEQ ID NO: 45172 - DNA, 15 bp, Homo sapiens
agggaaggagtgggc

SEQ ID NO: 45173 - DNA, 15 bp, Homo sapiens
gagggaaggagtggg

SEQ ID NO: 45174 - DNA, 15 bp, Homo sapiens
cgagggaaggagtgg

SEQ ID NO: 45175 - DNA, 15 bp, Homo sapiens
gcgagggaaggagtg

SEQ ID NO: 45176 - DNA, 15 bp, Homo sapiens
ggcgagggaaggagt

SEQ ID NO: 45177 - DNA, 15 bp, Homo sapiens
aggcgagggaaggag

SEQ ID NO: 45178 - DNA, 15 bp, Homo sapiens
gaggcgagggaagga

SEQ ID NO: 45179 - DNA, 15 bp, Homo sapiens
ggaggcgagggaagg

SEQ ID NO: 45180 - DNA, 15 bp, Homo sapiens
aggaggcgagggaag

SEQ ID NO: 45181 - DNA, 15 bp, Homo sapiens
caggaggcgagggaa

SEQ ID NO: 45182 - DNA, 15 bp, Homo sapiens
tcaggaggcgaggga

SEQ ID NO: 45183 - DNA, 15 bp, Homo sapiens
gtcaggaggcgaggg

SEQ ID NO: 45184 - DNA, 15 bp, Homo sapiens
tgtcaggaggcgagg

SEQ ID NO: 45185 - DNA, 15 bp, Homo sapiens
ctgtcaggaggcgag

SEQ ID NO: 45186 - DNA, 15 bp, Homo sapiens
actgtcaggaggcga

SEQ ID NO: 45187 - DNA, 15 bp, Homo sapiens
tactgtcaggaggcg

SEQ ID NO: 45188 - DNA, 15 bp, Homo sapiens
ctactgtcaggaggc

SEQ ID NO: 45189 - DNA, 15 bp, Homo sapiens
gctactgtcaggagg

SEQ ID NO: 45190 - DNA, 15 bp, Homo sapiens
tgctactgtcaggag

SEQ ID NO: 45191 - DNA, 15 bp, Homo sapiens
gtgctactgtcagga

SEQ ID NO: 45192 - DNA, 15 bp, Homo sapiens
ggtgctactgtcagg

SEQ ID NO: 45193 - DNA, 15 bp, Homo sapiens
aggtgctactgtcag

SEQ ID NO: 45194 - DNA, 15 bp, Homo sapiens
gaggtgctactgtca

SEQ ID NO: 45195 - DNA, 15 bp, Homo sapiens
ggaggtgctactgtc

SEQ ID NO: 45196 - DNA, 15 bp, Homo sapiens
aggaggtgctactgt

SEQ ID NO: 45197 - DNA, 15 bp, Homo sapiens
aaggaggtgctactg

SEQ ID NO: 45198 - DNA, 15 bp, Homo sapiens
aaaggaggtgctact

SEQ ID NO: 45199 - DNA, 15 bp, Homo sapiens
taaaggaggtgctac

SEQ ID NO: 45200 - DNA, 15 bp, Homo sapiens
ctaaaggaggtgcta

SEQ ID NO: 45201 - DNA, 15 bp, Homo sapiens
gctaaaggaggtgct

SEQ ID NO: 45202 - DNA, 15 bp, Homo sapiens
ggctaaaggaggtgc

SEQ ID NO: 45203 - DNA, 15 bp, Homo sapiens
gggctaaaggaggtg

SEQ ID NO: 45204 - DNA, 15 bp, Homo sapiens
cgggctaaaggaggt

SEQ ID NO: 45205 - DNA, 15 bp, Homo sapiens
tcgggctaaaggagg

SEQ ID NO: 45206 - DNA, 15 bp, Homo sapiens
ctcgggctaaaggag

SEQ ID NO: 45207 - DNA, 15 bp, Homo sapiens
cctcgggctaaagga

SEQ ID NO: 45208 - DNA, 15 bp, Homo sapiens
ccctcgggctaaagg

SEQ ID NO: 45209 - DNA, 15 bp, Homo sapiens
accctcgggctaaag

SEQ ID NO: 45210 - DNA, 15 bp, Homo sapiens
caccctcgggctaaa

SEQ ID NO: 45211 - DNA, 15 bp, Homo sapiens
gcaccctcgggctaa

SEQ ID NO: 45212 - DNA, 15 bp, Homo sapiens
ggcaccctcgggcta

SEQ ID NO: 45213 - DNA, 15 bp, Homo sapiens
aggcaccctcgggct

SEQ ID NO: 45214 - DNA, 15 bp, Homo sapiens
caggcaccctcgggc

SEQ ID NO: 45215 - DNA, 15 bp, Homo sapiens
gcaggcaccctcggg

SEQ ID NO: 45216 - DNA, 15 bp, Homo sapiens
ggcaggcaccctcgg

SEQ ID NO: 45217 - DNA, 15 bp, Homo sapiens
gggcaggcaccctcg

SEQ ID NO: 45218 - DNA, 15 bp, Homo sapiens
ggggcaggcaccctc

SEQ ID NO: 45219 - DNA, 15 bp, Homo sapiens
tggggcaggcaccct

SEQ ID NO: 45220 - DNA, 15 bp, Homo sapiens
gtggggcaggcaccc

SEQ ID NO: 45221 - DNA, 15 bp, Homo sapiens
agtggggcaggcacc

SEQ ID NO: 45222 - DNA, 15 bp, Homo sapiens
gagtggggcaggcac

SEQ ID NO: 45223 - DNA, 15 bp, Homo sapiens
agagtggggcaggca

SEQ ID NO: 45224 - DNA, 15 bp, Homo sapiens
cagagtggggcaggc

SEQ ID NO: 45225 - DNA, 15 bp, Homo sapiens
acagagtggggcagg

SEQ ID NO: 45226 - DNA, 15 bp, Homo sapiens
cacagagtggggcag

SEQ ID NO: 45227 - DNA, 15 bp, Homo sapiens
gcacagagtggggca

SEQ ID NO: 45228 - DNA, 15 bp, Homo sapiens
agcacagagtggggc

SEQ ID NO: 45229 - DNA, 15 bp, Homo sapiens
aagcacagagtgggg

SEQ ID NO: 45230 - DNA, 15 bp, Homo sapiens
aaagcacagagtggg

SEQ ID NO: 45231 - DNA, 15 bp, Homo sapiens
gaaagcacagagtgg

SEQ ID NO: 45232 - DNA, 15 bp, Homo sapiens
tgaaagcacagagtg

SEQ ID NO: 45233 - DNA, 15 bp, Homo sapiens
ctgaaagcacagagt

SEQ ID NO: 45234 - DNA, 15 bp, Homo sapiens
cctgaaagcacagag

SEQ ID NO: 45235 - DNA, 15 bp, Homo sapiens
tcctgaaagcacaga

SEQ ID NO: 45236 - DNA, 15 bp, Homo sapiens
ttcctgaaagcacag

SEQ ID NO: 45237 - DNA, 15 bp, Homo sapiens
tttcctgaaagcaca

SEQ ID NO: 45238 - DNA, 15 bp, Homo sapiens
atttcctgaaagcac

SEQ ID NO: 45239 - DNA, 15 bp, Homo sapiens
tatttcctgaaagca

SEQ ID NO: 45240 - DNA, 15 bp, Homo sapiens
ctatttcctgaaagc

SEQ ID NO: 45241 - DNA, 15 bp, Homo sapiens
cctatttcctgaaag

SEQ ID NO: 45242 - DNA, 15 bp, Homo sapiens
tcctatttcctgaaa

SEQ ID NO: 45243 - DNA, 15 bp, Homo sapiens
ttcctatttcctgaa

SEQ ID NO: 45244 - DNA, 15 bp, Homo sapiens
cttcctatttcctga

SEQ ID NO: 45245 - DNA, 15 bp, Homo sapiens
gcttcctatttcctg

SEQ ID NO: 45246 - DNA, 15 bp, Homo sapiens
ggcttcctatttcct

SEQ ID NO: 45247 - DNA, 15 bp, Homo sapiens
gggcttcctatttcc

SEQ ID NO: 45248 - DNA, 15 bp, Homo sapiens
ggggcttcctatttc

SEQ ID NO: 45249 - DNA, 15 bp, Homo sapiens
tggggcttcctattt

SEQ ID NO: 45250 - DNA, 15 bp, Homo sapiens
ctggggcttcctatt

SEQ ID NO: 45251 - DNA, 15 bp, Homo sapiens
gctggggcttcctat

SEQ ID NO: 45252 - DNA, 15 bp, Homo sapiens
tgctggggcttccta

SEQ ID NO: 45253 - DNA, 15 bp, Homo sapiens
ctgctggggcttcct

SEQ ID NO: 45254 - DNA, 15 bp, Homo sapiens
cctgctggggcttcc

SEQ ID NO: 45255 - DNA, 15 bp, Homo sapiens
tcctgctggggcttc

SEQ ID NO: 45256 - DNA, 15 bp, Homo sapiens
ttcctgctggggctt

SEQ ID NO: 45257 - DNA, 15 bp, Homo sapiens
attcctgctggggct

SEQ ID NO: 45258 - DNA, 15 bp, Homo sapiens
aattcctgctggggc

SEQ ID NO: 45259 - DNA, 15 bp, Homo sapiens
aaattcctgctgggg

SEQ ID NO: 45260 - DNA, 15 bp, Homo sapiens
aaaattcctgctggg

SEQ ID NO: 45261 - DNA, 15 bp, Homo sapiens
gaaaattcctgctgg

SEQ ID NO: 45262 - DNA, 15 bp, Homo sapiens
ggaaaattcctgctg

SEQ ID NO: 45263 - DNA, 15 bp, Homo sapiens
tggaaaattcctgct

SEQ ID NO: 45264 - DNA, 15 bp, Homo sapiens
atggaaaattcctgc

SEQ ID NO: 45265 - DNA, 15 bp, Homo sapiens
gatggaaaattcctg

SEQ ID NO: 45266 - DNA, 15 bp, Homo sapiens
ggatggaaaattcct

SEQ ID NO: 45267 - DNA, 15 bp, Homo sapiens
gggatggaaaattcc

SEQ ID NO: 45268 - DNA, 15 bp, Homo sapiens
tgggatggaaaattc

SEQ ID NO: 45269 - DNA, 15 bp, Homo sapiens
ctgggatggaaaatt

SEQ ID NO: 45270 - DNA, 15 bp, Homo sapiens
cctgggatggaaaat

SEQ ID NO: 45271 - DNA, 15 bp, Homo sapiens
acctgggatggaaaa

SEQ ID NO: 45272 - DNA, 15 bp, Homo sapiens
tacctgggatggaaa

SEQ ID NO: 45273 - DNA, 15 bp, Homo sapiens
gtacctgggatggaa

SEQ ID NO: 45274 - DNA, 15 bp, Homo sapiens
agtacctgggatgga

SEQ ID NO: 45275 - DNA, 15 bp, Homo sapiens
tagtacctgggatgg

SEQ ID NO: 45276 - DNA, 15 bp, Homo sapiens
atagtacctgggatg

SEQ ID NO: 45277 - DNA, 15 bp, Homo sapiens
aatagtacctgggat

SEQ ID NO: 45278 - DNA, 15 bp, Homo sapiens
aaatagtacctggga

SEQ ID NO: 45279 - DNA, 15 bp, Homo sapiens
caaatagtacctggg

SEQ ID NO: 45280 - DNA, 15 bp, Homo sapiens
tcaaatagtacctgg

SEQ ID NO: 45281 - DNA, 15 bp, Homo sapiens
ttcaaatagtacctg

SEQ ID NO: 45282 - DNA, 15 bp, Homo sapiens
cttcaaatagtacct

SEQ ID NO: 45283 - DNA, 15 bp, Homo sapiens
tcttcaaatagtacc

SEQ ID NO: 45284 - DNA, 15 bp, Homo sapiens
ttcttcaaatagtac

SEQ ID NO: 45285 - DNA, 15 bp, Homo sapiens
gttcttcaaatagta

SEQ ID NO: 45286 - DNA, 15 bp, Homo sapiens
ggttcttcaaatagt

SEQ ID NO: 45287 - DNA, 15 bp, Homo sapiens
tggttcttcaaatag

SEQ ID NO: 45288 - DNA, 15 bp, Homo sapiens
gtggttcttcaaata

SEQ ID NO: 45289 - DNA, 15 bp, Homo sapiens
agtggttcttcaaat

SEQ ID NO: 45290 - DNA, 15 bp, Homo sapiens
cagtggttcttcaaa

SEQ ID NO: 45291 - DNA, 15 bp, Homo sapiens
gcagtggttcttcaa

SEQ ID NO: 45292 - DNA, 15 bp, Homo sapiens
agcagtggttcttca

SEQ ID NO: 45293 - DNA, 15 bp, Homo sapiens
aagcagtggttcttc

SEQ ID NO: 45294 - DNA, 15 bp, Homo sapiens
taagcagtggttctt

SEQ ID NO: 45295 - DNA, 15 bp, Homo sapiens
ctaagcagtggttct

SEQ ID NO: 45296 - DNA, 15 bp, Homo sapiens
cctaagcagtggttc

SEQ ID NO: 45297 - DNA, 15 bp, Homo sapiens
tcctaagcagtggtt

SEQ ID NO: 45298 - DNA, 15 bp, Homo sapiens
ttcctaagcagtggt

SEQ ID NO: 45299 - DNA, 15 bp, Homo sapiens
gttcctaagcagtgg

SEQ ID NO: 45300 - DNA, 15 bp, Homo sapiens
ggttcctaagcagtg

SEQ ID NO: 45301 - DNA, 15 bp, Homo sapiens
gggttcctaagcagt

SEQ ID NO: 45302 - DNA, 15 bp, Homo sapiens
agggttcctaagcag

SEQ ID NO: 45303 - DNA, 15 bp, Homo sapiens
gagggttcctaagca

SEQ ID NO: 45304 - DNA, 15 bp, Homo sapiens
tgagggttcctaagc

SEQ ID NO: 45305 - DNA, 15 bp, Homo sapiens
ctgagggttcctaag

SEQ ID NO: 45306 - DNA, 15 bp, Homo sapiens
gctgagggttcctaa

SEQ ID NO: 45307 - DNA, 15 bp, Homo sapiens
agctgagggttccta

SEQ ID NO: 45308 - DNA, 15 bp, Homo sapiens
cagctgagggttcct

SEQ ID NO: 45309 - DNA, 15 bp, Homo sapiens
ccagctgagggttcc

SEQ ID NO: 45310 - DNA, 15 bp, Homo sapiens
cccagctgagggttc

SEQ ID NO: 45311 - DNA, 15 bp, Homo sapiens
gcccagctgagggtt

SEQ ID NO: 45312 - DNA, 15 bp, Homo sapiens
cgcccagctgagggt

SEQ ID NO: 45313 - DNA, 15 bp, Homo sapiens
tcgcccagctgaggg

SEQ ID NO: 45314 - DNA, 15 bp, Homo sapiens
ctcgcccagctgagg

SEQ ID NO: 45315 - DNA, 15 bp, Homo sapiens
cctcgcccagctgag

SEQ ID NO: 45316 - DNA, 15 bp, Homo sapiens
acctcgcccagctga

SEQ ID NO: 45317 - DNA, 15 bp, Homo sapiens
cacctcgcccagctg

SEQ ID NO: 45318 - DNA, 15 bp, Homo sapiens
ccacctcgcccagct

SEQ ID NO: 45319 - DNA, 15 bp, Homo sapiens
gccacctcgcccagc

SEQ ID NO: 45320 - DNA, 15 bp, Homo sapiens
agccacctcgcccag

SEQ ID NO: 45321 - DNA, 15 bp, Homo sapiens
gagccacctcgccca

SEQ ID NO: 45322 - DNA, 15 bp, Homo sapiens
tgagccacctcgccc

SEQ ID NO: 45323 - DNA, 15 bp, Homo sapiens
atgagccacctcgcc

SEQ ID NO: 45324 - DNA, 15 bp, Homo sapiens
catgagccacctcgc

SEQ ID NO: 45325 - DNA, 15 bp, Homo sapiens
gcatgagccacctcg

SEQ ID NO: 45326 - DNA, 15 bp, Homo sapiens
taggcatgagccacc

SEQ ID NO: 45327 - DNA, 15 bp, Homo sapiens
ataggcatgagccac

SEQ ID NO: 45328 - DNA, 15 bp, Homo sapiens
tataggcatgagcca

SEQ ID NO: 45329 - DNA, 15 bp, Homo sapiens
ttataggcatgagcc

SEQ ID NO: 45330 - DNA, 15 bp, Homo sapiens
attataggcatgagc

SEQ ID NO: 45331 - DNA, 15 bp, Homo sapiens
tattataggcatgag

SEQ ID NO: 45332 - DNA, 15 bp, Homo sapiens
gtattataggcatga

SEQ ID NO: 45333 - DNA, 15 bp, Homo sapiens
ggtattataggcatg

SEQ ID NO: 45334 - DNA, 15 bp, Homo sapiens
tggtattataggcat

SEQ ID NO: 45335 - DNA, 15 bp, Homo sapiens
ctggtattataggca

SEQ ID NO: 45336 - DNA, 15 bp, Homo sapiens
gctggtattataggc

SEQ ID NO: 45337 - DNA, 15 bp, Homo sapiens
tgctggtattatagg

SEQ ID NO: 45338 - DNA, 15 bp, Homo sapiens
gtgctggtattatag

SEQ ID NO: 45339 - DNA, 15 bp, Homo sapiens
agtgctggtattata

SEQ ID NO: 45340 - DNA, 15 bp, Homo sapiens
aagtgctggtattat

SEQ ID NO: 45341 - DNA, 15 bp, Homo sapiens
aaagtgctggtatta

SEQ ID NO: 45342 - DNA, 15 bp, Homo sapiens
aaaagtgctggtatt

SEQ ID NO: 45343 - DNA, 15 bp, Homo sapiens
caaaagtgctggtat

SEQ ID NO: 45344 - DNA, 15 bp, Homo sapiens
ccaaaagtgctggta

SEQ ID NO: 45345 - DNA, 15 bp, Homo sapiens
tccaaaagtgctggt

SEQ ID NO: 45346 - DNA, 15 bp, Homo sapiens
ctccaaaagtgctgg

SEQ ID NO: 45347 - DNA, 15 bp, Homo sapiens
cctccaaaagtgctg

SEQ ID NO: 45348 - DNA, 15 bp, Homo sapiens
gcctccaaaagtgct

SEQ ID NO: 45349 - DNA, 15 bp, Homo sapiens
ggcctccaaaagtgc

SEQ ID NO: 45350 - DNA, 15 bp, Homo sapiens
tggcctccaaaagtg

SEQ ID NO: 45351 - DNA, 15 bp, Homo sapiens
ttggcctccaaaagt

SEQ ID NO: 45352 - DNA, 15 bp, Homo sapiens
cttggcctccaaaag

SEQ ID NO: 45353 - DNA, 15 bp, Homo sapiens
tcttggcctccaaaa

SEQ ID NO: 45354 - DNA, 15 bp, Homo sapiens
atcttggcctccaaa

SEQ ID NO: 45355 - DNA, 15 bp, Homo sapiens
catcttggcctccaa

SEQ ID NO: 45356 - DNA, 15 bp, Homo sapiens
ccatcttggcctcca

SEQ ID NO: 45357 - DNA, 15 bp, Homo sapiens
cccatcttggcctcc

SEQ ID NO: 45358 - DNA, 15 bp, Homo sapiens
tcccatcttggcctc

SEQ ID NO: 45359 - DNA, 15 bp, Homo sapiens
ctcccatcttggcct

SEQ ID NO: 45360 - DNA, 15 bp, Homo sapiens
cctcccatcttggcc

SEQ ID NO: 45361 - DNA, 15 bp, Homo sapiens
tcctcccatcttggc

SEQ ID NO: 45362 - DNA, 15 bp, Homo sapiens
atcctcccatcttgg

SEQ ID NO: 45363 - DNA, 15 bp, Homo sapiens
gatcctcccatcttg

SEQ ID NO: 45364 - DNA, 15 bp, Homo sapiens
tgatcctcccatctt

SEQ ID NO: 45365 - DNA, 15 bp, Homo sapiens
gtgatcctcccatct

SEQ ID NO: 45366 - DNA, 15 bp, Homo sapiens
agtgatcctcccatc

SEQ ID NO: 45367 - DNA, 15 bp, Homo sapiens
aagtgatcctcccat

SEQ ID NO: 45368 - DNA, 15 bp, Homo sapiens
caagtgatcctccca

SEQ ID NO: 45369 - DNA, 15 bp, Homo sapiens
cctcctgggctcaag

SEQ ID NO: 45370 - DNA, 15 bp, Homo sapiens
cacctcctgggctca

SEQ ID NO: 45371 - DNA, 15 bp, Homo sapiens
ccacctcctgggctc

SEQ ID NO: 45372 - DNA, 15 bp, Homo sapiens
tccacctcctgggct

SEQ ID NO: 45373 - DNA, 15 bp, Homo sapiens
ctccacctcctgggc

SEQ ID NO: 45374 - DNA, 15 bp, Homo sapiens
gcctccacctcctgg

SEQ ID NO: 45375 - DNA, 15 bp, Homo sapiens
agcctccacctcctg

SEQ ID NO: 45376 - DNA, 15 bp, Homo sapiens
tagcctccacctcct

SEQ ID NO: 45377 - DNA, 15 bp, Homo sapiens
gtagcctccacctcc

SEQ ID NO: 45378 - DNA, 15 bp, Homo sapiens
tgtagcctccacctc

SEQ ID NO: 45379 - DNA, 15 bp, Homo sapiens
ctgtagcctccacct

SEQ ID NO: 45380 - DNA, 15 bp, Homo sapiens
actgtagcctccacc

SEQ ID NO: 45381 - DNA, 15 bp, Homo sapiens
cactgtagcctccac

SEQ ID NO: 45382 - DNA, 15 bp, Homo sapiens
tcactgtagcctcca

SEQ ID NO: 45383 - DNA, 15 bp, Homo sapiens
ctcactgtagcctcc

SEQ ID NO: 45384 - DNA, 15 bp, Homo sapiens
gctcactgtagcctc

SEQ ID NO: 45385 - DNA, 15 bp, Homo sapiens
agctcactgtagcct

SEQ ID NO: 45386 - DNA, 15 bp, Homo sapiens
cagctcactgtagcc

SEQ ID NO: 45387 - DNA, 15 bp, Homo sapiens
acagctcactgtagc

SEQ ID NO: 45388 - DNA, 15 bp, Homo sapiens
cacagctcactgtag

SEQ ID NO: 45389 - DNA, 15 bp, Homo sapiens
tcacagctcactgta

SEQ ID NO: 45390 - DNA, 15 bp, Homo sapiens
atcacagctcactgt

SEQ ID NO: 45391 - DNA, 15 bp, Homo sapiens
gatcacagctcactg

SEQ ID NO: 45392 - DNA, 15 bp, Homo sapiens
tgatcacagctcact

SEQ ID NO: 45393 - DNA, 15 bp, Homo sapiens
ttgatcacagctcac

SEQ ID NO: 45394 - DNA, 15 bp, Homo sapiens
cttgatcacagctca

SEQ ID NO: 45395 - DNA, 15 bp, Homo sapiens
gcttgatcacagctc

SEQ ID NO: 45396 - DNA, 15 bp, Homo sapiens
ggcttgatcacagct

SEQ ID NO: 45397 - DNA, 15 bp, Homo sapiens
tggcttgatcacagc

SEQ ID NO: 45398 - DNA, 15 bp, Homo sapiens
gtggcttgatcacag

SEQ ID NO: 45399 - DNA, 15 bp, Homo sapiens
agtggcttgatcaca

SEQ ID NO: 45400 - DNA, 15 bp, Homo sapiens
cagtggcttgatcac

SEQ ID NO: 45401 - DNA, 15 bp, Homo sapiens
gcagtggcttgatca

SEQ ID NO: 45402 - DNA, 15 bp, Homo sapiens
tgcagtggcttgatc

SEQ ID NO: 45403 - DNA, 15 bp, Homo sapiens
gtgcagtggcttgat

SEQ ID NO: 45404 - DNA, 15 bp, Homo sapiens
agtgcagtggcttga

SEQ ID NO: 45405 - DNA, 15 bp, Homo sapiens
gagtgcagtggcttg

SEQ ID NO: 45406 - DNA, 15 bp, Homo sapiens
ggagtgcagtggctt

SEQ ID NO: 45407 - DNA, 15 bp, Homo sapiens
tggagtgcagtggct

SEQ ID NO: 45408 - DNA, 15 bp, Homo sapiens
tcccaggctggagtg

SEQ ID NO: 45409 - DNA, 15 bp, Homo sapiens
ctcccaggctggagt

SEQ ID NO: 45410 - DNA, 15 bp, Homo sapiens
tctcccaggctggag

SEQ ID NO: 45411 - DNA, 15 bp, Homo sapiens
gtctcccaggctgga

SEQ ID NO: 45412 - DNA, 15 bp, Homo sapiens
tgtctcccaggctgg

SEQ ID NO: 45413 - DNA, 15 bp, Homo sapiens
ctgtctcccaggctg

SEQ ID NO: 45414 - DNA, 15 bp, Homo sapiens
actgtctcccaggct

SEQ ID NO: 45415 - DNA, 15 bp, Homo sapiens
aactgtctcccaggc

SEQ ID NO: 45416 - DNA, 15 bp, Homo sapiens
taactgtctcccagg

SEQ ID NO: 45417 - DNA, 15 bp, Homo sapiens
ctaactgtctcccag

SEQ ID NO: 45418 - DNA, 15 bp, Homo sapiens
tctaactgtctccca

SEQ ID NO: 45419 - DNA, 15 bp, Homo sapiens
gtctaactgtctccc

SEQ ID NO: 45420 - DNA, 15 bp, Homo sapiens
ggtctaactgtctcc

SEQ ID NO: 45421 - DNA, 15 bp, Homo sapiens
gggtctaactgtctc

SEQ ID NO: 45422 - DNA, 15 bp, Homo sapiens
agggtctaactgtct

SEQ ID NO: 45423 - DNA, 15 bp, Homo sapiens
cagggtctaactgtc

SEQ ID NO: 45424 - DNA, 15 bp, Homo sapiens
acagggtctaactgt

SEQ ID NO: 45425 - DNA, 15 bp, Homo sapiens
gacagggtctaactg

SEQ ID NO: 45426 - DNA, 15 bp, Homo sapiens
agacagggtctaact

SEQ ID NO: 45427 - DNA, 15 bp, Homo sapiens
gagacagggtctaac

SEQ ID NO: 45428 - DNA, 15 bp, Homo sapiens
tgagacagggtctaa

SEQ ID NO: 45429 - DNA, 15 bp, Homo sapiens
ttgagacagggtcta

SEQ ID NO: 45430 - DNA, 15 bp, Homo sapiens
ttttgagacagggtc

SEQ ID NO: 45431 - DNA, 15 bp, Homo sapiens
tttttgagacagggt

SEQ ID NO: 45432 - DNA, 15 bp, Homo sapiens
gtttttgagacaggg

SEQ ID NO: 45433 - DNA, 15 bp, Homo sapiens
tgtttttgagacagg

SEQ ID NO: 45434 - DNA, 15 bp, Homo sapiens
ttgtttttgagacag

SEQ ID NO: 45435 - DNA, 15 bp, Homo sapiens
tttgtttttgagaca

SEQ ID NO: 45436 - DNA, 15 bp, Homo sapiens
atttgtttttgagac

SEQ ID NO: 45437 - DNA, 15 bp, Homo sapiens
catttgtttttgaga

SEQ ID NO: 45438 - DNA, 15 bp, Homo sapiens
tcatttgtttttgag

SEQ ID NO: 45439 - DNA, 15 bp, Homo sapiens
ttcatttgtttttga

SEQ ID NO: 45440 - DNA, 15 bp, Homo sapiens
gttcatttgtttttg

SEQ ID NO: 45441 - DNA, 15 bp, Homo sapiens
tgttcatttgttttt

SEQ ID NO: 45442 - DNA, 15 bp, Homo sapiens
ttgttcatttgtttt

SEQ ID NO: 45443 - DNA, 15 bp, Homo sapiens
tttgttcatttgttt

SEQ ID NO: 45444 - DNA, 15 bp, Homo sapiens
gtttgttcatttgtt

SEQ ID NO: 45445 - DNA, 15 bp, Homo sapiens
tgtttgttcatttgt

SEQ ID NO: 45446 - DNA, 15 bp, Homo sapiens
ttgtttgttcatttg

SEQ ID NO: 45447 - DNA, 15 bp, Homo sapiens
tttgtttgttcattt

SEQ ID NO: 45448 - DNA, 15 bp, Homo sapiens
gtttgtttgttcatt

SEQ ID NO: 45449 - DNA, 15 bp, Homo sapiens
tgtttgtttgttcat

SEQ ID NO: 45450 - DNA, 15 bp, Homo sapiens
ttgtttgtttgttca

SEQ ID NO: 45451 - DNA, 15 bp, Homo sapiens
tttgtttgtttgttc

SEQ ID NO: 45452 - DNA, 15 bp, Homo sapiens
gtttttgtttgtttg

SEQ ID NO: 45453 - DNA, 15 bp, Homo sapiens
ggtttttgtttgttt

SEQ ID NO: 45454 - DNA, 15 bp, Homo sapiens
gggtttttgtttgtt

SEQ ID NO: 45455 - DNA, 15 bp, Homo sapiens
agggtttttgtttgt

SEQ ID NO: 45456 - DNA, 15 bp, Homo sapiens
gagggtttttgtttg

SEQ ID NO: 45457 - DNA, 15 bp, Homo sapiens
tgagggtttttgttt

SEQ ID NO: 45458 - DNA, 15 bp, Homo sapiens
ttgagggtttttgtt

SEQ ID NO: 45459 - DNA, 15 bp, Homo sapiens
attgagggtttttgt

SEQ ID NO: 45460 - DNA, 15 bp, Homo sapiens
aattgagggtttttg

SEQ ID NO: 45461 - DNA, 15 bp, Homo sapiens
gaattgagggttttt

SEQ ID NO: 45462 - DNA, 15 bp, Homo sapiens
ggaattgagggtttt

SEQ ID NO: 45463 - DNA, 15 bp, Homo sapiens
gggaattgagggttt

SEQ ID NO: 45464 - DNA, 15 bp, Homo sapiens
tgggaattgagggtt

SEQ ID NO: 45465 - DNA, 15 bp, Homo sapiens
gtgggaattgagggt

SEQ ID NO: 45466 - DNA, 15 bp, Homo sapiens
cgtgggaattgaggg

SEQ ID NO: 45467 - DNA, 15 bp, Homo sapiens
tcgtgggaattgagg

SEQ ID NO: 45468 - DNA, 15 bp, Homo sapiens
ttcgtgggaattgag

SEQ ID NO: 45469 - DNA, 15 bp, Homo sapiens
gttcgtgggaattga

SEQ ID NO: 45470 - DNA, 15 bp, Homo sapiens
cgttcgtgggaattg

SEQ ID NO: 45471 - DNA, 15 bp, Homo sapiens
gcgttcgtgggaatt

SEQ ID NO: 45472 - DNA, 15 bp, Homo sapiens
ggcgttcgtgggaat

SEQ ID NO: 45473 - DNA, 15 bp, Homo sapiens
gggcgttcgtgggaa

SEQ ID NO: 45474 - DNA, 15 bp, Homo sapiens
ggggcgttcgtggga

SEQ ID NO: 45475 - DNA, 15 bp, Homo sapiens
tggggcgttcgtggg

SEQ ID NO: 45476 - DNA, 15 bp, Homo sapiens
ctggggcgttcgtgg

SEQ ID NO: 45477 - DNA, 15 bp, Homo sapiens
cctggggcgttcgtg

SEQ ID NO: 45478 - DNA, 15 bp, Homo sapiens
tcctggggcgttcgt

SEQ ID NO: 45479 - DNA, 15 bp, Homo sapiens
ctcctggggcgttcg

SEQ ID NO: 45480 - DNA, 15 bp, Homo sapiens
tctcctggggcgttc

SEQ ID NO: 45481 - DNA, 15 bp, Homo sapiens
atctcctggggcgtt

SEQ ID NO: 45482 - DNA, 15 bp, Homo sapiens
tatctcctggggcgt

SEQ ID NO: 45483 - DNA, 15 bp, Homo sapiens
ttatctcctggggcg

SEQ ID NO: 45484 - DNA, 15 bp, Homo sapiens
cttatctcctggggc

SEQ ID NO: 45485 - DNA, 15 bp, Homo sapiens
ccttatctcctgggg

SEQ ID NO: 45486 - DNA, 15 bp, Homo sapiens
cccttatctcctggg

SEQ ID NO: 45487 - DNA, 15 bp, Homo sapiens
tcccttatctcctgg

SEQ ID NO: 45488 - DNA, 15 bp, Homo sapiens
ctcccttatctcctg

SEQ ID NO: 45489 - DNA, 15 bp, Homo sapiens
gctcccttatctcct

SEQ ID NO: 45490 - DNA, 15 bp, Homo sapiens
tgctcccttatctcc

SEQ ID NO: 45491 - DNA, 15 bp, Homo sapiens
atgctcccttatctc

SEQ ID NO: 45492 - DNA, 15 bp, Homo sapiens
catgctcccttatct

SEQ ID NO: 45493 - DNA, 15 bp, Homo sapiens
ccatgctcccttatc

SEQ ID NO: 45494 - DNA, 15 bp, Homo sapiens
gccatgctcccttat

SEQ ID NO: 45495 - DNA, 15 bp, Homo sapiens
ggccatgctccctta

SEQ ID NO: 45496 - DNA, 15 bp, Homo sapiens
gggccatgctccctt

SEQ ID NO: 45497 - DNA, 15 bp, Homo sapiens
tgggccatgctccct

SEQ ID NO: 45498 - DNA, 15 bp, Homo sapiens
ctgggccatgctccc

SEQ ID NO: 45499 - DNA, 15 bp, Homo sapiens
cctgggccatgctcc

SEQ ID NO: 45500 - DNA, 15 bp, Homo sapiens
gcctgggccatgctc

SEQ ID NO: 45501 - DNA, 15 bp, Homo sapiens
ggcctgggccatgct

SEQ ID NO: 45502 - DNA, 15 bp, Homo sapiens
aggcctgggccatgc

SEQ ID NO: 45503 - DNA, 15 bp, Homo sapiens
aaggcctgggccatg

SEQ ID NO: 45504 - DNA, 15 bp, Homo sapiens
caaggcctgggccat

SEQ ID NO: 45505 - DNA, 15 bp, Homo sapiens
tcaaggcctgggcca

SEQ ID NO: 45506 - DNA, 15 bp, Homo sapiens
ctcaaggcctgggcc

SEQ ID NO: 45507 - DNA, 15 bp, Homo sapiens
gctcaaggcctgggc

SEQ ID NO: 45508 - DNA, 15 bp, Homo sapiens
ggctcaaggcctggg

SEQ ID NO: 45509 - DNA, 15 bp, Homo sapiens
tggctcaaggcctgg

SEQ ID NO: 45510 - DNA, 15 bp, Homo sapiens
ctggctcaaggcctg

SEQ ID NO: 45511 - DNA, 15 bp, Homo sapiens
cctggctcaaggcct

SEQ ID NO: 45512 - DNA, 15 bp, Homo sapiens
ccctggctcaaggcc

SEQ ID NO: 45513 - DNA, 15 bp, Homo sapiens
gccctggctcaaggc

SEQ ID NO: 45514 - DNA, 15 bp, Homo sapiens
agccctggctcaagg

SEQ ID NO: 45515 - DNA, 15 bp, Homo sapiens
aagccctggctcaag

SEQ ID NO: 45516 - DNA, 15 bp, Homo sapiens
gaagccctggctcaa

SEQ ID NO: 45517 - DNA, 15 bp, Homo sapiens
agaagccctggctca

SEQ ID NO: 45518 - DNA, 15 bp, Homo sapiens
cagaagccctggctc

SEQ ID NO: 45519 - DNA, 15 bp, Homo sapiens
ccagaagccctggct

SEQ ID NO: 45520 - DNA, 15 bp, Homo sapiens
gccagaagccctggc

SEQ ID NO: 45521 - DNA, 15 bp, Homo sapiens
tgccagaagccctgg

SEQ ID NO: 45522 - DNA, 15 bp, Homo sapiens
ctgccagaagccctg

SEQ ID NO: 45523 - DNA, 15 bp, Homo sapiens
actgccagaagccct

SEQ ID NO: 45524 - DNA, 15 bp, Homo sapiens
tactgccagaagccc

SEQ ID NO: 45525 - DNA, 15 bp, Homo sapiens
ctactgccagaagcc

SEQ ID NO: 45526 - DNA, 15 bp, Homo sapiens
cctactgccagaagc

SEQ ID NO: 45527 - DNA, 15 bp, Homo sapiens
ccctactgccagaag

SEQ ID NO: 45528 - DNA, 15 bp, Homo sapiens
cccctactgccagaa

SEQ ID NO: 45529 - DNA, 15 bp, Homo sapiens
tcccctactgccaga

SEQ ID NO: 45530 - DNA, 15 bp, Homo sapiens
ctcccctactgccag

SEQ ID NO: 45531 - DNA, 15 bp, Homo sapiens
gctcccctactgcca

SEQ ID NO: 45532 - DNA, 15 bp, Homo sapiens
ggctcccctactgcc

SEQ ID NO: 45533 - DNA, 15 bp, Homo sapiens
aggctcccctactgc

SEQ ID NO: 45534 - DNA, 15 bp, Homo sapiens
gaggctcccctactg

SEQ ID NO: 45535 - DNA, 15 bp, Homo sapiens
ggaggctcccctact

SEQ ID NO: 45536 - DNA, 15 bp, Homo sapiens
gggaggctcccctac

SEQ ID NO: 45537 - DNA, 15 bp, Homo sapiens
ggggaggctccccta

SEQ ID NO: 45538 - DNA, 15 bp, Homo sapiens
gggggaggctcccct

SEQ ID NO: 45539 - DNA, 15 bp, Homo sapiens
tgggggaggctcccc

SEQ ID NO: 45540 - DNA, 15 bp, Homo sapiens
atgggggaggctccc

SEQ ID NO: 45541 - DNA, 15 bp, Homo sapiens
aatgggggaggctcc

SEQ ID NO: 45542 - DNA, 15 bp, Homo sapiens
aaatgggggaggctc

SEQ ID NO: 45543 - DNA, 15 bp, Homo sapiens
caaatgggggaggct

SEQ ID NO: 45544 - DNA, 15 bp, Homo sapiens
gcaaatgggggaggc

SEQ ID NO: 45545 - DNA, 15 bp, Homo sapiens
agcaaatgggggagg

SEQ ID NO: 45546 - DNA, 15 bp, Homo sapiens
tagcaaatgggggag

SEQ ID NO: 45547 - DNA, 15 bp, Homo sapiens
ttagcaaatggggga

SEQ ID NO: 45548 - DNA, 15 bp, Homo sapiens
cttagcaaatggggg

SEQ ID NO: 45549 - DNA, 15 bp, Homo sapiens
gcttagcaaatgggg

SEQ ID NO: 45550 - DNA, 15 bp, Homo sapiens
cgcttagcaaatggg

SEQ ID NO: 45551 - DNA, 15 bp, Homo sapiens
ccgcttagcaaatgg

SEQ ID NO: 45552 - DNA, 15 bp, Homo sapiens
tccgcttagcaaatg

SEQ ID NO: 45553 - DNA, 15 bp, Homo sapiens
gtccgcttagcaaat

SEQ ID NO: 45554 - DNA, 15 bp, Homo sapiens
agtccgcttagcaaa

SEQ ID NO: 45555 - DNA, 15 bp, Homo sapiens
aagtccgcttagcaa

SEQ ID NO: 45556 - DNA, 15 bp, Homo sapiens
aaagtccgcttagca

SEQ ID NO: 45557 - DNA, 15 bp, Homo sapiens
gaaagtccgcttagc

SEQ ID NO: 45558 - DNA, 15 bp, Homo sapiens
ggaaagtccgcttag

SEQ ID NO: 45559 - DNA, 15 bp, Homo sapiens
aggaaagtccgctta

SEQ ID NO: 45560 - DNA, 15 bp, Homo sapiens
gaggaaagtccgctt

SEQ ID NO: 45561 - DNA, 15 bp, Homo sapiens
agaggaaagtccgct

SEQ ID NO: 45562 - DNA, 15 bp, Homo sapiens
aagaggaaagtccgc

SEQ ID NO: 45563 - DNA, 15 bp, Homo sapiens
gaagaggaaagtccg

SEQ ID NO: 45564 - DNA, 15 bp, Homo sapiens
ggaagaggaaagtcc

SEQ ID NO: 45565 - DNA, 15 bp, Homo sapiens
aggaagaggaaagtc

SEQ ID NO: 45566 - DNA, 15 bp, Homo sapiens
aaggaagaggaaagt

SEQ ID NO: 45567 - DNA, 15 bp, Homo sapiens
gaaggaagaggaaag

SEQ ID NO: 45568 - DNA, 15 bp, Homo sapiens
agaaggaagaggaaa

SEQ ID NO: 45569 - DNA, 15 bp, Homo sapiens
cagaaggaagaggaa

SEQ ID NO: 45570 - DNA, 15 bp, Homo sapiens
acagaaggaagagga

SEQ ID NO: 45571 - DNA, 15 bp, Homo sapiens
tacagaaggaagagg

SEQ ID NO: 45572 - DNA, 15 bp, Homo sapiens
ctacagaaggaagag

SEQ ID NO: 45573 - DNA, 15 bp, Homo sapiens
cctacagaaggaaga

SEQ ID NO: 45574 - DNA, 15 bp, Homo sapiens
gcctacagaaggaag

SEQ ID NO: 45575 - DNA, 15 bp, Homo sapiens
agcctacagaaggaa

SEQ ID NO: 45576 - DNA, 15 bp, Homo sapiens
aagcctacagaagga

SEQ ID NO: 45577 - DNA, 15 bp, Homo sapiens
caagcctacagaagg

SEQ ID NO: 45578 - DNA, 15 bp, Homo sapiens
ccaagcctacagaag

SEQ ID NO: 45579 - DNA, 15 bp, Homo sapiens
cccaagcctacagaa

SEQ ID NO: 45580 - DNA, 15 bp, Homo sapiens
gcccaagcctacaga

SEQ ID NO: 45581 - DNA, 15 bp, Homo sapiens
ggcccaagcctacag

SEQ ID NO: 45582 - DNA, 15 bp, Homo sapiens
aggcccaagcctaca

SEQ ID NO: 45583 - DNA, 15 bp, Homo sapiens
caggcccaagcctac

SEQ ID NO: 45584 - DNA, 15 bp, Homo sapiens
ccaggcccaagccta

SEQ ID NO: 45585 - DNA, 15 bp, Homo sapiens
tccaggcccaagcct

SEQ ID NO: 45586 - DNA, 15 bp, Homo sapiens
ttccaggcccaagcc

SEQ ID NO: 45587 - DNA, 15 bp, Homo sapiens
gttccaggcccaagc

SEQ ID NO: 45588 - DNA, 15 bp, Homo sapiens
tgttccaggcccaag

SEQ ID NO: 45589 - DNA, 15 bp, Homo sapiens
ctgttccaggcccaa

SEQ ID NO: 45590 - DNA, 15 bp, Homo sapiens
cctgttccaggccca

SEQ ID NO: 45591 - DNA, 15 bp, Homo sapiens
tcctgttccaggccc

SEQ ID NO: 45592 - DNA, 15 bp, Homo sapiens
gtcctgttccaggcc

SEQ ID NO: 45593 - DNA, 15 bp, Homo sapiens
tgtcctgttccaggc

SEQ ID NO: 45594 - DNA, 15 bp, Homo sapiens
ctgtcctgttccagg

SEQ ID NO: 45595 - DNA, 15 bp, Homo sapiens
cctgtcctgttccag

SEQ ID NO: 45596 - DNA, 15 bp, Homo sapiens
gcctgtcctgttcca

SEQ ID NO: 45597 - DNA, 15 bp, Homo sapiens
tgcctgtcctgttcc

SEQ ID NO: 45598 - DNA, 15 bp, Homo sapiens
ctgcctgtcctgttc

SEQ ID NO: 45599 - DNA, 15 bp, Homo sapiens
cctgcctgtcctgtt

SEQ ID NO: 45600 - DNA, 15 bp, Homo sapiens
ccctgcctgtcctgt

SEQ ID NO: 45601 - DNA, 15 bp, Homo sapiens
cccctgcctgtcctg

SEQ ID NO: 45602 - DNA, 15 bp, Homo sapiens
gcccctgcctgtcct

SEQ ID NO: 45603 - DNA, 15 bp, Homo sapiens
ggcccctgcctgtcc

SEQ ID NO: 45604 - DNA, 15 bp, Homo sapiens
gggcccctgcctgtc

SEQ ID NO: 45605 - DNA, 15 bp, Homo sapiens
cgggcccctgcctgt

SEQ ID NO: 45606 - DNA, 15 bp, Homo sapiens
tcgggcccctgcctg

SEQ ID NO: 45607 - DNA, 15 bp, Homo sapiens
ttcgggcccctgcct

SEQ ID NO: 45608 - DNA, 15 bp, Homo sapiens
cttcgggcccctgcc

SEQ ID NO: 45609 - DNA, 15 bp, Homo sapiens
tcttcgggcccctgc

SEQ ID NO: 45610 - DNA, 15 bp, Homo sapiens
ttcttcgggcccctg

SEQ ID NO: 45611 - DNA, 15 bp, Homo sapiens
tttcttcgggcccct

SEQ ID NO: 45612 - DNA, 15 bp, Homo sapiens
ctttcttcgggcccc

SEQ ID NO: 45613 - DNA, 15 bp, Homo sapiens
actttcttcgggccc

SEQ ID NO: 45614 - DNA, 15 bp, Homo sapiens
cactttcttcgggcc

SEQ ID NO: 45615 - DNA, 15 bp, Homo sapiens
tcactttcttcgggc

SEQ ID NO: 45616 - DNA, 15 bp, Homo sapiens
atcactttcttcggg

SEQ ID NO: 45617 - DNA, 15 bp, Homo sapiens
catcactttcttcgg

SEQ ID NO: 45618 - DNA, 15 bp, Homo sapiens
tcatcactttcttcg

SEQ ID NO: 45619 - DNA, 15 bp, Homo sapiens
ttcatcactttcttc

SEQ ID NO: 45620 - DNA, 15 bp, Homo sapiens
attcatcactttctt

SEQ ID NO: 45621 - DNA, 15 bp, Homo sapiens
aattcatcactttct

SEQ ID NO: 45622 - DNA, 15 bp, Homo sapiens
aaattcatcactttc

SEQ ID NO: 45623 - DNA, 15 bp, Homo sapiens
gaaattcatcacttt

SEQ ID NO: 45624 - DNA, 15 bp, Homo sapiens
tgaaattcatcactt

SEQ ID NO: 45625 - DNA, 15 bp, Homo sapiens
ctgaaattcatcact

SEQ ID NO: 45626 - DNA, 15 bp, Homo sapiens
tctgaaattcatcac

SEQ ID NO: 45627 - DNA, 15 bp, Homo sapiens
ctctgaaattcatca

SEQ ID NO: 45628 - DNA, 15 bp, Homo sapiens
gctctgaaattcatc

SEQ ID NO: 45629 - DNA, 15 bp, Homo sapiens
agctctgaaattcat

SEQ ID NO: 45630 - DNA, 15 bp, Homo sapiens
cagctctgaaattca

SEQ ID NO: 45631 - DNA, 15 bp, Homo sapiens
tcagctctgaaattc

SEQ ID NO: 45632 - DNA, 15 bp, Homo sapiens
atcagctctgaaatt

SEQ ID NO: 45633 - DNA, 15 bp, Homo sapiens
catcagctctgaaat

SEQ ID NO: 45634 - DNA, 15 bp, Homo sapiens
acatcagctctgaaa

SEQ ID NO: 45635 - DNA, 15 bp, Homo sapiens
cacatcagctctgaa

SEQ ID NO: 45636 - DNA, 15 bp, Homo sapiens
acacatcagctctga

SEQ ID NO: 45637 - DNA, 15 bp, Homo sapiens
aacacatcagctctg

SEQ ID NO: 45638 - DNA, 15 bp, Homo sapiens
gaacacatcagctct

SEQ ID NO: 45639 - DNA, 15 bp, Homo sapiens
tgaacacatcagctc

SEQ ID NO: 45640 - DNA, 15 bp, Homo sapiens
gtgaacacatcagct

SEQ ID NO: 45641 - DNA, 15 bp, Homo sapiens
ggtgaacacatcagc

SEQ ID NO: 45642 - DNA, 15 bp, Homo sapiens
aggtgaacacatcag

SEQ ID NO: 45643 - DNA, 15 bp, Homo sapiens
caggtgaacacatca

SEQ ID NO: 45644 - DNA, 15 bp, Homo sapiens
ccaggtgaacacatc

SEQ ID NO: 45645 - DNA, 15 bp, Homo sapiens
cccaggtgaacacat

SEQ ID NO: 45646 - DNA, 15 bp, Homo sapiens
gcccaggtgaacaca

SEQ ID NO: 45647 - DNA, 15 bp, Homo sapiens
tgcccaggtgaacac

SEQ ID NO: 45648 - DNA, 15 bp, Homo sapiens
ctgcccaggtgaaca

SEQ ID NO: 45649 - DNA, 15 bp, Homo sapiens
tctgcccaggtgaac

SEQ ID NO: 45650 - DNA, 15 bp, Homo sapiens
atctgcccaggtgaa

SEQ ID NO: 45651 - DNA, 15 bp, Homo sapiens
gatctgcccaggtga

SEQ ID NO: 45652 - DNA, 15 bp, Homo sapiens
ggatctgcccaggtg

SEQ ID NO: 45653 - DNA, 15 bp, Homo sapiens
gggatctgcccaggt

SEQ ID NO: 45654 - DNA, 15 bp, Homo sapiens
ggggatctgcccagg

SEQ ID NO: 45655 - DNA, 15 bp, Homo sapiens
gggggatctgcccag

SEQ ID NO: 45656 - DNA, 15 bp, Homo sapiens
tgggggatctgccca

SEQ ID NO: 45657 - DNA, 15 bp, Homo sapiens
ttgggggatctgccc

SEQ ID NO: 45658 - DNA, 15 bp, Homo sapiens
tttgggggatctgcc

SEQ ID NO: 45659 - DNA, 15 bp, Homo sapiens
atttgggggatctgc

SEQ ID NO: 45660 - DNA, 15 bp, Homo sapiens
gatttgggggatctg

SEQ ID NO: 45661 - DNA, 15 bp, Homo sapiens
ggatttgggggatct

SEQ ID NO: 45662 - DNA, 15 bp, Homo sapiens
cggatttgggggatc

SEQ ID NO: 45663 - DNA, 15 bp, Homo sapiens
ccggatttgggggat

SEQ ID NO: 45664 - DNA, 15 bp, Homo sapiens
tccggatttggggga

SEQ ID NO: 45665 - DNA, 15 bp, Homo sapiens
ttccggatttggggg

SEQ ID NO: 45666 - DNA, 15 bp, Homo sapiens
cttccggatttgggg

SEQ ID NO: 45667 - DNA, 15 bp, Homo sapiens
acttccggatttggg

SEQ ID NO: 45668 - DNA, 15 bp, Homo sapiens
gacttccggatttgg

SEQ ID NO: 45669 - DNA, 15 bp, Homo sapiens
tgacttccggatttg

SEQ ID NO: 45670 - DNA, 15 bp, Homo sapiens
ttgacttccggattt

SEQ ID NO: 45671 - DNA, 15 bp, Homo sapiens
tttgacttccggatt

SEQ ID NO: 45672 - DNA, 15 bp, Homo sapiens
ctttgacttccggat

SEQ ID NO: 45673 - DNA, 15 bp, Homo sapiens
actttgacttccgga

SEQ ID NO: 45674 - DNA, 15 bp, Homo sapiens
aactttgacttccgg

SEQ ID NO: 45675 - DNA, 15 bp, Homo sapiens
gaactttgacttccg

SEQ ID NO: 45676 - DNA, 15 bp, Homo sapiens
agaactttgacttcc

SEQ ID NO: 45677 - DNA, 15 bp, Homo sapiens
gagaactttgacttc

SEQ ID NO: 45678 - DNA, 15 bp, Homo sapiens
tgagaactttgactt

SEQ ID NO: 45679 - DNA, 15 bp, Homo sapiens
atgagaactttgact

SEQ ID NO: 45680 - DNA, 15 bp, Homo sapiens
catgagaactttgac

SEQ ID NO: 45681 - DNA, 15 bp, Homo sapiens
ccatgagaactttga

SEQ ID NO: 45682 - DNA, 15 bp, Homo sapiens
accatgagaactttg

SEQ ID NO: 45683 - DNA, 15 bp, Homo sapiens
gaccatgagaacttt

SEQ ID NO: 45684 - DNA, 15 bp, Homo sapiens
tgaccatgagaactt

SEQ ID NO: 45685 - DNA, 15 bp, Homo sapiens
ctgaccatgagaact

SEQ ID NO: 45686 - DNA, 15 bp, Homo sapiens
tctgaccatgagaac

SEQ ID NO: 45687 - DNA, 15 bp, Homo sapiens
ttctgaccatgagaa

SEQ ID NO: 45688 - DNA, 15 bp, Homo sapiens
cttctgaccatgaga

SEQ ID NO: 45689 - DNA, 15 bp, Homo sapiens
acttctgaccatgag

SEQ ID NO: 45690 - DNA, 15 bp, Homo sapiens
aacttctgaccatga

SEQ ID NO: 45691 - DNA, 15 bp, Homo sapiens
gaacttctgaccatg

SEQ ID NO: 45692 - DNA, 15 bp, Homo sapiens
agaacttctgaccat

SEQ ID NO: 45693 - DNA, 15 bp, Homo sapiens
gagaacttctgacca

SEQ ID NO: 45694 - DNA, 15 bp, Homo sapiens
tgagaacttctgacc

SEQ ID NO: 45695 - DNA, 15 bp, Homo sapiens
atgagaacttctgac

SEQ ID NO: 45696 - DNA, 15 bp, Homo sapiens
catgagaacttctga

SEQ ID NO: 45697 - DNA, 15 bp, Homo sapiens
ccatgagaacttctg

SEQ ID NO: 45698 - DNA, 15 bp, Homo sapiens
accatgagaacttct

SEQ ID NO: 45699 - DNA, 15 bp, Homo sapiens
caccatgagaacttc

SEQ ID NO: 45700 - DNA, 15 bp, Homo sapiens
gcaccatgagaactt

SEQ ID NO: 45701 - DNA, 15 bp, Homo sapiens
tgcaccatgagaact

SEQ ID NO: 45702 - DNA, 15 bp, Homo sapiens
gtgcaccatgagaac

SEQ ID NO: 45703 - DNA, 15 bp, Homo sapiens
cgtgcaccatgagaa

SEQ ID NO: 45704 - DNA, 15 bp, Homo sapiens
tcgtgcaccatgaga

SEQ ID NO: 45705 - DNA, 15 bp, Homo sapiens
ctcgtgcaccatgag

SEQ ID NO: 45706 - DNA, 15 bp, Homo sapiens
actcgtgcaccatga

SEQ ID NO: 45707 - DNA, 15 bp, Homo sapiens
gactcgtgcaccatg

SEQ ID NO: 45708 - DNA, 15 bp, Homo sapiens
ggactcgtgcaccat

SEQ ID NO: 45709 - DNA, 15 bp, Homo sapiens
aggactcgtgcacca

SEQ ID NO: 45710 - DNA, 15 bp, Homo sapiens
gaggactcgtgcacc

SEQ ID NO: 45711 - DNA, 15 bp, Homo sapiens
tgaggactcgtgcac

SEQ ID NO: 45712 - DNA, 15 bp, Homo sapiens
ctgaggactcgtgca

SEQ ID NO: 45713 - DNA, 15 bp, Homo sapiens
gctgaggactcgtgc

SEQ ID NO: 45714 - DNA, 15 bp, Homo sapiens
tgctgaggactcgtg

SEQ ID NO: 45715 - DNA, 15 bp, Homo sapiens
gtgctgaggactcgt

SEQ ID NO: 45716 - DNA, 15 bp, Homo sapiens
agtgctgaggactcg

SEQ ID NO: 45717 - DNA, 15 bp, Homo sapiens
gagtgctgaggactc

SEQ ID NO: 45718 - DNA, 15 bp, Homo sapiens
agagtgctgaggact

SEQ ID NO: 45719 - DNA, 15 bp, Homo sapiens
cagagtgctgaggac

SEQ ID NO: 45720 - DNA, 15 bp, Homo sapiens
gcagagtgctgagga

SEQ ID NO: 45721 - DNA, 15 bp, Homo sapiens
ggcagagtgctgagg

SEQ ID NO: 45722 - DNA, 15 bp, Homo sapiens
cggcagagtgctgag

SEQ ID NO: 45723 - DNA, 15 bp, Homo sapiens
ccggcagagtgctga

SEQ ID NO: 45724 - DNA, 15 bp, Homo sapiens
gccggcagagtgctg

SEQ ID NO: 45725 - DNA, 15 bp, Homo sapiens
tgccggcagagtgct

SEQ ID NO: 45726 - DNA, 15 bp, Homo sapiens
ctgccggcagagtgc

SEQ ID NO: 45727 - DNA, 15 bp, Homo sapiens
actgccggcagagtg

SEQ ID NO: 45728 - DNA, 15 bp, Homo sapiens
cactgccggcagagt

SEQ ID NO: 45729 - DNA, 15 bp, Homo sapiens
ccactgccggcagag

SEQ ID NO: 45730 - DNA, 15 bp, Homo sapiens
cccactgccggcaga

SEQ ID NO: 45731 - DNA, 15 bp, Homo sapiens
ccccactgccggcag

SEQ ID NO: 45732 - DNA, 15 bp, Homo sapiens
cccccactgccggca

SEQ ID NO: 45733 - DNA, 15 bp, Homo sapiens
acccccactgccggc

SEQ ID NO: 45734 - DNA, 15 bp, Homo sapiens
cacccccactgccgg

SEQ ID NO: 45735 - DNA, 15 bp, Homo sapiens
ccacccccactgccg

SEQ ID NO: 45736 - DNA, 15 bp, Homo sapiens
cccacccccactgcc

SEQ ID NO: 45737 - DNA, 15 bp, Homo sapiens
ccccacccccactgc

SEQ ID NO: 45738 - DNA, 15 bp, Homo sapiens
cccccacccccactg

SEQ ID NO: 45739 - DNA, 15 bp, Homo sapiens
gcccccacccccact

SEQ ID NO: 45740 - DNA, 15 bp, Homo sapiens
ggcccccacccccac

SEQ ID NO: 45741 - DNA, 15 bp, Homo sapiens
gggcccccaccccca

SEQ ID NO: 45742 - DNA, 15 bp, Homo sapiens
tgggcccccaccccc

SEQ ID NO: 45743 - DNA, 15 bp, Homo sapiens
atgggcccccacccc

SEQ ID NO: 45744 - DNA, 15 bp, Homo sapiens
catgggcccccaccc

SEQ ID NO: 45745 - DNA, 15 bp, Homo sapiens
gcatgggcccccacc

SEQ ID NO: 45746 - DNA, 15 bp, Homo sapiens
ggcatgggcccccac

SEQ ID NO: 45747 - DNA, 15 bp, Homo sapiens
gggcatgggccccca

SEQ ID NO: 45748 - DNA, 15 bp, Homo sapiens
cgggcatgggccccc

SEQ ID NO: 45749 - DNA, 15 bp, Homo sapiens
gcgggcatgggcccc

SEQ ID NO: 45750 - DNA, 15 bp, Homo sapiens
cgcgggcatgggccc

SEQ ID NO: 45751 - DNA, 15 bp, Homo sapiens
ccgcgggcatgggcc

SEQ ID NO: 45752 - DNA, 15 bp, Homo sapiens
cccgcgggcatgggc

SEQ ID NO: 45753 - DNA, 15 bp, Homo sapiens
ccccgcgggcatggg

SEQ ID NO: 45754 - DNA, 15 bp, Homo sapiens
cccccgcgggcatgg

SEQ ID NO: 45755 - DNA, 15 bp, Homo sapiens
tcccccgcgggcatg

SEQ ID NO: 45756 - DNA, 15 bp, Homo sapiens
ctcccccgcgggcat

SEQ ID NO: 45757 - DNA, 15 bp, Homo sapiens
tctcccccgcgggca

SEQ ID NO: 45758 - DNA, 15 bp, Homo sapiens
ctctcccccgcgggc

SEQ ID NO: 45759 - DNA, 15 bp, Homo sapiens
tctctcccccgcggg

SEQ ID NO: 45760 - DNA, 15 bp, Homo sapiens
ttctctcccccgcgg

SEQ ID NO: 45761 - DNA, 15 bp, Homo sapiens
cttctctcccccgcg

SEQ ID NO: 45762 - DNA, 15 bp, Homo sapiens
ccttctctcccccgc

SEQ ID NO: 45763 - DNA, 15 bp, Homo sapiens
tccttctctcccccg

SEQ ID NO: 45764 - DNA, 15 bp, Homo sapiens
ctccttctctccccc

SEQ ID NO: 45765 - DNA, 15 bp, Homo sapiens
cctccttctctcccc

SEQ ID NO: 45766 - DNA, 15 bp, Homo sapiens
acctccttctctccc

SEQ ID NO: 45767 - DNA, 15 bp, Homo sapiens
cacctccttctctcc

SEQ ID NO: 45768 - DNA, 15 bp, Homo sapiens
ccacctccttctctc

SEQ ID NO: 45769 - DNA, 15 bp, Homo sapiens
gccacctccttctct

SEQ ID NO: 45770 - DNA, 15 bp, Homo sapiens
ggccacctccttctc

SEQ ID NO: 45771 - DNA, 15 bp, Homo sapiens
gggccacctccttct

SEQ ID NO: 45772 - DNA, 15 bp, Homo sapiens
agggccacctccttc

SEQ ID NO: 45773 - DNA, 15 bp, Homo sapiens
cagggccacctcctt

SEQ ID NO: 45774 - DNA, 15 bp, Homo sapiens
gcagggccacctcct

SEQ ID NO: 45775 - DNA, 15 bp, Homo sapiens
agcagggccacctcc

SEQ ID NO: 45776 - DNA, 15 bp, Homo sapiens
cagcagggccacctc

SEQ ID NO: 45777 - DNA, 15 bp, Homo sapiens
acagcagggccacct

SEQ ID NO: 45778 - DNA, 15 bp, Homo sapiens
aacagcagggccacc

SEQ ID NO: 45779 - DNA, 15 bp, Homo sapiens
gaacagcagggccac

SEQ ID NO: 45780 - DNA, 15 bp, Homo sapiens
agaacagcagggcca

SEQ ID NO: 45781 - DNA, 15 bp, Homo sapiens
tagaacagcagggcc

SEQ ID NO: 45782 - DNA, 15 bp, Homo sapiens
ctagaacagcagggc

SEQ ID NO: 45783 - DNA, 15 bp, Homo sapiens
cctagaacagcaggg

SEQ ID NO: 45784 - DNA, 15 bp, Homo sapiens
gcctagaacagcagg

SEQ ID NO: 45785 - DNA, 15 bp, Homo sapiens
agcctagaacagcag

SEQ ID NO: 45786 - DNA, 15 bp, Homo sapiens
gagcctagaacagca

SEQ ID NO: 45787 - DNA, 15 bp, Homo sapiens
agagcctagaacagc

SEQ ID NO: 45788 - DNA, 15 bp, Homo sapiens
cagagcctagaacag

SEQ ID NO: 45789 - DNA, 15 bp, Homo sapiens
acagagcctagaaca

SEQ ID NO: 45790 - DNA, 15 bp, Homo sapiens
cacagagcctagaac

SEQ ID NO: 45791 - DNA, 15 bp, Homo sapiens
ccacagagcctagaa

SEQ ID NO: 45792 - DNA, 15 bp, Homo sapiens
cccacagagcctaga

SEQ ID NO: 45793 - DNA, 15 bp, Homo sapiens
gcccacagagcctag

SEQ ID NO: 45794 - DNA, 15 bp, Homo sapiens
tgcccacagagccta

SEQ ID NO: 45795 - DNA, 15 bp, Homo sapiens
atgcccacagagcct

SEQ ID NO: 45796 - DNA, 15 bp, Homo sapiens
tatgcccacagagcc

SEQ ID NO: 45797 - DNA, 15 bp, Homo sapiens
ctatgcccacagagc

SEQ ID NO: 45798 - DNA, 15 bp, Homo sapiens
cctatgcccacagag

SEQ ID NO: 45799 - DNA, 15 bp, Homo sapiens
gcctatgcccacaga

SEQ ID NO: 45800 - DNA, 15 bp, Homo sapiens
tgcctatgcccacag

SEQ ID NO: 45801 - DNA, 15 bp, Homo sapiens
ctgcctatgcccaca

SEQ ID NO: 45802 - DNA, 15 bp, Homo sapiens
cctgcctatgcccac

SEQ ID NO: 45803 - DNA, 15 bp, Homo sapiens
gcctgcctatgccca

SEQ ID NO: 45804 - DNA, 15 bp, Homo sapiens
tgcctgcctatgccc

SEQ ID NO: 45805 - DNA, 15 bp, Homo sapiens
ctgcctgcctatgcc

SEQ ID NO: 45806 - DNA, 15 bp, Homo sapiens
tctgcctgcctatgc

SEQ ID NO: 45807 - DNA, 15 bp, Homo sapiens
ctctgcctgcctatg

SEQ ID NO: 45808 - DNA, 15 bp, Homo sapiens
actctgcctgcctat

SEQ ID NO: 45809 - DNA, 15 bp, Homo sapiens
cactctgcctgccta

SEQ ID NO: 45810 - DNA, 15 bp, Homo sapiens
ccactctgcctgcct

SEQ ID NO: 45811 - DNA, 15 bp, Homo sapiens
tccactctgcctgcc

SEQ ID NO: 45812 - DNA, 15 bp, Homo sapiens
ttccactctgcctgc

SEQ ID NO: 45813 - DNA, 15 bp, Homo sapiens
gttccactctgcctg

SEQ ID NO: 45814 - DNA, 15 bp, Homo sapiens
ggttccactctgcct

SEQ ID NO: 45815 - DNA, 15 bp, Homo sapiens
gggttccactctgcc

SEQ ID NO: 45816 - DNA, 15 bp, Homo sapiens
agggttccactctgc

SEQ ID NO: 45817 - DNA, 15 bp, Homo sapiens
cagggttccactctg

SEQ ID NO: 45818 - DNA, 15 bp, Homo sapiens
gcagggttccactct

SEQ ID NO: 45819 - DNA, 15 bp, Homo sapiens
ggcagggttccactc

SEQ ID NO: 45820 - DNA, 15 bp, Homo sapiens
aggcagggttccact

SEQ ID NO: 45821 - DNA, 15 bp, Homo sapiens
gaggcagggttccac

SEQ ID NO: 45822 - DNA, 15 bp, Homo sapiens
ggaggcagggttcca

SEQ ID NO: 45823 - DNA, 15 bp, Homo sapiens
tggaggcagggttcc

SEQ ID NO: 45824 - DNA, 15 bp, Homo sapiens
atggaggcagggttc

SEQ ID NO: 45825 - DNA, 15 bp, Homo sapiens
catggaggcagggtt

SEQ ID NO: 45826 - DNA, 15 bp, Homo sapiens
gcatggaggcagggt

SEQ ID NO: 45827 - DNA, 15 bp, Homo sapiens
ggcatggaggcaggg

SEQ ID NO: 45828 - DNA, 15 bp, Homo sapiens
tggcatggaggcagg

SEQ ID NO: 45829 - DNA, 15 bp, Homo sapiens
ctggcatggaggcag

SEQ ID NO: 45830 - DNA, 15 bp, Homo sapiens
gctggcatggaggca

SEQ ID NO: 45831 - DNA, 15 bp, Homo sapiens
tgctggcatggaggc

SEQ ID NO: 45832 - DNA, 15 bp, Homo sapiens
atgctggcatggagg

SEQ ID NO: 45833 - DNA, 15 bp, Homo sapiens
gatgctggcatggag

SEQ ID NO: 45834 - DNA, 15 bp, Homo sapiens
agatgctggcatgga

SEQ ID NO: 45835 - DNA, 15 bp, Homo sapiens
cagatgctggcatgg

SEQ ID NO: 45836 - DNA, 15 bp, Homo sapiens
ccagatgctggcatg

SEQ ID NO: 45837 - DNA, 15 bp, Homo sapiens
cccagatgctggcat

SEQ ID NO: 45838 - DNA, 15 bp, Homo sapiens
ccccagatgctggca

SEQ ID NO: 45839 - DNA, 15 bp, Homo sapiens
cccccagatgctggc

SEQ ID NO: 45840 - DNA, 15 bp, Homo sapiens
gcccccagatgctgg

SEQ ID NO: 45841 - DNA, 15 bp, Homo sapiens
tgcccccagatgctg

SEQ ID NO: 45842 - DNA, 15 bp, Homo sapiens
ttgcccccagatgct

SEQ ID NO: 45843 - DNA, 15 bp, Homo sapiens
cttgcccccagatgc

SEQ ID NO: 45844 - DNA, 15 bp, Homo sapiens
ccttgcccccagatg

SEQ ID NO: 45845 - DNA, 15 bp, Homo sapiens
tccttgcccccagat

SEQ ID NO: 45846 - DNA, 15 bp, Homo sapiens
ttccttgcccccaga

SEQ ID NO: 45847 - DNA, 15 bp, Homo sapiens
cttccttgcccccag

SEQ ID NO: 45848 - DNA, 15 bp, Homo sapiens
ccttccttgccccca

SEQ ID NO: 45849 - DNA, 15 bp, Homo sapiens
gccttccttgccccc

SEQ ID NO: 45850 - DNA, 15 bp, Homo sapiens
agccttccttgcccc

SEQ ID NO: 45851 - DNA, 15 bp, Homo sapiens
cagccttccttgccc

SEQ ID NO: 45852 - DNA, 15 bp, Homo sapiens
ccagccttccttgcc

SEQ ID NO: 45853 - DNA, 15 bp, Homo sapiens
gccagccttccttgc

SEQ ID NO: 45854 - DNA, 15 bp, Homo sapiens
tgccagccttccttg

SEQ ID NO: 45855 - DNA, 15 bp, Homo sapiens
atgccagccttcctt

SEQ ID NO: 45856 - DNA, 15 bp, Homo sapiens
gatgccagccttcct

SEQ ID NO: 45857 - DNA, 15 bp, Homo sapiens
tgatgccagccttcc

SEQ ID NO: 45858 - DNA, 15 bp, Homo sapiens
atgatgccagccttc

SEQ ID NO: 45859 - DNA, 15 bp, Homo sapiens
gatgatgccagcctt

SEQ ID NO: 45860 - DNA, 15 bp, Homo sapiens
ggatgatgccagcct

SEQ ID NO: 45861 - DNA, 15 bp, Homo sapiens
tggatgatgccagcc

SEQ ID NO: 45862 - DNA, 15 bp, Homo sapiens
ctggatgatgccagc

SEQ ID NO: 45863 - DNA, 15 bp, Homo sapiens
actggatgatgccag

SEQ ID NO: 45864 - DNA, 15 bp, Homo sapiens
cactggatgatgcca

SEQ ID NO: 45865 - DNA, 15 bp, Homo sapiens
tcactggatgatgcc

SEQ ID NO: 45866 - DNA, 15 bp, Homo sapiens
ctcactggatgatgc

SEQ ID NO: 45867 - DNA, 15 bp, Homo sapiens
cctcactggatgatg

SEQ ID NO: 45868 - DNA, 15 bp, Homo sapiens
tcctcactggatgat

SEQ ID NO: 45869 - DNA, 15 bp, Homo sapiens
ctcctcactggatga

SEQ ID NO: 45870 - DNA, 15 bp, Homo sapiens
cctcctcactggatg

SEQ ID NO: 45871 - DNA, 15 bp, Homo sapiens
gcctcctcactggat

SEQ ID NO: 45872 - DNA, 15 bp, Homo sapiens
agcctcctcactgga

SEQ ID NO: 45873 - DNA, 15 bp, Homo sapiens
cagcctcctcactgg

SEQ ID NO: 45874 - DNA, 15 bp, Homo sapiens
ccagcctcctcactg

SEQ ID NO: 45875 - DNA, 15 bp, Homo sapiens
gccagcctcctcact

SEQ ID NO: 45876 - DNA, 15 bp, Homo sapiens
cgccagcctcctcac

SEQ ID NO: 45877 - DNA, 15 bp, Homo sapiens
gcgccagcctcctca

SEQ ID NO: 45878 - DNA, 15 bp, Homo sapiens
tgcgccagcctcctc

SEQ ID NO: 45879 - DNA, 15 bp, Homo sapiens
atgcgccagcctcct

SEQ ID NO: 45880 - DNA, 15 bp, Homo sapiens
catgcgccagcctcc

SEQ ID NO: 45881 - DNA, 15 bp, Homo sapiens
acatgcgccagcctc

SEQ ID NO: 45882 - DNA, 15 bp, Homo sapiens
aacatgcgccagcct

SEQ ID NO: 45883 - DNA, 15 bp, Homo sapiens
caacatgcgccagcc

SEQ ID NO: 45884 - DNA, 15 bp, Homo sapiens
ccaacatgcgccagc

SEQ ID NO: 45885 - DNA, 15 bp, Homo sapiens
cccaacatgcgccag

SEQ ID NO: 45886 - DNA, 15 bp, Homo sapiens
tcccaacatgcgcca

SEQ ID NO: 45887 - DNA, 15 bp, Homo sapiens
ctcccaacatgcgcc

SEQ ID NO: 45888 - DNA, 15 bp, Homo sapiens
cctcccaacatgcgc

SEQ ID NO: 45889 - DNA, 15 bp, Homo sapiens
gcctcccaacatgcg

SEQ ID NO: 45890 - DNA, 15 bp, Homo sapiens
agcctcccaacatgc

SEQ ID NO: 45891 - DNA, 15 bp, Homo sapiens
cagcctcccaacatg

SEQ ID NO: 45892 - DNA, 15 bp, Homo sapiens
gcagcctcccaacat

SEQ ID NO: 45893 - DNA, 15 bp, Homo sapiens
agcagcctcccaaca

SEQ ID NO: 45894 - DNA, 15 bp, Homo sapiens
cagcagcctcccaac

SEQ ID NO: 45895 - DNA, 15 bp, Homo sapiens
ccagcagcctcccaa

SEQ ID NO: 45896 - DNA, 15 bp, Homo sapiens
gccagcagcctccca

SEQ ID NO: 45897 - DNA, 15 bp, Homo sapiens
agccagcagcctccc

SEQ ID NO: 45898 - DNA, 15 bp, Homo sapiens
cagccagcagcctcc

SEQ ID NO: 45899 - DNA, 15 bp, Homo sapiens
gcagccagcagcctc

SEQ ID NO: 45900 - DNA, 15 bp, Homo sapiens
tgcagccagcagcct

SEQ ID NO: 45901 - DNA, 15 bp, Homo sapiens
gtgcagccagcagcc

SEQ ID NO: 45902 - DNA, 15 bp, Homo sapiens
tgtgcagccagcagc

SEQ ID NO: 45903 - DNA, 15 bp, Homo sapiens
ctgtgcagccagcag

SEQ ID NO: 45904 - DNA, 15 bp, Homo sapiens
tctgtgcagccagca

SEQ ID NO: 45905 - DNA, 15 bp, Homo sapiens
gtctgtgcagccagc

SEQ ID NO: 45906 - DNA, 15 bp, Homo sapiens
ggtctgtgcagccag

SEQ ID NO: 45907 - DNA, 15 bp, Homo sapiens
gggtctgtgcagcca

SEQ ID NO: 45908 - DNA, 15 bp, Homo sapiens
cgggtctgtgcagcc

SEQ ID NO: 45909 - DNA, 15 bp, Homo sapiens
acgggtctgtgcagc

SEQ ID NO: 45910 - DNA, 15 bp, Homo sapiens
cacgggtctgtgcag

SEQ ID NO: 45911 - DNA, 15 bp, Homo sapiens
tcacgggtctgtgca

SEQ ID NO: 45912 - DNA, 15 bp, Homo sapiens
ctcacgggtctgtgc

SEQ ID NO: 45913 - DNA, 15 bp, Homo sapiens
cctcacgggtctgtg

SEQ ID NO: 45914 - DNA, 15 bp, Homo sapiens
ccctcacgggtctgt

SEQ ID NO: 45915 - DNA, 15 bp, Homo sapiens
cccctcacgggtctg

SEQ ID NO: 45916 - DNA, 15 bp, Homo sapiens
tcccctcacgggtct

SEQ ID NO: 45917 - DNA, 15 bp, Homo sapiens
ctcccctcacgggtc

SEQ ID NO: 45918 - DNA, 15 bp, Homo sapiens
cctcccctcacgggt

SEQ ID NO: 45919 - DNA, 15 bp, Homo sapiens
tcctcccctcacggg

SEQ ID NO: 45920 - DNA, 15 bp, Homo sapiens
ctcctcccctcacgg

SEQ ID NO: 45921 - DNA, 15 bp, Homo sapiens
tctcctcccctcacg

SEQ ID NO: 45922 - DNA, 15 bp, Homo sapiens
ctctcctcccctcac

SEQ ID NO: 45923 - DNA, 15 bp, Homo sapiens
cctctcctcccctca

SEQ ID NO: 45924 - DNA, 15 bp, Homo sapiens
ccctctcctcccctc

SEQ ID NO: 45925 - DNA, 15 bp, Homo sapiens
cccctctcctcccct

SEQ ID NO: 45926 - DNA, 15 bp, Homo sapiens
gcccctctcctcccc

SEQ ID NO: 45927 - DNA, 15 bp, Homo sapiens
agcccctctcctccc

SEQ ID NO: 45928 - DNA, 15 bp, Homo sapiens
cagcccctctcctcc

SEQ ID NO: 45929 - DNA, 15 bp, Homo sapiens
gcagcccctctcctc

SEQ ID NO: 45930 - DNA, 15 bp, Homo sapiens
agcagcccctctcct

SEQ ID NO: 45931 - DNA, 15 bp, Homo sapiens
cagcagcccctctcc

SEQ ID NO: 45932 - DNA, 15 bp, Homo sapiens
acagcagcccctctc

SEQ ID NO: 45933 - DNA, 15 bp, Homo sapiens
cacagcagcccctct

SEQ ID NO: 45934 - DNA, 15 bp, Homo sapiens
gcacagcagcccctc

SEQ ID NO: 45935 - DNA, 15 bp, Homo sapiens
tgcacagcagcccct

SEQ ID NO: 45936 - DNA, 15 bp, Homo sapiens
ctgcacagcagcccc

SEQ ID NO: 45937 - DNA, 15 bp, Homo sapiens
cctgcacagcagccc

SEQ ID NO: 45938 - DNA, 15 bp, Homo sapiens
ccctgcacagcagcc

SEQ ID NO: 45939 - DNA, 15 bp, Homo sapiens
cccctgcacagcagc

SEQ ID NO: 45940 - DNA, 15 bp, Homo sapiens
acccctgcacagcag

SEQ ID NO: 45941 - DNA, 15 bp, Homo sapiens
cacccctgcacagca

SEQ ID NO: 45942 - DNA, 15 bp, Homo sapiens
acacccctgcacagc

SEQ ID NO: 45943 - DNA, 15 bp, Homo sapiens
cacacccctgcacag

SEQ ID NO: 45944 - DNA, 15 bp, Homo sapiens
ccacacccctgcaca

SEQ ID NO: 45945 - DNA, 15 bp, Homo sapiens
tccacacccctgcac

SEQ ID NO: 45946 - DNA, 15 bp, Homo sapiens
ctccacacccctgca

SEQ ID NO: 45947 - DNA, 15 bp, Homo sapiens
actccacacccctgc

SEQ ID NO: 45948 - DNA, 15 bp, Homo sapiens
tactccacacccctg

SEQ ID NO: 45949 - DNA, 15 bp, Homo sapiens
ctactccacacccct

SEQ ID NO: 45950 - DNA, 15 bp, Homo sapiens
cctactccacacccc

SEQ ID NO: 45951 - DNA, 15 bp, Homo sapiens
ccctactccacaccc

SEQ ID NO: 45952 - DNA, 15 bp, Homo sapiens
tccctactccacacc

SEQ ID NO: 45953 - DNA, 15 bp, Homo sapiens
ctccctactccacac

SEQ ID NO: 45954 - DNA, 15 bp, Homo sapiens
gctccctactccaca

SEQ ID NO: 45955 - DNA, 15 bp, Homo sapiens
agctccctactccac

SEQ ID NO: 45956 - DNA, 15 bp, Homo sapiens
cagctccctactcca

SEQ ID NO: 45957 - DNA, 15 bp, Homo sapiens
ccagctccctactcc

SEQ ID NO: 45958 - DNA, 15 bp, Homo sapiens
gccagctccctactc

SEQ ID NO: 45959 - DNA, 15 bp, Homo sapiens
agccagctccctact

SEQ ID NO: 45960 - DNA, 15 bp, Homo sapiens
gagccagctccctac

SEQ ID NO: 45961 - DNA, 15 bp, Homo sapiens
ggagccagctcccta

SEQ ID NO: 45962 - DNA, 15 bp, Homo sapiens
gggagccagctccct

SEQ ID NO: 45963 - DNA, 15 bp, Homo sapiens
ggggagccagctccc

SEQ ID NO: 45964 - DNA, 15 bp, Homo sapiens
aggggagccagctcc

SEQ ID NO: 45965 - DNA, 15 bp, Homo sapiens
caggggagccagctc

SEQ ID NO: 45966 - DNA, 15 bp, Homo sapiens
tcaggggagccagct

SEQ ID NO: 45967 - DNA, 15 bp, Homo sapiens
ctcaggggagccagc

SEQ ID NO: 45968 - DNA, 15 bp, Homo sapiens
tctcaggggagccag

SEQ ID NO: 45969 - DNA, 15 bp, Homo sapiens
ctctcaggggagcca

SEQ ID NO: 45970 - DNA, 15 bp, Homo sapiens
gctctcaggggagcc

SEQ ID NO: 45971 - DNA, 15 bp, Homo sapiens
ggctctcaggggagc

SEQ ID NO: 45972 - DNA, 15 bp, Homo sapiens
tggctctcaggggag

SEQ ID NO: 45973 - DNA, 15 bp, Homo sapiens
atggctctcagggga

SEQ ID NO: 45974 - DNA, 15 bp, Homo sapiens
catggctctcagggg

SEQ ID NO: 45975 - DNA, 15 bp, Homo sapiens
gcatggctctcaggg

SEQ ID NO: 45976 - DNA, 15 bp, Homo sapiens
tgcatggctctcagg

SEQ ID NO: 45977 - DNA, 15 bp, Homo sapiens
ctgcatggctctcag

SEQ ID NO: 45978 - DNA, 15 bp, Homo sapiens
cctgcatggctctca

SEQ ID NO: 45979 - DNA, 15 bp, Homo sapiens
ccctgcatggctctc

SEQ ID NO: 45980 - DNA, 15 bp, Homo sapiens
gccctgcatggctct

SEQ ID NO: 45981 - DNA, 15 bp, Homo sapiens
cgccctgcatggctc

SEQ ID NO: 45982 - DNA, 15 bp, Homo sapiens
acgccctgcatggct

SEQ ID NO: 45983 - DNA, 15 bp, Homo sapiens
gacgccctgcatggc

SEQ ID NO: 45984 - DNA, 15 bp, Homo sapiens
agacgccctgcatgg

SEQ ID NO: 45985 - DNA, 15 bp, Homo sapiens
cagacgccctgcatg

SEQ ID NO: 45986 - DNA, 15 bp, Homo sapiens
gcagacgccctgcat

SEQ ID NO: 45987 - DNA, 15 bp, Homo sapiens
tgcagacgccctgca

SEQ ID NO: 45988 - DNA, 15 bp, Homo sapiens
ctgcagacgccctgc

SEQ ID NO: 45989 - DNA, 15 bp, Homo sapiens
gctgcagacgccctg

SEQ ID NO: 45990 - DNA, 15 bp, Homo sapiens
ggctgcagacgccct

SEQ ID NO: 45991 - DNA, 15 bp, Homo sapiens
gggctgcagacgccc

SEQ ID NO: 45992 - DNA, 15 bp, Homo sapiens
tgggctgcagacgcc

SEQ ID NO: 45993 - DNA, 15 bp, Homo sapiens
ctgggctgcagacgc

SEQ ID NO: 45994 - DNA, 15 bp, Homo sapiens
cctgggctgcagacg

SEQ ID NO: 45995 - DNA, 15 bp, Homo sapiens
gcctgggctgcagac

SEQ ID NO: 45996 - DNA, 15 bp, Homo sapiens
ggcctgggctgcaga

SEQ ID NO: 45997 - DNA, 15 bp, Homo sapiens
aggcctgggctgcag

SEQ ID NO: 45998 - DNA, 15 bp, Homo sapiens
gaggcctgggctgca

SEQ ID NO: 45999 - DNA, 15 bp, Homo sapiens
agaggcctgggctgc

SEQ ID NO: 46000 - DNA, 15 bp, Homo sapiens
cagaggcctgggctg

SEQ ID NO: 46001 - DNA, 15 bp, Homo sapiens
ccagaggcctgggct

SEQ ID NO: 46002 - DNA, 15 bp, Homo sapiens
gccagaggcctgggc

SEQ ID NO: 46003 - DNA, 15 bp, Homo sapiens
tgccagaggcctggg

SEQ ID NO: 46004 - DNA, 15 bp, Homo sapiens
ctgccagaggcctgg

SEQ ID NO: 46005 - DNA, 15 bp, Homo sapiens
gctgccagaggcctg

SEQ ID NO: 46006 - DNA, 15 bp, Homo sapiens
tgctgccagaggcct

SEQ ID NO: 46007 - DNA, 15 bp, Homo sapiens
ctgctgccagaggcc

SEQ ID NO: 46008 - DNA, 15 bp, Homo sapiens
gctgctgccagaggc

SEQ ID NO: 46009 - DNA, 15 bp, Homo sapiens
agctgctgccagagg

SEQ ID NO: 46010 - DNA, 15 bp, Homo sapiens
gagctgctgccagag

SEQ ID NO: 46011 - DNA, 15 bp, Homo sapiens
agagctgctgccaga

SEQ ID NO: 46012 - DNA, 15 bp, Homo sapiens
aagagctgctgccag

SEQ ID NO: 46013 - DNA, 15 bp, Homo sapiens
aaagagctgctgcca

SEQ ID NO: 46014 - DNA, 15 bp, Homo sapiens
caaagagctgctgcc

SEQ ID NO: 46015 - DNA, 15 bp, Homo sapiens
gcaaagagctgctgc

SEQ ID NO: 46016 - DNA, 15 bp, Homo sapiens
ggcaaagagctgctg

SEQ ID NO: 46017 - DNA, 15 bp, Homo sapiens
gggcaaagagctgct

SEQ ID NO: 46018 - DNA, 15 bp, Homo sapiens
tgggcaaagagctgc

SEQ ID NO: 46019 - DNA, 15 bp, Homo sapiens
atgggcaaagagctg

SEQ ID NO: 46020 - DNA, 15 bp, Homo sapiens
gatgggcaaagagct

SEQ ID NO: 46021 - DNA, 15 bp, Homo sapiens
agatgggcaaagagc

SEQ ID NO: 46022 - DNA, 15 bp, Homo sapiens
gagatgggcaaagag

SEQ ID NO: 46023 - DNA, 15 bp, Homo sapiens
agagatgggcaaaga

SEQ ID NO: 46024 - DNA, 15 bp, Homo sapiens
aagagatgggcaaag

SEQ ID NO: 46025 - DNA, 15 bp, Homo sapiens
aaagagatgggcaaa

SEQ ID NO: 46026 - DNA, 15 bp, Homo sapiens
caaagagatgggcaa

SEQ ID NO: 46027 - DNA, 15 bp, Homo sapiens
ccaaagagatgggca

SEQ ID NO: 46028 - DNA, 15 bp, Homo sapiens
tccaaagagatgggc

SEQ ID NO: 46029 - DNA, 15 bp, Homo sapiens
gtccaaagagatggg

SEQ ID NO: 46030 - DNA, 15 bp, Homo sapiens
tgtccaaagagatgg

SEQ ID NO: 46031 - DNA, 15 bp, Homo sapiens
ctgtccaaagagatg

SEQ ID NO: 46032 - DNA, 15 bp, Homo sapiens
actgtccaaagagat

SEQ ID NO: 46033 - DNA, 15 bp, Homo sapiens
cactgtccaaagaga

SEQ ID NO: 46034 - DNA, 15 bp, Homo sapiens
ccactgtccaaagag

SEQ ID NO: 46035 - DNA, 15 bp, Homo sapiens
gccactgtccaaaga

SEQ ID NO: 46036 - DNA, 15 bp, Homo sapiens
ggccactgtccaaag

SEQ ID NO: 46037 - DNA, 15 bp, Homo sapiens
tggccactgtccaaa

SEQ ID NO: 46038 - DNA, 15 bp, Homo sapiens
gtggccactgtccaa

SEQ ID NO: 46039 - DNA, 15 bp, Homo sapiens
ggtggccactgtcca

SEQ ID NO: 46040 - DNA, 15 bp, Homo sapiens
gggtggccactgtcc

SEQ ID NO: 46041 - DNA, 15 bp, Homo sapiens
agggtggccactgtc

SEQ ID NO: 46042 - DNA, 15 bp, Homo sapiens
cagggtggccactgt

SEQ ID NO: 46043 - DNA, 15 bp, Homo sapiens
gcagggtggccactg

SEQ ID NO: 46044 - DNA, 15 bp, Homo sapiens
tgcagggtggccact

SEQ ID NO: 46045 - DNA, 15 bp, Homo sapiens
gtgcagggtggccac

SEQ ID NO: 46046 - DNA, 15 bp, Homo sapiens
tgtgcagggtggcca

SEQ ID NO: 46047 - DNA, 15 bp, Homo sapiens
ttgtgcagggtggcc

SEQ ID NO: 46048 - DNA, 15 bp, Homo sapiens
attgtgcagggtggc

SEQ ID NO: 46049 - DNA, 15 bp, Homo sapiens
cattgtgcagggtgg

SEQ ID NO: 46050 - DNA, 15 bp, Homo sapiens
ccattgtgcagggtg

SEQ ID NO: 46051 - DNA, 15 bp, Homo sapiens
cccattgtgcagggt

SEQ ID NO: 46052 - DNA, 15 bp, Homo sapiens
ccccattgtgcaggg

SEQ ID NO: 46053 - DNA, 15 bp, Homo sapiens
gccccattgtgcagg

SEQ ID NO: 46054 - DNA, 15 bp, Homo sapiens
ggccccattgtgcag

SEQ ID NO: 46055 - DNA, 15 bp, Homo sapiens
cggccccattgtgca

SEQ ID NO: 46056 - DNA, 15 bp, Homo sapiens
tcggccccattgtgc

SEQ ID NO: 46057 - DNA, 15 bp, Homo sapiens
gtcggccccattgtg

SEQ ID NO: 46058 - DNA, 15 bp, Homo sapiens
cgtcggccccattgt

SEQ ID NO: 46059 - DNA, 15 bp, Homo sapiens
tcgtcggccccattg

SEQ ID NO: 46060 - DNA, 15 bp, Homo sapiens
ctcgtcggccccatt

SEQ ID NO: 46061 - DNA, 15 bp, Homo sapiens
cctcgtcggccccat

SEQ ID NO: 46062 - DNA, 15 bp, Homo sapiens
gcctcgtcggcccca

SEQ ID NO: 46063 - DNA, 15 bp, Homo sapiens
ggcctcgtcggcccc

SEQ ID NO: 46064 - DNA, 15 bp, Homo sapiens
aggcctcgtcggccc

SEQ ID NO: 46065 - DNA, 15 bp, Homo sapiens
taggcctcgtcggcc

SEQ ID NO: 46066 - DNA, 15 bp, Homo sapiens
ctaggcctcgtcggc

SEQ ID NO: 46067 - DNA, 15 bp, Homo sapiens
cctaggcctcgtcgg

SEQ ID NO: 46068 - DNA, 15 bp, Homo sapiens
ccctaggcctcgtcg

SEQ ID NO: 46069 - DNA, 15 bp, Homo sapiens
gccctaggcctcgtc

SEQ ID NO: 46070 - DNA, 15 bp, Homo sapiens
ggccctaggcctcgt

SEQ ID NO: 46071 - DNA, 15 bp, Homo sapiens
gggccctaggcctcg

SEQ ID NO: 46072 - DNA, 15 bp, Homo sapiens
agggccctaggcctc

SEQ ID NO: 46073 - DNA, 15 bp, Homo sapiens
gagggccctaggcct

SEQ ID NO: 46074 - DNA, 15 bp, Homo sapiens
ggagggccctaggcc

SEQ ID NO: 46075 - DNA, 15 bp, Homo sapiens
aggagggccctaggc

SEQ ID NO: 46076 - DNA, 15 bp, Homo sapiens
taggagggccctagg

SEQ ID NO: 46077 - DNA, 15 bp, Homo sapiens
gtaggagggccctag

SEQ ID NO: 46078 - DNA, 15 bp, Homo sapiens
ggtaggagggcccta

SEQ ID NO: 46079 - DNA, 15 bp, Homo sapiens
aggtaggagggccct

SEQ ID NO: 46080 - DNA, 15 bp, Homo sapiens
caggtaggagggccc

SEQ ID NO: 46081 - DNA, 15 bp, Homo sapiens
gcaggtaggagggcc

SEQ ID NO: 46082 - DNA, 15 bp, Homo sapiens
agcaggtaggagggc

SEQ ID NO: 46083 - DNA, 15 bp, Homo sapiens
aagcaggtaggaggg

SEQ ID NO: 46084 - DNA, 15 bp, Homo sapiens
taagcaggtaggagg

SEQ ID NO: 46085 - DNA, 15 bp, Homo sapiens
gtaagcaggtaggag

SEQ ID NO: 46086 - DNA, 15 bp, Homo sapiens
tgtaagcaggtagga

SEQ ID NO: 46087 - DNA, 15 bp, Homo sapiens
ttgtaagcaggtagg

SEQ ID NO: 46088 - DNA, 15 bp, Homo sapiens
attgtaagcaggtag

SEQ ID NO: 46089 - DNA, 15 bp, Homo sapiens
aattgtaagcaggta

SEQ ID NO: 46090 - DNA, 15 bp, Homo sapiens
aaattgtaagcaggt

SEQ ID NO: 46091 - DNA, 15 bp, Homo sapiens
caaattgtaagcagg

SEQ ID NO: 46092 - DNA, 15 bp, Homo sapiens
ccaaattgtaagcag

SEQ ID NO: 46093 - DNA, 15 bp, Homo sapiens
tccaaattgtaagca

SEQ ID NO: 46094 - DNA, 15 bp, Homo sapiens
ttccaaattgtaagc

SEQ ID NO: 46095 - DNA, 15 bp, Homo sapiens
tttccaaattgtaag

SEQ ID NO: 46096 - DNA, 15 bp, Homo sapiens
ttttccaaattgtaa

SEQ ID NO: 46097 - DNA, 15 bp, Homo sapiens
cttttccaaattgta

SEQ ID NO: 46098 - DNA, 15 bp, Homo sapiens
acttttccaaattgt

SEQ ID NO: 46099 - DNA, 15 bp, Homo sapiens
cacttttccaaattg

SEQ ID NO: 46100 - DNA, 15 bp, Homo sapiens
acacttttccaaatt

SEQ ID NO: 46101 - DNA, 15 bp, Homo sapiens
cacacttttccaaat

SEQ ID NO: 46102 - DNA, 15 bp, Homo sapiens
ccacacttttccaaa

SEQ ID NO: 46103 - DNA, 15 bp, Homo sapiens
gccacacttttccaa

SEQ ID NO: 46104 - DNA, 15 bp, Homo sapiens
ggccacacttttcca

SEQ ID NO: 46105 - DNA, 15 bp, Homo sapiens
cggccacacttttcc

SEQ ID NO: 46106 - DNA, 15 bp, Homo sapiens
ccggccacacttttc

SEQ ID NO: 46107 - DNA, 15 bp, Homo sapiens
cccggccacactttt

SEQ ID NO: 46108 - DNA, 15 bp, Homo sapiens
acccggccacacttt

SEQ ID NO: 46109 - DNA, 15 bp, Homo sapiens
cacccggccacactt

SEQ ID NO: 46110 - DNA, 15 bp, Homo sapiens
gcacccggccacact

SEQ ID NO: 46111 - DNA, 15 bp, Homo sapiens
cgcacccggccacac

SEQ ID NO: 46112 - DNA, 15 bp, Homo sapiens
ccgcacccggccaca

SEQ ID NO: 46113 - DNA, 15 bp, Homo sapiens
accgcacccggccac

SEQ ID NO: 46114 - DNA, 15 bp, Homo sapiens
tcctgccttggcctc

SEQ ID NO: 46115 - DNA, 15 bp, Homo sapiens
ctcctgccttggcct

SEQ ID NO: 46116 - DNA, 15 bp, Homo sapiens
cctcctgccttggcc

SEQ ID NO: 46117 - DNA, 15 bp, Homo sapiens
tcctcctgccttggc

SEQ ID NO: 46118 - DNA, 15 bp, Homo sapiens
atcctcctgccttgg

SEQ ID NO: 46119 - DNA, 15 bp, Homo sapiens
gatcctcctgccttg

SEQ ID NO: 46120 - DNA, 15 bp, Homo sapiens
cgatcctcctgcctt

SEQ ID NO: 46121 - DNA, 15 bp, Homo sapiens
cagcgatcctcctgc

SEQ ID NO: 46122 - DNA, 15 bp, Homo sapiens
ccagcgatcctcctg

SEQ ID NO: 46123 - DNA, 15 bp, Homo sapiens
tccagcgatcctcct

SEQ ID NO: 46124 - DNA, 15 bp, Homo sapiens
ctccagcgatcctcc

SEQ ID NO: 46125 - DNA, 15 bp, Homo sapiens
gctccagcgatcctc

SEQ ID NO: 46126 - DNA, 15 bp, Homo sapiens
ggctccagcgatcct

SEQ ID NO: 46127 - DNA, 15 bp, Homo sapiens
gggctccagcgatcc

SEQ ID NO: 46128 - DNA, 15 bp, Homo sapiens
tgggctccagcgatc

SEQ ID NO: 46129 - DNA, 15 bp, Homo sapiens
ctgggctccagcgat

SEQ ID NO: 46130 - DNA, 15 bp, Homo sapiens
actgggctccagcga

SEQ ID NO: 46131 - DNA, 15 bp, Homo sapiens
tactgggctccagcg

SEQ ID NO: 46132 - DNA, 15 bp, Homo sapiens
ctactgggctccagc

SEQ ID NO: 46133 - DNA, 15 bp, Homo sapiens
cctactgggctccag

SEQ ID NO: 46134 - DNA, 15 bp, Homo sapiens
acctactgggctcca

SEQ ID NO: 46135 - DNA, 15 bp, Homo sapiens
gacctactgggctcc

SEQ ID NO: 46136 - DNA, 15 bp, Homo sapiens
tgacctactgggctc

SEQ ID NO: 46137 - DNA, 15 bp, Homo sapiens
ttgacctactgggct

SEQ ID NO: 46138 - DNA, 15 bp, Homo sapiens
cttgacctactgggc

SEQ ID NO: 46139 - DNA, 15 bp, Homo sapiens
tcttgacctactggg

SEQ ID NO: 46140 - DNA, 15 bp, Homo sapiens
gtcttgacctactgg

SEQ ID NO: 46141 - DNA, 15 bp, Homo sapiens
ggtcttgacctactg

SEQ ID NO: 46142 - DNA, 15 bp, Homo sapiens
tggtcttgacctact

SEQ ID NO: 46143 - DNA, 15 bp, Homo sapiens
ctggtcttgacctac

SEQ ID NO: 46144 - DNA, 15 bp, Homo sapiens
gctggtcttgaccta

SEQ ID NO: 46145 - DNA, 15 bp, Homo sapiens
ggctggtcttgacct

SEQ ID NO: 46146 - DNA, 15 bp, Homo sapiens
tggctggtcttgacc

SEQ ID NO: 46147 - DNA, 15 bp, Homo sapiens
ctggctggtcttgac

SEQ ID NO: 46148 - DNA, 15 bp, Homo sapiens
cctggctggtcttga

SEQ ID NO: 46149 - DNA, 15 bp, Homo sapiens
ccctggctggtcttg

SEQ ID NO: 46150 - DNA, 15 bp, Homo sapiens
gccctggctggtctt

SEQ ID NO: 46151 - DNA, 15 bp, Homo sapiens
tgccctggctggtct

SEQ ID NO: 46152 - DNA, 15 bp, Homo sapiens
ttgccctggctggtc

SEQ ID NO: 46153 - DNA, 15 bp, Homo sapiens
gttgccctggctggt

SEQ ID NO: 46154 - DNA, 15 bp, Homo sapiens
tgttgccctggctgg

SEQ ID NO: 46155 - DNA, 15 bp, Homo sapiens
atgttgccctggctg

SEQ ID NO: 46156 - DNA, 15 bp, Homo sapiens
catgttgccctggct

SEQ ID NO: 46157 - DNA, 15 bp, Homo sapiens
tcatgttgccctggc

SEQ ID NO: 46158 - DNA, 15 bp, Homo sapiens
atcatgttgccctgg

SEQ ID NO: 46159 - DNA, 15 bp, Homo sapiens
catcatgttgccctg

SEQ ID NO: 46160 - DNA, 15 bp, Homo sapiens
tcatcatgttgccct

SEQ ID NO: 46161 - DNA, 15 bp, Homo sapiens
ctcatcatgttgccc

SEQ ID NO: 46162 - DNA, 15 bp, Homo sapiens
tctcatcatgttgcc

SEQ ID NO: 46163 - DNA, 15 bp, Homo sapiens
gtctcatcatgttgc

SEQ ID NO: 46164 - DNA, 15 bp, Homo sapiens
ggtctcatcatgttg

SEQ ID NO: 46165 - DNA, 15 bp, Homo sapiens
gggtctcatcatgtt

SEQ ID NO: 46166 - DNA, 15 bp, Homo sapiens
agggtctcatcatgt

SEQ ID NO: 46167 - DNA, 15 bp, Homo sapiens
cagggtctcatcatg

SEQ ID NO: 46168 - DNA, 15 bp, Homo sapiens
acagggtctcatcat

SEQ ID NO: 46169 - DNA, 15 bp, Homo sapiens
gacagggtctcatca

SEQ ID NO: 46170 - DNA, 15 bp, Homo sapiens
agacagggtctcatc

SEQ ID NO: 46171 - DNA, 15 bp, Homo sapiens
gagacagggtctcat

SEQ ID NO: 46172 - DNA, 15 bp, Homo sapiens
agagacagggtctca

SEQ ID NO: 46173 - DNA, 15 bp, Homo sapiens
cagagacagggtctc

SEQ ID NO: 46174 - DNA, 15 bp, Homo sapiens
gcagagacagggtct

SEQ ID NO: 46175 - DNA, 15 bp, Homo sapiens
ggcagagacagggtc

SEQ ID NO: 46176 - DNA, 15 bp, Homo sapiens
tggcagagacagggt

SEQ ID NO: 46177 - DNA, 15 bp, Homo sapiens
ttggcagagacaggg

SEQ ID NO: 46178 - DNA, 15 bp, Homo sapiens
tttggcagagacagg

SEQ ID NO: 46179 - DNA, 15 bp, Homo sapiens
ttttggcagagacag

SEQ ID NO: 46180 - DNA, 15 bp, Homo sapiens
tttttggcagagaca

SEQ ID NO: 46181 - DNA, 15 bp, Homo sapiens
ttttttggcagagac

SEQ ID NO: 46182 - DNA, 15 bp, Homo sapiens
attttttggcagaga

SEQ ID NO: 46183 - DNA, 15 bp, Homo sapiens
aattttttggcagag

SEQ ID NO: 46184 - DNA, 15 bp, Homo sapiens
aaattttttggcaga

SEQ ID NO: 46185 - DNA, 15 bp, Homo sapiens
aaaattttttggcag

SEQ ID NO: 46186 - DNA, 15 bp, Homo sapiens
aaaaattttttggca

SEQ ID NO: 46187 - DNA, 15 bp, Homo sapiens
aaaaaattttttggc

SEQ ID NO: 46188 - DNA, 15 bp, Homo sapiens
taaaaaattttttgg

SEQ ID NO: 46189 - DNA, 15 bp, Homo sapiens
ttaaaaaattttttg

SEQ ID NO: 46190 - DNA, 15 bp, Homo sapiens
tttaaaaaatttttt

SEQ ID NO: 46191 - DNA, 15 bp, Homo sapiens
gtttaaaaaattttt

SEQ ID NO: 46192 - DNA, 15 bp, Homo sapiens
agtttaaaaaatttt

SEQ ID NO: 46193 - DNA, 15 bp, Homo sapiens
tagtttaaaaaattt

SEQ ID NO: 46194 - DNA, 15 bp, Homo sapiens
atagtttaaaaaatt

SEQ ID NO: 46195 - DNA, 15 bp, Homo sapiens
aatagtttaaaaaat

SEQ ID NO: 46196 - DNA, 15 bp, Homo sapiens
taatagtttaaaaaa

SEQ ID NO: 46197 - DNA, 15 bp, Homo sapiens
ctaatagtttaaaaa

SEQ ID NO: 46198 - DNA, 15 bp, Homo sapiens
gctaatagtttaaaa

SEQ ID NO: 46199 - DNA, 15 bp, Homo sapiens
ggctaatagtttaaa

SEQ ID NO: 46200 - DNA, 15 bp, Homo sapiens
aggctaatagtttaa

SEQ ID NO: 46201 - DNA, 15 bp, Homo sapiens
caggctaatagttta

SEQ ID NO: 46202 - DNA, 15 bp, Homo sapiens
ccaggctaatagttt

SEQ ID NO: 46203 - DNA, 15 bp, Homo sapiens
gccaggctaatagtt

SEQ ID NO: 46204 - DNA, 15 bp, Homo sapiens
cgccaggctaatagt

SEQ ID NO: 46205 - DNA, 15 bp, Homo sapiens
acgccaggctaatag

SEQ ID NO: 46206 - DNA, 15 bp, Homo sapiens
cacgccaggctaata

SEQ ID NO: 46207 - DNA, 15 bp, Homo sapiens
cgctaccacgccagg

SEQ ID NO: 46208 - DNA, 15 bp, Homo sapiens
gcgctaccacgccag

SEQ ID NO: 46209 - DNA, 15 bp, Homo sapiens
tgcgctaccacgcca

SEQ ID NO: 46210 - DNA, 15 bp, Homo sapiens
gtgcgctaccacgcc

SEQ ID NO: 46211 - DNA, 15 bp, Homo sapiens
cgtgcgctaccacgc

SEQ ID NO: 46212 - DNA, 15 bp, Homo sapiens
gcgtgcgctaccacg

SEQ ID NO: 46213 - DNA, 15 bp, Homo sapiens
ggcgtgcgctaccac

SEQ ID NO: 46214 - DNA, 15 bp, Homo sapiens
aggcgtgcgctacca

SEQ ID NO: 46215 - DNA, 15 bp, Homo sapiens
caggcgtgcgctacc

SEQ ID NO: 46216 - DNA, 15 bp, Homo sapiens
acaggcgtgcgctac

SEQ ID NO: 46217 - DNA, 15 bp, Homo sapiens
cacaggcgtgcgcta

SEQ ID NO: 46218 - DNA, 15 bp, Homo sapiens
ccacaggcgtgcgct

SEQ ID NO: 46219 - DNA, 15 bp, Homo sapiens
accacaggcgtgcgc

SEQ ID NO: 46220 - DNA, 15 bp, Homo sapiens
gaccacaggcgtgcg

SEQ ID NO: 46221 - DNA, 15 bp, Homo sapiens
ggaccacaggcgtgc

SEQ ID NO: 46222 - DNA, 15 bp, Homo sapiens
gggaccacaggcgtg

SEQ ID NO: 46223 - DNA, 15 bp, Homo sapiens
tgggaccacaggcgt

SEQ ID NO: 46224 - DNA, 15 bp, Homo sapiens
ctgggaccacaggcg

SEQ ID NO: 46225 - DNA, 15 bp, Homo sapiens
gctgggaccacaggc

SEQ ID NO: 46226 - DNA, 15 bp, Homo sapiens
agctgggaccacagg

SEQ ID NO: 46227 - DNA, 15 bp, Homo sapiens
cagctgggaccacag

SEQ ID NO: 46228 - DNA, 15 bp, Homo sapiens
gcagctgggaccaca

SEQ ID NO: 46229 - DNA, 15 bp, Homo sapiens
agcagctgggaccac

SEQ ID NO: 46230 - DNA, 15 bp, Homo sapiens
cagcagctgggacca

SEQ ID NO: 46231 - DNA, 15 bp, Homo sapiens
ccagcagctgggacc

SEQ ID NO: 46232 - DNA, 15 bp, Homo sapiens
cccagcagctgggac

SEQ ID NO: 46233 - DNA, 15 bp, Homo sapiens
ccccagcagctggga

SEQ ID NO: 46234 - DNA, 15 bp, Homo sapiens
tccccagcagctggg

SEQ ID NO: 46235 - DNA, 15 bp, Homo sapiens
ctccccagcagctgg

SEQ ID NO: 46236 - DNA, 15 bp, Homo sapiens
cctccccagcagctg

SEQ ID NO: 46237 - DNA, 15 bp, Homo sapiens
gcctccccagcagct

SEQ ID NO: 46238 - DNA, 15 bp, Homo sapiens
agcctccccagcagc

SEQ ID NO: 46239 - DNA, 15 bp, Homo sapiens
cagcctccccagcag

SEQ ID NO: 46240 - DNA, 15 bp, Homo sapiens
tcagcctccccagca

SEQ ID NO: 46241 - DNA, 15 bp, Homo sapiens
ttcagcctccccagc

SEQ ID NO: 46242 - DNA, 15 bp, Homo sapiens
cttcagcctccccag

SEQ ID NO: 46243 - DNA, 15 bp, Homo sapiens
acttcagcctcccca

SEQ ID NO: 46244 - DNA, 15 bp, Homo sapiens
tacttcagcctcccc

SEQ ID NO: 46245 - DNA, 15 bp, Homo sapiens
ctacttcagcctccc

SEQ ID NO: 46246 - DNA, 15 bp, Homo sapiens
cctacttcagcctcc

SEQ ID NO: 46247 - DNA, 15 bp, Homo sapiens
tcctacttcagcctc

SEQ ID NO: 46248 - DNA, 15 bp, Homo sapiens
ctcctacttcagcct

SEQ ID NO: 46249 - DNA, 15 bp, Homo sapiens
cctcctacttcagcc

SEQ ID NO: 46250 - DNA, 15 bp, Homo sapiens
tcctcctacttcagc

SEQ ID NO: 46251 - DNA, 15 bp, Homo sapiens
atcctcctacttcag

SEQ ID NO: 46252 - DNA, 15 bp, Homo sapiens
gatcctcctacttca

SEQ ID NO: 46253 - DNA, 15 bp, Homo sapiens
tgatcctcctacttc

SEQ ID NO: 46254 - DNA, 15 bp, Homo sapiens
atgatcctcctactt

SEQ ID NO: 46255 - DNA, 15 bp, Homo sapiens
aatgatcctcctact

SEQ ID NO: 46256 - DNA, 15 bp, Homo sapiens
aaatgatcctcctac

SEQ ID NO: 46257 - DNA, 15 bp, Homo sapiens
taaatgatcctccta

SEQ ID NO: 46258 - DNA, 15 bp, Homo sapiens
ataaatgatcctcct

SEQ ID NO: 46259 - DNA, 15 bp, Homo sapiens
cataaatgatcctcc

SEQ ID NO: 46260 - DNA, 15 bp, Homo sapiens
gcataaatgatcctc

SEQ ID NO: 46261 - DNA, 15 bp, Homo sapiens
agcataaatgatcct

SEQ ID NO: 46262 - DNA, 15 bp, Homo sapiens
aagcataaatgatcc

SEQ ID NO: 46263 - DNA, 15 bp, Homo sapiens
caagcataaatgatc

SEQ ID NO: 46264 - DNA, 15 bp, Homo sapiens
ccaagcataaatgat

SEQ ID NO: 46265 - DNA, 15 bp, Homo sapiens
cccaagcataaatga

SEQ ID NO: 46266 - DNA, 15 bp, Homo sapiens
tcccaagcataaatg

SEQ ID NO: 46267 - DNA, 15 bp, Homo sapiens
ctcccaagcataaat

SEQ ID NO: 46268 - DNA, 15 bp, Homo sapiens
cctcccaagcataaa

SEQ ID NO: 46269 - DNA, 15 bp, Homo sapiens
acctcccaagcataa

SEQ ID NO: 46270 - DNA, 15 bp, Homo sapiens
gacctcccaagcata

SEQ ID NO: 46271 - DNA, 15 bp, Homo sapiens
cgacctcccaagcat

SEQ ID NO: 46272 - DNA, 15 bp, Homo sapiens
tcgacctcccaagca

SEQ ID NO: 46273 - DNA, 15 bp, Homo sapiens
ctcgacctcccaagc

SEQ ID NO: 46274 - DNA, 15 bp, Homo sapiens
cctcgacctcccaag

SEQ ID NO: 46275 - DNA, 15 bp, Homo sapiens
gcctcgacctcccaa

SEQ ID NO: 46276 - DNA, 15 bp, Homo sapiens
agcctcgacctccca

SEQ ID NO: 46277 - DNA, 15 bp, Homo sapiens
cagcctcgacctccc

SEQ ID NO: 46278 - DNA, 15 bp, Homo sapiens
gcagcctcgacctcc

SEQ ID NO: 46279 - DNA, 15 bp, Homo sapiens
tgcagcctcgacctc

SEQ ID NO: 46280 - DNA, 15 bp, Homo sapiens
ctgcagcctcgacct

SEQ ID NO: 46281 - DNA, 15 bp, Homo sapiens
actgcagcctcgacc

SEQ ID NO: 46282 - DNA, 15 bp, Homo sapiens
cactgcagcctcgac

SEQ ID NO: 46283 - DNA, 15 bp, Homo sapiens
tcactgcagcctcga

SEQ ID NO: 46284 - DNA, 15 bp, Homo sapiens
ctcactgcagcctcg

SEQ ID NO: 46285 - DNA, 15 bp, Homo sapiens
tgactcactgcagcc

SEQ ID NO: 46286 - DNA, 15 bp, Homo sapiens
atgactcactgcagc

SEQ ID NO: 46287 - DNA, 15 bp, Homo sapiens
catgactcactgcag

SEQ ID NO: 46288 - DNA, 15 bp, Homo sapiens
tcatgactcactgca

SEQ ID NO: 46289 - DNA, 15 bp, Homo sapiens
atcatgactcactgc

SEQ ID NO: 46290 - DNA, 15 bp, Homo sapiens
aatcatgactcactg

SEQ ID NO: 46291 - DNA, 15 bp, Homo sapiens
caatcatgactcact

SEQ ID NO: 46292 - DNA, 15 bp, Homo sapiens
acaatcatgactcac

SEQ ID NO: 46293 - DNA, 15 bp, Homo sapiens
tacaatcatgactca

SEQ ID NO: 46294 - DNA, 15 bp, Homo sapiens
atacaatcatgactc

SEQ ID NO: 46295 - DNA, 15 bp, Homo sapiens
catacaatcatgact

SEQ ID NO: 46296 - DNA, 15 bp, Homo sapiens
tcatacaatcatgac

SEQ ID NO: 46297 - DNA, 15 bp, Homo sapiens
gtcatacaatcatga

SEQ ID NO: 46298 - DNA, 15 bp, Homo sapiens
agtcatacaatcatg

SEQ ID NO: 46299 - DNA, 15 bp, Homo sapiens
cagtcatacaatcat

SEQ ID NO: 46300 - DNA, 15 bp, Homo sapiens
gcagtcatacaatca

SEQ ID NO: 46301 - DNA, 15 bp, Homo sapiens
tgcagtcatacaatc

SEQ ID NO: 46302 - DNA, 15 bp, Homo sapiens
gtgcagtcatacaat

SEQ ID NO: 46303 - DNA, 15 bp, Homo sapiens
agtgcagtcatacaa

SEQ ID NO: 46304 - DNA, 15 bp, Homo sapiens
gagtgcagtcataca

SEQ ID NO: 46305 - DNA, 15 bp, Homo sapiens
ggagtgcagtcatac

SEQ ID NO: 46306 - DNA, 15 bp, Homo sapiens
tggagtgcagtcata

SEQ ID NO: 46307 - DNA, 15 bp, Homo sapiens
ctggagtgcagtcat

SEQ ID NO: 46308 - DNA, 15 bp, Homo sapiens
gctggagtgcagtca

SEQ ID NO: 46309 - DNA, 15 bp, Homo sapiens
ggctggagtgcagtc

SEQ ID NO: 46310 - DNA, 15 bp, Homo sapiens
gctctgtcacccagg

SEQ ID NO: 46311 - DNA, 15 bp, Homo sapiens
tgctctgtcacccag

SEQ ID NO: 46312 - DNA, 15 bp, Homo sapiens
aacagggtcttgctc

SEQ ID NO: 46313 - DNA, 15 bp, Homo sapiens
aaacagggtcttgct

SEQ ID NO: 46314 - DNA, 15 bp, Homo sapiens
gaaacagggtcttgc

SEQ ID NO: 46315 - DNA, 15 bp, Homo sapiens
tgaaacagggtcttg

SEQ ID NO: 46316 - DNA, 15 bp, Homo sapiens
ttgaaacagggtctt

SEQ ID NO: 46317 - DNA, 15 bp, Homo sapiens
tttgaaacagggtct

SEQ ID NO: 46318 - DNA, 15 bp, Homo sapiens
ttttgaaacagggtc

SEQ ID NO: 46319 - DNA, 15 bp, Homo sapiens
tttttgaaacagggt

SEQ ID NO: 46320 - DNA, 15 bp, Homo sapiens
ctttttgaaacaggg

SEQ ID NO: 46321 - DNA, 15 bp, Homo sapiens
tctttttgaaacagg

SEQ ID NO: 46322 - DNA, 15 bp, Homo sapiens
ttctttttgaaacag

SEQ ID NO: 46323 - DNA, 15 bp, Homo sapiens
tttctttttgaaaca

SEQ ID NO: 46324 - DNA, 15 bp, Homo sapiens
ttttctttttgaaac

SEQ ID NO: 46325 - DNA, 15 bp, Homo sapiens
tttttctttttgaaa

SEQ ID NO: 46326 - DNA, 15 bp, Homo sapiens
gtttttctttttgaa

SEQ ID NO: 46327 - DNA, 15 bp, Homo sapiens
ggtttttctttttga

SEQ ID NO: 46328 - DNA, 15 bp, Homo sapiens
gggtttttctttttg

SEQ ID NO: 46329 - DNA, 15 bp, Homo sapiens
agggtttttcttttt

SEQ ID NO: 46330 - DNA, 15 bp, Homo sapiens
cagggtttttctttt

SEQ ID NO: 46331 - DNA, 15 bp, Homo sapiens
ccagggtttttcttt

SEQ ID NO: 46332 - DNA, 15 bp, Homo sapiens
cccagggtttttctt

SEQ ID NO: 46333 - DNA, 15 bp, Homo sapiens
tcccagggtttttct

SEQ ID NO: 46334 - DNA, 15 bp, Homo sapiens
ttcccagggtttttc

SEQ ID NO: 46335 - DNA, 15 bp, Homo sapiens
tttcccagggttttt

SEQ ID NO: 46336 - DNA, 15 bp, Homo sapiens
ttttcccagggtttt

SEQ ID NO: 46337 - DNA, 15 bp, Homo sapiens
cttttcccagggttt

SEQ ID NO: 46338 - DNA, 15 bp, Homo sapiens
acttttcccagggtt

SEQ ID NO: 46339 - DNA, 15 bp, Homo sapiens
cacttttcccagggt

SEQ ID NO: 46340 - DNA, 15 bp, Homo sapiens
tcacttttcccaggg

SEQ ID NO: 46341 - DNA, 15 bp, Homo sapiens
ttcacttttcccagg

SEQ ID NO: 46342 - DNA, 15 bp, Homo sapiens
cttcacttttcccag

SEQ ID NO: 46343 - DNA, 15 bp, Homo sapiens
acttcacttttccca

SEQ ID NO: 46344 - DNA, 15 bp, Homo sapiens
tacttcacttttccc

SEQ ID NO: 46345 - DNA, 15 bp, Homo sapiens
atacttcacttttcc

SEQ ID NO: 46346 - DNA, 15 bp, Homo sapiens
catacttcacttttc

SEQ ID NO: 46347 - DNA, 15 bp, Homo sapiens
ccatacttcactttt

SEQ ID NO: 46348 - DNA, 15 bp, Homo sapiens
gccatacttcacttt

SEQ ID NO: 46349 - DNA, 15 bp, Homo sapiens
agccatacttcactt

SEQ ID NO: 46350 - DNA, 15 bp, Homo sapiens
cagccatacttcact

SEQ ID NO: 46351 - DNA, 15 bp, Homo sapiens
acagccatacttcac

SEQ ID NO: 46352 - DNA, 15 bp, Homo sapiens
tacagccatacttca

SEQ ID NO: 46353 - DNA, 15 bp, Homo sapiens
ttacagccatacttc

SEQ ID NO: 46354 - DNA, 15 bp, Homo sapiens
cttacagccatactt

SEQ ID NO: 46355 - DNA, 15 bp, Homo sapiens
acttacagccatact

SEQ ID NO: 46356 - DNA, 15 bp, Homo sapiens
gacttacagccatac

SEQ ID NO: 46357 - DNA, 15 bp, Homo sapiens
agacttacagccata

SEQ ID NO: 46358 - DNA, 15 bp, Homo sapiens
gagacttacagccat

SEQ ID NO: 46359 - DNA, 15 bp, Homo sapiens
tgagacttacagcca

SEQ ID NO: 46360 - DNA, 15 bp, Homo sapiens
atgagacttacagcc

SEQ ID NO: 46361 - DNA, 15 bp, Homo sapiens
catgagacttacagc

SEQ ID NO: 46362 - DNA, 15 bp, Homo sapiens
ccatgagacttacag

SEQ ID NO: 46363 - DNA, 15 bp, Homo sapiens
accatgagacttaca

SEQ ID NO: 46364 - DNA, 15 bp, Homo sapiens
aaccatgagacttac

SEQ ID NO: 46365 - DNA, 15 bp, Homo sapiens
gaaccatgagactta

SEQ ID NO: 46366 - DNA, 15 bp, Homo sapiens
tgaaccatgagactt

SEQ ID NO: 46367 - DNA, 15 bp, Homo sapiens
ctgaaccatgagact

SEQ ID NO: 46368 - DNA, 15 bp, Homo sapiens
actgaaccatgagac

SEQ ID NO: 46369 - DNA, 15 bp, Homo sapiens
gactgaaccatgaga

SEQ ID NO: 46370 - DNA, 15 bp, Homo sapiens
ggactgaaccatgag

SEQ ID NO: 46371 - DNA, 15 bp, Homo sapiens
aggactgaaccatga

SEQ ID NO: 46372 - DNA, 15 bp, Homo sapiens
taggactgaaccatg

SEQ ID NO: 46373 - DNA, 15 bp, Homo sapiens
ctaggactgaaccat

SEQ ID NO: 46374 - DNA, 15 bp, Homo sapiens
gctaggactgaacca

SEQ ID NO: 46375 - DNA, 15 bp, Homo sapiens
tgctaggactgaacc

SEQ ID NO: 46376 - DNA, 15 bp, Homo sapiens
ttgctaggactgaac

SEQ ID NO: 46377 - DNA, 15 bp, Homo sapiens
cttgctaggactgaa

SEQ ID NO: 46378 - DNA, 15 bp, Homo sapiens
tcttgctaggactga

SEQ ID NO: 46379 - DNA, 15 bp, Homo sapiens
ttcttgctaggactg

SEQ ID NO: 46380 - DNA, 15 bp, Homo sapiens
cttcttgctaggact

SEQ ID NO: 46381 - DNA, 15 bp, Homo sapiens
gcttcttgctaggac

SEQ ID NO: 46382 - DNA, 15 bp, Homo sapiens
cgcttcttgctagga

SEQ ID NO: 46383 - DNA, 15 bp, Homo sapiens
tcgcttcttgctagg

SEQ ID NO: 46384 - DNA, 15 bp, Homo sapiens
ctcgcttcttgctag

SEQ ID NO: 46385 - DNA, 15 bp, Homo sapiens
tctcgcttcttgcta

SEQ ID NO: 46386 - DNA, 15 bp, Homo sapiens
ttctcgcttcttgct

SEQ ID NO: 46387 - DNA, 15 bp, Homo sapiens
attctcgcttcttgc

SEQ ID NO: 46388 - DNA, 15 bp, Homo sapiens
aattctcgcttcttg

SEQ ID NO: 46389 - DNA, 15 bp, Homo sapiens
gaattctcgcttctt

SEQ ID NO: 46390 - DNA, 15 bp, Homo sapiens
agaattctcgcttct

SEQ ID NO: 46391 - DNA, 15 bp, Homo sapiens
cagaattctcgcttc

SEQ ID NO: 46392 - DNA, 15 bp, Homo sapiens
tcagaattctcgctt

SEQ ID NO: 46393 - DNA, 15 bp, Homo sapiens
ctcagaattctcgct

SEQ ID NO: 46394 - DNA, 15 bp, Homo sapiens
tctcagaattctcgc

SEQ ID NO: 46395 - DNA, 15 bp, Homo sapiens
atctcagaattctcg

SEQ ID NO: 46396 - DNA, 15 bp, Homo sapiens
gatctcagaattctc

SEQ ID NO: 46397 - DNA, 15 bp, Homo sapiens
ggatctcagaattct

SEQ ID NO: 46398 - DNA, 15 bp, Homo sapiens
aggatctcagaattc

SEQ ID NO: 46399 - DNA, 15 bp, Homo sapiens
gaggatctcagaatt

SEQ ID NO: 46400 - DNA, 15 bp, Homo sapiens
ggaggatctcagaat

SEQ ID NO: 46401 - DNA, 15 bp, Homo sapiens
tggaggatctcagaa

SEQ ID NO: 46402 - DNA, 15 bp, Homo sapiens
ctggaggatctcaga

SEQ ID NO: 46403 - DNA, 15 bp, Homo sapiens
tctggaggatctcag

SEQ ID NO: 46404 - DNA, 15 bp, Homo sapiens
ttctggaggatctca

SEQ ID NO: 46405 - DNA, 15 bp, Homo sapiens
tttctggaggatctc

SEQ ID NO: 46406 - DNA, 15 bp, Homo sapiens
ctttctggaggatct

SEQ ID NO: 46407 - DNA, 15 bp, Homo sapiens
actttctggaggatc

SEQ ID NO: 46408 - DNA, 15 bp, Homo sapiens
gactttctggaggat

SEQ ID NO: 46409 - DNA, 15 bp, Homo sapiens
cgactttctggagga

SEQ ID NO: 46410 - DNA, 15 bp, Homo sapiens
tcgactttctggagg

SEQ ID NO: 46411 - DNA, 15 bp, Homo sapiens
ctcgactttctggag

SEQ ID NO: 46412 - DNA, 15 bp, Homo sapiens
gctcgactttctgga

SEQ ID NO: 46413 - DNA, 15 bp, Homo sapiens
tgctcgactttctgg

SEQ ID NO: 46414 - DNA, 15 bp, Homo sapiens
ctgctcgactttctg

SEQ ID NO: 46415 - DNA, 15 bp, Homo sapiens
gctgctcgactttct

SEQ ID NO: 46416 - DNA, 15 bp, Homo sapiens
tgctgctcgactttc

SEQ ID NO: 46417 - DNA, 15 bp, Homo sapiens
gtgctgctcgacttt

SEQ ID NO: 46418 - DNA, 15 bp, Homo sapiens
ggtgctgctcgactt

SEQ ID NO: 46419 - DNA, 15 bp, Homo sapiens
gggtgctgctcgact

SEQ ID NO: 46420 - DNA, 15 bp, Homo sapiens
tgggtgctgctcgac

SEQ ID NO: 46421 - DNA, 15 bp, Homo sapiens
gtgggtgctgctcga

SEQ ID NO: 46422 - DNA, 15 bp, Homo sapiens
ggtgggtgctgctcg

SEQ ID NO: 46423 - DNA, 15 bp, Homo sapiens
aggtgggtgctgctc

SEQ ID NO: 46424 - DNA, 15 bp, Homo sapiens
gaggtgggtgctgct

SEQ ID NO: 46425 - DNA, 15 bp, Homo sapiens
ggaggtgggtgctgc

SEQ ID NO: 46426 - DNA, 15 bp, Homo sapiens
tggaggtgggtgctg

SEQ ID NO: 46427 - DNA, 15 bp, Homo sapiens
ttggaggtgggtgct

SEQ ID NO: 46428 - DNA, 15 bp, Homo sapiens
gttggaggtgggtgc

SEQ ID NO: 46429 - DNA, 15 bp, Homo sapiens
ggttggaggtgggtg

SEQ ID NO: 46430 - DNA, 15 bp, Homo sapiens
aggttggaggtgggt

SEQ ID NO: 46431 - DNA, 15 bp, Homo sapiens
gaggttggaggtggg

SEQ ID NO: 46432 - DNA, 15 bp, Homo sapiens
cgaggttggaggtgg

SEQ ID NO: 46433 - DNA, 15 bp, Homo sapiens
ccgaggttggaggtg

SEQ ID NO: 46434 - DNA, 15 bp, Homo sapiens
cccgaggttggaggt

SEQ ID NO: 46435 - DNA, 15 bp, Homo sapiens
gcccgaggttggagg

SEQ ID NO: 46436 - DNA, 15 bp, Homo sapiens
ggcccgaggttggag

SEQ ID NO: 46437 - DNA, 15 bp, Homo sapiens
tggcccgaggttgga

SEQ ID NO: 46438 - DNA, 15 bp, Homo sapiens
ctggcccgaggttgg

SEQ ID NO: 46439 - DNA, 15 bp, Homo sapiens
actggcccgaggttg

SEQ ID NO: 46440 - DNA, 15 bp, Homo sapiens
cactggcccgaggtt

SEQ ID NO: 46441 - DNA, 15 bp, Homo sapiens
acactggcccgaggt

SEQ ID NO: 46442 - DNA, 15 bp, Homo sapiens
gacactggcccgagg

SEQ ID NO: 46443 - DNA, 15 bp, Homo sapiens
agacactggcccgag

SEQ ID NO: 46444 - DNA, 15 bp, Homo sapiens
aagacactggcccga

SEQ ID NO: 46445 - DNA, 15 bp, Homo sapiens
gaagacactggcccg

SEQ ID NO: 46446 - DNA, 15 bp, Homo sapiens
tgaagacactggccc

SEQ ID NO: 46447 - DNA, 15 bp, Homo sapiens
ctgaagacactggcc

SEQ ID NO: 46448 - DNA, 15 bp, Homo sapiens
cctgaagacactggc

SEQ ID NO: 46449 - DNA, 15 bp, Homo sapiens
gcctgaagacactgg

SEQ ID NO: 46450 - DNA, 15 bp, Homo sapiens
agcctgaagacactg

SEQ ID NO: 46451 - DNA, 15 bp, Homo sapiens
aagcctgaagacact

SEQ ID NO: 46452 - DNA, 15 bp, Homo sapiens
aaagcctgaagacac

SEQ ID NO: 46453 - DNA, 15 bp, Homo sapiens
taaagcctgaagaca

SEQ ID NO: 46454 - DNA, 15 bp, Homo sapiens
gtaaagcctgaagac

SEQ ID NO: 46455 - DNA, 15 bp, Homo sapiens
agtaaagcctgaaga

SEQ ID NO: 46456 - DNA, 15 bp, Homo sapiens
cagtaaagcctgaag

SEQ ID NO: 46457 - DNA, 15 bp, Homo sapiens
ccagtaaagcctgaa

SEQ ID NO: 46458 - DNA, 15 bp, Homo sapiens
cccagtaaagcctga

SEQ ID NO: 46459 - DNA, 15 bp, Homo sapiens
ccccagtaaagcctg

SEQ ID NO: 46460 - DNA, 15 bp, Homo sapiens
tccccagtaaagcct

SEQ ID NO: 46461 - DNA, 15 bp, Homo sapiens
gtccccagtaaagcc

SEQ ID NO: 46462 - DNA, 15 bp, Homo sapiens
ggtccccagtaaagc

SEQ ID NO: 46463 - DNA, 15 bp, Homo sapiens
aggtccccagtaaag

SEQ ID NO: 46464 - DNA, 15 bp, Homo sapiens
caggtccccagtaaa

SEQ ID NO: 46465 - DNA, 15 bp, Homo sapiens
gcaggtccccagtaa

SEQ ID NO: 46466 - DNA, 15 bp, Homo sapiens
cgcaggtccccagta

SEQ ID NO: 46467 - DNA, 15 bp, Homo sapiens
tcgcaggtccccagt

SEQ ID NO: 46468 - DNA, 15 bp, Homo sapiens
ctcgcaggtccccag

SEQ ID NO: 46469 - DNA, 15 bp, Homo sapiens
gctcgcaggtcccca

SEQ ID NO: 46470 - DNA, 15 bp, Homo sapiens
agctcgcaggtcccc

SEQ ID NO: 46471 - DNA, 15 bp, Homo sapiens
cagctcgcaggtccc

SEQ ID NO: 46472 - DNA, 15 bp, Homo sapiens
ccagctcgcaggtcc

SEQ ID NO: 46473 - DNA, 15 bp, Homo sapiens
gccagctcgcaggtc

SEQ ID NO: 46474 - DNA, 15 bp, Homo sapiens
ggccagctcgcaggt

SEQ ID NO: 46475 - DNA, 15 bp, Homo sapiens
aggccagctcgcagg

SEQ ID NO: 46476 - DNA, 15 bp, Homo sapiens
taggccagctcgcag

SEQ ID NO: 46477 - DNA, 15 bp, Homo sapiens
ttaggccagctcgca

SEQ ID NO: 46478 - DNA, 15 bp, Homo sapiens
attaggccagctcgc

SEQ ID NO: 46479 - DNA, 15 bp, Homo sapiens
cattaggccagctcg

SEQ ID NO: 46480 - DNA, 15 bp, Homo sapiens
acattaggccagctc

SEQ ID NO: 46481 - DNA, 15 bp, Homo sapiens
cacattaggccagct

SEQ ID NO: 46482 - DNA, 15 bp, Homo sapiens
ccacattaggccagc

SEQ ID NO: 46483 - DNA, 15 bp, Homo sapiens
accacattaggccag

SEQ ID NO: 46484 - DNA, 15 bp, Homo sapiens
caccacattaggcca

SEQ ID NO: 46485 - DNA, 15 bp, Homo sapiens
ccaccacattaggcc

SEQ ID NO: 46486 - DNA, 15 bp, Homo sapiens
gccaccacattaggc

SEQ ID NO: 46487 - DNA, 15 bp, Homo sapiens
ggccaccacattagg

SEQ ID NO: 46488 - DNA, 15 bp, Homo sapiens
aggccaccacattag

SEQ ID NO: 46489 - DNA, 15 bp, Homo sapiens
caggccaccacatta

SEQ ID NO: 46490 - DNA, 15 bp, Homo sapiens
gcaggccaccacatt

SEQ ID NO: 46491 - DNA, 15 bp, Homo sapiens
tgcaggccaccacat

SEQ ID NO: 46492 - DNA, 15 bp, Homo sapiens
ttgcaggccaccaca

SEQ ID NO: 46493 - DNA, 15 bp, Homo sapiens
cttgcaggccaccac

SEQ ID NO: 46494 - DNA, 15 bp, Homo sapiens
gcttgcaggccacca

SEQ ID NO: 46495 - DNA, 15 bp, Homo sapiens
ggcttgcaggccacc

SEQ ID NO: 46496 - DNA, 15 bp, Homo sapiens
tggcttgcaggccac

SEQ ID NO: 46497 - DNA, 15 bp, Homo sapiens
ctggcttgcaggcca

SEQ ID NO: 46498 - DNA, 15 bp, Homo sapiens
cctggcttgcaggcc

SEQ ID NO: 46499 - DNA, 15 bp, Homo sapiens
gcctggcttgcaggc

SEQ ID NO: 46500 - DNA, 15 bp, Homo sapiens
ggcctggcttgcagg

SEQ ID NO: 46501 - DNA, 15 bp, Homo sapiens
tggcctggcttgcag

SEQ ID NO: 46502 - DNA, 15 bp, Homo sapiens
atggcctggcttgca

SEQ ID NO: 46503 - DNA, 15 bp, Homo sapiens
gatggcctggcttgc

SEQ ID NO: 46504 - DNA, 15 bp, Homo sapiens
ggatggcctggcttg

SEQ ID NO: 46505 - DNA, 15 bp, Homo sapiens
gggatggcctggctt

SEQ ID NO: 46506 - DNA, 15 bp, Homo sapiens
agggatggcctggct

SEQ ID NO: 46507 - DNA, 15 bp, Homo sapiens
cagggatggcctggc

SEQ ID NO: 46508 - DNA, 15 bp, Homo sapiens
ccagggatggcctgg

SEQ ID NO: 46509 - DNA, 15 bp, Homo sapiens
cccagggatggcctg

SEQ ID NO: 46510 - DNA, 15 bp, Homo sapiens
gcccagggatggcct

SEQ ID NO: 46511 - DNA, 15 bp, Homo sapiens
cgcccagggatggcc

SEQ ID NO: 46512 - DNA, 15 bp, Homo sapiens
gcgcccagggatggc

SEQ ID NO: 46513 - DNA, 15 bp, Homo sapiens
ggcgcccagggatgg

SEQ ID NO: 46514 - DNA, 15 bp, Homo sapiens
tggcgcccagggatg

SEQ ID NO: 46515 - DNA, 15 bp, Homo sapiens
gtggcgcccagggat

SEQ ID NO: 46516 - DNA, 15 bp, Homo sapiens
tgtggcgcccaggga

SEQ ID NO: 46517 - DNA, 15 bp, Homo sapiens
ctgtggcgcccaggg

SEQ ID NO: 46518 - DNA, 15 bp, Homo sapiens
tctgtggcgcccagg

SEQ ID NO: 46519 - DNA, 15 bp, Homo sapiens
gtctgtggcgcccag

SEQ ID NO: 46520 - DNA, 15 bp, Homo sapiens
cgtctgtggcgccca

SEQ ID NO: 46521 - DNA, 15 bp, Homo sapiens
tcgtctgtggcgccc

SEQ ID NO: 46522 - DNA, 15 bp, Homo sapiens
ctcgtctgtggcgcc

SEQ ID NO: 46523 - DNA, 15 bp, Homo sapiens
gctcgtctgtggcgc

SEQ ID NO: 46524 - DNA, 15 bp, Homo sapiens
agctcgtctgtggcg

SEQ ID NO: 46525 - DNA, 15 bp, Homo sapiens
gagctcgtctgtggc

SEQ ID NO: 46526 - DNA, 15 bp, Homo sapiens
ggagctcgtctgtgg

SEQ ID NO: 46527 - DNA, 15 bp, Homo sapiens
cggagctcgtctgtg

SEQ ID NO: 46528 - DNA, 15 bp, Homo sapiens
tcggagctcgtctgt

SEQ ID NO: 46529 - DNA, 15 bp, Homo sapiens
ctcggagctcgtctg

SEQ ID NO: 46530 - DNA, 15 bp, Homo sapiens
gctcggagctcgtct

SEQ ID NO: 46531 - DNA, 15 bp, Homo sapiens
ggctcggagctcgtc

SEQ ID NO: 46532 - DNA, 15 bp, Homo sapiens
tggctcggagctcgt

SEQ ID NO: 46533 - DNA, 15 bp, Homo sapiens
ctggctcggagctcg

SEQ ID NO: 46534 - DNA, 15 bp, Homo sapiens
cctggctcggagctc

SEQ ID NO: 46535 - DNA, 15 bp, Homo sapiens
acctggctcggagct

SEQ ID NO: 46536 - DNA, 15 bp, Homo sapiens
gacctggctcggagc

SEQ ID NO: 46537 - DNA, 15 bp, Homo sapiens
tgacctggctcggag

SEQ ID NO: 46538 - DNA, 15 bp, Homo sapiens
ctgacctggctcgga

SEQ ID NO: 46539 - DNA, 15 bp, Homo sapiens
cctgacctggctcgg

SEQ ID NO: 46540 - DNA, 15 bp, Homo sapiens
gcctgacctggctcg

SEQ ID NO: 46541 - DNA, 15 bp, Homo sapiens
agcctgacctggctc

SEQ ID NO: 46542 - DNA, 15 bp, Homo sapiens
aagcctgacctggct

SEQ ID NO: 46543 - DNA, 15 bp, Homo sapiens
gaagcctgacctggc

SEQ ID NO: 46544 - DNA, 15 bp, Homo sapiens
cgaagcctgacctgg

SEQ ID NO: 46545 - DNA, 15 bp, Homo sapiens
ccgaagcctgacctg

SEQ ID NO: 46546 - DNA, 15 bp, Homo sapiens
tccgaagcctgacct

SEQ ID NO: 46547 - DNA, 15 bp, Homo sapiens
ctccgaagcctgacc

SEQ ID NO: 46548 - DNA, 15 bp, Homo sapiens
cctccgaagcctgac

SEQ ID NO: 46549 - DNA, 15 bp, Homo sapiens
gcctccgaagcctga

SEQ ID NO: 46550 - DNA, 15 bp, Homo sapiens
ggcctccgaagcctg

SEQ ID NO: 46551 - DNA, 15 bp, Homo sapiens
tggcctccgaagcct

SEQ ID NO: 46552 - DNA, 15 bp, Homo sapiens
gtggcctccgaagcc

SEQ ID NO: 46553 - DNA, 15 bp, Homo sapiens
tgtggcctccgaagc

SEQ ID NO: 46554 - DNA, 15 bp, Homo sapiens
ttgtggcctccgaag

SEQ ID NO: 46555 - DNA, 15 bp, Homo sapiens
cttgtggcctccgaa

SEQ ID NO: 46556 - DNA, 15 bp, Homo sapiens
gcttgtggcctccga

SEQ ID NO: 46557 - DNA, 15 bp, Homo sapiens
agcttgtggcctccg

SEQ ID NO: 46558 - DNA, 15 bp, Homo sapiens
gagcttgtggcctcc

SEQ ID NO: 46559 - DNA, 15 bp, Homo sapiens
tgagcttgtggcctc

SEQ ID NO: 46560 - DNA, 15 bp, Homo sapiens
ctgagcttgtggcct

SEQ ID NO: 46561 - DNA, 15 bp, Homo sapiens
gctgagcttgtggcc

SEQ ID NO: 46562 - DNA, 15 bp, Homo sapiens
ggctgagcttgtggc

SEQ ID NO: 46563 - DNA, 15 bp, Homo sapiens
aggctgagcttgtgg

SEQ ID NO: 46564 - DNA, 15 bp, Homo sapiens
gaggctgagcttgtg

SEQ ID NO: 46565 - DNA, 15 bp, Homo sapiens
tgaggctgagcttgt

SEQ ID NO: 46566 - DNA, 15 bp, Homo sapiens
ctgaggctgagcttg

SEQ ID NO: 46567 - DNA, 15 bp, Homo sapiens
cctgaggctgagctt

SEQ ID NO: 46568 - DNA, 15 bp, Homo sapiens
gcctgaggctgagct

SEQ ID NO: 46569 - DNA, 15 bp, Homo sapiens
ggcctgaggctgagc

SEQ ID NO: 46570 - DNA, 15 bp, Homo sapiens
gggcctgaggctgag

SEQ ID NO: 46571 - DNA, 15 bp, Homo sapiens
tgggcctgaggctga

SEQ ID NO: 46572 - DNA, 15 bp, Homo sapiens
ctgggcctgaggctg

SEQ ID NO: 46573 - DNA, 15 bp, Homo sapiens
cctgggcctgaggct

SEQ ID NO: 46574 - DNA, 15 bp, Homo sapiens
gcctgggcctgaggc

SEQ ID NO: 46575 - DNA, 15 bp, Homo sapiens
tgcctgggcctgagg

SEQ ID NO: 46576 - DNA, 15 bp, Homo sapiens
agtgcctgggcctga

SEQ ID NO: 46577 - DNA, 15 bp, Homo sapiens
cagtgcctgggcctg

SEQ ID NO: 46578 - DNA, 15 bp, Homo sapiens
tcagtgcctgggcct

SEQ ID NO: 46579 - DNA, 15 bp, Homo sapiens
atcagtgcctgggcc

SEQ ID NO: 46580 - DNA, 15 bp, Homo sapiens
aatcagtgcctgggc

SEQ ID NO: 46581 - DNA, 15 bp, Homo sapiens
caatcagtgcctggg

SEQ ID NO: 46582 - DNA, 15 bp, Homo sapiens
acaatcagtgcctgg

SEQ ID NO: 46583 - DNA, 15 bp, Homo sapiens
cacaatcagtgcctg

SEQ ID NO: 46584 - DNA, 15 bp, Homo sapiens
ccacaatcagtgcct

SEQ ID NO: 46585 - DNA, 15 bp, Homo sapiens
gccacaatcagtgcc

SEQ ID NO: 46586 - DNA, 15 bp, Homo sapiens
tgccacaatcagtgc

SEQ ID NO: 46587 - DNA, 15 bp, Homo sapiens
ctgccacaatcagtg

SEQ ID NO: 46588 - DNA, 15 bp, Homo sapiens
tctgccacaatcagt

SEQ ID NO: 46589 - DNA, 15 bp, Homo sapiens
ctctgccacaatcag

SEQ ID NO: 46590 - DNA, 15 bp, Homo sapiens
cctctgccacaatca

SEQ ID NO: 46591 - DNA, 15 bp, Homo sapiens
ccctctgccacaatc

SEQ ID NO: 46592 - DNA, 15 bp, Homo sapiens
cccctctgccacaat

SEQ ID NO: 46593 - DNA, 15 bp, Homo sapiens
gcccctctgccacaa

SEQ ID NO: 46594 - DNA, 15 bp, Homo sapiens
ggcccctctgccaca

SEQ ID NO: 46595 - DNA, 15 bp, Homo sapiens
tggcccctctgccac

SEQ ID NO: 46596 - DNA, 15 bp, Homo sapiens
gtggcccctctgcca

SEQ ID NO: 46597 - DNA, 15 bp, Homo sapiens
agtggcccctctgcc

SEQ ID NO: 46598 - DNA, 15 bp, Homo sapiens
tagtggcccctctgc

SEQ ID NO: 46599 - DNA, 15 bp, Homo sapiens
gtagtggcccctctg

SEQ ID NO: 46600 - DNA, 15 bp, Homo sapiens
ggtagtggcccctct

SEQ ID NO: 46601 - DNA, 15 bp, Homo sapiens
gggtagtggcccctc

SEQ ID NO: 46602 - DNA, 15 bp, Homo sapiens
tgggtagtggcccct

SEQ ID NO: 46603 - DNA, 15 bp, Homo sapiens
ttgggtagtggcccc

SEQ ID NO: 46604 - DNA, 15 bp, Homo sapiens
cttgggtagtggccc

SEQ ID NO: 46605 - DNA, 15 bp, Homo sapiens
ccttgggtagtggcc

SEQ ID NO: 46606 - DNA, 15 bp, Homo sapiens
accttgggtagtggc

SEQ ID NO: 46607 - DNA, 15 bp, Homo sapiens
gaccttgggtagtgg

SEQ ID NO: 46608 - DNA, 15 bp, Homo sapiens
agaccttgggtagtg

SEQ ID NO: 46609 - DNA, 15 bp, Homo sapiens
tagaccttgggtagt

SEQ ID NO: 46610 - DNA, 15 bp, Homo sapiens
ctagaccttgggtag

SEQ ID NO: 46611 - DNA, 15 bp, Homo sapiens
gctagaccttgggta

SEQ ID NO: 46612 - DNA, 15 bp, Homo sapiens
agctagaccttgggt

SEQ ID NO: 46613 - DNA, 15 bp, Homo sapiens
tagctagaccttggg

SEQ ID NO: 46614 - DNA, 15 bp, Homo sapiens
ctagctagaccttgg

SEQ ID NO: 46615 - DNA, 15 bp, Homo sapiens
cctagctagaccttg

SEQ ID NO: 46616 - DNA, 15 bp, Homo sapiens
gcctagctagacctt

SEQ ID NO: 46617 - DNA, 15 bp, Homo sapiens
ggcctagctagacct

SEQ ID NO: 46618 - DNA, 15 bp, Homo sapiens
gggcctagctagacc

SEQ ID NO: 46619 - DNA, 15 bp, Homo sapiens
tgggcctagctagac

SEQ ID NO: 46620 - DNA, 15 bp, Homo sapiens
ttgggcctagctaga

SEQ ID NO: 46621 - DNA, 15 bp, Homo sapiens
cttgggcctagctag

SEQ ID NO: 46622 - DNA, 15 bp, Homo sapiens
tcttgggcctagcta

SEQ ID NO: 46623 - DNA, 15 bp, Homo sapiens
gtcttgggcctagct

SEQ ID NO: 46624 - DNA, 15 bp, Homo sapiens
ggtcttgggcctagc

SEQ ID NO: 46625 - DNA, 15 bp, Homo sapiens
aggtcttgggcctag

SEQ ID NO: 46626 - DNA, 15 bp, Homo sapiens
taggtcttgggccta

SEQ ID NO: 46627 - DNA, 15 bp, Homo sapiens
ctaggtcttgggcct

SEQ ID NO: 46628 - DNA, 15 bp, Homo sapiens
actaggtcttgggcc

SEQ ID NO: 46629 - DNA, 15 bp, Homo sapiens
aactaggtcttgggc

SEQ ID NO: 46630 - DNA, 15 bp, Homo sapiens
taactaggtcttggg

SEQ ID NO: 46631 - DNA, 15 bp, Homo sapiens
gtaactaggtcttgg

SEQ ID NO: 46632 - DNA, 15 bp, Homo sapiens
ggtaactaggtcttg

SEQ ID NO: 46633 - DNA, 15 bp, Homo sapiens
gggtaactaggtctt

SEQ ID NO: 46634 - DNA, 15 bp, Homo sapiens
tgggtaactaggtct

SEQ ID NO: 46635 - DNA, 15 bp, Homo sapiens
ctgggtaactaggtc

SEQ ID NO: 46636 - DNA, 15 bp, Homo sapiens
tctgggtaactaggt

SEQ ID NO: 46637 - DNA, 15 bp, Homo sapiens
gtctgggtaactagg

SEQ ID NO: 46638 - DNA, 15 bp, Homo sapiens
tgtctgggtaactag

SEQ ID NO: 46639 - DNA, 15 bp, Homo sapiens
ctgtctgggtaacta

SEQ ID NO: 46640 - DNA, 15 bp, Homo sapiens
actgtctgggtaact

SEQ ID NO: 46641 - DNA, 15 bp, Homo sapiens
cactgtctgggtaac

SEQ ID NO: 46642 - DNA, 15 bp, Homo sapiens
tcactgtctgggtaa

SEQ ID NO: 46643 - DNA, 15 bp, Homo sapiens
ctcactgtctgggta

SEQ ID NO: 46644 - DNA, 15 bp, Homo sapiens
tctcactgtctgggt

SEQ ID NO: 46645 - DNA, 15 bp, Homo sapiens
ttctcactgtctggg

SEQ ID NO: 46646 - DNA, 15 bp, Homo sapiens
cttctcactgtctgg

SEQ ID NO: 46647 - DNA, 15 bp, Homo sapiens
gcttctcactgtctg

SEQ ID NO: 46648 - DNA, 15 bp, Homo sapiens
ggcttctcactgtct

SEQ ID NO: 46649 - DNA, 15 bp, Homo sapiens
gggcttctcactgtc

SEQ ID NO: 46650 - DNA, 15 bp, Homo sapiens
ggggcttctcactgt

SEQ ID NO: 46651 - DNA, 15 bp, Homo sapiens
aggggcttctcactg

SEQ ID NO: 46652 - DNA, 15 bp, Homo sapiens
caggggcttctcact

SEQ ID NO: 46653 - DNA, 15 bp, Homo sapiens
ccaggggcttctcac

SEQ ID NO: 46654 - DNA, 15 bp, Homo sapiens
tccaggggcttctca

SEQ ID NO: 46655 - DNA, 15 bp, Homo sapiens
ttccaggggcttctc

SEQ ID NO: 46656 - DNA, 15 bp, Homo sapiens
cttccaggggcttct

SEQ ID NO: 46657 - DNA, 15 bp, Homo sapiens
ccttccaggggcttc

SEQ ID NO: 46658 - DNA, 15 bp, Homo sapiens
gccttccaggggctt

SEQ ID NO: 46659 - DNA, 15 bp, Homo sapiens
tgccttccaggggct

SEQ ID NO: 46660 - DNA, 15 bp, Homo sapiens
ctgccttccaggggc

SEQ ID NO: 46661 - DNA, 15 bp, Homo sapiens
tctgccttccagggg

SEQ ID NO: 46662 - DNA, 15 bp, Homo sapiens
ttctgccttccaggg

SEQ ID NO: 46663 - DNA, 15 bp, Homo sapiens
tttctgccttccagg

SEQ ID NO: 46664 - DNA, 15 bp, Homo sapiens
ttttctgccttccag

SEQ ID NO: 46665 - DNA, 15 bp, Homo sapiens
cttttctgccttcca

SEQ ID NO: 46666 - DNA, 15 bp, Homo sapiens
acttttctgccttcc

SEQ ID NO: 46667 - DNA, 15 bp, Homo sapiens
aacttttctgccttc

SEQ ID NO: 46668 - DNA, 15 bp, Homo sapiens
caacttttctgcctt

SEQ ID NO: 46669 - DNA, 15 bp, Homo sapiens
ccaacttttctgcct

SEQ ID NO: 46670 - DNA, 15 bp, Homo sapiens
cccaacttttctgcc

SEQ ID NO: 46671 - DNA, 15 bp, Homo sapiens
tcccaacttttctgc

SEQ ID NO: 46672 - DNA, 15 bp, Homo sapiens
ctcccaacttttctg

SEQ ID NO: 46673 - DNA, 15 bp, Homo sapiens
gctcccaacttttct

SEQ ID NO: 46674 - DNA, 15 bp, Homo sapiens
tgctcccaacttttc

SEQ ID NO: 46675 - DNA, 15 bp, Homo sapiens
atgctcccaactttt

SEQ ID NO: 46676 - DNA, 15 bp, Homo sapiens
catgctcccaacttt

SEQ ID NO: 46677 - DNA, 15 bp, Homo sapiens
ccatgctcccaactt

SEQ ID NO: 46678 - DNA, 15 bp, Homo sapiens
gccatgctcccaact

SEQ ID NO: 46679 - DNA, 15 bp, Homo sapiens
tgccatgctcccaac

SEQ ID NO: 46680 - DNA, 15 bp, Homo sapiens
ctgccatgctcccaa

SEQ ID NO: 46681 - DNA, 15 bp, Homo sapiens
tctgccatgctccca

SEQ ID NO: 46682 - DNA, 15 bp, Homo sapiens
gtctgccatgctccc

SEQ ID NO: 46683 - DNA, 15 bp, Homo sapiens
tgtctgccatgctcc

SEQ ID NO: 46684 - DNA, 15 bp, Homo sapiens
ctgtctgccatgctc

SEQ ID NO: 46685 - DNA, 15 bp, Homo sapiens
cctgtctgccatgct

SEQ ID NO: 46686 - DNA, 15 bp, Homo sapiens
ccctgtctgccatgc

SEQ ID NO: 46687 - DNA, 15 bp, Homo sapiens
tccctgtctgccatg

SEQ ID NO: 46688 - DNA, 15 bp, Homo sapiens
ttccctgtctgccat

SEQ ID NO: 46689 - DNA, 15 bp, Homo sapiens
cttccctgtctgcca

SEQ ID NO: 46690 - DNA, 15 bp, Homo sapiens
ccttccctgtctgcc

SEQ ID NO: 46691 - DNA, 15 bp, Homo sapiens
cccttccctgtctgc

SEQ ID NO: 46692 - DNA, 15 bp, Homo sapiens
tcccttccctgtctg

SEQ ID NO: 46693 - DNA, 15 bp, Homo sapiens
ttcccttccctgtct

SEQ ID NO: 46694 - DNA, 15 bp, Homo sapiens
tttcccttccctgtc

SEQ ID NO: 46695 - DNA, 15 bp, Homo sapiens
gtttcccttccctgt

SEQ ID NO: 46696 - DNA, 15 bp, Homo sapiens
tgtttcccttccctg

SEQ ID NO: 46697 - DNA, 15 bp, Homo sapiens
atgtttcccttccct

SEQ ID NO: 46698 - DNA, 15 bp, Homo sapiens
aatgtttcccttccc

SEQ ID NO: 46699 - DNA, 15 bp, Homo sapiens
aaatgtttcccttcc

SEQ ID NO: 46700 - DNA, 15 bp, Homo sapiens
aaaatgtttcccttc

SEQ ID NO: 46701 - DNA, 15 bp, Homo sapiens
gaaaatgtttccctt

SEQ ID NO: 46702 - DNA, 15 bp, Homo sapiens
tgaaaatgtttccct

SEQ ID NO: 46703 - DNA, 15 bp, Homo sapiens
ctgaaaatgtttccc

SEQ ID NO: 46704 - DNA, 15 bp, Homo sapiens
cctgaaaatgtttcc

SEQ ID NO: 46705 - DNA, 15 bp, Homo sapiens
ccctgaaaatgtttc

SEQ ID NO: 46706 - DNA, 15 bp, Homo sapiens
tccctgaaaatgttt

SEQ ID NO: 46707 - DNA, 15 bp, Homo sapiens
ttccctgaaaatgtt

SEQ ID NO: 46708 - DNA, 15 bp, Homo sapiens
tttccctgaaaatgt

SEQ ID NO: 46709 - DNA, 15 bp, Homo sapiens
ttttccctgaaaatg

SEQ ID NO: 46710 - DNA, 15 bp, Homo sapiens
cttttccctgaaaat

SEQ ID NO: 46711 - DNA, 15 bp, Homo sapiens
tcttttccctgaaaa

SEQ ID NO: 46712 - DNA, 15 bp, Homo sapiens
gtcttttccctgaaa

SEQ ID NO: 46713 - DNA, 15 bp, Homo sapiens
tgtcttttccctgaa

SEQ ID NO: 46714 - DNA, 15 bp, Homo sapiens
atgtcttttccctga

SEQ ID NO: 46715 - DNA, 15 bp, Homo sapiens
catgtcttttccctg

SEQ ID NO: 46716 - DNA, 15 bp, Homo sapiens
acatgtcttttccct

SEQ ID NO: 46717 - DNA, 15 bp, Homo sapiens
tacatgtcttttccc

SEQ ID NO: 46718 - DNA, 15 bp, Homo sapiens
atacatgtcttttcc

SEQ ID NO: 46719 - DNA, 15 bp, Homo sapiens
gatacatgtcttttc

SEQ ID NO: 46720 - DNA, 15 bp, Homo sapiens
tgatacatgtctttt

SEQ ID NO: 46721 - DNA, 15 bp, Homo sapiens
gtgatacatgtcttt

SEQ ID NO: 46722 - DNA, 15 bp, Homo sapiens
tgtgatacatgtctt

SEQ ID NO: 46723 - DNA, 15 bp, Homo sapiens
atgtgatacatgtct

SEQ ID NO: 46724 - DNA, 15 bp, Homo sapiens
catgtgatacatgtc

SEQ ID NO: 46725 - DNA, 15 bp, Homo sapiens
acatgtgatacatgt

SEQ ID NO: 46726 - DNA, 15 bp, Homo sapiens
gacatgtgatacatg

SEQ ID NO: 46727 - DNA, 15 bp, Homo sapiens
agacatgtgatacat

SEQ ID NO: 46728 - DNA, 15 bp, Homo sapiens
aagacatgtgataca

SEQ ID NO: 46729 - DNA, 15 bp, Homo sapiens
gaagacatgtgatac

SEQ ID NO: 46730 - DNA, 15 bp, Homo sapiens
tgaagacatgtgata

SEQ ID NO: 46731 - DNA, 15 bp, Homo sapiens
ctgaagacatgtgat

SEQ ID NO: 46732 - DNA, 15 bp, Homo sapiens
tctgaagacatgtga

SEQ ID NO: 46733 - DNA, 15 bp, Homo sapiens
ttctgaagacatgtg

SEQ ID NO: 46734 - DNA, 15 bp, Homo sapiens
cttctgaagacatgt

SEQ ID NO: 46735 - DNA, 15 bp, Homo sapiens
gcttctgaagacatg

SEQ ID NO: 46736 - DNA, 15 bp, Homo sapiens
tgcttctgaagacat

SEQ ID NO: 46737 - DNA, 15 bp, Homo sapiens
ttgcttctgaagaca

SEQ ID NO: 46738 - DNA, 15 bp, Homo sapiens
cttgcttctgaagac

SEQ ID NO: 46739 - DNA, 15 bp, Homo sapiens
acttgcttctgaaga

SEQ ID NO: 46740 - DNA, 15 bp, Homo sapiens
gacttgcttctgaag

SEQ ID NO: 46741 - DNA, 15 bp, Homo sapiens
tgacttgcttctgaa

SEQ ID NO: 46742 - DNA, 15 bp, Homo sapiens
ctgacttgcttctga

SEQ ID NO: 46743 - DNA, 15 bp, Homo sapiens
cctgacttgcttctg

SEQ ID NO: 46744 - DNA, 15 bp, Homo sapiens
acctgacttgcttct

SEQ ID NO: 46745 - DNA, 15 bp, Homo sapiens
aacctgacttgcttc

SEQ ID NO: 46746 - DNA, 15 bp, Homo sapiens
aaacctgacttgctt

SEQ ID NO: 46747 - DNA, 15 bp, Homo sapiens
gaaacctgacttgct

SEQ ID NO: 46748 - DNA, 15 bp, Homo sapiens
tgaaacctgacttgc

SEQ ID NO: 46749 - DNA, 15 bp, Homo sapiens
atgaaacctgacttg

SEQ ID NO: 46750 - DNA, 15 bp, Homo sapiens
catgaaacctgactt

SEQ ID NO: 46751 - DNA, 15 bp, Homo sapiens
acatgaaacctgact

SEQ ID NO: 46752 - DNA, 15 bp, Homo sapiens
tacatgaaacctgac

SEQ ID NO: 46753 - DNA, 15 bp, Homo sapiens
ttacatgaaacctga

SEQ ID NO: 46754 - DNA, 15 bp, Homo sapiens
gttacatgaaacctg

SEQ ID NO: 46755 - DNA, 15 bp, Homo sapiens
ggttacatgaaacct

SEQ ID NO: 46756 - DNA, 15 bp, Homo sapiens
cggttacatgaaacc

SEQ ID NO: 46757 - DNA, 15 bp, Homo sapiens
tcggttacatgaaac

SEQ ID NO: 46758 - DNA, 15 bp, Homo sapiens
ctcggttacatgaaa

SEQ ID NO: 46759 - DNA, 15 bp, Homo sapiens
actcggttacatgaa

SEQ ID NO: 46760 - DNA, 15 bp, Homo sapiens
cactcggttacatga

SEQ ID NO: 46761 - DNA, 15 bp, Homo sapiens
acactcggttacatg

SEQ ID NO: 46762 - DNA, 15 bp, Homo sapiens
gacactcggttacat

SEQ ID NO: 46763 - DNA, 15 bp, Homo sapiens
ggacactcggttaca

SEQ ID NO: 46764 - DNA, 15 bp, Homo sapiens
aggacactcggttac

SEQ ID NO: 46765 - DNA, 15 bp, Homo sapiens
gaggacactcggtta

SEQ ID NO: 46766 - DNA, 15 bp, Homo sapiens
agaggacactcggtt

SEQ ID NO: 46767 - DNA, 15 bp, Homo sapiens
aagaggacactcggt

SEQ ID NO: 46768 - DNA, 15 bp, Homo sapiens
caagaggacactcgg

SEQ ID NO: 46769 - DNA, 15 bp, Homo sapiens
gcaagaggacactcg

SEQ ID NO: 46770 - DNA, 15 bp, Homo sapiens
cgcaagaggacactc

SEQ ID NO: 46771 - DNA, 15 bp, Homo sapiens
acgcaagaggacact

SEQ ID NO: 46772 - DNA, 15 bp, Homo sapiens
cacgcaagaggacac

SEQ ID NO: 46773 - DNA, 15 bp, Homo sapiens
acacgcaagaggaca

SEQ ID NO: 46774 - DNA, 15 bp, Homo sapiens
gacacgcaagaggac

SEQ ID NO: 46775 - DNA, 15 bp, Homo sapiens
ggacacgcaagagga

SEQ ID NO: 46776 - DNA, 15 bp, Homo sapiens
tggacacgcaagagg

SEQ ID NO: 46777 - DNA, 15 bp, Homo sapiens
ttggacacgcaagag

SEQ ID NO: 46778 - DNA, 15 bp, Homo sapiens
tttggacacgcaaga

SEQ ID NO: 46779 - DNA, 15 bp, Homo sapiens
ttttggacacgcaag

SEQ ID NO: 46780 - DNA, 15 bp, Homo sapiens
cttttggacacgcaa

SEQ ID NO: 46781 - DNA, 15 bp, Homo sapiens
acttttggacacgca

SEQ ID NO: 46782 - DNA, 15 bp, Homo sapiens
tacttttggacacgc

SEQ ID NO: 46783 - DNA, 15 bp, Homo sapiens
ctacttttggacacg

SEQ ID NO: 46784 - DNA, 15 bp, Homo sapiens
gctacttttggacac

SEQ ID NO: 46785 - DNA, 15 bp, Homo sapiens
ggctacttttggaca

SEQ ID NO: 46786 - DNA, 15 bp, Homo sapiens
gggctacttttggac

SEQ ID NO: 46787 - DNA, 15 bp, Homo sapiens
tgggctacttttgga

SEQ ID NO: 46788 - DNA, 15 bp, Homo sapiens
ctgggctacttttgg

SEQ ID NO: 46789 - DNA, 15 bp, Homo sapiens
cctgggctacttttg

SEQ ID NO: 46790 - DNA, 15 bp, Homo sapiens
ccctgggctactttt

SEQ ID NO: 46791 - DNA, 15 bp, Homo sapiens
gccctgggctacttt

SEQ ID NO: 46792 - DNA, 15 bp, Homo sapiens
agccctgggctactt

SEQ ID NO: 46793 - DNA, 15 bp, Homo sapiens
cagccctgggctact

SEQ ID NO: 46794 - DNA, 15 bp, Homo sapiens
acagccctgggctac

SEQ ID NO: 46795 - DNA, 15 bp, Homo sapiens
tacagccctgggcta

SEQ ID NO: 46796 - DNA, 15 bp, Homo sapiens
ctacagccctgggct

SEQ ID NO: 46797 - DNA, 15 bp, Homo sapiens
gctacagccctgggc

SEQ ID NO: 46798 - DNA, 15 bp, Homo sapiens
tgctacagccctggg

SEQ ID NO: 46799 - DNA, 15 bp, Homo sapiens
gtgctacagccctgg

SEQ ID NO: 46800 - DNA, 15 bp, Homo sapiens
tgtgctacagccctg

SEQ ID NO: 46801 - DNA, 15 bp, Homo sapiens
ctgtgctacagccct

SEQ ID NO: 46802 - DNA, 15 bp, Homo sapiens
cctgtgctacagccc

SEQ ID NO: 46803 - DNA, 15 bp, Homo sapiens
gcctgtgctacagcc

SEQ ID NO: 46804 - DNA, 15 bp, Homo sapiens
agcctgtgctacagc

SEQ ID NO: 46805 - DNA, 15 bp, Homo sapiens
aagcctgtgctacag

SEQ ID NO: 46806 - DNA, 15 bp, Homo sapiens
gaagcctgtgctaca

SEQ ID NO: 46807 - DNA, 15 bp, Homo sapiens
tgaagcctgtgctac

SEQ ID NO: 46808 - DNA, 15 bp, Homo sapiens
gtgaagcctgtgcta

SEQ ID NO: 46809 - DNA, 15 bp, Homo sapiens
tgtgaagcctgtgct

SEQ ID NO: 46810 - DNA, 15 bp, Homo sapiens
ctgtgaagcctgtgc

SEQ ID NO: 46811 - DNA, 15 bp, Homo sapiens
actgtgaagcctgtg

SEQ ID NO: 46812 - DNA, 15 bp, Homo sapiens
cactgtgaagcctgt

SEQ ID NO: 46813 - DNA, 15 bp, Homo sapiens
tcactgtgaagcctg

SEQ ID NO: 46814 - DNA, 15 bp, Homo sapiens
atcactgtgaagcct

SEQ ID NO: 46815 - DNA, 15 bp, Homo sapiens
aatcactgtgaagcc

SEQ ID NO: 46816 - DNA, 15 bp, Homo sapiens
aaatcactgtgaagc

SEQ ID NO: 46817 - DNA, 15 bp, Homo sapiens
aaaatcactgtgaag

SEQ ID NO: 46818 - DNA, 15 bp, Homo sapiens
caaaatcactgtgaa

SEQ ID NO: 46819 - DNA, 15 bp, Homo sapiens
acaaaatcactgtga

SEQ ID NO: 46820 - DNA, 15 bp, Homo sapiens
cacaaaatcactgtg

SEQ ID NO: 46821 - DNA, 15 bp, Homo sapiens
acacaaaatcactgt

SEQ ID NO: 46822 - DNA, 15 bp, Homo sapiens
aacacaaaatcactg

SEQ ID NO: 46823 - DNA, 15 bp, Homo sapiens
gaacacaaaatcact

SEQ ID NO: 46824 - DNA, 15 bp, Homo sapiens
tgaacacaaaatcac

SEQ ID NO: 46825 - DNA, 15 bp, Homo sapiens
ctgaacacaaaatca

SEQ ID NO: 46826 - DNA, 15 bp, Homo sapiens
gctgaacacaaaatc

SEQ ID NO: 46827 - DNA, 15 bp, Homo sapiens
ggctgaacacaaaat

SEQ ID NO: 46828 - DNA, 15 bp, Homo sapiens
cggctgaacacaaaa

SEQ ID NO: 46829 - DNA, 15 bp, Homo sapiens
acggctgaacacaaa

SEQ ID NO: 46830 - DNA, 15 bp, Homo sapiens
cacggctgaacacaa

SEQ ID NO: 46831 - DNA, 15 bp, Homo sapiens
tcacggctgaacaca

SEQ ID NO: 46832 - DNA, 15 bp, Homo sapiens
ctcacggctgaacac

SEQ ID NO: 46833 - DNA, 15 bp, Homo sapiens
actcacggctgaaca

SEQ ID NO: 46834 - DNA, 15 bp, Homo sapiens
gactcacggctgaac

SEQ ID NO: 46835 - DNA, 15 bp, Homo sapiens
tgactcacggctgaa

SEQ ID NO: 46836 - DNA, 15 bp, Homo sapiens
gtgactcacggctga

SEQ ID NO: 46837 - DNA, 15 bp, Homo sapiens
tgtgactcacggctg

SEQ ID NO: 46838 - DNA, 15 bp, Homo sapiens
gtgtgactcacggct

SEQ ID NO: 46839 - DNA, 15 bp, Homo sapiens
agtgtgactcacggc

SEQ ID NO: 46840 - DNA, 15 bp, Homo sapiens
tagtgtgactcacgg

SEQ ID NO: 46841 - DNA, 15 bp, Homo sapiens
gtagtgtgactcacg

SEQ ID NO: 46842 - DNA, 15 bp, Homo sapiens
tgtagtgtgactcac

SEQ ID NO: 46843 - DNA, 15 bp, Homo sapiens
atgtagtgtgactca

SEQ ID NO: 46844 - DNA, 15 bp, Homo sapiens
catgtagtgtgactc

SEQ ID NO: 46845 - DNA, 15 bp, Homo sapiens
gcatgtagtgtgact

SEQ ID NO: 46846 - DNA, 15 bp, Homo sapiens
ggcatgtagtgtgac

SEQ ID NO: 46847 - DNA, 15 bp, Homo sapiens
gggcatgtagtgtga

SEQ ID NO: 46848 - DNA, 15 bp, Homo sapiens
ggggcatgtagtgtg

SEQ ID NO: 46849 - DNA, 15 bp, Homo sapiens
gggggcatgtagtgt

SEQ ID NO: 46850 - DNA, 15 bp, Homo sapiens
cgggggcatgtagtg

SEQ ID NO: 46851 - DNA, 15 bp, Homo sapiens
acgggggcatgtagt

SEQ ID NO: 46852 - DNA, 15 bp, Homo sapiens
cacgggggcatgtag

SEQ ID NO: 46853 - DNA, 15 bp, Homo sapiens
tcacgggggcatgta

SEQ ID NO: 46854 - DNA, 15 bp, Homo sapiens
ttcacgggggcatgt

SEQ ID NO: 46855 - DNA, 15 bp, Homo sapiens
cttcacgggggcatg

SEQ ID NO: 46856 - DNA, 15 bp, Homo sapiens
gcttcacgggggcat

SEQ ID NO: 46857 - DNA, 15 bp, Homo sapiens
agcttcacgggggca

SEQ ID NO: 46858 - DNA, 15 bp, Homo sapiens
cagcttcacgggggc

SEQ ID NO: 46859 - DNA, 15 bp, Homo sapiens
ccagcttcacggggg

SEQ ID NO: 46860 - DNA, 15 bp, Homo sapiens
cccagcttcacgggg

SEQ ID NO: 46861 - DNA, 15 bp, Homo sapiens
gcccagcttcacggg

SEQ ID NO: 46862 - DNA, 15 bp, Homo sapiens
tgcccagcttcacgg

SEQ ID NO: 46863 - DNA, 15 bp, Homo sapiens
atgcccagcttcacg

SEQ ID NO: 46864 - DNA, 15 bp, Homo sapiens
aatgcccagcttcac

SEQ ID NO: 46865 - DNA, 15 bp, Homo sapiens
caatgcccagcttca

SEQ ID NO: 46866 - DNA, 15 bp, Homo sapiens
ccaatgcccagcttc

SEQ ID NO: 46867 - DNA, 15 bp, Homo sapiens
accaatgcccagctt

SEQ ID NO: 46868 - DNA, 15 bp, Homo sapiens
caccaatgcccagct

SEQ ID NO: 46869 - DNA, 15 bp, Homo sapiens
tcaccaatgcccagc

SEQ ID NO: 46870 - DNA, 15 bp, Homo sapiens
gtcaccaatgcccag

SEQ ID NO: 46871 - DNA, 15 bp, Homo sapiens
cgtcaccaatgccca

SEQ ID NO: 46872 - DNA, 15 bp, Homo sapiens
acgtcaccaatgccc

SEQ ID NO: 46873 - DNA, 15 bp, Homo sapiens
gacgtcaccaatgcc

SEQ ID NO: 46874 - DNA, 15 bp, Homo sapiens
ggacgtcaccaatgc

SEQ ID NO: 46875 - DNA, 15 bp, Homo sapiens
tggacgtcaccaatg

SEQ ID NO: 46876 - DNA, 15 bp, Homo sapiens
ctggacgtcaccaat

SEQ ID NO: 46877 - DNA, 15 bp, Homo sapiens
cctggacgtcaccaa

SEQ ID NO: 46878 - DNA, 15 bp, Homo sapiens
acctggacgtcacca

SEQ ID NO: 46879 - DNA, 15 bp, Homo sapiens
aacctggacgtcacc

SEQ ID NO: 46880 - DNA, 15 bp, Homo sapiens
caacctggacgtcac

SEQ ID NO: 46881 - DNA, 15 bp, Homo sapiens
acaacctggacgtca

SEQ ID NO: 46882 - DNA, 15 bp, Homo sapiens
gacaacctggacgtc

SEQ ID NO: 46883 - DNA, 15 bp, Homo sapiens
ggacaacctggacgt

SEQ ID NO: 46884 - DNA, 15 bp, Homo sapiens
aggacaacctggacg

SEQ ID NO: 46885 - DNA, 15 bp, Homo sapiens
aaggacaacctggac

SEQ ID NO: 46886 - DNA, 15 bp, Homo sapiens
caaggacaacctgga

SEQ ID NO: 46887 - DNA, 15 bp, Homo sapiens
tcaaggacaacctgg

SEQ ID NO: 46888 - DNA, 15 bp, Homo sapiens
ctcaaggacaacctg

SEQ ID NO: 46889 - DNA, 15 bp, Homo sapiens
actcaaggacaacct

SEQ ID NO: 46890 - DNA, 15 bp, Homo sapiens
tactcaaggacaacc

SEQ ID NO: 46891 - DNA, 15 bp, Homo sapiens
ttactcaaggacaac

SEQ ID NO: 46892 - DNA, 15 bp, Homo sapiens
attactcaaggacaa

SEQ ID NO: 46893 - DNA, 15 bp, Homo sapiens
tattactcaaggaca

SEQ ID NO: 46894 - DNA, 15 bp, Homo sapiens
ttattactcaaggac

SEQ ID NO: 46895 - DNA, 15 bp, Homo sapiens
tttattactcaagga

SEQ ID NO: 46896 - DNA, 15 bp, Homo sapiens
ttttattactcaagg

SEQ ID NO: 46897 - DNA, 15 bp, Homo sapiens
tttttattactcaag

SEQ ID NO: 46898 - DNA, 15 bp, Homo sapiens
gtttttattactcaa

SEQ ID NO: 46899 - DNA, 15 bp, Homo sapiens
cgtttttattactca

SEQ ID NO: 46900 - DNA, 15 bp, Homo sapiens
acgtttttattactc

SEQ ID NO: 46901 - DNA, 15 bp, Homo sapiens
tacgtttttattact

SEQ ID NO: 46902 - DNA, 15 bp, Homo sapiens
atacgtttttattac

SEQ ID NO: 46903 - DNA, 15 bp, Homo sapiens
catacgtttttatta

SEQ ID NO: 46904 - DNA, 15 bp, Homo sapiens
acatacgtttttatt

SEQ ID NO: 46905 - DNA, 15 bp, Homo sapiens
aacatacgtttttat

SEQ ID NO: 46906 - DNA, 15 bp, Homo sapiens
caacatacgttttta

SEQ ID NO: 46907 - DNA, 15 bp, Homo sapiens
gcaacatacgttttt

SEQ ID NO: 46908 - DNA, 15 bp, Homo sapiens
tgcaacatacgtttt

SEQ ID NO: 46909 - DNA, 15 bp, Homo sapiens
ttgcaacatacgttt

SEQ ID NO: 46910 - DNA, 15 bp, Homo sapiens
attgcaacatacgtt

SEQ ID NO: 46911 - DNA, 15 bp, Homo sapiens
gattgcaacatacgt

SEQ ID NO: 46912 - DNA, 15 bp, Homo sapiens
agattgcaacatacg

SEQ ID NO: 46913 - DNA, 15 bp, Homo sapiens
gagattgcaacatac

SEQ ID NO: 46914 - DNA, 15 bp, Homo sapiens
cgagattgcaacata

SEQ ID NO: 46915 - DNA, 15 bp, Homo sapiens
ccgagattgcaacat

SEQ ID NO: 46916 - DNA, 15 bp, Homo sapiens
cccgagattgcaaca

SEQ ID NO: 46917 - DNA, 15 bp, Homo sapiens
gcccgagattgcaac

SEQ ID NO: 46918 - DNA, 15 bp, Homo sapiens
agcccgagattgcaa

SEQ ID NO: 46919 - DNA, 15 bp, Homo sapiens
gagcccgagattgca

SEQ ID NO: 46920 - DNA, 15 bp, Homo sapiens
agagcccgagattgc

SEQ ID NO: 46921 - DNA, 15 bp, Homo sapiens
tagagcccgagattg

SEQ ID NO: 46922 - DNA, 15 bp, Homo sapiens
gtagagcccgagatt

SEQ ID NO: 46923 - DNA, 15 bp, Homo sapiens
agtagagcccgagat

SEQ ID NO: 46924 - DNA, 15 bp, Homo sapiens
aagtagagcccgaga

SEQ ID NO: 46925 - DNA, 15 bp, Homo sapiens
caagtagagcccgag

SEQ ID NO: 46926 - DNA, 15 bp, Homo sapiens
acaagtagagcccga

SEQ ID NO: 46927 - DNA, 15 bp, Homo sapiens
cacaagtagagcccg

SEQ ID NO: 46928 - DNA, 15 bp, Homo sapiens
ccacaagtagagccc

SEQ ID NO: 46929 - DNA, 15 bp, Homo sapiens
tccacaagtagagcc

SEQ ID NO: 46930 - DNA, 15 bp, Homo sapiens
gtccacaagtagagc

SEQ ID NO: 46931 - DNA, 15 bp, Homo sapiens
agtccacaagtagag

SEQ ID NO: 46932 - DNA, 15 bp, Homo sapiens
aagtccacaagtaga

SEQ ID NO: 46933 - DNA, 15 bp, Homo sapiens
aaagtccacaagtag

SEQ ID NO: 46934 - DNA, 15 bp, Homo sapiens
caaagtccacaagta

SEQ ID NO: 46935 - DNA, 15 bp, Homo sapiens
acaaagtccacaagt

SEQ ID NO: 46936 - DNA, 15 bp, Homo sapiens
aacaaagtccacaag

SEQ ID NO: 46937 - DNA, 15 bp, Homo sapiens
caacaaagtccacaa

SEQ ID NO: 46938 - DNA, 15 bp, Homo sapiens
gcaacaaagtccaca

SEQ ID NO: 46939 - DNA, 15 bp, Homo sapiens
tgcaacaaagtccac

SEQ ID NO: 46940 - DNA, 15 bp, Homo sapiens
gtgcaacaaagtcca

SEQ ID NO: 46941 - DNA, 15 bp, Homo sapiens
ggtgcaacaaagtcc

SEQ ID NO: 46942 - DNA, 15 bp, Homo sapiens
cggtgcaacaaagtc

SEQ ID NO: 46943 - DNA, 15 bp, Homo sapiens
tcggtgcaacaaagt

SEQ ID NO: 46944 - DNA, 15 bp, Homo sapiens
ttcggtgcaacaaag

SEQ ID NO: 46945 - DNA, 15 bp, Homo sapiens
tttcggtgcaacaaa

SEQ ID NO: 46946 - DNA, 15 bp, Homo sapiens
ctttcggtgcaacaa

SEQ ID NO: 46947 - DNA, 15 bp, Homo sapiens
gctttcggtgcaaca

SEQ ID NO: 46948 - DNA, 15 bp, Homo sapiens
ggctttcggtgcaac

SEQ ID NO: 46949 - DNA, 15 bp, Homo sapiens
aggctttcggtgcaa

SEQ ID NO: 46950 - DNA, 15 bp, Homo sapiens
aaggctttcggtgca

SEQ ID NO: 46951 - DNA, 15 bp, Homo sapiens
caaggctttcggtgc

SEQ ID NO: 46952 - DNA, 15 bp, Homo sapiens
tcaaggctttcggtg

SEQ ID NO: 46953 - DNA, 15 bp, Homo sapiens
ctcaaggctttcggt

SEQ ID NO: 46954 - DNA, 15 bp, Homo sapiens
gctcaaggctttcgg

SEQ ID NO: 46955 - DNA, 15 bp, Homo sapiens
agctcaaggctttcg

SEQ ID NO: 46956 - DNA, 15 bp, Homo sapiens
aagctcaaggctttc

SEQ ID NO: 46957 - DNA, 15 bp, Homo sapiens
aaagctcaaggcttt

SEQ ID NO: 46958 - DNA, 15 bp, Homo sapiens
gaaagctcaaggctt

SEQ ID NO: 46959 - DNA, 15 bp, Homo sapiens
ggaaagctcaaggct

SEQ ID NO: 46960 - DNA, 15 bp, Homo sapiens
aggaaagctcaaggc

SEQ ID NO: 46961 - DNA, 15 bp, Homo sapiens
caggaaagctcaagg

SEQ ID NO: 46962 - DNA, 15 bp, Homo sapiens
tcaggaaagctcaag

SEQ ID NO: 46963 - DNA, 15 bp, Homo sapiens
atcaggaaagctcaa

SEQ ID NO: 46964 - DNA, 15 bp, Homo sapiens
catcaggaaagctca

SEQ ID NO: 46965 - DNA, 15 bp, Homo sapiens
gcatcaggaaagctc

SEQ ID NO: 46966 - DNA, 15 bp, Homo sapiens
ggcatcaggaaagct

SEQ ID NO: 46967 - DNA, 15 bp, Homo sapiens
aggcatcaggaaagc

SEQ ID NO: 46968 - DNA, 15 bp, Homo sapiens
aaggcatcaggaaag

SEQ ID NO: 46969 - DNA, 15 bp, Homo sapiens
taaggcatcaggaaa

SEQ ID NO: 46970 - DNA, 15 bp, Homo sapiens
gtaaggcatcaggaa

SEQ ID NO: 46971 - DNA, 15 bp, Homo sapiens
tgtaaggcatcagga

SEQ ID NO: 46972 - DNA, 15 bp, Homo sapiens
gtgtaaggcatcagg

SEQ ID NO: 46973 - DNA, 15 bp, Homo sapiens
agtgtaaggcatcag

SEQ ID NO: 46974 - DNA, 15 bp, Homo sapiens
aagtgtaaggcatca

SEQ ID NO: 46975 - DNA, 15 bp, Homo sapiens
gaagtgtaaggcatc

SEQ ID NO: 46976 - DNA, 15 bp, Homo sapiens
tgaagtgtaaggcat

SEQ ID NO: 46977 - DNA, 15 bp, Homo sapiens
ctgaagtgtaaggca

SEQ ID NO: 46978 - DNA, 15 bp, Homo sapiens
cctgaagtgtaaggc

SEQ ID NO: 46979 - DNA, 15 bp, Homo sapiens
ccctgaagtgtaagg

SEQ ID NO: 46980 - DNA, 15 bp, Homo sapiens
accctgaagtgtaag

SEQ ID NO: 46981 - DNA, 15 bp, Homo sapiens
aaccctgaagtgtaa

SEQ ID NO: 46982 - DNA, 15 bp, Homo sapiens
gaaccctgaagtgta

SEQ ID NO: 46983 - DNA, 15 bp, Homo sapiens
agaaccctgaagtgt

SEQ ID NO: 46984 - DNA, 15 bp, Homo sapiens
aagaaccctgaagtg

SEQ ID NO: 46985 - DNA, 15 bp, Homo sapiens
caagaaccctgaagt

SEQ ID NO: 46986 - DNA, 15 bp, Homo sapiens
tcaagaaccctgaag

SEQ ID NO: 46987 - DNA, 15 bp, Homo sapiens
ctcaagaaccctgaa

SEQ ID NO: 46988 - DNA, 15 bp, Homo sapiens
gctcaagaaccctga

SEQ ID NO: 46989 - DNA, 15 bp, Homo sapiens
cgctcaagaaccctg

SEQ ID NO: 46990 - DNA, 15 bp, Homo sapiens
acgctcaagaaccct

SEQ ID NO: 46991 - DNA, 15 bp, Homo sapiens
gacgctcaagaaccc

SEQ ID NO: 46992 - DNA, 15 bp, Homo sapiens
ggacgctcaagaacc

SEQ ID NO: 46993 - DNA, 15 bp, Homo sapiens
tggacgctcaagaac

SEQ ID NO: 46994 - DNA, 15 bp, Homo sapiens
ctggacgctcaagaa

SEQ ID NO: 46995 - DNA, 15 bp, Homo sapiens
cctggacgctcaaga

SEQ ID NO: 46996 - DNA, 15 bp, Homo sapiens
ccctggacgctcaag

SEQ ID NO: 46997 - DNA, 15 bp, Homo sapiens
accctggacgctcaa

SEQ ID NO: 46998 - DNA, 15 bp, Homo sapiens
gaccctggacgctca

SEQ ID NO: 46999 - DNA, 15 bp, Homo sapiens
agaccctggacgctc

SEQ ID NO: 47000 - DNA, 15 bp, Homo sapiens
aagaccctggacgct

SEQ ID NO: 47001 - DNA, 15 bp, Homo sapiens
caagaccctggacgc

SEQ ID NO: 47002 - DNA, 15 bp, Homo sapiens
acaagaccctggacg

SEQ ID NO: 47003 - DNA, 15 bp, Homo sapiens
aacaagaccctggac

SEQ ID NO: 47004 - DNA, 15 bp, Homo sapiens
taacaagaccctgga

SEQ ID NO: 47005 - DNA, 15 bp, Homo sapiens
gtaacaagaccctgg

SEQ ID NO: 47006 - DNA, 15 bp, Homo sapiens
agtaacaagaccctg

SEQ ID NO: 47007 - DNA, 15 bp, Homo sapiens
tagtaacaagaccct

SEQ ID NO: 47008 - DNA, 15 bp, Homo sapiens
gtagtaacaagaccc

SEQ ID NO: 47009 - DNA, 15 bp, Homo sapiens
agtagtaacaagacc

SEQ ID NO: 47010 - DNA, 15 bp, Homo sapiens
gagtagtaacaagac

SEQ ID NO: 47011 - DNA, 15 bp, Homo sapiens
agagtagtaacaaga

SEQ ID NO: 47012 - DNA, 15 bp, Homo sapiens
cagagtagtaacaag

SEQ ID NO: 47013 - DNA, 15 bp, Homo sapiens
ccagagtagtaacaa

SEQ ID NO: 47014 - DNA, 15 bp, Homo sapiens
cccagagtagtaaca

SEQ ID NO: 47015 - DNA, 15 bp, Homo sapiens
gcccagagtagtaac

SEQ ID NO: 47016 - DNA, 15 bp, Homo sapiens
agcccagagtagtaa

SEQ ID NO: 47017 - DNA, 15 bp, Homo sapiens
cagcccagagtagta

SEQ ID NO: 47018 - DNA, 15 bp, Homo sapiens
ccagcccagagtagt

SEQ ID NO: 47019 - DNA, 15 bp, Homo sapiens
gccagcccagagtag

SEQ ID NO: 47020 - DNA, 15 bp, Homo sapiens
ggccagcccagagta

SEQ ID NO: 47021 - DNA, 15 bp, Homo sapiens
tggccagcccagagt

SEQ ID NO: 47022 - DNA, 15 bp, Homo sapiens
gtggccagcccagag

SEQ ID NO: 47023 - DNA, 15 bp, Homo sapiens
tgtggccagcccaga

SEQ ID NO: 47024 - DNA, 15 bp, Homo sapiens
gtgtggccagcccag

SEQ ID NO: 47025 - DNA, 15 bp, Homo sapiens
ggtgtggccagccca

SEQ ID NO: 47026 - DNA, 15 bp, Homo sapiens
gggtgtggccagccc

SEQ ID NO: 47027 - DNA, 15 bp, Homo sapiens
tgggtgtggccagcc

SEQ ID NO: 47028 - DNA, 15 bp, Homo sapiens
ctgggtgtggccagc

SEQ ID NO: 47029 - DNA, 15 bp, Homo sapiens
gctgggtgtggccag

SEQ ID NO: 47030 - DNA, 15 bp, Homo sapiens
tgctgggtgtggcca

SEQ ID NO: 47031 - DNA, 15 bp, Homo sapiens
gtgctgggtgtggcc

SEQ ID NO: 47032 - DNA, 15 bp, Homo sapiens
agtgctgggtgtggc

SEQ ID NO: 47033 - DNA, 15 bp, Homo sapiens
aagtgctgggtgtgg

SEQ ID NO: 47034 - DNA, 15 bp, Homo sapiens
gaagtgctgggtgtg

SEQ ID NO: 47035 - DNA, 15 bp, Homo sapiens
ggaagtgctgggtgt

SEQ ID NO: 47036 - DNA, 15 bp, Homo sapiens
gggaagtgctgggtg

SEQ ID NO: 47037 - DNA, 15 bp, Homo sapiens
cgggaagtgctgggt

SEQ ID NO: 47038 - DNA, 15 bp, Homo sapiens
acgggaagtgctggg

SEQ ID NO: 47039 - DNA, 15 bp, Homo sapiens
cacgggaagtgctgg

SEQ ID NO: 47040 - DNA, 15 bp, Homo sapiens
acacgggaagtgctg

SEQ ID NO: 47041 - DNA, 15 bp, Homo sapiens
gacacgggaagtgct

SEQ ID NO: 47042 - DNA, 15 bp, Homo sapiens
tgacacgggaagtgc

SEQ ID NO: 47043 - DNA, 15 bp, Homo sapiens
ctgacacgggaagtg

SEQ ID NO: 47044 - DNA, 15 bp, Homo sapiens
cctgacacgggaagt

SEQ ID NO: 47045 - DNA, 15 bp, Homo sapiens
acctgacacgggaag

SEQ ID NO: 47046 - DNA, 15 bp, Homo sapiens
aacctgacacgggaa

SEQ ID NO: 47047 - DNA, 15 bp, Homo sapiens
aaacctgacacggga

SEQ ID NO: 47048 - DNA, 15 bp, Homo sapiens
aaaacctgacacggg

SEQ ID NO: 47049 - DNA, 15 bp, Homo sapiens
aaaaacctgacacgg

SEQ ID NO: 47050 - DNA, 15 bp, Homo sapiens
gaaaaacctgacacg

SEQ ID NO: 47051 - DNA, 15 bp, Homo sapiens
ggaaaaacctgacac

SEQ ID NO: 47052 - DNA, 15 bp, Homo sapiens
aggaaaaacctgaca

SEQ ID NO: 47053 - DNA, 15 bp, Homo sapiens
caggaaaaacctgac

SEQ ID NO: 47054 - DNA, 15 bp, Homo sapiens
tcaggaaaaacctga

SEQ ID NO: 47055 - DNA, 15 bp, Homo sapiens
atcaggaaaaacctg

SEQ ID NO: 47056 - DNA, 15 bp, Homo sapiens
catcaggaaaaacct

SEQ ID NO: 47057 - DNA, 15 bp, Homo sapiens
acatcaggaaaaacc

SEQ ID NO: 47058 - DNA, 15 bp, Homo sapiens
tacatcaggaaaaac

SEQ ID NO: 47059 - DNA, 15 bp, Homo sapiens
ctacatcaggaaaaa

SEQ ID NO: 47060 - DNA, 15 bp, Homo sapiens
actacatcaggaaaa

SEQ ID NO: 47061 - DNA, 15 bp, Homo sapiens
gactacatcaggaaa

SEQ ID NO: 47062 - DNA, 15 bp, Homo sapiens
ggactacatcaggaa

SEQ ID NO: 47063 - DNA, 15 bp, Homo sapiens
tggactacatcagga

SEQ ID NO: 47064 - DNA, 15 bp, Homo sapiens
atggactacatcagg

SEQ ID NO: 47065 - DNA, 15 bp, Homo sapiens
catggactacatcag

SEQ ID NO: 47066 - DNA, 15 bp, Homo sapiens
acatggactacatca

SEQ ID NO: 47067 - DNA, 15 bp, Homo sapiens
aacatggactacatc

SEQ ID NO: 47068 - DNA, 15 bp, Homo sapiens
aaacatggactacat

SEQ ID NO: 47069 - DNA, 15 bp, Homo sapiens
aaaacatggactaca

SEQ ID NO: 47070 - DNA, 15 bp, Homo sapiens
aaaaacatggactac

SEQ ID NO: 47071 - DNA, 15 bp, Homo sapiens
aaaaaacatggacta

SEQ ID NO: 47072 - DNA, 15 bp, Homo sapiens
taaaaaacatggact

SEQ ID NO: 47073 - DNA, 15 bp, Homo sapiens
ataaaaaacatggac

SEQ ID NO: 47074 - DNA, 15 bp, Homo sapiens
cataaaaaacatgga

SEQ ID NO: 47075 - DNA, 15 bp, Homo sapiens
gcataaaaaacatgg

SEQ ID NO: 47076 - DNA, 15 bp, Homo sapiens
agcataaaaaacatg

SEQ ID NO: 47077 - DNA, 15 bp, Homo sapiens
tagcataaaaaacat

SEQ ID NO: 47078 - DNA, 15 bp, Homo sapiens
atagcataaaaaaca

SEQ ID NO: 47079 - DNA, 15 bp, Homo sapiens
aatagcataaaaaac

SEQ ID NO: 47080 - DNA, 15 bp, Homo sapiens
gaatagcataaaaaa

SEQ ID NO: 47081 - DNA, 15 bp, Homo sapiens
agaatagcataaaaa

SEQ ID NO: 47082 - DNA, 15 bp, Homo sapiens
tagaatagcataaaa

SEQ ID NO: 47083 - DNA, 15 bp, Homo sapiens
ttagaatagcataaa

SEQ ID NO: 47084 - DNA, 15 bp, Homo sapiens
tttagaatagcataa

SEQ ID NO: 47085 - DNA, 15 bp, Homo sapiens
atttagaatagcata

SEQ ID NO: 47086 - DNA, 15 bp, Homo sapiens
catttagaatagcat

SEQ ID NO: 47087 - DNA, 15 bp, Homo sapiens
ccatttagaatagca

SEQ ID NO: 47088 - DNA, 15 bp, Homo sapiens
accatttagaatagc

SEQ ID NO: 47089 - DNA, 15 bp, Homo sapiens
taccatttagaatag

SEQ ID NO: 47090 - DNA, 15 bp, Homo sapiens
ataccatttagaata

SEQ ID NO: 47091 - DNA, 15 bp, Homo sapiens
gataccatttagaat

SEQ ID NO: 47092 - DNA, 15 bp, Homo sapiens
agataccatttagaa

SEQ ID NO: 47093 - DNA, 15 bp, Homo sapiens
aagataccatttaga

SEQ ID NO: 47094 - DNA, 15 bp, Homo sapiens
aaagataccatttag

SEQ ID NO: 47095 - DNA, 15 bp, Homo sapiens
caaagataccattta

SEQ ID NO: 47096 - DNA, 15 bp, Homo sapiens
tcaaagataccattt

SEQ ID NO: 47097 - DNA, 15 bp, Homo sapiens
atcaaagataccatt

SEQ ID NO: 47098 - DNA, 15 bp, Homo sapiens
aatcaaagataccat

SEQ ID NO: 47099 - DNA, 15 bp, Homo sapiens
aaatcaaagatacca

SEQ ID NO: 47100 - DNA, 15 bp, Homo sapiens
aaaatcaaagatacc

SEQ ID NO: 47101 - DNA, 15 bp, Homo sapiens
gaaaatcaaagatac

SEQ ID NO: 47102 - DNA, 15 bp, Homo sapiens
agaaaatcaaagata

SEQ ID NO: 47103 - DNA, 15 bp, Homo sapiens
tagaaaatcaaagat

SEQ ID NO: 47104 - DNA, 15 bp, Homo sapiens
ctagaaaatcaaaga

SEQ ID NO: 47105 - DNA, 15 bp, Homo sapiens
actagaaaatcaaag

SEQ ID NO: 47106 - DNA, 15 bp, Homo sapiens
aactagaaaatcaaa

SEQ ID NO: 47107 - DNA, 15 bp, Homo sapiens
gaactagaaaatcaa

SEQ ID NO: 47108 - DNA, 15 bp, Homo sapiens
tgaactagaaaatca

SEQ ID NO: 47109 - DNA, 15 bp, Homo sapiens
atgaactagaaaatc

SEQ ID NO: 47110 - DNA, 15 bp, Homo sapiens
gatgaactagaaaat

SEQ ID NO: 47111 - DNA, 15 bp, Homo sapiens
tgatgaactagaaaa

SEQ ID NO: 47112 - DNA, 15 bp, Homo sapiens
atgatgaactagaaa

SEQ ID NO: 47113 - DNA, 15 bp, Homo sapiens
catgatgaactagaa

SEQ ID NO: 47114 - DNA, 15 bp, Homo sapiens
tcatgatgaactaga

SEQ ID NO: 47115 - DNA, 15 bp, Homo sapiens
atcatgatgaactag

SEQ ID NO: 47116 - DNA, 15 bp, Homo sapiens
tatcatgatgaacta

SEQ ID NO: 47117 - DNA, 15 bp, Homo sapiens
atatcatgatgaact

SEQ ID NO: 47118 - DNA, 15 bp, Homo sapiens
aatatcatgatgaac

SEQ ID NO: 47119 - DNA, 15 bp, Homo sapiens
taatatcatgatgaa

SEQ ID NO: 47120 - DNA, 15 bp, Homo sapiens
ataatatcatgatga

SEQ ID NO: 47121 - DNA, 15 bp, Homo sapiens
tataatatcatgatg

SEQ ID NO: 47122 - DNA, 15 bp, Homo sapiens
gtataatatcatgat

SEQ ID NO: 47123 - DNA, 15 bp, Homo sapiens
tgtataatatcatga

SEQ ID NO: 47124 - DNA, 15 bp, Homo sapiens
ctgtataatatcatg

SEQ ID NO: 47125 - DNA, 15 bp, Homo sapiens
tctgtataatatcat

SEQ ID NO: 47126 - DNA, 15 bp, Homo sapiens
ttctgtataatatca

SEQ ID NO: 47127 - DNA, 15 bp, Homo sapiens
tttctgtataatatc

SEQ ID NO: 47128 - DNA, 15 bp, Homo sapiens
atttctgtataatat

SEQ ID NO: 47129 - DNA, 15 bp, Homo sapiens
catttctgtataata

SEQ ID NO: 47130 - DNA, 15 bp, Homo sapiens
gcatttctgtataat

SEQ ID NO: 47131 - DNA, 15 bp, Homo sapiens
tgcatttctgtataa

SEQ ID NO: 47132 - DNA, 15 bp, Homo sapiens
ttgcatttctgtata

SEQ ID NO: 47133 - DNA, 15 bp, Homo sapiens
attgcatttctgtat

SEQ ID NO: 47134 - DNA, 15 bp, Homo sapiens
aattgcatttctgta

SEQ ID NO: 47135 - DNA, 15 bp, Homo sapiens
caattgcatttctgt

SEQ ID NO: 47136 - DNA, 15 bp, Homo sapiens
tcaattgcatttctg

SEQ ID NO: 47137 - DNA, 15 bp, Homo sapiens
atcaattgcatttct

SEQ ID NO: 47138 - DNA, 15 bp, Homo sapiens
catcaattgcatttc

SEQ ID NO: 47139 - DNA, 15 bp, Homo sapiens
gcatcaattgcattt

SEQ ID NO: 47140 - DNA, 15 bp, Homo sapiens
agcatcaattgcatt

SEQ ID NO: 47141 - DNA, 15 bp, Homo sapiens
cagcatcaattgcat

SEQ ID NO: 47142 - DNA, 15 bp, Homo sapiens
ccagcatcaattgca

SEQ ID NO: 47143 - DNA, 15 bp, Homo sapiens
cccagcatcaattgc

SEQ ID NO: 47144 - DNA, 15 bp, Homo sapiens
gcccagcatcaattg

SEQ ID NO: 47145 - DNA, 15 bp, Homo sapiens
tgcccagcatcaatt

SEQ ID NO: 47146 - DNA, 15 bp, Homo sapiens
gtgcccagcatcaat

SEQ ID NO: 47147 - DNA, 15 bp, Homo sapiens
cgtgcccagcatcaa

SEQ ID NO: 47148 - DNA, 15 bp, Homo sapiens
ccgtgcccagcatca

SEQ ID NO: 47149 - DNA, 15 bp, Homo sapiens
accgtgcccagcatc

SEQ ID NO: 47150 - DNA, 15 bp, Homo sapiens
caccgtgcccagcat

SEQ ID NO: 47151 - DNA, 15 bp, Homo sapiens
ccaccgtgcccagca

SEQ ID NO: 47152 - DNA, 15 bp, Homo sapiens
cacaggcgtgagcca

SEQ ID NO: 47153 - DNA, 15 bp, Homo sapiens
tcacaggcgtgagcc

SEQ ID NO: 47154 - DNA, 15 bp, Homo sapiens
atcacaggcgtgagc

SEQ ID NO: 47155 - DNA, 15 bp, Homo sapiens
aatcacaggcgtgag

SEQ ID NO: 47156 - DNA, 15 bp, Homo sapiens
gaatcacaggcgtga

SEQ ID NO: 47157 - DNA, 15 bp, Homo sapiens
ggaatcacaggcgtg

SEQ ID NO: 47158 - DNA, 15 bp, Homo sapiens
tggaatcacaggcgt

SEQ ID NO: 47159 - DNA, 15 bp, Homo sapiens
ctggaatcacaggcg

SEQ ID NO: 47160 - DNA, 15 bp, Homo sapiens
gctggaatcacaggc

SEQ ID NO: 47161 - DNA, 15 bp, Homo sapiens
cgctggaatcacagg

SEQ ID NO: 47162 - DNA, 15 bp, Homo sapiens
gcgctggaatcacag

SEQ ID NO: 47163 - DNA, 15 bp, Homo sapiens
agcgctggaatcaca

SEQ ID NO: 47164 - DNA, 15 bp, Homo sapiens
aagcgctggaatcac

SEQ ID NO: 47165 - DNA, 15 bp, Homo sapiens
aaagcgctggaatca

SEQ ID NO: 47166 - DNA, 15 bp, Homo sapiens
caaagcgctggaatc

SEQ ID NO: 47167 - DNA, 15 bp, Homo sapiens
ccaaagcgctggaat

SEQ ID NO: 47168 - DNA, 15 bp, Homo sapiens
cccaaagcgctggaa

SEQ ID NO: 47169 - DNA, 15 bp, Homo sapiens
tcccaaagcgctgga

SEQ ID NO: 47170 - DNA, 15 bp, Homo sapiens
ttcccaaagcgctgg

SEQ ID NO: 47171 - DNA, 15 bp, Homo sapiens
cttcccaaagcgctg

SEQ ID NO: 47172 - DNA, 15 bp, Homo sapiens
gcttcccaaagcgct

SEQ ID NO: 47173 - DNA, 15 bp, Homo sapiens
agcttcccaaagcgc

SEQ ID NO: 47174 - DNA, 15 bp, Homo sapiens
tagcttcccaaagcg

SEQ ID NO: 47175 - DNA, 15 bp, Homo sapiens
ttagcttcccaaagc

SEQ ID NO: 47176 - DNA, 15 bp, Homo sapiens
cttagcttcccaaag

SEQ ID NO: 47177 - DNA, 15 bp, Homo sapiens
ccttagcttcccaaa

SEQ ID NO: 47178 - DNA, 15 bp, Homo sapiens
gccttagcttcccaa

SEQ ID NO: 47179 - DNA, 15 bp, Homo sapiens
cgccttagcttccca

SEQ ID NO: 47180 - DNA, 15 bp, Homo sapiens
ccgccttagcttccc

SEQ ID NO: 47181 - DNA, 15 bp, Homo sapiens
cccgccttagcttcc

SEQ ID NO: 47182 - DNA, 15 bp, Homo sapiens
gcccgccttagcttc

SEQ ID NO: 47183 - DNA, 15 bp, Homo sapiens
tgcccgccttagctt

SEQ ID NO: 47184 - DNA, 15 bp, Homo sapiens
ctgcccgccttagct

SEQ ID NO: 47185 - DNA, 15 bp, Homo sapiens
tctgcccgccttagc

SEQ ID NO: 47186 - DNA, 15 bp, Homo sapiens
atctgcccgccttag

SEQ ID NO: 47187 - DNA, 15 bp, Homo sapiens
gatctgcccgcctta

SEQ ID NO: 47188 - DNA, 15 bp, Homo sapiens
agtgatctgcccgcc

SEQ ID NO: 47189 - DNA, 15 bp, Homo sapiens
aagtgatctgcccgc

SEQ ID NO: 47190 - DNA, 15 bp, Homo sapiens
caagtgatctgcccg

SEQ ID NO: 47191 - DNA, 15 bp, Homo sapiens
cctcaagtgatctgc

SEQ ID NO: 47192 - DNA, 15 bp, Homo sapiens
gccatgttgcccagg

SEQ ID NO: 47193 - DNA, 15 bp, Homo sapiens
cgccatgttgcccag

SEQ ID NO: 47194 - DNA, 15 bp, Homo sapiens
tcgccatgttgccca

SEQ ID NO: 47195 - DNA, 15 bp, Homo sapiens
ttcgccatgttgccc

SEQ ID NO: 47196 - DNA, 15 bp, Homo sapiens
tttcgccatgttgcc

SEQ ID NO: 47197 - DNA, 15 bp, Homo sapiens
gtttcgccatgttgc

SEQ ID NO: 47198 - DNA, 15 bp, Homo sapiens
cggggtttcgccatg

SEQ ID NO: 47199 - DNA, 15 bp, Homo sapiens
acggggtttcgccat

SEQ ID NO: 47200 - DNA, 15 bp, Homo sapiens
gacggggtttcgcca

SEQ ID NO: 47201 - DNA, 15 bp, Homo sapiens
agacggggtttcgcc

SEQ ID NO: 47202 - DNA, 15 bp, Homo sapiens
gagacggggtttcgc

SEQ ID NO: 47203 - DNA, 15 bp, Homo sapiens
ctttttgtagagacg

SEQ ID NO: 47204 - DNA, 15 bp, Homo sapiens
actttttgtagagac

SEQ ID NO: 47205 - DNA, 15 bp, Homo sapiens
tactttttgtagaga

SEQ ID NO: 47206 - DNA, 15 bp, Homo sapiens
gtactttttgtagag

SEQ ID NO: 47207 - DNA, 15 bp, Homo sapiens
tgtactttttgtaga

SEQ ID NO: 47208 - DNA, 15 bp, Homo sapiens
ttgtactttttgtag

SEQ ID NO: 47209 - DNA, 15 bp, Homo sapiens
tttgtactttttgta

SEQ ID NO: 47210 - DNA, 15 bp, Homo sapiens
ttttgtactttttgt

SEQ ID NO: 47211 - DNA, 15 bp, Homo sapiens
tttttgtactttttg

SEQ ID NO: 47212 - DNA, 15 bp, Homo sapiens
atttttgtacttttt

SEQ ID NO: 47213 - DNA, 15 bp, Homo sapiens
aatttttgtactttt

SEQ ID NO: 47214 - DNA, 15 bp, Homo sapiens
taatttttgtacttt

SEQ ID NO: 47215 - DNA, 15 bp, Homo sapiens
ctaatttttgtactt

SEQ ID NO: 47216 - DNA, 15 bp, Homo sapiens
gctaatttttgtact

SEQ ID NO: 47217 - DNA, 15 bp, Homo sapiens
ggctaatttttgtac

SEQ ID NO: 47218 - DNA, 15 bp, Homo sapiens
tgcctggctaatttt

SEQ ID NO: 47219 - DNA, 15 bp, Homo sapiens
atgcctggctaattt

SEQ ID NO: 47220 - DNA, 15 bp, Homo sapiens
catgcctggctaatt

SEQ ID NO: 47221 - DNA, 15 bp, Homo sapiens
ccatgcctggctaat

SEQ ID NO: 47222 - DNA, 15 bp, Homo sapiens
accatgcctggctaa

SEQ ID NO: 47223 - DNA, 15 bp, Homo sapiens
caccatgcctggcta

SEQ ID NO: 47224 - DNA, 15 bp, Homo sapiens
ccaccatgcctggct

SEQ ID NO: 47225 - DNA, 15 bp, Homo sapiens
accaccatgcctggc

SEQ ID NO: 47226 - DNA, 15 bp, Homo sapiens
caccaccatgcctgg

SEQ ID NO: 47227 - DNA, 15 bp, Homo sapiens
gcaccaccatgcctg

SEQ ID NO: 47228 - DNA, 15 bp, Homo sapiens
tgcaccaccatgcct

SEQ ID NO: 47229 - DNA, 15 bp, Homo sapiens
atgcaccaccatgcc

SEQ ID NO: 47230 - DNA, 15 bp, Homo sapiens
catgcaccaccatgc

SEQ ID NO: 47231 - DNA, 15 bp, Homo sapiens
gcatgcaccaccatg

SEQ ID NO: 47232 - DNA, 15 bp, Homo sapiens
ggcatgcaccaccat

SEQ ID NO: 47233 - DNA, 15 bp, Homo sapiens
aggcatgcaccacca

SEQ ID NO: 47234 - DNA, 15 bp, Homo sapiens
caggcatgcaccacc

SEQ ID NO: 47235 - DNA, 15 bp, Homo sapiens
acaggcatgcaccac

SEQ ID NO: 47236 - DNA, 15 bp, Homo sapiens
tacaggcatgcacca

SEQ ID NO: 47237 - DNA, 15 bp, Homo sapiens
aactacaggcatgca

SEQ ID NO: 47238 - DNA, 15 bp, Homo sapiens
aaactacaggcatgc

SEQ ID NO: 47239 - DNA, 15 bp, Homo sapiens
caaactacaggcatg

SEQ ID NO: 47240 - DNA, 15 bp, Homo sapiens
tcaaactacaggcat

SEQ ID NO: 47241 - DNA, 15 bp, Homo sapiens
ctcaaactacaggca

SEQ ID NO: 47242 - DNA, 15 bp, Homo sapiens
gctcaaactacaggc

SEQ ID NO: 47243 - DNA, 15 bp, Homo sapiens
agctcaaactacagg

SEQ ID NO: 47244 - DNA, 15 bp, Homo sapiens
tagctcaaactacag

SEQ ID NO: 47245 - DNA, 15 bp, Homo sapiens
gtagctcaaactaca

SEQ ID NO: 47246 - DNA, 15 bp, Homo sapiens
agtagctcaaactac

SEQ ID NO: 47247 - DNA, 15 bp, Homo sapiens
gagtagctcaaacta

SEQ ID NO: 47248 - DNA, 15 bp, Homo sapiens
tgagtagctcaaact

SEQ ID NO: 47249 - DNA, 15 bp, Homo sapiens
ctgagtagctcaaac

SEQ ID NO: 47250 - DNA, 15 bp, Homo sapiens
cctgagtagctcaaa

SEQ ID NO: 47251 - DNA, 15 bp, Homo sapiens
tcctgagtagctcaa

SEQ ID NO: 47252 - DNA, 15 bp, Homo sapiens
ctcctgagtagctca

SEQ ID NO: 47253 - DNA, 15 bp, Homo sapiens
cctcctgagtagctc

SEQ ID NO: 47254 - DNA, 15 bp, Homo sapiens
gtcagcctcctgagt

SEQ ID NO: 47255 - DNA, 15 bp, Homo sapiens
ggtcagcctcctgag

SEQ ID NO: 47256 - DNA, 15 bp, Homo sapiens
gggtcagcctcctga

SEQ ID NO: 47257 - DNA, 15 bp, Homo sapiens
tgggtcagcctcctg

SEQ ID NO: 47258 - DNA, 15 bp, Homo sapiens
ctgggtcagcctcct

SEQ ID NO: 47259 - DNA, 15 bp, Homo sapiens
cctgggtcagcctcc

SEQ ID NO: 47260 - DNA, 15 bp, Homo sapiens
tcctgggtcagcctc

SEQ ID NO: 47261 - DNA, 15 bp, Homo sapiens
ctcctgggtcagcct

SEQ ID NO: 47262 - DNA, 15 bp, Homo sapiens
cctcctgggtcagcc

SEQ ID NO: 47263 - DNA, 15 bp, Homo sapiens
tcctcctgggtcagc

SEQ ID NO: 47264 - DNA, 15 bp, Homo sapiens
atcctcctgggtcag

SEQ ID NO: 47265 - DNA, 15 bp, Homo sapiens
tatcctcctgggtca

SEQ ID NO: 47266 - DNA, 15 bp, Homo sapiens
ctatcctcctgggtc

SEQ ID NO: 47267 - DNA, 15 bp, Homo sapiens
actatcctcctgggt

SEQ ID NO: 47268 - DNA, 15 bp, Homo sapiens
aactatcctcctggg

SEQ ID NO: 47269 - DNA, 15 bp, Homo sapiens
aaactatcctcctgg

SEQ ID NO: 47270 - DNA, 15 bp, Homo sapiens
caaactatcctcctg

SEQ ID NO: 47271 - DNA, 15 bp, Homo sapiens
tcaaactatcctcct

SEQ ID NO: 47272 - DNA, 15 bp, Homo sapiens
ctcaaactatcctcc

SEQ ID NO: 47273 - DNA, 15 bp, Homo sapiens
gctcaaactatcctc

SEQ ID NO: 47274 - DNA, 15 bp, Homo sapiens
ggctcaaactatcct

SEQ ID NO: 47275 - DNA, 15 bp, Homo sapiens
gggctcaaactatcc

SEQ ID NO: 47276 - DNA, 15 bp, Homo sapiens
tgggctcaaactatc

SEQ ID NO: 47277 - DNA, 15 bp, Homo sapiens
ctgggctcaaactat

SEQ ID NO: 47278 - DNA, 15 bp, Homo sapiens
cctgggctcaaacta

SEQ ID NO: 47279 - DNA, 15 bp, Homo sapiens
tcctgggctcaaact

SEQ ID NO: 47280 - DNA, 15 bp, Homo sapiens
gtcctgggctcaaac

SEQ ID NO: 47281 - DNA, 15 bp, Homo sapiens
cgtcctgggctcaaa

SEQ ID NO: 47282 - DNA, 15 bp, Homo sapiens
acgtcctgggctcaa

SEQ ID NO: 47283 - DNA, 15 bp, Homo sapiens
aacgtcctgggctca

SEQ ID NO: 47284 - DNA, 15 bp, Homo sapiens
caacgtcctgggctc

SEQ ID NO: 47285 - DNA, 15 bp, Homo sapiens
tcaacgtcctgggct

SEQ ID NO: 47286 - DNA, 15 bp, Homo sapiens
ctcaacgtcctgggc

SEQ ID NO: 47287 - DNA, 15 bp, Homo sapiens
cctcaacgtcctggg

SEQ ID NO: 47288 - DNA, 15 bp, Homo sapiens
gcctcaacgtcctgg

SEQ ID NO: 47289 - DNA, 15 bp, Homo sapiens
agcctcaacgtcctg

SEQ ID NO: 47290 - DNA, 15 bp, Homo sapiens
cagcctcaacgtcct

SEQ ID NO: 47291 - DNA, 15 bp, Homo sapiens
gcagcctcaacgtcc

SEQ ID NO: 47292 - DNA, 15 bp, Homo sapiens
tgcagcctcaacgtc

SEQ ID NO: 47293 - DNA, 15 bp, Homo sapiens
ctgcagcctcaacgt

SEQ ID NO: 47294 - DNA, 15 bp, Homo sapiens
actgcagcctcaacg

SEQ ID NO: 47295 - DNA, 15 bp, Homo sapiens
tcactgcagcctcaa

SEQ ID NO: 47296 - DNA, 15 bp, Homo sapiens
ctcactgcagcctca

SEQ ID NO: 47297 - DNA, 15 bp, Homo sapiens
gctcactgcagcctc

SEQ ID NO: 47298 - DNA, 15 bp, Homo sapiens
atcatggctcactgc

SEQ ID NO: 47299 - DNA, 15 bp, Homo sapiens
aatcatggctcactg

SEQ ID NO: 47300 - DNA, 15 bp, Homo sapiens
gaatcatggctcact

SEQ ID NO: 47301 - DNA, 15 bp, Homo sapiens
ggaatcatggctcac

SEQ ID NO: 47302 - DNA, 15 bp, Homo sapiens
tggaatcatggctca

SEQ ID NO: 47303 - DNA, 15 bp, Homo sapiens
gtggaatcatggctc

SEQ ID NO: 47304 - DNA, 15 bp, Homo sapiens
ggtggaatcatggct

SEQ ID NO: 47305 - DNA, 15 bp, Homo sapiens
tggtggaatcatggc

SEQ ID NO: 47306 - DNA, 15 bp, Homo sapiens
gtggtggaatcatgg

SEQ ID NO: 47307 - DNA, 15 bp, Homo sapiens
agtggtggaatcatg

SEQ ID NO: 47308 - DNA, 15 bp, Homo sapiens
cagtggtggaatcat

SEQ ID NO: 47309 - DNA, 15 bp, Homo sapiens
gcagtggtggaatca

SEQ ID NO: 47310 - DNA, 15 bp, Homo sapiens
tgcagtggtggaatc

SEQ ID NO: 47311 - DNA, 15 bp, Homo sapiens
gtgcagtggtggaat

SEQ ID NO: 47312 - DNA, 15 bp, Homo sapiens
agtgcagtggtggaa

SEQ ID NO: 47313 - DNA, 15 bp, Homo sapiens
gagtgcagtggtgga

SEQ ID NO: 47314 - DNA, 15 bp, Homo sapiens
ggagtgcagtggtgg

SEQ ID NO: 47315 - DNA, 15 bp, Homo sapiens
gggctggagtgcagt

SEQ ID NO: 47316 - DNA, 15 bp, Homo sapiens
cgggctggagtgcag

SEQ ID NO: 47317 - DNA, 15 bp, Homo sapiens
ccgggctggagtgca

SEQ ID NO: 47318 - DNA, 15 bp, Homo sapiens
cccgggctggagtgc

SEQ ID NO: 47319 - DNA, 15 bp, Homo sapiens
gcccgggctggagtg

SEQ ID NO: 47320 - DNA, 15 bp, Homo sapiens
tgcccgggctggagt

SEQ ID NO: 47321 - DNA, 15 bp, Homo sapiens
ttgcccgggctggag

SEQ ID NO: 47322 - DNA, 15 bp, Homo sapiens
gttgcccgggctgga

SEQ ID NO: 47323 - DNA, 15 bp, Homo sapiens
tgttgcccgggctgg

SEQ ID NO: 47324 - DNA, 15 bp, Homo sapiens
ctgttgcccgggctg

SEQ ID NO: 47325 - DNA, 15 bp, Homo sapiens
tctgttgcccgggct

SEQ ID NO: 47326 - DNA, 15 bp, Homo sapiens
ctctgttgcccgggc

SEQ ID NO: 47327 - DNA, 15 bp, Homo sapiens
cctctgttgcccggg

SEQ ID NO: 47328 - DNA, 15 bp, Homo sapiens
ccctctgttgcccgg

SEQ ID NO: 47329 - DNA, 15 bp, Homo sapiens
tccctctgttgcccg

SEQ ID NO: 47330 - DNA, 15 bp, Homo sapiens
ctccctctgttgccc

SEQ ID NO: 47331 - DNA, 15 bp, Homo sapiens
tctccctctgttgcc

SEQ ID NO: 47332 - DNA, 15 bp, Homo sapiens
gtctccctctgttgc

SEQ ID NO: 47333 - DNA, 15 bp, Homo sapiens
ggtctccctctgttg

SEQ ID NO: 47334 - DNA, 15 bp, Homo sapiens
aggtctccctctgtt

SEQ ID NO: 47335 - DNA, 15 bp, Homo sapiens
aaggtctccctctgt

SEQ ID NO: 47336 - DNA, 15 bp, Homo sapiens
caaggtctccctctg

SEQ ID NO: 47337 - DNA, 15 bp, Homo sapiens
gcaaggtctccctct

SEQ ID NO: 47338 - DNA, 15 bp, Homo sapiens
ggcaaggtctccctc

SEQ ID NO: 47339 - DNA, 15 bp, Homo sapiens
aggcaaggtctccct

SEQ ID NO: 47340 - DNA, 15 bp, Homo sapiens
gaggcaaggtctccc

SEQ ID NO: 47341 - DNA, 15 bp, Homo sapiens
tgaggcaaggtctcc

SEQ ID NO: 47342 - DNA, 15 bp, Homo sapiens
ttgaggcaaggtctc

SEQ ID NO: 47343 - DNA, 15 bp, Homo sapiens
tttgaggcaaggtct

SEQ ID NO: 47344 - DNA, 15 bp, Homo sapiens
ttttgaggcaaggtc

SEQ ID NO: 47345 - DNA, 15 bp, Homo sapiens
tttttgaggcaaggt

SEQ ID NO: 47346 - DNA, 15 bp, Homo sapiens
ttttttgaggcaagg

SEQ ID NO: 47347 - DNA, 15 bp, Homo sapiens
tttttttgaggcaag

SEQ ID NO: 47348 - DNA, 15 bp, Homo sapiens
ttttttttgaggcaa

SEQ ID NO: 47349 - DNA, 15 bp, Homo sapiens
tttttttttgaggca

SEQ ID NO: 47350 - DNA, 15 bp, Homo sapiens
ttttttttttgaggc

SEQ ID NO: 47351 - DNA, 15 bp, Homo sapiens
cgctttttttttttt

SEQ ID NO: 47352 - DNA, 15 bp, Homo sapiens
ccgcttttttttttt

SEQ ID NO: 47353 - DNA, 15 bp, Homo sapiens
accgctttttttttt

SEQ ID NO: 47354 - DNA, 15 bp, Homo sapiens
aaccgcttttttttt

SEQ ID NO: 47355 - DNA, 15 bp, Homo sapiens
caaccgctttttttt

SEQ ID NO: 47356 - DNA, 15 bp, Homo sapiens
tcaaccgcttttttt

SEQ ID NO: 47357 - DNA, 15 bp, Homo sapiens
ctcaaccgctttttt

SEQ ID NO: 47358 - DNA, 15 bp, Homo sapiens
actcaaccgcttttt

SEQ ID NO: 47359 - DNA, 15 bp, Homo sapiens
aactcaaccgctttt

SEQ ID NO: 47360 - DNA, 15 bp, Homo sapiens
aaactcaaccgcttt

SEQ ID NO: 47361 - DNA, 15 bp, Homo sapiens
aaaactcaaccgctt

SEQ ID NO: 47362 - DNA, 15 bp, Homo sapiens
caaaactcaaccgct

SEQ ID NO: 47363 - DNA, 15 bp, Homo sapiens
gcaaaactcaaccgc

SEQ ID NO: 47364 - DNA, 15 bp, Homo sapiens
tgcaaaactcaaccg

SEQ ID NO: 47365 - DNA, 15 bp, Homo sapiens
atgcaaaactcaacc

SEQ ID NO: 47366 - DNA, 15 bp, Homo sapiens
tatgcaaaactcaac

SEQ ID NO: 47367 - DNA, 15 bp, Homo sapiens
atatgcaaaactcaa

SEQ ID NO: 47368 - DNA, 15 bp, Homo sapiens
catatgcaaaactca

SEQ ID NO: 47369 - DNA, 15 bp, Homo sapiens
tcatatgcaaaactc

SEQ ID NO: 47370 - DNA, 15 bp, Homo sapiens
ttcatatgcaaaact

SEQ ID NO: 47371 - DNA, 15 bp, Homo sapiens
gttcatatgcaaaac

SEQ ID NO: 47372 - DNA, 15 bp, Homo sapiens
ggttcatatgcaaaa

SEQ ID NO: 47373 - DNA, 15 bp, Homo sapiens
cggttcatatgcaaa

SEQ ID NO: 47374 - DNA, 15 bp, Homo sapiens
acggttcatatgcaa

SEQ ID NO: 47375 - DNA, 15 bp, Homo sapiens
tacggttcatatgca

SEQ ID NO: 47376 - DNA, 15 bp, Homo sapiens
atacggttcatatgc

SEQ ID NO: 47377 - DNA, 15 bp, Homo sapiens
tatacggttcatatg

SEQ ID NO: 47378 - DNA, 15 bp, Homo sapiens
atatacggttcatat

SEQ ID NO: 47379 - DNA, 15 bp, Homo sapiens
aatatacggttcata

SEQ ID NO: 47380 - DNA, 15 bp, Homo sapiens
gaatatacggttcat

SEQ ID NO: 47381 - DNA, 15 bp, Homo sapiens
agaatatacggttca

SEQ ID NO: 47382 - DNA, 15 bp, Homo sapiens
cagaatatacggttc

SEQ ID NO: 47383 - DNA, 15 bp, Homo sapiens
acagaatatacggtt

SEQ ID NO: 47384 - DNA, 15 bp, Homo sapiens
cacagaatatacggt

SEQ ID NO: 47385 - DNA, 15 bp, Homo sapiens
tcacagaatatacgg

SEQ ID NO: 47386 - DNA, 15 bp, Homo sapiens
gtcacagaatatacg

SEQ ID NO: 47387 - DNA, 15 bp, Homo sapiens
ggtcacagaatatac

SEQ ID NO: 47388 - DNA, 15 bp, Homo sapiens
aggtcacagaatata

SEQ ID NO: 47389 - DNA, 15 bp, Homo sapiens
aaggtcacagaatat

SEQ ID NO: 47390 - DNA, 15 bp, Homo sapiens
caaggtcacagaata

SEQ ID NO: 47391 - DNA, 15 bp, Homo sapiens
acaaggtcacagaat

SEQ ID NO: 47392 - DNA, 15 bp, Homo sapiens
aacaaggtcacagaa

SEQ ID NO: 47393 - DNA, 15 bp, Homo sapiens
aaacaaggtcacaga

SEQ ID NO: 47394 - DNA, 15 bp, Homo sapiens
taaacaaggtcacag

SEQ ID NO: 47395 - DNA, 15 bp, Homo sapiens
ttaaacaaggtcaca

SEQ ID NO: 47396 - DNA, 15 bp, Homo sapiens
tttaaacaaggtcac

SEQ ID NO: 47397 - DNA, 15 bp, Homo sapiens
atttaaacaaggtca

SEQ ID NO: 47398 - DNA, 15 bp, Homo sapiens
aatttaaacaaggtc

SEQ ID NO: 47399 - DNA, 15 bp, Homo sapiens
gaatttaaacaaggt

SEQ ID NO: 47400 - DNA, 15 bp, Homo sapiens
agaatttaaacaagg

SEQ ID NO: 47401 - DNA, 15 bp, Homo sapiens
aagaatttaaacaag

SEQ ID NO: 47402 - DNA, 15 bp, Homo sapiens
aaagaatttaaacaa

SEQ ID NO: 47403 - DNA, 15 bp, Homo sapiens
aaaagaatttaaaca

SEQ ID NO: 47404 - DNA, 15 bp, Homo sapiens
aaaaagaatttaaac

SEQ ID NO: 47405 - DNA, 15 bp, Homo sapiens
aaaaaagaatttaaa

SEQ ID NO: 47406 - DNA, 15 bp, Homo sapiens
aaaaaaagaatttaa

SEQ ID NO: 47407 - DNA, 15 bp, Homo sapiens
aaaaaaaagaattta

SEQ ID NO: 47408 - DNA, 15 bp, Homo sapiens
aaaaaaaaagaattt

SEQ ID NO: 47409 - DNA, 15 bp, Homo sapiens
aaaaaaaaaagaatt

SEQ ID NO: 47410 - DNA, 15 bp, Homo sapiens
aaaaaaaaaaagaat

SEQ ID NO: 47411 - DNA, 15 bp, Homo sapiens
gaaaaaaaaaaaaga

SEQ ID NO: 47412 - DNA, 15 bp, Homo sapiens
agaaaaaaaaaaaag

SEQ ID NO: 47413 - DNA, 15 bp, Homo sapiens
aaaactccatctcaa

SEQ ID NO: 47414 - DNA, 15 bp, Homo sapiens
caaaactccatctca

SEQ ID NO: 47415 - DNA, 15 bp, Homo sapiens
gcaaaactccatctc

SEQ ID NO: 47416 - DNA, 15 bp, Homo sapiens
agcaaaactccatct

SEQ ID NO: 47417 - DNA, 15 bp, Homo sapiens
gagcaaaactccatc

SEQ ID NO: 47418 - DNA, 15 bp, Homo sapiens
agagcaaaactccat

SEQ ID NO: 47419 - DNA, 15 bp, Homo sapiens
aagagcaaaactcca

SEQ ID NO: 47420 - DNA, 15 bp, Homo sapiens
gcagcctgggcaaca

SEQ ID NO: 47421 - DNA, 15 bp, Homo sapiens
tgcagcctgggcaac

SEQ ID NO: 47422 - DNA, 15 bp, Homo sapiens
ctgcagcctgggcaa

SEQ ID NO: 47423 - DNA, 15 bp, Homo sapiens
actgcagcctgggca

SEQ ID NO: 47424 - DNA, 15 bp, Homo sapiens
cactgcagcctgggc

SEQ ID NO: 47425 - DNA, 15 bp, Homo sapiens
gcactgcagcctggg

SEQ ID NO: 47426 - DNA, 15 bp, Homo sapiens
tgcactgcagcctgg

SEQ ID NO: 47427 - DNA, 15 bp, Homo sapiens
ttgcactgcagcctg

SEQ ID NO: 47428 - DNA, 15 bp, Homo sapiens
attgcactgcagcct

SEQ ID NO: 47429 - DNA, 15 bp, Homo sapiens
cattgcactgcagcc

SEQ ID NO: 47430 - DNA, 15 bp, Homo sapiens
ccattgcactgcagc

SEQ ID NO: 47431 - DNA, 15 bp, Homo sapiens
gccattgcactgcag

SEQ ID NO: 47432 - DNA, 15 bp, Homo sapiens
cgccattgcactgca

SEQ ID NO: 47433 - DNA, 15 bp, Homo sapiens
gcgccattgcactgc

SEQ ID NO: 47434 - DNA, 15 bp, Homo sapiens
agcgccattgcactg

SEQ ID NO: 47435 - DNA, 15 bp, Homo sapiens
tagcgccattgcact

SEQ ID NO: 47436 - DNA, 15 bp, Homo sapiens
atagcgccattgcac

SEQ ID NO: 47437 - DNA, 15 bp, Homo sapiens
gatagcgccattgca

SEQ ID NO: 47438 - DNA, 15 bp, Homo sapiens
agatagcgccattgc

SEQ ID NO: 47439 - DNA, 15 bp, Homo sapiens
gagatagcgccattg

SEQ ID NO: 47440 - DNA, 15 bp, Homo sapiens
tgagatagcgccatt

SEQ ID NO: 47441 - DNA, 15 bp, Homo sapiens
ctgagatagcgccat

SEQ ID NO: 47442 - DNA, 15 bp, Homo sapiens
gctgagatagcgcca

SEQ ID NO: 47443 - DNA, 15 bp, Homo sapiens
agctgagatagcgcc

SEQ ID NO: 47444 - DNA, 15 bp, Homo sapiens
gagctgagatagcgc

SEQ ID NO: 47445 - DNA, 15 bp, Homo sapiens
tgagctgagatagcg

SEQ ID NO: 47446 - DNA, 15 bp, Homo sapiens
gtgagctgagatagc

SEQ ID NO: 47447 - DNA, 15 bp, Homo sapiens
agtgagctgagatag

SEQ ID NO: 47448 - DNA, 15 bp, Homo sapiens
cagtgagctgagata

SEQ ID NO: 47449 - DNA, 15 bp, Homo sapiens
taggaggcagaggtt

SEQ ID NO: 47450 - DNA, 15 bp, Homo sapiens
ctaggaggcagaggt

SEQ ID NO: 47451 - DNA, 15 bp, Homo sapiens
cctaggaggcagagg

SEQ ID NO: 47452 - DNA, 15 bp, Homo sapiens
acctaggaggcagag

SEQ ID NO: 47453 - DNA, 15 bp, Homo sapiens
aacctaggaggcaga

SEQ ID NO: 47454 - DNA, 15 bp, Homo sapiens
gaacctaggaggcag

SEQ ID NO: 47455 - DNA, 15 bp, Homo sapiens
tgaacctaggaggca

SEQ ID NO: 47456 - DNA, 15 bp, Homo sapiens
ttgaacctaggaggc

SEQ ID NO: 47457 - DNA, 15 bp, Homo sapiens
cttgaacctaggagg

SEQ ID NO: 47458 - DNA, 15 bp, Homo sapiens
acttgaacctaggag

SEQ ID NO: 47459 - DNA, 15 bp, Homo sapiens
cacttgaacctagga

SEQ ID NO: 47460 - DNA, 15 bp, Homo sapiens
tcacttgaacctagg

SEQ ID NO: 47461 - DNA, 15 bp, Homo sapiens
atcacttgaacctag

SEQ ID NO: 47462 - DNA, 15 bp, Homo sapiens
cagggagaggccggg

SEQ ID NO: 47463 - DNA, 15 bp, Homo sapiens
gcttttttttttttt

SEQ ID NO: 47464 - DNA, 15 bp, Homo sapiens
gcatgggtgacagag

SEQ ID NO: 47465 - DNA, 15 bp, Homo sapiens
agcatgggtgacaga

SEQ ID NO: 47466 - DNA, 15 bp, Homo sapiens
cagcatgggtgacag

SEQ ID NO: 47467 - DNA, 15 bp, Homo sapiens
ccagcatgggtgaca

SEQ ID NO: 47468 - DNA, 15 bp, Homo sapiens
tggtgaaaccccgtc

SEQ ID NO: 47469 - DNA, 15 bp, Homo sapiens
atggtgaaaccccgt

SEQ ID NO: 47470 - DNA, 15 bp, Homo sapiens
gatggtgaaaccccg

SEQ ID NO: 47471 - DNA, 15 bp, Homo sapiens
agatggtgaaacccc

SEQ ID NO: 47472 - DNA, 15 bp, Homo sapiens
tcaggagttcaagac

SEQ ID NO: 47473 - DNA, 15 bp, Homo sapiens
gtcaggagttcaaga

SEQ ID NO: 47474 - DNA, 15 bp, Homo sapiens
ggtcaggagttcaag

SEQ ID NO: 47475 - DNA, 15 bp, Homo sapiens
aggtcaggagttcaa

SEQ ID NO: 47476 - DNA, 15 bp, Homo sapiens
gaggtcaggagttca

SEQ ID NO: 47477 - DNA, 15 bp, Homo sapiens
cgaggtcaggagttc

SEQ ID NO: 47478 - DNA, 15 bp, Homo sapiens
acgaggtcaggagtt

SEQ ID NO: 47479 - DNA, 15 bp, Homo sapiens
cacgaggtcaggagt

SEQ ID NO: 47480 - DNA, 15 bp, Homo sapiens
ggatcacgaggtcag

SEQ ID NO: 47481 - DNA, 15 bp, Homo sapiens
tggatcacgaggtca

SEQ ID NO: 47482 - DNA, 15 bp, Homo sapiens
gtggatcacgaggtc

SEQ ID NO: 47483 - DNA, 15 bp, Homo sapiens
ggtggatcacgaggt

SEQ ID NO: 47484 - DNA, 15 bp, Homo sapiens
gggtggatcacgagg

SEQ ID NO: 47485 - DNA, 15 bp, Homo sapiens
aaaaaaaaaaaaaac

SEQ ID NO: 47486 - DNA, 15 bp, Homo sapiens
ttttaaaaaaaaaaa

SEQ ID NO: 47487 - DNA, 15 bp, Homo sapiens
tttttaaaaaaaaaa

SEQ ID NO: 47488 - DNA, 15 bp, Homo sapiens
ttttttaaaaaaaaa

SEQ ID NO: 47489 - DNA, 15 bp, Homo sapiens
tttttttaaaaaaaa

SEQ ID NO: 47490 - DNA, 15 bp, Homo sapiens
ttttttttaaaaaaa

SEQ ID NO: 47491 - DNA, 15 bp, Homo sapiens
tttttttttaaaaaa

SEQ ID NO: 47492 - DNA, 15 bp, Homo sapiens
ttttttttttaaaaa

SEQ ID NO: 47493 - DNA, 15 bp, Homo sapiens
tttttttttttaaaa

SEQ ID NO: 47494 - DNA, 15 bp, Homo sapiens
gcaggagtgcagtgg

SEQ ID NO: 47495 - DNA, 15 bp, Homo sapiens
ggcaggagtgcagtg

SEQ ID NO: 47496 - DNA, 15 bp, Homo sapiens
aggcaggagtgcagt

SEQ ID NO: 47497 - DNA, 15 bp, Homo sapiens
caggcaggagtgcag

SEQ ID NO: 47498 - DNA, 15 bp, Homo sapiens
ccaggcaggagtgca

SEQ ID NO: 47499 - DNA, 15 bp, Homo sapiens
cccaggcaggagtgc

SEQ ID NO: 47500 - DNA, 15 bp, Homo sapiens
agtctcactctgtca

SEQ ID NO: 47501 - DNA, 15 bp, Homo sapiens
aggaggtggaggttg

SEQ ID NO: 47502 - DNA, 15 bp, Homo sapiens
caggaggtggaggtt

SEQ ID NO: 47503 - DNA, 15 bp, Homo sapiens
ccaggaggtggaggt

SEQ ID NO: 47504 - DNA, 15 bp, Homo sapiens
cccaggaggtggagg

SEQ ID NO: 47505 - DNA, 15 bp, Homo sapiens
acccaggaggtggag

SEQ ID NO: 47506 - DNA, 15 bp, Homo sapiens
aacccaggaggtgga

SEQ ID NO: 47507 - DNA, 15 bp, Homo sapiens
gaacccaggaggtgg

SEQ ID NO: 47508 - DNA, 15 bp, Homo sapiens
tgaacccaggaggtg

SEQ ID NO: 47509 - DNA, 15 bp, Homo sapiens
ttgaacccaggaggt

SEQ ID NO: 47510 - DNA, 15 bp, Homo sapiens
gcgcctgtaatccca

SEQ ID NO: 47511 - DNA, 15 bp, Homo sapiens
ggcgcctgtaatccc

SEQ ID NO: 47512 - DNA, 15 bp, Homo sapiens
aggcgcctgtaatcc

SEQ ID NO: 47513 - DNA, 15 bp, Homo sapiens
caggcgcctgtaatc

SEQ ID NO: 47514 - DNA, 15 bp, Homo sapiens
gcaggcgcctgtaat

SEQ ID NO: 47515 - DNA, 15 bp, Homo sapiens
ggcaggcgcctgtaa

SEQ ID NO: 47516 - DNA, 15 bp, Homo sapiens
tggcaggcgcctgta

SEQ ID NO: 47517 - DNA, 15 bp, Homo sapiens
gtggcaggcgcctgt

SEQ ID NO: 47518 - DNA, 15 bp, Homo sapiens
cgcctgaggtcagga

SEQ ID NO: 47519 - DNA, 15 bp, Homo sapiens
tcgcctgaggtcagg

SEQ ID NO: 47520 - DNA, 15 bp, Homo sapiens
atcgcctgaggtcag

SEQ ID NO: 47521 - DNA, 15 bp, Homo sapiens
gatcgcctgaggtca

SEQ ID NO: 47522 - DNA, 15 bp, Homo sapiens
ggatcgcctgaggtc

SEQ ID NO: 47523 - DNA, 15 bp, Homo sapiens
tggatcgcctgaggt

SEQ ID NO: 47524 - DNA, 15 bp, Homo sapiens
gtggatcgcctgagg

SEQ ID NO: 47525 - DNA, 15 bp, Homo sapiens
ggtggatcgcctgag

SEQ ID NO: 47526 - DNA, 15 bp, Homo sapiens
caaggcaggtggatc

SEQ ID NO: 47527 - DNA, 15 bp, Homo sapiens
ccaaggcaggtggat

SEQ ID NO: 47528 - DNA, 15 bp, Homo sapiens
gccaaggcaggtgga

SEQ ID NO: 47529 - DNA, 15 bp, Homo sapiens
ggccaaggcaggtgg

SEQ ID NO: 47530 - DNA, 15 bp, Homo sapiens
aggccaaggcaggtg

SEQ ID NO: 47531 - DNA, 15 bp, Homo sapiens
gaggccaaggcaggt

SEQ ID NO: 47532 - DNA, 15 bp, Homo sapiens
caggctagtctcgaa

SEQ ID NO: 47533 - DNA, 15 bp, Homo sapiens
ccaggctagtctcga

SEQ ID NO: 47534 - DNA, 15 bp, Homo sapiens
gccaggctagtctcg

SEQ ID NO: 47535 - DNA, 15 bp, Homo sapiens
ggccaggctagtctc

SEQ ID NO: 47536 - DNA, 15 bp, Homo sapiens
tggccaggctagtct

SEQ ID NO: 47537 - DNA, 15 bp, Homo sapiens
ttggccaggctagtc

SEQ ID NO: 47538 - DNA, 15 bp, Homo sapiens
agtttcaccatgttg

SEQ ID NO: 47539 - DNA, 15 bp, Homo sapiens
gagtttcaccatgtt

SEQ ID NO: 47540 - DNA, 15 bp, Homo sapiens
ggagtttcaccatgt

SEQ ID NO: 47541 - DNA, 15 bp, Homo sapiens
cggagtttcaccatg

SEQ ID NO: 47542 - DNA, 15 bp, Homo sapiens
acggagtttcaccat

SEQ ID NO: 47543 - DNA, 15 bp, Homo sapiens
gacggagtttcacca

SEQ ID NO: 47544 - DNA, 15 bp, Homo sapiens
agacggagtttcacc

SEQ ID NO: 47545 - DNA, 15 bp, Homo sapiens
ggttcaggcgattct

SEQ ID NO: 47546 - DNA, 15 bp, Homo sapiens
aggcgtgagccaccg

SEQ ID NO: 47547 - DNA, 15 bp, Homo sapiens
gctaggattacaggc

SEQ ID NO: 47548 - DNA, 15 bp, Homo sapiens
acctcccaaagtgct

SEQ ID NO: 47549 - DNA, 15 bp, Homo sapiens
cacctcccaaagtgc

SEQ ID NO: 47550 - DNA, 15 bp, Homo sapiens
cgtgagccaccacgc

SEQ ID NO: 47551 - DNA, 15 bp, Homo sapiens
gcgtgagccaccacg

SEQ ID NO: 47552 - DNA, 15 bp, Homo sapiens
aggtgggaggatcac

SEQ ID NO: 47553 - DNA, 15 bp, Homo sapiens
gaggtgggaggatca

SEQ ID NO: 47554 - DNA, 15 bp, Homo sapiens
gaattgcttgaaccc

SEQ ID NO: 47555 - DNA, 15 bp, Homo sapiens
tgaactcctgacctc

SEQ ID NO: 47556 - DNA, 15 bp, Homo sapiens
ttgaactcctgacct

SEQ ID NO: 47557 - DNA, 15 bp, Homo sapiens
cttgaactcctgacc

SEQ ID NO: 47558 - DNA, 15 bp, Homo sapiens
tcttgaactcctgac

SEQ ID NO: 47559 - DNA, 15 bp, Homo sapiens
gtcttgaactcctga

SEQ ID NO: 47560 - DNA, 15 bp, Homo sapiens
gggttcaagcaattc

SEQ ID NO: 47561 - DNA, 15 bp, Homo sapiens
gtttttttttttttt

SEQ ID NO: 47562 - DNA, 15 bp, Homo sapiens
tcaaactcctgacct

SEQ ID NO: 47563 - DNA, 15 bp, Homo sapiens
ctcaaactcctgacc

SEQ ID NO: 47564 - DNA, 15 bp, Homo sapiens
cagcctcccaagtag

SEQ ID NO: 47565 - DNA, 15 bp, Homo sapiens
tcagcctcccaagta

SEQ ID NO: 47566 - DNA, 15 bp, Homo sapiens
ctcagcctcccaagt

SEQ ID NO: 47567 - DNA, 15 bp, Homo sapiens
ggcctcaaactcctg

SEQ ID NO: 47568 - DNA, 15 bp, Homo sapiens
tggcctcaaactcct

SEQ ID NO: 47569 - DNA, 15 bp, Homo sapiens
gactctgtctcaaaa

SEQ ID NO: 47570 - DNA, 15 bp, Homo sapiens
aggctgaggcgggag

SEQ ID NO: 47571 - DNA, 15 bp, Homo sapiens
gaggctgaggcggga

SEQ ID NO: 47572 - DNA, 15 bp, Homo sapiens
agctgggcatggtgg

SEQ ID NO: 47573 - DNA, 15 bp, Homo sapiens
tagctgggcatggtg

SEQ ID NO: 47574 - DNA, 15 bp, Homo sapiens
ttagctgggcatggt

SEQ ID NO: 47575 - DNA, 15 bp, Homo sapiens
cccggcactttggga

SEQ ID NO: 47576 - DNA, 15 bp, Homo sapiens
tcccggcactttggg

SEQ ID NO: 47577 - DNA, 15 bp, Homo sapiens
atcccggcactttgg

SEQ ID NO: 47578 - DNA, 15 bp, Homo sapiens
aatcccggcactttg

SEQ ID NO: 47579 - DNA, 15 bp, Homo sapiens
taatcccggcacttt

SEQ ID NO: 47580 - DNA, 15 bp, Homo sapiens
gtaatcccggcactt

SEQ ID NO: 47581 - DNA, 15 bp, Homo sapiens
tgtaatcccggcact

SEQ ID NO: 47582 - DNA, 15 bp, Homo sapiens
ccagcctgagcaaca

SEQ ID NO: 47583 - DNA, 15 bp, Homo sapiens
agtggctcacgcctg

SEQ ID NO: 47584 - DNA, 15 bp, Homo sapiens
cagtggctcacgcct

SEQ ID NO: 47585 - DNA, 15 bp, Homo sapiens
gcagtggctcacgcc

SEQ ID NO: 47586 - DNA, 15 bp, Homo sapiens
attgaggcatattga

SEQ ID NO: 47587 - DNA, 15 bp, Homo sapiens
tattgaggcatattg

SEQ ID NO: 47588 - DNA, 15 bp, Homo sapiens
atattgaggcatatt

SEQ ID NO: 47589 - DNA, 15 bp, Homo sapiens
aatattgaggcatat

SEQ ID NO: 47590 - DNA, 15 bp, Homo sapiens
caatattgaggcata

SEQ ID NO: 47591 - DNA, 15 bp, Homo sapiens
tcaatattgaggcat

SEQ ID NO: 47592 - DNA, 15 bp, Homo sapiens
ctcaatattgaggca

SEQ ID NO: 47593 - DNA, 15 bp, Homo sapiens
cctcaatattgaggc

SEQ ID NO: 47594 - DNA, 15 bp, Homo sapiens
gcctcaatattgagg

SEQ ID NO: 47595 - DNA, 15 bp, Homo sapiens
tgcctcaatattgag

SEQ ID NO: 47596 - DNA, 15 bp, Homo sapiens
atgcctcaatattga

SEQ ID NO: 47597 - DNA, 15 bp, Homo sapiens
tatgcctcaatattg

SEQ ID NO: 47598 - DNA, 15 bp, Homo sapiens
atatgcctcaatatt

SEQ ID NO: 47599 - DNA, 15 bp, Homo sapiens
aatatgcctcaatat

SEQ ID NO: 47600 - DNA, 15 bp, Homo sapiens
caatatgcctcaata

SEQ ID NO: 47601 - DNA, 15 bp, Homo sapiens
tcaatatgcctcaat

SEQ ID NO: 47602 - DNA, 15 bp, Homo sapiens
cattgcattccagcc

SEQ ID NO: 47603 - DNA, 15 bp, Homo sapiens
ccattgcattccagc

SEQ ID NO: 47604 - DNA, 15 bp, Homo sapiens
gccattgcattccag

SEQ ID NO: 47605 - DNA, 15 bp, Homo sapiens
tgccattgcattcca

SEQ ID NO: 47606 - DNA, 15 bp, Homo sapiens
gtgccattgcattcc

SEQ ID NO: 47607 - DNA, 15 bp, Homo sapiens
gaggttgaggctgca

SEQ ID NO: 47608 - DNA, 15 bp, Homo sapiens
ggaggttgaggctgc

SEQ ID NO: 47609 - DNA, 15 bp, Homo sapiens
ttgagcctgggagtt

SEQ ID NO: 47610 - DNA, 15 bp, Homo sapiens
cttgagcctgggagt

SEQ ID NO: 47611 - DNA, 15 bp, Homo sapiens
gcttgagcctgggag

SEQ ID NO: 47612 - DNA, 15 bp, Homo sapiens
tgatcgacccgcctc

SEQ ID NO: 47613 - DNA, 15 bp, Homo sapiens
gtgatcgacccgcct

SEQ ID NO: 47614 - DNA, 15 bp, Homo sapiens
ggtgatcgacccgcc

SEQ ID NO: 47615 - DNA, 15 bp, Homo sapiens
aggtgatcgacccgc

SEQ ID NO: 47616 - DNA, 15 bp, Homo sapiens
caggtgatcgacccg

SEQ ID NO: 47617 - DNA, 15 bp, Homo sapiens
tcaggtgatcgaccc

SEQ ID NO: 47618 - DNA, 15 bp, Homo sapiens
ctcaggtgatcgacc

SEQ ID NO: 47619 - DNA, 15 bp, Homo sapiens
cctcaggtgatcgac

SEQ ID NO: 47620 - DNA, 15 bp, Homo sapiens
acctcaggtgatcga

SEQ ID NO: 47621 - DNA, 15 bp, Homo sapiens
gacctcaggtgatcg

SEQ ID NO: 47622 - DNA, 15 bp, Homo sapiens
tcaggaagtccttat

SEQ ID NO: 47623 - DNA, 15 bp, Homo sapiens
tccccctccctccga

SEQ ID NO: 47624 - DNA, 15 bp, Homo sapiens
tcggagggaggggga

SEQ ID NO: 47625 - DNA, 15 bp, Homo sapiens
tgatcctcccacctc

SEQ ID NO: 47626 - DNA, 15 bp, Homo sapiens
gtgatcctcccacct

SEQ ID NO: 47627 - DNA, 15 bp, Homo sapiens
gcagcctcaacctcc

SEQ ID NO: 47628 - DNA, 15 bp, Homo sapiens
tgcagcctcaacctc

SEQ ID NO: 47629 - DNA, 15 bp, Homo sapiens
aggctcaagtgatcc

SEQ ID NO: 47630 - DNA, 15 bp, Homo sapiens
taggctcaagtgatc

SEQ ID NO: 47631 - DNA, 15 bp, Homo sapiens
aaaaaaaaaaagaga

SEQ ID NO: 47632 - DNA, 15 bp, Homo sapiens
acctcctgggctcaa

SEQ ID NO: 47633 - DNA, 15 bp, Homo sapiens
cgtgagccaccgcac

SEQ ID NO: 47634 - DNA, 15 bp, Homo sapiens
gcgtgagccaccgca

SEQ ID NO: 47635 - DNA, 15 bp, Homo sapiens
ggcgtgagccaccgc

SEQ ID NO: 47636 - DNA, 15 bp, Homo sapiens
actcactgcagcctc

SEQ ID NO: 47637 - DNA, 15 bp, Homo sapiens
gactcactgcagcct

SEQ ID NO: 47638 - DNA, 15 bp, Homo sapiens
ggtcttgctctgtca

SEQ ID NO: 47639 - DNA, 15 bp, Homo sapiens
gggtcttgctctgtc

SEQ ID NO: 47640 - DNA, 15 bp, Homo sapiens
agggtcttgctctgt

SEQ ID NO: 47641 - DNA, 15 bp, Homo sapiens
cagggtcttgctctg

SEQ ID NO: 47642 - DNA, 15 bp, Homo sapiens
acagggtcttgctct

SEQ ID NO: 47643 - DNA, 15 bp, Homo sapiens
ctacaggcatgcacc

SEQ ID NO: 47644 - DNA, 15 bp, Homo sapiens
actacaggcatgcac

SEQ ID NO: 47645 - DNA, 15 bp, Homo sapiens
cactgcagcctcaac

SEQ ID NO: 47646 - DNA, 15 bp, Homo sapiens
ggctcactgcagcct

SEQ ID NO: 47647 - DNA, 15 bp, Homo sapiens
tggctcactgcagcc

SEQ ID NO: 47648 - DNA, 15 bp, Homo sapiens
atggctcactgcagc

SEQ ID NO: 47649 - DNA, 15 bp, Homo sapiens
catggctcactgcag

SEQ ID NO: 47650 - DNA, 15 bp, Homo sapiens
tcatggctcactgca

SEQ ID NO: 47651 - DNA, 15 bp, Homo sapiens
tttttttttttgagg

SEQ ID NO: 47652 - DNA, 15 bp, Homo sapiens
aactccatctcaaaa

SEQ ID NO: 47653 - DNA, 15 bp, Homo sapiens
aaactccatctcaaa

SEQ ID NO: 47654 - DNA, 15 bp, Homo sapiens
ggagcctggtttcca

SEQ ID NO: 47655 - DNA, 15 bp, Homo sapiens
gagcctggtttccat

SEQ ID NO: 47656 - DNA, 15 bp, Homo sapiens
agcctggtttccatt

SEQ ID NO: 47657 - DNA, 15 bp, Homo sapiens
gcctggtttccattg

SEQ ID NO: 47658 - DNA, 15 bp, Homo sapiens
cctggtttccattgc

SEQ ID NO: 47659 - DNA, 15 bp, Homo sapiens
ctggtttccattgct

SEQ ID NO: 47660 - DNA, 15 bp, Homo sapiens
tggtttccattgcta

SEQ ID NO: 47661 - DNA, 15 bp, Homo sapiens
ggtttccattgctaa

SEQ ID NO: 47662 - DNA, 15 bp, Homo sapiens
gtttccattgctaat

SEQ ID NO: 47663 - DNA, 15 bp, Homo sapiens
tttccattgctaatg

SEQ ID NO: 47664 - DNA, 15 bp, Homo sapiens
ttccattgctaatgt

SEQ ID NO: 47665 - DNA, 15 bp, Homo sapiens
tccattgctaatgta

SEQ ID NO: 47666 - DNA, 15 bp, Homo sapiens
ccattgctaatgtac

SEQ ID NO: 47667 - DNA, 15 bp, Homo sapiens
cattgctaatgtacc

SEQ ID NO: 47668 - DNA, 15 bp, Homo sapiens
attgctaatgtacct

SEQ ID NO: 47669 - DNA, 15 bp, Homo sapiens
ttgctaatgtacctg

SEQ ID NO: 47670 - DNA, 15 bp, Homo sapiens
tgctaatgtacctgc

SEQ ID NO: 47671 - DNA, 15 bp, Homo sapiens
gctaatgtacctgct

SEQ ID NO: 47672 - DNA, 15 bp, Homo sapiens
ctaatgtacctgctt

SEQ ID NO: 47673 - DNA, 15 bp, Homo sapiens
taatgtacctgcttg

SEQ ID NO: 47674 - DNA, 15 bp, Homo sapiens
aatgtacctgcttgg

SEQ ID NO: 47675 - DNA, 15 bp, Homo sapiens
atgtacctgcttggg

SEQ ID NO: 47676 - DNA, 15 bp, Homo sapiens
tgtacctgcttggga

SEQ ID NO: 47677 - DNA, 15 bp, Homo sapiens
gtacctgcttgggac

SEQ ID NO: 47678 - DNA, 15 bp, Homo sapiens
tacctgcttgggact

SEQ ID NO: 47679 - DNA, 15 bp, Homo sapiens
acctgcttgggactc

SEQ ID NO: 47680 - DNA, 15 bp, Homo sapiens
cctgcttgggactct

SEQ ID NO: 47681 - DNA, 15 bp, Homo sapiens
ctgcttgggactctg

SEQ ID NO: 47682 - DNA, 15 bp, Homo sapiens
tgcttgggactctgc

SEQ ID NO: 47683 - DNA, 15 bp, Homo sapiens
gcttgggactctgca

SEQ ID NO: 47684 - DNA, 15 bp, Homo sapiens
cttgggactctgcat

SEQ ID NO: 47685 - DNA, 15 bp, Homo sapiens
ttgggactctgcatg

SEQ ID NO: 47686 - DNA, 15 bp, Homo sapiens
tgggactctgcatga

SEQ ID NO: 47687 - DNA, 15 bp, Homo sapiens
gggactctgcatgat

SEQ ID NO: 47688 - DNA, 15 bp, Homo sapiens
ggactctgcatgata

SEQ ID NO: 47689 - DNA, 15 bp, Homo sapiens
gactctgcatgataa

SEQ ID NO: 47690 - DNA, 15 bp, Homo sapiens
actctgcatgataaa

SEQ ID NO: 47691 - DNA, 15 bp, Homo sapiens
ctctgcatgataaat

SEQ ID NO: 47692 - DNA, 15 bp, Homo sapiens
tctgcatgataaatg

SEQ ID NO: 47693 - DNA, 15 bp, Homo sapiens
ctgcatgataaatga

SEQ ID NO: 47694 - DNA, 15 bp, Homo sapiens
tgcatgataaatgac

SEQ ID NO: 47695 - DNA, 15 bp, Homo sapiens
gcatgataaatgacg

SEQ ID NO: 47696 - DNA, 15 bp, Homo sapiens
catgataaatgacgt

SEQ ID NO: 47697 - DNA, 15 bp, Homo sapiens
atgataaatgacgtg

SEQ ID NO: 47698 - DNA, 15 bp, Homo sapiens
tgataaatgacgtgt

SEQ ID NO: 47699 - DNA, 15 bp, Homo sapiens
gataaatgacgtgtc

SEQ ID NO: 47700 - DNA, 15 bp, Homo sapiens
ataaatgacgtgtcc

SEQ ID NO: 47701 - DNA, 15 bp, Homo sapiens
taaatgacgtgtcct

SEQ ID NO: 47702 - DNA, 15 bp, Homo sapiens
aaatgacgtgtcctg

SEQ ID NO: 47703 - DNA, 15 bp, Homo sapiens
aatgacgtgtcctgg

SEQ ID NO: 47704 - DNA, 15 bp, Homo sapiens
atgacgtgtcctgga

SEQ ID NO: 47705 - DNA, 15 bp, Homo sapiens
tgacgtgtcctggaa

SEQ ID NO: 47706 - DNA, 15 bp, Homo sapiens
gacgtgtcctggaac

SEQ ID NO: 47707 - DNA, 15 bp, Homo sapiens
acgtgtcctggaacc

SEQ ID NO: 47708 - DNA, 15 bp, Homo sapiens
cgtgtcctggaacct

SEQ ID NO: 47709 - DNA, 15 bp, Homo sapiens
gtgtcctggaacctg

SEQ ID NO: 47710 - DNA, 15 bp, Homo sapiens
tgtcctggaacctga

SEQ ID NO: 47711 - DNA, 15 bp, Homo sapiens
gtcctggaacctgaa

SEQ ID NO: 47712 - DNA, 15 bp, Homo sapiens
tcctggaacctgaaa

SEQ ID NO: 47713 - DNA, 15 bp, Homo sapiens
cctggaacctgaaat

SEQ ID NO: 47714 - DNA, 15 bp, Homo sapiens
ctggaacctgaaatc

SEQ ID NO: 47715 - DNA, 15 bp, Homo sapiens
tggaacctgaaatct

SEQ ID NO: 47716 - DNA, 15 bp, Homo sapiens
ggaacctgaaatctt

SEQ ID NO: 47717 - DNA, 15 bp, Homo sapiens
gaacctgaaatcttt

SEQ ID NO: 47718 - DNA, 15 bp, Homo sapiens
aacctgaaatctttt

SEQ ID NO: 47719 - DNA, 15 bp, Homo sapiens
acctgaaatctttta

SEQ ID NO: 47720 - DNA, 15 bp, Homo sapiens
cctgaaatcttttat

SEQ ID NO: 47721 - DNA, 15 bp, Homo sapiens
ctgaaatcttttata

SEQ ID NO: 47722 - DNA, 15 bp, Homo sapiens
tgaaatcttttataa

SEQ ID NO: 47723 - DNA, 15 bp, Homo sapiens
gaaatcttttataaa

SEQ ID NO: 47724 - DNA, 15 bp, Homo sapiens
aaatcttttataaag

SEQ ID NO: 47725 - DNA, 15 bp, Homo sapiens
aatcttttataaagg

SEQ ID NO: 47726 - DNA, 15 bp, Homo sapiens
atcttttataaaggt

SEQ ID NO: 47727 - DNA, 15 bp, Homo sapiens
tcttttataaaggtt

SEQ ID NO: 47728 - DNA, 15 bp, Homo sapiens
cttttataaaggtta

SEQ ID NO: 47729 - DNA, 15 bp, Homo sapiens
ttttataaaggttaa

SEQ ID NO: 47730 - DNA, 15 bp, Homo sapiens
tttataaaggttaat

SEQ ID NO: 47731 - DNA, 15 bp, Homo sapiens
ttataaaggttaata

SEQ ID NO: 47732 - DNA, 15 bp, Homo sapiens
tataaaggttaatat

SEQ ID NO: 47733 - DNA, 15 bp, Homo sapiens
ataaaggttaatatc

SEQ ID NO: 47734 - DNA, 15 bp, Homo sapiens
taaaggttaatatca

SEQ ID NO: 47735 - DNA, 15 bp, Homo sapiens
aaaggttaatatcag

SEQ ID NO: 47736 - DNA, 15 bp, Homo sapiens
aaggttaatatcagc

SEQ ID NO: 47737 - DNA, 15 bp, Homo sapiens
aggttaatatcagca

SEQ ID NO: 47738 - DNA, 15 bp, Homo sapiens
ggttaatatcagcag

SEQ ID NO: 47739 - DNA, 15 bp, Homo sapiens
gttaatatcagcaga

SEQ ID NO: 47740 - DNA, 15 bp, Homo sapiens
ttaatatcagcagaa

SEQ ID NO: 47741 - DNA, 15 bp, Homo sapiens
taatatcagcagaaa

SEQ ID NO: 47742 - DNA, 15 bp, Homo sapiens
aatatcagcagaaat

SEQ ID NO: 47743 - DNA, 15 bp, Homo sapiens
atatcagcagaaatc

SEQ ID NO: 47744 - DNA, 15 bp, Homo sapiens
tatcagcagaaatct

SEQ ID NO: 47745 - DNA, 15 bp, Homo sapiens
atcagcagaaatctt

SEQ ID NO: 47746 - DNA, 15 bp, Homo sapiens
tcagcagaaatcttt

SEQ ID NO: 47747 - DNA, 15 bp, Homo sapiens
cagcagaaatctttt

SEQ ID NO: 47748 - DNA, 15 bp, Homo sapiens
agcagaaatctttta

SEQ ID NO: 47749 - DNA, 15 bp, Homo sapiens
gcagaaatcttttaa

SEQ ID NO: 47750 - DNA, 15 bp, Homo sapiens
cagaaatcttttaat

SEQ ID NO: 47751 - DNA, 15 bp, Homo sapiens
agaaatcttttaatt

SEQ ID NO: 47752 - DNA, 15 bp, Homo sapiens
gaaatcttttaatta

SEQ ID NO: 47753 - DNA, 15 bp, Homo sapiens
aaatcttttaattag

SEQ ID NO: 47754 - DNA, 15 bp, Homo sapiens
aatcttttaattagc

SEQ ID NO: 47755 - DNA, 15 bp, Homo sapiens
atcttttaattagct

SEQ ID NO: 47756 - DNA, 15 bp, Homo sapiens
tcttttaattagcta

SEQ ID NO: 47757 - DNA, 15 bp, Homo sapiens
cttttaattagctaa

SEQ ID NO: 47758 - DNA, 15 bp, Homo sapiens
ttttaattagctaag

SEQ ID NO: 47759 - DNA, 15 bp, Homo sapiens
tttaattagctaaga

SEQ ID NO: 47760 - DNA, 15 bp, Homo sapiens
ttaattagctaagag

SEQ ID NO: 47761 - DNA, 15 bp, Homo sapiens
taattagctaagagc

SEQ ID NO: 47762 - DNA, 15 bp, Homo sapiens
aattagctaagagca

SEQ ID NO: 47763 - DNA, 15 bp, Homo sapiens
attagctaagagcag

SEQ ID NO: 47764 - DNA, 15 bp, Homo sapiens
ttagctaagagcagc

SEQ ID NO: 47765 - DNA, 15 bp, Homo sapiens
tagctaagagcagct

SEQ ID NO: 47766 - DNA, 15 bp, Homo sapiens
agctaagagcagctt

SEQ ID NO: 47767 - DNA, 15 bp, Homo sapiens
gctaagagcagcttg

SEQ ID NO: 47768 - DNA, 15 bp, Homo sapiens
ctaagagcagcttgt

SEQ ID NO: 47769 - DNA, 15 bp, Homo sapiens
taagagcagcttgtt

SEQ ID NO: 47770 - DNA, 15 bp, Homo sapiens
aagagcagcttgttc

SEQ ID NO: 47771 - DNA, 15 bp, Homo sapiens
agagcagcttgttct

SEQ ID NO: 47772 - DNA, 15 bp, Homo sapiens
gagcagcttgttctc

SEQ ID NO: 47773 - DNA, 15 bp, Homo sapiens
agcagcttgttctca

SEQ ID NO: 47774 - DNA, 15 bp, Homo sapiens
gcagcttgttctcaa

SEQ ID NO: 47775 - DNA, 15 bp, Homo sapiens
cagcttgttctcaag

SEQ ID NO: 47776 - DNA, 15 bp, Homo sapiens
agcttgttctcaagc

SEQ ID NO: 47777 - DNA, 15 bp, Homo sapiens
gcttgttctcaagct

SEQ ID NO: 47778 - DNA, 15 bp, Homo sapiens
cttgttctcaagctg

SEQ ID NO: 47779 - DNA, 15 bp, Homo sapiens
ttgttctcaagctgc

SEQ ID NO: 47780 - DNA, 15 bp, Homo sapiens
tgttctcaagctgcc

SEQ ID NO: 47781 - DNA, 15 bp, Homo sapiens
gttctcaagctgccc

SEQ ID NO: 47782 - DNA, 15 bp, Homo sapiens
ttctcaagctgcccg

SEQ ID NO: 47783 - DNA, 15 bp, Homo sapiens
tctcaagctgcccga

SEQ ID NO: 47784 - DNA, 15 bp, Homo sapiens
ctcaagctgcccgag

SEQ ID NO: 47785 - DNA, 15 bp, Homo sapiens
tcaagctgcccgagt

SEQ ID NO: 47786 - DNA, 15 bp, Homo sapiens
caagctgcccgagtt

SEQ ID NO: 47787 - DNA, 15 bp, Homo sapiens
aagctgcccgagtta

SEQ ID NO: 47788 - DNA, 15 bp, Homo sapiens
agctgcccgagttat

SEQ ID NO: 47789 - DNA, 15 bp, Homo sapiens
gctgcccgagttatc

SEQ ID NO: 47790 - DNA, 15 bp, Homo sapiens
ctgcccgagttatct

SEQ ID NO: 47791 - DNA, 15 bp, Homo sapiens
tgcccgagttatctt

SEQ ID NO: 47792 - DNA, 15 bp, Homo sapiens
gcccgagttatcttg

SEQ ID NO: 47793 - DNA, 15 bp, Homo sapiens
cccgagttatcttgg

SEQ ID NO: 47794 - DNA, 15 bp, Homo sapiens
ccgagttatcttgga

SEQ ID NO: 47795 - DNA, 15 bp, Homo sapiens
cgagttatcttggag

SEQ ID NO: 47796 - DNA, 15 bp, Homo sapiens
gagttatcttggagg

SEQ ID NO: 47797 - DNA, 15 bp, Homo sapiens
agttatcttggagga

SEQ ID NO: 47798 - DNA, 15 bp, Homo sapiens
gttatcttggaggag

SEQ ID NO: 47799 - DNA, 15 bp, Homo sapiens
ttatcttggaggaga

SEQ ID NO: 47800 - DNA, 15 bp, Homo sapiens
tatcttggaggagag

SEQ ID NO: 47801 - DNA, 15 bp, Homo sapiens
atcttggaggagaga

SEQ ID NO: 47802 - DNA, 15 bp, Homo sapiens
tcttggaggagagaa

SEQ ID NO: 47803 - DNA, 15 bp, Homo sapiens
cttggaggagagaat

SEQ ID NO: 47804 - DNA, 15 bp, Homo sapiens
ttggaggagagaatc

SEQ ID NO: 47805 - DNA, 15 bp, Homo sapiens
tggaggagagaatca

SEQ ID NO: 47806 - DNA, 15 bp, Homo sapiens
ggaggagagaatcac

SEQ ID NO: 47807 - DNA, 15 bp, Homo sapiens
gaggagagaatcaca

SEQ ID NO: 47808 - DNA, 15 bp, Homo sapiens
aggagagaatcacag

SEQ ID NO: 47809 - DNA, 15 bp, Homo sapiens
ggagagaatcacagg

SEQ ID NO: 47810 - DNA, 15 bp, Homo sapiens
gagagaatcacagga

SEQ ID NO: 47811 - DNA, 15 bp, Homo sapiens
agagaatcacaggaa

SEQ ID NO: 47812 - DNA, 15 bp, Homo sapiens
gagaatcacaggaaa

SEQ ID NO: 47813 - DNA, 15 bp, Homo sapiens
agaatcacaggaaat

SEQ ID NO: 47814 - DNA, 15 bp, Homo sapiens
gaatcacaggaaatg

SEQ ID NO: 47815 - DNA, 15 bp, Homo sapiens
aatcacaggaaatgt

SEQ ID NO: 47816 - DNA, 15 bp, Homo sapiens
atcacaggaaatgtt

SEQ ID NO: 47817 - DNA, 15 bp, Homo sapiens
tcacaggaaatgttt

SEQ ID NO: 47818 - DNA, 15 bp, Homo sapiens
cacaggaaatgtttg

SEQ ID NO: 47819 - DNA, 15 bp, Homo sapiens
acaggaaatgtttga

SEQ ID NO: 47820 - DNA, 15 bp, Homo sapiens
caggaaatgtttgat

SEQ ID NO: 47821 - DNA, 15 bp, Homo sapiens
aggaaatgtttgata

SEQ ID NO: 47822 - DNA, 15 bp, Homo sapiens
ggaaatgtttgatat

SEQ ID NO: 47823 - DNA, 15 bp, Homo sapiens
gaaatgtttgatatt

SEQ ID NO: 47824 - DNA, 15 bp, Homo sapiens
aaatgtttgatattt

SEQ ID NO: 47825 - DNA, 15 bp, Homo sapiens
aatgtttgatatttc

SEQ ID NO: 47826 - DNA, 15 bp, Homo sapiens
atgtttgatatttct

SEQ ID NO: 47827 - DNA, 15 bp, Homo sapiens
tgtttgatatttcta

SEQ ID NO: 47828 - DNA, 15 bp, Homo sapiens
gtttgatatttctag

SEQ ID NO: 47829 - DNA, 15 bp, Homo sapiens
tttgatatttctagt

SEQ ID NO: 47830 - DNA, 15 bp, Homo sapiens
ttgatatttctagta

SEQ ID NO: 47831 - DNA, 15 bp, Homo sapiens
tgatatttctagtaa

SEQ ID NO: 47832 - DNA, 15 bp, Homo sapiens
gatatttctagtaac

SEQ ID NO: 47833 - DNA, 15 bp, Homo sapiens
atatttctagtaacc

SEQ ID NO: 47834 - DNA, 15 bp, Homo sapiens
tatttctagtaacca

SEQ ID NO: 47835 - DNA, 15 bp, Homo sapiens
atttctagtaaccag

SEQ ID NO: 47836 - DNA, 15 bp, Homo sapiens
tttctagtaaccagt

SEQ ID NO: 47837 - DNA, 15 bp, Homo sapiens
ttctagtaaccagtg

SEQ ID NO: 47838 - DNA, 15 bp, Homo sapiens
tctagtaaccagtgt

SEQ ID NO: 47839 - DNA, 15 bp, Homo sapiens
ctagtaaccagtgtt

SEQ ID NO: 47840 - DNA, 15 bp, Homo sapiens
tagtaaccagtgttt

SEQ ID NO: 47841 - DNA, 15 bp, Homo sapiens
agtaaccagtgtttt

SEQ ID NO: 47842 - DNA, 15 bp, Homo sapiens
gtaaccagtgttttc

SEQ ID NO: 47843 - DNA, 15 bp, Homo sapiens
taaccagtgttttca

SEQ ID NO: 47844 - DNA, 15 bp, Homo sapiens
aaccagtgttttcag

SEQ ID NO: 47845 - DNA, 15 bp, Homo sapiens
accagtgttttcagt

SEQ ID NO: 47846 - DNA, 15 bp, Homo sapiens
ccagtgttttcagtg

SEQ ID NO: 47847 - DNA, 15 bp, Homo sapiens
cagtgttttcagtgc

SEQ ID NO: 47848 - DNA, 15 bp, Homo sapiens
agtgttttcagtgcg

SEQ ID NO: 47849 - DNA, 15 bp, Homo sapiens
gtgttttcagtgcgt

SEQ ID NO: 47850 - DNA, 15 bp, Homo sapiens
tgttttcagtgcgtg

SEQ ID NO: 47851 - DNA, 15 bp, Homo sapiens
gttttcagtgcgtgg

SEQ ID NO: 47852 - DNA, 15 bp, Homo sapiens
ttttcagtgcgtggg

SEQ ID NO: 47853 - DNA, 15 bp, Homo sapiens
tttcagtgcgtgggg

SEQ ID NO: 47854 - DNA, 15 bp, Homo sapiens
ttcagtgcgtggggt

SEQ ID NO: 47855 - DNA, 15 bp, Homo sapiens
tcagtgcgtggggta

SEQ ID NO: 47856 - DNA, 15 bp, Homo sapiens
cagtgcgtggggtaa

SEQ ID NO: 47857 - DNA, 15 bp, Homo sapiens
agtgcgtggggtaaa

SEQ ID NO: 47858 - DNA, 15 bp, Homo sapiens
gtgcgtggggtaaag

SEQ ID NO: 47859 - DNA, 15 bp, Homo sapiens
tgcgtggggtaaagc

SEQ ID NO: 47860 - DNA, 15 bp, Homo sapiens
gcgtggggtaaagca

SEQ ID NO: 47861 - DNA, 15 bp, Homo sapiens
cgtggggtaaagcac

SEQ ID NO: 47862 - DNA, 15 bp, Homo sapiens
gtggggtaaagcaca

SEQ ID NO: 47863 - DNA, 15 bp, Homo sapiens
tggggtaaagcacac

SEQ ID NO: 47864 - DNA, 15 bp, Homo sapiens
ggggtaaagcacact

SEQ ID NO: 47865 - DNA, 15 bp, Homo sapiens
gggtaaagcacactc

SEQ ID NO: 47866 - DNA, 15 bp, Homo sapiens
ggtaaagcacactcc

SEQ ID NO: 47867 - DNA, 15 bp, Homo sapiens
gtaaagcacactcct

SEQ ID NO: 47868 - DNA, 15 bp, Homo sapiens
taaagcacactccta

SEQ ID NO: 47869 - DNA, 15 bp, Homo sapiens
aaagcacactcctag

SEQ ID NO: 47870 - DNA, 15 bp, Homo sapiens
aagcacactcctaga

SEQ ID NO: 47871 - DNA, 15 bp, Homo sapiens
agcacactcctagac

SEQ ID NO: 47872 - DNA, 15 bp, Homo sapiens
gcacactcctagact

SEQ ID NO: 47873 - DNA, 15 bp, Homo sapiens
cacactcctagactg

SEQ ID NO: 47874 - DNA, 15 bp, Homo sapiens
acactcctagactgg

SEQ ID NO: 47875 - DNA, 15 bp, Homo sapiens
cactcctagactggc

SEQ ID NO: 47876 - DNA, 15 bp, Homo sapiens
actcctagactggcc

SEQ ID NO: 47877 - DNA, 15 bp, Homo sapiens
ctcctagactggcca

SEQ ID NO: 47878 - DNA, 15 bp, Homo sapiens
tcctagactggccag

SEQ ID NO: 47879 - DNA, 15 bp, Homo sapiens
cctagactggccagt

SEQ ID NO: 47880 - DNA, 15 bp, Homo sapiens
ctagactggccagtc

SEQ ID NO: 47881 - DNA, 15 bp, Homo sapiens
tagactggccagtcc

SEQ ID NO: 47882 - DNA, 15 bp, Homo sapiens
agactggccagtccc

SEQ ID NO: 47883 - DNA, 15 bp, Homo sapiens
gactggccagtccca

SEQ ID NO: 47884 - DNA, 15 bp, Homo sapiens
actggccagtcccaa

SEQ ID NO: 47885 - DNA, 15 bp, Homo sapiens
ctggccagtcccaaa

SEQ ID NO: 47886 - DNA, 15 bp, Homo sapiens
tggccagtcccaaag

SEQ ID NO: 47887 - DNA, 15 bp, Homo sapiens
ggccagtcccaaaga

SEQ ID NO: 47888 - DNA, 15 bp, Homo sapiens
gccagtcccaaagag

SEQ ID NO: 47889 - DNA, 15 bp, Homo sapiens
ccagtcccaaagagt

SEQ ID NO: 47890 - DNA, 15 bp, Homo sapiens
cagtcccaaagagtg

SEQ ID NO: 47891 - DNA, 15 bp, Homo sapiens
agtcccaaagagtgt

SEQ ID NO: 47892 - DNA, 15 bp, Homo sapiens
gtcccaaagagtgtg

SEQ ID NO: 47893 - DNA, 15 bp, Homo sapiens
tcccaaagagtgtgg

SEQ ID NO: 47894 - DNA, 15 bp, Homo sapiens
cccaaagagtgtggc

SEQ ID NO: 47895 - DNA, 15 bp, Homo sapiens
ccaaagagtgtggca

SEQ ID NO: 47896 - DNA, 15 bp, Homo sapiens
caaagagtgtggcag

SEQ ID NO: 47897 - DNA, 15 bp, Homo sapiens
aaagagtgtggcagg

SEQ ID NO: 47898 - DNA, 15 bp, Homo sapiens
aagagtgtggcagga

SEQ ID NO: 47899 - DNA, 15 bp, Homo sapiens
agagtgtggcaggac

SEQ ID NO: 47900 - DNA, 15 bp, Homo sapiens
gagtgtggcaggaca

SEQ ID NO: 47901 - DNA, 15 bp, Homo sapiens
agtgtggcaggacac

SEQ ID NO: 47902 - DNA, 15 bp, Homo sapiens
gtgtggcaggacacc

SEQ ID NO: 47903 - DNA, 15 bp, Homo sapiens
tgtggcaggacacct

SEQ ID NO: 47904 - DNA, 15 bp, Homo sapiens
gtggcaggacacctg

SEQ ID NO: 47905 - DNA, 15 bp, Homo sapiens
tggcaggacacctgc

SEQ ID NO: 47906 - DNA, 15 bp, Homo sapiens
ggcaggacacctgct

SEQ ID NO: 47907 - DNA, 15 bp, Homo sapiens
gcaggacacctgctt

SEQ ID NO: 47908 - DNA, 15 bp, Homo sapiens
caggacacctgcttg

SEQ ID NO: 47909 - DNA, 15 bp, Homo sapiens
aggacacctgcttgt

SEQ ID NO: 47910 - DNA, 15 bp, Homo sapiens
ggacacctgcttgtt

SEQ ID NO: 47911 - DNA, 15 bp, Homo sapiens
gacacctgcttgttt

SEQ ID NO: 47912 - DNA, 15 bp, Homo sapiens
acacctgcttgtttt

SEQ ID NO: 47913 - DNA, 15 bp, Homo sapiens
cacctgcttgttttc

SEQ ID NO: 47914 - DNA, 15 bp, Homo sapiens
acctgcttgttttcc

SEQ ID NO: 47915 - DNA, 15 bp, Homo sapiens
cctgcttgttttccc

SEQ ID NO: 47916 - DNA, 15 bp, Homo sapiens
ctgcttgttttccct

SEQ ID NO: 47917 - DNA, 15 bp, Homo sapiens
tgcttgttttccctg

SEQ ID NO: 47918 - DNA, 15 bp, Homo sapiens
gcttgttttccctgc

SEQ ID NO: 47919 - DNA, 15 bp, Homo sapiens
cttgttttccctgcc

SEQ ID NO: 47920 - DNA, 15 bp, Homo sapiens
ttgttttccctgccc

SEQ ID NO: 47921 - DNA, 15 bp, Homo sapiens
tgttttccctgccct

SEQ ID NO: 47922 - DNA, 15 bp, Homo sapiens
gttttccctgccctc

SEQ ID NO: 47923 - DNA, 15 bp, Homo sapiens
ttttccctgccctct

SEQ ID NO: 47924 - DNA, 15 bp, Homo sapiens
tttccctgccctctg

SEQ ID NO: 47925 - DNA, 15 bp, Homo sapiens
ttccctgccctctgc

SEQ ID NO: 47926 - DNA, 15 bp, Homo sapiens
tccctgccctctgct

SEQ ID NO: 47927 - DNA, 15 bp, Homo sapiens
ccctgccctctgcta

SEQ ID NO: 47928 - DNA, 15 bp, Homo sapiens
cctgccctctgctat

SEQ ID NO: 47929 - DNA, 15 bp, Homo sapiens
ctgccctctgctatg

SEQ ID NO: 47930 - DNA, 15 bp, Homo sapiens
tgccctctgctatgg

SEQ ID NO: 47931 - DNA, 15 bp, Homo sapiens
gccctctgctatggt

SEQ ID NO: 47932 - DNA, 15 bp, Homo sapiens
ccctctgctatggtg

SEQ ID NO: 47933 - DNA, 15 bp, Homo sapiens
cctctgctatggtga

SEQ ID NO: 47934 - DNA, 15 bp, Homo sapiens
ctctgctatggtgac

SEQ ID NO: 47935 - DNA, 15 bp, Homo sapiens
tctgctatggtgaca

SEQ ID NO: 47936 - DNA, 15 bp, Homo sapiens
ctgctatggtgacat

SEQ ID NO: 47937 - DNA, 15 bp, Homo sapiens
tgctatggtgacatc

SEQ ID NO: 47938 - DNA, 15 bp, Homo sapiens
gctatggtgacatcc

SEQ ID NO: 47939 - DNA, 15 bp, Homo sapiens
ctatggtgacatcct

SEQ ID NO: 47940 - DNA, 15 bp, Homo sapiens
tatggtgacatcctt

SEQ ID NO: 47941 - DNA, 15 bp, Homo sapiens
atggtgacatccttg

SEQ ID NO: 47942 - DNA, 15 bp, Homo sapiens
tggtgacatccttgc

SEQ ID NO: 47943 - DNA, 15 bp, Homo sapiens
ggtgacatccttgca

SEQ ID NO: 47944 - DNA, 15 bp, Homo sapiens
gtgacatccttgcag

SEQ ID NO: 47945 - DNA, 15 bp, Homo sapiens
tgacatccttgcaga

SEQ ID NO: 47946 - DNA, 15 bp, Homo sapiens
gacatccttgcagac

SEQ ID NO: 47947 - DNA, 15 bp, Homo sapiens
acatccttgcagacc

SEQ ID NO: 47948 - DNA, 15 bp, Homo sapiens
catccttgcagacca

SEQ ID NO: 47949 - DNA, 15 bp, Homo sapiens
atccttgcagaccag

SEQ ID NO: 47950 - DNA, 15 bp, Homo sapiens
tccttgcagaccagt

SEQ ID NO: 47951 - DNA, 15 bp, Homo sapiens
ccttgcagaccagtc

SEQ ID NO: 47952 - DNA, 15 bp, Homo sapiens
cttgcagaccagtct

SEQ ID NO: 47953 - DNA, 15 bp, Homo sapiens
ttgcagaccagtctt

SEQ ID NO: 47954 - DNA, 15 bp, Homo sapiens
tgcagaccagtcttg

SEQ ID NO: 47955 - DNA, 15 bp, Homo sapiens
gcagaccagtcttgc

SEQ ID NO: 47956 - DNA, 15 bp, Homo sapiens
cagaccagtcttgcg

SEQ ID NO: 47957 - DNA, 15 bp, Homo sapiens
agaccagtcttgcgt

SEQ ID NO: 47958 - DNA, 15 bp, Homo sapiens
gaccagtcttgcgtg

SEQ ID NO: 47959 - DNA, 15 bp, Homo sapiens
accagtcttgcgtgg

SEQ ID NO: 47960 - DNA, 15 bp, Homo sapiens
ccagtcttgcgtggc

SEQ ID NO: 47961 - DNA, 15 bp, Homo sapiens
cagtcttgcgtggct

SEQ ID NO: 47962 - DNA, 15 bp, Homo sapiens
agtcttgcgtggctg

SEQ ID NO: 47963 - DNA, 15 bp, Homo sapiens
gtcttgcgtggctgg

SEQ ID NO: 47964 - DNA, 15 bp, Homo sapiens
tcttgcgtggctggc

SEQ ID NO: 47965 - DNA, 15 bp, Homo sapiens
cttgcgtggctggca

SEQ ID NO: 47966 - DNA, 15 bp, Homo sapiens
ttgcgtggctggcag

SEQ ID NO: 47967 - DNA, 15 bp, Homo sapiens
tgcgtggctggcaga

SEQ ID NO: 47968 - DNA, 15 bp, Homo sapiens
gcgtggctggcagac

SEQ ID NO: 47969 - DNA, 15 bp, Homo sapiens
cgtggctggcagacg

SEQ ID NO: 47970 - DNA, 15 bp, Homo sapiens
gtggctggcagacgc

SEQ ID NO: 47971 - DNA, 15 bp, Homo sapiens
tggctggcagacgca

SEQ ID NO: 47972 - DNA, 15 bp, Homo sapiens
ggctggcagacgcaa

SEQ ID NO: 47973 - DNA, 15 bp, Homo sapiens
gctggcagacgcaat

SEQ ID NO: 47974 - DNA, 15 bp, Homo sapiens
ctggcagacgcaatc

SEQ ID NO: 47975 - DNA, 15 bp, Homo sapiens
tggcagacgcaatct

SEQ ID NO: 47976 - DNA, 15 bp, Homo sapiens
ggcagacgcaatctt

SEQ ID NO: 47977 - DNA, 15 bp, Homo sapiens
gcagacgcaatcttt

SEQ ID NO: 47978 - DNA, 15 bp, Homo sapiens
cagacgcaatctttt

SEQ ID NO: 47979 - DNA, 15 bp, Homo sapiens
agacgcaatcttttt

SEQ ID NO: 47980 - DNA, 15 bp, Homo sapiens
gacgcaatctttttt

SEQ ID NO: 47981 - DNA, 15 bp, Homo sapiens
acgcaatcttttttt

SEQ ID NO: 47982 - DNA, 15 bp, Homo sapiens
cgcaatctttttttc

SEQ ID NO: 47983 - DNA, 15 bp, Homo sapiens
gcaatctttttttct

SEQ ID NO: 47984 - DNA, 15 bp, Homo sapiens
caatctttttttctt

SEQ ID NO: 47985 - DNA, 15 bp, Homo sapiens
aatctttttttcttg

SEQ ID NO: 47986 - DNA, 15 bp, Homo sapiens
atctttttttcttgg

SEQ ID NO: 47987 - DNA, 15 bp, Homo sapiens
tctttttttcttggg

SEQ ID NO: 47988 - DNA, 15 bp, Homo sapiens
ctttttttcttgggt

SEQ ID NO: 47989 - DNA, 15 bp, Homo sapiens
tttttttcttgggta

SEQ ID NO: 47990 - DNA, 15 bp, Homo sapiens
ttttttcttgggtag

SEQ ID NO: 47991 - DNA, 15 bp, Homo sapiens
tttttcttgggtaga

SEQ ID NO: 47992 - DNA, 15 bp, Homo sapiens
ttttcttgggtagag

SEQ ID NO: 47993 - DNA, 15 bp, Homo sapiens
tttcttgggtagagc

SEQ ID NO: 47994 - DNA, 15 bp, Homo sapiens
ttcttgggtagagca

SEQ ID NO: 47995 - DNA, 15 bp, Homo sapiens
tcttgggtagagcat

SEQ ID NO: 47996 - DNA, 15 bp, Homo sapiens
cttgggtagagcatt

SEQ ID NO: 47997 - DNA, 15 bp, Homo sapiens
ttgggtagagcatta

SEQ ID NO: 47998 - DNA, 15 bp, Homo sapiens
tgggtagagcattat

SEQ ID NO: 47999 - DNA, 15 bp, Homo sapiens
gggtagagcattatc

SEQ ID NO: 48000 - DNA, 15 bp, Homo sapiens
ggtagagcattatca

SEQ ID NO: 48001 - DNA, 15 bp, Homo sapiens
gtagagcattatcac

SEQ ID NO: 48002 - DNA, 15 bp, Homo sapiens
tagagcattatcacc

SEQ ID NO: 48003 - DNA, 15 bp, Homo sapiens
agagcattatcaccg

SEQ ID NO: 48004 - DNA, 15 bp, Homo sapiens
gagcattatcaccgc

SEQ ID NO: 48005 - DNA, 15 bp, Homo sapiens
agcattatcaccgct

SEQ ID NO: 48006 - DNA, 15 bp, Homo sapiens
gcattatcaccgctg

SEQ ID NO: 48007 - DNA, 15 bp, Homo sapiens
cattatcaccgctgc

SEQ ID NO: 48008 - DNA, 15 bp, Homo sapiens
attatcaccgctgcg

SEQ ID NO: 48009 - DNA, 15 bp, Homo sapiens
ttatcaccgctgcga

SEQ ID NO: 48010 - DNA, 15 bp, Homo sapiens
tatcaccgctgcgat

SEQ ID NO: 48011 - DNA, 15 bp, Homo sapiens
atcaccgctgcgatg

SEQ ID NO: 48012 - DNA, 15 bp, Homo sapiens
tcaccgctgcgatgg

SEQ ID NO: 48013 - DNA, 15 bp, Homo sapiens
caccgctgcgatgga

SEQ ID NO: 48014 - DNA, 15 bp, Homo sapiens
accgctgcgatggaa

SEQ ID NO: 48015 - DNA, 15 bp, Homo sapiens
ccgctgcgatggaag

SEQ ID NO: 48016 - DNA, 15 bp, Homo sapiens
cgctgcgatggaagg

SEQ ID NO: 48017 - DNA, 15 bp, Homo sapiens
gctgcgatggaagga

SEQ ID NO: 48018 - DNA, 15 bp, Homo sapiens
ctgcgatggaaggac

SEQ ID NO: 48019 - DNA, 15 bp, Homo sapiens
tgcgatggaaggacc

SEQ ID NO: 48020 - DNA, 15 bp, Homo sapiens
gcgatggaaggacct

SEQ ID NO: 48021 - DNA, 15 bp, Homo sapiens
cgatggaaggacctt

SEQ ID NO: 48022 - DNA, 15 bp, Homo sapiens
gatggaaggaccttg

SEQ ID NO: 48023 - DNA, 15 bp, Homo sapiens
atggaaggaccttgt

SEQ ID NO: 48024 - DNA, 15 bp, Homo sapiens
tggaaggaccttgtc

SEQ ID NO: 48025 - DNA, 15 bp, Homo sapiens
ggaaggaccttgtcc

SEQ ID NO: 48026 - DNA, 15 bp, Homo sapiens
gaaggaccttgtcct

SEQ ID NO: 48027 - DNA, 15 bp, Homo sapiens
aaggaccttgtcctc

SEQ ID NO: 48028 - DNA, 15 bp, Homo sapiens
aggaccttgtcctcg

SEQ ID NO: 48029 - DNA, 15 bp, Homo sapiens
ggaccttgtcctcgg

SEQ ID NO: 48030 - DNA, 15 bp, Homo sapiens
gaccttgtcctcggt

SEQ ID NO: 48031 - DNA, 15 bp, Homo sapiens
accttgtcctcggtg

SEQ ID NO: 48032 - DNA, 15 bp, Homo sapiens
ccttgtcctcggtgc

SEQ ID NO: 48033 - DNA, 15 bp, Homo sapiens
cttgtcctcggtgcc

SEQ ID NO: 48034 - DNA, 15 bp, Homo sapiens
ttgtcctcggtgcct

SEQ ID NO: 48035 - DNA, 15 bp, Homo sapiens
tgtcctcggtgcctc

SEQ ID NO: 48036 - DNA, 15 bp, Homo sapiens
gtcctcggtgcctcc

SEQ ID NO: 48037 - DNA, 15 bp, Homo sapiens
tcctcggtgcctcca

SEQ ID NO: 48038 - DNA, 15 bp, Homo sapiens
cctcggtgcctccat

SEQ ID NO: 48039 - DNA, 15 bp, Homo sapiens
ctcggtgcctccata

SEQ ID NO: 48040 - DNA, 15 bp, Homo sapiens
tcggtgcctccatac

SEQ ID NO: 48041 - DNA, 15 bp, Homo sapiens
cggtgcctccatacc

SEQ ID NO: 48042 - DNA, 15 bp, Homo sapiens
ggtgcctccatacca

SEQ ID NO: 48043 - DNA, 15 bp, Homo sapiens
gtgcctccataccag

SEQ ID NO: 48044 - DNA, 15 bp, Homo sapiens
tgcctccataccagc

SEQ ID NO: 48045 - DNA, 15 bp, Homo sapiens
gcctccataccagcc

SEQ ID NO: 48046 - DNA, 15 bp, Homo sapiens
cctccataccagccc

SEQ ID NO: 48047 - DNA, 15 bp, Homo sapiens
ctccataccagccct

SEQ ID NO: 48048 - DNA, 15 bp, Homo sapiens
agccctttccagtga

SEQ ID NO: 48049 - DNA, 15 bp, Homo sapiens
gccctttccagtgaa

SEQ ID NO: 48050 - DNA, 15 bp, Homo sapiens
ccctttccagtgaaa

SEQ ID NO: 48051 - DNA, 15 bp, Homo sapiens
cctttccagtgaaac

SEQ ID NO: 48052 - DNA, 15 bp, Homo sapiens
ctttccagtgaaact

SEQ ID NO: 48053 - DNA, 15 bp, Homo sapiens
tttccagtgaaacta

SEQ ID NO: 48054 - DNA, 15 bp, Homo sapiens
ttccagtgaaactac

SEQ ID NO: 48055 - DNA, 15 bp, Homo sapiens
tccagtgaaactact

SEQ ID NO: 48056 - DNA, 15 bp, Homo sapiens
ccagtgaaactactg

SEQ ID NO: 48057 - DNA, 15 bp, Homo sapiens
cagtgaaactactgc

SEQ ID NO: 48058 - DNA, 15 bp, Homo sapiens
agtgaaactactgct

SEQ ID NO: 48059 - DNA, 15 bp, Homo sapiens
gtgaaactactgctg

SEQ ID NO: 48060 - DNA, 15 bp, Homo sapiens
tgaaactactgctgt

SEQ ID NO: 48061 - DNA, 15 bp, Homo sapiens
gaaactactgctgtc

SEQ ID NO: 48062 - DNA, 15 bp, Homo sapiens
aaactactgctgtcc

SEQ ID NO: 48063 - DNA, 15 bp, Homo sapiens
aactactgctgtccc

SEQ ID NO: 48064 - DNA, 15 bp, Homo sapiens
actactgctgtcccg

SEQ ID NO: 48065 - DNA, 15 bp, Homo sapiens
ctactgctgtcccgg

SEQ ID NO: 48066 - DNA, 15 bp, Homo sapiens
tactgctgtcccggc

SEQ ID NO: 48067 - DNA, 15 bp, Homo sapiens
actgctgtcccggca

SEQ ID NO: 48068 - DNA, 15 bp, Homo sapiens
ctgctgtcccggcaa

SEQ ID NO: 48069 - DNA, 15 bp, Homo sapiens
tgctgtcccggcaag

SEQ ID NO: 48070 - DNA, 15 bp, Homo sapiens
gctgtcccggcaagc

SEQ ID NO: 48071 - DNA, 15 bp, Homo sapiens
ctgtcccggcaagcc

SEQ ID NO: 48072 - DNA, 15 bp, Homo sapiens
tgtcccggcaagccc

SEQ ID NO: 48073 - DNA, 15 bp, Homo sapiens
gtcccggcaagcccc

SEQ ID NO: 48074 - DNA, 15 bp, Homo sapiens
tcccggcaagcccct

SEQ ID NO: 48075 - DNA, 15 bp, Homo sapiens
cccggcaagcccctg

SEQ ID NO: 48076 - DNA, 15 bp, Homo sapiens
ccggcaagcccctgt

SEQ ID NO: 48077 - DNA, 15 bp, Homo sapiens
cggcaagcccctgtg

SEQ ID NO: 48078 - DNA, 15 bp, Homo sapiens
ggcaagcccctgtgc

SEQ ID NO: 48079 - DNA, 15 bp, Homo sapiens
gcaagcccctgtgcg

SEQ ID NO: 48080 - DNA, 15 bp, Homo sapiens
caagcccctgtgcgt

SEQ ID NO: 48081 - DNA, 15 bp, Homo sapiens
aagcccctgtgcgtg

SEQ ID NO: 48082 - DNA, 15 bp, Homo sapiens
agcccctgtgcgtgt

SEQ ID NO: 48083 - DNA, 15 bp, Homo sapiens
gcccctgtgcgtgtg

SEQ ID NO: 48084 - DNA, 15 bp, Homo sapiens
cccctgtgcgtgtgc

SEQ ID NO: 48085 - DNA, 15 bp, Homo sapiens
ccctgtgcgtgtgca

SEQ ID NO: 48086 - DNA, 15 bp, Homo sapiens
cctgtgcgtgtgcat

SEQ ID NO: 48087 - DNA, 15 bp, Homo sapiens
ctgtgcgtgtgcatc

SEQ ID NO: 48088 - DNA, 15 bp, Homo sapiens
tgtgcgtgtgcatca

SEQ ID NO: 48089 - DNA, 15 bp, Homo sapiens
gtgcgtgtgcatcat

SEQ ID NO: 48090 - DNA, 15 bp, Homo sapiens
tgcgtgtgcatcatt

SEQ ID NO: 48091 - DNA, 15 bp, Homo sapiens
gcgtgtgcatcattc

SEQ ID NO: 48092 - DNA, 15 bp, Homo sapiens
cgtgtgcatcattcc

SEQ ID NO: 48093 - DNA, 15 bp, Homo sapiens
gtgtgcatcattccg

SEQ ID NO: 48094 - DNA, 15 bp, Homo sapiens
tgtgcatcattccgg

SEQ ID NO: 48095 - DNA, 15 bp, Homo sapiens
gtgcatcattccggg

SEQ ID NO: 48096 - DNA, 15 bp, Homo sapiens
tgcatcattccgggt

SEQ ID NO: 48097 - DNA, 15 bp, Homo sapiens
gcatcattccgggta

SEQ ID NO: 48098 - DNA, 15 bp, Homo sapiens
catcattccgggtag

SEQ ID NO: 48099 - DNA, 15 bp, Homo sapiens
atcattccgggtagg

SEQ ID NO: 48100 - DNA, 15 bp, Homo sapiens
tcattccgggtagga

SEQ ID NO: 48101 - DNA, 15 bp, Homo sapiens
cattccgggtaggac

SEQ ID NO: 48102 - DNA, 15 bp, Homo sapiens
attccgggtaggaca

SEQ ID NO: 48103 - DNA, 15 bp, Homo sapiens
ttccgggtaggacaa

SEQ ID NO: 48104 - DNA, 15 bp, Homo sapiens
tccgggtaggacaag

SEQ ID NO: 48105 - DNA, 15 bp, Homo sapiens
ccgggtaggacaaga

SEQ ID NO: 48106 - DNA, 15 bp, Homo sapiens
cgggtaggacaagat

SEQ ID NO: 48107 - DNA, 15 bp, Homo sapiens
gggtaggacaagatg

SEQ ID NO: 48108 - DNA, 15 bp, Homo sapiens
ggtaggacaagatgt

SEQ ID NO: 48109 - DNA, 15 bp, Homo sapiens
gtaggacaagatgtg

SEQ ID NO: 48110 - DNA, 15 bp, Homo sapiens
taggacaagatgtga

SEQ ID NO: 48111 - DNA, 15 bp, Homo sapiens
aggacaagatgtgaa

SEQ ID NO: 48112 - DNA, 15 bp, Homo sapiens
ggacaagatgtgaac

SEQ ID NO: 48113 - DNA, 15 bp, Homo sapiens
gacaagatgtgaaca

SEQ ID NO: 48114 - DNA, 15 bp, Homo sapiens
acaagatgtgaacag

SEQ ID NO: 48115 - DNA, 15 bp, Homo sapiens
caagatgtgaacagg

SEQ ID NO: 48116 - DNA, 15 bp, Homo sapiens
aagatgtgaacaggt

SEQ ID NO: 48117 - DNA, 15 bp, Homo sapiens
agatgtgaacaggtc

SEQ ID NO: 48118 - DNA, 15 bp, Homo sapiens
gatgtgaacaggtcc

SEQ ID NO: 48119 - DNA, 15 bp, Homo sapiens
atgtgaacaggtccc

SEQ ID NO: 48120 - DNA, 15 bp, Homo sapiens
tgtgaacaggtccct

SEQ ID NO: 48121 - DNA, 15 bp, Homo sapiens
gtgaacaggtccctc

SEQ ID NO: 48122 - DNA, 15 bp, Homo sapiens
tgaacaggtccctct

SEQ ID NO: 48123 - DNA, 15 bp, Homo sapiens
gaacaggtccctctt

SEQ ID NO: 48124 - DNA, 15 bp, Homo sapiens
aacaggtccctcttc

SEQ ID NO: 48125 - DNA, 15 bp, Homo sapiens
acaggtccctcttct

SEQ ID NO: 48126 - DNA, 15 bp, Homo sapiens
caggtccctcttctt

SEQ ID NO: 48127 - DNA, 15 bp, Homo sapiens
aggtccctcttcttt

SEQ ID NO: 48128 - DNA, 15 bp, Homo sapiens
ggtccctcttctttg

SEQ ID NO: 48129 - DNA, 15 bp, Homo sapiens
gtccctcttctttgg

SEQ ID NO: 48130 - DNA, 15 bp, Homo sapiens
tccctcttctttggg

SEQ ID NO: 48131 - DNA, 15 bp, Homo sapiens
ccctcttctttgggc

SEQ ID NO: 48132 - DNA, 15 bp, Homo sapiens
cctcttctttgggct

SEQ ID NO: 48133 - DNA, 15 bp, Homo sapiens
ctcttctttgggctt

SEQ ID NO: 48134 - DNA, 15 bp, Homo sapiens
tcttctttgggctta

SEQ ID NO: 48135 - DNA, 15 bp, Homo sapiens
cttctttgggcttaa

SEQ ID NO: 48136 - DNA, 15 bp, Homo sapiens
ttctttgggcttaag

SEQ ID NO: 48137 - DNA, 15 bp, Homo sapiens
tctttgggcttaagt

SEQ ID NO: 48138 - DNA, 15 bp, Homo sapiens
ctttgggcttaagta

SEQ ID NO: 48139 - DNA, 15 bp, Homo sapiens
tttgggcttaagtag

SEQ ID NO: 48140 - DNA, 15 bp, Homo sapiens
ttgggcttaagtaga

SEQ ID NO: 48141 - DNA, 15 bp, Homo sapiens
tgggcttaagtagaa

SEQ ID NO: 48142 - DNA, 15 bp, Homo sapiens
gggcttaagtagaag

SEQ ID NO: 48143 - DNA, 15 bp, Homo sapiens
ggcttaagtagaagt

SEQ ID NO: 48144 - DNA, 15 bp, Homo sapiens
gcttaagtagaagtt

SEQ ID NO: 48145 - DNA, 15 bp, Homo sapiens
cttaagtagaagttg

SEQ ID NO: 48146 - DNA, 15 bp, Homo sapiens
ttaagtagaagttgt

SEQ ID NO: 48147 - DNA, 15 bp, Homo sapiens
taagtagaagttgtg

SEQ ID NO: 48148 - DNA, 15 bp, Homo sapiens
aagtagaagttgtgc

SEQ ID NO: 48149 - DNA, 15 bp, Homo sapiens
agtagaagttgtgct

SEQ ID NO: 48150 - DNA, 15 bp, Homo sapiens
gtagaagttgtgctc

SEQ ID NO: 48151 - DNA, 15 bp, Homo sapiens
tagaagttgtgctct

SEQ ID NO: 48152 - DNA, 15 bp, Homo sapiens
agaagttgtgctctt

SEQ ID NO: 48153 - DNA, 15 bp, Homo sapiens
gaagttgtgctcttc

SEQ ID NO: 48154 - DNA, 15 bp, Homo sapiens
aagttgtgctcttct

SEQ ID NO: 48155 - DNA, 15 bp, Homo sapiens
agttgtgctcttctg

SEQ ID NO: 48156 - DNA, 15 bp, Homo sapiens
gttgtgctcttctgc

SEQ ID NO: 48157 - DNA, 15 bp, Homo sapiens
ttgtgctcttctgct

SEQ ID NO: 48158 - DNA, 15 bp, Homo sapiens
tgtgctcttctgctt

SEQ ID NO: 48159 - DNA, 15 bp, Homo sapiens
gtgctcttctgcttt

SEQ ID NO: 48160 - DNA, 15 bp, Homo sapiens
tgctcttctgctttt

SEQ ID NO: 48161 - DNA, 15 bp, Homo sapiens
gctcttctgctttta

SEQ ID NO: 48162 - DNA, 15 bp, Homo sapiens
ctcttctgcttttac

SEQ ID NO: 48163 - DNA, 15 bp, Homo sapiens
tcttctgcttttacc

SEQ ID NO: 48164 - DNA, 15 bp, Homo sapiens
cttctgcttttacct

SEQ ID NO: 48165 - DNA, 15 bp, Homo sapiens
ttctgcttttacctg

SEQ ID NO: 48166 - DNA, 15 bp, Homo sapiens
tctgcttttacctgt

SEQ ID NO: 48167 - DNA, 15 bp, Homo sapiens
ctgcttttacctgtg

SEQ ID NO: 48168 - DNA, 15 bp, Homo sapiens
tgcttttacctgtgt

SEQ ID NO: 48169 - DNA, 15 bp, Homo sapiens
gcttttacctgtgtg

SEQ ID NO: 48170 - DNA, 15 bp, Homo sapiens
cttttacctgtgtgc

SEQ ID NO: 48171 - DNA, 15 bp, Homo sapiens
ttttacctgtgtgct

SEQ ID NO: 48172 - DNA, 15 bp, Homo sapiens
tttacctgtgtgctc

SEQ ID NO: 48173 - DNA, 15 bp, Homo sapiens
ttacctgtgtgctct

SEQ ID NO: 48174 - DNA, 15 bp, Homo sapiens
tacctgtgtgctctt

SEQ ID NO: 48175 - DNA, 15 bp, Homo sapiens
acctgtgtgctcttc

SEQ ID NO: 48176 - DNA, 15 bp, Homo sapiens
cctgtgtgctcttct

SEQ ID NO: 48177 - DNA, 15 bp, Homo sapiens
ctgtgtgctcttctg

SEQ ID NO: 48178 - DNA, 15 bp, Homo sapiens
tgtgtgctcttctgc

SEQ ID NO: 48179 - DNA, 15 bp, Homo sapiens
gtgtgctcttctgct

SEQ ID NO: 48180 - DNA, 15 bp, Homo sapiens
ctgcttttacctgtt

SEQ ID NO: 48181 - DNA, 15 bp, Homo sapiens
tgcttttacctgttc

SEQ ID NO: 48182 - DNA, 15 bp, Homo sapiens
gcttttacctgttct

SEQ ID NO: 48183 - DNA, 15 bp, Homo sapiens
cttttacctgttctc

SEQ ID NO: 48184 - DNA, 15 bp, Homo sapiens
ttttacctgttctct

SEQ ID NO: 48185 - DNA, 15 bp, Homo sapiens
tttacctgttctctt

SEQ ID NO: 48186 - DNA, 15 bp, Homo sapiens
ttacctgttctcttc

SEQ ID NO: 48187 - DNA, 15 bp, Homo sapiens
tacctgttctcttct

SEQ ID NO: 48188 - DNA, 15 bp, Homo sapiens
acctgttctcttctg

SEQ ID NO: 48189 - DNA, 15 bp, Homo sapiens
cctgttctcttctgc

SEQ ID NO: 48190 - DNA, 15 bp, Homo sapiens
ctgttctcttctgcc

SEQ ID NO: 48191 - DNA, 15 bp, Homo sapiens
tgttctcttctgcct

SEQ ID NO: 48192 - DNA, 15 bp, Homo sapiens
gttctcttctgcctt

SEQ ID NO: 48193 - DNA, 15 bp, Homo sapiens
ttctcttctgccttt

SEQ ID NO: 48194 - DNA, 15 bp, Homo sapiens
tctcttctgcctttc

SEQ ID NO: 48195 - DNA, 15 bp, Homo sapiens
ctcttctgcctttct

SEQ ID NO: 48196 - DNA, 15 bp, Homo sapiens
tcttctgcctttctc

SEQ ID NO: 48197 - DNA, 15 bp, Homo sapiens
cttctgcctttctct

SEQ ID NO: 48198 - DNA, 15 bp, Homo sapiens
ttctgcctttctctt

SEQ ID NO: 48199 - DNA, 15 bp, Homo sapiens
tctgcctttctcttg

SEQ ID NO: 48200 - DNA, 15 bp, Homo sapiens
ctgcctttctcttgc

SEQ ID NO: 48201 - DNA, 15 bp, Homo sapiens
tgcctttctcttgca

SEQ ID NO: 48202 - DNA, 15 bp, Homo sapiens
gcctttctcttgcaa

SEQ ID NO: 48203 - DNA, 15 bp, Homo sapiens
cctttctcttgcaag

SEQ ID NO: 48204 - DNA, 15 bp, Homo sapiens
ctttctcttgcaaga

SEQ ID NO: 48205 - DNA, 15 bp, Homo sapiens
tttctcttgcaagaa

SEQ ID NO: 48206 - DNA, 15 bp, Homo sapiens
ttctcttgcaagaaa

SEQ ID NO: 48207 - DNA, 15 bp, Homo sapiens
tctcttgcaagaaac

SEQ ID NO: 48208 - DNA, 15 bp, Homo sapiens
ctcttgcaagaaacc

SEQ ID NO: 48209 - DNA, 15 bp, Homo sapiens
tcttgcaagaaacct

SEQ ID NO: 48210 - DNA, 15 bp, Homo sapiens
cttgcaagaaacctg

SEQ ID NO: 48211 - DNA, 15 bp, Homo sapiens
ttgcaagaaacctgt

SEQ ID NO: 48212 - DNA, 15 bp, Homo sapiens
tgcaagaaacctgtc

SEQ ID NO: 48213 - DNA, 15 bp, Homo sapiens
gcaagaaacctgtcg

SEQ ID NO: 48214 - DNA, 15 bp, Homo sapiens
caagaaacctgtcga

SEQ ID NO: 48215 - DNA, 15 bp, Homo sapiens
aagaaacctgtcgaa

SEQ ID NO: 48216 - DNA, 15 bp, Homo sapiens
agaaacctgtcgaaa

SEQ ID NO: 48217 - DNA, 15 bp, Homo sapiens
gaaacctgtcgaaag

SEQ ID NO: 48218 - DNA, 15 bp, Homo sapiens
aaacctgtcgaaagc

SEQ ID NO: 48219 - DNA, 15 bp, Homo sapiens
aacctgtcgaaagct

SEQ ID NO: 48220 - DNA, 15 bp, Homo sapiens
acctgtcgaaagctt

SEQ ID NO: 48221 - DNA, 15 bp, Homo sapiens
cctgtcgaaagcttg

SEQ ID NO: 48222 - DNA, 15 bp, Homo sapiens
ctgtcgaaagcttgc

SEQ ID NO: 48223 - DNA, 15 bp, Homo sapiens
tgtcgaaagcttgct

SEQ ID NO: 48224 - DNA, 15 bp, Homo sapiens
gtcgaaagcttgctt

SEQ ID NO: 48225 - DNA, 15 bp, Homo sapiens
tcgaaagcttgcttt

SEQ ID NO: 48226 - DNA, 15 bp, Homo sapiens
cgaaagcttgctttg

SEQ ID NO: 48227 - DNA, 15 bp, Homo sapiens
gaaagcttgctttgc

SEQ ID NO: 48228 - DNA, 15 bp, Homo sapiens
aaagcttgctttgca

SEQ ID NO: 48229 - DNA, 15 bp, Homo sapiens
aagcttgctttgcat

SEQ ID NO: 48230 - DNA, 15 bp, Homo sapiens
agcttgctttgcatg

SEQ ID NO: 48231 - DNA, 15 bp, Homo sapiens
gcttgctttgcatgc

SEQ ID NO: 48232 - DNA, 15 bp, Homo sapiens
cttgctttgcatgcc

SEQ ID NO: 48233 - DNA, 15 bp, Homo sapiens
ttgctttgcatgcca

SEQ ID NO: 48234 - DNA, 15 bp, Homo sapiens
tgctttgcatgccat

SEQ ID NO: 48235 - DNA, 15 bp, Homo sapiens
gctttgcatgccatt

SEQ ID NO: 48236 - DNA, 15 bp, Homo sapiens
ctttgcatgccattg

SEQ ID NO: 48237 - DNA, 15 bp, Homo sapiens
tttgcatgccattgc

SEQ ID NO: 48238 - DNA, 15 bp, Homo sapiens
ttgcatgccattgct

SEQ ID NO: 48239 - DNA, 15 bp, Homo sapiens
tgcatgccattgctt

SEQ ID NO: 48240 - DNA, 15 bp, Homo sapiens
gcatgccattgctta

SEQ ID NO: 48241 - DNA, 15 bp, Homo sapiens
catgccattgcttaa

SEQ ID NO: 48242 - DNA, 15 bp, Homo sapiens
atgccattgcttaaa

SEQ ID NO: 48243 - DNA, 15 bp, Homo sapiens
tgccattgcttaaat

SEQ ID NO: 48244 - DNA, 15 bp, Homo sapiens
gccattgcttaaata

SEQ ID NO: 48245 - DNA, 15 bp, Homo sapiens
ccattgcttaaatac

SEQ ID NO: 48246 - DNA, 15 bp, Homo sapiens
cattgcttaaatact

SEQ ID NO: 48247 - DNA, 15 bp, Homo sapiens
attgcttaaatactt

SEQ ID NO: 48248 - DNA, 15 bp, Homo sapiens
ttgcttaaatacttt

SEQ ID NO: 48249 - DNA, 15 bp, Homo sapiens
tgcttaaatactttg

SEQ ID NO: 48250 - DNA, 15 bp, Homo sapiens
gcttaaatactttga

SEQ ID NO: 48251 - DNA, 15 bp, Homo sapiens
cttaaatactttgat

SEQ ID NO: 48252 - DNA, 15 bp, Homo sapiens
ttaaatactttgatg

SEQ ID NO: 48253 - DNA, 15 bp, Homo sapiens
taaatactttgatgg

SEQ ID NO: 48254 - DNA, 15 bp, Homo sapiens
aaatactttgatggt

SEQ ID NO: 48255 - DNA, 15 bp, Homo sapiens
aatactttgatggta

SEQ ID NO: 48256 - DNA, 15 bp, Homo sapiens
atactttgatggtat

SEQ ID NO: 48257 - DNA, 15 bp, Homo sapiens
tactttgatggtatg

SEQ ID NO: 48258 - DNA, 15 bp, Homo sapiens
actttgatggtatgt

SEQ ID NO: 48259 - DNA, 15 bp, Homo sapiens
ctttgatggtatgta

SEQ ID NO: 48260 - DNA, 15 bp, Homo sapiens
tttgatggtatgtat

SEQ ID NO: 48261 - DNA, 15 bp, Homo sapiens
ttgatggtatgtatg

SEQ ID NO: 48262 - DNA, 15 bp, Homo sapiens
tgatggtatgtatgg

SEQ ID NO: 48263 - DNA, 15 bp, Homo sapiens
gatggtatgtatggt

SEQ ID NO: 48264 - DNA, 15 bp, Homo sapiens
atggtatgtatggta

SEQ ID NO: 48265 - DNA, 15 bp, Homo sapiens
tggtatgtatggtat

SEQ ID NO: 48266 - DNA, 15 bp, Homo sapiens
ggtatgtatggtatg

SEQ ID NO: 48267 - DNA, 15 bp, Homo sapiens
gtatgtatggtatgt

SEQ ID NO: 48268 - DNA, 15 bp, Homo sapiens
tatgtatggtatgtg

SEQ ID NO: 48269 - DNA, 15 bp, Homo sapiens
atgtatggtatgtgg

SEQ ID NO: 48270 - DNA, 15 bp, Homo sapiens
tgtatggtatgtggg

SEQ ID NO: 48271 - DNA, 15 bp, Homo sapiens
gtatggtatgtggga

SEQ ID NO: 48272 - DNA, 15 bp, Homo sapiens
tatggtatgtgggat

SEQ ID NO: 48273 - DNA, 15 bp, Homo sapiens
atggtatgtgggata

SEQ ID NO: 48274 - DNA, 15 bp, Homo sapiens
tggtatgtgggataa

SEQ ID NO: 48275 - DNA, 15 bp, Homo sapiens
ggtatgtgggataac

SEQ ID NO: 48276 - DNA, 15 bp, Homo sapiens
gtatgtgggataact

SEQ ID NO: 48277 - DNA, 15 bp, Homo sapiens
tatgtgggataactg

SEQ ID NO: 48278 - DNA, 15 bp, Homo sapiens
atgtgggataactga

SEQ ID NO: 48279 - DNA, 15 bp, Homo sapiens
tgtgggataactgag

SEQ ID NO: 48280 - DNA, 15 bp, Homo sapiens
gtgggataactgagt

SEQ ID NO: 48281 - DNA, 15 bp, Homo sapiens
tgggataactgagtg

SEQ ID NO: 48282 - DNA, 15 bp, Homo sapiens
gggataactgagtgg

SEQ ID NO: 48283 - DNA, 15 bp, Homo sapiens
ggataactgagtggg

SEQ ID NO: 48284 - DNA, 15 bp, Homo sapiens
gataactgagtggga

SEQ ID NO: 48285 - DNA, 15 bp, Homo sapiens
ataactgagtgggag

SEQ ID NO: 48286 - DNA, 15 bp, Homo sapiens
taactgagtgggagc

SEQ ID NO: 48287 - DNA, 15 bp, Homo sapiens
aactgagtgggagcc

SEQ ID NO: 48288 - DNA, 15 bp, Homo sapiens
actgagtgggagccg

SEQ ID NO: 48289 - DNA, 15 bp, Homo sapiens
ctgagtgggagccgg

SEQ ID NO: 48290 - DNA, 15 bp, Homo sapiens
tgagtgggagccgga

SEQ ID NO: 48291 - DNA, 15 bp, Homo sapiens
gagtgggagccggaa

SEQ ID NO: 48292 - DNA, 15 bp, Homo sapiens
agtgggagccggaat

SEQ ID NO: 48293 - DNA, 15 bp, Homo sapiens
gtgggagccggaatt

SEQ ID NO: 48294 - DNA, 15 bp, Homo sapiens
tgggagccggaattg

SEQ ID NO: 48295 - DNA, 15 bp, Homo sapiens
gggagccggaattgg

SEQ ID NO: 48296 - DNA, 15 bp, Homo sapiens
ggagccggaattggg

SEQ ID NO: 48297 - DNA, 15 bp, Homo sapiens
gagccggaattgggg

SEQ ID NO: 48298 - DNA, 15 bp, Homo sapiens
agccggaattggggg

SEQ ID NO: 48299 - DNA, 15 bp, Homo sapiens
gccggaattgggggg

SEQ ID NO: 48300 - DNA, 15 bp, Homo sapiens
ccggaattggggggt

SEQ ID NO: 48301 - DNA, 15 bp, Homo sapiens
cggaattggggggtg

SEQ ID NO: 48302 - DNA, 15 bp, Homo sapiens
ggaattggggggtgg

SEQ ID NO: 48303 - DNA, 15 bp, Homo sapiens
gaattggggggtggg

SEQ ID NO: 48304 - DNA, 15 bp, Homo sapiens
aattggggggtgggc

SEQ ID NO: 48305 - DNA, 15 bp, Homo sapiens
attggggggtgggca

SEQ ID NO: 48306 - DNA, 15 bp, Homo sapiens
ttggggggtgggcag

SEQ ID NO: 48307 - DNA, 15 bp, Homo sapiens
tggggggtgggcagg

SEQ ID NO: 48308 - DNA, 15 bp, Homo sapiens
ggggggtgggcaggg

SEQ ID NO: 48309 - DNA, 15 bp, Homo sapiens
gggggtgggcagggc

SEQ ID NO: 48310 - DNA, 15 bp, Homo sapiens
ggggtgggcagggca

SEQ ID NO: 48311 - DNA, 15 bp, Homo sapiens
gggtgggcagggcat

SEQ ID NO: 48312 - DNA, 15 bp, Homo sapiens
ggtgggcagggcatc

SEQ ID NO: 48313 - DNA, 15 bp, Homo sapiens
gtgggcagggcatcc

SEQ ID NO: 48314 - DNA, 15 bp, Homo sapiens
tgggcagggcatccc

SEQ ID NO: 48315 - DNA, 15 bp, Homo sapiens
gggcagggcatcccc

SEQ ID NO: 48316 - DNA, 15 bp, Homo sapiens
ggcagggcatcccca

SEQ ID NO: 48317 - DNA, 15 bp, Homo sapiens
gcagggcatccccac

SEQ ID NO: 48318 - DNA, 15 bp, Homo sapiens
cagggcatccccacc

SEQ ID NO: 48319 - DNA, 15 bp, Homo sapiens
agggcatccccaccc

SEQ ID NO: 48320 - DNA, 15 bp, Homo sapiens
gggcatccccacccc

SEQ ID NO: 48321 - DNA, 15 bp, Homo sapiens
ggcatccccaccccc

SEQ ID NO: 48322 - DNA, 15 bp, Homo sapiens
gcatccccaccccca

SEQ ID NO: 48323 - DNA, 15 bp, Homo sapiens
catccccacccccac

SEQ ID NO: 48324 - DNA, 15 bp, Homo sapiens
atccccacccccacc

SEQ ID NO: 48325 - DNA, 15 bp, Homo sapiens
tccccacccccaccc

SEQ ID NO: 48326 - DNA, 15 bp, Homo sapiens
ccccacccccacccc

SEQ ID NO: 48327 - DNA, 15 bp, Homo sapiens
cccacccccaccccc

SEQ ID NO: 48328 - DNA, 15 bp, Homo sapiens
ccacccccaccccca

SEQ ID NO: 48329 - DNA, 15 bp, Homo sapiens
cacccccacccccac

SEQ ID NO: 48330 - DNA, 15 bp, Homo sapiens
acccccacccccaca

SEQ ID NO: 48331 - DNA, 15 bp, Homo sapiens
cccccacccccacat

SEQ ID NO: 48332 - DNA, 15 bp, Homo sapiens
ccccacccccacatc

SEQ ID NO: 48333 - DNA, 15 bp, Homo sapiens
cccacccccacatca

SEQ ID NO: 48334 - DNA, 15 bp, Homo sapiens
ccacccccacatcaa

SEQ ID NO: 48335 - DNA, 15 bp, Homo sapiens
cacccccacatcaaa

SEQ ID NO: 48336 - DNA, 15 bp, Homo sapiens
acccccacatcaaag

SEQ ID NO: 48337 - DNA, 15 bp, Homo sapiens
cccccacatcaaagg

SEQ ID NO: 48338 - DNA, 15 bp, Homo sapiens
ccccacatcaaaggg

SEQ ID NO: 48339 - DNA, 15 bp, Homo sapiens
cccacatcaaagggg

SEQ ID NO: 48340 - DNA, 15 bp, Homo sapiens
ccacatcaaaggggg

SEQ ID NO: 48341 - DNA, 15 bp, Homo sapiens
cacatcaaaggggga

SEQ ID NO: 48342 - DNA, 15 bp, Homo sapiens
acatcaaagggggaa

SEQ ID NO: 48343 - DNA, 15 bp, Homo sapiens
catcaaagggggaat

SEQ ID NO: 48344 - DNA, 15 bp, Homo sapiens
atcaaagggggaatg

SEQ ID NO: 48345 - DNA, 15 bp, Homo sapiens
tcaaagggggaatga

SEQ ID NO: 48346 - DNA, 15 bp, Homo sapiens
caaagggggaatgac

SEQ ID NO: 48347 - DNA, 15 bp, Homo sapiens
aaagggggaatgacc

SEQ ID NO: 48348 - DNA, 15 bp, Homo sapiens
aagggggaatgacca

SEQ ID NO: 48349 - DNA, 15 bp, Homo sapiens
agggggaatgaccat

SEQ ID NO: 48350 - DNA, 15 bp, Homo sapiens
gggggaatgaccatt

SEQ ID NO: 48351 - DNA, 15 bp, Homo sapiens
ggggaatgaccattt

SEQ ID NO: 48352 - DNA, 15 bp, Homo sapiens
gggaatgaccatttc

SEQ ID NO: 48353 - DNA, 15 bp, Homo sapiens
ggaatgaccatttcg

SEQ ID NO: 48354 - DNA, 15 bp, Homo sapiens
gaatgaccatttcgt

SEQ ID NO: 48355 - DNA, 15 bp, Homo sapiens
aatgaccatttcgtt

SEQ ID NO: 48356 - DNA, 15 bp, Homo sapiens
atgaccatttcgtta

SEQ ID NO: 48357 - DNA, 15 bp, Homo sapiens
tgaccatttcgttag

SEQ ID NO: 48358 - DNA, 15 bp, Homo sapiens
gaccatttcgttaga

SEQ ID NO: 48359 - DNA, 15 bp, Homo sapiens
accatttcgttagag

SEQ ID NO: 48360 - DNA, 15 bp, Homo sapiens
ccatttcgttagaga

SEQ ID NO: 48361 - DNA, 15 bp, Homo sapiens
catttcgttagagaa

SEQ ID NO: 48362 - DNA, 15 bp, Homo sapiens
atttcgttagagaat

SEQ ID NO: 48363 - DNA, 15 bp, Homo sapiens
tttcgttagagaata

SEQ ID NO: 48364 - DNA, 15 bp, Homo sapiens
ttcgttagagaataa

SEQ ID NO: 48365 - DNA, 15 bp, Homo sapiens
tcgttagagaataaa

SEQ ID NO: 48366 - DNA, 15 bp, Homo sapiens
cgttagagaataaag

SEQ ID NO: 48367 - DNA, 15 bp, Homo sapiens
gttagagaataaagc

SEQ ID NO: 48368 - DNA, 15 bp, Homo sapiens
ttagagaataaagcc

SEQ ID NO: 48369 - DNA, 15 bp, Homo sapiens
tagagaataaagcct

SEQ ID NO: 48370 - DNA, 15 bp, Homo sapiens
agagaataaagcctg

SEQ ID NO: 48371 - DNA, 15 bp, Homo sapiens
gagaataaagcctga

SEQ ID NO: 48372 - DNA, 15 bp, Homo sapiens
agaataaagcctgag

SEQ ID NO: 48373 - DNA, 15 bp, Homo sapiens
gaataaagcctgagt

SEQ ID NO: 48374 - DNA, 15 bp, Homo sapiens
aataaagcctgagtc

SEQ ID NO: 48375 - DNA, 15 bp, Homo sapiens
ataaagcctgagtct

SEQ ID NO: 48376 - DNA, 15 bp, Homo sapiens
taaagcctgagtctt

SEQ ID NO: 48377 - DNA, 15 bp, Homo sapiens
aaagcctgagtctta

SEQ ID NO: 48378 - DNA, 15 bp, Homo sapiens
aagcctgagtcttat

SEQ ID NO: 48379 - DNA, 15 bp, Homo sapiens
agcctgagtcttata

SEQ ID NO: 48380 - DNA, 15 bp, Homo sapiens
gcctgagtcttataa

SEQ ID NO: 48381 - DNA, 15 bp, Homo sapiens
cctgagtcttataac

SEQ ID NO: 48382 - DNA, 15 bp, Homo sapiens
ctgagtcttataact

SEQ ID NO: 48383 - DNA, 15 bp, Homo sapiens
tgagtcttataactt

SEQ ID NO: 48384 - DNA, 15 bp, Homo sapiens
gagtcttataacttc

SEQ ID NO: 48385 - DNA, 15 bp, Homo sapiens
agtcttataacttct

SEQ ID NO: 48386 - DNA, 15 bp, Homo sapiens
gtcttataacttctt

SEQ ID NO: 48387 - DNA, 15 bp, Homo sapiens
tcttataacttcttc

SEQ ID NO: 48388 - DNA, 15 bp, Homo sapiens
cttataacttcttca

SEQ ID NO: 48389 - DNA, 15 bp, Homo sapiens
ttataacttcttcaa

SEQ ID NO: 48390 - DNA, 15 bp, Homo sapiens
tataacttcttcaag

SEQ ID NO: 48391 - DNA, 15 bp, Homo sapiens
ataacttcttcaagc

SEQ ID NO: 48392 - DNA, 15 bp, Homo sapiens
taacttcttcaagca

SEQ ID NO: 48393 - DNA, 15 bp, Homo sapiens
aacttcttcaagcac

SEQ ID NO: 48394 - DNA, 15 bp, Homo sapiens
acttcttcaagcaca

SEQ ID NO: 48395 - DNA, 15 bp, Homo sapiens
cttcttcaagcacat

SEQ ID NO: 48396 - DNA, 15 bp, Homo sapiens
ttcttcaagcacatg

SEQ ID NO: 48397 - DNA, 15 bp, Homo sapiens
tcttcaagcacatgt

SEQ ID NO: 48398 - DNA, 15 bp, Homo sapiens
cttcaagcacatgta

SEQ ID NO: 48399 - DNA, 15 bp, Homo sapiens
ttcaagcacatgtat

SEQ ID NO: 48400 - DNA, 15 bp, Homo sapiens
tcaagcacatgtatg

SEQ ID NO: 48401 - DNA, 15 bp, Homo sapiens
caagcacatgtatgc

SEQ ID NO: 48402 - DNA, 15 bp, Homo sapiens
aagcacatgtatgct

SEQ ID NO: 48403 - DNA, 15 bp, Homo sapiens
agcacatgtatgctg

SEQ ID NO: 48404 - DNA, 15 bp, Homo sapiens
gcacatgtatgctgg

SEQ ID NO: 48405 - DNA, 15 bp, Homo sapiens
cacatgtatgctggg

SEQ ID NO: 48406 - DNA, 15 bp, Homo sapiens
acatgtatgctgggt

SEQ ID NO: 48407 - DNA, 15 bp, Homo sapiens
catgtatgctgggtc

SEQ ID NO: 48408 - DNA, 15 bp, Homo sapiens
atgtatgctgggtct

SEQ ID NO: 48409 - DNA, 15 bp, Homo sapiens
tgtatgctgggtctc

SEQ ID NO: 48410 - DNA, 15 bp, Homo sapiens
gtatgctgggtctcc

SEQ ID NO: 48411 - DNA, 15 bp, Homo sapiens
tatgctgggtctcct

SEQ ID NO: 48412 - DNA, 15 bp, Homo sapiens
atgctgggtctcctg

SEQ ID NO: 48413 - DNA, 15 bp, Homo sapiens
tgctgggtctcctgg

SEQ ID NO: 48414 - DNA, 15 bp, Homo sapiens
gctgggtctcctggc

SEQ ID NO: 48415 - DNA, 15 bp, Homo sapiens
ctgggtctcctggcg

SEQ ID NO: 48416 - DNA, 15 bp, Homo sapiens
tgggtctcctggcgt

SEQ ID NO: 48417 - DNA, 15 bp, Homo sapiens
gggtctcctggcgtg

SEQ ID NO: 48418 - DNA, 15 bp, Homo sapiens
ggtctcctggcgtgt

SEQ ID NO: 48419 - DNA, 15 bp, Homo sapiens
gtctcctggcgtgtg

SEQ ID NO: 48420 - DNA, 15 bp, Homo sapiens
tctcctggcgtgtga

SEQ ID NO: 48421 - DNA, 15 bp, Homo sapiens
ctcctggcgtgtgaa

SEQ ID NO: 48422 - DNA, 15 bp, Homo sapiens
tcctggcgtgtgaat

SEQ ID NO: 48423 - DNA, 15 bp, Homo sapiens
cctggcgtgtgaatg

SEQ ID NO: 48424 - DNA, 15 bp, Homo sapiens
ctggcgtgtgaatgt

SEQ ID NO: 48425 - DNA, 15 bp, Homo sapiens
tggcgtgtgaatgtg

SEQ ID NO: 48426 - DNA, 15 bp, Homo sapiens
ggcgtgtgaatgtgt

SEQ ID NO: 48427 - DNA, 15 bp, Homo sapiens
gcgtgtgaatgtgtt

SEQ ID NO: 48428 - DNA, 15 bp, Homo sapiens
cgtgtgaatgtgttc

SEQ ID NO: 48429 - DNA, 15 bp, Homo sapiens
gtgtgaatgtgttcc

SEQ ID NO: 48430 - DNA, 15 bp, Homo sapiens
tgtgaatgtgttccc

SEQ ID NO: 48431 - DNA, 15 bp, Homo sapiens
gtgaatgtgttcccg

SEQ ID NO: 48432 - DNA, 15 bp, Homo sapiens
tgaatgtgttcccgc

SEQ ID NO: 48433 - DNA, 15 bp, Homo sapiens
gaatgtgttcccgct

SEQ ID NO: 48434 - DNA, 15 bp, Homo sapiens
aatgtgttcccgctg

SEQ ID NO: 48435 - DNA, 15 bp, Homo sapiens
atgtgttcccgctgt

SEQ ID NO: 48436 - DNA, 15 bp, Homo sapiens
tgtgttcccgctgtg

SEQ ID NO: 48437 - DNA, 15 bp, Homo sapiens
gtgttcccgctgtgc

SEQ ID NO: 48438 - DNA, 15 bp, Homo sapiens
tgttcccgctgtgct

SEQ ID NO: 48439 - DNA, 15 bp, Homo sapiens
gttcccgctgtgctg

SEQ ID NO: 48440 - DNA, 15 bp, Homo sapiens
ttcccgctgtgctgt

SEQ ID NO: 48441 - DNA, 15 bp, Homo sapiens
tcccgctgtgctgtg

SEQ ID NO: 48442 - DNA, 15 bp, Homo sapiens
cccgctgtgctgtgt

SEQ ID NO: 48443 - DNA, 15 bp, Homo sapiens
ccgctgtgctgtgtg

SEQ ID NO: 48444 - DNA, 15 bp, Homo sapiens
cgctgtgctgtgtgg

SEQ ID NO: 48445 - DNA, 15 bp, Homo sapiens
gctgtgctgtgtggc

SEQ ID NO: 48446 - DNA, 15 bp, Homo sapiens
ctgtgctgtgtggct

SEQ ID NO: 48447 - DNA, 15 bp, Homo sapiens
tgtgctgtgtggctg

SEQ ID NO: 48448 - DNA, 15 bp, Homo sapiens
gtgctgtgtggctgt

SEQ ID NO: 48449 - DNA, 15 bp, Homo sapiens
tgctgtgtggctgtt

SEQ ID NO: 48450 - DNA, 15 bp, Homo sapiens
gctgtgtggctgttt

SEQ ID NO: 48451 - DNA, 15 bp, Homo sapiens
ctgtgtggctgtttt

SEQ ID NO: 48452 - DNA, 15 bp, Homo sapiens
tgtgtggctgttttg

SEQ ID NO: 48453 - DNA, 15 bp, Homo sapiens
gtgtggctgttttgc

SEQ ID NO: 48454 - DNA, 15 bp, Homo sapiens
tgtggctgttttgca

SEQ ID NO: 48455 - DNA, 15 bp, Homo sapiens
gtggctgttttgcag

SEQ ID NO: 48456 - DNA, 15 bp, Homo sapiens
tggctgttttgcagt

SEQ ID NO: 48457 - DNA, 15 bp, Homo sapiens
ggctgttttgcagtt

SEQ ID NO: 48458 - DNA, 15 bp, Homo sapiens
gctgttttgcagtta

SEQ ID NO: 48459 - DNA, 15 bp, Homo sapiens
ctgttttgcagttac

SEQ ID NO: 48460 - DNA, 15 bp, Homo sapiens
tgttttgcagttact

SEQ ID NO: 48461 - DNA, 15 bp, Homo sapiens
gttttgcagttactg

SEQ ID NO: 48462 - DNA, 15 bp, Homo sapiens
ttttgcagttactgt

SEQ ID NO: 48463 - DNA, 15 bp, Homo sapiens
tttgcagttactgta

SEQ ID NO: 48464 - DNA, 15 bp, Homo sapiens
ttgcagttactgtag

SEQ ID NO: 48465 - DNA, 15 bp, Homo sapiens
tgcagttactgtaga

SEQ ID NO: 48466 - DNA, 15 bp, Homo sapiens
gcagttactgtagac

SEQ ID NO: 48467 - DNA, 15 bp, Homo sapiens
cagttactgtagaca

SEQ ID NO: 48468 - DNA, 15 bp, Homo sapiens
agttactgtagacac

SEQ ID NO: 48469 - DNA, 15 bp, Homo sapiens
gttactgtagacact

SEQ ID NO: 48470 - DNA, 15 bp, Homo sapiens
ttactgtagacactg

SEQ ID NO: 48471 - DNA, 15 bp, Homo sapiens
tactgtagacactgt

SEQ ID NO: 48472 - DNA, 15 bp, Homo sapiens
actgtagacactgta

SEQ ID NO: 48473 - DNA, 15 bp, Homo sapiens
ctgtagacactgtag

SEQ ID NO: 48474 - DNA, 15 bp, Homo sapiens
tgtagacactgtagt

SEQ ID NO: 48475 - DNA, 15 bp, Homo sapiens
gtagacactgtagtc

SEQ ID NO: 48476 - DNA, 15 bp, Homo sapiens
tagacactgtagtct

SEQ ID NO: 48477 - DNA, 15 bp, Homo sapiens
agacactgtagtctg

SEQ ID NO: 48478 - DNA, 15 bp, Homo sapiens
gacactgtagtctgg

SEQ ID NO: 48479 - DNA, 15 bp, Homo sapiens
acactgtagtctggg

SEQ ID NO: 48480 - DNA, 15 bp, Homo sapiens
cactgtagtctgggc

SEQ ID NO: 48481 - DNA, 15 bp, Homo sapiens
actgtagtctgggct

SEQ ID NO: 48482 - DNA, 15 bp, Homo sapiens
ctgtagtctgggctc

SEQ ID NO: 48483 - DNA, 15 bp, Homo sapiens
tgtagtctgggctct

SEQ ID NO: 48484 - DNA, 15 bp, Homo sapiens
gtagtctgggctctc

SEQ ID NO: 48485 - DNA, 15 bp, Homo sapiens
tagtctgggctctca

SEQ ID NO: 48486 - DNA, 15 bp, Homo sapiens
agtctgggctctcat

SEQ ID NO: 48487 - DNA, 15 bp, Homo sapiens
gtctgggctctcatt

SEQ ID NO: 48488 - DNA, 15 bp, Homo sapiens
tctgggctctcatta

SEQ ID NO: 48489 - DNA, 15 bp, Homo sapiens
ctgggctctcattat

SEQ ID NO: 48490 - DNA, 15 bp, Homo sapiens
tgggctctcattatt

SEQ ID NO: 48491 - DNA, 15 bp, Homo sapiens
gggctctcattattg

SEQ ID NO: 48492 - DNA, 15 bp, Homo sapiens
ggctctcattattgc

SEQ ID NO: 48493 - DNA, 15 bp, Homo sapiens
gctctcattattgcc

SEQ ID NO: 48494 - DNA, 15 bp, Homo sapiens
ctctcattattgcct

SEQ ID NO: 48495 - DNA, 15 bp, Homo sapiens
tctcattattgcctc

SEQ ID NO: 48496 - DNA, 15 bp, Homo sapiens
ctcattattgcctct

SEQ ID NO: 48497 - DNA, 15 bp, Homo sapiens
tcattattgcctctg

SEQ ID NO: 48498 - DNA, 15 bp, Homo sapiens
cattattgcctctga

SEQ ID NO: 48499 - DNA, 15 bp, Homo sapiens
attattgcctctgaa

SEQ ID NO: 48500 - DNA, 15 bp, Homo sapiens
ttattgcctctgaag

SEQ ID NO: 48501 - DNA, 15 bp, Homo sapiens
tattgcctctgaagt

SEQ ID NO: 48502 - DNA, 15 bp, Homo sapiens
attgcctctgaagtt

SEQ ID NO: 48503 - DNA, 15 bp, Homo sapiens
ttgcctctgaagttg

SEQ ID NO: 48504 - DNA, 15 bp, Homo sapiens
tgcctctgaagttga

SEQ ID NO: 48505 - DNA, 15 bp, Homo sapiens
gcctctgaagttgac

SEQ ID NO: 48506 - DNA, 15 bp, Homo sapiens
cctctgaagttgaca

SEQ ID NO: 48507 - DNA, 15 bp, Homo sapiens
ctctgaagttgacag

SEQ ID NO: 48508 - DNA, 15 bp, Homo sapiens
tctgaagttgacagg

SEQ ID NO: 48509 - DNA, 15 bp, Homo sapiens
ctgaagttgacagga

SEQ ID NO: 48510 - DNA, 15 bp, Homo sapiens
tgaagttgacaggac

SEQ ID NO: 48511 - DNA, 15 bp, Homo sapiens
gaagttgacaggacc

SEQ ID NO: 48512 - DNA, 15 bp, Homo sapiens
aagttgacaggacca

SEQ ID NO: 48513 - DNA, 15 bp, Homo sapiens
agttgacaggaccaa

SEQ ID NO: 48514 - DNA, 15 bp, Homo sapiens
gttgacaggaccaag

SEQ ID NO: 48515 - DNA, 15 bp, Homo sapiens
ttgacaggaccaagc

SEQ ID NO: 48516 - DNA, 15 bp, Homo sapiens
tgacaggaccaagcc

SEQ ID NO: 48517 - DNA, 15 bp, Homo sapiens
gacaggaccaagcct

SEQ ID NO: 48518 - DNA, 15 bp, Homo sapiens
acaggaccaagcctt

SEQ ID NO: 48519 - DNA, 15 bp, Homo sapiens
caggaccaagcctta

SEQ ID NO: 48520 - DNA, 15 bp, Homo sapiens
aggaccaagccttag

SEQ ID NO: 48521 - DNA, 15 bp, Homo sapiens
ggaccaagccttagt

SEQ ID NO: 48522 - DNA, 15 bp, Homo sapiens
gaccaagccttagta

SEQ ID NO: 48523 - DNA, 15 bp, Homo sapiens
accaagccttagtaa

SEQ ID NO: 48524 - DNA, 15 bp, Homo sapiens
ccaagccttagtaag

SEQ ID NO: 48525 - DNA, 15 bp, Homo sapiens
caagccttagtaagg

SEQ ID NO: 48526 - DNA, 15 bp, Homo sapiens
aagccttagtaagga

SEQ ID NO: 48527 - DNA, 15 bp, Homo sapiens
agccttagtaaggat

SEQ ID NO: 48528 - DNA, 15 bp, Homo sapiens
gccttagtaaggatg

SEQ ID NO: 48529 - DNA, 15 bp, Homo sapiens
ccttagtaaggatgc

SEQ ID NO: 48530 - DNA, 15 bp, Homo sapiens
cttagtaaggatgca

SEQ ID NO: 48531 - DNA, 15 bp, Homo sapiens
ttagtaaggatgcac

SEQ ID NO: 48532 - DNA, 15 bp, Homo sapiens
tagtaaggatgcact

SEQ ID NO: 48533 - DNA, 15 bp, Homo sapiens
agtaaggatgcactt

SEQ ID NO: 48534 - DNA, 15 bp, Homo sapiens
gtaaggatgcacttg

SEQ ID NO: 48535 - DNA, 15 bp, Homo sapiens
taaggatgcacttgt

SEQ ID NO: 48536 - DNA, 15 bp, Homo sapiens
aaggatgcacttgtc

SEQ ID NO: 48537 - DNA, 15 bp, Homo sapiens
aggatgcacttgtct

SEQ ID NO: 48538 - DNA, 15 bp, Homo sapiens
ggatgcacttgtctt

SEQ ID NO: 48539 - DNA, 15 bp, Homo sapiens
gatgcacttgtcttc

SEQ ID NO: 48540 - DNA, 15 bp, Homo sapiens
atgcacttgtcttcc

SEQ ID NO: 48541 - DNA, 15 bp, Homo sapiens
tgcacttgtcttcct

SEQ ID NO: 48542 - DNA, 15 bp, Homo sapiens
gcacttgtcttccta

SEQ ID NO: 48543 - DNA, 15 bp, Homo sapiens
cacttgtcttcctag

SEQ ID NO: 48544 - DNA, 15 bp, Homo sapiens
acttgtcttcctagc

SEQ ID NO: 48545 - DNA, 15 bp, Homo sapiens
cttgtcttcctagcc

SEQ ID NO: 48546 - DNA, 15 bp, Homo sapiens
ttgtcttcctagccc

SEQ ID NO: 48547 - DNA, 15 bp, Homo sapiens
tgtcttcctagccca

SEQ ID NO: 48548 - DNA, 15 bp, Homo sapiens
gtcttcctagcccaa

SEQ ID NO: 48549 - DNA, 15 bp, Homo sapiens
tcttcctagcccaag

SEQ ID NO: 48550 - DNA, 15 bp, Homo sapiens
cttcctagcccaaga

SEQ ID NO: 48551 - DNA, 15 bp, Homo sapiens
ttcctagcccaagag

SEQ ID NO: 48552 - DNA, 15 bp, Homo sapiens
tcctagcccaagagc

SEQ ID NO: 48553 - DNA, 15 bp, Homo sapiens
cctagcccaagagct

SEQ ID NO: 48554 - DNA, 15 bp, Homo sapiens
ctagcccaagagcta

SEQ ID NO: 48555 - DNA, 15 bp, Homo sapiens
tagcccaagagctag

SEQ ID NO: 48556 - DNA, 15 bp, Homo sapiens
agcccaagagctagg

SEQ ID NO: 48557 - DNA, 15 bp, Homo sapiens
gcccaagagctaggg

SEQ ID NO: 48558 - DNA, 15 bp, Homo sapiens
cccaagagctagggg

SEQ ID NO: 48559 - DNA, 15 bp, Homo sapiens
ccaagagctaggggt

SEQ ID NO: 48560 - DNA, 15 bp, Homo sapiens
caagagctaggggtg

SEQ ID NO: 48561 - DNA, 15 bp, Homo sapiens
aagagctaggggtgt

SEQ ID NO: 48562 - DNA, 15 bp, Homo sapiens
agagctaggggtgtt

SEQ ID NO: 48563 - DNA, 15 bp, Homo sapiens
gagctaggggtgttt

SEQ ID NO: 48564 - DNA, 15 bp, Homo sapiens
agctaggggtgtttt

SEQ ID NO: 48565 - DNA, 15 bp, Homo sapiens
gctaggggtgtttta

SEQ ID NO: 48566 - DNA, 15 bp, Homo sapiens
ctaggggtgttttat

SEQ ID NO: 48567 - DNA, 15 bp, Homo sapiens
taggggtgttttata

SEQ ID NO: 48568 - DNA, 15 bp, Homo sapiens
aggggtgttttatat

SEQ ID NO: 48569 - DNA, 15 bp, Homo sapiens
ggggtgttttatata

SEQ ID NO: 48570 - DNA, 15 bp, Homo sapiens
gggtgttttatatat

SEQ ID NO: 48571 - DNA, 15 bp, Homo sapiens
ggtgttttatatata

SEQ ID NO: 48572 - DNA, 15 bp, Homo sapiens
gtgttttatatatat

SEQ ID NO: 48573 - DNA, 15 bp, Homo sapiens
tgttttatatatata

SEQ ID NO: 48574 - DNA, 15 bp, Homo sapiens
gttttatatatatat

SEQ ID NO: 48575 - DNA, 15 bp, Homo sapiens
ttttatatatatatt

SEQ ID NO: 48576 - DNA, 15 bp, Homo sapiens
tttatatatatatta

SEQ ID NO: 48577 - DNA, 15 bp, Homo sapiens
ttatatatatattaa

SEQ ID NO: 48578 - DNA, 15 bp, Homo sapiens
tatatatatattaac

SEQ ID NO: 48579 - DNA, 15 bp, Homo sapiens
atatatatattaact

SEQ ID NO: 48580 - DNA, 15 bp, Homo sapiens
tatatatattaactt

SEQ ID NO: 48581 - DNA, 15 bp, Homo sapiens
atatatattaacttt

SEQ ID NO: 48582 - DNA, 15 bp, Homo sapiens
tatatattaactttc

SEQ ID NO: 48583 - DNA, 15 bp, Homo sapiens
atatattaactttct

SEQ ID NO: 48584 - DNA, 15 bp, Homo sapiens
tatattaactttctt

SEQ ID NO: 48585 - DNA, 15 bp, Homo sapiens
atattaactttcttt

SEQ ID NO: 48586 - DNA, 15 bp, Homo sapiens
tattaactttctttt

SEQ ID NO: 48587 - DNA, 15 bp, Homo sapiens
attaactttcttttt

SEQ ID NO: 48588 - DNA, 15 bp, Homo sapiens
ttaactttctttttt

SEQ ID NO: 48589 - DNA, 15 bp, Homo sapiens
taactttctttttta

SEQ ID NO: 48590 - DNA, 15 bp, Homo sapiens
aactttcttttttag

SEQ ID NO: 48591 - DNA, 15 bp, Homo sapiens
actttcttttttaga

SEQ ID NO: 48592 - DNA, 15 bp, Homo sapiens
ctttcttttttagat

SEQ ID NO: 48593 - DNA, 15 bp, Homo sapiens
tttcttttttagatt

SEQ ID NO: 48594 - DNA, 15 bp, Homo sapiens
ttcttttttagattt

SEQ ID NO: 48595 - DNA, 15 bp, Homo sapiens
tcttttttagatttc

SEQ ID NO: 48596 - DNA, 15 bp, Homo sapiens
cttttttagatttca

SEQ ID NO: 48597 - DNA, 15 bp, Homo sapiens
ttttttagatttcat

SEQ ID NO: 48598 - DNA, 15 bp, Homo sapiens
tttttagatttcata

SEQ ID NO: 48599 - DNA, 15 bp, Homo sapiens
ttttagatttcataa

SEQ ID NO: 48600 - DNA, 15 bp, Homo sapiens
tttagatttcataaa

SEQ ID NO: 48601 - DNA, 15 bp, Homo sapiens
ttagatttcataaac

SEQ ID NO: 48602 - DNA, 15 bp, Homo sapiens
tagatttcataaact

SEQ ID NO: 48603 - DNA, 15 bp, Homo sapiens
agatttcataaactg

SEQ ID NO: 48604 - DNA, 15 bp, Homo sapiens
gatttcataaactgc

SEQ ID NO: 48605 - DNA, 15 bp, Homo sapiens
atttcataaactgct

SEQ ID NO: 48606 - DNA, 15 bp, Homo sapiens
tttcataaactgctc

SEQ ID NO: 48607 - DNA, 15 bp, Homo sapiens
ttcataaactgctct

SEQ ID NO: 48608 - DNA, 15 bp, Homo sapiens
tcataaactgctctc

SEQ ID NO: 48609 - DNA, 15 bp, Homo sapiens
cataaactgctctca

SEQ ID NO: 48610 - DNA, 15 bp, Homo sapiens
ataaactgctctcat

SEQ ID NO: 48611 - DNA, 15 bp, Homo sapiens
taaactgctctcatt

SEQ ID NO: 48612 - DNA, 15 bp, Homo sapiens
aaactgctctcattt

SEQ ID NO: 48613 - DNA, 15 bp, Homo sapiens
aactgctctcatttt

SEQ ID NO: 48614 - DNA, 15 bp, Homo sapiens
actgctctcattttc

SEQ ID NO: 48615 - DNA, 15 bp, Homo sapiens
ctgctctcattttct

SEQ ID NO: 48616 - DNA, 15 bp, Homo sapiens
tgctctcattttctc

SEQ ID NO: 48617 - DNA, 15 bp, Homo sapiens
gctctcattttctct

SEQ ID NO: 48618 - DNA, 15 bp, Homo sapiens
ctctcattttctctt

SEQ ID NO: 48619 - DNA, 15 bp, Homo sapiens
tctcattttctcttt

SEQ ID NO: 48620 - DNA, 15 bp, Homo sapiens
ctcattttctctttt

SEQ ID NO: 48621 - DNA, 15 bp, Homo sapiens
tcattttctcttttc

SEQ ID NO: 48622 - DNA, 15 bp, Homo sapiens
cattttctcttttct

SEQ ID NO: 48623 - DNA, 15 bp, Homo sapiens
attttctcttttctt

SEQ ID NO: 48624 - DNA, 15 bp, Homo sapiens
ttttctcttttcttt

SEQ ID NO: 48625 - DNA, 15 bp, Homo sapiens
tttctcttttctttc

SEQ ID NO: 48626 - DNA, 15 bp, Homo sapiens
ttctcttttctttct

SEQ ID NO: 48627 - DNA, 15 bp, Homo sapiens
tctcttttctttctt

SEQ ID NO: 48628 - DNA, 15 bp, Homo sapiens
ctcttttctttcttt

SEQ ID NO: 48629 - DNA, 15 bp, Homo sapiens
tcttttctttctttc

SEQ ID NO: 48630 - DNA, 15 bp, Homo sapiens
cttttctttctttct

SEQ ID NO: 48631 - DNA, 15 bp, Homo sapiens
ttttctttctttctt

SEQ ID NO: 48632 - DNA, 15 bp, Homo sapiens
tttctttctttcttt

SEQ ID NO: 48633 - DNA, 15 bp, Homo sapiens
ttctttctttctttt

SEQ ID NO: 48634 - DNA, 15 bp, Homo sapiens
tctttctttcttttt

SEQ ID NO: 48635 - DNA, 15 bp, Homo sapiens
ctttctttctttttt

SEQ ID NO: 48636 - DNA, 15 bp, Homo sapiens
tttctttcttttttt

SEQ ID NO: 48637 - DNA, 15 bp, Homo sapiens
ttctttctttttttt

SEQ ID NO: 48638 - DNA, 15 bp, Homo sapiens
tctttcttttttttt

SEQ ID NO: 48639 - DNA, 15 bp, Homo sapiens
tttttttgagacagt

SEQ ID NO: 48640 - DNA, 15 bp, Homo sapiens
ttttttgagacagtc

SEQ ID NO: 48641 - DNA, 15 bp, Homo sapiens
tttttgagacagtct

SEQ ID NO: 48642 - DNA, 15 bp, Homo sapiens
ttttgagacagtctc

SEQ ID NO: 48643 - DNA, 15 bp, Homo sapiens
tttgagacagtctca

SEQ ID NO: 48644 - DNA, 15 bp, Homo sapiens
ttgagacagtctcac

SEQ ID NO: 48645 - DNA, 15 bp, Homo sapiens
tgagacagtctcact

SEQ ID NO: 48646 - DNA, 15 bp, Homo sapiens
gagacagtctcactc

SEQ ID NO: 48647 - DNA, 15 bp, Homo sapiens
agacagtctcactct

SEQ ID NO: 48648 - DNA, 15 bp, Homo sapiens
gacagtctcactctg

SEQ ID NO: 48649 - DNA, 15 bp, Homo sapiens
acagtctcactctgt

SEQ ID NO: 48650 - DNA, 15 bp, Homo sapiens
cagtctcactctgtc

SEQ ID NO: 48651 - DNA, 15 bp, Homo sapiens
cactctgtcacccat

SEQ ID NO: 48652 - DNA, 15 bp, Homo sapiens
actctgtcacccatg

SEQ ID NO: 48653 - DNA, 15 bp, Homo sapiens
ctctgtcacccatgc

SEQ ID NO: 48654 - DNA, 15 bp, Homo sapiens
tctgtcacccatgct

SEQ ID NO: 48655 - DNA, 15 bp, Homo sapiens
ctgtcacccatgctg

SEQ ID NO: 48656 - DNA, 15 bp, Homo sapiens
tgtcacccatgctgg

SEQ ID NO: 48657 - DNA, 15 bp, Homo sapiens
gtcacccatgctgga

SEQ ID NO: 48658 - DNA, 15 bp, Homo sapiens
tcacccatgctggag

SEQ ID NO: 48659 - DNA, 15 bp, Homo sapiens
cacccatgctggagt

SEQ ID NO: 48660 - DNA, 15 bp, Homo sapiens
acccatgctggagtg

SEQ ID NO: 48661 - DNA, 15 bp, Homo sapiens
cccatgctggagtgc

SEQ ID NO: 48662 - DNA, 15 bp, Homo sapiens
ccatgctggagtgca

SEQ ID NO: 48663 - DNA, 15 bp, Homo sapiens
catgctggagtgcag

SEQ ID NO: 48664 - DNA, 15 bp, Homo sapiens
atgctggagtgcagt

SEQ ID NO: 48665 - DNA, 15 bp, Homo sapiens
tgctggagtgcagtg

SEQ ID NO: 48666 - DNA, 15 bp, Homo sapiens
agtggcacgatctca

SEQ ID NO: 48667 - DNA, 15 bp, Homo sapiens
gtggcacgatctcag

SEQ ID NO: 48668 - DNA, 15 bp, Homo sapiens
tggcacgatctcagc

SEQ ID NO: 48669 - DNA, 15 bp, Homo sapiens
ggcacgatctcagct

SEQ ID NO: 48670 - DNA, 15 bp, Homo sapiens
gcacgatctcagctc

SEQ ID NO: 48671 - DNA, 15 bp, Homo sapiens
cacgatctcagctca

SEQ ID NO: 48672 - DNA, 15 bp, Homo sapiens
acgatctcagctcac

SEQ ID NO: 48673 - DNA, 15 bp, Homo sapiens
cgatctcagctcact

SEQ ID NO: 48674 - DNA, 15 bp, Homo sapiens
gatctcagctcactg

SEQ ID NO: 48675 - DNA, 15 bp, Homo sapiens
atctcagctcactgc

SEQ ID NO: 48676 - DNA, 15 bp, Homo sapiens
tctcagctcactgca

SEQ ID NO: 48677 - DNA, 15 bp, Homo sapiens
ctcagctcactgcaa

SEQ ID NO: 48678 - DNA, 15 bp, Homo sapiens
tcagctcactgcaac

SEQ ID NO: 48679 - DNA, 15 bp, Homo sapiens
cagctcactgcaacc

SEQ ID NO: 48680 - DNA, 15 bp, Homo sapiens
agctcactgcaacct

SEQ ID NO: 48681 - DNA, 15 bp, Homo sapiens
aacctctgcctcccg

SEQ ID NO: 48682 - DNA, 15 bp, Homo sapiens
acctctgcctcccgg

SEQ ID NO: 48683 - DNA, 15 bp, Homo sapiens
cctctgcctcccggg

SEQ ID NO: 48684 - DNA, 15 bp, Homo sapiens
ctctgcctcccgggc

SEQ ID NO: 48685 - DNA, 15 bp, Homo sapiens
tctgcctcccgggct

SEQ ID NO: 48686 - DNA, 15 bp, Homo sapiens
ctgcctcccgggctc

SEQ ID NO: 48687 - DNA, 15 bp, Homo sapiens
tgcctcccgggctca

SEQ ID NO: 48688 - DNA, 15 bp, Homo sapiens
gcctcccgggctcaa

SEQ ID NO: 48689 - DNA, 15 bp, Homo sapiens
cctcccgggctcaag

SEQ ID NO: 48690 - DNA, 15 bp, Homo sapiens
ctcccgggctcaagc

SEQ ID NO: 48691 - DNA, 15 bp, Homo sapiens
tcccgggctcaagca

SEQ ID NO: 48692 - DNA, 15 bp, Homo sapiens
cccgggctcaagcag

SEQ ID NO: 48693 - DNA, 15 bp, Homo sapiens
ccgggctcaagcagt

SEQ ID NO: 48694 - DNA, 15 bp, Homo sapiens
cgggctcaagcagtt

SEQ ID NO: 48695 - DNA, 15 bp, Homo sapiens
gggctcaagcagttc

SEQ ID NO: 48696 - DNA, 15 bp, Homo sapiens
ggctcaagcagttct

SEQ ID NO: 48697 - DNA, 15 bp, Homo sapiens
gctcaagcagttctc

SEQ ID NO: 48698 - DNA, 15 bp, Homo sapiens
ctcaagcagttctct

SEQ ID NO: 48699 - DNA, 15 bp, Homo sapiens
tcaagcagttctctg

SEQ ID NO: 48700 - DNA, 15 bp, Homo sapiens
caagcagttctctgc

SEQ ID NO: 48701 - DNA, 15 bp, Homo sapiens
aagcagttctctgcc

SEQ ID NO: 48702 - DNA, 15 bp, Homo sapiens
agcagttctctgcct

SEQ ID NO: 48703 - DNA, 15 bp, Homo sapiens
gcagttctctgcctc

SEQ ID NO: 48704 - DNA, 15 bp, Homo sapiens
cagttctctgcctca

SEQ ID NO: 48705 - DNA, 15 bp, Homo sapiens
agttctctgcctcag

SEQ ID NO: 48706 - DNA, 15 bp, Homo sapiens
gttctctgcctcagc

SEQ ID NO: 48707 - DNA, 15 bp, Homo sapiens
ttctctgcctcagcc

SEQ ID NO: 48708 - DNA, 15 bp, Homo sapiens
tctctgcctcagcct

SEQ ID NO: 48709 - DNA, 15 bp, Homo sapiens
ctctgcctcagcctc

SEQ ID NO: 48710 - DNA, 15 bp, Homo sapiens
tctgcctcagcctcc

SEQ ID NO: 48711 - DNA, 15 bp, Homo sapiens
agcctcccaagtagc

SEQ ID NO: 48712 - DNA, 15 bp, Homo sapiens
ggattacaggcacct

SEQ ID NO: 48713 - DNA, 15 bp, Homo sapiens
gattacaggcacctg

SEQ ID NO: 48714 - DNA, 15 bp, Homo sapiens
attacaggcacctgc

SEQ ID NO: 48715 - DNA, 15 bp, Homo sapiens
ttacaggcacctgcc

SEQ ID NO: 48716 - DNA, 15 bp, Homo sapiens
tacaggcacctgcca

SEQ ID NO: 48717 - DNA, 15 bp, Homo sapiens
acaggcacctgccac

SEQ ID NO: 48718 - DNA, 15 bp, Homo sapiens
caggcacctgccacc

SEQ ID NO: 48719 - DNA, 15 bp, Homo sapiens
aggcacctgccacca

SEQ ID NO: 48720 - DNA, 15 bp, Homo sapiens
ggcacctgccaccac

SEQ ID NO: 48721 - DNA, 15 bp, Homo sapiens
gcacctgccaccacg

SEQ ID NO: 48722 - DNA, 15 bp, Homo sapiens
cacctgccaccacgc

SEQ ID NO: 48723 - DNA, 15 bp, Homo sapiens
acctgccaccacgcc

SEQ ID NO: 48724 - DNA, 15 bp, Homo sapiens
cctgccaccacgcct

SEQ ID NO: 48725 - DNA, 15 bp, Homo sapiens
ctgccaccacgcctg

SEQ ID NO: 48726 - DNA, 15 bp, Homo sapiens
tgccaccacgcctgg

SEQ ID NO: 48727 - DNA, 15 bp, Homo sapiens
gccaccacgcctggc

SEQ ID NO: 48728 - DNA, 15 bp, Homo sapiens
ccaccacgcctggct

SEQ ID NO: 48729 - DNA, 15 bp, Homo sapiens
caccacgcctggcta

SEQ ID NO: 48730 - DNA, 15 bp, Homo sapiens
accacgcctggctaa

SEQ ID NO: 48731 - DNA, 15 bp, Homo sapiens
ccacgcctggctaat

SEQ ID NO: 48732 - DNA, 15 bp, Homo sapiens
cacgcctggctaatt

SEQ ID NO: 48733 - DNA, 15 bp, Homo sapiens
acgcctggctaattt

SEQ ID NO: 48734 - DNA, 15 bp, Homo sapiens
cgcctggctaatttt

SEQ ID NO: 48735 - DNA, 15 bp, Homo sapiens
cctggctaatttttg

SEQ ID NO: 48736 - DNA, 15 bp, Homo sapiens
ctggctaatttttgt

SEQ ID NO: 48737 - DNA, 15 bp, Homo sapiens
tggctaatttttgta

SEQ ID NO: 48738 - DNA, 15 bp, Homo sapiens
atttttgtatttttt

SEQ ID NO: 48739 - DNA, 15 bp, Homo sapiens
tttttgtattttttt

SEQ ID NO: 48740 - DNA, 15 bp, Homo sapiens
ttttgtatttttttt

SEQ ID NO: 48741 - DNA, 15 bp, Homo sapiens
tttgtattttttttt

SEQ ID NO: 48742 - DNA, 15 bp, Homo sapiens
ttgtatttttttttt

SEQ ID NO: 48743 - DNA, 15 bp, Homo sapiens
tgtattttttttttt

SEQ ID NO: 48744 - DNA, 15 bp, Homo sapiens
gtatttttttttttt

SEQ ID NO: 48745 - DNA, 15 bp, Homo sapiens
tattttttttttttt

SEQ ID NO: 48746 - DNA, 15 bp, Homo sapiens
tttttttttttttag

SEQ ID NO: 48747 - DNA, 15 bp, Homo sapiens
ttttttttttttagt

SEQ ID NO: 48748 - DNA, 15 bp, Homo sapiens
tttttttttttagtc

SEQ ID NO: 48749 - DNA, 15 bp, Homo sapiens
ttttttttttagtcg

SEQ ID NO: 48750 - DNA, 15 bp, Homo sapiens
tttttttttagtcga

SEQ ID NO: 48751 - DNA, 15 bp, Homo sapiens
ttttttttagtcgag

SEQ ID NO: 48752 - DNA, 15 bp, Homo sapiens
tttttttagtcgaga

SEQ ID NO: 48753 - DNA, 15 bp, Homo sapiens
ttttttagtcgagac

SEQ ID NO: 48754 - DNA, 15 bp, Homo sapiens
tttttagtcgagacg

SEQ ID NO: 48755 - DNA, 15 bp, Homo sapiens
ttttagtcgagacgg

SEQ ID NO: 48756 - DNA, 15 bp, Homo sapiens
tttagtcgagacggg

SEQ ID NO: 48757 - DNA, 15 bp, Homo sapiens
ttagtcgagacgggg

SEQ ID NO: 48758 - DNA, 15 bp, Homo sapiens
tagtcgagacggggt

SEQ ID NO: 48759 - DNA, 15 bp, Homo sapiens
agtcgagacggggtt

SEQ ID NO: 48760 - DNA, 15 bp, Homo sapiens
gtcgagacggggttt

SEQ ID NO: 48761 - DNA, 15 bp, Homo sapiens
tcgagacggggtttc

SEQ ID NO: 48762 - DNA, 15 bp, Homo sapiens
cgagacggggtttca

SEQ ID NO: 48763 - DNA, 15 bp, Homo sapiens
gacggggtttcacca

SEQ ID NO: 48764 - DNA, 15 bp, Homo sapiens
acggggtttcaccat

SEQ ID NO: 48765 - DNA, 15 bp, Homo sapiens
cggggtttcaccatc

SEQ ID NO: 48766 - DNA, 15 bp, Homo sapiens
ggggtttcaccatct

SEQ ID NO: 48767 - DNA, 15 bp, Homo sapiens
gggtttcaccatctt

SEQ ID NO: 48768 - DNA, 15 bp, Homo sapiens
ggtttcaccatcttg

SEQ ID NO: 48769 - DNA, 15 bp, Homo sapiens
gtttcaccatcttgg

SEQ ID NO: 48770 - DNA, 15 bp, Homo sapiens
tttcaccatcttggc

SEQ ID NO: 48771 - DNA, 15 bp, Homo sapiens
ttcaccatcttggcc

SEQ ID NO: 48772 - DNA, 15 bp, Homo sapiens
tcaccatcttggcca

SEQ ID NO: 48773 - DNA, 15 bp, Homo sapiens
caccatcttggccac

SEQ ID NO: 48774 - DNA, 15 bp, Homo sapiens
accatcttggccacg

SEQ ID NO: 48775 - DNA, 15 bp, Homo sapiens
ccatcttggccacgc

SEQ ID NO: 48776 - DNA, 15 bp, Homo sapiens
catcttggccacgct

SEQ ID NO: 48777 - DNA, 15 bp, Homo sapiens
atcttggccacgctg

SEQ ID NO: 48778 - DNA, 15 bp, Homo sapiens
tcttggccacgctgg

SEQ ID NO: 48779 - DNA, 15 bp, Homo sapiens
cttggccacgctggt

SEQ ID NO: 48780 - DNA, 15 bp, Homo sapiens
ttggccacgctggtc

SEQ ID NO: 48781 - DNA, 15 bp, Homo sapiens
tggccacgctggtct

SEQ ID NO: 48782 - DNA, 15 bp, Homo sapiens
ggccacgctggtctt

SEQ ID NO: 48783 - DNA, 15 bp, Homo sapiens
gccacgctggtcttg

SEQ ID NO: 48784 - DNA, 15 bp, Homo sapiens
ccacgctggtcttga

SEQ ID NO: 48785 - DNA, 15 bp, Homo sapiens
cacgctggtcttgaa

SEQ ID NO: 48786 - DNA, 15 bp, Homo sapiens
acgctggtcttgaac

SEQ ID NO: 48787 - DNA, 15 bp, Homo sapiens
cgctggtcttgaact

SEQ ID NO: 48788 - DNA, 15 bp, Homo sapiens
gaactcctgacctcg

SEQ ID NO: 48789 - DNA, 15 bp, Homo sapiens
aactcctgacctcgt

SEQ ID NO: 48790 - DNA, 15 bp, Homo sapiens
actcctgacctcgtg

SEQ ID NO: 48791 - DNA, 15 bp, Homo sapiens
ctgacctcgtgatcc

SEQ ID NO: 48792 - DNA, 15 bp, Homo sapiens
tgacctcgtgatcca

SEQ ID NO: 48793 - DNA, 15 bp, Homo sapiens
gacctcgtgatccac

SEQ ID NO: 48794 - DNA, 15 bp, Homo sapiens
acctcgtgatccacc

SEQ ID NO: 48795 - DNA, 15 bp, Homo sapiens
cctcgtgatccaccc

SEQ ID NO: 48796 - DNA, 15 bp, Homo sapiens
ctcgtgatccacccg

SEQ ID NO: 48797 - DNA, 15 bp, Homo sapiens
tcgtgatccacccgc

SEQ ID NO: 48798 - DNA, 15 bp, Homo sapiens
cgtgatccacccgct

SEQ ID NO: 48799 - DNA, 15 bp, Homo sapiens
gtgatccacccgctt

SEQ ID NO: 48800 - DNA, 15 bp, Homo sapiens
tgatccacccgcttc

SEQ ID NO: 48801 - DNA, 15 bp, Homo sapiens
gatccacccgcttca

SEQ ID NO: 48802 - DNA, 15 bp, Homo sapiens
atccacccgcttcag

SEQ ID NO: 48803 - DNA, 15 bp, Homo sapiens
tccacccgcttcagc

SEQ ID NO: 48804 - DNA, 15 bp, Homo sapiens
ccacccgcttcagcc

SEQ ID NO: 48805 - DNA, 15 bp, Homo sapiens
cacccgcttcagcct

SEQ ID NO: 48806 - DNA, 15 bp, Homo sapiens
acccgcttcagcctc

SEQ ID NO: 48807 - DNA, 15 bp, Homo sapiens
cccgcttcagcctcc

SEQ ID NO: 48808 - DNA, 15 bp, Homo sapiens
ccgcttcagcctccc

SEQ ID NO: 48809 - DNA, 15 bp, Homo sapiens
cgcttcagcctccca

SEQ ID NO: 48810 - DNA, 15 bp, Homo sapiens
gcttcagcctcccaa

SEQ ID NO: 48811 - DNA, 15 bp, Homo sapiens
cttcagcctcccaaa

SEQ ID NO: 48812 - DNA, 15 bp, Homo sapiens
ttcagcctcccaaag

SEQ ID NO: 48813 - DNA, 15 bp, Homo sapiens
tcagcctcccaaagt

SEQ ID NO: 48814 - DNA, 15 bp, Homo sapiens
cagcctcccaaagtg

SEQ ID NO: 48815 - DNA, 15 bp, Homo sapiens
agcctcccaaagtgc

SEQ ID NO: 48816 - DNA, 15 bp, Homo sapiens
gcctcccaaagtgca

SEQ ID NO: 48817 - DNA, 15 bp, Homo sapiens
cctcccaaagtgcag

SEQ ID NO: 48818 - DNA, 15 bp, Homo sapiens
ctcccaaagtgcagg

SEQ ID NO: 48819 - DNA, 15 bp, Homo sapiens
tcccaaagtgcaggg

SEQ ID NO: 48820 - DNA, 15 bp, Homo sapiens
cccaaagtgcaggga

SEQ ID NO: 48821 - DNA, 15 bp, Homo sapiens
ccaaagtgcagggat

SEQ ID NO: 48822 - DNA, 15 bp, Homo sapiens
caaagtgcagggatt

SEQ ID NO: 48823 - DNA, 15 bp, Homo sapiens
aaagtgcagggatta

SEQ ID NO: 48824 - DNA, 15 bp, Homo sapiens
aagtgcagggattac

SEQ ID NO: 48825 - DNA, 15 bp, Homo sapiens
agtgcagggattaca

SEQ ID NO: 48826 - DNA, 15 bp, Homo sapiens
gtgcagggattacag

SEQ ID NO: 48827 - DNA, 15 bp, Homo sapiens
tgcagggattacagg

SEQ ID NO: 48828 - DNA, 15 bp, Homo sapiens
gcagggattacaggc

SEQ ID NO: 48829 - DNA, 15 bp, Homo sapiens
cagggattacaggcg

SEQ ID NO: 48830 - DNA, 15 bp, Homo sapiens
agggattacaggcgt

SEQ ID NO: 48831 - DNA, 15 bp, Homo sapiens
gtgagccaccgcacc

SEQ ID NO: 48832 - DNA, 15 bp, Homo sapiens
tgagccaccgcaccc

SEQ ID NO: 48833 - DNA, 15 bp, Homo sapiens
gagccaccgcaccca

SEQ ID NO: 48834 - DNA, 15 bp, Homo sapiens
agccaccgcacccag

SEQ ID NO: 48835 - DNA, 15 bp, Homo sapiens
gccaccgcacccagc

SEQ ID NO: 48836 - DNA, 15 bp, Homo sapiens
ccaccgcacccagcc

SEQ ID NO: 48837 - DNA, 15 bp, Homo sapiens
caccgcacccagcct

SEQ ID NO: 48838 - DNA, 15 bp, Homo sapiens
accgcacccagcctc

SEQ ID NO: 48839 - DNA, 15 bp, Homo sapiens
ccgcacccagcctct

SEQ ID NO: 48840 - DNA, 15 bp, Homo sapiens
cgcacccagcctctg

SEQ ID NO: 48841 - DNA, 15 bp, Homo sapiens
gcacccagcctctgg

SEQ ID NO: 48842 - DNA, 15 bp, Homo sapiens
cacccagcctctggc

SEQ ID NO: 48843 - DNA, 15 bp, Homo sapiens
acccagcctctggct

SEQ ID NO: 48844 - DNA, 15 bp, Homo sapiens
cccagcctctggctc

SEQ ID NO: 48845 - DNA, 15 bp, Homo sapiens
ccagcctctggctct

SEQ ID NO: 48846 - DNA, 15 bp, Homo sapiens
cagcctctggctctt

SEQ ID NO: 48847 - DNA, 15 bp, Homo sapiens
agcctctggctcttt

SEQ ID NO: 48848 - DNA, 15 bp, Homo sapiens
gcctctggctctttt

SEQ ID NO: 48849 - DNA, 15 bp, Homo sapiens
cctctggctcttttc

SEQ ID NO: 48850 - DNA, 15 bp, Homo sapiens
ctctggctcttttct

SEQ ID NO: 48851 - DNA, 15 bp, Homo sapiens
tctggctcttttctt

SEQ ID NO: 48852 - DNA, 15 bp, Homo sapiens
ctggctcttttcttt

SEQ ID NO: 48853 - DNA, 15 bp, Homo sapiens
tggctcttttctttt

SEQ ID NO: 48854 - DNA, 15 bp, Homo sapiens
ggctcttttcttttt

SEQ ID NO: 48855 - DNA, 15 bp, Homo sapiens
gctcttttctttttg

SEQ ID NO: 48856 - DNA, 15 bp, Homo sapiens
ctcttttctttttga

SEQ ID NO: 48857 - DNA, 15 bp, Homo sapiens
tcttttctttttgac

SEQ ID NO: 48858 - DNA, 15 bp, Homo sapiens
cttttctttttgaca

SEQ ID NO: 48859 - DNA, 15 bp, Homo sapiens
ttttctttttgacat

SEQ ID NO: 48860 - DNA, 15 bp, Homo sapiens
tttctttttgacatg

SEQ ID NO: 48861 - DNA, 15 bp, Homo sapiens
ttctttttgacatga

SEQ ID NO: 48862 - DNA, 15 bp, Homo sapiens
tctttttgacatgaa

SEQ ID NO: 48863 - DNA, 15 bp, Homo sapiens
ctttttgacatgaaa

SEQ ID NO: 48864 - DNA, 15 bp, Homo sapiens
tttttgacatgaaat

SEQ ID NO: 48865 - DNA, 15 bp, Homo sapiens
ttttgacatgaaatc

SEQ ID NO: 48866 - DNA, 15 bp, Homo sapiens
tttgacatgaaatct

SEQ ID NO: 48867 - DNA, 15 bp, Homo sapiens
ttgacatgaaatctt

SEQ ID NO: 48868 - DNA, 15 bp, Homo sapiens
tgacatgaaatctta

SEQ ID NO: 48869 - DNA, 15 bp, Homo sapiens
gacatgaaatcttaa

SEQ ID NO: 48870 - DNA, 15 bp, Homo sapiens
acatgaaatcttaag

SEQ ID NO: 48871 - DNA, 15 bp, Homo sapiens
catgaaatcttaagt

SEQ ID NO: 48872 - DNA, 15 bp, Homo sapiens
atgaaatcttaagtt

SEQ ID NO: 48873 - DNA, 15 bp, Homo sapiens
tgaaatcttaagtta

SEQ ID NO: 48874 - DNA, 15 bp, Homo sapiens
gaaatcttaagttaa

SEQ ID NO: 48875 - DNA, 15 bp, Homo sapiens
aaatcttaagttaat

SEQ ID NO: 48876 - DNA, 15 bp, Homo sapiens
aatcttaagttaatt

SEQ ID NO: 48877 - DNA, 15 bp, Homo sapiens
atcttaagttaatta

SEQ ID NO: 48878 - DNA, 15 bp, Homo sapiens
tcttaagttaattat

SEQ ID NO: 48879 - DNA, 15 bp, Homo sapiens
cttaagttaattatc

SEQ ID NO: 48880 - DNA, 15 bp, Homo sapiens
ttaagttaattatct

SEQ ID NO: 48881 - DNA, 15 bp, Homo sapiens
taagttaattatctt

SEQ ID NO: 48882 - DNA, 15 bp, Homo sapiens
aagttaattatctta

SEQ ID NO: 48883 - DNA, 15 bp, Homo sapiens
agttaattatcttaa

SEQ ID NO: 48884 - DNA, 15 bp, Homo sapiens
gttaattatcttaaa

SEQ ID NO: 48885 - DNA, 15 bp, Homo sapiens
ttaattatcttaaac

SEQ ID NO: 48886 - DNA, 15 bp, Homo sapiens
taattatcttaaact

SEQ ID NO: 48887 - DNA, 15 bp, Homo sapiens
aattatcttaaactt

SEQ ID NO: 48888 - DNA, 15 bp, Homo sapiens
attatcttaaacttt

SEQ ID NO: 48889 - DNA, 15 bp, Homo sapiens
ttatcttaaacttta

SEQ ID NO: 48890 - DNA, 15 bp, Homo sapiens
tatcttaaactttaa

SEQ ID NO: 48891 - DNA, 15 bp, Homo sapiens
atcttaaactttaag

SEQ ID NO: 48892 - DNA, 15 bp, Homo sapiens
tcttaaactttaaga

SEQ ID NO: 48893 - DNA, 15 bp, Homo sapiens
cttaaactttaagaa

SEQ ID NO: 48894 - DNA, 15 bp, Homo sapiens
ttaaactttaagaac

SEQ ID NO: 48895 - DNA, 15 bp, Homo sapiens
taaactttaagaact

SEQ ID NO: 48896 - DNA, 15 bp, Homo sapiens
aaactttaagaacta

SEQ ID NO: 48897 - DNA, 15 bp, Homo sapiens
aactttaagaactag

SEQ ID NO: 48898 - DNA, 15 bp, Homo sapiens
actttaagaactaga

SEQ ID NO: 48899 - DNA, 15 bp, Homo sapiens
ctttaagaactagaa

SEQ ID NO: 48900 - DNA, 15 bp, Homo sapiens
tttaagaactagaag

SEQ ID NO: 48901 - DNA, 15 bp, Homo sapiens
ttaagaactagaagg

SEQ ID NO: 48902 - DNA, 15 bp, Homo sapiens
taagaactagaagga

SEQ ID NO: 48903 - DNA, 15 bp, Homo sapiens
aagaactagaaggat

SEQ ID NO: 48904 - DNA, 15 bp, Homo sapiens
agaactagaaggatt

SEQ ID NO: 48905 - DNA, 15 bp, Homo sapiens
gaactagaaggattc

SEQ ID NO: 48906 - DNA, 15 bp, Homo sapiens
aactagaaggattct

SEQ ID NO: 48907 - DNA, 15 bp, Homo sapiens
actagaaggattctt

SEQ ID NO: 48908 - DNA, 15 bp, Homo sapiens
ctagaaggattctta

SEQ ID NO: 48909 - DNA, 15 bp, Homo sapiens
tagaaggattcttag

SEQ ID NO: 48910 - DNA, 15 bp, Homo sapiens
agaaggattcttagt

SEQ ID NO: 48911 - DNA, 15 bp, Homo sapiens
gaaggattcttagtc

SEQ ID NO: 48912 - DNA, 15 bp, Homo sapiens
aaggattcttagtcc

SEQ ID NO: 48913 - DNA, 15 bp, Homo sapiens
aggattcttagtcca

SEQ ID NO: 48914 - DNA, 15 bp, Homo sapiens
ggattcttagtccag

SEQ ID NO: 48915 - DNA, 15 bp, Homo sapiens
gattcttagtccagc

SEQ ID NO: 48916 - DNA, 15 bp, Homo sapiens
attcttagtccagca

SEQ ID NO: 48917 - DNA, 15 bp, Homo sapiens
ttcttagtccagcac

SEQ ID NO: 48918 - DNA, 15 bp, Homo sapiens
tcttagtccagcacc

SEQ ID NO: 48919 - DNA, 15 bp, Homo sapiens
cttagtccagcacca

SEQ ID NO: 48920 - DNA, 15 bp, Homo sapiens
ttagtccagcaccat

SEQ ID NO: 48921 - DNA, 15 bp, Homo sapiens
tagtccagcaccatc

SEQ ID NO: 48922 - DNA, 15 bp, Homo sapiens
agtccagcaccatca

SEQ ID NO: 48923 - DNA, 15 bp, Homo sapiens
gtccagcaccatcag

SEQ ID NO: 48924 - DNA, 15 bp, Homo sapiens
tccagcaccatcagt

SEQ ID NO: 48925 - DNA, 15 bp, Homo sapiens
ccagcaccatcagtt

SEQ ID NO: 48926 - DNA, 15 bp, Homo sapiens
cagcaccatcagttt

SEQ ID NO: 48927 - DNA, 15 bp, Homo sapiens
agcaccatcagttta

SEQ ID NO: 48928 - DNA, 15 bp, Homo sapiens
gcaccatcagtttac

SEQ ID NO: 48929 - DNA, 15 bp, Homo sapiens
caccatcagtttaca

SEQ ID NO: 48930 - DNA, 15 bp, Homo sapiens
accatcagtttacaa

SEQ ID NO: 48931 - DNA, 15 bp, Homo sapiens
ccatcagtttacaaa

SEQ ID NO: 48932 - DNA, 15 bp, Homo sapiens
catcagtttacaaac

SEQ ID NO: 48933 - DNA, 15 bp, Homo sapiens
atcagtttacaaaca

SEQ ID NO: 48934 - DNA, 15 bp, Homo sapiens
tcagtttacaaacaa

SEQ ID NO: 48935 - DNA, 15 bp, Homo sapiens
cagtttacaaacaaa

SEQ ID NO: 48936 - DNA, 15 bp, Homo sapiens
agtttacaaacaaaa

SEQ ID NO: 48937 - DNA, 15 bp, Homo sapiens
gtttacaaacaaaaa

SEQ ID NO: 48938 - DNA, 15 bp, Homo sapiens
tttacaaacaaaaaa

SEQ ID NO: 48939 - DNA, 15 bp, Homo sapiens
ttacaaacaaaaaaa

SEQ ID NO: 48940 - DNA, 15 bp, Homo sapiens
tacaaacaaaaaaaa

SEQ ID NO: 48941 - DNA, 15 bp, Homo sapiens
acaaacaaaaaaaac

SEQ ID NO: 48942 - DNA, 15 bp, Homo sapiens
caaacaaaaaaaact

SEQ ID NO: 48943 - DNA, 15 bp, Homo sapiens
aaacaaaaaaaactt

SEQ ID NO: 48944 - DNA, 15 bp, Homo sapiens
aacaaaaaaaacttg

SEQ ID NO: 48945 - DNA, 15 bp, Homo sapiens
acaaaaaaaacttgt

SEQ ID NO: 48946 - DNA, 15 bp, Homo sapiens
caaaaaaaacttgtg

SEQ ID NO: 48947 - DNA, 15 bp, Homo sapiens
aaaaaaaacttgtgt

SEQ ID NO: 48948 - DNA, 15 bp, Homo sapiens
aaaaaaacttgtgtc

SEQ ID NO: 48949 - DNA, 15 bp, Homo sapiens
aaaaaacttgtgtcc

SEQ ID NO: 48950 - DNA, 15 bp, Homo sapiens
aaaaacttgtgtccc

SEQ ID NO: 48951 - DNA, 15 bp, Homo sapiens
aaaacttgtgtccct

SEQ ID NO: 48952 - DNA, 15 bp, Homo sapiens
aaacttgtgtccctg

SEQ ID NO: 48953 - DNA, 15 bp, Homo sapiens
aacttgtgtccctga

SEQ ID NO: 48954 - DNA, 15 bp, Homo sapiens
acttgtgtccctgag

SEQ ID NO: 48955 - DNA, 15 bp, Homo sapiens
cttgtgtccctgaga

SEQ ID NO: 48956 - DNA, 15 bp, Homo sapiens
ttgtgtccctgagaa

SEQ ID NO: 48957 - DNA, 15 bp, Homo sapiens
tgtgtccctgagaag

SEQ ID NO: 48958 - DNA, 15 bp, Homo sapiens
gtgtccctgagaagt

SEQ ID NO: 48959 - DNA, 15 bp, Homo sapiens
tgtccctgagaagtt

SEQ ID NO: 48960 - DNA, 15 bp, Homo sapiens
gtccctgagaagttg

SEQ ID NO: 48961 - DNA, 15 bp, Homo sapiens
tccctgagaagttgt

SEQ ID NO: 48962 - DNA, 15 bp, Homo sapiens
ccctgagaagttgtg

SEQ ID NO: 48963 - DNA, 15 bp, Homo sapiens
cctgagaagttgtga

SEQ ID NO: 48964 - DNA, 15 bp, Homo sapiens
ctgagaagttgtgac

SEQ ID NO: 48965 - DNA, 15 bp, Homo sapiens
tgagaagttgtgact

SEQ ID NO: 48966 - DNA, 15 bp, Homo sapiens
gagaagttgtgactt

SEQ ID NO: 48967 - DNA, 15 bp, Homo sapiens
agaagttgtgacttt

SEQ ID NO: 48968 - DNA, 15 bp, Homo sapiens
gaagttgtgactttt

SEQ ID NO: 48969 - DNA, 15 bp, Homo sapiens
aagttgtgacttttc

SEQ ID NO: 48970 - DNA, 15 bp, Homo sapiens
agttgtgacttttcc

SEQ ID NO: 48971 - DNA, 15 bp, Homo sapiens
gttgtgacttttcca

SEQ ID NO: 48972 - DNA, 15 bp, Homo sapiens
ttgtgacttttccag

SEQ ID NO: 48973 - DNA, 15 bp, Homo sapiens
tgtgacttttccagg

SEQ ID NO: 48974 - DNA, 15 bp, Homo sapiens
gtgacttttccaggg

SEQ ID NO: 48975 - DNA, 15 bp, Homo sapiens
tgacttttccagggc

SEQ ID NO: 48976 - DNA, 15 bp, Homo sapiens
gacttttccagggcc

SEQ ID NO: 48977 - DNA, 15 bp, Homo sapiens
acttttccagggcct

SEQ ID NO: 48978 - DNA, 15 bp, Homo sapiens
cttttccagggcctc

SEQ ID NO: 48979 - DNA, 15 bp, Homo sapiens
ttttccagggcctcc

SEQ ID NO: 48980 - DNA, 15 bp, Homo sapiens
tttccagggcctcct

SEQ ID NO: 48981 - DNA, 15 bp, Homo sapiens
ttccagggcctccta

SEQ ID NO: 48982 - DNA, 15 bp, Homo sapiens
tccagggcctcctag

SEQ ID NO: 48983 - DNA, 15 bp, Homo sapiens
ccagggcctcctagc

SEQ ID NO: 48984 - DNA, 15 bp, Homo sapiens
cagggcctcctagcc

SEQ ID NO: 48985 - DNA, 15 bp, Homo sapiens
agggcctcctagcca

SEQ ID NO: 48986 - DNA, 15 bp, Homo sapiens
gggcctcctagccag

SEQ ID NO: 48987 - DNA, 15 bp, Homo sapiens
ggcctcctagccagg

SEQ ID NO: 48988 - DNA, 15 bp, Homo sapiens
gcctcctagccagga

SEQ ID NO: 48989 - DNA, 15 bp, Homo sapiens
cctcctagccaggat

SEQ ID NO: 48990 - DNA, 15 bp, Homo sapiens
ctcctagccaggata

SEQ ID NO: 48991 - DNA, 15 bp, Homo sapiens
tcctagccaggatac

SEQ ID NO: 48992 - DNA, 15 bp, Homo sapiens
cctagccaggatacc

SEQ ID NO: 48993 - DNA, 15 bp, Homo sapiens
ctagccaggatacca

SEQ ID NO: 48994 - DNA, 15 bp, Homo sapiens
tagccaggataccag

SEQ ID NO: 48995 - DNA, 15 bp, Homo sapiens
agccaggataccagt

SEQ ID NO: 48996 - DNA, 15 bp, Homo sapiens
gccaggataccagtt

SEQ ID NO: 48997 - DNA, 15 bp, Homo sapiens
ccaggataccagttt

SEQ ID NO: 48998 - DNA, 15 bp, Homo sapiens
caggataccagtttg

SEQ ID NO: 48999 - DNA, 15 bp, Homo sapiens
aggataccagtttgg

SEQ ID NO: 49000 - DNA, 15 bp, Homo sapiens
ggataccagtttggt

SEQ ID NO: 49001 - DNA, 15 bp, Homo sapiens
gataccagtttggtt

SEQ ID NO: 49002 - DNA, 15 bp, Homo sapiens
ataccagtttggttt

SEQ ID NO: 49003 - DNA, 15 bp, Homo sapiens
taccagtttggtttt

SEQ ID NO: 49004 - DNA, 15 bp, Homo sapiens
accagtttggttttt

SEQ ID NO: 49005 - DNA, 15 bp, Homo sapiens
ccagtttggttttta

SEQ ID NO: 49006 - DNA, 15 bp, Homo sapiens
cagtttggtttttat

SEQ ID NO: 49007 - DNA, 15 bp, Homo sapiens
agtttggtttttatt

SEQ ID NO: 49008 - DNA, 15 bp, Homo sapiens
gtttggtttttatta

SEQ ID NO: 49009 - DNA, 15 bp, Homo sapiens
tttggtttttattat

SEQ ID NO: 49010 - DNA, 15 bp, Homo sapiens
ttggtttttattata

SEQ ID NO: 49011 - DNA, 15 bp, Homo sapiens
tggtttttattatat

SEQ ID NO: 49012 - DNA, 15 bp, Homo sapiens
ggtttttattatata

SEQ ID NO: 49013 - DNA, 15 bp, Homo sapiens
gtttttattatatag

SEQ ID NO: 49014 - DNA, 15 bp, Homo sapiens
tttttattatatagc

SEQ ID NO: 49015 - DNA, 15 bp, Homo sapiens
ttttattatatagct

SEQ ID NO: 49016 - DNA, 15 bp, Homo sapiens
tttattatatagcta

SEQ ID NO: 49017 - DNA, 15 bp, Homo sapiens
ttattatatagctag

SEQ ID NO: 49018 - DNA, 15 bp, Homo sapiens
tattatatagctagc

SEQ ID NO: 49019 - DNA, 15 bp, Homo sapiens
attatatagctagcc

SEQ ID NO: 49020 - DNA, 15 bp, Homo sapiens
ttatatagctagccg

SEQ ID NO: 49021 - DNA, 15 bp, Homo sapiens
tatatagctagccga

SEQ ID NO: 49022 - DNA, 15 bp, Homo sapiens
atatagctagccgag

SEQ ID NO: 49023 - DNA, 15 bp, Homo sapiens
tatagctagccgagt

SEQ ID NO: 49024 - DNA, 15 bp, Homo sapiens
atagctagccgagta

SEQ ID NO: 49025 - DNA, 15 bp, Homo sapiens
tagctagccgagtaa

SEQ ID NO: 49026 - DNA, 15 bp, Homo sapiens
agctagccgagtaat

SEQ ID NO: 49027 - DNA, 15 bp, Homo sapiens
gctagccgagtaata

SEQ ID NO: 49028 - DNA, 15 bp, Homo sapiens
ctagccgagtaatac

SEQ ID NO: 49029 - DNA, 15 bp, Homo sapiens
tagccgagtaatact

SEQ ID NO: 49030 - DNA, 15 bp, Homo sapiens
agccgagtaatacta

SEQ ID NO: 49031 - DNA, 15 bp, Homo sapiens
gccgagtaatactat

SEQ ID NO: 49032 - DNA, 15 bp, Homo sapiens
ccgagtaatactatt

SEQ ID NO: 49033 - DNA, 15 bp, Homo sapiens
cgagtaatactatta

SEQ ID NO: 49034 - DNA, 15 bp, Homo sapiens
gagtaatactattaa

SEQ ID NO: 49035 - DNA, 15 bp, Homo sapiens
agtaatactattaac

SEQ ID NO: 49036 - DNA, 15 bp, Homo sapiens
gtaatactattaact

SEQ ID NO: 49037 - DNA, 15 bp, Homo sapiens
taatactattaactt

SEQ ID NO: 49038 - DNA, 15 bp, Homo sapiens
aatactattaacttg

SEQ ID NO: 49039 - DNA, 15 bp, Homo sapiens
atactattaacttga

SEQ ID NO: 49040 - DNA, 15 bp, Homo sapiens
tactattaacttgac

SEQ ID NO: 49041 - DNA, 15 bp, Homo sapiens
actattaacttgact

SEQ ID NO: 49042 - DNA, 15 bp, Homo sapiens
ctattaacttgactt

SEQ ID NO: 49043 - DNA, 15 bp, Homo sapiens
tattaacttgacttc

SEQ ID NO: 49044 - DNA, 15 bp, Homo sapiens
attaacttgacttct

SEQ ID NO: 49045 - DNA, 15 bp, Homo sapiens
ttaacttgacttctg

SEQ ID NO: 49046 - DNA, 15 bp, Homo sapiens
taacttgacttctgg

SEQ ID NO: 49047 - DNA, 15 bp, Homo sapiens
aacttgacttctggg

SEQ ID NO: 49048 - DNA, 15 bp, Homo sapiens
acttgacttctggga

SEQ ID NO: 49049 - DNA, 15 bp, Homo sapiens
cttgacttctgggat

SEQ ID NO: 49050 - DNA, 15 bp, Homo sapiens
ttgacttctgggatt

SEQ ID NO: 49051 - DNA, 15 bp, Homo sapiens
tgacttctgggattt

SEQ ID NO: 49052 - DNA, 15 bp, Homo sapiens
gacttctgggatttc

SEQ ID NO: 49053 - DNA, 15 bp, Homo sapiens
acttctgggatttca

SEQ ID NO: 49054 - DNA, 15 bp, Homo sapiens
cttctgggatttcaa

SEQ ID NO: 49055 - DNA, 15 bp, Homo sapiens
ttctgggatttcaaa

SEQ ID NO: 49056 - DNA, 15 bp, Homo sapiens
tctgggatttcaaag

SEQ ID NO: 49057 - DNA, 15 bp, Homo sapiens
ctgggatttcaaagt

SEQ ID NO: 49058 - DNA, 15 bp, Homo sapiens
tgggatttcaaagta

SEQ ID NO: 49059 - DNA, 15 bp, Homo sapiens
gggatttcaaagtat

SEQ ID NO: 49060 - DNA, 15 bp, Homo sapiens
ggatttcaaagtatt

SEQ ID NO: 49061 - DNA, 15 bp, Homo sapiens
gatttcaaagtattc

SEQ ID NO: 49062 - DNA, 15 bp, Homo sapiens
atttcaaagtattct

SEQ ID NO: 49063 - DNA, 15 bp, Homo sapiens
tttcaaagtattcta

SEQ ID NO: 49064 - DNA, 15 bp, Homo sapiens
ttcaaagtattctat

SEQ ID NO: 49065 - DNA, 15 bp, Homo sapiens
tcaaagtattctatg

SEQ ID NO: 49066 - DNA, 15 bp, Homo sapiens
caaagtattctatga

SEQ ID NO: 49067 - DNA, 15 bp, Homo sapiens
aaagtattctatgac

SEQ ID NO: 49068 - DNA, 15 bp, Homo sapiens
aagtattctatgact

SEQ ID NO: 49069 - DNA, 15 bp, Homo sapiens
agtattctatgactt

SEQ ID NO: 49070 - DNA, 15 bp, Homo sapiens
gtattctatgacttg

SEQ ID NO: 49071 - DNA, 15 bp, Homo sapiens
tattctatgacttga

SEQ ID NO: 49072 - DNA, 15 bp, Homo sapiens
attctatgacttgac

SEQ ID NO: 49073 - DNA, 15 bp, Homo sapiens
ttctatgacttgact

SEQ ID NO: 49074 - DNA, 15 bp, Homo sapiens
tctatgacttgactg

SEQ ID NO: 49075 - DNA, 15 bp, Homo sapiens
ctatgacttgactgt

SEQ ID NO: 49076 - DNA, 15 bp, Homo sapiens
tatgacttgactgtt

SEQ ID NO: 49077 - DNA, 15 bp, Homo sapiens
atgacttgactgttt

SEQ ID NO: 49078 - DNA, 15 bp, Homo sapiens
tgacttgactgttta

SEQ ID NO: 49079 - DNA, 15 bp, Homo sapiens
gacttgactgtttaa

SEQ ID NO: 49080 - DNA, 15 bp, Homo sapiens
acttgactgtttaag

SEQ ID NO: 49081 - DNA, 15 bp, Homo sapiens
cttgactgtttaagg

SEQ ID NO: 49082 - DNA, 15 bp, Homo sapiens
ttgactgtttaaggg

SEQ ID NO: 49083 - DNA, 15 bp, Homo sapiens
tgactgtttaaggga

SEQ ID NO: 49084 - DNA, 15 bp, Homo sapiens
gactgtttaagggaa

SEQ ID NO: 49085 - DNA, 15 bp, Homo sapiens
actgtttaagggaat

SEQ ID NO: 49086 - DNA, 15 bp, Homo sapiens
ctgtttaagggaatt

SEQ ID NO: 49087 - DNA, 15 bp, Homo sapiens
tgtttaagggaatta

SEQ ID NO: 49088 - DNA, 15 bp, Homo sapiens
gtttaagggaattat

SEQ ID NO: 49089 - DNA, 15 bp, Homo sapiens
tttaagggaattatg

SEQ ID NO: 49090 - DNA, 15 bp, Homo sapiens
ttaagggaattatga

SEQ ID NO: 49091 - DNA, 15 bp, Homo sapiens
taagggaattatgag

SEQ ID NO: 49092 - DNA, 15 bp, Homo sapiens
aagggaattatgagg

SEQ ID NO: 49093 - DNA, 15 bp, Homo sapiens
agggaattatgaggc

SEQ ID NO: 49094 - DNA, 15 bp, Homo sapiens
gggaattatgaggcc

SEQ ID NO: 49095 - DNA, 15 bp, Homo sapiens
ggaattatgaggcct

SEQ ID NO: 49096 - DNA, 15 bp, Homo sapiens
gaattatgaggcctc

SEQ ID NO: 49097 - DNA, 15 bp, Homo sapiens
aattatgaggcctca

SEQ ID NO: 49098 - DNA, 15 bp, Homo sapiens
attatgaggcctcac

SEQ ID NO: 49099 - DNA, 15 bp, Homo sapiens
ttatgaggcctcact

SEQ ID NO: 49100 - DNA, 15 bp, Homo sapiens
tatgaggcctcactg

SEQ ID NO: 49101 - DNA, 15 bp, Homo sapiens
atgaggcctcactga

SEQ ID NO: 49102 - DNA, 15 bp, Homo sapiens
tgaggcctcactgaa

SEQ ID NO: 49103 - DNA, 15 bp, Homo sapiens
gaggcctcactgaac

SEQ ID NO: 49104 - DNA, 15 bp, Homo sapiens
aggcctcactgaacc

SEQ ID NO: 49105 - DNA, 15 bp, Homo sapiens
ggcctcactgaacct

SEQ ID NO: 49106 - DNA, 15 bp, Homo sapiens
gcctcactgaacctc

SEQ ID NO: 49107 - DNA, 15 bp, Homo sapiens
cctcactgaacctca

SEQ ID NO: 49108 - DNA, 15 bp, Homo sapiens
ctcactgaacctcaa

SEQ ID NO: 49109 - DNA, 15 bp, Homo sapiens
tcactgaacctcaaa

SEQ ID NO: 49110 - DNA, 15 bp, Homo sapiens
cactgaacctcaaaa

SEQ ID NO: 49111 - DNA, 15 bp, Homo sapiens
actgaacctcaaaag

SEQ ID NO: 49112 - DNA, 15 bp, Homo sapiens
ctgaacctcaaaaga

SEQ ID NO: 49113 - DNA, 15 bp, Homo sapiens
tgaacctcaaaagat

SEQ ID NO: 49114 - DNA, 15 bp, Homo sapiens
gaacctcaaaagata

SEQ ID NO: 49115 - DNA, 15 bp, Homo sapiens
aacctcaaaagataa

SEQ ID NO: 49116 - DNA, 15 bp, Homo sapiens
acctcaaaagataat

SEQ ID NO: 49117 - DNA, 15 bp, Homo sapiens
cctcaaaagataatt

SEQ ID NO: 49118 - DNA, 15 bp, Homo sapiens
ctcaaaagataattt

SEQ ID NO: 49119 - DNA, 15 bp, Homo sapiens
tcaaaagataatttt

SEQ ID NO: 49120 - DNA, 15 bp, Homo sapiens
caaaagataatttta

SEQ ID NO: 49121 - DNA, 15 bp, Homo sapiens
aaaagataattttag

SEQ ID NO: 49122 - DNA, 15 bp, Homo sapiens
aaagataattttagg

SEQ ID NO: 49123 - DNA, 15 bp, Homo sapiens
aagataattttaggt

SEQ ID NO: 49124 - DNA, 15 bp, Homo sapiens
agataattttaggta

SEQ ID NO: 49125 - DNA, 15 bp, Homo sapiens
gataattttaggtac

SEQ ID NO: 49126 - DNA, 15 bp, Homo sapiens
ataattttaggtacc

SEQ ID NO: 49127 - DNA, 15 bp, Homo sapiens
taattttaggtacca

SEQ ID NO: 49128 - DNA, 15 bp, Homo sapiens
aattttaggtaccat

SEQ ID NO: 49129 - DNA, 15 bp, Homo sapiens
attttaggtaccatc

SEQ ID NO: 49130 - DNA, 15 bp, Homo sapiens
ttttaggtaccatcc

SEQ ID NO: 49131 - DNA, 15 bp, Homo sapiens
tttaggtaccatcct

SEQ ID NO: 49132 - DNA, 15 bp, Homo sapiens
ttaggtaccatcctg

SEQ ID NO: 49133 - DNA, 15 bp, Homo sapiens
taggtaccatcctgg

SEQ ID NO: 49134 - DNA, 15 bp, Homo sapiens
aggtaccatcctggt

SEQ ID NO: 49135 - DNA, 15 bp, Homo sapiens
ggtaccatcctggta

SEQ ID NO: 49136 - DNA, 15 bp, Homo sapiens
gtaccatcctggtag

SEQ ID NO: 49137 - DNA, 15 bp, Homo sapiens
taccatcctggtagc

SEQ ID NO: 49138 - DNA, 15 bp, Homo sapiens
accatcctggtagct

SEQ ID NO: 49139 - DNA, 15 bp, Homo sapiens
ccatcctggtagctg

SEQ ID NO: 49140 - DNA, 15 bp, Homo sapiens
catcctggtagctgt

SEQ ID NO: 49141 - DNA, 15 bp, Homo sapiens
atcctggtagctgta

SEQ ID NO: 49142 - DNA, 15 bp, Homo sapiens
tcctggtagctgtag

SEQ ID NO: 49143 - DNA, 15 bp, Homo sapiens
cctggtagctgtaga

SEQ ID NO: 49144 - DNA, 15 bp, Homo sapiens
ctggtagctgtagag

SEQ ID NO: 49145 - DNA, 15 bp, Homo sapiens
tggtagctgtagagc

SEQ ID NO: 49146 - DNA, 15 bp, Homo sapiens
ggtagctgtagagca

SEQ ID NO: 49147 - DNA, 15 bp, Homo sapiens
gtagctgtagagcag

SEQ ID NO: 49148 - DNA, 15 bp, Homo sapiens
tagctgtagagcagc

SEQ ID NO: 49149 - DNA, 15 bp, Homo sapiens
agctgtagagcagca

SEQ ID NO: 49150 - DNA, 15 bp, Homo sapiens
gctgtagagcagcaa

SEQ ID NO: 49151 - DNA, 15 bp, Homo sapiens
ctgtagagcagcaac

SEQ ID NO: 49152 - DNA, 15 bp, Homo sapiens
tgtagagcagcaaca

SEQ ID NO: 49153 - DNA, 15 bp, Homo sapiens
gtagagcagcaacag

SEQ ID NO: 49154 - DNA, 15 bp, Homo sapiens
tagagcagcaacaga

SEQ ID NO: 49155 - DNA, 15 bp, Homo sapiens
agagcagcaacagac

SEQ ID NO: 49156 - DNA, 15 bp, Homo sapiens
gagcagcaacagacc

SEQ ID NO: 49157 - DNA, 15 bp, Homo sapiens
agcagcaacagacca

SEQ ID NO: 49158 - DNA, 15 bp, Homo sapiens
gcagcaacagaccag

SEQ ID NO: 49159 - DNA, 15 bp, Homo sapiens
cagcaacagaccagt

SEQ ID NO: 49160 - DNA, 15 bp, Homo sapiens
agcaacagaccagta

SEQ ID NO: 49161 - DNA, 15 bp, Homo sapiens
gcaacagaccagtaa

SEQ ID NO: 49162 - DNA, 15 bp, Homo sapiens
caacagaccagtaaa

SEQ ID NO: 49163 - DNA, 15 bp, Homo sapiens
aacagaccagtaaaa

SEQ ID NO: 49164 - DNA, 15 bp, Homo sapiens
acagaccagtaaaag

SEQ ID NO: 49165 - DNA, 15 bp, Homo sapiens
cagaccagtaaaaga

SEQ ID NO: 49166 - DNA, 15 bp, Homo sapiens
agaccagtaaaagac

SEQ ID NO: 49167 - DNA, 15 bp, Homo sapiens
gaccagtaaaagact

SEQ ID NO: 49168 - DNA, 15 bp, Homo sapiens
accagtaaaagactt

SEQ ID NO: 49169 - DNA, 15 bp, Homo sapiens
ccagtaaaagacttg

SEQ ID NO: 49170 - DNA, 15 bp, Homo sapiens
cagtaaaagacttgg

SEQ ID NO: 49171 - DNA, 15 bp, Homo sapiens
agtaaaagacttggt

SEQ ID NO: 49172 - DNA, 15 bp, Homo sapiens
gtaaaagacttggtt

SEQ ID NO: 49173 - DNA, 15 bp, Homo sapiens
taaaagacttggttg

SEQ ID NO: 49174 - DNA, 15 bp, Homo sapiens
aaaagacttggttgg

SEQ ID NO: 49175 - DNA, 15 bp, Homo sapiens
aaagacttggttggt

SEQ ID NO: 49176 - DNA, 15 bp, Homo sapiens
aagacttggttggtg

SEQ ID NO: 49177 - DNA, 15 bp, Homo sapiens
agacttggttggtgt

SEQ ID NO: 49178 - DNA, 15 bp, Homo sapiens
gacttggttggtgtt

SEQ ID NO: 49179 - DNA, 15 bp, Homo sapiens
acttggttggtgttg

SEQ ID NO: 49180 - DNA, 15 bp, Homo sapiens
cttggttggtgttgc

SEQ ID NO: 49181 - DNA, 15 bp, Homo sapiens
ttggttggtgttgcc

SEQ ID NO: 49182 - DNA, 15 bp, Homo sapiens
tggttggtgttgccc

SEQ ID NO: 49183 - DNA, 15 bp, Homo sapiens
ggttggtgttgccct

SEQ ID NO: 49184 - DNA, 15 bp, Homo sapiens
gttggtgttgccctt

SEQ ID NO: 49185 - DNA, 15 bp, Homo sapiens
ttggtgttgcccttc

SEQ ID NO: 49186 - DNA, 15 bp, Homo sapiens
tggtgttgcccttct

SEQ ID NO: 49187 - DNA, 15 bp, Homo sapiens
ggtgttgcccttctt

SEQ ID NO: 49188 - DNA, 15 bp, Homo sapiens
gtgttgcccttcttc

SEQ ID NO: 49189 - DNA, 15 bp, Homo sapiens
tgttgcccttcttct

SEQ ID NO: 49190 - DNA, 15 bp, Homo sapiens
gttgcccttcttctg

SEQ ID NO: 49191 - DNA, 15 bp, Homo sapiens
ttgcccttcttctgg

SEQ ID NO: 49192 - DNA, 15 bp, Homo sapiens
tgcccttcttctggg

SEQ ID NO: 49193 - DNA, 15 bp, Homo sapiens
gcccttcttctgggt

SEQ ID NO: 49194 - DNA, 15 bp, Homo sapiens
cccttcttctgggtt

SEQ ID NO: 49195 - DNA, 15 bp, Homo sapiens
ccttcttctgggttt

SEQ ID NO: 49196 - DNA, 15 bp, Homo sapiens
cttcttctgggtttg

SEQ ID NO: 49197 - DNA, 15 bp, Homo sapiens
ttcttctgggtttga

SEQ ID NO: 49198 - DNA, 15 bp, Homo sapiens
tcttctgggtttgat

SEQ ID NO: 49199 - DNA, 15 bp, Homo sapiens
cttctgggtttgatt

SEQ ID NO: 49200 - DNA, 15 bp, Homo sapiens
ttctgggtttgatta

SEQ ID NO: 49201 - DNA, 15 bp, Homo sapiens
tctgggtttgattac

SEQ ID NO: 49202 - DNA, 15 bp, Homo sapiens
ctgggtttgattaca

SEQ ID NO: 49203 - DNA, 15 bp, Homo sapiens
tgggtttgattacat

SEQ ID NO: 49204 - DNA, 15 bp, Homo sapiens
gggtttgattacatg

SEQ ID NO: 49205 - DNA, 15 bp, Homo sapiens
ggtttgattacatga

SEQ ID NO: 49206 - DNA, 15 bp, Homo sapiens
gtttgattacatgag

SEQ ID NO: 49207 - DNA, 15 bp, Homo sapiens
tttgattacatgagt

SEQ ID NO: 49208 - DNA, 15 bp, Homo sapiens
ttgattacatgagta

SEQ ID NO: 49209 - DNA, 15 bp, Homo sapiens
tgattacatgagtaa

SEQ ID NO: 49210 - DNA, 15 bp, Homo sapiens
gattacatgagtaat

SEQ ID NO: 49211 - DNA, 15 bp, Homo sapiens
attacatgagtaatt

SEQ ID NO: 49212 - DNA, 15 bp, Homo sapiens
ttacatgagtaattg

SEQ ID NO: 49213 - DNA, 15 bp, Homo sapiens
tacatgagtaattgt

SEQ ID NO: 49214 - DNA, 15 bp, Homo sapiens
acatgagtaattgtg

SEQ ID NO: 49215 - DNA, 15 bp, Homo sapiens
catgagtaattgtgt

SEQ ID NO: 49216 - DNA, 15 bp, Homo sapiens
atgagtaattgtgtg

SEQ ID NO: 49217 - DNA, 15 bp, Homo sapiens
tgagtaattgtgtga

SEQ ID NO: 49218 - DNA, 15 bp, Homo sapiens
gagtaattgtgtgaa

SEQ ID NO: 49219 - DNA, 15 bp, Homo sapiens
agtaattgtgtgaat

SEQ ID NO: 49220 - DNA, 15 bp, Homo sapiens
gtaattgtgtgaata

SEQ ID NO: 49221 - DNA, 15 bp, Homo sapiens
taattgtgtgaatag

SEQ ID NO: 49222 - DNA, 15 bp, Homo sapiens
aattgtgtgaatagt

SEQ ID NO: 49223 - DNA, 15 bp, Homo sapiens
attgtgtgaatagtc

SEQ ID NO: 49224 - DNA, 15 bp, Homo sapiens
ttgtgtgaatagtct

SEQ ID NO: 49225 - DNA, 15 bp, Homo sapiens
tgtgtgaatagtctc

SEQ ID NO: 49226 - DNA, 15 bp, Homo sapiens
gtgtgaatagtctct

SEQ ID NO: 49227 - DNA, 15 bp, Homo sapiens
tgtgaatagtctcta

SEQ ID NO: 49228 - DNA, 15 bp, Homo sapiens
gtgaatagtctctaa

SEQ ID NO: 49229 - DNA, 15 bp, Homo sapiens
tgaatagtctctaag

SEQ ID NO: 49230 - DNA, 15 bp, Homo sapiens
gaatagtctctaagt

SEQ ID NO: 49231 - DNA, 15 bp, Homo sapiens
aatagtctctaagtt

SEQ ID NO: 49232 - DNA, 15 bp, Homo sapiens
atagtctctaagttg

SEQ ID NO: 49233 - DNA, 15 bp, Homo sapiens
tagtctctaagttgt

SEQ ID NO: 49234 - DNA, 15 bp, Homo sapiens
agtctctaagttgta

SEQ ID NO: 49235 - DNA, 15 bp, Homo sapiens
gtctctaagttgtat

SEQ ID NO: 49236 - DNA, 15 bp, Homo sapiens
tctctaagttgtatg

SEQ ID NO: 49237 - DNA, 15 bp, Homo sapiens
ctctaagttgtatgc

SEQ ID NO: 49238 - DNA, 15 bp, Homo sapiens
tctaagttgtatgct

SEQ ID NO: 49239 - DNA, 15 bp, Homo sapiens
ctaagttgtatgctc

SEQ ID NO: 49240 - DNA, 15 bp, Homo sapiens
taagttgtatgctct

SEQ ID NO: 49241 - DNA, 15 bp, Homo sapiens
aagttgtatgctctg

SEQ ID NO: 49242 - DNA, 15 bp, Homo sapiens
agttgtatgctctga

SEQ ID NO: 49243 - DNA, 15 bp, Homo sapiens
gttgtatgctctgag

SEQ ID NO: 49244 - DNA, 15 bp, Homo sapiens
ttgtatgctctgagc

SEQ ID NO: 49245 - DNA, 15 bp, Homo sapiens
tgtatgctctgagct

SEQ ID NO: 49246 - DNA, 15 bp, Homo sapiens
gtatgctctgagctt

SEQ ID NO: 49247 - DNA, 15 bp, Homo sapiens
tatgctctgagcttt

SEQ ID NO: 49248 - DNA, 15 bp, Homo sapiens
atgctctgagctttc

SEQ ID NO: 49249 - DNA, 15 bp, Homo sapiens
tgctctgagctttcg

SEQ ID NO: 49250 - DNA, 15 bp, Homo sapiens
gctctgagctttcgt

SEQ ID NO: 49251 - DNA, 15 bp, Homo sapiens
ctctgagctttcgtt

SEQ ID NO: 49252 - DNA, 15 bp, Homo sapiens
tctgagctttcgttt

SEQ ID NO: 49253 - DNA, 15 bp, Homo sapiens
ctgagctttcgtttt

SEQ ID NO: 49254 - DNA, 15 bp, Homo sapiens
tgagctttcgttttt

SEQ ID NO: 49255 - DNA, 15 bp, Homo sapiens
gagctttcgttttta

SEQ ID NO: 49256 - DNA, 15 bp, Homo sapiens
agctttcgtttttag

SEQ ID NO: 49257 - DNA, 15 bp, Homo sapiens
gctttcgtttttagc

SEQ ID NO: 49258 - DNA, 15 bp, Homo sapiens
ctttcgtttttagct

SEQ ID NO: 49259 - DNA, 15 bp, Homo sapiens
tttcgtttttagctt

SEQ ID NO: 49260 - DNA, 15 bp, Homo sapiens
ttcgtttttagctta

SEQ ID NO: 49261 - DNA, 15 bp, Homo sapiens
tcgtttttagcttat

SEQ ID NO: 49262 - DNA, 15 bp, Homo sapiens
cgtttttagcttata

SEQ ID NO: 49263 - DNA, 15 bp, Homo sapiens
gtttttagcttataa

SEQ ID NO: 49264 - DNA, 15 bp, Homo sapiens
tttttagcttataaa

SEQ ID NO: 49265 - DNA, 15 bp, Homo sapiens
ttttagcttataaaa

SEQ ID NO: 49266 - DNA, 15 bp, Homo sapiens
tttagcttataaaag

SEQ ID NO: 49267 - DNA, 15 bp, Homo sapiens
ttagcttataaaagt

SEQ ID NO: 49268 - DNA, 15 bp, Homo sapiens
tagcttataaaagtg

SEQ ID NO: 49269 - DNA, 15 bp, Homo sapiens
agcttataaaagtgc

SEQ ID NO: 49270 - DNA, 15 bp, Homo sapiens
gcttataaaagtgct

SEQ ID NO: 49271 - DNA, 15 bp, Homo sapiens
cttataaaagtgcta

SEQ ID NO: 49272 - DNA, 15 bp, Homo sapiens
ttataaaagtgctac

SEQ ID NO: 49273 - DNA, 15 bp, Homo sapiens
tataaaagtgctact

SEQ ID NO: 49274 - DNA, 15 bp, Homo sapiens
ataaaagtgctactc

SEQ ID NO: 49275 - DNA, 15 bp, Homo sapiens
taaaagtgctactct

SEQ ID NO: 49276 - DNA, 15 bp, Homo sapiens
aaaagtgctactctt

SEQ ID NO: 49277 - DNA, 15 bp, Homo sapiens
aaagtgctactcttg

SEQ ID NO: 49278 - DNA, 15 bp, Homo sapiens
aagtgctactcttgg

SEQ ID NO: 49279 - DNA, 15 bp, Homo sapiens
agtgctactcttggg

SEQ ID NO: 49280 - DNA, 15 bp, Homo sapiens
gtgctactcttgggc

SEQ ID NO: 49281 - DNA, 15 bp, Homo sapiens
tgctactcttgggcc

SEQ ID NO: 49282 - DNA, 15 bp, Homo sapiens
gctactcttgggcca

SEQ ID NO: 49283 - DNA, 15 bp, Homo sapiens
ctactcttgggccag

SEQ ID NO: 49284 - DNA, 15 bp, Homo sapiens
tactcttgggccagc

SEQ ID NO: 49285 - DNA, 15 bp, Homo sapiens
actcttgggccagca

SEQ ID NO: 49286 - DNA, 15 bp, Homo sapiens
ctcttgggccagcat

SEQ ID NO: 49287 - DNA, 15 bp, Homo sapiens
tcttgggccagcata

SEQ ID NO: 49288 - DNA, 15 bp, Homo sapiens
cttgggccagcatag

SEQ ID NO: 49289 - DNA, 15 bp, Homo sapiens
ttgggccagcatagt

SEQ ID NO: 49290 - DNA, 15 bp, Homo sapiens
tgggccagcatagta

SEQ ID NO: 49291 - DNA, 15 bp, Homo sapiens
gggccagcatagtat

SEQ ID NO: 49292 - DNA, 15 bp, Homo sapiens
ggccagcatagtatc

SEQ ID NO: 49293 - DNA, 15 bp, Homo sapiens
gccagcatagtatca

SEQ ID NO: 49294 - DNA, 15 bp, Homo sapiens
ccagcatagtatcag

SEQ ID NO: 49295 - DNA, 15 bp, Homo sapiens
cagcatagtatcaga

SEQ ID NO: 49296 - DNA, 15 bp, Homo sapiens
agcatagtatcagaa

SEQ ID NO: 49297 - DNA, 15 bp, Homo sapiens
gcatagtatcagaaa

SEQ ID NO: 49298 - DNA, 15 bp, Homo sapiens
catagtatcagaaat

SEQ ID NO: 49299 - DNA, 15 bp, Homo sapiens
atagtatcagaaatt

SEQ ID NO: 49300 - DNA, 15 bp, Homo sapiens
tagtatcagaaatta

SEQ ID NO: 49301 - DNA, 15 bp, Homo sapiens
agtatcagaaattag

SEQ ID NO: 49302 - DNA, 15 bp, Homo sapiens
gtatcagaaattagc

SEQ ID NO: 49303 - DNA, 15 bp, Homo sapiens
tatcagaaattagct

SEQ ID NO: 49304 - DNA, 15 bp, Homo sapiens
atcagaaattagcta

SEQ ID NO: 49305 - DNA, 15 bp, Homo sapiens
tcagaaattagctaa

SEQ ID NO: 49306 - DNA, 15 bp, Homo sapiens
cagaaattagctaat

SEQ ID NO: 49307 - DNA, 15 bp, Homo sapiens
agaaattagctaatt

SEQ ID NO: 49308 - DNA, 15 bp, Homo sapiens
gaaattagctaattc

SEQ ID NO: 49309 - DNA, 15 bp, Homo sapiens
aaattagctaattca

SEQ ID NO: 49310 - DNA, 15 bp, Homo sapiens
aattagctaattcat

SEQ ID NO: 49311 - DNA, 15 bp, Homo sapiens
attagctaattcata

SEQ ID NO: 49312 - DNA, 15 bp, Homo sapiens
ttagctaattcatat

SEQ ID NO: 49313 - DNA, 15 bp, Homo sapiens
tagctaattcatatg

SEQ ID NO: 49314 - DNA, 15 bp, Homo sapiens
agctaattcatatgg

SEQ ID NO: 49315 - DNA, 15 bp, Homo sapiens
gctaattcatatggg

SEQ ID NO: 49316 - DNA, 15 bp, Homo sapiens
ctaattcatatgggg

SEQ ID NO: 49317 - DNA, 15 bp, Homo sapiens
taattcatatggggc

SEQ ID NO: 49318 - DNA, 15 bp, Homo sapiens
aattcatatggggca

SEQ ID NO: 49319 - DNA, 15 bp, Homo sapiens
attcatatggggcag

SEQ ID NO: 49320 - DNA, 15 bp, Homo sapiens
ttcatatggggcagt

SEQ ID NO: 49321 - DNA, 15 bp, Homo sapiens
tcatatggggcagtt

SEQ ID NO: 49322 - DNA, 15 bp, Homo sapiens
catatggggcagttt

SEQ ID NO: 49323 - DNA, 15 bp, Homo sapiens
atatggggcagttta

SEQ ID NO: 49324 - DNA, 15 bp, Homo sapiens
tatggggcagtttag

SEQ ID NO: 49325 - DNA, 15 bp, Homo sapiens
atggggcagtttagg

SEQ ID NO: 49326 - DNA, 15 bp, Homo sapiens
tggggcagtttaggc

SEQ ID NO: 49327 - DNA, 15 bp, Homo sapiens
ggggcagtttaggct

SEQ ID NO: 49328 - DNA, 15 bp, Homo sapiens
gggcagtttaggctt

SEQ ID NO: 49329 - DNA, 15 bp, Homo sapiens
ggcagtttaggcttt

SEQ ID NO: 49330 - DNA, 15 bp, Homo sapiens
gcagtttaggcttta

SEQ ID NO: 49331 - DNA, 15 bp, Homo sapiens
cagtttaggctttaa

SEQ ID NO: 49332 - DNA, 15 bp, Homo sapiens
agtttaggctttaac

SEQ ID NO: 49333 - DNA, 15 bp, Homo sapiens
gtttaggctttaact

SEQ ID NO: 49334 - DNA, 15 bp, Homo sapiens
tttaggctttaacta

SEQ ID NO: 49335 - DNA, 15 bp, Homo sapiens
ttaggctttaactag

SEQ ID NO: 49336 - DNA, 15 bp, Homo sapiens
taggctttaactagg

SEQ ID NO: 49337 - DNA, 15 bp, Homo sapiens
aggctttaactagga

SEQ ID NO: 49338 - DNA, 15 bp, Homo sapiens
ggctttaactaggaa

SEQ ID NO: 49339 - DNA, 15 bp, Homo sapiens
gctttaactaggaaa

SEQ ID NO: 49340 - DNA, 15 bp, Homo sapiens
ctttaactaggaaat

SEQ ID NO: 49341 - DNA, 15 bp, Homo sapiens
tttaactaggaaatg

SEQ ID NO: 49342 - DNA, 15 bp, Homo sapiens
ttaactaggaaatga

SEQ ID NO: 49343 - DNA, 15 bp, Homo sapiens
taactaggaaatgat

SEQ ID NO: 49344 - DNA, 15 bp, Homo sapiens
aactaggaaatgatg

SEQ ID NO: 49345 - DNA, 15 bp, Homo sapiens
actaggaaatgatgg

SEQ ID NO: 49346 - DNA, 15 bp, Homo sapiens
ctaggaaatgatggt

SEQ ID NO: 49347 - DNA, 15 bp, Homo sapiens
taggaaatgatggtt

SEQ ID NO: 49348 - DNA, 15 bp, Homo sapiens
aggaaatgatggtta

SEQ ID NO: 49349 - DNA, 15 bp, Homo sapiens
ggaaatgatggttat

SEQ ID NO: 49350 - DNA, 15 bp, Homo sapiens
gaaatgatggttatc

SEQ ID NO: 49351 - DNA, 15 bp, Homo sapiens
aaatgatggttatct

SEQ ID NO: 49352 - DNA, 15 bp, Homo sapiens
aatgatggttatctt

SEQ ID NO: 49353 - DNA, 15 bp, Homo sapiens
atgatggttatctta

SEQ ID NO: 49354 - DNA, 15 bp, Homo sapiens
tgatggttatcttaa

SEQ ID NO: 49355 - DNA, 15 bp, Homo sapiens
gatggttatcttaat

SEQ ID NO: 49356 - DNA, 15 bp, Homo sapiens
atggttatcttaatg

SEQ ID NO: 49357 - DNA, 15 bp, Homo sapiens
tggttatcttaatga

SEQ ID NO: 49358 - DNA, 15 bp, Homo sapiens
ggttatcttaatgac

SEQ ID NO: 49359 - DNA, 15 bp, Homo sapiens
gttatcttaatgaca

SEQ ID NO: 49360 - DNA, 15 bp, Homo sapiens
ttatcttaatgacaa

SEQ ID NO: 49361 - DNA, 15 bp, Homo sapiens
tatcttaatgacaaa

SEQ ID NO: 49362 - DNA, 15 bp, Homo sapiens
atcttaatgacaaaa

SEQ ID NO: 49363 - DNA, 15 bp, Homo sapiens
tcttaatgacaaaaa

SEQ ID NO: 49364 - DNA, 15 bp, Homo sapiens
cttaatgacaaaaaa

SEQ ID NO: 49365 - DNA, 15 bp, Homo sapiens
ttaatgacaaaaaag

SEQ ID NO: 49366 - DNA, 15 bp, Homo sapiens
taatgacaaaaaagg

SEQ ID NO: 49367 - DNA, 15 bp, Homo sapiens
aatgacaaaaaaggt

SEQ ID NO: 49368 - DNA, 15 bp, Homo sapiens
atgacaaaaaaggta

SEQ ID NO: 49369 - DNA, 15 bp, Homo sapiens
tgacaaaaaaggtac

SEQ ID NO: 49370 - DNA, 15 bp, Homo sapiens
gacaaaaaaggtact

SEQ ID NO: 49371 - DNA, 15 bp, Homo sapiens
acaaaaaaggtactg

SEQ ID NO: 49372 - DNA, 15 bp, Homo sapiens
caaaaaaggtactga

SEQ ID NO: 49373 - DNA, 15 bp, Homo sapiens
aaaaaaggtactgac

SEQ ID NO: 49374 - DNA, 15 bp, Homo sapiens
aaaaaggtactgaca

SEQ ID NO: 49375 - DNA, 15 bp, Homo sapiens
aaaaggtactgacaa

SEQ ID NO: 49376 - DNA, 15 bp, Homo sapiens
aaaggtactgacaaa

SEQ ID NO: 49377 - DNA, 15 bp, Homo sapiens
aaggtactgacaaaa

SEQ ID NO: 49378 - DNA, 15 bp, Homo sapiens
aggtactgacaaaag

SEQ ID NO: 49379 - DNA, 15 bp, Homo sapiens
ggtactgacaaaagt

SEQ ID NO: 49380 - DNA, 15 bp, Homo sapiens
gtactgacaaaagtc

SEQ ID NO: 49381 - DNA, 15 bp, Homo sapiens
tactgacaaaagtcc

SEQ ID NO: 49382 - DNA, 15 bp, Homo sapiens
actgacaaaagtcct

SEQ ID NO: 49383 - DNA, 15 bp, Homo sapiens
ctgacaaaagtcctt

SEQ ID NO: 49384 - DNA, 15 bp, Homo sapiens
tgacaaaagtccttt

SEQ ID NO: 49385 - DNA, 15 bp, Homo sapiens
gacaaaagtcctttt

SEQ ID NO: 49386 - DNA, 15 bp, Homo sapiens
acaaaagtccttttt

SEQ ID NO: 49387 - DNA, 15 bp, Homo sapiens
caaaagtcctttttt

SEQ ID NO: 49388 - DNA, 15 bp, Homo sapiens
aaaagtccttttttg

SEQ ID NO: 49389 - DNA, 15 bp, Homo sapiens
aaagtccttttttga

SEQ ID NO: 49390 - DNA, 15 bp, Homo sapiens
aagtccttttttgaa

SEQ ID NO: 49391 - DNA, 15 bp, Homo sapiens
agtccttttttgaac

SEQ ID NO: 49392 - DNA, 15 bp, Homo sapiens
gtccttttttgaaca

SEQ ID NO: 49393 - DNA, 15 bp, Homo sapiens
tccttttttgaacat

SEQ ID NO: 49394 - DNA, 15 bp, Homo sapiens
ccttttttgaacatg

SEQ ID NO: 49395 - DNA, 15 bp, Homo sapiens
cttttttgaacatgt

SEQ ID NO: 49396 - DNA, 15 bp, Homo sapiens
ttttttgaacatgtg

SEQ ID NO: 49397 - DNA, 15 bp, Homo sapiens
tttttgaacatgtgt

SEQ ID NO: 49398 - DNA, 15 bp, Homo sapiens
ttttgaacatgtgtt

SEQ ID NO: 49399 - DNA, 15 bp, Homo sapiens
tttgaacatgtgttc

SEQ ID NO: 49400 - DNA, 15 bp, Homo sapiens
ttgaacatgtgttca

SEQ ID NO: 49401 - DNA, 15 bp, Homo sapiens
tgaacatgtgttcaa

SEQ ID NO: 49402 - DNA, 15 bp, Homo sapiens
gaacatgtgttcaaa

SEQ ID NO: 49403 - DNA, 15 bp, Homo sapiens
aacatgtgttcaaaa

SEQ ID NO: 49404 - DNA, 15 bp, Homo sapiens
acatgtgttcaaaag

SEQ ID NO: 49405 - DNA, 15 bp, Homo sapiens
catgtgttcaaaaga

SEQ ID NO: 49406 - DNA, 15 bp, Homo sapiens
atgtgttcaaaagaa

SEQ ID NO: 49407 - DNA, 15 bp, Homo sapiens
tgtgttcaaaagaaa

SEQ ID NO: 49408 - DNA, 15 bp, Homo sapiens
gtgttcaaaagaaaa

SEQ ID NO: 49409 - DNA, 15 bp, Homo sapiens
tgttcaaaagaaaaa

SEQ ID NO: 49410 - DNA, 15 bp, Homo sapiens
gttcaaaagaaaaag

SEQ ID NO: 49411 - DNA, 15 bp, Homo sapiens
ttcaaaagaaaaaga

SEQ ID NO: 49412 - DNA, 15 bp, Homo sapiens
tcaaaagaaaaagag

SEQ ID NO: 49413 - DNA, 15 bp, Homo sapiens
caaaagaaaaagaga

SEQ ID NO: 49414 - DNA, 15 bp, Homo sapiens
aaaagaaaaagagaa

SEQ ID NO: 49415 - DNA, 15 bp, Homo sapiens
aaagaaaaagagaaa

SEQ ID NO: 49416 - DNA, 15 bp, Homo sapiens
aagaaaaagagaaac

SEQ ID NO: 49417 - DNA, 15 bp, Homo sapiens
agaaaaagagaaact

SEQ ID NO: 49418 - DNA, 15 bp, Homo sapiens
gaaaaagagaaacta

SEQ ID NO: 49419 - DNA, 15 bp, Homo sapiens
aaaaagagaaactat

SEQ ID NO: 49420 - DNA, 15 bp, Homo sapiens
aaaagagaaactatc

SEQ ID NO: 49421 - DNA, 15 bp, Homo sapiens
aaagagaaactatca

SEQ ID NO: 49422 - DNA, 15 bp, Homo sapiens
aagagaaactatcaa

SEQ ID NO: 49423 - DNA, 15 bp, Homo sapiens
agagaaactatcaaa

SEQ ID NO: 49424 - DNA, 15 bp, Homo sapiens
gagaaactatcaaac

SEQ ID NO: 49425 - DNA, 15 bp, Homo sapiens
agaaactatcaaact

SEQ ID NO: 49426 - DNA, 15 bp, Homo sapiens
gaaactatcaaacta

SEQ ID NO: 49427 - DNA, 15 bp, Homo sapiens
aaactatcaaactaa

SEQ ID NO: 49428 - DNA, 15 bp, Homo sapiens
aactatcaaactaat

SEQ ID NO: 49429 - DNA, 15 bp, Homo sapiens
actatcaaactaata

SEQ ID NO: 49430 - DNA, 15 bp, Homo sapiens
ctatcaaactaataa

SEQ ID NO: 49431 - DNA, 15 bp, Homo sapiens
tatcaaactaataac

SEQ ID NO: 49432 - DNA, 15 bp, Homo sapiens
atcaaactaataact

SEQ ID NO: 49433 - DNA, 15 bp, Homo sapiens
tcaaactaataactg

SEQ ID NO: 49434 - DNA, 15 bp, Homo sapiens
caaactaataactga

SEQ ID NO: 49435 - DNA, 15 bp, Homo sapiens
aaactaataactgag

SEQ ID NO: 49436 - DNA, 15 bp, Homo sapiens
aactaataactgagt

SEQ ID NO: 49437 - DNA, 15 bp, Homo sapiens
actaataactgagtt

SEQ ID NO: 49438 - DNA, 15 bp, Homo sapiens
ctaataactgagttt

SEQ ID NO: 49439 - DNA, 15 bp, Homo sapiens
taataactgagtttg

SEQ ID NO: 49440 - DNA, 15 bp, Homo sapiens
aataactgagtttgt

SEQ ID NO: 49441 - DNA, 15 bp, Homo sapiens
ataactgagtttgtt

SEQ ID NO: 49442 - DNA, 15 bp, Homo sapiens
taactgagtttgttg

SEQ ID NO: 49443 - DNA, 15 bp, Homo sapiens
aactgagtttgttga

SEQ ID NO: 49444 - DNA, 15 bp, Homo sapiens
actgagtttgttgaa

SEQ ID NO: 49445 - DNA, 15 bp, Homo sapiens
ctgagtttgttgaac

SEQ ID NO: 49446 - DNA, 15 bp, Homo sapiens
tgagtttgttgaaca

SEQ ID NO: 49447 - DNA, 15 bp, Homo sapiens
gagtttgttgaacat

SEQ ID NO: 49448 - DNA, 15 bp, Homo sapiens
agtttgttgaacatc

SEQ ID NO: 49449 - DNA, 15 bp, Homo sapiens
gtttgttgaacatcg

SEQ ID NO: 49450 - DNA, 15 bp, Homo sapiens
tttgttgaacatcga

SEQ ID NO: 49451 - DNA, 15 bp, Homo sapiens
ttgttgaacatcgag

SEQ ID NO: 49452 - DNA, 15 bp, Homo sapiens
tgttgaacatcgaga

SEQ ID NO: 49453 - DNA, 15 bp, Homo sapiens
gttgaacatcgagat

SEQ ID NO: 49454 - DNA, 15 bp, Homo sapiens
ttgaacatcgagatt

SEQ ID NO: 49455 - DNA, 15 bp, Homo sapiens
tgaacatcgagattg

SEQ ID NO: 49456 - DNA, 15 bp, Homo sapiens
gaacatcgagattga

SEQ ID NO: 49457 - DNA, 15 bp, Homo sapiens
aacatcgagattgac

SEQ ID NO: 49458 - DNA, 15 bp, Homo sapiens
acatcgagattgact

SEQ ID NO: 49459 - DNA, 15 bp, Homo sapiens
catcgagattgactg

SEQ ID NO: 49460 - DNA, 15 bp, Homo sapiens
atcgagattgactga

SEQ ID NO: 49461 - DNA, 15 bp, Homo sapiens
tcgagattgactgat

SEQ ID NO: 49462 - DNA, 15 bp, Homo sapiens
cgagattgactgatc

SEQ ID NO: 49463 - DNA, 15 bp, Homo sapiens
gagattgactgatct

SEQ ID NO: 49464 - DNA, 15 bp, Homo sapiens
agattgactgatctg

SEQ ID NO: 49465 - DNA, 15 bp, Homo sapiens
gattgactgatctga

SEQ ID NO: 49466 - DNA, 15 bp, Homo sapiens
attgactgatctgag

SEQ ID NO: 49467 - DNA, 15 bp, Homo sapiens
ttgactgatctgaga

SEQ ID NO: 49468 - DNA, 15 bp, Homo sapiens
tgactgatctgagag

SEQ ID NO: 49469 - DNA, 15 bp, Homo sapiens
gactgatctgagagg

SEQ ID NO: 49470 - DNA, 15 bp, Homo sapiens
actgatctgagaggc

SEQ ID NO: 49471 - DNA, 15 bp, Homo sapiens
ctgatctgagaggct

SEQ ID NO: 49472 - DNA, 15 bp, Homo sapiens
tgatctgagaggctt

SEQ ID NO: 49473 - DNA, 15 bp, Homo sapiens
gatctgagaggctta

SEQ ID NO: 49474 - DNA, 15 bp, Homo sapiens
atctgagaggcttaa

SEQ ID NO: 49475 - DNA, 15 bp, Homo sapiens
tctgagaggcttaaa

SEQ ID NO: 49476 - DNA, 15 bp, Homo sapiens
ctgagaggcttaaaa

SEQ ID NO: 49477 - DNA, 15 bp, Homo sapiens
tgagaggcttaaaac

SEQ ID NO: 49478 - DNA, 15 bp, Homo sapiens
gagaggcttaaaact

SEQ ID NO: 49479 - DNA, 15 bp, Homo sapiens
agaggcttaaaactg

SEQ ID NO: 49480 - DNA, 15 bp, Homo sapiens
gaggcttaaaactga

SEQ ID NO: 49481 - DNA, 15 bp, Homo sapiens
aggcttaaaactgat

SEQ ID NO: 49482 - DNA, 15 bp, Homo sapiens
ggcttaaaactgatt

SEQ ID NO: 49483 - DNA, 15 bp, Homo sapiens
gcttaaaactgattg

SEQ ID NO: 49484 - DNA, 15 bp, Homo sapiens
cttaaaactgattgc

SEQ ID NO: 49485 - DNA, 15 bp, Homo sapiens
ttaaaactgattgcc

SEQ ID NO: 49486 - DNA, 15 bp, Homo sapiens
taaaactgattgccc

SEQ ID NO: 49487 - DNA, 15 bp, Homo sapiens
aaaactgattgccct

SEQ ID NO: 49488 - DNA, 15 bp, Homo sapiens
aaactgattgccctg

SEQ ID NO: 49489 - DNA, 15 bp, Homo sapiens
aactgattgccctga

SEQ ID NO: 49490 - DNA, 15 bp, Homo sapiens
actgattgccctgaa

SEQ ID NO: 49491 - DNA, 15 bp, Homo sapiens
ctgattgccctgaaa

SEQ ID NO: 49492 - DNA, 15 bp, Homo sapiens
tgattgccctgaaat

SEQ ID NO: 49493 - DNA, 15 bp, Homo sapiens
gattgccctgaaata

SEQ ID NO: 49494 - DNA, 15 bp, Homo sapiens
attgccctgaaatag

SEQ ID NO: 49495 - DNA, 15 bp, Homo sapiens
ttgccctgaaataga

SEQ ID NO: 49496 - DNA, 15 bp, Homo sapiens
tgccctgaaatagac

SEQ ID NO: 49497 - DNA, 15 bp, Homo sapiens
gccctgaaatagact

SEQ ID NO: 49498 - DNA, 15 bp, Homo sapiens
ccctgaaatagactt

SEQ ID NO: 49499 - DNA, 15 bp, Homo sapiens
cctgaaatagacttg

SEQ ID NO: 49500 - DNA, 15 bp, Homo sapiens
ctgaaatagacttgc

SEQ ID NO: 49501 - DNA, 15 bp, Homo sapiens
tgaaatagacttgca

SEQ ID NO: 49502 - DNA, 15 bp, Homo sapiens
gaaatagacttgcat

SEQ ID NO: 49503 - DNA, 15 bp, Homo sapiens
aaatagacttgcatg

SEQ ID NO: 49504 - DNA, 15 bp, Homo sapiens
aatagacttgcatgt

SEQ ID NO: 49505 - DNA, 15 bp, Homo sapiens
atagacttgcatgtt

SEQ ID NO: 49506 - DNA, 15 bp, Homo sapiens
tagacttgcatgttt

SEQ ID NO: 49507 - DNA, 15 bp, Homo sapiens
agacttgcatgtttt

SEQ ID NO: 49508 - DNA, 15 bp, Homo sapiens
gacttgcatgttttg

SEQ ID NO: 49509 - DNA, 15 bp, Homo sapiens
acttgcatgttttgg

SEQ ID NO: 49510 - DNA, 15 bp, Homo sapiens
cttgcatgttttgga

SEQ ID NO: 49511 - DNA, 15 bp, Homo sapiens
ttgcatgttttggat

SEQ ID NO: 49512 - DNA, 15 bp, Homo sapiens
tgcatgttttggatg

SEQ ID NO: 49513 - DNA, 15 bp, Homo sapiens
gcatgttttggatga

SEQ ID NO: 49514 - DNA, 15 bp, Homo sapiens
catgttttggatgat

SEQ ID NO: 49515 - DNA, 15 bp, Homo sapiens
atgttttggatgatg

SEQ ID NO: 49516 - DNA, 15 bp, Homo sapiens
tgttttggatgatgg

SEQ ID NO: 49517 - DNA, 15 bp, Homo sapiens
gttttggatgatggc

SEQ ID NO: 49518 - DNA, 15 bp, Homo sapiens
ttttggatgatggct

SEQ ID NO: 49519 - DNA, 15 bp, Homo sapiens
tttggatgatggctt

SEQ ID NO: 49520 - DNA, 15 bp, Homo sapiens
ttggatgatggcttt

SEQ ID NO: 49521 - DNA, 15 bp, Homo sapiens
tggatgatggctttg

SEQ ID NO: 49522 - DNA, 15 bp, Homo sapiens
ggatgatggctttgg

SEQ ID NO: 49523 - DNA, 15 bp, Homo sapiens
gatgatggctttggg

SEQ ID NO: 49524 - DNA, 15 bp, Homo sapiens
atgatggctttgggt

SEQ ID NO: 49525 - DNA, 15 bp, Homo sapiens
tgatggctttgggtc

SEQ ID NO: 49526 - DNA, 15 bp, Homo sapiens
gatggctttgggtct

SEQ ID NO: 49527 - DNA, 15 bp, Homo sapiens
atggctttgggtctc

SEQ ID NO: 49528 - DNA, 15 bp, Homo sapiens
tggctttgggtctcc

SEQ ID NO: 49529 - DNA, 15 bp, Homo sapiens
ggctttgggtctccc

SEQ ID NO: 49530 - DNA, 15 bp, Homo sapiens
gctttgggtctccca

SEQ ID NO: 49531 - DNA, 15 bp, Homo sapiens
ctttgggtctcccag

SEQ ID NO: 49532 - DNA, 15 bp, Homo sapiens
tttgggtctcccaga

SEQ ID NO: 49533 - DNA, 15 bp, Homo sapiens
ttgggtctcccagag

SEQ ID NO: 49534 - DNA, 15 bp, Homo sapiens
tgggtctcccagagc

SEQ ID NO: 49535 - DNA, 15 bp, Homo sapiens
gggtctcccagagca

SEQ ID NO: 49536 - DNA, 15 bp, Homo sapiens
ggtctcccagagcac

SEQ ID NO: 49537 - DNA, 15 bp, Homo sapiens
gtctcccagagcact

SEQ ID NO: 49538 - DNA, 15 bp, Homo sapiens
tctcccagagcactt

SEQ ID NO: 49539 - DNA, 15 bp, Homo sapiens
ctcccagagcacttg

SEQ ID NO: 49540 - DNA, 15 bp, Homo sapiens
tcccagagcacttgg

SEQ ID NO: 49541 - DNA, 15 bp, Homo sapiens
cccagagcacttggt

SEQ ID NO: 49542 - DNA, 15 bp, Homo sapiens
ccagagcacttggtt

SEQ ID NO: 49543 - DNA, 15 bp, Homo sapiens
cagagcacttggttt

SEQ ID NO: 49544 - DNA, 15 bp, Homo sapiens
agagcacttggtttc

SEQ ID NO: 49545 - DNA, 15 bp, Homo sapiens
gagcacttggtttcc

SEQ ID NO: 49546 - DNA, 15 bp, Homo sapiens
agcacttggtttccc

SEQ ID NO: 49547 - DNA, 15 bp, Homo sapiens
gcacttggtttccct

SEQ ID NO: 49548 - DNA, 15 bp, Homo sapiens
cacttggtttccctt

SEQ ID NO: 49549 - DNA, 15 bp, Homo sapiens
acttggtttcccttg

SEQ ID NO: 49550 - DNA, 15 bp, Homo sapiens
cttggtttcccttgg

SEQ ID NO: 49551 - DNA, 15 bp, Homo sapiens
ttggtttcccttggt

SEQ ID NO: 49552 - DNA, 15 bp, Homo sapiens
tggtttcccttggtg

SEQ ID NO: 49553 - DNA, 15 bp, Homo sapiens
ggtttcccttggtgc

SEQ ID NO: 49554 - DNA, 15 bp, Homo sapiens
gtttcccttggtgct

SEQ ID NO: 49555 - DNA, 15 bp, Homo sapiens
tttcccttggtgctg

SEQ ID NO: 49556 - DNA, 15 bp, Homo sapiens
ttcccttggtgctga

SEQ ID NO: 49557 - DNA, 15 bp, Homo sapiens
tcccttggtgctgat

SEQ ID NO: 49558 - DNA, 15 bp, Homo sapiens
cccttggtgctgatt

SEQ ID NO: 49559 - DNA, 15 bp, Homo sapiens
ccttggtgctgattt

SEQ ID NO: 49560 - DNA, 15 bp, Homo sapiens
cttggtgctgatttt

SEQ ID NO: 49561 - DNA, 15 bp, Homo sapiens
ttggtgctgattttt

SEQ ID NO: 49562 - DNA, 15 bp, Homo sapiens
tggtgctgatttttt

SEQ ID NO: 49563 - DNA, 15 bp, Homo sapiens
ggtgctgattttttc

SEQ ID NO: 49564 - DNA, 15 bp, Homo sapiens
gtgctgattttttct

SEQ ID NO: 49565 - DNA, 15 bp, Homo sapiens
tgctgattttttctc

SEQ ID NO: 49566 - DNA, 15 bp, Homo sapiens
gctgattttttctct

SEQ ID NO: 49567 - DNA, 15 bp, Homo sapiens
ctgattttttctctc

SEQ ID NO: 49568 - DNA, 15 bp, Homo sapiens
tgattttttctctca

SEQ ID NO: 49569 - DNA, 15 bp, Homo sapiens
gattttttctctcag

SEQ ID NO: 49570 - DNA, 15 bp, Homo sapiens
attttttctctcagg

SEQ ID NO: 49571 - DNA, 15 bp, Homo sapiens
ttttttctctcagga

SEQ ID NO: 49572 - DNA, 15 bp, Homo sapiens
tttttctctcaggat

SEQ ID NO: 49573 - DNA, 15 bp, Homo sapiens
ttttctctcaggatt

SEQ ID NO: 49574 - DNA, 15 bp, Homo sapiens
tttctctcaggatta

SEQ ID NO: 49575 - DNA, 15 bp, Homo sapiens
ttctctcaggattaa

SEQ ID NO: 49576 - DNA, 15 bp, Homo sapiens
tctctcaggattaaa

SEQ ID NO: 49577 - DNA, 15 bp, Homo sapiens
ctctcaggattaaag

SEQ ID NO: 49578 - DNA, 15 bp, Homo sapiens
tctcaggattaaagc

SEQ ID NO: 49579 - DNA, 15 bp, Homo sapiens
ctcaggattaaagcc

SEQ ID NO: 49580 - DNA, 15 bp, Homo sapiens
tcaggattaaagccc

SEQ ID NO: 49581 - DNA, 15 bp, Homo sapiens
caggattaaagcccc

SEQ ID NO: 49582 - DNA, 15 bp, Homo sapiens
aggattaaagcccct

SEQ ID NO: 49583 - DNA, 15 bp, Homo sapiens
ggattaaagcccctt

SEQ ID NO: 49584 - DNA, 15 bp, Homo sapiens
gattaaagccccttt

SEQ ID NO: 49585 - DNA, 15 bp, Homo sapiens
attaaagccccttta

SEQ ID NO: 49586 - DNA, 15 bp, Homo sapiens
ttaaagcccctttat

SEQ ID NO: 49587 - DNA, 15 bp, Homo sapiens
taaagcccctttatg

SEQ ID NO: 49588 - DNA, 15 bp, Homo sapiens
aaagcccctttatgt

SEQ ID NO: 49589 - DNA, 15 bp, Homo sapiens
aagcccctttatgtg

SEQ ID NO: 49590 - DNA, 15 bp, Homo sapiens
agcccctttatgtga

SEQ ID NO: 49591 - DNA, 15 bp, Homo sapiens
gcccctttatgtgat

SEQ ID NO: 49592 - DNA, 15 bp, Homo sapiens
cccctttatgtgatg

SEQ ID NO: 49593 - DNA, 15 bp, Homo sapiens
ccctttatgtgatgt

SEQ ID NO: 49594 - DNA, 15 bp, Homo sapiens
cctttatgtgatgtt

SEQ ID NO: 49595 - DNA, 15 bp, Homo sapiens
ctttatgtgatgttg

SEQ ID NO: 49596 - DNA, 15 bp, Homo sapiens
tttatgtgatgttgt

SEQ ID NO: 49597 - DNA, 15 bp, Homo sapiens
ttatgtgatgttgtt

SEQ ID NO: 49598 - DNA, 15 bp, Homo sapiens
tatgtgatgttgtta

SEQ ID NO: 49599 - DNA, 15 bp, Homo sapiens
atgtgatgttgttac

SEQ ID NO: 49600 - DNA, 15 bp, Homo sapiens
tgtgatgttgttaca

SEQ ID NO: 49601 - DNA, 15 bp, Homo sapiens
gtgatgttgttacag

SEQ ID NO: 49602 - DNA, 15 bp, Homo sapiens
tgatgttgttacagc

SEQ ID NO: 49603 - DNA, 15 bp, Homo sapiens
gatgttgttacagca

SEQ ID NO: 49604 - DNA, 15 bp, Homo sapiens
atgttgttacagcag

SEQ ID NO: 49605 - DNA, 15 bp, Homo sapiens
tgttgttacagcagc

SEQ ID NO: 49606 - DNA, 15 bp, Homo sapiens
gttgttacagcagct

SEQ ID NO: 49607 - DNA, 15 bp, Homo sapiens
ttgttacagcagctt

SEQ ID NO: 49608 - DNA, 15 bp, Homo sapiens
tgttacagcagctta

SEQ ID NO: 49609 - DNA, 15 bp, Homo sapiens
gttacagcagcttat

SEQ ID NO: 49610 - DNA, 15 bp, Homo sapiens
ttacagcagcttatt

SEQ ID NO: 49611 - DNA, 15 bp, Homo sapiens
tacagcagcttattg

SEQ ID NO: 49612 - DNA, 15 bp, Homo sapiens
acagcagcttattgc

SEQ ID NO: 49613 - DNA, 15 bp, Homo sapiens
cagcagcttattgca

SEQ ID NO: 49614 - DNA, 15 bp, Homo sapiens
agcagcttattgcaa

SEQ ID NO: 49615 - DNA, 15 bp, Homo sapiens
gcagcttattgcaac

SEQ ID NO: 49616 - DNA, 15 bp, Homo sapiens
cagcttattgcaact

SEQ ID NO: 49617 - DNA, 15 bp, Homo sapiens
agcttattgcaactt

SEQ ID NO: 49618 - DNA, 15 bp, Homo sapiens
gcttattgcaacttc

SEQ ID NO: 49619 - DNA, 15 bp, Homo sapiens
cttattgcaacttca

SEQ ID NO: 49620 - DNA, 15 bp, Homo sapiens
ttattgcaacttcat

SEQ ID NO: 49621 - DNA, 15 bp, Homo sapiens
tattgcaacttcatt

SEQ ID NO: 49622 - DNA, 15 bp, Homo sapiens
attgcaacttcattc

SEQ ID NO: 49623 - DNA, 15 bp, Homo sapiens
ttgcaacttcattca

SEQ ID NO: 49624 - DNA, 15 bp, Homo sapiens
tgcaacttcattcag

SEQ ID NO: 49625 - DNA, 15 bp, Homo sapiens
gcaacttcattcagc

SEQ ID NO: 49626 - DNA, 15 bp, Homo sapiens
caacttcattcagct

SEQ ID NO: 49627 - DNA, 15 bp, Homo sapiens
aacttcattcagctg

SEQ ID NO: 49628 - DNA, 15 bp, Homo sapiens
acttcattcagctgc

SEQ ID NO: 49629 - DNA, 15 bp, Homo sapiens
cttcattcagctgct

SEQ ID NO: 49630 - DNA, 15 bp, Homo sapiens
ttcattcagctgctt

SEQ ID NO: 49631 - DNA, 15 bp, Homo sapiens
tcattcagctgcttg

SEQ ID NO: 49632 - DNA, 15 bp, Homo sapiens
cattcagctgcttga

SEQ ID NO: 49633 - DNA, 15 bp, Homo sapiens
attcagctgcttgaa

SEQ ID NO: 49634 - DNA, 15 bp, Homo sapiens
ttcagctgcttgaaa

SEQ ID NO: 49635 - DNA, 15 bp, Homo sapiens
tcagctgcttgaaaa

SEQ ID NO: 49636 - DNA, 15 bp, Homo sapiens
cagctgcttgaaaaa

SEQ ID NO: 49637 - DNA, 15 bp, Homo sapiens
agctgcttgaaaaag

SEQ ID NO: 49638 - DNA, 15 bp, Homo sapiens
gctgcttgaaaaaga

SEQ ID NO: 49639 - DNA, 15 bp, Homo sapiens
ctgcttgaaaaagaa

SEQ ID NO: 49640 - DNA, 15 bp, Homo sapiens
tgcttgaaaaagaag

SEQ ID NO: 49641 - DNA, 15 bp, Homo sapiens
gcttgaaaaagaagg

SEQ ID NO: 49642 - DNA, 15 bp, Homo sapiens
cttgaaaaagaaggg

SEQ ID NO: 49643 - DNA, 15 bp, Homo sapiens
ttgaaaaagaaggga

SEQ ID NO: 49644 - DNA, 15 bp, Homo sapiens
tgaaaaagaagggag

SEQ ID NO: 49645 - DNA, 15 bp, Homo sapiens
gaaaaagaagggaga

SEQ ID NO: 49646 - DNA, 15 bp, Homo sapiens
aaaaagaagggagac

SEQ ID NO: 49647 - DNA, 15 bp, Homo sapiens
aaaagaagggagact

SEQ ID NO: 49648 - DNA, 15 bp, Homo sapiens
aaagaagggagactg

SEQ ID NO: 49649 - DNA, 15 bp, Homo sapiens
aagaagggagactgc

SEQ ID NO: 49650 - DNA, 15 bp, Homo sapiens
agaagggagactgcc

SEQ ID NO: 49651 - DNA, 15 bp, Homo sapiens
gaagggagactgcct

SEQ ID NO: 49652 - DNA, 15 bp, Homo sapiens
aagggagactgcctc

SEQ ID NO: 49653 - DNA, 15 bp, Homo sapiens
agggagactgcctct

SEQ ID NO: 49654 - DNA, 15 bp, Homo sapiens
gggagactgcctcta

SEQ ID NO: 49655 - DNA, 15 bp, Homo sapiens
ggagactgcctctag

SEQ ID NO: 49656 - DNA, 15 bp, Homo sapiens
gagactgcctctagg

SEQ ID NO: 49657 - DNA, 15 bp, Homo sapiens
agactgcctctaggt

SEQ ID NO: 49658 - DNA, 15 bp, Homo sapiens
gactgcctctaggtt

SEQ ID NO: 49659 - DNA, 15 bp, Homo sapiens
actgcctctaggttc

SEQ ID NO: 49660 - DNA, 15 bp, Homo sapiens
ctgcctctaggttcc

SEQ ID NO: 49661 - DNA, 15 bp, Homo sapiens
tgcctctaggttcca

SEQ ID NO: 49662 - DNA, 15 bp, Homo sapiens
gcctctaggttccat

SEQ ID NO: 49663 - DNA, 15 bp, Homo sapiens
cctctaggttccatg

SEQ ID NO: 49664 - DNA, 15 bp, Homo sapiens
ctctaggttccatgt

SEQ ID NO: 49665 - DNA, 15 bp, Homo sapiens
tctaggttccatgtg

SEQ ID NO: 49666 - DNA, 15 bp, Homo sapiens
ctaggttccatgtgt

SEQ ID NO: 49667 - DNA, 15 bp, Homo sapiens
taggttccatgtgtt

SEQ ID NO: 49668 - DNA, 15 bp, Homo sapiens
aggttccatgtgttc

SEQ ID NO: 49669 - DNA, 15 bp, Homo sapiens
ggttccatgtgttct

SEQ ID NO: 49670 - DNA, 15 bp, Homo sapiens
gttccatgtgttctt

SEQ ID NO: 49671 - DNA, 15 bp, Homo sapiens
ttccatgtgttcttt

SEQ ID NO: 49672 - DNA, 15 bp, Homo sapiens
tccatgtgttctttc

SEQ ID NO: 49673 - DNA, 15 bp, Homo sapiens
ccatgtgttctttca

SEQ ID NO: 49674 - DNA, 15 bp, Homo sapiens
catgtgttctttcag

SEQ ID NO: 49675 - DNA, 15 bp, Homo sapiens
atgtgttctttcagg

SEQ ID NO: 49676 - DNA, 15 bp, Homo sapiens
tgtgttctttcaggg

SEQ ID NO: 49677 - DNA, 15 bp, Homo sapiens
gtgttctttcaggga

SEQ ID NO: 49678 - DNA, 15 bp, Homo sapiens
tgttctttcagggat

SEQ ID NO: 49679 - DNA, 15 bp, Homo sapiens
gttctttcagggatg

SEQ ID NO: 49680 - DNA, 15 bp, Homo sapiens
ttctttcagggatgg

SEQ ID NO: 49681 - DNA, 15 bp, Homo sapiens
tctttcagggatggt

SEQ ID NO: 49682 - DNA, 15 bp, Homo sapiens
ctttcagggatggta

SEQ ID NO: 49683 - DNA, 15 bp, Homo sapiens
tttcagggatggtat

SEQ ID NO: 49684 - DNA, 15 bp, Homo sapiens
ttcagggatggtatt

SEQ ID NO: 49685 - DNA, 15 bp, Homo sapiens
tcagggatggtattt

SEQ ID NO: 49686 - DNA, 15 bp, Homo sapiens
cagggatggtatttt

SEQ ID NO: 49687 - DNA, 15 bp, Homo sapiens
agggatggtattttg

SEQ ID NO: 49688 - DNA, 15 bp, Homo sapiens
gggatggtattttga

SEQ ID NO: 49689 - DNA, 15 bp, Homo sapiens
ggatggtattttgat

SEQ ID NO: 49690 - DNA, 15 bp, Homo sapiens
gatggtattttgatg

SEQ ID NO: 49691 - DNA, 15 bp, Homo sapiens
atggtattttgatgt

SEQ ID NO: 49692 - DNA, 15 bp, Homo sapiens
tggtattttgatgtt

SEQ ID NO: 49693 - DNA, 15 bp, Homo sapiens
ggtattttgatgttg

SEQ ID NO: 49694 - DNA, 15 bp, Homo sapiens
gtattttgatgttgc

SEQ ID NO: 49695 - DNA, 15 bp, Homo sapiens
tattttgatgttgcg

SEQ ID NO: 49696 - DNA, 15 bp, Homo sapiens
attttgatgttgcgt

SEQ ID NO: 49697 - DNA, 15 bp, Homo sapiens
ttttgatgttgcgta

SEQ ID NO: 49698 - DNA, 15 bp, Homo sapiens
tttgatgttgcgtat

SEQ ID NO: 49699 - DNA, 15 bp, Homo sapiens
ttgatgttgcgtatt

SEQ ID NO: 49700 - DNA, 15 bp, Homo sapiens
tgatgttgcgtattc

SEQ ID NO: 49701 - DNA, 15 bp, Homo sapiens
gatgttgcgtattct

SEQ ID NO: 49702 - DNA, 15 bp, Homo sapiens
atgttgcgtattctc

SEQ ID NO: 49703 - DNA, 15 bp, Homo sapiens
tgttgcgtattctct

SEQ ID NO: 49704 - DNA, 15 bp, Homo sapiens
gttgcgtattctctt

SEQ ID NO: 49705 - DNA, 15 bp, Homo sapiens
ttgcgtattctcttg

SEQ ID NO: 49706 - DNA, 15 bp, Homo sapiens
tgcgtattctcttga

SEQ ID NO: 49707 - DNA, 15 bp, Homo sapiens
gcgtattctcttgaa

SEQ ID NO: 49708 - DNA, 15 bp, Homo sapiens
cgtattctcttgaac

SEQ ID NO: 49709 - DNA, 15 bp, Homo sapiens
gtattctcttgaaca

SEQ ID NO: 49710 - DNA, 15 bp, Homo sapiens
tattctcttgaacat

SEQ ID NO: 49711 - DNA, 15 bp, Homo sapiens
attctcttgaacatg

SEQ ID NO: 49712 - DNA, 15 bp, Homo sapiens
ttctcttgaacatgt

SEQ ID NO: 49713 - DNA, 15 bp, Homo sapiens
tctcttgaacatgta

SEQ ID NO: 49714 - DNA, 15 bp, Homo sapiens
ctcttgaacatgtat

SEQ ID NO: 49715 - DNA, 15 bp, Homo sapiens
tcttgaacatgtatt

SEQ ID NO: 49716 - DNA, 15 bp, Homo sapiens
cttgaacatgtattc

SEQ ID NO: 49717 - DNA, 15 bp, Homo sapiens
ttgaacatgtattct

SEQ ID NO: 49718 - DNA, 15 bp, Homo sapiens
tgaacatgtattctt

SEQ ID NO: 49719 - DNA, 15 bp, Homo sapiens
gaacatgtattcttc

SEQ ID NO: 49720 - DNA, 15 bp, Homo sapiens
aacatgtattcttcc

SEQ ID NO: 49721 - DNA, 15 bp, Homo sapiens
acatgtattcttccc

SEQ ID NO: 49722 - DNA, 15 bp, Homo sapiens
catgtattcttccct

SEQ ID NO: 49723 - DNA, 15 bp, Homo sapiens
atgtattcttccctg

SEQ ID NO: 49724 - DNA, 15 bp, Homo sapiens
tgtattcttccctga

SEQ ID NO: 49725 - DNA, 15 bp, Homo sapiens
gtattcttccctgag

SEQ ID NO: 49726 - DNA, 15 bp, Homo sapiens
tattcttccctgaga

SEQ ID NO: 49727 - DNA, 15 bp, Homo sapiens
attcttccctgagaa

SEQ ID NO: 49728 - DNA, 15 bp, Homo sapiens
ttcttccctgagaat

SEQ ID NO: 49729 - DNA, 15 bp, Homo sapiens
tcttccctgagaatt

SEQ ID NO: 49730 - DNA, 15 bp, Homo sapiens
cttccctgagaattt

SEQ ID NO: 49731 - DNA, 15 bp, Homo sapiens
ttccctgagaatttc

SEQ ID NO: 49732 - DNA, 15 bp, Homo sapiens
tccctgagaatttct

SEQ ID NO: 49733 - DNA, 15 bp, Homo sapiens
ccctgagaatttctg

SEQ ID NO: 49734 - DNA, 15 bp, Homo sapiens
cctgagaatttctgt

SEQ ID NO: 49735 - DNA, 15 bp, Homo sapiens
ctgagaatttctgtg

SEQ ID NO: 49736 - DNA, 15 bp, Homo sapiens
tgagaatttctgtgt

SEQ ID NO: 49737 - DNA, 15 bp, Homo sapiens
gagaatttctgtgtg

SEQ ID NO: 49738 - DNA, 15 bp, Homo sapiens
agaatttctgtgtgc

SEQ ID NO: 49739 - DNA, 15 bp, Homo sapiens
gaatttctgtgtgcc

SEQ ID NO: 49740 - DNA, 15 bp, Homo sapiens
aatttctgtgtgccg

SEQ ID NO: 49741 - DNA, 15 bp, Homo sapiens
atttctgtgtgccgt

SEQ ID NO: 49742 - DNA, 15 bp, Homo sapiens
tttctgtgtgccgtg

SEQ ID NO: 49743 - DNA, 15 bp, Homo sapiens
ttctgtgtgccgtgg

SEQ ID NO: 49744 - DNA, 15 bp, Homo sapiens
tctgtgtgccgtggt

SEQ ID NO: 49745 - DNA, 15 bp, Homo sapiens
ctgtgtgccgtggta

SEQ ID NO: 49746 - DNA, 15 bp, Homo sapiens
tgtgtgccgtggtag

SEQ ID NO: 49747 - DNA, 15 bp, Homo sapiens
gtgtgccgtggtaga

SEQ ID NO: 49748 - DNA, 15 bp, Homo sapiens
tgtgccgtggtagaa

SEQ ID NO: 49749 - DNA, 15 bp, Homo sapiens
gtgccgtggtagaag

SEQ ID NO: 49750 - DNA, 15 bp, Homo sapiens
tgccgtggtagaaga

SEQ ID NO: 49751 - DNA, 15 bp, Homo sapiens
gccgtggtagaagaa

SEQ ID NO: 49752 - DNA, 15 bp, Homo sapiens
ccgtggtagaagaaa

SEQ ID NO: 49753 - DNA, 15 bp, Homo sapiens
cgtggtagaagaaat

SEQ ID NO: 49754 - DNA, 15 bp, Homo sapiens
gtggtagaagaaata

SEQ ID NO: 49755 - DNA, 15 bp, Homo sapiens
tggtagaagaaatac

SEQ ID NO: 49756 - DNA, 15 bp, Homo sapiens
ggtagaagaaatact

SEQ ID NO: 49757 - DNA, 15 bp, Homo sapiens
gtagaagaaatactt

SEQ ID NO: 49758 - DNA, 15 bp, Homo sapiens
tagaagaaatacttg

SEQ ID NO: 49759 - DNA, 15 bp, Homo sapiens
agaagaaatacttgc

SEQ ID NO: 49760 - DNA, 15 bp, Homo sapiens
gaagaaatacttgcc

SEQ ID NO: 49761 - DNA, 15 bp, Homo sapiens
aagaaatacttgcca

SEQ ID NO: 49762 - DNA, 15 bp, Homo sapiens
agaaatacttgccag

SEQ ID NO: 49763 - DNA, 15 bp, Homo sapiens
gaaatacttgccaga

SEQ ID NO: 49764 - DNA, 15 bp, Homo sapiens
aaatacttgccagaa

SEQ ID NO: 49765 - DNA, 15 bp, Homo sapiens
aatacttgccagaaa

SEQ ID NO: 49766 - DNA, 15 bp, Homo sapiens
atacttgccagaaat

SEQ ID NO: 49767 - DNA, 15 bp, Homo sapiens
tacttgccagaaatc

SEQ ID NO: 49768 - DNA, 15 bp, Homo sapiens
acttgccagaaatcg

SEQ ID NO: 49769 - DNA, 15 bp, Homo sapiens
cttgccagaaatcgc

SEQ ID NO: 49770 - DNA, 15 bp, Homo sapiens
ttgccagaaatcgcc

SEQ ID NO: 49771 - DNA, 15 bp, Homo sapiens
tgccagaaatcgcca

SEQ ID NO: 49772 - DNA, 15 bp, Homo sapiens
gccagaaatcgccac

SEQ ID NO: 49773 - DNA, 15 bp, Homo sapiens
ccagaaatcgccact

SEQ ID NO: 49774 - DNA, 15 bp, Homo sapiens
cagaaatcgccactc

SEQ ID NO: 49775 - DNA, 15 bp, Homo sapiens
agaaatcgccactca

SEQ ID NO: 49776 - DNA, 15 bp, Homo sapiens
gaaatcgccactcat

SEQ ID NO: 49777 - DNA, 15 bp, Homo sapiens
aaatcgccactcatg

SEQ ID NO: 49778 - DNA, 15 bp, Homo sapiens
aatcgccactcatgg

SEQ ID NO: 49779 - DNA, 15 bp, Homo sapiens
atcgccactcatggt

SEQ ID NO: 49780 - DNA, 15 bp, Homo sapiens
tcgccactcatggta

SEQ ID NO: 49781 - DNA, 15 bp, Homo sapiens
cgccactcatggtat

SEQ ID NO: 49782 - DNA, 15 bp, Homo sapiens
gccactcatggtatg

SEQ ID NO: 49783 - DNA, 15 bp, Homo sapiens
ccactcatggtatgc

SEQ ID NO: 49784 - DNA, 15 bp, Homo sapiens
cactcatggtatgct

SEQ ID NO: 49785 - DNA, 15 bp, Homo sapiens
actcatggtatgctt

SEQ ID NO: 49786 - DNA, 15 bp, Homo sapiens
ctcatggtatgcttt

SEQ ID NO: 49787 - DNA, 15 bp, Homo sapiens
tcatggtatgctttt

SEQ ID NO: 49788 - DNA, 15 bp, Homo sapiens
catggtatgcttttg

SEQ ID NO: 49789 - DNA, 15 bp, Homo sapiens
atggtatgcttttgt

SEQ ID NO: 49790 - DNA, 15 bp, Homo sapiens
tggtatgcttttgta

SEQ ID NO: 49791 - DNA, 15 bp, Homo sapiens
ggtatgcttttgtag

SEQ ID NO: 49792 - DNA, 15 bp, Homo sapiens
gtatgcttttgtagt

SEQ ID NO: 49793 - DNA, 15 bp, Homo sapiens
tatgcttttgtagtg

SEQ ID NO: 49794 - DNA, 15 bp, Homo sapiens
atgcttttgtagtgt

SEQ ID NO: 49795 - DNA, 15 bp, Homo sapiens
tgcttttgtagtgtc

SEQ ID NO: 49796 - DNA, 15 bp, Homo sapiens
gcttttgtagtgtcg

SEQ ID NO: 49797 - DNA, 15 bp, Homo sapiens
cttttgtagtgtcga

SEQ ID NO: 49798 - DNA, 15 bp, Homo sapiens
ttttgtagtgtcgaa

SEQ ID NO: 49799 - DNA, 15 bp, Homo sapiens
tttgtagtgtcgaag

SEQ ID NO: 49800 - DNA, 15 bp, Homo sapiens
ttgtagtgtcgaagt

SEQ ID NO: 49801 - DNA, 15 bp, Homo sapiens
tgtagtgtcgaagtg

SEQ ID NO: 49802 - DNA, 15 bp, Homo sapiens
gtagtgtcgaagtgt

SEQ ID NO: 49803 - DNA, 15 bp, Homo sapiens
tagtgtcgaagtgtc

SEQ ID NO: 49804 - DNA, 15 bp, Homo sapiens
agtgtcgaagtgtcc

SEQ ID NO: 49805 - DNA, 15 bp, Homo sapiens
gtgtcgaagtgtccc

SEQ ID NO: 49806 - DNA, 15 bp, Homo sapiens
tgtcgaagtgtcccc

SEQ ID NO: 49807 - DNA, 15 bp, Homo sapiens
gtcgaagtgtcccct

SEQ ID NO: 49808 - DNA, 15 bp, Homo sapiens
tcgaagtgtccccta

SEQ ID NO: 49809 - DNA, 15 bp, Homo sapiens
cgaagtgtcccctag

SEQ ID NO: 49810 - DNA, 15 bp, Homo sapiens
gaagtgtcccctaga

SEQ ID NO: 49811 - DNA, 15 bp, Homo sapiens
aagtgtcccctagag

SEQ ID NO: 49812 - DNA, 15 bp, Homo sapiens
agtgtcccctagagg

SEQ ID NO: 49813 - DNA, 15 bp, Homo sapiens
gtgtcccctagaggt

SEQ ID NO: 49814 - DNA, 15 bp, Homo sapiens
tgtcccctagaggtg

SEQ ID NO: 49815 - DNA, 15 bp, Homo sapiens
gtcccctagaggtga

SEQ ID NO: 49816 - DNA, 15 bp, Homo sapiens
tcccctagaggtgac

SEQ ID NO: 49817 - DNA, 15 bp, Homo sapiens
cccctagaggtgaca

SEQ ID NO: 49818 - DNA, 15 bp, Homo sapiens
ccctagaggtgacaa

SEQ ID NO: 49819 - DNA, 15 bp, Homo sapiens
cctagaggtgacaag

SEQ ID NO: 49820 - DNA, 15 bp, Homo sapiens
ctagaggtgacaagg

SEQ ID NO: 49821 - DNA, 15 bp, Homo sapiens
tagaggtgacaaggc

SEQ ID NO: 49822 - DNA, 15 bp, Homo sapiens
agaggtgacaaggct

SEQ ID NO: 49823 - DNA, 15 bp, Homo sapiens
gaggtgacaaggctt

SEQ ID NO: 49824 - DNA, 15 bp, Homo sapiens
aggtgacaaggcttg

SEQ ID NO: 49825 - DNA, 15 bp, Homo sapiens
ggtgacaaggcttgt

SEQ ID NO: 49826 - DNA, 15 bp, Homo sapiens
gtgacaaggcttgtg

SEQ ID NO: 49827 - DNA, 15 bp, Homo sapiens
tgacaaggcttgtga

SEQ ID NO: 49828 - DNA, 15 bp, Homo sapiens
gacaaggcttgtgat

SEQ ID NO: 49829 - DNA, 15 bp, Homo sapiens
acaaggcttgtgata

SEQ ID NO: 49830 - DNA, 15 bp, Homo sapiens
caaggcttgtgatag

SEQ ID NO: 49831 - DNA, 15 bp, Homo sapiens
aaggcttgtgatagt

SEQ ID NO: 49832 - DNA, 15 bp, Homo sapiens
aggcttgtgatagtg

SEQ ID NO: 49833 - DNA, 15 bp, Homo sapiens
ggcttgtgatagtgt

SEQ ID NO: 49834 - DNA, 15 bp, Homo sapiens
gcttgtgatagtgtt

SEQ ID NO: 49835 - DNA, 15 bp, Homo sapiens
cttgtgatagtgttg

SEQ ID NO: 49836 - DNA, 15 bp, Homo sapiens
ttgtgatagtgttga

SEQ ID NO: 49837 - DNA, 15 bp, Homo sapiens
tgtgatagtgttgat

SEQ ID NO: 49838 - DNA, 15 bp, Homo sapiens
gtgatagtgttgatt

SEQ ID NO: 49839 - DNA, 15 bp, Homo sapiens
tgatagtgttgattc

SEQ ID NO: 49840 - DNA, 15 bp, Homo sapiens
gatagtgttgattct

SEQ ID NO: 49841 - DNA, 15 bp, Homo sapiens
atagtgttgattcta

SEQ ID NO: 49842 - DNA, 15 bp, Homo sapiens
tagtgttgattctaa

SEQ ID NO: 49843 - DNA, 15 bp, Homo sapiens
agtgttgattctaac

SEQ ID NO: 49844 - DNA, 15 bp, Homo sapiens
gtgttgattctaaca

SEQ ID NO: 49845 - DNA, 15 bp, Homo sapiens
tgttgattctaacaa

SEQ ID NO: 49846 - DNA, 15 bp, Homo sapiens
gttgattctaacaag

SEQ ID NO: 49847 - DNA, 15 bp, Homo sapiens
ttgattctaacaagc

SEQ ID NO: 49848 - DNA, 15 bp, Homo sapiens
tgattctaacaagca

SEQ ID NO: 49849 - DNA, 15 bp, Homo sapiens
gattctaacaagcat

SEQ ID NO: 49850 - DNA, 15 bp, Homo sapiens
attctaacaagcatg

SEQ ID NO: 49851 - DNA, 15 bp, Homo sapiens
ttctaacaagcatga

SEQ ID NO: 49852 - DNA, 15 bp, Homo sapiens
tctaacaagcatgaa

SEQ ID NO: 49853 - DNA, 15 bp, Homo sapiens
ctaacaagcatgaat

SEQ ID NO: 49854 - DNA, 15 bp, Homo sapiens
taacaagcatgaatc

SEQ ID NO: 49855 - DNA, 15 bp, Homo sapiens
aacaagcatgaatct

SEQ ID NO: 49856 - DNA, 15 bp, Homo sapiens
acaagcatgaatctt

SEQ ID NO: 49857 - DNA, 15 bp, Homo sapiens
caagcatgaatcttt

SEQ ID NO: 49858 - DNA, 15 bp, Homo sapiens
aagcatgaatctttc

SEQ ID NO: 49859 - DNA, 15 bp, Homo sapiens
agcatgaatctttcc

SEQ ID NO: 49860 - DNA, 15 bp, Homo sapiens
gcatgaatctttcct

SEQ ID NO: 49861 - DNA, 15 bp, Homo sapiens
catgaatctttcctt

SEQ ID NO: 49862 - DNA, 15 bp, Homo sapiens
atgaatctttccttt

SEQ ID NO: 49863 - DNA, 15 bp, Homo sapiens
tgaatctttccttta

SEQ ID NO: 49864 - DNA, 15 bp, Homo sapiens
gaatctttcctttat

SEQ ID NO: 49865 - DNA, 15 bp, Homo sapiens
aatctttcctttatt

SEQ ID NO: 49866 - DNA, 15 bp, Homo sapiens
atctttcctttattt

SEQ ID NO: 49867 - DNA, 15 bp, Homo sapiens
tctttcctttatttt

SEQ ID NO: 49868 - DNA, 15 bp, Homo sapiens
ctttcctttatttta

SEQ ID NO: 49869 - DNA, 15 bp, Homo sapiens
tttcctttattttag

SEQ ID NO: 49870 - DNA, 15 bp, Homo sapiens
ttcctttattttagc

SEQ ID NO: 49871 - DNA, 15 bp, Homo sapiens
tcctttattttagca

SEQ ID NO: 49872 - DNA, 15 bp, Homo sapiens
cctttattttagcac

SEQ ID NO: 49873 - DNA, 15 bp, Homo sapiens
ctttattttagcact

SEQ ID NO: 49874 - DNA, 15 bp, Homo sapiens
tttattttagcactg

SEQ ID NO: 49875 - DNA, 15 bp, Homo sapiens
ttattttagcactgt

SEQ ID NO: 49876 - DNA, 15 bp, Homo sapiens
tattttagcactgtg

SEQ ID NO: 49877 - DNA, 15 bp, Homo sapiens
attttagcactgtgt

SEQ ID NO: 49878 - DNA, 15 bp, Homo sapiens
ttttagcactgtgtg

SEQ ID NO: 49879 - DNA, 15 bp, Homo sapiens
tttagcactgtgtgt

SEQ ID NO: 49880 - DNA, 15 bp, Homo sapiens
ttagcactgtgtgtt

SEQ ID NO: 49881 - DNA, 15 bp, Homo sapiens
tagcactgtgtgtta

SEQ ID NO: 49882 - DNA, 15 bp, Homo sapiens
agcactgtgtgttac

SEQ ID NO: 49883 - DNA, 15 bp, Homo sapiens
gcactgtgtgttacg

SEQ ID NO: 49884 - DNA, 15 bp, Homo sapiens
cactgtgtgttacgt

SEQ ID NO: 49885 - DNA, 15 bp, Homo sapiens
actgtgtgttacgtg

SEQ ID NO: 49886 - DNA, 15 bp, Homo sapiens
ctgtgtgttacgtgc

SEQ ID NO: 49887 - DNA, 15 bp, Homo sapiens
tgtgtgttacgtgcc

SEQ ID NO: 49888 - DNA, 15 bp, Homo sapiens
gtgtgttacgtgcca

SEQ ID NO: 49889 - DNA, 15 bp, Homo sapiens
tgtgttacgtgccag

SEQ ID NO: 49890 - DNA, 15 bp, Homo sapiens
gtgttacgtgccagt

SEQ ID NO: 49891 - DNA, 15 bp, Homo sapiens
tgttacgtgccagta

SEQ ID NO: 49892 - DNA, 15 bp, Homo sapiens
gttacgtgccagtaa

SEQ ID NO: 49893 - DNA, 15 bp, Homo sapiens
ttacgtgccagtaat

SEQ ID NO: 49894 - DNA, 15 bp, Homo sapiens
tacgtgccagtaatt

SEQ ID NO: 49895 - DNA, 15 bp, Homo sapiens
acgtgccagtaattt

SEQ ID NO: 49896 - DNA, 15 bp, Homo sapiens
cgtgccagtaatttg

SEQ ID NO: 49897 - DNA, 15 bp, Homo sapiens
gtgccagtaatttgc

SEQ ID NO: 49898 - DNA, 15 bp, Homo sapiens
tgccagtaatttgca

SEQ ID NO: 49899 - DNA, 15 bp, Homo sapiens
gccagtaatttgcag

SEQ ID NO: 49900 - DNA, 15 bp, Homo sapiens
ccagtaatttgcagc

SEQ ID NO: 49901 - DNA, 15 bp, Homo sapiens
cagtaatttgcagct

SEQ ID NO: 49902 - DNA, 15 bp, Homo sapiens
agtaatttgcagctt

SEQ ID NO: 49903 - DNA, 15 bp, Homo sapiens
gtaatttgcagctta

SEQ ID NO: 49904 - DNA, 15 bp, Homo sapiens
taatttgcagcttat

SEQ ID NO: 49905 - DNA, 15 bp, Homo sapiens
aatttgcagcttatc

SEQ ID NO: 49906 - DNA, 15 bp, Homo sapiens
atttgcagcttatcc

SEQ ID NO: 49907 - DNA, 15 bp, Homo sapiens
tttgcagcttatcct

SEQ ID NO: 49908 - DNA, 15 bp, Homo sapiens
ttgcagcttatcctt

SEQ ID NO: 49909 - DNA, 15 bp, Homo sapiens
tgcagcttatccttt

SEQ ID NO: 49910 - DNA, 15 bp, Homo sapiens
gcagcttatcctttg

SEQ ID NO: 49911 - DNA, 15 bp, Homo sapiens
cagcttatcctttgt

SEQ ID NO: 49912 - DNA, 15 bp, Homo sapiens
agcttatcctttgtt

SEQ ID NO: 49913 - DNA, 15 bp, Homo sapiens
gcttatcctttgttt

SEQ ID NO: 49914 - DNA, 15 bp, Homo sapiens
cttatcctttgtttc

SEQ ID NO: 49915 - DNA, 15 bp, Homo sapiens
ttatcctttgtttct

SEQ ID NO: 49916 - DNA, 15 bp, Homo sapiens
tatcctttgtttcta

SEQ ID NO: 49917 - DNA, 15 bp, Homo sapiens
atcctttgtttctag

SEQ ID NO: 49918 - DNA, 15 bp, Homo sapiens
tcctttgtttctagc

SEQ ID NO: 49919 - DNA, 15 bp, Homo sapiens
cctttgtttctagct

SEQ ID NO: 49920 - DNA, 15 bp, Homo sapiens
ctttgtttctagcta

SEQ ID NO: 49921 - DNA, 15 bp, Homo sapiens
tttgtttctagctag

SEQ ID NO: 49922 - DNA, 15 bp, Homo sapiens
ttgtttctagctagg

SEQ ID NO: 49923 - DNA, 15 bp, Homo sapiens
tgtttctagctaggt

SEQ ID NO: 49924 - DNA, 15 bp, Homo sapiens
gtttctagctaggta

SEQ ID NO: 49925 - DNA, 15 bp, Homo sapiens
tttctagctaggtaa

SEQ ID NO: 49926 - DNA, 15 bp, Homo sapiens
ttctagctaggtaag

SEQ ID NO: 49927 - DNA, 15 bp, Homo sapiens
tctagctaggtaagc

SEQ ID NO: 49928 - DNA, 15 bp, Homo sapiens
ctagctaggtaagct

SEQ ID NO: 49929 - DNA, 15 bp, Homo sapiens
tagctaggtaagctg

SEQ ID NO: 49930 - DNA, 15 bp, Homo sapiens
agctaggtaagctgg

SEQ ID NO: 49931 - DNA, 15 bp, Homo sapiens
gctaggtaagctggg

SEQ ID NO: 49932 - DNA, 15 bp, Homo sapiens
ctaggtaagctggga

SEQ ID NO: 49933 - DNA, 15 bp, Homo sapiens
taggtaagctgggaa

SEQ ID NO: 49934 - DNA, 15 bp, Homo sapiens
aggtaagctgggaaa

SEQ ID NO: 49935 - DNA, 15 bp, Homo sapiens
ggtaagctgggaaat

SEQ ID NO: 49936 - DNA, 15 bp, Homo sapiens
gtaagctgggaaata

SEQ ID NO: 49937 - DNA, 15 bp, Homo sapiens
taagctgggaaatag

SEQ ID NO: 49938 - DNA, 15 bp, Homo sapiens
aagctgggaaatagc

SEQ ID NO: 49939 - DNA, 15 bp, Homo sapiens
agctgggaaatagcc

SEQ ID NO: 49940 - DNA, 15 bp, Homo sapiens
gctgggaaatagcct

SEQ ID NO: 49941 - DNA, 15 bp, Homo sapiens
ctgggaaatagccta

SEQ ID NO: 49942 - DNA, 15 bp, Homo sapiens
tgggaaatagcctag

SEQ ID NO: 49943 - DNA, 15 bp, Homo sapiens
gggaaatagcctagt

SEQ ID NO: 49944 - DNA, 15 bp, Homo sapiens
ggaaatagcctagta

SEQ ID NO: 49945 - DNA, 15 bp, Homo sapiens
gaaatagcctagtac

SEQ ID NO: 49946 - DNA, 15 bp, Homo sapiens
aaatagcctagtact

SEQ ID NO: 49947 - DNA, 15 bp, Homo sapiens
aatagcctagtactt

SEQ ID NO: 49948 - DNA, 15 bp, Homo sapiens
atagcctagtacttt

SEQ ID NO: 49949 - DNA, 15 bp, Homo sapiens
tagcctagtactttg

SEQ ID NO: 49950 - DNA, 15 bp, Homo sapiens
agcctagtactttgt

SEQ ID NO: 49951 - DNA, 15 bp, Homo sapiens
gcctagtactttgtc

SEQ ID NO: 49952 - DNA, 15 bp, Homo sapiens
cctagtactttgtct

SEQ ID NO: 49953 - DNA, 15 bp, Homo sapiens
ctagtactttgtcta

SEQ ID NO: 49954 - DNA, 15 bp, Homo sapiens
tagtactttgtctat

SEQ ID NO: 49955 - DNA, 15 bp, Homo sapiens
agtactttgtctatg

SEQ ID NO: 49956 - DNA, 15 bp, Homo sapiens
gtactttgtctatgt

SEQ ID NO: 49957 - DNA, 15 bp, Homo sapiens
tactttgtctatgtg

SEQ ID NO: 49958 - DNA, 15 bp, Homo sapiens
actttgtctatgtgt

SEQ ID NO: 49959 - DNA, 15 bp, Homo sapiens
ctttgtctatgtgtt

SEQ ID NO: 49960 - DNA, 15 bp, Homo sapiens
tttgtctatgtgttt

SEQ ID NO: 49961 - DNA, 15 bp, Homo sapiens
ttgtctatgtgttta

SEQ ID NO: 49962 - DNA, 15 bp, Homo sapiens
tgtctatgtgtttat

SEQ ID NO: 49963 - DNA, 15 bp, Homo sapiens
gtctatgtgtttatc

SEQ ID NO: 49964 - DNA, 15 bp, Homo sapiens
tctatgtgtttatct

SEQ ID NO: 49965 - DNA, 15 bp, Homo sapiens
ctatgtgtttatctt

SEQ ID NO: 49966 - DNA, 15 bp, Homo sapiens
tatgtgtttatcttc

SEQ ID NO: 49967 - DNA, 15 bp, Homo sapiens
atgtgtttatcttca

SEQ ID NO: 49968 - DNA, 15 bp, Homo sapiens
tgtgtttatcttcaa

SEQ ID NO: 49969 - DNA, 15 bp, Homo sapiens
gtgtttatcttcaaa

SEQ ID NO: 49970 - DNA, 15 bp, Homo sapiens
tgtttatcttcaaaa

SEQ ID NO: 49971 - DNA, 15 bp, Homo sapiens
gtttatcttcaaaat

SEQ ID NO: 49972 - DNA, 15 bp, Homo sapiens
tttatcttcaaaatg

SEQ ID NO: 49973 - DNA, 15 bp, Homo sapiens
ttatcttcaaaatgt

SEQ ID NO: 49974 - DNA, 15 bp, Homo sapiens
tatcttcaaaatgtc

SEQ ID NO: 49975 - DNA, 15 bp, Homo sapiens
atcttcaaaatgtcc

SEQ ID NO: 49976 - DNA, 15 bp, Homo sapiens
tcttcaaaatgtccc

SEQ ID NO: 49977 - DNA, 15 bp, Homo sapiens
cttcaaaatgtccca

SEQ ID NO: 49978 - DNA, 15 bp, Homo sapiens
ttcaaaatgtcccaa

SEQ ID NO: 49979 - DNA, 15 bp, Homo sapiens
tcaaaatgtcccaaa

SEQ ID NO: 49980 - DNA, 15 bp, Homo sapiens
caaaatgtcccaaat

SEQ ID NO: 49981 - DNA, 15 bp, Homo sapiens
aaaatgtcccaaata

SEQ ID NO: 49982 - DNA, 15 bp, Homo sapiens
aaatgtcccaaatag

SEQ ID NO: 49983 - DNA, 15 bp, Homo sapiens
aatgtcccaaatagc

SEQ ID NO: 49984 - DNA, 15 bp, Homo sapiens
atgtcccaaatagcc

SEQ ID NO: 49985 - DNA, 15 bp, Homo sapiens
tgtcccaaatagccc

SEQ ID NO: 49986 - DNA, 15 bp, Homo sapiens
gtcccaaatagccct

SEQ ID NO: 49987 - DNA, 15 bp, Homo sapiens
tcccaaatagccctg

SEQ ID NO: 49988 - DNA, 15 bp, Homo sapiens
cccaaatagccctgg

SEQ ID NO: 49989 - DNA, 15 bp, Homo sapiens
ccaaatagccctggg

SEQ ID NO: 49990 - DNA, 15 bp, Homo sapiens
caaatagccctggga

SEQ ID NO: 49991 - DNA, 15 bp, Homo sapiens
aaatagccctgggaa

SEQ ID NO: 49992 - DNA, 15 bp, Homo sapiens
aatagccctgggaaa

SEQ ID NO: 49993 - DNA, 15 bp, Homo sapiens
atagccctgggaaaa

SEQ ID NO: 49994 - DNA, 15 bp, Homo sapiens
tagccctgggaaaaa

SEQ ID NO: 49995 - DNA, 15 bp, Homo sapiens
agccctgggaaaaag

SEQ ID NO: 49996 - DNA, 15 bp, Homo sapiens
gccctgggaaaaagg

SEQ ID NO: 49997 - DNA, 15 bp, Homo sapiens
ccctgggaaaaaggt

SEQ ID NO: 49998 - DNA, 15 bp, Homo sapiens
cctgggaaaaaggtc

SEQ ID NO: 49999 - DNA, 15 bp, Homo sapiens
ctgggaaaaaggtcg

SEQ ID NO: 50000 - DNA, 15 bp, Homo sapiens
tgggaaaaaggtcgt

SEQ ID NO: 50001 - DNA, 15 bp, Homo sapiens
gggaaaaaggtcgtg

SEQ ID NO: 50002 - DNA, 15 bp, Homo sapiens
ggaaaaaggtcgtgc

SEQ ID NO: 50003 - DNA, 15 bp, Homo sapiens
gaaaaaggtcgtgca

SEQ ID NO: 50004 - DNA, 15 bp, Homo sapiens
aaaaaggtcgtgcag

SEQ ID NO: 50005 - DNA, 15 bp, Homo sapiens
aaaaggtcgtgcagc

SEQ ID NO: 50006 - DNA, 15 bp, Homo sapiens
aaaggtcgtgcagct

SEQ ID NO: 50007 - DNA, 15 bp, Homo sapiens
aaggtcgtgcagctc

SEQ ID NO: 50008 - DNA, 15 bp, Homo sapiens
aggtcgtgcagctca

SEQ ID NO: 50009 - DNA, 15 bp, Homo sapiens
ggtcgtgcagctcaa

SEQ ID NO: 50010 - DNA, 15 bp, Homo sapiens
gtcgtgcagctcaat

SEQ ID NO: 50011 - DNA, 15 bp, Homo sapiens
tcgtgcagctcaatg

SEQ ID NO: 50012 - DNA, 15 bp, Homo sapiens
cgtgcagctcaatgg

SEQ ID NO: 50013 - DNA, 15 bp, Homo sapiens
gtgcagctcaatggg

SEQ ID NO: 50014 - DNA, 15 bp, Homo sapiens
tgcagctcaatgggg

SEQ ID NO: 50015 - DNA, 15 bp, Homo sapiens
gcagctcaatggggg

SEQ ID NO: 50016 - DNA, 15 bp, Homo sapiens
cagctcaatgggggc

SEQ ID NO: 50017 - DNA, 15 bp, Homo sapiens
agctcaatgggggct

SEQ ID NO: 50018 - DNA, 15 bp, Homo sapiens
gctcaatgggggctt

SEQ ID NO: 50019 - DNA, 15 bp, Homo sapiens
ctcaatgggggcttt

SEQ ID NO: 50020 - DNA, 15 bp, Homo sapiens
tcaatgggggctttc

SEQ ID NO: 50021 - DNA, 15 bp, Homo sapiens
caatgggggctttca

SEQ ID NO: 50022 - DNA, 15 bp, Homo sapiens
aatgggggctttcaa

SEQ ID NO: 50023 - DNA, 15 bp, Homo sapiens
atgggggctttcaac

SEQ ID NO: 50024 - DNA, 15 bp, Homo sapiens
tgggggctttcaact

SEQ ID NO: 50025 - DNA, 15 bp, Homo sapiens
gggggctttcaactt

SEQ ID NO: 50026 - DNA, 15 bp, Homo sapiens
ggggctttcaactta

SEQ ID NO: 50027 - DNA, 15 bp, Homo sapiens
gggctttcaacttac

SEQ ID NO: 50028 - DNA, 15 bp, Homo sapiens
ggctttcaacttaca

SEQ ID NO: 50029 - DNA, 15 bp, Homo sapiens
gctttcaacttacaa

SEQ ID NO: 50030 - DNA, 15 bp, Homo sapiens
ctttcaacttacaat

SEQ ID NO: 50031 - DNA, 15 bp, Homo sapiens
tttcaacttacaatt

SEQ ID NO: 50032 - DNA, 15 bp, Homo sapiens
ttcaacttacaattt

SEQ ID NO: 50033 - DNA, 15 bp, Homo sapiens
tcaacttacaatttt

SEQ ID NO: 50034 - DNA, 15 bp, Homo sapiens
caacttacaattttc

SEQ ID NO: 50035 - DNA, 15 bp, Homo sapiens
aacttacaattttct

SEQ ID NO: 50036 - DNA, 15 bp, Homo sapiens
acttacaattttctt

SEQ ID NO: 50037 - DNA, 15 bp, Homo sapiens
cttacaattttcttt

SEQ ID NO: 50038 - DNA, 15 bp, Homo sapiens
ttacaattttctttg

SEQ ID NO: 50039 - DNA, 15 bp, Homo sapiens
tacaattttctttgt

SEQ ID NO: 50040 - DNA, 15 bp, Homo sapiens
acaattttctttgtt

SEQ ID NO: 50041 - DNA, 15 bp, Homo sapiens
caattttctttgttt

SEQ ID NO: 50042 - DNA, 15 bp, Homo sapiens
aattttctttgtttt

SEQ ID NO: 50043 - DNA, 15 bp, Homo sapiens
attttctttgtttta

SEQ ID NO: 50044 - DNA, 15 bp, Homo sapiens
ttttctttgttttag

SEQ ID NO: 50045 - DNA, 15 bp, Homo sapiens
tttctttgttttagg

SEQ ID NO: 50046 - DNA, 15 bp, Homo sapiens
ttctttgttttaggc

SEQ ID NO: 50047 - DNA, 15 bp, Homo sapiens
tctttgttttaggct

SEQ ID NO: 50048 - DNA, 15 bp, Homo sapiens
ctttgttttaggctc

SEQ ID NO: 50049 - DNA, 15 bp, Homo sapiens
tttgttttaggctcc

SEQ ID NO: 50050 - DNA, 15 bp, Homo sapiens
ttgttttaggctcca

SEQ ID NO: 50051 - DNA, 15 bp, Homo sapiens
tgttttaggctccat

SEQ ID NO: 50052 - DNA, 15 bp, Homo sapiens
gttttaggctccata

SEQ ID NO: 50053 - DNA, 15 bp, Homo sapiens
ttttaggctccataa

SEQ ID NO: 50054 - DNA, 15 bp, Homo sapiens
tttaggctccataaa

SEQ ID NO: 50055 - DNA, 15 bp, Homo sapiens
ttaggctccataaaa

SEQ ID NO: 50056 - DNA, 15 bp, Homo sapiens
taggctccataaaaa

SEQ ID NO: 50057 - DNA, 15 bp, Homo sapiens
aggctccataaaaat

SEQ ID NO: 50058 - DNA, 15 bp, Homo sapiens
ggctccataaaaata

SEQ ID NO: 50059 - DNA, 15 bp, Homo sapiens
gctccataaaaatac

SEQ ID NO: 50060 - DNA, 15 bp, Homo sapiens
ctccataaaaataca

SEQ ID NO: 50061 - DNA, 15 bp, Homo sapiens
tccataaaaatacag

SEQ ID NO: 50062 - DNA, 15 bp, Homo sapiens
ccataaaaatacaga

SEQ ID NO: 50063 - DNA, 15 bp, Homo sapiens
cataaaaatacagac

SEQ ID NO: 50064 - DNA, 15 bp, Homo sapiens
ataaaaatacagact

SEQ ID NO: 50065 - DNA, 15 bp, Homo sapiens
taaaaatacagactc

SEQ ID NO: 50066 - DNA, 15 bp, Homo sapiens
aaaaatacagactca

SEQ ID NO: 50067 - DNA, 15 bp, Homo sapiens
aaaatacagactcac

SEQ ID NO: 50068 - DNA, 15 bp, Homo sapiens
aaatacagactcacc

SEQ ID NO: 50069 - DNA, 15 bp, Homo sapiens
aatacagactcacca

SEQ ID NO: 50070 - DNA, 15 bp, Homo sapiens
atacagactcaccag

SEQ ID NO: 50071 - DNA, 15 bp, Homo sapiens
tacagactcaccagt

SEQ ID NO: 50072 - DNA, 15 bp, Homo sapiens
acagactcaccagtt

SEQ ID NO: 50073 - DNA, 15 bp, Homo sapiens
cagactcaccagttc

SEQ ID NO: 50074 - DNA, 15 bp, Homo sapiens
agactcaccagttcc

SEQ ID NO: 50075 - DNA, 15 bp, Homo sapiens
gactcaccagttcct

SEQ ID NO: 50076 - DNA, 15 bp, Homo sapiens
actcaccagttcctg

SEQ ID NO: 50077 - DNA, 15 bp, Homo sapiens
ctcaccagttcctgc

SEQ ID NO: 50078 - DNA, 15 bp, Homo sapiens
tcaccagttcctgct

SEQ ID NO: 50079 - DNA, 15 bp, Homo sapiens
caccagttcctgctt

SEQ ID NO: 50080 - DNA, 15 bp, Homo sapiens
accagttcctgcttt

SEQ ID NO: 50081 - DNA, 15 bp, Homo sapiens
ccagttcctgctttg

SEQ ID NO: 50082 - DNA, 15 bp, Homo sapiens
cagttcctgctttga

SEQ ID NO: 50083 - DNA, 15 bp, Homo sapiens
agttcctgctttgat

SEQ ID NO: 50084 - DNA, 15 bp, Homo sapiens
gttcctgctttgatg

SEQ ID NO: 50085 - DNA, 15 bp, Homo sapiens
ttcctgctttgatgt

SEQ ID NO: 50086 - DNA, 15 bp, Homo sapiens
tcctgctttgatgtg

SEQ ID NO: 50087 - DNA, 15 bp, Homo sapiens
cctgctttgatgtga

SEQ ID NO: 50088 - DNA, 15 bp, Homo sapiens
ctgctttgatgtgac

SEQ ID NO: 50089 - DNA, 15 bp, Homo sapiens
tgctttgatgtgaca

SEQ ID NO: 50090 - DNA, 15 bp, Homo sapiens
gctttgatgtgacat

SEQ ID NO: 50091 - DNA, 15 bp, Homo sapiens
ctttgatgtgacatg

SEQ ID NO: 50092 - DNA, 15 bp, Homo sapiens
tttgatgtgacatgt

SEQ ID NO: 50093 - DNA, 15 bp, Homo sapiens
ttgatgtgacatgtg

SEQ ID NO: 50094 - DNA, 15 bp, Homo sapiens
tgatgtgacatgtga

SEQ ID NO: 50095 - DNA, 15 bp, Homo sapiens
gatgtgacatgtgac

SEQ ID NO: 50096 - DNA, 15 bp, Homo sapiens
atgtgacatgtgact

SEQ ID NO: 50097 - DNA, 15 bp, Homo sapiens
tgtgacatgtgactc

SEQ ID NO: 50098 - DNA, 15 bp, Homo sapiens
gtgacatgtgactcc

SEQ ID NO: 50099 - DNA, 15 bp, Homo sapiens
tgacatgtgactccc

SEQ ID NO: 50100 - DNA, 15 bp, Homo sapiens
gacatgtgactcccc

SEQ ID NO: 50101 - DNA, 15 bp, Homo sapiens
acatgtgactcccca

SEQ ID NO: 50102 - DNA, 15 bp, Homo sapiens
catgtgactccccag

SEQ ID NO: 50103 - DNA, 15 bp, Homo sapiens
atgtgactccccaga

SEQ ID NO: 50104 - DNA, 15 bp, Homo sapiens
tgtgactccccagaa

SEQ ID NO: 50105 - DNA, 15 bp, Homo sapiens
gtgactccccagaat

SEQ ID NO: 50106 - DNA, 15 bp, Homo sapiens
tgactccccagaata

SEQ ID NO: 50107 - DNA, 15 bp, Homo sapiens
gactccccagaatac

SEQ ID NO: 50108 - DNA, 15 bp, Homo sapiens
actccccagaataca

SEQ ID NO: 50109 - DNA, 15 bp, Homo sapiens
ctccccagaatacac

SEQ ID NO: 50110 - DNA, 15 bp, Homo sapiens
tccccagaatacacc

SEQ ID NO: 50111 - DNA, 15 bp, Homo sapiens
ccccagaatacacct

SEQ ID NO: 50112 - DNA, 15 bp, Homo sapiens
cccagaatacacctt

SEQ ID NO: 50113 - DNA, 15 bp, Homo sapiens
ccagaatacaccttg

SEQ ID NO: 50114 - DNA, 15 bp, Homo sapiens
cagaatacaccttgc

SEQ ID NO: 50115 - DNA, 15 bp, Homo sapiens
agaatacaccttgct

SEQ ID NO: 50116 - DNA, 15 bp, Homo sapiens
gaatacaccttgctt

SEQ ID NO: 50117 - DNA, 15 bp, Homo sapiens
aatacaccttgcttc

SEQ ID NO: 50118 - DNA, 15 bp, Homo sapiens
atacaccttgcttct

SEQ ID NO: 50119 - DNA, 15 bp, Homo sapiens
tacaccttgcttctg

SEQ ID NO: 50120 - DNA, 15 bp, Homo sapiens
acaccttgcttctgt

SEQ ID NO: 50121 - DNA, 15 bp, Homo sapiens
caccttgcttctgta

SEQ ID NO: 50122 - DNA, 15 bp, Homo sapiens
accttgcttctgtag

SEQ ID NO: 50123 - DNA, 15 bp, Homo sapiens
ccttgcttctgtaga

SEQ ID NO: 50124 - DNA, 15 bp, Homo sapiens
cttgcttctgtagac

SEQ ID NO: 50125 - DNA, 15 bp, Homo sapiens
ttgcttctgtagacc

SEQ ID NO: 50126 - DNA, 15 bp, Homo sapiens
tgcttctgtagacca

SEQ ID NO: 50127 - DNA, 15 bp, Homo sapiens
gcttctgtagaccag

SEQ ID NO: 50128 - DNA, 15 bp, Homo sapiens
cttctgtagaccagc

SEQ ID NO: 50129 - DNA, 15 bp, Homo sapiens
ttctgtagaccagct

SEQ ID NO: 50130 - DNA, 15 bp, Homo sapiens
tctgtagaccagctc

SEQ ID NO: 50131 - DNA, 15 bp, Homo sapiens
ctgtagaccagctcc

SEQ ID NO: 50132 - DNA, 15 bp, Homo sapiens
tgtagaccagctcca

SEQ ID NO: 50133 - DNA, 15 bp, Homo sapiens
gtagaccagctccaa

SEQ ID NO: 50134 - DNA, 15 bp, Homo sapiens
tagaccagctccaac

SEQ ID NO: 50135 - DNA, 15 bp, Homo sapiens
agaccagctccaaca

SEQ ID NO: 50136 - DNA, 15 bp, Homo sapiens
gaccagctccaacag

SEQ ID NO: 50137 - DNA, 15 bp, Homo sapiens
accagctccaacagg

SEQ ID NO: 50138 - DNA, 15 bp, Homo sapiens
ccagctccaacagga

SEQ ID NO: 50139 - DNA, 15 bp, Homo sapiens
cagctccaacaggat

SEQ ID NO: 50140 - DNA, 15 bp, Homo sapiens
agctccaacaggatt

SEQ ID NO: 50141 - DNA, 15 bp, Homo sapiens
gctccaacaggattc

SEQ ID NO: 50142 - DNA, 15 bp, Homo sapiens
ctccaacaggattcc

SEQ ID NO: 50143 - DNA, 15 bp, Homo sapiens
tccaacaggattcca

SEQ ID NO: 50144 - DNA, 15 bp, Homo sapiens
ccaacaggattccat

SEQ ID NO: 50145 - DNA, 15 bp, Homo sapiens
caacaggattccatg

SEQ ID NO: 50146 - DNA, 15 bp, Homo sapiens
aacaggattccatgg

SEQ ID NO: 50147 - DNA, 15 bp, Homo sapiens
acaggattccatggt

SEQ ID NO: 50148 - DNA, 15 bp, Homo sapiens
caggattccatggta

SEQ ID NO: 50149 - DNA, 15 bp, Homo sapiens
aggattccatggtag

SEQ ID NO: 50150 - DNA, 15 bp, Homo sapiens
ggattccatggtagc

SEQ ID NO: 50151 - DNA, 15 bp, Homo sapiens
gattccatggtagct

SEQ ID NO: 50152 - DNA, 15 bp, Homo sapiens
attccatggtagctg

SEQ ID NO: 50153 - DNA, 15 bp, Homo sapiens
ttccatggtagctgg

SEQ ID NO: 50154 - DNA, 15 bp, Homo sapiens
tccatggtagctggg

SEQ ID NO: 50155 - DNA, 15 bp, Homo sapiens
ccatggtagctggga

SEQ ID NO: 50156 - DNA, 15 bp, Homo sapiens
catggtagctgggat

SEQ ID NO: 50157 - DNA, 15 bp, Homo sapiens
atggtagctgggatg

SEQ ID NO: 50158 - DNA, 15 bp, Homo sapiens
tggtagctgggatgt

SEQ ID NO: 50159 - DNA, 15 bp, Homo sapiens
ggtagctgggatgtt

SEQ ID NO: 50160 - DNA, 15 bp, Homo sapiens
gtagctgggatgtta

SEQ ID NO: 50161 - DNA, 15 bp, Homo sapiens
tagctgggatgttag

SEQ ID NO: 50162 - DNA, 15 bp, Homo sapiens
agctgggatgttagg

SEQ ID NO: 50163 - DNA, 15 bp, Homo sapiens
gctgggatgttaggg

SEQ ID NO: 50164 - DNA, 15 bp, Homo sapiens
ctgggatgttagggc

SEQ ID NO: 50165 - DNA, 15 bp, Homo sapiens
tgggatgttagggct

SEQ ID NO: 50166 - DNA, 15 bp, Homo sapiens
gggatgttagggctc

SEQ ID NO: 50167 - DNA, 15 bp, Homo sapiens
ggatgttagggctca

SEQ ID NO: 50168 - DNA, 15 bp, Homo sapiens
gatgttagggctcag

SEQ ID NO: 50169 - DNA, 15 bp, Homo sapiens
atgttagggctcagg

SEQ ID NO: 50170 - DNA, 15 bp, Homo sapiens
tgttagggctcaggt

SEQ ID NO: 50171 - DNA, 15 bp, Homo sapiens
gttagggctcaggta

SEQ ID NO: 50172 - DNA, 15 bp, Homo sapiens
ttagggctcaggtaa

SEQ ID NO: 50173 - DNA, 15 bp, Homo sapiens
tagggctcaggtaag

SEQ ID NO: 50174 - DNA, 15 bp, Homo sapiens
agggctcaggtaagt

SEQ ID NO: 50175 - DNA, 15 bp, Homo sapiens
gggctcaggtaagta

SEQ ID NO: 50176 - DNA, 15 bp, Homo sapiens
ggctcaggtaagtaa

SEQ ID NO: 50177 - DNA, 15 bp, Homo sapiens
gctcaggtaagtaac

SEQ ID NO: 50178 - DNA, 15 bp, Homo sapiens
ctcaggtaagtaacc

SEQ ID NO: 50179 - DNA, 15 bp, Homo sapiens
tcaggtaagtaacct

SEQ ID NO: 50180 - DNA, 15 bp, Homo sapiens
caggtaagtaacctt

SEQ ID NO: 50181 - DNA, 15 bp, Homo sapiens
aggtaagtaaccttc

SEQ ID NO: 50182 - DNA, 15 bp, Homo sapiens
ggtaagtaaccttcc

SEQ ID NO: 50183 - DNA, 15 bp, Homo sapiens
gtaagtaaccttcct

SEQ ID NO: 50184 - DNA, 15 bp, Homo sapiens
taagtaaccttcctt

SEQ ID NO: 50185 - DNA, 15 bp, Homo sapiens
aagtaaccttccttt

SEQ ID NO: 50186 - DNA, 15 bp, Homo sapiens
agtaaccttcctttt

SEQ ID NO: 50187 - DNA, 15 bp, Homo sapiens
gtaaccttccttttt

SEQ ID NO: 50188 - DNA, 15 bp, Homo sapiens
taaccttcctttttt

SEQ ID NO: 50189 - DNA, 15 bp, Homo sapiens
aaccttccttttttt

SEQ ID NO: 50190 - DNA, 15 bp, Homo sapiens
accttcctttttttt

SEQ ID NO: 50191 - DNA, 15 bp, Homo sapiens
ccttccttttttttt

SEQ ID NO: 50192 - DNA, 15 bp, Homo sapiens
cttcctttttttttt

SEQ ID NO: 50193 - DNA, 15 bp, Homo sapiens
cttttttttttttta

SEQ ID NO: 50194 - DNA, 15 bp, Homo sapiens
tttttttttttagta

SEQ ID NO: 50195 - DNA, 15 bp, Homo sapiens
ttttttttttagtat

SEQ ID NO: 50196 - DNA, 15 bp, Homo sapiens
tttttttttagtata

SEQ ID NO: 50197 - DNA, 15 bp, Homo sapiens
ttttttttagtatat

SEQ ID NO: 50198 - DNA, 15 bp, Homo sapiens
tttttttagtatatg

SEQ ID NO: 50199 - DNA, 15 bp, Homo sapiens
ttttttagtatatgt

SEQ ID NO: 50200 - DNA, 15 bp, Homo sapiens
tttttagtatatgtc

SEQ ID NO: 50201 - DNA, 15 bp, Homo sapiens
ttttagtatatgtcc

SEQ ID NO: 50202 - DNA, 15 bp, Homo sapiens
tttagtatatgtcct

SEQ ID NO: 50203 - DNA, 15 bp, Homo sapiens
ttagtatatgtcctg

SEQ ID NO: 50204 - DNA, 15 bp, Homo sapiens
tagtatatgtcctgg

SEQ ID NO: 50205 - DNA, 15 bp, Homo sapiens
agtatatgtcctggt

SEQ ID NO: 50206 - DNA, 15 bp, Homo sapiens
gtatatgtcctggtt

SEQ ID NO: 50207 - DNA, 15 bp, Homo sapiens
tatatgtcctggttt

SEQ ID NO: 50208 - DNA, 15 bp, Homo sapiens
atatgtcctggtttg

SEQ ID NO: 50209 - DNA, 15 bp, Homo sapiens
tatgtcctggtttgg

SEQ ID NO: 50210 - DNA, 15 bp, Homo sapiens
atgtcctggtttggc

SEQ ID NO: 50211 - DNA, 15 bp, Homo sapiens
tgtcctggtttggcc

SEQ ID NO: 50212 - DNA, 15 bp, Homo sapiens
gtcctggtttggcca

SEQ ID NO: 50213 - DNA, 15 bp, Homo sapiens
tcctggtttggccat

SEQ ID NO: 50214 - DNA, 15 bp, Homo sapiens
cctggtttggccatc

SEQ ID NO: 50215 - DNA, 15 bp, Homo sapiens
ctggtttggccatct

SEQ ID NO: 50216 - DNA, 15 bp, Homo sapiens
tggtttggccatctg

SEQ ID NO: 50217 - DNA, 15 bp, Homo sapiens
ggtttggccatctgt

SEQ ID NO: 50218 - DNA, 15 bp, Homo sapiens
gtttggccatctgtt

SEQ ID NO: 50219 - DNA, 15 bp, Homo sapiens
tttggccatctgttt

SEQ ID NO: 50220 - DNA, 15 bp, Homo sapiens
ttggccatctgtttt

SEQ ID NO: 50221 - DNA, 15 bp, Homo sapiens
tggccatctgttttt

SEQ ID NO: 50222 - DNA, 15 bp, Homo sapiens
ggccatctgtttttt

SEQ ID NO: 50223 - DNA, 15 bp, Homo sapiens
gccatctgttttttt

SEQ ID NO: 50224 - DNA, 15 bp, Homo sapiens
ccatctgtttttttt

SEQ ID NO: 50225 - DNA, 15 bp, Homo sapiens
catctgttttttttt

SEQ ID NO: 50226 - DNA, 15 bp, Homo sapiens
atctgtttttttttt

SEQ ID NO: 50227 - DNA, 15 bp, Homo sapiens
tctgttttttttttt

SEQ ID NO: 50228 - DNA, 15 bp, Homo sapiens
ctgtttttttttttt

SEQ ID NO: 50229 - DNA, 15 bp, Homo sapiens
tgttttttttttttt

SEQ ID NO: 50230 - DNA, 15 bp, Homo sapiens
tttaaaaaaaaaaaa

SEQ ID NO: 50231 - DNA, 15 bp, Homo sapiens
ttaaaaaaaaaaaaa

SEQ ID NO: 50232 - DNA, 15 bp, Homo sapiens
taaaaaaaaaaaaaa

SEQ ID NO: 50233 - DNA, 15 bp, Homo sapiens
aaaaaaaaaaaaagg

SEQ ID NO: 50234 - DNA, 15 bp, Homo sapiens
aaaaaaaaaaaagga

SEQ ID NO: 50235 - DNA, 15 bp, Homo sapiens
aaaaaaaaaaaggaa

SEQ ID NO: 50236 - DNA, 15 bp, Homo sapiens
aaaaaaaaaaggaaa

SEQ ID NO: 50237 - DNA, 15 bp, Homo sapiens
aaaaaaaaaggaaaa

SEQ ID NO: 50238 - DNA, 15 bp, Homo sapiens
aaaaaaaaggaaaag

SEQ ID NO: 50239 - DNA, 15 bp, Homo sapiens
aaaaaaaggaaaaga

SEQ ID NO: 50240 - DNA, 15 bp, Homo sapiens
aaaaaaggaaaagag

SEQ ID NO: 50241 - DNA, 15 bp, Homo sapiens
aaaaaggaaaagagg

SEQ ID NO: 50242 - DNA, 15 bp, Homo sapiens
aaaaggaaaagagga

SEQ ID NO: 50243 - DNA, 15 bp, Homo sapiens
aaaggaaaagaggaa

SEQ ID NO: 50244 - DNA, 15 bp, Homo sapiens
aaggaaaagaggaaa

SEQ ID NO: 50245 - DNA, 15 bp, Homo sapiens
aggaaaagaggaaaa

SEQ ID NO: 50246 - DNA, 15 bp, Homo sapiens
ggaaaagaggaaaaa

SEQ ID NO: 50247 - DNA, 15 bp, Homo sapiens
gaaaagaggaaaaaa

SEQ ID NO: 50248 - DNA, 15 bp, Homo sapiens
aaaagaggaaaaaaa

SEQ ID NO: 50249 - DNA, 15 bp, Homo sapiens
aaagaggaaaaaaat

SEQ ID NO: 50250 - DNA, 15 bp, Homo sapiens
aagaggaaaaaaata

SEQ ID NO: 50251 - DNA, 15 bp, Homo sapiens
agaggaaaaaaatat

SEQ ID NO: 50252 - DNA, 15 bp, Homo sapiens
gaggaaaaaaatata

SEQ ID NO: 50253 - DNA, 15 bp, Homo sapiens
aggaaaaaaatatac

SEQ ID NO: 50254 - DNA, 15 bp, Homo sapiens
ggaaaaaaatatact

SEQ ID NO: 50255 - DNA, 15 bp, Homo sapiens
gaaaaaaatatacta

SEQ ID NO: 50256 - DNA, 15 bp, Homo sapiens
aaaaaaatatactac

SEQ ID NO: 50257 - DNA, 15 bp, Homo sapiens
aaaaaatatactact

SEQ ID NO: 50258 - DNA, 15 bp, Homo sapiens
aaaaatatactactc

SEQ ID NO: 50259 - DNA, 15 bp, Homo sapiens
aaaatatactactct

SEQ ID NO: 50260 - DNA, 15 bp, Homo sapiens
aaatatactactctt

SEQ ID NO: 50261 - DNA, 15 bp, Homo sapiens
aatatactactcttg

SEQ ID NO: 50262 - DNA, 15 bp, Homo sapiens
atatactactcttgg

SEQ ID NO: 50263 - DNA, 15 bp, Homo sapiens
tatactactcttgga

SEQ ID NO: 50264 - DNA, 15 bp, Homo sapiens
atactactcttggac

SEQ ID NO: 50265 - DNA, 15 bp, Homo sapiens
tactactcttggaca

SEQ ID NO: 50266 - DNA, 15 bp, Homo sapiens
actactcttggacag

SEQ ID NO: 50267 - DNA, 15 bp, Homo sapiens
ctactcttggacagt

SEQ ID NO: 50268 - DNA, 15 bp, Homo sapiens
tactcttggacagta

SEQ ID NO: 50269 - DNA, 15 bp, Homo sapiens
actcttggacagtat

SEQ ID NO: 50270 - DNA, 15 bp, Homo sapiens
ctcttggacagtata

SEQ ID NO: 50271 - DNA, 15 bp, Homo sapiens
tcttggacagtataa

SEQ ID NO: 50272 - DNA, 15 bp, Homo sapiens
cttggacagtataaa

SEQ ID NO: 50273 - DNA, 15 bp, Homo sapiens
ttggacagtataaaa

SEQ ID NO: 50274 - DNA, 15 bp, Homo sapiens
tggacagtataaaag

SEQ ID NO: 50275 - DNA, 15 bp, Homo sapiens
ggacagtataaaagt

SEQ ID NO: 50276 - DNA, 15 bp, Homo sapiens
gacagtataaaagta

SEQ ID NO: 50277 - DNA, 15 bp, Homo sapiens
acagtataaaagtac

SEQ ID NO: 50278 - DNA, 15 bp, Homo sapiens
cagtataaaagtacc

SEQ ID NO: 50279 - DNA, 15 bp, Homo sapiens
agtataaaagtaccc

SEQ ID NO: 50280 - DNA, 15 bp, Homo sapiens
gtataaaagtacccc

SEQ ID NO: 50281 - DNA, 15 bp, Homo sapiens
tataaaagtacccca

SEQ ID NO: 50282 - DNA, 15 bp, Homo sapiens
ataaaagtaccccaa

SEQ ID NO: 50283 - DNA, 15 bp, Homo sapiens
taaaagtaccccaaa

SEQ ID NO: 50284 - DNA, 15 bp, Homo sapiens
aaaagtaccccaaag

SEQ ID NO: 50285 - DNA, 15 bp, Homo sapiens
aaagtaccccaaaga

SEQ ID NO: 50286 - DNA, 15 bp, Homo sapiens
aagtaccccaaagac

SEQ ID NO: 50287 - DNA, 15 bp, Homo sapiens
agtaccccaaagact

SEQ ID NO: 50288 - DNA, 15 bp, Homo sapiens
gtaccccaaagacta

SEQ ID NO: 50289 - DNA, 15 bp, Homo sapiens
taccccaaagactaa

SEQ ID NO: 50290 - DNA, 15 bp, Homo sapiens
accccaaagactaaa

SEQ ID NO: 50291 - DNA, 15 bp, Homo sapiens
ccccaaagactaaag

SEQ ID NO: 50292 - DNA, 15 bp, Homo sapiens
cccaaagactaaaga

SEQ ID NO: 50293 - DNA, 15 bp, Homo sapiens
ccaaagactaaagac

SEQ ID NO: 50294 - DNA, 15 bp, Homo sapiens
caaagactaaagaca

SEQ ID NO: 50295 - DNA, 15 bp, Homo sapiens
aaagactaaagacat

SEQ ID NO: 50296 - DNA, 15 bp, Homo sapiens
aagactaaagacata

SEQ ID NO: 50297 - DNA, 15 bp, Homo sapiens
agactaaagacataa

SEQ ID NO: 50298 - DNA, 15 bp, Homo sapiens
gactaaagacataac

SEQ ID NO: 50299 - DNA, 15 bp, Homo sapiens
actaaagacataact

SEQ ID NO: 50300 - DNA, 15 bp, Homo sapiens
ctaaagacataactg

SEQ ID NO: 50301 - DNA, 15 bp, Homo sapiens
taaagacataactgt

SEQ ID NO: 50302 - DNA, 15 bp, Homo sapiens
aaagacataactgtg

SEQ ID NO: 50303 - DNA, 15 bp, Homo sapiens
aagacataactgtgc

SEQ ID NO: 50304 - DNA, 15 bp, Homo sapiens
agacataactgtgcc

SEQ ID NO: 50305 - DNA, 15 bp, Homo sapiens
gacataactgtgcca

SEQ ID NO: 50306 - DNA, 15 bp, Homo sapiens
acataactgtgccaa

SEQ ID NO: 50307 - DNA, 15 bp, Homo sapiens
cataactgtgccaaa

SEQ ID NO: 50308 - DNA, 15 bp, Homo sapiens
ataactgtgccaaac

SEQ ID NO: 50309 - DNA, 15 bp, Homo sapiens
taactgtgccaaact

SEQ ID NO: 50310 - DNA, 15 bp, Homo sapiens
aactgtgccaaactg

SEQ ID NO: 50311 - DNA, 15 bp, Homo sapiens
actgtgccaaactgt

SEQ ID NO: 50312 - DNA, 15 bp, Homo sapiens
ctgtgccaaactgtg

SEQ ID NO: 50313 - DNA, 15 bp, Homo sapiens
tgtgccaaactgtgc

SEQ ID NO: 50314 - DNA, 15 bp, Homo sapiens
gtgccaaactgtgcc

SEQ ID NO: 50315 - DNA, 15 bp, Homo sapiens
tgccaaactgtgcca

SEQ ID NO: 50316 - DNA, 15 bp, Homo sapiens
gccaaactgtgccat

SEQ ID NO: 50317 - DNA, 15 bp, Homo sapiens
ccaaactgtgccata

SEQ ID NO: 50318 - DNA, 15 bp, Homo sapiens
caaactgtgccatat

SEQ ID NO: 50319 - DNA, 15 bp, Homo sapiens
aaactgtgccatata

SEQ ID NO: 50320 - DNA, 15 bp, Homo sapiens
aactgtgccatataa

SEQ ID NO: 50321 - DNA, 15 bp, Homo sapiens
actgtgccatataat

SEQ ID NO: 50322 - DNA, 15 bp, Homo sapiens
ctgtgccatataata

SEQ ID NO: 50323 - DNA, 15 bp, Homo sapiens
tgtgccatataataa

SEQ ID NO: 50324 - DNA, 15 bp, Homo sapiens
gtgccatataataaa

SEQ ID NO: 50325 - DNA, 15 bp, Homo sapiens
tgccatataataaaa

SEQ ID NO: 50326 - DNA, 15 bp, Homo sapiens
gccatataataaaaa

SEQ ID NO: 50327 - DNA, 15 bp, Homo sapiens
ccatataataaaaaa

SEQ ID NO: 50328 - DNA, 15 bp, Homo sapiens
catataataaaaaaa

SEQ ID NO: 50329 - DNA, 15 bp, Homo sapiens
atataataaaaaaaa

SEQ ID NO: 50330 - DNA, 15 bp, Homo sapiens
tataataaaaaaaag

SEQ ID NO: 50331 - DNA, 15 bp, Homo sapiens
ataataaaaaaaagt

SEQ ID NO: 50332 - DNA, 15 bp, Homo sapiens
taataaaaaaaagtc

SEQ ID NO: 50333 - DNA, 15 bp, Homo sapiens
aataaaaaaaagtca

SEQ ID NO: 50334 - DNA, 15 bp, Homo sapiens
ataaaaaaaagtcac

SEQ ID NO: 50335 - DNA, 15 bp, Homo sapiens
taaaaaaaagtcact

SEQ ID NO: 50336 - DNA, 15 bp, Homo sapiens
aaaaaaaagtcactt

SEQ ID NO: 50337 - DNA, 15 bp, Homo sapiens
aaaaaaagtcacttc

SEQ ID NO: 50338 - DNA, 15 bp, Homo sapiens
aaaaaagtcacttcc

SEQ ID NO: 50339 - DNA, 15 bp, Homo sapiens
aaaaagtcacttccc

SEQ ID NO: 50340 - DNA, 15 bp, Homo sapiens
aaaagtcacttccct

SEQ ID NO: 50341 - DNA, 15 bp, Homo sapiens
aaagtcacttccctg

SEQ ID NO: 50342 - DNA, 15 bp, Homo sapiens
aagtcacttccctga

SEQ ID NO: 50343 - DNA, 15 bp, Homo sapiens
agtcacttccctgag

SEQ ID NO: 50344 - DNA, 15 bp, Homo sapiens
gtcacttccctgagc

SEQ ID NO: 50345 - DNA, 15 bp, Homo sapiens
tcacttccctgagcc

SEQ ID NO: 50346 - DNA, 15 bp, Homo sapiens
cacttccctgagccc

SEQ ID NO: 50347 - DNA, 15 bp, Homo sapiens
acttccctgagccct

SEQ ID NO: 50348 - DNA, 15 bp, Homo sapiens
cttccctgagccctg

SEQ ID NO: 50349 - DNA, 15 bp, Homo sapiens
ttccctgagccctga

SEQ ID NO: 50350 - DNA, 15 bp, Homo sapiens
tccctgagccctgaa

SEQ ID NO: 50351 - DNA, 15 bp, Homo sapiens
ccctgagccctgaaa

SEQ ID NO: 50352 - DNA, 15 bp, Homo sapiens
cctgagccctgaaag

SEQ ID NO: 50353 - DNA, 15 bp, Homo sapiens
ctgagccctgaaagg

SEQ ID NO: 50354 - DNA, 15 bp, Homo sapiens
tgagccctgaaaggt

SEQ ID NO: 50355 - DNA, 15 bp, Homo sapiens
gagccctgaaaggtc

SEQ ID NO: 50356 - DNA, 15 bp, Homo sapiens
agccctgaaaggtca

SEQ ID NO: 50357 - DNA, 15 bp, Homo sapiens
gccctgaaaggtcag

SEQ ID NO: 50358 - DNA, 15 bp, Homo sapiens
ccctgaaaggtcagt

SEQ ID NO: 50359 - DNA, 15 bp, Homo sapiens
cctgaaaggtcagtg

SEQ ID NO: 50360 - DNA, 15 bp, Homo sapiens
ctgaaaggtcagtgt

SEQ ID NO: 50361 - DNA, 15 bp, Homo sapiens
tgaaaggtcagtgtg

SEQ ID NO: 50362 - DNA, 15 bp, Homo sapiens
gaaaggtcagtgtgt

SEQ ID NO: 50363 - DNA, 15 bp, Homo sapiens
aaaggtcagtgtgtg

SEQ ID NO: 50364 - DNA, 15 bp, Homo sapiens
aaggtcagtgtgtgt

SEQ ID NO: 50365 - DNA, 15 bp, Homo sapiens
aggtcagtgtgtgta

SEQ ID NO: 50366 - DNA, 15 bp, Homo sapiens
ggtcagtgtgtgtag

SEQ ID NO: 50367 - DNA, 15 bp, Homo sapiens
gtcagtgtgtgtagg

SEQ ID NO: 50368 - DNA, 15 bp, Homo sapiens
tcagtgtgtgtaggg

SEQ ID NO: 50369 - DNA, 15 bp, Homo sapiens
cagtgtgtgtagggt

SEQ ID NO: 50370 - DNA, 15 bp, Homo sapiens
agtgtgtgtagggtt

SEQ ID NO: 50371 - DNA, 15 bp, Homo sapiens
gtgtgtgtagggtta

SEQ ID NO: 50372 - DNA, 15 bp, Homo sapiens
tgtgtgtagggttac

SEQ ID NO: 50373 - DNA, 15 bp, Homo sapiens
gtgtgtagggttact

SEQ ID NO: 50374 - DNA, 15 bp, Homo sapiens
tgtgtagggttactt

SEQ ID NO: 50375 - DNA, 15 bp, Homo sapiens
gtgtagggttacttg

SEQ ID NO: 50376 - DNA, 15 bp, Homo sapiens
tgtagggttacttgg

SEQ ID NO: 50377 - DNA, 15 bp, Homo sapiens
gtagggttacttggt

SEQ ID NO: 50378 - DNA, 15 bp, Homo sapiens
tagggttacttggtc

SEQ ID NO: 50379 - DNA, 15 bp, Homo sapiens
agggttacttggtcg

SEQ ID NO: 50380 - DNA, 15 bp, Homo sapiens
gggttacttggtcgc

SEQ ID NO: 50381 - DNA, 15 bp, Homo sapiens
ggttacttggtcgcc

SEQ ID NO: 50382 - DNA, 15 bp, Homo sapiens
gttacttggtcgcca

SEQ ID NO: 50383 - DNA, 15 bp, Homo sapiens
ttacttggtcgccac

SEQ ID NO: 50384 - DNA, 15 bp, Homo sapiens
tacttggtcgccaca

SEQ ID NO: 50385 - DNA, 15 bp, Homo sapiens
acttggtcgccacag

SEQ ID NO: 50386 - DNA, 15 bp, Homo sapiens
cttggtcgccacagc

SEQ ID NO: 50387 - DNA, 15 bp, Homo sapiens
ttggtcgccacagcg

SEQ ID NO: 50388 - DNA, 15 bp, Homo sapiens
tggtcgccacagcgt

SEQ ID NO: 50389 - DNA, 15 bp, Homo sapiens
ggtcgccacagcgtg

SEQ ID NO: 50390 - DNA, 15 bp, Homo sapiens
gtcgccacagcgtga

SEQ ID NO: 50391 - DNA, 15 bp, Homo sapiens
tcgccacagcgtgat

SEQ ID NO: 50392 - DNA, 15 bp, Homo sapiens
cgccacagcgtgatc

SEQ ID NO: 50393 - DNA, 15 bp, Homo sapiens
gccacagcgtgatct

SEQ ID NO: 50394 - DNA, 15 bp, Homo sapiens
ccacagcgtgatctg

SEQ ID NO: 50395 - DNA, 15 bp, Homo sapiens
cacagcgtgatctgg

SEQ ID NO: 50396 - DNA, 15 bp, Homo sapiens
acagcgtgatctggg

SEQ ID NO: 50397 - DNA, 15 bp, Homo sapiens
cagcgtgatctgggg

SEQ ID NO: 50398 - DNA, 15 bp, Homo sapiens
agcgtgatctggggg

SEQ ID NO: 50399 - DNA, 15 bp, Homo sapiens
gcgtgatctgggggc

SEQ ID NO: 50400 - DNA, 15 bp, Homo sapiens
cgtgatctgggggcg

SEQ ID NO: 50401 - DNA, 15 bp, Homo sapiens
gtgatctgggggcgg

SEQ ID NO: 50402 - DNA, 15 bp, Homo sapiens
tgatctgggggcggg

SEQ ID NO: 50403 - DNA, 15 bp, Homo sapiens
gatctgggggcgggc

SEQ ID NO: 50404 - DNA, 15 bp, Homo sapiens
atctgggggcgggcg

SEQ ID NO: 50405 - DNA, 15 bp, Homo sapiens
tctgggggcgggcgt

SEQ ID NO: 50406 - DNA, 15 bp, Homo sapiens
ctgggggcgggcgtc

SEQ ID NO: 50407 - DNA, 15 bp, Homo sapiens
tgggggcgggcgtca

SEQ ID NO: 50408 - DNA, 15 bp, Homo sapiens
gggggcgggcgtcag

SEQ ID NO: 50409 - DNA, 15 bp, Homo sapiens
ggggcgggcgtcaga

SEQ ID NO: 50410 - DNA, 15 bp, Homo sapiens
gggcgggcgtcagat

SEQ ID NO: 50411 - DNA, 15 bp, Homo sapiens
ggcgggcgtcagatt

SEQ ID NO: 50412 - DNA, 15 bp, Homo sapiens
gcgggcgtcagatta

SEQ ID NO: 50413 - DNA, 15 bp, Homo sapiens
cgggcgtcagattag

SEQ ID NO: 50414 - DNA, 15 bp, Homo sapiens
gggcgtcagattaga

SEQ ID NO: 50415 - DNA, 15 bp, Homo sapiens
ggcgtcagattagag

SEQ ID NO: 50416 - DNA, 15 bp, Homo sapiens
gcgtcagattagagc

SEQ ID NO: 50417 - DNA, 15 bp, Homo sapiens
cgtcagattagagcc

SEQ ID NO: 50418 - DNA, 15 bp, Homo sapiens
gtcagattagagccg

SEQ ID NO: 50419 - DNA, 15 bp, Homo sapiens
tcagattagagccgg

SEQ ID NO: 50420 - DNA, 15 bp, Homo sapiens
cagattagagccgga

SEQ ID NO: 50421 - DNA, 15 bp, Homo sapiens
agattagagccggaa

SEQ ID NO: 50422 - DNA, 15 bp, Homo sapiens
gattagagccggaac

SEQ ID NO: 50423 - DNA, 15 bp, Homo sapiens
attagagccggaact

SEQ ID NO: 50424 - DNA, 15 bp, Homo sapiens
ttagagccggaactg

SEQ ID NO: 50425 - DNA, 15 bp, Homo sapiens
tagagccggaactgg

SEQ ID NO: 50426 - DNA, 15 bp, Homo sapiens
agagccggaactggt

SEQ ID NO: 50427 - DNA, 15 bp, Homo sapiens
gagccggaactggtg

SEQ ID NO: 50428 - DNA, 15 bp, Homo sapiens
agccggaactggtga

SEQ ID NO: 50429 - DNA, 15 bp, Homo sapiens
gccggaactggtgat

SEQ ID NO: 50430 - DNA, 15 bp, Homo sapiens
ccggaactggtgatc

SEQ ID NO: 50431 - DNA, 15 bp, Homo sapiens
cggaactggtgatct

SEQ ID NO: 50432 - DNA, 15 bp, Homo sapiens
ggaactggtgatctg

SEQ ID NO: 50433 - DNA, 15 bp, Homo sapiens
gaactggtgatctgc

SEQ ID NO: 50434 - DNA, 15 bp, Homo sapiens
aactggtgatctgca

SEQ ID NO: 50435 - DNA, 15 bp, Homo sapiens
actggtgatctgcaa

SEQ ID NO: 50436 - DNA, 15 bp, Homo sapiens
ctggtgatctgcaac

SEQ ID NO: 50437 - DNA, 15 bp, Homo sapiens
tggtgatctgcaact

SEQ ID NO: 50438 - DNA, 15 bp, Homo sapiens
ggtgatctgcaactt

SEQ ID NO: 50439 - DNA, 15 bp, Homo sapiens
gtgatctgcaacttc

SEQ ID NO: 50440 - DNA, 15 bp, Homo sapiens
tgatctgcaacttca

SEQ ID NO: 50441 - DNA, 15 bp, Homo sapiens
gatctgcaacttcag

SEQ ID NO: 50442 - DNA, 15 bp, Homo sapiens
atctgcaacttcagt

SEQ ID NO: 50443 - DNA, 15 bp, Homo sapiens
tctgcaacttcagtt

SEQ ID NO: 50444 - DNA, 15 bp, Homo sapiens
ctgcaacttcagttc

SEQ ID NO: 50445 - DNA, 15 bp, Homo sapiens
tgcaacttcagttca

SEQ ID NO: 50446 - DNA, 15 bp, Homo sapiens
gcaacttcagttcac

SEQ ID NO: 50447 - DNA, 15 bp, Homo sapiens
caacttcagttcacc

SEQ ID NO: 50448 - DNA, 15 bp, Homo sapiens
aacttcagttcacct

SEQ ID NO: 50449 - DNA, 15 bp, Homo sapiens
acttcagttcacctt

SEQ ID NO: 50450 - DNA, 15 bp, Homo sapiens
cttcagttcaccttg

SEQ ID NO: 50451 - DNA, 15 bp, Homo sapiens
ttcagttcaccttga

SEQ ID NO: 50452 - DNA, 15 bp, Homo sapiens
tcagttcaccttgaa

SEQ ID NO: 50453 - DNA, 15 bp, Homo sapiens
cagttcaccttgaag

SEQ ID NO: 50454 - DNA, 15 bp, Homo sapiens
agttcaccttgaagc

SEQ ID NO: 50455 - DNA, 15 bp, Homo sapiens
gttcaccttgaagca

SEQ ID NO: 50456 - DNA, 15 bp, Homo sapiens
ttcaccttgaagcag

SEQ ID NO: 50457 - DNA, 15 bp, Homo sapiens
tcaccttgaagcagg

SEQ ID NO: 50458 - DNA, 15 bp, Homo sapiens
caccttgaagcaggt

SEQ ID NO: 50459 - DNA, 15 bp, Homo sapiens
accttgaagcaggtc

SEQ ID NO: 50460 - DNA, 15 bp, Homo sapiens
ccttgaagcaggtca

SEQ ID NO: 50461 - DNA, 15 bp, Homo sapiens
cttgaagcaggtcag

SEQ ID NO: 50462 - DNA, 15 bp, Homo sapiens
ttgaagcaggtcagc

SEQ ID NO: 50463 - DNA, 15 bp, Homo sapiens
tgaagcaggtcagct

SEQ ID NO: 50464 - DNA, 15 bp, Homo sapiens
gaagcaggtcagctg

SEQ ID NO: 50465 - DNA, 15 bp, Homo sapiens
aagcaggtcagctga

SEQ ID NO: 50466 - DNA, 15 bp, Homo sapiens
agcaggtcagctgag

SEQ ID NO: 50467 - DNA, 15 bp, Homo sapiens
gcaggtcagctgagc

SEQ ID NO: 50468 - DNA, 15 bp, Homo sapiens
caggtcagctgagct

SEQ ID NO: 50469 - DNA, 15 bp, Homo sapiens
aggtcagctgagctg

SEQ ID NO: 50470 - DNA, 15 bp, Homo sapiens
ggtcagctgagctga

SEQ ID NO: 50471 - DNA, 15 bp, Homo sapiens
gtcagctgagctgag

SEQ ID NO: 50472 - DNA, 15 bp, Homo sapiens
tcagctgagctgaga

SEQ ID NO: 50473 - DNA, 15 bp, Homo sapiens
cagctgagctgagag

SEQ ID NO: 50474 - DNA, 15 bp, Homo sapiens
agctgagctgagagc

SEQ ID NO: 50475 - DNA, 15 bp, Homo sapiens
gctgagctgagagcg

SEQ ID NO: 50476 - DNA, 15 bp, Homo sapiens
ctgagctgagagcgc

SEQ ID NO: 50477 - DNA, 15 bp, Homo sapiens
tgagctgagagcgct

SEQ ID NO: 50478 - DNA, 15 bp, Homo sapiens
gagctgagagcgctt

SEQ ID NO: 50479 - DNA, 15 bp, Homo sapiens
agctgagagcgcttg

SEQ ID NO: 50480 - DNA, 15 bp, Homo sapiens
gctgagagcgcttgc

SEQ ID NO: 50481 - DNA, 15 bp, Homo sapiens
ctgagagcgcttgca

SEQ ID NO: 50482 - DNA, 15 bp, Homo sapiens
tgagagcgcttgcac

SEQ ID NO: 50483 - DNA, 15 bp, Homo sapiens
gagagcgcttgcact

SEQ ID NO: 50484 - DNA, 15 bp, Homo sapiens
agagcgcttgcactg

SEQ ID NO: 50485 - DNA, 15 bp, Homo sapiens
gagcgcttgcactga

SEQ ID NO: 50486 - DNA, 15 bp, Homo sapiens
agcgcttgcactgag

SEQ ID NO: 50487 - DNA, 15 bp, Homo sapiens
gcgcttgcactgagc

SEQ ID NO: 50488 - DNA, 15 bp, Homo sapiens
cgcttgcactgagcc

SEQ ID NO: 50489 - DNA, 15 bp, Homo sapiens
gcttgcactgagccc

SEQ ID NO: 50490 - DNA, 15 bp, Homo sapiens
cttgcactgagccct

SEQ ID NO: 50491 - DNA, 15 bp, Homo sapiens
ttgcactgagccctt

SEQ ID NO: 50492 - DNA, 15 bp, Homo sapiens
tgcactgagcccttt

SEQ ID NO: 50493 - DNA, 15 bp, Homo sapiens
gcactgagccctttt

SEQ ID NO: 50494 - DNA, 15 bp, Homo sapiens
cactgagcccttttg

SEQ ID NO: 50495 - DNA, 15 bp, Homo sapiens
actgagcccttttgc

SEQ ID NO: 50496 - DNA, 15 bp, Homo sapiens
ctgagcccttttgcg

SEQ ID NO: 50497 - DNA, 15 bp, Homo sapiens
tgagcccttttgcgc

SEQ ID NO: 50498 - DNA, 15 bp, Homo sapiens
gagcccttttgcgct

SEQ ID NO: 50499 - DNA, 15 bp, Homo sapiens
agcccttttgcgctg

SEQ ID NO: 50500 - DNA, 15 bp, Homo sapiens
gcccttttgcgctgc

SEQ ID NO: 50501 - DNA, 15 bp, Homo sapiens
cccttttgcgctgct

SEQ ID NO: 50502 - DNA, 15 bp, Homo sapiens
ccttttgcgctgctg

SEQ ID NO: 50503 - DNA, 15 bp, Homo sapiens
cttttgcgctgctgc

SEQ ID NO: 50504 - DNA, 15 bp, Homo sapiens
ttttgcgctgctgct

SEQ ID NO: 50505 - DNA, 15 bp, Homo sapiens
tttgcgctgctgctg

SEQ ID NO: 50506 - DNA, 15 bp, Homo sapiens
ttgcgctgctgctgt

SEQ ID NO: 50507 - DNA, 15 bp, Homo sapiens
tgcgctgctgctgtt

SEQ ID NO: 50508 - DNA, 15 bp, Homo sapiens
gcgctgctgctgttg

SEQ ID NO: 50509 - DNA, 15 bp, Homo sapiens
cgctgctgctgttgc

SEQ ID NO: 50510 - DNA, 15 bp, Homo sapiens
gctgctgctgttgcc

SEQ ID NO: 50511 - DNA, 15 bp, Homo sapiens
ctgctgctgttgcct

SEQ ID NO: 50512 - DNA, 15 bp, Homo sapiens
tgctgctgttgcctt

SEQ ID NO: 50513 - DNA, 15 bp, Homo sapiens
gctgctgttgcctta

SEQ ID NO: 50514 - DNA, 15 bp, Homo sapiens
ctgctgttgccttag

SEQ ID NO: 50515 - DNA, 15 bp, Homo sapiens
tgctgttgccttagc

SEQ ID NO: 50516 - DNA, 15 bp, Homo sapiens
gctgttgccttagcg

SEQ ID NO: 50517 - DNA, 15 bp, Homo sapiens
ctgttgccttagcgg

SEQ ID NO: 50518 - DNA, 15 bp, Homo sapiens
tgttgccttagcggt

SEQ ID NO: 50519 - DNA, 15 bp, Homo sapiens
gttgccttagcggtc

SEQ ID NO: 50520 - DNA, 15 bp, Homo sapiens
ttgccttagcggtct

SEQ ID NO: 50521 - DNA, 15 bp, Homo sapiens
tgccttagcggtctt

SEQ ID NO: 50522 - DNA, 15 bp, Homo sapiens
gccttagcggtcttc

SEQ ID NO: 50523 - DNA, 15 bp, Homo sapiens
ccttagcggtcttca

SEQ ID NO: 50524 - DNA, 15 bp, Homo sapiens
cttagcggtcttcag

SEQ ID NO: 50525 - DNA, 15 bp, Homo sapiens
ttagcggtcttcagc

SEQ ID NO: 50526 - DNA, 15 bp, Homo sapiens
tagcggtcttcagca

SEQ ID NO: 50527 - DNA, 15 bp, Homo sapiens
agcggtcttcagcat

SEQ ID NO: 50528 - DNA, 15 bp, Homo sapiens
gcggtcttcagcatg

SEQ ID NO: 50529 - DNA, 15 bp, Homo sapiens
cggtcttcagcatgt

SEQ ID NO: 50530 - DNA, 15 bp, Homo sapiens
ggtcttcagcatgtg

SEQ ID NO: 50531 - DNA, 15 bp, Homo sapiens
gtcttcagcatgtgt

SEQ ID NO: 50532 - DNA, 15 bp, Homo sapiens
tcttcagcatgtgtt

SEQ ID NO: 50533 - DNA, 15 bp, Homo sapiens
cttcagcatgtgttt

SEQ ID NO: 50534 - DNA, 15 bp, Homo sapiens
ttcagcatgtgtttg

SEQ ID NO: 50535 - DNA, 15 bp, Homo sapiens
tcagcatgtgtttgc

SEQ ID NO: 50536 - DNA, 15 bp, Homo sapiens
cagcatgtgtttgct

SEQ ID NO: 50537 - DNA, 15 bp, Homo sapiens
agcatgtgtttgctt

SEQ ID NO: 50538 - DNA, 15 bp, Homo sapiens
gcatgtgtttgcttt

SEQ ID NO: 50539 - DNA, 15 bp, Homo sapiens
catgtgtttgctttg

SEQ ID NO: 50540 - DNA, 15 bp, Homo sapiens
atgtgtttgctttgg

SEQ ID NO: 50541 - DNA, 15 bp, Homo sapiens
tgtgtttgctttggt

SEQ ID NO: 50542 - DNA, 15 bp, Homo sapiens
gtgtttgctttggtt

SEQ ID NO: 50543 - DNA, 15 bp, Homo sapiens
tgtttgctttggttt

SEQ ID NO: 50544 - DNA, 15 bp, Homo sapiens
gtttgctttggtttg

SEQ ID NO: 50545 - DNA, 15 bp, Homo sapiens
tttgctttggtttgg

SEQ ID NO: 50546 - DNA, 15 bp, Homo sapiens
ttgctttggtttggg

SEQ ID NO: 50547 - DNA, 15 bp, Homo sapiens
tgctttggtttgggg

SEQ ID NO: 50548 - DNA, 15 bp, Homo sapiens
gctttggtttggggt

SEQ ID NO: 50549 - DNA, 15 bp, Homo sapiens
ctttggtttggggta

SEQ ID NO: 50550 - DNA, 15 bp, Homo sapiens
tttggtttggggtaa

SEQ ID NO: 50551 - DNA, 15 bp, Homo sapiens
ttggtttggggtaaa

SEQ ID NO: 50552 - DNA, 15 bp, Homo sapiens
tggtttggggtaaat

SEQ ID NO: 50553 - DNA, 15 bp, Homo sapiens
ggtttggggtaaatg

SEQ ID NO: 50554 - DNA, 15 bp, Homo sapiens
gtttggggtaaatgg

SEQ ID NO: 50555 - DNA, 15 bp, Homo sapiens
tttggggtaaatggc

SEQ ID NO: 50556 - DNA, 15 bp, Homo sapiens
ttggggtaaatggct

SEQ ID NO: 50557 - DNA, 15 bp, Homo sapiens
tggggtaaatggctt

SEQ ID NO: 50558 - DNA, 15 bp, Homo sapiens
ggggtaaatggctta

SEQ ID NO: 50559 - DNA, 15 bp, Homo sapiens
gggtaaatggcttag

SEQ ID NO: 50560 - DNA, 15 bp, Homo sapiens
ggtaaatggcttagt

SEQ ID NO: 50561 - DNA, 15 bp, Homo sapiens
gtaaatggcttagtg

SEQ ID NO: 50562 - DNA, 15 bp, Homo sapiens
taaatggcttagtgg

SEQ ID NO: 50563 - DNA, 15 bp, Homo sapiens
aaatggcttagtggt

SEQ ID NO: 50564 - DNA, 15 bp, Homo sapiens
aatggcttagtggtc

SEQ ID NO: 50565 - DNA, 15 bp, Homo sapiens
atggcttagtggtca

SEQ ID NO: 50566 - DNA, 15 bp, Homo sapiens
tggcttagtggtcaa

SEQ ID NO: 50567 - DNA, 15 bp, Homo sapiens
ggcttagtggtcaac

SEQ ID NO: 50568 - DNA, 15 bp, Homo sapiens
gcttagtggtcaaca

SEQ ID NO: 50569 - DNA, 15 bp, Homo sapiens
cttagtggtcaacat

SEQ ID NO: 50570 - DNA, 15 bp, Homo sapiens
ttagtggtcaacatt

SEQ ID NO: 50571 - DNA, 15 bp, Homo sapiens
tagtggtcaacatta

SEQ ID NO: 50572 - DNA, 15 bp, Homo sapiens
agtggtcaacattag

SEQ ID NO: 50573 - DNA, 15 bp, Homo sapiens
gtggtcaacattagt

SEQ ID NO: 50574 - DNA, 15 bp, Homo sapiens
tggtcaacattagtg

SEQ ID NO: 50575 - DNA, 15 bp, Homo sapiens
ggtcaacattagtga

SEQ ID NO: 50576 - DNA, 15 bp, Homo sapiens
gtcaacattagtgag

SEQ ID NO: 50577 - DNA, 15 bp, Homo sapiens
tcaacattagtgagc

SEQ ID NO: 50578 - DNA, 15 bp, Homo sapiens
caacattagtgagca

SEQ ID NO: 50579 - DNA, 15 bp, Homo sapiens
aacattagtgagcag

SEQ ID NO: 50580 - DNA, 15 bp, Homo sapiens
acattagtgagcagt

SEQ ID NO: 50581 - DNA, 15 bp, Homo sapiens
cattagtgagcagtg

SEQ ID NO: 50582 - DNA, 15 bp, Homo sapiens
attagtgagcagtgg

SEQ ID NO: 50583 - DNA, 15 bp, Homo sapiens
ttagtgagcagtggt

SEQ ID NO: 50584 - DNA, 15 bp, Homo sapiens
tagtgagcagtggta

SEQ ID NO: 50585 - DNA, 15 bp, Homo sapiens
agtgagcagtggtaa

SEQ ID NO: 50586 - DNA, 15 bp, Homo sapiens
gtgagcagtggtaat

SEQ ID NO: 50587 - DNA, 15 bp, Homo sapiens
tgagcagtggtaatg

SEQ ID NO: 50588 - DNA, 15 bp, Homo sapiens
gagcagtggtaatgc

SEQ ID NO: 50589 - DNA, 15 bp, Homo sapiens
agcagtggtaatgca

SEQ ID NO: 50590 - DNA, 15 bp, Homo sapiens
gcagtggtaatgcat

SEQ ID NO: 50591 - DNA, 15 bp, Homo sapiens
cagtggtaatgcatt

SEQ ID NO: 50592 - DNA, 15 bp, Homo sapiens
agtggtaatgcattt

SEQ ID NO: 50593 - DNA, 15 bp, Homo sapiens
gtggtaatgcatttt

SEQ ID NO: 50594 - DNA, 15 bp, Homo sapiens
tggtaatgcattttc

SEQ ID NO: 50595 - DNA, 15 bp, Homo sapiens
ggtaatgcattttca

SEQ ID NO: 50596 - DNA, 15 bp, Homo sapiens
gtaatgcattttcag

SEQ ID NO: 50597 - DNA, 15 bp, Homo sapiens
taatgcattttcaga

SEQ ID NO: 50598 - DNA, 15 bp, Homo sapiens
aatgcattttcagat

SEQ ID NO: 50599 - DNA, 15 bp, Homo sapiens
atgcattttcagata

SEQ ID NO: 50600 - DNA, 15 bp, Homo sapiens
tgcattttcagatat

SEQ ID NO: 50601 - DNA, 15 bp, Homo sapiens
gcattttcagatatg

SEQ ID NO: 50602 - DNA, 15 bp, Homo sapiens
cattttcagatatgg

SEQ ID NO: 50603 - DNA, 15 bp, Homo sapiens
attttcagatatggg

SEQ ID NO: 50604 - DNA, 15 bp, Homo sapiens
ttttcagatatggga

SEQ ID NO: 50605 - DNA, 15 bp, Homo sapiens
tttcagatatgggaa

SEQ ID NO: 50606 - DNA, 15 bp, Homo sapiens
ttcagatatgggaac

SEQ ID NO: 50607 - DNA, 15 bp, Homo sapiens
tcagatatgggaact

SEQ ID NO: 50608 - DNA, 15 bp, Homo sapiens
cagatatgggaactg

SEQ ID NO: 50609 - DNA, 15 bp, Homo sapiens
agatatgggaactgg

SEQ ID NO: 50610 - DNA, 15 bp, Homo sapiens
gatatgggaactggt

SEQ ID NO: 50611 - DNA, 15 bp, Homo sapiens
atatgggaactggta

SEQ ID NO: 50612 - DNA, 15 bp, Homo sapiens
tatgggaactggtat

SEQ ID NO: 50613 - DNA, 15 bp, Homo sapiens
atgggaactggtatg

SEQ ID NO: 50614 - DNA, 15 bp, Homo sapiens
tgggaactggtatgt

SEQ ID NO: 50615 - DNA, 15 bp, Homo sapiens
gggaactggtatgtg

SEQ ID NO: 50616 - DNA, 15 bp, Homo sapiens
ggaactggtatgtgg

SEQ ID NO: 50617 - DNA, 15 bp, Homo sapiens
gaactggtatgtggt

SEQ ID NO: 50618 - DNA, 15 bp, Homo sapiens
aactggtatgtggtt

SEQ ID NO: 50619 - DNA, 15 bp, Homo sapiens
actggtatgtggttg

SEQ ID NO: 50620 - DNA, 15 bp, Homo sapiens
ctggtatgtggttgg

SEQ ID NO: 50621 - DNA, 15 bp, Homo sapiens
tggtatgtggttggt

SEQ ID NO: 50622 - DNA, 15 bp, Homo sapiens
ggtatgtggttggtt

SEQ ID NO: 50623 - DNA, 15 bp, Homo sapiens
gtatgtggttggttc

SEQ ID NO: 50624 - DNA, 15 bp, Homo sapiens
tatgtggttggttcc

SEQ ID NO: 50625 - DNA, 15 bp, Homo sapiens
atgtggttggttccc

SEQ ID NO: 50626 - DNA, 15 bp, Homo sapiens
tgtggttggttccct

SEQ ID NO: 50627 - DNA, 15 bp, Homo sapiens
gtggttggttcccta

SEQ ID NO: 50628 - DNA, 15 bp, Homo sapiens
tggttggttccctag

SEQ ID NO: 50629 - DNA, 15 bp, Homo sapiens
ggttggttccctaga

SEQ ID NO: 50630 - DNA, 15 bp, Homo sapiens
gttggttccctagaa

SEQ ID NO: 50631 - DNA, 15 bp, Homo sapiens
ttggttccctagaag

SEQ ID NO: 50632 - DNA, 15 bp, Homo sapiens
tggttccctagaagg

SEQ ID NO: 50633 - DNA, 15 bp, Homo sapiens
ggttccctagaagga

SEQ ID NO: 50634 - DNA, 15 bp, Homo sapiens
gttccctagaaggac

SEQ ID NO: 50635 - DNA, 15 bp, Homo sapiens
ttccctagaaggaca

SEQ ID NO: 50636 - DNA, 15 bp, Homo sapiens
tccctagaaggacac

SEQ ID NO: 50637 - DNA, 15 bp, Homo sapiens
ccctagaaggacacc

SEQ ID NO: 50638 - DNA, 15 bp, Homo sapiens
cctagaaggacaccc

SEQ ID NO: 50639 - DNA, 15 bp, Homo sapiens
ctagaaggacaccct

SEQ ID NO: 50640 - DNA, 15 bp, Homo sapiens
tagaaggacaccctc

SEQ ID NO: 50641 - DNA, 15 bp, Homo sapiens
agaaggacaccctcc

SEQ ID NO: 50642 - DNA, 15 bp, Homo sapiens
gaaggacaccctcct

SEQ ID NO: 50643 - DNA, 15 bp, Homo sapiens
aaggacaccctcctg

SEQ ID NO: 50644 - DNA, 15 bp, Homo sapiens
aggacaccctcctga

SEQ ID NO: 50645 - DNA, 15 bp, Homo sapiens
ggacaccctcctgaa

SEQ ID NO: 50646 - DNA, 15 bp, Homo sapiens
gacaccctcctgaaa

SEQ ID NO: 50647 - DNA, 15 bp, Homo sapiens
acaccctcctgaaag

SEQ ID NO: 50648 - DNA, 15 bp, Homo sapiens
caccctcctgaaagc

SEQ ID NO: 50649 - DNA, 15 bp, Homo sapiens
accctcctgaaagct

SEQ ID NO: 50650 - DNA, 15 bp, Homo sapiens
ccctcctgaaagctg

SEQ ID NO: 50651 - DNA, 15 bp, Homo sapiens
cctcctgaaagctgt

SEQ ID NO: 50652 - DNA, 15 bp, Homo sapiens
ctcctgaaagctgtc

SEQ ID NO: 50653 - DNA, 15 bp, Homo sapiens
tcctgaaagctgtct

SEQ ID NO: 50654 - DNA, 15 bp, Homo sapiens
cctgaaagctgtctc

SEQ ID NO: 50655 - DNA, 15 bp, Homo sapiens
ctgaaagctgtctca

SEQ ID NO: 50656 - DNA, 15 bp, Homo sapiens
tgaaagctgtctcag

SEQ ID NO: 50657 - DNA, 15 bp, Homo sapiens
gaaagctgtctcaga

SEQ ID NO: 50658 - DNA, 15 bp, Homo sapiens
aaagctgtctcagaa

SEQ ID NO: 50659 - DNA, 15 bp, Homo sapiens
aagctgtctcagaac

SEQ ID NO: 50660 - DNA, 15 bp, Homo sapiens
agctgtctcagaaca

SEQ ID NO: 50661 - DNA, 15 bp, Homo sapiens
gctgtctcagaacac

SEQ ID NO: 50662 - DNA, 15 bp, Homo sapiens
ctgtctcagaacacc

SEQ ID NO: 50663 - DNA, 15 bp, Homo sapiens
tgtctcagaacaccg

SEQ ID NO: 50664 - DNA, 15 bp, Homo sapiens
gtctcagaacaccgg

SEQ ID NO: 50665 - DNA, 15 bp, Homo sapiens
tctcagaacaccggg

SEQ ID NO: 50666 - DNA, 15 bp, Homo sapiens
ctcagaacaccgggg

SEQ ID NO: 50667 - DNA, 15 bp, Homo sapiens
tcagaacaccggggg

SEQ ID NO: 50668 - DNA, 15 bp, Homo sapiens
cagaacaccgggggc

SEQ ID NO: 50669 - DNA, 15 bp, Homo sapiens
agaacaccgggggcc

SEQ ID NO: 50670 - DNA, 15 bp, Homo sapiens
gaacaccgggggcca

SEQ ID NO: 50671 - DNA, 15 bp, Homo sapiens
aacaccgggggccat

SEQ ID NO: 50672 - DNA, 15 bp, Homo sapiens
acaccgggggccatg

SEQ ID NO: 50673 - DNA, 15 bp, Homo sapiens
caccgggggccatgg

SEQ ID NO: 50674 - DNA, 15 bp, Homo sapiens
accgggggccatggc

SEQ ID NO: 50675 - DNA, 15 bp, Homo sapiens
ccgggggccatggct

SEQ ID NO: 50676 - DNA, 15 bp, Homo sapiens
cgggggccatggcta

SEQ ID NO: 50677 - DNA, 15 bp, Homo sapiens
gggggccatggctaa

SEQ ID NO: 50678 - DNA, 15 bp, Homo sapiens
ggggccatggctaat

SEQ ID NO: 50679 - DNA, 15 bp, Homo sapiens
gggccatggctaatg

SEQ ID NO: 50680 - DNA, 15 bp, Homo sapiens
ggccatggctaatgt

SEQ ID NO: 50681 - DNA, 15 bp, Homo sapiens
gccatggctaatgtc

SEQ ID NO: 50682 - DNA, 15 bp, Homo sapiens
ccatggctaatgtca

SEQ ID NO: 50683 - DNA, 15 bp, Homo sapiens
catggctaatgtcat

SEQ ID NO: 50684 - DNA, 15 bp, Homo sapiens
atggctaatgtcatg

SEQ ID NO: 50685 - DNA, 15 bp, Homo sapiens
tggctaatgtcatgt

SEQ ID NO: 50686 - DNA, 15 bp, Homo sapiens
ggctaatgtcatgtg

SEQ ID NO: 50687 - DNA, 15 bp, Homo sapiens
gctaatgtcatgtgc

SEQ ID NO: 50688 - DNA, 15 bp, Homo sapiens
ctaatgtcatgtgct

SEQ ID NO: 50689 - DNA, 15 bp, Homo sapiens
taatgtcatgtgctt

SEQ ID NO: 50690 - DNA, 15 bp, Homo sapiens
aatgtcatgtgcttg

SEQ ID NO: 50691 - DNA, 15 bp, Homo sapiens
atgtcatgtgcttgc

SEQ ID NO: 50692 - DNA, 15 bp, Homo sapiens
tgtcatgtgcttgct

SEQ ID NO: 50693 - DNA, 15 bp, Homo sapiens
gtcatgtgcttgcta

SEQ ID NO: 50694 - DNA, 15 bp, Homo sapiens
tcatgtgcttgctac

SEQ ID NO: 50695 - DNA, 15 bp, Homo sapiens
catgtgcttgctaca

SEQ ID NO: 50696 - DNA, 15 bp, Homo sapiens
atgtgcttgctacac

SEQ ID NO: 50697 - DNA, 15 bp, Homo sapiens
tgtgcttgctacact

SEQ ID NO: 50698 - DNA, 15 bp, Homo sapiens
gtgcttgctacactc

SEQ ID NO: 50699 - DNA, 15 bp, Homo sapiens
tgcttgctacactcc

SEQ ID NO: 50700 - DNA, 15 bp, Homo sapiens
gcttgctacactcct

SEQ ID NO: 50701 - DNA, 15 bp, Homo sapiens
cttgctacactcctc

SEQ ID NO: 50702 - DNA, 15 bp, Homo sapiens
ttgctacactcctcc

SEQ ID NO: 50703 - DNA, 15 bp, Homo sapiens
tgctacactcctccc

SEQ ID NO: 50704 - DNA, 15 bp, Homo sapiens
gctacactcctccca

SEQ ID NO: 50705 - DNA, 15 bp, Homo sapiens
ctacactcctcccat

SEQ ID NO: 50706 - DNA, 15 bp, Homo sapiens
tacactcctcccatg

SEQ ID NO: 50707 - DNA, 15 bp, Homo sapiens
acactcctcccatgg

SEQ ID NO: 50708 - DNA, 15 bp, Homo sapiens
cactcctcccatggt

SEQ ID NO: 50709 - DNA, 15 bp, Homo sapiens
actcctcccatggta

SEQ ID NO: 50710 - DNA, 15 bp, Homo sapiens
ctcctcccatggtaa

SEQ ID NO: 50711 - DNA, 15 bp, Homo sapiens
tcctcccatggtaac

SEQ ID NO: 50712 - DNA, 15 bp, Homo sapiens
cctcccatggtaact

SEQ ID NO: 50713 - DNA, 15 bp, Homo sapiens
ctcccatggtaacta

SEQ ID NO: 50714 - DNA, 15 bp, Homo sapiens
tcccatggtaactaa

SEQ ID NO: 50715 - DNA, 15 bp, Homo sapiens
cccatggtaactaaa

SEQ ID NO: 50716 - DNA, 15 bp, Homo sapiens
ccatggtaactaaag

SEQ ID NO: 50717 - DNA, 15 bp, Homo sapiens
catggtaactaaaga

SEQ ID NO: 50718 - DNA, 15 bp, Homo sapiens
atggtaactaaagag

SEQ ID NO: 50719 - DNA, 15 bp, Homo sapiens
tggtaactaaagaga

SEQ ID NO: 50720 - DNA, 15 bp, Homo sapiens
ggtaactaaagagag

SEQ ID NO: 50721 - DNA, 15 bp, Homo sapiens
gtaactaaagagagt

SEQ ID NO: 50722 - DNA, 15 bp, Homo sapiens
taactaaagagagta

SEQ ID NO: 50723 - DNA, 15 bp, Homo sapiens
aactaaagagagtac

SEQ ID NO: 50724 - DNA, 15 bp, Homo sapiens
actaaagagagtacc

SEQ ID NO: 50725 - DNA, 15 bp, Homo sapiens
ctaaagagagtaccc

SEQ ID NO: 50726 - DNA, 15 bp, Homo sapiens
taaagagagtaccca

SEQ ID NO: 50727 - DNA, 15 bp, Homo sapiens
aaagagagtacccag

SEQ ID NO: 50728 - DNA, 15 bp, Homo sapiens
aagagagtacccaga

SEQ ID NO: 50729 - DNA, 15 bp, Homo sapiens
agagagtacccagat

SEQ ID NO: 50730 - DNA, 15 bp, Homo sapiens
gagagtacccagata

SEQ ID NO: 50731 - DNA, 15 bp, Homo sapiens
agagtacccagatat

SEQ ID NO: 50732 - DNA, 15 bp, Homo sapiens
gagtacccagatata

SEQ ID NO: 50733 - DNA, 15 bp, Homo sapiens
agtacccagatatac

SEQ ID NO: 50734 - DNA, 15 bp, Homo sapiens
gtacccagatataca

SEQ ID NO: 50735 - DNA, 15 bp, Homo sapiens
tacccagatatacat

SEQ ID NO: 50736 - DNA, 15 bp, Homo sapiens
acccagatatacatc

SEQ ID NO: 50737 - DNA, 15 bp, Homo sapiens
cccagatatacatct

SEQ ID NO: 50738 - DNA, 15 bp, Homo sapiens
ccagatatacatctg

SEQ ID NO: 50739 - DNA, 15 bp, Homo sapiens
cagatatacatctgg

SEQ ID NO: 50740 - DNA, 15 bp, Homo sapiens
agatatacatctggt

SEQ ID NO: 50741 - DNA, 15 bp, Homo sapiens
gatatacatctggtt

SEQ ID NO: 50742 - DNA, 15 bp, Homo sapiens
atatacatctggttc

SEQ ID NO: 50743 - DNA, 15 bp, Homo sapiens
tatacatctggttct

SEQ ID NO: 50744 - DNA, 15 bp, Homo sapiens
atacatctggttctt

SEQ ID NO: 50745 - DNA, 15 bp, Homo sapiens
tacatctggttcttg

SEQ ID NO: 50746 - DNA, 15 bp, Homo sapiens
acatctggttcttgg

SEQ ID NO: 50747 - DNA, 15 bp, Homo sapiens
catctggttcttggg

SEQ ID NO: 50748 - DNA, 15 bp, Homo sapiens
atctggttcttggga

SEQ ID NO: 50749 - DNA, 15 bp, Homo sapiens
tctggttcttgggac

SEQ ID NO: 50750 - DNA, 15 bp, Homo sapiens
ctggttcttgggact

SEQ ID NO: 50751 - DNA, 15 bp, Homo sapiens
tggttcttgggactc

SEQ ID NO: 50752 - DNA, 15 bp, Homo sapiens
ggttcttgggactct

SEQ ID NO: 50753 - DNA, 15 bp, Homo sapiens
gttcttgggactcta

SEQ ID NO: 50754 - DNA, 15 bp, Homo sapiens
ttcttgggactctag

SEQ ID NO: 50755 - DNA, 15 bp, Homo sapiens
tcttgggactctaga

SEQ ID NO: 50756 - DNA, 15 bp, Homo sapiens
cttgggactctagag

SEQ ID NO: 50757 - DNA, 15 bp, Homo sapiens
ttgggactctagagg

SEQ ID NO: 50758 - DNA, 15 bp, Homo sapiens
tgggactctagagga

SEQ ID NO: 50759 - DNA, 15 bp, Homo sapiens
gggactctagaggag

SEQ ID NO: 50760 - DNA, 15 bp, Homo sapiens
ggactctagaggagg

SEQ ID NO: 50761 - DNA, 15 bp, Homo sapiens
gactctagaggagga

SEQ ID NO: 50762 - DNA, 15 bp, Homo sapiens
actctagaggaggat

SEQ ID NO: 50763 - DNA, 15 bp, Homo sapiens
ctctagaggaggatg

SEQ ID NO: 50764 - DNA, 15 bp, Homo sapiens
tctagaggaggatga

SEQ ID NO: 50765 - DNA, 15 bp, Homo sapiens
ctagaggaggatgag

SEQ ID NO: 50766 - DNA, 15 bp, Homo sapiens
tagaggaggatgagt

SEQ ID NO: 50767 - DNA, 15 bp, Homo sapiens
agaggaggatgagta

SEQ ID NO: 50768 - DNA, 15 bp, Homo sapiens
gaggaggatgagtac

SEQ ID NO: 50769 - DNA, 15 bp, Homo sapiens
aggaggatgagtact

SEQ ID NO: 50770 - DNA, 15 bp, Homo sapiens
ggaggatgagtactt

SEQ ID NO: 50771 - DNA, 15 bp, Homo sapiens
gaggatgagtacttt

SEQ ID NO: 50772 - DNA, 15 bp, Homo sapiens
aggatgagtactttg

SEQ ID NO: 50773 - DNA, 15 bp, Homo sapiens
ggatgagtactttgt

SEQ ID NO: 50774 - DNA, 15 bp, Homo sapiens
gatgagtactttgta

SEQ ID NO: 50775 - DNA, 15 bp, Homo sapiens
atgagtactttgtaa

SEQ ID NO: 50776 - DNA, 15 bp, Homo sapiens
tgagtactttgtaaa

SEQ ID NO: 50777 - DNA, 15 bp, Homo sapiens
gagtactttgtaaaa

SEQ ID NO: 50778 - DNA, 15 bp, Homo sapiens
agtactttgtaaaaa

SEQ ID NO: 50779 - DNA, 15 bp, Homo sapiens
gtactttgtaaaaac

SEQ ID NO: 50780 - DNA, 15 bp, Homo sapiens
tactttgtaaaaacc

SEQ ID NO: 50781 - DNA, 15 bp, Homo sapiens
actttgtaaaaacct

SEQ ID NO: 50782 - DNA, 15 bp, Homo sapiens
ctttgtaaaaacctg

SEQ ID NO: 50783 - DNA, 15 bp, Homo sapiens
tttgtaaaaacctgg

SEQ ID NO: 50784 - DNA, 15 bp, Homo sapiens
ttgtaaaaacctggg

SEQ ID NO: 50785 - DNA, 15 bp, Homo sapiens
tgtaaaaacctgggg

SEQ ID NO: 50786 - DNA, 15 bp, Homo sapiens
gtaaaaacctggggg

SEQ ID NO: 50787 - DNA, 15 bp, Homo sapiens
taaaaacctgggggc

SEQ ID NO: 50788 - DNA, 15 bp, Homo sapiens
aaaaacctgggggcc

SEQ ID NO: 50789 - DNA, 15 bp, Homo sapiens
aaaacctgggggccc

SEQ ID NO: 50790 - DNA, 15 bp, Homo sapiens
aaacctgggggcccc

SEQ ID NO: 50791 - DNA, 15 bp, Homo sapiens
aacctgggggcccca

SEQ ID NO: 50792 - DNA, 15 bp, Homo sapiens
acctgggggccccag

SEQ ID NO: 50793 - DNA, 15 bp, Homo sapiens
cctgggggccccagt

SEQ ID NO: 50794 - DNA, 15 bp, Homo sapiens
ctgggggccccagtc

SEQ ID NO: 50795 - DNA, 15 bp, Homo sapiens
tgggggccccagtca

SEQ ID NO: 50796 - DNA, 15 bp, Homo sapiens
gggggccccagtcat

SEQ ID NO: 50797 - DNA, 15 bp, Homo sapiens
ggggccccagtcatt

SEQ ID NO: 50798 - DNA, 15 bp, Homo sapiens
gggccccagtcattc

SEQ ID NO: 50799 - DNA, 15 bp, Homo sapiens
ggccccagtcattct

SEQ ID NO: 50800 - DNA, 15 bp, Homo sapiens
gccccagtcattcta

SEQ ID NO: 50801 - DNA, 15 bp, Homo sapiens
ccccagtcattctag

SEQ ID NO: 50802 - DNA, 15 bp, Homo sapiens
cccagtcattctagg

SEQ ID NO: 50803 - DNA, 15 bp, Homo sapiens
ccagtcattctaggt

SEQ ID NO: 50804 - DNA, 15 bp, Homo sapiens
cagtcattctaggtc

SEQ ID NO: 50805 - DNA, 15 bp, Homo sapiens
agtcattctaggtct

SEQ ID NO: 50806 - DNA, 15 bp, Homo sapiens
gtcattctaggtctg

SEQ ID NO: 50807 - DNA, 15 bp, Homo sapiens
tcattctaggtctga

SEQ ID NO: 50808 - DNA, 15 bp, Homo sapiens
cattctaggtctgac

SEQ ID NO: 50809 - DNA, 15 bp, Homo sapiens
attctaggtctgaca

SEQ ID NO: 50810 - DNA, 15 bp, Homo sapiens
ttctaggtctgacac

SEQ ID NO: 50811 - DNA, 15 bp, Homo sapiens
tctaggtctgacact

SEQ ID NO: 50812 - DNA, 15 bp, Homo sapiens
ctaggtctgacactc

SEQ ID NO: 50813 - DNA, 15 bp, Homo sapiens
taggtctgacactca

SEQ ID NO: 50814 - DNA, 15 bp, Homo sapiens
aggtctgacactcag

SEQ ID NO: 50815 - DNA, 15 bp, Homo sapiens
ggtctgacactcagg

SEQ ID NO: 50816 - DNA, 15 bp, Homo sapiens
gtctgacactcaggt

SEQ ID NO: 50817 - DNA, 15 bp, Homo sapiens
tctgacactcaggtg

SEQ ID NO: 50818 - DNA, 15 bp, Homo sapiens
ctgacactcaggtgc

SEQ ID NO: 50819 - DNA, 15 bp, Homo sapiens
tgacactcaggtgct

SEQ ID NO: 50820 - DNA, 15 bp, Homo sapiens
gacactcaggtgctg

SEQ ID NO: 50821 - DNA, 15 bp, Homo sapiens
acactcaggtgctgt

SEQ ID NO: 50822 - DNA, 15 bp, Homo sapiens
cactcaggtgctgta

SEQ ID NO: 50823 - DNA, 15 bp, Homo sapiens
actcaggtgctgtat

SEQ ID NO: 50824 - DNA, 15 bp, Homo sapiens
ctcaggtgctgtatc

SEQ ID NO: 50825 - DNA, 15 bp, Homo sapiens
tcaggtgctgtatca

SEQ ID NO: 50826 - DNA, 15 bp, Homo sapiens
caggtgctgtatcag

SEQ ID NO: 50827 - DNA, 15 bp, Homo sapiens
aggtgctgtatcagc

SEQ ID NO: 50828 - DNA, 15 bp, Homo sapiens
ggtgctgtatcagct

SEQ ID NO: 50829 - DNA, 15 bp, Homo sapiens
gtgctgtatcagctg

SEQ ID NO: 50830 - DNA, 15 bp, Homo sapiens
tgctgtatcagctgc

SEQ ID NO: 50831 - DNA, 15 bp, Homo sapiens
gctgtatcagctgca

SEQ ID NO: 50832 - DNA, 15 bp, Homo sapiens
ctgtatcagctgcag

SEQ ID NO: 50833 - DNA, 15 bp, Homo sapiens
tgtatcagctgcagt

SEQ ID NO: 50834 - DNA, 15 bp, Homo sapiens
gtatcagctgcagtt

SEQ ID NO: 50835 - DNA, 15 bp, Homo sapiens
tatcagctgcagttt

SEQ ID NO: 50836 - DNA, 15 bp, Homo sapiens
atcagctgcagtttg

SEQ ID NO: 50837 - DNA, 15 bp, Homo sapiens
tcagctgcagtttga

SEQ ID NO: 50838 - DNA, 15 bp, Homo sapiens
cagctgcagtttgaa

SEQ ID NO: 50839 - DNA, 15 bp, Homo sapiens
agctgcagtttgaac

SEQ ID NO: 50840 - DNA, 15 bp, Homo sapiens
gctgcagtttgaact

SEQ ID NO: 50841 - DNA, 15 bp, Homo sapiens
ctgcagtttgaacta

SEQ ID NO: 50842 - DNA, 15 bp, Homo sapiens
tgcagtttgaactac

SEQ ID NO: 50843 - DNA, 15 bp, Homo sapiens
gcagtttgaactact

SEQ ID NO: 50844 - DNA, 15 bp, Homo sapiens
cagtttgaactactt

SEQ ID NO: 50845 - DNA, 15 bp, Homo sapiens
agtttgaactacttg

SEQ ID NO: 50846 - DNA, 15 bp, Homo sapiens
gtttgaactacttgg

SEQ ID NO: 50847 - DNA, 15 bp, Homo sapiens
tttgaactacttggc

SEQ ID NO: 50848 - DNA, 15 bp, Homo sapiens
ttgaactacttggca

SEQ ID NO: 50849 - DNA, 15 bp, Homo sapiens
tgaactacttggcac

SEQ ID NO: 50850 - DNA, 15 bp, Homo sapiens
gaactacttggcacc

SEQ ID NO: 50851 - DNA, 15 bp, Homo sapiens
aactacttggcacca

SEQ ID NO: 50852 - DNA, 15 bp, Homo sapiens
actacttggcaccat

SEQ ID NO: 50853 - DNA, 15 bp, Homo sapiens
ctacttggcaccatt

SEQ ID NO: 50854 - DNA, 15 bp, Homo sapiens
tacttggcaccattg

SEQ ID NO: 50855 - DNA, 15 bp, Homo sapiens
acttggcaccattgt

SEQ ID NO: 50856 - DNA, 15 bp, Homo sapiens
cttggcaccattgtg

SEQ ID NO: 50857 - DNA, 15 bp, Homo sapiens
ttggcaccattgtgt

SEQ ID NO: 50858 - DNA, 15 bp, Homo sapiens
tggcaccattgtgtg

SEQ ID NO: 50859 - DNA, 15 bp, Homo sapiens
ggcaccattgtgtgg

SEQ ID NO: 50860 - DNA, 15 bp, Homo sapiens
gcaccattgtgtgga

SEQ ID NO: 50861 - DNA, 15 bp, Homo sapiens
caccattgtgtggac

SEQ ID NO: 50862 - DNA, 15 bp, Homo sapiens
accattgtgtggact

SEQ ID NO: 50863 - DNA, 15 bp, Homo sapiens
ccattgtgtggactt

SEQ ID NO: 50864 - DNA, 15 bp, Homo sapiens
cattgtgtggacttt

SEQ ID NO: 50865 - DNA, 15 bp, Homo sapiens
attgtgtggacttta

SEQ ID NO: 50866 - DNA, 15 bp, Homo sapiens
ttgtgtggactttag

SEQ ID NO: 50867 - DNA, 15 bp, Homo sapiens
tgtgtggactttagt

SEQ ID NO: 50868 - DNA, 15 bp, Homo sapiens
gtgtggactttagtt

SEQ ID NO: 50869 - DNA, 15 bp, Homo sapiens
tgtggactttagttt

SEQ ID NO: 50870 - DNA, 15 bp, Homo sapiens
gtggactttagtttt

SEQ ID NO: 50871 - DNA, 15 bp, Homo sapiens
tggactttagttttg

SEQ ID NO: 50872 - DNA, 15 bp, Homo sapiens
ggactttagttttgt

SEQ ID NO: 50873 - DNA, 15 bp, Homo sapiens
gactttagttttgta

SEQ ID NO: 50874 - DNA, 15 bp, Homo sapiens
actttagttttgtaa

SEQ ID NO: 50875 - DNA, 15 bp, Homo sapiens
ctttagttttgtaaa

SEQ ID NO: 50876 - DNA, 15 bp, Homo sapiens
tttagttttgtaaaa

SEQ ID NO: 50877 - DNA, 15 bp, Homo sapiens
ttagttttgtaaaaa

SEQ ID NO: 50878 - DNA, 15 bp, Homo sapiens
tagttttgtaaaaat

SEQ ID NO: 50879 - DNA, 15 bp, Homo sapiens
agttttgtaaaaatg

SEQ ID NO: 50880 - DNA, 15 bp, Homo sapiens
gttttgtaaaaatga

SEQ ID NO: 50881 - DNA, 15 bp, Homo sapiens
ttttgtaaaaatgaa

SEQ ID NO: 50882 - DNA, 15 bp, Homo sapiens
tttgtaaaaatgaat

SEQ ID NO: 50883 - DNA, 15 bp, Homo sapiens
ttgtaaaaatgaatg

SEQ ID NO: 50884 - DNA, 15 bp, Homo sapiens
tgtaaaaatgaatgg

SEQ ID NO: 50885 - DNA, 15 bp, Homo sapiens
gtaaaaatgaatggt

SEQ ID NO: 50886 - DNA, 15 bp, Homo sapiens
taaaaatgaatggtt

SEQ ID NO: 50887 - DNA, 15 bp, Homo sapiens
aaaaatgaatggttc

SEQ ID NO: 50888 - DNA, 15 bp, Homo sapiens
aaaatgaatggttcc

SEQ ID NO: 50889 - DNA, 15 bp, Homo sapiens
aaatgaatggttcct

SEQ ID NO: 50890 - DNA, 15 bp, Homo sapiens
aatgaatggttcctt

SEQ ID NO: 50891 - DNA, 15 bp, Homo sapiens
atgaatggttcctta

SEQ ID NO: 50892 - DNA, 15 bp, Homo sapiens
tgaatggttccttaa

SEQ ID NO: 50893 - DNA, 15 bp, Homo sapiens
gaatggttccttaat

SEQ ID NO: 50894 - DNA, 15 bp, Homo sapiens
aatggttccttaatt

SEQ ID NO: 50895 - DNA, 15 bp, Homo sapiens
atggttccttaattt

SEQ ID NO: 50896 - DNA, 15 bp, Homo sapiens
tggttccttaatttc

SEQ ID NO: 50897 - DNA, 15 bp, Homo sapiens
ggttccttaatttct

SEQ ID NO: 50898 - DNA, 15 bp, Homo sapiens
gttccttaatttctc

SEQ ID NO: 50899 - DNA, 15 bp, Homo sapiens
ttccttaatttctca

SEQ ID NO: 50900 - DNA, 15 bp, Homo sapiens
tccttaatttctcaa

SEQ ID NO: 50901 - DNA, 15 bp, Homo sapiens
ccttaatttctcaac

SEQ ID NO: 50902 - DNA, 15 bp, Homo sapiens
cttaatttctcaacc

SEQ ID NO: 50903 - DNA, 15 bp, Homo sapiens
ttaatttctcaacct

SEQ ID NO: 50904 - DNA, 15 bp, Homo sapiens
taatttctcaacctt

SEQ ID NO: 50905 - DNA, 15 bp, Homo sapiens
aatttctcaaccttc

SEQ ID NO: 50906 - DNA, 15 bp, Homo sapiens
atttctcaaccttca

SEQ ID NO: 50907 - DNA, 15 bp, Homo sapiens
tttctcaaccttcag

SEQ ID NO: 50908 - DNA, 15 bp, Homo sapiens
ttctcaaccttcagg

SEQ ID NO: 50909 - DNA, 15 bp, Homo sapiens
tctcaaccttcaggc

SEQ ID NO: 50910 - DNA, 15 bp, Homo sapiens
ctcaaccttcaggct

SEQ ID NO: 50911 - DNA, 15 bp, Homo sapiens
tcaaccttcaggctc

SEQ ID NO: 50912 - DNA, 15 bp, Homo sapiens
caaccttcaggctca

SEQ ID NO: 50913 - DNA, 15 bp, Homo sapiens
aaccttcaggctcaa

SEQ ID NO: 50914 - DNA, 15 bp, Homo sapiens
accttcaggctcaac

SEQ ID NO: 50915 - DNA, 15 bp, Homo sapiens
ccttcaggctcaaca

SEQ ID NO: 50916 - DNA, 15 bp, Homo sapiens
cttcaggctcaacat

SEQ ID NO: 50917 - DNA, 15 bp, Homo sapiens
ttcaggctcaacatc

SEQ ID NO: 50918 - DNA, 15 bp, Homo sapiens
tcaggctcaacatct

SEQ ID NO: 50919 - DNA, 15 bp, Homo sapiens
caggctcaacatctc

SEQ ID NO: 50920 - DNA, 15 bp, Homo sapiens
aggctcaacatctca

SEQ ID NO: 50921 - DNA, 15 bp, Homo sapiens
ggctcaacatctcaa

SEQ ID NO: 50922 - DNA, 15 bp, Homo sapiens
gctcaacatctcaag

SEQ ID NO: 50923 - DNA, 15 bp, Homo sapiens
ctcaacatctcaagc

SEQ ID NO: 50924 - DNA, 15 bp, Homo sapiens
tcaacatctcaagct

SEQ ID NO: 50925 - DNA, 15 bp, Homo sapiens
caacatctcaagctg

SEQ ID NO: 50926 - DNA, 15 bp, Homo sapiens
aacatctcaagctgt

SEQ ID NO: 50927 - DNA, 15 bp, Homo sapiens
acatctcaagctgtt

SEQ ID NO: 50928 - DNA, 15 bp, Homo sapiens
catctcaagctgttt

SEQ ID NO: 50929 - DNA, 15 bp, Homo sapiens
atctcaagctgtttg

SEQ ID NO: 50930 - DNA, 15 bp, Homo sapiens
tctcaagctgtttgt

SEQ ID NO: 50931 - DNA, 15 bp, Homo sapiens
ctcaagctgtttgtt

SEQ ID NO: 50932 - DNA, 15 bp, Homo sapiens
tcaagctgtttgttg

SEQ ID NO: 50933 - DNA, 15 bp, Homo sapiens
caagctgtttgttgt

SEQ ID NO: 50934 - DNA, 15 bp, Homo sapiens
aagctgtttgttgtt

SEQ ID NO: 50935 - DNA, 15 bp, Homo sapiens
agctgtttgttgttg

SEQ ID NO: 50936 - DNA, 15 bp, Homo sapiens
gctgtttgttgttgt

SEQ ID NO: 50937 - DNA, 15 bp, Homo sapiens
ctgtttgttgttgtt

SEQ ID NO: 50938 - DNA, 15 bp, Homo sapiens
tgtttgttgttgttg

SEQ ID NO: 50939 - DNA, 15 bp, Homo sapiens
gtttgttgttgttgt

SEQ ID NO: 50940 - DNA, 15 bp, Homo sapiens
tttgttgttgttgtt

SEQ ID NO: 50941 - DNA, 15 bp, Homo sapiens
ttgttgttgttgttg

SEQ ID NO: 50942 - DNA, 15 bp, Homo sapiens
tgttgttgttgttgt

SEQ ID NO: 50943 - DNA, 15 bp, Homo sapiens
gttgttgttgttgtt

SEQ ID NO: 50944 - DNA, 15 bp, Homo sapiens
ttgttgttgttgttt

SEQ ID NO: 50945 - DNA, 15 bp, Homo sapiens
tgttgttgttgtttt

SEQ ID NO: 50946 - DNA, 15 bp, Homo sapiens
gttgttgttgttttg

SEQ ID NO: 50947 - DNA, 15 bp, Homo sapiens
ttgttgttgttttgt

SEQ ID NO: 50948 - DNA, 15 bp, Homo sapiens
tgttgttgttttgtt

SEQ ID NO: 50949 - DNA, 15 bp, Homo sapiens
gttgttgttttgttt

SEQ ID NO: 50950 - DNA, 15 bp, Homo sapiens
ttgttgttttgtttt

SEQ ID NO: 50951 - DNA, 15 bp, Homo sapiens
tgttgttttgttttg

SEQ ID NO: 50952 - DNA, 15 bp, Homo sapiens
gttgttttgttttgt

SEQ ID NO: 50953 - DNA, 15 bp, Homo sapiens
ttgttttgttttgtc

SEQ ID NO: 50954 - DNA, 15 bp, Homo sapiens
tgttttgttttgtct

SEQ ID NO: 50955 - DNA, 15 bp, Homo sapiens
gttttgttttgtctt

SEQ ID NO: 50956 - DNA, 15 bp, Homo sapiens
ttttgttttgtcttt

SEQ ID NO: 50957 - DNA, 15 bp, Homo sapiens
tttgttttgtctttt

SEQ ID NO: 50958 - DNA, 15 bp, Homo sapiens
ttgttttgtcttttt

SEQ ID NO: 50959 - DNA, 15 bp, Homo sapiens
tgttttgtctttttg

SEQ ID NO: 50960 - DNA, 15 bp, Homo sapiens
gttttgtctttttga

SEQ ID NO: 50961 - DNA, 15 bp, Homo sapiens
tgtctttttgattag

SEQ ID NO: 50962 - DNA, 15 bp, Homo sapiens
gtctttttgattagt

SEQ ID NO: 50963 - DNA, 15 bp, Homo sapiens
tctttttgattagtg

SEQ ID NO: 50964 - DNA, 15 bp, Homo sapiens
ctttttgattagtgg

SEQ ID NO: 50965 - DNA, 15 bp, Homo sapiens
tttttgattagtggt

SEQ ID NO: 50966 - DNA, 15 bp, Homo sapiens
ttttgattagtggtc

SEQ ID NO: 50967 - DNA, 15 bp, Homo sapiens
tttgattagtggtca

SEQ ID NO: 50968 - DNA, 15 bp, Homo sapiens
ttgattagtggtcac

SEQ ID NO: 50969 - DNA, 15 bp, Homo sapiens
tgattagtggtcact

SEQ ID NO: 50970 - DNA, 15 bp, Homo sapiens
gattagtggtcactc

SEQ ID NO: 50971 - DNA, 15 bp, Homo sapiens
attagtggtcactcc

SEQ ID NO: 50972 - DNA, 15 bp, Homo sapiens
ttagtggtcactccg

SEQ ID NO: 50973 - DNA, 15 bp, Homo sapiens
tagtggtcactccgc

SEQ ID NO: 50974 - DNA, 15 bp, Homo sapiens
agtggtcactccgca

SEQ ID NO: 50975 - DNA, 15 bp, Homo sapiens
gtggtcactccgcat

SEQ ID NO: 50976 - DNA, 15 bp, Homo sapiens
tggtcactccgcatt

SEQ ID NO: 50977 - DNA, 15 bp, Homo sapiens
ggtcactccgcattt

SEQ ID NO: 50978 - DNA, 15 bp, Homo sapiens
gtcactccgcatttg

SEQ ID NO: 50979 - DNA, 15 bp, Homo sapiens
tcactccgcatttga

SEQ ID NO: 50980 - DNA, 15 bp, Homo sapiens
cactccgcatttgat

SEQ ID NO: 50981 - DNA, 15 bp, Homo sapiens
actccgcatttgatg

SEQ ID NO: 50982 - DNA, 15 bp, Homo sapiens
ctccgcatttgatgt

SEQ ID NO: 50983 - DNA, 15 bp, Homo sapiens
tccgcatttgatgtt

SEQ ID NO: 50984 - DNA, 15 bp, Homo sapiens
ccgcatttgatgttt

SEQ ID NO: 50985 - DNA, 15 bp, Homo sapiens
cgcatttgatgtttt

SEQ ID NO: 50986 - DNA, 15 bp, Homo sapiens
gcatttgatgttttg

SEQ ID NO: 50987 - DNA, 15 bp, Homo sapiens
catttgatgttttga

SEQ ID NO: 50988 - DNA, 15 bp, Homo sapiens
atttgatgttttgac

SEQ ID NO: 50989 - DNA, 15 bp, Homo sapiens
tttgatgttttgaca

SEQ ID NO: 50990 - DNA, 15 bp, Homo sapiens
ttgatgttttgacat

SEQ ID NO: 50991 - DNA, 15 bp, Homo sapiens
tgatgttttgacatg

SEQ ID NO: 50992 - DNA, 15 bp, Homo sapiens
gatgttttgacatgt

SEQ ID NO: 50993 - DNA, 15 bp, Homo sapiens
atgttttgacatgtg

SEQ ID NO: 50994 - DNA, 15 bp, Homo sapiens
tgttttgacatgtgg

SEQ ID NO: 50995 - DNA, 15 bp, Homo sapiens
gttttgacatgtgga

SEQ ID NO: 50996 - DNA, 15 bp, Homo sapiens
ttttgacatgtggat

SEQ ID NO: 50997 - DNA, 15 bp, Homo sapiens
tttgacatgtggatt

SEQ ID NO: 50998 - DNA, 15 bp, Homo sapiens
ttgacatgtggattt

SEQ ID NO: 50999 - DNA, 15 bp, Homo sapiens
tgacatgtggatttc

SEQ ID NO: 51000 - DNA, 15 bp, Homo sapiens
gacatgtggatttca

SEQ ID NO: 51001 - DNA, 15 bp, Homo sapiens
acatgtggatttcag

SEQ ID NO: 51002 - DNA, 15 bp, Homo sapiens
catgtggatttcaga

SEQ ID NO: 51003 - DNA, 15 bp, Homo sapiens
atgtggatttcagaa

SEQ ID NO: 51004 - DNA, 15 bp, Homo sapiens
tgtggatttcagaac

SEQ ID NO: 51005 - DNA, 15 bp, Homo sapiens
gtggatttcagaact

SEQ ID NO: 51006 - DNA, 15 bp, Homo sapiens
tggatttcagaactt

SEQ ID NO: 51007 - DNA, 15 bp, Homo sapiens
ggatttcagaacttc

SEQ ID NO: 51008 - DNA, 15 bp, Homo sapiens
gatttcagaacttct

SEQ ID NO: 51009 - DNA, 15 bp, Homo sapiens
atttcagaacttctg

SEQ ID NO: 51010 - DNA, 15 bp, Homo sapiens
tttcagaacttctgt

SEQ ID NO: 51011 - DNA, 15 bp, Homo sapiens
ttcagaacttctgtg

SEQ ID NO: 51012 - DNA, 15 bp, Homo sapiens
tcagaacttctgtgt

SEQ ID NO: 51013 - DNA, 15 bp, Homo sapiens
cagaacttctgtgtg

SEQ ID NO: 51014 - DNA, 15 bp, Homo sapiens
agaacttctgtgtgg

SEQ ID NO: 51015 - DNA, 15 bp, Homo sapiens
gaacttctgtgtggt

SEQ ID NO: 51016 - DNA, 15 bp, Homo sapiens
aacttctgtgtggta

SEQ ID NO: 51017 - DNA, 15 bp, Homo sapiens
acttctgtgtggtaa

SEQ ID NO: 51018 - DNA, 15 bp, Homo sapiens
cttctgtgtggtaaa

SEQ ID NO: 51019 - DNA, 15 bp, Homo sapiens
ttctgtgtggtaaag

SEQ ID NO: 51020 - DNA, 15 bp, Homo sapiens
tctgtgtggtaaagc

SEQ ID NO: 51021 - DNA, 15 bp, Homo sapiens
ctgtgtggtaaagca

SEQ ID NO: 51022 - DNA, 15 bp, Homo sapiens
tgtgtggtaaagcag

SEQ ID NO: 51023 - DNA, 15 bp, Homo sapiens
gtgtggtaaagcaga

SEQ ID NO: 51024 - DNA, 15 bp, Homo sapiens
tgtggtaaagcagaa

SEQ ID NO: 51025 - DNA, 15 bp, Homo sapiens
gtggtaaagcagaat

SEQ ID NO: 51026 - DNA, 15 bp, Homo sapiens
tggtaaagcagaatg

SEQ ID NO: 51027 - DNA, 15 bp, Homo sapiens
ggtaaagcagaatgt

SEQ ID NO: 51028 - DNA, 15 bp, Homo sapiens
gtaaagcagaatgtt

SEQ ID NO: 51029 - DNA, 15 bp, Homo sapiens
taaagcagaatgttc

SEQ ID NO: 51030 - DNA, 15 bp, Homo sapiens
aaagcagaatgttcc

SEQ ID NO: 51031 - DNA, 15 bp, Homo sapiens
aagcagaatgttcca

SEQ ID NO: 51032 - DNA, 15 bp, Homo sapiens
agcagaatgttccaa

SEQ ID NO: 51033 - DNA, 15 bp, Homo sapiens
gcagaatgttccaat

SEQ ID NO: 51034 - DNA, 15 bp, Homo sapiens
cagaatgttccaatt

SEQ ID NO: 51035 - DNA, 15 bp, Homo sapiens
agaatgttccaattg

SEQ ID NO: 51036 - DNA, 15 bp, Homo sapiens
gaatgttccaattga

SEQ ID NO: 51037 - DNA, 15 bp, Homo sapiens
aatgttccaattgaa

SEQ ID NO: 51038 - DNA, 15 bp, Homo sapiens
atgttccaattgaat

SEQ ID NO: 51039 - DNA, 15 bp, Homo sapiens
tgttccaattgaatt

SEQ ID NO: 51040 - DNA, 15 bp, Homo sapiens
gttccaattgaattt

SEQ ID NO: 51041 - DNA, 15 bp, Homo sapiens
ttccaattgaatttt

SEQ ID NO: 51042 - DNA, 15 bp, Homo sapiens
tccaattgaattttc

SEQ ID NO: 51043 - DNA, 15 bp, Homo sapiens
ccaattgaattttcc

SEQ ID NO: 51044 - DNA, 15 bp, Homo sapiens
caattgaattttccc

SEQ ID NO: 51045 - DNA, 15 bp, Homo sapiens
aattgaattttccca

SEQ ID NO: 51046 - DNA, 15 bp, Homo sapiens
attgaattttcccat

SEQ ID NO: 51047 - DNA, 15 bp, Homo sapiens
ttgaattttcccatt

SEQ ID NO: 51048 - DNA, 15 bp, Homo sapiens
tgaattttcccattt

SEQ ID NO: 51049 - DNA, 15 bp, Homo sapiens
gaattttcccatttt

SEQ ID NO: 51050 - DNA, 15 bp, Homo sapiens
aattttcccattttt

SEQ ID NO: 51051 - DNA, 15 bp, Homo sapiens
attttcccatttttt

SEQ ID NO: 51052 - DNA, 15 bp, Homo sapiens
ttttcccattttttt

SEQ ID NO: 51053 - DNA, 15 bp, Homo sapiens
tttcccatttttttt

SEQ ID NO: 51054 - DNA, 15 bp, Homo sapiens
ttcccattttttttc

SEQ ID NO: 51055 - DNA, 15 bp, Homo sapiens
tcccattttttttcc

SEQ ID NO: 51056 - DNA, 15 bp, Homo sapiens
cccattttttttccc

SEQ ID NO: 51057 - DNA, 15 bp, Homo sapiens
ccattttttttcccc

SEQ ID NO: 51058 - DNA, 15 bp, Homo sapiens
cattttttttcccct

SEQ ID NO: 51059 - DNA, 15 bp, Homo sapiens
attttttttccccta

SEQ ID NO: 51060 - DNA, 15 bp, Homo sapiens
ttttttttcccctaa

SEQ ID NO: 51061 - DNA, 15 bp, Homo sapiens
tttttttcccctaag

SEQ ID NO: 51062 - DNA, 15 bp, Homo sapiens
ttttttcccctaagc

SEQ ID NO: 51063 - DNA, 15 bp, Homo sapiens
tttttcccctaagca

SEQ ID NO: 51064 - DNA, 15 bp, Homo sapiens
ttttcccctaagcaa

SEQ ID NO: 51065 - DNA, 15 bp, Homo sapiens
tttcccctaagcaaa

SEQ ID NO: 51066 - DNA, 15 bp, Homo sapiens
ttcccctaagcaaaa

SEQ ID NO: 51067 - DNA, 15 bp, Homo sapiens
tcccctaagcaaaaa

SEQ ID NO: 51068 - DNA, 15 bp, Homo sapiens
cccctaagcaaaaat

SEQ ID NO: 51069 - DNA, 15 bp, Homo sapiens
ccctaagcaaaaatg

SEQ ID NO: 51070 - DNA, 15 bp, Homo sapiens
cctaagcaaaaatgt

SEQ ID NO: 51071 - DNA, 15 bp, Homo sapiens
ctaagcaaaaatgtg

SEQ ID NO: 51072 - DNA, 15 bp, Homo sapiens
taagcaaaaatgtga

SEQ ID NO: 51073 - DNA, 15 bp, Homo sapiens
aagcaaaaatgtgag

SEQ ID NO: 51074 - DNA, 15 bp, Homo sapiens
agcaaaaatgtgagt

SEQ ID NO: 51075 - DNA, 15 bp, Homo sapiens
gcaaaaatgtgagtt

SEQ ID NO: 51076 - DNA, 15 bp, Homo sapiens
caaaaatgtgagttt

SEQ ID NO: 51077 - DNA, 15 bp, Homo sapiens
aaaaatgtgagtttt

SEQ ID NO: 51078 - DNA, 15 bp, Homo sapiens
aaaatgtgagttttc

SEQ ID NO: 51079 - DNA, 15 bp, Homo sapiens
aaatgtgagttttca

SEQ ID NO: 51080 - DNA, 15 bp, Homo sapiens
aatgtgagttttcac

SEQ ID NO: 51081 - DNA, 15 bp, Homo sapiens
atgtgagttttcact

SEQ ID NO: 51082 - DNA, 15 bp, Homo sapiens
tgtgagttttcactt

SEQ ID NO: 51083 - DNA, 15 bp, Homo sapiens
gtgagttttcactta

SEQ ID NO: 51084 - DNA, 15 bp, Homo sapiens
tgagttttcacttat

SEQ ID NO: 51085 - DNA, 15 bp, Homo sapiens
gagttttcacttatg

SEQ ID NO: 51086 - DNA, 15 bp, Homo sapiens
agttttcacttatgc

SEQ ID NO: 51087 - DNA, 15 bp, Homo sapiens
gttttcacttatgcg

SEQ ID NO: 51088 - DNA, 15 bp, Homo sapiens
ttttcacttatgcgg

SEQ ID NO: 51089 - DNA, 15 bp, Homo sapiens
tttcacttatgcggc

SEQ ID NO: 51090 - DNA, 15 bp, Homo sapiens
ttcacttatgcggcc

SEQ ID NO: 51091 - DNA, 15 bp, Homo sapiens
tcacttatgcggcca

SEQ ID NO: 51092 - DNA, 15 bp, Homo sapiens
cacttatgcggccat

SEQ ID NO: 51093 - DNA, 15 bp, Homo sapiens
acttatgcggccatt

SEQ ID NO: 51094 - DNA, 15 bp, Homo sapiens
cttatgcggccattg

SEQ ID NO: 51095 - DNA, 15 bp, Homo sapiens
ttatgcggccattgt

SEQ ID NO: 51096 - DNA, 15 bp, Homo sapiens
tatgcggccattgtg

SEQ ID NO: 51097 - DNA, 15 bp, Homo sapiens
atgcggccattgtga

SEQ ID NO: 51098 - DNA, 15 bp, Homo sapiens
tgcggccattgtgat

SEQ ID NO: 51099 - DNA, 15 bp, Homo sapiens
gcggccattgtgatt

SEQ ID NO: 51100 - DNA, 15 bp, Homo sapiens
cggccattgtgattc

SEQ ID NO: 51101 - DNA, 15 bp, Homo sapiens
ggccattgtgattcc

SEQ ID NO: 51102 - DNA, 15 bp, Homo sapiens
gccattgtgattccg

SEQ ID NO: 51103 - DNA, 15 bp, Homo sapiens
ccattgtgattccga

SEQ ID NO: 51104 - DNA, 15 bp, Homo sapiens
cattgtgattccgac

SEQ ID NO: 51105 - DNA, 15 bp, Homo sapiens
attgtgattccgact

SEQ ID NO: 51106 - DNA, 15 bp, Homo sapiens
ttgtgattccgactg

SEQ ID NO: 51107 - DNA, 15 bp, Homo sapiens
tgtgattccgactga

SEQ ID NO: 51108 - DNA, 15 bp, Homo sapiens
gtgattccgactgag

SEQ ID NO: 51109 - DNA, 15 bp, Homo sapiens
tgattccgactgaga

SEQ ID NO: 51110 - DNA, 15 bp, Homo sapiens
gattccgactgagac

SEQ ID NO: 51111 - DNA, 15 bp, Homo sapiens
attccgactgagacc

SEQ ID NO: 51112 - DNA, 15 bp, Homo sapiens
ttccgactgagaccc

SEQ ID NO: 51113 - DNA, 15 bp, Homo sapiens
tccgactgagaccct

SEQ ID NO: 51114 - DNA, 15 bp, Homo sapiens
ccgactgagacccta

SEQ ID NO: 51115 - DNA, 15 bp, Homo sapiens
cgactgagaccctaa

SEQ ID NO: 51116 - DNA, 15 bp, Homo sapiens
gactgagaccctaag

SEQ ID NO: 51117 - DNA, 15 bp, Homo sapiens
actgagaccctaagt

SEQ ID NO: 51118 - DNA, 15 bp, Homo sapiens
ctgagaccctaagtc

SEQ ID NO: 51119 - DNA, 15 bp, Homo sapiens
tgagaccctaagtcg

SEQ ID NO: 51120 - DNA, 15 bp, Homo sapiens
gagaccctaagtcgt

SEQ ID NO: 51121 - DNA, 15 bp, Homo sapiens
agaccctaagtcgtt

SEQ ID NO: 51122 - DNA, 15 bp, Homo sapiens
gaccctaagtcgttc

SEQ ID NO: 51123 - DNA, 15 bp, Homo sapiens
accctaagtcgttct

SEQ ID NO: 51124 - DNA, 15 bp, Homo sapiens
ccctaagtcgttctt

SEQ ID NO: 51125 - DNA, 15 bp, Homo sapiens
cctaagtcgttcttt

SEQ ID NO: 51126 - DNA, 15 bp, Homo sapiens
ctaagtcgttctttg

SEQ ID NO: 51127 - DNA, 15 bp, Homo sapiens
taagtcgttctttgt

SEQ ID NO: 51128 - DNA, 15 bp, Homo sapiens
aagtcgttctttgtt

SEQ ID NO: 51129 - DNA, 15 bp, Homo sapiens
agtcgttctttgttg

SEQ ID NO: 51130 - DNA, 15 bp, Homo sapiens
gtcgttctttgttgt

SEQ ID NO: 51131 - DNA, 15 bp, Homo sapiens
tcgttctttgttgtc

SEQ ID NO: 51132 - DNA, 15 bp, Homo sapiens
cgttctttgttgtct

SEQ ID NO: 51133 - DNA, 15 bp, Homo sapiens
gttctttgttgtctc

SEQ ID NO: 51134 - DNA, 15 bp, Homo sapiens
ttctttgttgtctct

SEQ ID NO: 51135 - DNA, 15 bp, Homo sapiens
tctttgttgtctctc

SEQ ID NO: 51136 - DNA, 15 bp, Homo sapiens
ctttgttgtctctct

SEQ ID NO: 51137 - DNA, 15 bp, Homo sapiens
tttgttgtctctcta

SEQ ID NO: 51138 - DNA, 15 bp, Homo sapiens
ttgttgtctctctag

SEQ ID NO: 51139 - DNA, 15 bp, Homo sapiens
tgttgtctctctagt

SEQ ID NO: 51140 - DNA, 15 bp, Homo sapiens
gttgtctctctagtg

SEQ ID NO: 51141 - DNA, 15 bp, Homo sapiens
ttgtctctctagtgg

SEQ ID NO: 51142 - DNA, 15 bp, Homo sapiens
tgtctctctagtggt

SEQ ID NO: 51143 - DNA, 15 bp, Homo sapiens
gtctctctagtggtt

SEQ ID NO: 51144 - DNA, 15 bp, Homo sapiens
tctctctagtggttt

SEQ ID NO: 51145 - DNA, 15 bp, Homo sapiens
ctctctagtggtttc

SEQ ID NO: 51146 - DNA, 15 bp, Homo sapiens
tctctagtggtttct

SEQ ID NO: 51147 - DNA, 15 bp, Homo sapiens
ctctagtggtttctg

SEQ ID NO: 51148 - DNA, 15 bp, Homo sapiens
tctagtggtttctga

SEQ ID NO: 51149 - DNA, 15 bp, Homo sapiens
ctagtggtttctgac

SEQ ID NO: 51150 - DNA, 15 bp, Homo sapiens
tagtggtttctgaca

SEQ ID NO: 51151 - DNA, 15 bp, Homo sapiens
agtggtttctgacac

SEQ ID NO: 51152 - DNA, 15 bp, Homo sapiens
gtggtttctgacacc

SEQ ID NO: 51153 - DNA, 15 bp, Homo sapiens
tggtttctgacacct

SEQ ID NO: 51154 - DNA, 15 bp, Homo sapiens
ggtttctgacacctc

SEQ ID NO: 51155 - DNA, 15 bp, Homo sapiens
gtttctgacacctca

SEQ ID NO: 51156 - DNA, 15 bp, Homo sapiens
tttctgacacctcag

SEQ ID NO: 51157 - DNA, 15 bp, Homo sapiens
ttctgacacctcagt

SEQ ID NO: 51158 - DNA, 15 bp, Homo sapiens
tctgacacctcagtg

SEQ ID NO: 51159 - DNA, 15 bp, Homo sapiens
ctgacacctcagtgt

SEQ ID NO: 51160 - DNA, 15 bp, Homo sapiens
tgacacctcagtgtg

SEQ ID NO: 51161 - DNA, 15 bp, Homo sapiens
gacacctcagtgtga

SEQ ID NO: 51162 - DNA, 15 bp, Homo sapiens
acacctcagtgtgaa

SEQ ID NO: 51163 - DNA, 15 bp, Homo sapiens
cacctcagtgtgaag

SEQ ID NO: 51164 - DNA, 15 bp, Homo sapiens
acctcagtgtgaagc

SEQ ID NO: 51165 - DNA, 15 bp, Homo sapiens
cctcagtgtgaagct

SEQ ID NO: 51166 - DNA, 15 bp, Homo sapiens
ctcagtgtgaagctg

SEQ ID NO: 51167 - DNA, 15 bp, Homo sapiens
tcagtgtgaagctgt

SEQ ID NO: 51168 - DNA, 15 bp, Homo sapiens
cagtgtgaagctgtt

SEQ ID NO: 51169 - DNA, 15 bp, Homo sapiens
agtgtgaagctgttg

SEQ ID NO: 51170 - DNA, 15 bp, Homo sapiens
gtgtgaagctgttgt

SEQ ID NO: 51171 - DNA, 15 bp, Homo sapiens
tgtgaagctgttgta

SEQ ID NO: 51172 - DNA, 15 bp, Homo sapiens
gtgaagctgttgtag

SEQ ID NO: 51173 - DNA, 15 bp, Homo sapiens
tgaagctgttgtaga

SEQ ID NO: 51174 - DNA, 15 bp, Homo sapiens
gaagctgttgtagac

SEQ ID NO: 51175 - DNA, 15 bp, Homo sapiens
aagctgttgtagaca

SEQ ID NO: 51176 - DNA, 15 bp, Homo sapiens
agctgttgtagacat

SEQ ID NO: 51177 - DNA, 15 bp, Homo sapiens
gctgttgtagacatc

SEQ ID NO: 51178 - DNA, 15 bp, Homo sapiens
ctgttgtagacatcc

SEQ ID NO: 51179 - DNA, 15 bp, Homo sapiens
tgttgtagacatcca

SEQ ID NO: 51180 - DNA, 15 bp, Homo sapiens
gttgtagacatccat

SEQ ID NO: 51181 - DNA, 15 bp, Homo sapiens
ttgtagacatccata

SEQ ID NO: 51182 - DNA, 15 bp, Homo sapiens
tgtagacatccataa

SEQ ID NO: 51183 - DNA, 15 bp, Homo sapiens
gtagacatccataag

SEQ ID NO: 51184 - DNA, 15 bp, Homo sapiens
tagacatccataaga

SEQ ID NO: 51185 - DNA, 15 bp, Homo sapiens
agacatccataagaa

SEQ ID NO: 51186 - DNA, 15 bp, Homo sapiens
gacatccataagaaa

SEQ ID NO: 51187 - DNA, 15 bp, Homo sapiens
acatccataagaaat

SEQ ID NO: 51188 - DNA, 15 bp, Homo sapiens
catccataagaaata

SEQ ID NO: 51189 - DNA, 15 bp, Homo sapiens
atccataagaaatag

SEQ ID NO: 51190 - DNA, 15 bp, Homo sapiens
tccataagaaatagc

SEQ ID NO: 51191 - DNA, 15 bp, Homo sapiens
ccataagaaatagcc

SEQ ID NO: 51192 - DNA, 15 bp, Homo sapiens
cataagaaatagcct

SEQ ID NO: 51193 - DNA, 15 bp, Homo sapiens
ataagaaatagcctg

SEQ ID NO: 51194 - DNA, 15 bp, Homo sapiens
taagaaatagcctgc

SEQ ID NO: 51195 - DNA, 15 bp, Homo sapiens
aagaaatagcctgct

SEQ ID NO: 51196 - DNA, 15 bp, Homo sapiens
agaaatagcctgctt

SEQ ID NO: 51197 - DNA, 15 bp, Homo sapiens
gaaatagcctgctta

SEQ ID NO: 51198 - DNA, 15 bp, Homo sapiens
aaatagcctgcttag

SEQ ID NO: 51199 - DNA, 15 bp, Homo sapiens
aatagcctgcttagg

SEQ ID NO: 51200 - DNA, 15 bp, Homo sapiens
atagcctgcttaggg

SEQ ID NO: 51201 - DNA, 15 bp, Homo sapiens
tagcctgcttaggga

SEQ ID NO: 51202 - DNA, 15 bp, Homo sapiens
agcctgcttagggat

SEQ ID NO: 51203 - DNA, 15 bp, Homo sapiens
gcctgcttagggatt

SEQ ID NO: 51204 - DNA, 15 bp, Homo sapiens
cctgcttagggatta

SEQ ID NO: 51205 - DNA, 15 bp, Homo sapiens
ctgcttagggattat

SEQ ID NO: 51206 - DNA, 15 bp, Homo sapiens
tgcttagggattatg

SEQ ID NO: 51207 - DNA, 15 bp, Homo sapiens
gcttagggattatgt

SEQ ID NO: 51208 - DNA, 15 bp, Homo sapiens
cttagggattatgtg

SEQ ID NO: 51209 - DNA, 15 bp, Homo sapiens
ttagggattatgtga

SEQ ID NO: 51210 - DNA, 15 bp, Homo sapiens
tagggattatgtgag

SEQ ID NO: 51211 - DNA, 15 bp, Homo sapiens
agggattatgtgagg

SEQ ID NO: 51212 - DNA, 15 bp, Homo sapiens
gggattatgtgaggg

SEQ ID NO: 51213 - DNA, 15 bp, Homo sapiens
ggattatgtgagggc

SEQ ID NO: 51214 - DNA, 15 bp, Homo sapiens
gattatgtgagggca

SEQ ID NO: 51215 - DNA, 15 bp, Homo sapiens
attatgtgagggcaa

SEQ ID NO: 51216 - DNA, 15 bp, Homo sapiens
ttatgtgagggcaag

SEQ ID NO: 51217 - DNA, 15 bp, Homo sapiens
tatgtgagggcaagg

SEQ ID NO: 51218 - DNA, 15 bp, Homo sapiens
atgtgagggcaaggt

SEQ ID NO: 51219 - DNA, 15 bp, Homo sapiens
tgtgagggcaaggtt

SEQ ID NO: 51220 - DNA, 15 bp, Homo sapiens
gtgagggcaaggttt

SEQ ID NO: 51221 - DNA, 15 bp, Homo sapiens
tgagggcaaggtttg

SEQ ID NO: 51222 - DNA, 15 bp, Homo sapiens
gagggcaaggtttgg

SEQ ID NO: 51223 - DNA, 15 bp, Homo sapiens
agggcaaggtttggc

SEQ ID NO: 51224 - DNA, 15 bp, Homo sapiens
gggcaaggtttggct

SEQ ID NO: 51225 - DNA, 15 bp, Homo sapiens
ggcaaggtttggctg

SEQ ID NO: 51226 - DNA, 15 bp, Homo sapiens
gcaaggtttggctga

SEQ ID NO: 51227 - DNA, 15 bp, Homo sapiens
caaggtttggctgaa

SEQ ID NO: 51228 - DNA, 15 bp, Homo sapiens
aaggtttggctgaag

SEQ ID NO: 51229 - DNA, 15 bp, Homo sapiens
aggtttggctgaagg

SEQ ID NO: 51230 - DNA, 15 bp, Homo sapiens
ggtttggctgaagga

SEQ ID NO: 51231 - DNA, 15 bp, Homo sapiens
gtttggctgaaggag

SEQ ID NO: 51232 - DNA, 15 bp, Homo sapiens
tttggctgaaggaga

SEQ ID NO: 51233 - DNA, 15 bp, Homo sapiens
ttggctgaaggagaa

SEQ ID NO: 51234 - DNA, 15 bp, Homo sapiens
tggctgaaggagaat

SEQ ID NO: 51235 - DNA, 15 bp, Homo sapiens
ggctgaaggagaata

SEQ ID NO: 51236 - DNA, 15 bp, Homo sapiens
gctgaaggagaatag

SEQ ID NO: 51237 - DNA, 15 bp, Homo sapiens
ctgaaggagaataga

SEQ ID NO: 51238 - DNA, 15 bp, Homo sapiens
tgaaggagaatagaa

SEQ ID NO: 51239 - DNA, 15 bp, Homo sapiens
gaaggagaatagaag

SEQ ID NO: 51240 - DNA, 15 bp, Homo sapiens
aaggagaatagaagg

SEQ ID NO: 51241 - DNA, 15 bp, Homo sapiens
aggagaatagaaggt

SEQ ID NO: 51242 - DNA, 15 bp, Homo sapiens
ggagaatagaaggtg

SEQ ID NO: 51243 - DNA, 15 bp, Homo sapiens
gagaatagaaggtgt

SEQ ID NO: 51244 - DNA, 15 bp, Homo sapiens
agaatagaaggtgtg

SEQ ID NO: 51245 - DNA, 15 bp, Homo sapiens
gaatagaaggtgtgg

SEQ ID NO: 51246 - DNA, 15 bp, Homo sapiens
aatagaaggtgtgga

SEQ ID NO: 51247 - DNA, 15 bp, Homo sapiens
atagaaggtgtggaa

SEQ ID NO: 51248 - DNA, 15 bp, Homo sapiens
tagaaggtgtggaag

SEQ ID NO: 51249 - DNA, 15 bp, Homo sapiens
agaaggtgtggaagg

SEQ ID NO: 51250 - DNA, 15 bp, Homo sapiens
gaaggtgtggaagga

SEQ ID NO: 51251 - DNA, 15 bp, Homo sapiens
aaggtgtggaaggaa

SEQ ID NO: 51252 - DNA, 15 bp, Homo sapiens
aggtgtggaaggaag

SEQ ID NO: 51253 - DNA, 15 bp, Homo sapiens
ggtgtggaaggaagc

SEQ ID NO: 51254 - DNA, 15 bp, Homo sapiens
gtgtggaaggaagcg

SEQ ID NO: 51255 - DNA, 15 bp, Homo sapiens
tgtggaaggaagcgg

SEQ ID NO: 51256 - DNA, 15 bp, Homo sapiens
gtggaaggaagcgga

SEQ ID NO: 51257 - DNA, 15 bp, Homo sapiens
tggaaggaagcggaa

SEQ ID NO: 51258 - DNA, 15 bp, Homo sapiens
ggaaggaagcggaag

SEQ ID NO: 51259 - DNA, 15 bp, Homo sapiens
gaaggaagcggaaga

SEQ ID NO: 51260 - DNA, 15 bp, Homo sapiens
aaggaagcggaagac

SEQ ID NO: 51261 - DNA, 15 bp, Homo sapiens
aggaagcggaagacc

SEQ ID NO: 51262 - DNA, 15 bp, Homo sapiens
ggaagcggaagacca

SEQ ID NO: 51263 - DNA, 15 bp, Homo sapiens
gaagcggaagaccag

SEQ ID NO: 51264 - DNA, 15 bp, Homo sapiens
aagcggaagaccaga

SEQ ID NO: 51265 - DNA, 15 bp, Homo sapiens
agcggaagaccagaa

SEQ ID NO: 51266 - DNA, 15 bp, Homo sapiens
gcggaagaccagaag

SEQ ID NO: 51267 - DNA, 15 bp, Homo sapiens
cggaagaccagaaga

SEQ ID NO: 51268 - DNA, 15 bp, Homo sapiens
ggaagaccagaagag

SEQ ID NO: 51269 - DNA, 15 bp, Homo sapiens
gaagaccagaagagc

SEQ ID NO: 51270 - DNA, 15 bp, Homo sapiens
aagaccagaagagca

SEQ ID NO: 51271 - DNA, 15 bp, Homo sapiens
agaccagaagagcat

SEQ ID NO: 51272 - DNA, 15 bp, Homo sapiens
gaccagaagagcatc

SEQ ID NO: 51273 - DNA, 15 bp, Homo sapiens
accagaagagcatca

SEQ ID NO: 51274 - DNA, 15 bp, Homo sapiens
ccagaagagcatcac

SEQ ID NO: 51275 - DNA, 15 bp, Homo sapiens
cagaagagcatcaca

SEQ ID NO: 51276 - DNA, 15 bp, Homo sapiens
agaagagcatcacac

SEQ ID NO: 51277 - DNA, 15 bp, Homo sapiens
gaagagcatcacact

SEQ ID NO: 51278 - DNA, 15 bp, Homo sapiens
aagagcatcacactg

SEQ ID NO: 51279 - DNA, 15 bp, Homo sapiens
agagcatcacactgc

SEQ ID NO: 51280 - DNA, 15 bp, Homo sapiens
gagcatcacactgcc

SEQ ID NO: 51281 - DNA, 15 bp, Homo sapiens
agcatcacactgcct

SEQ ID NO: 51282 - DNA, 15 bp, Homo sapiens
gcatcacactgcctc

SEQ ID NO: 51283 - DNA, 15 bp, Homo sapiens
catcacactgcctca

SEQ ID NO: 51284 - DNA, 15 bp, Homo sapiens
atcacactgcctcaa

SEQ ID NO: 51285 - DNA, 15 bp, Homo sapiens
tcacactgcctcaag

SEQ ID NO: 51286 - DNA, 15 bp, Homo sapiens
cacactgcctcaagt

SEQ ID NO: 51287 - DNA, 15 bp, Homo sapiens
acactgcctcaagtc

SEQ ID NO: 51288 - DNA, 15 bp, Homo sapiens
cactgcctcaagtcc

SEQ ID NO: 51289 - DNA, 15 bp, Homo sapiens
actgcctcaagtccc

SEQ ID NO: 51290 - DNA, 15 bp, Homo sapiens
ctgcctcaagtccca

SEQ ID NO: 51291 - DNA, 15 bp, Homo sapiens
tgcctcaagtcccaa

SEQ ID NO: 51292 - DNA, 15 bp, Homo sapiens
gcctcaagtcccaaa

SEQ ID NO: 51293 - DNA, 15 bp, Homo sapiens
cctcaagtcccaaat

SEQ ID NO: 51294 - DNA, 15 bp, Homo sapiens
ctcaagtcccaaatt

SEQ ID NO: 51295 - DNA, 15 bp, Homo sapiens
tcaagtcccaaattt

SEQ ID NO: 51296 - DNA, 15 bp, Homo sapiens
caagtcccaaatttg

SEQ ID NO: 51297 - DNA, 15 bp, Homo sapiens
aagtcccaaatttga

SEQ ID NO: 51298 - DNA, 15 bp, Homo sapiens
agtcccaaatttgat

SEQ ID NO: 51299 - DNA, 15 bp, Homo sapiens
gtcccaaatttgatt

SEQ ID NO: 51300 - DNA, 15 bp, Homo sapiens
tcccaaatttgattc

SEQ ID NO: 51301 - DNA, 15 bp, Homo sapiens
cccaaatttgattct

SEQ ID NO: 51302 - DNA, 15 bp, Homo sapiens
ccaaatttgattctg

SEQ ID NO: 51303 - DNA, 15 bp, Homo sapiens
caaatttgattctgc

SEQ ID NO: 51304 - DNA, 15 bp, Homo sapiens
aaatttgattctgct

SEQ ID NO: 51305 - DNA, 15 bp, Homo sapiens
aatttgattctgctc

SEQ ID NO: 51306 - DNA, 15 bp, Homo sapiens
atttgattctgctcc

SEQ ID NO: 51307 - DNA, 15 bp, Homo sapiens
tttgattctgctcct

SEQ ID NO: 51308 - DNA, 15 bp, Homo sapiens
ttgattctgctcctg

SEQ ID NO: 51309 - DNA, 15 bp, Homo sapiens
tgattctgctcctga

SEQ ID NO: 51310 - DNA, 15 bp, Homo sapiens
gattctgctcctgat

SEQ ID NO: 51311 - DNA, 15 bp, Homo sapiens
attctgctcctgatc

SEQ ID NO: 51312 - DNA, 15 bp, Homo sapiens
ttctgctcctgatcc

SEQ ID NO: 51313 - DNA, 15 bp, Homo sapiens
tctgctcctgatcct

SEQ ID NO: 51314 - DNA, 15 bp, Homo sapiens
ctgctcctgatcctg

SEQ ID NO: 51315 - DNA, 15 bp, Homo sapiens
tgctcctgatcctgt

SEQ ID NO: 51316 - DNA, 15 bp, Homo sapiens
gctcctgatcctgtg

SEQ ID NO: 51317 - DNA, 15 bp, Homo sapiens
ctcctgatcctgtga

SEQ ID NO: 51318 - DNA, 15 bp, Homo sapiens
tcctgatcctgtgac

SEQ ID NO: 51319 - DNA, 15 bp, Homo sapiens
cctgatcctgtgact

SEQ ID NO: 51320 - DNA, 15 bp, Homo sapiens
ctgatcctgtgactc

SEQ ID NO: 51321 - DNA, 15 bp, Homo sapiens
tgatcctgtgactca

SEQ ID NO: 51322 - DNA, 15 bp, Homo sapiens
gatcctgtgactcaa

SEQ ID NO: 51323 - DNA, 15 bp, Homo sapiens
atcctgtgactcaaa

SEQ ID NO: 51324 - DNA, 15 bp, Homo sapiens
tcctgtgactcaaat

SEQ ID NO: 51325 - DNA, 15 bp, Homo sapiens
cctgtgactcaaatt

SEQ ID NO: 51326 - DNA, 15 bp, Homo sapiens
ctgtgactcaaattg

SEQ ID NO: 51327 - DNA, 15 bp, Homo sapiens
tgtgactcaaattgt

SEQ ID NO: 51328 - DNA, 15 bp, Homo sapiens
gtgactcaaattgtc

SEQ ID NO: 51329 - DNA, 15 bp, Homo sapiens
tgactcaaattgtca

SEQ ID NO: 51330 - DNA, 15 bp, Homo sapiens
gactcaaattgtcat

SEQ ID NO: 51331 - DNA, 15 bp, Homo sapiens
actcaaattgtcatt

SEQ ID NO: 51332 - DNA, 15 bp, Homo sapiens
ctcaaattgtcattc

SEQ ID NO: 51333 - DNA, 15 bp, Homo sapiens
tcaaattgtcattct

SEQ ID NO: 51334 - DNA, 15 bp, Homo sapiens
caaattgtcattctc

SEQ ID NO: 51335 - DNA, 15 bp, Homo sapiens
aaattgtcattctct

SEQ ID NO: 51336 - DNA, 15 bp, Homo sapiens
aattgtcattctctt

SEQ ID NO: 51337 - DNA, 15 bp, Homo sapiens
attgtcattctcttt

SEQ ID NO: 51338 - DNA, 15 bp, Homo sapiens
ttgtcattctctttt

SEQ ID NO: 51339 - DNA, 15 bp, Homo sapiens
tgtcattctctttta

SEQ ID NO: 51340 - DNA, 15 bp, Homo sapiens
gtcattctcttttac

SEQ ID NO: 51341 - DNA, 15 bp, Homo sapiens
tcattctcttttact

SEQ ID NO: 51342 - DNA, 15 bp, Homo sapiens
cattctcttttactg

SEQ ID NO: 51343 - DNA, 15 bp, Homo sapiens
attctcttttactgc

SEQ ID NO: 51344 - DNA, 15 bp, Homo sapiens
ttctcttttactgct

SEQ ID NO: 51345 - DNA, 15 bp, Homo sapiens
tctcttttactgctg

SEQ ID NO: 51346 - DNA, 15 bp, Homo sapiens
ctcttttactgctgt

SEQ ID NO: 51347 - DNA, 15 bp, Homo sapiens
tcttttactgctgtg

SEQ ID NO: 51348 - DNA, 15 bp, Homo sapiens
cttttactgctgtgg

SEQ ID NO: 51349 - DNA, 15 bp, Homo sapiens
ttttactgctgtggg

SEQ ID NO: 51350 - DNA, 15 bp, Homo sapiens
tttactgctgtgggg

SEQ ID NO: 51351 - DNA, 15 bp, Homo sapiens
ttactgctgtggggt

SEQ ID NO: 51352 - DNA, 15 bp, Homo sapiens
tactgctgtggggtg

SEQ ID NO: 51353 - DNA, 15 bp, Homo sapiens
actgctgtggggtgt

SEQ ID NO: 51354 - DNA, 15 bp, Homo sapiens
ctgctgtggggtgtg

SEQ ID NO: 51355 - DNA, 15 bp, Homo sapiens
tgctgtggggtgtgc

SEQ ID NO: 51356 - DNA, 15 bp, Homo sapiens
gctgtggggtgtgct

SEQ ID NO: 51357 - DNA, 15 bp, Homo sapiens
ctgtggggtgtgctc

SEQ ID NO: 51358 - DNA, 15 bp, Homo sapiens
tgtggggtgtgctct

SEQ ID NO: 51359 - DNA, 15 bp, Homo sapiens
gtggggtgtgctctg

SEQ ID NO: 51360 - DNA, 15 bp, Homo sapiens
tggggtgtgctctgg

SEQ ID NO: 51361 - DNA, 15 bp, Homo sapiens
ggggtgtgctctggg

SEQ ID NO: 51362 - DNA, 15 bp, Homo sapiens
gggtgtgctctgggc

SEQ ID NO: 51363 - DNA, 15 bp, Homo sapiens
ggtgtgctctgggcc

SEQ ID NO: 51364 - DNA, 15 bp, Homo sapiens
gtgtgctctgggccc

SEQ ID NO: 51365 - DNA, 15 bp, Homo sapiens
tgtgctctgggccca

SEQ ID NO: 51366 - DNA, 15 bp, Homo sapiens
gtgctctgggcccag

SEQ ID NO: 51367 - DNA, 15 bp, Homo sapiens
tgctctgggcccagc

SEQ ID NO: 51368 - DNA, 15 bp, Homo sapiens
gctctgggcccagct

SEQ ID NO: 51369 - DNA, 15 bp, Homo sapiens
ctctgggcccagctg

SEQ ID NO: 51370 - DNA, 15 bp, Homo sapiens
tctgggcccagctga

SEQ ID NO: 51371 - DNA, 15 bp, Homo sapiens
ctgggcccagctgac

SEQ ID NO: 51372 - DNA, 15 bp, Homo sapiens
tgggcccagctgaca

SEQ ID NO: 51373 - DNA, 15 bp, Homo sapiens
gggcccagctgacag

SEQ ID NO: 51374 - DNA, 15 bp, Homo sapiens
ggcccagctgacagg

SEQ ID NO: 51375 - DNA, 15 bp, Homo sapiens
gcccagctgacagga

SEQ ID NO: 51376 - DNA, 15 bp, Homo sapiens
cccagctgacaggac

SEQ ID NO: 51377 - DNA, 15 bp, Homo sapiens
ccagctgacaggaca

SEQ ID NO: 51378 - DNA, 15 bp, Homo sapiens
cagctgacaggacat

SEQ ID NO: 51379 - DNA, 15 bp, Homo sapiens
agctgacaggacatt

SEQ ID NO: 51380 - DNA, 15 bp, Homo sapiens
gctgacaggacattc

SEQ ID NO: 51381 - DNA, 15 bp, Homo sapiens
ctgacaggacattct

SEQ ID NO: 51382 - DNA, 15 bp, Homo sapiens
tgacaggacattctt

SEQ ID NO: 51383 - DNA, 15 bp, Homo sapiens
gacaggacattcttt

SEQ ID NO: 51384 - DNA, 15 bp, Homo sapiens
acaggacattctttg

SEQ ID NO: 51385 - DNA, 15 bp, Homo sapiens
caggacattctttgt

SEQ ID NO: 51386 - DNA, 15 bp, Homo sapiens
aggacattctttgta

SEQ ID NO: 51387 - DNA, 15 bp, Homo sapiens
ggacattctttgtac

SEQ ID NO: 51388 - DNA, 15 bp, Homo sapiens
gacattctttgtact

SEQ ID NO: 51389 - DNA, 15 bp, Homo sapiens
acattctttgtactc

SEQ ID NO: 51390 - DNA, 15 bp, Homo sapiens
cattctttgtactcc

SEQ ID NO: 51391 - DNA, 15 bp, Homo sapiens
attctttgtactcca

SEQ ID NO: 51392 - DNA, 15 bp, Homo sapiens
ttctttgtactccac

SEQ ID NO: 51393 - DNA, 15 bp, Homo sapiens
tctttgtactccacg

SEQ ID NO: 51394 - DNA, 15 bp, Homo sapiens
ctttgtactccacgt

SEQ ID NO: 51395 - DNA, 15 bp, Homo sapiens
tttgtactccacgta

SEQ ID NO: 51396 - DNA, 15 bp, Homo sapiens
ttgtactccacgtat

SEQ ID NO: 51397 - DNA, 15 bp, Homo sapiens
tgtactccacgtatt

SEQ ID NO: 51398 - DNA, 15 bp, Homo sapiens
gtactccacgtattt

SEQ ID NO: 51399 - DNA, 15 bp, Homo sapiens
tactccacgtattta

SEQ ID NO: 51400 - DNA, 15 bp, Homo sapiens
actccacgtatttat

SEQ ID NO: 51401 - DNA, 15 bp, Homo sapiens
ctccacgtatttatg

SEQ ID NO: 51402 - DNA, 15 bp, Homo sapiens
tccacgtatttatgc

SEQ ID NO: 51403 - DNA, 15 bp, Homo sapiens
ccacgtatttatgct

SEQ ID NO: 51404 - DNA, 15 bp, Homo sapiens
cacgtatttatgctg

SEQ ID NO: 51405 - DNA, 15 bp, Homo sapiens
acgtatttatgctgg

SEQ ID NO: 51406 - DNA, 15 bp, Homo sapiens
cgtatttatgctggt

SEQ ID NO: 51407 - DNA, 15 bp, Homo sapiens
gtatttatgctggtg

SEQ ID NO: 51408 - DNA, 15 bp, Homo sapiens
tatttatgctggtgg

SEQ ID NO: 51409 - DNA, 15 bp, Homo sapiens
atttatgctggtggg

SEQ ID NO: 51410 - DNA, 15 bp, Homo sapiens
tttatgctggtggga

SEQ ID NO: 51411 - DNA, 15 bp, Homo sapiens
ttatgctggtgggag

SEQ ID NO: 51412 - DNA, 15 bp, Homo sapiens
tatgctggtgggagt

SEQ ID NO: 51413 - DNA, 15 bp, Homo sapiens
atgctggtgggagtt

SEQ ID NO: 51414 - DNA, 15 bp, Homo sapiens
tgctggtgggagttg

SEQ ID NO: 51415 - DNA, 15 bp, Homo sapiens
gctggtgggagttgt

SEQ ID NO: 51416 - DNA, 15 bp, Homo sapiens
ctggtgggagttgta

SEQ ID NO: 51417 - DNA, 15 bp, Homo sapiens
tggtgggagttgtat

SEQ ID NO: 51418 - DNA, 15 bp, Homo sapiens
ggtgggagttgtatg

SEQ ID NO: 51419 - DNA, 15 bp, Homo sapiens
gtgggagttgtatgg

SEQ ID NO: 51420 - DNA, 15 bp, Homo sapiens
tgggagttgtatggc

SEQ ID NO: 51421 - DNA, 15 bp, Homo sapiens
gggagttgtatggct

SEQ ID NO: 51422 - DNA, 15 bp, Homo sapiens
ggagttgtatggcta

SEQ ID NO: 51423 - DNA, 15 bp, Homo sapiens
gagttgtatggctag

SEQ ID NO: 51424 - DNA, 15 bp, Homo sapiens
agttgtatggctagt

SEQ ID NO: 51425 - DNA, 15 bp, Homo sapiens
gttgtatggctagtg

SEQ ID NO: 51426 - DNA, 15 bp, Homo sapiens
ttgtatggctagtgc

SEQ ID NO: 51427 - DNA, 15 bp, Homo sapiens
tgtatggctagtgct

SEQ ID NO: 51428 - DNA, 15 bp, Homo sapiens
gtatggctagtgctt

SEQ ID NO: 51429 - DNA, 15 bp, Homo sapiens
tatggctagtgcttt

SEQ ID NO: 51430 - DNA, 15 bp, Homo sapiens
atggctagtgctttg

SEQ ID NO: 51431 - DNA, 15 bp, Homo sapiens
tggctagtgctttgt

SEQ ID NO: 51432 - DNA, 15 bp, Homo sapiens
ggctagtgctttgtg

SEQ ID NO: 51433 - DNA, 15 bp, Homo sapiens
gctagtgctttgtgc

SEQ ID NO: 51434 - DNA, 15 bp, Homo sapiens
ctagtgctttgtgct

SEQ ID NO: 51435 - DNA, 15 bp, Homo sapiens
tagtgctttgtgctt

SEQ ID NO: 51436 - DNA, 15 bp, Homo sapiens
agtgctttgtgcttt

SEQ ID NO: 51437 - DNA, 15 bp, Homo sapiens
gtgctttgtgctttg

SEQ ID NO: 51438 - DNA, 15 bp, Homo sapiens
tgctttgtgctttgt

SEQ ID NO: 51439 - DNA, 15 bp, Homo sapiens
gctttgtgctttgtc

SEQ ID NO: 51440 - DNA, 15 bp, Homo sapiens
ctttgtgctttgtct

SEQ ID NO: 51441 - DNA, 15 bp, Homo sapiens
tttgtgctttgtctc

SEQ ID NO: 51442 - DNA, 15 bp, Homo sapiens
ttgtgctttgtctca

SEQ ID NO: 51443 - DNA, 15 bp, Homo sapiens
tgtgctttgtctcag

SEQ ID NO: 51444 - DNA, 15 bp, Homo sapiens
gtgctttgtctcaga

SEQ ID NO: 51445 - DNA, 15 bp, Homo sapiens
tgctttgtctcagaa

SEQ ID NO: 51446 - DNA, 15 bp, Homo sapiens
gctttgtctcagaaa

SEQ ID NO: 51447 - DNA, 15 bp, Homo sapiens
ctttgtctcagaaat

SEQ ID NO: 51448 - DNA, 15 bp, Homo sapiens
tttgtctcagaaatt

SEQ ID NO: 51449 - DNA, 15 bp, Homo sapiens
ttgtctcagaaattg

SEQ ID NO: 51450 - DNA, 15 bp, Homo sapiens
tgtctcagaaattgt

SEQ ID NO: 51451 - DNA, 15 bp, Homo sapiens
gtctcagaaattgtg

SEQ ID NO: 51452 - DNA, 15 bp, Homo sapiens
tctcagaaattgtgt

SEQ ID NO: 51453 - DNA, 15 bp, Homo sapiens
ctcagaaattgtgtg

SEQ ID NO: 51454 - DNA, 15 bp, Homo sapiens
tcagaaattgtgtgg

SEQ ID NO: 51455 - DNA, 15 bp, Homo sapiens
cagaaattgtgtgga

SEQ ID NO: 51456 - DNA, 15 bp, Homo sapiens
agaaattgtgtggac

SEQ ID NO: 51457 - DNA, 15 bp, Homo sapiens
gaaattgtgtggact

SEQ ID NO: 51458 - DNA, 15 bp, Homo sapiens
aaattgtgtggacta

SEQ ID NO: 51459 - DNA, 15 bp, Homo sapiens
aattgtgtggactaa

SEQ ID NO: 51460 - DNA, 15 bp, Homo sapiens
attgtgtggactaaa

SEQ ID NO: 51461 - DNA, 15 bp, Homo sapiens
ttgtgtggactaaat

SEQ ID NO: 51462 - DNA, 15 bp, Homo sapiens
tgtgtggactaaatg

SEQ ID NO: 51463 - DNA, 15 bp, Homo sapiens
gtgtggactaaatgt

SEQ ID NO: 51464 - DNA, 15 bp, Homo sapiens
tgtggactaaatgta

SEQ ID NO: 51465 - DNA, 15 bp, Homo sapiens
gtggactaaatgtaa

SEQ ID NO: 51466 - DNA, 15 bp, Homo sapiens
tggactaaatgtaat

SEQ ID NO: 51467 - DNA, 15 bp, Homo sapiens
ggactaaatgtaata

SEQ ID NO: 51468 - DNA, 15 bp, Homo sapiens
gactaaatgtaatat

SEQ ID NO: 51469 - DNA, 15 bp, Homo sapiens
actaaatgtaatatg

SEQ ID NO: 51470 - DNA, 15 bp, Homo sapiens
ctaaatgtaatatgg

SEQ ID NO: 51471 - DNA, 15 bp, Homo sapiens
taaatgtaatatggg

SEQ ID NO: 51472 - DNA, 15 bp, Homo sapiens
aaatgtaatatgggc

SEQ ID NO: 51473 - DNA, 15 bp, Homo sapiens
aatgtaatatgggca

SEQ ID NO: 51474 - DNA, 15 bp, Homo sapiens
atgtaatatgggcag

SEQ ID NO: 51475 - DNA, 15 bp, Homo sapiens
tgtaatatgggcagt

SEQ ID NO: 51476 - DNA, 15 bp, Homo sapiens
gtaatatgggcagtg

SEQ ID NO: 51477 - DNA, 15 bp, Homo sapiens
taatatgggcagtga

SEQ ID NO: 51478 - DNA, 15 bp, Homo sapiens
aatatgggcagtgaa

SEQ ID NO: 51479 - DNA, 15 bp, Homo sapiens
atatgggcagtgaat

SEQ ID NO: 51480 - DNA, 15 bp, Homo sapiens
tatgggcagtgaatg

SEQ ID NO: 51481 - DNA, 15 bp, Homo sapiens
atgggcagtgaatgg

SEQ ID NO: 51482 - DNA, 15 bp, Homo sapiens
tgggcagtgaatggg

SEQ ID NO: 51483 - DNA, 15 bp, Homo sapiens
gggcagtgaatgggt

SEQ ID NO: 51484 - DNA, 15 bp, Homo sapiens
ggcagtgaatgggtt

SEQ ID NO: 51485 - DNA, 15 bp, Homo sapiens
gcagtgaatgggttt

SEQ ID NO: 51486 - DNA, 15 bp, Homo sapiens
cagtgaatgggtttc

SEQ ID NO: 51487 - DNA, 15 bp, Homo sapiens
agtgaatgggtttct

SEQ ID NO: 51488 - DNA, 15 bp, Homo sapiens
gtgaatgggtttctt

SEQ ID NO: 51489 - DNA, 15 bp, Homo sapiens
tgaatgggtttcttc

SEQ ID NO: 51490 - DNA, 15 bp, Homo sapiens
gaatgggtttcttct

SEQ ID NO: 51491 - DNA, 15 bp, Homo sapiens
aatgggtttcttctg

SEQ ID NO: 51492 - DNA, 15 bp, Homo sapiens
atgggtttcttctgg

SEQ ID NO: 51493 - DNA, 15 bp, Homo sapiens
tgggtttcttctgga

SEQ ID NO: 51494 - DNA, 15 bp, Homo sapiens
gggtttcttctggaa

SEQ ID NO: 51495 - DNA, 15 bp, Homo sapiens
ggtttcttctggaag

SEQ ID NO: 51496 - DNA, 15 bp, Homo sapiens
gtttcttctggaaga

SEQ ID NO: 51497 - DNA, 15 bp, Homo sapiens
tttcttctggaagat

SEQ ID NO: 51498 - DNA, 15 bp, Homo sapiens
ttcttctggaagatg

SEQ ID NO: 51499 - DNA, 15 bp, Homo sapiens
tcttctggaagatgt

SEQ ID NO: 51500 - DNA, 15 bp, Homo sapiens
cttctggaagatgtt

SEQ ID NO: 51501 - DNA, 15 bp, Homo sapiens
ttctggaagatgtta

SEQ ID NO: 51502 - DNA, 15 bp, Homo sapiens
tctggaagatgttag

SEQ ID NO: 51503 - DNA, 15 bp, Homo sapiens
ctggaagatgttagg

SEQ ID NO: 51504 - DNA, 15 bp, Homo sapiens
tggaagatgttaggc

SEQ ID NO: 51505 - DNA, 15 bp, Homo sapiens
ggaagatgttaggcc

SEQ ID NO: 51506 - DNA, 15 bp, Homo sapiens
gaagatgttaggcct

SEQ ID NO: 51507 - DNA, 15 bp, Homo sapiens
aagatgttaggcctg

SEQ ID NO: 51508 - DNA, 15 bp, Homo sapiens
agatgttaggcctgg

SEQ ID NO: 51509 - DNA, 15 bp, Homo sapiens
gatgttaggcctgga

SEQ ID NO: 51510 - DNA, 15 bp, Homo sapiens
atgttaggcctggag

SEQ ID NO: 51511 - DNA, 15 bp, Homo sapiens
tgttaggcctggagg

SEQ ID NO: 51512 - DNA, 15 bp, Homo sapiens
gttaggcctggaggg

SEQ ID NO: 51513 - DNA, 15 bp, Homo sapiens
ttaggcctggagggt

SEQ ID NO: 51514 - DNA, 15 bp, Homo sapiens
taggcctggagggtg

SEQ ID NO: 51515 - DNA, 15 bp, Homo sapiens
aggcctggagggtgg

SEQ ID NO: 51516 - DNA, 15 bp, Homo sapiens
ggcctggagggtggt

SEQ ID NO: 51517 - DNA, 15 bp, Homo sapiens
gcctggagggtggtt

SEQ ID NO: 51518 - DNA, 15 bp, Homo sapiens
cctggagggtggttt

SEQ ID NO: 51519 - DNA, 15 bp, Homo sapiens
ctggagggtggtttg

SEQ ID NO: 51520 - DNA, 15 bp, Homo sapiens
tggagggtggtttgg

SEQ ID NO: 51521 - DNA, 15 bp, Homo sapiens
ggagggtggtttggg

SEQ ID NO: 51522 - DNA, 15 bp, Homo sapiens
gagggtggtttgggt

SEQ ID NO: 51523 - DNA, 15 bp, Homo sapiens
agggtggtttgggtt

SEQ ID NO: 51524 - DNA, 15 bp, Homo sapiens
gggtggtttgggttt

SEQ ID NO: 51525 - DNA, 15 bp, Homo sapiens
ggtggtttgggtttt

SEQ ID NO: 51526 - DNA, 15 bp, Homo sapiens
gtggtttgggttttt

SEQ ID NO: 51527 - DNA, 15 bp, Homo sapiens
tggtttgggttttta

SEQ ID NO: 51528 - DNA, 15 bp, Homo sapiens
ggtttgggtttttac

SEQ ID NO: 51529 - DNA, 15 bp, Homo sapiens
gtttgggtttttacg

SEQ ID NO: 51530 - DNA, 15 bp, Homo sapiens
tttgggtttttacga

SEQ ID NO: 51531 - DNA, 15 bp, Homo sapiens
ttgggtttttacgag

SEQ ID NO: 51532 - DNA, 15 bp, Homo sapiens
tgggtttttacgagt

SEQ ID NO: 51533 - DNA, 15 bp, Homo sapiens
gggtttttacgagtc

SEQ ID NO: 51534 - DNA, 15 bp, Homo sapiens
ggtttttacgagtct

SEQ ID NO: 51535 - DNA, 15 bp, Homo sapiens
gtttttacgagtctt

SEQ ID NO: 51536 - DNA, 15 bp, Homo sapiens
tttttacgagtcttt

SEQ ID NO: 51537 - DNA, 15 bp, Homo sapiens
ttttacgagtctttt

SEQ ID NO: 51538 - DNA, 15 bp, Homo sapiens
tttacgagtcttttt

SEQ ID NO: 51539 - DNA, 15 bp, Homo sapiens
ttacgagtctttttc

SEQ ID NO: 51540 - DNA, 15 bp, Homo sapiens
tacgagtctttttct

SEQ ID NO: 51541 - DNA, 15 bp, Homo sapiens
acgagtctttttctc

SEQ ID NO: 51542 - DNA, 15 bp, Homo sapiens
cgagtctttttctca

SEQ ID NO: 51543 - DNA, 15 bp, Homo sapiens
gagtctttttctcag

SEQ ID NO: 51544 - DNA, 15 bp, Homo sapiens
agtctttttctcaga

SEQ ID NO: 51545 - DNA, 15 bp, Homo sapiens
gtctttttctcagat

SEQ ID NO: 51546 - DNA, 15 bp, Homo sapiens
tctttttctcagatt

SEQ ID NO: 51547 - DNA, 15 bp, Homo sapiens
ctttttctcagatta

SEQ ID NO: 51548 - DNA, 15 bp, Homo sapiens
tttttctcagattac

SEQ ID NO: 51549 - DNA, 15 bp, Homo sapiens
ttttctcagattaca

SEQ ID NO: 51550 - DNA, 15 bp, Homo sapiens
tttctcagattacag

SEQ ID NO: 51551 - DNA, 15 bp, Homo sapiens
ttctcagattacaga

SEQ ID NO: 51552 - DNA, 15 bp, Homo sapiens
tctcagattacagat

SEQ ID NO: 51553 - DNA, 15 bp, Homo sapiens
ctcagattacagatt

SEQ ID NO: 51554 - DNA, 15 bp, Homo sapiens
tcagattacagatta

SEQ ID NO: 51555 - DNA, 15 bp, Homo sapiens
cagattacagattac

SEQ ID NO: 51556 - DNA, 15 bp, Homo sapiens
agattacagattacg

SEQ ID NO: 51557 - DNA, 15 bp, Homo sapiens
gattacagattacga

SEQ ID NO: 51558 - DNA, 15 bp, Homo sapiens
attacagattacgaa

SEQ ID NO: 51559 - DNA, 15 bp, Homo sapiens
ttacagattacgaat

SEQ ID NO: 51560 - DNA, 15 bp, Homo sapiens
tacagattacgaatg

SEQ ID NO: 51561 - DNA, 15 bp, Homo sapiens
acagattacgaatgg

SEQ ID NO: 51562 - DNA, 15 bp, Homo sapiens
cagattacgaatgga

SEQ ID NO: 51563 - DNA, 15 bp, Homo sapiens
agattacgaatggat

SEQ ID NO: 51564 - DNA, 15 bp, Homo sapiens
gattacgaatggatg

SEQ ID NO: 51565 - DNA, 15 bp, Homo sapiens
attacgaatggatgt

SEQ ID NO: 51566 - DNA, 15 bp, Homo sapiens
ttacgaatggatgtt

SEQ ID NO: 51567 - DNA, 15 bp, Homo sapiens
tacgaatggatgtta

SEQ ID NO: 51568 - DNA, 15 bp, Homo sapiens
acgaatggatgttat

SEQ ID NO: 51569 - DNA, 15 bp, Homo sapiens
cgaatggatgttata

SEQ ID NO: 51570 - DNA, 15 bp, Homo sapiens
gaatggatgttataa

SEQ ID NO: 51571 - DNA, 15 bp, Homo sapiens
aatggatgttataaa

SEQ ID NO: 51572 - DNA, 15 bp, Homo sapiens
ttgcaaaactgaaat

SEQ ID NO: 51573 - DNA, 15 bp, Homo sapiens
tgcaaaactgaaatt

SEQ ID NO: 51574 - DNA, 15 bp, Homo sapiens
gcaaaactgaaattt

SEQ ID NO: 51575 - DNA, 15 bp, Homo sapiens
caaaactgaaatttc

SEQ ID NO: 51576 - DNA, 15 bp, Homo sapiens
aaaactgaaatttca

SEQ ID NO: 51577 - DNA, 15 bp, Homo sapiens
aaactgaaatttcat

SEQ ID NO: 51578 - DNA, 15 bp, Homo sapiens
aactgaaatttcata

SEQ ID NO: 51579 - DNA, 15 bp, Homo sapiens
actgaaatttcatac

SEQ ID NO: 51580 - DNA, 15 bp, Homo sapiens
ctgaaatttcatacc

SEQ ID NO: 51581 - DNA, 15 bp, Homo sapiens
tgaaatttcatacct

SEQ ID NO: 51582 - DNA, 15 bp, Homo sapiens
gaaatttcataccta

SEQ ID NO: 51583 - DNA, 15 bp, Homo sapiens
aaatttcatacctat

SEQ ID NO: 51584 - DNA, 15 bp, Homo sapiens
aatttcatacctatt

SEQ ID NO: 51585 - DNA, 15 bp, Homo sapiens
atttcatacctatta

SEQ ID NO: 51586 - DNA, 15 bp, Homo sapiens
tttcatacctattaa

SEQ ID NO: 51587 - DNA, 15 bp, Homo sapiens
ttcatacctattaaa

SEQ ID NO: 51588 - DNA, 15 bp, Homo sapiens
tcatacctattaaac

SEQ ID NO: 51589 - DNA, 15 bp, Homo sapiens
catacctattaaaca

SEQ ID NO: 51590 - DNA, 15 bp, Homo sapiens
atacctattaaacac

SEQ ID NO: 51591 - DNA, 15 bp, Homo sapiens
tacctattaaacact

SEQ ID NO: 51592 - DNA, 15 bp, Homo sapiens
acctattaaacacta

SEQ ID NO: 51593 - DNA, 15 bp, Homo sapiens
cctattaaacactaa

SEQ ID NO: 51594 - DNA, 15 bp, Homo sapiens
ctattaaacactaac

SEQ ID NO: 51595 - DNA, 15 bp, Homo sapiens
tattaaacactaact

SEQ ID NO: 51596 - DNA, 15 bp, Homo sapiens
attaaacactaactc

SEQ ID NO: 51597 - DNA, 15 bp, Homo sapiens
ttaaacactaactcc

SEQ ID NO: 51598 - DNA, 15 bp, Homo sapiens
taaacactaactccc

SEQ ID NO: 51599 - DNA, 15 bp, Homo sapiens
aaacactaactccca

SEQ ID NO: 51600 - DNA, 15 bp, Homo sapiens
aacactaactcccac

SEQ ID NO: 51601 - DNA, 15 bp, Homo sapiens
acactaactcccact

SEQ ID NO: 51602 - DNA, 15 bp, Homo sapiens
cactaactcccactt

SEQ ID NO: 51603 - DNA, 15 bp, Homo sapiens
actaactcccacttc

SEQ ID NO: 51604 - DNA, 15 bp, Homo sapiens
ctaactcccacttct

SEQ ID NO: 51605 - DNA, 15 bp, Homo sapiens
taactcccacttctc

SEQ ID NO: 51606 - DNA, 15 bp, Homo sapiens
aactcccacttctcc

SEQ ID NO: 51607 - DNA, 15 bp, Homo sapiens
actcccacttctccc

SEQ ID NO: 51608 - DNA, 15 bp, Homo sapiens
ctcccacttctcccc

SEQ ID NO: 51609 - DNA, 15 bp, Homo sapiens
tcccacttctcccct

SEQ ID NO: 51610 - DNA, 15 bp, Homo sapiens
cccacttctcccctt

SEQ ID NO: 51611 - DNA, 15 bp, Homo sapiens
ccacttctccccttt

SEQ ID NO: 51612 - DNA, 15 bp, Homo sapiens
cacttctcccctttc

SEQ ID NO: 51613 - DNA, 15 bp, Homo sapiens
acttctcccctttcc

SEQ ID NO: 51614 - DNA, 15 bp, Homo sapiens
cttctcccctttccc

SEQ ID NO: 51615 - DNA, 15 bp, Homo sapiens
ttctcccctttcccc

SEQ ID NO: 51616 - DNA, 15 bp, Homo sapiens
tctcccctttccccc

SEQ ID NO: 51617 - DNA, 15 bp, Homo sapiens
ctcccctttccccca

SEQ ID NO: 51618 - DNA, 15 bp, Homo sapiens
tcccctttcccccac

SEQ ID NO: 51619 - DNA, 15 bp, Homo sapiens
cccctttcccccacc

SEQ ID NO: 51620 - DNA, 15 bp, Homo sapiens
ccctttcccccaccc

SEQ ID NO: 51621 - DNA, 15 bp, Homo sapiens
cctttcccccacccc

SEQ ID NO: 51622 - DNA, 15 bp, Homo sapiens
ctttcccccacccca

SEQ ID NO: 51623 - DNA, 15 bp, Homo sapiens
tttcccccaccccac

SEQ ID NO: 51624 - DNA, 15 bp, Homo sapiens
ttcccccaccccacc

SEQ ID NO: 51625 - DNA, 15 bp, Homo sapiens
tcccccaccccaccc

SEQ ID NO: 51626 - DNA, 15 bp, Homo sapiens
cccccaccccaccct

SEQ ID NO: 51627 - DNA, 15 bp, Homo sapiens
ccccaccccaccctc

SEQ ID NO: 51628 - DNA, 15 bp, Homo sapiens
cccaccccaccctct

SEQ ID NO: 51629 - DNA, 15 bp, Homo sapiens
ccaccccaccctctg

SEQ ID NO: 51630 - DNA, 15 bp, Homo sapiens
caccccaccctctgg

SEQ ID NO: 51631 - DNA, 15 bp, Homo sapiens
accccaccctctggc

SEQ ID NO: 51632 - DNA, 15 bp, Homo sapiens
ccccaccctctggca

SEQ ID NO: 51633 - DNA, 15 bp, Homo sapiens
cccaccctctggcaa

SEQ ID NO: 51634 - DNA, 15 bp, Homo sapiens
ccaccctctggcaac

SEQ ID NO: 51635 - DNA, 15 bp, Homo sapiens
caccctctggcaact

SEQ ID NO: 51636 - DNA, 15 bp, Homo sapiens
accctctggcaacta

SEQ ID NO: 51637 - DNA, 15 bp, Homo sapiens
ccctctggcaactac

SEQ ID NO: 51638 - DNA, 15 bp, Homo sapiens
cctctggcaactact

SEQ ID NO: 51639 - DNA, 15 bp, Homo sapiens
ctctggcaactacta

SEQ ID NO: 51640 - DNA, 15 bp, Homo sapiens
tctggcaactactat

SEQ ID NO: 51641 - DNA, 15 bp, Homo sapiens
ctggcaactactatt

SEQ ID NO: 51642 - DNA, 15 bp, Homo sapiens
tggcaactactattc

SEQ ID NO: 51643 - DNA, 15 bp, Homo sapiens
ggcaactactattct

SEQ ID NO: 51644 - DNA, 15 bp, Homo sapiens
gcaactactattcta

SEQ ID NO: 51645 - DNA, 15 bp, Homo sapiens
caactactattctac

SEQ ID NO: 51646 - DNA, 15 bp, Homo sapiens
aactactattctact

SEQ ID NO: 51647 - DNA, 15 bp, Homo sapiens
actactattctactc

SEQ ID NO: 51648 - DNA, 15 bp, Homo sapiens
ctactattctactct

SEQ ID NO: 51649 - DNA, 15 bp, Homo sapiens
tactattctactctt

SEQ ID NO: 51650 - DNA, 15 bp, Homo sapiens
actattctactcttt

SEQ ID NO: 51651 - DNA, 15 bp, Homo sapiens
ctattctactctttg

SEQ ID NO: 51652 - DNA, 15 bp, Homo sapiens
tattctactctttgt

SEQ ID NO: 51653 - DNA, 15 bp, Homo sapiens
attctactctttgtc

SEQ ID NO: 51654 - DNA, 15 bp, Homo sapiens
ttctactctttgtct

SEQ ID NO: 51655 - DNA, 15 bp, Homo sapiens
tctactctttgtctc

SEQ ID NO: 51656 - DNA, 15 bp, Homo sapiens
ctactctttgtctct

SEQ ID NO: 51657 - DNA, 15 bp, Homo sapiens
tactctttgtctcta

SEQ ID NO: 51658 - DNA, 15 bp, Homo sapiens
actctttgtctctat

SEQ ID NO: 51659 - DNA, 15 bp, Homo sapiens
ctctttgtctctatt

SEQ ID NO: 51660 - DNA, 15 bp, Homo sapiens
ctttgtctctattgg

SEQ ID NO: 51661 - DNA, 15 bp, Homo sapiens
tttgtctctattgga

SEQ ID NO: 51662 - DNA, 15 bp, Homo sapiens
ttgtctctattggac

SEQ ID NO: 51663 - DNA, 15 bp, Homo sapiens
tgtctctattggaca

SEQ ID NO: 51664 - DNA, 15 bp, Homo sapiens
gtctctattggacat

SEQ ID NO: 51665 - DNA, 15 bp, Homo sapiens
tctctattggacata

SEQ ID NO: 51666 - DNA, 15 bp, Homo sapiens
ctctattggacatat

SEQ ID NO: 51667 - DNA, 15 bp, Homo sapiens
tctattggacatatt

SEQ ID NO: 51668 - DNA, 15 bp, Homo sapiens
ctattggacatattt

SEQ ID NO: 51669 - DNA, 15 bp, Homo sapiens
tattggacatatttt

SEQ ID NO: 51670 - DNA, 15 bp, Homo sapiens
attggacatattttt

SEQ ID NO: 51671 - DNA, 15 bp, Homo sapiens
ttggacatatttttg

SEQ ID NO: 51672 - DNA, 15 bp, Homo sapiens
tggacatatttttgt

SEQ ID NO: 51673 - DNA, 15 bp, Homo sapiens
ggacatatttttgtg

SEQ ID NO: 51674 - DNA, 15 bp, Homo sapiens
gacatatttttgtgt

SEQ ID NO: 51675 - DNA, 15 bp, Homo sapiens
acatatttttgtgtg

SEQ ID NO: 51676 - DNA, 15 bp, Homo sapiens
catatttttgtgtgt

SEQ ID NO: 51677 - DNA, 15 bp, Homo sapiens
atatttttgtgtgtt

SEQ ID NO: 51678 - DNA, 15 bp, Homo sapiens
tatttttgtgtgttt

SEQ ID NO: 51679 - DNA, 15 bp, Homo sapiens
atttttgtgtgttta

SEQ ID NO: 51680 - DNA, 15 bp, Homo sapiens
tttttgtgtgtttag

SEQ ID NO: 51681 - DNA, 15 bp, Homo sapiens
ttttgtgtgtttagg

SEQ ID NO: 51682 - DNA, 15 bp, Homo sapiens
tttgtgtgtttaggt

SEQ ID NO: 51683 - DNA, 15 bp, Homo sapiens
ttgtgtgtttaggtt

SEQ ID NO: 51684 - DNA, 15 bp, Homo sapiens
tgtgtgtttaggttt

SEQ ID NO: 51685 - DNA, 15 bp, Homo sapiens
gtgtgtttaggtttg

SEQ ID NO: 51686 - DNA, 15 bp, Homo sapiens
tgtgtttaggtttgt

SEQ ID NO: 51687 - DNA, 15 bp, Homo sapiens
gtgtttaggtttgtg

SEQ ID NO: 51688 - DNA, 15 bp, Homo sapiens
tgtttaggtttgtgt

SEQ ID NO: 51689 - DNA, 15 bp, Homo sapiens
gtttaggtttgtgta

SEQ ID NO: 51690 - DNA, 15 bp, Homo sapiens
tttaggtttgtgtat

SEQ ID NO: 51691 - DNA, 15 bp, Homo sapiens
ttaggtttgtgtata

SEQ ID NO: 51692 - DNA, 15 bp, Homo sapiens
taggtttgtgtatat

SEQ ID NO: 51693 - DNA, 15 bp, Homo sapiens
aggtttgtgtatata

SEQ ID NO: 51694 - DNA, 15 bp, Homo sapiens
ggtttgtgtatatat

SEQ ID NO: 51695 - DNA, 15 bp, Homo sapiens
gtttgtgtatatatt

SEQ ID NO: 51696 - DNA, 15 bp, Homo sapiens
tttgtgtatatattt

SEQ ID NO: 51697 - DNA, 15 bp, Homo sapiens
ttgtgtatatatttt

SEQ ID NO: 51698 - DNA, 15 bp, Homo sapiens
tgtgtatatatttta

SEQ ID NO: 51699 - DNA, 15 bp, Homo sapiens
gtgtatatattttac

SEQ ID NO: 51700 - DNA, 15 bp, Homo sapiens
tgtatatattttaca

SEQ ID NO: 51701 - DNA, 15 bp, Homo sapiens
gtatatattttacat

SEQ ID NO: 51702 - DNA, 15 bp, Homo sapiens
tatatattttacatg

SEQ ID NO: 51703 - DNA, 15 bp, Homo sapiens
atatattttacatgt

SEQ ID NO: 51704 - DNA, 15 bp, Homo sapiens
tatattttacatgtg

SEQ ID NO: 51705 - DNA, 15 bp, Homo sapiens
atattttacatgtgt

SEQ ID NO: 51706 - DNA, 15 bp, Homo sapiens
tattttacatgtgtg

SEQ ID NO: 51707 - DNA, 15 bp, Homo sapiens
attttacatgtgtgt

SEQ ID NO: 51708 - DNA, 15 bp, Homo sapiens
ttttacatgtgtgta

SEQ ID NO: 51709 - DNA, 15 bp, Homo sapiens
tttacatgtgtgtat

SEQ ID NO: 51710 - DNA, 15 bp, Homo sapiens
ttacatgtgtgtata

SEQ ID NO: 51711 - DNA, 15 bp, Homo sapiens
tacatgtgtgtataa

SEQ ID NO: 51712 - DNA, 15 bp, Homo sapiens
acatgtgtgtataaa

SEQ ID NO: 51713 - DNA, 15 bp, Homo sapiens
catgtgtgtataaat

SEQ ID NO: 51714 - DNA, 15 bp, Homo sapiens
atgtgtgtataaata

SEQ ID NO: 51715 - DNA, 15 bp, Homo sapiens
tgtgtgtataaatac

SEQ ID NO: 51716 - DNA, 15 bp, Homo sapiens
gtgtgtataaataca

SEQ ID NO: 51717 - DNA, 15 bp, Homo sapiens
tgtgtataaatacac

SEQ ID NO: 51718 - DNA, 15 bp, Homo sapiens
gtgtataaatacaca

SEQ ID NO: 51719 - DNA, 15 bp, Homo sapiens
tgtataaatacacaa

SEQ ID NO: 51720 - DNA, 15 bp, Homo sapiens
gtataaatacacaag

SEQ ID NO: 51721 - DNA, 15 bp, Homo sapiens
tataaatacacaagg

SEQ ID NO: 51722 - DNA, 15 bp, Homo sapiens
ataaatacacaaggg

SEQ ID NO: 51723 - DNA, 15 bp, Homo sapiens
taaatacacaagggt

SEQ ID NO: 51724 - DNA, 15 bp, Homo sapiens
aaatacacaagggta

SEQ ID NO: 51725 - DNA, 15 bp, Homo sapiens
aatacacaagggtat

SEQ ID NO: 51726 - DNA, 15 bp, Homo sapiens
atacacaagggtatg

SEQ ID NO: 51727 - DNA, 15 bp, Homo sapiens
tacacaagggtatgt

SEQ ID NO: 51728 - DNA, 15 bp, Homo sapiens
acacaagggtatgtg

SEQ ID NO: 51729 - DNA, 15 bp, Homo sapiens
cacaagggtatgtgg

SEQ ID NO: 51730 - DNA, 15 bp, Homo sapiens
acaagggtatgtggg

SEQ ID NO: 51731 - DNA, 15 bp, Homo sapiens
caagggtatgtgggc

SEQ ID NO: 51732 - DNA, 15 bp, Homo sapiens
aagggtatgtgggcg

SEQ ID NO: 51733 - DNA, 15 bp, Homo sapiens
agggtatgtgggcgt

SEQ ID NO: 51734 - DNA, 15 bp, Homo sapiens
gggtatgtgggcgtt

SEQ ID NO: 51735 - DNA, 15 bp, Homo sapiens
ggtatgtgggcgttg

SEQ ID NO: 51736 - DNA, 15 bp, Homo sapiens
gtatgtgggcgttgt

SEQ ID NO: 51737 - DNA, 15 bp, Homo sapiens
tatgtgggcgttgtg

SEQ ID NO: 51738 - DNA, 15 bp, Homo sapiens
atgtgggcgttgtgt

SEQ ID NO: 51739 - DNA, 15 bp, Homo sapiens
tgtgggcgttgtgtt

SEQ ID NO: 51740 - DNA, 15 bp, Homo sapiens
gtgggcgttgtgttt

SEQ ID NO: 51741 - DNA, 15 bp, Homo sapiens
tgggcgttgtgtttt

SEQ ID NO: 51742 - DNA, 15 bp, Homo sapiens
gggcgttgtgttttt

SEQ ID NO: 51743 - DNA, 15 bp, Homo sapiens
ggcgttgtgttttta

SEQ ID NO: 51744 - DNA, 15 bp, Homo sapiens
gcgttgtgtttttac

SEQ ID NO: 51745 - DNA, 15 bp, Homo sapiens
cgttgtgtttttaca

SEQ ID NO: 51746 - DNA, 15 bp, Homo sapiens
gttgtgtttttacac

SEQ ID NO: 51747 - DNA, 15 bp, Homo sapiens
ttgtgtttttacaca

SEQ ID NO: 51748 - DNA, 15 bp, Homo sapiens
tgtgtttttacacat

SEQ ID NO: 51749 - DNA, 15 bp, Homo sapiens
gtgtttttacacata

SEQ ID NO: 51750 - DNA, 15 bp, Homo sapiens
tgtttttacacatac

SEQ ID NO: 51751 - DNA, 15 bp, Homo sapiens
gtttttacacatact

SEQ ID NO: 51752 - DNA, 15 bp, Homo sapiens
tttttacacatacta

SEQ ID NO: 51753 - DNA, 15 bp, Homo sapiens
ttttacacatactat

SEQ ID NO: 51754 - DNA, 15 bp, Homo sapiens
tttacacatactata

SEQ ID NO: 51755 - DNA, 15 bp, Homo sapiens
ttacacatactataa

SEQ ID NO: 51756 - DNA, 15 bp, Homo sapiens
tacacatactataaa

SEQ ID NO: 51757 - DNA, 15 bp, Homo sapiens
acacatactataaaa

SEQ ID NO: 51758 - DNA, 15 bp, Homo sapiens
cacatactataaaat

SEQ ID NO: 51759 - DNA, 15 bp, Homo sapiens
acatactataaaata

SEQ ID NO: 51760 - DNA, 15 bp, Homo sapiens
catactataaaatat

SEQ ID NO: 51761 - DNA, 15 bp, Homo sapiens
atactataaaatatt

SEQ ID NO: 51762 - DNA, 15 bp, Homo sapiens
tactataaaatattg

SEQ ID NO: 51763 - DNA, 15 bp, Homo sapiens
actataaaatattgt

SEQ ID NO: 51764 - DNA, 15 bp, Homo sapiens
ctataaaatattgtg

SEQ ID NO: 51765 - DNA, 15 bp, Homo sapiens
tataaaatattgtgc

SEQ ID NO: 51766 - DNA, 15 bp, Homo sapiens
ataaaatattgtgca

SEQ ID NO: 51767 - DNA, 15 bp, Homo sapiens
taaaatattgtgcac

SEQ ID NO: 51768 - DNA, 15 bp, Homo sapiens
aaaatattgtgcaca

SEQ ID NO: 51769 - DNA, 15 bp, Homo sapiens
aaatattgtgcacat

SEQ ID NO: 51770 - DNA, 15 bp, Homo sapiens
aatattgtgcacatt

SEQ ID NO: 51771 - DNA, 15 bp, Homo sapiens
atattgtgcacattt

SEQ ID NO: 51772 - DNA, 15 bp, Homo sapiens
tattgtgcacatttg

SEQ ID NO: 51773 - DNA, 15 bp, Homo sapiens
attgtgcacatttgt

SEQ ID NO: 51774 - DNA, 15 bp, Homo sapiens
ttgtgcacatttgtt

SEQ ID NO: 51775 - DNA, 15 bp, Homo sapiens
tgtgcacatttgttt

SEQ ID NO: 51776 - DNA, 15 bp, Homo sapiens
gtgcacatttgttta

SEQ ID NO: 51777 - DNA, 15 bp, Homo sapiens
tgcacatttgtttat

SEQ ID NO: 51778 - DNA, 15 bp, Homo sapiens
gcacatttgtttatt

SEQ ID NO: 51779 - DNA, 15 bp, Homo sapiens
cacatttgtttattt

SEQ ID NO: 51780 - DNA, 15 bp, Homo sapiens
acatttgtttatttt

SEQ ID NO: 51781 - DNA, 15 bp, Homo sapiens
catttgtttatttta

SEQ ID NO: 51782 - DNA, 15 bp, Homo sapiens
atttgtttattttaa

SEQ ID NO: 51783 - DNA, 15 bp, Homo sapiens
tttgtttattttaat

SEQ ID NO: 51784 - DNA, 15 bp, Homo sapiens
ttgtttattttaatg

SEQ ID NO: 51785 - DNA, 15 bp, Homo sapiens
tgtttattttaatgt

SEQ ID NO: 51786 - DNA, 15 bp, Homo sapiens
gtttattttaatgta

SEQ ID NO: 51787 - DNA, 15 bp, Homo sapiens
tttattttaatgtat

SEQ ID NO: 51788 - DNA, 15 bp, Homo sapiens
ttattttaatgtatc

SEQ ID NO: 51789 - DNA, 15 bp, Homo sapiens
tattttaatgtatcc

SEQ ID NO: 51790 - DNA, 15 bp, Homo sapiens
attttaatgtatcct

SEQ ID NO: 51791 - DNA, 15 bp, Homo sapiens
ttttaatgtatcctg

SEQ ID NO: 51792 - DNA, 15 bp, Homo sapiens
tttaatgtatcctgt

SEQ ID NO: 51793 - DNA, 15 bp, Homo sapiens
ttaatgtatcctgta

SEQ ID NO: 51794 - DNA, 15 bp, Homo sapiens
taatgtatcctgtag

SEQ ID NO: 51795 - DNA, 15 bp, Homo sapiens
aatgtatcctgtaga

SEQ ID NO: 51796 - DNA, 15 bp, Homo sapiens
atgtatcctgtagat

SEQ ID NO: 51797 - DNA, 15 bp, Homo sapiens
tgtatcctgtagatt

SEQ ID NO: 51798 - DNA, 15 bp, Homo sapiens
gtatcctgtagatta

SEQ ID NO: 51799 - DNA, 15 bp, Homo sapiens
tatcctgtagattat

SEQ ID NO: 51800 - DNA, 15 bp, Homo sapiens
atcctgtagattatt

SEQ ID NO: 51801 - DNA, 15 bp, Homo sapiens
tcctgtagattattt

SEQ ID NO: 51802 - DNA, 15 bp, Homo sapiens
cctgtagattattta

SEQ ID NO: 51803 - DNA, 15 bp, Homo sapiens
ctgtagattatttag

SEQ ID NO: 51804 - DNA, 15 bp, Homo sapiens
tgtagattatttaga

SEQ ID NO: 51805 - DNA, 15 bp, Homo sapiens
gtagattatttagaa

SEQ ID NO: 51806 - DNA, 15 bp, Homo sapiens
tagattatttagaat

SEQ ID NO: 51807 - DNA, 15 bp, Homo sapiens
agattatttagaatc

SEQ ID NO: 51808 - DNA, 15 bp, Homo sapiens
gattatttagaatcg

SEQ ID NO: 51809 - DNA, 15 bp, Homo sapiens
attatttagaatcgg

SEQ ID NO: 51810 - DNA, 15 bp, Homo sapiens
ttatttagaatcggt

SEQ ID NO: 51811 - DNA, 15 bp, Homo sapiens
tatttagaatcggtt

SEQ ID NO: 51812 - DNA, 15 bp, Homo sapiens
atttagaatcggttc

SEQ ID NO: 51813 - DNA, 15 bp, Homo sapiens
tttagaatcggttca

SEQ ID NO: 51814 - DNA, 15 bp, Homo sapiens
ttagaatcggttcat

SEQ ID NO: 51815 - DNA, 15 bp, Homo sapiens
tagaatcggttcata

SEQ ID NO: 51816 - DNA, 15 bp, Homo sapiens
agaatcggttcatac

SEQ ID NO: 51817 - DNA, 15 bp, Homo sapiens
gaatcggttcataca

SEQ ID NO: 51818 - DNA, 15 bp, Homo sapiens
aatcggttcatacag

SEQ ID NO: 51819 - DNA, 15 bp, Homo sapiens
atcggttcatacaga

SEQ ID NO: 51820 - DNA, 15 bp, Homo sapiens
tcggttcatacagag

SEQ ID NO: 51821 - DNA, 15 bp, Homo sapiens
cggttcatacagagc

SEQ ID NO: 51822 - DNA, 15 bp, Homo sapiens
ggttcatacagagcc

SEQ ID NO: 51823 - DNA, 15 bp, Homo sapiens
gttcatacagagccg

SEQ ID NO: 51824 - DNA, 15 bp, Homo sapiens
ttcatacagagccgt

SEQ ID NO: 51825 - DNA, 15 bp, Homo sapiens
tcatacagagccgta

SEQ ID NO: 51826 - DNA, 15 bp, Homo sapiens
catacagagccgtat

SEQ ID NO: 51827 - DNA, 15 bp, Homo sapiens
atacagagccgtatc

SEQ ID NO: 51828 - DNA, 15 bp, Homo sapiens
tacagagccgtatca

SEQ ID NO: 51829 - DNA, 15 bp, Homo sapiens
acagagccgtatcat

SEQ ID NO: 51830 - DNA, 15 bp, Homo sapiens
cagagccgtatcatt

SEQ ID NO: 51831 - DNA, 15 bp, Homo sapiens
agagccgtatcattc

SEQ ID NO: 51832 - DNA, 15 bp, Homo sapiens
gagccgtatcattcc

SEQ ID NO: 51833 - DNA, 15 bp, Homo sapiens
agccgtatcattcct

SEQ ID NO: 51834 - DNA, 15 bp, Homo sapiens
gccgtatcattcctt

SEQ ID NO: 51835 - DNA, 15 bp, Homo sapiens
ccgtatcattccttt

SEQ ID NO: 51836 - DNA, 15 bp, Homo sapiens
cgtatcattcctttt

SEQ ID NO: 51837 - DNA, 15 bp, Homo sapiens
gtatcattcctttta

SEQ ID NO: 51838 - DNA, 15 bp, Homo sapiens
tatcattccttttaa

SEQ ID NO: 51839 - DNA, 15 bp, Homo sapiens
atcattccttttaag

SEQ ID NO: 51840 - DNA, 15 bp, Homo sapiens
tcattccttttaagg

SEQ ID NO: 51841 - DNA, 15 bp, Homo sapiens
cattccttttaaggg

SEQ ID NO: 51842 - DNA, 15 bp, Homo sapiens
attccttttaagggt

SEQ ID NO: 51843 - DNA, 15 bp, Homo sapiens
ttccttttaagggtt

SEQ ID NO: 51844 - DNA, 15 bp, Homo sapiens
tccttttaagggttg

SEQ ID NO: 51845 - DNA, 15 bp, Homo sapiens
ccttttaagggttgg

SEQ ID NO: 51846 - DNA, 15 bp, Homo sapiens
cttttaagggttggg

SEQ ID NO: 51847 - DNA, 15 bp, Homo sapiens
ttttaagggttgggt

SEQ ID NO: 51848 - DNA, 15 bp, Homo sapiens
tttaagggttgggtt

SEQ ID NO: 51849 - DNA, 15 bp, Homo sapiens
ttaagggttgggttt

SEQ ID NO: 51850 - DNA, 15 bp, Homo sapiens
taagggttgggttta

SEQ ID NO: 51851 - DNA, 15 bp, Homo sapiens
aagggttgggtttaa

SEQ ID NO: 51852 - DNA, 15 bp, Homo sapiens
agggttgggtttaaa

SEQ ID NO: 51853 - DNA, 15 bp, Homo sapiens
gggttgggtttaaat

SEQ ID NO: 51854 - DNA, 15 bp, Homo sapiens
ggttgggtttaaata

SEQ ID NO: 51855 - DNA, 15 bp, Homo sapiens
gttgggtttaaatag

SEQ ID NO: 51856 - DNA, 15 bp, Homo sapiens
ttgggtttaaatagt

SEQ ID NO: 51857 - DNA, 15 bp, Homo sapiens
tgggtttaaatagtc

SEQ ID NO: 51858 - DNA, 15 bp, Homo sapiens
gggtttaaatagtct

SEQ ID NO: 51859 - DNA, 15 bp, Homo sapiens
ggtttaaatagtctg

SEQ ID NO: 51860 - DNA, 15 bp, Homo sapiens
gtttaaatagtctgt

SEQ ID NO: 51861 - DNA, 15 bp, Homo sapiens
tttaaatagtctgtt

SEQ ID NO: 51862 - DNA, 15 bp, Homo sapiens
ttaaatagtctgtta

SEQ ID NO: 51863 - DNA, 15 bp, Homo sapiens
taaatagtctgttat

SEQ ID NO: 51864 - DNA, 15 bp, Homo sapiens
aaatagtctgttatg

SEQ ID NO: 51865 - DNA, 15 bp, Homo sapiens
aatagtctgttatgg

SEQ ID NO: 51866 - DNA, 15 bp, Homo sapiens
atagtctgttatgga

SEQ ID NO: 51867 - DNA, 15 bp, Homo sapiens
tagtctgttatggat

SEQ ID NO: 51868 - DNA, 15 bp, Homo sapiens
agtctgttatggatg

SEQ ID NO: 51869 - DNA, 15 bp, Homo sapiens
gtctgttatggatgt

SEQ ID NO: 51870 - DNA, 15 bp, Homo sapiens
tctgttatggatgta

SEQ ID NO: 51871 - DNA, 15 bp, Homo sapiens
ctgttatggatgtac

SEQ ID NO: 51872 - DNA, 15 bp, Homo sapiens
tgttatggatgtacc

SEQ ID NO: 51873 - DNA, 15 bp, Homo sapiens
gttatggatgtacca

SEQ ID NO: 51874 - DNA, 15 bp, Homo sapiens
ttatggatgtaccac

SEQ ID NO: 51875 - DNA, 15 bp, Homo sapiens
tatggatgtaccaca

SEQ ID NO: 51876 - DNA, 15 bp, Homo sapiens
atggatgtaccacaa

SEQ ID NO: 51877 - DNA, 15 bp, Homo sapiens
tggatgtaccacaat

SEQ ID NO: 51878 - DNA, 15 bp, Homo sapiens
ggatgtaccacaatt

SEQ ID NO: 51879 - DNA, 15 bp, Homo sapiens
gatgtaccacaattt

SEQ ID NO: 51880 - DNA, 15 bp, Homo sapiens
atgtaccacaattta

SEQ ID NO: 51881 - DNA, 15 bp, Homo sapiens
tgtaccacaatttat

SEQ ID NO: 51882 - DNA, 15 bp, Homo sapiens
gtaccacaatttatt

SEQ ID NO: 51883 - DNA, 15 bp, Homo sapiens
taccacaatttattt

SEQ ID NO: 51884 - DNA, 15 bp, Homo sapiens
accacaatttattta

SEQ ID NO: 51885 - DNA, 15 bp, Homo sapiens
ccacaatttatttaa

SEQ ID NO: 51886 - DNA, 15 bp, Homo sapiens
cacaatttatttaac

SEQ ID NO: 51887 - DNA, 15 bp, Homo sapiens
acaatttatttaacc

SEQ ID NO: 51888 - DNA, 15 bp, Homo sapiens
caatttatttaacca

SEQ ID NO: 51889 - DNA, 15 bp, Homo sapiens
aatttatttaaccag

SEQ ID NO: 51890 - DNA, 15 bp, Homo sapiens
atttatttaaccagt

SEQ ID NO: 51891 - DNA, 15 bp, Homo sapiens
tttatttaaccagtt

SEQ ID NO: 51892 - DNA, 15 bp, Homo sapiens
ttatttaaccagttt

SEQ ID NO: 51893 - DNA, 15 bp, Homo sapiens
tatttaaccagtttt

SEQ ID NO: 51894 - DNA, 15 bp, Homo sapiens
atttaaccagttttt

SEQ ID NO: 51895 - DNA, 15 bp, Homo sapiens
tttaaccagttttta

SEQ ID NO: 51896 - DNA, 15 bp, Homo sapiens
ttaaccagtttttaa

SEQ ID NO: 51897 - DNA, 15 bp, Homo sapiens
taaccagtttttaaa

SEQ ID NO: 51898 - DNA, 15 bp, Homo sapiens
aaccagtttttaaat

SEQ ID NO: 51899 - DNA, 15 bp, Homo sapiens
accagtttttaaatt

SEQ ID NO: 51900 - DNA, 15 bp, Homo sapiens
ccagtttttaaattt

SEQ ID NO: 51901 - DNA, 15 bp, Homo sapiens
cagtttttaaatttt

SEQ ID NO: 51902 - DNA, 15 bp, Homo sapiens
agtttttaaattttt

SEQ ID NO: 51903 - DNA, 15 bp, Homo sapiens
gtttttaaatttttt

SEQ ID NO: 51904 - DNA, 15 bp, Homo sapiens
tttttaaatttttta

SEQ ID NO: 51905 - DNA, 15 bp, Homo sapiens
ttttaaattttttac

SEQ ID NO: 51906 - DNA, 15 bp, Homo sapiens
tttaaattttttact

SEQ ID NO: 51907 - DNA, 15 bp, Homo sapiens
ttaaattttttactt

SEQ ID NO: 51908 - DNA, 15 bp, Homo sapiens
taaattttttactta

SEQ ID NO: 51909 - DNA, 15 bp, Homo sapiens
aaattttttacttat

SEQ ID NO: 51910 - DNA, 15 bp, Homo sapiens
aattttttacttatt

SEQ ID NO: 51911 - DNA, 15 bp, Homo sapiens
attttttacttattt

SEQ ID NO: 51912 - DNA, 15 bp, Homo sapiens
ttttttacttatttt

SEQ ID NO: 51913 - DNA, 15 bp, Homo sapiens
tttttacttattttt

SEQ ID NO: 51914 - DNA, 15 bp, Homo sapiens
ttttacttatttttt

SEQ ID NO: 51915 - DNA, 15 bp, Homo sapiens
tttacttattttttt

SEQ ID NO: 51916 - DNA, 15 bp, Homo sapiens
ttacttatttttttt

SEQ ID NO: 51917 - DNA, 15 bp, Homo sapiens
tacttatttttttta

SEQ ID NO: 51918 - DNA, 15 bp, Homo sapiens
acttattttttttaa

SEQ ID NO: 51919 - DNA, 15 bp, Homo sapiens
cttattttttttaat

SEQ ID NO: 51920 - DNA, 15 bp, Homo sapiens
ttattttttttaatg

SEQ ID NO: 51921 - DNA, 15 bp, Homo sapiens
tattttttttaatgt

SEQ ID NO: 51922 - DNA, 15 bp, Homo sapiens
attttttttaatgtt

SEQ ID NO: 51923 - DNA, 15 bp, Homo sapiens
ttttttttaatgttt

SEQ ID NO: 51924 - DNA, 15 bp, Homo sapiens
tttttttaatgtttt

SEQ ID NO: 51925 - DNA, 15 bp, Homo sapiens
ttttttaatgttttt

SEQ ID NO: 51926 - DNA, 15 bp, Homo sapiens
tttttaatgtttttt

SEQ ID NO: 51927 - DNA, 15 bp, Homo sapiens
ttttaatgttttttt

SEQ ID NO: 51928 - DNA, 15 bp, Homo sapiens
tttaatgttttttta

SEQ ID NO: 51929 - DNA, 15 bp, Homo sapiens
ttaatgtttttttag

SEQ ID NO: 51930 - DNA, 15 bp, Homo sapiens
taatgtttttttaga

SEQ ID NO: 51931 - DNA, 15 bp, Homo sapiens
aatgtttttttagag

SEQ ID NO: 51932 - DNA, 15 bp, Homo sapiens
atgtttttttagaga

SEQ ID NO: 51933 - DNA, 15 bp, Homo sapiens
ttttttagagacagg

SEQ ID NO: 51934 - DNA, 15 bp, Homo sapiens
tttttagagacagga

SEQ ID NO: 51935 - DNA, 15 bp, Homo sapiens
ttttagagacaggat

SEQ ID NO: 51936 - DNA, 15 bp, Homo sapiens
tttagagacaggatc

SEQ ID NO: 51937 - DNA, 15 bp, Homo sapiens
ttagagacaggatcc

SEQ ID NO: 51938 - DNA, 15 bp, Homo sapiens
tagagacaggatccc

SEQ ID NO: 51939 - DNA, 15 bp, Homo sapiens
agagacaggatccca

SEQ ID NO: 51940 - DNA, 15 bp, Homo sapiens
gagacaggatcccac

SEQ ID NO: 51941 - DNA, 15 bp, Homo sapiens
agacaggatcccact

SEQ ID NO: 51942 - DNA, 15 bp, Homo sapiens
gacaggatcccactc

SEQ ID NO: 51943 - DNA, 15 bp, Homo sapiens
acaggatcccactcc

SEQ ID NO: 51944 - DNA, 15 bp, Homo sapiens
caggatcccactcca

SEQ ID NO: 51945 - DNA, 15 bp, Homo sapiens
aggatcccactccat

SEQ ID NO: 51946 - DNA, 15 bp, Homo sapiens
ggatcccactccatc

SEQ ID NO: 51947 - DNA, 15 bp, Homo sapiens
gatcccactccatca

SEQ ID NO: 51948 - DNA, 15 bp, Homo sapiens
atcccactccatcac

SEQ ID NO: 51949 - DNA, 15 bp, Homo sapiens
tcccactccatcacc

SEQ ID NO: 51950 - DNA, 15 bp, Homo sapiens
cccactccatcaccc

SEQ ID NO: 51951 - DNA, 15 bp, Homo sapiens
ccactccatcaccca

SEQ ID NO: 51952 - DNA, 15 bp, Homo sapiens
cactccatcacccag

SEQ ID NO: 51953 - DNA, 15 bp, Homo sapiens
actccatcacccaga

SEQ ID NO: 51954 - DNA, 15 bp, Homo sapiens
ctccatcacccagac

SEQ ID NO: 51955 - DNA, 15 bp, Homo sapiens
tccatcacccagact

SEQ ID NO: 51956 - DNA, 15 bp, Homo sapiens
ccatcacccagactg

SEQ ID NO: 51957 - DNA, 15 bp, Homo sapiens
catcacccagactgg

SEQ ID NO: 51958 - DNA, 15 bp, Homo sapiens
atcacccagactgga

SEQ ID NO: 51959 - DNA, 15 bp, Homo sapiens
tcacccagactggag

SEQ ID NO: 51960 - DNA, 15 bp, Homo sapiens
cacccagactggagt

SEQ ID NO: 51961 - DNA, 15 bp, Homo sapiens
acccagactggagtg

SEQ ID NO: 51962 - DNA, 15 bp, Homo sapiens
cccagactggagtgc

SEQ ID NO: 51963 - DNA, 15 bp, Homo sapiens
ccagactggagtgca

SEQ ID NO: 51964 - DNA, 15 bp, Homo sapiens
cagactggagtgcaa

SEQ ID NO: 51965 - DNA, 15 bp, Homo sapiens
agactggagtgcaac

SEQ ID NO: 51966 - DNA, 15 bp, Homo sapiens
gactggagtgcaaca

SEQ ID NO: 51967 - DNA, 15 bp, Homo sapiens
actggagtgcaacag

SEQ ID NO: 51968 - DNA, 15 bp, Homo sapiens
ctggagtgcaacagc

SEQ ID NO: 51969 - DNA, 15 bp, Homo sapiens
tggagtgcaacagca

SEQ ID NO: 51970 - DNA, 15 bp, Homo sapiens
ggagtgcaacagcat

SEQ ID NO: 51971 - DNA, 15 bp, Homo sapiens
gagtgcaacagcatg

SEQ ID NO: 51972 - DNA, 15 bp, Homo sapiens
agtgcaacagcatga

SEQ ID NO: 51973 - DNA, 15 bp, Homo sapiens
gtgcaacagcatgat

SEQ ID NO: 51974 - DNA, 15 bp, Homo sapiens
tgcaacagcatgatc

SEQ ID NO: 51975 - DNA, 15 bp, Homo sapiens
gcaacagcatgatca

SEQ ID NO: 51976 - DNA, 15 bp, Homo sapiens
caacagcatgatcat

SEQ ID NO: 51977 - DNA, 15 bp, Homo sapiens
aacagcatgatcata

SEQ ID NO: 51978 - DNA, 15 bp, Homo sapiens
acagcatgatcatag

SEQ ID NO: 51979 - DNA, 15 bp, Homo sapiens
cagcatgatcatagc

SEQ ID NO: 51980 - DNA, 15 bp, Homo sapiens
agcatgatcatagct

SEQ ID NO: 51981 - DNA, 15 bp, Homo sapiens
gcatgatcatagctt

SEQ ID NO: 51982 - DNA, 15 bp, Homo sapiens
catgatcatagctta

SEQ ID NO: 51983 - DNA, 15 bp, Homo sapiens
atgatcatagcttac

SEQ ID NO: 51984 - DNA, 15 bp, Homo sapiens
tgatcatagcttact

SEQ ID NO: 51985 - DNA, 15 bp, Homo sapiens
gatcatagcttactg

SEQ ID NO: 51986 - DNA, 15 bp, Homo sapiens
atcatagcttactgc

SEQ ID NO: 51987 - DNA, 15 bp, Homo sapiens
tcatagcttactgca

SEQ ID NO: 51988 - DNA, 15 bp, Homo sapiens
catagcttactgcag

SEQ ID NO: 51989 - DNA, 15 bp, Homo sapiens
atagcttactgcagc

SEQ ID NO: 51990 - DNA, 15 bp, Homo sapiens
tagcttactgcagcc

SEQ ID NO: 51991 - DNA, 15 bp, Homo sapiens
agcttactgcagcct

SEQ ID NO: 51992 - DNA, 15 bp, Homo sapiens
gcttactgcagcctt

SEQ ID NO: 51993 - DNA, 15 bp, Homo sapiens
cttactgcagccttg

SEQ ID NO: 51994 - DNA, 15 bp, Homo sapiens
ttactgcagccttga

SEQ ID NO: 51995 - DNA, 15 bp, Homo sapiens
tactgcagccttgaa

SEQ ID NO: 51996 - DNA, 15 bp, Homo sapiens
actgcagccttgaac

SEQ ID NO: 51997 - DNA, 15 bp, Homo sapiens
ctgcagccttgaact

SEQ ID NO: 51998 - DNA, 15 bp, Homo sapiens
tgcagccttgaactc

SEQ ID NO: 51999 - DNA, 15 bp, Homo sapiens
gcagccttgaactcc

SEQ ID NO: 52000 - DNA, 15 bp, Homo sapiens
cagccttgaactccg

SEQ ID NO: 52001 - DNA, 15 bp, Homo sapiens
agccttgaactccgg

SEQ ID NO: 52002 - DNA, 15 bp, Homo sapiens
gccttgaactccggg

SEQ ID NO: 52003 - DNA, 15 bp, Homo sapiens
ccttgaactccgggg

SEQ ID NO: 52004 - DNA, 15 bp, Homo sapiens
cttgaactccggggc

SEQ ID NO: 52005 - DNA, 15 bp, Homo sapiens
ttgaactccggggct

SEQ ID NO: 52006 - DNA, 15 bp, Homo sapiens
tgaactccggggctg

SEQ ID NO: 52007 - DNA, 15 bp, Homo sapiens
gaactccggggctga

SEQ ID NO: 52008 - DNA, 15 bp, Homo sapiens
aactccggggctgat

SEQ ID NO: 52009 - DNA, 15 bp, Homo sapiens
actccggggctgatg

SEQ ID NO: 52010 - DNA, 15 bp, Homo sapiens
ctccggggctgatgt

SEQ ID NO: 52011 - DNA, 15 bp, Homo sapiens
tccggggctgatgtg

SEQ ID NO: 52012 - DNA, 15 bp, Homo sapiens
ccggggctgatgtga

SEQ ID NO: 52013 - DNA, 15 bp, Homo sapiens
cggggctgatgtgat

SEQ ID NO: 52014 - DNA, 15 bp, Homo sapiens
ggggctgatgtgatc

SEQ ID NO: 52015 - DNA, 15 bp, Homo sapiens
gggctgatgtgatcc

SEQ ID NO: 52016 - DNA, 15 bp, Homo sapiens
ggctgatgtgatcct

SEQ ID NO: 52017 - DNA, 15 bp, Homo sapiens
gctgatgtgatcctc

SEQ ID NO: 52018 - DNA, 15 bp, Homo sapiens
ctgatgtgatcctcc

SEQ ID NO: 52019 - DNA, 15 bp, Homo sapiens
tgatgtgatcctccc

SEQ ID NO: 52020 - DNA, 15 bp, Homo sapiens
gatgtgatcctccca

SEQ ID NO: 52021 - DNA, 15 bp, Homo sapiens
atgtgatcctcccac

SEQ ID NO: 52022 - DNA, 15 bp, Homo sapiens
tgtgatcctcccacc

SEQ ID NO: 52023 - DNA, 15 bp, Homo sapiens
gatcctcccacctca

SEQ ID NO: 52024 - DNA, 15 bp, Homo sapiens
atcctcccacctcag

SEQ ID NO: 52025 - DNA, 15 bp, Homo sapiens
tcctcccacctcagg

SEQ ID NO: 52026 - DNA, 15 bp, Homo sapiens
cctcccacctcaggc

SEQ ID NO: 52027 - DNA, 15 bp, Homo sapiens
ctcccacctcaggct

SEQ ID NO: 52028 - DNA, 15 bp, Homo sapiens
tcccacctcaggctc

SEQ ID NO: 52029 - DNA, 15 bp, Homo sapiens
cccacctcaggctct

SEQ ID NO: 52030 - DNA, 15 bp, Homo sapiens
ccacctcaggctctc

SEQ ID NO: 52031 - DNA, 15 bp, Homo sapiens
cacctcaggctctct

SEQ ID NO: 52032 - DNA, 15 bp, Homo sapiens
acctcaggctctctt

SEQ ID NO: 52033 - DNA, 15 bp, Homo sapiens
cctcaggctctcttg

SEQ ID NO: 52034 - DNA, 15 bp, Homo sapiens
ctcaggctctcttgt

SEQ ID NO: 52035 - DNA, 15 bp, Homo sapiens
tcaggctctcttgta

SEQ ID NO: 52036 - DNA, 15 bp, Homo sapiens
caggctctcttgtag

SEQ ID NO: 52037 - DNA, 15 bp, Homo sapiens
aggctctcttgtagc

SEQ ID NO: 52038 - DNA, 15 bp, Homo sapiens
ggctctcttgtagct

SEQ ID NO: 52039 - DNA, 15 bp, Homo sapiens
gctctcttgtagctg

SEQ ID NO: 52040 - DNA, 15 bp, Homo sapiens
ctctcttgtagctgg

SEQ ID NO: 52041 - DNA, 15 bp, Homo sapiens
tctcttgtagctggg

SEQ ID NO: 52042 - DNA, 15 bp, Homo sapiens
ctcttgtagctggga

SEQ ID NO: 52043 - DNA, 15 bp, Homo sapiens
tcttgtagctgggac

SEQ ID NO: 52044 - DNA, 15 bp, Homo sapiens
cttgtagctgggact

SEQ ID NO: 52045 - DNA, 15 bp, Homo sapiens
ttgtagctgggacta

SEQ ID NO: 52046 - DNA, 15 bp, Homo sapiens
tgtagctgggactac

SEQ ID NO: 52047 - DNA, 15 bp, Homo sapiens
gctgggactacaggg

SEQ ID NO: 52048 - DNA, 15 bp, Homo sapiens
ctgggactacaggga

SEQ ID NO: 52049 - DNA, 15 bp, Homo sapiens
tgggactacagggat

SEQ ID NO: 52050 - DNA, 15 bp, Homo sapiens
gggactacagggatg

SEQ ID NO: 52051 - DNA, 15 bp, Homo sapiens
ggactacagggatgt

SEQ ID NO: 52052 - DNA, 15 bp, Homo sapiens
gactacagggatgtg

SEQ ID NO: 52053 - DNA, 15 bp, Homo sapiens
actacagggatgtgc

SEQ ID NO: 52054 - DNA, 15 bp, Homo sapiens
ctacagggatgtgcc

SEQ ID NO: 52055 - DNA, 15 bp, Homo sapiens
tacagggatgtgccg

SEQ ID NO: 52056 - DNA, 15 bp, Homo sapiens
acagggatgtgccgc

SEQ ID NO: 52057 - DNA, 15 bp, Homo sapiens
cagggatgtgccgcc

SEQ ID NO: 52058 - DNA, 15 bp, Homo sapiens
agggatgtgccgcca

SEQ ID NO: 52059 - DNA, 15 bp, Homo sapiens
gggatgtgccgccat

SEQ ID NO: 52060 - DNA, 15 bp, Homo sapiens
ggatgtgccgccatg

SEQ ID NO: 52061 - DNA, 15 bp, Homo sapiens
gatgtgccgccatgc

SEQ ID NO: 52062 - DNA, 15 bp, Homo sapiens
atgtgccgccatgcc

SEQ ID NO: 52063 - DNA, 15 bp, Homo sapiens
tgtgccgccatgcct

SEQ ID NO: 52064 - DNA, 15 bp, Homo sapiens
gtgccgccatgcctg

SEQ ID NO: 52065 - DNA, 15 bp, Homo sapiens
tgccgccatgcctgg

SEQ ID NO: 52066 - DNA, 15 bp, Homo sapiens
gccgccatgcctggc

SEQ ID NO: 52067 - DNA, 15 bp, Homo sapiens
ccgccatgcctggct

SEQ ID NO: 52068 - DNA, 15 bp, Homo sapiens
cgccatgcctggcta

SEQ ID NO: 52069 - DNA, 15 bp, Homo sapiens
gccatgcctggctaa

SEQ ID NO: 52070 - DNA, 15 bp, Homo sapiens
ccatgcctggctaaa

SEQ ID NO: 52071 - DNA, 15 bp, Homo sapiens
catgcctggctaaat

SEQ ID NO: 52072 - DNA, 15 bp, Homo sapiens
atgcctggctaaatt

SEQ ID NO: 52073 - DNA, 15 bp, Homo sapiens
tgcctggctaaattt

SEQ ID NO: 52074 - DNA, 15 bp, Homo sapiens
gcctggctaaatttt

SEQ ID NO: 52075 - DNA, 15 bp, Homo sapiens
cctggctaaattttt

SEQ ID NO: 52076 - DNA, 15 bp, Homo sapiens
ctggctaaatttttt

SEQ ID NO: 52077 - DNA, 15 bp, Homo sapiens
tggctaaatttttta

SEQ ID NO: 52078 - DNA, 15 bp, Homo sapiens
ggctaaattttttat

SEQ ID NO: 52079 - DNA, 15 bp, Homo sapiens
gctaaattttttatt

SEQ ID NO: 52080 - DNA, 15 bp, Homo sapiens
ctaaattttttattt

SEQ ID NO: 52081 - DNA, 15 bp, Homo sapiens
taaattttttatttt

SEQ ID NO: 52082 - DNA, 15 bp, Homo sapiens
aaattttttattttt

SEQ ID NO: 52083 - DNA, 15 bp, Homo sapiens
aattttttattttta

SEQ ID NO: 52084 - DNA, 15 bp, Homo sapiens
attttttatttttat

SEQ ID NO: 52085 - DNA, 15 bp, Homo sapiens
ttttttatttttatt

SEQ ID NO: 52086 - DNA, 15 bp, Homo sapiens
tttttatttttattt

SEQ ID NO: 52087 - DNA, 15 bp, Homo sapiens
ttatttttattttta

SEQ ID NO: 52088 - DNA, 15 bp, Homo sapiens
tatttttatttttat

SEQ ID NO: 52089 - DNA, 15 bp, Homo sapiens
atttttatttttatt

SEQ ID NO: 52090 - DNA, 15 bp, Homo sapiens
ttatttttatttttg

SEQ ID NO: 52091 - DNA, 15 bp, Homo sapiens
tatttttatttttgg

SEQ ID NO: 52092 - DNA, 15 bp, Homo sapiens
atttttatttttggt

SEQ ID NO: 52093 - DNA, 15 bp, Homo sapiens
tttttatttttggta

SEQ ID NO: 52094 - DNA, 15 bp, Homo sapiens
ttttatttttggtag

SEQ ID NO: 52095 - DNA, 15 bp, Homo sapiens
tttatttttggtaga

SEQ ID NO: 52096 - DNA, 15 bp, Homo sapiens
ttatttttggtagac

SEQ ID NO: 52097 - DNA, 15 bp, Homo sapiens
tatttttggtagaca

SEQ ID NO: 52098 - DNA, 15 bp, Homo sapiens
atttttggtagacac

SEQ ID NO: 52099 - DNA, 15 bp, Homo sapiens
tttttggtagacacg

SEQ ID NO: 52100 - DNA, 15 bp, Homo sapiens
ttttggtagacacgg

SEQ ID NO: 52101 - DNA, 15 bp, Homo sapiens
tttggtagacacggg

SEQ ID NO: 52102 - DNA, 15 bp, Homo sapiens
ttggtagacacgggg

SEQ ID NO: 52103 - DNA, 15 bp, Homo sapiens
tggtagacacggggt

SEQ ID NO: 52104 - DNA, 15 bp, Homo sapiens
ggtagacacggggtt

SEQ ID NO: 52105 - DNA, 15 bp, Homo sapiens
gtagacacggggttt

SEQ ID NO: 52106 - DNA, 15 bp, Homo sapiens
tagacacggggtttc

SEQ ID NO: 52107 - DNA, 15 bp, Homo sapiens
agacacggggtttca

SEQ ID NO: 52108 - DNA, 15 bp, Homo sapiens
gacacggggtttcac

SEQ ID NO: 52109 - DNA, 15 bp, Homo sapiens
acacggggtttcact

SEQ ID NO: 52110 - DNA, 15 bp, Homo sapiens
cacggggtttcactg

SEQ ID NO: 52111 - DNA, 15 bp, Homo sapiens
acggggtttcactgt

SEQ ID NO: 52112 - DNA, 15 bp, Homo sapiens
cggggtttcactgtg

SEQ ID NO: 52113 - DNA, 15 bp, Homo sapiens
ggggtttcactgtgt

SEQ ID NO: 52114 - DNA, 15 bp, Homo sapiens
gggtttcactgtgtt

SEQ ID NO: 52115 - DNA, 15 bp, Homo sapiens
ggtttcactgtgttg

SEQ ID NO: 52116 - DNA, 15 bp, Homo sapiens
gtttcactgtgttgc

SEQ ID NO: 52117 - DNA, 15 bp, Homo sapiens
tttcactgtgttgcc

SEQ ID NO: 52118 - DNA, 15 bp, Homo sapiens
ttcactgtgttgccc

SEQ ID NO: 52119 - DNA, 15 bp, Homo sapiens
tcactgtgttgccca

SEQ ID NO: 52120 - DNA, 15 bp, Homo sapiens
cactgtgttgcccag

SEQ ID NO: 52121 - DNA, 15 bp, Homo sapiens
actgtgttgcccagg

SEQ ID NO: 52122 - DNA, 15 bp, Homo sapiens
ctgtgttgcccaggc

SEQ ID NO: 52123 - DNA, 15 bp, Homo sapiens
tgtgttgcccaggct

SEQ ID NO: 52124 - DNA, 15 bp, Homo sapiens
gtgttgcccaggctg

SEQ ID NO: 52125 - DNA, 15 bp, Homo sapiens
tgttgcccaggctgg

SEQ ID NO: 52126 - DNA, 15 bp, Homo sapiens
gttgcccaggctggt

SEQ ID NO: 52127 - DNA, 15 bp, Homo sapiens
ttgcccaggctggtc

SEQ ID NO: 52128 - DNA, 15 bp, Homo sapiens
tgcccaggctggtct

SEQ ID NO: 52129 - DNA, 15 bp, Homo sapiens
gcccaggctggtctt

SEQ ID NO: 52130 - DNA, 15 bp, Homo sapiens
cccaggctggtcttg

SEQ ID NO: 52131 - DNA, 15 bp, Homo sapiens
ggtcttgaactcctt

SEQ ID NO: 52132 - DNA, 15 bp, Homo sapiens
gtcttgaactccttg

SEQ ID NO: 52133 - DNA, 15 bp, Homo sapiens
tcttgaactccttgg

SEQ ID NO: 52134 - DNA, 15 bp, Homo sapiens
cttgaactccttggg

SEQ ID NO: 52135 - DNA, 15 bp, Homo sapiens
ttgaactccttgggc

SEQ ID NO: 52136 - DNA, 15 bp, Homo sapiens
tgaactccttgggct

SEQ ID NO: 52137 - DNA, 15 bp, Homo sapiens
gaactccttgggctt

SEQ ID NO: 52138 - DNA, 15 bp, Homo sapiens
aactccttgggcttg

SEQ ID NO: 52139 - DNA, 15 bp, Homo sapiens
actccttgggcttga

SEQ ID NO: 52140 - DNA, 15 bp, Homo sapiens
ctccttgggcttgag

SEQ ID NO: 52141 - DNA, 15 bp, Homo sapiens
tccttgggcttgagt

SEQ ID NO: 52142 - DNA, 15 bp, Homo sapiens
ccttgggcttgagta

SEQ ID NO: 52143 - DNA, 15 bp, Homo sapiens
cttgggcttgagtaa

SEQ ID NO: 52144 - DNA, 15 bp, Homo sapiens
ttgggcttgagtaat

SEQ ID NO: 52145 - DNA, 15 bp, Homo sapiens
tgggcttgagtaatc

SEQ ID NO: 52146 - DNA, 15 bp, Homo sapiens
gggcttgagtaatcc

SEQ ID NO: 52147 - DNA, 15 bp, Homo sapiens
ggcttgagtaatcct

SEQ ID NO: 52148 - DNA, 15 bp, Homo sapiens
gcttgagtaatcctc

SEQ ID NO: 52149 - DNA, 15 bp, Homo sapiens
cttgagtaatcctcc

SEQ ID NO: 52150 - DNA, 15 bp, Homo sapiens
ttgagtaatcctcct

SEQ ID NO: 52151 - DNA, 15 bp, Homo sapiens
tgagtaatcctcctg

SEQ ID NO: 52152 - DNA, 15 bp, Homo sapiens
gagtaatcctcctgc

SEQ ID NO: 52153 - DNA, 15 bp, Homo sapiens
agtaatcctcctgcc

SEQ ID NO: 52154 - DNA, 15 bp, Homo sapiens
gtaatcctcctgcct

SEQ ID NO: 52155 - DNA, 15 bp, Homo sapiens
taatcctcctgcctt

SEQ ID NO: 52156 - DNA, 15 bp, Homo sapiens
aatcctcctgccttg

SEQ ID NO: 52157 - DNA, 15 bp, Homo sapiens
gcctcccaaagtgcc

SEQ ID NO: 52158 - DNA, 15 bp, Homo sapiens
cctcccaaagtgccg

SEQ ID NO: 52159 - DNA, 15 bp, Homo sapiens
ctcccaaagtgccga

SEQ ID NO: 52160 - DNA, 15 bp, Homo sapiens
tcccaaagtgccgag

SEQ ID NO: 52161 - DNA, 15 bp, Homo sapiens
cccaaagtgccgaga

SEQ ID NO: 52162 - DNA, 15 bp, Homo sapiens
ccaaagtgccgagat

SEQ ID NO: 52163 - DNA, 15 bp, Homo sapiens
caaagtgccgagatt

SEQ ID NO: 52164 - DNA, 15 bp, Homo sapiens
aaagtgccgagatta

SEQ ID NO: 52165 - DNA, 15 bp, Homo sapiens
aagtgccgagattac

SEQ ID NO: 52166 - DNA, 15 bp, Homo sapiens
agtgccgagattaca

SEQ ID NO: 52167 - DNA, 15 bp, Homo sapiens
gtgccgagattacaa

SEQ ID NO: 52168 - DNA, 15 bp, Homo sapiens
tgccgagattacaac

SEQ ID NO: 52169 - DNA, 15 bp, Homo sapiens
gccgagattacaacc

SEQ ID NO: 52170 - DNA, 15 bp, Homo sapiens
ccgagattacaacca

SEQ ID NO: 52171 - DNA, 15 bp, Homo sapiens
cgagattacaaccat

SEQ ID NO: 52172 - DNA, 15 bp, Homo sapiens
gagattacaaccatg

SEQ ID NO: 52173 - DNA, 15 bp, Homo sapiens
agattacaaccatga

SEQ ID NO: 52174 - DNA, 15 bp, Homo sapiens
gattacaaccatgag

SEQ ID NO: 52175 - DNA, 15 bp, Homo sapiens
attacaaccatgagc

SEQ ID NO: 52176 - DNA, 15 bp, Homo sapiens
ttacaaccatgagcc

SEQ ID NO: 52177 - DNA, 15 bp, Homo sapiens
tacaaccatgagcca

SEQ ID NO: 52178 - DNA, 15 bp, Homo sapiens
acaaccatgagccat

SEQ ID NO: 52179 - DNA, 15 bp, Homo sapiens
caaccatgagccatg

SEQ ID NO: 52180 - DNA, 15 bp, Homo sapiens
aaccatgagccatgg

SEQ ID NO: 52181 - DNA, 15 bp, Homo sapiens
accatgagccatgga

SEQ ID NO: 52182 - DNA, 15 bp, Homo sapiens
ccatgagccatggag

SEQ ID NO: 52183 - DNA, 15 bp, Homo sapiens
catgagccatggagc

SEQ ID NO: 52184 - DNA, 15 bp, Homo sapiens
atgagccatggagcc

SEQ ID NO: 52185 - DNA, 15 bp, Homo sapiens
tgagccatggagccc

SEQ ID NO: 52186 - DNA, 15 bp, Homo sapiens
gagccatggagcccg

SEQ ID NO: 52187 - DNA, 15 bp, Homo sapiens
agccatggagcccga

SEQ ID NO: 52188 - DNA, 15 bp, Homo sapiens
gccatggagcccgac

SEQ ID NO: 52189 - DNA, 15 bp, Homo sapiens
ccatggagcccgaca

SEQ ID NO: 52190 - DNA, 15 bp, Homo sapiens
catggagcccgacaa

SEQ ID NO: 52191 - DNA, 15 bp, Homo sapiens
atggagcccgacaag

SEQ ID NO: 52192 - DNA, 15 bp, Homo sapiens
tggagcccgacaaga

SEQ ID NO: 52193 - DNA, 15 bp, Homo sapiens
ggagcccgacaagag

SEQ ID NO: 52194 - DNA, 15 bp, Homo sapiens
gagcccgacaagagt

SEQ ID NO: 52195 - DNA, 15 bp, Homo sapiens
agcccgacaagagta

SEQ ID NO: 52196 - DNA, 15 bp, Homo sapiens
gcccgacaagagtag

SEQ ID NO: 52197 - DNA, 15 bp, Homo sapiens
cccgacaagagtagc

SEQ ID NO: 52198 - DNA, 15 bp, Homo sapiens
ccgacaagagtagcc

SEQ ID NO: 52199 - DNA, 15 bp, Homo sapiens
cgacaagagtagcct

SEQ ID NO: 52200 - DNA, 15 bp, Homo sapiens
gacaagagtagcctt

SEQ ID NO: 52201 - DNA, 15 bp, Homo sapiens
acaagagtagccttt

SEQ ID NO: 52202 - DNA, 15 bp, Homo sapiens
caagagtagcctttt

SEQ ID NO: 52203 - DNA, 15 bp, Homo sapiens
aagagtagcctttta

SEQ ID NO: 52204 - DNA, 15 bp, Homo sapiens
agagtagccttttat

SEQ ID NO: 52205 - DNA, 15 bp, Homo sapiens
gagtagccttttatt

SEQ ID NO: 52206 - DNA, 15 bp, Homo sapiens
agtagccttttattt

SEQ ID NO: 52207 - DNA, 15 bp, Homo sapiens
gtagccttttatttg

SEQ ID NO: 52208 - DNA, 15 bp, Homo sapiens
tagccttttatttgc

SEQ ID NO: 52209 - DNA, 15 bp, Homo sapiens
agccttttatttgca

SEQ ID NO: 52210 - DNA, 15 bp, Homo sapiens
gccttttatttgcag

SEQ ID NO: 52211 - DNA, 15 bp, Homo sapiens
ccttttatttgcaga

SEQ ID NO: 52212 - DNA, 15 bp, Homo sapiens
cttttatttgcagac

SEQ ID NO: 52213 - DNA, 15 bp, Homo sapiens
ttttatttgcagacc

SEQ ID NO: 52214 - DNA, 15 bp, Homo sapiens
tttatttgcagacca

SEQ ID NO: 52215 - DNA, 15 bp, Homo sapiens
ttatttgcagaccat

SEQ ID NO: 52216 - DNA, 15 bp, Homo sapiens
tatttgcagaccatt

SEQ ID NO: 52217 - DNA, 15 bp, Homo sapiens
atttgcagaccatta

SEQ ID NO: 52218 - DNA, 15 bp, Homo sapiens
tttgcagaccattag

SEQ ID NO: 52219 - DNA, 15 bp, Homo sapiens
ttgcagaccattaga

SEQ ID NO: 52220 - DNA, 15 bp, Homo sapiens
tgcagaccattagag

SEQ ID NO: 52221 - DNA, 15 bp, Homo sapiens
gcagaccattagaga

SEQ ID NO: 52222 - DNA, 15 bp, Homo sapiens
cagaccattagagaa

SEQ ID NO: 52223 - DNA, 15 bp, Homo sapiens
agaccattagagaaa

SEQ ID NO: 52224 - DNA, 15 bp, Homo sapiens
gaccattagagaaaa

SEQ ID NO: 52225 - DNA, 15 bp, Homo sapiens
accattagagaaaaa

SEQ ID NO: 52226 - DNA, 15 bp, Homo sapiens
ccattagagaaaaag

SEQ ID NO: 52227 - DNA, 15 bp, Homo sapiens
cattagagaaaaagt

SEQ ID NO: 52228 - DNA, 15 bp, Homo sapiens
attagagaaaaagtt

SEQ ID NO: 52229 - DNA, 15 bp, Homo sapiens
ttagagaaaaagttg

SEQ ID NO: 52230 - DNA, 15 bp, Homo sapiens
tagagaaaaagttgc

SEQ ID NO: 52231 - DNA, 15 bp, Homo sapiens
agagaaaaagttgcg

SEQ ID NO: 52232 - DNA, 15 bp, Homo sapiens
gagaaaaagttgcgt

SEQ ID NO: 52233 - DNA, 15 bp, Homo sapiens
agaaaaagttgcgtg

SEQ ID NO: 52234 - DNA, 15 bp, Homo sapiens
gaaaaagttgcgtgt

SEQ ID NO: 52235 - DNA, 15 bp, Homo sapiens
aaaaagttgcgtgta

SEQ ID NO: 52236 - DNA, 15 bp, Homo sapiens
aaaagttgcgtgtaa

SEQ ID NO: 52237 - DNA, 15 bp, Homo sapiens
aaagttgcgtgtaag

SEQ ID NO: 52238 - DNA, 15 bp, Homo sapiens
aagttgcgtgtaagt

SEQ ID NO: 52239 - DNA, 15 bp, Homo sapiens
agttgcgtgtaagta

SEQ ID NO: 52240 - DNA, 15 bp, Homo sapiens
gttgcgtgtaagtag

SEQ ID NO: 52241 - DNA, 15 bp, Homo sapiens
ttgcgtgtaagtaga

SEQ ID NO: 52242 - DNA, 15 bp, Homo sapiens
tgcgtgtaagtagat

SEQ ID NO: 52243 - DNA, 15 bp, Homo sapiens
gcgtgtaagtagata

SEQ ID NO: 52244 - DNA, 15 bp, Homo sapiens
cgtgtaagtagataa

SEQ ID NO: 52245 - DNA, 15 bp, Homo sapiens
gtgtaagtagataag

SEQ ID NO: 52246 - DNA, 15 bp, Homo sapiens
tgtaagtagataagc

SEQ ID NO: 52247 - DNA, 15 bp, Homo sapiens
gtaagtagataagca

SEQ ID NO: 52248 - DNA, 15 bp, Homo sapiens
taagtagataagcat

SEQ ID NO: 52249 - DNA, 15 bp, Homo sapiens
aagtagataagcata

SEQ ID NO: 52250 - DNA, 15 bp, Homo sapiens
agtagataagcatac

SEQ ID NO: 52251 - DNA, 15 bp, Homo sapiens
gtagataagcatacg

SEQ ID NO: 52252 - DNA, 15 bp, Homo sapiens
tagataagcatacga

SEQ ID NO: 52253 - DNA, 15 bp, Homo sapiens
agataagcatacgaa

SEQ ID NO: 52254 - DNA, 15 bp, Homo sapiens
gataagcatacgaat

SEQ ID NO: 52255 - DNA, 15 bp, Homo sapiens
ataagcatacgaatt

SEQ ID NO: 52256 - DNA, 15 bp, Homo sapiens
taagcatacgaattt

SEQ ID NO: 52257 - DNA, 15 bp, Homo sapiens
aagcatacgaattta

SEQ ID NO: 52258 - DNA, 15 bp, Homo sapiens
agcatacgaatttat

SEQ ID NO: 52259 - DNA, 15 bp, Homo sapiens
gcatacgaatttatc

SEQ ID NO: 52260 - DNA, 15 bp, Homo sapiens
catacgaatttatca

SEQ ID NO: 52261 - DNA, 15 bp, Homo sapiens
atacgaatttatcac

SEQ ID NO: 52262 - DNA, 15 bp, Homo sapiens
tacgaatttatcact

SEQ ID NO: 52263 - DNA, 15 bp, Homo sapiens
acgaatttatcactg

SEQ ID NO: 52264 - DNA, 15 bp, Homo sapiens
cgaatttatcactgc

SEQ ID NO: 52265 - DNA, 15 bp, Homo sapiens
gaatttatcactgca

SEQ ID NO: 52266 - DNA, 15 bp, Homo sapiens
aatttatcactgcaa

SEQ ID NO: 52267 - DNA, 15 bp, Homo sapiens
atttatcactgcaat

SEQ ID NO: 52268 - DNA, 15 bp, Homo sapiens
tttatcactgcaata

SEQ ID NO: 52269 - DNA, 15 bp, Homo sapiens
ttatcactgcaatac

SEQ ID NO: 52270 - DNA, 15 bp, Homo sapiens
tatcactgcaatact

SEQ ID NO: 52271 - DNA, 15 bp, Homo sapiens
atcactgcaatactg

SEQ ID NO: 52272 - DNA, 15 bp, Homo sapiens
tcactgcaatactgt

SEQ ID NO: 52273 - DNA, 15 bp, Homo sapiens
cactgcaatactgtt

SEQ ID NO: 52274 - DNA, 15 bp, Homo sapiens
actgcaatactgttt

SEQ ID NO: 52275 - DNA, 15 bp, Homo sapiens
ctgcaatactgtttg

SEQ ID NO: 52276 - DNA, 15 bp, Homo sapiens
tgcaatactgtttgt

SEQ ID NO: 52277 - DNA, 15 bp, Homo sapiens
gcaatactgtttgta

SEQ ID NO: 52278 - DNA, 15 bp, Homo sapiens
caatactgtttgtag

SEQ ID NO: 52279 - DNA, 15 bp, Homo sapiens
aatactgtttgtaga

SEQ ID NO: 52280 - DNA, 15 bp, Homo sapiens
atactgtttgtagag

SEQ ID NO: 52281 - DNA, 15 bp, Homo sapiens
tactgtttgtagaga

SEQ ID NO: 52282 - DNA, 15 bp, Homo sapiens
actgtttgtagagat

SEQ ID NO: 52283 - DNA, 15 bp, Homo sapiens
ctgtttgtagagatc

SEQ ID NO: 52284 - DNA, 15 bp, Homo sapiens
tgtttgtagagatca

SEQ ID NO: 52285 - DNA, 15 bp, Homo sapiens
gtttgtagagatcac

SEQ ID NO: 52286 - DNA, 15 bp, Homo sapiens
tttgtagagatcaca

SEQ ID NO: 52287 - DNA, 15 bp, Homo sapiens
ttgtagagatcacag

SEQ ID NO: 52288 - DNA, 15 bp, Homo sapiens
tgtagagatcacaga

SEQ ID NO: 52289 - DNA, 15 bp, Homo sapiens
gtagagatcacagag

SEQ ID NO: 52290 - DNA, 15 bp, Homo sapiens
tagagatcacagagc

SEQ ID NO: 52291 - DNA, 15 bp, Homo sapiens
agagatcacagagct

SEQ ID NO: 52292 - DNA, 15 bp, Homo sapiens
gagatcacagagctg

SEQ ID NO: 52293 - DNA, 15 bp, Homo sapiens
agatcacagagctgt

SEQ ID NO: 52294 - DNA, 15 bp, Homo sapiens
gatcacagagctgtt

SEQ ID NO: 52295 - DNA, 15 bp, Homo sapiens
atcacagagctgtta

SEQ ID NO: 52296 - DNA, 15 bp, Homo sapiens
tcacagagctgttag

SEQ ID NO: 52297 - DNA, 15 bp, Homo sapiens
cacagagctgttagg

SEQ ID NO: 52298 - DNA, 15 bp, Homo sapiens
acagagctgttaggc

SEQ ID NO: 52299 - DNA, 15 bp, Homo sapiens
cagagctgttaggct

SEQ ID NO: 52300 - DNA, 15 bp, Homo sapiens
agagctgttaggcta

SEQ ID NO: 52301 - DNA, 15 bp, Homo sapiens
gagctgttaggctag

SEQ ID NO: 52302 - DNA, 15 bp, Homo sapiens
agctgttaggctagg

SEQ ID NO: 52303 - DNA, 15 bp, Homo sapiens
gctgttaggctagga

SEQ ID NO: 52304 - DNA, 15 bp, Homo sapiens
ctgttaggctaggaa

SEQ ID NO: 52305 - DNA, 15 bp, Homo sapiens
tgttaggctaggaag

SEQ ID NO: 52306 - DNA, 15 bp, Homo sapiens
gttaggctaggaaga

SEQ ID NO: 52307 - DNA, 15 bp, Homo sapiens
ttaggctaggaagaa

SEQ ID NO: 52308 - DNA, 15 bp, Homo sapiens
taggctaggaagaag

SEQ ID NO: 52309 - DNA, 15 bp, Homo sapiens
aggctaggaagaagt

SEQ ID NO: 52310 - DNA, 15 bp, Homo sapiens
ggctaggaagaagtt

SEQ ID NO: 52311 - DNA, 15 bp, Homo sapiens
gctaggaagaagttt

SEQ ID NO: 52312 - DNA, 15 bp, Homo sapiens
ctaggaagaagtttt

SEQ ID NO: 52313 - DNA, 15 bp, Homo sapiens
taggaagaagttttt

SEQ ID NO: 52314 - DNA, 15 bp, Homo sapiens
aggaagaagttttta

SEQ ID NO: 52315 - DNA, 15 bp, Homo sapiens
ggaagaagtttttag

SEQ ID NO: 52316 - DNA, 15 bp, Homo sapiens
gaagaagtttttagc

SEQ ID NO: 52317 - DNA, 15 bp, Homo sapiens
aagaagtttttagca

SEQ ID NO: 52318 - DNA, 15 bp, Homo sapiens
agaagtttttagcag

SEQ ID NO: 52319 - DNA, 15 bp, Homo sapiens
gaagtttttagcagt

SEQ ID NO: 52320 - DNA, 15 bp, Homo sapiens
aagtttttagcagtt

SEQ ID NO: 52321 - DNA, 15 bp, Homo sapiens
agtttttagcagtta

SEQ ID NO: 52322 - DNA, 15 bp, Homo sapiens
gtttttagcagttag

SEQ ID NO: 52323 - DNA, 15 bp, Homo sapiens
tttttagcagttagc

SEQ ID NO: 52324 - DNA, 15 bp, Homo sapiens
ttttagcagttagca

SEQ ID NO: 52325 - DNA, 15 bp, Homo sapiens
tttagcagttagcac

SEQ ID NO: 52326 - DNA, 15 bp, Homo sapiens
ttagcagttagcact

SEQ ID NO: 52327 - DNA, 15 bp, Homo sapiens
tagcagttagcacta

SEQ ID NO: 52328 - DNA, 15 bp, Homo sapiens
agcagttagcactag

SEQ ID NO: 52329 - DNA, 15 bp, Homo sapiens
gcagttagcactaga

SEQ ID NO: 52330 - DNA, 15 bp, Homo sapiens
cagttagcactagaa

SEQ ID NO: 52331 - DNA, 15 bp, Homo sapiens
agttagcactagaaa

SEQ ID NO: 52332 - DNA, 15 bp, Homo sapiens
gttagcactagaaag

SEQ ID NO: 52333 - DNA, 15 bp, Homo sapiens
ttagcactagaaagc

SEQ ID NO: 52334 - DNA, 15 bp, Homo sapiens
tagcactagaaagca

SEQ ID NO: 52335 - DNA, 15 bp, Homo sapiens
agcactagaaagcaa

SEQ ID NO: 52336 - DNA, 15 bp, Homo sapiens
gcactagaaagcaaa

SEQ ID NO: 52337 - DNA, 15 bp, Homo sapiens
cactagaaagcaaaa

SEQ ID NO: 52338 - DNA, 15 bp, Homo sapiens
actagaaagcaaaac

SEQ ID NO: 52339 - DNA, 15 bp, Homo sapiens
ctagaaagcaaaact

SEQ ID NO: 52340 - DNA, 15 bp, Homo sapiens
tagaaagcaaaactt

SEQ ID NO: 52341 - DNA, 15 bp, Homo sapiens
agaaagcaaaacttt

SEQ ID NO: 52342 - DNA, 15 bp, Homo sapiens
gaaagcaaaactttg

SEQ ID NO: 52343 - DNA, 15 bp, Homo sapiens
aaagcaaaactttgg

SEQ ID NO: 52344 - DNA, 15 bp, Homo sapiens
aagcaaaactttgga

SEQ ID NO: 52345 - DNA, 15 bp, Homo sapiens
agcaaaactttggaa

SEQ ID NO: 52346 - DNA, 15 bp, Homo sapiens
gcaaaactttggaaa

SEQ ID NO: 52347 - DNA, 15 bp, Homo sapiens
caaaactttggaaac

SEQ ID NO: 52348 - DNA, 15 bp, Homo sapiens
aaaactttggaaact

SEQ ID NO: 52349 - DNA, 15 bp, Homo sapiens
aaactttggaaactt

SEQ ID NO: 52350 - DNA, 15 bp, Homo sapiens
aactttggaaacttc

SEQ ID NO: 52351 - DNA, 15 bp, Homo sapiens
actttggaaacttcc

SEQ ID NO: 52352 - DNA, 15 bp, Homo sapiens
ctttggaaacttcca

SEQ ID NO: 52353 - DNA, 15 bp, Homo sapiens
tttggaaacttccat

SEQ ID NO: 52354 - DNA, 15 bp, Homo sapiens
ttggaaacttccatt

SEQ ID NO: 52355 - DNA, 15 bp, Homo sapiens
tggaaacttccattt

SEQ ID NO: 52356 - DNA, 15 bp, Homo sapiens
ggaaacttccatttc

SEQ ID NO: 52357 - DNA, 15 bp, Homo sapiens
gaaacttccatttca

SEQ ID NO: 52358 - DNA, 15 bp, Homo sapiens
aaacttccatttcat

SEQ ID NO: 52359 - DNA, 15 bp, Homo sapiens
aacttccatttcatc

SEQ ID NO: 52360 - DNA, 15 bp, Homo sapiens
acttccatttcatca

SEQ ID NO: 52361 - DNA, 15 bp, Homo sapiens
cttccatttcatcaa

SEQ ID NO: 52362 - DNA, 15 bp, Homo sapiens
ttccatttcatcaaa

SEQ ID NO: 52363 - DNA, 15 bp, Homo sapiens
tccatttcatcaaaa

SEQ ID NO: 52364 - DNA, 15 bp, Homo sapiens
ccatttcatcaaaag

SEQ ID NO: 52365 - DNA, 15 bp, Homo sapiens
catttcatcaaaagt

SEQ ID NO: 52366 - DNA, 15 bp, Homo sapiens
atttcatcaaaagtg

SEQ ID NO: 52367 - DNA, 15 bp, Homo sapiens
tttcatcaaaagtga

SEQ ID NO: 52368 - DNA, 15 bp, Homo sapiens
ttcatcaaaagtgac

SEQ ID NO: 52369 - DNA, 15 bp, Homo sapiens
tcatcaaaagtgacc

SEQ ID NO: 52370 - DNA, 15 bp, Homo sapiens
catcaaaagtgacct

SEQ ID NO: 52371 - DNA, 15 bp, Homo sapiens
atcaaaagtgacctc

SEQ ID NO: 52372 - DNA, 15 bp, Homo sapiens
tcaaaagtgacctca

SEQ ID NO: 52373 - DNA, 15 bp, Homo sapiens
caaaagtgacctcat

SEQ ID NO: 52374 - DNA, 15 bp, Homo sapiens
aaaagtgacctcatc

SEQ ID NO: 52375 - DNA, 15 bp, Homo sapiens
aaagtgacctcatct

SEQ ID NO: 52376 - DNA, 15 bp, Homo sapiens
aagtgacctcatctg

SEQ ID NO: 52377 - DNA, 15 bp, Homo sapiens
agtgacctcatctga

SEQ ID NO: 52378 - DNA, 15 bp, Homo sapiens
gtgacctcatctgag

SEQ ID NO: 52379 - DNA, 15 bp, Homo sapiens
tgacctcatctgagt

SEQ ID NO: 52380 - DNA, 15 bp, Homo sapiens
gacctcatctgagta

SEQ ID NO: 52381 - DNA, 15 bp, Homo sapiens
acctcatctgagtag

SEQ ID NO: 52382 - DNA, 15 bp, Homo sapiens
cctcatctgagtagg

SEQ ID NO: 52383 - DNA, 15 bp, Homo sapiens
ctcatctgagtaggg

SEQ ID NO: 52384 - DNA, 15 bp, Homo sapiens
tcatctgagtagggc

SEQ ID NO: 52385 - DNA, 15 bp, Homo sapiens
catctgagtagggca

SEQ ID NO: 52386 - DNA, 15 bp, Homo sapiens
atctgagtagggcat

SEQ ID NO: 52387 - DNA, 15 bp, Homo sapiens
tctgagtagggcatg

SEQ ID NO: 52388 - DNA, 15 bp, Homo sapiens
ctgagtagggcatgt

SEQ ID NO: 52389 - DNA, 15 bp, Homo sapiens
tgagtagggcatgtg

SEQ ID NO: 52390 - DNA, 15 bp, Homo sapiens
gagtagggcatgtga

SEQ ID NO: 52391 - DNA, 15 bp, Homo sapiens
agtagggcatgtgag

SEQ ID NO: 52392 - DNA, 15 bp, Homo sapiens
gtagggcatgtgagg

SEQ ID NO: 52393 - DNA, 15 bp, Homo sapiens
tagggcatgtgaggg

SEQ ID NO: 52394 - DNA, 15 bp, Homo sapiens
agggcatgtgaggga

SEQ ID NO: 52395 - DNA, 15 bp, Homo sapiens
gggcatgtgagggaa

SEQ ID NO: 52396 - DNA, 15 bp, Homo sapiens
ggcatgtgagggaag

SEQ ID NO: 52397 - DNA, 15 bp, Homo sapiens
gcatgtgagggaagg

SEQ ID NO: 52398 - DNA, 15 bp, Homo sapiens
catgtgagggaagga

SEQ ID NO: 52399 - DNA, 15 bp, Homo sapiens
atgtgagggaaggac

SEQ ID NO: 52400 - DNA, 15 bp, Homo sapiens
tgtgagggaaggacc

SEQ ID NO: 52401 - DNA, 15 bp, Homo sapiens
gtgagggaaggacct

SEQ ID NO: 52402 - DNA, 15 bp, Homo sapiens
tgagggaaggacctt

SEQ ID NO: 52403 - DNA, 15 bp, Homo sapiens
gagggaaggaccttt

SEQ ID NO: 52404 - DNA, 15 bp, Homo sapiens
agggaaggacctttt

SEQ ID NO: 52405 - DNA, 15 bp, Homo sapiens
gggaaggaccttttt

SEQ ID NO: 52406 - DNA, 15 bp, Homo sapiens
ggaaggaccttttta

SEQ ID NO: 52407 - DNA, 15 bp, Homo sapiens
gaaggacctttttac

SEQ ID NO: 52408 - DNA, 15 bp, Homo sapiens
aaggacctttttact

SEQ ID NO: 52409 - DNA, 15 bp, Homo sapiens
aggacctttttactc

SEQ ID NO: 52410 - DNA, 15 bp, Homo sapiens
ggacctttttactcg

SEQ ID NO: 52411 - DNA, 15 bp, Homo sapiens
gacctttttactcga

SEQ ID NO: 52412 - DNA, 15 bp, Homo sapiens
acctttttactcgac

SEQ ID NO: 52413 - DNA, 15 bp, Homo sapiens
cctttttactcgaca

SEQ ID NO: 52414 - DNA, 15 bp, Homo sapiens
ctttttactcgacaa

SEQ ID NO: 52415 - DNA, 15 bp, Homo sapiens
tttttactcgacaag

SEQ ID NO: 52416 - DNA, 15 bp, Homo sapiens
ttttactcgacaagg

SEQ ID NO: 52417 - DNA, 15 bp, Homo sapiens
tttactcgacaaggg

SEQ ID NO: 52418 - DNA, 15 bp, Homo sapiens
ttactcgacaagggg

SEQ ID NO: 52419 - DNA, 15 bp, Homo sapiens
tactcgacaagggga

SEQ ID NO: 52420 - DNA, 15 bp, Homo sapiens
actcgacaaggggaa

SEQ ID NO: 52421 - DNA, 15 bp, Homo sapiens
ctcgacaaggggaac

SEQ ID NO: 52422 - DNA, 15 bp, Homo sapiens
tcgacaaggggaact

SEQ ID NO: 52423 - DNA, 15 bp, Homo sapiens
cgacaaggggaactt

SEQ ID NO: 52424 - DNA, 15 bp, Homo sapiens
gacaaggggaacttg

SEQ ID NO: 52425 - DNA, 15 bp, Homo sapiens
acaaggggaacttgc

SEQ ID NO: 52426 - DNA, 15 bp, Homo sapiens
caaggggaacttgcc

SEQ ID NO: 52427 - DNA, 15 bp, Homo sapiens
aaggggaacttgcca

SEQ ID NO: 52428 - DNA, 15 bp, Homo sapiens
aggggaacttgccag

SEQ ID NO: 52429 - DNA, 15 bp, Homo sapiens
ggggaacttgccagt

SEQ ID NO: 52430 - DNA, 15 bp, Homo sapiens
gggaacttgccagtt

SEQ ID NO: 52431 - DNA, 15 bp, Homo sapiens
ggaacttgccagttc

SEQ ID NO: 52432 - DNA, 15 bp, Homo sapiens
gaacttgccagttct

SEQ ID NO: 52433 - DNA, 15 bp, Homo sapiens
aacttgccagttctt

SEQ ID NO: 52434 - DNA, 15 bp, Homo sapiens
acttgccagttcttg

SEQ ID NO: 52435 - DNA, 15 bp, Homo sapiens
cttgccagttcttgt

SEQ ID NO: 52436 - DNA, 15 bp, Homo sapiens
ttgccagttcttgtt

SEQ ID NO: 52437 - DNA, 15 bp, Homo sapiens
tgccagttcttgttt

SEQ ID NO: 52438 - DNA, 15 bp, Homo sapiens
gccagttcttgtttg

SEQ ID NO: 52439 - DNA, 15 bp, Homo sapiens
ccagttcttgtttgt

SEQ ID NO: 52440 - DNA, 15 bp, Homo sapiens
cagttcttgtttgtg

SEQ ID NO: 52441 - DNA, 15 bp, Homo sapiens
agttcttgtttgtga

SEQ ID NO: 52442 - DNA, 15 bp, Homo sapiens
gttcttgtttgtgaa

SEQ ID NO: 52443 - DNA, 15 bp, Homo sapiens
ttcttgtttgtgaac

SEQ ID NO: 52444 - DNA, 15 bp, Homo sapiens
tcttgtttgtgaacc

SEQ ID NO: 52445 - DNA, 15 bp, Homo sapiens
cttgtttgtgaacct

SEQ ID NO: 52446 - DNA, 15 bp, Homo sapiens
ttgtttgtgaacctt

SEQ ID NO: 52447 - DNA, 15 bp, Homo sapiens
tgtttgtgaaccttg

SEQ ID NO: 52448 - DNA, 15 bp, Homo sapiens
gtttgtgaaccttga

SEQ ID NO: 52449 - DNA, 15 bp, Homo sapiens
tttgtgaaccttgaa

SEQ ID NO: 52450 - DNA, 15 bp, Homo sapiens
ttgtgaaccttgaag

SEQ ID NO: 52451 - DNA, 15 bp, Homo sapiens
tgtgaaccttgaaga

SEQ ID NO: 52452 - DNA, 15 bp, Homo sapiens
gtgaaccttgaagaa

SEQ ID NO: 52453 - DNA, 15 bp, Homo sapiens
tgaaccttgaagaaa

SEQ ID NO: 52454 - DNA, 15 bp, Homo sapiens
gaaccttgaagaaag

SEQ ID NO: 52455 - DNA, 15 bp, Homo sapiens
aaccttgaagaaagt

SEQ ID NO: 52456 - DNA, 15 bp, Homo sapiens
accttgaagaaagtg

SEQ ID NO: 52457 - DNA, 15 bp, Homo sapiens
ccttgaagaaagtgg

SEQ ID NO: 52458 - DNA, 15 bp, Homo sapiens
cttgaagaaagtgga

SEQ ID NO: 52459 - DNA, 15 bp, Homo sapiens
ttgaagaaagtggag

SEQ ID NO: 52460 - DNA, 15 bp, Homo sapiens
tgaagaaagtggagc

SEQ ID NO: 52461 - DNA, 15 bp, Homo sapiens
gaagaaagtggagca

SEQ ID NO: 52462 - DNA, 15 bp, Homo sapiens
aagaaagtggagcat

SEQ ID NO: 52463 - DNA, 15 bp, Homo sapiens
agaaagtggagcatt

SEQ ID NO: 52464 - DNA, 15 bp, Homo sapiens
gaaagtggagcattt

SEQ ID NO: 52465 - DNA, 15 bp, Homo sapiens
aaagtggagcatttt

SEQ ID NO: 52466 - DNA, 15 bp, Homo sapiens
aagtggagcattttt

SEQ ID NO: 52467 - DNA, 15 bp, Homo sapiens
agtggagcattttta

SEQ ID NO: 52468 - DNA, 15 bp, Homo sapiens
gtggagcatttttat

SEQ ID NO: 52469 - DNA, 15 bp, Homo sapiens
tggagcatttttatt

SEQ ID NO: 52470 - DNA, 15 bp, Homo sapiens
ggagcatttttattt

SEQ ID NO: 52471 - DNA, 15 bp, Homo sapiens
gagcatttttatttt

SEQ ID NO: 52472 - DNA, 15 bp, Homo sapiens
agcatttttattttg

SEQ ID NO: 52473 - DNA, 15 bp, Homo sapiens
gcatttttattttgg

SEQ ID NO: 52474 - DNA, 15 bp, Homo sapiens
catttttattttggg

SEQ ID NO: 52475 - DNA, 15 bp, Homo sapiens
atttttattttggga

SEQ ID NO: 52476 - DNA, 15 bp, Homo sapiens
tttttattttgggac

SEQ ID NO: 52477 - DNA, 15 bp, Homo sapiens
ttttattttgggacc

SEQ ID NO: 52478 - DNA, 15 bp, Homo sapiens
tttattttgggacca

SEQ ID NO: 52479 - DNA, 15 bp, Homo sapiens
ttattttgggaccat

SEQ ID NO: 52480 - DNA, 15 bp, Homo sapiens
tattttgggaccatt

SEQ ID NO: 52481 - DNA, 15 bp, Homo sapiens
attttgggaccattc

SEQ ID NO: 52482 - DNA, 15 bp, Homo sapiens
ttttgggaccattct

SEQ ID NO: 52483 - DNA, 15 bp, Homo sapiens
tttgggaccattcta

SEQ ID NO: 52484 - DNA, 15 bp, Homo sapiens
ttgggaccattctag

SEQ ID NO: 52485 - DNA, 15 bp, Homo sapiens
tgggaccattctagg

SEQ ID NO: 52486 - DNA, 15 bp, Homo sapiens
gggaccattctaggt

SEQ ID NO: 52487 - DNA, 15 bp, Homo sapiens
ggaccattctaggtt

SEQ ID NO: 52488 - DNA, 15 bp, Homo sapiens
gaccattctaggttg

SEQ ID NO: 52489 - DNA, 15 bp, Homo sapiens
accattctaggttgt

SEQ ID NO: 52490 - DNA, 15 bp, Homo sapiens
ccattctaggttgtg

SEQ ID NO: 52491 - DNA, 15 bp, Homo sapiens
cattctaggttgtgg

SEQ ID NO: 52492 - DNA, 15 bp, Homo sapiens
attctaggttgtggt

SEQ ID NO: 52493 - DNA, 15 bp, Homo sapiens
ttctaggttgtggta

SEQ ID NO: 52494 - DNA, 15 bp, Homo sapiens
tctaggttgtggtag

SEQ ID NO: 52495 - DNA, 15 bp, Homo sapiens
ctaggttgtggtagt

SEQ ID NO: 52496 - DNA, 15 bp, Homo sapiens
taggttgtggtagtt

SEQ ID NO: 52497 - DNA, 15 bp, Homo sapiens
aggttgtggtagttc

SEQ ID NO: 52498 - DNA, 15 bp, Homo sapiens
ggttgtggtagttcc

SEQ ID NO: 52499 - DNA, 15 bp, Homo sapiens
gttgtggtagttcct

SEQ ID NO: 52500 - DNA, 15 bp, Homo sapiens
ttgtggtagttcctt

SEQ ID NO: 52501 - DNA, 15 bp, Homo sapiens
tgtggtagttccttg

SEQ ID NO: 52502 - DNA, 15 bp, Homo sapiens
gtggtagttccttgg

SEQ ID NO: 52503 - DNA, 15 bp, Homo sapiens
tggtagttccttggt

SEQ ID NO: 52504 - DNA, 15 bp, Homo sapiens
ggtagttccttggta

SEQ ID NO: 52505 - DNA, 15 bp, Homo sapiens
gtagttccttggtac

SEQ ID NO: 52506 - DNA, 15 bp, Homo sapiens
tagttccttggtact

SEQ ID NO: 52507 - DNA, 15 bp, Homo sapiens
agttccttggtactc

SEQ ID NO: 52508 - DNA, 15 bp, Homo sapiens
gttccttggtactcg

SEQ ID NO: 52509 - DNA, 15 bp, Homo sapiens
ttccttggtactcgg

SEQ ID NO: 52510 - DNA, 15 bp, Homo sapiens
tccttggtactcggg

SEQ ID NO: 52511 - DNA, 15 bp, Homo sapiens
ccttggtactcgggg

SEQ ID NO: 52512 - DNA, 15 bp, Homo sapiens
cttggtactcggggt

SEQ ID NO: 52513 - DNA, 15 bp, Homo sapiens
ttggtactcggggtt

SEQ ID NO: 52514 - DNA, 15 bp, Homo sapiens
tggtactcggggttg

SEQ ID NO: 52515 - DNA, 15 bp, Homo sapiens
ggtactcggggttgg

SEQ ID NO: 52516 - DNA, 15 bp, Homo sapiens
gtactcggggttgga

SEQ ID NO: 52517 - DNA, 15 bp, Homo sapiens
tactcggggttggag

SEQ ID NO: 52518 - DNA, 15 bp, Homo sapiens
actcggggttggaga

SEQ ID NO: 52519 - DNA, 15 bp, Homo sapiens
ctcggggttggagaa

SEQ ID NO: 52520 - DNA, 15 bp, Homo sapiens
tcggggttggagaat

SEQ ID NO: 52521 - DNA, 15 bp, Homo sapiens
cggggttggagaatc

SEQ ID NO: 52522 - DNA, 15 bp, Homo sapiens
ggggttggagaatct

SEQ ID NO: 52523 - DNA, 15 bp, Homo sapiens
gggttggagaatctc

SEQ ID NO: 52524 - DNA, 15 bp, Homo sapiens
ggttggagaatctcc

SEQ ID NO: 52525 - DNA, 15 bp, Homo sapiens
gttggagaatctccc

SEQ ID NO: 52526 - DNA, 15 bp, Homo sapiens
ttggagaatctccct

SEQ ID NO: 52527 - DNA, 15 bp, Homo sapiens
tggagaatctccctc

SEQ ID NO: 52528 - DNA, 15 bp, Homo sapiens
ggagaatctccctct

SEQ ID NO: 52529 - DNA, 15 bp, Homo sapiens
gagaatctccctctg

SEQ ID NO: 52530 - DNA, 15 bp, Homo sapiens
agaatctccctctgc

SEQ ID NO: 52531 - DNA, 15 bp, Homo sapiens
gaatctccctctgct

SEQ ID NO: 52532 - DNA, 15 bp, Homo sapiens
aatctccctctgctg

SEQ ID NO: 52533 - DNA, 15 bp, Homo sapiens
atctccctctgctgc

SEQ ID NO: 52534 - DNA, 15 bp, Homo sapiens
tctccctctgctgct

SEQ ID NO: 52535 - DNA, 15 bp, Homo sapiens
ctccctctgctgctg

SEQ ID NO: 52536 - DNA, 15 bp, Homo sapiens
tccctctgctgctgg

SEQ ID NO: 52537 - DNA, 15 bp, Homo sapiens
ccctctgctgctgga

SEQ ID NO: 52538 - DNA, 15 bp, Homo sapiens
cctctgctgctggac

SEQ ID NO: 52539 - DNA, 15 bp, Homo sapiens
ctctgctgctggacc

SEQ ID NO: 52540 - DNA, 15 bp, Homo sapiens
tctgctgctggacct

SEQ ID NO: 52541 - DNA, 15 bp, Homo sapiens
ctgctgctggacctt

SEQ ID NO: 52542 - DNA, 15 bp, Homo sapiens
tgctgctggaccttc

SEQ ID NO: 52543 - DNA, 15 bp, Homo sapiens
gctgctggaccttct

SEQ ID NO: 52544 - DNA, 15 bp, Homo sapiens
ctgctggaccttctg

SEQ ID NO: 52545 - DNA, 15 bp, Homo sapiens
tgctggaccttctgc

SEQ ID NO: 52546 - DNA, 15 bp, Homo sapiens
gctggaccttctgcc

SEQ ID NO: 52547 - DNA, 15 bp, Homo sapiens
ctggaccttctgcct

SEQ ID NO: 52548 - DNA, 15 bp, Homo sapiens
tggaccttctgcctc

SEQ ID NO: 52549 - DNA, 15 bp, Homo sapiens
ggaccttctgcctcc

SEQ ID NO: 52550 - DNA, 15 bp, Homo sapiens
gaccttctgcctcct

SEQ ID NO: 52551 - DNA, 15 bp, Homo sapiens
accttctgcctcctc

SEQ ID NO: 52552 - DNA, 15 bp, Homo sapiens
ccttctgcctcctca

SEQ ID NO: 52553 - DNA, 15 bp, Homo sapiens
cttctgcctcctcat

SEQ ID NO: 52554 - DNA, 15 bp, Homo sapiens
ttctgcctcctcatg

SEQ ID NO: 52555 - DNA, 15 bp, Homo sapiens
tctgcctcctcatgc

SEQ ID NO: 52556 - DNA, 15 bp, Homo sapiens
ctgcctcctcatgct

SEQ ID NO: 52557 - DNA, 15 bp, Homo sapiens
tgcctcctcatgctg

SEQ ID NO: 52558 - DNA, 15 bp, Homo sapiens
gcctcctcatgctgt

SEQ ID NO: 52559 - DNA, 15 bp, Homo sapiens
cctcctcatgctgta

SEQ ID NO: 52560 - DNA, 15 bp, Homo sapiens
ctcctcatgctgtaa

SEQ ID NO: 52561 - DNA, 15 bp, Homo sapiens
tcctcatgctgtaat

SEQ ID NO: 52562 - DNA, 15 bp, Homo sapiens
cctcatgctgtaata

SEQ ID NO: 52563 - DNA, 15 bp, Homo sapiens
ctcatgctgtaatat

SEQ ID NO: 52564 - DNA, 15 bp, Homo sapiens
tcatgctgtaatatg

SEQ ID NO: 52565 - DNA, 15 bp, Homo sapiens
catgctgtaatatgc

SEQ ID NO: 52566 - DNA, 15 bp, Homo sapiens
atgctgtaatatgca

SEQ ID NO: 52567 - DNA, 15 bp, Homo sapiens
tgctgtaatatgcat

SEQ ID NO: 52568 - DNA, 15 bp, Homo sapiens
gctgtaatatgcata

SEQ ID NO: 52569 - DNA, 15 bp, Homo sapiens
ctgtaatatgcataa

SEQ ID NO: 52570 - DNA, 15 bp, Homo sapiens
tgtaatatgcataag

SEQ ID NO: 52571 - DNA, 15 bp, Homo sapiens
gtaatatgcataaga

SEQ ID NO: 52572 - DNA, 15 bp, Homo sapiens
taatatgcataagag

SEQ ID NO: 52573 - DNA, 15 bp, Homo sapiens
aatatgcataagagg

SEQ ID NO: 52574 - DNA, 15 bp, Homo sapiens
atatgcataagaggt

SEQ ID NO: 52575 - DNA, 15 bp, Homo sapiens
tatgcataagaggtg

SEQ ID NO: 52576 - DNA, 15 bp, Homo sapiens
atgcataagaggtgt

SEQ ID NO: 52577 - DNA, 15 bp, Homo sapiens
tgcataagaggtgtc

SEQ ID NO: 52578 - DNA, 15 bp, Homo sapiens
gcataagaggtgtcc

SEQ ID NO: 52579 - DNA, 15 bp, Homo sapiens
cataagaggtgtcct

SEQ ID NO: 52580 - DNA, 15 bp, Homo sapiens
ataagaggtgtccta

SEQ ID NO: 52581 - DNA, 15 bp, Homo sapiens
taagaggtgtcctag

SEQ ID NO: 52582 - DNA, 15 bp, Homo sapiens
aagaggtgtcctaga

SEQ ID NO: 52583 - DNA, 15 bp, Homo sapiens
agaggtgtcctagaa

SEQ ID NO: 52584 - DNA, 15 bp, Homo sapiens
gaggtgtcctagaag

SEQ ID NO: 52585 - DNA, 15 bp, Homo sapiens
aggtgtcctagaagt

SEQ ID NO: 52586 - DNA, 15 bp, Homo sapiens
ggtgtcctagaagta

SEQ ID NO: 52587 - DNA, 15 bp, Homo sapiens
gtgtcctagaagtat

SEQ ID NO: 52588 - DNA, 15 bp, Homo sapiens
tgtcctagaagtatt

SEQ ID NO: 52589 - DNA, 15 bp, Homo sapiens
gtcctagaagtattc

SEQ ID NO: 52590 - DNA, 15 bp, Homo sapiens
tcctagaagtattca

SEQ ID NO: 52591 - DNA, 15 bp, Homo sapiens
cctagaagtattcag

SEQ ID NO: 52592 - DNA, 15 bp, Homo sapiens
ctagaagtattcagg

SEQ ID NO: 52593 - DNA, 15 bp, Homo sapiens
tagaagtattcagga

SEQ ID NO: 52594 - DNA, 15 bp, Homo sapiens
agaagtattcaggaa

SEQ ID NO: 52595 - DNA, 15 bp, Homo sapiens
gaagtattcaggaac

SEQ ID NO: 52596 - DNA, 15 bp, Homo sapiens
aagtattcaggaaca

SEQ ID NO: 52597 - DNA, 15 bp, Homo sapiens
agtattcaggaacag

SEQ ID NO: 52598 - DNA, 15 bp, Homo sapiens
gtattcaggaacagg

SEQ ID NO: 52599 - DNA, 15 bp, Homo sapiens
tattcaggaacaggc

SEQ ID NO: 52600 - DNA, 15 bp, Homo sapiens
attcaggaacaggct

SEQ ID NO: 52601 - DNA, 15 bp, Homo sapiens
ttcaggaacaggctg

SEQ ID NO: 52602 - DNA, 15 bp, Homo sapiens
tcaggaacaggctgt

SEQ ID NO: 52603 - DNA, 15 bp, Homo sapiens
caggaacaggctgtg

SEQ ID NO: 52604 - DNA, 15 bp, Homo sapiens
aggaacaggctgtgg

SEQ ID NO: 52605 - DNA, 15 bp, Homo sapiens
ggaacaggctgtggt

SEQ ID NO: 52606 - DNA, 15 bp, Homo sapiens
gaacaggctgtggtt

SEQ ID NO: 52607 - DNA, 15 bp, Homo sapiens
aacaggctgtggttg

SEQ ID NO: 52608 - DNA, 15 bp, Homo sapiens
acaggctgtggttgc

SEQ ID NO: 52609 - DNA, 15 bp, Homo sapiens
caggctgtggttgct

SEQ ID NO: 52610 - DNA, 15 bp, Homo sapiens
aggctgtggttgctt

SEQ ID NO: 52611 - DNA, 15 bp, Homo sapiens
ggctgtggttgcttt

SEQ ID NO: 52612 - DNA, 15 bp, Homo sapiens
gctgtggttgctttg

SEQ ID NO: 52613 - DNA, 15 bp, Homo sapiens
ctgtggttgctttgt

SEQ ID NO: 52614 - DNA, 15 bp, Homo sapiens
tgtggttgctttgtt

SEQ ID NO: 52615 - DNA, 15 bp, Homo sapiens
gtggttgctttgttg

SEQ ID NO: 52616 - DNA, 15 bp, Homo sapiens
tggttgctttgttgt

SEQ ID NO: 52617 - DNA, 15 bp, Homo sapiens
ggttgctttgttgtt

SEQ ID NO: 52618 - DNA, 15 bp, Homo sapiens
gttgctttgttgttc

SEQ ID NO: 52619 - DNA, 15 bp, Homo sapiens
ttgctttgttgttct

SEQ ID NO: 52620 - DNA, 15 bp, Homo sapiens
tgctttgttgttctg

SEQ ID NO: 52621 - DNA, 15 bp, Homo sapiens
gctttgttgttctgt

SEQ ID NO: 52622 - DNA, 15 bp, Homo sapiens
ctttgttgttctgtg

SEQ ID NO: 52623 - DNA, 15 bp, Homo sapiens
tttgttgttctgtga

SEQ ID NO: 52624 - DNA, 15 bp, Homo sapiens
ttgttgttctgtgac

SEQ ID NO: 52625 - DNA, 15 bp, Homo sapiens
tgttgttctgtgact

SEQ ID NO: 52626 - DNA, 15 bp, Homo sapiens
gttgttctgtgactg

SEQ ID NO: 52627 - DNA, 15 bp, Homo sapiens
ttgttctgtgactgt

SEQ ID NO: 52628 - DNA, 15 bp, Homo sapiens
tgttctgtgactgtt

SEQ ID NO: 52629 - DNA, 15 bp, Homo sapiens
gttctgtgactgttg

SEQ ID NO: 52630 - DNA, 15 bp, Homo sapiens
ttctgtgactgttga

SEQ ID NO: 52631 - DNA, 15 bp, Homo sapiens
tctgtgactgttgaa

SEQ ID NO: 52632 - DNA, 15 bp, Homo sapiens
ctgtgactgttgaac

SEQ ID NO: 52633 - DNA, 15 bp, Homo sapiens
tgtgactgttgaact

SEQ ID NO: 52634 - DNA, 15 bp, Homo sapiens
gtgactgttgaactc

SEQ ID NO: 52635 - DNA, 15 bp, Homo sapiens
tgactgttgaactct

SEQ ID NO: 52636 - DNA, 15 bp, Homo sapiens
gactgttgaactctt

SEQ ID NO: 52637 - DNA, 15 bp, Homo sapiens
actgttgaactcttt

SEQ ID NO: 52638 - DNA, 15 bp, Homo sapiens
ctgttgaactcttta

SEQ ID NO: 52639 - DNA, 15 bp, Homo sapiens
tgttgaactctttat

SEQ ID NO: 52640 - DNA, 15 bp, Homo sapiens
gttgaactctttata

SEQ ID NO: 52641 - DNA, 15 bp, Homo sapiens
ttgaactctttatat

SEQ ID NO: 52642 - DNA, 15 bp, Homo sapiens
tgaactctttatata

SEQ ID NO: 52643 - DNA, 15 bp, Homo sapiens
gaactctttatatag

SEQ ID NO: 52644 - DNA, 15 bp, Homo sapiens
aactctttatatagc

SEQ ID NO: 52645 - DNA, 15 bp, Homo sapiens
actctttatatagca

SEQ ID NO: 52646 - DNA, 15 bp, Homo sapiens
ctctttatatagcag

SEQ ID NO: 52647 - DNA, 15 bp, Homo sapiens
tctttatatagcagt

SEQ ID NO: 52648 - DNA, 15 bp, Homo sapiens
ctttatatagcagta

SEQ ID NO: 52649 - DNA, 15 bp, Homo sapiens
tttatatagcagtac

SEQ ID NO: 52650 - DNA, 15 bp, Homo sapiens
ttatatagcagtact

SEQ ID NO: 52651 - DNA, 15 bp, Homo sapiens
tatatagcagtactt

SEQ ID NO: 52652 - DNA, 15 bp, Homo sapiens
atatagcagtacttt

SEQ ID NO: 52653 - DNA, 15 bp, Homo sapiens
tatagcagtactttt

SEQ ID NO: 52654 - DNA, 15 bp, Homo sapiens
atagcagtacttttt

SEQ ID NO: 52655 - DNA, 15 bp, Homo sapiens
tagcagtactttttt

SEQ ID NO: 52656 - DNA, 15 bp, Homo sapiens
agcagtactttttta

SEQ ID NO: 52657 - DNA, 15 bp, Homo sapiens
gcagtacttttttaa

SEQ ID NO: 52658 - DNA, 15 bp, Homo sapiens
cagtacttttttaag

SEQ ID NO: 52659 - DNA, 15 bp, Homo sapiens
agtacttttttaagc

SEQ ID NO: 52660 - DNA, 15 bp, Homo sapiens
gtacttttttaagct

SEQ ID NO: 52661 - DNA, 15 bp, Homo sapiens
tacttttttaagctg

SEQ ID NO: 52662 - DNA, 15 bp, Homo sapiens
acttttttaagctgt

SEQ ID NO: 52663 - DNA, 15 bp, Homo sapiens
cttttttaagctgta

SEQ ID NO: 52664 - DNA, 15 bp, Homo sapiens
ttttttaagctgtac

SEQ ID NO: 52665 - DNA, 15 bp, Homo sapiens
tttttaagctgtact

SEQ ID NO: 52666 - DNA, 15 bp, Homo sapiens
ttttaagctgtacta

SEQ ID NO: 52667 - DNA, 15 bp, Homo sapiens
tttaagctgtactaa

SEQ ID NO: 52668 - DNA, 15 bp, Homo sapiens
ttaagctgtactaat

SEQ ID NO: 52669 - DNA, 15 bp, Homo sapiens
taagctgtactaatt

SEQ ID NO: 52670 - DNA, 15 bp, Homo sapiens
aagctgtactaattg

SEQ ID NO: 52671 - DNA, 15 bp, Homo sapiens
agctgtactaattga

SEQ ID NO: 52672 - DNA, 15 bp, Homo sapiens
gctgtactaattgag

SEQ ID NO: 52673 - DNA, 15 bp, Homo sapiens
ctgtactaattgagc

SEQ ID NO: 52674 - DNA, 15 bp, Homo sapiens
tgtactaattgagca

SEQ ID NO: 52675 - DNA, 15 bp, Homo sapiens
gtactaattgagcat

SEQ ID NO: 52676 - DNA, 15 bp, Homo sapiens
tactaattgagcatt

SEQ ID NO: 52677 - DNA, 15 bp, Homo sapiens
actaattgagcattt

SEQ ID NO: 52678 - DNA, 15 bp, Homo sapiens
ctaattgagcattta

SEQ ID NO: 52679 - DNA, 15 bp, Homo sapiens
taattgagcatttat

SEQ ID NO: 52680 - DNA, 15 bp, Homo sapiens
aattgagcatttatt

SEQ ID NO: 52681 - DNA, 15 bp, Homo sapiens
attgagcatttatta

SEQ ID NO: 52682 - DNA, 15 bp, Homo sapiens
ttgagcatttattat

SEQ ID NO: 52683 - DNA, 15 bp, Homo sapiens
tgagcatttattatg

SEQ ID NO: 52684 - DNA, 15 bp, Homo sapiens
gagcatttattatgt

SEQ ID NO: 52685 - DNA, 15 bp, Homo sapiens
agcatttattatgtg

SEQ ID NO: 52686 - DNA, 15 bp, Homo sapiens
gcatttattatgtgt

SEQ ID NO: 52687 - DNA, 15 bp, Homo sapiens
catttattatgtgtc

SEQ ID NO: 52688 - DNA, 15 bp, Homo sapiens
atttattatgtgtca

SEQ ID NO: 52689 - DNA, 15 bp, Homo sapiens
tttattatgtgtcag

SEQ ID NO: 52690 - DNA, 15 bp, Homo sapiens
ttattatgtgtcagt

SEQ ID NO: 52691 - DNA, 15 bp, Homo sapiens
tattatgtgtcagtt

SEQ ID NO: 52692 - DNA, 15 bp, Homo sapiens
attatgtgtcagtta

SEQ ID NO: 52693 - DNA, 15 bp, Homo sapiens
ttatgtgtcagttac

SEQ ID NO: 52694 - DNA, 15 bp, Homo sapiens
tatgtgtcagttact

SEQ ID NO: 52695 - DNA, 15 bp, Homo sapiens
atgtgtcagttactg

SEQ ID NO: 52696 - DNA, 15 bp, Homo sapiens
tgtgtcagttactgt

SEQ ID NO: 52697 - DNA, 15 bp, Homo sapiens
gtgtcagttactgtg

SEQ ID NO: 52698 - DNA, 15 bp, Homo sapiens
tgtcagttactgtgc

SEQ ID NO: 52699 - DNA, 15 bp, Homo sapiens
gtcagttactgtgct

SEQ ID NO: 52700 - DNA, 15 bp, Homo sapiens
tcagttactgtgcta

SEQ ID NO: 52701 - DNA, 15 bp, Homo sapiens
cagttactgtgctag

SEQ ID NO: 52702 - DNA, 15 bp, Homo sapiens
agttactgtgctagc

SEQ ID NO: 52703 - DNA, 15 bp, Homo sapiens
gttactgtgctagct

SEQ ID NO: 52704 - DNA, 15 bp, Homo sapiens
ttactgtgctagctg

SEQ ID NO: 52705 - DNA, 15 bp, Homo sapiens
tactgtgctagctgc

SEQ ID NO: 52706 - DNA, 15 bp, Homo sapiens
actgtgctagctgct

SEQ ID NO: 52707 - DNA, 15 bp, Homo sapiens
ctgtgctagctgctg

SEQ ID NO: 52708 - DNA, 15 bp, Homo sapiens
tgtgctagctgctgg

SEQ ID NO: 52709 - DNA, 15 bp, Homo sapiens
gtgctagctgctgga

SEQ ID NO: 52710 - DNA, 15 bp, Homo sapiens
tgctagctgctggaa

SEQ ID NO: 52711 - DNA, 15 bp, Homo sapiens
gctagctgctggaaa

SEQ ID NO: 52712 - DNA, 15 bp, Homo sapiens
ctagctgctggaaac

SEQ ID NO: 52713 - DNA, 15 bp, Homo sapiens
tagctgctggaaact

SEQ ID NO: 52714 - DNA, 15 bp, Homo sapiens
agctgctggaaacta

SEQ ID NO: 52715 - DNA, 15 bp, Homo sapiens
gctgctggaaactat

SEQ ID NO: 52716 - DNA, 15 bp, Homo sapiens
ctgctggaaactatc

SEQ ID NO: 52717 - DNA, 15 bp, Homo sapiens
tgctggaaactatcc

SEQ ID NO: 52718 - DNA, 15 bp, Homo sapiens
gctggaaactatcct

SEQ ID NO: 52719 - DNA, 15 bp, Homo sapiens
ctggaaactatccta

SEQ ID NO: 52720 - DNA, 15 bp, Homo sapiens
tggaaactatcctac

SEQ ID NO: 52721 - DNA, 15 bp, Homo sapiens
ggaaactatcctacc

SEQ ID NO: 52722 - DNA, 15 bp, Homo sapiens
gaaactatcctaccc

SEQ ID NO: 52723 - DNA, 15 bp, Homo sapiens
aaactatcctaccct

SEQ ID NO: 52724 - DNA, 15 bp, Homo sapiens
aactatcctaccctc

SEQ ID NO: 52725 - DNA, 15 bp, Homo sapiens
actatcctaccctca

SEQ ID NO: 52726 - DNA, 15 bp, Homo sapiens
ctatcctaccctcag

SEQ ID NO: 52727 - DNA, 15 bp, Homo sapiens
tatcctaccctcagc

SEQ ID NO: 52728 - DNA, 15 bp, Homo sapiens
atcctaccctcagca

SEQ ID NO: 52729 - DNA, 15 bp, Homo sapiens
tcctaccctcagcag

SEQ ID NO: 52730 - DNA, 15 bp, Homo sapiens
cctaccctcagcagt

SEQ ID NO: 52731 - DNA, 15 bp, Homo sapiens
ctaccctcagcagtc

SEQ ID NO: 52732 - DNA, 15 bp, Homo sapiens
taccctcagcagtct

SEQ ID NO: 52733 - DNA, 15 bp, Homo sapiens
accctcagcagtctt

SEQ ID NO: 52734 - DNA, 15 bp, Homo sapiens
ccctcagcagtcttc

SEQ ID NO: 52735 - DNA, 15 bp, Homo sapiens
cctcagcagtcttct

SEQ ID NO: 52736 - DNA, 15 bp, Homo sapiens
ctcagcagtcttctg

SEQ ID NO: 52737 - DNA, 15 bp, Homo sapiens
tcagcagtcttctgg

SEQ ID NO: 52738 - DNA, 15 bp, Homo sapiens
cagcagtcttctggt

SEQ ID NO: 52739 - DNA, 15 bp, Homo sapiens
agcagtcttctggtc

SEQ ID NO: 52740 - DNA, 15 bp, Homo sapiens
gcagtcttctggtct

SEQ ID NO: 52741 - DNA, 15 bp, Homo sapiens
cagtcttctggtcta

SEQ ID NO: 52742 - DNA, 15 bp, Homo sapiens
agtcttctggtctaa

SEQ ID NO: 52743 - DNA, 15 bp, Homo sapiens
gtcttctggtctaat

SEQ ID NO: 52744 - DNA, 15 bp, Homo sapiens
tcttctggtctaatg

SEQ ID NO: 52745 - DNA, 15 bp, Homo sapiens
cttctggtctaatgg

SEQ ID NO: 52746 - DNA, 15 bp, Homo sapiens
ttctggtctaatggg

SEQ ID NO: 52747 - DNA, 15 bp, Homo sapiens
tctggtctaatggga

SEQ ID NO: 52748 - DNA, 15 bp, Homo sapiens
ctggtctaatgggag

SEQ ID NO: 52749 - DNA, 15 bp, Homo sapiens
tggtctaatgggagg

SEQ ID NO: 52750 - DNA, 15 bp, Homo sapiens
ggtctaatgggaggt

SEQ ID NO: 52751 - DNA, 15 bp, Homo sapiens
gtctaatgggaggta

SEQ ID NO: 52752 - DNA, 15 bp, Homo sapiens
tctaatgggaggtac

SEQ ID NO: 52753 - DNA, 15 bp, Homo sapiens
ctaatgggaggtaca

SEQ ID NO: 52754 - DNA, 15 bp, Homo sapiens
taatgggaggtacag

SEQ ID NO: 52755 - DNA, 15 bp, Homo sapiens
aatgggaggtacaga

SEQ ID NO: 52756 - DNA, 15 bp, Homo sapiens
atgggaggtacagac

SEQ ID NO: 52757 - DNA, 15 bp, Homo sapiens
tgggaggtacagaca

SEQ ID NO: 52758 - DNA, 15 bp, Homo sapiens
gggaggtacagacag

SEQ ID NO: 52759 - DNA, 15 bp, Homo sapiens
ggaggtacagacagg

SEQ ID NO: 52760 - DNA, 15 bp, Homo sapiens
gaggtacagacaggc

SEQ ID NO: 52761 - DNA, 15 bp, Homo sapiens
aggtacagacaggca

SEQ ID NO: 52762 - DNA, 15 bp, Homo sapiens
ggtacagacaggcaa

SEQ ID NO: 52763 - DNA, 15 bp, Homo sapiens
gtacagacaggcaaa

SEQ ID NO: 52764 - DNA, 15 bp, Homo sapiens
tacagacaggcaaat

SEQ ID NO: 52765 - DNA, 15 bp, Homo sapiens
acagacaggcaaatg

SEQ ID NO: 52766 - DNA, 15 bp, Homo sapiens
cagacaggcaaatgg

SEQ ID NO: 52767 - DNA, 15 bp, Homo sapiens
agacaggcaaatggg

SEQ ID NO: 52768 - DNA, 15 bp, Homo sapiens
gacaggcaaatgggc

SEQ ID NO: 52769 - DNA, 15 bp, Homo sapiens
acaggcaaatgggct

SEQ ID NO: 52770 - DNA, 15 bp, Homo sapiens
caggcaaatgggcta

SEQ ID NO: 52771 - DNA, 15 bp, Homo sapiens
aggcaaatgggctat

SEQ ID NO: 52772 - DNA, 15 bp, Homo sapiens
ggcaaatgggctatg

SEQ ID NO: 52773 - DNA, 15 bp, Homo sapiens
gcaaatgggctatga

SEQ ID NO: 52774 - DNA, 15 bp, Homo sapiens
caaatgggctatgac

SEQ ID NO: 52775 - DNA, 15 bp, Homo sapiens
aaatgggctatgact

SEQ ID NO: 52776 - DNA, 15 bp, Homo sapiens
aatgggctatgactt

SEQ ID NO: 52777 - DNA, 15 bp, Homo sapiens
atgggctatgacttt

SEQ ID NO: 52778 - DNA, 15 bp, Homo sapiens
tgggctatgacttta

SEQ ID NO: 52779 - DNA, 15 bp, Homo sapiens
gggctatgactttac

SEQ ID NO: 52780 - DNA, 15 bp, Homo sapiens
ggctatgactttaca

SEQ ID NO: 52781 - DNA, 15 bp, Homo sapiens
gctatgactttacaa

SEQ ID NO: 52782 - DNA, 15 bp, Homo sapiens
ctatgactttacaag

SEQ ID NO: 52783 - DNA, 15 bp, Homo sapiens
tatgactttacaaga

SEQ ID NO: 52784 - DNA, 15 bp, Homo sapiens
atgactttacaagag

SEQ ID NO: 52785 - DNA, 15 bp, Homo sapiens
tgactttacaagagg

SEQ ID NO: 52786 - DNA, 15 bp, Homo sapiens
gactttacaagaggc

SEQ ID NO: 52787 - DNA, 15 bp, Homo sapiens
actttacaagaggct

SEQ ID NO: 52788 - DNA, 15 bp, Homo sapiens
ctttacaagaggcta

SEQ ID NO: 52789 - DNA, 15 bp, Homo sapiens
tttacaagaggctaa

SEQ ID NO: 52790 - DNA, 15 bp, Homo sapiens
ttacaagaggctaac

SEQ ID NO: 52791 - DNA, 15 bp, Homo sapiens
tacaagaggctaact

SEQ ID NO: 52792 - DNA, 15 bp, Homo sapiens
acaagaggctaactt

SEQ ID NO: 52793 - DNA, 15 bp, Homo sapiens
caagaggctaacttc

SEQ ID NO: 52794 - DNA, 15 bp, Homo sapiens
aagaggctaacttct

SEQ ID NO: 52795 - DNA, 15 bp, Homo sapiens
agaggctaacttctg

SEQ ID NO: 52796 - DNA, 15 bp, Homo sapiens
gaggctaacttctgt

SEQ ID NO: 52797 - DNA, 15 bp, Homo sapiens
aggctaacttctgtg

SEQ ID NO: 52798 - DNA, 15 bp, Homo sapiens
ggctaacttctgtga

SEQ ID NO: 52799 - DNA, 15 bp, Homo sapiens
gctaacttctgtgat

SEQ ID NO: 52800 - DNA, 15 bp, Homo sapiens
ctaacttctgtgatg

SEQ ID NO: 52801 - DNA, 15 bp, Homo sapiens
taacttctgtgatgg

SEQ ID NO: 52802 - DNA, 15 bp, Homo sapiens
aacttctgtgatgga

SEQ ID NO: 52803 - DNA, 15 bp, Homo sapiens
acttctgtgatggag

SEQ ID NO: 52804 - DNA, 15 bp, Homo sapiens
cttctgtgatggaga

SEQ ID NO: 52805 - DNA, 15 bp, Homo sapiens
ttctgtgatggagag

SEQ ID NO: 52806 - DNA, 15 bp, Homo sapiens
tctgtgatggagaga

SEQ ID NO: 52807 - DNA, 15 bp, Homo sapiens
ctgtgatggagagaa

SEQ ID NO: 52808 - DNA, 15 bp, Homo sapiens
tgtgatggagagaag

SEQ ID NO: 52809 - DNA, 15 bp, Homo sapiens
gtgatggagagaagt

SEQ ID NO: 52810 - DNA, 15 bp, Homo sapiens
tgatggagagaagtt

SEQ ID NO: 52811 - DNA, 15 bp, Homo sapiens
gatggagagaagttc

SEQ ID NO: 52812 - DNA, 15 bp, Homo sapiens
atggagagaagttcc

SEQ ID NO: 52813 - DNA, 15 bp, Homo sapiens
tggagagaagttcca

SEQ ID NO: 52814 - DNA, 15 bp, Homo sapiens
ggagagaagttccag

SEQ ID NO: 52815 - DNA, 15 bp, Homo sapiens
gagagaagttccagc

SEQ ID NO: 52816 - DNA, 15 bp, Homo sapiens
agagaagttccagcc

SEQ ID NO: 52817 - DNA, 15 bp, Homo sapiens
gagaagttccagcca

SEQ ID NO: 52818 - DNA, 15 bp, Homo sapiens
agaagttccagccac

SEQ ID NO: 52819 - DNA, 15 bp, Homo sapiens
gaagttccagccact

SEQ ID NO: 52820 - DNA, 15 bp, Homo sapiens
aagttccagccacta

SEQ ID NO: 52821 - DNA, 15 bp, Homo sapiens
agttccagccactaa

SEQ ID NO: 52822 - DNA, 15 bp, Homo sapiens
gttccagccactaag

SEQ ID NO: 52823 - DNA, 15 bp, Homo sapiens
ttccagccactaagg

SEQ ID NO: 52824 - DNA, 15 bp, Homo sapiens
tccagccactaaggg

SEQ ID NO: 52825 - DNA, 15 bp, Homo sapiens
ccagccactaaggga

SEQ ID NO: 52826 - DNA, 15 bp, Homo sapiens
cagccactaagggag

SEQ ID NO: 52827 - DNA, 15 bp, Homo sapiens
agccactaagggagc

SEQ ID NO: 52828 - DNA, 15 bp, Homo sapiens
gccactaagggagca

SEQ ID NO: 52829 - DNA, 15 bp, Homo sapiens
ccactaagggagcac

SEQ ID NO: 52830 - DNA, 15 bp, Homo sapiens
cactaagggagcaca

SEQ ID NO: 52831 - DNA, 15 bp, Homo sapiens
actaagggagcacat

SEQ ID NO: 52832 - DNA, 15 bp, Homo sapiens
ctaagggagcacata

SEQ ID NO: 52833 - DNA, 15 bp, Homo sapiens
taagggagcacataa

SEQ ID NO: 52834 - DNA, 15 bp, Homo sapiens
aagggagcacataaa

SEQ ID NO: 52835 - DNA, 15 bp, Homo sapiens
agggagcacataaaa

SEQ ID NO: 52836 - DNA, 15 bp, Homo sapiens
gggagcacataaaaa

SEQ ID NO: 52837 - DNA, 15 bp, Homo sapiens
ggagcacataaaaat

SEQ ID NO: 52838 - DNA, 15 bp, Homo sapiens
gagcacataaaaatc

SEQ ID NO: 52839 - DNA, 15 bp, Homo sapiens
agcacataaaaatca

SEQ ID NO: 52840 - DNA, 15 bp, Homo sapiens
gcacataaaaatcag

SEQ ID NO: 52841 - DNA, 15 bp, Homo sapiens
cacataaaaatcaga

SEQ ID NO: 52842 - DNA, 15 bp, Homo sapiens
acataaaaatcagag

SEQ ID NO: 52843 - DNA, 15 bp, Homo sapiens
cataaaaatcagagg

SEQ ID NO: 52844 - DNA, 15 bp, Homo sapiens
ataaaaatcagagga

SEQ ID NO: 52845 - DNA, 15 bp, Homo sapiens
taaaaatcagaggag

SEQ ID NO: 52846 - DNA, 15 bp, Homo sapiens
aaaaatcagaggaga

SEQ ID NO: 52847 - DNA, 15 bp, Homo sapiens
aaaatcagaggagat

SEQ ID NO: 52848 - DNA, 15 bp, Homo sapiens
aaatcagaggagatc

SEQ ID NO: 52849 - DNA, 15 bp, Homo sapiens
aatcagaggagatcc

SEQ ID NO: 52850 - DNA, 15 bp, Homo sapiens
atcagaggagatcct

SEQ ID NO: 52851 - DNA, 15 bp, Homo sapiens
tcagaggagatccta

SEQ ID NO: 52852 - DNA, 15 bp, Homo sapiens
cagaggagatcctac

SEQ ID NO: 52853 - DNA, 15 bp, Homo sapiens
agaggagatcctacc

SEQ ID NO: 52854 - DNA, 15 bp, Homo sapiens
gaggagatcctacca

SEQ ID NO: 52855 - DNA, 15 bp, Homo sapiens
aggagatcctaccaa

SEQ ID NO: 52856 - DNA, 15 bp, Homo sapiens
ggagatcctaccaag

SEQ ID NO: 52857 - DNA, 15 bp, Homo sapiens
gagatcctaccaaga

SEQ ID NO: 52858 - DNA, 15 bp, Homo sapiens
agatcctaccaagaa

SEQ ID NO: 52859 - DNA, 15 bp, Homo sapiens
gatcctaccaagaat

SEQ ID NO: 52860 - DNA, 15 bp, Homo sapiens
atcctaccaagaatt

SEQ ID NO: 52861 - DNA, 15 bp, Homo sapiens
tcctaccaagaattg

SEQ ID NO: 52862 - DNA, 15 bp, Homo sapiens
cctaccaagaattgg

SEQ ID NO: 52863 - DNA, 15 bp, Homo sapiens
ctaccaagaattggg

SEQ ID NO: 52864 - DNA, 15 bp, Homo sapiens
taccaagaattggga

SEQ ID NO: 52865 - DNA, 15 bp, Homo sapiens
accaagaattgggag

SEQ ID NO: 52866 - DNA, 15 bp, Homo sapiens
ccaagaattgggagg

SEQ ID NO: 52867 - DNA, 15 bp, Homo sapiens
caagaattgggaggt

SEQ ID NO: 52868 - DNA, 15 bp, Homo sapiens
aagaattgggaggta

SEQ ID NO: 52869 - DNA, 15 bp, Homo sapiens
agaattgggaggtag

SEQ ID NO: 52870 - DNA, 15 bp, Homo sapiens
gaattgggaggtagg

SEQ ID NO: 52871 - DNA, 15 bp, Homo sapiens
aattgggaggtaggt

SEQ ID NO: 52872 - DNA, 15 bp, Homo sapiens
attgggaggtaggtc

SEQ ID NO: 52873 - DNA, 15 bp, Homo sapiens
ttgggaggtaggtca

SEQ ID NO: 52874 - DNA, 15 bp, Homo sapiens
tgggaggtaggtcag

SEQ ID NO: 52875 - DNA, 15 bp, Homo sapiens
gggaggtaggtcagg

SEQ ID NO: 52876 - DNA, 15 bp, Homo sapiens
ggaggtaggtcaggg

SEQ ID NO: 52877 - DNA, 15 bp, Homo sapiens
gaggtaggtcaggga

SEQ ID NO: 52878 - DNA, 15 bp, Homo sapiens
aggtaggtcagggag

SEQ ID NO: 52879 - DNA, 15 bp, Homo sapiens
ggtaggtcagggagg

SEQ ID NO: 52880 - DNA, 15 bp, Homo sapiens
gtaggtcagggagga

SEQ ID NO: 52881 - DNA, 15 bp, Homo sapiens
taggtcagggaggag

SEQ ID NO: 52882 - DNA, 15 bp, Homo sapiens
aggtcagggaggaga

SEQ ID NO: 52883 - DNA, 15 bp, Homo sapiens
ggtcagggaggagac

SEQ ID NO: 52884 - DNA, 15 bp, Homo sapiens
gtcagggaggagact

SEQ ID NO: 52885 - DNA, 15 bp, Homo sapiens
tcagggaggagactt

SEQ ID NO: 52886 - DNA, 15 bp, Homo sapiens
cagggaggagacttc

SEQ ID NO: 52887 - DNA, 15 bp, Homo sapiens
agggaggagacttct

SEQ ID NO: 52888 - DNA, 15 bp, Homo sapiens
gggaggagacttctt

SEQ ID NO: 52889 - DNA, 15 bp, Homo sapiens
ggaggagacttcttt

SEQ ID NO: 52890 - DNA, 15 bp, Homo sapiens
gaggagacttctttg

SEQ ID NO: 52891 - DNA, 15 bp, Homo sapiens
aggagacttctttga

SEQ ID NO: 52892 - DNA, 15 bp, Homo sapiens
ggagacttctttgaa

SEQ ID NO: 52893 - DNA, 15 bp, Homo sapiens
gagacttctttgaaa

SEQ ID NO: 52894 - DNA, 15 bp, Homo sapiens
agacttctttgaaaa

SEQ ID NO: 52895 - DNA, 15 bp, Homo sapiens
gacttctttgaaaaa

SEQ ID NO: 52896 - DNA, 15 bp, Homo sapiens
acttctttgaaaaat

SEQ ID NO: 52897 - DNA, 15 bp, Homo sapiens
cttctttgaaaaatg

SEQ ID NO: 52898 - DNA, 15 bp, Homo sapiens
ttctttgaaaaatgg

SEQ ID NO: 52899 - DNA, 15 bp, Homo sapiens
tctttgaaaaatggc

SEQ ID NO: 52900 - DNA, 15 bp, Homo sapiens
ctttgaaaaatggca

SEQ ID NO: 52901 - DNA, 15 bp, Homo sapiens
tttgaaaaatggcat

SEQ ID NO: 52902 - DNA, 15 bp, Homo sapiens
ttgaaaaatggcatc

SEQ ID NO: 52903 - DNA, 15 bp, Homo sapiens
tgaaaaatggcatct

SEQ ID NO: 52904 - DNA, 15 bp, Homo sapiens
gaaaaatggcatcta

SEQ ID NO: 52905 - DNA, 15 bp, Homo sapiens
aaaaatggcatctaa

SEQ ID NO: 52906 - DNA, 15 bp, Homo sapiens
aaaatggcatctaag

SEQ ID NO: 52907 - DNA, 15 bp, Homo sapiens
aaatggcatctaaga

SEQ ID NO: 52908 - DNA, 15 bp, Homo sapiens
aatggcatctaagac

SEQ ID NO: 52909 - DNA, 15 bp, Homo sapiens
atggcatctaagacc

SEQ ID NO: 52910 - DNA, 15 bp, Homo sapiens
tggcatctaagacct

SEQ ID NO: 52911 - DNA, 15 bp, Homo sapiens
ggcatctaagacctg

SEQ ID NO: 52912 - DNA, 15 bp, Homo sapiens
gcatctaagacctga

SEQ ID NO: 52913 - DNA, 15 bp, Homo sapiens
catctaagacctgaa

SEQ ID NO: 52914 - DNA, 15 bp, Homo sapiens
atctaagacctgaac

SEQ ID NO: 52915 - DNA, 15 bp, Homo sapiens
tctaagacctgaaca

SEQ ID NO: 52916 - DNA, 15 bp, Homo sapiens
ctaagacctgaacag

SEQ ID NO: 52917 - DNA, 15 bp, Homo sapiens
taagacctgaacagc

SEQ ID NO: 52918 - DNA, 15 bp, Homo sapiens
aagacctgaacagca

SEQ ID NO: 52919 - DNA, 15 bp, Homo sapiens
agacctgaacagcaa

SEQ ID NO: 52920 - DNA, 15 bp, Homo sapiens
gacctgaacagcaag

SEQ ID NO: 52921 - DNA, 15 bp, Homo sapiens
acctgaacagcaagg

SEQ ID NO: 52922 - DNA, 15 bp, Homo sapiens
cctgaacagcaagga

SEQ ID NO: 52923 - DNA, 15 bp, Homo sapiens
ctgaacagcaaggaa

SEQ ID NO: 52924 - DNA, 15 bp, Homo sapiens
tgaacagcaaggaaa

SEQ ID NO: 52925 - DNA, 15 bp, Homo sapiens
gaacagcaaggaaac

SEQ ID NO: 52926 - DNA, 15 bp, Homo sapiens
aacagcaaggaaaca

SEQ ID NO: 52927 - DNA, 15 bp, Homo sapiens
acagcaaggaaacat

SEQ ID NO: 52928 - DNA, 15 bp, Homo sapiens
cagcaaggaaacatt

SEQ ID NO: 52929 - DNA, 15 bp, Homo sapiens
agcaaggaaacatta

SEQ ID NO: 52930 - DNA, 15 bp, Homo sapiens
gcaaggaaacattag

SEQ ID NO: 52931 - DNA, 15 bp, Homo sapiens
caaggaaacattagc

SEQ ID NO: 52932 - DNA, 15 bp, Homo sapiens
aaggaaacattagct

SEQ ID NO: 52933 - DNA, 15 bp, Homo sapiens
aggaaacattagcta

SEQ ID NO: 52934 - DNA, 15 bp, Homo sapiens
ggaaacattagctag

SEQ ID NO: 52935 - DNA, 15 bp, Homo sapiens
gaaacattagctagg

SEQ ID NO: 52936 - DNA, 15 bp, Homo sapiens
aaacattagctaggt

SEQ ID NO: 52937 - DNA, 15 bp, Homo sapiens
aacattagctaggtc

SEQ ID NO: 52938 - DNA, 15 bp, Homo sapiens
acattagctaggtca

SEQ ID NO: 52939 - DNA, 15 bp, Homo sapiens
cattagctaggtcaa

SEQ ID NO: 52940 - DNA, 15 bp, Homo sapiens
attagctaggtcaag

SEQ ID NO: 52941 - DNA, 15 bp, Homo sapiens
ttagctaggtcaagg

SEQ ID NO: 52942 - DNA, 15 bp, Homo sapiens
tagctaggtcaagga

SEQ ID NO: 52943 - DNA, 15 bp, Homo sapiens
agctaggtcaaggac

SEQ ID NO: 52944 - DNA, 15 bp, Homo sapiens
gctaggtcaaggaca

SEQ ID NO: 52945 - DNA, 15 bp, Homo sapiens
ctaggtcaaggacaa

SEQ ID NO: 52946 - DNA, 15 bp, Homo sapiens
taggtcaaggacaaa

SEQ ID NO: 52947 - DNA, 15 bp, Homo sapiens
aggtcaaggacaaag

SEQ ID NO: 52948 - DNA, 15 bp, Homo sapiens
ggtcaaggacaaagc

SEQ ID NO: 52949 - DNA, 15 bp, Homo sapiens
gtcaaggacaaagca

SEQ ID NO: 52950 - DNA, 15 bp, Homo sapiens
tcaaggacaaagcat

SEQ ID NO: 52951 - DNA, 15 bp, Homo sapiens
caaggacaaagcatc

SEQ ID NO: 52952 - DNA, 15 bp, Homo sapiens
aaggacaaagcatca

SEQ ID NO: 52953 - DNA, 15 bp, Homo sapiens
aggacaaagcatcag

SEQ ID NO: 52954 - DNA, 15 bp, Homo sapiens
ggacaaagcatcagt

SEQ ID NO: 52955 - DNA, 15 bp, Homo sapiens
gacaaagcatcagtg

SEQ ID NO: 52956 - DNA, 15 bp, Homo sapiens
acaaagcatcagtgg

SEQ ID NO: 52957 - DNA, 15 bp, Homo sapiens
caaagcatcagtggg

SEQ ID NO: 52958 - DNA, 15 bp, Homo sapiens
aaagcatcagtgggg

SEQ ID NO: 52959 - DNA, 15 bp, Homo sapiens
aagcatcagtgggga

SEQ ID NO: 52960 - DNA, 15 bp, Homo sapiens
agcatcagtggggag

SEQ ID NO: 52961 - DNA, 15 bp, Homo sapiens
gcatcagtggggaga

SEQ ID NO: 52962 - DNA, 15 bp, Homo sapiens
catcagtggggagag

SEQ ID NO: 52963 - DNA, 15 bp, Homo sapiens
atcagtggggagaga

SEQ ID NO: 52964 - DNA, 15 bp, Homo sapiens
tcagtggggagagat

SEQ ID NO: 52965 - DNA, 15 bp, Homo sapiens
cagtggggagagatg

SEQ ID NO: 52966 - DNA, 15 bp, Homo sapiens
agtggggagagatgc

SEQ ID NO: 52967 - DNA, 15 bp, Homo sapiens
gtggggagagatgca

SEQ ID NO: 52968 - DNA, 15 bp, Homo sapiens
tggggagagatgcat

SEQ ID NO: 52969 - DNA, 15 bp, Homo sapiens
ggggagagatgcatg

SEQ ID NO: 52970 - DNA, 15 bp, Homo sapiens
gggagagatgcatga

SEQ ID NO: 52971 - DNA, 15 bp, Homo sapiens
ggagagatgcatgag

SEQ ID NO: 52972 - DNA, 15 bp, Homo sapiens
gagagatgcatgagt

SEQ ID NO: 52973 - DNA, 15 bp, Homo sapiens
agagatgcatgagtc

SEQ ID NO: 52974 - DNA, 15 bp, Homo sapiens
gagatgcatgagtct

SEQ ID NO: 52975 - DNA, 15 bp, Homo sapiens
agatgcatgagtctt

SEQ ID NO: 52976 - DNA, 15 bp, Homo sapiens
gatgcatgagtcttt

SEQ ID NO: 52977 - DNA, 15 bp, Homo sapiens
atgcatgagtctttt

SEQ ID NO: 52978 - DNA, 15 bp, Homo sapiens
tgcatgagtcttttg

SEQ ID NO: 52979 - DNA, 15 bp, Homo sapiens
gcatgagtcttttgg

SEQ ID NO: 52980 - DNA, 15 bp, Homo sapiens
catgagtcttttgga

SEQ ID NO: 52981 - DNA, 15 bp, Homo sapiens
atgagtcttttggaa

SEQ ID NO: 52982 - DNA, 15 bp, Homo sapiens
tgagtcttttggaag

SEQ ID NO: 52983 - DNA, 15 bp, Homo sapiens
gagtcttttggaagg

SEQ ID NO: 52984 - DNA, 15 bp, Homo sapiens
agtcttttggaagga

SEQ ID NO: 52985 - DNA, 15 bp, Homo sapiens
gtcttttggaaggac

SEQ ID NO: 52986 - DNA, 15 bp, Homo sapiens
tcttttggaaggacc

SEQ ID NO: 52987 - DNA, 15 bp, Homo sapiens
cttttggaaggacca

SEQ ID NO: 52988 - DNA, 15 bp, Homo sapiens
ttttggaaggaccag

SEQ ID NO: 52989 - DNA, 15 bp, Homo sapiens
tttggaaggaccagc

SEQ ID NO: 52990 - DNA, 15 bp, Homo sapiens
ttggaaggaccagca

SEQ ID NO: 52991 - DNA, 15 bp, Homo sapiens
tggaaggaccagcat

SEQ ID NO: 52992 - DNA, 15 bp, Homo sapiens
ggaaggaccagcatg

SEQ ID NO: 52993 - DNA, 15 bp, Homo sapiens
gaaggaccagcatgt

SEQ ID NO: 52994 - DNA, 15 bp, Homo sapiens
aaggaccagcatgtg

SEQ ID NO: 52995 - DNA, 15 bp, Homo sapiens
aggaccagcatgtgt

SEQ ID NO: 52996 - DNA, 15 bp, Homo sapiens
ggaccagcatgtgta

SEQ ID NO: 52997 - DNA, 15 bp, Homo sapiens
gaccagcatgtgtag

SEQ ID NO: 52998 - DNA, 15 bp, Homo sapiens
accagcatgtgtaga

SEQ ID NO: 52999 - DNA, 15 bp, Homo sapiens
ccagcatgtgtagag

SEQ ID NO: 53000 - DNA, 15 bp, Homo sapiens
cagcatgtgtagagg

SEQ ID NO: 53001 - DNA, 15 bp, Homo sapiens
agcatgtgtagaggc

SEQ ID NO: 53002 - DNA, 15 bp, Homo sapiens
gcatgtgtagaggct

SEQ ID NO: 53003 - DNA, 15 bp, Homo sapiens
catgtgtagaggctc

SEQ ID NO: 53004 - DNA, 15 bp, Homo sapiens
atgtgtagaggctct

SEQ ID NO: 53005 - DNA, 15 bp, Homo sapiens
tgtgtagaggctctg

SEQ ID NO: 53006 - DNA, 15 bp, Homo sapiens
gtgtagaggctctga

SEQ ID NO: 53007 - DNA, 15 bp, Homo sapiens
tgtagaggctctgac

SEQ ID NO: 53008 - DNA, 15 bp, Homo sapiens
gtagaggctctgaca

SEQ ID NO: 53009 - DNA, 15 bp, Homo sapiens
tagaggctctgacag

SEQ ID NO: 53010 - DNA, 15 bp, Homo sapiens
agaggctctgacagg

SEQ ID NO: 53011 - DNA, 15 bp, Homo sapiens
gaggctctgacagga

SEQ ID NO: 53012 - DNA, 15 bp, Homo sapiens
aggctctgacaggag

SEQ ID NO: 53013 - DNA, 15 bp, Homo sapiens
ggctctgacaggaga

SEQ ID NO: 53014 - DNA, 15 bp, Homo sapiens
gctctgacaggagag

SEQ ID NO: 53015 - DNA, 15 bp, Homo sapiens
ctctgacaggagaga

SEQ ID NO: 53016 - DNA, 15 bp, Homo sapiens
tctgacaggagagaa

SEQ ID NO: 53017 - DNA, 15 bp, Homo sapiens
ctgacaggagagaat

SEQ ID NO: 53018 - DNA, 15 bp, Homo sapiens
tgacaggagagaatc

SEQ ID NO: 53019 - DNA, 15 bp, Homo sapiens
gacaggagagaatct

SEQ ID NO: 53020 - DNA, 15 bp, Homo sapiens
acaggagagaatctc

SEQ ID NO: 53021 - DNA, 15 bp, Homo sapiens
caggagagaatctct

SEQ ID NO: 53022 - DNA, 15 bp, Homo sapiens
aggagagaatctctc

SEQ ID NO: 53023 - DNA, 15 bp, Homo sapiens
ggagagaatctctca

SEQ ID NO: 53024 - DNA, 15 bp, Homo sapiens
gagagaatctctcag

SEQ ID NO: 53025 - DNA, 15 bp, Homo sapiens
agagaatctctcagg

SEQ ID NO: 53026 - DNA, 15 bp, Homo sapiens
gagaatctctcaggc

SEQ ID NO: 53027 - DNA, 15 bp, Homo sapiens
agaatctctcaggcc

SEQ ID NO: 53028 - DNA, 15 bp, Homo sapiens
gaatctctcaggccc

SEQ ID NO: 53029 - DNA, 15 bp, Homo sapiens
aatctctcaggccca

SEQ ID NO: 53030 - DNA, 15 bp, Homo sapiens
atctctcaggcccat

SEQ ID NO: 53031 - DNA, 15 bp, Homo sapiens
tctctcaggcccatt

SEQ ID NO: 53032 - DNA, 15 bp, Homo sapiens
ctctcaggcccattc

SEQ ID NO: 53033 - DNA, 15 bp, Homo sapiens
tctcaggcccattca

SEQ ID NO: 53034 - DNA, 15 bp, Homo sapiens
ctcaggcccattcag

SEQ ID NO: 53035 - DNA, 15 bp, Homo sapiens
tcaggcccattcaga

SEQ ID NO: 53036 - DNA, 15 bp, Homo sapiens
caggcccattcagag

SEQ ID NO: 53037 - DNA, 15 bp, Homo sapiens
aggcccattcagaga

SEQ ID NO: 53038 - DNA, 15 bp, Homo sapiens
ggcccattcagagag

SEQ ID NO: 53039 - DNA, 15 bp, Homo sapiens
gcccattcagagagt

SEQ ID NO: 53040 - DNA, 15 bp, Homo sapiens
cccattcagagagtc

SEQ ID NO: 53041 - DNA, 15 bp, Homo sapiens
ccattcagagagtcc

SEQ ID NO: 53042 - DNA, 15 bp, Homo sapiens
cattcagagagtcca

SEQ ID NO: 53043 - DNA, 15 bp, Homo sapiens
attcagagagtccac

SEQ ID NO: 53044 - DNA, 15 bp, Homo sapiens
ttcagagagtccact

SEQ ID NO: 53045 - DNA, 15 bp, Homo sapiens
tcagagagtccactg

SEQ ID NO: 53046 - DNA, 15 bp, Homo sapiens
cagagagtccactgt

SEQ ID NO: 53047 - DNA, 15 bp, Homo sapiens
agagagtccactgtg

SEQ ID NO: 53048 - DNA, 15 bp, Homo sapiens
gagagtccactgtgt

SEQ ID NO: 53049 - DNA, 15 bp, Homo sapiens
agagtccactgtgtg

SEQ ID NO: 53050 - DNA, 15 bp, Homo sapiens
gagtccactgtgtga

SEQ ID NO: 53051 - DNA, 15 bp, Homo sapiens
agtccactgtgtgaa

SEQ ID NO: 53052 - DNA, 15 bp, Homo sapiens
gtccactgtgtgaag

SEQ ID NO: 53053 - DNA, 15 bp, Homo sapiens
tccactgtgtgaaga

SEQ ID NO: 53054 - DNA, 15 bp, Homo sapiens
ccactgtgtgaagac

SEQ ID NO: 53055 - DNA, 15 bp, Homo sapiens
cactgtgtgaagacg

SEQ ID NO: 53056 - DNA, 15 bp, Homo sapiens
actgtgtgaagacga

SEQ ID NO: 53057 - DNA, 15 bp, Homo sapiens
ctgtgtgaagacgag

SEQ ID NO: 53058 - DNA, 15 bp, Homo sapiens
tgtgtgaagacgagg

SEQ ID NO: 53059 - DNA, 15 bp, Homo sapiens
gtgtgaagacgaggc

SEQ ID NO: 53060 - DNA, 15 bp, Homo sapiens
tgtgaagacgaggca

SEQ ID NO: 53061 - DNA, 15 bp, Homo sapiens
gtgaagacgaggcat

SEQ ID NO: 53062 - DNA, 15 bp, Homo sapiens
tgaagacgaggcatg

SEQ ID NO: 53063 - DNA, 15 bp, Homo sapiens
gaagacgaggcatga

SEQ ID NO: 53064 - DNA, 15 bp, Homo sapiens
aagacgaggcatgaa

SEQ ID NO: 53065 - DNA, 15 bp, Homo sapiens
agacgaggcatgaac

SEQ ID NO: 53066 - DNA, 15 bp, Homo sapiens
gacgaggcatgaaca

SEQ ID NO: 53067 - DNA, 15 bp, Homo sapiens
acgaggcatgaacaa

SEQ ID NO: 53068 - DNA, 15 bp, Homo sapiens
cgaggcatgaacaac

SEQ ID NO: 53069 - DNA, 15 bp, Homo sapiens
gaggcatgaacaacc

SEQ ID NO: 53070 - DNA, 15 bp, Homo sapiens
aggcatgaacaacca

SEQ ID NO: 53071 - DNA, 15 bp, Homo sapiens
ggcatgaacaaccag

SEQ ID NO: 53072 - DNA, 15 bp, Homo sapiens
gcatgaacaaccagc

SEQ ID NO: 53073 - DNA, 15 bp, Homo sapiens
catgaacaaccagcc

SEQ ID NO: 53074 - DNA, 15 bp, Homo sapiens
atgaacaaccagcca

SEQ ID NO: 53075 - DNA, 15 bp, Homo sapiens
tgaacaaccagccag

SEQ ID NO: 53076 - DNA, 15 bp, Homo sapiens
gaacaaccagccagg

SEQ ID NO: 53077 - DNA, 15 bp, Homo sapiens
aacaaccagccagga

SEQ ID NO: 53078 - DNA, 15 bp, Homo sapiens
acaaccagccaggac

SEQ ID NO: 53079 - DNA, 15 bp, Homo sapiens
caaccagccaggaca

SEQ ID NO: 53080 - DNA, 15 bp, Homo sapiens
aaccagccaggacat

SEQ ID NO: 53081 - DNA, 15 bp, Homo sapiens
accagccaggacatg

SEQ ID NO: 53082 - DNA, 15 bp, Homo sapiens
ccagccaggacatgt

SEQ ID NO: 53083 - DNA, 15 bp, Homo sapiens
cagccaggacatgtg

SEQ ID NO: 53084 - DNA, 15 bp, Homo sapiens
agccaggacatgtgg

SEQ ID NO: 53085 - DNA, 15 bp, Homo sapiens
gccaggacatgtgga

SEQ ID NO: 53086 - DNA, 15 bp, Homo sapiens
ccaggacatgtggag

SEQ ID NO: 53087 - DNA, 15 bp, Homo sapiens
caggacatgtggaga

SEQ ID NO: 53088 - DNA, 15 bp, Homo sapiens
aggacatgtggagag

SEQ ID NO: 53089 - DNA, 15 bp, Homo sapiens
ggacatgtggagagg

SEQ ID NO: 53090 - DNA, 15 bp, Homo sapiens
gacatgtggagagga

SEQ ID NO: 53091 - DNA, 15 bp, Homo sapiens
acatgtggagaggag

SEQ ID NO: 53092 - DNA, 15 bp, Homo sapiens
catgtggagaggagc

SEQ ID NO: 53093 - DNA, 15 bp, Homo sapiens
atgtggagaggagca

SEQ ID NO: 53094 - DNA, 15 bp, Homo sapiens
tgtggagaggagcat

SEQ ID NO: 53095 - DNA, 15 bp, Homo sapiens
gtggagaggagcatt

SEQ ID NO: 53096 - DNA, 15 bp, Homo sapiens
tggagaggagcattt

SEQ ID NO: 53097 - DNA, 15 bp, Homo sapiens
ggagaggagcatttt

SEQ ID NO: 53098 - DNA, 15 bp, Homo sapiens
gagaggagcattttt

SEQ ID NO: 53099 - DNA, 15 bp, Homo sapiens
agaggagcatttttc

SEQ ID NO: 53100 - DNA, 15 bp, Homo sapiens
gaggagcatttttct

SEQ ID NO: 53101 - DNA, 15 bp, Homo sapiens
aggagcatttttctt

SEQ ID NO: 53102 - DNA, 15 bp, Homo sapiens
ggagcatttttcttt

SEQ ID NO: 53103 - DNA, 15 bp, Homo sapiens
gagcatttttctttt

SEQ ID NO: 53104 - DNA, 15 bp, Homo sapiens
agcatttttcttttt

SEQ ID NO: 53105 - DNA, 15 bp, Homo sapiens
gcatttttctttttt

SEQ ID NO: 53106 - DNA, 15 bp, Homo sapiens
catttttcttttttt

SEQ ID NO: 53107 - DNA, 15 bp, Homo sapiens
atttttctttttttc

SEQ ID NO: 53108 - DNA, 15 bp, Homo sapiens
tttttctttttttct

SEQ ID NO: 53109 - DNA, 15 bp, Homo sapiens
ttttctttttttctt

SEQ ID NO: 53110 - DNA, 15 bp, Homo sapiens
tttctttttttcttt

SEQ ID NO: 53111 - DNA, 15 bp, Homo sapiens
ttctttttttctttt

SEQ ID NO: 53112 - DNA, 15 bp, Homo sapiens
tctttttttcttttt

SEQ ID NO: 53113 - DNA, 15 bp, Homo sapiens
ctttttttctttttt

SEQ ID NO: 53114 - DNA, 15 bp, Homo sapiens
tttttttcttttttc

SEQ ID NO: 53115 - DNA, 15 bp, Homo sapiens
tttcttttttctttc

SEQ ID NO: 53116 - DNA, 15 bp, Homo sapiens
ttcttttttctttct

SEQ ID NO: 53117 - DNA, 15 bp, Homo sapiens
tcttttttctttctt

SEQ ID NO: 53118 - DNA, 15 bp, Homo sapiens
cttttttctttcttt

SEQ ID NO: 53119 - DNA, 15 bp, Homo sapiens
ttttttctttctttt

SEQ ID NO: 53120 - DNA, 15 bp, Homo sapiens
tttttctttcttttt

SEQ ID NO: 53121 - DNA, 15 bp, Homo sapiens
ttttctttctttttt

SEQ ID NO: 53122 - DNA, 15 bp, Homo sapiens
ttttttttgagacgt

SEQ ID NO: 53123 - DNA, 15 bp, Homo sapiens
tttttttgagacgtc

SEQ ID NO: 53124 - DNA, 15 bp, Homo sapiens
ttttttgagacgtct

SEQ ID NO: 53125 - DNA, 15 bp, Homo sapiens
tttttgagacgtctt

SEQ ID NO: 53126 - DNA, 15 bp, Homo sapiens
ttttgagacgtcttt

SEQ ID NO: 53127 - DNA, 15 bp, Homo sapiens
tttgagacgtctttc

SEQ ID NO: 53128 - DNA, 15 bp, Homo sapiens
ttgagacgtctttct

SEQ ID NO: 53129 - DNA, 15 bp, Homo sapiens
tgagacgtctttctc

SEQ ID NO: 53130 - DNA, 15 bp, Homo sapiens
gagacgtctttctct

SEQ ID NO: 53131 - DNA, 15 bp, Homo sapiens
agacgtctttctctg

SEQ ID NO: 53132 - DNA, 15 bp, Homo sapiens
gacgtctttctctgt

SEQ ID NO: 53133 - DNA, 15 bp, Homo sapiens
acgtctttctctgtc

SEQ ID NO: 53134 - DNA, 15 bp, Homo sapiens
cgtctttctctgtca

SEQ ID NO: 53135 - DNA, 15 bp, Homo sapiens
gtctttctctgtcac

SEQ ID NO: 53136 - DNA, 15 bp, Homo sapiens
tctttctctgtcacc

SEQ ID NO: 53137 - DNA, 15 bp, Homo sapiens
ctttctctgtcaccc

SEQ ID NO: 53138 - DNA, 15 bp, Homo sapiens
tttctctgtcaccca

SEQ ID NO: 53139 - DNA, 15 bp, Homo sapiens
ttctctgtcacccag

SEQ ID NO: 53140 - DNA, 15 bp, Homo sapiens
tctctgtcacccagg

SEQ ID NO: 53141 - DNA, 15 bp, Homo sapiens
ggagtgcaatggcat

SEQ ID NO: 53142 - DNA, 15 bp, Homo sapiens
gagtgcaatggcatg

SEQ ID NO: 53143 - DNA, 15 bp, Homo sapiens
agtgcaatggcatga

SEQ ID NO: 53144 - DNA, 15 bp, Homo sapiens
gtgcaatggcatgat

SEQ ID NO: 53145 - DNA, 15 bp, Homo sapiens
tgcaatggcatgatc

SEQ ID NO: 53146 - DNA, 15 bp, Homo sapiens
gcaatggcatgatct

SEQ ID NO: 53147 - DNA, 15 bp, Homo sapiens
caatggcatgatctc

SEQ ID NO: 53148 - DNA, 15 bp, Homo sapiens
aatggcatgatctcg

SEQ ID NO: 53149 - DNA, 15 bp, Homo sapiens
atggcatgatctcgg

SEQ ID NO: 53150 - DNA, 15 bp, Homo sapiens
tggcatgatctcggc

SEQ ID NO: 53151 - DNA, 15 bp, Homo sapiens
ggcatgatctcggct

SEQ ID NO: 53152 - DNA, 15 bp, Homo sapiens
gcatgatctcggctc

SEQ ID NO: 53153 - DNA, 15 bp, Homo sapiens
catgatctcggctca

SEQ ID NO: 53154 - DNA, 15 bp, Homo sapiens
atgatctcggctcac

SEQ ID NO: 53155 - DNA, 15 bp, Homo sapiens
tgatctcggctcact

SEQ ID NO: 53156 - DNA, 15 bp, Homo sapiens
ggctcactgcaaccc

SEQ ID NO: 53157 - DNA, 15 bp, Homo sapiens
gctcactgcaacccc

SEQ ID NO: 53158 - DNA, 15 bp, Homo sapiens
ctcactgcaaccccc

SEQ ID NO: 53159 - DNA, 15 bp, Homo sapiens
tcactgcaaccccca

SEQ ID NO: 53160 - DNA, 15 bp, Homo sapiens
cactgcaacccccac

SEQ ID NO: 53161 - DNA, 15 bp, Homo sapiens
actgcaacccccact

SEQ ID NO: 53162 - DNA, 15 bp, Homo sapiens
ctgcaacccccactt

SEQ ID NO: 53163 - DNA, 15 bp, Homo sapiens
tgcaacccccacttc

SEQ ID NO: 53164 - DNA, 15 bp, Homo sapiens
gcaacccccacttcc

SEQ ID NO: 53165 - DNA, 15 bp, Homo sapiens
caacccccacttcca

SEQ ID NO: 53166 - DNA, 15 bp, Homo sapiens
aacccccacttccag

SEQ ID NO: 53167 - DNA, 15 bp, Homo sapiens
acccccacttccagg

SEQ ID NO: 53168 - DNA, 15 bp, Homo sapiens
cccccacttccaggg

SEQ ID NO: 53169 - DNA, 15 bp, Homo sapiens
ccccacttccagggt

SEQ ID NO: 53170 - DNA, 15 bp, Homo sapiens
cccacttccagggtt

SEQ ID NO: 53171 - DNA, 15 bp, Homo sapiens
ccacttccagggttc

SEQ ID NO: 53172 - DNA, 15 bp, Homo sapiens
cacttccagggttca

SEQ ID NO: 53173 - DNA, 15 bp, Homo sapiens
acttccagggttcaa

SEQ ID NO: 53174 - DNA, 15 bp, Homo sapiens
cttccagggttcaag

SEQ ID NO: 53175 - DNA, 15 bp, Homo sapiens
ttccagggttcaagc

SEQ ID NO: 53176 - DNA, 15 bp, Homo sapiens
tccagggttcaagca

SEQ ID NO: 53177 - DNA, 15 bp, Homo sapiens
ccagggttcaagcaa

SEQ ID NO: 53178 - DNA, 15 bp, Homo sapiens
cagggttcaagcaat

SEQ ID NO: 53179 - DNA, 15 bp, Homo sapiens
agggttcaagcaatt

SEQ ID NO: 53180 - DNA, 15 bp, Homo sapiens
ttcaagcaattcttc

SEQ ID NO: 53181 - DNA, 15 bp, Homo sapiens
tcaagcaattcttct

SEQ ID NO: 53182 - DNA, 15 bp, Homo sapiens
caagcaattcttctg

SEQ ID NO: 53183 - DNA, 15 bp, Homo sapiens
aagcaattcttctgc

SEQ ID NO: 53184 - DNA, 15 bp, Homo sapiens
agcaattcttctgcc

SEQ ID NO: 53185 - DNA, 15 bp, Homo sapiens
gcaattcttctgcct

SEQ ID NO: 53186 - DNA, 15 bp, Homo sapiens
caattcttctgcctt

SEQ ID NO: 53187 - DNA, 15 bp, Homo sapiens
aattcttctgcctta

SEQ ID NO: 53188 - DNA, 15 bp, Homo sapiens
attcttctgccttag

SEQ ID NO: 53189 - DNA, 15 bp, Homo sapiens
ttcttctgccttagc

SEQ ID NO: 53190 - DNA, 15 bp, Homo sapiens
tcttctgccttagcc

SEQ ID NO: 53191 - DNA, 15 bp, Homo sapiens
cttctgccttagcct

SEQ ID NO: 53192 - DNA, 15 bp, Homo sapiens
ttctgccttagcctc

SEQ ID NO: 53193 - DNA, 15 bp, Homo sapiens
tctgccttagcctcc

SEQ ID NO: 53194 - DNA, 15 bp, Homo sapiens
ctgccttagcctccc

SEQ ID NO: 53195 - DNA, 15 bp, Homo sapiens
tgccttagcctccca

SEQ ID NO: 53196 - DNA, 15 bp, Homo sapiens
gccttagcctcccaa

SEQ ID NO: 53197 - DNA, 15 bp, Homo sapiens
ccttagcctcccaag

SEQ ID NO: 53198 - DNA, 15 bp, Homo sapiens
cttagcctcccaagc

SEQ ID NO: 53199 - DNA, 15 bp, Homo sapiens
ttagcctcccaagca

SEQ ID NO: 53200 - DNA, 15 bp, Homo sapiens
tagcctcccaagcag

SEQ ID NO: 53201 - DNA, 15 bp, Homo sapiens
cctcccaagcagcta

SEQ ID NO: 53202 - DNA, 15 bp, Homo sapiens
ctcccaagcagctag

SEQ ID NO: 53203 - DNA, 15 bp, Homo sapiens
tcccaagcagctagg

SEQ ID NO: 53204 - DNA, 15 bp, Homo sapiens
cccaagcagctagga

SEQ ID NO: 53205 - DNA, 15 bp, Homo sapiens
ccaagcagctaggat

SEQ ID NO: 53206 - DNA, 15 bp, Homo sapiens
caagcagctaggatt

SEQ ID NO: 53207 - DNA, 15 bp, Homo sapiens
aagcagctaggatta

SEQ ID NO: 53208 - DNA, 15 bp, Homo sapiens
agcagctaggattac

SEQ ID NO: 53209 - DNA, 15 bp, Homo sapiens
gcagctaggattaca

SEQ ID NO: 53210 - DNA, 15 bp, Homo sapiens
cagctaggattacag

SEQ ID NO: 53211 - DNA, 15 bp, Homo sapiens
agctaggattacagg

SEQ ID NO: 53212 - DNA, 15 bp, Homo sapiens
ctaggattacaggca

SEQ ID NO: 53213 - DNA, 15 bp, Homo sapiens
taggattacaggcac

SEQ ID NO: 53214 - DNA, 15 bp, Homo sapiens
aggattacaggcacc

SEQ ID NO: 53215 - DNA, 15 bp, Homo sapiens
gccaccatgcccggt

SEQ ID NO: 53216 - DNA, 15 bp, Homo sapiens
ccaccatgcccggtt

SEQ ID NO: 53217 - DNA, 15 bp, Homo sapiens
caccatgcccggtta

SEQ ID NO: 53218 - DNA, 15 bp, Homo sapiens
accatgcccggttaa

SEQ ID NO: 53219 - DNA, 15 bp, Homo sapiens
ccatgcccggttaat

SEQ ID NO: 53220 - DNA, 15 bp, Homo sapiens
catgcccggttaatt

SEQ ID NO: 53221 - DNA, 15 bp, Homo sapiens
atgcccggttaattt

SEQ ID NO: 53222 - DNA, 15 bp, Homo sapiens
tgcccggttaatttt

SEQ ID NO: 53223 - DNA, 15 bp, Homo sapiens
gcccggttaattttt

SEQ ID NO: 53224 - DNA, 15 bp, Homo sapiens
cccggttaatttttg

SEQ ID NO: 53225 - DNA, 15 bp, Homo sapiens
ccggttaatttttgt

SEQ ID NO: 53226 - DNA, 15 bp, Homo sapiens
cggttaatttttgta

SEQ ID NO: 53227 - DNA, 15 bp, Homo sapiens
ggttaatttttgtat

SEQ ID NO: 53228 - DNA, 15 bp, Homo sapiens
gttaatttttgtatt

SEQ ID NO: 53229 - DNA, 15 bp, Homo sapiens
ttaatttttgtattt

SEQ ID NO: 53230 - DNA, 15 bp, Homo sapiens
tttagtagagacgga

SEQ ID NO: 53231 - DNA, 15 bp, Homo sapiens
ttagtagagacggag

SEQ ID NO: 53232 - DNA, 15 bp, Homo sapiens
tagtagagacggagt

SEQ ID NO: 53233 - DNA, 15 bp, Homo sapiens
agtagagacggagtt

SEQ ID NO: 53234 - DNA, 15 bp, Homo sapiens
gtagagacggagttt

SEQ ID NO: 53235 - DNA, 15 bp, Homo sapiens
tagagacggagtttc

SEQ ID NO: 53236 - DNA, 15 bp, Homo sapiens
agagacggagtttca

SEQ ID NO: 53237 - DNA, 15 bp, Homo sapiens
gagacggagtttcac

SEQ ID NO: 53238 - DNA, 15 bp, Homo sapiens
tcaccatgttggcct

SEQ ID NO: 53239 - DNA, 15 bp, Homo sapiens
caccatgttggcctc

SEQ ID NO: 53240 - DNA, 15 bp, Homo sapiens
accatgttggcctca

SEQ ID NO: 53241 - DNA, 15 bp, Homo sapiens
ccatgttggcctcaa

SEQ ID NO: 53242 - DNA, 15 bp, Homo sapiens
catgttggcctcaaa

SEQ ID NO: 53243 - DNA, 15 bp, Homo sapiens
atgttggcctcaaac

SEQ ID NO: 53244 - DNA, 15 bp, Homo sapiens
tgttggcctcaaact

SEQ ID NO: 53245 - DNA, 15 bp, Homo sapiens
gttggcctcaaactc

SEQ ID NO: 53246 - DNA, 15 bp, Homo sapiens
ttggcctcaaactcc

SEQ ID NO: 53247 - DNA, 15 bp, Homo sapiens
gcctcaaactcctga

SEQ ID NO: 53248 - DNA, 15 bp, Homo sapiens
cctcaaactcctgac

SEQ ID NO: 53249 - DNA, 15 bp, Homo sapiens
caaactcctgacctt

SEQ ID NO: 53250 - DNA, 15 bp, Homo sapiens
aaactcctgacctta

SEQ ID NO: 53251 - DNA, 15 bp, Homo sapiens
aactcctgaccttag

SEQ ID NO: 53252 - DNA, 15 bp, Homo sapiens
actcctgaccttagg

SEQ ID NO: 53253 - DNA, 15 bp, Homo sapiens
ctcctgaccttaggt

SEQ ID NO: 53254 - DNA, 15 bp, Homo sapiens
tcctgaccttaggtg

SEQ ID NO: 53255 - DNA, 15 bp, Homo sapiens
cctgaccttaggtga

SEQ ID NO: 53256 - DNA, 15 bp, Homo sapiens
ctgaccttaggtgat

SEQ ID NO: 53257 - DNA, 15 bp, Homo sapiens
tgaccttaggtgatc

SEQ ID NO: 53258 - DNA, 15 bp, Homo sapiens
gaccttaggtgatcc

SEQ ID NO: 53259 - DNA, 15 bp, Homo sapiens
accttaggtgatcca

SEQ ID NO: 53260 - DNA, 15 bp, Homo sapiens
ccttaggtgatccac

SEQ ID NO: 53261 - DNA, 15 bp, Homo sapiens
cttaggtgatccacc

SEQ ID NO: 53262 - DNA, 15 bp, Homo sapiens
ttaggtgatccaccc

SEQ ID NO: 53263 - DNA, 15 bp, Homo sapiens
taggtgatccacccg

SEQ ID NO: 53264 - DNA, 15 bp, Homo sapiens
aggtgatccacccgt

SEQ ID NO: 53265 - DNA, 15 bp, Homo sapiens
ggtgatccacccgtc

SEQ ID NO: 53266 - DNA, 15 bp, Homo sapiens
gtgatccacccgtct

SEQ ID NO: 53267 - DNA, 15 bp, Homo sapiens
tgatccacccgtctc

SEQ ID NO: 53268 - DNA, 15 bp, Homo sapiens
gatccacccgtctcg

SEQ ID NO: 53269 - DNA, 15 bp, Homo sapiens
atccacccgtctcgg

SEQ ID NO: 53270 - DNA, 15 bp, Homo sapiens
tccacccgtctcggc

SEQ ID NO: 53271 - DNA, 15 bp, Homo sapiens
ccacccgtctcggcc

SEQ ID NO: 53272 - DNA, 15 bp, Homo sapiens
cacccgtctcggcct

SEQ ID NO: 53273 - DNA, 15 bp, Homo sapiens
acccgtctcggcctc

SEQ ID NO: 53274 - DNA, 15 bp, Homo sapiens
cccgtctcggcctcc

SEQ ID NO: 53275 - DNA, 15 bp, Homo sapiens
ccgtctcggcctccc

SEQ ID NO: 53276 - DNA, 15 bp, Homo sapiens
cgtctcggcctccca

SEQ ID NO: 53277 - DNA, 15 bp, Homo sapiens
gtctcggcctcccag

SEQ ID NO: 53278 - DNA, 15 bp, Homo sapiens
tctcggcctcccaga

SEQ ID NO: 53279 - DNA, 15 bp, Homo sapiens
ctcggcctcccagag

SEQ ID NO: 53280 - DNA, 15 bp, Homo sapiens
tcggcctcccagagt

SEQ ID NO: 53281 - DNA, 15 bp, Homo sapiens
cggcctcccagagtg

SEQ ID NO: 53282 - DNA, 15 bp, Homo sapiens
ggcctcccagagtgc

SEQ ID NO: 53283 - DNA, 15 bp, Homo sapiens
gcctcccagagtgct

SEQ ID NO: 53284 - DNA, 15 bp, Homo sapiens
cctcccagagtgctg

SEQ ID NO: 53285 - DNA, 15 bp, Homo sapiens
ctcccagagtgctgg

SEQ ID NO: 53286 - DNA, 15 bp, Homo sapiens
tcccagagtgctggg

SEQ ID NO: 53287 - DNA, 15 bp, Homo sapiens
cccagagtgctggga

SEQ ID NO: 53288 - DNA, 15 bp, Homo sapiens
ccagagtgctgggat

SEQ ID NO: 53289 - DNA, 15 bp, Homo sapiens
cagagtgctgggatt

SEQ ID NO: 53290 - DNA, 15 bp, Homo sapiens
agagtgctgggatta

SEQ ID NO: 53291 - DNA, 15 bp, Homo sapiens
gagtgctgggattac

SEQ ID NO: 53292 - DNA, 15 bp, Homo sapiens
tgggattacaggtga

SEQ ID NO: 53293 - DNA, 15 bp, Homo sapiens
gggattacaggtgag

SEQ ID NO: 53294 - DNA, 15 bp, Homo sapiens
ggattacaggtgaga

SEQ ID NO: 53295 - DNA, 15 bp, Homo sapiens
gattacaggtgagag

SEQ ID NO: 53296 - DNA, 15 bp, Homo sapiens
attacaggtgagagc

SEQ ID NO: 53297 - DNA, 15 bp, Homo sapiens
ttacaggtgagagcc

SEQ ID NO: 53298 - DNA, 15 bp, Homo sapiens
tacaggtgagagccc

SEQ ID NO: 53299 - DNA, 15 bp, Homo sapiens
acaggtgagagcccc

SEQ ID NO: 53300 - DNA, 15 bp, Homo sapiens
caggtgagagccccc

SEQ ID NO: 53301 - DNA, 15 bp, Homo sapiens
aggtgagagccccca

SEQ ID NO: 53302 - DNA, 15 bp, Homo sapiens
ggtgagagcccccac

SEQ ID NO: 53303 - DNA, 15 bp, Homo sapiens
gtgagagcccccacg

SEQ ID NO: 53304 - DNA, 15 bp, Homo sapiens
tgagagcccccacgc

SEQ ID NO: 53305 - DNA, 15 bp, Homo sapiens
gagagcccccacgcc

SEQ ID NO: 53306 - DNA, 15 bp, Homo sapiens
agagcccccacgccc

SEQ ID NO: 53307 - DNA, 15 bp, Homo sapiens
gagcccccacgcccg

SEQ ID NO: 53308 - DNA, 15 bp, Homo sapiens
agcccccacgcccgg

SEQ ID NO: 53309 - DNA, 15 bp, Homo sapiens
gcccccacgcccggc

SEQ ID NO: 53310 - DNA, 15 bp, Homo sapiens
cccccacgcccggcc

SEQ ID NO: 53311 - DNA, 15 bp, Homo sapiens
ccccacgcccggcca

SEQ ID NO: 53312 - DNA, 15 bp, Homo sapiens
cccacgcccggccag

SEQ ID NO: 53313 - DNA, 15 bp, Homo sapiens
ccacgcccggccagg

SEQ ID NO: 53314 - DNA, 15 bp, Homo sapiens
cacgcccggccaggc

SEQ ID NO: 53315 - DNA, 15 bp, Homo sapiens
acgcccggccaggct

SEQ ID NO: 53316 - DNA, 15 bp, Homo sapiens
cgcccggccaggctc

SEQ ID NO: 53317 - DNA, 15 bp, Homo sapiens
gcccggccaggctcg

SEQ ID NO: 53318 - DNA, 15 bp, Homo sapiens
cccggccaggctcgg

SEQ ID NO: 53319 - DNA, 15 bp, Homo sapiens
ccggccaggctcggc

SEQ ID NO: 53320 - DNA, 15 bp, Homo sapiens
cggccaggctcggct

SEQ ID NO: 53321 - DNA, 15 bp, Homo sapiens
ggccaggctcggctt

SEQ ID NO: 53322 - DNA, 15 bp, Homo sapiens
gccaggctcggcttt

SEQ ID NO: 53323 - DNA, 15 bp, Homo sapiens
ccaggctcggctttc

SEQ ID NO: 53324 - DNA, 15 bp, Homo sapiens
caggctcggctttct

SEQ ID NO: 53325 - DNA, 15 bp, Homo sapiens
aggctcggctttctt

SEQ ID NO: 53326 - DNA, 15 bp, Homo sapiens
ggctcggctttcttt

SEQ ID NO: 53327 - DNA, 15 bp, Homo sapiens
gctcggctttctttc

SEQ ID NO: 53328 - DNA, 15 bp, Homo sapiens
ctcggctttctttcc

SEQ ID NO: 53329 - DNA, 15 bp, Homo sapiens
tcggctttctttcca

SEQ ID NO: 53330 - DNA, 15 bp, Homo sapiens
cggctttctttccag

SEQ ID NO: 53331 - DNA, 15 bp, Homo sapiens
ggctttctttccagg

SEQ ID NO: 53332 - DNA, 15 bp, Homo sapiens
gctttctttccaggc

SEQ ID NO: 53333 - DNA, 15 bp, Homo sapiens
ctttctttccaggcc

SEQ ID NO: 53334 - DNA, 15 bp, Homo sapiens
tttctttccaggccc

SEQ ID NO: 53335 - DNA, 15 bp, Homo sapiens
ttctttccaggcccc

SEQ ID NO: 53336 - DNA, 15 bp, Homo sapiens
tctttccaggccccg

SEQ ID NO: 53337 - DNA, 15 bp, Homo sapiens
ctttccaggccccgt

SEQ ID NO: 53338 - DNA, 15 bp, Homo sapiens
tttccaggccccgtc

SEQ ID NO: 53339 - DNA, 15 bp, Homo sapiens
ttccaggccccgtca

SEQ ID NO: 53340 - DNA, 15 bp, Homo sapiens
tccaggccccgtcac

SEQ ID NO: 53341 - DNA, 15 bp, Homo sapiens
ccaggccccgtcaca

SEQ ID NO: 53342 - DNA, 15 bp, Homo sapiens
caggccccgtcacac

SEQ ID NO: 53343 - DNA, 15 bp, Homo sapiens
aggccccgtcacact

SEQ ID NO: 53344 - DNA, 15 bp, Homo sapiens
ggccccgtcacactc

SEQ ID NO: 53345 - DNA, 15 bp, Homo sapiens
gccccgtcacactct

SEQ ID NO: 53346 - DNA, 15 bp, Homo sapiens
ccccgtcacactctt

SEQ ID NO: 53347 - DNA, 15 bp, Homo sapiens
cccgtcacactctta

SEQ ID NO: 53348 - DNA, 15 bp, Homo sapiens
ccgtcacactcttag

SEQ ID NO: 53349 - DNA, 15 bp, Homo sapiens
cgtcacactcttaga

SEQ ID NO: 53350 - DNA, 15 bp, Homo sapiens
gtcacactcttagat

SEQ ID NO: 53351 - DNA, 15 bp, Homo sapiens
tcacactcttagatg

SEQ ID NO: 53352 - DNA, 15 bp, Homo sapiens
cacactcttagatgt

SEQ ID NO: 53353 - DNA, 15 bp, Homo sapiens
acactcttagatgtt

SEQ ID NO: 53354 - DNA, 15 bp, Homo sapiens
cactcttagatgttc

SEQ ID NO: 53355 - DNA, 15 bp, Homo sapiens
actcttagatgttcc

SEQ ID NO: 53356 - DNA, 15 bp, Homo sapiens
ctcttagatgttccc

SEQ ID NO: 53357 - DNA, 15 bp, Homo sapiens
tcttagatgttccct

SEQ ID NO: 53358 - DNA, 15 bp, Homo sapiens
cttagatgttccctg

SEQ ID NO: 53359 - DNA, 15 bp, Homo sapiens
ttagatgttccctgg

SEQ ID NO: 53360 - DNA, 15 bp, Homo sapiens
tagatgttccctggg

SEQ ID NO: 53361 - DNA, 15 bp, Homo sapiens
agatgttccctgggc

SEQ ID NO: 53362 - DNA, 15 bp, Homo sapiens
gatgttccctgggcc

SEQ ID NO: 53363 - DNA, 15 bp, Homo sapiens
atgttccctgggccc

SEQ ID NO: 53364 - DNA, 15 bp, Homo sapiens
tgttccctgggcccc

SEQ ID NO: 53365 - DNA, 15 bp, Homo sapiens
gttccctgggcccca

SEQ ID NO: 53366 - DNA, 15 bp, Homo sapiens
ttccctgggccccag

SEQ ID NO: 53367 - DNA, 15 bp, Homo sapiens
tccctgggccccaga

SEQ ID NO: 53368 - DNA, 15 bp, Homo sapiens
ccctgggccccagaa

SEQ ID NO: 53369 - DNA, 15 bp, Homo sapiens
cctgggccccagaag

SEQ ID NO: 53370 - DNA, 15 bp, Homo sapiens
ctgggccccagaagg

SEQ ID NO: 53371 - DNA, 15 bp, Homo sapiens
tgggccccagaaggc

SEQ ID NO: 53372 - DNA, 15 bp, Homo sapiens
gggccccagaaggca

SEQ ID NO: 53373 - DNA, 15 bp, Homo sapiens
ggccccagaaggcag

SEQ ID NO: 53374 - DNA, 15 bp, Homo sapiens
gccccagaaggcagc

SEQ ID NO: 53375 - DNA, 15 bp, Homo sapiens
ccccagaaggcagcg

SEQ ID NO: 53376 - DNA, 15 bp, Homo sapiens
cccagaaggcagcgt

SEQ ID NO: 53377 - DNA, 15 bp, Homo sapiens
ccagaaggcagcgtg

SEQ ID NO: 53378 - DNA, 15 bp, Homo sapiens
cagaaggcagcgtga

SEQ ID NO: 53379 - DNA, 15 bp, Homo sapiens
agaaggcagcgtgag

SEQ ID NO: 53380 - DNA, 15 bp, Homo sapiens
gaaggcagcgtgagg

SEQ ID NO: 53381 - DNA, 15 bp, Homo sapiens
aaggcagcgtgaggt

SEQ ID NO: 53382 - DNA, 15 bp, Homo sapiens
aggcagcgtgaggtg

SEQ ID NO: 53383 - DNA, 15 bp, Homo sapiens
ggcagcgtgaggtgc

SEQ ID NO: 53384 - DNA, 15 bp, Homo sapiens
gcagcgtgaggtgct

SEQ ID NO: 53385 - DNA, 15 bp, Homo sapiens
cagcgtgaggtgctc

SEQ ID NO: 53386 - DNA, 15 bp, Homo sapiens
agcgtgaggtgctct

SEQ ID NO: 53387 - DNA, 15 bp, Homo sapiens
gcgtgaggtgctctg

SEQ ID NO: 53388 - DNA, 15 bp, Homo sapiens
cgtgaggtgctctgc

SEQ ID NO: 53389 - DNA, 15 bp, Homo sapiens
gtgaggtgctctgcc

SEQ ID NO: 53390 - DNA, 15 bp, Homo sapiens
tgaggtgctctgccc

SEQ ID NO: 53391 - DNA, 15 bp, Homo sapiens
gaggtgctctgccca

SEQ ID NO: 53392 - DNA, 15 bp, Homo sapiens
aggtgctctgcccat

SEQ ID NO: 53393 - DNA, 15 bp, Homo sapiens
ggtgctctgcccatc

SEQ ID NO: 53394 - DNA, 15 bp, Homo sapiens
gtgctctgcccatct

SEQ ID NO: 53395 - DNA, 15 bp, Homo sapiens
tgctctgcccatcta

SEQ ID NO: 53396 - DNA, 15 bp, Homo sapiens
gctctgcccatctat

SEQ ID NO: 53397 - DNA, 15 bp, Homo sapiens
ctctgcccatctatg

SEQ ID NO: 53398 - DNA, 15 bp, Homo sapiens
tctgcccatctatgc

SEQ ID NO: 53399 - DNA, 15 bp, Homo sapiens
ctgcccatctatgct

SEQ ID NO: 53400 - DNA, 15 bp, Homo sapiens
tgcccatctatgctg

SEQ ID NO: 53401 - DNA, 15 bp, Homo sapiens
gcccatctatgctgt

SEQ ID NO: 53402 - DNA, 15 bp, Homo sapiens
cccatctatgctgtc

SEQ ID NO: 53403 - DNA, 15 bp, Homo sapiens
ccatctatgctgtcc

SEQ ID NO: 53404 - DNA, 15 bp, Homo sapiens
catctatgctgtcct

SEQ ID NO: 53405 - DNA, 15 bp, Homo sapiens
atctatgctgtcctt

SEQ ID NO: 53406 - DNA, 15 bp, Homo sapiens
tctatgctgtccttt

SEQ ID NO: 53407 - DNA, 15 bp, Homo sapiens
ctatgctgtcctttt

SEQ ID NO: 53408 - DNA, 15 bp, Homo sapiens
tatgctgtccttttc

SEQ ID NO: 53409 - DNA, 15 bp, Homo sapiens
atgctgtccttttcc

SEQ ID NO: 53410 - DNA, 15 bp, Homo sapiens
tgctgtccttttcca

SEQ ID NO: 53411 - DNA, 15 bp, Homo sapiens
gctgtccttttccac

SEQ ID NO: 53412 - DNA, 15 bp, Homo sapiens
ctgtccttttccacc

SEQ ID NO: 53413 - DNA, 15 bp, Homo sapiens
tgtccttttccaccc

SEQ ID NO: 53414 - DNA, 15 bp, Homo sapiens
gtccttttccacccc

SEQ ID NO: 53415 - DNA, 15 bp, Homo sapiens
tccttttccacccca

SEQ ID NO: 53416 - DNA, 15 bp, Homo sapiens
ccttttccaccccac

SEQ ID NO: 53417 - DNA, 15 bp, Homo sapiens
cttttccaccccacc

SEQ ID NO: 53418 - DNA, 15 bp, Homo sapiens
ttttccaccccaccc

SEQ ID NO: 53419 - DNA, 15 bp, Homo sapiens
tttccaccccaccct

SEQ ID NO: 53420 - DNA, 15 bp, Homo sapiens
ttccaccccacccta

SEQ ID NO: 53421 - DNA, 15 bp, Homo sapiens
tccaccccaccctat

SEQ ID NO: 53422 - DNA, 15 bp, Homo sapiens
ccaccccaccctatc

SEQ ID NO: 53423 - DNA, 15 bp, Homo sapiens
caccccaccctatcc

SEQ ID NO: 53424 - DNA, 15 bp, Homo sapiens
accccaccctatcca

SEQ ID NO: 53425 - DNA, 15 bp, Homo sapiens
ccccaccctatccac

SEQ ID NO: 53426 - DNA, 15 bp, Homo sapiens
cccaccctatccact

SEQ ID NO: 53427 - DNA, 15 bp, Homo sapiens
ccaccctatccactg

SEQ ID NO: 53428 - DNA, 15 bp, Homo sapiens
caccctatccactgg

SEQ ID NO: 53429 - DNA, 15 bp, Homo sapiens
accctatccactggg

SEQ ID NO: 53430 - DNA, 15 bp, Homo sapiens
ccctatccactgggc

SEQ ID NO: 53431 - DNA, 15 bp, Homo sapiens
cctatccactgggcc

SEQ ID NO: 53432 - DNA, 15 bp, Homo sapiens
ctatccactgggccc

SEQ ID NO: 53433 - DNA, 15 bp, Homo sapiens
tatccactgggcccc

SEQ ID NO: 53434 - DNA, 15 bp, Homo sapiens
atccactgggcccct

SEQ ID NO: 53435 - DNA, 15 bp, Homo sapiens
tccactgggcccctg

SEQ ID NO: 53436 - DNA, 15 bp, Homo sapiens
ccactgggcccctgg

SEQ ID NO: 53437 - DNA, 15 bp, Homo sapiens
cactgggcccctggg

SEQ ID NO: 53438 - DNA, 15 bp, Homo sapiens
actgggcccctgggg

SEQ ID NO: 53439 - DNA, 15 bp, Homo sapiens
ctgggcccctggggc

SEQ ID NO: 53440 - DNA, 15 bp, Homo sapiens
tgggcccctggggct

SEQ ID NO: 53441 - DNA, 15 bp, Homo sapiens
gggcccctggggctc

SEQ ID NO: 53442 - DNA, 15 bp, Homo sapiens
ggcccctggggctcc

SEQ ID NO: 53443 - DNA, 15 bp, Homo sapiens
gcccctggggctccc

SEQ ID NO: 53444 - DNA, 15 bp, Homo sapiens
cccctggggctccca

SEQ ID NO: 53445 - DNA, 15 bp, Homo sapiens
ccctggggctcccac

SEQ ID NO: 53446 - DNA, 15 bp, Homo sapiens
cctggggctcccact

SEQ ID NO: 53447 - DNA, 15 bp, Homo sapiens
ctggggctcccactc

SEQ ID NO: 53448 - DNA, 15 bp, Homo sapiens
tggggctcccactcc

SEQ ID NO: 53449 - DNA, 15 bp, Homo sapiens
ggggctcccactcca

SEQ ID NO: 53450 - DNA, 15 bp, Homo sapiens
gggctcccactccac

SEQ ID NO: 53451 - DNA, 15 bp, Homo sapiens
ggctcccactccact

SEQ ID NO: 53452 - DNA, 15 bp, Homo sapiens
gctcccactccactc

SEQ ID NO: 53453 - DNA, 15 bp, Homo sapiens
ctcccactccactcc

SEQ ID NO: 53454 - DNA, 15 bp, Homo sapiens
tcccactccactcca

SEQ ID NO: 53455 - DNA, 15 bp, Homo sapiens
cccactccactccag

SEQ ID NO: 53456 - DNA, 15 bp, Homo sapiens
ccactccactccagg

SEQ ID NO: 53457 - DNA, 15 bp, Homo sapiens
cactccactccaggt

SEQ ID NO: 53458 - DNA, 15 bp, Homo sapiens
actccactccaggtc

SEQ ID NO: 53459 - DNA, 15 bp, Homo sapiens
ctccactccaggtct

SEQ ID NO: 53460 - DNA, 15 bp, Homo sapiens
tccactccaggtctc

SEQ ID NO: 53461 - DNA, 15 bp, Homo sapiens
ccactccaggtctct

SEQ ID NO: 53462 - DNA, 15 bp, Homo sapiens
cactccaggtctctt

SEQ ID NO: 53463 - DNA, 15 bp, Homo sapiens
actccaggtctcttc

SEQ ID NO: 53464 - DNA, 15 bp, Homo sapiens
ctccaggtctcttca

SEQ ID NO: 53465 - DNA, 15 bp, Homo sapiens
tccaggtctcttcat

SEQ ID NO: 53466 - DNA, 15 bp, Homo sapiens
ccaggtctcttcatg

SEQ ID NO: 53467 - DNA, 15 bp, Homo sapiens
caggtctcttcatgg

SEQ ID NO: 53468 - DNA, 15 bp, Homo sapiens
aggtctcttcatgga

SEQ ID NO: 53469 - DNA, 15 bp, Homo sapiens
ggtctcttcatggac

SEQ ID NO: 53470 - DNA, 15 bp, Homo sapiens
gtctcttcatggacc

SEQ ID NO: 53471 - DNA, 15 bp, Homo sapiens
tctcttcatggaccc

SEQ ID NO: 53472 - DNA, 15 bp, Homo sapiens
ctcttcatggaccct

SEQ ID NO: 53473 - DNA, 15 bp, Homo sapiens
tcttcatggaccctt

SEQ ID NO: 53474 - DNA, 15 bp, Homo sapiens
cttcatggacccttc

SEQ ID NO: 53475 - DNA, 15 bp, Homo sapiens
ttcatggacccttct

SEQ ID NO: 53476 - DNA, 15 bp, Homo sapiens
tcatggacccttctt

SEQ ID NO: 53477 - DNA, 15 bp, Homo sapiens
catggacccttcttt

SEQ ID NO: 53478 - DNA, 15 bp, Homo sapiens
atggacccttctttc

SEQ ID NO: 53479 - DNA, 15 bp, Homo sapiens
tggacccttctttcc

SEQ ID NO: 53480 - DNA, 15 bp, Homo sapiens
ggacccttctttccc

SEQ ID NO: 53481 - DNA, 15 bp, Homo sapiens
gacccttctttccct

SEQ ID NO: 53482 - DNA, 15 bp, Homo sapiens
acccttctttccctt

SEQ ID NO: 53483 - DNA, 15 bp, Homo sapiens
cccttctttcccttc

SEQ ID NO: 53484 - DNA, 15 bp, Homo sapiens
ccttctttcccttca

SEQ ID NO: 53485 - DNA, 15 bp, Homo sapiens
cttctttcccttcac

SEQ ID NO: 53486 - DNA, 15 bp, Homo sapiens
ttctttcccttcact

SEQ ID NO: 53487 - DNA, 15 bp, Homo sapiens
tctttcccttcactt

SEQ ID NO: 53488 - DNA, 15 bp, Homo sapiens
ctttcccttcacttc

SEQ ID NO: 53489 - DNA, 15 bp, Homo sapiens
tttcccttcacttct

SEQ ID NO: 53490 - DNA, 15 bp, Homo sapiens
ttcccttcacttctg

SEQ ID NO: 53491 - DNA, 15 bp, Homo sapiens
tcccttcacttctgt

SEQ ID NO: 53492 - DNA, 15 bp, Homo sapiens
cccttcacttctgtc

SEQ ID NO: 53493 - DNA, 15 bp, Homo sapiens
ccttcacttctgtcc

SEQ ID NO: 53494 - DNA, 15 bp, Homo sapiens
cttcacttctgtccc

SEQ ID NO: 53495 - DNA, 15 bp, Homo sapiens
ttcacttctgtccca

SEQ ID NO: 53496 - DNA, 15 bp, Homo sapiens
tcacttctgtcccag

SEQ ID NO: 53497 - DNA, 15 bp, Homo sapiens
cacttctgtcccagg

SEQ ID NO: 53498 - DNA, 15 bp, Homo sapiens
acttctgtcccagga

SEQ ID NO: 53499 - DNA, 15 bp, Homo sapiens
cttctgtcccaggag

SEQ ID NO: 53500 - DNA, 15 bp, Homo sapiens
ttctgtcccaggaga

SEQ ID NO: 53501 - DNA, 15 bp, Homo sapiens
tctgtcccaggagac

SEQ ID NO: 53502 - DNA, 15 bp, Homo sapiens
ctgtcccaggagacc

SEQ ID NO: 53503 - DNA, 15 bp, Homo sapiens
tgtcccaggagacct

SEQ ID NO: 53504 - DNA, 15 bp, Homo sapiens
gtcccaggagacctg

SEQ ID NO: 53505 - DNA, 15 bp, Homo sapiens
tcccaggagacctgg

SEQ ID NO: 53506 - DNA, 15 bp, Homo sapiens
cccaggagacctggg

SEQ ID NO: 53507 - DNA, 15 bp, Homo sapiens
ccaggagacctggga

SEQ ID NO: 53508 - DNA, 15 bp, Homo sapiens
caggagacctgggag

SEQ ID NO: 53509 - DNA, 15 bp, Homo sapiens
aggagacctgggaga

SEQ ID NO: 53510 - DNA, 15 bp, Homo sapiens
ggagacctgggagac

SEQ ID NO: 53511 - DNA, 15 bp, Homo sapiens
gagacctgggagact

SEQ ID NO: 53512 - DNA, 15 bp, Homo sapiens
agacctgggagactc

SEQ ID NO: 53513 - DNA, 15 bp, Homo sapiens
gacctgggagactca

SEQ ID NO: 53514 - DNA, 15 bp, Homo sapiens
acctgggagactcat

SEQ ID NO: 53515 - DNA, 15 bp, Homo sapiens
cctgggagactcatg

SEQ ID NO: 53516 - DNA, 15 bp, Homo sapiens
ctgggagactcatgg

SEQ ID NO: 53517 - DNA, 15 bp, Homo sapiens
tgggagactcatggg

SEQ ID NO: 53518 - DNA, 15 bp, Homo sapiens
gggagactcatggga

SEQ ID NO: 53519 - DNA, 15 bp, Homo sapiens
ggagactcatgggaa

SEQ ID NO: 53520 - DNA, 15 bp, Homo sapiens
gagactcatgggaac

SEQ ID NO: 53521 - DNA, 15 bp, Homo sapiens
agactcatgggaaca

SEQ ID NO: 53522 - DNA, 15 bp, Homo sapiens
gactcatgggaacag

SEQ ID NO: 53523 - DNA, 15 bp, Homo sapiens
actcatgggaacagg

SEQ ID NO: 53524 - DNA, 15 bp, Homo sapiens
ctcatgggaacaggc

SEQ ID NO: 53525 - DNA, 15 bp, Homo sapiens
tcatgggaacaggca

SEQ ID NO: 53526 - DNA, 15 bp, Homo sapiens
catgggaacaggcat

SEQ ID NO: 53527 - DNA, 15 bp, Homo sapiens
atgggaacaggcatc

SEQ ID NO: 53528 - DNA, 15 bp, Homo sapiens
tgggaacaggcatca

SEQ ID NO: 53529 - DNA, 15 bp, Homo sapiens
gggaacaggcatcat

SEQ ID NO: 53530 - DNA, 15 bp, Homo sapiens
ggaacaggcatcatc

SEQ ID NO: 53531 - DNA, 15 bp, Homo sapiens
gaacaggcatcatct

SEQ ID NO: 53532 - DNA, 15 bp, Homo sapiens
aacaggcatcatctt

SEQ ID NO: 53533 - DNA, 15 bp, Homo sapiens
acaggcatcatcttc

SEQ ID NO: 53534 - DNA, 15 bp, Homo sapiens
caggcatcatcttct

SEQ ID NO: 53535 - DNA, 15 bp, Homo sapiens
aggcatcatcttctc

SEQ ID NO: 53536 - DNA, 15 bp, Homo sapiens
ggcatcatcttctcc

SEQ ID NO: 53537 - DNA, 15 bp, Homo sapiens
gcatcatcttctcca

SEQ ID NO: 53538 - DNA, 15 bp, Homo sapiens
catcatcttctccag

SEQ ID NO: 53539 - DNA, 15 bp, Homo sapiens
atcatcttctccagc

SEQ ID NO: 53540 - DNA, 15 bp, Homo sapiens
tcatcttctccagca

SEQ ID NO: 53541 - DNA, 15 bp, Homo sapiens
catcttctccagcac

SEQ ID NO: 53542 - DNA, 15 bp, Homo sapiens
atcttctccagcaca

SEQ ID NO: 53543 - DNA, 15 bp, Homo sapiens
tcttctccagcacag

SEQ ID NO: 53544 - DNA, 15 bp, Homo sapiens
cttctccagcacagt

SEQ ID NO: 53545 - DNA, 15 bp, Homo sapiens
ttctccagcacagtt

SEQ ID NO: 53546 - DNA, 15 bp, Homo sapiens
tctccagcacagttc

SEQ ID NO: 53547 - DNA, 15 bp, Homo sapiens
ctccagcacagttca

SEQ ID NO: 53548 - DNA, 15 bp, Homo sapiens
tccagcacagttcat

SEQ ID NO: 53549 - DNA, 15 bp, Homo sapiens
ccagcacagttcatt

SEQ ID NO: 53550 - DNA, 15 bp, Homo sapiens
cagcacagttcattg

SEQ ID NO: 53551 - DNA, 15 bp, Homo sapiens
agcacagttcattgt

SEQ ID NO: 53552 - DNA, 15 bp, Homo sapiens
gcacagttcattgtc

SEQ ID NO: 53553 - DNA, 15 bp, Homo sapiens
cacagttcattgtct

SEQ ID NO: 53554 - DNA, 15 bp, Homo sapiens
acagttcattgtcta

SEQ ID NO: 53555 - DNA, 15 bp, Homo sapiens
cagttcattgtctaa

SEQ ID NO: 53556 - DNA, 15 bp, Homo sapiens
agttcattgtctaat

SEQ ID NO: 53557 - DNA, 15 bp, Homo sapiens
gttcattgtctaatg

SEQ ID NO: 53558 - DNA, 15 bp, Homo sapiens
ttcattgtctaatgc

SEQ ID NO: 53559 - DNA, 15 bp, Homo sapiens
tcattgtctaatgca

SEQ ID NO: 53560 - DNA, 15 bp, Homo sapiens
cattgtctaatgcac

SEQ ID NO: 53561 - DNA, 15 bp, Homo sapiens
attgtctaatgcacg

SEQ ID NO: 53562 - DNA, 15 bp, Homo sapiens
ttgtctaatgcacga

SEQ ID NO: 53563 - DNA, 15 bp, Homo sapiens
tgtctaatgcacgaa

SEQ ID NO: 53564 - DNA, 15 bp, Homo sapiens
gtctaatgcacgaaa

SEQ ID NO: 53565 - DNA, 15 bp, Homo sapiens
tctaatgcacgaaag

SEQ ID NO: 53566 - DNA, 15 bp, Homo sapiens
ctaatgcacgaaagt

SEQ ID NO: 53567 - DNA, 15 bp, Homo sapiens
taatgcacgaaagtg

SEQ ID NO: 53568 - DNA, 15 bp, Homo sapiens
aatgcacgaaagtgc

SEQ ID NO: 53569 - DNA, 15 bp, Homo sapiens
atgcacgaaagtgct

SEQ ID NO: 53570 - DNA, 15 bp, Homo sapiens
tgcacgaaagtgctg

SEQ ID NO: 53571 - DNA, 15 bp, Homo sapiens
gcacgaaagtgctgg

SEQ ID NO: 53572 - DNA, 15 bp, Homo sapiens
cacgaaagtgctggg

SEQ ID NO: 53573 - DNA, 15 bp, Homo sapiens
acgaaagtgctgggc

SEQ ID NO: 53574 - DNA, 15 bp, Homo sapiens
cgaaagtgctgggct

SEQ ID NO: 53575 - DNA, 15 bp, Homo sapiens
gaaagtgctgggctg

SEQ ID NO: 53576 - DNA, 15 bp, Homo sapiens
aaagtgctgggctgt

SEQ ID NO: 53577 - DNA, 15 bp, Homo sapiens
aagtgctgggctgtg

SEQ ID NO: 53578 - DNA, 15 bp, Homo sapiens
agtgctgggctgtga

SEQ ID NO: 53579 - DNA, 15 bp, Homo sapiens
gtgctgggctgtgag

SEQ ID NO: 53580 - DNA, 15 bp, Homo sapiens
tgctgggctgtgaga

SEQ ID NO: 53581 - DNA, 15 bp, Homo sapiens
gctgggctgtgagaa

SEQ ID NO: 53582 - DNA, 15 bp, Homo sapiens
ctgggctgtgagaag

SEQ ID NO: 53583 - DNA, 15 bp, Homo sapiens
tgggctgtgagaagg

SEQ ID NO: 53584 - DNA, 15 bp, Homo sapiens
gggctgtgagaaggt

SEQ ID NO: 53585 - DNA, 15 bp, Homo sapiens
ggctgtgagaaggtc

SEQ ID NO: 53586 - DNA, 15 bp, Homo sapiens
gctgtgagaaggtca

SEQ ID NO: 53587 - DNA, 15 bp, Homo sapiens
ctgtgagaaggtcag

SEQ ID NO: 53588 - DNA, 15 bp, Homo sapiens
tgtgagaaggtcagg

SEQ ID NO: 53589 - DNA, 15 bp, Homo sapiens
gtgagaaggtcagga

SEQ ID NO: 53590 - DNA, 15 bp, Homo sapiens
tgagaaggtcaggag

SEQ ID NO: 53591 - DNA, 15 bp, Homo sapiens
gagaaggtcaggagc

SEQ ID NO: 53592 - DNA, 15 bp, Homo sapiens
agaaggtcaggagct

SEQ ID NO: 53593 - DNA, 15 bp, Homo sapiens
gaaggtcaggagctt

SEQ ID NO: 53594 - DNA, 15 bp, Homo sapiens
aaggtcaggagctta

SEQ ID NO: 53595 - DNA, 15 bp, Homo sapiens
aggtcaggagcttac

SEQ ID NO: 53596 - DNA, 15 bp, Homo sapiens
ggtcaggagcttaca

SEQ ID NO: 53597 - DNA, 15 bp, Homo sapiens
gtcaggagcttacat

SEQ ID NO: 53598 - DNA, 15 bp, Homo sapiens
tcaggagcttacatg

SEQ ID NO: 53599 - DNA, 15 bp, Homo sapiens
caggagcttacatgg

SEQ ID NO: 53600 - DNA, 15 bp, Homo sapiens
aggagcttacatgga

SEQ ID NO: 53601 - DNA, 15 bp, Homo sapiens
ggagcttacatggaa

SEQ ID NO: 53602 - DNA, 15 bp, Homo sapiens
gagcttacatggaat

SEQ ID NO: 53603 - DNA, 15 bp, Homo sapiens
agcttacatggaatg

SEQ ID NO: 53604 - DNA, 15 bp, Homo sapiens
gcttacatggaatgg

SEQ ID NO: 53605 - DNA, 15 bp, Homo sapiens
cttacatggaatggg

SEQ ID NO: 53606 - DNA, 15 bp, Homo sapiens
ttacatggaatggga

SEQ ID NO: 53607 - DNA, 15 bp, Homo sapiens
tacatggaatgggag

SEQ ID NO: 53608 - DNA, 15 bp, Homo sapiens
acatggaatgggagt

SEQ ID NO: 53609 - DNA, 15 bp, Homo sapiens
catggaatgggagtc

SEQ ID NO: 53610 - DNA, 15 bp, Homo sapiens
atggaatgggagtca

SEQ ID NO: 53611 - DNA, 15 bp, Homo sapiens
tggaatgggagtcag

SEQ ID NO: 53612 - DNA, 15 bp, Homo sapiens
ggaatgggagtcagc

SEQ ID NO: 53613 - DNA, 15 bp, Homo sapiens
gaatgggagtcagct

SEQ ID NO: 53614 - DNA, 15 bp, Homo sapiens
aatgggagtcagctg

SEQ ID NO: 53615 - DNA, 15 bp, Homo sapiens
atgggagtcagctgt

SEQ ID NO: 53616 - DNA, 15 bp, Homo sapiens
tgggagtcagctgtg

SEQ ID NO: 53617 - DNA, 15 bp, Homo sapiens
gggagtcagctgtgg

SEQ ID NO: 53618 - DNA, 15 bp, Homo sapiens
ggagtcagctgtggt

SEQ ID NO: 53619 - DNA, 15 bp, Homo sapiens
gagtcagctgtggta

SEQ ID NO: 53620 - DNA, 15 bp, Homo sapiens
agtcagctgtggtac

SEQ ID NO: 53621 - DNA, 15 bp, Homo sapiens
gtcagctgtggtaca

SEQ ID NO: 53622 - DNA, 15 bp, Homo sapiens
tcagctgtggtacaa

SEQ ID NO: 53623 - DNA, 15 bp, Homo sapiens
cagctgtggtacaaa

SEQ ID NO: 53624 - DNA, 15 bp, Homo sapiens
agctgtggtacaaag

SEQ ID NO: 53625 - DNA, 15 bp, Homo sapiens
gctgtggtacaaagt

SEQ ID NO: 53626 - DNA, 15 bp, Homo sapiens
ctgtggtacaaagta

SEQ ID NO: 53627 - DNA, 15 bp, Homo sapiens
tgtggtacaaagtac

SEQ ID NO: 53628 - DNA, 15 bp, Homo sapiens
gtggtacaaagtacg

SEQ ID NO: 53629 - DNA, 15 bp, Homo sapiens
tggtacaaagtacgc

SEQ ID NO: 53630 - DNA, 15 bp, Homo sapiens
ggtacaaagtacgct

SEQ ID NO: 53631 - DNA, 15 bp, Homo sapiens
gtacaaagtacgctg

SEQ ID NO: 53632 - DNA, 15 bp, Homo sapiens
tacaaagtacgctgc

SEQ ID NO: 53633 - DNA, 15 bp, Homo sapiens
acaaagtacgctgct

SEQ ID NO: 53634 - DNA, 15 bp, Homo sapiens
caaagtacgctgctt

SEQ ID NO: 53635 - DNA, 15 bp, Homo sapiens
aaagtacgctgctta

SEQ ID NO: 53636 - DNA, 15 bp, Homo sapiens
aagtacgctgcttag

SEQ ID NO: 53637 - DNA, 15 bp, Homo sapiens
agtacgctgcttagt

SEQ ID NO: 53638 - DNA, 15 bp, Homo sapiens
gtacgctgcttagtt

SEQ ID NO: 53639 - DNA, 15 bp, Homo sapiens
tacgctgcttagttc

SEQ ID NO: 53640 - DNA, 15 bp, Homo sapiens
acgctgcttagttct

SEQ ID NO: 53641 - DNA, 15 bp, Homo sapiens
cgctgcttagttcta

SEQ ID NO: 53642 - DNA, 15 bp, Homo sapiens
gctgcttagttctac

SEQ ID NO: 53643 - DNA, 15 bp, Homo sapiens
ctgcttagttctact

SEQ ID NO: 53644 - DNA, 15 bp, Homo sapiens
tgcttagttctactg

SEQ ID NO: 53645 - DNA, 15 bp, Homo sapiens
gcttagttctactga

SEQ ID NO: 53646 - DNA, 15 bp, Homo sapiens
cttagttctactgat

SEQ ID NO: 53647 - DNA, 15 bp, Homo sapiens
ttagttctactgatt

SEQ ID NO: 53648 - DNA, 15 bp, Homo sapiens
tagttctactgattt

SEQ ID NO: 53649 - DNA, 15 bp, Homo sapiens
agttctactgatttt

SEQ ID NO: 53650 - DNA, 15 bp, Homo sapiens
gttctactgattttt

SEQ ID NO: 53651 - DNA, 15 bp, Homo sapiens
ttctactgatttttt

SEQ ID NO: 53652 - DNA, 15 bp, Homo sapiens
tctactgatttttta

SEQ ID NO: 53653 - DNA, 15 bp, Homo sapiens
ctactgattttttat

SEQ ID NO: 53654 - DNA, 15 bp, Homo sapiens
tactgattttttatt

SEQ ID NO: 53655 - DNA, 15 bp, Homo sapiens
actgattttttattt

SEQ ID NO: 53656 - DNA, 15 bp, Homo sapiens
ctgattttttatttt

SEQ ID NO: 53657 - DNA, 15 bp, Homo sapiens
tgattttttattttt

SEQ ID NO: 53658 - DNA, 15 bp, Homo sapiens
gattttttatttttt

SEQ ID NO: 53659 - DNA, 15 bp, Homo sapiens
attttttatttttta

SEQ ID NO: 53660 - DNA, 15 bp, Homo sapiens
ttttttattttttat

SEQ ID NO: 53661 - DNA, 15 bp, Homo sapiens
tttttattttttatt

SEQ ID NO: 53662 - DNA, 15 bp, Homo sapiens
ttttattttttattt

SEQ ID NO: 53663 - DNA, 15 bp, Homo sapiens
tttattttttatttt

SEQ ID NO: 53664 - DNA, 15 bp, Homo sapiens
ttattttttattttt

SEQ ID NO: 53665 - DNA, 15 bp, Homo sapiens
tattttttattttta

SEQ ID NO: 53666 - DNA, 15 bp, Homo sapiens
attttttatttttac

SEQ ID NO: 53667 - DNA, 15 bp, Homo sapiens
ttttttatttttaca

SEQ ID NO: 53668 - DNA, 15 bp, Homo sapiens
tttttatttttacat

SEQ ID NO: 53669 - DNA, 15 bp, Homo sapiens
ttttatttttacata

SEQ ID NO: 53670 - DNA, 15 bp, Homo sapiens
tttatttttacataa

SEQ ID NO: 53671 - DNA, 15 bp, Homo sapiens
ttatttttacataag

SEQ ID NO: 53672 - DNA, 15 bp, Homo sapiens
tatttttacataaga

SEQ ID NO: 53673 - DNA, 15 bp, Homo sapiens
atttttacataagac

SEQ ID NO: 53674 - DNA, 15 bp, Homo sapiens
tttttacataagact

SEQ ID NO: 53675 - DNA, 15 bp, Homo sapiens
ttttacataagactt

SEQ ID NO: 53676 - DNA, 15 bp, Homo sapiens
tttacataagacttt

SEQ ID NO: 53677 - DNA, 15 bp, Homo sapiens
ttacataagactttg

SEQ ID NO: 53678 - DNA, 15 bp, Homo sapiens
tacataagactttga

SEQ ID NO: 53679 - DNA, 15 bp, Homo sapiens
acataagactttgat

SEQ ID NO: 53680 - DNA, 15 bp, Homo sapiens
cataagactttgatg

SEQ ID NO: 53681 - DNA, 15 bp, Homo sapiens
ataagactttgatgg

SEQ ID NO: 53682 - DNA, 15 bp, Homo sapiens
taagactttgatggt

SEQ ID NO: 53683 - DNA, 15 bp, Homo sapiens
aagactttgatggta

SEQ ID NO: 53684 - DNA, 15 bp, Homo sapiens
agactttgatggtaa

SEQ ID NO: 53685 - DNA, 15 bp, Homo sapiens
gactttgatggtaaa

SEQ ID NO: 53686 - DNA, 15 bp, Homo sapiens
actttgatggtaaag

SEQ ID NO: 53687 - DNA, 15 bp, Homo sapiens
ctttgatggtaaagg

SEQ ID NO: 53688 - DNA, 15 bp, Homo sapiens
tttgatggtaaagga

SEQ ID NO: 53689 - DNA, 15 bp, Homo sapiens
ttgatggtaaaggaa

SEQ ID NO: 53690 - DNA, 15 bp, Homo sapiens
tgatggtaaaggaag

SEQ ID NO: 53691 - DNA, 15 bp, Homo sapiens
gatggtaaaggaagc

SEQ ID NO: 53692 - DNA, 15 bp, Homo sapiens
atggtaaaggaagca

SEQ ID NO: 53693 - DNA, 15 bp, Homo sapiens
tggtaaaggaagcag

SEQ ID NO: 53694 - DNA, 15 bp, Homo sapiens
ggtaaaggaagcagt

SEQ ID NO: 53695 - DNA, 15 bp, Homo sapiens
gtaaaggaagcagtg

SEQ ID NO: 53696 - DNA, 15 bp, Homo sapiens
taaaggaagcagtgt

SEQ ID NO: 53697 - DNA, 15 bp, Homo sapiens
aaaggaagcagtgtg

SEQ ID NO: 53698 - DNA, 15 bp, Homo sapiens
aaggaagcagtgtgt

SEQ ID NO: 53699 - DNA, 15 bp, Homo sapiens
aggaagcagtgtgtg

SEQ ID NO: 53700 - DNA, 15 bp, Homo sapiens
ggaagcagtgtgtga

SEQ ID NO: 53701 - DNA, 15 bp, Homo sapiens
gaagcagtgtgtgag

SEQ ID NO: 53702 - DNA, 15 bp, Homo sapiens
aagcagtgtgtgagc

SEQ ID NO: 53703 - DNA, 15 bp, Homo sapiens
agcagtgtgtgagca

SEQ ID NO: 53704 - DNA, 15 bp, Homo sapiens
gcagtgtgtgagcaa

SEQ ID NO: 53705 - DNA, 15 bp, Homo sapiens
cagtgtgtgagcaag

SEQ ID NO: 53706 - DNA, 15 bp, Homo sapiens
agtgtgtgagcaagc

SEQ ID NO: 53707 - DNA, 15 bp, Homo sapiens
gtgtgtgagcaagct

SEQ ID NO: 53708 - DNA, 15 bp, Homo sapiens
tgtgtgagcaagctg

SEQ ID NO: 53709 - DNA, 15 bp, Homo sapiens
gtgtgagcaagctga

SEQ ID NO: 53710 - DNA, 15 bp, Homo sapiens
tgtgagcaagctgac

SEQ ID NO: 53711 - DNA, 15 bp, Homo sapiens
gtgagcaagctgact

SEQ ID NO: 53712 - DNA, 15 bp, Homo sapiens
tgagcaagctgactc

SEQ ID NO: 53713 - DNA, 15 bp, Homo sapiens
gagcaagctgactcc

SEQ ID NO: 53714 - DNA, 15 bp, Homo sapiens
agcaagctgactcct

SEQ ID NO: 53715 - DNA, 15 bp, Homo sapiens
gcaagctgactcctg

SEQ ID NO: 53716 - DNA, 15 bp, Homo sapiens
caagctgactcctgt

SEQ ID NO: 53717 - DNA, 15 bp, Homo sapiens
aagctgactcctgtc

SEQ ID NO: 53718 - DNA, 15 bp, Homo sapiens
agctgactcctgtct

SEQ ID NO: 53719 - DNA, 15 bp, Homo sapiens
gctgactcctgtctt

SEQ ID NO: 53720 - DNA, 15 bp, Homo sapiens
ctgactcctgtcttg

SEQ ID NO: 53721 - DNA, 15 bp, Homo sapiens
tgactcctgtcttgt

SEQ ID NO: 53722 - DNA, 15 bp, Homo sapiens
gactcctgtcttgtc

SEQ ID NO: 53723 - DNA, 15 bp, Homo sapiens
actcctgtcttgtca

SEQ ID NO: 53724 - DNA, 15 bp, Homo sapiens
ctcctgtcttgtcaa

SEQ ID NO: 53725 - DNA, 15 bp, Homo sapiens
tcctgtcttgtcaag

SEQ ID NO: 53726 - DNA, 15 bp, Homo sapiens
cctgtcttgtcaagt

SEQ ID NO: 53727 - DNA, 15 bp, Homo sapiens
ctgtcttgtcaagta

SEQ ID NO: 53728 - DNA, 15 bp, Homo sapiens
tgtcttgtcaagtac

SEQ ID NO: 53729 - DNA, 15 bp, Homo sapiens
gtcttgtcaagtacc

SEQ ID NO: 53730 - DNA, 15 bp, Homo sapiens
tcttgtcaagtacca

SEQ ID NO: 53731 - DNA, 15 bp, Homo sapiens
cttgtcaagtaccag

SEQ ID NO: 53732 - DNA, 15 bp, Homo sapiens
ttgtcaagtaccagg

SEQ ID NO: 53733 - DNA, 15 bp, Homo sapiens
tgtcaagtaccaggt

SEQ ID NO: 53734 - DNA, 15 bp, Homo sapiens
gtcaagtaccaggtc

SEQ ID NO: 53735 - DNA, 15 bp, Homo sapiens
tcaagtaccaggtcc

SEQ ID NO: 53736 - DNA, 15 bp, Homo sapiens
caagtaccaggtcca

SEQ ID NO: 53737 - DNA, 15 bp, Homo sapiens
aagtaccaggtccac

SEQ ID NO: 53738 - DNA, 15 bp, Homo sapiens
agtaccaggtccact

SEQ ID NO: 53739 - DNA, 15 bp, Homo sapiens
gtaccaggtccactc

SEQ ID NO: 53740 - DNA, 15 bp, Homo sapiens
taccaggtccactct

SEQ ID NO: 53741 - DNA, 15 bp, Homo sapiens
accaggtccactctg

SEQ ID NO: 53742 - DNA, 15 bp, Homo sapiens
ccaggtccactctga

SEQ ID NO: 53743 - DNA, 15 bp, Homo sapiens
caggtccactctgat

SEQ ID NO: 53744 - DNA, 15 bp, Homo sapiens
aggtccactctgatg

SEQ ID NO: 53745 - DNA, 15 bp, Homo sapiens
ggtccactctgatga

SEQ ID NO: 53746 - DNA, 15 bp, Homo sapiens
gtccactctgatgag

SEQ ID NO: 53747 - DNA, 15 bp, Homo sapiens
tccactctgatgagc

SEQ ID NO: 53748 - DNA, 15 bp, Homo sapiens
ccactctgatgagcc

SEQ ID NO: 53749 - DNA, 15 bp, Homo sapiens
cactctgatgagccc

SEQ ID NO: 53750 - DNA, 15 bp, Homo sapiens
actctgatgagcccc

SEQ ID NO: 53751 - DNA, 15 bp, Homo sapiens
ctctgatgagcccct

SEQ ID NO: 53752 - DNA, 15 bp, Homo sapiens
tctgatgagcccctg

SEQ ID NO: 53753 - DNA, 15 bp, Homo sapiens
ctgatgagcccctgt

SEQ ID NO: 53754 - DNA, 15 bp, Homo sapiens
tgatgagcccctgtg

SEQ ID NO: 53755 - DNA, 15 bp, Homo sapiens
gatgagcccctgtgg

SEQ ID NO: 53756 - DNA, 15 bp, Homo sapiens
atgagcccctgtgga

SEQ ID NO: 53757 - DNA, 15 bp, Homo sapiens
tgagcccctgtggac

SEQ ID NO: 53758 - DNA, 15 bp, Homo sapiens
gagcccctgtggaca

SEQ ID NO: 53759 - DNA, 15 bp, Homo sapiens
agcccctgtggacag

SEQ ID NO: 53760 - DNA, 15 bp, Homo sapiens
gcccctgtggacagc

SEQ ID NO: 53761 - DNA, 15 bp, Homo sapiens
cccctgtggacagca

SEQ ID NO: 53762 - DNA, 15 bp, Homo sapiens
ccctgtggacagcac

SEQ ID NO: 53763 - DNA, 15 bp, Homo sapiens
cctgtggacagcact

SEQ ID NO: 53764 - DNA, 15 bp, Homo sapiens
ctgtggacagcactg

SEQ ID NO: 53765 - DNA, 15 bp, Homo sapiens
tgtggacagcactgc

SEQ ID NO: 53766 - DNA, 15 bp, Homo sapiens
gtggacagcactgct

SEQ ID NO: 53767 - DNA, 15 bp, Homo sapiens
tggacagcactgctg

SEQ ID NO: 53768 - DNA, 15 bp, Homo sapiens
ggacagcactgctgt

SEQ ID NO: 53769 - DNA, 15 bp, Homo sapiens
gacagcactgctgta

SEQ ID NO: 53770 - DNA, 15 bp, Homo sapiens
acagcactgctgtaa

SEQ ID NO: 53771 - DNA, 15 bp, Homo sapiens
cagcactgctgtaac

SEQ ID NO: 53772 - DNA, 15 bp, Homo sapiens
agcactgctgtaact

SEQ ID NO: 53773 - DNA, 15 bp, Homo sapiens
gcactgctgtaactc

SEQ ID NO: 53774 - DNA, 15 bp, Homo sapiens
cactgctgtaactcc

SEQ ID NO: 53775 - DNA, 15 bp, Homo sapiens
actgctgtaactccc

SEQ ID NO: 53776 - DNA, 15 bp, Homo sapiens
ctgctgtaactcccc

SEQ ID NO: 53777 - DNA, 15 bp, Homo sapiens
tgctgtaactcccca

SEQ ID NO: 53778 - DNA, 15 bp, Homo sapiens
gctgtaactccccaa

SEQ ID NO: 53779 - DNA, 15 bp, Homo sapiens
ctgtaactccccaag

SEQ ID NO: 53780 - DNA, 15 bp, Homo sapiens
tgtaactccccaagc

SEQ ID NO: 53781 - DNA, 15 bp, Homo sapiens
gtaactccccaagcc

SEQ ID NO: 53782 - DNA, 15 bp, Homo sapiens
taactccccaagcct

SEQ ID NO: 53783 - DNA, 15 bp, Homo sapiens
aactccccaagcctg

SEQ ID NO: 53784 - DNA, 15 bp, Homo sapiens
actccccaagcctgg

SEQ ID NO: 53785 - DNA, 15 bp, Homo sapiens
ctccccaagcctggg

SEQ ID NO: 53786 - DNA, 15 bp, Homo sapiens
tccccaagcctgggc

SEQ ID NO: 53787 - DNA, 15 bp, Homo sapiens
ccccaagcctgggct

SEQ ID NO: 53788 - DNA, 15 bp, Homo sapiens
cccaagcctgggctc

SEQ ID NO: 53789 - DNA, 15 bp, Homo sapiens
ccaagcctgggctca

SEQ ID NO: 53790 - DNA, 15 bp, Homo sapiens
caagcctgggctcag

SEQ ID NO: 53791 - DNA, 15 bp, Homo sapiens
aagcctgggctcagg

SEQ ID NO: 53792 - DNA, 15 bp, Homo sapiens
agcctgggctcagga

SEQ ID NO: 53793 - DNA, 15 bp, Homo sapiens
gcctgggctcaggag

SEQ ID NO: 53794 - DNA, 15 bp, Homo sapiens
cctgggctcaggagg

SEQ ID NO: 53795 - DNA, 15 bp, Homo sapiens
ctgggctcaggaggt

SEQ ID NO: 53796 - DNA, 15 bp, Homo sapiens
tgggctcaggaggtg

SEQ ID NO: 53797 - DNA, 15 bp, Homo sapiens
gggctcaggaggtgg

SEQ ID NO: 53798 - DNA, 15 bp, Homo sapiens
ggctcaggaggtggg

SEQ ID NO: 53799 - DNA, 15 bp, Homo sapiens
gctcaggaggtgggc

SEQ ID NO: 53800 - DNA, 15 bp, Homo sapiens
ctcaggaggtgggcc

SEQ ID NO: 53801 - DNA, 15 bp, Homo sapiens
tcaggaggtgggccc

SEQ ID NO: 53802 - DNA, 15 bp, Homo sapiens
caggaggtgggccct

SEQ ID NO: 53803 - DNA, 15 bp, Homo sapiens
aggaggtgggcccta

SEQ ID NO: 53804 - DNA, 15 bp, Homo sapiens
ggaggtgggccctaa

SEQ ID NO: 53805 - DNA, 15 bp, Homo sapiens
gaggtgggccctaag

SEQ ID NO: 53806 - DNA, 15 bp, Homo sapiens
aggtgggccctaagc

SEQ ID NO: 53807 - DNA, 15 bp, Homo sapiens
ggtgggccctaagcg

SEQ ID NO: 53808 - DNA, 15 bp, Homo sapiens
gtgggccctaagcgc

SEQ ID NO: 53809 - DNA, 15 bp, Homo sapiens
tgggccctaagcgct

SEQ ID NO: 53810 - DNA, 15 bp, Homo sapiens
gggccctaagcgctg

SEQ ID NO: 53811 - DNA, 15 bp, Homo sapiens
ggccctaagcgctgt

SEQ ID NO: 53812 - DNA, 15 bp, Homo sapiens
gccctaagcgctgtt

SEQ ID NO: 53813 - DNA, 15 bp, Homo sapiens
ccctaagcgctgttc

SEQ ID NO: 53814 - DNA, 15 bp, Homo sapiens
cctaagcgctgttcc

SEQ ID NO: 53815 - DNA, 15 bp, Homo sapiens
ctaagcgctgttccc

SEQ ID NO: 53816 - DNA, 15 bp, Homo sapiens
taagcgctgttccca

SEQ ID NO: 53817 - DNA, 15 bp, Homo sapiens
aagcgctgttcccag

SEQ ID NO: 53818 - DNA, 15 bp, Homo sapiens
agcgctgttcccagc

SEQ ID NO: 53819 - DNA, 15 bp, Homo sapiens
gcgctgttcccagct

SEQ ID NO: 53820 - DNA, 15 bp, Homo sapiens
cgctgttcccagctc

SEQ ID NO: 53821 - DNA, 15 bp, Homo sapiens
gctgttcccagctct

SEQ ID NO: 53822 - DNA, 15 bp, Homo sapiens
ctgttcccagctctt

SEQ ID NO: 53823 - DNA, 15 bp, Homo sapiens
tgttcccagctcttc

SEQ ID NO: 53824 - DNA, 15 bp, Homo sapiens
gttcccagctcttcc

SEQ ID NO: 53825 - DNA, 15 bp, Homo sapiens
ttcccagctcttcct

SEQ ID NO: 53826 - DNA, 15 bp, Homo sapiens
tcccagctcttcctc

SEQ ID NO: 53827 - DNA, 15 bp, Homo sapiens
cccagctcttcctcc

SEQ ID NO: 53828 - DNA, 15 bp, Homo sapiens
ccagctcttcctcca

SEQ ID NO: 53829 - DNA, 15 bp, Homo sapiens
cagctcttcctccat

SEQ ID NO: 53830 - DNA, 15 bp, Homo sapiens
agctcttcctccatg

SEQ ID NO: 53831 - DNA, 15 bp, Homo sapiens
gctcttcctccatgc

SEQ ID NO: 53832 - DNA, 15 bp, Homo sapiens
ctcttcctccatgct

SEQ ID NO: 53833 - DNA, 15 bp, Homo sapiens
tcttcctccatgctg

SEQ ID NO: 53834 - DNA, 15 bp, Homo sapiens
cttcctccatgctgt

SEQ ID NO: 53835 - DNA, 15 bp, Homo sapiens
ttcctccatgctgtc

SEQ ID NO: 53836 - DNA, 15 bp, Homo sapiens
tcctccatgctgtca

SEQ ID NO: 53837 - DNA, 15 bp, Homo sapiens
cctccatgctgtcag

SEQ ID NO: 53838 - DNA, 15 bp, Homo sapiens
ctccatgctgtcagc

SEQ ID NO: 53839 - DNA, 15 bp, Homo sapiens
tccatgctgtcagct

SEQ ID NO: 53840 - DNA, 15 bp, Homo sapiens
ccatgctgtcagctc

SEQ ID NO: 53841 - DNA, 15 bp, Homo sapiens
catgctgtcagctct

SEQ ID NO: 53842 - DNA, 15 bp, Homo sapiens
atgctgtcagctctt

SEQ ID NO: 53843 - DNA, 15 bp, Homo sapiens
tgctgtcagctcttc

SEQ ID NO: 53844 - DNA, 15 bp, Homo sapiens
gctgtcagctcttcc

SEQ ID NO: 53845 - DNA, 15 bp, Homo sapiens
ctgtcagctcttcca

SEQ ID NO: 53846 - DNA, 15 bp, Homo sapiens
tgtcagctcttccac

SEQ ID NO: 53847 - DNA, 15 bp, Homo sapiens
gtcagctcttccacc

SEQ ID NO: 53848 - DNA, 15 bp, Homo sapiens
tcagctcttccacca

SEQ ID NO: 53849 - DNA, 15 bp, Homo sapiens
cagctcttccaccat

SEQ ID NO: 53850 - DNA, 15 bp, Homo sapiens
agctcttccaccatt

SEQ ID NO: 53851 - DNA, 15 bp, Homo sapiens
gctcttccaccattc

SEQ ID NO: 53852 - DNA, 15 bp, Homo sapiens
ctcttccaccattct

SEQ ID NO: 53853 - DNA, 15 bp, Homo sapiens
tcttccaccattctt

SEQ ID NO: 53854 - DNA, 15 bp, Homo sapiens
cttccaccattcttc

SEQ ID NO: 53855 - DNA, 15 bp, Homo sapiens
ttccaccattcttcc

SEQ ID NO: 53856 - DNA, 15 bp, Homo sapiens
tccaccattcttcct

SEQ ID NO: 53857 - DNA, 15 bp, Homo sapiens
ccaccattcttcctg

SEQ ID NO: 53858 - DNA, 15 bp, Homo sapiens
caccattcttcctgg

SEQ ID NO: 53859 - DNA, 15 bp, Homo sapiens
accattcttcctggc

SEQ ID NO: 53860 - DNA, 15 bp, Homo sapiens
ccattcttcctggcg

SEQ ID NO: 53861 - DNA, 15 bp, Homo sapiens
cattcttcctggcgt

SEQ ID NO: 53862 - DNA, 15 bp, Homo sapiens
attcttcctggcgtc

SEQ ID NO: 53863 - DNA, 15 bp, Homo sapiens
ttcttcctggcgtca

SEQ ID NO: 53864 - DNA, 15 bp, Homo sapiens
tcttcctggcgtcat

SEQ ID NO: 53865 - DNA, 15 bp, Homo sapiens
cttcctggcgtcatt

SEQ ID NO: 53866 - DNA, 15 bp, Homo sapiens
ttcctggcgtcattc

SEQ ID NO: 53867 - DNA, 15 bp, Homo sapiens
tcctggcgtcattct

SEQ ID NO: 53868 - DNA, 15 bp, Homo sapiens
cctggcgtcattcta

SEQ ID NO: 53869 - DNA, 15 bp, Homo sapiens
ctggcgtcattctaa

SEQ ID NO: 53870 - DNA, 15 bp, Homo sapiens
tggcgtcattctaag

SEQ ID NO: 53871 - DNA, 15 bp, Homo sapiens
ggcgtcattctaagg

SEQ ID NO: 53872 - DNA, 15 bp, Homo sapiens
gcgtcattctaaggt

SEQ ID NO: 53873 - DNA, 15 bp, Homo sapiens
cgtcattctaaggtc

SEQ ID NO: 53874 - DNA, 15 bp, Homo sapiens
gtcattctaaggtcc

SEQ ID NO: 53875 - DNA, 15 bp, Homo sapiens
tcattctaaggtcct

SEQ ID NO: 53876 - DNA, 15 bp, Homo sapiens
cattctaaggtcctg

SEQ ID NO: 53877 - DNA, 15 bp, Homo sapiens
attctaaggtcctgt

SEQ ID NO: 53878 - DNA, 15 bp, Homo sapiens
ttctaaggtcctgtc

SEQ ID NO: 53879 - DNA, 15 bp, Homo sapiens
tctaaggtcctgtct

SEQ ID NO: 53880 - DNA, 15 bp, Homo sapiens
ctaaggtcctgtctt

SEQ ID NO: 53881 - DNA, 15 bp, Homo sapiens
taaggtcctgtcttc

SEQ ID NO: 53882 - DNA, 15 bp, Homo sapiens
aaggtcctgtcttcc

SEQ ID NO: 53883 - DNA, 15 bp, Homo sapiens
aggtcctgtcttccc

SEQ ID NO: 53884 - DNA, 15 bp, Homo sapiens
ggtcctgtcttcccc

SEQ ID NO: 53885 - DNA, 15 bp, Homo sapiens
gtcctgtcttccccc

SEQ ID NO: 53886 - DNA, 15 bp, Homo sapiens
tcctgtcttcccccg

SEQ ID NO: 53887 - DNA, 15 bp, Homo sapiens
cctgtcttcccccgc

SEQ ID NO: 53888 - DNA, 15 bp, Homo sapiens
ctgtcttcccccgcc

SEQ ID NO: 53889 - DNA, 15 bp, Homo sapiens
tgtcttcccccgccc

SEQ ID NO: 53890 - DNA, 15 bp, Homo sapiens
gtcttcccccgccct

SEQ ID NO: 53891 - DNA, 15 bp, Homo sapiens
tcttcccccgccctc

SEQ ID NO: 53892 - DNA, 15 bp, Homo sapiens
cttcccccgccctct

SEQ ID NO: 53893 - DNA, 15 bp, Homo sapiens
ttcccccgccctctt

SEQ ID NO: 53894 - DNA, 15 bp, Homo sapiens
tcccccgccctcttc

SEQ ID NO: 53895 - DNA, 15 bp, Homo sapiens
cccccgccctcttcc

SEQ ID NO: 53896 - DNA, 15 bp, Homo sapiens
ccccgccctcttcct

SEQ ID NO: 53897 - DNA, 15 bp, Homo sapiens
cccgccctcttcctt

SEQ ID NO: 53898 - DNA, 15 bp, Homo sapiens
ccgccctcttccttc

SEQ ID NO: 53899 - DNA, 15 bp, Homo sapiens
cgccctcttccttcc

SEQ ID NO: 53900 - DNA, 15 bp, Homo sapiens
gccctcttccttcct

SEQ ID NO: 53901 - DNA, 15 bp, Homo sapiens
ccctcttccttcctg

SEQ ID NO: 53902 - DNA, 15 bp, Homo sapiens
cctcttccttcctgg

SEQ ID NO: 53903 - DNA, 15 bp, Homo sapiens
ctcttccttcctggc

SEQ ID NO: 53904 - DNA, 15 bp, Homo sapiens
tcttccttcctggct

SEQ ID NO: 53905 - DNA, 15 bp, Homo sapiens
cttccttcctggctt

SEQ ID NO: 53906 - DNA, 15 bp, Homo sapiens
ttccttcctggcttc

SEQ ID NO: 53907 - DNA, 15 bp, Homo sapiens
tccttcctggcttct

SEQ ID NO: 53908 - DNA, 15 bp, Homo sapiens
ccttcctggcttcta

SEQ ID NO: 53909 - DNA, 15 bp, Homo sapiens
cttcctggcttctac

SEQ ID NO: 53910 - DNA, 15 bp, Homo sapiens
ttcctggcttctacg

SEQ ID NO: 53911 - DNA, 15 bp, Homo sapiens
tcctggcttctacgc

SEQ ID NO: 53912 - DNA, 15 bp, Homo sapiens
cctggcttctacgct

SEQ ID NO: 53913 - DNA, 15 bp, Homo sapiens
ctggcttctacgctc

SEQ ID NO: 53914 - DNA, 15 bp, Homo sapiens
tggcttctacgctca

SEQ ID NO: 53915 - DNA, 15 bp, Homo sapiens
ggcttctacgctcag

SEQ ID NO: 53916 - DNA, 15 bp, Homo sapiens
gcttctacgctcagc

SEQ ID NO: 53917 - DNA, 15 bp, Homo sapiens
cttctacgctcagct

SEQ ID NO: 53918 - DNA, 15 bp, Homo sapiens
ttctacgctcagctc

SEQ ID NO: 53919 - DNA, 15 bp, Homo sapiens
tctacgctcagctca

SEQ ID NO: 53920 - DNA, 15 bp, Homo sapiens
ctacgctcagctcaa

SEQ ID NO: 53921 - DNA, 15 bp, Homo sapiens
tacgctcagctcaag

SEQ ID NO: 53922 - DNA, 15 bp, Homo sapiens
acgctcagctcaagt

SEQ ID NO: 53923 - DNA, 15 bp, Homo sapiens
cgctcagctcaagta

SEQ ID NO: 53924 - DNA, 15 bp, Homo sapiens
gctcagctcaagtag

SEQ ID NO: 53925 - DNA, 15 bp, Homo sapiens
ctcagctcaagtagt

SEQ ID NO: 53926 - DNA, 15 bp, Homo sapiens
tcagctcaagtagta

SEQ ID NO: 53927 - DNA, 15 bp, Homo sapiens
cagctcaagtagtag

SEQ ID NO: 53928 - DNA, 15 bp, Homo sapiens
agctcaagtagtagc

SEQ ID NO: 53929 - DNA, 15 bp, Homo sapiens
gctcaagtagtagct

SEQ ID NO: 53930 - DNA, 15 bp, Homo sapiens
ctcaagtagtagctg

SEQ ID NO: 53931 - DNA, 15 bp, Homo sapiens
tcaagtagtagctgt

SEQ ID NO: 53932 - DNA, 15 bp, Homo sapiens
caagtagtagctgtt

SEQ ID NO: 53933 - DNA, 15 bp, Homo sapiens
aagtagtagctgttt

SEQ ID NO: 53934 - DNA, 15 bp, Homo sapiens
agtagtagctgtttg

SEQ ID NO: 53935 - DNA, 15 bp, Homo sapiens
gtagtagctgtttgg

SEQ ID NO: 53936 - DNA, 15 bp, Homo sapiens
tagtagctgtttggg

SEQ ID NO: 53937 - DNA, 15 bp, Homo sapiens
agtagctgtttgggt

SEQ ID NO: 53938 - DNA, 15 bp, Homo sapiens
gtagctgtttgggta

SEQ ID NO: 53939 - DNA, 15 bp, Homo sapiens
tagctgtttgggtac

SEQ ID NO: 53940 - DNA, 15 bp, Homo sapiens
agctgtttgggtact

SEQ ID NO: 53941 - DNA, 15 bp, Homo sapiens
gctgtttgggtactt

SEQ ID NO: 53942 - DNA, 15 bp, Homo sapiens
ctgtttgggtacttt

SEQ ID NO: 53943 - DNA, 15 bp, Homo sapiens
tgtttgggtactttt

SEQ ID NO: 53944 - DNA, 15 bp, Homo sapiens
gtttgggtacttttc

SEQ ID NO: 53945 - DNA, 15 bp, Homo sapiens
tttgggtacttttca

SEQ ID NO: 53946 - DNA, 15 bp, Homo sapiens
ttgggtacttttcac

SEQ ID NO: 53947 - DNA, 15 bp, Homo sapiens
tgggtacttttcacc

SEQ ID NO: 53948 - DNA, 15 bp, Homo sapiens
gggtacttttcaccc

SEQ ID NO: 53949 - DNA, 15 bp, Homo sapiens
ggtacttttcaccca

SEQ ID NO: 53950 - DNA, 15 bp, Homo sapiens
gtacttttcacccag

SEQ ID NO: 53951 - DNA, 15 bp, Homo sapiens
tacttttcacccaga

SEQ ID NO: 53952 - DNA, 15 bp, Homo sapiens
acttttcacccagac

SEQ ID NO: 53953 - DNA, 15 bp, Homo sapiens
cttttcacccagact

SEQ ID NO: 53954 - DNA, 15 bp, Homo sapiens
ttttcacccagactt

SEQ ID NO: 53955 - DNA, 15 bp, Homo sapiens
tttcacccagactta

SEQ ID NO: 53956 - DNA, 15 bp, Homo sapiens
ttcacccagacttag

SEQ ID NO: 53957 - DNA, 15 bp, Homo sapiens
tcacccagacttagg

SEQ ID NO: 53958 - DNA, 15 bp, Homo sapiens
cacccagacttagga

SEQ ID NO: 53959 - DNA, 15 bp, Homo sapiens
acccagacttaggaa

SEQ ID NO: 53960 - DNA, 15 bp, Homo sapiens
cccagacttaggaaa

SEQ ID NO: 53961 - DNA, 15 bp, Homo sapiens
ccagacttaggaaat

SEQ ID NO: 53962 - DNA, 15 bp, Homo sapiens
cagacttaggaaatg

SEQ ID NO: 53963 - DNA, 15 bp, Homo sapiens
agacttaggaaatgt

SEQ ID NO: 53964 - DNA, 15 bp, Homo sapiens
gacttaggaaatgtt

SEQ ID NO: 53965 - DNA, 15 bp, Homo sapiens
acttaggaaatgtta

SEQ ID NO: 53966 - DNA, 15 bp, Homo sapiens
cttaggaaatgttat

SEQ ID NO: 53967 - DNA, 15 bp, Homo sapiens
ttaggaaatgttatc

SEQ ID NO: 53968 - DNA, 15 bp, Homo sapiens
taggaaatgttatca

SEQ ID NO: 53969 - DNA, 15 bp, Homo sapiens
aggaaatgttatcag

SEQ ID NO: 53970 - DNA, 15 bp, Homo sapiens
ggaaatgttatcagt

SEQ ID NO: 53971 - DNA, 15 bp, Homo sapiens
gaaatgttatcagtt

SEQ ID NO: 53972 - DNA, 15 bp, Homo sapiens
aaatgttatcagttg

SEQ ID NO: 53973 - DNA, 15 bp, Homo sapiens
aatgttatcagttgg

SEQ ID NO: 53974 - DNA, 15 bp, Homo sapiens
atgttatcagttggt

SEQ ID NO: 53975 - DNA, 15 bp, Homo sapiens
tgttatcagttggtc

SEQ ID NO: 53976 - DNA, 15 bp, Homo sapiens
gttatcagttggtcg

SEQ ID NO: 53977 - DNA, 15 bp, Homo sapiens
ttatcagttggtcgt

SEQ ID NO: 53978 - DNA, 15 bp, Homo sapiens
tatcagttggtcgta

SEQ ID NO: 53979 - DNA, 15 bp, Homo sapiens
atcagttggtcgtat

SEQ ID NO: 53980 - DNA, 15 bp, Homo sapiens
tcagttggtcgtatt

SEQ ID NO: 53981 - DNA, 15 bp, Homo sapiens
cagttggtcgtattc

SEQ ID NO: 53982 - DNA, 15 bp, Homo sapiens
agttggtcgtattcc

SEQ ID NO: 53983 - DNA, 15 bp, Homo sapiens
gttggtcgtattcct

SEQ ID NO: 53984 - DNA, 15 bp, Homo sapiens
ttggtcgtattcctg

SEQ ID NO: 53985 - DNA, 15 bp, Homo sapiens
tggtcgtattcctgt

SEQ ID NO: 53986 - DNA, 15 bp, Homo sapiens
ggtcgtattcctgtc

SEQ ID NO: 53987 - DNA, 15 bp, Homo sapiens
gtcgtattcctgtca

SEQ ID NO: 53988 - DNA, 15 bp, Homo sapiens
tcgtattcctgtcag

SEQ ID NO: 53989 - DNA, 15 bp, Homo sapiens
cgtattcctgtcagc

SEQ ID NO: 53990 - DNA, 15 bp, Homo sapiens
gtattcctgtcagcc

SEQ ID NO: 53991 - DNA, 15 bp, Homo sapiens
tattcctgtcagccc

SEQ ID NO: 53992 - DNA, 15 bp, Homo sapiens
attcctgtcagccct

SEQ ID NO: 53993 - DNA, 15 bp, Homo sapiens
ttcctgtcagccctc

SEQ ID NO: 53994 - DNA, 15 bp, Homo sapiens
tcctgtcagccctct

SEQ ID NO: 53995 - DNA, 15 bp, Homo sapiens
cctgtcagccctctt

SEQ ID NO: 53996 - DNA, 15 bp, Homo sapiens
ctgtcagccctctta

SEQ ID NO: 53997 - DNA, 15 bp, Homo sapiens
tgtcagccctcttac

SEQ ID NO: 53998 - DNA, 15 bp, Homo sapiens
gtcagccctcttact

SEQ ID NO: 53999 - DNA, 15 bp, Homo sapiens
tcagccctcttacta

SEQ ID NO: 54000 - DNA, 15 bp, Homo sapiens
cagccctcttactat

SEQ ID NO: 54001 - DNA, 15 bp, Homo sapiens
agccctcttactatg

SEQ ID NO: 54002 - DNA, 15 bp, Homo sapiens
gccctcttactatgg

SEQ ID NO: 54003 - DNA, 15 bp, Homo sapiens
ccctcttactatgga

SEQ ID NO: 54004 - DNA, 15 bp, Homo sapiens
cctcttactatggaa

SEQ ID NO: 54005 - DNA, 15 bp, Homo sapiens
ctcttactatggaac

SEQ ID NO: 54006 - DNA, 15 bp, Homo sapiens
tcttactatggaact

SEQ ID NO: 54007 - DNA, 15 bp, Homo sapiens
cttactatggaactc

SEQ ID NO: 54008 - DNA, 15 bp, Homo sapiens
ttactatggaactca

SEQ ID NO: 54009 - DNA, 15 bp, Homo sapiens
tactatggaactcaa

SEQ ID NO: 54010 - DNA, 15 bp, Homo sapiens
actatggaactcaaa

SEQ ID NO: 54011 - DNA, 15 bp, Homo sapiens
ctatggaactcaaat

SEQ ID NO: 54012 - DNA, 15 bp, Homo sapiens
tatggaactcaaata

SEQ ID NO: 54013 - DNA, 15 bp, Homo sapiens
atggaactcaaatag

SEQ ID NO: 54014 - DNA, 15 bp, Homo sapiens
tggaactcaaatagg

SEQ ID NO: 54015 - DNA, 15 bp, Homo sapiens
ggaactcaaatagga

SEQ ID NO: 54016 - DNA, 15 bp, Homo sapiens
gaactcaaataggac

SEQ ID NO: 54017 - DNA, 15 bp, Homo sapiens
aactcaaataggaca

SEQ ID NO: 54018 - DNA, 15 bp, Homo sapiens
actcaaataggacag

SEQ ID NO: 54019 - DNA, 15 bp, Homo sapiens
ctcaaataggacaga

SEQ ID NO: 54020 - DNA, 15 bp, Homo sapiens
tcaaataggacagat

SEQ ID NO: 54021 - DNA, 15 bp, Homo sapiens
caaataggacagatt

SEQ ID NO: 54022 - DNA, 15 bp, Homo sapiens
aaataggacagattc

SEQ ID NO: 54023 - DNA, 15 bp, Homo sapiens
aataggacagattca

SEQ ID NO: 54024 - DNA, 15 bp, Homo sapiens
ataggacagattcag

SEQ ID NO: 54025 - DNA, 15 bp, Homo sapiens
taggacagattcagc

SEQ ID NO: 54026 - DNA, 15 bp, Homo sapiens
aggacagattcagct

SEQ ID NO: 54027 - DNA, 15 bp, Homo sapiens
ggacagattcagctg

SEQ ID NO: 54028 - DNA, 15 bp, Homo sapiens
gacagattcagctga

SEQ ID NO: 54029 - DNA, 15 bp, Homo sapiens
acagattcagctgaa

SEQ ID NO: 54030 - DNA, 15 bp, Homo sapiens
cagattcagctgaat

SEQ ID NO: 54031 - DNA, 15 bp, Homo sapiens
agattcagctgaatt

SEQ ID NO: 54032 - DNA, 15 bp, Homo sapiens
gattcagctgaattc

SEQ ID NO: 54033 - DNA, 15 bp, Homo sapiens
attcagctgaattcc

SEQ ID NO: 54034 - DNA, 15 bp, Homo sapiens
ttcagctgaattccc

SEQ ID NO: 54035 - DNA, 15 bp, Homo sapiens
tcagctgaattccca

SEQ ID NO: 54036 - DNA, 15 bp, Homo sapiens
cagctgaattcccag

SEQ ID NO: 54037 - DNA, 15 bp, Homo sapiens
agctgaattcccagc

SEQ ID NO: 54038 - DNA, 15 bp, Homo sapiens
gctgaattcccagcc

SEQ ID NO: 54039 - DNA, 15 bp, Homo sapiens
ctgaattcccagccc

SEQ ID NO: 54040 - DNA, 15 bp, Homo sapiens
tgaattcccagccct

SEQ ID NO: 54041 - DNA, 15 bp, Homo sapiens
gaattcccagccctg

SEQ ID NO: 54042 - DNA, 15 bp, Homo sapiens
aattcccagccctgt

SEQ ID NO: 54043 - DNA, 15 bp, Homo sapiens
attcccagccctgtg

SEQ ID NO: 54044 - DNA, 15 bp, Homo sapiens
ttcccagccctgtgg

SEQ ID NO: 54045 - DNA, 15 bp, Homo sapiens
tcccagccctgtggt

SEQ ID NO: 54046 - DNA, 15 bp, Homo sapiens
cccagccctgtggtt

SEQ ID NO: 54047 - DNA, 15 bp, Homo sapiens
ccagccctgtggttg

SEQ ID NO: 54048 - DNA, 15 bp, Homo sapiens
cagccctgtggttgc

SEQ ID NO: 54049 - DNA, 15 bp, Homo sapiens
agccctgtggttgca

SEQ ID NO: 54050 - DNA, 15 bp, Homo sapiens
gccctgtggttgcac

SEQ ID NO: 54051 - DNA, 15 bp, Homo sapiens
ccctgtggttgcact

SEQ ID NO: 54052 - DNA, 15 bp, Homo sapiens
cctgtggttgcactc

SEQ ID NO: 54053 - DNA, 15 bp, Homo sapiens
ctgtggttgcactct

SEQ ID NO: 54054 - DNA, 15 bp, Homo sapiens
tgtggttgcactctt

SEQ ID NO: 54055 - DNA, 15 bp, Homo sapiens
gtggttgcactcttt

SEQ ID NO: 54056 - DNA, 15 bp, Homo sapiens
tggttgcactctttg

SEQ ID NO: 54057 - DNA, 15 bp, Homo sapiens
ggttgcactctttgt

SEQ ID NO: 54058 - DNA, 15 bp, Homo sapiens
gttgcactctttgtc

SEQ ID NO: 54059 - DNA, 15 bp, Homo sapiens
ttgcactctttgtct

SEQ ID NO: 54060 - DNA, 15 bp, Homo sapiens
tgcactctttgtctg

SEQ ID NO: 54061 - DNA, 15 bp, Homo sapiens
gcactctttgtctgc

SEQ ID NO: 54062 - DNA, 15 bp, Homo sapiens
cactctttgtctgcc

SEQ ID NO: 54063 - DNA, 15 bp, Homo sapiens
actctttgtctgccc

SEQ ID NO: 54064 - DNA, 15 bp, Homo sapiens
ctctttgtctgccct

SEQ ID NO: 54065 - DNA, 15 bp, Homo sapiens
tctttgtctgccctg

SEQ ID NO: 54066 - DNA, 15 bp, Homo sapiens
ctttgtctgccctgc

SEQ ID NO: 54067 - DNA, 15 bp, Homo sapiens
tttgtctgccctgct

SEQ ID NO: 54068 - DNA, 15 bp, Homo sapiens
ttgtctgccctgctt

SEQ ID NO: 54069 - DNA, 15 bp, Homo sapiens
tgtctgccctgcttc

SEQ ID NO: 54070 - DNA, 15 bp, Homo sapiens
gtctgccctgcttcc

SEQ ID NO: 54071 - DNA, 15 bp, Homo sapiens
tctgccctgcttccc

SEQ ID NO: 54072 - DNA, 15 bp, Homo sapiens
ctgccctgcttcccc

SEQ ID NO: 54073 - DNA, 15 bp, Homo sapiens
tgccctgcttcccca

SEQ ID NO: 54074 - DNA, 15 bp, Homo sapiens
gccctgcttccccaa

SEQ ID NO: 54075 - DNA, 15 bp, Homo sapiens
ccctgcttccccaag

SEQ ID NO: 54076 - DNA, 15 bp, Homo sapiens
cctgcttccccaagg

SEQ ID NO: 54077 - DNA, 15 bp, Homo sapiens
ctgcttccccaaggt

SEQ ID NO: 54078 - DNA, 15 bp, Homo sapiens
tgcttccccaaggta

SEQ ID NO: 54079 - DNA, 15 bp, Homo sapiens
gcttccccaaggtag

SEQ ID NO: 54080 - DNA, 15 bp, Homo sapiens
cttccccaaggtagc

SEQ ID NO: 54081 - DNA, 15 bp, Homo sapiens
ttccccaaggtagcc

SEQ ID NO: 54082 - DNA, 15 bp, Homo sapiens
tccccaaggtagcct

SEQ ID NO: 54083 - DNA, 15 bp, Homo sapiens
ccccaaggtagcctg

SEQ ID NO: 54084 - DNA, 15 bp, Homo sapiens
cccaaggtagcctgc

SEQ ID NO: 54085 - DNA, 15 bp, Homo sapiens
ccaaggtagcctgct

SEQ ID NO: 54086 - DNA, 15 bp, Homo sapiens
caaggtagcctgctc

SEQ ID NO: 54087 - DNA, 15 bp, Homo sapiens
aaggtagcctgctcc

SEQ ID NO: 54088 - DNA, 15 bp, Homo sapiens
aggtagcctgctccc

SEQ ID NO: 54089 - DNA, 15 bp, Homo sapiens
ggtagcctgctccct

SEQ ID NO: 54090 - DNA, 15 bp, Homo sapiens
gtagcctgctcccta

SEQ ID NO: 54091 - DNA, 15 bp, Homo sapiens
tagcctgctccctaa

SEQ ID NO: 54092 - DNA, 15 bp, Homo sapiens
agcctgctccctaaa

SEQ ID NO: 54093 - DNA, 15 bp, Homo sapiens
gcctgctccctaaag

SEQ ID NO: 54094 - DNA, 15 bp, Homo sapiens
cctgctccctaaagg

SEQ ID NO: 54095 - DNA, 15 bp, Homo sapiens
ctgctccctaaaggt

SEQ ID NO: 54096 - DNA, 15 bp, Homo sapiens
tgctccctaaaggtc

SEQ ID NO: 54097 - DNA, 15 bp, Homo sapiens
gctccctaaaggtca

SEQ ID NO: 54098 - DNA, 15 bp, Homo sapiens
ctccctaaaggtcac

SEQ ID NO: 54099 - DNA, 15 bp, Homo sapiens
tccctaaaggtcacc

SEQ ID NO: 54100 - DNA, 15 bp, Homo sapiens
ccctaaaggtcaccg

SEQ ID NO: 54101 - DNA, 15 bp, Homo sapiens
cctaaaggtcaccga

SEQ ID NO: 54102 - DNA, 15 bp, Homo sapiens
ctaaaggtcaccgag

SEQ ID NO: 54103 - DNA, 15 bp, Homo sapiens
taaaggtcaccgaga

SEQ ID NO: 54104 - DNA, 15 bp, Homo sapiens
aaaggtcaccgagat

SEQ ID NO: 54105 - DNA, 15 bp, Homo sapiens
aaggtcaccgagata

SEQ ID NO: 54106 - DNA, 15 bp, Homo sapiens
aggtcaccgagatac

SEQ ID NO: 54107 - DNA, 15 bp, Homo sapiens
ggtcaccgagatact

SEQ ID NO: 54108 - DNA, 15 bp, Homo sapiens
gtcaccgagatactc

SEQ ID NO: 54109 - DNA, 15 bp, Homo sapiens
tcaccgagatactcc

SEQ ID NO: 54110 - DNA, 15 bp, Homo sapiens
caccgagatactccc

SEQ ID NO: 54111 - DNA, 15 bp, Homo sapiens
accgagatactcccc

SEQ ID NO: 54112 - DNA, 15 bp, Homo sapiens
ccgagatactcccca

SEQ ID NO: 54113 - DNA, 15 bp, Homo sapiens
cgagatactccccat

SEQ ID NO: 54114 - DNA, 15 bp, Homo sapiens
gagatactccccatg

SEQ ID NO: 54115 - DNA, 15 bp, Homo sapiens
agatactccccatgc

SEQ ID NO: 54116 - DNA, 15 bp, Homo sapiens
gatactccccatgca

SEQ ID NO: 54117 - DNA, 15 bp, Homo sapiens
atactccccatgcaa

SEQ ID NO: 54118 - DNA, 15 bp, Homo sapiens
tactccccatgcaag

SEQ ID NO: 54119 - DNA, 15 bp, Homo sapiens
actccccatgcaagg

SEQ ID NO: 54120 - DNA, 15 bp, Homo sapiens
ctccccatgcaaggt

SEQ ID NO: 54121 - DNA, 15 bp, Homo sapiens
tccccatgcaaggtt

SEQ ID NO: 54122 - DNA, 15 bp, Homo sapiens
ccccatgcaaggttt

SEQ ID NO: 54123 - DNA, 15 bp, Homo sapiens
cccatgcaaggtttt

SEQ ID NO: 54124 - DNA, 15 bp, Homo sapiens
ccatgcaaggttttt

SEQ ID NO: 54125 - DNA, 15 bp, Homo sapiens
catgcaaggtttttg

SEQ ID NO: 54126 - DNA, 15 bp, Homo sapiens
atgcaaggtttttgt

SEQ ID NO: 54127 - DNA, 15 bp, Homo sapiens
tgcaaggtttttgtt

SEQ ID NO: 54128 - DNA, 15 bp, Homo sapiens
gcaaggtttttgttg

SEQ ID NO: 54129 - DNA, 15 bp, Homo sapiens
caaggtttttgttgt

SEQ ID NO: 54130 - DNA, 15 bp, Homo sapiens
aaggtttttgttgta

SEQ ID NO: 54131 - DNA, 15 bp, Homo sapiens
aggtttttgttgtat

SEQ ID NO: 54132 - DNA, 15 bp, Homo sapiens
ggtttttgttgtatt

SEQ ID NO: 54133 - DNA, 15 bp, Homo sapiens
gtttttgttgtatta

SEQ ID NO: 54134 - DNA, 15 bp, Homo sapiens
tttttgttgtattac

SEQ ID NO: 54135 - DNA, 15 bp, Homo sapiens
ttttgttgtattaca

SEQ ID NO: 54136 - DNA, 15 bp, Homo sapiens
tttgttgtattacac

SEQ ID NO: 54137 - DNA, 15 bp, Homo sapiens
ttgttgtattacaca

SEQ ID NO: 54138 - DNA, 15 bp, Homo sapiens
tgttgtattacacat

SEQ ID NO: 54139 - DNA, 15 bp, Homo sapiens
gttgtattacacatg

SEQ ID NO: 54140 - DNA, 15 bp, Homo sapiens
ttgtattacacatga

SEQ ID NO: 54141 - DNA, 15 bp, Homo sapiens
tgtattacacatgac

SEQ ID NO: 54142 - DNA, 15 bp, Homo sapiens
gtattacacatgaca

SEQ ID NO: 54143 - DNA, 15 bp, Homo sapiens
tattacacatgacaa

SEQ ID NO: 54144 - DNA, 15 bp, Homo sapiens
attacacatgacaac

SEQ ID NO: 54145 - DNA, 15 bp, Homo sapiens
ttacacatgacaaca

SEQ ID NO: 54146 - DNA, 15 bp, Homo sapiens
tacacatgacaacat

SEQ ID NO: 54147 - DNA, 15 bp, Homo sapiens
acacatgacaacatg

SEQ ID NO: 54148 - DNA, 15 bp, Homo sapiens
cacatgacaacatgg

SEQ ID NO: 54149 - DNA, 15 bp, Homo sapiens
acatgacaacatgga

SEQ ID NO: 54150 - DNA, 15 bp, Homo sapiens
catgacaacatggaa

SEQ ID NO: 54151 - DNA, 15 bp, Homo sapiens
atgacaacatggaat

SEQ ID NO: 54152 - DNA, 15 bp, Homo sapiens
tgacaacatggaata

SEQ ID NO: 54153 - DNA, 15 bp, Homo sapiens
gacaacatggaataa

SEQ ID NO: 54154 - DNA, 15 bp, Homo sapiens
acaacatggaataaa

SEQ ID NO: 54155 - DNA, 15 bp, Homo sapiens
caacatggaataaag

SEQ ID NO: 54156 - DNA, 15 bp, Homo sapiens
aacatggaataaagt

SEQ ID NO: 54157 - DNA, 15 bp, Homo sapiens
acatggaataaagtg

SEQ ID NO: 54158 - DNA, 15 bp, Homo sapiens
catggaataaagtgt

SEQ ID NO: 54159 - DNA, 15 bp, Homo sapiens
atggaataaagtgtt

SEQ ID NO: 54160 - DNA, 15 bp, Homo sapiens
tggaataaagtgttt

SEQ ID NO: 54161 - DNA, 15 bp, Homo sapiens
ggaataaagtgtttt

SEQ ID NO: 54162 - DNA, 15 bp, Homo sapiens
gaataaagtgttttg

SEQ ID NO: 54163 - DNA, 15 bp, Homo sapiens
aataaagtgttttgc

SEQ ID NO: 54164 - DNA, 15 bp, Homo sapiens
ataaagtgttttgca

SEQ ID NO: 54165 - DNA, 15 bp, Homo sapiens
taaagtgttttgcaa

SEQ ID NO: 54166 - DNA, 15 bp, Homo sapiens
aaagtgttttgcaaa

SEQ ID NO: 54167 - DNA, 15 bp, Homo sapiens
aagtgttttgcaaat

SEQ ID NO: 54168 - DNA, 15 bp, Homo sapiens
agtgttttgcaaatt

SEQ ID NO: 54169 - DNA, 15 bp, Homo sapiens
gtgttttgcaaattt

SEQ ID NO: 54170 - DNA, 15 bp, Homo sapiens
tgttttgcaaattta

SEQ ID NO: 54171 - DNA, 15 bp, Homo sapiens
gttttgcaaatttac

SEQ ID NO: 54172 - DNA, 15 bp, Homo sapiens
ttttgcaaatttact

SEQ ID NO: 54173 - DNA, 15 bp, Homo sapiens
tttgcaaatttactg

SEQ ID NO: 54174 - DNA, 15 bp, Homo sapiens
ttgcaaatttactgg

SEQ ID NO: 54175 - DNA, 15 bp, Homo sapiens
tgcaaatttactgga

SEQ ID NO: 54176 - DNA, 15 bp, Homo sapiens
gcaaatttactggat

SEQ ID NO: 54177 - DNA, 15 bp, Homo sapiens
caaatttactggatg

SEQ ID NO: 54178 - DNA, 15 bp, Homo sapiens
aaatttactggatga

SEQ ID NO: 54179 - DNA, 15 bp, Homo sapiens
aatttactggatgat

SEQ ID NO: 54180 - DNA, 15 bp, Homo sapiens
atttactggatgata

SEQ ID NO: 54181 - DNA, 15 bp, Homo sapiens
tttactggatgatat

SEQ ID NO: 54182 - DNA, 15 bp, Homo sapiens
ttactggatgatatc

SEQ ID NO: 54183 - DNA, 15 bp, Homo sapiens
tactggatgatatcc

SEQ ID NO: 54184 - DNA, 15 bp, Homo sapiens
actggatgatatcct

SEQ ID NO: 54185 - DNA, 15 bp, Homo sapiens
ctggatgatatccta

SEQ ID NO: 54186 - DNA, 15 bp, Homo sapiens
tggatgatatcctac

SEQ ID NO: 54187 - DNA, 15 bp, Homo sapiens
ggatgatatcctact

SEQ ID NO: 54188 - DNA, 15 bp, Homo sapiens
gatgatatcctacta

SEQ ID NO: 54189 - DNA, 15 bp, Homo sapiens
atgatatcctactat

SEQ ID NO: 54190 - DNA, 15 bp, Homo sapiens
tgatatcctactatg

SEQ ID NO: 54191 - DNA, 15 bp, Homo sapiens
gatatcctactatgt

SEQ ID NO: 54192 - DNA, 15 bp, Homo sapiens
atatcctactatgtg

SEQ ID NO: 54193 - DNA, 15 bp, Homo sapiens
tatcctactatgtgg

SEQ ID NO: 54194 - DNA, 15 bp, Homo sapiens
atcctactatgtgga

SEQ ID NO: 54195 - DNA, 15 bp, Homo sapiens
tcctactatgtggaa

SEQ ID NO: 54196 - DNA, 15 bp, Homo sapiens
cctactatgtggaac

SEQ ID NO: 54197 - DNA, 15 bp, Homo sapiens
ctactatgtggaaca

SEQ ID NO: 54198 - DNA, 15 bp, Homo sapiens
tactatgtggaacat

SEQ ID NO: 54199 - DNA, 15 bp, Homo sapiens
actatgtggaacatc

SEQ ID NO: 54200 - DNA, 15 bp, Homo sapiens
ctatgtggaacatcc

SEQ ID NO: 54201 - DNA, 15 bp, Homo sapiens
tatgtggaacatcct

SEQ ID NO: 54202 - DNA, 15 bp, Homo sapiens
atgtggaacatccta

SEQ ID NO: 54203 - DNA, 15 bp, Homo sapiens
tgtggaacatcctac

SEQ ID NO: 54204 - DNA, 15 bp, Homo sapiens
gtggaacatcctaca

SEQ ID NO: 54205 - DNA, 15 bp, Homo sapiens
tggaacatcctacaa

SEQ ID NO: 54206 - DNA, 15 bp, Homo sapiens
ggaacatcctacaac

SEQ ID NO: 54207 - DNA, 15 bp, Homo sapiens
gaacatcctacaact

SEQ ID NO: 54208 - DNA, 15 bp, Homo sapiens
aacatcctacaactt

SEQ ID NO: 54209 - DNA, 15 bp, Homo sapiens
acatcctacaactta

SEQ ID NO: 54210 - DNA, 15 bp, Homo sapiens
catcctacaacttac

SEQ ID NO: 54211 - DNA, 15 bp, Homo sapiens
atcctacaacttact

SEQ ID NO: 54212 - DNA, 15 bp, Homo sapiens
tcctacaacttactc

SEQ ID NO: 54213 - DNA, 15 bp, Homo sapiens
cctacaacttactct

SEQ ID NO: 54214 - DNA, 15 bp, Homo sapiens
ctacaacttactctt

SEQ ID NO: 54215 - DNA, 15 bp, Homo sapiens
tacaacttactcttt

SEQ ID NO: 54216 - DNA, 15 bp, Homo sapiens
acaacttactctttt

SEQ ID NO: 54217 - DNA, 15 bp, Homo sapiens
caacttactcttttc

SEQ ID NO: 54218 - DNA, 15 bp, Homo sapiens
aacttactcttttca

SEQ ID NO: 54219 - DNA, 15 bp, Homo sapiens
acttactcttttcac

SEQ ID NO: 54220 - DNA, 15 bp, Homo sapiens
cttactcttttcact

SEQ ID NO: 54221 - DNA, 15 bp, Homo sapiens
ttactcttttcactc

SEQ ID NO: 54222 - DNA, 15 bp, Homo sapiens
tactcttttcactca

SEQ ID NO: 54223 - DNA, 15 bp, Homo sapiens
actcttttcactcaa

SEQ ID NO: 54224 - DNA, 15 bp, Homo sapiens
ctcttttcactcaac

SEQ ID NO: 54225 - DNA, 15 bp, Homo sapiens
tcttttcactcaaca

SEQ ID NO: 54226 - DNA, 15 bp, Homo sapiens
cttttcactcaacat

SEQ ID NO: 54227 - DNA, 15 bp, Homo sapiens
ttttcactcaacatt

SEQ ID NO: 54228 - DNA, 15 bp, Homo sapiens
tttcactcaacattt

SEQ ID NO: 54229 - DNA, 15 bp, Homo sapiens
ttcactcaacatttg

SEQ ID NO: 54230 - DNA, 15 bp, Homo sapiens
tcactcaacatttga

SEQ ID NO: 54231 - DNA, 15 bp, Homo sapiens
cactcaacatttgac

SEQ ID NO: 54232 - DNA, 15 bp, Homo sapiens
actcaacatttgact

SEQ ID NO: 54233 - DNA, 15 bp, Homo sapiens
ctcaacatttgactt

SEQ ID NO: 54234 - DNA, 15 bp, Homo sapiens
tcaacatttgacttt

SEQ ID NO: 54235 - DNA, 15 bp, Homo sapiens
caacatttgactttt

SEQ ID NO: 54236 - DNA, 15 bp, Homo sapiens
aacatttgacttttg

SEQ ID NO: 54237 - DNA, 15 bp, Homo sapiens
acatttgacttttga

SEQ ID NO: 54238 - DNA, 15 bp, Homo sapiens
catttgacttttgaa

SEQ ID NO: 54239 - DNA, 15 bp, Homo sapiens
atttgacttttgaac

SEQ ID NO: 54240 - DNA, 15 bp, Homo sapiens
tttgacttttgaacc

SEQ ID NO: 54241 - DNA, 15 bp, Homo sapiens
ttgacttttgaacct

SEQ ID NO: 54242 - DNA, 15 bp, Homo sapiens
tgacttttgaacctg

SEQ ID NO: 54243 - DNA, 15 bp, Homo sapiens
gacttttgaacctgg

SEQ ID NO: 54244 - DNA, 15 bp, Homo sapiens
acttttgaacctggt

SEQ ID NO: 54245 - DNA, 15 bp, Homo sapiens
cttttgaacctggtc

SEQ ID NO: 54246 - DNA, 15 bp, Homo sapiens
ttttgaacctggtct

SEQ ID NO: 54247 - DNA, 15 bp, Homo sapiens
tttgaacctggtctg

SEQ ID NO: 54248 - DNA, 15 bp, Homo sapiens
ttgaacctggtctgt

SEQ ID NO: 54249 - DNA, 15 bp, Homo sapiens
tgaacctggtctgta

SEQ ID NO: 54250 - DNA, 15 bp, Homo sapiens
gaacctggtctgtat

SEQ ID NO: 54251 - DNA, 15 bp, Homo sapiens
aacctggtctgtatt

SEQ ID NO: 54252 - DNA, 15 bp, Homo sapiens
acctggtctgtattg

SEQ ID NO: 54253 - DNA, 15 bp, Homo sapiens
cctggtctgtattgc

SEQ ID NO: 54254 - DNA, 15 bp, Homo sapiens
ctggtctgtattgct

SEQ ID NO: 54255 - DNA, 15 bp, Homo sapiens
tggtctgtattgctc

SEQ ID NO: 54256 - DNA, 15 bp, Homo sapiens
ggtctgtattgctcc

SEQ ID NO: 54257 - DNA, 15 bp, Homo sapiens
gtctgtattgctccg

SEQ ID NO: 54258 - DNA, 15 bp, Homo sapiens
tctgtattgctccgt

SEQ ID NO: 54259 - DNA, 15 bp, Homo sapiens
ctgtattgctccgtg

SEQ ID NO: 54260 - DNA, 15 bp, Homo sapiens
tgtattgctccgtgc

SEQ ID NO: 54261 - DNA, 15 bp, Homo sapiens
gtattgctccgtgca

SEQ ID NO: 54262 - DNA, 15 bp, Homo sapiens
tattgctccgtgcag

SEQ ID NO: 54263 - DNA, 15 bp, Homo sapiens
attgctccgtgcaga

SEQ ID NO: 54264 - DNA, 15 bp, Homo sapiens
ttgctccgtgcagac

SEQ ID NO: 54265 - DNA, 15 bp, Homo sapiens
tgctccgtgcagacc

SEQ ID NO: 54266 - DNA, 15 bp, Homo sapiens
gctccgtgcagacca

SEQ ID NO: 54267 - DNA, 15 bp, Homo sapiens
ctccgtgcagaccaa

SEQ ID NO: 54268 - DNA, 15 bp, Homo sapiens
tccgtgcagaccaat

SEQ ID NO: 54269 - DNA, 15 bp, Homo sapiens
ccgtgcagaccaatg

SEQ ID NO: 54270 - DNA, 15 bp, Homo sapiens
cgtgcagaccaatgt

SEQ ID NO: 54271 - DNA, 15 bp, Homo sapiens
gtgcagaccaatgtt

SEQ ID NO: 54272 - DNA, 15 bp, Homo sapiens
tgcagaccaatgttc

SEQ ID NO: 54273 - DNA, 15 bp, Homo sapiens
gcagaccaatgttca

SEQ ID NO: 54274 - DNA, 15 bp, Homo sapiens
cagaccaatgttcat

SEQ ID NO: 54275 - DNA, 15 bp, Homo sapiens
agaccaatgttcatt

SEQ ID NO: 54276 - DNA, 15 bp, Homo sapiens
gaccaatgttcattc

SEQ ID NO: 54277 - DNA, 15 bp, Homo sapiens
accaatgttcattca

SEQ ID NO: 54278 - DNA, 15 bp, Homo sapiens
ccaatgttcattcat

SEQ ID NO: 54279 - DNA, 15 bp, Homo sapiens
caatgttcattcatt

SEQ ID NO: 54280 - DNA, 15 bp, Homo sapiens
aatgttcattcattt

SEQ ID NO: 54281 - DNA, 15 bp, Homo sapiens
atgttcattcatttg

SEQ ID NO: 54282 - DNA, 15 bp, Homo sapiens
tgttcattcatttga

SEQ ID NO: 54283 - DNA, 15 bp, Homo sapiens
gttcattcatttgat

SEQ ID NO: 54284 - DNA, 15 bp, Homo sapiens
ttcattcatttgata

SEQ ID NO: 54285 - DNA, 15 bp, Homo sapiens
tcattcatttgatat

SEQ ID NO: 54286 - DNA, 15 bp, Homo sapiens
cattcatttgatatg

SEQ ID NO: 54287 - DNA, 15 bp, Homo sapiens
attcatttgatatgt

SEQ ID NO: 54288 - DNA, 15 bp, Homo sapiens
ttcatttgatatgtc

SEQ ID NO: 54289 - DNA, 15 bp, Homo sapiens
tcatttgatatgtct

SEQ ID NO: 54290 - DNA, 15 bp, Homo sapiens
catttgatatgtctc

SEQ ID NO: 54291 - DNA, 15 bp, Homo sapiens
atttgatatgtctcc

SEQ ID NO: 54292 - DNA, 15 bp, Homo sapiens
tttgatatgtctcct

SEQ ID NO: 54293 - DNA, 15 bp, Homo sapiens
ttgatatgtctcctt

SEQ ID NO: 54294 - DNA, 15 bp, Homo sapiens
tgatatgtctccttg

SEQ ID NO: 54295 - DNA, 15 bp, Homo sapiens
gatatgtctccttgt

SEQ ID NO: 54296 - DNA, 15 bp, Homo sapiens
atatgtctccttgtg

SEQ ID NO: 54297 - DNA, 15 bp, Homo sapiens
tatgtctccttgtgc

SEQ ID NO: 54298 - DNA, 15 bp, Homo sapiens
atgtctccttgtgcc

SEQ ID NO: 54299 - DNA, 15 bp, Homo sapiens
tgtctccttgtgcca

SEQ ID NO: 54300 - DNA, 15 bp, Homo sapiens
gtctccttgtgccat

SEQ ID NO: 54301 - DNA, 15 bp, Homo sapiens
tctccttgtgccata

SEQ ID NO: 54302 - DNA, 15 bp, Homo sapiens
ctccttgtgccatag

SEQ ID NO: 54303 - DNA, 15 bp, Homo sapiens
tccttgtgccataga

SEQ ID NO: 54304 - DNA, 15 bp, Homo sapiens
ccttgtgccatagaa

SEQ ID NO: 54305 - DNA, 15 bp, Homo sapiens
cttgtgccatagaaa

SEQ ID NO: 54306 - DNA, 15 bp, Homo sapiens
ttgtgccatagaaat

SEQ ID NO: 54307 - DNA, 15 bp, Homo sapiens
tgtgccatagaaata

SEQ ID NO: 54308 - DNA, 15 bp, Homo sapiens
gtgccatagaaatag

SEQ ID NO: 54309 - DNA, 15 bp, Homo sapiens
tgccatagaaatagt

SEQ ID NO: 54310 - DNA, 15 bp, Homo sapiens
gccatagaaatagtt

SEQ ID NO: 54311 - DNA, 15 bp, Homo sapiens
ccatagaaatagttt

SEQ ID NO: 54312 - DNA, 15 bp, Homo sapiens
catagaaatagtttt

SEQ ID NO: 54313 - DNA, 15 bp, Homo sapiens
atagaaatagtttta

SEQ ID NO: 54314 - DNA, 15 bp, Homo sapiens
tagaaatagttttac

SEQ ID NO: 54315 - DNA, 15 bp, Homo sapiens
agaaatagttttaca

SEQ ID NO: 54316 - DNA, 15 bp, Homo sapiens
gaaatagttttacaa

SEQ ID NO: 54317 - DNA, 15 bp, Homo sapiens
aaatagttttacaat

SEQ ID NO: 54318 - DNA, 15 bp, Homo sapiens
aatagttttacaata

SEQ ID NO: 54319 - DNA, 15 bp, Homo sapiens
atagttttacaatag

SEQ ID NO: 54320 - DNA, 15 bp, Homo sapiens
tagttttacaataga

SEQ ID NO: 54321 - DNA, 15 bp, Homo sapiens
agttttacaatagaa

SEQ ID NO: 54322 - DNA, 15 bp, Homo sapiens
gttttacaatagaag

SEQ ID NO: 54323 - DNA, 15 bp, Homo sapiens
ttttacaatagaagc

SEQ ID NO: 54324 - DNA, 15 bp, Homo sapiens
tttacaatagaagcc

SEQ ID NO: 54325 - DNA, 15 bp, Homo sapiens
ttacaatagaagcct

SEQ ID NO: 54326 - DNA, 15 bp, Homo sapiens
tacaatagaagcctg

SEQ ID NO: 54327 - DNA, 15 bp, Homo sapiens
acaatagaagcctgt

SEQ ID NO: 54328 - DNA, 15 bp, Homo sapiens
caatagaagcctgtc

SEQ ID NO: 54329 - DNA, 15 bp, Homo sapiens
aatagaagcctgtcc

SEQ ID NO: 54330 - DNA, 15 bp, Homo sapiens
atagaagcctgtcca

SEQ ID NO: 54331 - DNA, 15 bp, Homo sapiens
tagaagcctgtccag

SEQ ID NO: 54332 - DNA, 15 bp, Homo sapiens
agaagcctgtccaga

SEQ ID NO: 54333 - DNA, 15 bp, Homo sapiens
gaagcctgtccagag

SEQ ID NO: 54334 - DNA, 15 bp, Homo sapiens
aagcctgtccagagc

SEQ ID NO: 54335 - DNA, 15 bp, Homo sapiens
agcctgtccagagcc

SEQ ID NO: 54336 - DNA, 15 bp, Homo sapiens
gcctgtccagagcca

SEQ ID NO: 54337 - DNA, 15 bp, Homo sapiens
cctgtccagagccat

SEQ ID NO: 54338 - DNA, 15 bp, Homo sapiens
ctgtccagagccatg

SEQ ID NO: 54339 - DNA, 15 bp, Homo sapiens
tgtccagagccatga

SEQ ID NO: 54340 - DNA, 15 bp, Homo sapiens
gtccagagccatgag

SEQ ID NO: 54341 - DNA, 15 bp, Homo sapiens
tccagagccatgagg

SEQ ID NO: 54342 - DNA, 15 bp, Homo sapiens
ccagagccatgaggg

SEQ ID NO: 54343 - DNA, 15 bp, Homo sapiens
cagagccatgaggga

SEQ ID NO: 54344 - DNA, 15 bp, Homo sapiens
agagccatgagggag

SEQ ID NO: 54345 - DNA, 15 bp, Homo sapiens
gagccatgagggaga

SEQ ID NO: 54346 - DNA, 15 bp, Homo sapiens
agccatgagggagaa

SEQ ID NO: 54347 - DNA, 15 bp, Homo sapiens
gccatgagggagaag

SEQ ID NO: 54348 - DNA, 15 bp, Homo sapiens
ccatgagggagaagg

SEQ ID NO: 54349 - DNA, 15 bp, Homo sapiens
catgagggagaaggg

SEQ ID NO: 54350 - DNA, 15 bp, Homo sapiens
atgagggagaagggg

SEQ ID NO: 54351 - DNA, 15 bp, Homo sapiens
tgagggagaagggga

SEQ ID NO: 54352 - DNA, 15 bp, Homo sapiens
gagggagaaggggat

SEQ ID NO: 54353 - DNA, 15 bp, Homo sapiens
agggagaaggggatt

SEQ ID NO: 54354 - DNA, 15 bp, Homo sapiens
gggagaaggggattg

SEQ ID NO: 54355 - DNA, 15 bp, Homo sapiens
ggagaaggggattgt

SEQ ID NO: 54356 - DNA, 15 bp, Homo sapiens
gagaaggggattgta

SEQ ID NO: 54357 - DNA, 15 bp, Homo sapiens
agaaggggattgtag

SEQ ID NO: 54358 - DNA, 15 bp, Homo sapiens
gaaggggattgtaga

SEQ ID NO: 54359 - DNA, 15 bp, Homo sapiens
aaggggattgtagag

SEQ ID NO: 54360 - DNA, 15 bp, Homo sapiens
aggggattgtagaga

SEQ ID NO: 54361 - DNA, 15 bp, Homo sapiens
ggggattgtagagaa

SEQ ID NO: 54362 - DNA, 15 bp, Homo sapiens
gggattgtagagaaa

SEQ ID NO: 54363 - DNA, 15 bp, Homo sapiens
ggattgtagagaaac

SEQ ID NO: 54364 - DNA, 15 bp, Homo sapiens
gattgtagagaaaca

SEQ ID NO: 54365 - DNA, 15 bp, Homo sapiens
attgtagagaaacaa

SEQ ID NO: 54366 - DNA, 15 bp, Homo sapiens
ttgtagagaaacaag

SEQ ID NO: 54367 - DNA, 15 bp, Homo sapiens
tgtagagaaacaagg

SEQ ID NO: 54368 - DNA, 15 bp, Homo sapiens
gtagagaaacaagga

SEQ ID NO: 54369 - DNA, 15 bp, Homo sapiens
tagagaaacaaggat

SEQ ID NO: 54370 - DNA, 15 bp, Homo sapiens
agagaaacaaggatt

SEQ ID NO: 54371 - DNA, 15 bp, Homo sapiens
gagaaacaaggattg

SEQ ID NO: 54372 - DNA, 15 bp, Homo sapiens
agaaacaaggattgg

SEQ ID NO: 54373 - DNA, 15 bp, Homo sapiens
gaaacaaggattggc

SEQ ID NO: 54374 - DNA, 15 bp, Homo sapiens
aaacaaggattggca

SEQ ID NO: 54375 - DNA, 15 bp, Homo sapiens
aacaaggattggcat

SEQ ID NO: 54376 - DNA, 15 bp, Homo sapiens
acaaggattggcatc

SEQ ID NO: 54377 - DNA, 15 bp, Homo sapiens
caaggattggcatct

SEQ ID NO: 54378 - DNA, 15 bp, Homo sapiens
aaggattggcatctg

SEQ ID NO: 54379 - DNA, 15 bp, Homo sapiens
aggattggcatctgg

SEQ ID NO: 54380 - DNA, 15 bp, Homo sapiens
ggattggcatctggt

SEQ ID NO: 54381 - DNA, 15 bp, Homo sapiens
gattggcatctggtt

SEQ ID NO: 54382 - DNA, 15 bp, Homo sapiens
attggcatctggttt

SEQ ID NO: 54383 - DNA, 15 bp, Homo sapiens
ttggcatctggttta

SEQ ID NO: 54384 - DNA, 15 bp, Homo sapiens
tggcatctggtttat

SEQ ID NO: 54385 - DNA, 15 bp, Homo sapiens
ggcatctggtttatg

SEQ ID NO: 54386 - DNA, 15 bp, Homo sapiens
gcatctggtttatgt

SEQ ID NO: 54387 - DNA, 15 bp, Homo sapiens
catctggtttatgtt

SEQ ID NO: 54388 - DNA, 15 bp, Homo sapiens
atctggtttatgttt

SEQ ID NO: 54389 - DNA, 15 bp, Homo sapiens
tctggtttatgttta

SEQ ID NO: 54390 - DNA, 15 bp, Homo sapiens
ctggtttatgtttac

SEQ ID NO: 54391 - DNA, 15 bp, Homo sapiens
tggtttatgtttaca

SEQ ID NO: 54392 - DNA, 15 bp, Homo sapiens
ggtttatgtttacat

SEQ ID NO: 54393 - DNA, 15 bp, Homo sapiens
gtttatgtttacatc

SEQ ID NO: 54394 - DNA, 15 bp, Homo sapiens
tttatgtttacatcc

SEQ ID NO: 54395 - DNA, 15 bp, Homo sapiens
ttatgtttacatcct

SEQ ID NO: 54396 - DNA, 15 bp, Homo sapiens
tatgtttacatcctt

SEQ ID NO: 54397 - DNA, 15 bp, Homo sapiens
atgtttacatccttt

SEQ ID NO: 54398 - DNA, 15 bp, Homo sapiens
tgtttacatccttta

SEQ ID NO: 54399 - DNA, 15 bp, Homo sapiens
gtttacatcctttag

SEQ ID NO: 54400 - DNA, 15 bp, Homo sapiens
tttacatcctttagt

SEQ ID NO: 54401 - DNA, 15 bp, Homo sapiens
ttacatcctttagtc

SEQ ID NO: 54402 - DNA, 15 bp, Homo sapiens
tacatcctttagtcc

SEQ ID NO: 54403 - DNA, 15 bp, Homo sapiens
acatcctttagtcct

SEQ ID NO: 54404 - DNA, 15 bp, Homo sapiens
catcctttagtcctg

SEQ ID NO: 54405 - DNA, 15 bp, Homo sapiens
atcctttagtcctgt

SEQ ID NO: 54406 - DNA, 15 bp, Homo sapiens
tcctttagtcctgtt

SEQ ID NO: 54407 - DNA, 15 bp, Homo sapiens
cctttagtcctgtta

SEQ ID NO: 54408 - DNA, 15 bp, Homo sapiens
ctttagtcctgttaa

SEQ ID NO: 54409 - DNA, 15 bp, Homo sapiens
tttagtcctgttaac

SEQ ID NO: 54410 - DNA, 15 bp, Homo sapiens
ttagtcctgttaacc

SEQ ID NO: 54411 - DNA, 15 bp, Homo sapiens
tagtcctgttaaccg

SEQ ID NO: 54412 - DNA, 15 bp, Homo sapiens
agtcctgttaaccga

SEQ ID NO: 54413 - DNA, 15 bp, Homo sapiens
gtcctgttaaccgag

SEQ ID NO: 54414 - DNA, 15 bp, Homo sapiens
tcctgttaaccgaga

SEQ ID NO: 54415 - DNA, 15 bp, Homo sapiens
cctgttaaccgagaa

SEQ ID NO: 54416 - DNA, 15 bp, Homo sapiens
ctgttaaccgagaag

SEQ ID NO: 54417 - DNA, 15 bp, Homo sapiens
tgttaaccgagaaga

SEQ ID NO: 54418 - DNA, 15 bp, Homo sapiens
gttaaccgagaagaa

SEQ ID NO: 54419 - DNA, 15 bp, Homo sapiens
ttaaccgagaagaag

SEQ ID NO: 54420 - DNA, 15 bp, Homo sapiens
taaccgagaagaaga

SEQ ID NO: 54421 - DNA, 15 bp, Homo sapiens
aaccgagaagaagat

SEQ ID NO: 54422 - DNA, 15 bp, Homo sapiens
accgagaagaagata

SEQ ID NO: 54423 - DNA, 15 bp, Homo sapiens
ccgagaagaagatat

SEQ ID NO: 54424 - DNA, 15 bp, Homo sapiens
cgagaagaagatatt

SEQ ID NO: 54425 - DNA, 15 bp, Homo sapiens
gagaagaagatattt

SEQ ID NO: 54426 - DNA, 15 bp, Homo sapiens
agaagaagatatttt

SEQ ID NO: 54427 - DNA, 15 bp, Homo sapiens
gaagaagatattttt

SEQ ID NO: 54428 - DNA, 15 bp, Homo sapiens
aagaagatattttta

SEQ ID NO: 54429 - DNA, 15 bp, Homo sapiens
agaagatatttttat

SEQ ID NO: 54430 - DNA, 15 bp, Homo sapiens
gaagatatttttatt

SEQ ID NO: 54431 - DNA, 15 bp, Homo sapiens
aagatatttttattt

SEQ ID NO: 54432 - DNA, 15 bp, Homo sapiens
agatatttttatttc

SEQ ID NO: 54433 - DNA, 15 bp, Homo sapiens
gatatttttatttcc

SEQ ID NO: 54434 - DNA, 15 bp, Homo sapiens
atatttttatttcca

SEQ ID NO: 54435 - DNA, 15 bp, Homo sapiens
tatttttatttccat

SEQ ID NO: 54436 - DNA, 15 bp, Homo sapiens
atttttatttccatg

SEQ ID NO: 54437 - DNA, 15 bp, Homo sapiens
tttttatttccatgt

SEQ ID NO: 54438 - DNA, 15 bp, Homo sapiens
ttttatttccatgtt

SEQ ID NO: 54439 - DNA, 15 bp, Homo sapiens
tttatttccatgttt

SEQ ID NO: 54440 - DNA, 15 bp, Homo sapiens
ttatttccatgtttg

SEQ ID NO: 54441 - DNA, 15 bp, Homo sapiens
tatttccatgtttgc

SEQ ID NO: 54442 - DNA, 15 bp, Homo sapiens
atttccatgtttgcg

SEQ ID NO: 54443 - DNA, 15 bp, Homo sapiens
tttccatgtttgcga

SEQ ID NO: 54444 - DNA, 15 bp, Homo sapiens
ttccatgtttgcgaa

SEQ ID NO: 54445 - DNA, 15 bp, Homo sapiens
tccatgtttgcgaaa

SEQ ID NO: 54446 - DNA, 15 bp, Homo sapiens
ccatgtttgcgaaag

SEQ ID NO: 54447 - DNA, 15 bp, Homo sapiens
catgtttgcgaaagc

SEQ ID NO: 54448 - DNA, 15 bp, Homo sapiens
atgtttgcgaaagct

SEQ ID NO: 54449 - DNA, 15 bp, Homo sapiens
tgtttgcgaaagctt

SEQ ID NO: 54450 - DNA, 15 bp, Homo sapiens
gtttgcgaaagcttt

SEQ ID NO: 54451 - DNA, 15 bp, Homo sapiens
tttgcgaaagctttc

SEQ ID NO: 54452 - DNA, 15 bp, Homo sapiens
ttgcgaaagctttcc

SEQ ID NO: 54453 - DNA, 15 bp, Homo sapiens
tgcgaaagctttcca

SEQ ID NO: 54454 - DNA, 15 bp, Homo sapiens
gcgaaagctttccac

SEQ ID NO: 54455 - DNA, 15 bp, Homo sapiens
cgaaagctttccaca

SEQ ID NO: 54456 - DNA, 15 bp, Homo sapiens
gaaagctttccacaa

SEQ ID NO: 54457 - DNA, 15 bp, Homo sapiens
aaagctttccacaaa

SEQ ID NO: 54458 - DNA, 15 bp, Homo sapiens
aagctttccacaaaa

SEQ ID NO: 54459 - DNA, 15 bp, Homo sapiens
agctttccacaaaaa

SEQ ID NO: 54460 - DNA, 15 bp, Homo sapiens
gctttccacaaaaaa

SEQ ID NO: 54461 - DNA, 15 bp, Homo sapiens
ctttccacaaaaaaa

SEQ ID NO: 54462 - DNA, 15 bp, Homo sapiens
tttccacaaaaaaaa

SEQ ID NO: 54463 - DNA, 15 bp, Homo sapiens
ttccacaaaaaaaag

SEQ ID NO: 54464 - DNA, 15 bp, Homo sapiens
tccacaaaaaaaagc

SEQ ID NO: 54465 - DNA, 15 bp, Homo sapiens
ccacaaaaaaaagca

SEQ ID NO: 54466 - DNA, 15 bp, Homo sapiens
cacaaaaaaaagcat

SEQ ID NO: 54467 - DNA, 15 bp, Homo sapiens
acaaaaaaaagcatc

SEQ ID NO: 54468 - DNA, 15 bp, Homo sapiens
caaaaaaaagcatcc

SEQ ID NO: 54469 - DNA, 15 bp, Homo sapiens
aaaaaaaagcatcca

SEQ ID NO: 54470 - DNA, 15 bp, Homo sapiens
aaaaaaagcatccat

SEQ ID NO: 54471 - DNA, 15 bp, Homo sapiens
aaaaaagcatccatt

SEQ ID NO: 54472 - DNA, 15 bp, Homo sapiens
aaaaagcatccattt

SEQ ID NO: 54473 - DNA, 15 bp, Homo sapiens
aaaagcatccatttt

SEQ ID NO: 54474 - DNA, 15 bp, Homo sapiens
aaagcatccattttc

SEQ ID NO: 54475 - DNA, 15 bp, Homo sapiens
aagcatccattttct

SEQ ID NO: 54476 - DNA, 15 bp, Homo sapiens
agcatccattttcta

SEQ ID NO: 54477 - DNA, 15 bp, Homo sapiens
gcatccattttctag

SEQ ID NO: 54478 - DNA, 15 bp, Homo sapiens
catccattttctaga

SEQ ID NO: 54479 - DNA, 15 bp, Homo sapiens
atccattttctagac

SEQ ID NO: 54480 - DNA, 15 bp, Homo sapiens
tccattttctagact

SEQ ID NO: 54481 - DNA, 15 bp, Homo sapiens
ccattttctagactt

SEQ ID NO: 54482 - DNA, 15 bp, Homo sapiens
cattttctagactta

SEQ ID NO: 54483 - DNA, 15 bp, Homo sapiens
attttctagacttat

SEQ ID NO: 54484 - DNA, 15 bp, Homo sapiens
ttttctagacttatt

SEQ ID NO: 54485 - DNA, 15 bp, Homo sapiens
tttctagacttatta

SEQ ID NO: 54486 - DNA, 15 bp, Homo sapiens
ttctagacttattaa

SEQ ID NO: 54487 - DNA, 15 bp, Homo sapiens
tctagacttattaat

SEQ ID NO: 54488 - DNA, 15 bp, Homo sapiens
ctagacttattaata

SEQ ID NO: 54489 - DNA, 15 bp, Homo sapiens
tagacttattaatag

SEQ ID NO: 54490 - DNA, 15 bp, Homo sapiens
agacttattaatagg

SEQ ID NO: 54491 - DNA, 15 bp, Homo sapiens
gacttattaataggg

SEQ ID NO: 54492 - DNA, 15 bp, Homo sapiens
acttattaatagggc

SEQ ID NO: 54493 - DNA, 15 bp, Homo sapiens
cttattaatagggca

SEQ ID NO: 54494 - DNA, 15 bp, Homo sapiens
ttattaatagggcag

SEQ ID NO: 54495 - DNA, 15 bp, Homo sapiens
tattaatagggcagt

SEQ ID NO: 54496 - DNA, 15 bp, Homo sapiens
attaatagggcagtc

SEQ ID NO: 54497 - DNA, 15 bp, Homo sapiens
ttaatagggcagtcc

SEQ ID NO: 54498 - DNA, 15 bp, Homo sapiens
taatagggcagtcca

SEQ ID NO: 54499 - DNA, 15 bp, Homo sapiens
aatagggcagtccaa

SEQ ID NO: 54500 - DNA, 15 bp, Homo sapiens
atagggcagtccaaa

SEQ ID NO: 54501 - DNA, 15 bp, Homo sapiens
tagggcagtccaaag

SEQ ID NO: 54502 - DNA, 15 bp, Homo sapiens
agggcagtccaaagg

SEQ ID NO: 54503 - DNA, 15 bp, Homo sapiens
gggcagtccaaaggt

SEQ ID NO: 54504 - DNA, 15 bp, Homo sapiens
ggcagtccaaaggtt

SEQ ID NO: 54505 - DNA, 15 bp, Homo sapiens
gcagtccaaaggttt

SEQ ID NO: 54506 - DNA, 15 bp, Homo sapiens
cagtccaaaggtttt

SEQ ID NO: 54507 - DNA, 15 bp, Homo sapiens
agtccaaaggtttta

SEQ ID NO: 54508 - DNA, 15 bp, Homo sapiens
gtccaaaggttttat

SEQ ID NO: 54509 - DNA, 15 bp, Homo sapiens
tccaaaggttttatt

SEQ ID NO: 54510 - DNA, 15 bp, Homo sapiens
ccaaaggttttattt

SEQ ID NO: 54511 - DNA, 15 bp, Homo sapiens
caaaggttttatttt

SEQ ID NO: 54512 - DNA, 15 bp, Homo sapiens
aaaggttttattttt

SEQ ID NO: 54513 - DNA, 15 bp, Homo sapiens
aaggttttattttta

SEQ ID NO: 54514 - DNA, 15 bp, Homo sapiens
aggttttatttttag

SEQ ID NO: 54515 - DNA, 15 bp, Homo sapiens
ggttttatttttaga

SEQ ID NO: 54516 - DNA, 15 bp, Homo sapiens
gttttatttttagat

SEQ ID NO: 54517 - DNA, 15 bp, Homo sapiens
ttttatttttagatt

SEQ ID NO: 54518 - DNA, 15 bp, Homo sapiens
tttatttttagattt

SEQ ID NO: 54519 - DNA, 15 bp, Homo sapiens
ttatttttagatttg

SEQ ID NO: 54520 - DNA, 15 bp, Homo sapiens
tatttttagatttga

SEQ ID NO: 54521 - DNA, 15 bp, Homo sapiens
atttttagatttgaa

SEQ ID NO: 54522 - DNA, 15 bp, Homo sapiens
tttttagatttgaaa

SEQ ID NO: 54523 - DNA, 15 bp, Homo sapiens
ttttagatttgaaag

SEQ ID NO: 54524 - DNA, 15 bp, Homo sapiens
tttagatttgaaaga

SEQ ID NO: 54525 - DNA, 15 bp, Homo sapiens
ttagatttgaaagaa

SEQ ID NO: 54526 - DNA, 15 bp, Homo sapiens
tagatttgaaagaaa

SEQ ID NO: 54527 - DNA, 15 bp, Homo sapiens
agatttgaaagaaag

SEQ ID NO: 54528 - DNA, 15 bp, Homo sapiens
gatttgaaagaaagc

SEQ ID NO: 54529 - DNA, 15 bp, Homo sapiens
atttgaaagaaagca

SEQ ID NO: 54530 - DNA, 15 bp, Homo sapiens
tttgaaagaaagcaa

SEQ ID NO: 54531 - DNA, 15 bp, Homo sapiens
ttgaaagaaagcaaa

SEQ ID NO: 54532 - DNA, 15 bp, Homo sapiens
tgaaagaaagcaaag

SEQ ID NO: 54533 - DNA, 15 bp, Homo sapiens
gaaagaaagcaaagt

SEQ ID NO: 54534 - DNA, 15 bp, Homo sapiens
aaagaaagcaaagta

SEQ ID NO: 54535 - DNA, 15 bp, Homo sapiens
aagaaagcaaagtag

SEQ ID NO: 54536 - DNA, 15 bp, Homo sapiens
agaaagcaaagtagg

SEQ ID NO: 54537 - DNA, 15 bp, Homo sapiens
gaaagcaaagtaggc

SEQ ID NO: 54538 - DNA, 15 bp, Homo sapiens
aaagcaaagtaggct

SEQ ID NO: 54539 - DNA, 15 bp, Homo sapiens
aagcaaagtaggctt

SEQ ID NO: 54540 - DNA, 15 bp, Homo sapiens
agcaaagtaggcttc

SEQ ID NO: 54541 - DNA, 15 bp, Homo sapiens
gcaaagtaggcttct

SEQ ID NO: 54542 - DNA, 15 bp, Homo sapiens
caaagtaggcttctg

SEQ ID NO: 54543 - DNA, 15 bp, Homo sapiens
aaagtaggcttctga

SEQ ID NO: 54544 - DNA, 15 bp, Homo sapiens
aagtaggcttctgag

SEQ ID NO: 54545 - DNA, 15 bp, Homo sapiens
agtaggcttctgaga

SEQ ID NO: 54546 - DNA, 15 bp, Homo sapiens
gtaggcttctgagat

SEQ ID NO: 54547 - DNA, 15 bp, Homo sapiens
taggcttctgagata

SEQ ID NO: 54548 - DNA, 15 bp, Homo sapiens
aggcttctgagatat

SEQ ID NO: 54549 - DNA, 15 bp, Homo sapiens
ggcttctgagatatg

SEQ ID NO: 54550 - DNA, 15 bp, Homo sapiens
gcttctgagatatgc

SEQ ID NO: 54551 - DNA, 15 bp, Homo sapiens
cttctgagatatgca

SEQ ID NO: 54552 - DNA, 15 bp, Homo sapiens
ttctgagatatgcac

SEQ ID NO: 54553 - DNA, 15 bp, Homo sapiens
tctgagatatgcaca

SEQ ID NO: 54554 - DNA, 15 bp, Homo sapiens
ctgagatatgcacat

SEQ ID NO: 54555 - DNA, 15 bp, Homo sapiens
tgagatatgcacatt

SEQ ID NO: 54556 - DNA, 15 bp, Homo sapiens
gagatatgcacattt

SEQ ID NO: 54557 - DNA, 15 bp, Homo sapiens
agatatgcacatttc

SEQ ID NO: 54558 - DNA, 15 bp, Homo sapiens
gatatgcacatttcc

SEQ ID NO: 54559 - DNA, 15 bp, Homo sapiens
atatgcacatttccc

SEQ ID NO: 54560 - DNA, 15 bp, Homo sapiens
tatgcacatttccct

SEQ ID NO: 54561 - DNA, 15 bp, Homo sapiens
atgcacatttccctg

SEQ ID NO: 54562 - DNA, 15 bp, Homo sapiens
tgcacatttccctgt

SEQ ID NO: 54563 - DNA, 15 bp, Homo sapiens
gcacatttccctgtg

SEQ ID NO: 54564 - DNA, 15 bp, Homo sapiens
cacatttccctgtgt

SEQ ID NO: 54565 - DNA, 15 bp, Homo sapiens
acatttccctgtgtc

SEQ ID NO: 54566 - DNA, 15 bp, Homo sapiens
catttccctgtgtcc

SEQ ID NO: 54567 - DNA, 15 bp, Homo sapiens
atttccctgtgtccc

SEQ ID NO: 54568 - DNA, 15 bp, Homo sapiens
tttccctgtgtccct

SEQ ID NO: 54569 - DNA, 15 bp, Homo sapiens
ttccctgtgtccctg

SEQ ID NO: 54570 - DNA, 15 bp, Homo sapiens
tccctgtgtccctgt

SEQ ID NO: 54571 - DNA, 15 bp, Homo sapiens
ccctgtgtccctgtc

SEQ ID NO: 54572 - DNA, 15 bp, Homo sapiens
cctgtgtccctgtct

SEQ ID NO: 54573 - DNA, 15 bp, Homo sapiens
ctgtgtccctgtctc

SEQ ID NO: 54574 - DNA, 15 bp, Homo sapiens
tgtgtccctgtctct

SEQ ID NO: 54575 - DNA, 15 bp, Homo sapiens
gtgtccctgtctctt

SEQ ID NO: 54576 - DNA, 15 bp, Homo sapiens
tgtccctgtctcttt

SEQ ID NO: 54577 - DNA, 15 bp, Homo sapiens
gtccctgtctctttt

SEQ ID NO: 54578 - DNA, 15 bp, Homo sapiens
tccctgtctcttttg

SEQ ID NO: 54579 - DNA, 15 bp, Homo sapiens
ccctgtctcttttgc

SEQ ID NO: 54580 - DNA, 15 bp, Homo sapiens
cctgtctcttttgca

SEQ ID NO: 54581 - DNA, 15 bp, Homo sapiens
ctgtctcttttgcaa

SEQ ID NO: 54582 - DNA, 15 bp, Homo sapiens
tgtctcttttgcaac

SEQ ID NO: 54583 - DNA, 15 bp, Homo sapiens
gtctcttttgcaaca

SEQ ID NO: 54584 - DNA, 15 bp, Homo sapiens
tctcttttgcaacat

SEQ ID NO: 54585 - DNA, 15 bp, Homo sapiens
ctcttttgcaacatt

SEQ ID NO: 54586 - DNA, 15 bp, Homo sapiens
tcttttgcaacattc

SEQ ID NO: 54587 - DNA, 15 bp, Homo sapiens
cttttgcaacattcc

SEQ ID NO: 54588 - DNA, 15 bp, Homo sapiens
ttttgcaacattcca

SEQ ID NO: 54589 - DNA, 15 bp, Homo sapiens
tttgcaacattccac

SEQ ID NO: 54590 - DNA, 15 bp, Homo sapiens
ttgcaacattccaca

SEQ ID NO: 54591 - DNA, 15 bp, Homo sapiens
tgcaacattccacat

SEQ ID NO: 54592 - DNA, 15 bp, Homo sapiens
gcaacattccacatt

SEQ ID NO: 54593 - DNA, 15 bp, Homo sapiens
caacattccacattg

SEQ ID NO: 54594 - DNA, 15 bp, Homo sapiens
aacattccacattgc

SEQ ID NO: 54595 - DNA, 15 bp, Homo sapiens
acattccacattgct

SEQ ID NO: 54596 - DNA, 15 bp, Homo sapiens
cattccacattgctg

SEQ ID NO: 54597 - DNA, 15 bp, Homo sapiens
attccacattgctgc

SEQ ID NO: 54598 - DNA, 15 bp, Homo sapiens
ttccacattgctgct

SEQ ID NO: 54599 - DNA, 15 bp, Homo sapiens
tccacattgctgcta

SEQ ID NO: 54600 - DNA, 15 bp, Homo sapiens
ccacattgctgctaa

SEQ ID NO: 54601 - DNA, 15 bp, Homo sapiens
cacattgctgctaaa

SEQ ID NO: 54602 - DNA, 15 bp, Homo sapiens
acattgctgctaaaa

SEQ ID NO: 54603 - DNA, 15 bp, Homo sapiens
cattgctgctaaaac

SEQ ID NO: 54604 - DNA, 15 bp, Homo sapiens
attgctgctaaaact

SEQ ID NO: 54605 - DNA, 15 bp, Homo sapiens
ttgctgctaaaactt

SEQ ID NO: 54606 - DNA, 15 bp, Homo sapiens
tgctgctaaaacttg

SEQ ID NO: 54607 - DNA, 15 bp, Homo sapiens
gctgctaaaacttga

SEQ ID NO: 54608 - DNA, 15 bp, Homo sapiens
ctgctaaaacttgaa

SEQ ID NO: 54609 - DNA, 15 bp, Homo sapiens
tgctaaaacttgaac

SEQ ID NO: 54610 - DNA, 15 bp, Homo sapiens
gctaaaacttgaaca

SEQ ID NO: 54611 - DNA, 15 bp, Homo sapiens
ctaaaacttgaacat

SEQ ID NO: 54612 - DNA, 15 bp, Homo sapiens
taaaacttgaacatg

SEQ ID NO: 54613 - DNA, 15 bp, Homo sapiens
aaaacttgaacatga

SEQ ID NO: 54614 - DNA, 15 bp, Homo sapiens
aaacttgaacatgag

SEQ ID NO: 54615 - DNA, 15 bp, Homo sapiens
aacttgaacatgagc

SEQ ID NO: 54616 - DNA, 15 bp, Homo sapiens
acttgaacatgagca

SEQ ID NO: 54617 - DNA, 15 bp, Homo sapiens
cttgaacatgagcac

SEQ ID NO: 54618 - DNA, 15 bp, Homo sapiens
ttgaacatgagcact

SEQ ID NO: 54619 - DNA, 15 bp, Homo sapiens
tgaacatgagcactt

SEQ ID NO: 54620 - DNA, 15 bp, Homo sapiens
gaacatgagcacttt

SEQ ID NO: 54621 - DNA, 15 bp, Homo sapiens
aacatgagcactttc

SEQ ID NO: 54622 - DNA, 15 bp, Homo sapiens
acatgagcactttca

SEQ ID NO: 54623 - DNA, 15 bp, Homo sapiens
catgagcactttcaa

SEQ ID NO: 54624 - DNA, 15 bp, Homo sapiens
atgagcactttcaag

SEQ ID NO: 54625 - DNA, 15 bp, Homo sapiens
tgagcactttcaagc

SEQ ID NO: 54626 - DNA, 15 bp, Homo sapiens
gagcactttcaagca

SEQ ID NO: 54627 - DNA, 15 bp, Homo sapiens
agcactttcaagcat

SEQ ID NO: 54628 - DNA, 15 bp, Homo sapiens
gcactttcaagcatg

SEQ ID NO: 54629 - DNA, 15 bp, Homo sapiens
cactttcaagcatgt

SEQ ID NO: 54630 - DNA, 15 bp, Homo sapiens
actttcaagcatgtg

SEQ ID NO: 54631 - DNA, 15 bp, Homo sapiens
ctttcaagcatgtgc

SEQ ID NO: 54632 - DNA, 15 bp, Homo sapiens
tttcaagcatgtgct

SEQ ID NO: 54633 - DNA, 15 bp, Homo sapiens
ttcaagcatgtgctt

SEQ ID NO: 54634 - DNA, 15 bp, Homo sapiens
tcaagcatgtgctta

SEQ ID NO: 54635 - DNA, 15 bp, Homo sapiens
caagcatgtgcttac

SEQ ID NO: 54636 - DNA, 15 bp, Homo sapiens
aagcatgtgcttact

SEQ ID NO: 54637 - DNA, 15 bp, Homo sapiens
agcatgtgcttactt

SEQ ID NO: 54638 - DNA, 15 bp, Homo sapiens
gcatgtgcttacttt

SEQ ID NO: 54639 - DNA, 15 bp, Homo sapiens
catgtgcttactttc

SEQ ID NO: 54640 - DNA, 15 bp, Homo sapiens
atgtgcttactttct

SEQ ID NO: 54641 - DNA, 15 bp, Homo sapiens
tgtgcttactttcta

SEQ ID NO: 54642 - DNA, 15 bp, Homo sapiens
gtgcttactttctat

SEQ ID NO: 54643 - DNA, 15 bp, Homo sapiens
tgcttactttctatg

SEQ ID NO: 54644 - DNA, 15 bp, Homo sapiens
gcttactttctatgt

SEQ ID NO: 54645 - DNA, 15 bp, Homo sapiens
cttactttctatgta

SEQ ID NO: 54646 - DNA, 15 bp, Homo sapiens
ttactttctatgtat

SEQ ID NO: 54647 - DNA, 15 bp, Homo sapiens
tactttctatgtatg

SEQ ID NO: 54648 - DNA, 15 bp, Homo sapiens
actttctatgtatga

SEQ ID NO: 54649 - DNA, 15 bp, Homo sapiens
ctttctatgtatgac

SEQ ID NO: 54650 - DNA, 15 bp, Homo sapiens
tttctatgtatgact

SEQ ID NO: 54651 - DNA, 15 bp, Homo sapiens
ttctatgtatgactc

SEQ ID NO: 54652 - DNA, 15 bp, Homo sapiens
tctatgtatgactca

SEQ ID NO: 54653 - DNA, 15 bp, Homo sapiens
ctatgtatgactcat

SEQ ID NO: 54654 - DNA, 15 bp, Homo sapiens
tatgtatgactcatt

SEQ ID NO: 54655 - DNA, 15 bp, Homo sapiens
atgtatgactcattt

SEQ ID NO: 54656 - DNA, 15 bp, Homo sapiens
tgtatgactcatttt

SEQ ID NO: 54657 - DNA, 15 bp, Homo sapiens
gtatgactcattttt

SEQ ID NO: 54658 - DNA, 15 bp, Homo sapiens
tatgactcatttttt

SEQ ID NO: 54659 - DNA, 15 bp, Homo sapiens
atgactcatttttta

SEQ ID NO: 54660 - DNA, 15 bp, Homo sapiens
tgactcattttttaa

SEQ ID NO: 54661 - DNA, 15 bp, Homo sapiens
gactcattttttaaa

SEQ ID NO: 54662 - DNA, 15 bp, Homo sapiens
actcattttttaaaa

SEQ ID NO: 54663 - DNA, 15 bp, Homo sapiens
ctcattttttaaaac

SEQ ID NO: 54664 - DNA, 15 bp, Homo sapiens
tcattttttaaaaca

SEQ ID NO: 54665 - DNA, 15 bp, Homo sapiens
cattttttaaaacat

SEQ ID NO: 54666 - DNA, 15 bp, Homo sapiens
attttttaaaacatt

SEQ ID NO: 54667 - DNA, 15 bp, Homo sapiens
ttttttaaaacatta

SEQ ID NO: 54668 - DNA, 15 bp, Homo sapiens
tttttaaaacattaa

SEQ ID NO: 54669 - DNA, 15 bp, Homo sapiens
ttttaaaacattaaa

SEQ ID NO: 54670 - DNA, 15 bp, Homo sapiens
tttaaaacattaaag

SEQ ID NO: 54671 - DNA, 15 bp, Homo sapiens
ttaaaacattaaagc

SEQ ID NO: 54672 - DNA, 15 bp, Homo sapiens
taaaacattaaagca

SEQ ID NO: 54673 - DNA, 15 bp, Homo sapiens
aaaacattaaagcat

SEQ ID NO: 54674 - DNA, 15 bp, Homo sapiens
aaacattaaagcatt

SEQ ID NO: 54675 - DNA, 15 bp, Homo sapiens
aacattaaagcattt

SEQ ID NO: 54676 - DNA, 15 bp, Homo sapiens
acattaaagcatttt

SEQ ID NO: 54677 - DNA, 15 bp, Homo sapiens
cattaaagcattttc

SEQ ID NO: 54678 - DNA, 15 bp, Homo sapiens
attaaagcattttcg

SEQ ID NO: 54679 - DNA, 15 bp, Homo sapiens
ttaaagcattttcgg

SEQ ID NO: 54680 - DNA, 15 bp, Homo sapiens
taaagcattttcggc

SEQ ID NO: 54681 - DNA, 15 bp, Homo sapiens
aaagcattttcggcc

SEQ ID NO: 54682 - DNA, 15 bp, Homo sapiens
aagcattttcggccg

SEQ ID NO: 54683 - DNA, 15 bp, Homo sapiens
agcattttcggccgg

SEQ ID NO: 54684 - DNA, 15 bp, Homo sapiens
gcattttcggccggg

SEQ ID NO: 54685 - DNA, 15 bp, Homo sapiens
cattttcggccgggt

SEQ ID NO: 54686 - DNA, 15 bp, Homo sapiens
attttcggccgggtg

SEQ ID NO: 54687 - DNA, 15 bp, Homo sapiens
ttttcggccgggtgt

SEQ ID NO: 54688 - DNA, 15 bp, Homo sapiens
tttcggccgggtgtg

SEQ ID NO: 54689 - DNA, 15 bp, Homo sapiens
ttcggccgggtgtgg

SEQ ID NO: 54690 - DNA, 15 bp, Homo sapiens
tcggccgggtgtggt

SEQ ID NO: 54691 - DNA, 15 bp, Homo sapiens
cggccgggtgtggtg

SEQ ID NO: 54692 - DNA, 15 bp, Homo sapiens
ggccgggtgtggtgg

SEQ ID NO: 54693 - DNA, 15 bp, Homo sapiens
gccgggtgtggtggc

SEQ ID NO: 54694 - DNA, 15 bp, Homo sapiens
ccgggtgtggtggct

SEQ ID NO: 54695 - DNA, 15 bp, Homo sapiens
cgggtgtggtggctc

SEQ ID NO: 54696 - DNA, 15 bp, Homo sapiens
gggtgtggtggctca

SEQ ID NO: 54697 - DNA, 15 bp, Homo sapiens
ggtgtggtggctcac

SEQ ID NO: 54698 - DNA, 15 bp, Homo sapiens
gtgtggtggctcacg

SEQ ID NO: 54699 - DNA, 15 bp, Homo sapiens
tgtggtggctcacgc

SEQ ID NO: 54700 - DNA, 15 bp, Homo sapiens
ggtggctcacgccta

SEQ ID NO: 54701 - DNA, 15 bp, Homo sapiens
gtggctcacgcctat

SEQ ID NO: 54702 - DNA, 15 bp, Homo sapiens
tggctcacgcctata

SEQ ID NO: 54703 - DNA, 15 bp, Homo sapiens
ggctcacgcctatat

SEQ ID NO: 54704 - DNA, 15 bp, Homo sapiens
gctcacgcctatatt

SEQ ID NO: 54705 - DNA, 15 bp, Homo sapiens
ctcacgcctatattc

SEQ ID NO: 54706 - DNA, 15 bp, Homo sapiens
tcacgcctatattcc

SEQ ID NO: 54707 - DNA, 15 bp, Homo sapiens
cacgcctatattcct

SEQ ID NO: 54708 - DNA, 15 bp, Homo sapiens
acgcctatattccta

SEQ ID NO: 54709 - DNA, 15 bp, Homo sapiens
cgcctatattcctag

SEQ ID NO: 54710 - DNA, 15 bp, Homo sapiens
gcctatattcctagc

SEQ ID NO: 54711 - DNA, 15 bp, Homo sapiens
cctatattcctagca

SEQ ID NO: 54712 - DNA, 15 bp, Homo sapiens
ctatattcctagcac

SEQ ID NO: 54713 - DNA, 15 bp, Homo sapiens
tatattcctagcact

SEQ ID NO: 54714 - DNA, 15 bp, Homo sapiens
atattcctagcactt

SEQ ID NO: 54715 - DNA, 15 bp, Homo sapiens
tattcctagcacttt

SEQ ID NO: 54716 - DNA, 15 bp, Homo sapiens
attcctagcacttta

SEQ ID NO: 54717 - DNA, 15 bp, Homo sapiens
ttcctagcactttag

SEQ ID NO: 54718 - DNA, 15 bp, Homo sapiens
tcctagcactttaga

SEQ ID NO: 54719 - DNA, 15 bp, Homo sapiens
cctagcactttagaa

SEQ ID NO: 54720 - DNA, 15 bp, Homo sapiens
ctagcactttagaag

SEQ ID NO: 54721 - DNA, 15 bp, Homo sapiens
tagcactttagaagg

SEQ ID NO: 54722 - DNA, 15 bp, Homo sapiens
agcactttagaaggc

SEQ ID NO: 54723 - DNA, 15 bp, Homo sapiens
gcactttagaaggcc

SEQ ID NO: 54724 - DNA, 15 bp, Homo sapiens
cactttagaaggccg

SEQ ID NO: 54725 - DNA, 15 bp, Homo sapiens
actttagaaggccga

SEQ ID NO: 54726 - DNA, 15 bp, Homo sapiens
ctttagaaggccgag

SEQ ID NO: 54727 - DNA, 15 bp, Homo sapiens
tttagaaggccgagg

SEQ ID NO: 54728 - DNA, 15 bp, Homo sapiens
ttagaaggccgaggc

SEQ ID NO: 54729 - DNA, 15 bp, Homo sapiens
tagaaggccgaggcg

SEQ ID NO: 54730 - DNA, 15 bp, Homo sapiens
agaaggccgaggcgg

SEQ ID NO: 54731 - DNA, 15 bp, Homo sapiens
gaaggccgaggcggg

SEQ ID NO: 54732 - DNA, 15 bp, Homo sapiens
aaggccgaggcgggt

SEQ ID NO: 54733 - DNA, 15 bp, Homo sapiens
aggccgaggcgggta

SEQ ID NO: 54734 - DNA, 15 bp, Homo sapiens
ggccgaggcgggtag

SEQ ID NO: 54735 - DNA, 15 bp, Homo sapiens
gccgaggcgggtaga

SEQ ID NO: 54736 - DNA, 15 bp, Homo sapiens
ccgaggcgggtagat

SEQ ID NO: 54737 - DNA, 15 bp, Homo sapiens
cgaggcgggtagatc

SEQ ID NO: 54738 - DNA, 15 bp, Homo sapiens
gaggcgggtagatca

SEQ ID NO: 54739 - DNA, 15 bp, Homo sapiens
aggcgggtagatcac

SEQ ID NO: 54740 - DNA, 15 bp, Homo sapiens
ggcgggtagatcact

SEQ ID NO: 54741 - DNA, 15 bp, Homo sapiens
gcgggtagatcactt

SEQ ID NO: 54742 - DNA, 15 bp, Homo sapiens
cgggtagatcacttg

SEQ ID NO: 54743 - DNA, 15 bp, Homo sapiens
gggtagatcacttga

SEQ ID NO: 54744 - DNA, 15 bp, Homo sapiens
ggtagatcacttgag

SEQ ID NO: 54745 - DNA, 15 bp, Homo sapiens
gtagatcacttgagg

SEQ ID NO: 54746 - DNA, 15 bp, Homo sapiens
tagatcacttgaggt

SEQ ID NO: 54747 - DNA, 15 bp, Homo sapiens
agatcacttgaggtc

SEQ ID NO: 54748 - DNA, 15 bp, Homo sapiens
acttgaggtcaggag

SEQ ID NO: 54749 - DNA, 15 bp, Homo sapiens
cttgaggtcaggagt

SEQ ID NO: 54750 - DNA, 15 bp, Homo sapiens
ttgaggtcaggagtt

SEQ ID NO: 54751 - DNA, 15 bp, Homo sapiens
caggagttcaagacc

SEQ ID NO: 54752 - DNA, 15 bp, Homo sapiens
aggagttcaagacca

SEQ ID NO: 54753 - DNA, 15 bp, Homo sapiens
ggagttcaagaccag

SEQ ID NO: 54754 - DNA, 15 bp, Homo sapiens
ttcaagaccagccta

SEQ ID NO: 54755 - DNA, 15 bp, Homo sapiens
tcaagaccagcctag

SEQ ID NO: 54756 - DNA, 15 bp, Homo sapiens
caagaccagcctagc

SEQ ID NO: 54757 - DNA, 15 bp, Homo sapiens
aagaccagcctagcc

SEQ ID NO: 54758 - DNA, 15 bp, Homo sapiens
accagcctagccaat

SEQ ID NO: 54759 - DNA, 15 bp, Homo sapiens
ccagcctagccaata

SEQ ID NO: 54760 - DNA, 15 bp, Homo sapiens
cagcctagccaatat

SEQ ID NO: 54761 - DNA, 15 bp, Homo sapiens
agcctagccaatata

SEQ ID NO: 54762 - DNA, 15 bp, Homo sapiens
gcctagccaatatag

SEQ ID NO: 54763 - DNA, 15 bp, Homo sapiens
cctagccaatatagt

SEQ ID NO: 54764 - DNA, 15 bp, Homo sapiens
ctagccaatatagtg

SEQ ID NO: 54765 - DNA, 15 bp, Homo sapiens
tagccaatatagtga

SEQ ID NO: 54766 - DNA, 15 bp, Homo sapiens
agccaatatagtgaa

SEQ ID NO: 54767 - DNA, 15 bp, Homo sapiens
gccaatatagtgaaa

SEQ ID NO: 54768 - DNA, 15 bp, Homo sapiens
ccaatatagtgaaac

SEQ ID NO: 54769 - DNA, 15 bp, Homo sapiens
caatatagtgaaacc

SEQ ID NO: 54770 - DNA, 15 bp, Homo sapiens
aatatagtgaaaccc

SEQ ID NO: 54771 - DNA, 15 bp, Homo sapiens
atatagtgaaacccc

SEQ ID NO: 54772 - DNA, 15 bp, Homo sapiens
tatagtgaaacccca

SEQ ID NO: 54773 - DNA, 15 bp, Homo sapiens
atagtgaaaccccat

SEQ ID NO: 54774 - DNA, 15 bp, Homo sapiens
tagtgaaaccccatc

SEQ ID NO: 54775 - DNA, 15 bp, Homo sapiens
agtgaaaccccatct

SEQ ID NO: 54776 - DNA, 15 bp, Homo sapiens
gtgaaaccccatctc

SEQ ID NO: 54777 - DNA, 15 bp, Homo sapiens
tgaaaccccatctcc

SEQ ID NO: 54778 - DNA, 15 bp, Homo sapiens
gaaaccccatctcca

SEQ ID NO: 54779 - DNA, 15 bp, Homo sapiens
aaaccccatctccac

SEQ ID NO: 54780 - DNA, 15 bp, Homo sapiens
aaccccatctccact

SEQ ID NO: 54781 - DNA, 15 bp, Homo sapiens
accccatctccacta

SEQ ID NO: 54782 - DNA, 15 bp, Homo sapiens
ccccatctccactaa

SEQ ID NO: 54783 - DNA, 15 bp, Homo sapiens
cccatctccactaaa

SEQ ID NO: 54784 - DNA, 15 bp, Homo sapiens
ccatctccactaaaa

SEQ ID NO: 54785 - DNA, 15 bp, Homo sapiens
catctccactaaaaa

SEQ ID NO: 54786 - DNA, 15 bp, Homo sapiens
atctccactaaaaat

SEQ ID NO: 54787 - DNA, 15 bp, Homo sapiens
tacaaaaattagccg

SEQ ID NO: 54788 - DNA, 15 bp, Homo sapiens
acaaaaattagccgg

SEQ ID NO: 54789 - DNA, 15 bp, Homo sapiens
caaaaattagccggg

SEQ ID NO: 54790 - DNA, 15 bp, Homo sapiens
ggcgggcgcctgtaa

SEQ ID NO: 54791 - DNA, 15 bp, Homo sapiens
gcgggcgcctgtaat

SEQ ID NO: 54792 - DNA, 15 bp, Homo sapiens
cgggcgcctgtaatc

SEQ ID NO: 54793 - DNA, 15 bp, Homo sapiens
gggcgcctgtaatcc

SEQ ID NO: 54794 - DNA, 15 bp, Homo sapiens
cctgtaatcccagct

SEQ ID NO: 54795 - DNA, 15 bp, Homo sapiens
ctgtaatcccagcta

SEQ ID NO: 54796 - DNA, 15 bp, Homo sapiens
tgtaatcccagctac

SEQ ID NO: 54797 - DNA, 15 bp, Homo sapiens
gtaatcccagctact

SEQ ID NO: 54798 - DNA, 15 bp, Homo sapiens
taatcccagctactc

SEQ ID NO: 54799 - DNA, 15 bp, Homo sapiens
aatcccagctactcg

SEQ ID NO: 54800 - DNA, 15 bp, Homo sapiens
atcccagctactcgg

SEQ ID NO: 54801 - DNA, 15 bp, Homo sapiens
tgaggcaggagaatt

SEQ ID NO: 54802 - DNA, 15 bp, Homo sapiens
gaggcaggagaattg

SEQ ID NO: 54803 - DNA, 15 bp, Homo sapiens
aggcaggagaattgc

SEQ ID NO: 54804 - DNA, 15 bp, Homo sapiens
ggcaggagaattgct

SEQ ID NO: 54805 - DNA, 15 bp, Homo sapiens
gcaggagaattgctt

SEQ ID NO: 54806 - DNA, 15 bp, Homo sapiens
caggagaattgcttg

SEQ ID NO: 54807 - DNA, 15 bp, Homo sapiens
aggagaattgcttga

SEQ ID NO: 54808 - DNA, 15 bp, Homo sapiens
ggagaattgcttgaa

SEQ ID NO: 54809 - DNA, 15 bp, Homo sapiens
gagaattgcttgaac

SEQ ID NO: 54810 - DNA, 15 bp, Homo sapiens
agaattgcttgaacc

SEQ ID NO: 54811 - DNA, 15 bp, Homo sapiens
aattgcttgaaccca

SEQ ID NO: 54812 - DNA, 15 bp, Homo sapiens
attgcttgaacccag

SEQ ID NO: 54813 - DNA, 15 bp, Homo sapiens
ttgcttgaacccagg

SEQ ID NO: 54814 - DNA, 15 bp, Homo sapiens
tgcttgaacccagga

SEQ ID NO: 54815 - DNA, 15 bp, Homo sapiens
ggaggtggaggttgc

SEQ ID NO: 54816 - DNA, 15 bp, Homo sapiens
gaggtggaggttgca

SEQ ID NO: 54817 - DNA, 15 bp, Homo sapiens
aggtggaggttgcag

SEQ ID NO: 54818 - DNA, 15 bp, Homo sapiens
ggtggaggttgcagt

SEQ ID NO: 54819 - DNA, 15 bp, Homo sapiens
gtggaggttgcagtg

SEQ ID NO: 54820 - DNA, 15 bp, Homo sapiens
tggaggttgcagtga

SEQ ID NO: 54821 - DNA, 15 bp, Homo sapiens
aggttgcagtgagca

SEQ ID NO: 54822 - DNA, 15 bp, Homo sapiens
ggttgcagtgagcag

SEQ ID NO: 54823 - DNA, 15 bp, Homo sapiens
gttgcagtgagcaga

SEQ ID NO: 54824 - DNA, 15 bp, Homo sapiens
ttgcagtgagcagag

SEQ ID NO: 54825 - DNA, 15 bp, Homo sapiens
tgcagtgagcagaga

SEQ ID NO: 54826 - DNA, 15 bp, Homo sapiens
gcagtgagcagagat

SEQ ID NO: 54827 - DNA, 15 bp, Homo sapiens
cagtgagcagagatc

SEQ ID NO: 54828 - DNA, 15 bp, Homo sapiens
agtgagcagagatcg

SEQ ID NO: 54829 - DNA, 15 bp, Homo sapiens
gtgagcagagatcga

SEQ ID NO: 54830 - DNA, 15 bp, Homo sapiens
tgagcagagatcgag

SEQ ID NO: 54831 - DNA, 15 bp, Homo sapiens
gagcagagatcgagc

SEQ ID NO: 54832 - DNA, 15 bp, Homo sapiens
agcagagatcgagcc

SEQ ID NO: 54833 - DNA, 15 bp, Homo sapiens
gcagagatcgagcca

SEQ ID NO: 54834 - DNA, 15 bp, Homo sapiens
cagagatcgagccac

SEQ ID NO: 54835 - DNA, 15 bp, Homo sapiens
agagatcgagccact

SEQ ID NO: 54836 - DNA, 15 bp, Homo sapiens
gagatcgagccactg

SEQ ID NO: 54837 - DNA, 15 bp, Homo sapiens
agatcgagccactgc

SEQ ID NO: 54838 - DNA, 15 bp, Homo sapiens
gatcgagccactgca

SEQ ID NO: 54839 - DNA, 15 bp, Homo sapiens
atcgagccactgcac

SEQ ID NO: 54840 - DNA, 15 bp, Homo sapiens
tcgagccactgcact

SEQ ID NO: 54841 - DNA, 15 bp, Homo sapiens
cgagccactgcactc

SEQ ID NO: 54842 - DNA, 15 bp, Homo sapiens
gagccactgcactct

SEQ ID NO: 54843 - DNA, 15 bp, Homo sapiens
agccactgcactcta

SEQ ID NO: 54844 - DNA, 15 bp, Homo sapiens
gccactgcactctag

SEQ ID NO: 54845 - DNA, 15 bp, Homo sapiens
ccactgcactctagc

SEQ ID NO: 54846 - DNA, 15 bp, Homo sapiens
cactgcactctagcc

SEQ ID NO: 54847 - DNA, 15 bp, Homo sapiens
actgcactctagcct

SEQ ID NO: 54848 - DNA, 15 bp, Homo sapiens
ctgcactctagccta

SEQ ID NO: 54849 - DNA, 15 bp, Homo sapiens
tgcactctagcctag

SEQ ID NO: 54850 - DNA, 15 bp, Homo sapiens
gcactctagcctagg

SEQ ID NO: 54851 - DNA, 15 bp, Homo sapiens
cactctagcctaggt

SEQ ID NO: 54852 - DNA, 15 bp, Homo sapiens
actctagcctaggtg

SEQ ID NO: 54853 - DNA, 15 bp, Homo sapiens
ctctagcctaggtga

SEQ ID NO: 54854 - DNA, 15 bp, Homo sapiens
tctagcctaggtgac

SEQ ID NO: 54855 - DNA, 15 bp, Homo sapiens
ctagcctaggtgaca

SEQ ID NO: 54856 - DNA, 15 bp, Homo sapiens
tagcctaggtgacag

SEQ ID NO: 54857 - DNA, 15 bp, Homo sapiens
agcctaggtgacaga

SEQ ID NO: 54858 - DNA, 15 bp, Homo sapiens
gcctaggtgacagag

SEQ ID NO: 54859 - DNA, 15 bp, Homo sapiens
cctaggtgacagagc

SEQ ID NO: 54860 - DNA, 15 bp, Homo sapiens
ctaggtgacagagcg

SEQ ID NO: 54861 - DNA, 15 bp, Homo sapiens
taggtgacagagcga

SEQ ID NO: 54862 - DNA, 15 bp, Homo sapiens
aggtgacagagcgag

SEQ ID NO: 54863 - DNA, 15 bp, Homo sapiens
ggtgacagagcgaga

SEQ ID NO: 54864 - DNA, 15 bp, Homo sapiens
gtgacagagcgagac

SEQ ID NO: 54865 - DNA, 15 bp, Homo sapiens
tgacagagcgagact

SEQ ID NO: 54866 - DNA, 15 bp, Homo sapiens
gacagagcgagactc

SEQ ID NO: 54867 - DNA, 15 bp, Homo sapiens
acagagcgagactct

SEQ ID NO: 54868 - DNA, 15 bp, Homo sapiens
cagagcgagactctg

SEQ ID NO: 54869 - DNA, 15 bp, Homo sapiens
agagcgagactctgt

SEQ ID NO: 54870 - DNA, 15 bp, Homo sapiens
gagcgagactctgtc

SEQ ID NO: 54871 - DNA, 15 bp, Homo sapiens
agcgagactctgtct

SEQ ID NO: 54872 - DNA, 15 bp, Homo sapiens
gcgagactctgtctc

SEQ ID NO: 54873 - DNA, 15 bp, Homo sapiens
cgagactctgtctca

SEQ ID NO: 54874 - DNA, 15 bp, Homo sapiens
actctgtctcaaaaa

SEQ ID NO: 54875 - DNA, 15 bp, Homo sapiens
ctctgtctcaaaaaa

SEQ ID NO: 54876 - DNA, 15 bp, Homo sapiens
tctgtctcaaaaaaa

SEQ ID NO: 54877 - DNA, 15 bp, Homo sapiens
ctgtctcaaaaaaat

SEQ ID NO: 54878 - DNA, 15 bp, Homo sapiens
tgtctcaaaaaaata

SEQ ID NO: 54879 - DNA, 15 bp, Homo sapiens
gtctcaaaaaaataa

SEQ ID NO: 54880 - DNA, 15 bp, Homo sapiens
tctcaaaaaaataaa

SEQ ID NO: 54881 - DNA, 15 bp, Homo sapiens
ctcaaaaaaataaaa

SEQ ID NO: 54882 - DNA, 15 bp, Homo sapiens
tcaaaaaaataaaaa

SEQ ID NO: 54883 - DNA, 15 bp, Homo sapiens
caaaaaaataaaaat

SEQ ID NO: 54884 - DNA, 15 bp, Homo sapiens
aaaaaaataaaaata

SEQ ID NO: 54885 - DNA, 15 bp, Homo sapiens
aaaaataaaaataaa

SEQ ID NO: 54886 - DNA, 15 bp, Homo sapiens
aaaataaaaataaag

SEQ ID NO: 54887 - DNA, 15 bp, Homo sapiens
aaataaaaataaagc

SEQ ID NO: 54888 - DNA, 15 bp, Homo sapiens
aataaaaataaagca

SEQ ID NO: 54889 - DNA, 15 bp, Homo sapiens
ataaaaataaagcat

SEQ ID NO: 54890 - DNA, 15 bp, Homo sapiens
taaaaataaagcatt

SEQ ID NO: 54891 - DNA, 15 bp, Homo sapiens
aaaaataaagcatta

SEQ ID NO: 54892 - DNA, 15 bp, Homo sapiens
aaaataaagcattaa

SEQ ID NO: 54893 - DNA, 15 bp, Homo sapiens
aaataaagcattaaa

SEQ ID NO: 54894 - DNA, 15 bp, Homo sapiens
aataaagcattaaag

SEQ ID NO: 54895 - DNA, 15 bp, Homo sapiens
ataaagcattaaagc

SEQ ID NO: 54896 - DNA, 15 bp, Homo sapiens
taaagcattaaagca

SEQ ID NO: 54897 - DNA, 15 bp, Homo sapiens
aaagcattaaagcac

SEQ ID NO: 54898 - DNA, 15 bp, Homo sapiens
aagcattaaagcact

SEQ ID NO: 54899 - DNA, 15 bp, Homo sapiens
agcattaaagcactt

SEQ ID NO: 54900 - DNA, 15 bp, Homo sapiens
gcattaaagcacttt

SEQ ID NO: 54901 - DNA, 15 bp, Homo sapiens
cattaaagcactttg

SEQ ID NO: 54902 - DNA, 15 bp, Homo sapiens
attaaagcactttgt

SEQ ID NO: 54903 - DNA, 15 bp, Homo sapiens
ttaaagcactttgtc

SEQ ID NO: 54904 - DNA, 15 bp, Homo sapiens
taaagcactttgtct

SEQ ID NO: 54905 - DNA, 15 bp, Homo sapiens
aaagcactttgtctg

SEQ ID NO: 54906 - DNA, 15 bp, Homo sapiens
aagcactttgtctgg

SEQ ID NO: 54907 - DNA, 15 bp, Homo sapiens
agcactttgtctggt

SEQ ID NO: 54908 - DNA, 15 bp, Homo sapiens
gcactttgtctggtg

SEQ ID NO: 54909 - DNA, 15 bp, Homo sapiens
cactttgtctggtgg

SEQ ID NO: 54910 - DNA, 15 bp, Homo sapiens
actttgtctggtggt

SEQ ID NO: 54911 - DNA, 15 bp, Homo sapiens
ctttgtctggtggta

SEQ ID NO: 54912 - DNA, 15 bp, Homo sapiens
tttgtctggtggtat

SEQ ID NO: 54913 - DNA, 15 bp, Homo sapiens
ttgtctggtggtatg

SEQ ID NO: 54914 - DNA, 15 bp, Homo sapiens
tgtctggtggtatgt

SEQ ID NO: 54915 - DNA, 15 bp, Homo sapiens
gtctggtggtatgta

SEQ ID NO: 54916 - DNA, 15 bp, Homo sapiens
tctggtggtatgtaa

SEQ ID NO: 54917 - DNA, 15 bp, Homo sapiens
ctggtggtatgtaag

SEQ ID NO: 54918 - DNA, 15 bp, Homo sapiens
tggtggtatgtaagt

SEQ ID NO: 54919 - DNA, 15 bp, Homo sapiens
ggtggtatgtaagtt

SEQ ID NO: 54920 - DNA, 15 bp, Homo sapiens
gtggtatgtaagttt

SEQ ID NO: 54921 - DNA, 15 bp, Homo sapiens
tggtatgtaagtttt

SEQ ID NO: 54922 - DNA, 15 bp, Homo sapiens
ggtatgtaagttttg

SEQ ID NO: 54923 - DNA, 15 bp, Homo sapiens
gtatgtaagttttgg

SEQ ID NO: 54924 - DNA, 15 bp, Homo sapiens
tatgtaagttttggc

SEQ ID NO: 54925 - DNA, 15 bp, Homo sapiens
atgtaagttttggca

SEQ ID NO: 54926 - DNA, 15 bp, Homo sapiens
tgtaagttttggcat

SEQ ID NO: 54927 - DNA, 15 bp, Homo sapiens
gtaagttttggcatt

SEQ ID NO: 54928 - DNA, 15 bp, Homo sapiens
taagttttggcatta

SEQ ID NO: 54929 - DNA, 15 bp, Homo sapiens
aagttttggcattac

SEQ ID NO: 54930 - DNA, 15 bp, Homo sapiens
agttttggcattact

SEQ ID NO: 54931 - DNA, 15 bp, Homo sapiens
gttttggcattactt

SEQ ID NO: 54932 - DNA, 15 bp, Homo sapiens
ttttggcattactta

SEQ ID NO: 54933 - DNA, 15 bp, Homo sapiens
tttggcattacttag

SEQ ID NO: 54934 - DNA, 15 bp, Homo sapiens
ttggcattacttaga

SEQ ID NO: 54935 - DNA, 15 bp, Homo sapiens
tggcattacttagat

SEQ ID NO: 54936 - DNA, 15 bp, Homo sapiens
ggcattacttagata

SEQ ID NO: 54937 - DNA, 15 bp, Homo sapiens
gcattacttagataa

SEQ ID NO: 54938 - DNA, 15 bp, Homo sapiens
cattacttagataag

SEQ ID NO: 54939 - DNA, 15 bp, Homo sapiens
attacttagataagt

SEQ ID NO: 54940 - DNA, 15 bp, Homo sapiens
ttacttagataagtt

SEQ ID NO: 54941 - DNA, 15 bp, Homo sapiens
tacttagataagttg

SEQ ID NO: 54942 - DNA, 15 bp, Homo sapiens
acttagataagttgt

SEQ ID NO: 54943 - DNA, 15 bp, Homo sapiens
cttagataagttgta

SEQ ID NO: 54944 - DNA, 15 bp, Homo sapiens
ttagataagttgtat

SEQ ID NO: 54945 - DNA, 15 bp, Homo sapiens
tagataagttgtatt

SEQ ID NO: 54946 - DNA, 15 bp, Homo sapiens
agataagttgtattt

SEQ ID NO: 54947 - DNA, 15 bp, Homo sapiens
gataagttgtatttt

SEQ ID NO: 54948 - DNA, 15 bp, Homo sapiens
ataagttgtatttta

SEQ ID NO: 54949 - DNA, 15 bp, Homo sapiens
taagttgtattttaa

SEQ ID NO: 54950 - DNA, 15 bp, Homo sapiens
aagttgtattttaag

SEQ ID NO: 54951 - DNA, 15 bp, Homo sapiens
agttgtattttaagt

SEQ ID NO: 54952 - DNA, 15 bp, Homo sapiens
gttgtattttaagtc

SEQ ID NO: 54953 - DNA, 15 bp, Homo sapiens
ttgtattttaagtct

SEQ ID NO: 54954 - DNA, 15 bp, Homo sapiens
tgtattttaagtctt

SEQ ID NO: 54955 - DNA, 15 bp, Homo sapiens
gtattttaagtcttt

SEQ ID NO: 54956 - DNA, 15 bp, Homo sapiens
tattttaagtctttc

SEQ ID NO: 54957 - DNA, 15 bp, Homo sapiens
attttaagtctttct

SEQ ID NO: 54958 - DNA, 15 bp, Homo sapiens
ttttaagtctttcta

SEQ ID NO: 54959 - DNA, 15 bp, Homo sapiens
tttaagtctttctac

SEQ ID NO: 54960 - DNA, 15 bp, Homo sapiens
ttaagtctttctaca

SEQ ID NO: 54961 - DNA, 15 bp, Homo sapiens
taagtctttctacac

SEQ ID NO: 54962 - DNA, 15 bp, Homo sapiens
aagtctttctacaca

SEQ ID NO: 54963 - DNA, 15 bp, Homo sapiens
agtctttctacacac

SEQ ID NO: 54964 - DNA, 15 bp, Homo sapiens
gtctttctacacaca

SEQ ID NO: 54965 - DNA, 15 bp, Homo sapiens
tctttctacacacaa

SEQ ID NO: 54966 - DNA, 15 bp, Homo sapiens
ctttctacacacaat

SEQ ID NO: 54967 - DNA, 15 bp, Homo sapiens
tttctacacacaata

SEQ ID NO: 54968 - DNA, 15 bp, Homo sapiens
ttctacacacaataa

SEQ ID NO: 54969 - DNA, 15 bp, Homo sapiens
tctacacacaataac

SEQ ID NO: 54970 - DNA, 15 bp, Homo sapiens
ctacacacaataact

SEQ ID NO: 54971 - DNA, 15 bp, Homo sapiens
tacacacaataactt

SEQ ID NO: 54972 - DNA, 15 bp, Homo sapiens
acacacaataactta

SEQ ID NO: 54973 - DNA, 15 bp, Homo sapiens
cacacaataacttat

SEQ ID NO: 54974 - DNA, 15 bp, Homo sapiens
acacaataacttatt

SEQ ID NO: 54975 - DNA, 15 bp, Homo sapiens
cacaataacttattt

SEQ ID NO: 54976 - DNA, 15 bp, Homo sapiens
acaataacttatttt

SEQ ID NO: 54977 - DNA, 15 bp, Homo sapiens
caataacttattttt

SEQ ID NO: 54978 - DNA, 15 bp, Homo sapiens
aataacttattttta

SEQ ID NO: 54979 - DNA, 15 bp, Homo sapiens
ataacttatttttaa

SEQ ID NO: 54980 - DNA, 15 bp, Homo sapiens
taacttatttttaaa

SEQ ID NO: 54981 - DNA, 15 bp, Homo sapiens
aacttatttttaaaa

SEQ ID NO: 54982 - DNA, 15 bp, Homo sapiens
acttatttttaaaat

SEQ ID NO: 54983 - DNA, 15 bp, Homo sapiens
cttatttttaaaata

SEQ ID NO: 54984 - DNA, 15 bp, Homo sapiens
ttatttttaaaatac

SEQ ID NO: 54985 - DNA, 15 bp, Homo sapiens
tatttttaaaataca

SEQ ID NO: 54986 - DNA, 15 bp, Homo sapiens
atttttaaaatacaa

SEQ ID NO: 54987 - DNA, 15 bp, Homo sapiens
tttttaaaatacaag

SEQ ID NO: 54988 - DNA, 15 bp, Homo sapiens
ttttaaaatacaagt

SEQ ID NO: 54989 - DNA, 15 bp, Homo sapiens
tttaaaatacaagtt

SEQ ID NO: 54990 - DNA, 15 bp, Homo sapiens
ttaaaatacaagttt

SEQ ID NO: 54991 - DNA, 15 bp, Homo sapiens
taaaatacaagtttc

SEQ ID NO: 54992 - DNA, 15 bp, Homo sapiens
aaaatacaagtttct

SEQ ID NO: 54993 - DNA, 15 bp, Homo sapiens
aaatacaagtttctg

SEQ ID NO: 54994 - DNA, 15 bp, Homo sapiens
aatacaagtttctgt

SEQ ID NO: 54995 - DNA, 15 bp, Homo sapiens
atacaagtttctgtg

SEQ ID NO: 54996 - DNA, 15 bp, Homo sapiens
tacaagtttctgtgt

SEQ ID NO: 54997 - DNA, 15 bp, Homo sapiens
acaagtttctgtgta

SEQ ID NO: 54998 - DNA, 15 bp, Homo sapiens
caagtttctgtgtac

SEQ ID NO: 54999 - DNA, 15 bp, Homo sapiens
aagtttctgtgtact

SEQ ID NO: 55000 - DNA, 15 bp, Homo sapiens
agtttctgtgtactt

SEQ ID NO: 55001 - DNA, 15 bp, Homo sapiens
gtttctgtgtacttc

SEQ ID NO: 55002 - DNA, 15 bp, Homo sapiens
tttctgtgtacttcc

SEQ ID NO: 55003 - DNA, 15 bp, Homo sapiens
ttctgtgtacttccg

SEQ ID NO: 55004 - DNA, 15 bp, Homo sapiens
tctgtgtacttccgg

SEQ ID NO: 55005 - DNA, 15 bp, Homo sapiens
ctgtgtacttccggg

SEQ ID NO: 55006 - DNA, 15 bp, Homo sapiens
tgtgtacttccgggt

SEQ ID NO: 55007 - DNA, 15 bp, Homo sapiens
gtgtacttccgggtt

SEQ ID NO: 55008 - DNA, 15 bp, Homo sapiens
tgtacttccgggttt

SEQ ID NO: 55009 - DNA, 15 bp, Homo sapiens
gtacttccgggtttt

SEQ ID NO: 55010 - DNA, 15 bp, Homo sapiens
tacttccgggttttg

SEQ ID NO: 55011 - DNA, 15 bp, Homo sapiens
acttccgggttttgt

SEQ ID NO: 55012 - DNA, 15 bp, Homo sapiens
cttccgggttttgtg

SEQ ID NO: 55013 - DNA, 15 bp, Homo sapiens
ttccgggttttgtgt

SEQ ID NO: 55014 - DNA, 15 bp, Homo sapiens
tccgggttttgtgtt

SEQ ID NO: 55015 - DNA, 15 bp, Homo sapiens
ccgggttttgtgttt

SEQ ID NO: 55016 - DNA, 15 bp, Homo sapiens
cgggttttgtgtttt

SEQ ID NO: 55017 - DNA, 15 bp, Homo sapiens
gggttttgtgttttt

SEQ ID NO: 55018 - DNA, 15 bp, Homo sapiens
ggttttgtgtttttg

SEQ ID NO: 55019 - DNA, 15 bp, Homo sapiens
gttttgtgtttttgt

SEQ ID NO: 55020 - DNA, 15 bp, Homo sapiens
ttttgtgtttttgta

SEQ ID NO: 55021 - DNA, 15 bp, Homo sapiens
tttgtgtttttgtaa

SEQ ID NO: 55022 - DNA, 15 bp, Homo sapiens
ttgtgtttttgtaaa

SEQ ID NO: 55023 - DNA, 15 bp, Homo sapiens
tgtgtttttgtaaac

SEQ ID NO: 55024 - DNA, 15 bp, Homo sapiens
gtgtttttgtaaaca

SEQ ID NO: 55025 - DNA, 15 bp, Homo sapiens
tgtttttgtaaacag

SEQ ID NO: 55026 - DNA, 15 bp, Homo sapiens
gtttttgtaaacagc

SEQ ID NO: 55027 - DNA, 15 bp, Homo sapiens
tttttgtaaacagca

SEQ ID NO: 55028 - DNA, 15 bp, Homo sapiens
ttttgtaaacagcag

SEQ ID NO: 55029 - DNA, 15 bp, Homo sapiens
tttgtaaacagcaga

SEQ ID NO: 55030 - DNA, 15 bp, Homo sapiens
ttgtaaacagcagaa

SEQ ID NO: 55031 - DNA, 15 bp, Homo sapiens
tgtaaacagcagaag

SEQ ID NO: 55032 - DNA, 15 bp, Homo sapiens
gtaaacagcagaagg

SEQ ID NO: 55033 - DNA, 15 bp, Homo sapiens
taaacagcagaaggt

SEQ ID NO: 55034 - DNA, 15 bp, Homo sapiens
aaacagcagaaggta

SEQ ID NO: 55035 - DNA, 15 bp, Homo sapiens
aacagcagaaggtat

SEQ ID NO: 55036 - DNA, 15 bp, Homo sapiens
acagcagaaggtatt

SEQ ID NO: 55037 - DNA, 15 bp, Homo sapiens
cagcagaaggtatta

SEQ ID NO: 55038 - DNA, 15 bp, Homo sapiens
agcagaaggtattag

SEQ ID NO: 55039 - DNA, 15 bp, Homo sapiens
gcagaaggtattagt

SEQ ID NO: 55040 - DNA, 15 bp, Homo sapiens
cagaaggtattagtc

SEQ ID NO: 55041 - DNA, 15 bp, Homo sapiens
agaaggtattagtcc

SEQ ID NO: 55042 - DNA, 15 bp, Homo sapiens
gaaggtattagtcca

SEQ ID NO: 55043 - DNA, 15 bp, Homo sapiens
aaggtattagtccat

SEQ ID NO: 55044 - DNA, 15 bp, Homo sapiens
aggtattagtccata

SEQ ID NO: 55045 - DNA, 15 bp, Homo sapiens
ggtattagtccatat

SEQ ID NO: 55046 - DNA, 15 bp, Homo sapiens
gtattagtccatatt

SEQ ID NO: 55047 - DNA, 15 bp, Homo sapiens
tattagtccatatta

SEQ ID NO: 55048 - DNA, 15 bp, Homo sapiens
attagtccatattaa

SEQ ID NO: 55049 - DNA, 15 bp, Homo sapiens
ttagtccatattaag

SEQ ID NO: 55050 - DNA, 15 bp, Homo sapiens
tagtccatattaagt

SEQ ID NO: 55051 - DNA, 15 bp, Homo sapiens
agtccatattaagta

SEQ ID NO: 55052 - DNA, 15 bp, Homo sapiens
gtccatattaagtac

SEQ ID NO: 55053 - DNA, 15 bp, Homo sapiens
tccatattaagtact

SEQ ID NO: 55054 - DNA, 15 bp, Homo sapiens
ccatattaagtacta

SEQ ID NO: 55055 - DNA, 15 bp, Homo sapiens
catattaagtactaa

SEQ ID NO: 55056 - DNA, 15 bp, Homo sapiens
atattaagtactaat

SEQ ID NO: 55057 - DNA, 15 bp, Homo sapiens
tattaagtactaatt

SEQ ID NO: 55058 - DNA, 15 bp, Homo sapiens
attaagtactaattt

SEQ ID NO: 55059 - DNA, 15 bp, Homo sapiens
ttaagtactaatttg

SEQ ID NO: 55060 - DNA, 15 bp, Homo sapiens
taagtactaatttgt

SEQ ID NO: 55061 - DNA, 15 bp, Homo sapiens
aagtactaatttgtt

SEQ ID NO: 55062 - DNA, 15 bp, Homo sapiens
agtactaatttgttc

SEQ ID NO: 55063 - DNA, 15 bp, Homo sapiens
gtactaatttgttct

SEQ ID NO: 55064 - DNA, 15 bp, Homo sapiens
tactaatttgttcta

SEQ ID NO: 55065 - DNA, 15 bp, Homo sapiens
actaatttgttctaa

SEQ ID NO: 55066 - DNA, 15 bp, Homo sapiens
ctaatttgttctaat

SEQ ID NO: 55067 - DNA, 15 bp, Homo sapiens
taatttgttctaata

SEQ ID NO: 55068 - DNA, 15 bp, Homo sapiens
aatttgttctaatat

SEQ ID NO: 55069 - DNA, 15 bp, Homo sapiens
atttgttctaatatt

SEQ ID NO: 55070 - DNA, 15 bp, Homo sapiens
tttgttctaatattt

SEQ ID NO: 55071 - DNA, 15 bp, Homo sapiens
ttgttctaatatttt

SEQ ID NO: 55072 - DNA, 15 bp, Homo sapiens
tgttctaatattttc

SEQ ID NO: 55073 - DNA, 15 bp, Homo sapiens
gttctaatattttca

SEQ ID NO: 55074 - DNA, 15 bp, Homo sapiens
ttctaatattttcag

SEQ ID NO: 55075 - DNA, 15 bp, Homo sapiens
tctaatattttcagc

SEQ ID NO: 55076 - DNA, 15 bp, Homo sapiens
ctaatattttcagct

SEQ ID NO: 55077 - DNA, 15 bp, Homo sapiens
taatattttcagctg

SEQ ID NO: 55078 - DNA, 15 bp, Homo sapiens
aatattttcagctgt

SEQ ID NO: 55079 - DNA, 15 bp, Homo sapiens
atattttcagctgtt

SEQ ID NO: 55080 - DNA, 15 bp, Homo sapiens
tattttcagctgttt

SEQ ID NO: 55081 - DNA, 15 bp, Homo sapiens
attttcagctgtttt

SEQ ID NO: 55082 - DNA, 15 bp, Homo sapiens
ttttcagctgttttt

SEQ ID NO: 55083 - DNA, 15 bp, Homo sapiens
tttcagctgtttttg

SEQ ID NO: 55084 - DNA, 15 bp, Homo sapiens
ttcagctgtttttgg

SEQ ID NO: 55085 - DNA, 15 bp, Homo sapiens
tcagctgtttttgga

SEQ ID NO: 55086 - DNA, 15 bp, Homo sapiens
cagctgtttttggaa

SEQ ID NO: 55087 - DNA, 15 bp, Homo sapiens
agctgtttttggaat

SEQ ID NO: 55088 - DNA, 15 bp, Homo sapiens
gctgtttttggaatt

SEQ ID NO: 55089 - DNA, 15 bp, Homo sapiens
ctgtttttggaatta

SEQ ID NO: 55090 - DNA, 15 bp, Homo sapiens
tgtttttggaattac

SEQ ID NO: 55091 - DNA, 15 bp, Homo sapiens
gtttttggaattaca

SEQ ID NO: 55092 - DNA, 15 bp, Homo sapiens
tttttggaattacac

SEQ ID NO: 55093 - DNA, 15 bp, Homo sapiens
ttttggaattacact

SEQ ID NO: 55094 - DNA, 15 bp, Homo sapiens
tttggaattacactt

SEQ ID NO: 55095 - DNA, 15 bp, Homo sapiens
ttggaattacacttg

SEQ ID NO: 55096 - DNA, 15 bp, Homo sapiens
tggaattacacttgg

SEQ ID NO: 55097 - DNA, 15 bp, Homo sapiens
ggaattacacttggc

SEQ ID NO: 55098 - DNA, 15 bp, Homo sapiens
gaattacacttggca

SEQ ID NO: 55099 - DNA, 15 bp, Homo sapiens
aattacacttggcaa

SEQ ID NO: 55100 - DNA, 15 bp, Homo sapiens
attacacttggcaaa

SEQ ID NO: 55101 - DNA, 15 bp, Homo sapiens
ttacacttggcaaaa

SEQ ID NO: 55102 - DNA, 15 bp, Homo sapiens
tacacttggcaaaaa

SEQ ID NO: 55103 - DNA, 15 bp, Homo sapiens
acacttggcaaaaaa

SEQ ID NO: 55104 - DNA, 15 bp, Homo sapiens
cacttggcaaaaaaa

SEQ ID NO: 55105 - DNA, 15 bp, Homo sapiens
acttggcaaaaaaat

SEQ ID NO: 55106 - DNA, 15 bp, Homo sapiens
cttggcaaaaaaata

SEQ ID NO: 55107 - DNA, 15 bp, Homo sapiens
ttggcaaaaaaatag

SEQ ID NO: 55108 - DNA, 15 bp, Homo sapiens
tggcaaaaaaataga

SEQ ID NO: 55109 - DNA, 15 bp, Homo sapiens
ggcaaaaaaatagac

SEQ ID NO: 55110 - DNA, 15 bp, Homo sapiens
gcaaaaaaatagaca

SEQ ID NO: 55111 - DNA, 15 bp, Homo sapiens
caaaaaaatagacaa

SEQ ID NO: 55112 - DNA, 15 bp, Homo sapiens
aaaaaaatagacaaa

SEQ ID NO: 55113 - DNA, 15 bp, Homo sapiens
aaaaaatagacaaat

SEQ ID NO: 55114 - DNA, 15 bp, Homo sapiens
aaaaatagacaaatg

SEQ ID NO: 55115 - DNA, 15 bp, Homo sapiens
aaaatagacaaatgt

SEQ ID NO: 55116 - DNA, 15 bp, Homo sapiens
aaatagacaaatgtc

SEQ ID NO: 55117 - DNA, 15 bp, Homo sapiens
aatagacaaatgtct

SEQ ID NO: 55118 - DNA, 15 bp, Homo sapiens
atagacaaatgtctg

SEQ ID NO: 55119 - DNA, 15 bp, Homo sapiens
tagacaaatgtctgc

SEQ ID NO: 55120 - DNA, 15 bp, Homo sapiens
agacaaatgtctgca

SEQ ID NO: 55121 - DNA, 15 bp, Homo sapiens
gacaaatgtctgcag

SEQ ID NO: 55122 - DNA, 15 bp, Homo sapiens
acaaatgtctgcagt

SEQ ID NO: 55123 - DNA, 15 bp, Homo sapiens
caaatgtctgcagtt

SEQ ID NO: 55124 - DNA, 15 bp, Homo sapiens
aaatgtctgcagttg

SEQ ID NO: 55125 - DNA, 15 bp, Homo sapiens
aatgtctgcagttgt

SEQ ID NO: 55126 - DNA, 15 bp, Homo sapiens
atgtctgcagttgtg

SEQ ID NO: 55127 - DNA, 15 bp, Homo sapiens
tgtctgcagttgtga

SEQ ID NO: 55128 - DNA, 15 bp, Homo sapiens
gtctgcagttgtgac

SEQ ID NO: 55129 - DNA, 15 bp, Homo sapiens
tctgcagttgtgaca

SEQ ID NO: 55130 - DNA, 15 bp, Homo sapiens
ctgcagttgtgacag

SEQ ID NO: 55131 - DNA, 15 bp, Homo sapiens
tgcagttgtgacagt

SEQ ID NO: 55132 - DNA, 15 bp, Homo sapiens
gcagttgtgacagtt

SEQ ID NO: 55133 - DNA, 15 bp, Homo sapiens
cagttgtgacagttt

SEQ ID NO: 55134 - DNA, 15 bp, Homo sapiens
agttgtgacagtttg

SEQ ID NO: 55135 - DNA, 15 bp, Homo sapiens
gttgtgacagtttgt

SEQ ID NO: 55136 - DNA, 15 bp, Homo sapiens
ttgtgacagtttgtt

SEQ ID NO: 55137 - DNA, 15 bp, Homo sapiens
tgtgacagtttgttt

SEQ ID NO: 55138 - DNA, 15 bp, Homo sapiens
gtgacagtttgtttt

SEQ ID NO: 55139 - DNA, 15 bp, Homo sapiens
tgacagtttgttttt

SEQ ID NO: 55140 - DNA, 15 bp, Homo sapiens
gacagtttgtttttt

SEQ ID NO: 55141 - DNA, 15 bp, Homo sapiens
acagtttgttttttt

SEQ ID NO: 55142 - DNA, 15 bp, Homo sapiens
cagtttgtttttttg

SEQ ID NO: 55143 - DNA, 15 bp, Homo sapiens
agtttgtttttttgt

SEQ ID NO: 55144 - DNA, 15 bp, Homo sapiens
gtttgtttttttgtt

SEQ ID NO: 55145 - DNA, 15 bp, Homo sapiens
tttgtttttttgttc

SEQ ID NO: 55146 - DNA, 15 bp, Homo sapiens
ttgtttttttgttct

SEQ ID NO: 55147 - DNA, 15 bp, Homo sapiens
tgtttttttgttctt

SEQ ID NO: 55148 - DNA, 15 bp, Homo sapiens
gtttttttgttcttt

SEQ ID NO: 55149 - DNA, 15 bp, Homo sapiens
tttttttgttctttt

SEQ ID NO: 55150 - DNA, 15 bp, Homo sapiens
ttttttgttcttttt

SEQ ID NO: 55151 - DNA, 15 bp, Homo sapiens
tttttgttcttttta

SEQ ID NO: 55152 - DNA, 15 bp, Homo sapiens
ttttgttctttttaa

SEQ ID NO: 55153 - DNA, 15 bp, Homo sapiens
tttgttctttttaac

SEQ ID NO: 55154 - DNA, 15 bp, Homo sapiens
ttgttctttttaact

SEQ ID NO: 55155 - DNA, 15 bp, Homo sapiens
tgttctttttaactc

SEQ ID NO: 55156 - DNA, 15 bp, Homo sapiens
gttctttttaactcc

SEQ ID NO: 55157 - DNA, 15 bp, Homo sapiens
ttctttttaactcca

SEQ ID NO: 55158 - DNA, 15 bp, Homo sapiens
tctttttaactccag

SEQ ID NO: 55159 - DNA, 15 bp, Homo sapiens
ctttttaactccaga

SEQ ID NO: 55160 - DNA, 15 bp, Homo sapiens
tttttaactccagaa

SEQ ID NO: 55161 - DNA, 15 bp, Homo sapiens
ttttaactccagaat

SEQ ID NO: 55162 - DNA, 15 bp, Homo sapiens
tttaactccagaata

SEQ ID NO: 55163 - DNA, 15 bp, Homo sapiens
ttaactccagaataa

SEQ ID NO: 55164 - DNA, 15 bp, Homo sapiens
taactccagaataaa

SEQ ID NO: 55165 - DNA, 15 bp, Homo sapiens
aactccagaataaat

SEQ ID NO: 55166 - DNA, 15 bp, Homo sapiens
actccagaataaata

SEQ ID NO: 55167 - DNA, 15 bp, Homo sapiens
ctccagaataaataa

SEQ ID NO: 55168 - DNA, 15 bp, Homo sapiens
tccagaataaataat

SEQ ID NO: 55169 - DNA, 15 bp, Homo sapiens
ccagaataaataatt

SEQ ID NO: 55170 - DNA, 15 bp, Homo sapiens
cagaataaataattc

SEQ ID NO: 55171 - DNA, 15 bp, Homo sapiens
agaataaataattct

SEQ ID NO: 55172 - DNA, 15 bp, Homo sapiens
gaataaataattcta

SEQ ID NO: 55173 - DNA, 15 bp, Homo sapiens
aataaataattctag

SEQ ID NO: 55174 - DNA, 15 bp, Homo sapiens
ataaataattctagt

SEQ ID NO: 55175 - DNA, 15 bp, Homo sapiens
taaataattctagtg

SEQ ID NO: 55176 - DNA, 15 bp, Homo sapiens
aaataattctagtga

SEQ ID NO: 55177 - DNA, 15 bp, Homo sapiens
aataattctagtgag

SEQ ID NO: 55178 - DNA, 15 bp, Homo sapiens
ataattctagtgagt

SEQ ID NO: 55179 - DNA, 15 bp, Homo sapiens
taattctagtgagtt

SEQ ID NO: 55180 - DNA, 15 bp, Homo sapiens
aattctagtgagttt

SEQ ID NO: 55181 - DNA, 15 bp, Homo sapiens
attctagtgagtttt

SEQ ID NO: 55182 - DNA, 15 bp, Homo sapiens
ttctagtgagttttt

SEQ ID NO: 55183 - DNA, 15 bp, Homo sapiens
tctagtgagtttttt

SEQ ID NO: 55184 - DNA, 15 bp, Homo sapiens
ctagtgagttttttt

SEQ ID NO: 55185 - DNA, 15 bp, Homo sapiens
tagtgagtttttttc

SEQ ID NO: 55186 - DNA, 15 bp, Homo sapiens
agtgagtttttttct

SEQ ID NO: 55187 - DNA, 15 bp, Homo sapiens
gtgagtttttttctt

SEQ ID NO: 55188 - DNA, 15 bp, Homo sapiens
tgagtttttttcttg

SEQ ID NO: 55189 - DNA, 15 bp, Homo sapiens
gagtttttttcttgg

SEQ ID NO: 55190 - DNA, 15 bp, Homo sapiens
agtttttttcttggc

SEQ ID NO: 55191 - DNA, 15 bp, Homo sapiens
gtttttttcttggct

SEQ ID NO: 55192 - DNA, 15 bp, Homo sapiens
tttttttcttggctt

SEQ ID NO: 55193 - DNA, 15 bp, Homo sapiens
ttttttcttggcttg

SEQ ID NO: 55194 - DNA, 15 bp, Homo sapiens
tttttcttggcttgt

SEQ ID NO: 55195 - DNA, 15 bp, Homo sapiens
ttttcttggcttgta

SEQ ID NO: 55196 - DNA, 15 bp, Homo sapiens
tttcttggcttgtaa

SEQ ID NO: 55197 - DNA, 15 bp, Homo sapiens
ttcttggcttgtaag

SEQ ID NO: 55198 - DNA, 15 bp, Homo sapiens
tcttggcttgtaaga

SEQ ID NO: 55199 - DNA, 15 bp, Homo sapiens
cttggcttgtaagaa

SEQ ID NO: 55200 - DNA, 15 bp, Homo sapiens
ttggcttgtaagaac

SEQ ID NO: 55201 - DNA, 15 bp, Homo sapiens
tggcttgtaagaaca

SEQ ID NO: 55202 - DNA, 15 bp, Homo sapiens
ggcttgtaagaacat

SEQ ID NO: 55203 - DNA, 15 bp, Homo sapiens
gcttgtaagaacatg

SEQ ID NO: 55204 - DNA, 15 bp, Homo sapiens
cttgtaagaacatgg

SEQ ID NO: 55205 - DNA, 15 bp, Homo sapiens
ttgtaagaacatggg

SEQ ID NO: 55206 - DNA, 15 bp, Homo sapiens
tgtaagaacatggga

SEQ ID NO: 55207 - DNA, 15 bp, Homo sapiens
gtaagaacatgggaa

SEQ ID NO: 55208 - DNA, 15 bp, Homo sapiens
taagaacatgggaat

SEQ ID NO: 55209 - DNA, 15 bp, Homo sapiens
aagaacatgggaatg

SEQ ID NO: 55210 - DNA, 15 bp, Homo sapiens
agaacatgggaatga

SEQ ID NO: 55211 - DNA, 15 bp, Homo sapiens
gaacatgggaatgat

SEQ ID NO: 55212 - DNA, 15 bp, Homo sapiens
aacatgggaatgatt

SEQ ID NO: 55213 - DNA, 15 bp, Homo sapiens
acatgggaatgatta

SEQ ID NO: 55214 - DNA, 15 bp, Homo sapiens
catgggaatgattag

SEQ ID NO: 55215 - DNA, 15 bp, Homo sapiens
atgggaatgattaga

SEQ ID NO: 55216 - DNA, 15 bp, Homo sapiens
tgggaatgattagag

SEQ ID NO: 55217 - DNA, 15 bp, Homo sapiens
gggaatgattagagt

SEQ ID NO: 55218 - DNA, 15 bp, Homo sapiens
ggaatgattagagtc

SEQ ID NO: 55219 - DNA, 15 bp, Homo sapiens
gaatgattagagtca

SEQ ID NO: 55220 - DNA, 15 bp, Homo sapiens
aatgattagagtcat

SEQ ID NO: 55221 - DNA, 15 bp, Homo sapiens
atgattagagtcatc

SEQ ID NO: 55222 - DNA, 15 bp, Homo sapiens
tgattagagtcatca

SEQ ID NO: 55223 - DNA, 15 bp, Homo sapiens
gattagagtcatcat

SEQ ID NO: 55224 - DNA, 15 bp, Homo sapiens
attagagtcatcata

SEQ ID NO: 55225 - DNA, 15 bp, Homo sapiens
ttagagtcatcataa

SEQ ID NO: 55226 - DNA, 15 bp, Homo sapiens
tagagtcatcataac

SEQ ID NO: 55227 - DNA, 15 bp, Homo sapiens
agagtcatcataaca

SEQ ID NO: 55228 - DNA, 15 bp, Homo sapiens
gagtcatcataacac

SEQ ID NO: 55229 - DNA, 15 bp, Homo sapiens
agtcatcataacact

SEQ ID NO: 55230 - DNA, 15 bp, Homo sapiens
gtcatcataacactt

SEQ ID NO: 55231 - DNA, 15 bp, Homo sapiens
tcatcataacactta

SEQ ID NO: 55232 - DNA, 15 bp, Homo sapiens
catcataacacttaa

SEQ ID NO: 55233 - DNA, 15 bp, Homo sapiens
atcataacacttaag

SEQ ID NO: 55234 - DNA, 15 bp, Homo sapiens
tcataacacttaagt

SEQ ID NO: 55235 - DNA, 15 bp, Homo sapiens
cataacacttaagta

SEQ ID NO: 55236 - DNA, 15 bp, Homo sapiens
ataacacttaagtag

SEQ ID NO: 55237 - DNA, 15 bp, Homo sapiens
taacacttaagtagt

SEQ ID NO: 55238 - DNA, 15 bp, Homo sapiens
aacacttaagtagtt

SEQ ID NO: 55239 - DNA, 15 bp, Homo sapiens
acacttaagtagtta

SEQ ID NO: 55240 - DNA, 15 bp, Homo sapiens
cacttaagtagttat

SEQ ID NO: 55241 - DNA, 15 bp, Homo sapiens
acttaagtagttata

SEQ ID NO: 55242 - DNA, 15 bp, Homo sapiens
cttaagtagttatag

SEQ ID NO: 55243 - DNA, 15 bp, Homo sapiens
ttaagtagttataga

SEQ ID NO: 55244 - DNA, 15 bp, Homo sapiens
taagtagttatagaa

SEQ ID NO: 55245 - DNA, 15 bp, Homo sapiens
aagtagttatagaag

SEQ ID NO: 55246 - DNA, 15 bp, Homo sapiens
agtagttatagaagg

SEQ ID NO: 55247 - DNA, 15 bp, Homo sapiens
gtagttatagaaggt

SEQ ID NO: 55248 - DNA, 15 bp, Homo sapiens
tagttatagaaggtt

SEQ ID NO: 55249 - DNA, 15 bp, Homo sapiens
agttatagaaggttg

SEQ ID NO: 55250 - DNA, 15 bp, Homo sapiens
gttatagaaggttga

SEQ ID NO: 55251 - DNA, 15 bp, Homo sapiens
ttatagaaggttgaa

SEQ ID NO: 55252 - DNA, 15 bp, Homo sapiens
tatagaaggttgaac

SEQ ID NO: 55253 - DNA, 15 bp, Homo sapiens
atagaaggttgaaca

SEQ ID NO: 55254 - DNA, 15 bp, Homo sapiens
tagaaggttgaacat

SEQ ID NO: 55255 - DNA, 15 bp, Homo sapiens
agaaggttgaacatc

SEQ ID NO: 55256 - DNA, 15 bp, Homo sapiens
gaaggttgaacatct

SEQ ID NO: 55257 - DNA, 15 bp, Homo sapiens
aaggttgaacatctg

SEQ ID NO: 55258 - DNA, 15 bp, Homo sapiens
aggttgaacatctgt

SEQ ID NO: 55259 - DNA, 15 bp, Homo sapiens
ggttgaacatctgta

SEQ ID NO: 55260 - DNA, 15 bp, Homo sapiens
gttgaacatctgtag

SEQ ID NO: 55261 - DNA, 15 bp, Homo sapiens
ttgaacatctgtagt

SEQ ID NO: 55262 - DNA, 15 bp, Homo sapiens
tgaacatctgtagtc

SEQ ID NO: 55263 - DNA, 15 bp, Homo sapiens
gaacatctgtagtca

SEQ ID NO: 55264 - DNA, 15 bp, Homo sapiens
aacatctgtagtcag

SEQ ID NO: 55265 - DNA, 15 bp, Homo sapiens
acatctgtagtcagt

SEQ ID NO: 55266 - DNA, 15 bp, Homo sapiens
catctgtagtcagtt

SEQ ID NO: 55267 - DNA, 15 bp, Homo sapiens
atctgtagtcagttg

SEQ ID NO: 55268 - DNA, 15 bp, Homo sapiens
tctgtagtcagttgt

SEQ ID NO: 55269 - DNA, 15 bp, Homo sapiens
ctgtagtcagttgta

SEQ ID NO: 55270 - DNA, 15 bp, Homo sapiens
tgtagtcagttgtat

SEQ ID NO: 55271 - DNA, 15 bp, Homo sapiens
gtagtcagttgtata

SEQ ID NO: 55272 - DNA, 15 bp, Homo sapiens
tagtcagttgtataa

SEQ ID NO: 55273 - DNA, 15 bp, Homo sapiens
agtcagttgtataaa

SEQ ID NO: 55274 - DNA, 15 bp, Homo sapiens
gtcagttgtataaaa

SEQ ID NO: 55275 - DNA, 15 bp, Homo sapiens
tcagttgtataaaat

SEQ ID NO: 55276 - DNA, 15 bp, Homo sapiens
cagttgtataaaatt

SEQ ID NO: 55277 - DNA, 15 bp, Homo sapiens
agttgtataaaattt

SEQ ID NO: 55278 - DNA, 15 bp, Homo sapiens
gttgtataaaatttc

SEQ ID NO: 55279 - DNA, 15 bp, Homo sapiens
ttgtataaaatttcc

SEQ ID NO: 55280 - DNA, 15 bp, Homo sapiens
tgtataaaatttcct

SEQ ID NO: 55281 - DNA, 15 bp, Homo sapiens
gtataaaatttccta

SEQ ID NO: 55282 - DNA, 15 bp, Homo sapiens
tataaaatttcctag

SEQ ID NO: 55283 - DNA, 15 bp, Homo sapiens
ataaaatttcctagt

SEQ ID NO: 55284 - DNA, 15 bp, Homo sapiens
taaaatttcctagtc

SEQ ID NO: 55285 - DNA, 15 bp, Homo sapiens
aaaatttcctagtca

SEQ ID NO: 55286 - DNA, 15 bp, Homo sapiens
aaatttcctagtcat

SEQ ID NO: 55287 - DNA, 15 bp, Homo sapiens
aatttcctagtcatc

SEQ ID NO: 55288 - DNA, 15 bp, Homo sapiens
atttcctagtcatcc

SEQ ID NO: 55289 - DNA, 15 bp, Homo sapiens
tttcctagtcatcct

SEQ ID NO: 55290 - DNA, 15 bp, Homo sapiens
ttcctagtcatcctt

SEQ ID NO: 55291 - DNA, 15 bp, Homo sapiens
tcctagtcatccttc

SEQ ID NO: 55292 - DNA, 15 bp, Homo sapiens
cctagtcatccttcc

SEQ ID NO: 55293 - DNA, 15 bp, Homo sapiens
ctagtcatccttcca

SEQ ID NO: 55294 - DNA, 15 bp, Homo sapiens
tagtcatccttccag

SEQ ID NO: 55295 - DNA, 15 bp, Homo sapiens
agtcatccttccagg

SEQ ID NO: 55296 - DNA, 15 bp, Homo sapiens
gtcatccttccaggt

SEQ ID NO: 55297 - DNA, 15 bp, Homo sapiens
tcatccttccaggtt

SEQ ID NO: 55298 - DNA, 15 bp, Homo sapiens
catccttccaggttg

SEQ ID NO: 55299 - DNA, 15 bp, Homo sapiens
atccttccaggttgt

SEQ ID NO: 55300 - DNA, 15 bp, Homo sapiens
tccttccaggttgtt

SEQ ID NO: 55301 - DNA, 15 bp, Homo sapiens
ccttccaggttgttt

SEQ ID NO: 55302 - DNA, 15 bp, Homo sapiens
cttccaggttgttta

SEQ ID NO: 55303 - DNA, 15 bp, Homo sapiens
ttccaggttgtttaa

SEQ ID NO: 55304 - DNA, 15 bp, Homo sapiens
tccaggttgtttaag

SEQ ID NO: 55305 - DNA, 15 bp, Homo sapiens
ccaggttgtttaaga

SEQ ID NO: 55306 - DNA, 15 bp, Homo sapiens
caggttgtttaagac

SEQ ID NO: 55307 - DNA, 15 bp, Homo sapiens
aggttgtttaagaca

SEQ ID NO: 55308 - DNA, 15 bp, Homo sapiens
ggttgtttaagacaa

SEQ ID NO: 55309 - DNA, 15 bp, Homo sapiens
gttgtttaagacaaa

SEQ ID NO: 55310 - DNA, 15 bp, Homo sapiens
ttgtttaagacaaac

SEQ ID NO: 55311 - DNA, 15 bp, Homo sapiens
tgtttaagacaaaca

SEQ ID NO: 55312 - DNA, 15 bp, Homo sapiens
gtttaagacaaacaa

SEQ ID NO: 55313 - DNA, 15 bp, Homo sapiens
tttaagacaaacaaa

SEQ ID NO: 55314 - DNA, 15 bp, Homo sapiens
ttaagacaaacaaat

SEQ ID NO: 55315 - DNA, 15 bp, Homo sapiens
taagacaaacaaata

SEQ ID NO: 55316 - DNA, 15 bp, Homo sapiens
aagacaaacaaatac

SEQ ID NO: 55317 - DNA, 15 bp, Homo sapiens
agacaaacaaataca

SEQ ID NO: 55318 - DNA, 15 bp, Homo sapiens
gacaaacaaatacat

SEQ ID NO: 55319 - DNA, 15 bp, Homo sapiens
acaaacaaatacata

SEQ ID NO: 55320 - DNA, 15 bp, Homo sapiens
caaacaaatacatag

SEQ ID NO: 55321 - DNA, 15 bp, Homo sapiens
aaacaaatacatagt

SEQ ID NO: 55322 - DNA, 15 bp, Homo sapiens
aacaaatacatagta

SEQ ID NO: 55323 - DNA, 15 bp, Homo sapiens
acaaatacatagtat

SEQ ID NO: 55324 - DNA, 15 bp, Homo sapiens
caaatacatagtatt

SEQ ID NO: 55325 - DNA, 15 bp, Homo sapiens
aaatacatagtattt

SEQ ID NO: 55326 - DNA, 15 bp, Homo sapiens
aatacatagtattta

SEQ ID NO: 55327 - DNA, 15 bp, Homo sapiens
atacatagtatttat

SEQ ID NO: 55328 - DNA, 15 bp, Homo sapiens
tacatagtatttatt

SEQ ID NO: 55329 - DNA, 15 bp, Homo sapiens
acatagtatttatta

SEQ ID NO: 55330 - DNA, 15 bp, Homo sapiens
catagtatttattaa

SEQ ID NO: 55331 - DNA, 15 bp, Homo sapiens
atagtatttattaag

SEQ ID NO: 55332 - DNA, 15 bp, Homo sapiens
tagtatttattaagc

SEQ ID NO: 55333 - DNA, 15 bp, Homo sapiens
agtatttattaagct

SEQ ID NO: 55334 - DNA, 15 bp, Homo sapiens
gtatttattaagctc

SEQ ID NO: 55335 - DNA, 15 bp, Homo sapiens
tatttattaagctct

SEQ ID NO: 55336 - DNA, 15 bp, Homo sapiens
atttattaagctctt

SEQ ID NO: 55337 - DNA, 15 bp, Homo sapiens
tttattaagctctta

SEQ ID NO: 55338 - DNA, 15 bp, Homo sapiens
ttattaagctcttat

SEQ ID NO: 55339 - DNA, 15 bp, Homo sapiens
tattaagctcttata

SEQ ID NO: 55340 - DNA, 15 bp, Homo sapiens
attaagctcttataa

SEQ ID NO: 55341 - DNA, 15 bp, Homo sapiens
ttaagctcttataaa

SEQ ID NO: 55342 - DNA, 15 bp, Homo sapiens
taagctcttataaat

SEQ ID NO: 55343 - DNA, 15 bp, Homo sapiens
aagctcttataaatt

SEQ ID NO: 55344 - DNA, 15 bp, Homo sapiens
agctcttataaattt

SEQ ID NO: 55345 - DNA, 15 bp, Homo sapiens
gctcttataaatttt

SEQ ID NO: 55346 - DNA, 15 bp, Homo sapiens
ctcttataaatttta

SEQ ID NO: 55347 - DNA, 15 bp, Homo sapiens
tcttataaattttaa

SEQ ID NO: 55348 - DNA, 15 bp, Homo sapiens
cttataaattttaat

SEQ ID NO: 55349 - DNA, 15 bp, Homo sapiens
ttataaattttaatt

SEQ ID NO: 55350 - DNA, 15 bp, Homo sapiens
tataaattttaattg

SEQ ID NO: 55351 - DNA, 15 bp, Homo sapiens
ataaattttaattgt

SEQ ID NO: 55352 - DNA, 15 bp, Homo sapiens
taaattttaattgta

SEQ ID NO: 55353 - DNA, 15 bp, Homo sapiens
aaattttaattgtaa

SEQ ID NO: 55354 - DNA, 15 bp, Homo sapiens
aattttaattgtaaa

SEQ ID NO: 55355 - DNA, 15 bp, Homo sapiens
attttaattgtaaaa

SEQ ID NO: 55356 - DNA, 15 bp, Homo sapiens
ttttaattgtaaaac

SEQ ID NO: 55357 - DNA, 15 bp, Homo sapiens
tttaattgtaaaaca

SEQ ID NO: 55358 - DNA, 15 bp, Homo sapiens
ttaattgtaaaacat

SEQ ID NO: 55359 - DNA, 15 bp, Homo sapiens
taattgtaaaacatc

SEQ ID NO: 55360 - DNA, 15 bp, Homo sapiens
aattgtaaaacatca

SEQ ID NO: 55361 - DNA, 15 bp, Homo sapiens
attgtaaaacatcat

SEQ ID NO: 55362 - DNA, 15 bp, Homo sapiens
ttgtaaaacatcatt

SEQ ID NO: 55363 - DNA, 15 bp, Homo sapiens
tgtaaaacatcattg

SEQ ID NO: 55364 - DNA, 15 bp, Homo sapiens
gtaaaacatcattgt

SEQ ID NO: 55365 - DNA, 15 bp, Homo sapiens
taaaacatcattgta

SEQ ID NO: 55366 - DNA, 15 bp, Homo sapiens
aaaacatcattgtac

SEQ ID NO: 55367 - DNA, 15 bp, Homo sapiens
aaacatcattgtaca

SEQ ID NO: 55368 - DNA, 15 bp, Homo sapiens
aacatcattgtacaa

SEQ ID NO: 55369 - DNA, 15 bp, Homo sapiens
acatcattgtacaaa

SEQ ID NO: 55370 - DNA, 15 bp, Homo sapiens
catcattgtacaaaa

SEQ ID NO: 55371 - DNA, 15 bp, Homo sapiens
atcattgtacaaaac

SEQ ID NO: 55372 - DNA, 15 bp, Homo sapiens
tcattgtacaaaact

SEQ ID NO: 55373 - DNA, 15 bp, Homo sapiens
cattgtacaaaactt

SEQ ID NO: 55374 - DNA, 15 bp, Homo sapiens
attgtacaaaacttt

SEQ ID NO: 55375 - DNA, 15 bp, Homo sapiens
ttgtacaaaactttg

SEQ ID NO: 55376 - DNA, 15 bp, Homo sapiens
tgtacaaaactttga

SEQ ID NO: 55377 - DNA, 15 bp, Homo sapiens
gtacaaaactttgaa

SEQ ID NO: 55378 - DNA, 15 bp, Homo sapiens
tacaaaactttgaaa

SEQ ID NO: 55379 - DNA, 15 bp, Homo sapiens
acaaaactttgaaaa

SEQ ID NO: 55380 - DNA, 15 bp, Homo sapiens
caaaactttgaaaat

SEQ ID NO: 55381 - DNA, 15 bp, Homo sapiens
aaaactttgaaaatg

SEQ ID NO: 55382 - DNA, 15 bp, Homo sapiens
aaactttgaaaatgc

SEQ ID NO: 55383 - DNA, 15 bp, Homo sapiens
aactttgaaaatgcg

SEQ ID NO: 55384 - DNA, 15 bp, Homo sapiens
actttgaaaatgcgt

SEQ ID NO: 55385 - DNA, 15 bp, Homo sapiens
ctttgaaaatgcgta

SEQ ID NO: 55386 - DNA, 15 bp, Homo sapiens
tttgaaaatgcgtat

SEQ ID NO: 55387 - DNA, 15 bp, Homo sapiens
ttgaaaatgcgtata

SEQ ID NO: 55388 - DNA, 15 bp, Homo sapiens
tgaaaatgcgtatag

SEQ ID NO: 55389 - DNA, 15 bp, Homo sapiens
gaaaatgcgtatagg

SEQ ID NO: 55390 - DNA, 15 bp, Homo sapiens
aaaatgcgtataggt

SEQ ID NO: 55391 - DNA, 15 bp, Homo sapiens
aaatgcgtataggta

SEQ ID NO: 55392 - DNA, 15 bp, Homo sapiens
aatgcgtataggtac

SEQ ID NO: 55393 - DNA, 15 bp, Homo sapiens
atgcgtataggtaca

SEQ ID NO: 55394 - DNA, 15 bp, Homo sapiens
tgcgtataggtacaa

SEQ ID NO: 55395 - DNA, 15 bp, Homo sapiens
gcgtataggtacaaa

SEQ ID NO: 55396 - DNA, 15 bp, Homo sapiens
cgtataggtacaaag

SEQ ID NO: 55397 - DNA, 15 bp, Homo sapiens
gtataggtacaaaga

SEQ ID NO: 55398 - DNA, 15 bp, Homo sapiens
tataggtacaaagat

SEQ ID NO: 55399 - DNA, 15 bp, Homo sapiens
ataggtacaaagata

SEQ ID NO: 55400 - DNA, 15 bp, Homo sapiens
taggtacaaagataa

SEQ ID NO: 55401 - DNA, 15 bp, Homo sapiens
aggtacaaagataaa

SEQ ID NO: 55402 - DNA, 15 bp, Homo sapiens
ggtacaaagataaaa

SEQ ID NO: 55403 - DNA, 15 bp, Homo sapiens
gtacaaagataaaaa

SEQ ID NO: 55404 - DNA, 15 bp, Homo sapiens
tacaaagataaaaaa

SEQ ID NO: 55405 - DNA, 15 bp, Homo sapiens
acaaagataaaaaat

SEQ ID NO: 55406 - DNA, 15 bp, Homo sapiens
caaagataaaaaatt

SEQ ID NO: 55407 - DNA, 15 bp, Homo sapiens
aaagataaaaaatta

SEQ ID NO: 55408 - DNA, 15 bp, Homo sapiens
aagataaaaaattag

SEQ ID NO: 55409 - DNA, 15 bp, Homo sapiens
agataaaaaattagg

SEQ ID NO: 55410 - DNA, 15 bp, Homo sapiens
gataaaaaattaggc

SEQ ID NO: 55411 - DNA, 15 bp, Homo sapiens
ataaaaaattaggcc

SEQ ID NO: 55412 - DNA, 15 bp, Homo sapiens
taaaaaattaggcca

SEQ ID NO: 55413 - DNA, 15 bp, Homo sapiens
aaaaaattaggccag

SEQ ID NO: 55414 - DNA, 15 bp, Homo sapiens
aaaaattaggccagg

SEQ ID NO: 55415 - DNA, 15 bp, Homo sapiens
aaaattaggccaggc

SEQ ID NO: 55416 - DNA, 15 bp, Homo sapiens
aaattaggccaggca

SEQ ID NO: 55417 - DNA, 15 bp, Homo sapiens
aattaggccaggcat

SEQ ID NO: 55418 - DNA, 15 bp, Homo sapiens
attaggccaggcatg

SEQ ID NO: 55419 - DNA, 15 bp, Homo sapiens
ttaggccaggcatgc

SEQ ID NO: 55420 - DNA, 15 bp, Homo sapiens
taggccaggcatgcc

SEQ ID NO: 55421 - DNA, 15 bp, Homo sapiens
aggccaggcatgcca

SEQ ID NO: 55422 - DNA, 15 bp, Homo sapiens
ggccaggcatgccat

SEQ ID NO: 55423 - DNA, 15 bp, Homo sapiens
gccaggcatgccatg

SEQ ID NO: 55424 - DNA, 15 bp, Homo sapiens
ccaggcatgccatgg

SEQ ID NO: 55425 - DNA, 15 bp, Homo sapiens
caggcatgccatggc

SEQ ID NO: 55426 - DNA, 15 bp, Homo sapiens
aggcatgccatggct

SEQ ID NO: 55427 - DNA, 15 bp, Homo sapiens
ggcatgccatggctc

SEQ ID NO: 55428 - DNA, 15 bp, Homo sapiens
gcatgccatggctca

SEQ ID NO: 55429 - DNA, 15 bp, Homo sapiens
catgccatggctcac

SEQ ID NO: 55430 - DNA, 15 bp, Homo sapiens
atgccatggctcacg

SEQ ID NO: 55431 - DNA, 15 bp, Homo sapiens
tgccatggctcacgc

SEQ ID NO: 55432 - DNA, 15 bp, Homo sapiens
gccatggctcacgcc

SEQ ID NO: 55433 - DNA, 15 bp, Homo sapiens
ccatggctcacgcct

SEQ ID NO: 55434 - DNA, 15 bp, Homo sapiens
catggctcacgcctg

SEQ ID NO: 55435 - DNA, 15 bp, Homo sapiens
atggctcacgcctgt

SEQ ID NO: 55436 - DNA, 15 bp, Homo sapiens
cactttgggaggcca

SEQ ID NO: 55437 - DNA, 15 bp, Homo sapiens
actttgggaggccaa

SEQ ID NO: 55438 - DNA, 15 bp, Homo sapiens
ctttgggaggccaag

SEQ ID NO: 55439 - DNA, 15 bp, Homo sapiens
tttgggaggccaagg

SEQ ID NO: 55440 - DNA, 15 bp, Homo sapiens
ttgggaggccaaggt

SEQ ID NO: 55441 - DNA, 15 bp, Homo sapiens
tgggaggccaaggtg

SEQ ID NO: 55442 - DNA, 15 bp, Homo sapiens
gggaggccaaggtgg

SEQ ID NO: 55443 - DNA, 15 bp, Homo sapiens
ggaggccaaggtggg

SEQ ID NO: 55444 - DNA, 15 bp, Homo sapiens
gaggccaaggtggga

SEQ ID NO: 55445 - DNA, 15 bp, Homo sapiens
aggccaaggtgggag

SEQ ID NO: 55446 - DNA, 15 bp, Homo sapiens
ggccaaggtgggagg

SEQ ID NO: 55447 - DNA, 15 bp, Homo sapiens
gccaaggtgggagga

SEQ ID NO: 55448 - DNA, 15 bp, Homo sapiens
ccaaggtgggaggat

SEQ ID NO: 55449 - DNA, 15 bp, Homo sapiens
caaggtgggaggatc

SEQ ID NO: 55450 - DNA, 15 bp, Homo sapiens
aaggtgggaggatct

SEQ ID NO: 55451 - DNA, 15 bp, Homo sapiens
aggtgggaggatctt

SEQ ID NO: 55452 - DNA, 15 bp, Homo sapiens
ggtgggaggatcttt

SEQ ID NO: 55453 - DNA, 15 bp, Homo sapiens
gtgggaggatctttt

SEQ ID NO: 55454 - DNA, 15 bp, Homo sapiens
tgggaggatcttttg

SEQ ID NO: 55455 - DNA, 15 bp, Homo sapiens
gggaggatcttttga

SEQ ID NO: 55456 - DNA, 15 bp, Homo sapiens
ggaggatcttttgag

SEQ ID NO: 55457 - DNA, 15 bp, Homo sapiens
gaggatcttttgagc

SEQ ID NO: 55458 - DNA, 15 bp, Homo sapiens
aggatcttttgagcc

SEQ ID NO: 55459 - DNA, 15 bp, Homo sapiens
ggatcttttgagccc

SEQ ID NO: 55460 - DNA, 15 bp, Homo sapiens
gatcttttgagccca

SEQ ID NO: 55461 - DNA, 15 bp, Homo sapiens
atcttttgagcccag

SEQ ID NO: 55462 - DNA, 15 bp, Homo sapiens
tcttttgagcccagg

SEQ ID NO: 55463 - DNA, 15 bp, Homo sapiens
cttttgagcccagga

SEQ ID NO: 55464 - DNA, 15 bp, Homo sapiens
ttttgagcccaggag

SEQ ID NO: 55465 - DNA, 15 bp, Homo sapiens
tttgagcccaggagt

SEQ ID NO: 55466 - DNA, 15 bp, Homo sapiens
ttgagcccaggagtt

SEQ ID NO: 55467 - DNA, 15 bp, Homo sapiens
tgagcccaggagttc

SEQ ID NO: 55468 - DNA, 15 bp, Homo sapiens
gagcccaggagttca

SEQ ID NO: 55469 - DNA, 15 bp, Homo sapiens
agcccaggagttcaa

SEQ ID NO: 55470 - DNA, 15 bp, Homo sapiens
gcccaggagttcaag

SEQ ID NO: 55471 - DNA, 15 bp, Homo sapiens
cccaggagttcaaga

SEQ ID NO: 55472 - DNA, 15 bp, Homo sapiens
ccaggagttcaagac

SEQ ID NO: 55473 - DNA, 15 bp, Homo sapiens
tcaagaccagcctga

SEQ ID NO: 55474 - DNA, 15 bp, Homo sapiens
caagaccagcctgag

SEQ ID NO: 55475 - DNA, 15 bp, Homo sapiens
aagaccagcctgagc

SEQ ID NO: 55476 - DNA, 15 bp, Homo sapiens
agaccagcctgagca

SEQ ID NO: 55477 - DNA, 15 bp, Homo sapiens
gaccagcctgagcaa

SEQ ID NO: 55478 - DNA, 15 bp, Homo sapiens
accagcctgagcaac

SEQ ID NO: 55479 - DNA, 15 bp, Homo sapiens
cagcctgagcaacat

SEQ ID NO: 55480 - DNA, 15 bp, Homo sapiens
agcctgagcaacata

SEQ ID NO: 55481 - DNA, 15 bp, Homo sapiens
gcctgagcaacatat

SEQ ID NO: 55482 - DNA, 15 bp, Homo sapiens
cctgagcaacatatt

SEQ ID NO: 55483 - DNA, 15 bp, Homo sapiens
ctgagcaacatattg

SEQ ID NO: 55484 - DNA, 15 bp, Homo sapiens
tgagcaacatattga

SEQ ID NO: 55485 - DNA, 15 bp, Homo sapiens
gagcaacatattgag

SEQ ID NO: 55486 - DNA, 15 bp, Homo sapiens
agcaacatattgaga

SEQ ID NO: 55487 - DNA, 15 bp, Homo sapiens
gcaacatattgagac

SEQ ID NO: 55488 - DNA, 15 bp, Homo sapiens
caacatattgagacc

SEQ ID NO: 55489 - DNA, 15 bp, Homo sapiens
aacatattgagaccc

SEQ ID NO: 55490 - DNA, 15 bp, Homo sapiens
acatattgagaccct

SEQ ID NO: 55491 - DNA, 15 bp, Homo sapiens
catattgagacccta

SEQ ID NO: 55492 - DNA, 15 bp, Homo sapiens
atattgagaccctat

SEQ ID NO: 55493 - DNA, 15 bp, Homo sapiens
tattgagaccctatc

SEQ ID NO: 55494 - DNA, 15 bp, Homo sapiens
attgagaccctatct

SEQ ID NO: 55495 - DNA, 15 bp, Homo sapiens
ttgagaccctatctc

SEQ ID NO: 55496 - DNA, 15 bp, Homo sapiens
tgagaccctatctct

SEQ ID NO: 55497 - DNA, 15 bp, Homo sapiens
gagaccctatctcta

SEQ ID NO: 55498 - DNA, 15 bp, Homo sapiens
agaccctatctctac

SEQ ID NO: 55499 - DNA, 15 bp, Homo sapiens
gaccctatctctaca

SEQ ID NO: 55500 - DNA, 15 bp, Homo sapiens
accctatctctacaa

SEQ ID NO: 55501 - DNA, 15 bp, Homo sapiens
ccctatctctacaaa

SEQ ID NO: 55502 - DNA, 15 bp, Homo sapiens
cctatctctacaaaa

SEQ ID NO: 55503 - DNA, 15 bp, Homo sapiens
ctatctctacaaaaa

SEQ ID NO: 55504 - DNA, 15 bp, Homo sapiens
tatctctacaaaaat

SEQ ID NO: 55505 - DNA, 15 bp, Homo sapiens
atctctacaaaaata

SEQ ID NO: 55506 - DNA, 15 bp, Homo sapiens
tctctacaaaaatat

SEQ ID NO: 55507 - DNA, 15 bp, Homo sapiens
ctctacaaaaatatc

SEQ ID NO: 55508 - DNA, 15 bp, Homo sapiens
tctacaaaaatatca

SEQ ID NO: 55509 - DNA, 15 bp, Homo sapiens
ctacaaaaatatcat

SEQ ID NO: 55510 - DNA, 15 bp, Homo sapiens
tacaaaaatatcata

SEQ ID NO: 55511 - DNA, 15 bp, Homo sapiens
acaaaaatatcataa

SEQ ID NO: 55512 - DNA, 15 bp, Homo sapiens
caaaaatatcataaa

SEQ ID NO: 55513 - DNA, 15 bp, Homo sapiens
aaaaatatcataaaa

SEQ ID NO: 55514 - DNA, 15 bp, Homo sapiens
aaaatatcataaaac

SEQ ID NO: 55515 - DNA, 15 bp, Homo sapiens
aaatatcataaaaca

SEQ ID NO: 55516 - DNA, 15 bp, Homo sapiens
aatatcataaaacaa

SEQ ID NO: 55517 - DNA, 15 bp, Homo sapiens
atatcataaaacaaa

SEQ ID NO: 55518 - DNA, 15 bp, Homo sapiens
tatcataaaacaaaa

SEQ ID NO: 55519 - DNA, 15 bp, Homo sapiens
atcataaaacaaaat

SEQ ID NO: 55520 - DNA, 15 bp, Homo sapiens
tcataaaacaaaata

SEQ ID NO: 55521 - DNA, 15 bp, Homo sapiens
cataaaacaaaatag

SEQ ID NO: 55522 - DNA, 15 bp, Homo sapiens
ataaaacaaaataga

SEQ ID NO: 55523 - DNA, 15 bp, Homo sapiens
taaaacaaaatagaa

SEQ ID NO: 55524 - DNA, 15 bp, Homo sapiens
aaaacaaaatagaat

SEQ ID NO: 55525 - DNA, 15 bp, Homo sapiens
aaacaaaatagaatc

SEQ ID NO: 55526 - DNA, 15 bp, Homo sapiens
aacaaaatagaatca

SEQ ID NO: 55527 - DNA, 15 bp, Homo sapiens
acaaaatagaatcac

SEQ ID NO: 55528 - DNA, 15 bp, Homo sapiens
caaaatagaatcact

SEQ ID NO: 55529 - DNA, 15 bp, Homo sapiens
aaaatagaatcactc

SEQ ID NO: 55530 - DNA, 15 bp, Homo sapiens
aaatagaatcactct

SEQ ID NO: 55531 - DNA, 15 bp, Homo sapiens
aatagaatcactctg

SEQ ID NO: 55532 - DNA, 15 bp, Homo sapiens
atagaatcactctgg

SEQ ID NO: 55533 - DNA, 15 bp, Homo sapiens
tagaatcactctggc

SEQ ID NO: 55534 - DNA, 15 bp, Homo sapiens
agaatcactctggcg

SEQ ID NO: 55535 - DNA, 15 bp, Homo sapiens
gaatcactctggcga

SEQ ID NO: 55536 - DNA, 15 bp, Homo sapiens
aatcactctggcgat

SEQ ID NO: 55537 - DNA, 15 bp, Homo sapiens
atcactctggcgatt

SEQ ID NO: 55538 - DNA, 15 bp, Homo sapiens
tcactctggcgattc

SEQ ID NO: 55539 - DNA, 15 bp, Homo sapiens
cactctggcgattcc

SEQ ID NO: 55540 - DNA, 15 bp, Homo sapiens
actctggcgattcca

SEQ ID NO: 55541 - DNA, 15 bp, Homo sapiens
ctctggcgattccac

SEQ ID NO: 55542 - DNA, 15 bp, Homo sapiens
tctggcgattccact

SEQ ID NO: 55543 - DNA, 15 bp, Homo sapiens
ctggcgattccacta

SEQ ID NO: 55544 - DNA, 15 bp, Homo sapiens
tggcgattccactat

SEQ ID NO: 55545 - DNA, 15 bp, Homo sapiens
ggcgattccactatc

SEQ ID NO: 55546 - DNA, 15 bp, Homo sapiens
gcgattccactatcc

SEQ ID NO: 55547 - DNA, 15 bp, Homo sapiens
cgattccactatcca

SEQ ID NO: 55548 - DNA, 15 bp, Homo sapiens
gattccactatccaa

SEQ ID NO: 55549 - DNA, 15 bp, Homo sapiens
attccactatccaaa

SEQ ID NO: 55550 - DNA, 15 bp, Homo sapiens
ttccactatccaaaa

SEQ ID NO: 55551 - DNA, 15 bp, Homo sapiens
tccactatccaaaaa

SEQ ID NO: 55552 - DNA, 15 bp, Homo sapiens
ccactatccaaaaaa

SEQ ID NO: 55553 - DNA, 15 bp, Homo sapiens
cactatccaaaaaaa

SEQ ID NO: 55554 - DNA, 15 bp, Homo sapiens
actatccaaaaaaaa

SEQ ID NO: 55555 - DNA, 15 bp, Homo sapiens
ctatccaaaaaaaaa

SEQ ID NO: 55556 - DNA, 15 bp, Homo sapiens
tatccaaaaaaaaaa

SEQ ID NO: 55557 - DNA, 15 bp, Homo sapiens
atccaaaaaaaaaaa

SEQ ID NO: 55558 - DNA, 15 bp, Homo sapiens
tccaaaaaaaaaaaa

SEQ ID NO: 55559 - DNA, 15 bp, Homo sapiens
ccaaaaaaaaaaaaa

SEQ ID NO: 55560 - DNA, 15 bp, Homo sapiens
aaaaaaaaaaaaact

SEQ ID NO: 55561 - DNA, 15 bp, Homo sapiens
aaaaaaaaaaaactg

SEQ ID NO: 55562 - DNA, 15 bp, Homo sapiens
aaaaaaaaaaactgc

SEQ ID NO: 55563 - DNA, 15 bp, Homo sapiens
aaaaaaaaaactgct

SEQ ID NO: 55564 - DNA, 15 bp, Homo sapiens
aaaaaaaaactgctg

SEQ ID NO: 55565 - DNA, 15 bp, Homo sapiens
aaaaaaaactgctgt

SEQ ID NO: 55566 - DNA, 15 bp, Homo sapiens
aaaaaaactgctgtt

SEQ ID NO: 55567 - DNA, 15 bp, Homo sapiens
aaaaaactgctgtta

SEQ ID NO: 55568 - DNA, 15 bp, Homo sapiens
aaaaactgctgttaa

SEQ ID NO: 55569 - DNA, 15 bp, Homo sapiens
aaaactgctgttaat

SEQ ID NO: 55570 - DNA, 15 bp, Homo sapiens
aaactgctgttaata

SEQ ID NO: 55571 - DNA, 15 bp, Homo sapiens
aactgctgttaatat

SEQ ID NO: 55572 - DNA, 15 bp, Homo sapiens
actgctgttaatatt

SEQ ID NO: 55573 - DNA, 15 bp, Homo sapiens
ctgctgttaatattt

SEQ ID NO: 55574 - DNA, 15 bp, Homo sapiens
tgctgttaatatttg

SEQ ID NO: 55575 - DNA, 15 bp, Homo sapiens
gctgttaatatttgg

SEQ ID NO: 55576 - DNA, 15 bp, Homo sapiens
ctgttaatatttggt

SEQ ID NO: 55577 - DNA, 15 bp, Homo sapiens
tgttaatatttggta

SEQ ID NO: 55578 - DNA, 15 bp, Homo sapiens
gttaatatttggtat

SEQ ID NO: 55579 - DNA, 15 bp, Homo sapiens
ttaatatttggtatg

SEQ ID NO: 55580 - DNA, 15 bp, Homo sapiens
taatatttggtatgt

SEQ ID NO: 55581 - DNA, 15 bp, Homo sapiens
aatatttggtatgta

SEQ ID NO: 55582 - DNA, 15 bp, Homo sapiens
atatttggtatgtat

SEQ ID NO: 55583 - DNA, 15 bp, Homo sapiens
tatttggtatgtatc

SEQ ID NO: 55584 - DNA, 15 bp, Homo sapiens
atttggtatgtatct

SEQ ID NO: 55585 - DNA, 15 bp, Homo sapiens
tttggtatgtatctt

SEQ ID NO: 55586 - DNA, 15 bp, Homo sapiens
ttggtatgtatcttt

SEQ ID NO: 55587 - DNA, 15 bp, Homo sapiens
tggtatgtatctttc

SEQ ID NO: 55588 - DNA, 15 bp, Homo sapiens
ggtatgtatctttct

SEQ ID NO: 55589 - DNA, 15 bp, Homo sapiens
gtatgtatctttcta

SEQ ID NO: 55590 - DNA, 15 bp, Homo sapiens
tatgtatctttctag

SEQ ID NO: 55591 - DNA, 15 bp, Homo sapiens
atgtatctttctaga

SEQ ID NO: 55592 - DNA, 15 bp, Homo sapiens
tgtatctttctagac

SEQ ID NO: 55593 - DNA, 15 bp, Homo sapiens
gtatctttctagacc

SEQ ID NO: 55594 - DNA, 15 bp, Homo sapiens
tatctttctagacca

SEQ ID NO: 55595 - DNA, 15 bp, Homo sapiens
atctttctagaccaa

SEQ ID NO: 55596 - DNA, 15 bp, Homo sapiens
tctttctagaccaag

SEQ ID NO: 55597 - DNA, 15 bp, Homo sapiens
ctttctagaccaagg

SEQ ID NO: 55598 - DNA, 15 bp, Homo sapiens
tttctagaccaaggc

SEQ ID NO: 55599 - DNA, 15 bp, Homo sapiens
ttctagaccaaggcc

SEQ ID NO: 55600 - DNA, 15 bp, Homo sapiens
tctagaccaaggcct

SEQ ID NO: 55601 - DNA, 15 bp, Homo sapiens
ctagaccaaggcctc

SEQ ID NO: 55602 - DNA, 15 bp, Homo sapiens
tagaccaaggcctcc

SEQ ID NO: 55603 - DNA, 15 bp, Homo sapiens
agaccaaggcctcca

SEQ ID NO: 55604 - DNA, 15 bp, Homo sapiens
gaccaaggcctccaa

SEQ ID NO: 55605 - DNA, 15 bp, Homo sapiens
accaaggcctccaac

SEQ ID NO: 55606 - DNA, 15 bp, Homo sapiens
ccaaggcctccaact

SEQ ID NO: 55607 - DNA, 15 bp, Homo sapiens
caaggcctccaactt

SEQ ID NO: 55608 - DNA, 15 bp, Homo sapiens
aaggcctccaacttt

SEQ ID NO: 55609 - DNA, 15 bp, Homo sapiens
aggcctccaactttg

SEQ ID NO: 55610 - DNA, 15 bp, Homo sapiens
ggcctccaactttgg

SEQ ID NO: 55611 - DNA, 15 bp, Homo sapiens
gcctccaactttggt

SEQ ID NO: 55612 - DNA, 15 bp, Homo sapiens
cctccaactttggtt

SEQ ID NO: 55613 - DNA, 15 bp, Homo sapiens
ctccaactttggttg

SEQ ID NO: 55614 - DNA, 15 bp, Homo sapiens
tccaactttggttga

SEQ ID NO: 55615 - DNA, 15 bp, Homo sapiens
ccaactttggttgag

SEQ ID NO: 55616 - DNA, 15 bp, Homo sapiens
caactttggttgaga

SEQ ID NO: 55617 - DNA, 15 bp, Homo sapiens
aactttggttgagaa

SEQ ID NO: 55618 - DNA, 15 bp, Homo sapiens
actttggttgagaat

SEQ ID NO: 55619 - DNA, 15 bp, Homo sapiens
ctttggttgagaatt

SEQ ID NO: 55620 - DNA, 15 bp, Homo sapiens
tttggttgagaattc

SEQ ID NO: 55621 - DNA, 15 bp, Homo sapiens
ttggttgagaattca

SEQ ID NO: 55622 - DNA, 15 bp, Homo sapiens
tggttgagaattcag

SEQ ID NO: 55623 - DNA, 15 bp, Homo sapiens
ggttgagaattcagc

SEQ ID NO: 55624 - DNA, 15 bp, Homo sapiens
gttgagaattcagcc

SEQ ID NO: 55625 - DNA, 15 bp, Homo sapiens
ttgagaattcagccg

SEQ ID NO: 55626 - DNA, 15 bp, Homo sapiens
tgagaattcagccgg

SEQ ID NO: 55627 - DNA, 15 bp, Homo sapiens
gagaattcagccggg

SEQ ID NO: 55628 - DNA, 15 bp, Homo sapiens
agaattcagccgggt

SEQ ID NO: 55629 - DNA, 15 bp, Homo sapiens
gaattcagccgggtc

SEQ ID NO: 55630 - DNA, 15 bp, Homo sapiens
aattcagccgggtct

SEQ ID NO: 55631 - DNA, 15 bp, Homo sapiens
attcagccgggtctg

SEQ ID NO: 55632 - DNA, 15 bp, Homo sapiens
ttcagccgggtctgt

SEQ ID NO: 55633 - DNA, 15 bp, Homo sapiens
tcagccgggtctgtg

SEQ ID NO: 55634 - DNA, 15 bp, Homo sapiens
cagccgggtctgtga

SEQ ID NO: 55635 - DNA, 15 bp, Homo sapiens
agccgggtctgtgac

SEQ ID NO: 55636 - DNA, 15 bp, Homo sapiens
gccgggtctgtgacc

SEQ ID NO: 55637 - DNA, 15 bp, Homo sapiens
ccgggtctgtgacct

SEQ ID NO: 55638 - DNA, 15 bp, Homo sapiens
cgggtctgtgacctt

SEQ ID NO: 55639 - DNA, 15 bp, Homo sapiens
gggtctgtgaccttg

SEQ ID NO: 55640 - DNA, 15 bp, Homo sapiens
ggtctgtgaccttgg

SEQ ID NO: 55641 - DNA, 15 bp, Homo sapiens
gtctgtgaccttgga

SEQ ID NO: 55642 - DNA, 15 bp, Homo sapiens
tctgtgaccttggat

SEQ ID NO: 55643 - DNA, 15 bp, Homo sapiens
ctgtgaccttggatg

SEQ ID NO: 55644 - DNA, 15 bp, Homo sapiens
tgtgaccttggatgg

SEQ ID NO: 55645 - DNA, 15 bp, Homo sapiens
gtgaccttggatggg

SEQ ID NO: 55646 - DNA, 15 bp, Homo sapiens
tgaccttggatggga

SEQ ID NO: 55647 - DNA, 15 bp, Homo sapiens
gaccttggatgggaa

SEQ ID NO: 55648 - DNA, 15 bp, Homo sapiens
accttggatgggaaa

SEQ ID NO: 55649 - DNA, 15 bp, Homo sapiens
ccttggatgggaaaa

SEQ ID NO: 55650 - DNA, 15 bp, Homo sapiens
cttggatgggaaaaa

SEQ ID NO: 55651 - DNA, 15 bp, Homo sapiens
ttggatgggaaaaac

SEQ ID NO: 55652 - DNA, 15 bp, Homo sapiens
tggatgggaaaaaca

SEQ ID NO: 55653 - DNA, 15 bp, Homo sapiens
ggatgggaaaaacat

SEQ ID NO: 55654 - DNA, 15 bp, Homo sapiens
gatgggaaaaacatt

SEQ ID NO: 55655 - DNA, 15 bp, Homo sapiens
atgggaaaaacattc

SEQ ID NO: 55656 - DNA, 15 bp, Homo sapiens
tgggaaaaacattca

SEQ ID NO: 55657 - DNA, 15 bp, Homo sapiens
gggaaaaacattcac

SEQ ID NO: 55658 - DNA, 15 bp, Homo sapiens
ggaaaaacattcact

SEQ ID NO: 55659 - DNA, 15 bp, Homo sapiens
gaaaaacattcactc

SEQ ID NO: 55660 - DNA, 15 bp, Homo sapiens
aaaaacattcactct

SEQ ID NO: 55661 - DNA, 15 bp, Homo sapiens
aaaacattcactctt

SEQ ID NO: 55662 - DNA, 15 bp, Homo sapiens
aaacattcactcttt

SEQ ID NO: 55663 - DNA, 15 bp, Homo sapiens
aacattcactcttta

SEQ ID NO: 55664 - DNA, 15 bp, Homo sapiens
acattcactctttat

SEQ ID NO: 55665 - DNA, 15 bp, Homo sapiens
cattcactctttatt

SEQ ID NO: 55666 - DNA, 15 bp, Homo sapiens
attcactctttattt

SEQ ID NO: 55667 - DNA, 15 bp, Homo sapiens
ttcactctttatttt

SEQ ID NO: 55668 - DNA, 15 bp, Homo sapiens
tcactctttattttc

SEQ ID NO: 55669 - DNA, 15 bp, Homo sapiens
cactctttattttca

SEQ ID NO: 55670 - DNA, 15 bp, Homo sapiens
actctttattttcac

SEQ ID NO: 55671 - DNA, 15 bp, Homo sapiens
ctctttattttcact

SEQ ID NO: 55672 - DNA, 15 bp, Homo sapiens
tctttattttcacta

SEQ ID NO: 55673 - DNA, 15 bp, Homo sapiens
ctttattttcactaa

SEQ ID NO: 55674 - DNA, 15 bp, Homo sapiens
tttattttcactaat

SEQ ID NO: 55675 - DNA, 15 bp, Homo sapiens
ttattttcactaatg

SEQ ID NO: 55676 - DNA, 15 bp, Homo sapiens
tattttcactaatgt

SEQ ID NO: 55677 - DNA, 15 bp, Homo sapiens
attttcactaatgtc

SEQ ID NO: 55678 - DNA, 15 bp, Homo sapiens
ttttcactaatgtct

SEQ ID NO: 55679 - DNA, 15 bp, Homo sapiens
tttcactaatgtctc

SEQ ID NO: 55680 - DNA, 15 bp, Homo sapiens
ttcactaatgtctct

SEQ ID NO: 55681 - DNA, 15 bp, Homo sapiens
tcactaatgtctctg

SEQ ID NO: 55682 - DNA, 15 bp, Homo sapiens
cactaatgtctctga

SEQ ID NO: 55683 - DNA, 15 bp, Homo sapiens
actaatgtctctgaa

SEQ ID NO: 55684 - DNA, 15 bp, Homo sapiens
ctaatgtctctgaaa

SEQ ID NO: 55685 - DNA, 15 bp, Homo sapiens
taatgtctctgaaaa

SEQ ID NO: 55686 - DNA, 15 bp, Homo sapiens
aatgtctctgaaaac

SEQ ID NO: 55687 - DNA, 15 bp, Homo sapiens
atgtctctgaaaacc

SEQ ID NO: 55688 - DNA, 15 bp, Homo sapiens
tgtctctgaaaaccc

SEQ ID NO: 55689 - DNA, 15 bp, Homo sapiens
gtctctgaaaaccca

SEQ ID NO: 55690 - DNA, 15 bp, Homo sapiens
tctctgaaaacccag

SEQ ID NO: 55691 - DNA, 15 bp, Homo sapiens
ctctgaaaacccaga

SEQ ID NO: 55692 - DNA, 15 bp, Homo sapiens
tctgaaaacccagat

SEQ ID NO: 55693 - DNA, 15 bp, Homo sapiens
ctgaaaacccagatt

SEQ ID NO: 55694 - DNA, 15 bp, Homo sapiens
tgaaaacccagattt

SEQ ID NO: 55695 - DNA, 15 bp, Homo sapiens
gaaaacccagatttt

SEQ ID NO: 55696 - DNA, 15 bp, Homo sapiens
aaaacccagattttt

SEQ ID NO: 55697 - DNA, 15 bp, Homo sapiens
aaacccagattttta

SEQ ID NO: 55698 - DNA, 15 bp, Homo sapiens
aacccagatttttag

SEQ ID NO: 55699 - DNA, 15 bp, Homo sapiens
acccagatttttagc

SEQ ID NO: 55700 - DNA, 15 bp, Homo sapiens
cccagatttttagct

SEQ ID NO: 55701 - DNA, 15 bp, Homo sapiens
ccagatttttagctg

SEQ ID NO: 55702 - DNA, 15 bp, Homo sapiens
cagatttttagctgg

SEQ ID NO: 55703 - DNA, 15 bp, Homo sapiens
agatttttagctggg

SEQ ID NO: 55704 - DNA, 15 bp, Homo sapiens
gatttttagctgggc

SEQ ID NO: 55705 - DNA, 15 bp, Homo sapiens
atttttagctgggca

SEQ ID NO: 55706 - DNA, 15 bp, Homo sapiens
tttttagctgggcat

SEQ ID NO: 55707 - DNA, 15 bp, Homo sapiens
ttttagctgggcatg

SEQ ID NO: 55708 - DNA, 15 bp, Homo sapiens
tttagctgggcatgg

SEQ ID NO: 55709 - DNA, 15 bp, Homo sapiens
gggcatggtggctcg

SEQ ID NO: 55710 - DNA, 15 bp, Homo sapiens
ggcatggtggctcgt

SEQ ID NO: 55711 - DNA, 15 bp, Homo sapiens
gcatggtggctcgtg

SEQ ID NO: 55712 - DNA, 15 bp, Homo sapiens
catggtggctcgtgc

SEQ ID NO: 55713 - DNA, 15 bp, Homo sapiens
atggtggctcgtgcc

SEQ ID NO: 55714 - DNA, 15 bp, Homo sapiens
tggtggctcgtgcct

SEQ ID NO: 55715 - DNA, 15 bp, Homo sapiens
ggtggctcgtgcctg

SEQ ID NO: 55716 - DNA, 15 bp, Homo sapiens
gtggctcgtgcctgt

SEQ ID NO: 55717 - DNA, 15 bp, Homo sapiens
tggctcgtgcctgta

SEQ ID NO: 55718 - DNA, 15 bp, Homo sapiens
ggctcgtgcctgtaa

SEQ ID NO: 55719 - DNA, 15 bp, Homo sapiens
gctcgtgcctgtaat

SEQ ID NO: 55720 - DNA, 15 bp, Homo sapiens
ctcgtgcctgtaatc

SEQ ID NO: 55721 - DNA, 15 bp, Homo sapiens
tcgtgcctgtaatcc

SEQ ID NO: 55722 - DNA, 15 bp, Homo sapiens
cgtgcctgtaatccc

SEQ ID NO: 55723 - DNA, 15 bp, Homo sapiens
gtgcctgtaatccca

SEQ ID NO: 55724 - DNA, 15 bp, Homo sapiens
gcctgtaatcccagt

SEQ ID NO: 55725 - DNA, 15 bp, Homo sapiens
cctgtaatcccagtg

SEQ ID NO: 55726 - DNA, 15 bp, Homo sapiens
ctgtaatcccagtgc

SEQ ID NO: 55727 - DNA, 15 bp, Homo sapiens
tgtaatcccagtgct

SEQ ID NO: 55728 - DNA, 15 bp, Homo sapiens
gtaatcccagtgctt

SEQ ID NO: 55729 - DNA, 15 bp, Homo sapiens
taatcccagtgcttt

SEQ ID NO: 55730 - DNA, 15 bp, Homo sapiens
aatcccagtgctttg

SEQ ID NO: 55731 - DNA, 15 bp, Homo sapiens
atcccagtgctttgg

SEQ ID NO: 55732 - DNA, 15 bp, Homo sapiens
tcccagtgctttgga

SEQ ID NO: 55733 - DNA, 15 bp, Homo sapiens
cccagtgctttggaa

SEQ ID NO: 55734 - DNA, 15 bp, Homo sapiens
ccagtgctttggaag

SEQ ID NO: 55735 - DNA, 15 bp, Homo sapiens
cagtgctttggaagc

SEQ ID NO: 55736 - DNA, 15 bp, Homo sapiens
agtgctttggaagcc

SEQ ID NO: 55737 - DNA, 15 bp, Homo sapiens
gtgctttggaagccc

SEQ ID NO: 55738 - DNA, 15 bp, Homo sapiens
tgctttggaagcccg

SEQ ID NO: 55739 - DNA, 15 bp, Homo sapiens
gctttggaagcccgt

SEQ ID NO: 55740 - DNA, 15 bp, Homo sapiens
ctttggaagcccgtg

SEQ ID NO: 55741 - DNA, 15 bp, Homo sapiens
tttggaagcccgtgg

SEQ ID NO: 55742 - DNA, 15 bp, Homo sapiens
ttggaagcccgtgga

SEQ ID NO: 55743 - DNA, 15 bp, Homo sapiens
tggaagcccgtggag

SEQ ID NO: 55744 - DNA, 15 bp, Homo sapiens
ggaagcccgtggagg

SEQ ID NO: 55745 - DNA, 15 bp, Homo sapiens
gaagcccgtggaggg

SEQ ID NO: 55746 - DNA, 15 bp, Homo sapiens
aagcccgtggagggc

SEQ ID NO: 55747 - DNA, 15 bp, Homo sapiens
agcccgtggagggca

SEQ ID NO: 55748 - DNA, 15 bp, Homo sapiens
gcccgtggagggcag

SEQ ID NO: 55749 - DNA, 15 bp, Homo sapiens
cccgtggagggcaga

SEQ ID NO: 55750 - DNA, 15 bp, Homo sapiens
ccgtggagggcagat

SEQ ID NO: 55751 - DNA, 15 bp, Homo sapiens
cgtggagggcagatc

SEQ ID NO: 55752 - DNA, 15 bp, Homo sapiens
gtggagggcagatca

SEQ ID NO: 55753 - DNA, 15 bp, Homo sapiens
tggagggcagatcac

SEQ ID NO: 55754 - DNA, 15 bp, Homo sapiens
ggagggcagatcact

SEQ ID NO: 55755 - DNA, 15 bp, Homo sapiens
gagggcagatcactt

SEQ ID NO: 55756 - DNA, 15 bp, Homo sapiens
agggcagatcacttg

SEQ ID NO: 55757 - DNA, 15 bp, Homo sapiens
gggcagatcacttga

SEQ ID NO: 55758 - DNA, 15 bp, Homo sapiens
ggcagatcacttgag

SEQ ID NO: 55759 - DNA, 15 bp, Homo sapiens
gcagatcacttgagc

SEQ ID NO: 55760 - DNA, 15 bp, Homo sapiens
cagatcacttgagcc

SEQ ID NO: 55761 - DNA, 15 bp, Homo sapiens
agatcacttgagccc

SEQ ID NO: 55762 - DNA, 15 bp, Homo sapiens
gatcacttgagccca

SEQ ID NO: 55763 - DNA, 15 bp, Homo sapiens
atcacttgagcccag

SEQ ID NO: 55764 - DNA, 15 bp, Homo sapiens
tcacttgagcccagg

SEQ ID NO: 55765 - DNA, 15 bp, Homo sapiens
cacttgagcccagga

SEQ ID NO: 55766 - DNA, 15 bp, Homo sapiens
acttgagcccaggag

SEQ ID NO: 55767 - DNA, 15 bp, Homo sapiens
cttgagcccaggagt

SEQ ID NO: 55768 - DNA, 15 bp, Homo sapiens
gagcccaggagtttg

SEQ ID NO: 55769 - DNA, 15 bp, Homo sapiens
agcccaggagtttga

SEQ ID NO: 55770 - DNA, 15 bp, Homo sapiens
gcccaggagtttgag

SEQ ID NO: 55771 - DNA, 15 bp, Homo sapiens
cccaggagtttgaga

SEQ ID NO: 55772 - DNA, 15 bp, Homo sapiens
ccaggagtttgagac

SEQ ID NO: 55773 - DNA, 15 bp, Homo sapiens
cccccagtctgtact

SEQ ID NO: 55774 - DNA, 15 bp, Homo sapiens
ccccagtctgtacta

SEQ ID NO: 55775 - DNA, 15 bp, Homo sapiens
cccagtctgtactat

SEQ ID NO: 55776 - DNA, 15 bp, Homo sapiens
ccagtctgtactatt

SEQ ID NO: 55777 - DNA, 15 bp, Homo sapiens
cagtctgtactattt

SEQ ID NO: 55778 - DNA, 15 bp, Homo sapiens
agtctgtactatttt

SEQ ID NO: 55779 - DNA, 15 bp, Homo sapiens
gtctgtactattttg

SEQ ID NO: 55780 - DNA, 15 bp, Homo sapiens
tctgtactattttgt

SEQ ID NO: 55781 - DNA, 15 bp, Homo sapiens
ctgtactattttgtt

SEQ ID NO: 55782 - DNA, 15 bp, Homo sapiens
tgtactattttgtta

SEQ ID NO: 55783 - DNA, 15 bp, Homo sapiens
gtactattttgttat

SEQ ID NO: 55784 - DNA, 15 bp, Homo sapiens
tactattttgttata

SEQ ID NO: 55785 - DNA, 15 bp, Homo sapiens
actattttgttatag

SEQ ID NO: 55786 - DNA, 15 bp, Homo sapiens
ctattttgttatagc

SEQ ID NO: 55787 - DNA, 15 bp, Homo sapiens
tattttgttatagct

SEQ ID NO: 55788 - DNA, 15 bp, Homo sapiens
attttgttatagctt

SEQ ID NO: 55789 - DNA, 15 bp, Homo sapiens
ttttgttatagcttg

SEQ ID NO: 55790 - DNA, 15 bp, Homo sapiens
tttgttatagcttga

SEQ ID NO: 55791 - DNA, 15 bp, Homo sapiens
ttgttatagcttgag

SEQ ID NO: 55792 - DNA, 15 bp, Homo sapiens
tgttatagcttgagc

SEQ ID NO: 55793 - DNA, 15 bp, Homo sapiens
gttatagcttgagca

SEQ ID NO: 55794 - DNA, 15 bp, Homo sapiens
ttatagcttgagcag

SEQ ID NO: 55795 - DNA, 15 bp, Homo sapiens
tatagcttgagcaga

SEQ ID NO: 55796 - DNA, 15 bp, Homo sapiens
atagcttgagcagac

SEQ ID NO: 55797 - DNA, 15 bp, Homo sapiens
tagcttgagcagact

SEQ ID NO: 55798 - DNA, 15 bp, Homo sapiens
agcttgagcagacta

SEQ ID NO: 55799 - DNA, 15 bp, Homo sapiens
gcttgagcagactaa

SEQ ID NO: 55800 - DNA, 15 bp, Homo sapiens
cttgagcagactaat

SEQ ID NO: 55801 - DNA, 15 bp, Homo sapiens
ttgagcagactaata

SEQ ID NO: 55802 - DNA, 15 bp, Homo sapiens
tgagcagactaatac

SEQ ID NO: 55803 - DNA, 15 bp, Homo sapiens
gagcagactaataca

SEQ ID NO: 55804 - DNA, 15 bp, Homo sapiens
agcagactaatacac

SEQ ID NO: 55805 - DNA, 15 bp, Homo sapiens
gcagactaatacacc

SEQ ID NO: 55806 - DNA, 15 bp, Homo sapiens
cagactaatacaccc

SEQ ID NO: 55807 - DNA, 15 bp, Homo sapiens
agactaatacaccca

SEQ ID NO: 55808 - DNA, 15 bp, Homo sapiens
gactaatacacccat

SEQ ID NO: 55809 - DNA, 15 bp, Homo sapiens
actaatacacccatg

SEQ ID NO: 55810 - DNA, 15 bp, Homo sapiens
ctaatacacccatgt

SEQ ID NO: 55811 - DNA, 15 bp, Homo sapiens
taatacacccatgtt

SEQ ID NO: 55812 - DNA, 15 bp, Homo sapiens
aatacacccatgtta

SEQ ID NO: 55813 - DNA, 15 bp, Homo sapiens
atacacccatgttat

SEQ ID NO: 55814 - DNA, 15 bp, Homo sapiens
tacacccatgttatg

SEQ ID NO: 55815 - DNA, 15 bp, Homo sapiens
acacccatgttatga

SEQ ID NO: 55816 - DNA, 15 bp, Homo sapiens
cacccatgttatgaa

SEQ ID NO: 55817 - DNA, 15 bp, Homo sapiens
acccatgttatgaaa

SEQ ID NO: 55818 - DNA, 15 bp, Homo sapiens
cccatgttatgaaaa

SEQ ID NO: 55819 - DNA, 15 bp, Homo sapiens
ccatgttatgaaaag

SEQ ID NO: 55820 - DNA, 15 bp, Homo sapiens
catgttatgaaaagc

SEQ ID NO: 55821 - DNA, 15 bp, Homo sapiens
atgttatgaaaagct

SEQ ID NO: 55822 - DNA, 15 bp, Homo sapiens
tgttatgaaaagcta

SEQ ID NO: 55823 - DNA, 15 bp, Homo sapiens
gttatgaaaagctat

SEQ ID NO: 55824 - DNA, 15 bp, Homo sapiens
ttatgaaaagctata

SEQ ID NO: 55825 - DNA, 15 bp, Homo sapiens
tatgaaaagctataa

SEQ ID NO: 55826 - DNA, 15 bp, Homo sapiens
atgaaaagctataaa

SEQ ID NO: 55827 - DNA, 15 bp, Homo sapiens
tgaaaagctataaac

SEQ ID NO: 55828 - DNA, 15 bp, Homo sapiens
gaaaagctataaaca

SEQ ID NO: 55829 - DNA, 15 bp, Homo sapiens
aaaagctataaacat

SEQ ID NO: 55830 - DNA, 15 bp, Homo sapiens
aaagctataaacatc

SEQ ID NO: 55831 - DNA, 15 bp, Homo sapiens
aagctataaacatcc

SEQ ID NO: 55832 - DNA, 15 bp, Homo sapiens
agctataaacatccc

SEQ ID NO: 55833 - DNA, 15 bp, Homo sapiens
gctataaacatccct

SEQ ID NO: 55834 - DNA, 15 bp, Homo sapiens
ctataaacatccctt

SEQ ID NO: 55835 - DNA, 15 bp, Homo sapiens
tataaacatcccttt

SEQ ID NO: 55836 - DNA, 15 bp, Homo sapiens
ataaacatcccttta

SEQ ID NO: 55837 - DNA, 15 bp, Homo sapiens
taaacatccctttaa

SEQ ID NO: 55838 - DNA, 15 bp, Homo sapiens
aaacatccctttaaa

SEQ ID NO: 55839 - DNA, 15 bp, Homo sapiens
aacatccctttaaag

SEQ ID NO: 55840 - DNA, 15 bp, Homo sapiens
acatccctttaaagg

SEQ ID NO: 55841 - DNA, 15 bp, Homo sapiens
catccctttaaaggc

SEQ ID NO: 55842 - DNA, 15 bp, Homo sapiens
atccctttaaaggcc

SEQ ID NO: 55843 - DNA, 15 bp, Homo sapiens
tccctttaaaggcca

SEQ ID NO: 55844 - DNA, 15 bp, Homo sapiens
ccctttaaaggccac

SEQ ID NO: 55845 - DNA, 15 bp, Homo sapiens
cctttaaaggccacc

SEQ ID NO: 55846 - DNA, 15 bp, Homo sapiens
ctttaaaggccacct

SEQ ID NO: 55847 - DNA, 15 bp, Homo sapiens
tttaaaggccaccta

SEQ ID NO: 55848 - DNA, 15 bp, Homo sapiens
ttaaaggccacctaa

SEQ ID NO: 55849 - DNA, 15 bp, Homo sapiens
taaaggccacctaac

SEQ ID NO: 55850 - DNA, 15 bp, Homo sapiens
aaaggccacctaacg

SEQ ID NO: 55851 - DNA, 15 bp, Homo sapiens
aaggccacctaacgc

SEQ ID NO: 55852 - DNA, 15 bp, Homo sapiens
aggccacctaacgcg

SEQ ID NO: 55853 - DNA, 15 bp, Homo sapiens
ggccacctaacgcgt

SEQ ID NO: 55854 - DNA, 15 bp, Homo sapiens
gccacctaacgcgtc

SEQ ID NO: 55855 - DNA, 15 bp, Homo sapiens
ccacctaacgcgtcg

SEQ ID NO: 55856 - DNA, 15 bp, Homo sapiens
cacctaacgcgtcgt

SEQ ID NO: 55857 - DNA, 15 bp, Homo sapiens
acctaacgcgtcgta

SEQ ID NO: 55858 - DNA, 15 bp, Homo sapiens
cctaacgcgtcgtat

SEQ ID NO: 55859 - DNA, 15 bp, Homo sapiens
ctaacgcgtcgtatt

SEQ ID NO: 55860 - DNA, 15 bp, Homo sapiens
taacgcgtcgtatta

SEQ ID NO: 55861 - DNA, 15 bp, Homo sapiens
aacgcgtcgtattac

SEQ ID NO: 55862 - DNA, 15 bp, Homo sapiens
acgcgtcgtattacc

SEQ ID NO: 55863 - DNA, 15 bp, Homo sapiens
cgcgtcgtattacct

SEQ ID NO: 55864 - DNA, 15 bp, Homo sapiens
gcgtcgtattacctc

SEQ ID NO: 55865 - DNA, 15 bp, Homo sapiens
cgtcgtattacctca

SEQ ID NO: 55866 - DNA, 15 bp, Homo sapiens
gtcgtattacctcat

SEQ ID NO: 55867 - DNA, 15 bp, Homo sapiens
tcgtattacctcatg

SEQ ID NO: 55868 - DNA, 15 bp, Homo sapiens
cgtattacctcatgc

SEQ ID NO: 55869 - DNA, 15 bp, Homo sapiens
gtattacctcatgca

SEQ ID NO: 55870 - DNA, 15 bp, Homo sapiens
tattacctcatgcat

SEQ ID NO: 55871 - DNA, 15 bp, Homo sapiens
attacctcatgcatc

SEQ ID NO: 55872 - DNA, 15 bp, Homo sapiens
ttacctcatgcatct

SEQ ID NO: 55873 - DNA, 15 bp, Homo sapiens
tacctcatgcatctt

SEQ ID NO: 55874 - DNA, 15 bp, Homo sapiens
acctcatgcatcttc

SEQ ID NO: 55875 - DNA, 15 bp, Homo sapiens
cctcatgcatcttct

SEQ ID NO: 55876 - DNA, 15 bp, Homo sapiens
ctcatgcatcttctc

SEQ ID NO: 55877 - DNA, 15 bp, Homo sapiens
tcatgcatcttctct

SEQ ID NO: 55878 - DNA, 15 bp, Homo sapiens
catgcatcttctctg

SEQ ID NO: 55879 - DNA, 15 bp, Homo sapiens
atgcatcttctctgc

SEQ ID NO: 55880 - DNA, 15 bp, Homo sapiens
tgcatcttctctgct

SEQ ID NO: 55881 - DNA, 15 bp, Homo sapiens
gcatcttctctgctg

SEQ ID NO: 55882 - DNA, 15 bp, Homo sapiens
catcttctctgctga

SEQ ID NO: 55883 - DNA, 15 bp, Homo sapiens
atcttctctgctgag

SEQ ID NO: 55884 - DNA, 15 bp, Homo sapiens
tcttctctgctgagc

SEQ ID NO: 55885 - DNA, 15 bp, Homo sapiens
cttctctgctgagct

SEQ ID NO: 55886 - DNA, 15 bp, Homo sapiens
ttctctgctgagctt

SEQ ID NO: 55887 - DNA, 15 bp, Homo sapiens
tctctgctgagcttt

SEQ ID NO: 55888 - DNA, 15 bp, Homo sapiens
ctctgctgagctttc

SEQ ID NO: 55889 - DNA, 15 bp, Homo sapiens
tctgctgagctttcc

SEQ ID NO: 55890 - DNA, 15 bp, Homo sapiens
ctgctgagctttcca

SEQ ID NO: 55891 - DNA, 15 bp, Homo sapiens
tgctgagctttccaa

SEQ ID NO: 55892 - DNA, 15 bp, Homo sapiens
gctgagctttccaaa

SEQ ID NO: 55893 - DNA, 15 bp, Homo sapiens
ctgagctttccaaaa

SEQ ID NO: 55894 - DNA, 15 bp, Homo sapiens
tgagctttccaaaag

SEQ ID NO: 55895 - DNA, 15 bp, Homo sapiens
gagctttccaaaaga

SEQ ID NO: 55896 - DNA, 15 bp, Homo sapiens
agctttccaaaagag

SEQ ID NO: 55897 - DNA, 15 bp, Homo sapiens
gctttccaaaagagt

SEQ ID NO: 55898 - DNA, 15 bp, Homo sapiens
ctttccaaaagagtg

SEQ ID NO: 55899 - DNA, 15 bp, Homo sapiens
tttccaaaagagtgg

SEQ ID NO: 55900 - DNA, 15 bp, Homo sapiens
ttccaaaagagtggc

SEQ ID NO: 55901 - DNA, 15 bp, Homo sapiens
tccaaaagagtggct

SEQ ID NO: 55902 - DNA, 15 bp, Homo sapiens
ccaaaagagtggctt

SEQ ID NO: 55903 - DNA, 15 bp, Homo sapiens
caaaagagtggctta

SEQ ID NO: 55904 - DNA, 15 bp, Homo sapiens
aaaagagtggcttag

SEQ ID NO: 55905 - DNA, 15 bp, Homo sapiens
aaagagtggcttagg

SEQ ID NO: 55906 - DNA, 15 bp, Homo sapiens
aagagtggcttaggc

SEQ ID NO: 55907 - DNA, 15 bp, Homo sapiens
agagtggcttaggct

SEQ ID NO: 55908 - DNA, 15 bp, Homo sapiens
gagtggcttaggctg

SEQ ID NO: 55909 - DNA, 15 bp, Homo sapiens
agtggcttaggctgg

SEQ ID NO: 55910 - DNA, 15 bp, Homo sapiens
gtggcttaggctggg

SEQ ID NO: 55911 - DNA, 15 bp, Homo sapiens
tggcttaggctgggc

SEQ ID NO: 55912 - DNA, 15 bp, Homo sapiens
ggcttaggctgggcc

SEQ ID NO: 55913 - DNA, 15 bp, Homo sapiens
gcttaggctgggcct

SEQ ID NO: 55914 - DNA, 15 bp, Homo sapiens
cttaggctgggcctg

SEQ ID NO: 55915 - DNA, 15 bp, Homo sapiens
ttaggctgggcctgg

SEQ ID NO: 55916 - DNA, 15 bp, Homo sapiens
taggctgggcctggt

SEQ ID NO: 55917 - DNA, 15 bp, Homo sapiens
aggctgggcctggtg

SEQ ID NO: 55918 - DNA, 15 bp, Homo sapiens
ggctgggcctggtgg

SEQ ID NO: 55919 - DNA, 15 bp, Homo sapiens
gctgggcctggtggc

SEQ ID NO: 55920 - DNA, 15 bp, Homo sapiens
ctgggcctggtggct

SEQ ID NO: 55921 - DNA, 15 bp, Homo sapiens
tgggcctggtggctc

SEQ ID NO: 55922 - DNA, 15 bp, Homo sapiens
gggcctggtggctca

SEQ ID NO: 55923 - DNA, 15 bp, Homo sapiens
ggcctggtggctcat

SEQ ID NO: 55924 - DNA, 15 bp, Homo sapiens
gcctggtggctcatg

SEQ ID NO: 55925 - DNA, 15 bp, Homo sapiens
cctggtggctcatgc

SEQ ID NO: 55926 - DNA, 15 bp, Homo sapiens
ctggtggctcatgcc

SEQ ID NO: 55927 - DNA, 15 bp, Homo sapiens
tgggaggccaaggca

SEQ ID NO: 55928 - DNA, 15 bp, Homo sapiens
gggaggccaaggcag

SEQ ID NO: 55929 - DNA, 15 bp, Homo sapiens
ggaggccaaggcagg

SEQ ID NO: 55930 - DNA, 15 bp, Homo sapiens
aaggcaggtggatca

SEQ ID NO: 55931 - DNA, 15 bp, Homo sapiens
aggcaggtggatcac

SEQ ID NO: 55932 - DNA, 15 bp, Homo sapiens
ggcaggtggatcacc

SEQ ID NO: 55933 - DNA, 15 bp, Homo sapiens
gcaggtggatcacct

SEQ ID NO: 55934 - DNA, 15 bp, Homo sapiens
caggtggatcacctg

SEQ ID NO: 55935 - DNA, 15 bp, Homo sapiens
aggtggatcacctga

SEQ ID NO: 55936 - DNA, 15 bp, Homo sapiens
caagaccagcctgac

SEQ ID NO: 55937 - DNA, 15 bp, Homo sapiens
aagaccagcctgacc

SEQ ID NO: 55938 - DNA, 15 bp, Homo sapiens
cctgaccaacatgga

SEQ ID NO: 55939 - DNA, 15 bp, Homo sapiens
ctgaccaacatggag

SEQ ID NO: 55940 - DNA, 15 bp, Homo sapiens
tgaccaacatggaga

SEQ ID NO: 55941 - DNA, 15 bp, Homo sapiens
gaccaacatggagaa

SEQ ID NO: 55942 - DNA, 15 bp, Homo sapiens
accaacatggagaaa

SEQ ID NO: 55943 - DNA, 15 bp, Homo sapiens
ccaacatggagaaat

SEQ ID NO: 55944 - DNA, 15 bp, Homo sapiens
caacatggagaaatc

SEQ ID NO: 55945 - DNA, 15 bp, Homo sapiens
aacatggagaaatcc

SEQ ID NO: 55946 - DNA, 15 bp, Homo sapiens
acatggagaaatccc

SEQ ID NO: 55947 - DNA, 15 bp, Homo sapiens
catggagaaatcccg

SEQ ID NO: 55948 - DNA, 15 bp, Homo sapiens
atggagaaatcccgt

SEQ ID NO: 55949 - DNA, 15 bp, Homo sapiens
tggagaaatcccgtc

SEQ ID NO: 55950 - DNA, 15 bp, Homo sapiens
ggagaaatcccgtcc

SEQ ID NO: 55951 - DNA, 15 bp, Homo sapiens
gagaaatcccgtccc

SEQ ID NO: 55952 - DNA, 15 bp, Homo sapiens
agaaatcccgtccct

SEQ ID NO: 55953 - DNA, 15 bp, Homo sapiens
gaaatcccgtcccta

SEQ ID NO: 55954 - DNA, 15 bp, Homo sapiens
aaatcccgtccctac

SEQ ID NO: 55955 - DNA, 15 bp, Homo sapiens
aatcccgtccctact

SEQ ID NO: 55956 - DNA, 15 bp, Homo sapiens
atcccgtccctacta

SEQ ID NO: 55957 - DNA, 15 bp, Homo sapiens
tcccgtccctactaa

SEQ ID NO: 55958 - DNA, 15 bp, Homo sapiens
cccgtccctactaaa

SEQ ID NO: 55959 - DNA, 15 bp, Homo sapiens
ccgtccctactaaaa

SEQ ID NO: 55960 - DNA, 15 bp, Homo sapiens
cgtccctactaaaaa

SEQ ID NO: 55961 - DNA, 15 bp, Homo sapiens
gtccctactaaaaat

SEQ ID NO: 55962 - DNA, 15 bp, Homo sapiens
tccctactaaaaata

SEQ ID NO: 55963 - DNA, 15 bp, Homo sapiens
ccctactaaaaatac

SEQ ID NO: 55964 - DNA, 15 bp, Homo sapiens
cctactaaaaataca

SEQ ID NO: 55965 - DNA, 15 bp, Homo sapiens
aatacaaaattagct

SEQ ID NO: 55966 - DNA, 15 bp, Homo sapiens
atacaaaattagctg

SEQ ID NO: 55967 - DNA, 15 bp, Homo sapiens
tacaaaattagctgg

SEQ ID NO: 55968 - DNA, 15 bp, Homo sapiens
acaaaattagctggg

SEQ ID NO: 55969 - DNA, 15 bp, Homo sapiens
caaaattagctgggc

SEQ ID NO: 55970 - DNA, 15 bp, Homo sapiens
aaaattagctgggcg

SEQ ID NO: 55971 - DNA, 15 bp, Homo sapiens
aaattagctgggcgt

SEQ ID NO: 55972 - DNA, 15 bp, Homo sapiens
aattagctgggcgtg

SEQ ID NO: 55973 - DNA, 15 bp, Homo sapiens
attagctgggcgtgg

SEQ ID NO: 55974 - DNA, 15 bp, Homo sapiens
ttagctgggcgtggt

SEQ ID NO: 55975 - DNA, 15 bp, Homo sapiens
tagctgggcgtggtg

SEQ ID NO: 55976 - DNA, 15 bp, Homo sapiens
agctgggcgtggtgg

SEQ ID NO: 55977 - DNA, 15 bp, Homo sapiens
ctgggcgtggtggcg

SEQ ID NO: 55978 - DNA, 15 bp, Homo sapiens
tgggcgtggtggcgc

SEQ ID NO: 55979 - DNA, 15 bp, Homo sapiens
gggcgtggtggcgca

SEQ ID NO: 55980 - DNA, 15 bp, Homo sapiens
ggcgtggtggcgcat

SEQ ID NO: 55981 - DNA, 15 bp, Homo sapiens
gcgtggtggcgcatg

SEQ ID NO: 55982 - DNA, 15 bp, Homo sapiens
cgtggtggcgcatgc

SEQ ID NO: 55983 - DNA, 15 bp, Homo sapiens
gtggtggcgcatgcc

SEQ ID NO: 55984 - DNA, 15 bp, Homo sapiens
tggtggcgcatgcct

SEQ ID NO: 55985 - DNA, 15 bp, Homo sapiens
ggtggcgcatgcctg

SEQ ID NO: 55986 - DNA, 15 bp, Homo sapiens
gtggcgcatgcctgt

SEQ ID NO: 55987 - DNA, 15 bp, Homo sapiens
tggcgcatgcctgta

SEQ ID NO: 55988 - DNA, 15 bp, Homo sapiens
ggcgcatgcctgtaa

SEQ ID NO: 55989 - DNA, 15 bp, Homo sapiens
gcgcatgcctgtaat

SEQ ID NO: 55990 - DNA, 15 bp, Homo sapiens
cgcatgcctgtaatc

SEQ ID NO: 55991 - DNA, 15 bp, Homo sapiens
gcatgcctgtaatcc

SEQ ID NO: 55992 - DNA, 15 bp, Homo sapiens
cttgggaggctgagc

SEQ ID NO: 55993 - DNA, 15 bp, Homo sapiens
ttgggaggctgagcc

SEQ ID NO: 55994 - DNA, 15 bp, Homo sapiens
tgggaggctgagcca

SEQ ID NO: 55995 - DNA, 15 bp, Homo sapiens
gggaggctgagccag

SEQ ID NO: 55996 - DNA, 15 bp, Homo sapiens
ggaggctgagccagg

SEQ ID NO: 55997 - DNA, 15 bp, Homo sapiens
gaggctgagccagga

SEQ ID NO: 55998 - DNA, 15 bp, Homo sapiens
aggctgagccaggag

SEQ ID NO: 55999 - DNA, 15 bp, Homo sapiens
ggctgagccaggaga

SEQ ID NO: 56000 - DNA, 15 bp, Homo sapiens
gctgagccaggagaa

SEQ ID NO: 56001 - DNA, 15 bp, Homo sapiens
ctgagccaggagaat

SEQ ID NO: 56002 - DNA, 15 bp, Homo sapiens
tgagccaggagaatc

SEQ ID NO: 56003 - DNA, 15 bp, Homo sapiens
gagccaggagaatca

SEQ ID NO: 56004 - DNA, 15 bp, Homo sapiens
agccaggagaatcac

SEQ ID NO: 56005 - DNA, 15 bp, Homo sapiens
gccaggagaatcact

SEQ ID NO: 56006 - DNA, 15 bp, Homo sapiens
ccaggagaatcactt

SEQ ID NO: 56007 - DNA, 15 bp, Homo sapiens
cttgaacctgggaga

SEQ ID NO: 56008 - DNA, 15 bp, Homo sapiens
ttgaacctgggagat

SEQ ID NO: 56009 - DNA, 15 bp, Homo sapiens
tgaacctgggagatg

SEQ ID NO: 56010 - DNA, 15 bp, Homo sapiens
gaacctgggagatgg

SEQ ID NO: 56011 - DNA, 15 bp, Homo sapiens
aacctgggagatgga

SEQ ID NO: 56012 - DNA, 15 bp, Homo sapiens
acctgggagatggag

SEQ ID NO: 56013 - DNA, 15 bp, Homo sapiens
cctgggagatggagg

SEQ ID NO: 56014 - DNA, 15 bp, Homo sapiens
ctgggagatggaggg

SEQ ID NO: 56015 - DNA, 15 bp, Homo sapiens
tgggagatggagggt

SEQ ID NO: 56016 - DNA, 15 bp, Homo sapiens
gggagatggagggtg

SEQ ID NO: 56017 - DNA, 15 bp, Homo sapiens
ggagatggagggtgc

SEQ ID NO: 56018 - DNA, 15 bp, Homo sapiens
gagatggagggtgca

SEQ ID NO: 56019 - DNA, 15 bp, Homo sapiens
agatggagggtgcag

SEQ ID NO: 56020 - DNA, 15 bp, Homo sapiens
gatggagggtgcagt

SEQ ID NO: 56021 - DNA, 15 bp, Homo sapiens
atggagggtgcagtg

SEQ ID NO: 56022 - DNA, 15 bp, Homo sapiens
tggagggtgcagtga

SEQ ID NO: 56023 - DNA, 15 bp, Homo sapiens
ggagggtgcagtgag

SEQ ID NO: 56024 - DNA, 15 bp, Homo sapiens
gagggtgcagtgagc

SEQ ID NO: 56025 - DNA, 15 bp, Homo sapiens
agggtgcagtgagcc

SEQ ID NO: 56026 - DNA, 15 bp, Homo sapiens
gggtgcagtgagccg

SEQ ID NO: 56027 - DNA, 15 bp, Homo sapiens
ggtgcagtgagccga

SEQ ID NO: 56028 - DNA, 15 bp, Homo sapiens
gtgcagtgagccgag

SEQ ID NO: 56029 - DNA, 15 bp, Homo sapiens
gtgagccgagatcgt

SEQ ID NO: 56030 - DNA, 15 bp, Homo sapiens
tgagccgagatcgtg

SEQ ID NO: 56031 - DNA, 15 bp, Homo sapiens
gagccgagatcgtgc

SEQ ID NO: 56032 - DNA, 15 bp, Homo sapiens
agccgagatcgtgcc

SEQ ID NO: 56033 - DNA, 15 bp, Homo sapiens
gccgagatcgtgcca

SEQ ID NO: 56034 - DNA, 15 bp, Homo sapiens
ccgagatcgtgccat

SEQ ID NO: 56035 - DNA, 15 bp, Homo sapiens
cgagatcgtgccatt

SEQ ID NO: 56036 - DNA, 15 bp, Homo sapiens
gagatcgtgccattg

SEQ ID NO: 56037 - DNA, 15 bp, Homo sapiens
atcgtgccattgcat

SEQ ID NO: 56038 - DNA, 15 bp, Homo sapiens
tcgtgccattgcatt

SEQ ID NO: 56039 - DNA, 15 bp, Homo sapiens
cgtgccattgcattc

SEQ ID NO: 56040 - DNA, 15 bp, Homo sapiens
attgcattccagccc

SEQ ID NO: 56041 - DNA, 15 bp, Homo sapiens
ttgcattccagcccg

SEQ ID NO: 56042 - DNA, 15 bp, Homo sapiens
tgcattccagcccgg

SEQ ID NO: 56043 - DNA, 15 bp, Homo sapiens
gcattccagcccggc

SEQ ID NO: 56044 - DNA, 15 bp, Homo sapiens
cattccagcccggcc

SEQ ID NO: 56045 - DNA, 15 bp, Homo sapiens
attccagcccggcca

SEQ ID NO: 56046 - DNA, 15 bp, Homo sapiens
ttccagcccggccaa

SEQ ID NO: 56047 - DNA, 15 bp, Homo sapiens
tccagcccggccaac

SEQ ID NO: 56048 - DNA, 15 bp, Homo sapiens
ccagcccggccaaca

SEQ ID NO: 56049 - DNA, 15 bp, Homo sapiens
cagcccggccaacaa

SEQ ID NO: 56050 - DNA, 15 bp, Homo sapiens
agcccggccaacaag

SEQ ID NO: 56051 - DNA, 15 bp, Homo sapiens
gcccggccaacaaga

SEQ ID NO: 56052 - DNA, 15 bp, Homo sapiens
cccggccaacaagag

SEQ ID NO: 56053 - DNA, 15 bp, Homo sapiens
ccggccaacaagagc

SEQ ID NO: 56054 - DNA, 15 bp, Homo sapiens
cggccaacaagagcg

SEQ ID NO: 56055 - DNA, 15 bp, Homo sapiens
ggccaacaagagcga

SEQ ID NO: 56056 - DNA, 15 bp, Homo sapiens
gccaacaagagcgaa

SEQ ID NO: 56057 - DNA, 15 bp, Homo sapiens
ccaacaagagcgaaa

SEQ ID NO: 56058 - DNA, 15 bp, Homo sapiens
caacaagagcgaaac

SEQ ID NO: 56059 - DNA, 15 bp, Homo sapiens
aacaagagcgaaact

SEQ ID NO: 56060 - DNA, 15 bp, Homo sapiens
acaagagcgaaactc

SEQ ID NO: 56061 - DNA, 15 bp, Homo sapiens
caagagcgaaactcc

SEQ ID NO: 56062 - DNA, 15 bp, Homo sapiens
aagagcgaaactcca

SEQ ID NO: 56063 - DNA, 15 bp, Homo sapiens
agagcgaaactccat

SEQ ID NO: 56064 - DNA, 15 bp, Homo sapiens
gagcgaaactccatc

SEQ ID NO: 56065 - DNA, 15 bp, Homo sapiens
agcgaaactccatct

SEQ ID NO: 56066 - DNA, 15 bp, Homo sapiens
gcgaaactccatctc

SEQ ID NO: 56067 - DNA, 15 bp, Homo sapiens
cgaaactccatctca

SEQ ID NO: 56068 - DNA, 15 bp, Homo sapiens
gaaactccatctcaa

SEQ ID NO: 56069 - DNA, 15 bp, Homo sapiens
atctcaaaaaaaaag

SEQ ID NO: 56070 - DNA, 15 bp, Homo sapiens
tctcaaaaaaaaaga

SEQ ID NO: 56071 - DNA, 15 bp, Homo sapiens
ctcaaaaaaaaagag

SEQ ID NO: 56072 - DNA, 15 bp, Homo sapiens
tcaaaaaaaaagagt

SEQ ID NO: 56073 - DNA, 15 bp, Homo sapiens
caaaaaaaaagagtg

SEQ ID NO: 56074 - DNA, 15 bp, Homo sapiens
aaaaaaaaagagtgg

SEQ ID NO: 56075 - DNA, 15 bp, Homo sapiens
aaaaaaaagagtggc

SEQ ID NO: 56076 - DNA, 15 bp, Homo sapiens
aaaaaaagagtggct

SEQ ID NO: 56077 - DNA, 15 bp, Homo sapiens
aaaaaagagtggctg

SEQ ID NO: 56078 - DNA, 15 bp, Homo sapiens
aaaaagagtggctgg

SEQ ID NO: 56079 - DNA, 15 bp, Homo sapiens
aaaagagtggctggc

SEQ ID NO: 56080 - DNA, 15 bp, Homo sapiens
aaagagtggctggcc

SEQ ID NO: 56081 - DNA, 15 bp, Homo sapiens
aagagtggctggccg

SEQ ID NO: 56082 - DNA, 15 bp, Homo sapiens
agagtggctggccgg

SEQ ID NO: 56083 - DNA, 15 bp, Homo sapiens
gagtggctggccggg

SEQ ID NO: 56084 - DNA, 15 bp, Homo sapiens
agtggctggccgggc

SEQ ID NO: 56085 - DNA, 15 bp, Homo sapiens
gtggctggccgggcg

SEQ ID NO: 56086 - DNA, 15 bp, Homo sapiens
tggctggccgggcgc

SEQ ID NO: 56087 - DNA, 15 bp, Homo sapiens
ggctggccgggcgca

SEQ ID NO: 56088 - DNA, 15 bp, Homo sapiens
gctggccgggcgcag

SEQ ID NO: 56089 - DNA, 15 bp, Homo sapiens
ctggccgggcgcagt

SEQ ID NO: 56090 - DNA, 15 bp, Homo sapiens
tggccgggcgcagtg

SEQ ID NO: 56091 - DNA, 15 bp, Homo sapiens
ggccgggcgcagtgg

SEQ ID NO: 56092 - DNA, 15 bp, Homo sapiens
gccgggcgcagtggc

SEQ ID NO: 56093 - DNA, 15 bp, Homo sapiens
ccgggcgcagtggct

SEQ ID NO: 56094 - DNA, 15 bp, Homo sapiens
cgggcgcagtggctc

SEQ ID NO: 56095 - DNA, 15 bp, Homo sapiens
gggcgcagtggctca

SEQ ID NO: 56096 - DNA, 15 bp, Homo sapiens
ggcgcagtggctcac

SEQ ID NO: 56097 - DNA, 15 bp, Homo sapiens
gcgcagtggctcacg

SEQ ID NO: 56098 - DNA, 15 bp, Homo sapiens
cgcagtggctcacgc

SEQ ID NO: 56099 - DNA, 15 bp, Homo sapiens
acgcctgtaatcccc

SEQ ID NO: 56100 - DNA, 15 bp, Homo sapiens
cgcctgtaatccccg

SEQ ID NO: 56101 - DNA, 15 bp, Homo sapiens
gcctgtaatccccgc

SEQ ID NO: 56102 - DNA, 15 bp, Homo sapiens
cctgtaatccccgca

SEQ ID NO: 56103 - DNA, 15 bp, Homo sapiens
ctgtaatccccgcac

SEQ ID NO: 56104 - DNA, 15 bp, Homo sapiens
tgtaatccccgcact

SEQ ID NO: 56105 - DNA, 15 bp, Homo sapiens
gtaatccccgcactg

SEQ ID NO: 56106 - DNA, 15 bp, Homo sapiens
taatccccgcactgt

SEQ ID NO: 56107 - DNA, 15 bp, Homo sapiens
aatccccgcactgtg

SEQ ID NO: 56108 - DNA, 15 bp, Homo sapiens
atccccgcactgtgg

SEQ ID NO: 56109 - DNA, 15 bp, Homo sapiens
tccccgcactgtggg

SEQ ID NO: 56110 - DNA, 15 bp, Homo sapiens
ccccgcactgtggga

SEQ ID NO: 56111 - DNA, 15 bp, Homo sapiens
cccgcactgtgggag

SEQ ID NO: 56112 - DNA, 15 bp, Homo sapiens
ccgcactgtgggagg

SEQ ID NO: 56113 - DNA, 15 bp, Homo sapiens
cgcactgtgggaggc

SEQ ID NO: 56114 - DNA, 15 bp, Homo sapiens
gcactgtgggaggcc

SEQ ID NO: 56115 - DNA, 15 bp, Homo sapiens
cactgtgggaggccg

SEQ ID NO: 56116 - DNA, 15 bp, Homo sapiens
actgtgggaggccga

SEQ ID NO: 56117 - DNA, 15 bp, Homo sapiens
ctgtgggaggccgag

SEQ ID NO: 56118 - DNA, 15 bp, Homo sapiens
tgtgggaggccgagg

SEQ ID NO: 56119 - DNA, 15 bp, Homo sapiens
gtgggaggccgaggt

SEQ ID NO: 56120 - DNA, 15 bp, Homo sapiens
ggtgggtggatcacg

SEQ ID NO: 56121 - DNA, 15 bp, Homo sapiens
gtgggtggatcacga

SEQ ID NO: 56122 - DNA, 15 bp, Homo sapiens
tgggtggatcacgag

SEQ ID NO: 56123 - DNA, 15 bp, Homo sapiens
ggtcaggagttcaaa

SEQ ID NO: 56124 - DNA, 15 bp, Homo sapiens
gtcaggagttcaaaa

SEQ ID NO: 56125 - DNA, 15 bp, Homo sapiens
tcaggagttcaaaac

SEQ ID NO: 56126 - DNA, 15 bp, Homo sapiens
caggagttcaaaacc

SEQ ID NO: 56127 - DNA, 15 bp, Homo sapiens
aggagttcaaaacca

SEQ ID NO: 56128 - DNA, 15 bp, Homo sapiens
ggagttcaaaaccag

SEQ ID NO: 56129 - DNA, 15 bp, Homo sapiens
gagttcaaaaccagc

SEQ ID NO: 56130 - DNA, 15 bp, Homo sapiens
agttcaaaaccagcc

SEQ ID NO: 56131 - DNA, 15 bp, Homo sapiens
gttcaaaaccagcct

SEQ ID NO: 56132 - DNA, 15 bp, Homo sapiens
ttcaaaaccagcctg

SEQ ID NO: 56133 - DNA, 15 bp, Homo sapiens
tcaaaaccagcctgg

SEQ ID NO: 56134 - DNA, 15 bp, Homo sapiens
caaaaccagcctggc

SEQ ID NO: 56135 - DNA, 15 bp, Homo sapiens
aaaaccagcctggcc

SEQ ID NO: 56136 - DNA, 15 bp, Homo sapiens
aaaccagcctggccg

SEQ ID NO: 56137 - DNA, 15 bp, Homo sapiens
aaccagcctggccga

SEQ ID NO: 56138 - DNA, 15 bp, Homo sapiens
accagcctggccgag

SEQ ID NO: 56139 - DNA, 15 bp, Homo sapiens
ccagcctggccgaga

SEQ ID NO: 56140 - DNA, 15 bp, Homo sapiens
cagcctggccgagat

SEQ ID NO: 56141 - DNA, 15 bp, Homo sapiens
agcctggccgagatg

SEQ ID NO: 56142 - DNA, 15 bp, Homo sapiens
gcctggccgagatgg

SEQ ID NO: 56143 - DNA, 15 bp, Homo sapiens
cctggccgagatggt

SEQ ID NO: 56144 - DNA, 15 bp, Homo sapiens
ctggccgagatggtg

SEQ ID NO: 56145 - DNA, 15 bp, Homo sapiens
tggccgagatggtga

SEQ ID NO: 56146 - DNA, 15 bp, Homo sapiens
ggccgagatggtgaa

SEQ ID NO: 56147 - DNA, 15 bp, Homo sapiens
gccgagatggtgaaa

SEQ ID NO: 56148 - DNA, 15 bp, Homo sapiens
ccgagatggtgaaac

SEQ ID NO: 56149 - DNA, 15 bp, Homo sapiens
cgagatggtgaaacc

SEQ ID NO: 56150 - DNA, 15 bp, Homo sapiens
gagatggtgaaaccc

SEQ ID NO: 56151 - DNA, 15 bp, Homo sapiens
ggtgaaaccccgtct

SEQ ID NO: 56152 - DNA, 15 bp, Homo sapiens
gtgaaaccccgtctc

SEQ ID NO: 56153 - DNA, 15 bp, Homo sapiens
tgaaaccccgtctct

SEQ ID NO: 56154 - DNA, 15 bp, Homo sapiens
aaccccgtctctact

SEQ ID NO: 56155 - DNA, 15 bp, Homo sapiens
accccgtctctacta

SEQ ID NO: 56156 - DNA, 15 bp, Homo sapiens
ccccgtctctactaa

SEQ ID NO: 56157 - DNA, 15 bp, Homo sapiens
taaaaatagaaaaac

SEQ ID NO: 56158 - DNA, 15 bp, Homo sapiens
aaaaatagaaaaact

SEQ ID NO: 56159 - DNA, 15 bp, Homo sapiens
aaaatagaaaaacta

SEQ ID NO: 56160 - DNA, 15 bp, Homo sapiens
aaatagaaaaactag

SEQ ID NO: 56161 - DNA, 15 bp, Homo sapiens
aatagaaaaactagc

SEQ ID NO: 56162 - DNA, 15 bp, Homo sapiens
atagaaaaactagcc

SEQ ID NO: 56163 - DNA, 15 bp, Homo sapiens
tagaaaaactagcca

SEQ ID NO: 56164 - DNA, 15 bp, Homo sapiens
agaaaaactagccag

SEQ ID NO: 56165 - DNA, 15 bp, Homo sapiens
gaaaaactagccagg

SEQ ID NO: 56166 - DNA, 15 bp, Homo sapiens
aaaaactagccaggc

SEQ ID NO: 56167 - DNA, 15 bp, Homo sapiens
aaaactagccaggcg

SEQ ID NO: 56168 - DNA, 15 bp, Homo sapiens
aaactagccaggcgc

SEQ ID NO: 56169 - DNA, 15 bp, Homo sapiens
aactagccaggcgca

SEQ ID NO: 56170 - DNA, 15 bp, Homo sapiens
actagccaggcgcag

SEQ ID NO: 56171 - DNA, 15 bp, Homo sapiens
ctagccaggcgcagt

SEQ ID NO: 56172 - DNA, 15 bp, Homo sapiens
tagccaggcgcagtg

SEQ ID NO: 56173 - DNA, 15 bp, Homo sapiens
agccaggcgcagtgg

SEQ ID NO: 56174 - DNA, 15 bp, Homo sapiens
gccaggcgcagtggc

SEQ ID NO: 56175 - DNA, 15 bp, Homo sapiens
ccaggcgcagtggca

SEQ ID NO: 56176 - DNA, 15 bp, Homo sapiens
caggcgcagtggcag

SEQ ID NO: 56177 - DNA, 15 bp, Homo sapiens
aggcgcagtggcagg

SEQ ID NO: 56178 - DNA, 15 bp, Homo sapiens
ggcgcagtggcaggc

SEQ ID NO: 56179 - DNA, 15 bp, Homo sapiens
gcgcagtggcaggcg

SEQ ID NO: 56180 - DNA, 15 bp, Homo sapiens
cgcagtggcaggcgc

SEQ ID NO: 56181 - DNA, 15 bp, Homo sapiens
gcagtggcaggcgcc

SEQ ID NO: 56182 - DNA, 15 bp, Homo sapiens
cagtggcaggcgcct

SEQ ID NO: 56183 - DNA, 15 bp, Homo sapiens
agtggcaggcgcctg

SEQ ID NO: 56184 - DNA, 15 bp, Homo sapiens
cccagctacttgggt

SEQ ID NO: 56185 - DNA, 15 bp, Homo sapiens
ccagctacttgggtg

SEQ ID NO: 56186 - DNA, 15 bp, Homo sapiens
cagctacttgggtgg

SEQ ID NO: 56187 - DNA, 15 bp, Homo sapiens
agctacttgggtggc

SEQ ID NO: 56188 - DNA, 15 bp, Homo sapiens
gctacttgggtggct

SEQ ID NO: 56189 - DNA, 15 bp, Homo sapiens
ctacttgggtggctg

SEQ ID NO: 56190 - DNA, 15 bp, Homo sapiens
tacttgggtggctga

SEQ ID NO: 56191 - DNA, 15 bp, Homo sapiens
acttgggtggctgag

SEQ ID NO: 56192 - DNA, 15 bp, Homo sapiens
cttgggtggctgagg

SEQ ID NO: 56193 - DNA, 15 bp, Homo sapiens
ttgggtggctgaggc

SEQ ID NO: 56194 - DNA, 15 bp, Homo sapiens
tgggtggctgaggca

SEQ ID NO: 56195 - DNA, 15 bp, Homo sapiens
gggtggctgaggcag

SEQ ID NO: 56196 - DNA, 15 bp, Homo sapiens
ggtggctgaggcagg

SEQ ID NO: 56197 - DNA, 15 bp, Homo sapiens
gtggctgaggcagga

SEQ ID NO: 56198 - DNA, 15 bp, Homo sapiens
tggctgaggcaggag

SEQ ID NO: 56199 - DNA, 15 bp, Homo sapiens
cgcttgaacctgggg

SEQ ID NO: 56200 - DNA, 15 bp, Homo sapiens
gcttgaacctggggg

SEQ ID NO: 56201 - DNA, 15 bp, Homo sapiens
cttgaacctgggggg

SEQ ID NO: 56202 - DNA, 15 bp, Homo sapiens
ttgaacctggggggc

SEQ ID NO: 56203 - DNA, 15 bp, Homo sapiens
tgaacctggggggcg

SEQ ID NO: 56204 - DNA, 15 bp, Homo sapiens
gaacctggggggcgg

SEQ ID NO: 56205 - DNA, 15 bp, Homo sapiens
aacctggggggcgga

SEQ ID NO: 56206 - DNA, 15 bp, Homo sapiens
acctggggggcggag

SEQ ID NO: 56207 - DNA, 15 bp, Homo sapiens
cctggggggcggagg

SEQ ID NO: 56208 - DNA, 15 bp, Homo sapiens
ctggggggcggaggt

SEQ ID NO: 56209 - DNA, 15 bp, Homo sapiens
tggggggcggaggtt

SEQ ID NO: 56210 - DNA, 15 bp, Homo sapiens
ggggggcggaggttg

SEQ ID NO: 56211 - DNA, 15 bp, Homo sapiens
gggggcggaggttgc

SEQ ID NO: 56212 - DNA, 15 bp, Homo sapiens
ggggcggaggttgca

SEQ ID NO: 56213 - DNA, 15 bp, Homo sapiens
gggcggaggttgcag

SEQ ID NO: 56214 - DNA, 15 bp, Homo sapiens
cagtgagccaagatg

SEQ ID NO: 56215 - DNA, 15 bp, Homo sapiens
agtgagccaagatgg

SEQ ID NO: 56216 - DNA, 15 bp, Homo sapiens
gtgagccaagatggt

SEQ ID NO: 56217 - DNA, 15 bp, Homo sapiens
tgagccaagatggtg

SEQ ID NO: 56218 - DNA, 15 bp, Homo sapiens
gagccaagatggtgc

SEQ ID NO: 56219 - DNA, 15 bp, Homo sapiens
agccaagatggtgcc

SEQ ID NO: 56220 - DNA, 15 bp, Homo sapiens
gccaagatggtgcca

SEQ ID NO: 56221 - DNA, 15 bp, Homo sapiens
ccaagatggtgccac

SEQ ID NO: 56222 - DNA, 15 bp, Homo sapiens
caagatggtgccact

SEQ ID NO: 56223 - DNA, 15 bp, Homo sapiens
aagatggtgccactg

SEQ ID NO: 56224 - DNA, 15 bp, Homo sapiens
agatggtgccactgc

SEQ ID NO: 56225 - DNA, 15 bp, Homo sapiens
gatggtgccactgca

SEQ ID NO: 56226 - DNA, 15 bp, Homo sapiens
atggtgccactgcac

SEQ ID NO: 56227 - DNA, 15 bp, Homo sapiens
tggtgccactgcact

SEQ ID NO: 56228 - DNA, 15 bp, Homo sapiens
ggtgccactgcactc

SEQ ID NO: 56229 - DNA, 15 bp, Homo sapiens
cagcctgggtgacac

SEQ ID NO: 56230 - DNA, 15 bp, Homo sapiens
agcctgggtgacaca

SEQ ID NO: 56231 - DNA, 15 bp, Homo sapiens
gcctgggtgacacag

SEQ ID NO: 56232 - DNA, 15 bp, Homo sapiens
cctgggtgacacagt

SEQ ID NO: 56233 - DNA, 15 bp, Homo sapiens
ctgggtgacacagtg

SEQ ID NO: 56234 - DNA, 15 bp, Homo sapiens
tgggtgacacagtga

SEQ ID NO: 56235 - DNA, 15 bp, Homo sapiens
gggtgacacagtgag

SEQ ID NO: 56236 - DNA, 15 bp, Homo sapiens
ggtgacacagtgaga

SEQ ID NO: 56237 - DNA, 15 bp, Homo sapiens
gtgacacagtgagac

SEQ ID NO: 56238 - DNA, 15 bp, Homo sapiens
tgacacagtgagacc

SEQ ID NO: 56239 - DNA, 15 bp, Homo sapiens
gacacagtgagaccc

SEQ ID NO: 56240 - DNA, 15 bp, Homo sapiens
acacagtgagacccc

SEQ ID NO: 56241 - DNA, 15 bp, Homo sapiens
cacagtgagaccccg

SEQ ID NO: 56242 - DNA, 15 bp, Homo sapiens
acagtgagaccccgt

SEQ ID NO: 56243 - DNA, 15 bp, Homo sapiens
cagtgagaccccgtc

SEQ ID NO: 56244 - DNA, 15 bp, Homo sapiens
agtgagaccccgtct

SEQ ID NO: 56245 - DNA, 15 bp, Homo sapiens
gtgagaccccgtctc

SEQ ID NO: 56246 - DNA, 15 bp, Homo sapiens
tgagaccccgtctca

SEQ ID NO: 56247 - DNA, 15 bp, Homo sapiens
gagaccccgtctcaa

SEQ ID NO: 56248 - DNA, 15 bp, Homo sapiens
agaccccgtctcaaa

SEQ ID NO: 56249 - DNA, 15 bp, Homo sapiens
gaccccgtctcaaaa

SEQ ID NO: 56250 - DNA, 15 bp, Homo sapiens
accccgtctcaaaaa

SEQ ID NO: 56251 - DNA, 15 bp, Homo sapiens
ccccgtctcaaaaaa

SEQ ID NO: 56252 - DNA, 15 bp, Homo sapiens
cccgtctcaaaaaaa

SEQ ID NO: 56253 - DNA, 15 bp, Homo sapiens
aaaaaaaaaaaagtg

SEQ ID NO: 56254 - DNA, 15 bp, Homo sapiens
aaaaaaaaaaagtgg

SEQ ID NO: 56255 - DNA, 15 bp, Homo sapiens
aaaaaaaaaagtggc

SEQ ID NO: 56256 - DNA, 15 bp, Homo sapiens
aaaaaaaaagtggcg

SEQ ID NO: 56257 - DNA, 15 bp, Homo sapiens
aaaaaaaagtggcgt

SEQ ID NO: 56258 - DNA, 15 bp, Homo sapiens
aaaaaaagtggcgta

SEQ ID NO: 56259 - DNA, 15 bp, Homo sapiens
aaaaaagtggcgtat

SEQ ID NO: 56260 - DNA, 15 bp, Homo sapiens
aaaaagtggcgtatg

SEQ ID NO: 56261 - DNA, 15 bp, Homo sapiens
aaaagtggcgtatgt

SEQ ID NO: 56262 - DNA, 15 bp, Homo sapiens
aaagtggcgtatgtt

SEQ ID NO: 56263 - DNA, 15 bp, Homo sapiens
aagtggcgtatgttc

SEQ ID NO: 56264 - DNA, 15 bp, Homo sapiens
agtggcgtatgttcc

SEQ ID NO: 56265 - DNA, 15 bp, Homo sapiens
gtggcgtatgttccc

SEQ ID NO: 56266 - DNA, 15 bp, Homo sapiens
tggcgtatgttcccg

SEQ ID NO: 56267 - DNA, 15 bp, Homo sapiens
ggcgtatgttcccgg

SEQ ID NO: 56268 - DNA, 15 bp, Homo sapiens
gcgtatgttcccggt

SEQ ID NO: 56269 - DNA, 15 bp, Homo sapiens
cgtatgttcccggtc

SEQ ID NO: 56270 - DNA, 15 bp, Homo sapiens
gtatgttcccggtct

SEQ ID NO: 56271 - DNA, 15 bp, Homo sapiens
tatgttcccggtctc

SEQ ID NO: 56272 - DNA, 15 bp, Homo sapiens
atgttcccggtctcc

SEQ ID NO: 56273 - DNA, 15 bp, Homo sapiens
tgttcccggtctcca

SEQ ID NO: 56274 - DNA, 15 bp, Homo sapiens
gttcccggtctccac

SEQ ID NO: 56275 - DNA, 15 bp, Homo sapiens
ttcccggtctccacc

SEQ ID NO: 56276 - DNA, 15 bp, Homo sapiens
tcccggtctccacct

SEQ ID NO: 56277 - DNA, 15 bp, Homo sapiens
cccggtctccacctc

SEQ ID NO: 56278 - DNA, 15 bp, Homo sapiens
ccggtctccacctct

SEQ ID NO: 56279 - DNA, 15 bp, Homo sapiens
cggtctccacctctc

SEQ ID NO: 56280 - DNA, 15 bp, Homo sapiens
ggtctccacctctca

SEQ ID NO: 56281 - DNA, 15 bp, Homo sapiens
gtctccacctctcat

SEQ ID NO: 56282 - DNA, 15 bp, Homo sapiens
tctccacctctcatt

SEQ ID NO: 56283 - DNA, 15 bp, Homo sapiens
ctccacctctcattc

SEQ ID NO: 56284 - DNA, 15 bp, Homo sapiens
tccacctctcattcg

SEQ ID NO: 56285 - DNA, 15 bp, Homo sapiens
ccacctctcattcgc

SEQ ID NO: 56286 - DNA, 15 bp, Homo sapiens
cacctctcattcgcc

SEQ ID NO: 56287 - DNA, 15 bp, Homo sapiens
acctctcattcgcca

SEQ ID NO: 56288 - DNA, 15 bp, Homo sapiens
cctctcattcgccag

SEQ ID NO: 56289 - DNA, 15 bp, Homo sapiens
ctctcattcgccagc

SEQ ID NO: 56290 - DNA, 15 bp, Homo sapiens
tctcattcgccagcc

SEQ ID NO: 56291 - DNA, 15 bp, Homo sapiens
ctcattcgccagccc

SEQ ID NO: 56292 - DNA, 15 bp, Homo sapiens
tcattcgccagcccc

SEQ ID NO: 56293 - DNA, 15 bp, Homo sapiens
cattcgccagcccct

SEQ ID NO: 56294 - DNA, 15 bp, Homo sapiens
attcgccagcccctg

SEQ ID NO: 56295 - DNA, 15 bp, Homo sapiens
ttcgccagcccctgt

SEQ ID NO: 56296 - DNA, 15 bp, Homo sapiens
tcgccagcccctgtg

SEQ ID NO: 56297 - DNA, 15 bp, Homo sapiens
cgccagcccctgtga

SEQ ID NO: 56298 - DNA, 15 bp, Homo sapiens
gccagcccctgtgac

SEQ ID NO: 56299 - DNA, 15 bp, Homo sapiens
ccagcccctgtgacc

SEQ ID NO: 56300 - DNA, 15 bp, Homo sapiens
cagcccctgtgacca

SEQ ID NO: 56301 - DNA, 15 bp, Homo sapiens
agcccctgtgaccaa

SEQ ID NO: 56302 - DNA, 15 bp, Homo sapiens
gcccctgtgaccaaa

SEQ ID NO: 56303 - DNA, 15 bp, Homo sapiens
cccctgtgaccaaac

SEQ ID NO: 56304 - DNA, 15 bp, Homo sapiens
ccctgtgaccaaacc

SEQ ID NO: 56305 - DNA, 15 bp, Homo sapiens
cctgtgaccaaaccc

SEQ ID NO: 56306 - DNA, 15 bp, Homo sapiens
ctgtgaccaaacccc

SEQ ID NO: 56307 - DNA, 15 bp, Homo sapiens
tgtgaccaaacccct

SEQ ID NO: 56308 - DNA, 15 bp, Homo sapiens
gtgaccaaacccctg

SEQ ID NO: 56309 - DNA, 15 bp, Homo sapiens
tgaccaaacccctgg

SEQ ID NO: 56310 - DNA, 15 bp, Homo sapiens
gaccaaacccctggg

SEQ ID NO: 56311 - DNA, 15 bp, Homo sapiens
accaaacccctggga

SEQ ID NO: 56312 - DNA, 15 bp, Homo sapiens
ccaaacccctgggat

SEQ ID NO: 56313 - DNA, 15 bp, Homo sapiens
caaacccctgggatt

SEQ ID NO: 56314 - DNA, 15 bp, Homo sapiens
aaacccctgggatta

SEQ ID NO: 56315 - DNA, 15 bp, Homo sapiens
aacccctgggattag

SEQ ID NO: 56316 - DNA, 15 bp, Homo sapiens
acccctgggattaga

SEQ ID NO: 56317 - DNA, 15 bp, Homo sapiens
cccctgggattagat

SEQ ID NO: 56318 - DNA, 15 bp, Homo sapiens
ccctgggattagatc

SEQ ID NO: 56319 - DNA, 15 bp, Homo sapiens
cctgggattagatct

SEQ ID NO: 56320 - DNA, 15 bp, Homo sapiens
ctgggattagatctc

SEQ ID NO: 56321 - DNA, 15 bp, Homo sapiens
tgggattagatctcc

SEQ ID NO: 56322 - DNA, 15 bp, Homo sapiens
gggattagatctcca

SEQ ID NO: 56323 - DNA, 15 bp, Homo sapiens
ggattagatctccat

SEQ ID NO: 56324 - DNA, 15 bp, Homo sapiens
gattagatctccatc

SEQ ID NO: 56325 - DNA, 15 bp, Homo sapiens
attagatctccatcg

SEQ ID NO: 56326 - DNA, 15 bp, Homo sapiens
ttagatctccatcgg

SEQ ID NO: 56327 - DNA, 15 bp, Homo sapiens
tagatctccatcggg

SEQ ID NO: 56328 - DNA, 15 bp, Homo sapiens
agatctccatcgggt

SEQ ID NO: 56329 - DNA, 15 bp, Homo sapiens
gatctccatcgggtc

SEQ ID NO: 56330 - DNA, 15 bp, Homo sapiens
atctccatcgggtcc

SEQ ID NO: 56331 - DNA, 15 bp, Homo sapiens
tctccatcgggtccc

SEQ ID NO: 56332 - DNA, 15 bp, Homo sapiens
ctccatcgggtccct

SEQ ID NO: 56333 - DNA, 15 bp, Homo sapiens
tccatcgggtccctc

SEQ ID NO: 56334 - DNA, 15 bp, Homo sapiens
ccatcgggtccctcc

SEQ ID NO: 56335 - DNA, 15 bp, Homo sapiens
catcgggtccctccc

SEQ ID NO: 56336 - DNA, 15 bp, Homo sapiens
atcgggtccctcccc

SEQ ID NO: 56337 - DNA, 15 bp, Homo sapiens
tcgggtccctcccct

SEQ ID NO: 56338 - DNA, 15 bp, Homo sapiens
cgggtccctcccctc

SEQ ID NO: 56339 - DNA, 15 bp, Homo sapiens
gggtccctcccctca

SEQ ID NO: 56340 - DNA, 15 bp, Homo sapiens
ggtccctcccctcac

SEQ ID NO: 56341 - DNA, 15 bp, Homo sapiens
gtccctcccctcacc

SEQ ID NO: 56342 - DNA, 15 bp, Homo sapiens
tccctcccctcaccc

SEQ ID NO: 56343 - DNA, 15 bp, Homo sapiens
ccctcccctcaccct

SEQ ID NO: 56344 - DNA, 15 bp, Homo sapiens
cctcccctcacccta

SEQ ID NO: 56345 - DNA, 15 bp, Homo sapiens
ctcccctcaccctaa

SEQ ID NO: 56346 - DNA, 15 bp, Homo sapiens
tcccctcaccctaac

SEQ ID NO: 56347 - DNA, 15 bp, Homo sapiens
cccctcaccctaacc

SEQ ID NO: 56348 - DNA, 15 bp, Homo sapiens
ccctcaccctaacct

SEQ ID NO: 56349 - DNA, 15 bp, Homo sapiens
cctcaccctaacctc

SEQ ID NO: 56350 - DNA, 15 bp, Homo sapiens
ctcaccctaacctca

SEQ ID NO: 56351 - DNA, 15 bp, Homo sapiens
tcaccctaacctcac

SEQ ID NO: 56352 - DNA, 15 bp, Homo sapiens
caccctaacctcaca

SEQ ID NO: 56353 - DNA, 15 bp, Homo sapiens
accctaacctcacat

SEQ ID NO: 56354 - DNA, 15 bp, Homo sapiens
ccctaacctcacatg

SEQ ID NO: 56355 - DNA, 15 bp, Homo sapiens
cctaacctcacatgc

SEQ ID NO: 56356 - DNA, 15 bp, Homo sapiens
ctaacctcacatgca

SEQ ID NO: 56357 - DNA, 15 bp, Homo sapiens
taacctcacatgcag

SEQ ID NO: 56358 - DNA, 15 bp, Homo sapiens
aacctcacatgcagt

SEQ ID NO: 56359 - DNA, 15 bp, Homo sapiens
acctcacatgcagtg

SEQ ID NO: 56360 - DNA, 15 bp, Homo sapiens
cctcacatgcagtgg

SEQ ID NO: 56361 - DNA, 15 bp, Homo sapiens
ctcacatgcagtggt

SEQ ID NO: 56362 - DNA, 15 bp, Homo sapiens
tcacatgcagtggtt

SEQ ID NO: 56363 - DNA, 15 bp, Homo sapiens
cacatgcagtggttc

SEQ ID NO: 56364 - DNA, 15 bp, Homo sapiens
acatgcagtggttcc

SEQ ID NO: 56365 - DNA, 15 bp, Homo sapiens
catgcagtggttcct

SEQ ID NO: 56366 - DNA, 15 bp, Homo sapiens
atgcagtggttcctg

SEQ ID NO: 56367 - DNA, 15 bp, Homo sapiens
tgcagtggttcctga

SEQ ID NO: 56368 - DNA, 15 bp, Homo sapiens
gcagtggttcctgag

SEQ ID NO: 56369 - DNA, 15 bp, Homo sapiens
cagtggttcctgaga

SEQ ID NO: 56370 - DNA, 15 bp, Homo sapiens
agtggttcctgagaa

SEQ ID NO: 56371 - DNA, 15 bp, Homo sapiens
gtggttcctgagaag

SEQ ID NO: 56372 - DNA, 15 bp, Homo sapiens
tggttcctgagaagc

SEQ ID NO: 56373 - DNA, 15 bp, Homo sapiens
ggttcctgagaagct

SEQ ID NO: 56374 - DNA, 15 bp, Homo sapiens
gttcctgagaagctg

SEQ ID NO: 56375 - DNA, 15 bp, Homo sapiens
ttcctgagaagctgc

SEQ ID NO: 56376 - DNA, 15 bp, Homo sapiens
tcctgagaagctgct

SEQ ID NO: 56377 - DNA, 15 bp, Homo sapiens
cctgagaagctgctg

SEQ ID NO: 56378 - DNA, 15 bp, Homo sapiens
ctgagaagctgctgt

SEQ ID NO: 56379 - DNA, 15 bp, Homo sapiens
tgagaagctgctgtt

SEQ ID NO: 56380 - DNA, 15 bp, Homo sapiens
gagaagctgctgttt

SEQ ID NO: 56381 - DNA, 15 bp, Homo sapiens
agaagctgctgttta

SEQ ID NO: 56382 - DNA, 15 bp, Homo sapiens
gaagctgctgtttat

SEQ ID NO: 56383 - DNA, 15 bp, Homo sapiens
aagctgctgtttatc

SEQ ID NO: 56384 - DNA, 15 bp, Homo sapiens
agctgctgtttatct

SEQ ID NO: 56385 - DNA, 15 bp, Homo sapiens
gctgctgtttatctg

SEQ ID NO: 56386 - DNA, 15 bp, Homo sapiens
ctgctgtttatctga

SEQ ID NO: 56387 - DNA, 15 bp, Homo sapiens
tgctgtttatctgat

SEQ ID NO: 56388 - DNA, 15 bp, Homo sapiens
gctgtttatctgatc

SEQ ID NO: 56389 - DNA, 15 bp, Homo sapiens
ctgtttatctgatca

SEQ ID NO: 56390 - DNA, 15 bp, Homo sapiens
tgtttatctgatcac

SEQ ID NO: 56391 - DNA, 15 bp, Homo sapiens
gtttatctgatcacg

SEQ ID NO: 56392 - DNA, 15 bp, Homo sapiens
tttatctgatcacgg

SEQ ID NO: 56393 - DNA, 15 bp, Homo sapiens
ttatctgatcacggg

SEQ ID NO: 56394 - DNA, 15 bp, Homo sapiens
tatctgatcacggga

SEQ ID NO: 56395 - DNA, 15 bp, Homo sapiens
atctgatcacgggat

SEQ ID NO: 56396 - DNA, 15 bp, Homo sapiens
tctgatcacgggatc

SEQ ID NO: 56397 - DNA, 15 bp, Homo sapiens
ctgatcacgggatcc

SEQ ID NO: 56398 - DNA, 15 bp, Homo sapiens
tgatcacgggatcca

SEQ ID NO: 56399 - DNA, 15 bp, Homo sapiens
gatcacgggatccag

SEQ ID NO: 56400 - DNA, 15 bp, Homo sapiens
atcacgggatccagc

SEQ ID NO: 56401 - DNA, 15 bp, Homo sapiens
tcacgggatccagca

SEQ ID NO: 56402 - DNA, 15 bp, Homo sapiens
cacgggatccagcag

SEQ ID NO: 56403 - DNA, 15 bp, Homo sapiens
acgggatccagcagg

SEQ ID NO: 56404 - DNA, 15 bp, Homo sapiens
cgggatccagcagga

SEQ ID NO: 56405 - DNA, 15 bp, Homo sapiens
gggatccagcaggat

SEQ ID NO: 56406 - DNA, 15 bp, Homo sapiens
ggatccagcaggatc

SEQ ID NO: 56407 - DNA, 15 bp, Homo sapiens
gatccagcaggatct

SEQ ID NO: 56408 - DNA, 15 bp, Homo sapiens
atccagcaggatctg

SEQ ID NO: 56409 - DNA, 15 bp, Homo sapiens
tccagcaggatctga

SEQ ID NO: 56410 - DNA, 15 bp, Homo sapiens
ccagcaggatctgag

SEQ ID NO: 56411 - DNA, 15 bp, Homo sapiens
cagcaggatctgagg

SEQ ID NO: 56412 - DNA, 15 bp, Homo sapiens
agcaggatctgaggg

SEQ ID NO: 56413 - DNA, 15 bp, Homo sapiens
gcaggatctgagggc

SEQ ID NO: 56414 - DNA, 15 bp, Homo sapiens
caggatctgagggct

SEQ ID NO: 56415 - DNA, 15 bp, Homo sapiens
aggatctgagggctc

SEQ ID NO: 56416 - DNA, 15 bp, Homo sapiens
ggatctgagggctca

SEQ ID NO: 56417 - DNA, 15 bp, Homo sapiens
gatctgagggctcat

SEQ ID NO: 56418 - DNA, 15 bp, Homo sapiens
atctgagggctcatt

SEQ ID NO: 56419 - DNA, 15 bp, Homo sapiens
tctgagggctcattc

SEQ ID NO: 56420 - DNA, 15 bp, Homo sapiens
ctgagggctcattca

SEQ ID NO: 56421 - DNA, 15 bp, Homo sapiens
tgagggctcattcac

SEQ ID NO: 56422 - DNA, 15 bp, Homo sapiens
gagggctcattcact

SEQ ID NO: 56423 - DNA, 15 bp, Homo sapiens
agggctcattcactg

SEQ ID NO: 56424 - DNA, 15 bp, Homo sapiens
gggctcattcactga

SEQ ID NO: 56425 - DNA, 15 bp, Homo sapiens
ggctcattcactgaa

SEQ ID NO: 56426 - DNA, 15 bp, Homo sapiens
gctcattcactgaat

SEQ ID NO: 56427 - DNA, 15 bp, Homo sapiens
ctcattcactgaatc

SEQ ID NO: 56428 - DNA, 15 bp, Homo sapiens
tcattcactgaatct

SEQ ID NO: 56429 - DNA, 15 bp, Homo sapiens
cattcactgaatctg

SEQ ID NO: 56430 - DNA, 15 bp, Homo sapiens
attcactgaatctgt

SEQ ID NO: 56431 - DNA, 15 bp, Homo sapiens
ttcactgaatctgta

SEQ ID NO: 56432 - DNA, 15 bp, Homo sapiens
tcactgaatctgtac

SEQ ID NO: 56433 - DNA, 15 bp, Homo sapiens
cactgaatctgtact

SEQ ID NO: 56434 - DNA, 15 bp, Homo sapiens
actgaatctgtacta

SEQ ID NO: 56435 - DNA, 15 bp, Homo sapiens
ctgaatctgtactac

SEQ ID NO: 56436 - DNA, 15 bp, Homo sapiens
tgaatctgtactacc

SEQ ID NO: 56437 - DNA, 15 bp, Homo sapiens
gaatctgtactaccc

SEQ ID NO: 56438 - DNA, 15 bp, Homo sapiens
aatctgtactaccca

SEQ ID NO: 56439 - DNA, 15 bp, Homo sapiens
atctgtactacccaa

SEQ ID NO: 56440 - DNA, 15 bp, Homo sapiens
tctgtactacccaac

SEQ ID NO: 56441 - DNA, 15 bp, Homo sapiens
ctgtactacccaaca

SEQ ID NO: 56442 - DNA, 15 bp, Homo sapiens
tgtactacccaacaa

SEQ ID NO: 56443 - DNA, 15 bp, Homo sapiens
gtactacccaacaag

SEQ ID NO: 56444 - DNA, 15 bp, Homo sapiens
tactacccaacaagg

SEQ ID NO: 56445 - DNA, 15 bp, Homo sapiens
actacccaacaaggc

SEQ ID NO: 56446 - DNA, 15 bp, Homo sapiens
ctacccaacaaggca

SEQ ID NO: 56447 - DNA, 15 bp, Homo sapiens
tacccaacaaggcag

SEQ ID NO: 56448 - DNA, 15 bp, Homo sapiens
acccaacaaggcagg

SEQ ID NO: 56449 - DNA, 15 bp, Homo sapiens
cccaacaaggcaggc

SEQ ID NO: 56450 - DNA, 15 bp, Homo sapiens
ccaacaaggcaggct

SEQ ID NO: 56451 - DNA, 15 bp, Homo sapiens
caacaaggcaggctt

SEQ ID NO: 56452 - DNA, 15 bp, Homo sapiens
aacaaggcaggcttg

SEQ ID NO: 56453 - DNA, 15 bp, Homo sapiens
acaaggcaggcttgt

SEQ ID NO: 56454 - DNA, 15 bp, Homo sapiens
caaggcaggcttgtc

SEQ ID NO: 56455 - DNA, 15 bp, Homo sapiens
aaggcaggcttgtcc

SEQ ID NO: 56456 - DNA, 15 bp, Homo sapiens
aggcaggcttgtcct

SEQ ID NO: 56457 - DNA, 15 bp, Homo sapiens
ggcaggcttgtcctt

SEQ ID NO: 56458 - DNA, 15 bp, Homo sapiens
gcaggcttgtcctta

SEQ ID NO: 56459 - DNA, 15 bp, Homo sapiens
caggcttgtccttac

SEQ ID NO: 56460 - DNA, 15 bp, Homo sapiens
aggcttgtccttacc

SEQ ID NO: 56461 - DNA, 15 bp, Homo sapiens
ggcttgtccttaccc

SEQ ID NO: 56462 - DNA, 15 bp, Homo sapiens
gcttgtccttaccca

SEQ ID NO: 56463 - DNA, 15 bp, Homo sapiens
cttgtccttacccac

SEQ ID NO: 56464 - DNA, 15 bp, Homo sapiens
ttgtccttacccaca

SEQ ID NO: 56465 - DNA, 15 bp, Homo sapiens
tgtccttacccacac

SEQ ID NO: 56466 - DNA, 15 bp, Homo sapiens
gtccttacccacact

SEQ ID NO: 56467 - DNA, 15 bp, Homo sapiens
tccttacccacactt

SEQ ID NO: 56468 - DNA, 15 bp, Homo sapiens
ccttacccacacttt

SEQ ID NO: 56469 - DNA, 15 bp, Homo sapiens
cttacccacactttt

SEQ ID NO: 56470 - DNA, 15 bp, Homo sapiens
ttacccacacttttc

SEQ ID NO: 56471 - DNA, 15 bp, Homo sapiens
tacccacacttttca

SEQ ID NO: 56472 - DNA, 15 bp, Homo sapiens
acccacacttttcag

SEQ ID NO: 56473 - DNA, 15 bp, Homo sapiens
cccacacttttcagg

SEQ ID NO: 56474 - DNA, 15 bp, Homo sapiens
ccacacttttcaggt

SEQ ID NO: 56475 - DNA, 15 bp, Homo sapiens
cacacttttcaggtg

SEQ ID NO: 56476 - DNA, 15 bp, Homo sapiens
acacttttcaggtga

SEQ ID NO: 56477 - DNA, 15 bp, Homo sapiens
cacttttcaggtgaa

SEQ ID NO: 56478 - DNA, 15 bp, Homo sapiens
acttttcaggtgaaa

SEQ ID NO: 56479 - DNA, 15 bp, Homo sapiens
cttttcaggtgaaaa

SEQ ID NO: 56480 - DNA, 15 bp, Homo sapiens
ttttcaggtgaaaac

SEQ ID NO: 56481 - DNA, 15 bp, Homo sapiens
tttcaggtgaaaact

SEQ ID NO: 56482 - DNA, 15 bp, Homo sapiens
ttcaggtgaaaactt

SEQ ID NO: 56483 - DNA, 15 bp, Homo sapiens
tcaggtgaaaactta

SEQ ID NO: 56484 - DNA, 15 bp, Homo sapiens
caggtgaaaacttaa

SEQ ID NO: 56485 - DNA, 15 bp, Homo sapiens
aggtgaaaacttaat

SEQ ID NO: 56486 - DNA, 15 bp, Homo sapiens
ggtgaaaacttaatc

SEQ ID NO: 56487 - DNA, 15 bp, Homo sapiens
gtgaaaacttaatca

SEQ ID NO: 56488 - DNA, 15 bp, Homo sapiens
tgaaaacttaatcag

SEQ ID NO: 56489 - DNA, 15 bp, Homo sapiens
gaaaacttaatcaga

SEQ ID NO: 56490 - DNA, 15 bp, Homo sapiens
aaaacttaatcagat

SEQ ID NO: 56491 - DNA, 15 bp, Homo sapiens
aaacttaatcagatt

SEQ ID NO: 56492 - DNA, 15 bp, Homo sapiens
aacttaatcagattc

SEQ ID NO: 56493 - DNA, 15 bp, Homo sapiens
acttaatcagattca

SEQ ID NO: 56494 - DNA, 15 bp, Homo sapiens
cttaatcagattcaa

SEQ ID NO: 56495 - DNA, 15 bp, Homo sapiens
ttaatcagattcaag

SEQ ID NO: 56496 - DNA, 15 bp, Homo sapiens
taatcagattcaagc

SEQ ID NO: 56497 - DNA, 15 bp, Homo sapiens
aatcagattcaagcg

SEQ ID NO: 56498 - DNA, 15 bp, Homo sapiens
atcagattcaagcgt

SEQ ID NO: 56499 - DNA, 15 bp, Homo sapiens
tcagattcaagcgtt

SEQ ID NO: 56500 - DNA, 15 bp, Homo sapiens
cagattcaagcgttt

SEQ ID NO: 56501 - DNA, 15 bp, Homo sapiens
agattcaagcgttta

SEQ ID NO: 56502 - DNA, 15 bp, Homo sapiens
gattcaagcgtttat

SEQ ID NO: 56503 - DNA, 15 bp, Homo sapiens
attcaagcgtttatc

SEQ ID NO: 56504 - DNA, 15 bp, Homo sapiens
ttcaagcgtttatct

SEQ ID NO: 56505 - DNA, 15 bp, Homo sapiens
tcaagcgtttatctt

SEQ ID NO: 56506 - DNA, 15 bp, Homo sapiens
caagcgtttatctta

SEQ ID NO: 56507 - DNA, 15 bp, Homo sapiens
aagcgtttatcttag

SEQ ID NO: 56508 - DNA, 15 bp, Homo sapiens
agcgtttatcttagt

SEQ ID NO: 56509 - DNA, 15 bp, Homo sapiens
gcgtttatcttagtg

SEQ ID NO: 56510 - DNA, 15 bp, Homo sapiens
cgtttatcttagtgg

SEQ ID NO: 56511 - DNA, 15 bp, Homo sapiens
gtttatcttagtggc

SEQ ID NO: 56512 - DNA, 15 bp, Homo sapiens
tttatcttagtggcc

SEQ ID NO: 56513 - DNA, 15 bp, Homo sapiens
ttatcttagtggcct

SEQ ID NO: 56514 - DNA, 15 bp, Homo sapiens
tatcttagtggcctc

SEQ ID NO: 56515 - DNA, 15 bp, Homo sapiens
atcttagtggcctct

SEQ ID NO: 56516 - DNA, 15 bp, Homo sapiens
tcttagtggcctctt

SEQ ID NO: 56517 - DNA, 15 bp, Homo sapiens
cttagtggcctcttc

SEQ ID NO: 56518 - DNA, 15 bp, Homo sapiens
ttagtggcctcttcg

SEQ ID NO: 56519 - DNA, 15 bp, Homo sapiens
tagtggcctcttcgt

SEQ ID NO: 56520 - DNA, 15 bp, Homo sapiens
agtggcctcttcgtg

SEQ ID NO: 56521 - DNA, 15 bp, Homo sapiens
gtggcctcttcgtgg

SEQ ID NO: 56522 - DNA, 15 bp, Homo sapiens
tggcctcttcgtggt

SEQ ID NO: 56523 - DNA, 15 bp, Homo sapiens
ggcctcttcgtggtg

SEQ ID NO: 56524 - DNA, 15 bp, Homo sapiens
gcctcttcgtggtgt

SEQ ID NO: 56525 - DNA, 15 bp, Homo sapiens
cctcttcgtggtgtg

SEQ ID NO: 56526 - DNA, 15 bp, Homo sapiens
ctcttcgtggtgtgt

SEQ ID NO: 56527 - DNA, 15 bp, Homo sapiens
tcttcgtggtgtgtg

SEQ ID NO: 56528 - DNA, 15 bp, Homo sapiens
cttcgtggtgtgtga

SEQ ID NO: 56529 - DNA, 15 bp, Homo sapiens
ttcgtggtgtgtgat

SEQ ID NO: 56530 - DNA, 15 bp, Homo sapiens
tcgtggtgtgtgatt

SEQ ID NO: 56531 - DNA, 15 bp, Homo sapiens
cgtggtgtgtgattt

SEQ ID NO: 56532 - DNA, 15 bp, Homo sapiens
gtggtgtgtgatttc

SEQ ID NO: 56533 - DNA, 15 bp, Homo sapiens
tggtgtgtgatttcc

SEQ ID NO: 56534 - DNA, 15 bp, Homo sapiens
ggtgtgtgatttcct

SEQ ID NO: 56535 - DNA, 15 bp, Homo sapiens
gtgtgtgatttcctt

SEQ ID NO: 56536 - DNA, 15 bp, Homo sapiens
tgtgtgatttccttc

SEQ ID NO: 56537 - DNA, 15 bp, Homo sapiens
gtgtgatttccttct

SEQ ID NO: 56538 - DNA, 15 bp, Homo sapiens
tgtgatttccttctt

SEQ ID NO: 56539 - DNA, 15 bp, Homo sapiens
gtgatttccttcttg

SEQ ID NO: 56540 - DNA, 15 bp, Homo sapiens
tgatttccttcttgc

SEQ ID NO: 56541 - DNA, 15 bp, Homo sapiens
gatttccttcttgca

SEQ ID NO: 56542 - DNA, 15 bp, Homo sapiens
atttccttcttgcag

SEQ ID NO: 56543 - DNA, 15 bp, Homo sapiens
tttccttcttgcagc

SEQ ID NO: 56544 - DNA, 15 bp, Homo sapiens
ttccttcttgcagct

SEQ ID NO: 56545 - DNA, 15 bp, Homo sapiens
tccttcttgcagctc

SEQ ID NO: 56546 - DNA, 15 bp, Homo sapiens
ccttcttgcagctct

SEQ ID NO: 56547 - DNA, 15 bp, Homo sapiens
cttcttgcagctctt

SEQ ID NO: 56548 - DNA, 15 bp, Homo sapiens
ttcttgcagctcttt

SEQ ID NO: 56549 - DNA, 15 bp, Homo sapiens
tcttgcagctcttta

SEQ ID NO: 56550 - DNA, 15 bp, Homo sapiens
cttgcagctctttac

SEQ ID NO: 56551 - DNA, 15 bp, Homo sapiens
ttgcagctctttact

SEQ ID NO: 56552 - DNA, 15 bp, Homo sapiens
tgcagctctttactg

SEQ ID NO: 56553 - DNA, 15 bp, Homo sapiens
gcagctctttactgg

SEQ ID NO: 56554 - DNA, 15 bp, Homo sapiens
cagctctttactggc

SEQ ID NO: 56555 - DNA, 15 bp, Homo sapiens
agctctttactggct

SEQ ID NO: 56556 - DNA, 15 bp, Homo sapiens
gctctttactggcta

SEQ ID NO: 56557 - DNA, 15 bp, Homo sapiens
ctctttactggctaa

SEQ ID NO: 56558 - DNA, 15 bp, Homo sapiens
tctttactggctaaa

SEQ ID NO: 56559 - DNA, 15 bp, Homo sapiens
ctttactggctaaaa

SEQ ID NO: 56560 - DNA, 15 bp, Homo sapiens
tttactggctaaaac

SEQ ID NO: 56561 - DNA, 15 bp, Homo sapiens
ttactggctaaaact

SEQ ID NO: 56562 - DNA, 15 bp, Homo sapiens
tactggctaaaactc

SEQ ID NO: 56563 - DNA, 15 bp, Homo sapiens
actggctaaaactct

SEQ ID NO: 56564 - DNA, 15 bp, Homo sapiens
ctggctaaaactctt

SEQ ID NO: 56565 - DNA, 15 bp, Homo sapiens
tggctaaaactcttc

SEQ ID NO: 56566 - DNA, 15 bp, Homo sapiens
ggctaaaactcttca

SEQ ID NO: 56567 - DNA, 15 bp, Homo sapiens
gctaaaactcttcac

SEQ ID NO: 56568 - DNA, 15 bp, Homo sapiens
ctaaaactcttcact

SEQ ID NO: 56569 - DNA, 15 bp, Homo sapiens
taaaactcttcactg

SEQ ID NO: 56570 - DNA, 15 bp, Homo sapiens
aaaactcttcactgg

SEQ ID NO: 56571 - DNA, 15 bp, Homo sapiens
aaactcttcactggg

SEQ ID NO: 56572 - DNA, 15 bp, Homo sapiens
aactcttcactggga

SEQ ID NO: 56573 - DNA, 15 bp, Homo sapiens
actcttcactgggag

SEQ ID NO: 56574 - DNA, 15 bp, Homo sapiens
ctcttcactgggagt

SEQ ID NO: 56575 - DNA, 15 bp, Homo sapiens
tcttcactgggagtt

SEQ ID NO: 56576 - DNA, 15 bp, Homo sapiens
cttcactgggagtta

SEQ ID NO: 56577 - DNA, 15 bp, Homo sapiens
ttcactgggagttaa

SEQ ID NO: 56578 - DNA, 15 bp, Homo sapiens
tcactgggagttaaa

SEQ ID NO: 56579 - DNA, 15 bp, Homo sapiens
cactgggagttaaac

SEQ ID NO: 56580 - DNA, 15 bp, Homo sapiens
actgggagttaaacc

SEQ ID NO: 56581 - DNA, 15 bp, Homo sapiens
ctgggagttaaacca

SEQ ID NO: 56582 - DNA, 15 bp, Homo sapiens
tgggagttaaaccag

SEQ ID NO: 56583 - DNA, 15 bp, Homo sapiens
gggagttaaaccagg

SEQ ID NO: 56584 - DNA, 15 bp, Homo sapiens
ggagttaaaccaggt

SEQ ID NO: 56585 - DNA, 15 bp, Homo sapiens
gagttaaaccaggtg

SEQ ID NO: 56586 - DNA, 15 bp, Homo sapiens
agttaaaccaggtgt

SEQ ID NO: 56587 - DNA, 15 bp, Homo sapiens
gttaaaccaggtgtg

SEQ ID NO: 56588 - DNA, 15 bp, Homo sapiens
ttaaaccaggtgtgg

SEQ ID NO: 56589 - DNA, 15 bp, Homo sapiens
taaaccaggtgtggt

SEQ ID NO: 56590 - DNA, 15 bp, Homo sapiens
aaaccaggtgtggtc

SEQ ID NO: 56591 - DNA, 15 bp, Homo sapiens
aaccaggtgtggtcc

SEQ ID NO: 56592 - DNA, 15 bp, Homo sapiens
accaggtgtggtcct

SEQ ID NO: 56593 - DNA, 15 bp, Homo sapiens
ccaggtgtggtcctt

SEQ ID NO: 56594 - DNA, 15 bp, Homo sapiens
caggtgtggtccttg

SEQ ID NO: 56595 - DNA, 15 bp, Homo sapiens
aggtgtggtccttga

SEQ ID NO: 56596 - DNA, 15 bp, Homo sapiens
ggtgtggtccttgac

SEQ ID NO: 56597 - DNA, 15 bp, Homo sapiens
gtgtggtccttgacc

SEQ ID NO: 56598 - DNA, 15 bp, Homo sapiens
tgtggtccttgaccc

SEQ ID NO: 56599 - DNA, 15 bp, Homo sapiens
gtggtccttgaccct

SEQ ID NO: 56600 - DNA, 15 bp, Homo sapiens
tggtccttgaccctc

SEQ ID NO: 56601 - DNA, 15 bp, Homo sapiens
ggtccttgaccctca

SEQ ID NO: 56602 - DNA, 15 bp, Homo sapiens
gtccttgaccctcat

SEQ ID NO: 56603 - DNA, 15 bp, Homo sapiens
tccttgaccctcatc

SEQ ID NO: 56604 - DNA, 15 bp, Homo sapiens
ccttgaccctcatca

SEQ ID NO: 56605 - DNA, 15 bp, Homo sapiens
cttgaccctcatcat

SEQ ID NO: 56606 - DNA, 15 bp, Homo sapiens
ttgaccctcatcatt

SEQ ID NO: 56607 - DNA, 15 bp, Homo sapiens
tgaccctcatcattt

SEQ ID NO: 56608 - DNA, 15 bp, Homo sapiens
gaccctcatcatttt

SEQ ID NO: 56609 - DNA, 15 bp, Homo sapiens
accctcatcattttg

SEQ ID NO: 56610 - DNA, 15 bp, Homo sapiens
ccctcatcattttgt

SEQ ID NO: 56611 - DNA, 15 bp, Homo sapiens
cctcatcattttgtc

SEQ ID NO: 56612 - DNA, 15 bp, Homo sapiens
ctcatcattttgtcc

SEQ ID NO: 56613 - DNA, 15 bp, Homo sapiens
tcatcattttgtccc

SEQ ID NO: 56614 - DNA, 15 bp, Homo sapiens
catcattttgtccca

SEQ ID NO: 56615 - DNA, 15 bp, Homo sapiens
atcattttgtcccat

SEQ ID NO: 56616 - DNA, 15 bp, Homo sapiens
tcattttgtcccatc

SEQ ID NO: 56617 - DNA, 15 bp, Homo sapiens
cattttgtcccatct

SEQ ID NO: 56618 - DNA, 15 bp, Homo sapiens
attttgtcccatctc

SEQ ID NO: 56619 - DNA, 15 bp, Homo sapiens
ttttgtcccatctcc

SEQ ID NO: 56620 - DNA, 15 bp, Homo sapiens
tttgtcccatctcct

SEQ ID NO: 56621 - DNA, 15 bp, Homo sapiens
ttgtcccatctccta

SEQ ID NO: 56622 - DNA, 15 bp, Homo sapiens
tgtcccatctcctat

SEQ ID NO: 56623 - DNA, 15 bp, Homo sapiens
gtcccatctcctatg

SEQ ID NO: 56624 - DNA, 15 bp, Homo sapiens
tcccatctcctatgc

SEQ ID NO: 56625 - DNA, 15 bp, Homo sapiens
cccatctcctatgct

SEQ ID NO: 56626 - DNA, 15 bp, Homo sapiens
ccatctcctatgctg

SEQ ID NO: 56627 - DNA, 15 bp, Homo sapiens
catctcctatgctgg

SEQ ID NO: 56628 - DNA, 15 bp, Homo sapiens
atctcctatgctggg

SEQ ID NO: 56629 - DNA, 15 bp, Homo sapiens
tctcctatgctgggc

SEQ ID NO: 56630 - DNA, 15 bp, Homo sapiens
ctcctatgctgggct

SEQ ID NO: 56631 - DNA, 15 bp, Homo sapiens
tcctatgctgggctc

SEQ ID NO: 56632 - DNA, 15 bp, Homo sapiens
cctatgctgggctct

SEQ ID NO: 56633 - DNA, 15 bp, Homo sapiens
ctatgctgggctctg

SEQ ID NO: 56634 - DNA, 15 bp, Homo sapiens
tatgctgggctctgt

SEQ ID NO: 56635 - DNA, 15 bp, Homo sapiens
atgctgggctctgta

SEQ ID NO: 56636 - DNA, 15 bp, Homo sapiens
tgctgggctctgtat

SEQ ID NO: 56637 - DNA, 15 bp, Homo sapiens
gctgggctctgtatc

SEQ ID NO: 56638 - DNA, 15 bp, Homo sapiens
ctgggctctgtatcc

SEQ ID NO: 56639 - DNA, 15 bp, Homo sapiens
tgggctctgtatcct

SEQ ID NO: 56640 - DNA, 15 bp, Homo sapiens
gggctctgtatcctt

SEQ ID NO: 56641 - DNA, 15 bp, Homo sapiens
ggctctgtatccttg

SEQ ID NO: 56642 - DNA, 15 bp, Homo sapiens
gctctgtatccttgt

SEQ ID NO: 56643 - DNA, 15 bp, Homo sapiens
ctctgtatccttgtc

SEQ ID NO: 56644 - DNA, 15 bp, Homo sapiens
tctgtatccttgtct

SEQ ID NO: 56645 - DNA, 15 bp, Homo sapiens
ctgtatccttgtctc

SEQ ID NO: 56646 - DNA, 15 bp, Homo sapiens
tgtatccttgtctcc

SEQ ID NO: 56647 - DNA, 15 bp, Homo sapiens
gtatccttgtctcca

SEQ ID NO: 56648 - DNA, 15 bp, Homo sapiens
tatccttgtctccaa

SEQ ID NO: 56649 - DNA, 15 bp, Homo sapiens
atccttgtctccaag

SEQ ID NO: 56650 - DNA, 15 bp, Homo sapiens
tccttgtctccaagc

SEQ ID NO: 56651 - DNA, 15 bp, Homo sapiens
ccttgtctccaagca

SEQ ID NO: 56652 - DNA, 15 bp, Homo sapiens
cttgtctccaagcag

SEQ ID NO: 56653 - DNA, 15 bp, Homo sapiens
ttgtctccaagcagt

SEQ ID NO: 56654 - DNA, 15 bp, Homo sapiens
tgtctccaagcagtc

SEQ ID NO: 56655 - DNA, 15 bp, Homo sapiens
gtctccaagcagtct

SEQ ID NO: 56656 - DNA, 15 bp, Homo sapiens
tctccaagcagtctc

SEQ ID NO: 56657 - DNA, 15 bp, Homo sapiens
ctccaagcagtctcg

SEQ ID NO: 56658 - DNA, 15 bp, Homo sapiens
tccaagcagtctcgt

SEQ ID NO: 56659 - DNA, 15 bp, Homo sapiens
ccaagcagtctcgtg

SEQ ID NO: 56660 - DNA, 15 bp, Homo sapiens
caagcagtctcgtgt

SEQ ID NO: 56661 - DNA, 15 bp, Homo sapiens
aagcagtctcgtgtg

SEQ ID NO: 56662 - DNA, 15 bp, Homo sapiens
agcagtctcgtgtga

SEQ ID NO: 56663 - DNA, 15 bp, Homo sapiens
gcagtctcgtgtgac

SEQ ID NO: 56664 - DNA, 15 bp, Homo sapiens
cagtctcgtgtgaca

SEQ ID NO: 56665 - DNA, 15 bp, Homo sapiens
agtctcgtgtgacag

SEQ ID NO: 56666 - DNA, 15 bp, Homo sapiens
gtctcgtgtgacagg

SEQ ID NO: 56667 - DNA, 15 bp, Homo sapiens
tctcgtgtgacaggg

SEQ ID NO: 56668 - DNA, 15 bp, Homo sapiens
ctcgtgtgacaggga

SEQ ID NO: 56669 - DNA, 15 bp, Homo sapiens
tcgtgtgacagggaa

SEQ ID NO: 56670 - DNA, 15 bp, Homo sapiens
cgtgtgacagggaag

SEQ ID NO: 56671 - DNA, 15 bp, Homo sapiens
gtgtgacagggaagt

SEQ ID NO: 56672 - DNA, 15 bp, Homo sapiens
tgtgacagggaagtt

SEQ ID NO: 56673 - DNA, 15 bp, Homo sapiens
gtgacagggaagtta

SEQ ID NO: 56674 - DNA, 15 bp, Homo sapiens
tgacagggaagttac

SEQ ID NO: 56675 - DNA, 15 bp, Homo sapiens
gacagggaagttacc

SEQ ID NO: 56676 - DNA, 15 bp, Homo sapiens
acagggaagttacct

SEQ ID NO: 56677 - DNA, 15 bp, Homo sapiens
cagggaagttaccta

SEQ ID NO: 56678 - DNA, 15 bp, Homo sapiens
agggaagttacctat

SEQ ID NO: 56679 - DNA, 15 bp, Homo sapiens
gggaagttacctatt

SEQ ID NO: 56680 - DNA, 15 bp, Homo sapiens
ggaagttacctatta

SEQ ID NO: 56681 - DNA, 15 bp, Homo sapiens
gaagttacctattat

SEQ ID NO: 56682 - DNA, 15 bp, Homo sapiens
aagttacctattatt

SEQ ID NO: 56683 - DNA, 15 bp, Homo sapiens
agttacctattattg

SEQ ID NO: 56684 - DNA, 15 bp, Homo sapiens
gttacctattattgt

SEQ ID NO: 56685 - DNA, 15 bp, Homo sapiens
ttacctattattgta

SEQ ID NO: 56686 - DNA, 15 bp, Homo sapiens
tacctattattgtat

SEQ ID NO: 56687 - DNA, 15 bp, Homo sapiens
acctattattgtatg

SEQ ID NO: 56688 - DNA, 15 bp, Homo sapiens
cctattattgtatgg

SEQ ID NO: 56689 - DNA, 15 bp, Homo sapiens
ctattattgtatggt

SEQ ID NO: 56690 - DNA, 15 bp, Homo sapiens
tattattgtatggtc

SEQ ID NO: 56691 - DNA, 15 bp, Homo sapiens
attattgtatggtcc

SEQ ID NO: 56692 - DNA, 15 bp, Homo sapiens
ttattgtatggtccc

SEQ ID NO: 56693 - DNA, 15 bp, Homo sapiens
tattgtatggtcccc

SEQ ID NO: 56694 - DNA, 15 bp, Homo sapiens
attgtatggtcccct

SEQ ID NO: 56695 - DNA, 15 bp, Homo sapiens
ttgtatggtcccctc

SEQ ID NO: 56696 - DNA, 15 bp, Homo sapiens
tgtatggtcccctct

SEQ ID NO: 56697 - DNA, 15 bp, Homo sapiens
gtatggtcccctctt

SEQ ID NO: 56698 - DNA, 15 bp, Homo sapiens
tatggtcccctcttc

SEQ ID NO: 56699 - DNA, 15 bp, Homo sapiens
atggtcccctcttct

SEQ ID NO: 56700 - DNA, 15 bp, Homo sapiens
tggtcccctcttctt

SEQ ID NO: 56701 - DNA, 15 bp, Homo sapiens
ggtcccctcttcttg

SEQ ID NO: 56702 - DNA, 15 bp, Homo sapiens
gtcccctcttcttgt

SEQ ID NO: 56703 - DNA, 15 bp, Homo sapiens
tcccctcttcttgtc

SEQ ID NO: 56704 - DNA, 15 bp, Homo sapiens
cccctcttcttgtca

SEQ ID NO: 56705 - DNA, 15 bp, Homo sapiens
ccctcttcttgtcac

SEQ ID NO: 56706 - DNA, 15 bp, Homo sapiens
cctcttcttgtcacc

SEQ ID NO: 56707 - DNA, 15 bp, Homo sapiens
ctcttcttgtcacct

SEQ ID NO: 56708 - DNA, 15 bp, Homo sapiens
tcttcttgtcacctc

SEQ ID NO: 56709 - DNA, 15 bp, Homo sapiens
cttcttgtcacctct

SEQ ID NO: 56710 - DNA, 15 bp, Homo sapiens
ttcttgtcacctctg

SEQ ID NO: 56711 - DNA, 15 bp, Homo sapiens
tcttgtcacctctgg

SEQ ID NO: 56712 - DNA, 15 bp, Homo sapiens
cttgtcacctctggt

SEQ ID NO: 56713 - DNA, 15 bp, Homo sapiens
ttgtcacctctggtg

SEQ ID NO: 56714 - DNA, 15 bp, Homo sapiens
tgtcacctctggtgt

SEQ ID NO: 56715 - DNA, 15 bp, Homo sapiens
gtcacctctggtgtg

SEQ ID NO: 56716 - DNA, 15 bp, Homo sapiens
tcacctctggtgtgg

SEQ ID NO: 56717 - DNA, 15 bp, Homo sapiens
cacctctggtgtggc

SEQ ID NO: 56718 - DNA, 15 bp, Homo sapiens
acctctggtgtggca

SEQ ID NO: 56719 - DNA, 15 bp, Homo sapiens
cctctggtgtggcac

SEQ ID NO: 56720 - DNA, 15 bp, Homo sapiens
ctctggtgtggcact

SEQ ID NO: 56721 - DNA, 15 bp, Homo sapiens
tctggtgtggcactt

SEQ ID NO: 56722 - DNA, 15 bp, Homo sapiens
ctggtgtggcacttg

SEQ ID NO: 56723 - DNA, 15 bp, Homo sapiens
tggtgtggcacttgt

SEQ ID NO: 56724 - DNA, 15 bp, Homo sapiens
ggtgtggcacttgtt

SEQ ID NO: 56725 - DNA, 15 bp, Homo sapiens
gtgtggcacttgttc

SEQ ID NO: 56726 - DNA, 15 bp, Homo sapiens
tgtggcacttgttcc

SEQ ID NO: 56727 - DNA, 15 bp, Homo sapiens
gtggcacttgttcca

SEQ ID NO: 56728 - DNA, 15 bp, Homo sapiens
tggcacttgttccat

SEQ ID NO: 56729 - DNA, 15 bp, Homo sapiens
ggcacttgttccatt

SEQ ID NO: 56730 - DNA, 15 bp, Homo sapiens
gcacttgttccattt

SEQ ID NO: 56731 - DNA, 15 bp, Homo sapiens
cacttgttccatttc

SEQ ID NO: 56732 - DNA, 15 bp, Homo sapiens
acttgttccatttct

SEQ ID NO: 56733 - DNA, 15 bp, Homo sapiens
cttgttccatttctt

SEQ ID NO: 56734 - DNA, 15 bp, Homo sapiens
ttgttccatttcttg

SEQ ID NO: 56735 - DNA, 15 bp, Homo sapiens
tgttccatttcttgt

SEQ ID NO: 56736 - DNA, 15 bp, Homo sapiens
gttccatttcttgtt

SEQ ID NO: 56737 - DNA, 15 bp, Homo sapiens
ttccatttcttgttc

SEQ ID NO: 56738 - DNA, 15 bp, Homo sapiens
tccatttcttgttca

SEQ ID NO: 56739 - DNA, 15 bp, Homo sapiens
ccatttcttgttcaa

SEQ ID NO: 56740 - DNA, 15 bp, Homo sapiens
catttcttgttcaat

SEQ ID NO: 56741 - DNA, 15 bp, Homo sapiens
atttcttgttcaatg

SEQ ID NO: 56742 - DNA, 15 bp, Homo sapiens
tttcttgttcaatga

SEQ ID NO: 56743 - DNA, 15 bp, Homo sapiens
ttcttgttcaatgaa

SEQ ID NO: 56744 - DNA, 15 bp, Homo sapiens
tcttgttcaatgaat

SEQ ID NO: 56745 - DNA, 15 bp, Homo sapiens
cttgttcaatgaatg

SEQ ID NO: 56746 - DNA, 15 bp, Homo sapiens
ttgttcaatgaatgt

SEQ ID NO: 56747 - DNA, 15 bp, Homo sapiens
tgttcaatgaatgtg

SEQ ID NO: 56748 - DNA, 15 bp, Homo sapiens
gttcaatgaatgtga

SEQ ID NO: 56749 - DNA, 15 bp, Homo sapiens
ttcaatgaatgtgat

SEQ ID NO: 56750 - DNA, 15 bp, Homo sapiens
tcaatgaatgtgatt

SEQ ID NO: 56751 - DNA, 15 bp, Homo sapiens
caatgaatgtgattt

SEQ ID NO: 56752 - DNA, 15 bp, Homo sapiens
aatgaatgtgatttg

SEQ ID NO: 56753 - DNA, 15 bp, Homo sapiens
atgaatgtgatttgt

SEQ ID NO: 56754 - DNA, 15 bp, Homo sapiens
tgaatgtgatttgtg

SEQ ID NO: 56755 - DNA, 15 bp, Homo sapiens
gaatgtgatttgtga

SEQ ID NO: 56756 - DNA, 15 bp, Homo sapiens
aatgtgatttgtgaa

SEQ ID NO: 56757 - DNA, 15 bp, Homo sapiens
atgtgatttgtgaat

SEQ ID NO: 56758 - DNA, 15 bp, Homo sapiens
tgtgatttgtgaatg

SEQ ID NO: 56759 - DNA, 15 bp, Homo sapiens
gtgatttgtgaatgt

SEQ ID NO: 56760 - DNA, 15 bp, Homo sapiens
tgatttgtgaatgtg

SEQ ID NO: 56761 - DNA, 15 bp, Homo sapiens
gatttgtgaatgtgc

SEQ ID NO: 56762 - DNA, 15 bp, Homo sapiens
atttgtgaatgtgcc

SEQ ID NO: 56763 - DNA, 15 bp, Homo sapiens
tttgtgaatgtgcca

SEQ ID NO: 56764 - DNA, 15 bp, Homo sapiens
ttgtgaatgtgccac

SEQ ID NO: 56765 - DNA, 15 bp, Homo sapiens
tgtgaatgtgccaca

SEQ ID NO: 56766 - DNA, 15 bp, Homo sapiens
gtgaatgtgccacat

SEQ ID NO: 56767 - DNA, 15 bp, Homo sapiens
tgaatgtgccacatc

SEQ ID NO: 56768 - DNA, 15 bp, Homo sapiens
gaatgtgccacatct

SEQ ID NO: 56769 - DNA, 15 bp, Homo sapiens
aatgtgccacatctg

SEQ ID NO: 56770 - DNA, 15 bp, Homo sapiens
atgtgccacatctgt

SEQ ID NO: 56771 - DNA, 15 bp, Homo sapiens
tgtgccacatctgtg

SEQ ID NO: 56772 - DNA, 15 bp, Homo sapiens
gtgccacatctgtgg

SEQ ID NO: 56773 - DNA, 15 bp, Homo sapiens
tgccacatctgtggg

SEQ ID NO: 56774 - DNA, 15 bp, Homo sapiens
gccacatctgtggga

SEQ ID NO: 56775 - DNA, 15 bp, Homo sapiens
ccacatctgtgggag

SEQ ID NO: 56776 - DNA, 15 bp, Homo sapiens
cacatctgtgggagg

SEQ ID NO: 56777 - DNA, 15 bp, Homo sapiens
acatctgtgggagga

SEQ ID NO: 56778 - DNA, 15 bp, Homo sapiens
catctgtgggaggaa

SEQ ID NO: 56779 - DNA, 15 bp, Homo sapiens
atctgtgggaggaag

SEQ ID NO: 56780 - DNA, 15 bp, Homo sapiens
tctgtgggaggaagg

SEQ ID NO: 56781 - DNA, 15 bp, Homo sapiens
ctgtgggaggaaggc

SEQ ID NO: 56782 - DNA, 15 bp, Homo sapiens
tgtgggaggaaggca

SEQ ID NO: 56783 - DNA, 15 bp, Homo sapiens
gtgggaggaaggcag

SEQ ID NO: 56784 - DNA, 15 bp, Homo sapiens
tgggaggaaggcagt

SEQ ID NO: 56785 - DNA, 15 bp, Homo sapiens
gggaggaaggcagtt

SEQ ID NO: 56786 - DNA, 15 bp, Homo sapiens
ggaggaaggcagttc

SEQ ID NO: 56787 - DNA, 15 bp, Homo sapiens
gaggaaggcagttcg

SEQ ID NO: 56788 - DNA, 15 bp, Homo sapiens
aggaaggcagttcgc

SEQ ID NO: 56789 - DNA, 15 bp, Homo sapiens
ggaaggcagttcgca

SEQ ID NO: 56790 - DNA, 15 bp, Homo sapiens
gaaggcagttcgcag

SEQ ID NO: 56791 - DNA, 15 bp, Homo sapiens
aaggcagttcgcagc

SEQ ID NO: 56792 - DNA, 15 bp, Homo sapiens
aggcagttcgcagca

SEQ ID NO: 56793 - DNA, 15 bp, Homo sapiens
ggcagttcgcagcaa

SEQ ID NO: 56794 - DNA, 15 bp, Homo sapiens
gcagttcgcagcaag

SEQ ID NO: 56795 - DNA, 15 bp, Homo sapiens
cagttcgcagcaaga

SEQ ID NO: 56796 - DNA, 15 bp, Homo sapiens
agttcgcagcaagag

SEQ ID NO: 56797 - DNA, 15 bp, Homo sapiens
gttcgcagcaagagt

SEQ ID NO: 56798 - DNA, 15 bp, Homo sapiens
ttcgcagcaagagtt

SEQ ID NO: 56799 - DNA, 15 bp, Homo sapiens
tcgcagcaagagttg

SEQ ID NO: 56800 - DNA, 15 bp, Homo sapiens
cgcagcaagagttgt

SEQ ID NO: 56801 - DNA, 15 bp, Homo sapiens
gcagcaagagttgta

SEQ ID NO: 56802 - DNA, 15 bp, Homo sapiens
cagcaagagttgtag

SEQ ID NO: 56803 - DNA, 15 bp, Homo sapiens
agcaagagttgtagt

SEQ ID NO: 56804 - DNA, 15 bp, Homo sapiens
gcaagagttgtagtt

SEQ ID NO: 56805 - DNA, 15 bp, Homo sapiens
caagagttgtagttc

SEQ ID NO: 56806 - DNA, 15 bp, Homo sapiens
aagagttgtagttcc

SEQ ID NO: 56807 - DNA, 15 bp, Homo sapiens
agagttgtagttccc

SEQ ID NO: 56808 - DNA, 15 bp, Homo sapiens
gagttgtagttccct

SEQ ID NO: 56809 - DNA, 15 bp, Homo sapiens
agttgtagttccctt

SEQ ID NO: 56810 - DNA, 15 bp, Homo sapiens
gttgtagttcccttg

SEQ ID NO: 56811 - DNA, 15 bp, Homo sapiens
ttgtagttcccttgc

SEQ ID NO: 56812 - DNA, 15 bp, Homo sapiens
tgtagttcccttgct

SEQ ID NO: 56813 - DNA, 15 bp, Homo sapiens
gtagttcccttgctt

SEQ ID NO: 56814 - DNA, 15 bp, Homo sapiens
tagttcccttgcttt

SEQ ID NO: 56815 - DNA, 15 bp, Homo sapiens
agttcccttgctttg

SEQ ID NO: 56816 - DNA, 15 bp, Homo sapiens
gttcccttgctttgc

SEQ ID NO: 56817 - DNA, 15 bp, Homo sapiens
ttcccttgctttgcc

SEQ ID NO: 56818 - DNA, 15 bp, Homo sapiens
tcccttgctttgccc

SEQ ID NO: 56819 - DNA, 15 bp, Homo sapiens
cccttgctttgccct

SEQ ID NO: 56820 - DNA, 15 bp, Homo sapiens
ccttgctttgccctg

SEQ ID NO: 56821 - DNA, 15 bp, Homo sapiens
cttgctttgccctga

SEQ ID NO: 56822 - DNA, 15 bp, Homo sapiens
ttgctttgccctgag

SEQ ID NO: 56823 - DNA, 15 bp, Homo sapiens
tgctttgccctgagg

SEQ ID NO: 56824 - DNA, 15 bp, Homo sapiens
gctttgccctgaggg

SEQ ID NO: 56825 - DNA, 15 bp, Homo sapiens
ctttgccctgagggc

SEQ ID NO: 56826 - DNA, 15 bp, Homo sapiens
tttgccctgagggcc

SEQ ID NO: 56827 - DNA, 15 bp, Homo sapiens
ttgccctgagggcca

SEQ ID NO: 56828 - DNA, 15 bp, Homo sapiens
tgccctgagggccag

SEQ ID NO: 56829 - DNA, 15 bp, Homo sapiens
gccctgagggccagg

SEQ ID NO: 56830 - DNA, 15 bp, Homo sapiens
ccctgagggccagga

SEQ ID NO: 56831 - DNA, 15 bp, Homo sapiens
cctgagggccaggac

SEQ ID NO: 56832 - DNA, 15 bp, Homo sapiens
ctgagggccaggact

SEQ ID NO: 56833 - DNA, 15 bp, Homo sapiens
tgagggccaggactt

SEQ ID NO: 56834 - DNA, 15 bp, Homo sapiens
gagggccaggacttt

SEQ ID NO: 56835 - DNA, 15 bp, Homo sapiens
agggccaggacttta

SEQ ID NO: 56836 - DNA, 15 bp, Homo sapiens
gggccaggactttac

SEQ ID NO: 56837 - DNA, 15 bp, Homo sapiens
ggccaggactttaca

SEQ ID NO: 56838 - DNA, 15 bp, Homo sapiens
gccaggactttacac

SEQ ID NO: 56839 - DNA, 15 bp, Homo sapiens
ccaggactttacact

SEQ ID NO: 56840 - DNA, 15 bp, Homo sapiens
caggactttacacta

SEQ ID NO: 56841 - DNA, 15 bp, Homo sapiens
aggactttacactag

SEQ ID NO: 56842 - DNA, 15 bp, Homo sapiens
ggactttacactaga

SEQ ID NO: 56843 - DNA, 15 bp, Homo sapiens
gactttacactagat

SEQ ID NO: 56844 - DNA, 15 bp, Homo sapiens
actttacactagatt

SEQ ID NO: 56845 - DNA, 15 bp, Homo sapiens
ctttacactagattt

SEQ ID NO: 56846 - DNA, 15 bp, Homo sapiens
tttacactagatttt

SEQ ID NO: 56847 - DNA, 15 bp, Homo sapiens
ttacactagattttt

SEQ ID NO: 56848 - DNA, 15 bp, Homo sapiens
tacactagatttttt

SEQ ID NO: 56849 - DNA, 15 bp, Homo sapiens
acactagattttttt

SEQ ID NO: 56850 - DNA, 15 bp, Homo sapiens
cactagatttttttg

SEQ ID NO: 56851 - DNA, 15 bp, Homo sapiens
actagatttttttgt

SEQ ID NO: 56852 - DNA, 15 bp, Homo sapiens
ctagatttttttgtt

SEQ ID NO: 56853 - DNA, 15 bp, Homo sapiens
tagatttttttgttg

SEQ ID NO: 56854 - DNA, 15 bp, Homo sapiens
agatttttttgttgc

SEQ ID NO: 56855 - DNA, 15 bp, Homo sapiens
gatttttttgttgca

SEQ ID NO: 56856 - DNA, 15 bp, Homo sapiens
atttttttgttgcat

SEQ ID NO: 56857 - DNA, 15 bp, Homo sapiens
tttttttgttgcatt

SEQ ID NO: 56858 - DNA, 15 bp, Homo sapiens
ttttttgttgcattc

SEQ ID NO: 56859 - DNA, 15 bp, Homo sapiens
tttttgttgcattcc

SEQ ID NO: 56860 - DNA, 15 bp, Homo sapiens
ttttgttgcattcct

SEQ ID NO: 56861 - DNA, 15 bp, Homo sapiens
tttgttgcattcctg

SEQ ID NO: 56862 - DNA, 15 bp, Homo sapiens
ttgttgcattcctgc

SEQ ID NO: 56863 - DNA, 15 bp, Homo sapiens
tgttgcattcctgca

SEQ ID NO: 56864 - DNA, 15 bp, Homo sapiens
gttgcattcctgcac

SEQ ID NO: 56865 - DNA, 15 bp, Homo sapiens
ttgcattcctgcact

SEQ ID NO: 56866 - DNA, 15 bp, Homo sapiens
tgcattcctgcactc

SEQ ID NO: 56867 - DNA, 15 bp, Homo sapiens
gcattcctgcactca

SEQ ID NO: 56868 - DNA, 15 bp, Homo sapiens
cattcctgcactcat

SEQ ID NO: 56869 - DNA, 15 bp, Homo sapiens
attcctgcactcata

SEQ ID NO: 56870 - DNA, 15 bp, Homo sapiens
ttcctgcactcataa

SEQ ID NO: 56871 - DNA, 15 bp, Homo sapiens
tcctgcactcataaa

SEQ ID NO: 56872 - DNA, 15 bp, Homo sapiens
cctgcactcataaag

SEQ ID NO: 56873 - DNA, 15 bp, Homo sapiens
ctgcactcataaagt

SEQ ID NO: 56874 - DNA, 15 bp, Homo sapiens
tgcactcataaagta

SEQ ID NO: 56875 - DNA, 15 bp, Homo sapiens
gcactcataaagtac

SEQ ID NO: 56876 - DNA, 15 bp, Homo sapiens
cactcataaagtaca

SEQ ID NO: 56877 - DNA, 15 bp, Homo sapiens
actcataaagtacac

SEQ ID NO: 56878 - DNA, 15 bp, Homo sapiens
ctcataaagtacacg

SEQ ID NO: 56879 - DNA, 15 bp, Homo sapiens
tcataaagtacacgt

SEQ ID NO: 56880 - DNA, 15 bp, Homo sapiens
cataaagtacacgta

SEQ ID NO: 56881 - DNA, 15 bp, Homo sapiens
ataaagtacacgtaa

SEQ ID NO: 56882 - DNA, 15 bp, Homo sapiens
taaagtacacgtaaa

SEQ ID NO: 56883 - DNA, 15 bp, Homo sapiens
aaagtacacgtaaac

SEQ ID NO: 56884 - DNA, 15 bp, Homo sapiens
aagtacacgtaaact

SEQ ID NO: 56885 - DNA, 15 bp, Homo sapiens
agtacacgtaaactt

SEQ ID NO: 56886 - DNA, 15 bp, Homo sapiens
gtacacgtaaactta

SEQ ID NO: 56887 - DNA, 15 bp, Homo sapiens
tacacgtaaacttag

SEQ ID NO: 56888 - DNA, 15 bp, Homo sapiens
acacgtaaacttaga

SEQ ID NO: 56889 - DNA, 15 bp, Homo sapiens
cacgtaaacttagag

SEQ ID NO: 56890 - DNA, 15 bp, Homo sapiens
acgtaaacttagagg

SEQ ID NO: 56891 - DNA, 15 bp, Homo sapiens
cgtaaacttagaggt

SEQ ID NO: 56892 - DNA, 15 bp, Homo sapiens
gtaaacttagaggtg

SEQ ID NO: 56893 - DNA, 15 bp, Homo sapiens
taaacttagaggtgg

SEQ ID NO: 56894 - DNA, 15 bp, Homo sapiens
aaacttagaggtggt

SEQ ID NO: 56895 - DNA, 15 bp, Homo sapiens
aacttagaggtggtg

SEQ ID NO: 56896 - DNA, 15 bp, Homo sapiens
acttagaggtggtgt

SEQ ID NO: 56897 - DNA, 15 bp, Homo sapiens
cttagaggtggtgtg

SEQ ID NO: 56898 - DNA, 15 bp, Homo sapiens
ttagaggtggtgtgt

SEQ ID NO: 56899 - DNA, 15 bp, Homo sapiens
tagaggtggtgtgtt

SEQ ID NO: 56900 - DNA, 15 bp, Homo sapiens
agaggtggtgtgtta

SEQ ID NO: 56901 - DNA, 15 bp, Homo sapiens
gaggtggtgtgttaa

SEQ ID NO: 56902 - DNA, 15 bp, Homo sapiens
aggtggtgtgttaaa

SEQ ID NO: 56903 - DNA, 15 bp, Homo sapiens
ggtggtgtgttaaat

SEQ ID NO: 56904 - DNA, 15 bp, Homo sapiens
gtggtgtgttaaatg

SEQ ID NO: 56905 - DNA, 15 bp, Homo sapiens
tggtgtgttaaatgc

SEQ ID NO: 56906 - DNA, 15 bp, Homo sapiens
ggtgtgttaaatgct

SEQ ID NO: 56907 - DNA, 15 bp, Homo sapiens
gtgtgttaaatgcta

SEQ ID NO: 56908 - DNA, 15 bp, Homo sapiens
tgtgttaaatgctag

SEQ ID NO: 56909 - DNA, 15 bp, Homo sapiens
gtgttaaatgctaga

SEQ ID NO: 56910 - DNA, 15 bp, Homo sapiens
tgttaaatgctagaa

SEQ ID NO: 56911 - DNA, 15 bp, Homo sapiens
gttaaatgctagaac

SEQ ID NO: 56912 - DNA, 15 bp, Homo sapiens
ttaaatgctagaact

SEQ ID NO: 56913 - DNA, 15 bp, Homo sapiens
taaatgctagaactt

SEQ ID NO: 56914 - DNA, 15 bp, Homo sapiens
aaatgctagaactta

SEQ ID NO: 56915 - DNA, 15 bp, Homo sapiens
aatgctagaacttaa

SEQ ID NO: 56916 - DNA, 15 bp, Homo sapiens
atgctagaacttaaa

SEQ ID NO: 56917 - DNA, 15 bp, Homo sapiens
tgctagaacttaaaa

SEQ ID NO: 56918 - DNA, 15 bp, Homo sapiens
gctagaacttaaaac

SEQ ID NO: 56919 - DNA, 15 bp, Homo sapiens
ctagaacttaaaact

SEQ ID NO: 56920 - DNA, 15 bp, Homo sapiens
tagaacttaaaactg

SEQ ID NO: 56921 - DNA, 15 bp, Homo sapiens
agaacttaaaactga

SEQ ID NO: 56922 - DNA, 15 bp, Homo sapiens
gaacttaaaactgag

SEQ ID NO: 56923 - DNA, 15 bp, Homo sapiens
aacttaaaactgagt

SEQ ID NO: 56924 - DNA, 15 bp, Homo sapiens
acttaaaactgagtt

SEQ ID NO: 56925 - DNA, 15 bp, Homo sapiens
cttaaaactgagttc

SEQ ID NO: 56926 - DNA, 15 bp, Homo sapiens
ttaaaactgagttca

SEQ ID NO: 56927 - DNA, 15 bp, Homo sapiens
taaaactgagttcag

SEQ ID NO: 56928 - DNA, 15 bp, Homo sapiens
aaaactgagttcagc

SEQ ID NO: 56929 - DNA, 15 bp, Homo sapiens
aaactgagttcagct

SEQ ID NO: 56930 - DNA, 15 bp, Homo sapiens
aactgagttcagcta

SEQ ID NO: 56931 - DNA, 15 bp, Homo sapiens
actgagttcagctag

SEQ ID NO: 56932 - DNA, 15 bp, Homo sapiens
ctgagttcagctagg

SEQ ID NO: 56933 - DNA, 15 bp, Homo sapiens
tgagttcagctaggc

SEQ ID NO: 56934 - DNA, 15 bp, Homo sapiens
gagttcagctaggct

SEQ ID NO: 56935 - DNA, 15 bp, Homo sapiens
agttcagctaggctc

SEQ ID NO: 56936 - DNA, 15 bp, Homo sapiens
gttcagctaggctca

SEQ ID NO: 56937 - DNA, 15 bp, Homo sapiens
ttcagctaggctcaa

SEQ ID NO: 56938 - DNA, 15 bp, Homo sapiens
tcagctaggctcaag

SEQ ID NO: 56939 - DNA, 15 bp, Homo sapiens
cagctaggctcaagt

SEQ ID NO: 56940 - DNA, 15 bp, Homo sapiens
agctaggctcaagtg

SEQ ID NO: 56941 - DNA, 15 bp, Homo sapiens
gctaggctcaagtgc

SEQ ID NO: 56942 - DNA, 15 bp, Homo sapiens
ctaggctcaagtgcc

SEQ ID NO: 56943 - DNA, 15 bp, Homo sapiens
taggctcaagtgccc

SEQ ID NO: 56944 - DNA, 15 bp, Homo sapiens
aggctcaagtgcccc

SEQ ID NO: 56945 - DNA, 15 bp, Homo sapiens
ggctcaagtgcccca

SEQ ID NO: 56946 - DNA, 15 bp, Homo sapiens
gctcaagtgccccac

SEQ ID NO: 56947 - DNA, 15 bp, Homo sapiens
ctcaagtgccccaca

SEQ ID NO: 56948 - DNA, 15 bp, Homo sapiens
tcaagtgccccacaa

SEQ ID NO: 56949 - DNA, 15 bp, Homo sapiens
caagtgccccacaat

SEQ ID NO: 56950 - DNA, 15 bp, Homo sapiens
aagtgccccacaatt

SEQ ID NO: 56951 - DNA, 15 bp, Homo sapiens
agtgccccacaattt

SEQ ID NO: 56952 - DNA, 15 bp, Homo sapiens
gtgccccacaatttt

SEQ ID NO: 56953 - DNA, 15 bp, Homo sapiens
tgccccacaattttt

SEQ ID NO: 56954 - DNA, 15 bp, Homo sapiens
gccccacaatttttg

SEQ ID NO: 56955 - DNA, 15 bp, Homo sapiens
ccccacaatttttgt

SEQ ID NO: 56956 - DNA, 15 bp, Homo sapiens
cccacaatttttgtc

SEQ ID NO: 56957 - DNA, 15 bp, Homo sapiens
ccacaatttttgtcc

SEQ ID NO: 56958 - DNA, 15 bp, Homo sapiens
cacaatttttgtccc

SEQ ID NO: 56959 - DNA, 15 bp, Homo sapiens
acaatttttgtccca

SEQ ID NO: 56960 - DNA, 15 bp, Homo sapiens
caatttttgtcccac

SEQ ID NO: 56961 - DNA, 15 bp, Homo sapiens
aatttttgtcccacc

SEQ ID NO: 56962 - DNA, 15 bp, Homo sapiens
atttttgtcccacca

SEQ ID NO: 56963 - DNA, 15 bp, Homo sapiens
tttttgtcccaccag

SEQ ID NO: 56964 - DNA, 15 bp, Homo sapiens
ttttgtcccaccaga

SEQ ID NO: 56965 - DNA, 15 bp, Homo sapiens
tttgtcccaccagac

SEQ ID NO: 56966 - DNA, 15 bp, Homo sapiens
ttgtcccaccagaca

SEQ ID NO: 56967 - DNA, 15 bp, Homo sapiens
tgtcccaccagacaa

SEQ ID NO: 56968 - DNA, 15 bp, Homo sapiens
gtcccaccagacaat

SEQ ID NO: 56969 - DNA, 15 bp, Homo sapiens
tcccaccagacaatt

SEQ ID NO: 56970 - DNA, 15 bp, Homo sapiens
cccaccagacaattt

SEQ ID NO: 56971 - DNA, 15 bp, Homo sapiens
ccaccagacaatttc

SEQ ID NO: 56972 - DNA, 15 bp, Homo sapiens
caccagacaatttca

SEQ ID NO: 56973 - DNA, 15 bp, Homo sapiens
accagacaatttcat

SEQ ID NO: 56974 - DNA, 15 bp, Homo sapiens
ccagacaatttcatg

SEQ ID NO: 56975 - DNA, 15 bp, Homo sapiens
cagacaatttcatga

SEQ ID NO: 56976 - DNA, 15 bp, Homo sapiens
agacaatttcatgaa

SEQ ID NO: 56977 - DNA, 15 bp, Homo sapiens
gacaatttcatgaat

SEQ ID NO: 56978 - DNA, 15 bp, Homo sapiens
acaatttcatgaata

SEQ ID NO: 56979 - DNA, 15 bp, Homo sapiens
caatttcatgaatat

SEQ ID NO: 56980 - DNA, 15 bp, Homo sapiens
aatttcatgaatatc

SEQ ID NO: 56981 - DNA, 15 bp, Homo sapiens
atttcatgaatatct

SEQ ID NO: 56982 - DNA, 15 bp, Homo sapiens
tttcatgaatatcta

SEQ ID NO: 56983 - DNA, 15 bp, Homo sapiens
ttcatgaatatctac

SEQ ID NO: 56984 - DNA, 15 bp, Homo sapiens
tcatgaatatctaca

SEQ ID NO: 56985 - DNA, 15 bp, Homo sapiens
catgaatatctacag

SEQ ID NO: 56986 - DNA, 15 bp, Homo sapiens
atgaatatctacaga

SEQ ID NO: 56987 - DNA, 15 bp, Homo sapiens
tgaatatctacagat

SEQ ID NO: 56988 - DNA, 15 bp, Homo sapiens
gaatatctacagatt

SEQ ID NO: 56989 - DNA, 15 bp, Homo sapiens
aatatctacagattg

SEQ ID NO: 56990 - DNA, 15 bp, Homo sapiens
atatctacagattgt

SEQ ID NO: 56991 - DNA, 15 bp, Homo sapiens
tatctacagattgtt

SEQ ID NO: 56992 - DNA, 15 bp, Homo sapiens
atctacagattgttc

SEQ ID NO: 56993 - DNA, 15 bp, Homo sapiens
tctacagattgttcc

SEQ ID NO: 56994 - DNA, 15 bp, Homo sapiens
ctacagattgttccc

SEQ ID NO: 56995 - DNA, 15 bp, Homo sapiens
tacagattgttccct

SEQ ID NO: 56996 - DNA, 15 bp, Homo sapiens
acagattgttccctc

SEQ ID NO: 56997 - DNA, 15 bp, Homo sapiens
cagattgttccctca

SEQ ID NO: 56998 - DNA, 15 bp, Homo sapiens
agattgttccctcaa

SEQ ID NO: 56999 - DNA, 15 bp, Homo sapiens
gattgttccctcaat

SEQ ID NO: 57000 - DNA, 15 bp, Homo sapiens
attgttccctcaata

SEQ ID NO: 57001 - DNA, 15 bp, Homo sapiens
ttgttccctcaatat

SEQ ID NO: 57002 - DNA, 15 bp, Homo sapiens
tgttccctcaatatg

SEQ ID NO: 57003 - DNA, 15 bp, Homo sapiens
gttccctcaatatgc

SEQ ID NO: 57004 - DNA, 15 bp, Homo sapiens
ttccctcaatatgcc

SEQ ID NO: 57005 - DNA, 15 bp, Homo sapiens
tccctcaatatgcct

SEQ ID NO: 57006 - DNA, 15 bp, Homo sapiens
ccctcaatatgcctc

SEQ ID NO: 57007 - DNA, 15 bp, Homo sapiens
cctcaatatgcctca

SEQ ID NO: 57008 - DNA, 15 bp, Homo sapiens
ctcaatatgcctcaa

SEQ ID NO: 57009 - DNA, 15 bp, Homo sapiens
ttgaggcatattgat

SEQ ID NO: 57010 - DNA, 15 bp, Homo sapiens
tgaggcatattgatt

SEQ ID NO: 57011 - DNA, 15 bp, Homo sapiens
gaggcatattgattt

SEQ ID NO: 57012 - DNA, 15 bp, Homo sapiens
aggcatattgatttg

SEQ ID NO: 57013 - DNA, 15 bp, Homo sapiens
ggcatattgatttgg

SEQ ID NO: 57014 - DNA, 15 bp, Homo sapiens
gcatattgatttggg

SEQ ID NO: 57015 - DNA, 15 bp, Homo sapiens
catattgatttgggg

SEQ ID NO: 57016 - DNA, 15 bp, Homo sapiens
atattgatttgggga

SEQ ID NO: 57017 - DNA, 15 bp, Homo sapiens
tattgatttggggag

SEQ ID NO: 57018 - DNA, 15 bp, Homo sapiens
attgatttggggagc

SEQ ID NO: 57019 - DNA, 15 bp, Homo sapiens
ttgatttggggagca

SEQ ID NO: 57020 - DNA, 15 bp, Homo sapiens
tgatttggggagcac

SEQ ID NO: 57021 - DNA, 15 bp, Homo sapiens
gatttggggagcaca

SEQ ID NO: 57022 - DNA, 15 bp, Homo sapiens
atttggggagcacag

SEQ ID NO: 57023 - DNA, 15 bp, Homo sapiens
tttggggagcacaga

SEQ ID NO: 57024 - DNA, 15 bp, Homo sapiens
ttggggagcacagac

SEQ ID NO: 57025 - DNA, 15 bp, Homo sapiens
tggggagcacagaca

SEQ ID NO: 57026 - DNA, 15 bp, Homo sapiens
ggggagcacagacaa

SEQ ID NO: 57027 - DNA, 15 bp, Homo sapiens
gggagcacagacaag

SEQ ID NO: 57028 - DNA, 15 bp, Homo sapiens
ggagcacagacaagt

SEQ ID NO: 57029 - DNA, 15 bp, Homo sapiens
gagcacagacaagtc

SEQ ID NO: 57030 - DNA, 15 bp, Homo sapiens
agcacagacaagtca

SEQ ID NO: 57031 - DNA, 15 bp, Homo sapiens
gcacagacaagtcaa

SEQ ID NO: 57032 - DNA, 15 bp, Homo sapiens
cacagacaagtcaag

SEQ ID NO: 57033 - DNA, 15 bp, Homo sapiens
acagacaagtcaagg

SEQ ID NO: 57034 - DNA, 15 bp, Homo sapiens
cagacaagtcaaggt

SEQ ID NO: 57035 - DNA, 15 bp, Homo sapiens
agacaagtcaaggtt

SEQ ID NO: 57036 - DNA, 15 bp, Homo sapiens
gacaagtcaaggttg

SEQ ID NO: 57037 - DNA, 15 bp, Homo sapiens
acaagtcaaggttga

SEQ ID NO: 57038 - DNA, 15 bp, Homo sapiens
caagtcaaggttgat

SEQ ID NO: 57039 - DNA, 15 bp, Homo sapiens
aagtcaaggttgatg

SEQ ID NO: 57040 - DNA, 15 bp, Homo sapiens
agtcaaggttgatgt

SEQ ID NO: 57041 - DNA, 15 bp, Homo sapiens
gtcaaggttgatgtg

SEQ ID NO: 57042 - DNA, 15 bp, Homo sapiens
tcaaggttgatgtgc

SEQ ID NO: 57043 - DNA, 15 bp, Homo sapiens
caaggttgatgtgca

SEQ ID NO: 57044 - DNA, 15 bp, Homo sapiens
aaggttgatgtgcat

SEQ ID NO: 57045 - DNA, 15 bp, Homo sapiens
aggttgatgtgcatc

SEQ ID NO: 57046 - DNA, 15 bp, Homo sapiens
ggttgatgtgcatcc

SEQ ID NO: 57047 - DNA, 15 bp, Homo sapiens
gttgatgtgcatccg

SEQ ID NO: 57048 - DNA, 15 bp, Homo sapiens
ttgatgtgcatccgc

SEQ ID NO: 57049 - DNA, 15 bp, Homo sapiens
tgatgtgcatccgct

SEQ ID NO: 57050 - DNA, 15 bp, Homo sapiens
gatgtgcatccgctg

SEQ ID NO: 57051 - DNA, 15 bp, Homo sapiens
atgtgcatccgctga

SEQ ID NO: 57052 - DNA, 15 bp, Homo sapiens
tgtgcatccgctgaa

SEQ ID NO: 57053 - DNA, 15 bp, Homo sapiens
gtgcatccgctgaac

SEQ ID NO: 57054 - DNA, 15 bp, Homo sapiens
tgcatccgctgaaca

SEQ ID NO: 57055 - DNA, 15 bp, Homo sapiens
gcatccgctgaacat

SEQ ID NO: 57056 - DNA, 15 bp, Homo sapiens
catccgctgaacatg

SEQ ID NO: 57057 - DNA, 15 bp, Homo sapiens
atccgctgaacatga

SEQ ID NO: 57058 - DNA, 15 bp, Homo sapiens
tccgctgaacatgat

SEQ ID NO: 57059 - DNA, 15 bp, Homo sapiens
ccgctgaacatgatc

SEQ ID NO: 57060 - DNA, 15 bp, Homo sapiens
cgctgaacatgatct

SEQ ID NO: 57061 - DNA, 15 bp, Homo sapiens
gctgaacatgatctt

SEQ ID NO: 57062 - DNA, 15 bp, Homo sapiens
ctgaacatgatctta

SEQ ID NO: 57063 - DNA, 15 bp, Homo sapiens
tgaacatgatcttaa

SEQ ID NO: 57064 - DNA, 15 bp, Homo sapiens
gaacatgatcttaag

SEQ ID NO: 57065 - DNA, 15 bp, Homo sapiens
aacatgatcttaagt

SEQ ID NO: 57066 - DNA, 15 bp, Homo sapiens
acatgatcttaagtt

SEQ ID NO: 57067 - DNA, 15 bp, Homo sapiens
catgatcttaagttg

SEQ ID NO: 57068 - DNA, 15 bp, Homo sapiens
atgatcttaagttgt

SEQ ID NO: 57069 - DNA, 15 bp, Homo sapiens
tgatcttaagttgtt

SEQ ID NO: 57070 - DNA, 15 bp, Homo sapiens
gatcttaagttgttg

SEQ ID NO: 57071 - DNA, 15 bp, Homo sapiens
atcttaagttgttga

SEQ ID NO: 57072 - DNA, 15 bp, Homo sapiens
tcttaagttgttgaa

SEQ ID NO: 57073 - DNA, 15 bp, Homo sapiens
cttaagttgttgaag

SEQ ID NO: 57074 - DNA, 15 bp, Homo sapiens
ttaagttgttgaagt

SEQ ID NO: 57075 - DNA, 15 bp, Homo sapiens
taagttgttgaagta

SEQ ID NO: 57076 - DNA, 15 bp, Homo sapiens
aagttgttgaagtag

SEQ ID NO: 57077 - DNA, 15 bp, Homo sapiens
agttgttgaagtagg

SEQ ID NO: 57078 - DNA, 15 bp, Homo sapiens
gttgttgaagtaggt

SEQ ID NO: 57079 - DNA, 15 bp, Homo sapiens
ttgttgaagtaggta

SEQ ID NO: 57080 - DNA, 15 bp, Homo sapiens
tgttgaagtaggtat

SEQ ID NO: 57081 - DNA, 15 bp, Homo sapiens
gttgaagtaggtatt

SEQ ID NO: 57082 - DNA, 15 bp, Homo sapiens
ttgaagtaggtatta

SEQ ID NO: 57083 - DNA, 15 bp, Homo sapiens
tgaagtaggtattat

SEQ ID NO: 57084 - DNA, 15 bp, Homo sapiens
gaagtaggtattatt

SEQ ID NO: 57085 - DNA, 15 bp, Homo sapiens
aagtaggtattatta

SEQ ID NO: 57086 - DNA, 15 bp, Homo sapiens
agtaggtattattaa

SEQ ID NO: 57087 - DNA, 15 bp, Homo sapiens
gtaggtattattaat

SEQ ID NO: 57088 - DNA, 15 bp, Homo sapiens
taggtattattaatg

SEQ ID NO: 57089 - DNA, 15 bp, Homo sapiens
aggtattattaatga

SEQ ID NO: 57090 - DNA, 15 bp, Homo sapiens
ggtattattaatgaa

SEQ ID NO: 57091 - DNA, 15 bp, Homo sapiens
gtattattaatgaac

SEQ ID NO: 57092 - DNA, 15 bp, Homo sapiens
tattattaatgaacg

SEQ ID NO: 57093 - DNA, 15 bp, Homo sapiens
attattaatgaacga

SEQ ID NO: 57094 - DNA, 15 bp, Homo sapiens
ttattaatgaacgaa

SEQ ID NO: 57095 - DNA, 15 bp, Homo sapiens
tattaatgaacgaac

SEQ ID NO: 57096 - DNA, 15 bp, Homo sapiens
attaatgaacgaacg

SEQ ID NO: 57097 - DNA, 15 bp, Homo sapiens
ttaatgaacgaacgt

SEQ ID NO: 57098 - DNA, 15 bp, Homo sapiens
taatgaacgaacgtc

SEQ ID NO: 57099 - DNA, 15 bp, Homo sapiens
aatgaacgaacgtct

SEQ ID NO: 57100 - DNA, 15 bp, Homo sapiens
atgaacgaacgtcta

SEQ ID NO: 57101 - DNA, 15 bp, Homo sapiens
tgaacgaacgtctat

SEQ ID NO: 57102 - DNA, 15 bp, Homo sapiens
gaacgaacgtctatt

SEQ ID NO: 57103 - DNA, 15 bp, Homo sapiens
aacgaacgtctattt

SEQ ID NO: 57104 - DNA, 15 bp, Homo sapiens
acgaacgtctatttt

SEQ ID NO: 57105 - DNA, 15 bp, Homo sapiens
cgaacgtctatttta

SEQ ID NO: 57106 - DNA, 15 bp, Homo sapiens
gaacgtctattttag

SEQ ID NO: 57107 - DNA, 15 bp, Homo sapiens
aacgtctattttagc

SEQ ID NO: 57108 - DNA, 15 bp, Homo sapiens
acgtctattttagct

SEQ ID NO: 57109 - DNA, 15 bp, Homo sapiens
cgtctattttagctc

SEQ ID NO: 57110 - DNA, 15 bp, Homo sapiens
gtctattttagctcc

SEQ ID NO: 57111 - DNA, 15 bp, Homo sapiens
tctattttagctcca

SEQ ID NO: 57112 - DNA, 15 bp, Homo sapiens
ctattttagctccaa

SEQ ID NO: 57113 - DNA, 15 bp, Homo sapiens
tattttagctccaag

SEQ ID NO: 57114 - DNA, 15 bp, Homo sapiens
attttagctccaaga

SEQ ID NO: 57115 - DNA, 15 bp, Homo sapiens
ttttagctccaagag

SEQ ID NO: 57116 - DNA, 15 bp, Homo sapiens
tttagctccaagagc

SEQ ID NO: 57117 - DNA, 15 bp, Homo sapiens
ttagctccaagagcc

SEQ ID NO: 57118 - DNA, 15 bp, Homo sapiens
tagctccaagagccc

SEQ ID NO: 57119 - DNA, 15 bp, Homo sapiens
agctccaagagcccc

SEQ ID NO: 57120 - DNA, 15 bp, Homo sapiens
gctccaagagcccct

SEQ ID NO: 57121 - DNA, 15 bp, Homo sapiens
ctccaagagcccctg

SEQ ID NO: 57122 - DNA, 15 bp, Homo sapiens
tccaagagcccctgg

SEQ ID NO: 57123 - DNA, 15 bp, Homo sapiens
ccaagagcccctggt

SEQ ID NO: 57124 - DNA, 15 bp, Homo sapiens
caagagcccctggtc

SEQ ID NO: 57125 - DNA, 15 bp, Homo sapiens
aagagcccctggtct

SEQ ID NO: 57126 - DNA, 15 bp, Homo sapiens
agagcccctggtctt

SEQ ID NO: 57127 - DNA, 15 bp, Homo sapiens
gagcccctggtcttc

SEQ ID NO: 57128 - DNA, 15 bp, Homo sapiens
agcccctggtcttcc

SEQ ID NO: 57129 - DNA, 15 bp, Homo sapiens
gcccctggtcttcca

SEQ ID NO: 57130 - DNA, 15 bp, Homo sapiens
cccctggtcttccag

SEQ ID NO: 57131 - DNA, 15 bp, Homo sapiens
ccctggtcttccaga

SEQ ID NO: 57132 - DNA, 15 bp, Homo sapiens
cctggtcttccagaa

SEQ ID NO: 57133 - DNA, 15 bp, Homo sapiens
ctggtcttccagaag

SEQ ID NO: 57134 - DNA, 15 bp, Homo sapiens
tggtcttccagaaga

SEQ ID NO: 57135 - DNA, 15 bp, Homo sapiens
ggtcttccagaagag

SEQ ID NO: 57136 - DNA, 15 bp, Homo sapiens
gtcttccagaagaga

SEQ ID NO: 57137 - DNA, 15 bp, Homo sapiens
tcttccagaagagac

SEQ ID NO: 57138 - DNA, 15 bp, Homo sapiens
cttccagaagagact

SEQ ID NO: 57139 - DNA, 15 bp, Homo sapiens
ttccagaagagactc

SEQ ID NO: 57140 - DNA, 15 bp, Homo sapiens
tccagaagagactcc

SEQ ID NO: 57141 - DNA, 15 bp, Homo sapiens
ccagaagagactccc

SEQ ID NO: 57142 - DNA, 15 bp, Homo sapiens
cagaagagactccca

SEQ ID NO: 57143 - DNA, 15 bp, Homo sapiens
agaagagactcccaa

SEQ ID NO: 57144 - DNA, 15 bp, Homo sapiens
gaagagactcccaat

SEQ ID NO: 57145 - DNA, 15 bp, Homo sapiens
aagagactcccaatg

SEQ ID NO: 57146 - DNA, 15 bp, Homo sapiens
agagactcccaatga

SEQ ID NO: 57147 - DNA, 15 bp, Homo sapiens
gagactcccaatgat

SEQ ID NO: 57148 - DNA, 15 bp, Homo sapiens
agactcccaatgatc

SEQ ID NO: 57149 - DNA, 15 bp, Homo sapiens
gactcccaatgatct

SEQ ID NO: 57150 - DNA, 15 bp, Homo sapiens
actcccaatgatctt

SEQ ID NO: 57151 - DNA, 15 bp, Homo sapiens
ctcccaatgatcttc

SEQ ID NO: 57152 - DNA, 15 bp, Homo sapiens
tcccaatgatcttcc

SEQ ID NO: 57153 - DNA, 15 bp, Homo sapiens
cccaatgatcttcca

SEQ ID NO: 57154 - DNA, 15 bp, Homo sapiens
ccaatgatcttccag

SEQ ID NO: 57155 - DNA, 15 bp, Homo sapiens
caatgatcttccaga

SEQ ID NO: 57156 - DNA, 15 bp, Homo sapiens
aatgatcttccagaa

SEQ ID NO: 57157 - DNA, 15 bp, Homo sapiens
atgatcttccagaag

SEQ ID NO: 57158 - DNA, 15 bp, Homo sapiens
tgatcttccagaagc

SEQ ID NO: 57159 - DNA, 15 bp, Homo sapiens
gatcttccagaagca

SEQ ID NO: 57160 - DNA, 15 bp, Homo sapiens
atcttccagaagcag

SEQ ID NO: 57161 - DNA, 15 bp, Homo sapiens
tcttccagaagcagc

SEQ ID NO: 57162 - DNA, 15 bp, Homo sapiens
cttccagaagcagct

SEQ ID NO: 57163 - DNA, 15 bp, Homo sapiens
ttccagaagcagctg

SEQ ID NO: 57164 - DNA, 15 bp, Homo sapiens
tccagaagcagctgg

SEQ ID NO: 57165 - DNA, 15 bp, Homo sapiens
ccagaagcagctggg

SEQ ID NO: 57166 - DNA, 15 bp, Homo sapiens
cagaagcagctgggc

SEQ ID NO: 57167 - DNA, 15 bp, Homo sapiens
agaagcagctgggct

SEQ ID NO: 57168 - DNA, 15 bp, Homo sapiens
gaagcagctgggctt

SEQ ID NO: 57169 - DNA, 15 bp, Homo sapiens
aagcagctgggcttc

SEQ ID NO: 57170 - DNA, 15 bp, Homo sapiens
agcagctgggcttct

SEQ ID NO: 57171 - DNA, 15 bp, Homo sapiens
gcagctgggcttctt

SEQ ID NO: 57172 - DNA, 15 bp, Homo sapiens
cagctgggcttcttt

SEQ ID NO: 57173 - DNA, 15 bp, Homo sapiens
agctgggcttctttt

SEQ ID NO: 57174 - DNA, 15 bp, Homo sapiens
gctgggcttcttttg

SEQ ID NO: 57175 - DNA, 15 bp, Homo sapiens
ctgggcttcttttgg

SEQ ID NO: 57176 - DNA, 15 bp, Homo sapiens
tgggcttcttttggt

SEQ ID NO: 57177 - DNA, 15 bp, Homo sapiens
gggcttcttttggtc

SEQ ID NO: 57178 - DNA, 15 bp, Homo sapiens
ggcttcttttggtcc

SEQ ID NO: 57179 - DNA, 15 bp, Homo sapiens
gcttcttttggtcct

SEQ ID NO: 57180 - DNA, 15 bp, Homo sapiens
cttcttttggtcctc

SEQ ID NO: 57181 - DNA, 15 bp, Homo sapiens
ttcttttggtcctcc

SEQ ID NO: 57182 - DNA, 15 bp, Homo sapiens
tcttttggtcctccc

SEQ ID NO: 57183 - DNA, 15 bp, Homo sapiens
cttttggtcctcccc

SEQ ID NO: 57184 - DNA, 15 bp, Homo sapiens
ttttggtcctccccc

SEQ ID NO: 57185 - DNA, 15 bp, Homo sapiens
tttggtcctccccca

SEQ ID NO: 57186 - DNA, 15 bp, Homo sapiens
ttggtcctcccccac

SEQ ID NO: 57187 - DNA, 15 bp, Homo sapiens
tggtcctcccccacc

SEQ ID NO: 57188 - DNA, 15 bp, Homo sapiens
ggtcctcccccaccc

SEQ ID NO: 57189 - DNA, 15 bp, Homo sapiens
gtcctcccccaccca

SEQ ID NO: 57190 - DNA, 15 bp, Homo sapiens
tcctcccccacccag

SEQ ID NO: 57191 - DNA, 15 bp, Homo sapiens
cctcccccacccagg

SEQ ID NO: 57192 - DNA, 15 bp, Homo sapiens
ctcccccacccaggt

SEQ ID NO: 57193 - DNA, 15 bp, Homo sapiens
tcccccacccaggtg

SEQ ID NO: 57194 - DNA, 15 bp, Homo sapiens
cccccacccaggtgc

SEQ ID NO: 57195 - DNA, 15 bp, Homo sapiens
ccccacccaggtgca

SEQ ID NO: 57196 - DNA, 15 bp, Homo sapiens
cccacccaggtgcag

SEQ ID NO: 57197 - DNA, 15 bp, Homo sapiens
ccacccaggtgcagt

SEQ ID NO: 57198 - DNA, 15 bp, Homo sapiens
cacccaggtgcagtc

SEQ ID NO: 57199 - DNA, 15 bp, Homo sapiens
acccaggtgcagtcc

SEQ ID NO: 57200 - DNA, 15 bp, Homo sapiens
cccaggtgcagtccc

SEQ ID NO: 57201 - DNA, 15 bp, Homo sapiens
ccaggtgcagtcccg

SEQ ID NO: 57202 - DNA, 15 bp, Homo sapiens
caggtgcagtcccgt

SEQ ID NO: 57203 - DNA, 15 bp, Homo sapiens
aggtgcagtcccgtt

SEQ ID NO: 57204 - DNA, 15 bp, Homo sapiens
ggtgcagtcccgttc

SEQ ID NO: 57205 - DNA, 15 bp, Homo sapiens
gtgcagtcccgttct

SEQ ID NO: 57206 - DNA, 15 bp, Homo sapiens
tgcagtcccgttctc

SEQ ID NO: 57207 - DNA, 15 bp, Homo sapiens
gcagtcccgttctcc

SEQ ID NO: 57208 - DNA, 15 bp, Homo sapiens
cagtcccgttctccc

SEQ ID NO: 57209 - DNA, 15 bp, Homo sapiens
agtcccgttctccct

SEQ ID NO: 57210 - DNA, 15 bp, Homo sapiens
gtcccgttctccctg

SEQ ID NO: 57211 - DNA, 15 bp, Homo sapiens
tcccgttctccctgc

SEQ ID NO: 57212 - DNA, 15 bp, Homo sapiens
cccgttctccctgcc

SEQ ID NO: 57213 - DNA, 15 bp, Homo sapiens
ccgttctccctgcct

SEQ ID NO: 57214 - DNA, 15 bp, Homo sapiens
cgttctccctgcctg

SEQ ID NO: 57215 - DNA, 15 bp, Homo sapiens
gttctccctgcctgg

SEQ ID NO: 57216 - DNA, 15 bp, Homo sapiens
ttctccctgcctggg

SEQ ID NO: 57217 - DNA, 15 bp, Homo sapiens
tctccctgcctgggt

SEQ ID NO: 57218 - DNA, 15 bp, Homo sapiens
ctccctgcctgggtg

SEQ ID NO: 57219 - DNA, 15 bp, Homo sapiens
tccctgcctgggtga

SEQ ID NO: 57220 - DNA, 15 bp, Homo sapiens
ccctgcctgggtgag

SEQ ID NO: 57221 - DNA, 15 bp, Homo sapiens
cctgcctgggtgagt

SEQ ID NO: 57222 - DNA, 15 bp, Homo sapiens
ctgcctgggtgagtt

SEQ ID NO: 57223 - DNA, 15 bp, Homo sapiens
tgcctgggtgagttt

SEQ ID NO: 57224 - DNA, 15 bp, Homo sapiens
gcctgggtgagtttg

SEQ ID NO: 57225 - DNA, 15 bp, Homo sapiens
cctgggtgagtttga

SEQ ID NO: 57226 - DNA, 15 bp, Homo sapiens
ctgggtgagtttgat

SEQ ID NO: 57227 - DNA, 15 bp, Homo sapiens
tgggtgagtttgatt

SEQ ID NO: 57228 - DNA, 15 bp, Homo sapiens
gggtgagtttgattc

SEQ ID NO: 57229 - DNA, 15 bp, Homo sapiens
ggtgagtttgattcc

SEQ ID NO: 57230 - DNA, 15 bp, Homo sapiens
gtgagtttgattcct

SEQ ID NO: 57231 - DNA, 15 bp, Homo sapiens
tgagtttgattcctc

SEQ ID NO: 57232 - DNA, 15 bp, Homo sapiens
gagtttgattcctct

SEQ ID NO: 57233 - DNA, 15 bp, Homo sapiens
agtttgattcctctg

SEQ ID NO: 57234 - DNA, 15 bp, Homo sapiens
gtttgattcctctgc

SEQ ID NO: 57235 - DNA, 15 bp, Homo sapiens
tttgattcctctgcc

SEQ ID NO: 57236 - DNA, 15 bp, Homo sapiens
ttgattcctctgccg

SEQ ID NO: 57237 - DNA, 15 bp, Homo sapiens
tgattcctctgccgt

SEQ ID NO: 57238 - DNA, 15 bp, Homo sapiens
gattcctctgccgtg

SEQ ID NO: 57239 - DNA, 15 bp, Homo sapiens
attcctctgccgtgg

SEQ ID NO: 57240 - DNA, 15 bp, Homo sapiens
ttcctctgccgtgga

SEQ ID NO: 57241 - DNA, 15 bp, Homo sapiens
tcctctgccgtggaa

SEQ ID NO: 57242 - DNA, 15 bp, Homo sapiens
cctctgccgtggaat

SEQ ID NO: 57243 - DNA, 15 bp, Homo sapiens
ctctgccgtggaata

SEQ ID NO: 57244 - DNA, 15 bp, Homo sapiens
tctgccgtggaatag

SEQ ID NO: 57245 - DNA, 15 bp, Homo sapiens
ctgccgtggaatagg

SEQ ID NO: 57246 - DNA, 15 bp, Homo sapiens
tgccgtggaataggc

SEQ ID NO: 57247 - DNA, 15 bp, Homo sapiens
gccgtggaataggct

SEQ ID NO: 57248 - DNA, 15 bp, Homo sapiens
ccgtggaataggcta

SEQ ID NO: 57249 - DNA, 15 bp, Homo sapiens
cgtggaataggctag

SEQ ID NO: 57250 - DNA, 15 bp, Homo sapiens
gtggaataggctagg

SEQ ID NO: 57251 - DNA, 15 bp, Homo sapiens
tggaataggctaggc

SEQ ID NO: 57252 - DNA, 15 bp, Homo sapiens
ggaataggctaggct

SEQ ID NO: 57253 - DNA, 15 bp, Homo sapiens
gaataggctaggctg

SEQ ID NO: 57254 - DNA, 15 bp, Homo sapiens
aataggctaggctgc

SEQ ID NO: 57255 - DNA, 15 bp, Homo sapiens
ataggctaggctgct

SEQ ID NO: 57256 - DNA, 15 bp, Homo sapiens
taggctaggctgcta

SEQ ID NO: 57257 - DNA, 15 bp, Homo sapiens
aggctaggctgctac

SEQ ID NO: 57258 - DNA, 15 bp, Homo sapiens
ggctaggctgctacc

SEQ ID NO: 57259 - DNA, 15 bp, Homo sapiens
gctaggctgctacct

SEQ ID NO: 57260 - DNA, 15 bp, Homo sapiens
ctaggctgctacctc

SEQ ID NO: 57261 - DNA, 15 bp, Homo sapiens
taggctgctacctct

SEQ ID NO: 57262 - DNA, 15 bp, Homo sapiens
aggctgctacctctt

SEQ ID NO: 57263 - DNA, 15 bp, Homo sapiens
ggctgctacctcttg

SEQ ID NO: 57264 - DNA, 15 bp, Homo sapiens
gctgctacctcttga

SEQ ID NO: 57265 - DNA, 15 bp, Homo sapiens
ctgctacctcttgag

SEQ ID NO: 57266 - DNA, 15 bp, Homo sapiens
tgctacctcttgagc

SEQ ID NO: 57267 - DNA, 15 bp, Homo sapiens
gctacctcttgagcc

SEQ ID NO: 57268 - DNA, 15 bp, Homo sapiens
ctacctcttgagcct

SEQ ID NO: 57269 - DNA, 15 bp, Homo sapiens
tacctcttgagcctc

SEQ ID NO: 57270 - DNA, 15 bp, Homo sapiens
acctcttgagcctct

SEQ ID NO: 57271 - DNA, 15 bp, Homo sapiens
cctcttgagcctctt

SEQ ID NO: 57272 - DNA, 15 bp, Homo sapiens
ctcttgagcctcttc

SEQ ID NO: 57273 - DNA, 15 bp, Homo sapiens
tcttgagcctcttcc

SEQ ID NO: 57274 - DNA, 15 bp, Homo sapiens
cttgagcctcttcca

SEQ ID NO: 57275 - DNA, 15 bp, Homo sapiens
ttgagcctcttccac

SEQ ID NO: 57276 - DNA, 15 bp, Homo sapiens
tgagcctcttccacc

SEQ ID NO: 57277 - DNA, 15 bp, Homo sapiens
gagcctcttccacca

SEQ ID NO: 57278 - DNA, 15 bp, Homo sapiens
agcctcttccaccag

SEQ ID NO: 57279 - DNA, 15 bp, Homo sapiens
gcctcttccaccagg

SEQ ID NO: 57280 - DNA, 15 bp, Homo sapiens
cctcttccaccaggc

SEQ ID NO: 57281 - DNA, 15 bp, Homo sapiens
ctcttccaccaggcc

SEQ ID NO: 57282 - DNA, 15 bp, Homo sapiens
tcttccaccaggcca

SEQ ID NO: 57283 - DNA, 15 bp, Homo sapiens
cttccaccaggccat

SEQ ID NO: 57284 - DNA, 15 bp, Homo sapiens
ttccaccaggccatc

SEQ ID NO: 57285 - DNA, 15 bp, Homo sapiens
tccaccaggccatcc

SEQ ID NO: 57286 - DNA, 15 bp, Homo sapiens
ccaccaggccatcca

SEQ ID NO: 57287 - DNA, 15 bp, Homo sapiens
caccaggccatccat

SEQ ID NO: 57288 - DNA, 15 bp, Homo sapiens
accaggccatccatt

SEQ ID NO: 57289 - DNA, 15 bp, Homo sapiens
ccaggccatccatta

SEQ ID NO: 57290 - DNA, 15 bp, Homo sapiens
caggccatccattag

SEQ ID NO: 57291 - DNA, 15 bp, Homo sapiens
aggccatccattagg

SEQ ID NO: 57292 - DNA, 15 bp, Homo sapiens
ggccatccattaggt

SEQ ID NO: 57293 - DNA, 15 bp, Homo sapiens
gccatccattaggtg

SEQ ID NO: 57294 - DNA, 15 bp, Homo sapiens
ccatccattaggtgg

SEQ ID NO: 57295 - DNA, 15 bp, Homo sapiens
catccattaggtggc

SEQ ID NO: 57296 - DNA, 15 bp, Homo sapiens
atccattaggtggcg

SEQ ID NO: 57297 - DNA, 15 bp, Homo sapiens
tccattaggtggcga

SEQ ID NO: 57298 - DNA, 15 bp, Homo sapiens
ccattaggtggcgac

SEQ ID NO: 57299 - DNA, 15 bp, Homo sapiens
cattaggtggcgaca

SEQ ID NO: 57300 - DNA, 15 bp, Homo sapiens
attaggtggcgacag

SEQ ID NO: 57301 - DNA, 15 bp, Homo sapiens
ttaggtggcgacaga

SEQ ID NO: 57302 - DNA, 15 bp, Homo sapiens
taggtggcgacagag

SEQ ID NO: 57303 - DNA, 15 bp, Homo sapiens
aggtggcgacagaga

SEQ ID NO: 57304 - DNA, 15 bp, Homo sapiens
ggtggcgacagagag

SEQ ID NO: 57305 - DNA, 15 bp, Homo sapiens
gtggcgacagagagc

SEQ ID NO: 57306 - DNA, 15 bp, Homo sapiens
tggcgacagagagca

SEQ ID NO: 57307 - DNA, 15 bp, Homo sapiens
ggcgacagagagcac

SEQ ID NO: 57308 - DNA, 15 bp, Homo sapiens
gcgacagagagcact

SEQ ID NO: 57309 - DNA, 15 bp, Homo sapiens
cgacagagagcacta

SEQ ID NO: 57310 - DNA, 15 bp, Homo sapiens
gacagagagcactaa

SEQ ID NO: 57311 - DNA, 15 bp, Homo sapiens
acagagagcactaaa

SEQ ID NO: 57312 - DNA, 15 bp, Homo sapiens
cagagagcactaaaa

SEQ ID NO: 57313 - DNA, 15 bp, Homo sapiens
agagagcactaaaag

SEQ ID NO: 57314 - DNA, 15 bp, Homo sapiens
gagagcactaaaagg

SEQ ID NO: 57315 - DNA, 15 bp, Homo sapiens
agagcactaaaagga

SEQ ID NO: 57316 - DNA, 15 bp, Homo sapiens
gagcactaaaaggaa

SEQ ID NO: 57317 - DNA, 15 bp, Homo sapiens
agcactaaaaggaac

SEQ ID NO: 57318 - DNA, 15 bp, Homo sapiens
gcactaaaaggaact

SEQ ID NO: 57319 - DNA, 15 bp, Homo sapiens
cactaaaaggaacta

SEQ ID NO: 57320 - DNA, 15 bp, Homo sapiens
actaaaaggaactac

SEQ ID NO: 57321 - DNA, 15 bp, Homo sapiens
ctaaaaggaactact

SEQ ID NO: 57322 - DNA, 15 bp, Homo sapiens
taaaaggaactacta

SEQ ID NO: 57323 - DNA, 15 bp, Homo sapiens
aaaaggaactactat

SEQ ID NO: 57324 - DNA, 15 bp, Homo sapiens
aaaggaactactatg

SEQ ID NO: 57325 - DNA, 15 bp, Homo sapiens
aaggaactactatgg

SEQ ID NO: 57326 - DNA, 15 bp, Homo sapiens
aggaactactatgga

SEQ ID NO: 57327 - DNA, 15 bp, Homo sapiens
ggaactactatggaa

SEQ ID NO: 57328 - DNA, 15 bp, Homo sapiens
gaactactatggaaa

SEQ ID NO: 57329 - DNA, 15 bp, Homo sapiens
aactactatggaaat

SEQ ID NO: 57330 - DNA, 15 bp, Homo sapiens
actactatggaaata

SEQ ID NO: 57331 - DNA, 15 bp, Homo sapiens
ctactatggaaataa

SEQ ID NO: 57332 - DNA, 15 bp, Homo sapiens
tactatggaaataaa

SEQ ID NO: 57333 - DNA, 15 bp, Homo sapiens
actatggaaataaaa

SEQ ID NO: 57334 - DNA, 15 bp, Homo sapiens
ctatggaaataaaac

SEQ ID NO: 57335 - DNA, 15 bp, Homo sapiens
tatggaaataaaact

SEQ ID NO: 57336 - DNA, 15 bp, Homo sapiens
atggaaataaaactt

SEQ ID NO: 57337 - DNA, 15 bp, Homo sapiens
tggaaataaaacttg

SEQ ID NO: 57338 - DNA, 15 bp, Homo sapiens
ggaaataaaacttgt

SEQ ID NO: 57339 - DNA, 15 bp, Homo sapiens
gaaataaaacttgtt

SEQ ID NO: 57340 - DNA, 15 bp, Homo sapiens
aaataaaacttgttt

SEQ ID NO: 57341 - DNA, 15 bp, Homo sapiens
aataaaacttgtttt

SEQ ID NO: 57342 - DNA, 15 bp, Homo sapiens
ataaaacttgttttg

SEQ ID NO: 57343 - DNA, 15 bp, Homo sapiens
taaaacttgttttgc

SEQ ID NO: 57344 - DNA, 15 bp, Homo sapiens
aaaacttgttttgct

SEQ ID NO: 57345 - DNA, 15 bp, Homo sapiens
aaacttgttttgctt

SEQ ID NO: 57346 - DNA, 15 bp, Homo sapiens
aacttgttttgcttc

SEQ ID NO: 57347 - DNA, 15 bp, Homo sapiens
acttgttttgcttct

SEQ ID NO: 57348 - DNA, 15 bp, Homo sapiens
cttgttttgcttctt

SEQ ID NO: 57349 - DNA, 15 bp, Homo sapiens
ttgttttgcttcttg

SEQ ID NO: 57350 - DNA, 15 bp, Homo sapiens
tgttttgcttcttgg

SEQ ID NO: 57351 - DNA, 15 bp, Homo sapiens
gttttgcttcttggg

SEQ ID NO: 57352 - DNA, 15 bp, Homo sapiens
ttttgcttcttgggg

SEQ ID NO: 57353 - DNA, 15 bp, Homo sapiens
tttgcttcttggggg

SEQ ID NO: 57354 - DNA, 15 bp, Homo sapiens
ttgcttcttgggggg

SEQ ID NO: 57355 - DNA, 15 bp, Homo sapiens
tgcttcttgggggga

SEQ ID NO: 57356 - DNA, 15 bp, Homo sapiens
gcttcttggggggaa

SEQ ID NO: 57357 - DNA, 15 bp, Homo sapiens
cttcttggggggaaa

SEQ ID NO: 57358 - DNA, 15 bp, Homo sapiens
ttcttggggggaaaa

SEQ ID NO: 57359 - DNA, 15 bp, Homo sapiens
tcttggggggaaaaa

SEQ ID NO: 57360 - DNA, 15 bp, Homo sapiens
cttggggggaaaaaa

SEQ ID NO: 57361 - DNA, 15 bp, Homo sapiens
ttggggggaaaaaaa

SEQ ID NO: 57362 - DNA, 15 bp, Homo sapiens
ggggggaaaaaaaaa

SEQ ID NO: 57363 - DNA, 15 bp, Homo sapiens
gggggaaaaaaaaag

SEQ ID NO: 57364 - DNA, 15 bp, Homo sapiens
ggggaaaaaaaaaga

SEQ ID NO: 57365 - DNA, 15 bp, Homo sapiens
gggaaaaaaaaagaa

SEQ ID NO: 57366 - DNA, 15 bp, Homo sapiens
ggaaaaaaaaagaaa

SEQ ID NO: 57367 - DNA, 15 bp, Homo sapiens
gaaaaaaaaagaaaa

SEQ ID NO: 57368 - DNA, 15 bp, Homo sapiens
aaaaaaagaaaaagg

SEQ ID NO: 57369 - DNA, 15 bp, Homo sapiens
aaaaaagaaaaaggc

SEQ ID NO: 57370 - DNA, 15 bp, Homo sapiens
aaaaagaaaaaggct

SEQ ID NO: 57371 - DNA, 15 bp, Homo sapiens
aaaagaaaaaggctt

SEQ ID NO: 57372 - DNA, 15 bp, Homo sapiens
aaagaaaaaggcttg

SEQ ID NO: 57373 - DNA, 15 bp, Homo sapiens
aagaaaaaggcttgt

SEQ ID NO: 57374 - DNA, 15 bp, Homo sapiens
agaaaaaggcttgtg

SEQ ID NO: 57375 - DNA, 15 bp, Homo sapiens
gaaaaaggcttgtgg

SEQ ID NO: 57376 - DNA, 15 bp, Homo sapiens
aaaaaggcttgtggg

SEQ ID NO: 57377 - DNA, 15 bp, Homo sapiens
aaaaggcttgtgggg

SEQ ID NO: 57378 - DNA, 15 bp, Homo sapiens
aaaggcttgtggggc

SEQ ID NO: 57379 - DNA, 15 bp, Homo sapiens
aaggcttgtggggcg

SEQ ID NO: 57380 - DNA, 15 bp, Homo sapiens
aggcttgtggggcgt

SEQ ID NO: 57381 - DNA, 15 bp, Homo sapiens
ggcttgtggggcgtg

SEQ ID NO: 57382 - DNA, 15 bp, Homo sapiens
gcttgtggggcgtgt

SEQ ID NO: 57383 - DNA, 15 bp, Homo sapiens
cttgtggggcgtgtg

SEQ ID NO: 57384 - DNA, 15 bp, Homo sapiens
ttgtggggcgtgtgt

SEQ ID NO: 57385 - DNA, 15 bp, Homo sapiens
tgtggggcgtgtgtg

SEQ ID NO: 57386 - DNA, 15 bp, Homo sapiens
gtggggcgtgtgtgc

SEQ ID NO: 57387 - DNA, 15 bp, Homo sapiens
tggggcgtgtgtgca

SEQ ID NO: 57388 - DNA, 15 bp, Homo sapiens
ggggcgtgtgtgcat

SEQ ID NO: 57389 - DNA, 15 bp, Homo sapiens
gggcgtgtgtgcatt

SEQ ID NO: 57390 - DNA, 15 bp, Homo sapiens
ggcgtgtgtgcattt

SEQ ID NO: 57391 - DNA, 15 bp, Homo sapiens
gcgtgtgtgcatttt

SEQ ID NO: 57392 - DNA, 15 bp, Homo sapiens
cgtgtgtgcatttta

SEQ ID NO: 57393 - DNA, 15 bp, Homo sapiens
gtgtgtgcattttag

SEQ ID NO: 57394 - DNA, 15 bp, Homo sapiens
tgtgtgcattttagt

SEQ ID NO: 57395 - DNA, 15 bp, Homo sapiens
gtgtgcattttagtc

SEQ ID NO: 57396 - DNA, 15 bp, Homo sapiens
tgtgcattttagtca

SEQ ID NO: 57397 - DNA, 15 bp, Homo sapiens
gtgcattttagtcag

SEQ ID NO: 57398 - DNA, 15 bp, Homo sapiens
tgcattttagtcaga

SEQ ID NO: 57399 - DNA, 15 bp, Homo sapiens
gcattttagtcagat

SEQ ID NO: 57400 - DNA, 15 bp, Homo sapiens
cattttagtcagatt

SEQ ID NO: 57401 - DNA, 15 bp, Homo sapiens
attttagtcagattt

SEQ ID NO: 57402 - DNA, 15 bp, Homo sapiens
ttttagtcagatttt

SEQ ID NO: 57403 - DNA, 15 bp, Homo sapiens
tttagtcagatttta

SEQ ID NO: 57404 - DNA, 15 bp, Homo sapiens
ttagtcagattttac

SEQ ID NO: 57405 - DNA, 15 bp, Homo sapiens
tagtcagattttact

SEQ ID NO: 57406 - DNA, 15 bp, Homo sapiens
agtcagattttactg

SEQ ID NO: 57407 - DNA, 15 bp, Homo sapiens
gtcagattttactgt

SEQ ID NO: 57408 - DNA, 15 bp, Homo sapiens
tcagattttactgtg

SEQ ID NO: 57409 - DNA, 15 bp, Homo sapiens
cagattttactgtgc

SEQ ID NO: 57410 - DNA, 15 bp, Homo sapiens
agattttactgtgca

SEQ ID NO: 57411 - DNA, 15 bp, Homo sapiens
gattttactgtgcaa

SEQ ID NO: 57412 - DNA, 15 bp, Homo sapiens
attttactgtgcaaa

SEQ ID NO: 57413 - DNA, 15 bp, Homo sapiens
ttttactgtgcaaaa

SEQ ID NO: 57414 - DNA, 15 bp, Homo sapiens
tttactgtgcaaaac

SEQ ID NO: 57415 - DNA, 15 bp, Homo sapiens
ttactgtgcaaaaca

SEQ ID NO: 57416 - DNA, 15 bp, Homo sapiens
tactgtgcaaaacat

SEQ ID NO: 57417 - DNA, 15 bp, Homo sapiens
actgtgcaaaacatt

SEQ ID NO: 57418 - DNA, 15 bp, Homo sapiens
ctgtgcaaaacattt

SEQ ID NO: 57419 - DNA, 15 bp, Homo sapiens
tgtgcaaaacatttg

SEQ ID NO: 57420 - DNA, 15 bp, Homo sapiens
gtgcaaaacatttga

SEQ ID NO: 57421 - DNA, 15 bp, Homo sapiens
tgcaaaacatttgag

SEQ ID NO: 57422 - DNA, 15 bp, Homo sapiens
gcaaaacatttgaga

SEQ ID NO: 57423 - DNA, 15 bp, Homo sapiens
caaaacatttgagag

SEQ ID NO: 57424 - DNA, 15 bp, Homo sapiens
aaaacatttgagaga

SEQ ID NO: 57425 - DNA, 15 bp, Homo sapiens
aaacatttgagagat

SEQ ID NO: 57426 - DNA, 15 bp, Homo sapiens
aacatttgagagatt

SEQ ID NO: 57427 - DNA, 15 bp, Homo sapiens
acatttgagagattt

SEQ ID NO: 57428 - DNA, 15 bp, Homo sapiens
catttgagagatttc

SEQ ID NO: 57429 - DNA, 15 bp, Homo sapiens
atttgagagatttct

SEQ ID NO: 57430 - DNA, 15 bp, Homo sapiens
tttgagagatttctg

SEQ ID NO: 57431 - DNA, 15 bp, Homo sapiens
ttgagagatttctgc

SEQ ID NO: 57432 - DNA, 15 bp, Homo sapiens
tgagagatttctgcc

SEQ ID NO: 57433 - DNA, 15 bp, Homo sapiens
gagagatttctgccc

SEQ ID NO: 57434 - DNA, 15 bp, Homo sapiens
agagatttctgccct

SEQ ID NO: 57435 - DNA, 15 bp, Homo sapiens
gagatttctgccctc

SEQ ID NO: 57436 - DNA, 15 bp, Homo sapiens
agatttctgccctct

SEQ ID NO: 57437 - DNA, 15 bp, Homo sapiens
gatttctgccctctt

SEQ ID NO: 57438 - DNA, 15 bp, Homo sapiens
atttctgccctcttt

SEQ ID NO: 57439 - DNA, 15 bp, Homo sapiens
tttctgccctctttc

SEQ ID NO: 57440 - DNA, 15 bp, Homo sapiens
ttctgccctctttct

SEQ ID NO: 57441 - DNA, 15 bp, Homo sapiens
tctgccctctttctc

SEQ ID NO: 57442 - DNA, 15 bp, Homo sapiens
ctgccctctttctcc

SEQ ID NO: 57443 - DNA, 15 bp, Homo sapiens
tgccctctttctccc

SEQ ID NO: 57444 - DNA, 15 bp, Homo sapiens
gccctctttctccct

SEQ ID NO: 57445 - DNA, 15 bp, Homo sapiens
ccctctttctccctt

SEQ ID NO: 57446 - DNA, 15 bp, Homo sapiens
cctctttctcccttc

SEQ ID NO: 57447 - DNA, 15 bp, Homo sapiens
ctctttctcccttcc

SEQ ID NO: 57448 - DNA, 15 bp, Homo sapiens
tctttctcccttcca

SEQ ID NO: 57449 - DNA, 15 bp, Homo sapiens
ctttctcccttccat

SEQ ID NO: 57450 - DNA, 15 bp, Homo sapiens
tttctcccttccatt

SEQ ID NO: 57451 - DNA, 15 bp, Homo sapiens
ttctcccttccattc

SEQ ID NO: 57452 - DNA, 15 bp, Homo sapiens
tctcccttccattct

SEQ ID NO: 57453 - DNA, 15 bp, Homo sapiens
ctcccttccattctt

SEQ ID NO: 57454 - DNA, 15 bp, Homo sapiens
tcccttccattcttc

SEQ ID NO: 57455 - DNA, 15 bp, Homo sapiens
cccttccattcttct

SEQ ID NO: 57456 - DNA, 15 bp, Homo sapiens
ccttccattcttctc

SEQ ID NO: 57457 - DNA, 15 bp, Homo sapiens
cttccattcttctca

SEQ ID NO: 57458 - DNA, 15 bp, Homo sapiens
ttccattcttctcaa

SEQ ID NO: 57459 - DNA, 15 bp, Homo sapiens
tccattcttctcaac

SEQ ID NO: 57460 - DNA, 15 bp, Homo sapiens
ccattcttctcaacc

SEQ ID NO: 57461 - DNA, 15 bp, Homo sapiens
cattcttctcaaccc

SEQ ID NO: 57462 - DNA, 15 bp, Homo sapiens
attcttctcaaccca

SEQ ID NO: 57463 - DNA, 15 bp, Homo sapiens
ttcttctcaacccac

SEQ ID NO: 57464 - DNA, 15 bp, Homo sapiens
tcttctcaacccact

SEQ ID NO: 57465 - DNA, 15 bp, Homo sapiens
cttctcaacccactg

SEQ ID NO: 57466 - DNA, 15 bp, Homo sapiens
ttctcaacccactgg

SEQ ID NO: 57467 - DNA, 15 bp, Homo sapiens
tctcaacccactggg

SEQ ID NO: 57468 - DNA, 15 bp, Homo sapiens
ctcaacccactgggc

SEQ ID NO: 57469 - DNA, 15 bp, Homo sapiens
tcaacccactgggcg

SEQ ID NO: 57470 - DNA, 15 bp, Homo sapiens
caacccactgggcgc

SEQ ID NO: 57471 - DNA, 15 bp, Homo sapiens
aacccactgggcgcc

SEQ ID NO: 57472 - DNA, 15 bp, Homo sapiens
acccactgggcgccc

SEQ ID NO: 57473 - DNA, 15 bp, Homo sapiens
cccactgggcgccct

SEQ ID NO: 57474 - DNA, 15 bp, Homo sapiens
ccactgggcgcccta

SEQ ID NO: 57475 - DNA, 15 bp, Homo sapiens
cactgggcgccctac

SEQ ID NO: 57476 - DNA, 15 bp, Homo sapiens
actgggcgccctacc

SEQ ID NO: 57477 - DNA, 15 bp, Homo sapiens
ctgggcgccctacca

SEQ ID NO: 57478 - DNA, 15 bp, Homo sapiens
tgggcgccctaccac

SEQ ID NO: 57479 - DNA, 15 bp, Homo sapiens
gggcgccctaccacc

SEQ ID NO: 57480 - DNA, 15 bp, Homo sapiens
ggcgccctaccaccc

SEQ ID NO: 57481 - DNA, 15 bp, Homo sapiens
gcgccctaccacccc

SEQ ID NO: 57482 - DNA, 15 bp, Homo sapiens
cgccctaccacccct

SEQ ID NO: 57483 - DNA, 15 bp, Homo sapiens
gccctaccacccctg

SEQ ID NO: 57484 - DNA, 15 bp, Homo sapiens
ccctaccacccctgt

SEQ ID NO: 57485 - DNA, 15 bp, Homo sapiens
cctaccacccctgtc

SEQ ID NO: 57486 - DNA, 15 bp, Homo sapiens
ctaccacccctgtct

SEQ ID NO: 57487 - DNA, 15 bp, Homo sapiens
taccacccctgtctc

SEQ ID NO: 57488 - DNA, 15 bp, Homo sapiens
accacccctgtctcc

SEQ ID NO: 57489 - DNA, 15 bp, Homo sapiens
ccacccctgtctcct

SEQ ID NO: 57490 - DNA, 15 bp, Homo sapiens
cacccctgtctcctt

SEQ ID NO: 57491 - DNA, 15 bp, Homo sapiens
acccctgtctccttc

SEQ ID NO: 57492 - DNA, 15 bp, Homo sapiens
cccctgtctccttca

SEQ ID NO: 57493 - DNA, 15 bp, Homo sapiens
ccctgtctccttcaa

SEQ ID NO: 57494 - DNA, 15 bp, Homo sapiens
cctgtctccttcaag

SEQ ID NO: 57495 - DNA, 15 bp, Homo sapiens
ctgtctccttcaaga

SEQ ID NO: 57496 - DNA, 15 bp, Homo sapiens
tgtctccttcaagat

SEQ ID NO: 57497 - DNA, 15 bp, Homo sapiens
gtctccttcaagata

SEQ ID NO: 57498 - DNA, 15 bp, Homo sapiens
tctccttcaagataa

SEQ ID NO: 57499 - DNA, 15 bp, Homo sapiens
ctccttcaagataag

SEQ ID NO: 57500 - DNA, 15 bp, Homo sapiens
tccttcaagataagg

SEQ ID NO: 57501 - DNA, 15 bp, Homo sapiens
ccttcaagataaggt

SEQ ID NO: 57502 - DNA, 15 bp, Homo sapiens
cttcaagataaggta

SEQ ID NO: 57503 - DNA, 15 bp, Homo sapiens
ttcaagataaggtag

SEQ ID NO: 57504 - DNA, 15 bp, Homo sapiens
tcaagataaggtaga

SEQ ID NO: 57505 - DNA, 15 bp, Homo sapiens
caagataaggtagat

SEQ ID NO: 57506 - DNA, 15 bp, Homo sapiens
aagataaggtagatc

SEQ ID NO: 57507 - DNA, 15 bp, Homo sapiens
agataaggtagatca

SEQ ID NO: 57508 - DNA, 15 bp, Homo sapiens
gataaggtagatcag

SEQ ID NO: 57509 - DNA, 15 bp, Homo sapiens
ataaggtagatcaga

SEQ ID NO: 57510 - DNA, 15 bp, Homo sapiens
taaggtagatcagaa

SEQ ID NO: 57511 - DNA, 15 bp, Homo sapiens
aaggtagatcagaag

SEQ ID NO: 57512 - DNA, 15 bp, Homo sapiens
aggtagatcagaaga

SEQ ID NO: 57513 - DNA, 15 bp, Homo sapiens
ggtagatcagaagac

SEQ ID NO: 57514 - DNA, 15 bp, Homo sapiens
gtagatcagaagacc

SEQ ID NO: 57515 - DNA, 15 bp, Homo sapiens
tagatcagaagacca

SEQ ID NO: 57516 - DNA, 15 bp, Homo sapiens
agatcagaagaccaa

SEQ ID NO: 57517 - DNA, 15 bp, Homo sapiens
gatcagaagaccaaa

SEQ ID NO: 57518 - DNA, 15 bp, Homo sapiens
atcagaagaccaaat

SEQ ID NO: 57519 - DNA, 15 bp, Homo sapiens
tcagaagaccaaata

SEQ ID NO: 57520 - DNA, 15 bp, Homo sapiens
cagaagaccaaatag

SEQ ID NO: 57521 - DNA, 15 bp, Homo sapiens
agaagaccaaataga

SEQ ID NO: 57522 - DNA, 15 bp, Homo sapiens
gaagaccaaatagac

SEQ ID NO: 57523 - DNA, 15 bp, Homo sapiens
aagaccaaatagaca

SEQ ID NO: 57524 - DNA, 15 bp, Homo sapiens
agaccaaatagacaa

SEQ ID NO: 57525 - DNA, 15 bp, Homo sapiens
gaccaaatagacaaa

SEQ ID NO: 57526 - DNA, 15 bp, Homo sapiens
accaaatagacaaat

SEQ ID NO: 57527 - DNA, 15 bp, Homo sapiens
ccaaatagacaaatg

SEQ ID NO: 57528 - DNA, 15 bp, Homo sapiens
caaatagacaaatgc

SEQ ID NO: 57529 - DNA, 15 bp, Homo sapiens
aaatagacaaatgcc

SEQ ID NO: 57530 - DNA, 15 bp, Homo sapiens
aatagacaaatgcca

SEQ ID NO: 57531 - DNA, 15 bp, Homo sapiens
atagacaaatgccat

SEQ ID NO: 57532 - DNA, 15 bp, Homo sapiens
tagacaaatgccatg

SEQ ID NO: 57533 - DNA, 15 bp, Homo sapiens
agacaaatgccatgt

SEQ ID NO: 57534 - DNA, 15 bp, Homo sapiens
gacaaatgccatgtc

SEQ ID NO: 57535 - DNA, 15 bp, Homo sapiens
acaaatgccatgtcc

SEQ ID NO: 57536 - DNA, 15 bp, Homo sapiens
caaatgccatgtcca

SEQ ID NO: 57537 - DNA, 15 bp, Homo sapiens
aaatgccatgtccac

SEQ ID NO: 57538 - DNA, 15 bp, Homo sapiens
aatgccatgtccact

SEQ ID NO: 57539 - DNA, 15 bp, Homo sapiens
atgccatgtccactg

SEQ ID NO: 57540 - DNA, 15 bp, Homo sapiens
tgccatgtccactgt

SEQ ID NO: 57541 - DNA, 15 bp, Homo sapiens
gccatgtccactgtt

SEQ ID NO: 57542 - DNA, 15 bp, Homo sapiens
ccatgtccactgttt

SEQ ID NO: 57543 - DNA, 15 bp, Homo sapiens
catgtccactgtttt

SEQ ID NO: 57544 - DNA, 15 bp, Homo sapiens
atgtccactgttttc

SEQ ID NO: 57545 - DNA, 15 bp, Homo sapiens
tgtccactgttttct

SEQ ID NO: 57546 - DNA, 15 bp, Homo sapiens
gtccactgttttctg

SEQ ID NO: 57547 - DNA, 15 bp, Homo sapiens
tccactgttttctgt

SEQ ID NO: 57548 - DNA, 15 bp, Homo sapiens
ccactgttttctgtc

SEQ ID NO: 57549 - DNA, 15 bp, Homo sapiens
cactgttttctgtca

SEQ ID NO: 57550 - DNA, 15 bp, Homo sapiens
actgttttctgtcac

SEQ ID NO: 57551 - DNA, 15 bp, Homo sapiens
ctgttttctgtcaca

SEQ ID NO: 57552 - DNA, 15 bp, Homo sapiens
tgttttctgtcacag

SEQ ID NO: 57553 - DNA, 15 bp, Homo sapiens
gttttctgtcacagt

SEQ ID NO: 57554 - DNA, 15 bp, Homo sapiens
ttttctgtcacagtt

SEQ ID NO: 57555 - DNA, 15 bp, Homo sapiens
tttctgtcacagttg

SEQ ID NO: 57556 - DNA, 15 bp, Homo sapiens
ttctgtcacagttga

SEQ ID NO: 57557 - DNA, 15 bp, Homo sapiens
tctgtcacagttgat

SEQ ID NO: 57558 - DNA, 15 bp, Homo sapiens
ctgtcacagttgata

SEQ ID NO: 57559 - DNA, 15 bp, Homo sapiens
tgtcacagttgatag

SEQ ID NO: 57560 - DNA, 15 bp, Homo sapiens
gtcacagttgatagc

SEQ ID NO: 57561 - DNA, 15 bp, Homo sapiens
tcacagttgatagcc

SEQ ID NO: 57562 - DNA, 15 bp, Homo sapiens
cacagttgatagcca

SEQ ID NO: 57563 - DNA, 15 bp, Homo sapiens
acagttgatagccat

SEQ ID NO: 57564 - DNA, 15 bp, Homo sapiens
cagttgatagccata

SEQ ID NO: 57565 - DNA, 15 bp, Homo sapiens
agttgatagccatac

SEQ ID NO: 57566 - DNA, 15 bp, Homo sapiens
gttgatagccatacc

SEQ ID NO: 57567 - DNA, 15 bp, Homo sapiens
ttgatagccatacca

SEQ ID NO: 57568 - DNA, 15 bp, Homo sapiens
tgatagccataccag

SEQ ID NO: 57569 - DNA, 15 bp, Homo sapiens
gatagccataccagt

SEQ ID NO: 57570 - DNA, 15 bp, Homo sapiens
atagccataccagtc

SEQ ID NO: 57571 - DNA, 15 bp, Homo sapiens
tagccataccagtca

SEQ ID NO: 57572 - DNA, 15 bp, Homo sapiens
agccataccagtcac

SEQ ID NO: 57573 - DNA, 15 bp, Homo sapiens
gccataccagtcacc

SEQ ID NO: 57574 - DNA, 15 bp, Homo sapiens
ccataccagtcaccc

SEQ ID NO: 57575 - DNA, 15 bp, Homo sapiens
cataccagtcaccca

SEQ ID NO: 57576 - DNA, 15 bp, Homo sapiens
ataccagtcacccaa

SEQ ID NO: 57577 - DNA, 15 bp, Homo sapiens
taccagtcacccaag

SEQ ID NO: 57578 - DNA, 15 bp, Homo sapiens
accagtcacccaagc

SEQ ID NO: 57579 - DNA, 15 bp, Homo sapiens
ccagtcacccaagct

SEQ ID NO: 57580 - DNA, 15 bp, Homo sapiens
cagtcacccaagctg

SEQ ID NO: 57581 - DNA, 15 bp, Homo sapiens
agtcacccaagctgg

SEQ ID NO: 57582 - DNA, 15 bp, Homo sapiens
gtcacccaagctgga

SEQ ID NO: 57583 - DNA, 15 bp, Homo sapiens
tcacccaagctggaa

SEQ ID NO: 57584 - DNA, 15 bp, Homo sapiens
cacccaagctggaaa

SEQ ID NO: 57585 - DNA, 15 bp, Homo sapiens
acccaagctggaaac

SEQ ID NO: 57586 - DNA, 15 bp, Homo sapiens
cccaagctggaaacc

SEQ ID NO: 57587 - DNA, 15 bp, Homo sapiens
ccaagctggaaaccc

SEQ ID NO: 57588 - DNA, 15 bp, Homo sapiens
caagctggaaaccca

SEQ ID NO: 57589 - DNA, 15 bp, Homo sapiens
aagctggaaacccaa

SEQ ID NO: 57590 - DNA, 15 bp, Homo sapiens
agctggaaacccaac

SEQ ID NO: 57591 - DNA, 15 bp, Homo sapiens
gctggaaacccaaca

SEQ ID NO: 57592 - DNA, 15 bp, Homo sapiens
ctggaaacccaacag

SEQ ID NO: 57593 - DNA, 15 bp, Homo sapiens
tggaaacccaacagg

SEQ ID NO: 57594 - DNA, 15 bp, Homo sapiens
ggaaacccaacaggc

SEQ ID NO: 57595 - DNA, 15 bp, Homo sapiens
gaaacccaacaggcc

SEQ ID NO: 57596 - DNA, 15 bp, Homo sapiens
aaacccaacaggccc

SEQ ID NO: 57597 - DNA, 15 bp, Homo sapiens
aacccaacaggcccc

SEQ ID NO: 57598 - DNA, 15 bp, Homo sapiens
acccaacaggcccct

SEQ ID NO: 57599 - DNA, 15 bp, Homo sapiens
cccaacaggcccctg

SEQ ID NO: 57600 - DNA, 15 bp, Homo sapiens
ccaacaggcccctgc

SEQ ID NO: 57601 - DNA, 15 bp, Homo sapiens
caacaggcccctgcc

SEQ ID NO: 57602 - DNA, 15 bp, Homo sapiens
aacaggcccctgccc

SEQ ID NO: 57603 - DNA, 15 bp, Homo sapiens
acaggcccctgccct

SEQ ID NO: 57604 - DNA, 15 bp, Homo sapiens
caggcccctgccctt

SEQ ID NO: 57605 - DNA, 15 bp, Homo sapiens
aggcccctgcccttc

SEQ ID NO: 57606 - DNA, 15 bp, Homo sapiens
ggcccctgcccttca

SEQ ID NO: 57607 - DNA, 15 bp, Homo sapiens
gcccctgcccttcac

SEQ ID NO: 57608 - DNA, 15 bp, Homo sapiens
cccctgcccttcact

SEQ ID NO: 57609 - DNA, 15 bp, Homo sapiens
ccctgcccttcactg

SEQ ID NO: 57610 - DNA, 15 bp, Homo sapiens
cctgcccttcactgc

SEQ ID NO: 57611 - DNA, 15 bp, Homo sapiens
ctgcccttcactgcc

SEQ ID NO: 57612 - DNA, 15 bp, Homo sapiens
tgcccttcactgccc

SEQ ID NO: 57613 - DNA, 15 bp, Homo sapiens
gcccttcactgccca

SEQ ID NO: 57614 - DNA, 15 bp, Homo sapiens
cccttcactgcccac

SEQ ID NO: 57615 - DNA, 15 bp, Homo sapiens
ccttcactgcccaca

SEQ ID NO: 57616 - DNA, 15 bp, Homo sapiens
cttcactgcccacat

SEQ ID NO: 57617 - DNA, 15 bp, Homo sapiens
ttcactgcccacatc

SEQ ID NO: 57618 - DNA, 15 bp, Homo sapiens
tcactgcccacatcc

SEQ ID NO: 57619 - DNA, 15 bp, Homo sapiens
cactgcccacatcca

SEQ ID NO: 57620 - DNA, 15 bp, Homo sapiens
actgcccacatccaa

SEQ ID NO: 57621 - DNA, 15 bp, Homo sapiens
ctgcccacatccaag

SEQ ID NO: 57622 - DNA, 15 bp, Homo sapiens
tgcccacatccaagg

SEQ ID NO: 57623 - DNA, 15 bp, Homo sapiens
gcccacatccaaggg

SEQ ID NO: 57624 - DNA, 15 bp, Homo sapiens
cccacatccaaggga

SEQ ID NO: 57625 - DNA, 15 bp, Homo sapiens
ccacatccaagggag

SEQ ID NO: 57626 - DNA, 15 bp, Homo sapiens
cacatccaagggagc

SEQ ID NO: 57627 - DNA, 15 bp, Homo sapiens
acatccaagggagcc

SEQ ID NO: 57628 - DNA, 15 bp, Homo sapiens
catccaagggagcca

SEQ ID NO: 57629 - DNA, 15 bp, Homo sapiens
atccaagggagccac

SEQ ID NO: 57630 - DNA, 15 bp, Homo sapiens
tccaagggagccacc

SEQ ID NO: 57631 - DNA, 15 bp, Homo sapiens
ccaagggagccacca

SEQ ID NO: 57632 - DNA, 15 bp, Homo sapiens
caagggagccaccaa

SEQ ID NO: 57633 - DNA, 15 bp, Homo sapiens
aagggagccaccaag

SEQ ID NO: 57634 - DNA, 15 bp, Homo sapiens
agggagccaccaagt

SEQ ID NO: 57635 - DNA, 15 bp, Homo sapiens
gggagccaccaagtc

SEQ ID NO: 57636 - DNA, 15 bp, Homo sapiens
ggagccaccaagtcc

SEQ ID NO: 57637 - DNA, 15 bp, Homo sapiens
gagccaccaagtccc

SEQ ID NO: 57638 - DNA, 15 bp, Homo sapiens
agccaccaagtccca

SEQ ID NO: 57639 - DNA, 15 bp, Homo sapiens
gccaccaagtcccac

SEQ ID NO: 57640 - DNA, 15 bp, Homo sapiens
ccaccaagtcccaca

SEQ ID NO: 57641 - DNA, 15 bp, Homo sapiens
caccaagtcccacaa

SEQ ID NO: 57642 - DNA, 15 bp, Homo sapiens
accaagtcccacaaa

SEQ ID NO: 57643 - DNA, 15 bp, Homo sapiens
ccaagtcccacaaat

SEQ ID NO: 57644 - DNA, 15 bp, Homo sapiens
caagtcccacaaatt

SEQ ID NO: 57645 - DNA, 15 bp, Homo sapiens
aagtcccacaaattg

SEQ ID NO: 57646 - DNA, 15 bp, Homo sapiens
agtcccacaaattgt

SEQ ID NO: 57647 - DNA, 15 bp, Homo sapiens
gtcccacaaattgtt

SEQ ID NO: 57648 - DNA, 15 bp, Homo sapiens
tcccacaaattgttc

SEQ ID NO: 57649 - DNA, 15 bp, Homo sapiens
cccacaaattgttcc

SEQ ID NO: 57650 - DNA, 15 bp, Homo sapiens
ccacaaattgttcct

SEQ ID NO: 57651 - DNA, 15 bp, Homo sapiens
cacaaattgttcctt

SEQ ID NO: 57652 - DNA, 15 bp, Homo sapiens
acaaattgttccttt

SEQ ID NO: 57653 - DNA, 15 bp, Homo sapiens
caaattgttccttta

SEQ ID NO: 57654 - DNA, 15 bp, Homo sapiens
aaattgttcctttaa

SEQ ID NO: 57655 - DNA, 15 bp, Homo sapiens
aattgttcctttaac

SEQ ID NO: 57656 - DNA, 15 bp, Homo sapiens
attgttcctttaact

SEQ ID NO: 57657 - DNA, 15 bp, Homo sapiens
ttgttcctttaactg

SEQ ID NO: 57658 - DNA, 15 bp, Homo sapiens
tgttcctttaactgt

SEQ ID NO: 57659 - DNA, 15 bp, Homo sapiens
gttcctttaactgtt

SEQ ID NO: 57660 - DNA, 15 bp, Homo sapiens
ttcctttaactgttt

SEQ ID NO: 57661 - DNA, 15 bp, Homo sapiens
tcctttaactgtttg

SEQ ID NO: 57662 - DNA, 15 bp, Homo sapiens
cctttaactgtttgt

SEQ ID NO: 57663 - DNA, 15 bp, Homo sapiens
ctttaactgtttgtc

SEQ ID NO: 57664 - DNA, 15 bp, Homo sapiens
tttaactgtttgtcc

SEQ ID NO: 57665 - DNA, 15 bp, Homo sapiens
ttaactgtttgtccc

SEQ ID NO: 57666 - DNA, 15 bp, Homo sapiens
taactgtttgtccct

SEQ ID NO: 57667 - DNA, 15 bp, Homo sapiens
aactgtttgtccctc

SEQ ID NO: 57668 - DNA, 15 bp, Homo sapiens
actgtttgtccctct

SEQ ID NO: 57669 - DNA, 15 bp, Homo sapiens
ctgtttgtccctctt

SEQ ID NO: 57670 - DNA, 15 bp, Homo sapiens
tgtttgtccctcttt

SEQ ID NO: 57671 - DNA, 15 bp, Homo sapiens
gtttgtccctctttt

SEQ ID NO: 57672 - DNA, 15 bp, Homo sapiens
tttgtccctcttttg

SEQ ID NO: 57673 - DNA, 15 bp, Homo sapiens
ttgtccctcttttgt

SEQ ID NO: 57674 - DNA, 15 bp, Homo sapiens
tgtccctcttttgtc

SEQ ID NO: 57675 - DNA, 15 bp, Homo sapiens
gtccctcttttgtct

SEQ ID NO: 57676 - DNA, 15 bp, Homo sapiens
tccctcttttgtctt

SEQ ID NO: 57677 - DNA, 15 bp, Homo sapiens
ccctcttttgtcttc

SEQ ID NO: 57678 - DNA, 15 bp, Homo sapiens
cctcttttgtcttct

SEQ ID NO: 57679 - DNA, 15 bp, Homo sapiens
ctcttttgtcttctg

SEQ ID NO: 57680 - DNA, 15 bp, Homo sapiens
tcttttgtcttctgt

SEQ ID NO: 57681 - DNA, 15 bp, Homo sapiens
cttttgtcttctgtc

SEQ ID NO: 57682 - DNA, 15 bp, Homo sapiens
ttttgtcttctgtca

SEQ ID NO: 57683 - DNA, 15 bp, Homo sapiens
tttgtcttctgtcat

SEQ ID NO: 57684 - DNA, 15 bp, Homo sapiens
ttgtcttctgtcatc

SEQ ID NO: 57685 - DNA, 15 bp, Homo sapiens
tgtcttctgtcatcc

SEQ ID NO: 57686 - DNA, 15 bp, Homo sapiens
gtcttctgtcatccc

SEQ ID NO: 57687 - DNA, 15 bp, Homo sapiens
tcttctgtcatccct

SEQ ID NO: 57688 - DNA, 15 bp, Homo sapiens
cttctgtcatccctt

SEQ ID NO: 57689 - DNA, 15 bp, Homo sapiens
ttctgtcatcccttc

SEQ ID NO: 57690 - DNA, 15 bp, Homo sapiens
tctgtcatcccttct

SEQ ID NO: 57691 - DNA, 15 bp, Homo sapiens
ctgtcatcccttcta

SEQ ID NO: 57692 - DNA, 15 bp, Homo sapiens
tgtcatcccttctac

SEQ ID NO: 57693 - DNA, 15 bp, Homo sapiens
gtcatcccttctacc

SEQ ID NO: 57694 - DNA, 15 bp, Homo sapiens
tcatcccttctaccg

SEQ ID NO: 57695 - DNA, 15 bp, Homo sapiens
catcccttctaccgc

SEQ ID NO: 57696 - DNA, 15 bp, Homo sapiens
atcccttctaccgct

SEQ ID NO: 57697 - DNA, 15 bp, Homo sapiens
tcccttctaccgctg

SEQ ID NO: 57698 - DNA, 15 bp, Homo sapiens
cccttctaccgctgt

SEQ ID NO: 57699 - DNA, 15 bp, Homo sapiens
ccttctaccgctgtc

SEQ ID NO: 57700 - DNA, 15 bp, Homo sapiens
cttctaccgctgtcc

SEQ ID NO: 57701 - DNA, 15 bp, Homo sapiens
ttctaccgctgtcct

SEQ ID NO: 57702 - DNA, 15 bp, Homo sapiens
tctaccgctgtcctg

SEQ ID NO: 57703 - DNA, 15 bp, Homo sapiens
ctaccgctgtcctgg

SEQ ID NO: 57704 - DNA, 15 bp, Homo sapiens
taccgctgtcctggt

SEQ ID NO: 57705 - DNA, 15 bp, Homo sapiens
accgctgtcctggtt

SEQ ID NO: 57706 - DNA, 15 bp, Homo sapiens
ccgctgtcctggttc

SEQ ID NO: 57707 - DNA, 15 bp, Homo sapiens
cgctgtcctggttca

SEQ ID NO: 57708 - DNA, 15 bp, Homo sapiens
gctgtcctggttcaa

SEQ ID NO: 57709 - DNA, 15 bp, Homo sapiens
ctgtcctggttcaat

SEQ ID NO: 57710 - DNA, 15 bp, Homo sapiens
tgtcctggttcaatc

SEQ ID NO: 57711 - DNA, 15 bp, Homo sapiens
gtcctggttcaatcc

SEQ ID NO: 57712 - DNA, 15 bp, Homo sapiens
tcctggttcaatccc

SEQ ID NO: 57713 - DNA, 15 bp, Homo sapiens
cctggttcaatccct

SEQ ID NO: 57714 - DNA, 15 bp, Homo sapiens
ctggttcaatccctc

SEQ ID NO: 57715 - DNA, 15 bp, Homo sapiens
tggttcaatccctca

SEQ ID NO: 57716 - DNA, 15 bp, Homo sapiens
ggttcaatccctcat

SEQ ID NO: 57717 - DNA, 15 bp, Homo sapiens
gttcaatccctcatc

SEQ ID NO: 57718 - DNA, 15 bp, Homo sapiens
ttcaatccctcatct

SEQ ID NO: 57719 - DNA, 15 bp, Homo sapiens
tcaatccctcatctt

SEQ ID NO: 57720 - DNA, 15 bp, Homo sapiens
caatccctcatcttg

SEQ ID NO: 57721 - DNA, 15 bp, Homo sapiens
aatccctcatcttgc

SEQ ID NO: 57722 - DNA, 15 bp, Homo sapiens
atccctcatcttgct

SEQ ID NO: 57723 - DNA, 15 bp, Homo sapiens
tccctcatcttgctc

SEQ ID NO: 57724 - DNA, 15 bp, Homo sapiens
ccctcatcttgctct

SEQ ID NO: 57725 - DNA, 15 bp, Homo sapiens
cctcatcttgctctg

SEQ ID NO: 57726 - DNA, 15 bp, Homo sapiens
ctcatcttgctctgg

SEQ ID NO: 57727 - DNA, 15 bp, Homo sapiens
tcatcttgctctggg

SEQ ID NO: 57728 - DNA, 15 bp, Homo sapiens
catcttgctctggga

SEQ ID NO: 57729 - DNA, 15 bp, Homo sapiens
atcttgctctgggac

SEQ ID NO: 57730 - DNA, 15 bp, Homo sapiens
tcttgctctgggact

SEQ ID NO: 57731 - DNA, 15 bp, Homo sapiens
cttgctctgggactc

SEQ ID NO: 57732 - DNA, 15 bp, Homo sapiens
ttgctctgggactcc

SEQ ID NO: 57733 - DNA, 15 bp, Homo sapiens
tgctctgggactccc

SEQ ID NO: 57734 - DNA, 15 bp, Homo sapiens
gctctgggactccca

SEQ ID NO: 57735 - DNA, 15 bp, Homo sapiens
ctctgggactcccat

SEQ ID NO: 57736 - DNA, 15 bp, Homo sapiens
tctgggactcccatg

SEQ ID NO: 57737 - DNA, 15 bp, Homo sapiens
ctgggactcccatga

SEQ ID NO: 57738 - DNA, 15 bp, Homo sapiens
tgggactcccatgat

SEQ ID NO: 57739 - DNA, 15 bp, Homo sapiens
gggactcccatgata

SEQ ID NO: 57740 - DNA, 15 bp, Homo sapiens
ggactcccatgataa

SEQ ID NO: 57741 - DNA, 15 bp, Homo sapiens
gactcccatgataac

SEQ ID NO: 57742 - DNA, 15 bp, Homo sapiens
actcccatgataact

SEQ ID NO: 57743 - DNA, 15 bp, Homo sapiens
ctcccatgataactt

SEQ ID NO: 57744 - DNA, 15 bp, Homo sapiens
tcccatgataactta

SEQ ID NO: 57745 - DNA, 15 bp, Homo sapiens
cccatgataacttat

SEQ ID NO: 57746 - DNA, 15 bp, Homo sapiens
ccatgataacttatg

SEQ ID NO: 57747 - DNA, 15 bp, Homo sapiens
catgataacttatga

SEQ ID NO: 57748 - DNA, 15 bp, Homo sapiens
atgataacttatgat

SEQ ID NO: 57749 - DNA, 15 bp, Homo sapiens
tgataacttatgatc

SEQ ID NO: 57750 - DNA, 15 bp, Homo sapiens
gataacttatgatct

SEQ ID NO: 57751 - DNA, 15 bp, Homo sapiens
ataacttatgatctt

SEQ ID NO: 57752 - DNA, 15 bp, Homo sapiens
taacttatgatcttt

SEQ ID NO: 57753 - DNA, 15 bp, Homo sapiens
aacttatgatctttc

SEQ ID NO: 57754 - DNA, 15 bp, Homo sapiens
acttatgatctttcc

SEQ ID NO: 57755 - DNA, 15 bp, Homo sapiens
cttatgatctttcct

SEQ ID NO: 57756 - DNA, 15 bp, Homo sapiens
ttatgatctttcctc

SEQ ID NO: 57757 - DNA, 15 bp, Homo sapiens
tatgatctttcctcc

SEQ ID NO: 57758 - DNA, 15 bp, Homo sapiens
atgatctttcctcca

SEQ ID NO: 57759 - DNA, 15 bp, Homo sapiens
tgatctttcctccac

SEQ ID NO: 57760 - DNA, 15 bp, Homo sapiens
gatctttcctccacc

SEQ ID NO: 57761 - DNA, 15 bp, Homo sapiens
atctttcctccacct

SEQ ID NO: 57762 - DNA, 15 bp, Homo sapiens
tctttcctccacctc

SEQ ID NO: 57763 - DNA, 15 bp, Homo sapiens
ctttcctccacctct

SEQ ID NO: 57764 - DNA, 15 bp, Homo sapiens
tttcctccacctctc

SEQ ID NO: 57765 - DNA, 15 bp, Homo sapiens
ttcctccacctctct

SEQ ID NO: 57766 - DNA, 15 bp, Homo sapiens
tcctccacctctcta

SEQ ID NO: 57767 - DNA, 15 bp, Homo sapiens
cctccacctctctat

SEQ ID NO: 57768 - DNA, 15 bp, Homo sapiens
ctccacctctctatc

SEQ ID NO: 57769 - DNA, 15 bp, Homo sapiens
tccacctctctatct

SEQ ID NO: 57770 - DNA, 15 bp, Homo sapiens
ccacctctctatctt

SEQ ID NO: 57771 - DNA, 15 bp, Homo sapiens
cacctctctatcttc

SEQ ID NO: 57772 - DNA, 15 bp, Homo sapiens
acctctctatcttcc

SEQ ID NO: 57773 - DNA, 15 bp, Homo sapiens
cctctctatcttcca

SEQ ID NO: 57774 - DNA, 15 bp, Homo sapiens
ctctctatcttccac

SEQ ID NO: 57775 - DNA, 15 bp, Homo sapiens
tctctatcttccaca

SEQ ID NO: 57776 - DNA, 15 bp, Homo sapiens
ctctatcttccacac

SEQ ID NO: 57777 - DNA, 15 bp, Homo sapiens
tctatcttccacaca

SEQ ID NO: 57778 - DNA, 15 bp, Homo sapiens
ctatcttccacacaa

SEQ ID NO: 57779 - DNA, 15 bp, Homo sapiens
tatcttccacacaat

SEQ ID NO: 57780 - DNA, 15 bp, Homo sapiens
atcttccacacaatc

SEQ ID NO: 57781 - DNA, 15 bp, Homo sapiens
tcttccacacaatcc

SEQ ID NO: 57782 - DNA, 15 bp, Homo sapiens
cttccacacaatccc

SEQ ID NO: 57783 - DNA, 15 bp, Homo sapiens
ttccacacaatccct

SEQ ID NO: 57784 - DNA, 15 bp, Homo sapiens
tccacacaatcccta

SEQ ID NO: 57785 - DNA, 15 bp, Homo sapiens
ccacacaatccctat

SEQ ID NO: 57786 - DNA, 15 bp, Homo sapiens
cacacaatccctatc

SEQ ID NO: 57787 - DNA, 15 bp, Homo sapiens
acacaatccctatca

SEQ ID NO: 57788 - DNA, 15 bp, Homo sapiens
cacaatccctatcat

SEQ ID NO: 57789 - DNA, 15 bp, Homo sapiens
acaatccctatcatc

SEQ ID NO: 57790 - DNA, 15 bp, Homo sapiens
caatccctatcatca

SEQ ID NO: 57791 - DNA, 15 bp, Homo sapiens
aatccctatcatcaa

SEQ ID NO: 57792 - DNA, 15 bp, Homo sapiens
atccctatcatcaat

SEQ ID NO: 57793 - DNA, 15 bp, Homo sapiens
tccctatcatcaatc

SEQ ID NO: 57794 - DNA, 15 bp, Homo sapiens
ccctatcatcaatct

SEQ ID NO: 57795 - DNA, 15 bp, Homo sapiens
cctatcatcaatctc

SEQ ID NO: 57796 - DNA, 15 bp, Homo sapiens
ctatcatcaatctca

SEQ ID NO: 57797 - DNA, 15 bp, Homo sapiens
tatcatcaatctcat

SEQ ID NO: 57798 - DNA, 15 bp, Homo sapiens
atcatcaatctcatt

SEQ ID NO: 57799 - DNA, 15 bp, Homo sapiens
tcatcaatctcattc

SEQ ID NO: 57800 - DNA, 15 bp, Homo sapiens
catcaatctcattcc

SEQ ID NO: 57801 - DNA, 15 bp, Homo sapiens
atcaatctcattccc

SEQ ID NO: 57802 - DNA, 15 bp, Homo sapiens
tcaatctcattcccc

SEQ ID NO: 57803 - DNA, 15 bp, Homo sapiens
caatctcattcccct

SEQ ID NO: 57804 - DNA, 15 bp, Homo sapiens
aatctcattcccctg

SEQ ID NO: 57805 - DNA, 15 bp, Homo sapiens
atctcattcccctgc

SEQ ID NO: 57806 - DNA, 15 bp, Homo sapiens
tctcattcccctgct

SEQ ID NO: 57807 - DNA, 15 bp, Homo sapiens
ctcattcccctgctt

SEQ ID NO: 57808 - DNA, 15 bp, Homo sapiens
tcattcccctgcttt

SEQ ID NO: 57809 - DNA, 15 bp, Homo sapiens
cattcccctgcttta

SEQ ID NO: 57810 - DNA, 15 bp, Homo sapiens
attcccctgctttaa

SEQ ID NO: 57811 - DNA, 15 bp, Homo sapiens
ttcccctgctttaaa

SEQ ID NO: 57812 - DNA, 15 bp, Homo sapiens
tcccctgctttaaac

SEQ ID NO: 57813 - DNA, 15 bp, Homo sapiens
cccctgctttaaacc

SEQ ID NO: 57814 - DNA, 15 bp, Homo sapiens
ccctgctttaaaccc

SEQ ID NO: 57815 - DNA, 15 bp, Homo sapiens
cctgctttaaaccca

SEQ ID NO: 57816 - DNA, 15 bp, Homo sapiens
ctgctttaaacccaa

SEQ ID NO: 57817 - DNA, 15 bp, Homo sapiens
tgctttaaacccaag

SEQ ID NO: 57818 - DNA, 15 bp, Homo sapiens
gctttaaacccaaga

SEQ ID NO: 57819 - DNA, 15 bp, Homo sapiens
ctttaaacccaagag

SEQ ID NO: 57820 - DNA, 15 bp, Homo sapiens
tttaaacccaagagt

SEQ ID NO: 57821 - DNA, 15 bp, Homo sapiens
ttaaacccaagagtg

SEQ ID NO: 57822 - DNA, 15 bp, Homo sapiens
taaacccaagagtgg

SEQ ID NO: 57823 - DNA, 15 bp, Homo sapiens
aaacccaagagtggc

SEQ ID NO: 57824 - DNA, 15 bp, Homo sapiens
aacccaagagtggca

SEQ ID NO: 57825 - DNA, 15 bp, Homo sapiens
acccaagagtggcac

SEQ ID NO: 57826 - DNA, 15 bp, Homo sapiens
cccaagagtggcacc

SEQ ID NO: 57827 - DNA, 15 bp, Homo sapiens
ccaagagtggcaccc

SEQ ID NO: 57828 - DNA, 15 bp, Homo sapiens
caagagtggcaccct

SEQ ID NO: 57829 - DNA, 15 bp, Homo sapiens
aagagtggcaccctg

SEQ ID NO: 57830 - DNA, 15 bp, Homo sapiens
agagtggcaccctgt

SEQ ID NO: 57831 - DNA, 15 bp, Homo sapiens
gagtggcaccctgtg

SEQ ID NO: 57832 - DNA, 15 bp, Homo sapiens
agtggcaccctgtgt

SEQ ID NO: 57833 - DNA, 15 bp, Homo sapiens
gtggcaccctgtgtt

SEQ ID NO: 57834 - DNA, 15 bp, Homo sapiens
tggcaccctgtgttt

SEQ ID NO: 57835 - DNA, 15 bp, Homo sapiens
ggcaccctgtgtttg

SEQ ID NO: 57836 - DNA, 15 bp, Homo sapiens
gcaccctgtgtttga

SEQ ID NO: 57837 - DNA, 15 bp, Homo sapiens
caccctgtgtttgag

SEQ ID NO: 57838 - DNA, 15 bp, Homo sapiens
accctgtgtttgagt

SEQ ID NO: 57839 - DNA, 15 bp, Homo sapiens
ccctgtgtttgagtg

SEQ ID NO: 57840 - DNA, 15 bp, Homo sapiens
cctgtgtttgagtga

SEQ ID NO: 57841 - DNA, 15 bp, Homo sapiens
ctgtgtttgagtgac

SEQ ID NO: 57842 - DNA, 15 bp, Homo sapiens
tgtgtttgagtgaca

SEQ ID NO: 57843 - DNA, 15 bp, Homo sapiens
gtgtttgagtgacat

SEQ ID NO: 57844 - DNA, 15 bp, Homo sapiens
tgtttgagtgacatc

SEQ ID NO: 57845 - DNA, 15 bp, Homo sapiens
gtttgagtgacatca

SEQ ID NO: 57846 - DNA, 15 bp, Homo sapiens
tttgagtgacatcag

SEQ ID NO: 57847 - DNA, 15 bp, Homo sapiens
ttgagtgacatcagg

SEQ ID NO: 57848 - DNA, 15 bp, Homo sapiens
tgagtgacatcaggg

SEQ ID NO: 57849 - DNA, 15 bp, Homo sapiens
gagtgacatcagggc

SEQ ID NO: 57850 - DNA, 15 bp, Homo sapiens
agtgacatcagggcc

SEQ ID NO: 57851 - DNA, 15 bp, Homo sapiens
gtgacatcagggccc

SEQ ID NO: 57852 - DNA, 15 bp, Homo sapiens
tgacatcagggcccc

SEQ ID NO: 57853 - DNA, 15 bp, Homo sapiens
gacatcagggcccct

SEQ ID NO: 57854 - DNA, 15 bp, Homo sapiens
acatcagggcccctc

SEQ ID NO: 57855 - DNA, 15 bp, Homo sapiens
catcagggcccctca

SEQ ID NO: 57856 - DNA, 15 bp, Homo sapiens
atcagggcccctcat

SEQ ID NO: 57857 - DNA, 15 bp, Homo sapiens
tcagggcccctcatg

SEQ ID NO: 57858 - DNA, 15 bp, Homo sapiens
cagggcccctcatgt

SEQ ID NO: 57859 - DNA, 15 bp, Homo sapiens
agggcccctcatgtg

SEQ ID NO: 57860 - DNA, 15 bp, Homo sapiens
gggcccctcatgtgg

SEQ ID NO: 57861 - DNA, 15 bp, Homo sapiens
ggcccctcatgtggc

SEQ ID NO: 57862 - DNA, 15 bp, Homo sapiens
gcccctcatgtggct

SEQ ID NO: 57863 - DNA, 15 bp, Homo sapiens
cccctcatgtggctc

SEQ ID NO: 57864 - DNA, 15 bp, Homo sapiens
ccctcatgtggctcc

SEQ ID NO: 57865 - DNA, 15 bp, Homo sapiens
cctcatgtggctcct

SEQ ID NO: 57866 - DNA, 15 bp, Homo sapiens
ctcatgtggctcctg

SEQ ID NO: 57867 - DNA, 15 bp, Homo sapiens
tcatgtggctcctgc

SEQ ID NO: 57868 - DNA, 15 bp, Homo sapiens
catgtggctcctgct

SEQ ID NO: 57869 - DNA, 15 bp, Homo sapiens
atgtggctcctgctt

SEQ ID NO: 57870 - DNA, 15 bp, Homo sapiens
tgtggctcctgcttc

SEQ ID NO: 57871 - DNA, 15 bp, Homo sapiens
gtggctcctgcttct

SEQ ID NO: 57872 - DNA, 15 bp, Homo sapiens
tggctcctgcttctc

SEQ ID NO: 57873 - DNA, 15 bp, Homo sapiens
ggctcctgcttctct

SEQ ID NO: 57874 - DNA, 15 bp, Homo sapiens
gctcctgcttctctt

SEQ ID NO: 57875 - DNA, 15 bp, Homo sapiens
ctcctgcttctcttt

SEQ ID NO: 57876 - DNA, 15 bp, Homo sapiens
tcctgcttctctttg

SEQ ID NO: 57877 - DNA, 15 bp, Homo sapiens
cctgcttctctttgt

SEQ ID NO: 57878 - DNA, 15 bp, Homo sapiens
ctgcttctctttgtg

SEQ ID NO: 57879 - DNA, 15 bp, Homo sapiens
tgcttctctttgtgg

SEQ ID NO: 57880 - DNA, 15 bp, Homo sapiens
gcttctctttgtggc

SEQ ID NO: 57881 - DNA, 15 bp, Homo sapiens
cttctctttgtggcc

SEQ ID NO: 57882 - DNA, 15 bp, Homo sapiens
ttctctttgtggccc

SEQ ID NO: 57883 - DNA, 15 bp, Homo sapiens
tctctttgtggcccc

SEQ ID NO: 57884 - DNA, 15 bp, Homo sapiens
ctctttgtggcccct

SEQ ID NO: 57885 - DNA, 15 bp, Homo sapiens
tctttgtggcccctt

SEQ ID NO: 57886 - DNA, 15 bp, Homo sapiens
ctttgtggccccttc

SEQ ID NO: 57887 - DNA, 15 bp, Homo sapiens
tttgtggccccttct

SEQ ID NO: 57888 - DNA, 15 bp, Homo sapiens
ttgtggccccttctg

SEQ ID NO: 57889 - DNA, 15 bp, Homo sapiens
tgtggccccttctgt

SEQ ID NO: 57890 - DNA, 15 bp, Homo sapiens
gtggccccttctgtt

SEQ ID NO: 57891 - DNA, 15 bp, Homo sapiens
tggccccttctgttg

SEQ ID NO: 57892 - DNA, 15 bp, Homo sapiens
ggccccttctgttgc

SEQ ID NO: 57893 - DNA, 15 bp, Homo sapiens
gccccttctgttgct

SEQ ID NO: 57894 - DNA, 15 bp, Homo sapiens
ccccttctgttgctg

SEQ ID NO: 57895 - DNA, 15 bp, Homo sapiens
cccttctgttgctgc

SEQ ID NO: 57896 - DNA, 15 bp, Homo sapiens
ccttctgttgctgct

SEQ ID NO: 57897 - DNA, 15 bp, Homo sapiens
cttctgttgctgctg

SEQ ID NO: 57898 - DNA, 15 bp, Homo sapiens
ttctgttgctgctgc

SEQ ID NO: 57899 - DNA, 15 bp, Homo sapiens
tctgttgctgctgct

SEQ ID NO: 57900 - DNA, 15 bp, Homo sapiens
ctgttgctgctgctt

SEQ ID NO: 57901 - DNA, 15 bp, Homo sapiens
tgttgctgctgcttt

SEQ ID NO: 57902 - DNA, 15 bp, Homo sapiens
gttgctgctgctttt

SEQ ID NO: 57903 - DNA, 15 bp, Homo sapiens
ttgctgctgcttttc

SEQ ID NO: 57904 - DNA, 15 bp, Homo sapiens
tgctgctgcttttct

SEQ ID NO: 57905 - DNA, 15 bp, Homo sapiens
gctgctgcttttctt

SEQ ID NO: 57906 - DNA, 15 bp, Homo sapiens
ctgctgcttttctta

SEQ ID NO: 57907 - DNA, 15 bp, Homo sapiens
tgctgcttttcttat

SEQ ID NO: 57908 - DNA, 15 bp, Homo sapiens
gctgcttttcttatg

SEQ ID NO: 57909 - DNA, 15 bp, Homo sapiens
ctgcttttcttatgg

SEQ ID NO: 57910 - DNA, 15 bp, Homo sapiens
tgcttttcttatgga

SEQ ID NO: 57911 - DNA, 15 bp, Homo sapiens
gcttttcttatggac

SEQ ID NO: 57912 - DNA, 15 bp, Homo sapiens
cttttcttatggaca

SEQ ID NO: 57913 - DNA, 15 bp, Homo sapiens
ttttcttatggacat

SEQ ID NO: 57914 - DNA, 15 bp, Homo sapiens
tttcttatggacata

SEQ ID NO: 57915 - DNA, 15 bp, Homo sapiens
ttcttatggacatag

SEQ ID NO: 57916 - DNA, 15 bp, Homo sapiens
tcttatggacatagc

SEQ ID NO: 57917 - DNA, 15 bp, Homo sapiens
cttatggacatagcc

SEQ ID NO: 57918 - DNA, 15 bp, Homo sapiens
ttatggacatagccc

SEQ ID NO: 57919 - DNA, 15 bp, Homo sapiens
tatggacatagccct

SEQ ID NO: 57920 - DNA, 15 bp, Homo sapiens
atggacatagccctc

SEQ ID NO: 57921 - DNA, 15 bp, Homo sapiens
tggacatagccctca

SEQ ID NO: 57922 - DNA, 15 bp, Homo sapiens
ggacatagccctcag

SEQ ID NO: 57923 - DNA, 15 bp, Homo sapiens
gacatagccctcagc

SEQ ID NO: 57924 - DNA, 15 bp, Homo sapiens
acatagccctcagca

SEQ ID NO: 57925 - DNA, 15 bp, Homo sapiens
catagccctcagcag

SEQ ID NO: 57926 - DNA, 15 bp, Homo sapiens
atagccctcagcagt

SEQ ID NO: 57927 - DNA, 15 bp, Homo sapiens
tagccctcagcagtc

SEQ ID NO: 57928 - DNA, 15 bp, Homo sapiens
agccctcagcagtcc

SEQ ID NO: 57929 - DNA, 15 bp, Homo sapiens
gccctcagcagtcca

SEQ ID NO: 57930 - DNA, 15 bp, Homo sapiens
ccctcagcagtccag

SEQ ID NO: 57931 - DNA, 15 bp, Homo sapiens
cctcagcagtccagg

SEQ ID NO: 57932 - DNA, 15 bp, Homo sapiens
ctcagcagtccagga

SEQ ID NO: 57933 - DNA, 15 bp, Homo sapiens
tcagcagtccaggac

SEQ ID NO: 57934 - DNA, 15 bp, Homo sapiens
cagcagtccaggact

SEQ ID NO: 57935 - DNA, 15 bp, Homo sapiens
agcagtccaggactg

SEQ ID NO: 57936 - DNA, 15 bp, Homo sapiens
gcagtccaggactgc

SEQ ID NO: 57937 - DNA, 15 bp, Homo sapiens
cagtccaggactgct

SEQ ID NO: 57938 - DNA, 15 bp, Homo sapiens
agtccaggactgctt

SEQ ID NO: 57939 - DNA, 15 bp, Homo sapiens
gtccaggactgcttg

SEQ ID NO: 57940 - DNA, 15 bp, Homo sapiens
tccaggactgcttgt

SEQ ID NO: 57941 - DNA, 15 bp, Homo sapiens
ccaggactgcttgta

SEQ ID NO: 57942 - DNA, 15 bp, Homo sapiens
caggactgcttgtag

SEQ ID NO: 57943 - DNA, 15 bp, Homo sapiens
aggactgcttgtagt

SEQ ID NO: 57944 - DNA, 15 bp, Homo sapiens
ggactgcttgtagtt

SEQ ID NO: 57945 - DNA, 15 bp, Homo sapiens
gactgcttgtagttc

SEQ ID NO: 57946 - DNA, 15 bp, Homo sapiens
actgcttgtagttcc

SEQ ID NO: 57947 - DNA, 15 bp, Homo sapiens
ctgcttgtagttcct

SEQ ID NO: 57948 - DNA, 15 bp, Homo sapiens
tgcttgtagttcctc

SEQ ID NO: 57949 - DNA, 15 bp, Homo sapiens
gcttgtagttcctcc

SEQ ID NO: 57950 - DNA, 15 bp, Homo sapiens
cttgtagttcctccc

SEQ ID NO: 57951 - DNA, 15 bp, Homo sapiens
ttgtagttcctccca

SEQ ID NO: 57952 - DNA, 15 bp, Homo sapiens
tgtagttcctcccag

SEQ ID NO: 57953 - DNA, 15 bp, Homo sapiens
gtagttcctcccagg

SEQ ID NO: 57954 - DNA, 15 bp, Homo sapiens
tagttcctcccaggt

SEQ ID NO: 57955 - DNA, 15 bp, Homo sapiens
agttcctcccaggta

SEQ ID NO: 57956 - DNA, 15 bp, Homo sapiens
gttcctcccaggtac

SEQ ID NO: 57957 - DNA, 15 bp, Homo sapiens
ttcctcccaggtacc

SEQ ID NO: 57958 - DNA, 15 bp, Homo sapiens
tcctcccaggtacca

SEQ ID NO: 57959 - DNA, 15 bp, Homo sapiens
cctcccaggtaccat

SEQ ID NO: 57960 - DNA, 15 bp, Homo sapiens
ctcccaggtaccatg

SEQ ID NO: 57961 - DNA, 15 bp, Homo sapiens
tcccaggtaccatgt

SEQ ID NO: 57962 - DNA, 15 bp, Homo sapiens
cccaggtaccatgtt

SEQ ID NO: 57963 - DNA, 15 bp, Homo sapiens
ccaggtaccatgttt

SEQ ID NO: 57964 - DNA, 15 bp, Homo sapiens
caggtaccatgtttc

SEQ ID NO: 57965 - DNA, 15 bp, Homo sapiens
aggtaccatgtttct

SEQ ID NO: 57966 - DNA, 15 bp, Homo sapiens
ggtaccatgtttctt

SEQ ID NO: 57967 - DNA, 15 bp, Homo sapiens
gtaccatgtttcttg

SEQ ID NO: 57968 - DNA, 15 bp, Homo sapiens
taccatgtttcttgc

SEQ ID NO: 57969 - DNA, 15 bp, Homo sapiens
accatgtttcttgca

SEQ ID NO: 57970 - DNA, 15 bp, Homo sapiens
ccatgtttcttgcac

SEQ ID NO: 57971 - DNA, 15 bp, Homo sapiens
catgtttcttgcact

SEQ ID NO: 57972 - DNA, 15 bp, Homo sapiens
atgtttcttgcactc

SEQ ID NO: 57973 - DNA, 15 bp, Homo sapiens
tgtttcttgcactcc

SEQ ID NO: 57974 - DNA, 15 bp, Homo sapiens
gtttcttgcactcct

SEQ ID NO: 57975 - DNA, 15 bp, Homo sapiens
tttcttgcactcctg

SEQ ID NO: 57976 - DNA, 15 bp, Homo sapiens
ttcttgcactcctgg

SEQ ID NO: 57977 - DNA, 15 bp, Homo sapiens
tcttgcactcctggc

SEQ ID NO: 57978 - DNA, 15 bp, Homo sapiens
cttgcactcctggcc

SEQ ID NO: 57979 - DNA, 15 bp, Homo sapiens
ttgcactcctggcct

SEQ ID NO: 57980 - DNA, 15 bp, Homo sapiens
tgcactcctggcctt

SEQ ID NO: 57981 - DNA, 15 bp, Homo sapiens
gcactcctggccttt

SEQ ID NO: 57982 - DNA, 15 bp, Homo sapiens
cactcctggcctttg

SEQ ID NO: 57983 - DNA, 15 bp, Homo sapiens
actcctggcctttgt

SEQ ID NO: 57984 - DNA, 15 bp, Homo sapiens
ctcctggcctttgtc

SEQ ID NO: 57985 - DNA, 15 bp, Homo sapiens
tcctggcctttgtca

SEQ ID NO: 57986 - DNA, 15 bp, Homo sapiens
cctggcctttgtcat

SEQ ID NO: 57987 - DNA, 15 bp, Homo sapiens
ctggcctttgtcatt

SEQ ID NO: 57988 - DNA, 15 bp, Homo sapiens
tggcctttgtcattg

SEQ ID NO: 57989 - DNA, 15 bp, Homo sapiens
ggcctttgtcattgg

SEQ ID NO: 57990 - DNA, 15 bp, Homo sapiens
gcctttgtcattggc

SEQ ID NO: 57991 - DNA, 15 bp, Homo sapiens
cctttgtcattggct

SEQ ID NO: 57992 - DNA, 15 bp, Homo sapiens
ctttgtcattggctc

SEQ ID NO: 57993 - DNA, 15 bp, Homo sapiens
tttgtcattggctcc

SEQ ID NO: 57994 - DNA, 15 bp, Homo sapiens
ttgtcattggctccc

SEQ ID NO: 57995 - DNA, 15 bp, Homo sapiens
tgtcattggctcccc

SEQ ID NO: 57996 - DNA, 15 bp, Homo sapiens
gtcattggctcccct

SEQ ID NO: 57997 - DNA, 15 bp, Homo sapiens
tcattggctcccctg

SEQ ID NO: 57998 - DNA, 15 bp, Homo sapiens
cattggctcccctgc

SEQ ID NO: 57999 - DNA, 15 bp, Homo sapiens
attggctcccctgcc

SEQ ID NO: 58000 - DNA, 15 bp, Homo sapiens
ttggctcccctgccc

SEQ ID NO: 58001 - DNA, 15 bp, Homo sapiens
tggctcccctgccca

SEQ ID NO: 58002 - DNA, 15 bp, Homo sapiens
ggctcccctgcccaa

SEQ ID NO: 58003 - DNA, 15 bp, Homo sapiens
gctcccctgcccaag

SEQ ID NO: 58004 - DNA, 15 bp, Homo sapiens
ctcccctgcccaagt

SEQ ID NO: 58005 - DNA, 15 bp, Homo sapiens
tcccctgcccaagtc

SEQ ID NO: 58006 - DNA, 15 bp, Homo sapiens
cccctgcccaagtcc

SEQ ID NO: 58007 - DNA, 15 bp, Homo sapiens
ccctgcccaagtccc

SEQ ID NO: 58008 - DNA, 15 bp, Homo sapiens
cctgcccaagtcccc

SEQ ID NO: 58009 - DNA, 15 bp, Homo sapiens
ctgcccaagtcccct

SEQ ID NO: 58010 - DNA, 15 bp, Homo sapiens
tgcccaagtcccctt

SEQ ID NO: 58011 - DNA, 15 bp, Homo sapiens
gcccaagtccccttc

SEQ ID NO: 58012 - DNA, 15 bp, Homo sapiens
cccaagtccccttct

SEQ ID NO: 58013 - DNA, 15 bp, Homo sapiens
ccaagtccccttctc

SEQ ID NO: 58014 - DNA, 15 bp, Homo sapiens
caagtccccttctct

SEQ ID NO: 58015 - DNA, 15 bp, Homo sapiens
aagtccccttctctt

SEQ ID NO: 58016 - DNA, 15 bp, Homo sapiens
agtccccttctcttc

SEQ ID NO: 58017 - DNA, 15 bp, Homo sapiens
gtccccttctcttct

SEQ ID NO: 58018 - DNA, 15 bp, Homo sapiens
tccccttctcttctc

SEQ ID NO: 58019 - DNA, 15 bp, Homo sapiens
ccccttctcttctcc

SEQ ID NO: 58020 - DNA, 15 bp, Homo sapiens
cccttctcttctcct

SEQ ID NO: 58021 - DNA, 15 bp, Homo sapiens
ccttctcttctcctt

SEQ ID NO: 58022 - DNA, 15 bp, Homo sapiens
cttctcttctccttt

SEQ ID NO: 58023 - DNA, 15 bp, Homo sapiens
ttctcttctcctttc

SEQ ID NO: 58024 - DNA, 15 bp, Homo sapiens
tctcttctcctttcc

SEQ ID NO: 58025 - DNA, 15 bp, Homo sapiens
ctcttctcctttcct

SEQ ID NO: 58026 - DNA, 15 bp, Homo sapiens
tcttctcctttcctt

SEQ ID NO: 58027 - DNA, 15 bp, Homo sapiens
cttctcctttccttc

SEQ ID NO: 58028 - DNA, 15 bp, Homo sapiens
ttctcctttccttcc

SEQ ID NO: 58029 - DNA, 15 bp, Homo sapiens
tctcctttccttccc

SEQ ID NO: 58030 - DNA, 15 bp, Homo sapiens
ctcctttccttcccc

SEQ ID NO: 58031 - DNA, 15 bp, Homo sapiens
tcctttccttcccct

SEQ ID NO: 58032 - DNA, 15 bp, Homo sapiens
cctttccttcccctg

SEQ ID NO: 58033 - DNA, 15 bp, Homo sapiens
ctttccttcccctgt

SEQ ID NO: 58034 - DNA, 15 bp, Homo sapiens
tttccttcccctgtg

SEQ ID NO: 58035 - DNA, 15 bp, Homo sapiens
ttccttcccctgtgg

SEQ ID NO: 58036 - DNA, 15 bp, Homo sapiens
tccttcccctgtggc

SEQ ID NO: 58037 - DNA, 15 bp, Homo sapiens
ccttcccctgtggcc

SEQ ID NO: 58038 - DNA, 15 bp, Homo sapiens
cttcccctgtggcct

SEQ ID NO: 58039 - DNA, 15 bp, Homo sapiens
ttcccctgtggcctt

SEQ ID NO: 58040 - DNA, 15 bp, Homo sapiens
tcccctgtggccttg

SEQ ID NO: 58041 - DNA, 15 bp, Homo sapiens
cccctgtggccttgc

SEQ ID NO: 58042 - DNA, 15 bp, Homo sapiens
ccctgtggccttgcc

SEQ ID NO: 58043 - DNA, 15 bp, Homo sapiens
cctgtggccttgcct

SEQ ID NO: 58044 - DNA, 15 bp, Homo sapiens
ctgtggccttgcctt

SEQ ID NO: 58045 - DNA, 15 bp, Homo sapiens
tgtggccttgccttg

SEQ ID NO: 58046 - DNA, 15 bp, Homo sapiens
gtggccttgccttgt

SEQ ID NO: 58047 - DNA, 15 bp, Homo sapiens
tggccttgccttgtc

SEQ ID NO: 58048 - DNA, 15 bp, Homo sapiens
ggccttgccttgtcg

SEQ ID NO: 58049 - DNA, 15 bp, Homo sapiens
gccttgccttgtcgt

SEQ ID NO: 58050 - DNA, 15 bp, Homo sapiens
ccttgccttgtcgtg

SEQ ID NO: 58051 - DNA, 15 bp, Homo sapiens
cttgccttgtcgtgc

SEQ ID NO: 58052 - DNA, 15 bp, Homo sapiens
ttgccttgtcgtgct

SEQ ID NO: 58053 - DNA, 15 bp, Homo sapiens
tgccttgtcgtgctt

SEQ ID NO: 58054 - DNA, 15 bp, Homo sapiens
gccttgtcgtgctta

SEQ ID NO: 58055 - DNA, 15 bp, Homo sapiens
ccttgtcgtgcttat

SEQ ID NO: 58056 - DNA, 15 bp, Homo sapiens
cttgtcgtgcttatc

SEQ ID NO: 58057 - DNA, 15 bp, Homo sapiens
ttgtcgtgcttatcc

SEQ ID NO: 58058 - DNA, 15 bp, Homo sapiens
tgtcgtgcttatcct

SEQ ID NO: 58059 - DNA, 15 bp, Homo sapiens
gtcgtgcttatcctt

SEQ ID NO: 58060 - DNA, 15 bp, Homo sapiens
tcgtgcttatccttg

SEQ ID NO: 58061 - DNA, 15 bp, Homo sapiens
cgtgcttatccttga

SEQ ID NO: 58062 - DNA, 15 bp, Homo sapiens
gtgcttatccttgaa

SEQ ID NO: 58063 - DNA, 15 bp, Homo sapiens
tgcttatccttgaag

SEQ ID NO: 58064 - DNA, 15 bp, Homo sapiens
gcttatccttgaaga

SEQ ID NO: 58065 - DNA, 15 bp, Homo sapiens
cttatccttgaagac

SEQ ID NO: 58066 - DNA, 15 bp, Homo sapiens
ttatccttgaagacc

SEQ ID NO: 58067 - DNA, 15 bp, Homo sapiens
tatccttgaagaccc

SEQ ID NO: 58068 - DNA, 15 bp, Homo sapiens
atccttgaagaccct

SEQ ID NO: 58069 - DNA, 15 bp, Homo sapiens
tccttgaagaccctg

SEQ ID NO: 58070 - DNA, 15 bp, Homo sapiens
ccttgaagaccctgt

SEQ ID NO: 58071 - DNA, 15 bp, Homo sapiens
cttgaagaccctgtc

SEQ ID NO: 58072 - DNA, 15 bp, Homo sapiens
ttgaagaccctgtca

SEQ ID NO: 58073 - DNA, 15 bp, Homo sapiens
tgaagaccctgtcag

SEQ ID NO: 58074 - DNA, 15 bp, Homo sapiens
gaagaccctgtcagg

SEQ ID NO: 58075 - DNA, 15 bp, Homo sapiens
aagaccctgtcaggt

SEQ ID NO: 58076 - DNA, 15 bp, Homo sapiens
agaccctgtcaggta

SEQ ID NO: 58077 - DNA, 15 bp, Homo sapiens
gaccctgtcaggtat

SEQ ID NO: 58078 - DNA, 15 bp, Homo sapiens
accctgtcaggtatc

SEQ ID NO: 58079 - DNA, 15 bp, Homo sapiens
ccctgtcaggtatct

SEQ ID NO: 58080 - DNA, 15 bp, Homo sapiens
cctgtcaggtatctc

SEQ ID NO: 58081 - DNA, 15 bp, Homo sapiens
ctgtcaggtatctct

SEQ ID NO: 58082 - DNA, 15 bp, Homo sapiens
tgtcaggtatctctt

SEQ ID NO: 58083 - DNA, 15 bp, Homo sapiens
gtcaggtatctcttc

SEQ ID NO: 58084 - DNA, 15 bp, Homo sapiens
tcaggtatctcttcc

SEQ ID NO: 58085 - DNA, 15 bp, Homo sapiens
caggtatctcttccc

SEQ ID NO: 58086 - DNA, 15 bp, Homo sapiens
aggtatctcttcccc

SEQ ID NO: 58087 - DNA, 15 bp, Homo sapiens
ggtatctcttcccca

SEQ ID NO: 58088 - DNA, 15 bp, Homo sapiens
gtatctcttccccaa

SEQ ID NO: 58089 - DNA, 15 bp, Homo sapiens
tatctcttccccaaa

SEQ ID NO: 58090 - DNA, 15 bp, Homo sapiens
atctcttccccaaag

SEQ ID NO: 58091 - DNA, 15 bp, Homo sapiens
tctcttccccaaaga

SEQ ID NO: 58092 - DNA, 15 bp, Homo sapiens
ctcttccccaaagag

SEQ ID NO: 58093 - DNA, 15 bp, Homo sapiens
tcttccccaaagagc

SEQ ID NO: 58094 - DNA, 15 bp, Homo sapiens
cttccccaaagagcc

SEQ ID NO: 58095 - DNA, 15 bp, Homo sapiens
ttccccaaagagccc

SEQ ID NO: 58096 - DNA, 15 bp, Homo sapiens
tccccaaagagccct

SEQ ID NO: 58097 - DNA, 15 bp, Homo sapiens
ccccaaagagccctg

SEQ ID NO: 58098 - DNA, 15 bp, Homo sapiens
cccaaagagccctgc

SEQ ID NO: 58099 - DNA, 15 bp, Homo sapiens
ccaaagagccctgcc

SEQ ID NO: 58100 - DNA, 15 bp, Homo sapiens
caaagagccctgcct

SEQ ID NO: 58101 - DNA, 15 bp, Homo sapiens
aaagagccctgccta

SEQ ID NO: 58102 - DNA, 15 bp, Homo sapiens
aagagccctgcctaa

SEQ ID NO: 58103 - DNA, 15 bp, Homo sapiens
agagccctgcctaac

SEQ ID NO: 58104 - DNA, 15 bp, Homo sapiens
gagccctgcctaacc

SEQ ID NO: 58105 - DNA, 15 bp, Homo sapiens
agccctgcctaacca

SEQ ID NO: 58106 - DNA, 15 bp, Homo sapiens
gccctgcctaaccac

SEQ ID NO: 58107 - DNA, 15 bp, Homo sapiens
ccctgcctaaccacc

SEQ ID NO: 58108 - DNA, 15 bp, Homo sapiens
cctgcctaaccaccg

SEQ ID NO: 58109 - DNA, 15 bp, Homo sapiens
ctgcctaaccaccgc

SEQ ID NO: 58110 - DNA, 15 bp, Homo sapiens
tgcctaaccaccgcc

SEQ ID NO: 58111 - DNA, 15 bp, Homo sapiens
gcctaaccaccgccc

SEQ ID NO: 58112 - DNA, 15 bp, Homo sapiens
cctaaccaccgcccc

SEQ ID NO: 58113 - DNA, 15 bp, Homo sapiens
ctaaccaccgccccc

SEQ ID NO: 58114 - DNA, 15 bp, Homo sapiens
taaccaccgcccccc

SEQ ID NO: 58115 - DNA, 15 bp, Homo sapiens
aaccaccgcccccct

SEQ ID NO: 58116 - DNA, 15 bp, Homo sapiens
accaccgcccccctc

SEQ ID NO: 58117 - DNA, 15 bp, Homo sapiens
ccaccgcccccctcc

SEQ ID NO: 58118 - DNA, 15 bp, Homo sapiens
caccgcccccctccc

SEQ ID NO: 58119 - DNA, 15 bp, Homo sapiens
accgcccccctcccc

SEQ ID NO: 58120 - DNA, 15 bp, Homo sapiens
ccgcccccctccccc

SEQ ID NO: 58121 - DNA, 15 bp, Homo sapiens
cgcccccctcccccc

SEQ ID NO: 58122 - DNA, 15 bp, Homo sapiens
gcccccctccccccc

SEQ ID NO: 58123 - DNA, 15 bp, Homo sapiens
cccccctcccccccg

SEQ ID NO: 58124 - DNA, 15 bp, Homo sapiens
ccccctcccccccgc

SEQ ID NO: 58125 - DNA, 15 bp, Homo sapiens
cccctcccccccgcg

SEQ ID NO: 58126 - DNA, 15 bp, Homo sapiens
ccctcccccccgcga

SEQ ID NO: 58127 - DNA, 15 bp, Homo sapiens
cctcccccccgcgac

SEQ ID NO: 58128 - DNA, 15 bp, Homo sapiens
ctcccccccgcgaca

SEQ ID NO: 58129 - DNA, 15 bp, Homo sapiens
tcccccccgcgacac

SEQ ID NO: 58130 - DNA, 15 bp, Homo sapiens
cccccccgcgacaca

SEQ ID NO: 58131 - DNA, 15 bp, Homo sapiens
ccccccgcgacacac

SEQ ID NO: 58132 - DNA, 15 bp, Homo sapiens
cccccgcgacacaca

SEQ ID NO: 58133 - DNA, 15 bp, Homo sapiens
ccccgcgacacacac

SEQ ID NO: 58134 - DNA, 15 bp, Homo sapiens
cccgcgacacacaca

SEQ ID NO: 58135 - DNA, 15 bp, Homo sapiens
ccgcgacacacacac

SEQ ID NO: 58136 - DNA, 15 bp, Homo sapiens
cgcgacacacacacc

SEQ ID NO: 58137 - DNA, 15 bp, Homo sapiens
gcgacacacacacct

SEQ ID NO: 58138 - DNA, 15 bp, Homo sapiens
cgacacacacacctg

SEQ ID NO: 58139 - DNA, 15 bp, Homo sapiens
gacacacacacctgg

SEQ ID NO: 58140 - DNA, 15 bp, Homo sapiens
acacacacacctggg

SEQ ID NO: 58141 - DNA, 15 bp, Homo sapiens
cacacacacctgggt

SEQ ID NO: 58142 - DNA, 15 bp, Homo sapiens
acacacacctgggtt

SEQ ID NO: 58143 - DNA, 15 bp, Homo sapiens
cacacacctgggtta

SEQ ID NO: 58144 - DNA, 15 bp, Homo sapiens
acacacctgggttag

SEQ ID NO: 58145 - DNA, 15 bp, Homo sapiens
cacacctgggttagg

SEQ ID NO: 58146 - DNA, 15 bp, Homo sapiens
acacctgggttaggc

SEQ ID NO: 58147 - DNA, 15 bp, Homo sapiens
cacctgggttaggcc

SEQ ID NO: 58148 - DNA, 15 bp, Homo sapiens
acctgggttaggccc

SEQ ID NO: 58149 - DNA, 15 bp, Homo sapiens
cctgggttaggccct

SEQ ID NO: 58150 - DNA, 15 bp, Homo sapiens
ctgggttaggccctg

SEQ ID NO: 58151 - DNA, 15 bp, Homo sapiens
tgggttaggccctgc

SEQ ID NO: 58152 - DNA, 15 bp, Homo sapiens
gggttaggccctgcc

SEQ ID NO: 58153 - DNA, 15 bp, Homo sapiens
ggttaggccctgcct

SEQ ID NO: 58154 - DNA, 15 bp, Homo sapiens
gttaggccctgcctc

SEQ ID NO: 58155 - DNA, 15 bp, Homo sapiens
ttaggccctgcctct

SEQ ID NO: 58156 - DNA, 15 bp, Homo sapiens
taggccctgcctctc

SEQ ID NO: 58157 - DNA, 15 bp, Homo sapiens
aggccctgcctctcc

SEQ ID NO: 58158 - DNA, 15 bp, Homo sapiens
ggccctgcctctcca

SEQ ID NO: 58159 - DNA, 15 bp, Homo sapiens
gccctgcctctccac

SEQ ID NO: 58160 - DNA, 15 bp, Homo sapiens
ccctgcctctccacg

SEQ ID NO: 58161 - DNA, 15 bp, Homo sapiens
cctgcctctccacgc

SEQ ID NO: 58162 - DNA, 15 bp, Homo sapiens
ctgcctctccacgcc

SEQ ID NO: 58163 - DNA, 15 bp, Homo sapiens
tgcctctccacgcct

SEQ ID NO: 58164 - DNA, 15 bp, Homo sapiens
gcctctccacgcctg

SEQ ID NO: 58165 - DNA, 15 bp, Homo sapiens
cctctccacgcctgt

SEQ ID NO: 58166 - DNA, 15 bp, Homo sapiens
ctctccacgcctgtg

SEQ ID NO: 58167 - DNA, 15 bp, Homo sapiens
tctccacgcctgtgc

SEQ ID NO: 58168 - DNA, 15 bp, Homo sapiens
ctccacgcctgtgcc

SEQ ID NO: 58169 - DNA, 15 bp, Homo sapiens
tccacgcctgtgcct

SEQ ID NO: 58170 - DNA, 15 bp, Homo sapiens
ccacgcctgtgcctc

SEQ ID NO: 58171 - DNA, 15 bp, Homo sapiens
cacgcctgtgcctcc

SEQ ID NO: 58172 - DNA, 15 bp, Homo sapiens
acgcctgtgcctcct

SEQ ID NO: 58173 - DNA, 15 bp, Homo sapiens
cgcctgtgcctcctg

SEQ ID NO: 58174 - DNA, 15 bp, Homo sapiens
gcctgtgcctcctgc

SEQ ID NO: 58175 - DNA, 15 bp, Homo sapiens
cctgtgcctcctgcc

SEQ ID NO: 58176 - DNA, 15 bp, Homo sapiens
ctgtgcctcctgcca

SEQ ID NO: 58177 - DNA, 15 bp, Homo sapiens
tgtgcctcctgccaa

SEQ ID NO: 58178 - DNA, 15 bp, Homo sapiens
gtgcctcctgccaag

SEQ ID NO: 58179 - DNA, 15 bp, Homo sapiens
tgcctcctgccaagt

SEQ ID NO: 58180 - DNA, 15 bp, Homo sapiens
gcctcctgccaagtc

SEQ ID NO: 58181 - DNA, 15 bp, Homo sapiens
cctcctgccaagtcc

SEQ ID NO: 58182 - DNA, 15 bp, Homo sapiens
ctcctgccaagtcct

SEQ ID NO: 58183 - DNA, 15 bp, Homo sapiens
tcctgccaagtcctc

SEQ ID NO: 58184 - DNA, 15 bp, Homo sapiens
cctgccaagtcctca

SEQ ID NO: 58185 - DNA, 15 bp, Homo sapiens
ctgccaagtcctcag

SEQ ID NO: 58186 - DNA, 15 bp, Homo sapiens
tgccaagtcctcaga

SEQ ID NO: 58187 - DNA, 15 bp, Homo sapiens
gccaagtcctcagag

SEQ ID NO: 58188 - DNA, 15 bp, Homo sapiens
ccaagtcctcagagg

SEQ ID NO: 58189 - DNA, 15 bp, Homo sapiens
caagtcctcagaggt

SEQ ID NO: 58190 - DNA, 15 bp, Homo sapiens
aagtcctcagaggtc

SEQ ID NO: 58191 - DNA, 15 bp, Homo sapiens
agtcctcagaggtct

SEQ ID NO: 58192 - DNA, 15 bp, Homo sapiens
gtcctcagaggtctc

SEQ ID NO: 58193 - DNA, 15 bp, Homo sapiens
tcctcagaggtctct

SEQ ID NO: 58194 - DNA, 15 bp, Homo sapiens
cctcagaggtctctg

SEQ ID NO: 58195 - DNA, 15 bp, Homo sapiens
ctcagaggtctctga

SEQ ID NO: 58196 - DNA, 15 bp, Homo sapiens
tcagaggtctctgat

SEQ ID NO: 58197 - DNA, 15 bp, Homo sapiens
cagaggtctctgatc

SEQ ID NO: 58198 - DNA, 15 bp, Homo sapiens
agaggtctctgatcc

SEQ ID NO: 58199 - DNA, 15 bp, Homo sapiens
gaggtctctgatccc

SEQ ID NO: 58200 - DNA, 15 bp, Homo sapiens
aggtctctgatccca

SEQ ID NO: 58201 - DNA, 15 bp, Homo sapiens
ggtctctgatcccat

SEQ ID NO: 58202 - DNA, 15 bp, Homo sapiens
gtctctgatcccatg

SEQ ID NO: 58203 - DNA, 15 bp, Homo sapiens
tctctgatcccatgt

SEQ ID NO: 58204 - DNA, 15 bp, Homo sapiens
ctctgatcccatgtg

SEQ ID NO: 58205 - DNA, 15 bp, Homo sapiens
tctgatcccatgtgc

SEQ ID NO: 58206 - DNA, 15 bp, Homo sapiens
ctgatcccatgtgcc

SEQ ID NO: 58207 - DNA, 15 bp, Homo sapiens
tgatcccatgtgcct

SEQ ID NO: 58208 - DNA, 15 bp, Homo sapiens
gatcccatgtgcctc

SEQ ID NO: 58209 - DNA, 15 bp, Homo sapiens
atcccatgtgcctcc

SEQ ID NO: 58210 - DNA, 15 bp, Homo sapiens
tcccatgtgcctcca

SEQ ID NO: 58211 - DNA, 15 bp, Homo sapiens
cccatgtgcctccag

SEQ ID NO: 58212 - DNA, 15 bp, Homo sapiens
ccatgtgcctccagg

SEQ ID NO: 58213 - DNA, 15 bp, Homo sapiens
catgtgcctccaggc

SEQ ID NO: 58214 - DNA, 15 bp, Homo sapiens
atgtgcctccaggca

SEQ ID NO: 58215 - DNA, 15 bp, Homo sapiens
tgtgcctccaggcat

SEQ ID NO: 58216 - DNA, 15 bp, Homo sapiens
gtgcctccaggcatg

SEQ ID NO: 58217 - DNA, 15 bp, Homo sapiens
tgcctccaggcatgg

SEQ ID NO: 58218 - DNA, 15 bp, Homo sapiens
gcctccaggcatggc

SEQ ID NO: 58219 - DNA, 15 bp, Homo sapiens
cctccaggcatggca

SEQ ID NO: 58220 - DNA, 15 bp, Homo sapiens
ctccaggcatggcat

SEQ ID NO: 58221 - DNA, 15 bp, Homo sapiens
tccaggcatggcata

SEQ ID NO: 58222 - DNA, 15 bp, Homo sapiens
ccaggcatggcatag

SEQ ID NO: 58223 - DNA, 15 bp, Homo sapiens
caggcatggcatagg

SEQ ID NO: 58224 - DNA, 15 bp, Homo sapiens
aggcatggcataggg

SEQ ID NO: 58225 - DNA, 15 bp, Homo sapiens
ggcatggcatagggg

SEQ ID NO: 58226 - DNA, 15 bp, Homo sapiens
gcatggcataggggg

SEQ ID NO: 58227 - DNA, 15 bp, Homo sapiens
catggcataggggga

SEQ ID NO: 58228 - DNA, 15 bp, Homo sapiens
atggcatagggggac

SEQ ID NO: 58229 - DNA, 15 bp, Homo sapiens
tggcatagggggact

SEQ ID NO: 58230 - DNA, 15 bp, Homo sapiens
ggcatagggggactg

SEQ ID NO: 58231 - DNA, 15 bp, Homo sapiens
gcatagggggactgt

SEQ ID NO: 58232 - DNA, 15 bp, Homo sapiens
catagggggactgtg

SEQ ID NO: 58233 - DNA, 15 bp, Homo sapiens
atagggggactgtga

SEQ ID NO: 58234 - DNA, 15 bp, Homo sapiens
tagggggactgtgac

SEQ ID NO: 58235 - DNA, 15 bp, Homo sapiens
agggggactgtgaca

SEQ ID NO: 58236 - DNA, 15 bp, Homo sapiens
gggggactgtgacac

SEQ ID NO: 58237 - DNA, 15 bp, Homo sapiens
ggggactgtgacaca

SEQ ID NO: 58238 - DNA, 15 bp, Homo sapiens
gggactgtgacacag

SEQ ID NO: 58239 - DNA, 15 bp, Homo sapiens
ggactgtgacacagc

SEQ ID NO: 58240 - DNA, 15 bp, Homo sapiens
gactgtgacacagcc

SEQ ID NO: 58241 - DNA, 15 bp, Homo sapiens
actgtgacacagcct

SEQ ID NO: 58242 - DNA, 15 bp, Homo sapiens
ctgtgacacagcctc

SEQ ID NO: 58243 - DNA, 15 bp, Homo sapiens
tgtgacacagcctct

SEQ ID NO: 58244 - DNA, 15 bp, Homo sapiens
gtgacacagcctctc

SEQ ID NO: 58245 - DNA, 15 bp, Homo sapiens
tgacacagcctctcg

SEQ ID NO: 58246 - DNA, 15 bp, Homo sapiens
gacacagcctctcgg

SEQ ID NO: 58247 - DNA, 15 bp, Homo sapiens
acacagcctctcggc

SEQ ID NO: 58248 - DNA, 15 bp, Homo sapiens
cacagcctctcggcc

SEQ ID NO: 58249 - DNA, 15 bp, Homo sapiens
acagcctctcggccc

SEQ ID NO: 58250 - DNA, 15 bp, Homo sapiens
cagcctctcggccca

SEQ ID NO: 58251 - DNA, 15 bp, Homo sapiens
agcctctcggcccac

SEQ ID NO: 58252 - DNA, 15 bp, Homo sapiens
gcctctcggcccaca

SEQ ID NO: 58253 - DNA, 15 bp, Homo sapiens
cctctcggcccacag

SEQ ID NO: 58254 - DNA, 15 bp, Homo sapiens
ctctcggcccacaga

SEQ ID NO: 58255 - DNA, 15 bp, Homo sapiens
tctcggcccacagac

SEQ ID NO: 58256 - DNA, 15 bp, Homo sapiens
ctcggcccacagacc

SEQ ID NO: 58257 - DNA, 15 bp, Homo sapiens
tcggcccacagaccc

SEQ ID NO: 58258 - DNA, 15 bp, Homo sapiens
cggcccacagacccc

SEQ ID NO: 58259 - DNA, 15 bp, Homo sapiens
ggcccacagacccct

SEQ ID NO: 58260 - DNA, 15 bp, Homo sapiens
gcccacagacccctg

SEQ ID NO: 58261 - DNA, 15 bp, Homo sapiens
cccacagacccctga

SEQ ID NO: 58262 - DNA, 15 bp, Homo sapiens
ccacagacccctgat

SEQ ID NO: 58263 - DNA, 15 bp, Homo sapiens
cacagacccctgatt

SEQ ID NO: 58264 - DNA, 15 bp, Homo sapiens
acagacccctgattg

SEQ ID NO: 58265 - DNA, 15 bp, Homo sapiens
cagacccctgattgt

SEQ ID NO: 58266 - DNA, 15 bp, Homo sapiens
agacccctgattgtg

SEQ ID NO: 58267 - DNA, 15 bp, Homo sapiens
gacccctgattgtgg

SEQ ID NO: 58268 - DNA, 15 bp, Homo sapiens
acccctgattgtggg

SEQ ID NO: 58269 - DNA, 15 bp, Homo sapiens
cccctgattgtgggc

SEQ ID NO: 58270 - DNA, 15 bp, Homo sapiens
ccctgattgtgggct

SEQ ID NO: 58271 - DNA, 15 bp, Homo sapiens
cctgattgtgggctt

SEQ ID NO: 58272 - DNA, 15 bp, Homo sapiens
ctgattgtgggcttg

SEQ ID NO: 58273 - DNA, 15 bp, Homo sapiens
tgattgtgggcttgc

SEQ ID NO: 58274 - DNA, 15 bp, Homo sapiens
gattgtgggcttgct

SEQ ID NO: 58275 - DNA, 15 bp, Homo sapiens
attgtgggcttgctc

SEQ ID NO: 58276 - DNA, 15 bp, Homo sapiens
ttgtgggcttgctca

SEQ ID NO: 58277 - DNA, 15 bp, Homo sapiens
tgtgggcttgctcac

SEQ ID NO: 58278 - DNA, 15 bp, Homo sapiens
gtgggcttgctcact

SEQ ID NO: 58279 - DNA, 15 bp, Homo sapiens
tgggcttgctcactg

SEQ ID NO: 58280 - DNA, 15 bp, Homo sapiens
gggcttgctcactgc

SEQ ID NO: 58281 - DNA, 15 bp, Homo sapiens
ggcttgctcactgcc

SEQ ID NO: 58282 - DNA, 15 bp, Homo sapiens
gcttgctcactgccc

SEQ ID NO: 58283 - DNA, 15 bp, Homo sapiens
cttgctcactgcccc

SEQ ID NO: 58284 - DNA, 15 bp, Homo sapiens
ttgctcactgcccca

SEQ ID NO: 58285 - DNA, 15 bp, Homo sapiens
tgctcactgccccag

SEQ ID NO: 58286 - DNA, 15 bp, Homo sapiens
gctcactgccccagt

SEQ ID NO: 58287 - DNA, 15 bp, Homo sapiens
ctcactgccccagtc

SEQ ID NO: 58288 - DNA, 15 bp, Homo sapiens
tcactgccccagtca

SEQ ID NO: 58289 - DNA, 15 bp, Homo sapiens
cactgccccagtcag

SEQ ID NO: 58290 - DNA, 15 bp, Homo sapiens
actgccccagtcagt

SEQ ID NO: 58291 - DNA, 15 bp, Homo sapiens
ctgccccagtcagtc

SEQ ID NO: 58292 - DNA, 15 bp, Homo sapiens
tgccccagtcagtcc

SEQ ID NO: 58293 - DNA, 15 bp, Homo sapiens
gccccagtcagtcct

SEQ ID NO: 58294 - DNA, 15 bp, Homo sapiens
ccccagtcagtcctc

SEQ ID NO: 58295 - DNA, 15 bp, Homo sapiens
cccagtcagtcctct

SEQ ID NO: 58296 - DNA, 15 bp, Homo sapiens
ccagtcagtcctctt

SEQ ID NO: 58297 - DNA, 15 bp, Homo sapiens
cagtcagtcctctta

SEQ ID NO: 58298 - DNA, 15 bp, Homo sapiens
agtcagtcctcttat

SEQ ID NO: 58299 - DNA, 15 bp, Homo sapiens
gtcagtcctcttatt

SEQ ID NO: 58300 - DNA, 15 bp, Homo sapiens
tcagtcctcttattg

SEQ ID NO: 58301 - DNA, 15 bp, Homo sapiens
cagtcctcttattga

SEQ ID NO: 58302 - DNA, 15 bp, Homo sapiens
agtcctcttattgag

SEQ ID NO: 58303 - DNA, 15 bp, Homo sapiens
gtcctcttattgagg

SEQ ID NO: 58304 - DNA, 15 bp, Homo sapiens
tcctcttattgagga

SEQ ID NO: 58305 - DNA, 15 bp, Homo sapiens
cctcttattgaggat

SEQ ID NO: 58306 - DNA, 15 bp, Homo sapiens
ctcttattgaggatt

SEQ ID NO: 58307 - DNA, 15 bp, Homo sapiens
tcttattgaggattc

SEQ ID NO: 58308 - DNA, 15 bp, Homo sapiens
cttattgaggattcc

SEQ ID NO: 58309 - DNA, 15 bp, Homo sapiens
ttattgaggattccg

SEQ ID NO: 58310 - DNA, 15 bp, Homo sapiens
tattgaggattccgt

SEQ ID NO: 58311 - DNA, 15 bp, Homo sapiens
attgaggattccgtg

SEQ ID NO: 58312 - DNA, 15 bp, Homo sapiens
ttgaggattccgtgc

SEQ ID NO: 58313 - DNA, 15 bp, Homo sapiens
tgaggattccgtgcc

SEQ ID NO: 58314 - DNA, 15 bp, Homo sapiens
gaggattccgtgcca

SEQ ID NO: 58315 - DNA, 15 bp, Homo sapiens
aggattccgtgccag

SEQ ID NO: 58316 - DNA, 15 bp, Homo sapiens
ggattccgtgccagt

SEQ ID NO: 58317 - DNA, 15 bp, Homo sapiens
gattccgtgccagtt

SEQ ID NO: 58318 - DNA, 15 bp, Homo sapiens
attccgtgccagttc

SEQ ID NO: 58319 - DNA, 15 bp, Homo sapiens
ttccgtgccagttcc

SEQ ID NO: 58320 - DNA, 15 bp, Homo sapiens
tccgtgccagttcct

SEQ ID NO: 58321 - DNA, 15 bp, Homo sapiens
ccgtgccagttcctg

SEQ ID NO: 58322 - DNA, 15 bp, Homo sapiens
cgtgccagttcctga

SEQ ID NO: 58323 - DNA, 15 bp, Homo sapiens
gtgccagttcctgac

SEQ ID NO: 58324 - DNA, 15 bp, Homo sapiens
tgccagttcctgact

SEQ ID NO: 58325 - DNA, 15 bp, Homo sapiens
gccagttcctgactc

SEQ ID NO: 58326 - DNA, 15 bp, Homo sapiens
ccagttcctgactcc

SEQ ID NO: 58327 - DNA, 15 bp, Homo sapiens
cagttcctgactcca

SEQ ID NO: 58328 - DNA, 15 bp, Homo sapiens
agttcctgactccag

SEQ ID NO: 58329 - DNA, 15 bp, Homo sapiens
gttcctgactccagc

SEQ ID NO: 58330 - DNA, 15 bp, Homo sapiens
ttcctgactccagca

SEQ ID NO: 58331 - DNA, 15 bp, Homo sapiens
tcctgactccagcac

SEQ ID NO: 58332 - DNA, 15 bp, Homo sapiens
cctgactccagcaca

SEQ ID NO: 58333 - DNA, 15 bp, Homo sapiens
ctgactccagcacac

SEQ ID NO: 58334 - DNA, 15 bp, Homo sapiens
tgactccagcacaca

SEQ ID NO: 58335 - DNA, 15 bp, Homo sapiens
gactccagcacacac

SEQ ID NO: 58336 - DNA, 15 bp, Homo sapiens
actccagcacacaca

SEQ ID NO: 58337 - DNA, 15 bp, Homo sapiens
ctccagcacacacac

SEQ ID NO: 58338 - DNA, 15 bp, Homo sapiens
tccagcacacacacg

SEQ ID NO: 58339 - DNA, 15 bp, Homo sapiens
ccagcacacacacgc

SEQ ID NO: 58340 - DNA, 15 bp, Homo sapiens
cagcacacacacgca

SEQ ID NO: 58341 - DNA, 15 bp, Homo sapiens
agcacacacacgcat

SEQ ID NO: 58342 - DNA, 15 bp, Homo sapiens
gcacacacacgcatg

SEQ ID NO: 58343 - DNA, 15 bp, Homo sapiens
cacacacacgcatgt

SEQ ID NO: 58344 - DNA, 15 bp, Homo sapiens
acacacacgcatgta

SEQ ID NO: 58345 - DNA, 15 bp, Homo sapiens
cacacacgcatgtag

SEQ ID NO: 58346 - DNA, 15 bp, Homo sapiens
acacacgcatgtagg

SEQ ID NO: 58347 - DNA, 15 bp, Homo sapiens
cacacgcatgtaggc

SEQ ID NO: 58348 - DNA, 15 bp, Homo sapiens
acacgcatgtaggcc

SEQ ID NO: 58349 - DNA, 15 bp, Homo sapiens
cacgcatgtaggccg

SEQ ID NO: 58350 - DNA, 15 bp, Homo sapiens
acgcatgtaggccgc

SEQ ID NO: 58351 - DNA, 15 bp, Homo sapiens
cgcatgtaggccgcc

SEQ ID NO: 58352 - DNA, 15 bp, Homo sapiens
gcatgtaggccgccc

SEQ ID NO: 58353 - DNA, 15 bp, Homo sapiens
catgtaggccgccct

SEQ ID NO: 58354 - DNA, 15 bp, Homo sapiens
atgtaggccgccctc

SEQ ID NO: 58355 - DNA, 15 bp, Homo sapiens
tgtaggccgccctcc

SEQ ID NO: 58356 - DNA, 15 bp, Homo sapiens
gtaggccgccctcct

SEQ ID NO: 58357 - DNA, 15 bp, Homo sapiens
taggccgccctccta

SEQ ID NO: 58358 - DNA, 15 bp, Homo sapiens
aggccgccctcctag

SEQ ID NO: 58359 - DNA, 15 bp, Homo sapiens
ggccgccctcctagt

SEQ ID NO: 58360 - DNA, 15 bp, Homo sapiens
gccgccctcctagtg

SEQ ID NO: 58361 - DNA, 15 bp, Homo sapiens
ccgccctcctagtgc

SEQ ID NO: 58362 - DNA, 15 bp, Homo sapiens
cgccctcctagtgcc

SEQ ID NO: 58363 - DNA, 15 bp, Homo sapiens
gccctcctagtgcct

SEQ ID NO: 58364 - DNA, 15 bp, Homo sapiens
ccctcctagtgcctg

SEQ ID NO: 58365 - DNA, 15 bp, Homo sapiens
cctcctagtgcctgg

SEQ ID NO: 58366 - DNA, 15 bp, Homo sapiens
ctcctagtgcctggc

SEQ ID NO: 58367 - DNA, 15 bp, Homo sapiens
tcctagtgcctggct

SEQ ID NO: 58368 - DNA, 15 bp, Homo sapiens
cctagtgcctggctc

SEQ ID NO: 58369 - DNA, 15 bp, Homo sapiens
ctagtgcctggctcc

SEQ ID NO: 58370 - DNA, 15 bp, Homo sapiens
tagtgcctggctcct

SEQ ID NO: 58371 - DNA, 15 bp, Homo sapiens
agtgcctggctcctt

SEQ ID NO: 58372 - DNA, 15 bp, Homo sapiens
gtgcctggctccttc

SEQ ID NO: 58373 - DNA, 15 bp, Homo sapiens
tgcctggctccttcc

SEQ ID NO: 58374 - DNA, 15 bp, Homo sapiens
gcctggctccttccc

SEQ ID NO: 58375 - DNA, 15 bp, Homo sapiens
cctggctccttccct

SEQ ID NO: 58376 - DNA, 15 bp, Homo sapiens
ctggctccttccctg

SEQ ID NO: 58377 - DNA, 15 bp, Homo sapiens
tggctccttccctgt

SEQ ID NO: 58378 - DNA, 15 bp, Homo sapiens
ggctccttccctgtc

SEQ ID NO: 58379 - DNA, 15 bp, Homo sapiens
gctccttccctgtct

SEQ ID NO: 58380 - DNA, 15 bp, Homo sapiens
ctccttccctgtctc

SEQ ID NO: 58381 - DNA, 15 bp, Homo sapiens
tccttccctgtctct

SEQ ID NO: 58382 - DNA, 15 bp, Homo sapiens
ccttccctgtctctt

SEQ ID NO: 58383 - DNA, 15 bp, Homo sapiens
cttccctgtctcttc

SEQ ID NO: 58384 - DNA, 15 bp, Homo sapiens
ttccctgtctcttct

SEQ ID NO: 58385 - DNA, 15 bp, Homo sapiens
tccctgtctcttctg

SEQ ID NO: 58386 - DNA, 15 bp, Homo sapiens
ccctgtctcttctgc

SEQ ID NO: 58387 - DNA, 15 bp, Homo sapiens
cctgtctcttctgcc

SEQ ID NO: 58388 - DNA, 15 bp, Homo sapiens
ctgtctcttctgcca

SEQ ID NO: 58389 - DNA, 15 bp, Homo sapiens
tgtctcttctgccac

SEQ ID NO: 58390 - DNA, 15 bp, Homo sapiens
gtctcttctgccact

SEQ ID NO: 58391 - DNA, 15 bp, Homo sapiens
tctcttctgccactc

SEQ ID NO: 58392 - DNA, 15 bp, Homo sapiens
ctcttctgccactca

SEQ ID NO: 58393 - DNA, 15 bp, Homo sapiens
tcttctgccactcat

SEQ ID NO: 58394 - DNA, 15 bp, Homo sapiens
cttctgccactcatt

SEQ ID NO: 58395 - DNA, 15 bp, Homo sapiens
ttctgccactcattc

SEQ ID NO: 58396 - DNA, 15 bp, Homo sapiens
tctgccactcattcc

SEQ ID NO: 58397 - DNA, 15 bp, Homo sapiens
ctgccactcattccc

SEQ ID NO: 58398 - DNA, 15 bp, Homo sapiens
tgccactcattccca

SEQ ID NO: 58399 - DNA, 15 bp, Homo sapiens
gccactcattcccat

SEQ ID NO: 58400 - DNA, 15 bp, Homo sapiens
ccactcattcccatg

SEQ ID NO: 58401 - DNA, 15 bp, Homo sapiens
cactcattcccatgg

SEQ ID NO: 58402 - DNA, 15 bp, Homo sapiens
actcattcccatggt

SEQ ID NO: 58403 - DNA, 15 bp, Homo sapiens
ctcattcccatggtc

SEQ ID NO: 58404 - DNA, 15 bp, Homo sapiens
tcattcccatggtcg

SEQ ID NO: 58405 - DNA, 15 bp, Homo sapiens
cattcccatggtcgt

SEQ ID NO: 58406 - DNA, 15 bp, Homo sapiens
attcccatggtcgta

SEQ ID NO: 58407 - DNA, 15 bp, Homo sapiens
ttcccatggtcgtat

SEQ ID NO: 58408 - DNA, 15 bp, Homo sapiens
tcccatggtcgtatc

SEQ ID NO: 58409 - DNA, 15 bp, Homo sapiens
cccatggtcgtatcc

SEQ ID NO: 58410 - DNA, 15 bp, Homo sapiens
ccatggtcgtatcct

SEQ ID NO: 58411 - DNA, 15 bp, Homo sapiens
catggtcgtatcctg

SEQ ID NO: 58412 - DNA, 15 bp, Homo sapiens
atggtcgtatcctgg

SEQ ID NO: 58413 - DNA, 15 bp, Homo sapiens
tggtcgtatcctgga

SEQ ID NO: 58414 - DNA, 15 bp, Homo sapiens
ggtcgtatcctggag

SEQ ID NO: 58415 - DNA, 15 bp, Homo sapiens
gtcgtatcctggagt

SEQ ID NO: 58416 - DNA, 15 bp, Homo sapiens
tcgtatcctggagtt

SEQ ID NO: 58417 - DNA, 15 bp, Homo sapiens
cgtatcctggagttg

SEQ ID NO: 58418 - DNA, 15 bp, Homo sapiens
gtatcctggagttgg

SEQ ID NO: 58419 - DNA, 15 bp, Homo sapiens
tatcctggagttggt

SEQ ID NO: 58420 - DNA, 15 bp, Homo sapiens
atcctggagttggtc

SEQ ID NO: 58421 - DNA, 15 bp, Homo sapiens
tcctggagttggtca

SEQ ID NO: 58422 - DNA, 15 bp, Homo sapiens
cctggagttggtcat

SEQ ID NO: 58423 - DNA, 15 bp, Homo sapiens
ctggagttggtcatc

SEQ ID NO: 58424 - DNA, 15 bp, Homo sapiens
tggagttggtcatct

SEQ ID NO: 58425 - DNA, 15 bp, Homo sapiens
ggagttggtcatctc

SEQ ID NO: 58426 - DNA, 15 bp, Homo sapiens
gagttggtcatctct

SEQ ID NO: 58427 - DNA, 15 bp, Homo sapiens
agttggtcatctctg

SEQ ID NO: 58428 - DNA, 15 bp, Homo sapiens
gttggtcatctctgg

SEQ ID NO: 58429 - DNA, 15 bp, Homo sapiens
ttggtcatctctgga

SEQ ID NO: 58430 - DNA, 15 bp, Homo sapiens
tggtcatctctggaa

SEQ ID NO: 58431 - DNA, 15 bp, Homo sapiens
ggtcatctctggaac

SEQ ID NO: 58432 - DNA, 15 bp, Homo sapiens
gtcatctctggaact

SEQ ID NO: 58433 - DNA, 15 bp, Homo sapiens
tcatctctggaactc

SEQ ID NO: 58434 - DNA, 15 bp, Homo sapiens
catctctggaactcc

SEQ ID NO: 58435 - DNA, 15 bp, Homo sapiens
atctctggaactcca

SEQ ID NO: 58436 - DNA, 15 bp, Homo sapiens
tctctggaactccac

SEQ ID NO: 58437 - DNA, 15 bp, Homo sapiens
ctctggaactccacc

SEQ ID NO: 58438 - DNA, 15 bp, Homo sapiens
tctggaactccaccc

SEQ ID NO: 58439 - DNA, 15 bp, Homo sapiens
ctggaactccaccca

SEQ ID NO: 58440 - DNA, 15 bp, Homo sapiens
tggaactccacccac

SEQ ID NO: 58441 - DNA, 15 bp, Homo sapiens
ggaactccacccacg

SEQ ID NO: 58442 - DNA, 15 bp, Homo sapiens
gaactccacccacgg

SEQ ID NO: 58443 - DNA, 15 bp, Homo sapiens
aactccacccacgga

SEQ ID NO: 58444 - DNA, 15 bp, Homo sapiens
actccacccacggag

SEQ ID NO: 58445 - DNA, 15 bp, Homo sapiens
ctccacccacggagt

SEQ ID NO: 58446 - DNA, 15 bp, Homo sapiens
tccacccacggagtt

SEQ ID NO: 58447 - DNA, 15 bp, Homo sapiens
ccacccacggagttc

SEQ ID NO: 58448 - DNA, 15 bp, Homo sapiens
cacccacggagttct

SEQ ID NO: 58449 - DNA, 15 bp, Homo sapiens
acccacggagttcta

SEQ ID NO: 58450 - DNA, 15 bp, Homo sapiens
cccacggagttctaa

SEQ ID NO: 58451 - DNA, 15 bp, Homo sapiens
ccacggagttctaac

SEQ ID NO: 58452 - DNA, 15 bp, Homo sapiens
cacggagttctaact

SEQ ID NO: 58453 - DNA, 15 bp, Homo sapiens
acggagttctaactt

SEQ ID NO: 58454 - DNA, 15 bp, Homo sapiens
cggagttctaactta

SEQ ID NO: 58455 - DNA, 15 bp, Homo sapiens
ggagttctaacttag

SEQ ID NO: 58456 - DNA, 15 bp, Homo sapiens
gagttctaacttagc

SEQ ID NO: 58457 - DNA, 15 bp, Homo sapiens
agttctaacttagct

SEQ ID NO: 58458 - DNA, 15 bp, Homo sapiens
gttctaacttagctc

SEQ ID NO: 58459 - DNA, 15 bp, Homo sapiens
ttctaacttagctct

SEQ ID NO: 58460 - DNA, 15 bp, Homo sapiens
tctaacttagctctg

SEQ ID NO: 58461 - DNA, 15 bp, Homo sapiens
ctaacttagctctgc

SEQ ID NO: 58462 - DNA, 15 bp, Homo sapiens
taacttagctctgcc

SEQ ID NO: 58463 - DNA, 15 bp, Homo sapiens
aacttagctctgcct

SEQ ID NO: 58464 - DNA, 15 bp, Homo sapiens
acttagctctgccta

SEQ ID NO: 58465 - DNA, 15 bp, Homo sapiens
cttagctctgcctat

SEQ ID NO: 58466 - DNA, 15 bp, Homo sapiens
ttagctctgcctatg

SEQ ID NO: 58467 - DNA, 15 bp, Homo sapiens
tagctctgcctatga

SEQ ID NO: 58468 - DNA, 15 bp, Homo sapiens
agctctgcctatgat

SEQ ID NO: 58469 - DNA, 15 bp, Homo sapiens
gctctgcctatgatg

SEQ ID NO: 58470 - DNA, 15 bp, Homo sapiens
ctctgcctatgatga

SEQ ID NO: 58471 - DNA, 15 bp, Homo sapiens
tctgcctatgatgag

SEQ ID NO: 58472 - DNA, 15 bp, Homo sapiens
ctgcctatgatgagg

SEQ ID NO: 58473 - DNA, 15 bp, Homo sapiens
tgcctatgatgagga

SEQ ID NO: 58474 - DNA, 15 bp, Homo sapiens
gcctatgatgaggac

SEQ ID NO: 58475 - DNA, 15 bp, Homo sapiens
cctatgatgaggact

SEQ ID NO: 58476 - DNA, 15 bp, Homo sapiens
ctatgatgaggactt

SEQ ID NO: 58477 - DNA, 15 bp, Homo sapiens
tatgatgaggactta

SEQ ID NO: 58478 - DNA, 15 bp, Homo sapiens
atgatgaggacttac

SEQ ID NO: 58479 - DNA, 15 bp, Homo sapiens
tgatgaggacttact

SEQ ID NO: 58480 - DNA, 15 bp, Homo sapiens
gatgaggacttactg

SEQ ID NO: 58481 - DNA, 15 bp, Homo sapiens
atgaggacttactgt

SEQ ID NO: 58482 - DNA, 15 bp, Homo sapiens
tgaggacttactgtc

SEQ ID NO: 58483 - DNA, 15 bp, Homo sapiens
gaggacttactgtct

SEQ ID NO: 58484 - DNA, 15 bp, Homo sapiens
aggacttactgtctt

SEQ ID NO: 58485 - DNA, 15 bp, Homo sapiens
ggacttactgtcttc

SEQ ID NO: 58486 - DNA, 15 bp, Homo sapiens
gacttactgtcttcc

SEQ ID NO: 58487 - DNA, 15 bp, Homo sapiens
acttactgtcttccc

SEQ ID NO: 58488 - DNA, 15 bp, Homo sapiens
cttactgtcttccca

SEQ ID NO: 58489 - DNA, 15 bp, Homo sapiens
ttactgtcttcccag

SEQ ID NO: 58490 - DNA, 15 bp, Homo sapiens
tactgtcttcccagc

SEQ ID NO: 58491 - DNA, 15 bp, Homo sapiens
actgtcttcccagct

SEQ ID NO: 58492 - DNA, 15 bp, Homo sapiens
ctgtcttcccagctt

SEQ ID NO: 58493 - DNA, 15 bp, Homo sapiens
tgtcttcccagcttg

SEQ ID NO: 58494 - DNA, 15 bp, Homo sapiens
gtcttcccagcttgc

SEQ ID NO: 58495 - DNA, 15 bp, Homo sapiens
tcttcccagcttgca

SEQ ID NO: 58496 - DNA, 15 bp, Homo sapiens
cttcccagcttgcag

SEQ ID NO: 58497 - DNA, 15 bp, Homo sapiens
ttcccagcttgcagt

SEQ ID NO: 58498 - DNA, 15 bp, Homo sapiens
tcccagcttgcagtg

SEQ ID NO: 58499 - DNA, 15 bp, Homo sapiens
cccagcttgcagtgt

SEQ ID NO: 58500 - DNA, 15 bp, Homo sapiens
ccagcttgcagtgtc

SEQ ID NO: 58501 - DNA, 15 bp, Homo sapiens
cagcttgcagtgtca

SEQ ID NO: 58502 - DNA, 15 bp, Homo sapiens
agcttgcagtgtcaa

SEQ ID NO: 58503 - DNA, 15 bp, Homo sapiens
gcttgcagtgtcaac

SEQ ID NO: 58504 - DNA, 15 bp, Homo sapiens
cttgcagtgtcaacc

SEQ ID NO: 58505 - DNA, 15 bp, Homo sapiens
ttgcagtgtcaacca

SEQ ID NO: 58506 - DNA, 15 bp, Homo sapiens
tgcagtgtcaaccac

SEQ ID NO: 58507 - DNA, 15 bp, Homo sapiens
gcagtgtcaaccact

SEQ ID NO: 58508 - DNA, 15 bp, Homo sapiens
cagtgtcaaccactg

SEQ ID NO: 58509 - DNA, 15 bp, Homo sapiens
agtgtcaaccactgt

SEQ ID NO: 58510 - DNA, 15 bp, Homo sapiens
gtgtcaaccactgtt

SEQ ID NO: 58511 - DNA, 15 bp, Homo sapiens
tgtcaaccactgttt

SEQ ID NO: 58512 - DNA, 15 bp, Homo sapiens
gtcaaccactgtttg

SEQ ID NO: 58513 - DNA, 15 bp, Homo sapiens
tcaaccactgtttga

SEQ ID NO: 58514 - DNA, 15 bp, Homo sapiens
caaccactgtttgat

SEQ ID NO: 58515 - DNA, 15 bp, Homo sapiens
aaccactgtttgatg

SEQ ID NO: 58516 - DNA, 15 bp, Homo sapiens
accactgtttgatgc

SEQ ID NO: 58517 - DNA, 15 bp, Homo sapiens
ccactgtttgatgcc

SEQ ID NO: 58518 - DNA, 15 bp, Homo sapiens
cactgtttgatgccc

SEQ ID NO: 58519 - DNA, 15 bp, Homo sapiens
actgtttgatgcccc

SEQ ID NO: 58520 - DNA, 15 bp, Homo sapiens
ctgtttgatgcccct

SEQ ID NO: 58521 - DNA, 15 bp, Homo sapiens
tgtttgatgcccctg

SEQ ID NO: 58522 - DNA, 15 bp, Homo sapiens
gtttgatgcccctgg

SEQ ID NO: 58523 - DNA, 15 bp, Homo sapiens
tttgatgcccctggg

SEQ ID NO: 58524 - DNA, 15 bp, Homo sapiens
ttgatgcccctggga

SEQ ID NO: 58525 - DNA, 15 bp, Homo sapiens
tgatgcccctgggac

SEQ ID NO: 58526 - DNA, 15 bp, Homo sapiens
gatgcccctgggact

SEQ ID NO: 58527 - DNA, 15 bp, Homo sapiens
atgcccctgggactc

SEQ ID NO: 58528 - DNA, 15 bp, Homo sapiens
tgcccctgggactcc

SEQ ID NO: 58529 - DNA, 15 bp, Homo sapiens
gcccctgggactcca

SEQ ID NO: 58530 - DNA, 15 bp, Homo sapiens
cccctgggactccat

SEQ ID NO: 58531 - DNA, 15 bp, Homo sapiens
ccctgggactccatt

SEQ ID NO: 58532 - DNA, 15 bp, Homo sapiens
cctgggactccattg

SEQ ID NO: 58533 - DNA, 15 bp, Homo sapiens
ctgggactccattgg

SEQ ID NO: 58534 - DNA, 15 bp, Homo sapiens
tgggactccattggt

SEQ ID NO: 58535 - DNA, 15 bp, Homo sapiens
gggactccattggtc

SEQ ID NO: 58536 - DNA, 15 bp, Homo sapiens
ggactccattggtct

SEQ ID NO: 58537 - DNA, 15 bp, Homo sapiens
gactccattggtctt

SEQ ID NO: 58538 - DNA, 15 bp, Homo sapiens
actccattggtcttc

SEQ ID NO: 58539 - DNA, 15 bp, Homo sapiens
ctccattggtcttcc

SEQ ID NO: 58540 - DNA, 15 bp, Homo sapiens
tccattggtcttccc

SEQ ID NO: 58541 - DNA, 15 bp, Homo sapiens
ccattggtcttccct

SEQ ID NO: 58542 - DNA, 15 bp, Homo sapiens
cattggtcttccctc

SEQ ID NO: 58543 - DNA, 15 bp, Homo sapiens
attggtcttccctcc

SEQ ID NO: 58544 - DNA, 15 bp, Homo sapiens
ttggtcttccctcct

SEQ ID NO: 58545 - DNA, 15 bp, Homo sapiens
tggtcttccctcctc

SEQ ID NO: 58546 - DNA, 15 bp, Homo sapiens
ggtcttccctcctct

SEQ ID NO: 58547 - DNA, 15 bp, Homo sapiens
gtcttccctcctctt

SEQ ID NO: 58548 - DNA, 15 bp, Homo sapiens
tcttccctcctcttg

SEQ ID NO: 58549 - DNA, 15 bp, Homo sapiens
cttccctcctcttgt

SEQ ID NO: 58550 - DNA, 15 bp, Homo sapiens
ttccctcctcttgtg

SEQ ID NO: 58551 - DNA, 15 bp, Homo sapiens
tccctcctcttgtga

SEQ ID NO: 58552 - DNA, 15 bp, Homo sapiens
ccctcctcttgtgaa

SEQ ID NO: 58553 - DNA, 15 bp, Homo sapiens
cctcctcttgtgaac

SEQ ID NO: 58554 - DNA, 15 bp, Homo sapiens
ctcctcttgtgaact

SEQ ID NO: 58555 - DNA, 15 bp, Homo sapiens
tcctcttgtgaactg

SEQ ID NO: 58556 - DNA, 15 bp, Homo sapiens
cctcttgtgaactgt

SEQ ID NO: 58557 - DNA, 15 bp, Homo sapiens
ctcttgtgaactgtg

SEQ ID NO: 58558 - DNA, 15 bp, Homo sapiens
tcttgtgaactgtgc

SEQ ID NO: 58559 - DNA, 15 bp, Homo sapiens
cttgtgaactgtgcc

SEQ ID NO: 58560 - DNA, 15 bp, Homo sapiens
ttgtgaactgtgccc

SEQ ID NO: 58561 - DNA, 15 bp, Homo sapiens
tgtgaactgtgccca

SEQ ID NO: 58562 - DNA, 15 bp, Homo sapiens
gtgaactgtgcccat

SEQ ID NO: 58563 - DNA, 15 bp, Homo sapiens
tgaactgtgcccatc

SEQ ID NO: 58564 - DNA, 15 bp, Homo sapiens
gaactgtgcccatca

SEQ ID NO: 58565 - DNA, 15 bp, Homo sapiens
aactgtgcccatcac

SEQ ID NO: 58566 - DNA, 15 bp, Homo sapiens
actgtgcccatcacc

SEQ ID NO: 58567 - DNA, 15 bp, Homo sapiens
ctgtgcccatcacca

SEQ ID NO: 58568 - DNA, 15 bp, Homo sapiens
tgtgcccatcaccag

SEQ ID NO: 58569 - DNA, 15 bp, Homo sapiens
gtgcccatcaccaga

SEQ ID NO: 58570 - DNA, 15 bp, Homo sapiens
tgcccatcaccagac

SEQ ID NO: 58571 - DNA, 15 bp, Homo sapiens
gcccatcaccagacg

SEQ ID NO: 58572 - DNA, 15 bp, Homo sapiens
cccatcaccagacga

SEQ ID NO: 58573 - DNA, 15 bp, Homo sapiens
ccatcaccagacgaa

SEQ ID NO: 58574 - DNA, 15 bp, Homo sapiens
catcaccagacgaac

SEQ ID NO: 58575 - DNA, 15 bp, Homo sapiens
atcaccagacgaact

SEQ ID NO: 58576 - DNA, 15 bp, Homo sapiens
tcaccagacgaactt

SEQ ID NO: 58577 - DNA, 15 bp, Homo sapiens
caccagacgaacttg

SEQ ID NO: 58578 - DNA, 15 bp, Homo sapiens
accagacgaacttgt

SEQ ID NO: 58579 - DNA, 15 bp, Homo sapiens
ccagacgaacttgtt

SEQ ID NO: 58580 - DNA, 15 bp, Homo sapiens
cagacgaacttgttt

SEQ ID NO: 58581 - DNA, 15 bp, Homo sapiens
agacgaacttgtttt

SEQ ID NO: 58582 - DNA, 15 bp, Homo sapiens
gacgaacttgtttta

SEQ ID NO: 58583 - DNA, 15 bp, Homo sapiens
acgaacttgttttag

SEQ ID NO: 58584 - DNA, 15 bp, Homo sapiens
cgaacttgttttaga

SEQ ID NO: 58585 - DNA, 15 bp, Homo sapiens
gaacttgttttagaa

SEQ ID NO: 58586 - DNA, 15 bp, Homo sapiens
aacttgttttagaat

SEQ ID NO: 58587 - DNA, 15 bp, Homo sapiens
acttgttttagaatt

SEQ ID NO: 58588 - DNA, 15 bp, Homo sapiens
cttgttttagaattt

SEQ ID NO: 58589 - DNA, 15 bp, Homo sapiens
ttgttttagaattta

SEQ ID NO: 58590 - DNA, 15 bp, Homo sapiens
tgttttagaatttac

SEQ ID NO: 58591 - DNA, 15 bp, Homo sapiens
gttttagaatttacc

SEQ ID NO: 58592 - DNA, 15 bp, Homo sapiens
ttttagaatttacca

SEQ ID NO: 58593 - DNA, 15 bp, Homo sapiens
tttagaatttaccat

SEQ ID NO: 58594 - DNA, 15 bp, Homo sapiens
ttagaatttaccatc

SEQ ID NO: 58595 - DNA, 15 bp, Homo sapiens
tagaatttaccatcg

SEQ ID NO: 58596 - DNA, 15 bp, Homo sapiens
agaatttaccatcgt

SEQ ID NO: 58597 - DNA, 15 bp, Homo sapiens
gaatttaccatcgta

SEQ ID NO: 58598 - DNA, 15 bp, Homo sapiens
aatttaccatcgtaa

SEQ ID NO: 58599 - DNA, 15 bp, Homo sapiens
atttaccatcgtaac

SEQ ID NO: 58600 - DNA, 15 bp, Homo sapiens
tttaccatcgtaact

SEQ ID NO: 58601 - DNA, 15 bp, Homo sapiens
ttaccatcgtaactg

SEQ ID NO: 58602 - DNA, 15 bp, Homo sapiens
taccatcgtaactga

SEQ ID NO: 58603 - DNA, 15 bp, Homo sapiens
accatcgtaactgag

SEQ ID NO: 58604 - DNA, 15 bp, Homo sapiens
ccatcgtaactgagc

SEQ ID NO: 58605 - DNA, 15 bp, Homo sapiens
catcgtaactgagct

SEQ ID NO: 58606 - DNA, 15 bp, Homo sapiens
atcgtaactgagctc

SEQ ID NO: 58607 - DNA, 15 bp, Homo sapiens
tcgtaactgagctcc

SEQ ID NO: 58608 - DNA, 15 bp, Homo sapiens
cgtaactgagctccc

SEQ ID NO: 58609 - DNA, 15 bp, Homo sapiens
gtaactgagctccct

SEQ ID NO: 58610 - DNA, 15 bp, Homo sapiens
taactgagctccctt

SEQ ID NO: 58611 - DNA, 15 bp, Homo sapiens
aactgagctcccttc

SEQ ID NO: 58612 - DNA, 15 bp, Homo sapiens
actgagctcccttca

SEQ ID NO: 58613 - DNA, 15 bp, Homo sapiens
ctgagctcccttcag

SEQ ID NO: 58614 - DNA, 15 bp, Homo sapiens
tgagctcccttcagc

SEQ ID NO: 58615 - DNA, 15 bp, Homo sapiens
gagctcccttcagcg

SEQ ID NO: 58616 - DNA, 15 bp, Homo sapiens
agctcccttcagcgc

SEQ ID NO: 58617 - DNA, 15 bp, Homo sapiens
gctcccttcagcgca

SEQ ID NO: 58618 - DNA, 15 bp, Homo sapiens
ctcccttcagcgcat

SEQ ID NO: 58619 - DNA, 15 bp, Homo sapiens
tcccttcagcgcata

SEQ ID NO: 58620 - DNA, 15 bp, Homo sapiens
cccttcagcgcatac

SEQ ID NO: 58621 - DNA, 15 bp, Homo sapiens
ccttcagcgcatacc

SEQ ID NO: 58622 - DNA, 15 bp, Homo sapiens
cttcagcgcatacct

SEQ ID NO: 58623 - DNA, 15 bp, Homo sapiens
ttcagcgcatacctc

SEQ ID NO: 58624 - DNA, 15 bp, Homo sapiens
tcagcgcatacctcc

SEQ ID NO: 58625 - DNA, 15 bp, Homo sapiens
cagcgcatacctcct

SEQ ID NO: 58626 - DNA, 15 bp, Homo sapiens
agcgcatacctcctt

SEQ ID NO: 58627 - DNA, 15 bp, Homo sapiens
gcgcatacctccttg

SEQ ID NO: 58628 - DNA, 15 bp, Homo sapiens
cgcatacctccttgg

SEQ ID NO: 58629 - DNA, 15 bp, Homo sapiens
gcatacctccttggc

SEQ ID NO: 58630 - DNA, 15 bp, Homo sapiens
catacctccttggct

SEQ ID NO: 58631 - DNA, 15 bp, Homo sapiens
atacctccttggctc

SEQ ID NO: 58632 - DNA, 15 bp, Homo sapiens
tacctccttggctcc

SEQ ID NO: 58633 - DNA, 15 bp, Homo sapiens
acctccttggctcct

SEQ ID NO: 58634 - DNA, 15 bp, Homo sapiens
cctccttggctcctg

SEQ ID NO: 58635 - DNA, 15 bp, Homo sapiens
ctccttggctcctgc

SEQ ID NO: 58636 - DNA, 15 bp, Homo sapiens
tccttggctcctgct

SEQ ID NO: 58637 - DNA, 15 bp, Homo sapiens
ccttggctcctgctc

SEQ ID NO: 58638 - DNA, 15 bp, Homo sapiens
cttggctcctgctca

SEQ ID NO: 58639 - DNA, 15 bp, Homo sapiens
ttggctcctgctcag

SEQ ID NO: 58640 - DNA, 15 bp, Homo sapiens
tggctcctgctcagt

SEQ ID NO: 58641 - DNA, 15 bp, Homo sapiens
ggctcctgctcagtc

SEQ ID NO: 58642 - DNA, 15 bp, Homo sapiens
gctcctgctcagtct

SEQ ID NO: 58643 - DNA, 15 bp, Homo sapiens
ctcctgctcagtctc

SEQ ID NO: 58644 - DNA, 15 bp, Homo sapiens
tcctgctcagtctct

SEQ ID NO: 58645 - DNA, 15 bp, Homo sapiens
cctgctcagtctctg

SEQ ID NO: 58646 - DNA, 15 bp, Homo sapiens
ctgctcagtctctgt

SEQ ID NO: 58647 - DNA, 15 bp, Homo sapiens
tgctcagtctctgtt

SEQ ID NO: 58648 - DNA, 15 bp, Homo sapiens
gctcagtctctgttt

SEQ ID NO: 58649 - DNA, 15 bp, Homo sapiens
ctcagtctctgtttc

SEQ ID NO: 58650 - DNA, 15 bp, Homo sapiens
tcagtctctgtttct

SEQ ID NO: 58651 - DNA, 15 bp, Homo sapiens
cagtctctgtttctc

SEQ ID NO: 58652 - DNA, 15 bp, Homo sapiens
agtctctgtttctcc

SEQ ID NO: 58653 - DNA, 15 bp, Homo sapiens
gtctctgtttctcct

SEQ ID NO: 58654 - DNA, 15 bp, Homo sapiens
tctctgtttctcctt

SEQ ID NO: 58655 - DNA, 15 bp, Homo sapiens
ctctgtttctccttt

SEQ ID NO: 58656 - DNA, 15 bp, Homo sapiens
tctgtttctcctttt

SEQ ID NO: 58657 - DNA, 15 bp, Homo sapiens
ctgtttctcctttta

SEQ ID NO: 58658 - DNA, 15 bp, Homo sapiens
tgtttctccttttag

SEQ ID NO: 58659 - DNA, 15 bp, Homo sapiens
gtttctccttttagc

SEQ ID NO: 58660 - DNA, 15 bp, Homo sapiens
tttctccttttagcc

SEQ ID NO: 58661 - DNA, 15 bp, Homo sapiens
ttctccttttagcca

SEQ ID NO: 58662 - DNA, 15 bp, Homo sapiens
tctccttttagccaa

SEQ ID NO: 58663 - DNA, 15 bp, Homo sapiens
ctccttttagccaaa

SEQ ID NO: 58664 - DNA, 15 bp, Homo sapiens
tccttttagccaaac

SEQ ID NO: 58665 - DNA, 15 bp, Homo sapiens
ccttttagccaaact

SEQ ID NO: 58666 - DNA, 15 bp, Homo sapiens
cttttagccaaactc

SEQ ID NO: 58667 - DNA, 15 bp, Homo sapiens
ttttagccaaactct

SEQ ID NO: 58668 - DNA, 15 bp, Homo sapiens
tttagccaaactctc

SEQ ID NO: 58669 - DNA, 15 bp, Homo sapiens
ttagccaaactctct

SEQ ID NO: 58670 - DNA, 15 bp, Homo sapiens
tagccaaactctcta

SEQ ID NO: 58671 - DNA, 15 bp, Homo sapiens
agccaaactctctaa

SEQ ID NO: 58672 - DNA, 15 bp, Homo sapiens
gccaaactctctaag

SEQ ID NO: 58673 - DNA, 15 bp, Homo sapiens
ccaaactctctaaga

SEQ ID NO: 58674 - DNA, 15 bp, Homo sapiens
caaactctctaagag

SEQ ID NO: 58675 - DNA, 15 bp, Homo sapiens
aaactctctaagagt

SEQ ID NO: 58676 - DNA, 15 bp, Homo sapiens
aactctctaagagtt

SEQ ID NO: 58677 - DNA, 15 bp, Homo sapiens
actctctaagagttc

SEQ ID NO: 58678 - DNA, 15 bp, Homo sapiens
ctctctaagagttct

SEQ ID NO: 58679 - DNA, 15 bp, Homo sapiens
tctctaagagttctc

SEQ ID NO: 58680 - DNA, 15 bp, Homo sapiens
ctctaagagttctct

SEQ ID NO: 58681 - DNA, 15 bp, Homo sapiens
tctaagagttctctc

SEQ ID NO: 58682 - DNA, 15 bp, Homo sapiens
ctaagagttctctcc

SEQ ID NO: 58683 - DNA, 15 bp, Homo sapiens
taagagttctctcca

SEQ ID NO: 58684 - DNA, 15 bp, Homo sapiens
aagagttctctccac

SEQ ID NO: 58685 - DNA, 15 bp, Homo sapiens
agagttctctccact

SEQ ID NO: 58686 - DNA, 15 bp, Homo sapiens
gagttctctccactc

SEQ ID NO: 58687 - DNA, 15 bp, Homo sapiens
agttctctccactca

SEQ ID NO: 58688 - DNA, 15 bp, Homo sapiens
gttctctccactcat

SEQ ID NO: 58689 - DNA, 15 bp, Homo sapiens
ttctctccactcatg

SEQ ID NO: 58690 - DNA, 15 bp, Homo sapiens
tctctccactcatgg

SEQ ID NO: 58691 - DNA, 15 bp, Homo sapiens
ctctccactcatggg

SEQ ID NO: 58692 - DNA, 15 bp, Homo sapiens
tctccactcatgggc

SEQ ID NO: 58693 - DNA, 15 bp, Homo sapiens
ctccactcatgggcc

SEQ ID NO: 58694 - DNA, 15 bp, Homo sapiens
tccactcatgggccc

SEQ ID NO: 58695 - DNA, 15 bp, Homo sapiens
ccactcatgggccct

SEQ ID NO: 58696 - DNA, 15 bp, Homo sapiens
cactcatgggccctc

SEQ ID NO: 58697 - DNA, 15 bp, Homo sapiens
actcatgggccctct

SEQ ID NO: 58698 - DNA, 15 bp, Homo sapiens
ctcatgggccctctt

SEQ ID NO: 58699 - DNA, 15 bp, Homo sapiens
tcatgggccctcttc

SEQ ID NO: 58700 - DNA, 15 bp, Homo sapiens
catgggccctcttcc

SEQ ID NO: 58701 - DNA, 15 bp, Homo sapiens
atgggccctcttcct

SEQ ID NO: 58702 - DNA, 15 bp, Homo sapiens
tgggccctcttcctt

SEQ ID NO: 58703 - DNA, 15 bp, Homo sapiens
gggccctcttccttg

SEQ ID NO: 58704 - DNA, 15 bp, Homo sapiens
ggccctcttccttgc

SEQ ID NO: 58705 - DNA, 15 bp, Homo sapiens
gccctcttccttgcc

SEQ ID NO: 58706 - DNA, 15 bp, Homo sapiens
ccctcttccttgcct

SEQ ID NO: 58707 - DNA, 15 bp, Homo sapiens
cctcttccttgcctg

SEQ ID NO: 58708 - DNA, 15 bp, Homo sapiens
ctcttccttgcctgc

SEQ ID NO: 58709 - DNA, 15 bp, Homo sapiens
tcttccttgcctgct

SEQ ID NO: 58710 - DNA, 15 bp, Homo sapiens
cttccttgcctgctg

SEQ ID NO: 58711 - DNA, 15 bp, Homo sapiens
ttccttgcctgctgc

SEQ ID NO: 58712 - DNA, 15 bp, Homo sapiens
tccttgcctgctgct

SEQ ID NO: 58713 - DNA, 15 bp, Homo sapiens
ccttgcctgctgctc

SEQ ID NO: 58714 - DNA, 15 bp, Homo sapiens
cttgcctgctgctcc

SEQ ID NO: 58715 - DNA, 15 bp, Homo sapiens
ttgcctgctgctcct

SEQ ID NO: 58716 - DNA, 15 bp, Homo sapiens
tgcctgctgctcctt

SEQ ID NO: 58717 - DNA, 15 bp, Homo sapiens
gcctgctgctccttg

SEQ ID NO: 58718 - DNA, 15 bp, Homo sapiens
cctgctgctccttgc

SEQ ID NO: 58719 - DNA, 15 bp, Homo sapiens
ctgctgctccttgct

SEQ ID NO: 58720 - DNA, 15 bp, Homo sapiens
tgctgctccttgctc

SEQ ID NO: 58721 - DNA, 15 bp, Homo sapiens
gctgctccttgctca

SEQ ID NO: 58722 - DNA, 15 bp, Homo sapiens
ctgctccttgctcag

SEQ ID NO: 58723 - DNA, 15 bp, Homo sapiens
tgctccttgctcagc

SEQ ID NO: 58724 - DNA, 15 bp, Homo sapiens
gctccttgctcagct

SEQ ID NO: 58725 - DNA, 15 bp, Homo sapiens
ctccttgctcagctt

SEQ ID NO: 58726 - DNA, 15 bp, Homo sapiens
tccttgctcagcttg

SEQ ID NO: 58727 - DNA, 15 bp, Homo sapiens
ccttgctcagcttgc

SEQ ID NO: 58728 - DNA, 15 bp, Homo sapiens
cttgctcagcttgct

SEQ ID NO: 58729 - DNA, 15 bp, Homo sapiens
ttgctcagcttgctc

SEQ ID NO: 58730 - DNA, 15 bp, Homo sapiens
tgctcagcttgctcc

SEQ ID NO: 58731 - DNA, 15 bp, Homo sapiens
gctcagcttgctcca

SEQ ID NO: 58732 - DNA, 15 bp, Homo sapiens
ctcagcttgctccat

SEQ ID NO: 58733 - DNA, 15 bp, Homo sapiens
tcagcttgctccatg

SEQ ID NO: 58734 - DNA, 15 bp, Homo sapiens
cagcttgctccatga

SEQ ID NO: 58735 - DNA, 15 bp, Homo sapiens
agcttgctccatgaa

SEQ ID NO: 58736 - DNA, 15 bp, Homo sapiens
gcttgctccatgaac

SEQ ID NO: 58737 - DNA, 15 bp, Homo sapiens
cttgctccatgaaca

SEQ ID NO: 58738 - DNA, 15 bp, Homo sapiens
ttgctccatgaacac

SEQ ID NO: 58739 - DNA, 15 bp, Homo sapiens
tgctccatgaacact

SEQ ID NO: 58740 - DNA, 15 bp, Homo sapiens
gctccatgaacactt

SEQ ID NO: 58741 - DNA, 15 bp, Homo sapiens
ctccatgaacacttg

SEQ ID NO: 58742 - DNA, 15 bp, Homo sapiens
tccatgaacacttgc

SEQ ID NO: 58743 - DNA, 15 bp, Homo sapiens
ccatgaacacttgct

SEQ ID NO: 58744 - DNA, 15 bp, Homo sapiens
catgaacacttgctt

SEQ ID NO: 58745 - DNA, 15 bp, Homo sapiens
atgaacacttgcttt

SEQ ID NO: 58746 - DNA, 15 bp, Homo sapiens
tgaacacttgctttt

SEQ ID NO: 58747 - DNA, 15 bp, Homo sapiens
gaacacttgcttttc

SEQ ID NO: 58748 - DNA, 15 bp, Homo sapiens
aacacttgcttttcc

SEQ ID NO: 58749 - DNA, 15 bp, Homo sapiens
acacttgcttttcca

SEQ ID NO: 58750 - DNA, 15 bp, Homo sapiens
cacttgcttttccac

SEQ ID NO: 58751 - DNA, 15 bp, Homo sapiens
acttgcttttccaca

SEQ ID NO: 58752 - DNA, 15 bp, Homo sapiens
cttgcttttccacat

SEQ ID NO: 58753 - DNA, 15 bp, Homo sapiens
ttgcttttccacatt

SEQ ID NO: 58754 - DNA, 15 bp, Homo sapiens
tgcttttccacattc

SEQ ID NO: 58755 - DNA, 15 bp, Homo sapiens
gcttttccacattcc

SEQ ID NO: 58756 - DNA, 15 bp, Homo sapiens
cttttccacattcca

SEQ ID NO: 58757 - DNA, 15 bp, Homo sapiens
ttttccacattccat

SEQ ID NO: 58758 - DNA, 15 bp, Homo sapiens
tttccacattccatg

SEQ ID NO: 58759 - DNA, 15 bp, Homo sapiens
ttccacattccatga

SEQ ID NO: 58760 - DNA, 15 bp, Homo sapiens
tccacattccatgaa

SEQ ID NO: 58761 - DNA, 15 bp, Homo sapiens
ccacattccatgaaa

SEQ ID NO: 58762 - DNA, 15 bp, Homo sapiens
cacattccatgaaat

SEQ ID NO: 58763 - DNA, 15 bp, Homo sapiens
acattccatgaaata

SEQ ID NO: 58764 - DNA, 15 bp, Homo sapiens
cattccatgaaataa

SEQ ID NO: 58765 - DNA, 15 bp, Homo sapiens
attccatgaaataat

SEQ ID NO: 58766 - DNA, 15 bp, Homo sapiens
ttccatgaaataatc

SEQ ID NO: 58767 - DNA, 15 bp, Homo sapiens
tccatgaaataatct

SEQ ID NO: 58768 - DNA, 15 bp, Homo sapiens
ccatgaaataatctt

SEQ ID NO: 58769 - DNA, 15 bp, Homo sapiens
catgaaataatctta

SEQ ID NO: 58770 - DNA, 15 bp, Homo sapiens
atgaaataatcttaa

SEQ ID NO: 58771 - DNA, 15 bp, Homo sapiens
tgaaataatcttaac

SEQ ID NO: 58772 - DNA, 15 bp, Homo sapiens
gaaataatcttaaca

SEQ ID NO: 58773 - DNA, 15 bp, Homo sapiens
aaataatcttaacag

SEQ ID NO: 58774 - DNA, 15 bp, Homo sapiens
aataatcttaacagt

SEQ ID NO: 58775 - DNA, 15 bp, Homo sapiens
ataatcttaacagtc

SEQ ID NO: 58776 - DNA, 15 bp, Homo sapiens
taatcttaacagtca

SEQ ID NO: 58777 - DNA, 15 bp, Homo sapiens
aatcttaacagtcat

SEQ ID NO: 58778 - DNA, 15 bp, Homo sapiens
atcttaacagtcatc

SEQ ID NO: 58779 - DNA, 15 bp, Homo sapiens
tcttaacagtcatca

SEQ ID NO: 58780 - DNA, 15 bp, Homo sapiens
cttaacagtcatcag

SEQ ID NO: 58781 - DNA, 15 bp, Homo sapiens
ttaacagtcatcagt

SEQ ID NO: 58782 - DNA, 15 bp, Homo sapiens
taacagtcatcagtg

SEQ ID NO: 58783 - DNA, 15 bp, Homo sapiens
aacagtcatcagtgg

SEQ ID NO: 58784 - DNA, 15 bp, Homo sapiens
acagtcatcagtggc

SEQ ID NO: 58785 - DNA, 15 bp, Homo sapiens
cagtcatcagtggct

SEQ ID NO: 58786 - DNA, 15 bp, Homo sapiens
agtcatcagtggctg

SEQ ID NO: 58787 - DNA, 15 bp, Homo sapiens
gtcatcagtggctgt

SEQ ID NO: 58788 - DNA, 15 bp, Homo sapiens
tcatcagtggctgtc

SEQ ID NO: 58789 - DNA, 15 bp, Homo sapiens
catcagtggctgtca

SEQ ID NO: 58790 - DNA, 15 bp, Homo sapiens
atcagtggctgtcac

SEQ ID NO: 58791 - DNA, 15 bp, Homo sapiens
tcagtggctgtcact

SEQ ID NO: 58792 - DNA, 15 bp, Homo sapiens
cagtggctgtcactc

SEQ ID NO: 58793 - DNA, 15 bp, Homo sapiens
agtggctgtcactcc

SEQ ID NO: 58794 - DNA, 15 bp, Homo sapiens
gtggctgtcactcct

SEQ ID NO: 58795 - DNA, 15 bp, Homo sapiens
tggctgtcactcctt

SEQ ID NO: 58796 - DNA, 15 bp, Homo sapiens
ggctgtcactccttc

SEQ ID NO: 58797 - DNA, 15 bp, Homo sapiens
gctgtcactccttct

SEQ ID NO: 58798 - DNA, 15 bp, Homo sapiens
ctgtcactccttctc

SEQ ID NO: 58799 - DNA, 15 bp, Homo sapiens
tgtcactccttctca

SEQ ID NO: 58800 - DNA, 15 bp, Homo sapiens
gtcactccttctcag

SEQ ID NO: 58801 - DNA, 15 bp, Homo sapiens
tcactccttctcagc

SEQ ID NO: 58802 - DNA, 15 bp, Homo sapiens
cactccttctcagcc

SEQ ID NO: 58803 - DNA, 15 bp, Homo sapiens
actccttctcagccc

SEQ ID NO: 58804 - DNA, 15 bp, Homo sapiens
ctccttctcagccct

SEQ ID NO: 58805 - DNA, 15 bp, Homo sapiens
tccttctcagccctt

SEQ ID NO: 58806 - DNA, 15 bp, Homo sapiens
ccttctcagcccttt

SEQ ID NO: 58807 - DNA, 15 bp, Homo sapiens
cttctcagccctttc

SEQ ID NO: 58808 - DNA, 15 bp, Homo sapiens
ttctcagccctttcc

SEQ ID NO: 58809 - DNA, 15 bp, Homo sapiens
tctcagccctttcct

SEQ ID NO: 58810 - DNA, 15 bp, Homo sapiens
ctcagccctttcctt

SEQ ID NO: 58811 - DNA, 15 bp, Homo sapiens
tcagccctttccttg

SEQ ID NO: 58812 - DNA, 15 bp, Homo sapiens
cagccctttccttgt

SEQ ID NO: 58813 - DNA, 15 bp, Homo sapiens
agccctttccttgtg

SEQ ID NO: 58814 - DNA, 15 bp, Homo sapiens
gccctttccttgtgt

SEQ ID NO: 58815 - DNA, 15 bp, Homo sapiens
ccctttccttgtgtc

SEQ ID NO: 58816 - DNA, 15 bp, Homo sapiens
cctttccttgtgtct

SEQ ID NO: 58817 - DNA, 15 bp, Homo sapiens
ctttccttgtgtctc

SEQ ID NO: 58818 - DNA, 15 bp, Homo sapiens
tttccttgtgtctct

SEQ ID NO: 58819 - DNA, 15 bp, Homo sapiens
ttccttgtgtctctt

SEQ ID NO: 58820 - DNA, 15 bp, Homo sapiens
tccttgtgtctcttc

SEQ ID NO: 58821 - DNA, 15 bp, Homo sapiens
ccttgtgtctcttct

SEQ ID NO: 58822 - DNA, 15 bp, Homo sapiens
cttgtgtctcttctg

SEQ ID NO: 58823 - DNA, 15 bp, Homo sapiens
ttgtgtctcttctgg

SEQ ID NO: 58824 - DNA, 15 bp, Homo sapiens
tgtgtctcttctggt

SEQ ID NO: 58825 - DNA, 15 bp, Homo sapiens
gtgtctcttctggta

SEQ ID NO: 58826 - DNA, 15 bp, Homo sapiens
tgtctcttctggtac

SEQ ID NO: 58827 - DNA, 15 bp, Homo sapiens
gtctcttctggtacc

SEQ ID NO: 58828 - DNA, 15 bp, Homo sapiens
tctcttctggtacct

SEQ ID NO: 58829 - DNA, 15 bp, Homo sapiens
ctcttctggtacctc

SEQ ID NO: 58830 - DNA, 15 bp, Homo sapiens
tcttctggtacctca

SEQ ID NO: 58831 - DNA, 15 bp, Homo sapiens
cttctggtacctcat

SEQ ID NO: 58832 - DNA, 15 bp, Homo sapiens
ttctggtacctcata

SEQ ID NO: 58833 - DNA, 15 bp, Homo sapiens
tctggtacctcatac

SEQ ID NO: 58834 - DNA, 15 bp, Homo sapiens
ctggtacctcatact

SEQ ID NO: 58835 - DNA, 15 bp, Homo sapiens
tggtacctcatactc

SEQ ID NO: 58836 - DNA, 15 bp, Homo sapiens
ggtacctcatactct

SEQ ID NO: 58837 - DNA, 15 bp, Homo sapiens
gtacctcatactctc

SEQ ID NO: 58838 - DNA, 15 bp, Homo sapiens
tacctcatactctcc

SEQ ID NO: 58839 - DNA, 15 bp, Homo sapiens
acctcatactctcca

SEQ ID NO: 58840 - DNA, 15 bp, Homo sapiens
cctcatactctccag

SEQ ID NO: 58841 - DNA, 15 bp, Homo sapiens
ctcatactctccagg

SEQ ID NO: 58842 - DNA, 15 bp, Homo sapiens
tcatactctccaggt

SEQ ID NO: 58843 - DNA, 15 bp, Homo sapiens
catactctccaggtg

SEQ ID NO: 58844 - DNA, 15 bp, Homo sapiens
atactctccaggtgg

SEQ ID NO: 58845 - DNA, 15 bp, Homo sapiens
tactctccaggtggc

SEQ ID NO: 58846 - DNA, 15 bp, Homo sapiens
actctccaggtggcc

SEQ ID NO: 58847 - DNA, 15 bp, Homo sapiens
ctctccaggtggcca

SEQ ID NO: 58848 - DNA, 15 bp, Homo sapiens
tctccaggtggccat

SEQ ID NO: 58849 - DNA, 15 bp, Homo sapiens
ctccaggtggccatc

SEQ ID NO: 58850 - DNA, 15 bp, Homo sapiens
tccaggtggccatct

SEQ ID NO: 58851 - DNA, 15 bp, Homo sapiens
ccaggtggccatctc

SEQ ID NO: 58852 - DNA, 15 bp, Homo sapiens
caggtggccatctca

SEQ ID NO: 58853 - DNA, 15 bp, Homo sapiens
aggtggccatctcac

SEQ ID NO: 58854 - DNA, 15 bp, Homo sapiens
ggtggccatctcacc

SEQ ID NO: 58855 - DNA, 15 bp, Homo sapiens
gtggccatctcacct

SEQ ID NO: 58856 - DNA, 15 bp, Homo sapiens
tggccatctcacctc

SEQ ID NO: 58857 - DNA, 15 bp, Homo sapiens
ggccatctcacctca

SEQ ID NO: 58858 - DNA, 15 bp, Homo sapiens
gccatctcacctcac

SEQ ID NO: 58859 - DNA, 15 bp, Homo sapiens
ccatctcacctcaca

SEQ ID NO: 58860 - DNA, 15 bp, Homo sapiens
catctcacctcacat

SEQ ID NO: 58861 - DNA, 15 bp, Homo sapiens
atctcacctcacatc

SEQ ID NO: 58862 - DNA, 15 bp, Homo sapiens
tctcacctcacatct

SEQ ID NO: 58863 - DNA, 15 bp, Homo sapiens
ctcacctcacatctt

SEQ ID NO: 58864 - DNA, 15 bp, Homo sapiens
tcacctcacatcttg

SEQ ID NO: 58865 - DNA, 15 bp, Homo sapiens
cacctcacatcttga

SEQ ID NO: 58866 - DNA, 15 bp, Homo sapiens
acctcacatcttgaa

SEQ ID NO: 58867 - DNA, 15 bp, Homo sapiens
cctcacatcttgaac

SEQ ID NO: 58868 - DNA, 15 bp, Homo sapiens
ctcacatcttgaacc

SEQ ID NO: 58869 - DNA, 15 bp, Homo sapiens
tcacatcttgaaccc

SEQ ID NO: 58870 - DNA, 15 bp, Homo sapiens
cacatcttgaaccct

SEQ ID NO: 58871 - DNA, 15 bp, Homo sapiens
acatcttgaaccctc

SEQ ID NO: 58872 - DNA, 15 bp, Homo sapiens
catcttgaaccctct

SEQ ID NO: 58873 - DNA, 15 bp, Homo sapiens
atcttgaaccctctg

SEQ ID NO: 58874 - DNA, 15 bp, Homo sapiens
tcttgaaccctctgg

SEQ ID NO: 58875 - DNA, 15 bp, Homo sapiens
cttgaaccctctggg

SEQ ID NO: 58876 - DNA, 15 bp, Homo sapiens
ttgaaccctctgggt

SEQ ID NO: 58877 - DNA, 15 bp, Homo sapiens
tgaaccctctgggtt

SEQ ID NO: 58878 - DNA, 15 bp, Homo sapiens
gaaccctctgggttt

SEQ ID NO: 58879 - DNA, 15 bp, Homo sapiens
aaccctctgggtttg

SEQ ID NO: 58880 - DNA, 15 bp, Homo sapiens
accctctgggtttgg

SEQ ID NO: 58881 - DNA, 15 bp, Homo sapiens
ccctctgggtttggg

SEQ ID NO: 58882 - DNA, 15 bp, Homo sapiens
cctctgggtttggga

SEQ ID NO: 58883 - DNA, 15 bp, Homo sapiens
ctctgggtttgggag

SEQ ID NO: 58884 - DNA, 15 bp, Homo sapiens
tctgggtttgggaga

SEQ ID NO: 58885 - DNA, 15 bp, Homo sapiens
ctgggtttgggagaa

SEQ ID NO: 58886 - DNA, 15 bp, Homo sapiens
tgggtttgggagaat

SEQ ID NO: 58887 - DNA, 15 bp, Homo sapiens
gggtttgggagaatt

SEQ ID NO: 58888 - DNA, 15 bp, Homo sapiens
ggtttgggagaattc

SEQ ID NO: 58889 - DNA, 15 bp, Homo sapiens
gtttgggagaattct

SEQ ID NO: 58890 - DNA, 15 bp, Homo sapiens
tttgggagaattctc

SEQ ID NO: 58891 - DNA, 15 bp, Homo sapiens
ttgggagaattctca

SEQ ID NO: 58892 - DNA, 15 bp, Homo sapiens
tgggagaattctcac

SEQ ID NO: 58893 - DNA, 15 bp, Homo sapiens
gggagaattctcacc

SEQ ID NO: 58894 - DNA, 15 bp, Homo sapiens
ggagaattctcacct

SEQ ID NO: 58895 - DNA, 15 bp, Homo sapiens
gagaattctcacctc

SEQ ID NO: 58896 - DNA, 15 bp, Homo sapiens
agaattctcacctca

SEQ ID NO: 58897 - DNA, 15 bp, Homo sapiens
gaattctcacctcac

SEQ ID NO: 58898 - DNA, 15 bp, Homo sapiens
aattctcacctcacg

SEQ ID NO: 58899 - DNA, 15 bp, Homo sapiens
attctcacctcacga

SEQ ID NO: 58900 - DNA, 15 bp, Homo sapiens
ttctcacctcacgag

SEQ ID NO: 58901 - DNA, 15 bp, Homo sapiens
tctcacctcacgagt

SEQ ID NO: 58902 - DNA, 15 bp, Homo sapiens
ctcacctcacgagtt

SEQ ID NO: 58903 - DNA, 15 bp, Homo sapiens
tcacctcacgagttg

SEQ ID NO: 58904 - DNA, 15 bp, Homo sapiens
cacctcacgagttga

SEQ ID NO: 58905 - DNA, 15 bp, Homo sapiens
acctcacgagttgat

SEQ ID NO: 58906 - DNA, 15 bp, Homo sapiens
cctcacgagttgatg

SEQ ID NO: 58907 - DNA, 15 bp, Homo sapiens
ctcacgagttgatgg

SEQ ID NO: 58908 - DNA, 15 bp, Homo sapiens
tcacgagttgatggg

SEQ ID NO: 58909 - DNA, 15 bp, Homo sapiens
cacgagttgatggga

SEQ ID NO: 58910 - DNA, 15 bp, Homo sapiens
acgagttgatgggag

SEQ ID NO: 58911 - DNA, 15 bp, Homo sapiens
cgagttgatgggagg

SEQ ID NO: 58912 - DNA, 15 bp, Homo sapiens
gagttgatgggaggc

SEQ ID NO: 58913 - DNA, 15 bp, Homo sapiens
agttgatgggaggcc

SEQ ID NO: 58914 - DNA, 15 bp, Homo sapiens
gttgatgggaggcct

SEQ ID NO: 58915 - DNA, 15 bp, Homo sapiens
ttgatgggaggcctg

SEQ ID NO: 58916 - DNA, 15 bp, Homo sapiens
tgatgggaggcctgg

SEQ ID NO: 58917 - DNA, 15 bp, Homo sapiens
gatgggaggcctggc

SEQ ID NO: 58918 - DNA, 15 bp, Homo sapiens
atgggaggcctggcg

SEQ ID NO: 58919 - DNA, 15 bp, Homo sapiens
tgggaggcctggcga

SEQ ID NO: 58920 - DNA, 15 bp, Homo sapiens
gggaggcctggcgac

SEQ ID NO: 58921 - DNA, 15 bp, Homo sapiens
ggaggcctggcgacc

SEQ ID NO: 58922 - DNA, 15 bp, Homo sapiens
gaggcctggcgacct

SEQ ID NO: 58923 - DNA, 15 bp, Homo sapiens
aggcctggcgacctc

SEQ ID NO: 58924 - DNA, 15 bp, Homo sapiens
ggcctggcgacctct

SEQ ID NO: 58925 - DNA, 15 bp, Homo sapiens
gcctggcgacctctg

SEQ ID NO: 58926 - DNA, 15 bp, Homo sapiens
cctggcgacctctga

SEQ ID NO: 58927 - DNA, 15 bp, Homo sapiens
ctggcgacctctgat

SEQ ID NO: 58928 - DNA, 15 bp, Homo sapiens
tggcgacctctgatt

SEQ ID NO: 58929 - DNA, 15 bp, Homo sapiens
ggcgacctctgattg

SEQ ID NO: 58930 - DNA, 15 bp, Homo sapiens
gcgacctctgattgt

SEQ ID NO: 58931 - DNA, 15 bp, Homo sapiens
cgacctctgattgta

SEQ ID NO: 58932 - DNA, 15 bp, Homo sapiens
gacctctgattgtag

SEQ ID NO: 58933 - DNA, 15 bp, Homo sapiens
acctctgattgtagt

SEQ ID NO: 58934 - DNA, 15 bp, Homo sapiens
cctctgattgtagtc

SEQ ID NO: 58935 - DNA, 15 bp, Homo sapiens
ctctgattgtagtca

SEQ ID NO: 58936 - DNA, 15 bp, Homo sapiens
tctgattgtagtcac

SEQ ID NO: 58937 - DNA, 15 bp, Homo sapiens
ctgattgtagtcact

SEQ ID NO: 58938 - DNA, 15 bp, Homo sapiens
tgattgtagtcactg

SEQ ID NO: 58939 - DNA, 15 bp, Homo sapiens
gattgtagtcactgc

SEQ ID NO: 58940 - DNA, 15 bp, Homo sapiens
attgtagtcactgca

SEQ ID NO: 58941 - DNA, 15 bp, Homo sapiens
ttgtagtcactgcaa

SEQ ID NO: 58942 - DNA, 15 bp, Homo sapiens
tgtagtcactgcaaa

SEQ ID NO: 58943 - DNA, 15 bp, Homo sapiens
gtagtcactgcaaat

SEQ ID NO: 58944 - DNA, 15 bp, Homo sapiens
tagtcactgcaaatg

SEQ ID NO: 58945 - DNA, 15 bp, Homo sapiens
agtcactgcaaatgc

SEQ ID NO: 58946 - DNA, 15 bp, Homo sapiens
gtcactgcaaatgcc

SEQ ID NO: 58947 - DNA, 15 bp, Homo sapiens
tcactgcaaatgcca

SEQ ID NO: 58948 - DNA, 15 bp, Homo sapiens
cactgcaaatgccag

SEQ ID NO: 58949 - DNA, 15 bp, Homo sapiens
actgcaaatgccaga

SEQ ID NO: 58950 - DNA, 15 bp, Homo sapiens
ctgcaaatgccagat

SEQ ID NO: 58951 - DNA, 15 bp, Homo sapiens
tgcaaatgccagatg

SEQ ID NO: 58952 - DNA, 15 bp, Homo sapiens
gcaaatgccagatgc

SEQ ID NO: 58953 - DNA, 15 bp, Homo sapiens
caaatgccagatgct

SEQ ID NO: 58954 - DNA, 15 bp, Homo sapiens
aaatgccagatgctt

SEQ ID NO: 58955 - DNA, 15 bp, Homo sapiens
aatgccagatgctta

SEQ ID NO: 58956 - DNA, 15 bp, Homo sapiens
atgccagatgcttat

SEQ ID NO: 58957 - DNA, 15 bp, Homo sapiens
tgccagatgcttatt

SEQ ID NO: 58958 - DNA, 15 bp, Homo sapiens
gccagatgcttattt

SEQ ID NO: 58959 - DNA, 15 bp, Homo sapiens
ccagatgcttatttg

SEQ ID NO: 58960 - DNA, 15 bp, Homo sapiens
cagatgcttatttgc

SEQ ID NO: 58961 - DNA, 15 bp, Homo sapiens
agatgcttatttgcc

SEQ ID NO: 58962 - DNA, 15 bp, Homo sapiens
gatgcttatttgcct

SEQ ID NO: 58963 - DNA, 15 bp, Homo sapiens
atgcttatttgccta

SEQ ID NO: 58964 - DNA, 15 bp, Homo sapiens
tgcttatttgcctag

SEQ ID NO: 58965 - DNA, 15 bp, Homo sapiens
gcttatttgcctagc

SEQ ID NO: 58966 - DNA, 15 bp, Homo sapiens
cttatttgcctagct

SEQ ID NO: 58967 - DNA, 15 bp, Homo sapiens
ttatttgcctagctt

SEQ ID NO: 58968 - DNA, 15 bp, Homo sapiens
tatttgcctagcttc

SEQ ID NO: 58969 - DNA, 15 bp, Homo sapiens
atttgcctagcttcc

SEQ ID NO: 58970 - DNA, 15 bp, Homo sapiens
tttgcctagcttccc

SEQ ID NO: 58971 - DNA, 15 bp, Homo sapiens
ttgcctagcttccct

SEQ ID NO: 58972 - DNA, 15 bp, Homo sapiens
tgcctagcttccctt

SEQ ID NO: 58973 - DNA, 15 bp, Homo sapiens
gcctagcttcccttt

SEQ ID NO: 58974 - DNA, 15 bp, Homo sapiens
cctagcttccctttc

SEQ ID NO: 58975 - DNA, 15 bp, Homo sapiens
ctagcttccctttcg

SEQ ID NO: 58976 - DNA, 15 bp, Homo sapiens
tagcttccctttcgg

SEQ ID NO: 58977 - DNA, 15 bp, Homo sapiens
agcttccctttcggt

SEQ ID NO: 58978 - DNA, 15 bp, Homo sapiens
gcttccctttcggtc

SEQ ID NO: 58979 - DNA, 15 bp, Homo sapiens
cttccctttcggtca

SEQ ID NO: 58980 - DNA, 15 bp, Homo sapiens
ttccctttcggtcag

SEQ ID NO: 58981 - DNA, 15 bp, Homo sapiens
tccctttcggtcagg

SEQ ID NO: 58982 - DNA, 15 bp, Homo sapiens
ccctttcggtcaggg

SEQ ID NO: 58983 - DNA, 15 bp, Homo sapiens
cctttcggtcagggc

SEQ ID NO: 58984 - DNA, 15 bp, Homo sapiens
ctttcggtcagggca

SEQ ID NO: 58985 - DNA, 15 bp, Homo sapiens
tttcggtcagggcag

SEQ ID NO: 58986 - DNA, 15 bp, Homo sapiens
ttcggtcagggcagc

SEQ ID NO: 58987 - DNA, 15 bp, Homo sapiens
tcggtcagggcagca

SEQ ID NO: 58988 - DNA, 15 bp, Homo sapiens
cggtcagggcagcag

SEQ ID NO: 58989 - DNA, 15 bp, Homo sapiens
ggtcagggcagcagt

SEQ ID NO: 58990 - DNA, 15 bp, Homo sapiens
gtcagggcagcagtt

SEQ ID NO: 58991 - DNA, 15 bp, Homo sapiens
tcagggcagcagttg

SEQ ID NO: 58992 - DNA, 15 bp, Homo sapiens
cagggcagcagttgg

SEQ ID NO: 58993 - DNA, 15 bp, Homo sapiens
agggcagcagttggc

SEQ ID NO: 58994 - DNA, 15 bp, Homo sapiens
gggcagcagttggca

SEQ ID NO: 58995 - DNA, 15 bp, Homo sapiens
ggcagcagttggcaa

SEQ ID NO: 58996 - DNA, 15 bp, Homo sapiens
gcagcagttggcaaa

SEQ ID NO: 58997 - DNA, 15 bp, Homo sapiens
cagcagttggcaaac

SEQ ID NO: 58998 - DNA, 15 bp, Homo sapiens
agcagttggcaaacg

SEQ ID NO: 58999 - DNA, 15 bp, Homo sapiens
gcagttggcaaacgg

SEQ ID NO: 59000 - DNA, 15 bp, Homo sapiens
cagttggcaaacggt

SEQ ID NO: 59001 - DNA, 15 bp, Homo sapiens
agttggcaaacggta

SEQ ID NO: 59002 - DNA, 15 bp, Homo sapiens
gttggcaaacggtat

SEQ ID NO: 59003 - DNA, 15 bp, Homo sapiens
ttggcaaacggtatc

SEQ ID NO: 59004 - DNA, 15 bp, Homo sapiens
tggcaaacggtatct

SEQ ID NO: 59005 - DNA, 15 bp, Homo sapiens
ggcaaacggtatctc

SEQ ID NO: 59006 - DNA, 15 bp, Homo sapiens
gcaaacggtatctca

SEQ ID NO: 59007 - DNA, 15 bp, Homo sapiens
caaacggtatctcaa

SEQ ID NO: 59008 - DNA, 15 bp, Homo sapiens
aaacggtatctcaag

SEQ ID NO: 59009 - DNA, 15 bp, Homo sapiens
aacggtatctcaagg

SEQ ID NO: 59010 - DNA, 15 bp, Homo sapiens
acggtatctcaaggg

SEQ ID NO: 59011 - DNA, 15 bp, Homo sapiens
cggtatctcaagggc

SEQ ID NO: 59012 - DNA, 15 bp, Homo sapiens
ggtatctcaagggcc

SEQ ID NO: 59013 - DNA, 15 bp, Homo sapiens
gtatctcaagggcca

SEQ ID NO: 59014 - DNA, 15 bp, Homo sapiens
tatctcaagggccaa

SEQ ID NO: 59015 - DNA, 15 bp, Homo sapiens
atctcaagggccaag

SEQ ID NO: 59016 - DNA, 15 bp, Homo sapiens
tctcaagggccaagt

SEQ ID NO: 59017 - DNA, 15 bp, Homo sapiens
ctcaagggccaagtc

SEQ ID NO: 59018 - DNA, 15 bp, Homo sapiens
tcaagggccaagtcc

SEQ ID NO: 59019 - DNA, 15 bp, Homo sapiens
caagggccaagtccg

SEQ ID NO: 59020 - DNA, 15 bp, Homo sapiens
aagggccaagtccgg

SEQ ID NO: 59021 - DNA, 15 bp, Homo sapiens
agggccaagtccggc

SEQ ID NO: 59022 - DNA, 15 bp, Homo sapiens
gggccaagtccggcc

SEQ ID NO: 59023 - DNA, 15 bp, Homo sapiens
ggccaagtccggccc

SEQ ID NO: 59024 - DNA, 15 bp, Homo sapiens
gccaagtccggccca

SEQ ID NO: 59025 - DNA, 15 bp, Homo sapiens
ccaagtccggcccac

SEQ ID NO: 59026 - DNA, 15 bp, Homo sapiens
caagtccggcccact

SEQ ID NO: 59027 - DNA, 15 bp, Homo sapiens
aagtccggcccactg

SEQ ID NO: 59028 - DNA, 15 bp, Homo sapiens
agtccggcccactgc

SEQ ID NO: 59029 - DNA, 15 bp, Homo sapiens
gtccggcccactgcc

SEQ ID NO: 59030 - DNA, 15 bp, Homo sapiens
tccggcccactgcct

SEQ ID NO: 59031 - DNA, 15 bp, Homo sapiens
ccggcccactgcctg

SEQ ID NO: 59032 - DNA, 15 bp, Homo sapiens
cggcccactgcctgt

SEQ ID NO: 59033 - DNA, 15 bp, Homo sapiens
ggcccactgcctgtt

SEQ ID NO: 59034 - DNA, 15 bp, Homo sapiens
gcccactgcctgttt

SEQ ID NO: 59035 - DNA, 15 bp, Homo sapiens
cccactgcctgtttt

SEQ ID NO: 59036 - DNA, 15 bp, Homo sapiens
ccactgcctgttttc

SEQ ID NO: 59037 - DNA, 15 bp, Homo sapiens
cactgcctgttttcg

SEQ ID NO: 59038 - DNA, 15 bp, Homo sapiens
actgcctgttttcgt

SEQ ID NO: 59039 - DNA, 15 bp, Homo sapiens
ctgcctgttttcgta

SEQ ID NO: 59040 - DNA, 15 bp, Homo sapiens
tgcctgttttcgtaa

SEQ ID NO: 59041 - DNA, 15 bp, Homo sapiens
gcctgttttcgtaaa

SEQ ID NO: 59042 - DNA, 15 bp, Homo sapiens
cctgttttcgtaaat

SEQ ID NO: 59043 - DNA, 15 bp, Homo sapiens
ctgttttcgtaaatg

SEQ ID NO: 59044 - DNA, 15 bp, Homo sapiens
tgttttcgtaaatga

SEQ ID NO: 59045 - DNA, 15 bp, Homo sapiens
gttttcgtaaatgaa

SEQ ID NO: 59046 - DNA, 15 bp, Homo sapiens
ttttcgtaaatgaag

SEQ ID NO: 59047 - DNA, 15 bp, Homo sapiens
tttcgtaaatgaagc

SEQ ID NO: 59048 - DNA, 15 bp, Homo sapiens
ttcgtaaatgaagct

SEQ ID NO: 59049 - DNA, 15 bp, Homo sapiens
tcgtaaatgaagctt

SEQ ID NO: 59050 - DNA, 15 bp, Homo sapiens
cgtaaatgaagcttt

SEQ ID NO: 59051 - DNA, 15 bp, Homo sapiens
gtaaatgaagcttta

SEQ ID NO: 59052 - DNA, 15 bp, Homo sapiens
taaatgaagctttac

SEQ ID NO: 59053 - DNA, 15 bp, Homo sapiens
aaatgaagctttacc

SEQ ID NO: 59054 - DNA, 15 bp, Homo sapiens
aatgaagctttacca

SEQ ID NO: 59055 - DNA, 15 bp, Homo sapiens
atgaagctttaccag

SEQ ID NO: 59056 - DNA, 15 bp, Homo sapiens
tgaagctttaccagg

SEQ ID NO: 59057 - DNA, 15 bp, Homo sapiens
gaagctttaccagga

SEQ ID NO: 59058 - DNA, 15 bp, Homo sapiens
aagctttaccaggac

SEQ ID NO: 59059 - DNA, 15 bp, Homo sapiens
agctttaccaggacc

SEQ ID NO: 59060 - DNA, 15 bp, Homo sapiens
gctttaccaggaccc

SEQ ID NO: 59061 - DNA, 15 bp, Homo sapiens
ctttaccaggaccca

SEQ ID NO: 59062 - DNA, 15 bp, Homo sapiens
tttaccaggacccag

SEQ ID NO: 59063 - DNA, 15 bp, Homo sapiens
ttaccaggacccagt

SEQ ID NO: 59064 - DNA, 15 bp, Homo sapiens
taccaggacccagtt

SEQ ID NO: 59065 - DNA, 15 bp, Homo sapiens
accaggacccagttc

SEQ ID NO: 59066 - DNA, 15 bp, Homo sapiens
ccaggacccagttcc

SEQ ID NO: 59067 - DNA, 15 bp, Homo sapiens
caggacccagttcca

SEQ ID NO: 59068 - DNA, 15 bp, Homo sapiens
aggacccagttccac

SEQ ID NO: 59069 - DNA, 15 bp, Homo sapiens
ggacccagttccacc

SEQ ID NO: 59070 - DNA, 15 bp, Homo sapiens
gacccagttccaccc

SEQ ID NO: 59071 - DNA, 15 bp, Homo sapiens
acccagttccacccc

SEQ ID NO: 59072 - DNA, 15 bp, Homo sapiens
cccagttccaccccg

SEQ ID NO: 59073 - DNA, 15 bp, Homo sapiens
ccagttccaccccgt

SEQ ID NO: 59074 - DNA, 15 bp, Homo sapiens
cagttccaccccgtc

SEQ ID NO: 59075 - DNA, 15 bp, Homo sapiens
agttccaccccgtcc

SEQ ID NO: 59076 - DNA, 15 bp, Homo sapiens
gttccaccccgtcct

SEQ ID NO: 59077 - DNA, 15 bp, Homo sapiens
ttccaccccgtcctt

SEQ ID NO: 59078 - DNA, 15 bp, Homo sapiens
tccaccccgtccttt

SEQ ID NO: 59079 - DNA, 15 bp, Homo sapiens
ccaccccgtcctttg

SEQ ID NO: 59080 - DNA, 15 bp, Homo sapiens
caccccgtcctttgt

SEQ ID NO: 59081 - DNA, 15 bp, Homo sapiens
accccgtcctttgtg

SEQ ID NO: 59082 - DNA, 15 bp, Homo sapiens
ccccgtcctttgtgc

SEQ ID NO: 59083 - DNA, 15 bp, Homo sapiens
cccgtcctttgtgca

SEQ ID NO: 59084 - DNA, 15 bp, Homo sapiens
ccgtcctttgtgcat

SEQ ID NO: 59085 - DNA, 15 bp, Homo sapiens
cgtcctttgtgcatt

SEQ ID NO: 59086 - DNA, 15 bp, Homo sapiens
gtcctttgtgcattg

SEQ ID NO: 59087 - DNA, 15 bp, Homo sapiens
tcctttgtgcattgt

SEQ ID NO: 59088 - DNA, 15 bp, Homo sapiens
cctttgtgcattgtc

SEQ ID NO: 59089 - DNA, 15 bp, Homo sapiens
ctttgtgcattgtcc

SEQ ID NO: 59090 - DNA, 15 bp, Homo sapiens
tttgtgcattgtcca

SEQ ID NO: 59091 - DNA, 15 bp, Homo sapiens
ttgtgcattgtccaa

SEQ ID NO: 59092 - DNA, 15 bp, Homo sapiens
tgtgcattgtccaag

SEQ ID NO: 59093 - DNA, 15 bp, Homo sapiens
gtgcattgtccaaga

SEQ ID NO: 59094 - DNA, 15 bp, Homo sapiens
tgcattgtccaagac

SEQ ID NO: 59095 - DNA, 15 bp, Homo sapiens
gcattgtccaagact

SEQ ID NO: 59096 - DNA, 15 bp, Homo sapiens
cattgtccaagactg

SEQ ID NO: 59097 - DNA, 15 bp, Homo sapiens
attgtccaagactgc

SEQ ID NO: 59098 - DNA, 15 bp, Homo sapiens
ttgtccaagactgct

SEQ ID NO: 59099 - DNA, 15 bp, Homo sapiens
tgtccaagactgctc

SEQ ID NO: 59100 - DNA, 15 bp, Homo sapiens
gtccaagactgctct

SEQ ID NO: 59101 - DNA, 15 bp, Homo sapiens
tccaagactgctctc

SEQ ID NO: 59102 - DNA, 15 bp, Homo sapiens
ccaagactgctctcc

SEQ ID NO: 59103 - DNA, 15 bp, Homo sapiens
caagactgctctcct

SEQ ID NO: 59104 - DNA, 15 bp, Homo sapiens
aagactgctctcctg

SEQ ID NO: 59105 - DNA, 15 bp, Homo sapiens
agactgctctcctgt

SEQ ID NO: 59106 - DNA, 15 bp, Homo sapiens
gactgctctcctgta

SEQ ID NO: 59107 - DNA, 15 bp, Homo sapiens
actgctctcctgtac

SEQ ID NO: 59108 - DNA, 15 bp, Homo sapiens
ctgctctcctgtaca

SEQ ID NO: 59109 - DNA, 15 bp, Homo sapiens
tgctctcctgtacaa

SEQ ID NO: 59110 - DNA, 15 bp, Homo sapiens
gctctcctgtacaac

SEQ ID NO: 59111 - DNA, 15 bp, Homo sapiens
ctctcctgtacaaca

SEQ ID NO: 59112 - DNA, 15 bp, Homo sapiens
tctcctgtacaacag

SEQ ID NO: 59113 - DNA, 15 bp, Homo sapiens
ctcctgtacaacagc

SEQ ID NO: 59114 - DNA, 15 bp, Homo sapiens
tcctgtacaacagca

SEQ ID NO: 59115 - DNA, 15 bp, Homo sapiens
cctgtacaacagcag

SEQ ID NO: 59116 - DNA, 15 bp, Homo sapiens
ctgtacaacagcagg

SEQ ID NO: 59117 - DNA, 15 bp, Homo sapiens
tgtacaacagcaggt

SEQ ID NO: 59118 - DNA, 15 bp, Homo sapiens
gtacaacagcaggtg

SEQ ID NO: 59119 - DNA, 15 bp, Homo sapiens
tacaacagcaggtgg

SEQ ID NO: 59120 - DNA, 15 bp, Homo sapiens
acaacagcaggtggg

SEQ ID NO: 59121 - DNA, 15 bp, Homo sapiens
caacagcaggtgggc

SEQ ID NO: 59122 - DNA, 15 bp, Homo sapiens
aacagcaggtgggct

SEQ ID NO: 59123 - DNA, 15 bp, Homo sapiens
acagcaggtgggctg

SEQ ID NO: 59124 - DNA, 15 bp, Homo sapiens
cagcaggtgggctgg

SEQ ID NO: 59125 - DNA, 15 bp, Homo sapiens
agcaggtgggctggt

SEQ ID NO: 59126 - DNA, 15 bp, Homo sapiens
gcaggtgggctggtt

SEQ ID NO: 59127 - DNA, 15 bp, Homo sapiens
caggtgggctggttg

SEQ ID NO: 59128 - DNA, 15 bp, Homo sapiens
aggtgggctggttgt

SEQ ID NO: 59129 - DNA, 15 bp, Homo sapiens
ggtgggctggttgtg

SEQ ID NO: 59130 - DNA, 15 bp, Homo sapiens
gtgggctggttgtga

SEQ ID NO: 59131 - DNA, 15 bp, Homo sapiens
tgggctggttgtgac

SEQ ID NO: 59132 - DNA, 15 bp, Homo sapiens
gggctggttgtgaca

SEQ ID NO: 59133 - DNA, 15 bp, Homo sapiens
ggctggttgtgacag

SEQ ID NO: 59134 - DNA, 15 bp, Homo sapiens
gctggttgtgacaga

SEQ ID NO: 59135 - DNA, 15 bp, Homo sapiens
ctggttgtgacagat

SEQ ID NO: 59136 - DNA, 15 bp, Homo sapiens
tggttgtgacagata

SEQ ID NO: 59137 - DNA, 15 bp, Homo sapiens
ggttgtgacagatac

SEQ ID NO: 59138 - DNA, 15 bp, Homo sapiens
gttgtgacagatact

SEQ ID NO: 59139 - DNA, 15 bp, Homo sapiens
ttgtgacagatactg

SEQ ID NO: 59140 - DNA, 15 bp, Homo sapiens
tgtgacagatactgt

SEQ ID NO: 59141 - DNA, 15 bp, Homo sapiens
gtgacagatactgtc

SEQ ID NO: 59142 - DNA, 15 bp, Homo sapiens
tgacagatactgtct

SEQ ID NO: 59143 - DNA, 15 bp, Homo sapiens
gacagatactgtctg

SEQ ID NO: 59144 - DNA, 15 bp, Homo sapiens
acagatactgtctgg

SEQ ID NO: 59145 - DNA, 15 bp, Homo sapiens
cagatactgtctggc

SEQ ID NO: 59146 - DNA, 15 bp, Homo sapiens
agatactgtctggcc

SEQ ID NO: 59147 - DNA, 15 bp, Homo sapiens
gatactgtctggccc

SEQ ID NO: 59148 - DNA, 15 bp, Homo sapiens
atactgtctggccca

SEQ ID NO: 59149 - DNA, 15 bp, Homo sapiens
tactgtctggcccac

SEQ ID NO: 59150 - DNA, 15 bp, Homo sapiens
actgtctggcccaca

SEQ ID NO: 59151 - DNA, 15 bp, Homo sapiens
ctgtctggcccacaa

SEQ ID NO: 59152 - DNA, 15 bp, Homo sapiens
tgtctggcccacaag

SEQ ID NO: 59153 - DNA, 15 bp, Homo sapiens
gtctggcccacaagg

SEQ ID NO: 59154 - DNA, 15 bp, Homo sapiens
tctggcccacaaggt

SEQ ID NO: 59155 - DNA, 15 bp, Homo sapiens
ctggcccacaaggtg

SEQ ID NO: 59156 - DNA, 15 bp, Homo sapiens
tggcccacaaggtgg

SEQ ID NO: 59157 - DNA, 15 bp, Homo sapiens
ggcccacaaggtgga

SEQ ID NO: 59158 - DNA, 15 bp, Homo sapiens
gcccacaaggtggaa

SEQ ID NO: 59159 - DNA, 15 bp, Homo sapiens
cccacaaggtggaaa

SEQ ID NO: 59160 - DNA, 15 bp, Homo sapiens
ccacaaggtggaaaa

SEQ ID NO: 59161 - DNA, 15 bp, Homo sapiens
cacaaggtggaaaat

SEQ ID NO: 59162 - DNA, 15 bp, Homo sapiens
acaaggtggaaaata

SEQ ID NO: 59163 - DNA, 15 bp, Homo sapiens
caaggtggaaaatac

SEQ ID NO: 59164 - DNA, 15 bp, Homo sapiens
aaggtggaaaatact

SEQ ID NO: 59165 - DNA, 15 bp, Homo sapiens
aggtggaaaatacta

SEQ ID NO: 59166 - DNA, 15 bp, Homo sapiens
ggtggaaaatactat

SEQ ID NO: 59167 - DNA, 15 bp, Homo sapiens
gtggaaaatactatc

SEQ ID NO: 59168 - DNA, 15 bp, Homo sapiens
tggaaaatactatct

SEQ ID NO: 59169 - DNA, 15 bp, Homo sapiens
ggaaaatactatctg

SEQ ID NO: 59170 - DNA, 15 bp, Homo sapiens
gaaaatactatctgg

SEQ ID NO: 59171 - DNA, 15 bp, Homo sapiens
aaaatactatctggc

SEQ ID NO: 59172 - DNA, 15 bp, Homo sapiens
aaatactatctggcc

SEQ ID NO: 59173 - DNA, 15 bp, Homo sapiens
aatactatctggccc

SEQ ID NO: 59174 - DNA, 15 bp, Homo sapiens
atactatctggcccc

SEQ ID NO: 59175 - DNA, 15 bp, Homo sapiens
tactatctggcccct

SEQ ID NO: 59176 - DNA, 15 bp, Homo sapiens
actatctggcccctt

SEQ ID NO: 59177 - DNA, 15 bp, Homo sapiens
ctatctggcccctta

SEQ ID NO: 59178 - DNA, 15 bp, Homo sapiens
tatctggccccttac

SEQ ID NO: 59179 - DNA, 15 bp, Homo sapiens
atctggccccttaca

SEQ ID NO: 59180 - DNA, 15 bp, Homo sapiens
tctggccccttacag

SEQ ID NO: 59181 - DNA, 15 bp, Homo sapiens
ctggccccttacaga

SEQ ID NO: 59182 - DNA, 15 bp, Homo sapiens
tggccccttacagaa

SEQ ID NO: 59183 - DNA, 15 bp, Homo sapiens
ggccccttacagaaa

SEQ ID NO: 59184 - DNA, 15 bp, Homo sapiens
gccccttacagaaag

SEQ ID NO: 59185 - DNA, 15 bp, Homo sapiens
ccccttacagaaaga

SEQ ID NO: 59186 - DNA, 15 bp, Homo sapiens
cccttacagaaagaa

SEQ ID NO: 59187 - DNA, 15 bp, Homo sapiens
ccttacagaaagaaa

SEQ ID NO: 59188 - DNA, 15 bp, Homo sapiens
cttacagaaagaaat

SEQ ID NO: 59189 - DNA, 15 bp, Homo sapiens
ttacagaaagaaatt

SEQ ID NO: 59190 - DNA, 15 bp, Homo sapiens
tacagaaagaaatta

SEQ ID NO: 59191 - DNA, 15 bp, Homo sapiens
acagaaagaaattac

SEQ ID NO: 59192 - DNA, 15 bp, Homo sapiens
cagaaagaaattacc

SEQ ID NO: 59193 - DNA, 15 bp, Homo sapiens
agaaagaaattacct

SEQ ID NO: 59194 - DNA, 15 bp, Homo sapiens
gaaagaaattacctg

SEQ ID NO: 59195 - DNA, 15 bp, Homo sapiens
aaagaaattacctga

SEQ ID NO: 59196 - DNA, 15 bp, Homo sapiens
aagaaattacctgag

SEQ ID NO: 59197 - DNA, 15 bp, Homo sapiens
agaaattacctgagt

SEQ ID NO: 59198 - DNA, 15 bp, Homo sapiens
gaaattacctgagtt

SEQ ID NO: 59199 - DNA, 15 bp, Homo sapiens
aaattacctgagttc

SEQ ID NO: 59200 - DNA, 15 bp, Homo sapiens
aattacctgagttct

SEQ ID NO: 59201 - DNA, 15 bp, Homo sapiens
attacctgagttcta

SEQ ID NO: 59202 - DNA, 15 bp, Homo sapiens
ttacctgagttctac

SEQ ID NO: 59203 - DNA, 15 bp, Homo sapiens
tacctgagttctaca

SEQ ID NO: 59204 - DNA, 15 bp, Homo sapiens
acctgagttctacac

SEQ ID NO: 59205 - DNA, 15 bp, Homo sapiens
cctgagttctacacg

SEQ ID NO: 59206 - DNA, 15 bp, Homo sapiens
ctgagttctacacga

SEQ ID NO: 59207 - DNA, 15 bp, Homo sapiens
tgagttctacacgag

SEQ ID NO: 59208 - DNA, 15 bp, Homo sapiens
gagttctacacgagg

SEQ ID NO: 59209 - DNA, 15 bp, Homo sapiens
agttctacacgaggg

SEQ ID NO: 59210 - DNA, 15 bp, Homo sapiens
gttctacacgagggt

SEQ ID NO: 59211 - DNA, 15 bp, Homo sapiens
ttctacacgagggtg

SEQ ID NO: 59212 - DNA, 15 bp, Homo sapiens
tctacacgagggtgt

SEQ ID NO: 59213 - DNA, 15 bp, Homo sapiens
ctacacgagggtgta

SEQ ID NO: 59214 - DNA, 15 bp, Homo sapiens
tacacgagggtgtag

SEQ ID NO: 59215 - DNA, 15 bp, Homo sapiens
acacgagggtgtagg

SEQ ID NO: 59216 - DNA, 15 bp, Homo sapiens
cacgagggtgtaggt

SEQ ID NO: 59217 - DNA, 15 bp, Homo sapiens
acgagggtgtaggta

SEQ ID NO: 59218 - DNA, 15 bp, Homo sapiens
cgagggtgtaggtat

SEQ ID NO: 59219 - DNA, 15 bp, Homo sapiens
gagggtgtaggtatg

SEQ ID NO: 59220 - DNA, 15 bp, Homo sapiens
agggtgtaggtatgt

SEQ ID NO: 59221 - DNA, 15 bp, Homo sapiens
gggtgtaggtatgta

SEQ ID NO: 59222 - DNA, 15 bp, Homo sapiens
ggtgtaggtatgtac

SEQ ID NO: 59223 - DNA, 15 bp, Homo sapiens
gtgtaggtatgtacc

SEQ ID NO: 59224 - DNA, 15 bp, Homo sapiens
tgtaggtatgtaccc

SEQ ID NO: 59225 - DNA, 15 bp, Homo sapiens
gtaggtatgtaccct

SEQ ID NO: 59226 - DNA, 15 bp, Homo sapiens
taggtatgtaccctg

SEQ ID NO: 59227 - DNA, 15 bp, Homo sapiens
aggtatgtaccctgg

SEQ ID NO: 59228 - DNA, 15 bp, Homo sapiens
ggtatgtaccctggc

SEQ ID NO: 59229 - DNA, 15 bp, Homo sapiens
gtatgtaccctggcc

SEQ ID NO: 59230 - DNA, 15 bp, Homo sapiens
tatgtaccctggcct

SEQ ID NO: 59231 - DNA, 15 bp, Homo sapiens
atgtaccctggcctc

SEQ ID NO: 59232 - DNA, 15 bp, Homo sapiens
tgtaccctggcctct

SEQ ID NO: 59233 - DNA, 15 bp, Homo sapiens
gtaccctggcctctg

SEQ ID NO: 59234 - DNA, 15 bp, Homo sapiens
taccctggcctctgc

SEQ ID NO: 59235 - DNA, 15 bp, Homo sapiens
accctggcctctgcc

SEQ ID NO: 59236 - DNA, 15 bp, Homo sapiens
ccctggcctctgcca

SEQ ID NO: 59237 - DNA, 15 bp, Homo sapiens
cctggcctctgccag

SEQ ID NO: 59238 - DNA, 15 bp, Homo sapiens
ctggcctctgccagt

SEQ ID NO: 59239 - DNA, 15 bp, Homo sapiens
tggcctctgccagtc

SEQ ID NO: 59240 - DNA, 15 bp, Homo sapiens
ggcctctgccagtca

SEQ ID NO: 59241 - DNA, 15 bp, Homo sapiens
gcctctgccagtcag

SEQ ID NO: 59242 - DNA, 15 bp, Homo sapiens
cctctgccagtcaga

SEQ ID NO: 59243 - DNA, 15 bp, Homo sapiens
ctctgccagtcagac

SEQ ID NO: 59244 - DNA, 15 bp, Homo sapiens
tctgccagtcagact

SEQ ID NO: 59245 - DNA, 15 bp, Homo sapiens
ctgccagtcagactc

SEQ ID NO: 59246 - DNA, 15 bp, Homo sapiens
tgccagtcagactca

SEQ ID NO: 59247 - DNA, 15 bp, Homo sapiens
gccagtcagactcac

SEQ ID NO: 59248 - DNA, 15 bp, Homo sapiens
ccagtcagactcaca

SEQ ID NO: 59249 - DNA, 15 bp, Homo sapiens
cagtcagactcacat

SEQ ID NO: 59250 - DNA, 15 bp, Homo sapiens
agtcagactcacatg

SEQ ID NO: 59251 - DNA, 15 bp, Homo sapiens
gtcagactcacatgc

SEQ ID NO: 59252 - DNA, 15 bp, Homo sapiens
tcagactcacatgct

SEQ ID NO: 59253 - DNA, 15 bp, Homo sapiens
cagactcacatgcta

SEQ ID NO: 59254 - DNA, 15 bp, Homo sapiens
agactcacatgctag

SEQ ID NO: 59255 - DNA, 15 bp, Homo sapiens
gactcacatgctagg

SEQ ID NO: 59256 - DNA, 15 bp, Homo sapiens
actcacatgctagga

SEQ ID NO: 59257 - DNA, 15 bp, Homo sapiens
ctcacatgctaggag

SEQ ID NO: 59258 - DNA, 15 bp, Homo sapiens
tcacatgctaggagg

SEQ ID NO: 59259 - DNA, 15 bp, Homo sapiens
cacatgctaggagga

SEQ ID NO: 59260 - DNA, 15 bp, Homo sapiens
acatgctaggaggag

SEQ ID NO: 59261 - DNA, 15 bp, Homo sapiens
catgctaggaggagc

SEQ ID NO: 59262 - DNA, 15 bp, Homo sapiens
atgctaggaggagca

SEQ ID NO: 59263 - DNA, 15 bp, Homo sapiens
tgctaggaggagcag

SEQ ID NO: 59264 - DNA, 15 bp, Homo sapiens
gctaggaggagcagg

SEQ ID NO: 59265 - DNA, 15 bp, Homo sapiens
ctaggaggagcaggg

SEQ ID NO: 59266 - DNA, 15 bp, Homo sapiens
taggaggagcagggc

SEQ ID NO: 59267 - DNA, 15 bp, Homo sapiens
aggaggagcagggcc

SEQ ID NO: 59268 - DNA, 15 bp, Homo sapiens
ggaggagcagggcca

SEQ ID NO: 59269 - DNA, 15 bp, Homo sapiens
gaggagcagggccag

SEQ ID NO: 59270 - DNA, 15 bp, Homo sapiens
aggagcagggccagg

SEQ ID NO: 59271 - DNA, 15 bp, Homo sapiens
ggagcagggccaggc

SEQ ID NO: 59272 - DNA, 15 bp, Homo sapiens
gagcagggccaggca

SEQ ID NO: 59273 - DNA, 15 bp, Homo sapiens
agcagggccaggcag

SEQ ID NO: 59274 - DNA, 15 bp, Homo sapiens
gcagggccaggcagg

SEQ ID NO: 59275 - DNA, 15 bp, Homo sapiens
cagggccaggcagga

SEQ ID NO: 59276 - DNA, 15 bp, Homo sapiens
agggccaggcaggag

SEQ ID NO: 59277 - DNA, 15 bp, Homo sapiens
gggccaggcaggaga

SEQ ID NO: 59278 - DNA, 15 bp, Homo sapiens
ggccaggcaggagag

SEQ ID NO: 59279 - DNA, 15 bp, Homo sapiens
gccaggcaggagagc

SEQ ID NO: 59280 - DNA, 15 bp, Homo sapiens
ccaggcaggagagcc

SEQ ID NO: 59281 - DNA, 15 bp, Homo sapiens
caggcaggagagccg

SEQ ID NO: 59282 - DNA, 15 bp, Homo sapiens
aggcaggagagccgt

SEQ ID NO: 59283 - DNA, 15 bp, Homo sapiens
ggcaggagagccgtg

SEQ ID NO: 59284 - DNA, 15 bp, Homo sapiens
gcaggagagccgtgt

SEQ ID NO: 59285 - DNA, 15 bp, Homo sapiens
caggagagccgtgtc

SEQ ID NO: 59286 - DNA, 15 bp, Homo sapiens
aggagagccgtgtct

SEQ ID NO: 59287 - DNA, 15 bp, Homo sapiens
ggagagccgtgtctc

SEQ ID NO: 59288 - DNA, 15 bp, Homo sapiens
gagagccgtgtctcc

SEQ ID NO: 59289 - DNA, 15 bp, Homo sapiens
agagccgtgtctcct

SEQ ID NO: 59290 - DNA, 15 bp, Homo sapiens
gagccgtgtctcctg

SEQ ID NO: 59291 - DNA, 15 bp, Homo sapiens
agccgtgtctcctgg

SEQ ID NO: 59292 - DNA, 15 bp, Homo sapiens
gccgtgtctcctggc

SEQ ID NO: 59293 - DNA, 15 bp, Homo sapiens
ccgtgtctcctggca

SEQ ID NO: 59294 - DNA, 15 bp, Homo sapiens
cgtgtctcctggcat

SEQ ID NO: 59295 - DNA, 15 bp, Homo sapiens
gtgtctcctggcatt

SEQ ID NO: 59296 - DNA, 15 bp, Homo sapiens
tgtctcctggcattg

SEQ ID NO: 59297 - DNA, 15 bp, Homo sapiens
gtctcctggcattgg

SEQ ID NO: 59298 - DNA, 15 bp, Homo sapiens
tctcctggcattggg

SEQ ID NO: 59299 - DNA, 15 bp, Homo sapiens
ctcctggcattgggg

SEQ ID NO: 59300 - DNA, 15 bp, Homo sapiens
tcctggcattggggc

SEQ ID NO: 59301 - DNA, 15 bp, Homo sapiens
cctggcattggggct

SEQ ID NO: 59302 - DNA, 15 bp, Homo sapiens
ctggcattggggctg

SEQ ID NO: 59303 - DNA, 15 bp, Homo sapiens
tggcattggggctgc

SEQ ID NO: 59304 - DNA, 15 bp, Homo sapiens
ggcattggggctgca

SEQ ID NO: 59305 - DNA, 15 bp, Homo sapiens
gcattggggctgcag

SEQ ID NO: 59306 - DNA, 15 bp, Homo sapiens
cattggggctgcagg

SEQ ID NO: 59307 - DNA, 15 bp, Homo sapiens
attggggctgcagga

SEQ ID NO: 59308 - DNA, 15 bp, Homo sapiens
ttggggctgcaggaa

SEQ ID NO: 59309 - DNA, 15 bp, Homo sapiens
tggggctgcaggaaa

SEQ ID NO: 59310 - DNA, 15 bp, Homo sapiens
ggggctgcaggaaag

SEQ ID NO: 59311 - DNA, 15 bp, Homo sapiens
gggctgcaggaaaga

SEQ ID NO: 59312 - DNA, 15 bp, Homo sapiens
ggctgcaggaaagac

SEQ ID NO: 59313 - DNA, 15 bp, Homo sapiens
gctgcaggaaagacg

SEQ ID NO: 59314 - DNA, 15 bp, Homo sapiens
ctgcaggaaagacga

SEQ ID NO: 59315 - DNA, 15 bp, Homo sapiens
tgcaggaaagacgag

SEQ ID NO: 59316 - DNA, 15 bp, Homo sapiens
gcaggaaagacgagc

SEQ ID NO: 59317 - DNA, 15 bp, Homo sapiens
caggaaagacgagct

SEQ ID NO: 59318 - DNA, 15 bp, Homo sapiens
aggaaagacgagctc

SEQ ID NO: 59319 - DNA, 15 bp, Homo sapiens
ggaaagacgagctcc

SEQ ID NO: 59320 - DNA, 15 bp, Homo sapiens
gaaagacgagctcct

SEQ ID NO: 59321 - DNA, 15 bp, Homo sapiens
aaagacgagctccta

SEQ ID NO: 59322 - DNA, 15 bp, Homo sapiens
aagacgagctcctag

SEQ ID NO: 59323 - DNA, 15 bp, Homo sapiens
agacgagctcctagg

SEQ ID NO: 59324 - DNA, 15 bp, Homo sapiens
gacgagctcctaggc

SEQ ID NO: 59325 - DNA, 15 bp, Homo sapiens
acgagctcctaggcc

SEQ ID NO: 59326 - DNA, 15 bp, Homo sapiens
cgagctcctaggcca

SEQ ID NO: 59327 - DNA, 15 bp, Homo sapiens
gagctcctaggccac

SEQ ID NO: 59328 - DNA, 15 bp, Homo sapiens
agctcctaggccaca

SEQ ID NO: 59329 - DNA, 15 bp, Homo sapiens
gctcctaggccacag

SEQ ID NO: 59330 - DNA, 15 bp, Homo sapiens
ctcctaggccacagt

SEQ ID NO: 59331 - DNA, 15 bp, Homo sapiens
tcctaggccacagtg

SEQ ID NO: 59332 - DNA, 15 bp, Homo sapiens
cctaggccacagtgc

SEQ ID NO: 59333 - DNA, 15 bp, Homo sapiens
ctaggccacagtgcc

SEQ ID NO: 59334 - DNA, 15 bp, Homo sapiens
taggccacagtgcca

SEQ ID NO: 59335 - DNA, 15 bp, Homo sapiens
aggccacagtgccag

SEQ ID NO: 59336 - DNA, 15 bp, Homo sapiens
ggccacagtgccagt

SEQ ID NO: 59337 - DNA, 15 bp, Homo sapiens
gccacagtgccagtg

SEQ ID NO: 59338 - DNA, 15 bp, Homo sapiens
ccacagtgccagtgg

SEQ ID NO: 59339 - DNA, 15 bp, Homo sapiens
cacagtgccagtggc

SEQ ID NO: 59340 - DNA, 15 bp, Homo sapiens
acagtgccagtggcc

SEQ ID NO: 59341 - DNA, 15 bp, Homo sapiens
cagtgccagtggcca

SEQ ID NO: 59342 - DNA, 15 bp, Homo sapiens
agtgccagtggccag

SEQ ID NO: 59343 - DNA, 15 bp, Homo sapiens
gtgccagtggccagt

SEQ ID NO: 59344 - DNA, 15 bp, Homo sapiens
tgccagtggccagtg

SEQ ID NO: 59345 - DNA, 15 bp, Homo sapiens
gccagtggccagtgc

SEQ ID NO: 59346 - DNA, 15 bp, Homo sapiens
ccagtggccagtgct

SEQ ID NO: 59347 - DNA, 15 bp, Homo sapiens
cagtggccagtgctg

SEQ ID NO: 59348 - DNA, 15 bp, Homo sapiens
agtggccagtgctgc

SEQ ID NO: 59349 - DNA, 15 bp, Homo sapiens
gtggccagtgctgct

SEQ ID NO: 59350 - DNA, 15 bp, Homo sapiens
tggccagtgctgctg

SEQ ID NO: 59351 - DNA, 15 bp, Homo sapiens
ggccagtgctgctgc

SEQ ID NO: 59352 - DNA, 15 bp, Homo sapiens
gccagtgctgctgcc

SEQ ID NO: 59353 - DNA, 15 bp, Homo sapiens
ccagtgctgctgcct

SEQ ID NO: 59354 - DNA, 15 bp, Homo sapiens
cagtgctgctgcctt

SEQ ID NO: 59355 - DNA, 15 bp, Homo sapiens
agtgctgctgccttg

SEQ ID NO: 59356 - DNA, 15 bp, Homo sapiens
gtgctgctgccttgc

SEQ ID NO: 59357 - DNA, 15 bp, Homo sapiens
tgctgctgccttgca

SEQ ID NO: 59358 - DNA, 15 bp, Homo sapiens
gctgctgccttgcag

SEQ ID NO: 59359 - DNA, 15 bp, Homo sapiens
ctgctgccttgcagg

SEQ ID NO: 59360 - DNA, 15 bp, Homo sapiens
tgctgccttgcaggg

SEQ ID NO: 59361 - DNA, 15 bp, Homo sapiens
gctgccttgcagggt

SEQ ID NO: 59362 - DNA, 15 bp, Homo sapiens
ctgccttgcagggtc

SEQ ID NO: 59363 - DNA, 15 bp, Homo sapiens
tgccttgcagggtcg

SEQ ID NO: 59364 - DNA, 15 bp, Homo sapiens
gccttgcagggtcgc

SEQ ID NO: 59365 - DNA, 15 bp, Homo sapiens
ccttgcagggtcgca

SEQ ID NO: 59366 - DNA, 15 bp, Homo sapiens
cttgcagggtcgcac

SEQ ID NO: 59367 - DNA, 15 bp, Homo sapiens
ttgcagggtcgcaca

SEQ ID NO: 59368 - DNA, 15 bp, Homo sapiens
tgcagggtcgcacag

SEQ ID NO: 59369 - DNA, 15 bp, Homo sapiens
gcagggtcgcacagg

SEQ ID NO: 59370 - DNA, 15 bp, Homo sapiens
cagggtcgcacaggc

SEQ ID NO: 59371 - DNA, 15 bp, Homo sapiens
agggtcgcacaggca

SEQ ID NO: 59372 - DNA, 15 bp, Homo sapiens
gggtcgcacaggcag

SEQ ID NO: 59373 - DNA, 15 bp, Homo sapiens
ggtcgcacaggcagt

SEQ ID NO: 59374 - DNA, 15 bp, Homo sapiens
gtcgcacaggcagtg

SEQ ID NO: 59375 - DNA, 15 bp, Homo sapiens
tcgcacaggcagtgc

SEQ ID NO: 59376 - DNA, 15 bp, Homo sapiens
cgcacaggcagtgct

SEQ ID NO: 59377 - DNA, 15 bp, Homo sapiens
gcacaggcagtgctg

SEQ ID NO: 59378 - DNA, 15 bp, Homo sapiens
cacaggcagtgctgg

SEQ ID NO: 59379 - DNA, 15 bp, Homo sapiens
acaggcagtgctggc

SEQ ID NO: 59380 - DNA, 15 bp, Homo sapiens
caggcagtgctggct

SEQ ID NO: 59381 - DNA, 15 bp, Homo sapiens
aggcagtgctggctg

SEQ ID NO: 59382 - DNA, 15 bp, Homo sapiens
ggcagtgctggctgt

SEQ ID NO: 59383 - DNA, 15 bp, Homo sapiens
gcagtgctggctgtt

SEQ ID NO: 59384 - DNA, 15 bp, Homo sapiens
cagtgctggctgttt

SEQ ID NO: 59385 - DNA, 15 bp, Homo sapiens
agtgctggctgtttg

SEQ ID NO: 59386 - DNA, 15 bp, Homo sapiens
gtgctggctgtttgg

SEQ ID NO: 59387 - DNA, 15 bp, Homo sapiens
tgctggctgtttgga

SEQ ID NO: 59388 - DNA, 15 bp, Homo sapiens
gctggctgtttggac

SEQ ID NO: 59389 - DNA, 15 bp, Homo sapiens
ctggctgtttggact

SEQ ID NO: 59390 - DNA, 15 bp, Homo sapiens
tggctgtttggactg

SEQ ID NO: 59391 - DNA, 15 bp, Homo sapiens
ggctgtttggactgg

SEQ ID NO: 59392 - DNA, 15 bp, Homo sapiens
gctgtttggactggc

SEQ ID NO: 59393 - DNA, 15 bp, Homo sapiens
ctgtttggactggct

SEQ ID NO: 59394 - DNA, 15 bp, Homo sapiens
tgtttggactggctt

SEQ ID NO: 59395 - DNA, 15 bp, Homo sapiens
gtttggactggcttg

SEQ ID NO: 59396 - DNA, 15 bp, Homo sapiens
tttggactggcttgg

SEQ ID NO: 59397 - DNA, 15 bp, Homo sapiens
ttggactggcttggc

SEQ ID NO: 59398 - DNA, 15 bp, Homo sapiens
tggactggcttggca

SEQ ID NO: 59399 - DNA, 15 bp, Homo sapiens
ggactggcttggcag

SEQ ID NO: 59400 - DNA, 15 bp, Homo sapiens
gactggcttggcaga

SEQ ID NO: 59401 - DNA, 15 bp, Homo sapiens
actggcttggcagaa

SEQ ID NO: 59402 - DNA, 15 bp, Homo sapiens
ctggcttggcagaag

SEQ ID NO: 59403 - DNA, 15 bp, Homo sapiens
tggcttggcagaagg

SEQ ID NO: 59404 - DNA, 15 bp, Homo sapiens
ggcttggcagaagga

SEQ ID NO: 59405 - DNA, 15 bp, Homo sapiens
gcttggcagaaggat

SEQ ID NO: 59406 - DNA, 15 bp, Homo sapiens
cttggcagaaggatt

SEQ ID NO: 59407 - DNA, 15 bp, Homo sapiens
ttggcagaaggattt

SEQ ID NO: 59408 - DNA, 15 bp, Homo sapiens
tggcagaaggatttg

SEQ ID NO: 59409 - DNA, 15 bp, Homo sapiens
ggcagaaggatttga

SEQ ID NO: 59410 - DNA, 15 bp, Homo sapiens
gcagaaggatttgaa

SEQ ID NO: 59411 - DNA, 15 bp, Homo sapiens
cagaaggatttgaag

SEQ ID NO: 59412 - DNA, 15 bp, Homo sapiens
agaaggatttgaagt

SEQ ID NO: 59413 - DNA, 15 bp, Homo sapiens
gaaggatttgaagta

SEQ ID NO: 59414 - DNA, 15 bp, Homo sapiens
aaggatttgaagtat

SEQ ID NO: 59415 - DNA, 15 bp, Homo sapiens
aggatttgaagtatt

SEQ ID NO: 59416 - DNA, 15 bp, Homo sapiens
ggatttgaagtattg

SEQ ID NO: 59417 - DNA, 15 bp, Homo sapiens
gatttgaagtattgt

SEQ ID NO: 59418 - DNA, 15 bp, Homo sapiens
atttgaagtattgtt

SEQ ID NO: 59419 - DNA, 15 bp, Homo sapiens
tttgaagtattgttc

SEQ ID NO: 59420 - DNA, 15 bp, Homo sapiens
ttgaagtattgttcc

SEQ ID NO: 59421 - DNA, 15 bp, Homo sapiens
tgaagtattgttcct

SEQ ID NO: 59422 - DNA, 15 bp, Homo sapiens
gaagtattgttccta

SEQ ID NO: 59423 - DNA, 15 bp, Homo sapiens
aagtattgttcctag

SEQ ID NO: 59424 - DNA, 15 bp, Homo sapiens
agtattgttcctagc

SEQ ID NO: 59425 - DNA, 15 bp, Homo sapiens
gtattgttcctagcc

SEQ ID NO: 59426 - DNA, 15 bp, Homo sapiens
tattgttcctagcca

SEQ ID NO: 59427 - DNA, 15 bp, Homo sapiens
attgttcctagccaa

SEQ ID NO: 59428 - DNA, 15 bp, Homo sapiens
ttgttcctagccaac

SEQ ID NO: 59429 - DNA, 15 bp, Homo sapiens
tgttcctagccaact

SEQ ID NO: 59430 - DNA, 15 bp, Homo sapiens
gttcctagccaactg

SEQ ID NO: 59431 - DNA, 15 bp, Homo sapiens
ttcctagccaactgg

SEQ ID NO: 59432 - DNA, 15 bp, Homo sapiens
tcctagccaactgga

SEQ ID NO: 59433 - DNA, 15 bp, Homo sapiens
cctagccaactggac

SEQ ID NO: 59434 - DNA, 15 bp, Homo sapiens
ctagccaactggact

SEQ ID NO: 59435 - DNA, 15 bp, Homo sapiens
tagccaactggactc

SEQ ID NO: 59436 - DNA, 15 bp, Homo sapiens
agccaactggactca

SEQ ID NO: 59437 - DNA, 15 bp, Homo sapiens
gccaactggactcaa

SEQ ID NO: 59438 - DNA, 15 bp, Homo sapiens
ccaactggactcaaa

SEQ ID NO: 59439 - DNA, 15 bp, Homo sapiens
caactggactcaaac

SEQ ID NO: 59440 - DNA, 15 bp, Homo sapiens
aactggactcaaacc

SEQ ID NO: 59441 - DNA, 15 bp, Homo sapiens
actggactcaaacct

SEQ ID NO: 59442 - DNA, 15 bp, Homo sapiens
ctggactcaaacctg

SEQ ID NO: 59443 - DNA, 15 bp, Homo sapiens
tggactcaaacctgt

SEQ ID NO: 59444 - DNA, 15 bp, Homo sapiens
ggactcaaacctgtt

SEQ ID NO: 59445 - DNA, 15 bp, Homo sapiens
gactcaaacctgttc

SEQ ID NO: 59446 - DNA, 15 bp, Homo sapiens
actcaaacctgttcc

SEQ ID NO: 59447 - DNA, 15 bp, Homo sapiens
ctcaaacctgttcct

SEQ ID NO: 59448 - DNA, 15 bp, Homo sapiens
tcaaacctgttcctc

SEQ ID NO: 59449 - DNA, 15 bp, Homo sapiens
caaacctgttcctcc

SEQ ID NO: 59450 - DNA, 15 bp, Homo sapiens
aaacctgttcctcca

SEQ ID NO: 59451 - DNA, 15 bp, Homo sapiens
aacctgttcctccaa

SEQ ID NO: 59452 - DNA, 15 bp, Homo sapiens
acctgttcctccaac

SEQ ID NO: 59453 - DNA, 15 bp, Homo sapiens
cctgttcctccaacc

SEQ ID NO: 59454 - DNA, 15 bp, Homo sapiens
ctgttcctccaaccc

SEQ ID NO: 59455 - DNA, 15 bp, Homo sapiens
tgttcctccaaccct

SEQ ID NO: 59456 - DNA, 15 bp, Homo sapiens
gttcctccaaccctc

SEQ ID NO: 59457 - DNA, 15 bp, Homo sapiens
ttcctccaaccctct

SEQ ID NO: 59458 - DNA, 15 bp, Homo sapiens
tcctccaaccctcta

SEQ ID NO: 59459 - DNA, 15 bp, Homo sapiens
cctccaaccctctag

SEQ ID NO: 59460 - DNA, 15 bp, Homo sapiens
ctccaaccctctagg

SEQ ID NO: 59461 - DNA, 15 bp, Homo sapiens
tccaaccctctaggg

SEQ ID NO: 59462 - DNA, 15 bp, Homo sapiens
ccaaccctctaggga

SEQ ID NO: 59463 - DNA, 15 bp, Homo sapiens
caaccctctagggat

SEQ ID NO: 59464 - DNA, 15 bp, Homo sapiens
aaccctctagggatt

SEQ ID NO: 59465 - DNA, 15 bp, Homo sapiens
accctctagggattc

SEQ ID NO: 59466 - DNA, 15 bp, Homo sapiens
ccctctagggattct

SEQ ID NO: 59467 - DNA, 15 bp, Homo sapiens
cctctagggattctc

SEQ ID NO: 59468 - DNA, 15 bp, Homo sapiens
ctctagggattctct

SEQ ID NO: 59469 - DNA, 15 bp, Homo sapiens
tctagggattctctt

SEQ ID NO: 59470 - DNA, 15 bp, Homo sapiens
ctagggattctctta

SEQ ID NO: 59471 - DNA, 15 bp, Homo sapiens
tagggattctcttat

SEQ ID NO: 59472 - DNA, 15 bp, Homo sapiens
agggattctcttatc

SEQ ID NO: 59473 - DNA, 15 bp, Homo sapiens
gggattctcttatca

SEQ ID NO: 59474 - DNA, 15 bp, Homo sapiens
ggattctcttatcac

SEQ ID NO: 59475 - DNA, 15 bp, Homo sapiens
gattctcttatcacc

SEQ ID NO: 59476 - DNA, 15 bp, Homo sapiens
attctcttatcaccc

SEQ ID NO: 59477 - DNA, 15 bp, Homo sapiens
ttctcttatcaccca

SEQ ID NO: 59478 - DNA, 15 bp, Homo sapiens
tctcttatcacccag

SEQ ID NO: 59479 - DNA, 15 bp, Homo sapiens
ctcttatcacccagt

SEQ ID NO: 59480 - DNA, 15 bp, Homo sapiens
tcttatcacccagta

SEQ ID NO: 59481 - DNA, 15 bp, Homo sapiens
cttatcacccagtag

SEQ ID NO: 59482 - DNA, 15 bp, Homo sapiens
ttatcacccagtagc

SEQ ID NO: 59483 - DNA, 15 bp, Homo sapiens
tatcacccagtagcc

SEQ ID NO: 59484 - DNA, 15 bp, Homo sapiens
atcacccagtagcct

SEQ ID NO: 59485 - DNA, 15 bp, Homo sapiens
tcacccagtagcctt

SEQ ID NO: 59486 - DNA, 15 bp, Homo sapiens
cacccagtagccttt

SEQ ID NO: 59487 - DNA, 15 bp, Homo sapiens
acccagtagcctttt

SEQ ID NO: 59488 - DNA, 15 bp, Homo sapiens
cccagtagccttttc

SEQ ID NO: 59489 - DNA, 15 bp, Homo sapiens
ccagtagccttttcc

SEQ ID NO: 59490 - DNA, 15 bp, Homo sapiens
cagtagccttttccc

SEQ ID NO: 59491 - DNA, 15 bp, Homo sapiens
agtagccttttcccc

SEQ ID NO: 59492 - DNA, 15 bp, Homo sapiens
gtagccttttccccc

SEQ ID NO: 59493 - DNA, 15 bp, Homo sapiens
tagccttttccccct

SEQ ID NO: 59494 - DNA, 15 bp, Homo sapiens
agccttttcccccta

SEQ ID NO: 59495 - DNA, 15 bp, Homo sapiens
gccttttccccctag

SEQ ID NO: 59496 - DNA, 15 bp, Homo sapiens
ccttttccccctagt

SEQ ID NO: 59497 - DNA, 15 bp, Homo sapiens
cttttccccctagtt

SEQ ID NO: 59498 - DNA, 15 bp, Homo sapiens
ttttccccctagttt

SEQ ID NO: 59499 - DNA, 15 bp, Homo sapiens
tttccccctagtttt

SEQ ID NO: 59500 - DNA, 15 bp, Homo sapiens
ttccccctagtttta

SEQ ID NO: 59501 - DNA, 15 bp, Homo sapiens
tccccctagttttaa

SEQ ID NO: 59502 - DNA, 15 bp, Homo sapiens
ccccctagttttaaa

SEQ ID NO: 59503 - DNA, 15 bp, Homo sapiens
cccctagttttaaaa

SEQ ID NO: 59504 - DNA, 15 bp, Homo sapiens
ccctagttttaaaaa

SEQ ID NO: 59505 - DNA, 15 bp, Homo sapiens
cctagttttaaaaat

SEQ ID NO: 59506 - DNA, 15 bp, Homo sapiens
ctagttttaaaaatt

SEQ ID NO: 59507 - DNA, 15 bp, Homo sapiens
tagttttaaaaattg

SEQ ID NO: 59508 - DNA, 15 bp, Homo sapiens
agttttaaaaattgc

SEQ ID NO: 59509 - DNA, 15 bp, Homo sapiens
gttttaaaaattgca

SEQ ID NO: 59510 - DNA, 15 bp, Homo sapiens
ttttaaaaattgcag

SEQ ID NO: 59511 - DNA, 15 bp, Homo sapiens
tttaaaaattgcagt

SEQ ID NO: 59512 - DNA, 15 bp, Homo sapiens
ttaaaaattgcagta

SEQ ID NO: 59513 - DNA, 15 bp, Homo sapiens
taaaaattgcagtaa

SEQ ID NO: 59514 - DNA, 15 bp, Homo sapiens
aaaaattgcagtaaa

SEQ ID NO: 59515 - DNA, 15 bp, Homo sapiens
aaaattgcagtaaaa

SEQ ID NO: 59516 - DNA, 15 bp, Homo sapiens
aaattgcagtaaaat

SEQ ID NO: 59517 - DNA, 15 bp, Homo sapiens
aattgcagtaaaata

SEQ ID NO: 59518 - DNA, 15 bp, Homo sapiens
attgcagtaaaatac

SEQ ID NO: 59519 - DNA, 15 bp, Homo sapiens
ttgcagtaaaataca

SEQ ID NO: 59520 - DNA, 15 bp, Homo sapiens
tgcagtaaaatacac

SEQ ID NO: 59521 - DNA, 15 bp, Homo sapiens
gcagtaaaatacaca

SEQ ID NO: 59522 - DNA, 15 bp, Homo sapiens
cagtaaaatacacaa

SEQ ID NO: 59523 - DNA, 15 bp, Homo sapiens
agtaaaatacacaaa

SEQ ID NO: 59524 - DNA, 15 bp, Homo sapiens
gtaaaatacacaaaa

SEQ ID NO: 59525 - DNA, 15 bp, Homo sapiens
taaaatacacaaaag

SEQ ID NO: 59526 - DNA, 15 bp, Homo sapiens
aaaatacacaaaaga

SEQ ID NO: 59527 - DNA, 15 bp, Homo sapiens
aaatacacaaaagat

SEQ ID NO: 59528 - DNA, 15 bp, Homo sapiens
aatacacaaaagata

SEQ ID NO: 59529 - DNA, 15 bp, Homo sapiens
atacacaaaagataa

SEQ ID NO: 59530 - DNA, 15 bp, Homo sapiens
tacacaaaagataaa

SEQ ID NO: 59531 - DNA, 15 bp, Homo sapiens
acacaaaagataaaa

SEQ ID NO: 59532 - DNA, 15 bp, Homo sapiens
cacaaaagataaaat

SEQ ID NO: 59533 - DNA, 15 bp, Homo sapiens
acaaaagataaaatg

SEQ ID NO: 59534 - DNA, 15 bp, Homo sapiens
caaaagataaaatgt

SEQ ID NO: 59535 - DNA, 15 bp, Homo sapiens
aaaagataaaatgta

SEQ ID NO: 59536 - DNA, 15 bp, Homo sapiens
aaagataaaatgtac

SEQ ID NO: 59537 - DNA, 15 bp, Homo sapiens
aagataaaatgtact

SEQ ID NO: 59538 - DNA, 15 bp, Homo sapiens
agataaaatgtactg

SEQ ID NO: 59539 - DNA, 15 bp, Homo sapiens
gataaaatgtactgc

SEQ ID NO: 59540 - DNA, 15 bp, Homo sapiens
ataaaatgtactgcc

SEQ ID NO: 59541 - DNA, 15 bp, Homo sapiens
taaaatgtactgcct

SEQ ID NO: 59542 - DNA, 15 bp, Homo sapiens
aaaatgtactgcctt

SEQ ID NO: 59543 - DNA, 15 bp, Homo sapiens
aaatgtactgcctta

SEQ ID NO: 59544 - DNA, 15 bp, Homo sapiens
aatgtactgccttaa

SEQ ID NO: 59545 - DNA, 15 bp, Homo sapiens
atgtactgccttaac

SEQ ID NO: 59546 - DNA, 15 bp, Homo sapiens
tgtactgccttaacc

SEQ ID NO: 59547 - DNA, 15 bp, Homo sapiens
gtactgccttaacca

SEQ ID NO: 59548 - DNA, 15 bp, Homo sapiens
tactgccttaaccat

SEQ ID NO: 59549 - DNA, 15 bp, Homo sapiens
actgccttaaccatt

SEQ ID NO: 59550 - DNA, 15 bp, Homo sapiens
ctgccttaaccattt

SEQ ID NO: 59551 - DNA, 15 bp, Homo sapiens
tgccttaaccatttt

SEQ ID NO: 59552 - DNA, 15 bp, Homo sapiens
gccttaaccattttt

SEQ ID NO: 59553 - DNA, 15 bp, Homo sapiens
ccttaaccattttta

SEQ ID NO: 59554 - DNA, 15 bp, Homo sapiens
cttaaccatttttaa

SEQ ID NO: 59555 - DNA, 15 bp, Homo sapiens
ttaaccatttttaag

SEQ ID NO: 59556 - DNA, 15 bp, Homo sapiens
taaccatttttaagt

SEQ ID NO: 59557 - DNA, 15 bp, Homo sapiens
aaccatttttaagtg

SEQ ID NO: 59558 - DNA, 15 bp, Homo sapiens
accatttttaagtgt

SEQ ID NO: 59559 - DNA, 15 bp, Homo sapiens
ccatttttaagtgta

SEQ ID NO: 59560 - DNA, 15 bp, Homo sapiens
catttttaagtgtac

SEQ ID NO: 59561 - DNA, 15 bp, Homo sapiens
atttttaagtgtaca

SEQ ID NO: 59562 - DNA, 15 bp, Homo sapiens
tttttaagtgtacaa

SEQ ID NO: 59563 - DNA, 15 bp, Homo sapiens
ttttaagtgtacaat

SEQ ID NO: 59564 - DNA, 15 bp, Homo sapiens
tttaagtgtacaatt

SEQ ID NO: 59565 - DNA, 15 bp, Homo sapiens
ttaagtgtacaattc

SEQ ID NO: 59566 - DNA, 15 bp, Homo sapiens
taagtgtacaattct

SEQ ID NO: 59567 - DNA, 15 bp, Homo sapiens
aagtgtacaattctg

SEQ ID NO: 59568 - DNA, 15 bp, Homo sapiens
agtgtacaattctgt

SEQ ID NO: 59569 - DNA, 15 bp, Homo sapiens
gtgtacaattctgtg

SEQ ID NO: 59570 - DNA, 15 bp, Homo sapiens
tgtacaattctgtgg

SEQ ID NO: 59571 - DNA, 15 bp, Homo sapiens
gtacaattctgtggt

SEQ ID NO: 59572 - DNA, 15 bp, Homo sapiens
tacaattctgtggta

SEQ ID NO: 59573 - DNA, 15 bp, Homo sapiens
acaattctgtggtat

SEQ ID NO: 59574 - DNA, 15 bp, Homo sapiens
caattctgtggtatt

SEQ ID NO: 59575 - DNA, 15 bp, Homo sapiens
aattctgtggtattg

SEQ ID NO: 59576 - DNA, 15 bp, Homo sapiens
attctgtggtattga

SEQ ID NO: 59577 - DNA, 15 bp, Homo sapiens
ttctgtggtattgag

SEQ ID NO: 59578 - DNA, 15 bp, Homo sapiens
tctgtggtattgagc

SEQ ID NO: 59579 - DNA, 15 bp, Homo sapiens
ctgtggtattgagca

SEQ ID NO: 59580 - DNA, 15 bp, Homo sapiens
tgtggtattgagcac

SEQ ID NO: 59581 - DNA, 15 bp, Homo sapiens
gtggtattgagcaca

SEQ ID NO: 59582 - DNA, 15 bp, Homo sapiens
tggtattgagcacat

SEQ ID NO: 59583 - DNA, 15 bp, Homo sapiens
ggtattgagcacatt

SEQ ID NO: 59584 - DNA, 15 bp, Homo sapiens
gtattgagcacattt

SEQ ID NO: 59585 - DNA, 15 bp, Homo sapiens
tattgagcacattta

SEQ ID NO: 59586 - DNA, 15 bp, Homo sapiens
attgagcacatttat

SEQ ID NO: 59587 - DNA, 15 bp, Homo sapiens
ttgagcacatttata

SEQ ID NO: 59588 - DNA, 15 bp, Homo sapiens
tgagcacatttatat

SEQ ID NO: 59589 - DNA, 15 bp, Homo sapiens
gagcacatttatatt

SEQ ID NO: 59590 - DNA, 15 bp, Homo sapiens
agcacatttatattg

SEQ ID NO: 59591 - DNA, 15 bp, Homo sapiens
gcacatttatattgt

SEQ ID NO: 59592 - DNA, 15 bp, Homo sapiens
cacatttatattgtg

SEQ ID NO: 59593 - DNA, 15 bp, Homo sapiens
acatttatattgtgc

SEQ ID NO: 59594 - DNA, 15 bp, Homo sapiens
catttatattgtgca

SEQ ID NO: 59595 - DNA, 15 bp, Homo sapiens
atttatattgtgcaa

SEQ ID NO: 59596 - DNA, 15 bp, Homo sapiens
tttatattgtgcaac

SEQ ID NO: 59597 - DNA, 15 bp, Homo sapiens
ttatattgtgcaacc

SEQ ID NO: 59598 - DNA, 15 bp, Homo sapiens
tatattgtgcaacca

SEQ ID NO: 59599 - DNA, 15 bp, Homo sapiens
atattgtgcaaccat

SEQ ID NO: 59600 - DNA, 15 bp, Homo sapiens
tattgtgcaaccatc

SEQ ID NO: 59601 - DNA, 15 bp, Homo sapiens
attgtgcaaccatca

SEQ ID NO: 59602 - DNA, 15 bp, Homo sapiens
ttgtgcaaccatcac

SEQ ID NO: 59603 - DNA, 15 bp, Homo sapiens
tgtgcaaccatcacc

SEQ ID NO: 59604 - DNA, 15 bp, Homo sapiens
gtgcaaccatcacca

SEQ ID NO: 59605 - DNA, 15 bp, Homo sapiens
tgcaaccatcaccac

SEQ ID NO: 59606 - DNA, 15 bp, Homo sapiens
gcaaccatcaccaca

SEQ ID NO: 59607 - DNA, 15 bp, Homo sapiens
caaccatcaccacat

SEQ ID NO: 59608 - DNA, 15 bp, Homo sapiens
aaccatcaccacatg

SEQ ID NO: 59609 - DNA, 15 bp, Homo sapiens
accatcaccacatgc

SEQ ID NO: 59610 - DNA, 15 bp, Homo sapiens
ccatcaccacatgca

SEQ ID NO: 59611 - DNA, 15 bp, Homo sapiens
catcaccacatgcat

SEQ ID NO: 59612 - DNA, 15 bp, Homo sapiens
atcaccacatgcatc

SEQ ID NO: 59613 - DNA, 15 bp, Homo sapiens
tcaccacatgcatct

SEQ ID NO: 59614 - DNA, 15 bp, Homo sapiens
caccacatgcatctt

SEQ ID NO: 59615 - DNA, 15 bp, Homo sapiens
accacatgcatcttc

SEQ ID NO: 59616 - DNA, 15 bp, Homo sapiens
ccacatgcatcttca

SEQ ID NO: 59617 - DNA, 15 bp, Homo sapiens
cacatgcatcttcaa

SEQ ID NO: 59618 - DNA, 15 bp, Homo sapiens
acatgcatcttcaat

SEQ ID NO: 59619 - DNA, 15 bp, Homo sapiens
catgcatcttcaata

SEQ ID NO: 59620 - DNA, 15 bp, Homo sapiens
atgcatcttcaatag

SEQ ID NO: 59621 - DNA, 15 bp, Homo sapiens
tgcatcttcaatagc

SEQ ID NO: 59622 - DNA, 15 bp, Homo sapiens
gcatcttcaatagct

SEQ ID NO: 59623 - DNA, 15 bp, Homo sapiens
catcttcaatagctt

SEQ ID NO: 59624 - DNA, 15 bp, Homo sapiens
atcttcaatagcttt

SEQ ID NO: 59625 - DNA, 15 bp, Homo sapiens
tcttcaatagctttt

SEQ ID NO: 59626 - DNA, 15 bp, Homo sapiens
cttcaatagcttttc

SEQ ID NO: 59627 - DNA, 15 bp, Homo sapiens
ttcaatagcttttca

SEQ ID NO: 59628 - DNA, 15 bp, Homo sapiens
tcaatagcttttcat

SEQ ID NO: 59629 - DNA, 15 bp, Homo sapiens
caatagcttttcatc

SEQ ID NO: 59630 - DNA, 15 bp, Homo sapiens
aatagcttttcatca

SEQ ID NO: 59631 - DNA, 15 bp, Homo sapiens
atagcttttcatcag

SEQ ID NO: 59632 - DNA, 15 bp, Homo sapiens
tagcttttcatcagt

SEQ ID NO: 59633 - DNA, 15 bp, Homo sapiens
agcttttcatcagtc

SEQ ID NO: 59634 - DNA, 15 bp, Homo sapiens
gcttttcatcagtcc

SEQ ID NO: 59635 - DNA, 15 bp, Homo sapiens
cttttcatcagtcct

SEQ ID NO: 59636 - DNA, 15 bp, Homo sapiens
ttttcatcagtcctt

SEQ ID NO: 59637 - DNA, 15 bp, Homo sapiens
tttcatcagtccttg

SEQ ID NO: 59638 - DNA, 15 bp, Homo sapiens
ttcatcagtccttgt

SEQ ID NO: 59639 - DNA, 15 bp, Homo sapiens
tcatcagtccttgtc

SEQ ID NO: 59640 - DNA, 15 bp, Homo sapiens
catcagtccttgtct

SEQ ID NO: 59641 - DNA, 15 bp, Homo sapiens
atcagtccttgtctg

SEQ ID NO: 59642 - DNA, 15 bp, Homo sapiens
tcagtccttgtctgc

SEQ ID NO: 59643 - DNA, 15 bp, Homo sapiens
cagtccttgtctgca

SEQ ID NO: 59644 - DNA, 15 bp, Homo sapiens
agtccttgtctgcat

SEQ ID NO: 59645 - DNA, 15 bp, Homo sapiens
gtccttgtctgcata

SEQ ID NO: 59646 - DNA, 15 bp, Homo sapiens
tccttgtctgcataa

SEQ ID NO: 59647 - DNA, 15 bp, Homo sapiens
ccttgtctgcataaa

SEQ ID NO: 59648 - DNA, 15 bp, Homo sapiens
cttgtctgcataaat

SEQ ID NO: 59649 - DNA, 15 bp, Homo sapiens
ttgtctgcataaatc

SEQ ID NO: 59650 - DNA, 15 bp, Homo sapiens
tgtctgcataaatca

SEQ ID NO: 59651 - DNA, 15 bp, Homo sapiens
gtctgcataaatcag

SEQ ID NO: 59652 - DNA, 15 bp, Homo sapiens
tctgcataaatcagc

SEQ ID NO: 59653 - DNA, 15 bp, Homo sapiens
ctgcataaatcagct

SEQ ID NO: 59654 - DNA, 15 bp, Homo sapiens
tgcataaatcagcta

SEQ ID NO: 59655 - DNA, 15 bp, Homo sapiens
gcataaatcagctag

SEQ ID NO: 59656 - DNA, 15 bp, Homo sapiens
cataaatcagctaga

SEQ ID NO: 59657 - DNA, 15 bp, Homo sapiens
ataaatcagctagag

SEQ ID NO: 59658 - DNA, 15 bp, Homo sapiens
taaatcagctagagt

SEQ ID NO: 59659 - DNA, 15 bp, Homo sapiens
aaatcagctagagtt

SEQ ID NO: 59660 - DNA, 15 bp, Homo sapiens
aatcagctagagttg

SEQ ID NO: 59661 - DNA, 15 bp, Homo sapiens
atcagctagagttgg

SEQ ID NO: 59662 - DNA, 15 bp, Homo sapiens
tcagctagagttggt

SEQ ID NO: 59663 - DNA, 15 bp, Homo sapiens
cagctagagttggtt

SEQ ID NO: 59664 - DNA, 15 bp, Homo sapiens
agctagagttggttt

SEQ ID NO: 59665 - DNA, 15 bp, Homo sapiens
gctagagttggtttc

SEQ ID NO: 59666 - DNA, 15 bp, Homo sapiens
ctagagttggtttct

SEQ ID NO: 59667 - DNA, 15 bp, Homo sapiens
tagagttggtttcta

SEQ ID NO: 59668 - DNA, 15 bp, Homo sapiens
agagttggtttctat

SEQ ID NO: 59669 - DNA, 15 bp, Homo sapiens
gagttggtttctatt

SEQ ID NO: 59670 - DNA, 15 bp, Homo sapiens
agttggtttctattg

SEQ ID NO: 59671 - DNA, 15 bp, Homo sapiens
gttggtttctattga

SEQ ID NO: 59672 - DNA, 15 bp, Homo sapiens
ttggtttctattgat

SEQ ID NO: 59673 - DNA, 15 bp, Homo sapiens
tggtttctattgatt

SEQ ID NO: 59674 - DNA, 15 bp, Homo sapiens
ggtttctattgattg

SEQ ID NO: 59675 - DNA, 15 bp, Homo sapiens
gtttctattgattgc

SEQ ID NO: 59676 - DNA, 15 bp, Homo sapiens
tttctattgattgcc

SEQ ID NO: 59677 - DNA, 15 bp, Homo sapiens
ttctattgattgcca

SEQ ID NO: 59678 - DNA, 15 bp, Homo sapiens
tctattgattgccac

SEQ ID NO: 59679 - DNA, 15 bp, Homo sapiens
ctattgattgccacc

SEQ ID NO: 59680 - DNA, 15 bp, Homo sapiens
tattgattgccacca

SEQ ID NO: 59681 - DNA, 15 bp, Homo sapiens
attgattgccaccaa

SEQ ID NO: 59682 - DNA, 15 bp, Homo sapiens
ttgattgccaccaat

SEQ ID NO: 59683 - DNA, 15 bp, Homo sapiens
tgattgccaccaata

SEQ ID NO: 59684 - DNA, 15 bp, Homo sapiens
gattgccaccaataa

SEQ ID NO: 59685 - DNA, 15 bp, Homo sapiens
attgccaccaataat

SEQ ID NO: 59686 - DNA, 15 bp, Homo sapiens
ttgccaccaataatc

SEQ ID NO: 59687 - DNA, 15 bp, Homo sapiens
tgccaccaataatct

SEQ ID NO: 59688 - DNA, 15 bp, Homo sapiens
gccaccaataatctt

SEQ ID NO: 59689 - DNA, 15 bp, Homo sapiens
ccaccaataatcttg

SEQ ID NO: 59690 - DNA, 15 bp, Homo sapiens
caccaataatcttga

SEQ ID NO: 59691 - DNA, 15 bp, Homo sapiens
accaataatcttgac

SEQ ID NO: 59692 - DNA, 15 bp, Homo sapiens
ccaataatcttgaca

SEQ ID NO: 59693 - DNA, 15 bp, Homo sapiens
caataatcttgacag

SEQ ID NO: 59694 - DNA, 15 bp, Homo sapiens
aataatcttgacaga

SEQ ID NO: 59695 - DNA, 15 bp, Homo sapiens
ataatcttgacagat

SEQ ID NO: 59696 - DNA, 15 bp, Homo sapiens
taatcttgacagata

SEQ ID NO: 59697 - DNA, 15 bp, Homo sapiens
aatcttgacagatat

SEQ ID NO: 59698 - DNA, 15 bp, Homo sapiens
atcttgacagatatg

SEQ ID NO: 59699 - DNA, 15 bp, Homo sapiens
tcttgacagatatgt

SEQ ID NO: 59700 - DNA, 15 bp, Homo sapiens
cttgacagatatgtc

SEQ ID NO: 59701 - DNA, 15 bp, Homo sapiens
ttgacagatatgtct

SEQ ID NO: 59702 - DNA, 15 bp, Homo sapiens
tgacagatatgtctg

SEQ ID NO: 59703 - DNA, 15 bp, Homo sapiens
gacagatatgtctga

SEQ ID NO: 59704 - DNA, 15 bp, Homo sapiens
acagatatgtctgat

SEQ ID NO: 59705 - DNA, 15 bp, Homo sapiens
cagatatgtctgatc

SEQ ID NO: 59706 - DNA, 15 bp, Homo sapiens
agatatgtctgatct

SEQ ID NO: 59707 - DNA, 15 bp, Homo sapiens
gatatgtctgatctt

SEQ ID NO: 59708 - DNA, 15 bp, Homo sapiens
atatgtctgatcttc

SEQ ID NO: 59709 - DNA, 15 bp, Homo sapiens
tatgtctgatcttcc

SEQ ID NO: 59710 - DNA, 15 bp, Homo sapiens
atgtctgatcttcct

SEQ ID NO: 59711 - DNA, 15 bp, Homo sapiens
tgtctgatcttcctt

SEQ ID NO: 59712 - DNA, 15 bp, Homo sapiens
gtctgatcttccttc

SEQ ID NO: 59713 - DNA, 15 bp, Homo sapiens
tctgatcttccttct

SEQ ID NO: 59714 - DNA, 15 bp, Homo sapiens
ctgatcttccttctc

SEQ ID NO: 59715 - DNA, 15 bp, Homo sapiens
tgatcttccttctct

SEQ ID NO: 59716 - DNA, 15 bp, Homo sapiens
gatcttccttctctg

SEQ ID NO: 59717 - DNA, 15 bp, Homo sapiens
atcttccttctctgc

SEQ ID NO: 59718 - DNA, 15 bp, Homo sapiens
tcttccttctctgca

SEQ ID NO: 59719 - DNA, 15 bp, Homo sapiens
cttccttctctgcac

SEQ ID NO: 59720 - DNA, 15 bp, Homo sapiens
ttccttctctgcact

SEQ ID NO: 59721 - DNA, 15 bp, Homo sapiens
tccttctctgcactg

SEQ ID NO: 59722 - DNA, 15 bp, Homo sapiens
ccttctctgcactga

SEQ ID NO: 59723 - DNA, 15 bp, Homo sapiens
cttctctgcactgac

SEQ ID NO: 59724 - DNA, 15 bp, Homo sapiens
ttctctgcactgact

SEQ ID NO: 59725 - DNA, 15 bp, Homo sapiens
tctctgcactgactc

SEQ ID NO: 59726 - DNA, 15 bp, Homo sapiens
ctctgcactgactcc

SEQ ID NO: 59727 - DNA, 15 bp, Homo sapiens
tctgcactgactcct

SEQ ID NO: 59728 - DNA, 15 bp, Homo sapiens
ctgcactgactcctc

SEQ ID NO: 59729 - DNA, 15 bp, Homo sapiens
tgcactgactcctct

SEQ ID NO: 59730 - DNA, 15 bp, Homo sapiens
gcactgactcctctt

SEQ ID NO: 59731 - DNA, 15 bp, Homo sapiens
cactgactcctcttt

SEQ ID NO: 59732 - DNA, 15 bp, Homo sapiens
actgactcctctttc

SEQ ID NO: 59733 - DNA, 15 bp, Homo sapiens
ctgactcctctttct

SEQ ID NO: 59734 - DNA, 15 bp, Homo sapiens
tgactcctctttctc

SEQ ID NO: 59735 - DNA, 15 bp, Homo sapiens
gactcctctttctct

SEQ ID NO: 59736 - DNA, 15 bp, Homo sapiens
actcctctttctctg

SEQ ID NO: 59737 - DNA, 15 bp, Homo sapiens
ctcctctttctctgt

SEQ ID NO: 59738 - DNA, 15 bp, Homo sapiens
tcctctttctctgtc

SEQ ID NO: 59739 - DNA, 15 bp, Homo sapiens
cctctttctctgtct

SEQ ID NO: 59740 - DNA, 15 bp, Homo sapiens
ctctttctctgtctc

SEQ ID NO: 59741 - DNA, 15 bp, Homo sapiens
tctttctctgtctcc

SEQ ID NO: 59742 - DNA, 15 bp, Homo sapiens
ctttctctgtctcct

SEQ ID NO: 59743 - DNA, 15 bp, Homo sapiens
tttctctgtctcctc

SEQ ID NO: 59744 - DNA, 15 bp, Homo sapiens
ttctctgtctcctct

SEQ ID NO: 59745 - DNA, 15 bp, Homo sapiens
tctctgtctcctctg

SEQ ID NO: 59746 - DNA, 15 bp, Homo sapiens
ctctgtctcctctgc

SEQ ID NO: 59747 - DNA, 15 bp, Homo sapiens
tctgtctcctctgct

SEQ ID NO: 59748 - DNA, 15 bp, Homo sapiens
ctgtctcctctgctg

SEQ ID NO: 59749 - DNA, 15 bp, Homo sapiens
tgtctcctctgctga

SEQ ID NO: 59750 - DNA, 15 bp, Homo sapiens
gtctcctctgctgat

SEQ ID NO: 59751 - DNA, 15 bp, Homo sapiens
tctcctctgctgatt

SEQ ID NO: 59752 - DNA, 15 bp, Homo sapiens
ctcctctgctgattc

SEQ ID NO: 59753 - DNA, 15 bp, Homo sapiens
tcctctgctgattct

SEQ ID NO: 59754 - DNA, 15 bp, Homo sapiens
cctctgctgattctt

SEQ ID NO: 59755 - DNA, 15 bp, Homo sapiens
ctctgctgattcttt

SEQ ID NO: 59756 - DNA, 15 bp, Homo sapiens
tctgctgattctttc

SEQ ID NO: 59757 - DNA, 15 bp, Homo sapiens
ctgctgattctttct

SEQ ID NO: 59758 - DNA, 15 bp, Homo sapiens
tgctgattctttctc

SEQ ID NO: 59759 - DNA, 15 bp, Homo sapiens
gctgattctttctcc

SEQ ID NO: 59760 - DNA, 15 bp, Homo sapiens
ctgattctttctcct

SEQ ID NO: 59761 - DNA, 15 bp, Homo sapiens
tgattctttctcctc

SEQ ID NO: 59762 - DNA, 15 bp, Homo sapiens
gattctttctcctca

SEQ ID NO: 59763 - DNA, 15 bp, Homo sapiens
attctttctcctcat

SEQ ID NO: 59764 - DNA, 15 bp, Homo sapiens
ttctttctcctcatc

SEQ ID NO: 59765 - DNA, 15 bp, Homo sapiens
tctttctcctcatca

SEQ ID NO: 59766 - DNA, 15 bp, Homo sapiens
ctttctcctcatcac

SEQ ID NO: 59767 - DNA, 15 bp, Homo sapiens
tttctcctcatcaca

SEQ ID NO: 59768 - DNA, 15 bp, Homo sapiens
ttctcctcatcacaa

SEQ ID NO: 59769 - DNA, 15 bp, Homo sapiens
tctcctcatcacaac

SEQ ID NO: 59770 - DNA, 15 bp, Homo sapiens
ctcctcatcacaact

SEQ ID NO: 59771 - DNA, 15 bp, Homo sapiens
tcctcatcacaactc

SEQ ID NO: 59772 - DNA, 15 bp, Homo sapiens
cctcatcacaactcc

SEQ ID NO: 59773 - DNA, 15 bp, Homo sapiens
ctcatcacaactcca

SEQ ID NO: 59774 - DNA, 15 bp, Homo sapiens
tcatcacaactccaa

SEQ ID NO: 59775 - DNA, 15 bp, Homo sapiens
catcacaactccaaa

SEQ ID NO: 59776 - DNA, 15 bp, Homo sapiens
atcacaactccaaat

SEQ ID NO: 59777 - DNA, 15 bp, Homo sapiens
tcacaactccaaata

SEQ ID NO: 59778 - DNA, 15 bp, Homo sapiens
cacaactccaaatag

SEQ ID NO: 59779 - DNA, 15 bp, Homo sapiens
acaactccaaatagc

SEQ ID NO: 59780 - DNA, 15 bp, Homo sapiens
caactccaaatagca

SEQ ID NO: 59781 - DNA, 15 bp, Homo sapiens
aactccaaatagcag

SEQ ID NO: 59782 - DNA, 15 bp, Homo sapiens
actccaaatagcagg

SEQ ID NO: 59783 - DNA, 15 bp, Homo sapiens
ctccaaatagcaggg

SEQ ID NO: 59784 - DNA, 15 bp, Homo sapiens
tccaaatagcagggg

SEQ ID NO: 59785 - DNA, 15 bp, Homo sapiens
ccaaatagcaggggg

SEQ ID NO: 59786 - DNA, 15 bp, Homo sapiens
caaatagcaggggga

SEQ ID NO: 59787 - DNA, 15 bp, Homo sapiens
aaatagcagggggag

SEQ ID NO: 59788 - DNA, 15 bp, Homo sapiens
aatagcagggggagg

SEQ ID NO: 59789 - DNA, 15 bp, Homo sapiens
atagcagggggaggg

SEQ ID NO: 59790 - DNA, 15 bp, Homo sapiens
tagcagggggagggt

SEQ ID NO: 59791 - DNA, 15 bp, Homo sapiens
agcagggggagggtt

SEQ ID NO: 59792 - DNA, 15 bp, Homo sapiens
gcagggggagggttg

SEQ ID NO: 59793 - DNA, 15 bp, Homo sapiens
cagggggagggttgt

SEQ ID NO: 59794 - DNA, 15 bp, Homo sapiens
agggggagggttgtt

SEQ ID NO: 59795 - DNA, 15 bp, Homo sapiens
gggggagggttgttt

SEQ ID NO: 59796 - DNA, 15 bp, Homo sapiens
ggggagggttgttta

SEQ ID NO: 59797 - DNA, 15 bp, Homo sapiens
gggagggttgtttac

SEQ ID NO: 59798 - DNA, 15 bp, Homo sapiens
ggagggttgtttaca

SEQ ID NO: 59799 - DNA, 15 bp, Homo sapiens
gagggttgtttacac

SEQ ID NO: 59800 - DNA, 15 bp, Homo sapiens
agggttgtttacact

SEQ ID NO: 59801 - DNA, 15 bp, Homo sapiens
gggttgtttacactt

SEQ ID NO: 59802 - DNA, 15 bp, Homo sapiens
ggttgtttacactta

SEQ ID NO: 59803 - DNA, 15 bp, Homo sapiens
gttgtttacacttat

SEQ ID NO: 59804 - DNA, 15 bp, Homo sapiens
ttgtttacacttata

SEQ ID NO: 59805 - DNA, 15 bp, Homo sapiens
tgtttacacttatat

SEQ ID NO: 59806 - DNA, 15 bp, Homo sapiens
gtttacacttatatt

SEQ ID NO: 59807 - DNA, 15 bp, Homo sapiens
tttacacttatattc

SEQ ID NO: 59808 - DNA, 15 bp, Homo sapiens
ttacacttatattca

SEQ ID NO: 59809 - DNA, 15 bp, Homo sapiens
tacacttatattcag

SEQ ID NO: 59810 - DNA, 15 bp, Homo sapiens
acacttatattcagc

SEQ ID NO: 59811 - DNA, 15 bp, Homo sapiens
cacttatattcagca

SEQ ID NO: 59812 - DNA, 15 bp, Homo sapiens
acttatattcagcac

SEQ ID NO: 59813 - DNA, 15 bp, Homo sapiens
cttatattcagcacg

SEQ ID NO: 59814 - DNA, 15 bp, Homo sapiens
ttatattcagcacgc

SEQ ID NO: 59815 - DNA, 15 bp, Homo sapiens
tatattcagcacgcc

SEQ ID NO: 59816 - DNA, 15 bp, Homo sapiens
atattcagcacgccc

SEQ ID NO: 59817 - DNA, 15 bp, Homo sapiens
tattcagcacgccct

SEQ ID NO: 59818 - DNA, 15 bp, Homo sapiens
attcagcacgccctc

SEQ ID NO: 59819 - DNA, 15 bp, Homo sapiens
ttcagcacgccctca

SEQ ID NO: 59820 - DNA, 15 bp, Homo sapiens
tcagcacgccctcac

SEQ ID NO: 59821 - DNA, 15 bp, Homo sapiens
cagcacgccctcacg

SEQ ID NO: 59822 - DNA, 15 bp, Homo sapiens
agcacgccctcacgc

SEQ ID NO: 59823 - DNA, 15 bp, Homo sapiens
gcacgccctcacgca

SEQ ID NO: 59824 - DNA, 15 bp, Homo sapiens
cacgccctcacgcac

SEQ ID NO: 59825 - DNA, 15 bp, Homo sapiens
acgccctcacgcact

SEQ ID NO: 59826 - DNA, 15 bp, Homo sapiens
cgccctcacgcactc

SEQ ID NO: 59827 - DNA, 15 bp, Homo sapiens
gccctcacgcactcg

SEQ ID NO: 59828 - DNA, 15 bp, Homo sapiens
ccctcacgcactcgc

SEQ ID NO: 59829 - DNA, 15 bp, Homo sapiens
cctcacgcactcgcc

SEQ ID NO: 59830 - DNA, 15 bp, Homo sapiens
ctcacgcactcgcct

SEQ ID NO: 59831 - DNA, 15 bp, Homo sapiens
tcacgcactcgcctg

SEQ ID NO: 59832 - DNA, 15 bp, Homo sapiens
cacgcactcgcctgg

SEQ ID NO: 59833 - DNA, 15 bp, Homo sapiens
acgcactcgcctggc

SEQ ID NO: 59834 - DNA, 15 bp, Homo sapiens
cgcactcgcctggct

SEQ ID NO: 59835 - DNA, 15 bp, Homo sapiens
gcactcgcctggctc

SEQ ID NO: 59836 - DNA, 15 bp, Homo sapiens
cactcgcctggctct

SEQ ID NO: 59837 - DNA, 15 bp, Homo sapiens
actcgcctggctctt

SEQ ID NO: 59838 - DNA, 15 bp, Homo sapiens
ctcgcctggctcttc

SEQ ID NO: 59839 - DNA, 15 bp, Homo sapiens
tcgcctggctcttca

SEQ ID NO: 59840 - DNA, 15 bp, Homo sapiens
cgcctggctcttcag

SEQ ID NO: 59841 - DNA, 15 bp, Homo sapiens
gcctggctcttcaga

SEQ ID NO: 59842 - DNA, 15 bp, Homo sapiens
cctggctcttcagac

SEQ ID NO: 59843 - DNA, 15 bp, Homo sapiens
ctggctcttcagacc

SEQ ID NO: 59844 - DNA, 15 bp, Homo sapiens
tggctcttcagacct

SEQ ID NO: 59845 - DNA, 15 bp, Homo sapiens
ggctcttcagacctc

SEQ ID NO: 59846 - DNA, 15 bp, Homo sapiens
gctcttcagacctct

SEQ ID NO: 59847 - DNA, 15 bp, Homo sapiens
ctcttcagacctctc

SEQ ID NO: 59848 - DNA, 15 bp, Homo sapiens
tcttcagacctctcc

SEQ ID NO: 59849 - DNA, 15 bp, Homo sapiens
cttcagacctctccc

SEQ ID NO: 59850 - DNA, 15 bp, Homo sapiens
ttcagacctctcccc

SEQ ID NO: 59851 - DNA, 15 bp, Homo sapiens
tcagacctctcccct

SEQ ID NO: 59852 - DNA, 15 bp, Homo sapiens
cagacctctcccctg

SEQ ID NO: 59853 - DNA, 15 bp, Homo sapiens
agacctctcccctga

SEQ ID NO: 59854 - DNA, 15 bp, Homo sapiens
gacctctcccctgaa

SEQ ID NO: 59855 - DNA, 15 bp, Homo sapiens
acctctcccctgaac

SEQ ID NO: 59856 - DNA, 15 bp, Homo sapiens
cctctcccctgaact

SEQ ID NO: 59857 - DNA, 15 bp, Homo sapiens
ctctcccctgaactc

SEQ ID NO: 59858 - DNA, 15 bp, Homo sapiens
tctcccctgaactcc

SEQ ID NO: 59859 - DNA, 15 bp, Homo sapiens
ctcccctgaactcca

SEQ ID NO: 59860 - DNA, 15 bp, Homo sapiens
tcccctgaactccag

SEQ ID NO: 59861 - DNA, 15 bp, Homo sapiens
cccctgaactccaga

SEQ ID NO: 59862 - DNA, 15 bp, Homo sapiens
ccctgaactccagat

SEQ ID NO: 59863 - DNA, 15 bp, Homo sapiens
cctgaactccagatt

SEQ ID NO: 59864 - DNA, 15 bp, Homo sapiens
ctgaactccagattc

SEQ ID NO: 59865 - DNA, 15 bp, Homo sapiens
tgaactccagattca

SEQ ID NO: 59866 - DNA, 15 bp, Homo sapiens
gaactccagattcat

SEQ ID NO: 59867 - DNA, 15 bp, Homo sapiens
aactccagattcata

SEQ ID NO: 59868 - DNA, 15 bp, Homo sapiens
actccagattcatac

SEQ ID NO: 59869 - DNA, 15 bp, Homo sapiens
ctccagattcataca

SEQ ID NO: 59870 - DNA, 15 bp, Homo sapiens
tccagattcatacat

SEQ ID NO: 59871 - DNA, 15 bp, Homo sapiens
ccagattcatacatc

SEQ ID NO: 59872 - DNA, 15 bp, Homo sapiens
cagattcatacatcc

SEQ ID NO: 59873 - DNA, 15 bp, Homo sapiens
agattcatacatcca

SEQ ID NO: 59874 - DNA, 15 bp, Homo sapiens
gattcatacatccag

SEQ ID NO: 59875 - DNA, 15 bp, Homo sapiens
attcatacatccagc

SEQ ID NO: 59876 - DNA, 15 bp, Homo sapiens
ttcatacatccagct

SEQ ID NO: 59877 - DNA, 15 bp, Homo sapiens
tcatacatccagctg

SEQ ID NO: 59878 - DNA, 15 bp, Homo sapiens
catacatccagctgc

SEQ ID NO: 59879 - DNA, 15 bp, Homo sapiens
atacatccagctgcc

SEQ ID NO: 59880 - DNA, 15 bp, Homo sapiens
tacatccagctgccc

SEQ ID NO: 59881 - DNA, 15 bp, Homo sapiens
acatccagctgccct

SEQ ID NO: 59882 - DNA, 15 bp, Homo sapiens
catccagctgccctt

SEQ ID NO: 59883 - DNA, 15 bp, Homo sapiens
atccagctgcccttt

SEQ ID NO: 59884 - DNA, 15 bp, Homo sapiens
tccagctgcccttta

SEQ ID NO: 59885 - DNA, 15 bp, Homo sapiens
ccagctgccctttag

SEQ ID NO: 59886 - DNA, 15 bp, Homo sapiens
cagctgccctttagg

SEQ ID NO: 59887 - DNA, 15 bp, Homo sapiens
agctgccctttaggc

SEQ ID NO: 59888 - DNA, 15 bp, Homo sapiens
gctgccctttaggcc

SEQ ID NO: 59889 - DNA, 15 bp, Homo sapiens
ctgccctttaggcct

SEQ ID NO: 59890 - DNA, 15 bp, Homo sapiens
tgccctttaggcctc

SEQ ID NO: 59891 - DNA, 15 bp, Homo sapiens
gccctttaggcctct

SEQ ID NO: 59892 - DNA, 15 bp, Homo sapiens
ccctttaggcctcta

SEQ ID NO: 59893 - DNA, 15 bp, Homo sapiens
cctttaggcctctag

SEQ ID NO: 59894 - DNA, 15 bp, Homo sapiens
ctttaggcctctaga

SEQ ID NO: 59895 - DNA, 15 bp, Homo sapiens
tttaggcctctagaa

SEQ ID NO: 59896 - DNA, 15 bp, Homo sapiens
ttaggcctctagaaa

SEQ ID NO: 59897 - DNA, 15 bp, Homo sapiens
taggcctctagaaag

SEQ ID NO: 59898 - DNA, 15 bp, Homo sapiens
aggcctctagaaagc

SEQ ID NO: 59899 - DNA, 15 bp, Homo sapiens
ggcctctagaaagct

SEQ ID NO: 59900 - DNA, 15 bp, Homo sapiens
gcctctagaaagcta

SEQ ID NO: 59901 - DNA, 15 bp, Homo sapiens
cctctagaaagctaa

SEQ ID NO: 59902 - DNA, 15 bp, Homo sapiens
ctctagaaagctaaa

SEQ ID NO: 59903 - DNA, 15 bp, Homo sapiens
tctagaaagctaaat

SEQ ID NO: 59904 - DNA, 15 bp, Homo sapiens
ctagaaagctaaata

SEQ ID NO: 59905 - DNA, 15 bp, Homo sapiens
tagaaagctaaatac

SEQ ID NO: 59906 - DNA, 15 bp, Homo sapiens
agaaagctaaatacc

SEQ ID NO: 59907 - DNA, 15 bp, Homo sapiens
gaaagctaaatacct

SEQ ID NO: 59908 - DNA, 15 bp, Homo sapiens
aaagctaaatacctc

SEQ ID NO: 59909 - DNA, 15 bp, Homo sapiens
aagctaaatacctca

SEQ ID NO: 59910 - DNA, 15 bp, Homo sapiens
agctaaatacctcag

SEQ ID NO: 59911 - DNA, 15 bp, Homo sapiens
gctaaatacctcagt

SEQ ID NO: 59912 - DNA, 15 bp, Homo sapiens
ctaaatacctcagta

SEQ ID NO: 59913 - DNA, 15 bp, Homo sapiens
taaatacctcagtat

SEQ ID NO: 59914 - DNA, 15 bp, Homo sapiens
aaatacctcagtatc

SEQ ID NO: 59915 - DNA, 15 bp, Homo sapiens
aatacctcagtatca

SEQ ID NO: 59916 - DNA, 15 bp, Homo sapiens
atacctcagtatcaa

SEQ ID NO: 59917 - DNA, 15 bp, Homo sapiens
tacctcagtatcaaa

SEQ ID NO: 59918 - DNA, 15 bp, Homo sapiens
acctcagtatcaaaa

SEQ ID NO: 59919 - DNA, 15 bp, Homo sapiens
cctcagtatcaaaaa

SEQ ID NO: 59920 - DNA, 15 bp, Homo sapiens
ctcagtatcaaaaac

SEQ ID NO: 59921 - DNA, 15 bp, Homo sapiens
tcagtatcaaaaaca

SEQ ID NO: 59922 - DNA, 15 bp, Homo sapiens
cagtatcaaaaacat

SEQ ID NO: 59923 - DNA, 15 bp, Homo sapiens
agtatcaaaaacatg

SEQ ID NO: 59924 - DNA, 15 bp, Homo sapiens
gtatcaaaaacatga

SEQ ID NO: 59925 - DNA, 15 bp, Homo sapiens
tatcaaaaacatgag

SEQ ID NO: 59926 - DNA, 15 bp, Homo sapiens
atcaaaaacatgaga

SEQ ID NO: 59927 - DNA, 15 bp, Homo sapiens
tcaaaaacatgagaa

SEQ ID NO: 59928 - DNA, 15 bp, Homo sapiens
caaaaacatgagaaa

SEQ ID NO: 59929 - DNA, 15 bp, Homo sapiens
aaaaacatgagaaac

SEQ ID NO: 59930 - DNA, 15 bp, Homo sapiens
aaaacatgagaaacg

SEQ ID NO: 59931 - DNA, 15 bp, Homo sapiens
aaacatgagaaacgg

SEQ ID NO: 59932 - DNA, 15 bp, Homo sapiens
aacatgagaaacgga

SEQ ID NO: 59933 - DNA, 15 bp, Homo sapiens
acatgagaaacggaa

SEQ ID NO: 59934 - DNA, 15 bp, Homo sapiens
catgagaaacggaag

SEQ ID NO: 59935 - DNA, 15 bp, Homo sapiens
atgagaaacggaagc

SEQ ID NO: 59936 - DNA, 15 bp, Homo sapiens
tgagaaacggaagcc

SEQ ID NO: 59937 - DNA, 15 bp, Homo sapiens
gagaaacggaagcca

SEQ ID NO: 59938 - DNA, 15 bp, Homo sapiens
agaaacggaagccag

SEQ ID NO: 59939 - DNA, 15 bp, Homo sapiens
gaaacggaagccaga

SEQ ID NO: 59940 - DNA, 15 bp, Homo sapiens
aaacggaagccagag

SEQ ID NO: 59941 - DNA, 15 bp, Homo sapiens
aacggaagccagagt

SEQ ID NO: 59942 - DNA, 15 bp, Homo sapiens
acggaagccagagtc

SEQ ID NO: 59943 - DNA, 15 bp, Homo sapiens
cggaagccagagtcc

SEQ ID NO: 59944 - DNA, 15 bp, Homo sapiens
ggaagccagagtcct

SEQ ID NO: 59945 - DNA, 15 bp, Homo sapiens
gaagccagagtcctg

SEQ ID NO: 59946 - DNA, 15 bp, Homo sapiens
aagccagagtcctgg

SEQ ID NO: 59947 - DNA, 15 bp, Homo sapiens
agccagagtcctgga

SEQ ID NO: 59948 - DNA, 15 bp, Homo sapiens
gccagagtcctggat

SEQ ID NO: 59949 - DNA, 15 bp, Homo sapiens
ccagagtcctggatc

SEQ ID NO: 59950 - DNA, 15 bp, Homo sapiens
cagagtcctggatct

SEQ ID NO: 59951 - DNA, 15 bp, Homo sapiens
agagtcctggatctc

SEQ ID NO: 59952 - DNA, 15 bp, Homo sapiens
gagtcctggatctct

SEQ ID NO: 59953 - DNA, 15 bp, Homo sapiens
agtcctggatctctc

SEQ ID NO: 59954 - DNA, 15 bp, Homo sapiens
gtcctggatctctcg

SEQ ID NO: 59955 - DNA, 15 bp, Homo sapiens
tcctggatctctcgc

SEQ ID NO: 59956 - DNA, 15 bp, Homo sapiens
cctggatctctcgcc

SEQ ID NO: 59957 - DNA, 15 bp, Homo sapiens
ctggatctctcgccc

SEQ ID NO: 59958 - DNA, 15 bp, Homo sapiens
tggatctctcgccct

SEQ ID NO: 59959 - DNA, 15 bp, Homo sapiens
ggatctctcgccctt

SEQ ID NO: 59960 - DNA, 15 bp, Homo sapiens
gatctctcgcccttt

SEQ ID NO: 59961 - DNA, 15 bp, Homo sapiens
atctctcgccctttc

SEQ ID NO: 59962 - DNA, 15 bp, Homo sapiens
tctctcgccctttcg

SEQ ID NO: 59963 - DNA, 15 bp, Homo sapiens
ctctcgccctttcgc

SEQ ID NO: 59964 - DNA, 15 bp, Homo sapiens
tctcgccctttcgct

SEQ ID NO: 59965 - DNA, 15 bp, Homo sapiens
ctcgccctttcgctg

SEQ ID NO: 59966 - DNA, 15 bp, Homo sapiens
tcgccctttcgctgt

SEQ ID NO: 59967 - DNA, 15 bp, Homo sapiens
cgccctttcgctgtc

SEQ ID NO: 59968 - DNA, 15 bp, Homo sapiens
gccctttcgctgtcc

SEQ ID NO: 59969 - DNA, 15 bp, Homo sapiens
ccctttcgctgtccc

SEQ ID NO: 59970 - DNA, 15 bp, Homo sapiens
cctttcgctgtcccg

SEQ ID NO: 59971 - DNA, 15 bp, Homo sapiens
ctttcgctgtcccgg

SEQ ID NO: 59972 - DNA, 15 bp, Homo sapiens
tttcgctgtcccggt

SEQ ID NO: 59973 - DNA, 15 bp, Homo sapiens
ttcgctgtcccggtg

SEQ ID NO: 59974 - DNA, 15 bp, Homo sapiens
tcgctgtcccggtgc

SEQ ID NO: 59975 - DNA, 15 bp, Homo sapiens
cgctgtcccggtgcc

SEQ ID NO: 59976 - DNA, 15 bp, Homo sapiens
gctgtcccggtgccc

SEQ ID NO: 59977 - DNA, 15 bp, Homo sapiens
ctgtcccggtgccca

SEQ ID NO: 59978 - DNA, 15 bp, Homo sapiens
tgtcccggtgcccat

SEQ ID NO: 59979 - DNA, 15 bp, Homo sapiens
gtcccggtgcccatg

SEQ ID NO: 59980 - DNA, 15 bp, Homo sapiens
tcccggtgcccatgc

SEQ ID NO: 59981 - DNA, 15 bp, Homo sapiens
cccggtgcccatgcc

SEQ ID NO: 59982 - DNA, 15 bp, Homo sapiens
ccggtgcccatgccc

SEQ ID NO: 59983 - DNA, 15 bp, Homo sapiens
cggtgcccatgccct

SEQ ID NO: 59984 - DNA, 15 bp, Homo sapiens
ggtgcccatgccctt

SEQ ID NO: 59985 - DNA, 15 bp, Homo sapiens
gtgcccatgcccttc

SEQ ID NO: 59986 - DNA, 15 bp, Homo sapiens
tgcccatgcccttca

SEQ ID NO: 59987 - DNA, 15 bp, Homo sapiens
gcccatgcccttcag

SEQ ID NO: 59988 - DNA, 15 bp, Homo sapiens
cccatgcccttcagg

SEQ ID NO: 59989 - DNA, 15 bp, Homo sapiens
ccatgcccttcaggg

SEQ ID NO: 59990 - DNA, 15 bp, Homo sapiens
catgcccttcaggga

SEQ ID NO: 59991 - DNA, 15 bp, Homo sapiens
atgcccttcagggat

SEQ ID NO: 59992 - DNA, 15 bp, Homo sapiens
tgcccttcagggatg

SEQ ID NO: 59993 - DNA, 15 bp, Homo sapiens
gcccttcagggatgg

SEQ ID NO: 59994 - DNA, 15 bp, Homo sapiens
cccttcagggatggc

SEQ ID NO: 59995 - DNA, 15 bp, Homo sapiens
ccttcagggatggca

SEQ ID NO: 59996 - DNA, 15 bp, Homo sapiens
cttcagggatggcac

SEQ ID NO: 59997 - DNA, 15 bp, Homo sapiens
ttcagggatggcacc

SEQ ID NO: 59998 - DNA, 15 bp, Homo sapiens
tcagggatggcacct

SEQ ID NO: 59999 - DNA, 15 bp, Homo sapiens
cagggatggcaccta

SEQ ID NO: 60000 - DNA, 15 bp, Homo sapiens
agggatggcacctag

SEQ ID NO: 60001 - DNA, 15 bp, Homo sapiens
gggatggcacctaga

SEQ ID NO: 60002 - DNA, 15 bp, Homo sapiens
ggatggcacctagac

SEQ ID NO: 60003 - DNA, 15 bp, Homo sapiens
gatggcacctagacc

SEQ ID NO: 60004 - DNA, 15 bp, Homo sapiens
atggcacctagacca

SEQ ID NO: 60005 - DNA, 15 bp, Homo sapiens
tggcacctagaccag

SEQ ID NO: 60006 - DNA, 15 bp, Homo sapiens
ggcacctagaccagc

SEQ ID NO: 60007 - DNA, 15 bp, Homo sapiens
gcacctagaccagct

SEQ ID NO: 60008 - DNA, 15 bp, Homo sapiens
cacctagaccagctc

SEQ ID NO: 60009 - DNA, 15 bp, Homo sapiens
acctagaccagctcc

SEQ ID NO: 60010 - DNA, 15 bp, Homo sapiens
cctagaccagctccc

SEQ ID NO: 60011 - DNA, 15 bp, Homo sapiens
ctagaccagctccct

SEQ ID NO: 60012 - DNA, 15 bp, Homo sapiens
tagaccagctccctg

SEQ ID NO: 60013 - DNA, 15 bp, Homo sapiens
agaccagctccctgc

SEQ ID NO: 60014 - DNA, 15 bp, Homo sapiens
gaccagctccctgca

SEQ ID NO: 60015 - DNA, 15 bp, Homo sapiens
accagctccctgcat

SEQ ID NO: 60016 - DNA, 15 bp, Homo sapiens
ccagctccctgcatc

SEQ ID NO: 60017 - DNA, 15 bp, Homo sapiens
cagctccctgcatcc

SEQ ID NO: 60018 - DNA, 15 bp, Homo sapiens
agctccctgcatccc

SEQ ID NO: 60019 - DNA, 15 bp, Homo sapiens
gctccctgcatccct

SEQ ID NO: 60020 - DNA, 15 bp, Homo sapiens
ctccctgcatccctg

SEQ ID NO: 60021 - DNA, 15 bp, Homo sapiens
tccctgcatccctgc

SEQ ID NO: 60022 - DNA, 15 bp, Homo sapiens
ccctgcatccctgcc

SEQ ID NO: 60023 - DNA, 15 bp, Homo sapiens
cctgcatccctgcct

SEQ ID NO: 60024 - DNA, 15 bp, Homo sapiens
ctgcatccctgccta

SEQ ID NO: 60025 - DNA, 15 bp, Homo sapiens
tgcatccctgcctag

SEQ ID NO: 60026 - DNA, 15 bp, Homo sapiens
gcatccctgcctaga

SEQ ID NO: 60027 - DNA, 15 bp, Homo sapiens
catccctgcctagac

SEQ ID NO: 60028 - DNA, 15 bp, Homo sapiens
atccctgcctagact

SEQ ID NO: 60029 - DNA, 15 bp, Homo sapiens
tccctgcctagactc

SEQ ID NO: 60030 - DNA, 15 bp, Homo sapiens
ccctgcctagactct

SEQ ID NO: 60031 - DNA, 15 bp, Homo sapiens
cctgcctagactctg

SEQ ID NO: 60032 - DNA, 15 bp, Homo sapiens
ctgcctagactctgc

SEQ ID NO: 60033 - DNA, 15 bp, Homo sapiens
tgcctagactctgca

SEQ ID NO: 60034 - DNA, 15 bp, Homo sapiens
gcctagactctgcag

SEQ ID NO: 60035 - DNA, 15 bp, Homo sapiens
cctagactctgcagt

SEQ ID NO: 60036 - DNA, 15 bp, Homo sapiens
ctagactctgcagta

SEQ ID NO: 60037 - DNA, 15 bp, Homo sapiens
tagactctgcagtag

SEQ ID NO: 60038 - DNA, 15 bp, Homo sapiens
agactctgcagtagt

SEQ ID NO: 60039 - DNA, 15 bp, Homo sapiens
gactctgcagtagtc

SEQ ID NO: 60040 - DNA, 15 bp, Homo sapiens
actctgcagtagtct

SEQ ID NO: 60041 - DNA, 15 bp, Homo sapiens
ctctgcagtagtctc

SEQ ID NO: 60042 - DNA, 15 bp, Homo sapiens
tctgcagtagtctca

SEQ ID NO: 60043 - DNA, 15 bp, Homo sapiens
ctgcagtagtctcac

SEQ ID NO: 60044 - DNA, 15 bp, Homo sapiens
tgcagtagtctcacg

SEQ ID NO: 60045 - DNA, 15 bp, Homo sapiens
gcagtagtctcacgt

SEQ ID NO: 60046 - DNA, 15 bp, Homo sapiens
cagtagtctcacgtg

SEQ ID NO: 60047 - DNA, 15 bp, Homo sapiens
agtagtctcacgtgg

SEQ ID NO: 60048 - DNA, 15 bp, Homo sapiens
gtagtctcacgtggc

SEQ ID NO: 60049 - DNA, 15 bp, Homo sapiens
tagtctcacgtggca

SEQ ID NO: 60050 - DNA, 15 bp, Homo sapiens
agtctcacgtggcag

SEQ ID NO: 60051 - DNA, 15 bp, Homo sapiens
gtctcacgtggcaga

SEQ ID NO: 60052 - DNA, 15 bp, Homo sapiens
tctcacgtggcagac

SEQ ID NO: 60053 - DNA, 15 bp, Homo sapiens
ctcacgtggcagacc

SEQ ID NO: 60054 - DNA, 15 bp, Homo sapiens
tcacgtggcagaccc

SEQ ID NO: 60055 - DNA, 15 bp, Homo sapiens
cacgtggcagacccg

SEQ ID NO: 60056 - DNA, 15 bp, Homo sapiens
acgtggcagacccgg

SEQ ID NO: 60057 - DNA, 15 bp, Homo sapiens
cgtggcagacccgga

SEQ ID NO: 60058 - DNA, 15 bp, Homo sapiens
gtggcagacccggag

SEQ ID NO: 60059 - DNA, 15 bp, Homo sapiens
tggcagacccggagg

SEQ ID NO: 60060 - DNA, 15 bp, Homo sapiens
ggcagacccggaggt

SEQ ID NO: 60061 - DNA, 15 bp, Homo sapiens
gcagacccggaggtc

SEQ ID NO: 60062 - DNA, 15 bp, Homo sapiens
cagacccggaggtca

SEQ ID NO: 60063 - DNA, 15 bp, Homo sapiens
agacccggaggtcac

SEQ ID NO: 60064 - DNA, 15 bp, Homo sapiens
gacccggaggtcact

SEQ ID NO: 60065 - DNA, 15 bp, Homo sapiens
acccggaggtcactc

SEQ ID NO: 60066 - DNA, 15 bp, Homo sapiens
cccggaggtcactct

SEQ ID NO: 60067 - DNA, 15 bp, Homo sapiens
ccggaggtcactctc

SEQ ID NO: 60068 - DNA, 15 bp, Homo sapiens
cggaggtcactctcc

SEQ ID NO: 60069 - DNA, 15 bp, Homo sapiens
ggaggtcactctcct

SEQ ID NO: 60070 - DNA, 15 bp, Homo sapiens
gaggtcactctcctc

SEQ ID NO: 60071 - DNA, 15 bp, Homo sapiens
aggtcactctcctct

SEQ ID NO: 60072 - DNA, 15 bp, Homo sapiens
ggtcactctcctctc

SEQ ID NO: 60073 - DNA, 15 bp, Homo sapiens
gtcactctcctctct

SEQ ID NO: 60074 - DNA, 15 bp, Homo sapiens
tcactctcctctctg

SEQ ID NO: 60075 - DNA, 15 bp, Homo sapiens
cactctcctctctgg

SEQ ID NO: 60076 - DNA, 15 bp, Homo sapiens
actctcctctctgga

SEQ ID NO: 60077 - DNA, 15 bp, Homo sapiens
ctctcctctctggat

SEQ ID NO: 60078 - DNA, 15 bp, Homo sapiens
tctcctctctggatg

SEQ ID NO: 60079 - DNA, 15 bp, Homo sapiens
ctcctctctggatgc

SEQ ID NO: 60080 - DNA, 15 bp, Homo sapiens
tcctctctggatgcc

SEQ ID NO: 60081 - DNA, 15 bp, Homo sapiens
cctctctggatgccc

SEQ ID NO: 60082 - DNA, 15 bp, Homo sapiens
ctctctggatgccct

SEQ ID NO: 60083 - DNA, 15 bp, Homo sapiens
tctctggatgccctg

SEQ ID NO: 60084 - DNA, 15 bp, Homo sapiens
ctctggatgccctgc

SEQ ID NO: 60085 - DNA, 15 bp, Homo sapiens
tctggatgccctgcg

SEQ ID NO: 60086 - DNA, 15 bp, Homo sapiens
ctggatgccctgcgg

SEQ ID NO: 60087 - DNA, 15 bp, Homo sapiens
tggatgccctgcgga

SEQ ID NO: 60088 - DNA, 15 bp, Homo sapiens
ggatgccctgcggac

SEQ ID NO: 60089 - DNA, 15 bp, Homo sapiens
gatgccctgcggaca

SEQ ID NO: 60090 - DNA, 15 bp, Homo sapiens
atgccctgcggacac

SEQ ID NO: 60091 - DNA, 15 bp, Homo sapiens
tgccctgcggacact

SEQ ID NO: 60092 - DNA, 15 bp, Homo sapiens
gccctgcggacactc

SEQ ID NO: 60093 - DNA, 15 bp, Homo sapiens
ccctgcggacactcc

SEQ ID NO: 60094 - DNA, 15 bp, Homo sapiens
cctgcggacactccg

SEQ ID NO: 60095 - DNA, 15 bp, Homo sapiens
ctgcggacactccgg

SEQ ID NO: 60096 - DNA, 15 bp, Homo sapiens
tgcggacactccggt

SEQ ID NO: 60097 - DNA, 15 bp, Homo sapiens
gcggacactccggtt

SEQ ID NO: 60098 - DNA, 15 bp, Homo sapiens
cggacactccggtta

SEQ ID NO: 60099 - DNA, 15 bp, Homo sapiens
ggacactccggttag

SEQ ID NO: 60100 - DNA, 15 bp, Homo sapiens
gacactccggttagc

SEQ ID NO: 60101 - DNA, 15 bp, Homo sapiens
acactccggttagcc

SEQ ID NO: 60102 - DNA, 15 bp, Homo sapiens
cactccggttagcct

SEQ ID NO: 60103 - DNA, 15 bp, Homo sapiens
actccggttagcctc

SEQ ID NO: 60104 - DNA, 15 bp, Homo sapiens
ctccggttagcctca

SEQ ID NO: 60105 - DNA, 15 bp, Homo sapiens
tccggttagcctcag

SEQ ID NO: 60106 - DNA, 15 bp, Homo sapiens
ccggttagcctcagc

SEQ ID NO: 60107 - DNA, 15 bp, Homo sapiens
cggttagcctcagct

SEQ ID NO: 60108 - DNA, 15 bp, Homo sapiens
ggttagcctcagctg

SEQ ID NO: 60109 - DNA, 15 bp, Homo sapiens
gttagcctcagctgc

SEQ ID NO: 60110 - DNA, 15 bp, Homo sapiens
ttagcctcagctgca

SEQ ID NO: 60111 - DNA, 15 bp, Homo sapiens
tagcctcagctgcaa

SEQ ID NO: 60112 - DNA, 15 bp, Homo sapiens
agcctcagctgcaag

SEQ ID NO: 60113 - DNA, 15 bp, Homo sapiens
gcctcagctgcaaga

SEQ ID NO: 60114 - DNA, 15 bp, Homo sapiens
cctcagctgcaagag

SEQ ID NO: 60115 - DNA, 15 bp, Homo sapiens
ctcagctgcaagagc

SEQ ID NO: 60116 - DNA, 15 bp, Homo sapiens
tcagctgcaagagcc

SEQ ID NO: 60117 - DNA, 15 bp, Homo sapiens
cagctgcaagagcct

SEQ ID NO: 60118 - DNA, 15 bp, Homo sapiens
agctgcaagagcctc

SEQ ID NO: 60119 - DNA, 15 bp, Homo sapiens
gctgcaagagcctcc

SEQ ID NO: 60120 - DNA, 15 bp, Homo sapiens
ctgcaagagcctcct

SEQ ID NO: 60121 - DNA, 15 bp, Homo sapiens
tgcaagagcctcctc

SEQ ID NO: 60122 - DNA, 15 bp, Homo sapiens
gcaagagcctcctca

SEQ ID NO: 60123 - DNA, 15 bp, Homo sapiens
caagagcctcctcac

SEQ ID NO: 60124 - DNA, 15 bp, Homo sapiens
aagagcctcctcacc

SEQ ID NO: 60125 - DNA, 15 bp, Homo sapiens
agagcctcctcaccc

SEQ ID NO: 60126 - DNA, 15 bp, Homo sapiens
gagcctcctcaccca

SEQ ID NO: 60127 - DNA, 15 bp, Homo sapiens
agcctcctcacccaa

SEQ ID NO: 60128 - DNA, 15 bp, Homo sapiens
gcctcctcacccaag

SEQ ID NO: 60129 - DNA, 15 bp, Homo sapiens
cctcctcacccaagg

SEQ ID NO: 60130 - DNA, 15 bp, Homo sapiens
ctcctcacccaaggt

SEQ ID NO: 60131 - DNA, 15 bp, Homo sapiens
tcctcacccaaggtc

SEQ ID NO: 60132 - DNA, 15 bp, Homo sapiens
cctcacccaaggtca

SEQ ID NO: 60133 - DNA, 15 bp, Homo sapiens
ctcacccaaggtcac

SEQ ID NO: 60134 - DNA, 15 bp, Homo sapiens
tcacccaaggtcacg

SEQ ID NO: 60135 - DNA, 15 bp, Homo sapiens
cacccaaggtcacgc

SEQ ID NO: 60136 - DNA, 15 bp, Homo sapiens
acccaaggtcacgcc

SEQ ID NO: 60137 - DNA, 15 bp, Homo sapiens
cccaaggtcacgcca

SEQ ID NO: 60138 - DNA, 15 bp, Homo sapiens
ccaaggtcacgccat

SEQ ID NO: 60139 - DNA, 15 bp, Homo sapiens
caaggtcacgccatt

SEQ ID NO: 60140 - DNA, 15 bp, Homo sapiens
aaggtcacgccattt

SEQ ID NO: 60141 - DNA, 15 bp, Homo sapiens
aggtcacgccatttc

SEQ ID NO: 60142 - DNA, 15 bp, Homo sapiens
ggtcacgccatttcc

SEQ ID NO: 60143 - DNA, 15 bp, Homo sapiens
gtcacgccatttcca

SEQ ID NO: 60144 - DNA, 15 bp, Homo sapiens
tcacgccatttccag

SEQ ID NO: 60145 - DNA, 15 bp, Homo sapiens
cacgccatttccagg

SEQ ID NO: 60146 - DNA, 15 bp, Homo sapiens
acgccatttccagga

SEQ ID NO: 60147 - DNA, 15 bp, Homo sapiens
cgccatttccaggac

SEQ ID NO: 60148 - DNA, 15 bp, Homo sapiens
gccatttccaggaca

SEQ ID NO: 60149 - DNA, 15 bp, Homo sapiens
ccatttccaggacag

SEQ ID NO: 60150 - DNA, 15 bp, Homo sapiens
catttccaggacagc

SEQ ID NO: 60151 - DNA, 15 bp, Homo sapiens
atttccaggacagca

SEQ ID NO: 60152 - DNA, 15 bp, Homo sapiens
tttccaggacagcac

SEQ ID NO: 60153 - DNA, 15 bp, Homo sapiens
ttccaggacagcacc

SEQ ID NO: 60154 - DNA, 15 bp, Homo sapiens
tccaggacagcaccc

SEQ ID NO: 60155 - DNA, 15 bp, Homo sapiens
ccaggacagcaccct

SEQ ID NO: 60156 - DNA, 15 bp, Homo sapiens
caggacagcaccctg

SEQ ID NO: 60157 - DNA, 15 bp, Homo sapiens
aggacagcaccctgg

SEQ ID NO: 60158 - DNA, 15 bp, Homo sapiens
ggacagcaccctggt

SEQ ID NO: 60159 - DNA, 15 bp, Homo sapiens
gacagcaccctggtg

SEQ ID NO: 60160 - DNA, 15 bp, Homo sapiens
acagcaccctggtga

SEQ ID NO: 60161 - DNA, 15 bp, Homo sapiens
cagcaccctggtgac

SEQ ID NO: 60162 - DNA, 15 bp, Homo sapiens
agcaccctggtgact

SEQ ID NO: 60163 - DNA, 15 bp, Homo sapiens
gcaccctggtgactg

SEQ ID NO: 60164 - DNA, 15 bp, Homo sapiens
caccctggtgactga

SEQ ID NO: 60165 - DNA, 15 bp, Homo sapiens
accctggtgactgag

SEQ ID NO: 60166 - DNA, 15 bp, Homo sapiens
ccctggtgactgagc

SEQ ID NO: 60167 - DNA, 15 bp, Homo sapiens
cctggtgactgagcg

SEQ ID NO: 60168 - DNA, 15 bp, Homo sapiens
ctggtgactgagcga

SEQ ID NO: 60169 - DNA, 15 bp, Homo sapiens
tggtgactgagcgag

SEQ ID NO: 60170 - DNA, 15 bp, Homo sapiens
ggtgactgagcgagg

SEQ ID NO: 60171 - DNA, 15 bp, Homo sapiens
gtgactgagcgaggt

SEQ ID NO: 60172 - DNA, 15 bp, Homo sapiens
tgactgagcgaggta

SEQ ID NO: 60173 - DNA, 15 bp, Homo sapiens
gactgagcgaggtaa

SEQ ID NO: 60174 - DNA, 15 bp, Homo sapiens
actgagcgaggtaag

SEQ ID NO: 60175 - DNA, 15 bp, Homo sapiens
ctgagcgaggtaagg

SEQ ID NO: 60176 - DNA, 15 bp, Homo sapiens
tgagcgaggtaaggg

SEQ ID NO: 60177 - DNA, 15 bp, Homo sapiens
gagcgaggtaagggt

SEQ ID NO: 60178 - DNA, 15 bp, Homo sapiens
agcgaggtaagggta

SEQ ID NO: 60179 - DNA, 15 bp, Homo sapiens
gcgaggtaagggtac

SEQ ID NO: 60180 - DNA, 15 bp, Homo sapiens
cgaggtaagggtaca

SEQ ID NO: 60181 - DNA, 15 bp, Homo sapiens
gaggtaagggtacaa

SEQ ID NO: 60182 - DNA, 15 bp, Homo sapiens
aggtaagggtacaag

SEQ ID NO: 60183 - DNA, 15 bp, Homo sapiens
ggtaagggtacaagg

SEQ ID NO: 60184 - DNA, 15 bp, Homo sapiens
gtaagggtacaaggc

SEQ ID NO: 60185 - DNA, 15 bp, Homo sapiens
taagggtacaaggcc

SEQ ID NO: 60186 - DNA, 15 bp, Homo sapiens
aagggtacaaggccc

SEQ ID NO: 60187 - DNA, 15 bp, Homo sapiens
agggtacaaggccct

SEQ ID NO: 60188 - DNA, 15 bp, Homo sapiens
gggtacaaggccctt

SEQ ID NO: 60189 - DNA, 15 bp, Homo sapiens
ggtacaaggccctta

SEQ ID NO: 60190 - DNA, 15 bp, Homo sapiens
gtacaaggcccttat

SEQ ID NO: 60191 - DNA, 15 bp, Homo sapiens
tacaaggcccttata

SEQ ID NO: 60192 - DNA, 15 bp, Homo sapiens
acaaggcccttatag

SEQ ID NO: 60193 - DNA, 15 bp, Homo sapiens
caaggcccttatagg

SEQ ID NO: 60194 - DNA, 15 bp, Homo sapiens
aaggcccttataggg

SEQ ID NO: 60195 - DNA, 15 bp, Homo sapiens
aggcccttatagggc

SEQ ID NO: 60196 - DNA, 15 bp, Homo sapiens
ggcccttatagggcc

SEQ ID NO: 60197 - DNA, 15 bp, Homo sapiens
gcccttatagggcct

SEQ ID NO: 60198 - DNA, 15 bp, Homo sapiens
cccttatagggcctt

SEQ ID NO: 60199 - DNA, 15 bp, Homo sapiens
ccttatagggccttc

SEQ ID NO: 60200 - DNA, 15 bp, Homo sapiens
cttatagggccttct

SEQ ID NO: 60201 - DNA, 15 bp, Homo sapiens
ttatagggccttctc

SEQ ID NO: 60202 - DNA, 15 bp, Homo sapiens
tatagggccttctct

SEQ ID NO: 60203 - DNA, 15 bp, Homo sapiens
atagggccttctctt

SEQ ID NO: 60204 - DNA, 15 bp, Homo sapiens
tagggccttctcttt

SEQ ID NO: 60205 - DNA, 15 bp, Homo sapiens
agggccttctctttg

SEQ ID NO: 60206 - DNA, 15 bp, Homo sapiens
gggccttctctttga

SEQ ID NO: 60207 - DNA, 15 bp, Homo sapiens
ggccttctctttgac

SEQ ID NO: 60208 - DNA, 15 bp, Homo sapiens
gccttctctttgact

SEQ ID NO: 60209 - DNA, 15 bp, Homo sapiens
ccttctctttgactt

SEQ ID NO: 60210 - DNA, 15 bp, Homo sapiens
cttctctttgacttc

SEQ ID NO: 60211 - DNA, 15 bp, Homo sapiens
ttctctttgacttct

SEQ ID NO: 60212 - DNA, 15 bp, Homo sapiens
tctctttgacttctt

SEQ ID NO: 60213 - DNA, 15 bp, Homo sapiens
ctctttgacttcttc

SEQ ID NO: 60214 - DNA, 15 bp, Homo sapiens
tctttgacttcttcc

SEQ ID NO: 60215 - DNA, 15 bp, Homo sapiens
ctttgacttcttccc

SEQ ID NO: 60216 - DNA, 15 bp, Homo sapiens
tttgacttcttccca

SEQ ID NO: 60217 - DNA, 15 bp, Homo sapiens
ttgacttcttcccac

SEQ ID NO: 60218 - DNA, 15 bp, Homo sapiens
tgacttcttcccacc

SEQ ID NO: 60219 - DNA, 15 bp, Homo sapiens
gacttcttcccacct

SEQ ID NO: 60220 - DNA, 15 bp, Homo sapiens
acttcttcccacctc

SEQ ID NO: 60221 - DNA, 15 bp, Homo sapiens
cttcttcccacctcc

SEQ ID NO: 60222 - DNA, 15 bp, Homo sapiens
ttcttcccacctccc

SEQ ID NO: 60223 - DNA, 15 bp, Homo sapiens
tcttcccacctccct

SEQ ID NO: 60224 - DNA, 15 bp, Homo sapiens
cttcccacctccctt

SEQ ID NO: 60225 - DNA, 15 bp, Homo sapiens
ttcccacctcccttt

SEQ ID NO: 60226 - DNA, 15 bp, Homo sapiens
tcccacctcccttta

SEQ ID NO: 60227 - DNA, 15 bp, Homo sapiens
cccacctccctttat

SEQ ID NO: 60228 - DNA, 15 bp, Homo sapiens
ccacctccctttatg

SEQ ID NO: 60229 - DNA, 15 bp, Homo sapiens
cacctccctttatgg

SEQ ID NO: 60230 - DNA, 15 bp, Homo sapiens
acctccctttatgga

SEQ ID NO: 60231 - DNA, 15 bp, Homo sapiens
cctccctttatggat

SEQ ID NO: 60232 - DNA, 15 bp, Homo sapiens
ctccctttatggatg

SEQ ID NO: 60233 - DNA, 15 bp, Homo sapiens
tccctttatggatgt

SEQ ID NO: 60234 - DNA, 15 bp, Homo sapiens
ccctttatggatgtc

SEQ ID NO: 60235 - DNA, 15 bp, Homo sapiens
cctttatggatgtca

SEQ ID NO: 60236 - DNA, 15 bp, Homo sapiens
ctttatggatgtcag

SEQ ID NO: 60237 - DNA, 15 bp, Homo sapiens
tttatggatgtcagt

SEQ ID NO: 60238 - DNA, 15 bp, Homo sapiens
ttatggatgtcagtt

SEQ ID NO: 60239 - DNA, 15 bp, Homo sapiens
tatggatgtcagttc

SEQ ID NO: 60240 - DNA, 15 bp, Homo sapiens
atggatgtcagttcc

SEQ ID NO: 60241 - DNA, 15 bp, Homo sapiens
tggatgtcagttcct

SEQ ID NO: 60242 - DNA, 15 bp, Homo sapiens
ggatgtcagttcctg

SEQ ID NO: 60243 - DNA, 15 bp, Homo sapiens
gatgtcagttcctga

SEQ ID NO: 60244 - DNA, 15 bp, Homo sapiens
atgtcagttcctgat

SEQ ID NO: 60245 - DNA, 15 bp, Homo sapiens
tgtcagttcctgatg

SEQ ID NO: 60246 - DNA, 15 bp, Homo sapiens
gtcagttcctgatga

SEQ ID NO: 60247 - DNA, 15 bp, Homo sapiens
tcagttcctgatgaa

SEQ ID NO: 60248 - DNA, 15 bp, Homo sapiens
cagttcctgatgaac

SEQ ID NO: 60249 - DNA, 15 bp, Homo sapiens
agttcctgatgaaca

SEQ ID NO: 60250 - DNA, 15 bp, Homo sapiens
gttcctgatgaacat

SEQ ID NO: 60251 - DNA, 15 bp, Homo sapiens
ttcctgatgaacatc

SEQ ID NO: 60252 - DNA, 15 bp, Homo sapiens
tcctgatgaacatct

SEQ ID NO: 60253 - DNA, 15 bp, Homo sapiens
cctgatgaacatctt

SEQ ID NO: 60254 - DNA, 15 bp, Homo sapiens
ctgatgaacatctta

SEQ ID NO: 60255 - DNA, 15 bp, Homo sapiens
tgatgaacatcttac

SEQ ID NO: 60256 - DNA, 15 bp, Homo sapiens
gatgaacatcttaca

SEQ ID NO: 60257 - DNA, 15 bp, Homo sapiens
atgaacatcttacac

SEQ ID NO: 60258 - DNA, 15 bp, Homo sapiens
tgaacatcttacacc

SEQ ID NO: 60259 - DNA, 15 bp, Homo sapiens
gaacatcttacacct

SEQ ID NO: 60260 - DNA, 15 bp, Homo sapiens
aacatcttacacctc

SEQ ID NO: 60261 - DNA, 15 bp, Homo sapiens
acatcttacacctca

SEQ ID NO: 60262 - DNA, 15 bp, Homo sapiens
catcttacacctcaa

SEQ ID NO: 60263 - DNA, 15 bp, Homo sapiens
atcttacacctcaaa

SEQ ID NO: 60264 - DNA, 15 bp, Homo sapiens
tcttacacctcaaac

SEQ ID NO: 60265 - DNA, 15 bp, Homo sapiens
cttacacctcaaacc

SEQ ID NO: 60266 - DNA, 15 bp, Homo sapiens
ttacacctcaaaccg

SEQ ID NO: 60267 - DNA, 15 bp, Homo sapiens
tacacctcaaaccgt

SEQ ID NO: 60268 - DNA, 15 bp, Homo sapiens
acacctcaaaccgtg

SEQ ID NO: 60269 - DNA, 15 bp, Homo sapiens
cacctcaaaccgtga

SEQ ID NO: 60270 - DNA, 15 bp, Homo sapiens
acctcaaaccgtgac

SEQ ID NO: 60271 - DNA, 15 bp, Homo sapiens
cctcaaaccgtgacc

SEQ ID NO: 60272 - DNA, 15 bp, Homo sapiens
ctcaaaccgtgaccc

SEQ ID NO: 60273 - DNA, 15 bp, Homo sapiens
tcaaaccgtgaccca

SEQ ID NO: 60274 - DNA, 15 bp, Homo sapiens
caaaccgtgacccaa

SEQ ID NO: 60275 - DNA, 15 bp, Homo sapiens
aaaccgtgacccaac

SEQ ID NO: 60276 - DNA, 15 bp, Homo sapiens
aaccgtgacccaaca

SEQ ID NO: 60277 - DNA, 15 bp, Homo sapiens
accgtgacccaacat

SEQ ID NO: 60278 - DNA, 15 bp, Homo sapiens
ccgtgacccaacatc

SEQ ID NO: 60279 - DNA, 15 bp, Homo sapiens
cgtgacccaacatct

SEQ ID NO: 60280 - DNA, 15 bp, Homo sapiens
gtgacccaacatctg

SEQ ID NO: 60281 - DNA, 15 bp, Homo sapiens
tgacccaacatctgc

SEQ ID NO: 60282 - DNA, 15 bp, Homo sapiens
gacccaacatctgct

SEQ ID NO: 60283 - DNA, 15 bp, Homo sapiens
acccaacatctgctt

SEQ ID NO: 60284 - DNA, 15 bp, Homo sapiens
cccaacatctgcttc

SEQ ID NO: 60285 - DNA, 15 bp, Homo sapiens
ccaacatctgcttct

SEQ ID NO: 60286 - DNA, 15 bp, Homo sapiens
caacatctgcttctg

SEQ ID NO: 60287 - DNA, 15 bp, Homo sapiens
aacatctgcttctgc

SEQ ID NO: 60288 - DNA, 15 bp, Homo sapiens
acatctgcttctgca

SEQ ID NO: 60289 - DNA, 15 bp, Homo sapiens
catctgcttctgcag

SEQ ID NO: 60290 - DNA, 15 bp, Homo sapiens
atctgcttctgcaga

SEQ ID NO: 60291 - DNA, 15 bp, Homo sapiens
tctgcttctgcagag

SEQ ID NO: 60292 - DNA, 15 bp, Homo sapiens
ctgcttctgcagagc

SEQ ID NO: 60293 - DNA, 15 bp, Homo sapiens
tgcttctgcagagcc

SEQ ID NO: 60294 - DNA, 15 bp, Homo sapiens
gcttctgcagagccc

SEQ ID NO: 60295 - DNA, 15 bp, Homo sapiens
cttctgcagagcccc

SEQ ID NO: 60296 - DNA, 15 bp, Homo sapiens
ttctgcagagccccc

SEQ ID NO: 60297 - DNA, 15 bp, Homo sapiens
tctgcagagcccccc

SEQ ID NO: 60298 - DNA, 15 bp, Homo sapiens
ctgcagagcccccct

SEQ ID NO: 60299 - DNA, 15 bp, Homo sapiens
tgcagagcccccctg

SEQ ID NO: 60300 - DNA, 15 bp, Homo sapiens
gcagagcccccctgt

SEQ ID NO: 60301 - DNA, 15 bp, Homo sapiens
cagagcccccctgtg

SEQ ID NO: 60302 - DNA, 15 bp, Homo sapiens
agagcccccctgtgg

SEQ ID NO: 60303 - DNA, 15 bp, Homo sapiens
gagcccccctgtggc

SEQ ID NO: 60304 - DNA, 15 bp, Homo sapiens
agcccccctgtggca

SEQ ID NO: 60305 - DNA, 15 bp, Homo sapiens
gcccccctgtggcat

SEQ ID NO: 60306 - DNA, 15 bp, Homo sapiens
cccccctgtggcatc

SEQ ID NO: 60307 - DNA, 15 bp, Homo sapiens
ccccctgtggcatct

SEQ ID NO: 60308 - DNA, 15 bp, Homo sapiens
cccctgtggcatctt

SEQ ID NO: 60309 - DNA, 15 bp, Homo sapiens
ccctgtggcatcttg

SEQ ID NO: 60310 - DNA, 15 bp, Homo sapiens
cctgtggcatcttgt

SEQ ID NO: 60311 - DNA, 15 bp, Homo sapiens
ctgtggcatcttgtg

SEQ ID NO: 60312 - DNA, 15 bp, Homo sapiens
tgtggcatcttgtgc

SEQ ID NO: 60313 - DNA, 15 bp, Homo sapiens
gtggcatcttgtgcc

SEQ ID NO: 60314 - DNA, 15 bp, Homo sapiens
tggcatcttgtgccc

SEQ ID NO: 60315 - DNA, 15 bp, Homo sapiens
ggcatcttgtgccct

SEQ ID NO: 60316 - DNA, 15 bp, Homo sapiens
gcatcttgtgccctc

SEQ ID NO: 60317 - DNA, 15 bp, Homo sapiens
catcttgtgccctcc

SEQ ID NO: 60318 - DNA, 15 bp, Homo sapiens
atcttgtgccctcct

SEQ ID NO: 60319 - DNA, 15 bp, Homo sapiens
tcttgtgccctcctg

SEQ ID NO: 60320 - DNA, 15 bp, Homo sapiens
cttgtgccctcctgc

SEQ ID NO: 60321 - DNA, 15 bp, Homo sapiens
ttgtgccctcctgcc

SEQ ID NO: 60322 - DNA, 15 bp, Homo sapiens
tgtgccctcctgccc

SEQ ID NO: 60323 - DNA, 15 bp, Homo sapiens
gtgccctcctgcccc

SEQ ID NO: 60324 - DNA, 15 bp, Homo sapiens
tgccctcctgcccca

SEQ ID NO: 60325 - DNA, 15 bp, Homo sapiens
gccctcctgccccac

SEQ ID NO: 60326 - DNA, 15 bp, Homo sapiens
ccctcctgccccact

SEQ ID NO: 60327 - DNA, 15 bp, Homo sapiens
cctcctgccccactc

SEQ ID NO: 60328 - DNA, 15 bp, Homo sapiens
ctcctgccccactcc

SEQ ID NO: 60329 - DNA, 15 bp, Homo sapiens
tcctgccccactccc

SEQ ID NO: 60330 - DNA, 15 bp, Homo sapiens
cctgccccactccct

SEQ ID NO: 60331 - DNA, 15 bp, Homo sapiens
ctgccccactccctc

SEQ ID NO: 60332 - DNA, 15 bp, Homo sapiens
tgccccactccctct

SEQ ID NO: 60333 - DNA, 15 bp, Homo sapiens
gccccactccctcta

SEQ ID NO: 60334 - DNA, 15 bp, Homo sapiens
ccccactccctctac

SEQ ID NO: 60335 - DNA, 15 bp, Homo sapiens
cccactccctctact

SEQ ID NO: 60336 - DNA, 15 bp, Homo sapiens
ccactccctctactc

SEQ ID NO: 60337 - DNA, 15 bp, Homo sapiens
cactccctctactct

SEQ ID NO: 60338 - DNA, 15 bp, Homo sapiens
actccctctactcta

SEQ ID NO: 60339 - DNA, 15 bp, Homo sapiens
ctccctctactctat

SEQ ID NO: 60340 - DNA, 15 bp, Homo sapiens
tccctctactctata

SEQ ID NO: 60341 - DNA, 15 bp, Homo sapiens
ccctctactctatat

SEQ ID NO: 60342 - DNA, 15 bp, Homo sapiens
cctctactctatatc

SEQ ID NO: 60343 - DNA, 15 bp, Homo sapiens
ctctactctatatct

SEQ ID NO: 60344 - DNA, 15 bp, Homo sapiens
tctactctatatctt

SEQ ID NO: 60345 - DNA, 15 bp, Homo sapiens
ctactctatatcttc

SEQ ID NO: 60346 - DNA, 15 bp, Homo sapiens
tactctatatcttcc

SEQ ID NO: 60347 - DNA, 15 bp, Homo sapiens
actctatatcttccc

SEQ ID NO: 60348 - DNA, 15 bp, Homo sapiens
ctctatatcttccca

SEQ ID NO: 60349 - DNA, 15 bp, Homo sapiens
tctatatcttcccat

SEQ ID NO: 60350 - DNA, 15 bp, Homo sapiens
ctatatcttcccata

SEQ ID NO: 60351 - DNA, 15 bp, Homo sapiens
tatatcttcccatag

SEQ ID NO: 60352 - DNA, 15 bp, Homo sapiens
atatcttcccatagt

SEQ ID NO: 60353 - DNA, 15 bp, Homo sapiens
tatcttcccatagtt

SEQ ID NO: 60354 - DNA, 15 bp, Homo sapiens
atcttcccatagtta

SEQ ID NO: 60355 - DNA, 15 bp, Homo sapiens
tcttcccatagttag

SEQ ID NO: 60356 - DNA, 15 bp, Homo sapiens
cttcccatagttaga

SEQ ID NO: 60357 - DNA, 15 bp, Homo sapiens
ttcccatagttagaa

SEQ ID NO: 60358 - DNA, 15 bp, Homo sapiens
tcccatagttagaat

SEQ ID NO: 60359 - DNA, 15 bp, Homo sapiens
cccatagttagaatg

SEQ ID NO: 60360 - DNA, 15 bp, Homo sapiens
ccatagttagaatgg

SEQ ID NO: 60361 - DNA, 15 bp, Homo sapiens
catagttagaatggg

SEQ ID NO: 60362 - DNA, 15 bp, Homo sapiens
atagttagaatgggc

SEQ ID NO: 60363 - DNA, 15 bp, Homo sapiens
tagttagaatgggct

SEQ ID NO: 60364 - DNA, 15 bp, Homo sapiens
agttagaatgggctt

SEQ ID NO: 60365 - DNA, 15 bp, Homo sapiens
gttagaatgggcttt

SEQ ID NO: 60366 - DNA, 15 bp, Homo sapiens
ttagaatgggctttt

SEQ ID NO: 60367 - DNA, 15 bp, Homo sapiens
tagaatgggcttttt

SEQ ID NO: 60368 - DNA, 15 bp, Homo sapiens
agaatgggctttttt

SEQ ID NO: 60369 - DNA, 15 bp, Homo sapiens
gaatgggcttttttt

SEQ ID NO: 60370 - DNA, 15 bp, Homo sapiens
aatgggctttttttt

SEQ ID NO: 60371 - DNA, 15 bp, Homo sapiens
atgggcttttttttt

SEQ ID NO: 60372 - DNA, 15 bp, Homo sapiens
tgggctttttttttt

SEQ ID NO: 60373 - DNA, 15 bp, Homo sapiens
gggcttttttttttt

SEQ ID NO: 60374 - DNA, 15 bp, Homo sapiens
ggctttttttttttt

SEQ ID NO: 60375 - DNA, 15 bp, Homo sapiens
tttttttttgagata

SEQ ID NO: 60376 - DNA, 15 bp, Homo sapiens
ttttttttgagataa

SEQ ID NO: 60377 - DNA, 15 bp, Homo sapiens
tttttttgagataag

SEQ ID NO: 60378 - DNA, 15 bp, Homo sapiens
ttttttgagataagg

SEQ ID NO: 60379 - DNA, 15 bp, Homo sapiens
tttttgagataaggt

SEQ ID NO: 60380 - DNA, 15 bp, Homo sapiens
ttttgagataaggtc

SEQ ID NO: 60381 - DNA, 15 bp, Homo sapiens
tttgagataaggtct

SEQ ID NO: 60382 - DNA, 15 bp, Homo sapiens
ttgagataaggtctc

SEQ ID NO: 60383 - DNA, 15 bp, Homo sapiens
tgagataaggtctcc

SEQ ID NO: 60384 - DNA, 15 bp, Homo sapiens
gagataaggtctccc

SEQ ID NO: 60385 - DNA, 15 bp, Homo sapiens
agataaggtctccct

SEQ ID NO: 60386 - DNA, 15 bp, Homo sapiens
gataaggtctccctt

SEQ ID NO: 60387 - DNA, 15 bp, Homo sapiens
ataaggtctcccttt

SEQ ID NO: 60388 - DNA, 15 bp, Homo sapiens
taaggtctccctttg

SEQ ID NO: 60389 - DNA, 15 bp, Homo sapiens
aaggtctccctttgt

SEQ ID NO: 60390 - DNA, 15 bp, Homo sapiens
aggtctccctttgtc

SEQ ID NO: 60391 - DNA, 15 bp, Homo sapiens
ggtctccctttgtca

SEQ ID NO: 60392 - DNA, 15 bp, Homo sapiens
gtctccctttgtcac

SEQ ID NO: 60393 - DNA, 15 bp, Homo sapiens
tctccctttgtcacc

SEQ ID NO: 60394 - DNA, 15 bp, Homo sapiens
ctccctttgtcaccc

SEQ ID NO: 60395 - DNA, 15 bp, Homo sapiens
tccctttgtcaccca

SEQ ID NO: 60396 - DNA, 15 bp, Homo sapiens
ccctttgtcacccag

SEQ ID NO: 60397 - DNA, 15 bp, Homo sapiens
cctttgtcacccagg

SEQ ID NO: 60398 - DNA, 15 bp, Homo sapiens
ctttgtcacccaggc

SEQ ID NO: 60399 - DNA, 15 bp, Homo sapiens
tttgtcacccaggct

SEQ ID NO: 60400 - DNA, 15 bp, Homo sapiens
ttgtcacccaggctg

SEQ ID NO: 60401 - DNA, 15 bp, Homo sapiens
tcacccaggctggaa

SEQ ID NO: 60402 - DNA, 15 bp, Homo sapiens
cacccaggctggaat

SEQ ID NO: 60403 - DNA, 15 bp, Homo sapiens
acccaggctggaatg

SEQ ID NO: 60404 - DNA, 15 bp, Homo sapiens
cccaggctggaatgc

SEQ ID NO: 60405 - DNA, 15 bp, Homo sapiens
ccaggctggaatgca

SEQ ID NO: 60406 - DNA, 15 bp, Homo sapiens
caggctggaatgcaa

SEQ ID NO: 60407 - DNA, 15 bp, Homo sapiens
aggctggaatgcaat

SEQ ID NO: 60408 - DNA, 15 bp, Homo sapiens
ggctggaatgcaatg

SEQ ID NO: 60409 - DNA, 15 bp, Homo sapiens
gctggaatgcaatgg

SEQ ID NO: 60410 - DNA, 15 bp, Homo sapiens
ctggaatgcaatggc

SEQ ID NO: 60411 - DNA, 15 bp, Homo sapiens
tggaatgcaatggca

SEQ ID NO: 60412 - DNA, 15 bp, Homo sapiens
ggaatgcaatggcac

SEQ ID NO: 60413 - DNA, 15 bp, Homo sapiens
gaatgcaatggcaca

SEQ ID NO: 60414 - DNA, 15 bp, Homo sapiens
aatgcaatggcacag

SEQ ID NO: 60415 - DNA, 15 bp, Homo sapiens
atgcaatggcacagt

SEQ ID NO: 60416 - DNA, 15 bp, Homo sapiens
tgcaatggcacagtc

SEQ ID NO: 60417 - DNA, 15 bp, Homo sapiens
gcaatggcacagtca

SEQ ID NO: 60418 - DNA, 15 bp, Homo sapiens
caatggcacagtcac

SEQ ID NO: 60419 - DNA, 15 bp, Homo sapiens
aatggcacagtcacg

SEQ ID NO: 60420 - DNA, 15 bp, Homo sapiens
atggcacagtcacga

SEQ ID NO: 60421 - DNA, 15 bp, Homo sapiens
tggcacagtcacgac

SEQ ID NO: 60422 - DNA, 15 bp, Homo sapiens
ggcacagtcacgact

SEQ ID NO: 60423 - DNA, 15 bp, Homo sapiens
gcacagtcacgactc

SEQ ID NO: 60424 - DNA, 15 bp, Homo sapiens
cacagtcacgactca

SEQ ID NO: 60425 - DNA, 15 bp, Homo sapiens
acagtcacgactcac

SEQ ID NO: 60426 - DNA, 15 bp, Homo sapiens
cagtcacgactcact

SEQ ID NO: 60427 - DNA, 15 bp, Homo sapiens
agtcacgactcactg

SEQ ID NO: 60428 - DNA, 15 bp, Homo sapiens
gtcacgactcactgc

SEQ ID NO: 60429 - DNA, 15 bp, Homo sapiens
tcacgactcactgca

SEQ ID NO: 60430 - DNA, 15 bp, Homo sapiens
cacgactcactgcag

SEQ ID NO: 60431 - DNA, 15 bp, Homo sapiens
acgactcactgcagc

SEQ ID NO: 60432 - DNA, 15 bp, Homo sapiens
cgactcactgcagcc

SEQ ID NO: 60433 - DNA, 15 bp, Homo sapiens
actgcagcctcaacc

SEQ ID NO: 60434 - DNA, 15 bp, Homo sapiens
ctgcagcctcaacct

SEQ ID NO: 60435 - DNA, 15 bp, Homo sapiens
cagcctcaacctcct

SEQ ID NO: 60436 - DNA, 15 bp, Homo sapiens
agcctcaacctcctg

SEQ ID NO: 60437 - DNA, 15 bp, Homo sapiens
gcctcaacctcctgg

SEQ ID NO: 60438 - DNA, 15 bp, Homo sapiens
cctcaacctcctggg

SEQ ID NO: 60439 - DNA, 15 bp, Homo sapiens
ctcaacctcctgggc

SEQ ID NO: 60440 - DNA, 15 bp, Homo sapiens
tcaacctcctgggct

SEQ ID NO: 60441 - DNA, 15 bp, Homo sapiens
caacctcctgggctc

SEQ ID NO: 60442 - DNA, 15 bp, Homo sapiens
aacctcctgggctca

SEQ ID NO: 60443 - DNA, 15 bp, Homo sapiens
tgggctcaagcagtc

SEQ ID NO: 60444 - DNA, 15 bp, Homo sapiens
gggctcaagcagtcc

SEQ ID NO: 60445 - DNA, 15 bp, Homo sapiens
ggctcaagcagtcct

SEQ ID NO: 60446 - DNA, 15 bp, Homo sapiens
gctcaagcagtcctc

SEQ ID NO: 60447 - DNA, 15 bp, Homo sapiens
ctcaagcagtcctcc

SEQ ID NO: 60448 - DNA, 15 bp, Homo sapiens
tcaagcagtcctccc

SEQ ID NO: 60449 - DNA, 15 bp, Homo sapiens
caagcagtcctccca

SEQ ID NO: 60450 - DNA, 15 bp, Homo sapiens
aagcagtcctcccac

SEQ ID NO: 60451 - DNA, 15 bp, Homo sapiens
agcagtcctcccacc

SEQ ID NO: 60452 - DNA, 15 bp, Homo sapiens
gcagtcctcccacct

SEQ ID NO: 60453 - DNA, 15 bp, Homo sapiens
cagtcctcccacctc

SEQ ID NO: 60454 - DNA, 15 bp, Homo sapiens
agtcctcccacctca

SEQ ID NO: 60455 - DNA, 15 bp, Homo sapiens
ctcccaagtagctga

SEQ ID NO: 60456 - DNA, 15 bp, Homo sapiens
tcccaagtagctgag

SEQ ID NO: 60457 - DNA, 15 bp, Homo sapiens
cccaagtagctgaga

SEQ ID NO: 60458 - DNA, 15 bp, Homo sapiens
ccaagtagctgagac

SEQ ID NO: 60459 - DNA, 15 bp, Homo sapiens
caagtagctgagact

SEQ ID NO: 60460 - DNA, 15 bp, Homo sapiens
aagtagctgagacta

SEQ ID NO: 60461 - DNA, 15 bp, Homo sapiens
agtagctgagactac

SEQ ID NO: 60462 - DNA, 15 bp, Homo sapiens
gtagctgagactaca

SEQ ID NO: 60463 - DNA, 15 bp, Homo sapiens
tagctgagactacag

SEQ ID NO: 60464 - DNA, 15 bp, Homo sapiens
agctgagactacagg

SEQ ID NO: 60465 - DNA, 15 bp, Homo sapiens
gctgagactacaggt

SEQ ID NO: 60466 - DNA, 15 bp, Homo sapiens
ctgagactacaggta

SEQ ID NO: 60467 - DNA, 15 bp, Homo sapiens
tgagactacaggtat

SEQ ID NO: 60468 - DNA, 15 bp, Homo sapiens
gagactacaggtatg

SEQ ID NO: 60469 - DNA, 15 bp, Homo sapiens
agactacaggtatgc

SEQ ID NO: 60470 - DNA, 15 bp, Homo sapiens
gactacaggtatgca

SEQ ID NO: 60471 - DNA, 15 bp, Homo sapiens
actacaggtatgcac

SEQ ID NO: 60472 - DNA, 15 bp, Homo sapiens
ctacaggtatgcacc

SEQ ID NO: 60473 - DNA, 15 bp, Homo sapiens
tacaggtatgcacca

SEQ ID NO: 60474 - DNA, 15 bp, Homo sapiens
acaggtatgcaccac

SEQ ID NO: 60475 - DNA, 15 bp, Homo sapiens
caggtatgcaccacc

SEQ ID NO: 60476 - DNA, 15 bp, Homo sapiens
aggtatgcaccacca

SEQ ID NO: 60477 - DNA, 15 bp, Homo sapiens
ggtatgcaccaccac

SEQ ID NO: 60478 - DNA, 15 bp, Homo sapiens
gtatgcaccaccaca

SEQ ID NO: 60479 - DNA, 15 bp, Homo sapiens
tatgcaccaccacac

SEQ ID NO: 60480 - DNA, 15 bp, Homo sapiens
atgcaccaccacacc

SEQ ID NO: 60481 - DNA, 15 bp, Homo sapiens
tgcaccaccacacct

SEQ ID NO: 60482 - DNA, 15 bp, Homo sapiens
gcaccaccacacctg

SEQ ID NO: 60483 - DNA, 15 bp, Homo sapiens
caccaccacacctgg

SEQ ID NO: 60484 - DNA, 15 bp, Homo sapiens
accaccacacctggc

SEQ ID NO: 60485 - DNA, 15 bp, Homo sapiens
ccaccacacctggct

SEQ ID NO: 60486 - DNA, 15 bp, Homo sapiens
caccacacctggcta

SEQ ID NO: 60487 - DNA, 15 bp, Homo sapiens
accacacctggctaa

SEQ ID NO: 60488 - DNA, 15 bp, Homo sapiens
ccacacctggctaat

SEQ ID NO: 60489 - DNA, 15 bp, Homo sapiens
cacacctggctaatt

SEQ ID NO: 60490 - DNA, 15 bp, Homo sapiens
acacctggctaattt

SEQ ID NO: 60491 - DNA, 15 bp, Homo sapiens
cacctggctaatttt

SEQ ID NO: 60492 - DNA, 15 bp, Homo sapiens
acctggctaattttt

SEQ ID NO: 60493 - DNA, 15 bp, Homo sapiens
ctggctaatttttat

SEQ ID NO: 60494 - DNA, 15 bp, Homo sapiens
tggctaatttttata

SEQ ID NO: 60495 - DNA, 15 bp, Homo sapiens
ggctaatttttatat

SEQ ID NO: 60496 - DNA, 15 bp, Homo sapiens
tttttatattttttg

SEQ ID NO: 60497 - DNA, 15 bp, Homo sapiens
ttttatattttttgt

SEQ ID NO: 60498 - DNA, 15 bp, Homo sapiens
tttatattttttgta

SEQ ID NO: 60499 - DNA, 15 bp, Homo sapiens
ttatattttttgtag

SEQ ID NO: 60500 - DNA, 15 bp, Homo sapiens
tatattttttgtaga

SEQ ID NO: 60501 - DNA, 15 bp, Homo sapiens
atattttttgtagag

SEQ ID NO: 60502 - DNA, 15 bp, Homo sapiens
tattttttgtagaga

SEQ ID NO: 60503 - DNA, 15 bp, Homo sapiens
attttttgtagagac

SEQ ID NO: 60504 - DNA, 15 bp, Homo sapiens
ttttttgtagagact

SEQ ID NO: 60505 - DNA, 15 bp, Homo sapiens
tttttgtagagactg

SEQ ID NO: 60506 - DNA, 15 bp, Homo sapiens
ttttgtagagactgg

SEQ ID NO: 60507 - DNA, 15 bp, Homo sapiens
tttgtagagactggg

SEQ ID NO: 60508 - DNA, 15 bp, Homo sapiens
ttgtagagactgggg

SEQ ID NO: 60509 - DNA, 15 bp, Homo sapiens
tgtagagactggggt

SEQ ID NO: 60510 - DNA, 15 bp, Homo sapiens
gtagagactggggtc

SEQ ID NO: 60511 - DNA, 15 bp, Homo sapiens
tagagactggggtct

SEQ ID NO: 60512 - DNA, 15 bp, Homo sapiens
agagactggggtctc

SEQ ID NO: 60513 - DNA, 15 bp, Homo sapiens
gagactggggtctcc

SEQ ID NO: 60514 - DNA, 15 bp, Homo sapiens
agactggggtctccc

SEQ ID NO: 60515 - DNA, 15 bp, Homo sapiens
gactggggtctccct

SEQ ID NO: 60516 - DNA, 15 bp, Homo sapiens
actggggtctcccta

SEQ ID NO: 60517 - DNA, 15 bp, Homo sapiens
ctggggtctccctat

SEQ ID NO: 60518 - DNA, 15 bp, Homo sapiens
tggggtctccctatg

SEQ ID NO: 60519 - DNA, 15 bp, Homo sapiens
ggggtctccctatgt

SEQ ID NO: 60520 - DNA, 15 bp, Homo sapiens
gggtctccctatgtt

SEQ ID NO: 60521 - DNA, 15 bp, Homo sapiens
ggtctccctatgttg

SEQ ID NO: 60522 - DNA, 15 bp, Homo sapiens
gtctccctatgttgc

SEQ ID NO: 60523 - DNA, 15 bp, Homo sapiens
tctccctatgttgcc

SEQ ID NO: 60524 - DNA, 15 bp, Homo sapiens
ctccctatgttgccc

SEQ ID NO: 60525 - DNA, 15 bp, Homo sapiens
tccctatgttgcccg

SEQ ID NO: 60526 - DNA, 15 bp, Homo sapiens
gctgggcgtggtggt

SEQ ID NO: 60527 - DNA, 15 bp, Homo sapiens
ctgggcgtggtggtg

SEQ ID NO: 60528 - DNA, 15 bp, Homo sapiens
tgggcgtggtggtgc

SEQ ID NO: 60529 - DNA, 15 bp, Homo sapiens
gggcgtggtggtgcg

SEQ ID NO: 60530 - DNA, 15 bp, Homo sapiens
ggcgtggtggtgcgc

SEQ ID NO: 60531 - DNA, 15 bp, Homo sapiens
gcgtggtggtgcgca

SEQ ID NO: 60532 - DNA, 15 bp, Homo sapiens
cgtggtggtgcgcat

SEQ ID NO: 60533 - DNA, 15 bp, Homo sapiens
gtggtggtgcgcatc

SEQ ID NO: 60534 - DNA, 15 bp, Homo sapiens
tggtggtgcgcatct

SEQ ID NO: 60535 - DNA, 15 bp, Homo sapiens
ggtggtgcgcatctg

SEQ ID NO: 60536 - DNA, 15 bp, Homo sapiens
gtggtgcgcatctgt

SEQ ID NO: 60537 - DNA, 15 bp, Homo sapiens
tggtgcgcatctgta

SEQ ID NO: 60538 - DNA, 15 bp, Homo sapiens
ggtgcgcatctgtaa

SEQ ID NO: 60539 - DNA, 15 bp, Homo sapiens
gtgcgcatctgtaat

SEQ ID NO: 60540 - DNA, 15 bp, Homo sapiens
tgcgcatctgtaatc

SEQ ID NO: 60541 - DNA, 15 bp, Homo sapiens
gcgcatctgtaatct

SEQ ID NO: 60542 - DNA, 15 bp, Homo sapiens
cgcatctgtaatctc

SEQ ID NO: 60543 - DNA, 15 bp, Homo sapiens
gcatctgtaatctca

SEQ ID NO: 60544 - DNA, 15 bp, Homo sapiens
catctgtaatctcag

SEQ ID NO: 60545 - DNA, 15 bp, Homo sapiens
atctgtaatctcagc

SEQ ID NO: 60546 - DNA, 15 bp, Homo sapiens
tctgtaatctcagct

SEQ ID NO: 60547 - DNA, 15 bp, Homo sapiens
ctgtaatctcagcta

SEQ ID NO: 60548 - DNA, 15 bp, Homo sapiens
tgtaatctcagctac

SEQ ID NO: 60549 - DNA, 15 bp, Homo sapiens
gtaatctcagctact

SEQ ID NO: 60550 - DNA, 15 bp, Homo sapiens
taatctcagctactc

SEQ ID NO: 60551 - DNA, 15 bp, Homo sapiens
aatctcagctactcg

SEQ ID NO: 60552 - DNA, 15 bp, Homo sapiens
atctcagctactcgg

SEQ ID NO: 60553 - DNA, 15 bp, Homo sapiens
tctcagctactcggg

SEQ ID NO: 60554 - DNA, 15 bp, Homo sapiens
ctcagctactcggga

SEQ ID NO: 60555 - DNA, 15 bp, Homo sapiens
tcagctactcgggag

SEQ ID NO: 60556 - DNA, 15 bp, Homo sapiens
agaatcgcttgaact

SEQ ID NO: 60557 - DNA, 15 bp, Homo sapiens
gaatcgcttgaactc

SEQ ID NO: 60558 - DNA, 15 bp, Homo sapiens
aatcgcttgaactca

SEQ ID NO: 60559 - DNA, 15 bp, Homo sapiens
atcgcttgaactcag

SEQ ID NO: 60560 - DNA, 15 bp, Homo sapiens
tcgcttgaactcagg

SEQ ID NO: 60561 - DNA, 15 bp, Homo sapiens
cgcttgaactcagga

SEQ ID NO: 60562 - DNA, 15 bp, Homo sapiens
gcttgaactcaggag

SEQ ID NO: 60563 - DNA, 15 bp, Homo sapiens
cttgaactcaggagg

SEQ ID NO: 60564 - DNA, 15 bp, Homo sapiens
ttgaactcaggaggg

SEQ ID NO: 60565 - DNA, 15 bp, Homo sapiens
tgaactcaggaggga

SEQ ID NO: 60566 - DNA, 15 bp, Homo sapiens
gaactcaggagggag

SEQ ID NO: 60567 - DNA, 15 bp, Homo sapiens
aactcaggagggagg

SEQ ID NO: 60568 - DNA, 15 bp, Homo sapiens
actcaggagggaggc

SEQ ID NO: 60569 - DNA, 15 bp, Homo sapiens
ctcaggagggaggca

SEQ ID NO: 60570 - DNA, 15 bp, Homo sapiens
tcaggagggaggcag

SEQ ID NO: 60571 - DNA, 15 bp, Homo sapiens
caggagggaggcaga

SEQ ID NO: 60572 - DNA, 15 bp, Homo sapiens
aggagggaggcagag

SEQ ID NO: 60573 - DNA, 15 bp, Homo sapiens
ggagggaggcagagc

SEQ ID NO: 60574 - DNA, 15 bp, Homo sapiens
gagggaggcagagcc

SEQ ID NO: 60575 - DNA, 15 bp, Homo sapiens
agggaggcagagcct

SEQ ID NO: 60576 - DNA, 15 bp, Homo sapiens
gggaggcagagcctg

SEQ ID NO: 60577 - DNA, 15 bp, Homo sapiens
ggaggcagagcctgt

SEQ ID NO: 60578 - DNA, 15 bp, Homo sapiens
gaggcagagcctgta

SEQ ID NO: 60579 - DNA, 15 bp, Homo sapiens
aggcagagcctgtat

SEQ ID NO: 60580 - DNA, 15 bp, Homo sapiens
ggcagagcctgtatg

SEQ ID NO: 60581 - DNA, 15 bp, Homo sapiens
gcagagcctgtatgc

SEQ ID NO: 60582 - DNA, 15 bp, Homo sapiens
cagagcctgtatgca

SEQ ID NO: 60583 - DNA, 15 bp, Homo sapiens
agagcctgtatgcag

SEQ ID NO: 60584 - DNA, 15 bp, Homo sapiens
gagcctgtatgcagt

SEQ ID NO: 60585 - DNA, 15 bp, Homo sapiens
agcctgtatgcagta

SEQ ID NO: 60586 - DNA, 15 bp, Homo sapiens
gcctgtatgcagtaa

SEQ ID NO: 60587 - DNA, 15 bp, Homo sapiens
cctgtatgcagtaag

SEQ ID NO: 60588 - DNA, 15 bp, Homo sapiens
ctgtatgcagtaagc

SEQ ID NO: 60589 - DNA, 15 bp, Homo sapiens
tgtatgcagtaagcc

SEQ ID NO: 60590 - DNA, 15 bp, Homo sapiens
gtatgcagtaagccg

SEQ ID NO: 60591 - DNA, 15 bp, Homo sapiens
tatgcagtaagccga

SEQ ID NO: 60592 - DNA, 15 bp, Homo sapiens
atgcagtaagccgag

SEQ ID NO: 60593 - DNA, 15 bp, Homo sapiens
tgcagtaagccgaga

SEQ ID NO: 60594 - DNA, 15 bp, Homo sapiens
gcagtaagccgagat

SEQ ID NO: 60595 - DNA, 15 bp, Homo sapiens
cagtaagccgagatt

SEQ ID NO: 60596 - DNA, 15 bp, Homo sapiens
agtaagccgagattg

SEQ ID NO: 60597 - DNA, 15 bp, Homo sapiens
gtaagccgagattgc

SEQ ID NO: 60598 - DNA, 15 bp, Homo sapiens
taagccgagattgcg

SEQ ID NO: 60599 - DNA, 15 bp, Homo sapiens
aagccgagattgcgc

SEQ ID NO: 60600 - DNA, 15 bp, Homo sapiens
agccgagattgcgcc

SEQ ID NO: 60601 - DNA, 15 bp, Homo sapiens
gccgagattgcgcca

SEQ ID NO: 60602 - DNA, 15 bp, Homo sapiens
ccgagattgcgccac

SEQ ID NO: 60603 - DNA, 15 bp, Homo sapiens
cgagattgcgccacc

SEQ ID NO: 60604 - DNA, 15 bp, Homo sapiens
gagattgcgccacca

SEQ ID NO: 60605 - DNA, 15 bp, Homo sapiens
agattgcgccaccac

SEQ ID NO: 60606 - DNA, 15 bp, Homo sapiens
gattgcgccaccaca

SEQ ID NO: 60607 - DNA, 15 bp, Homo sapiens
attgcgccaccacac

SEQ ID NO: 60608 - DNA, 15 bp, Homo sapiens
ttgcgccaccacacc

SEQ ID NO: 60609 - DNA, 15 bp, Homo sapiens
tgcgccaccacaccc

SEQ ID NO: 60610 - DNA, 15 bp, Homo sapiens
gcgccaccacacccc

SEQ ID NO: 60611 - DNA, 15 bp, Homo sapiens
cgccaccacacccca

SEQ ID NO: 60612 - DNA, 15 bp, Homo sapiens
gccaccacaccccag

SEQ ID NO: 60613 - DNA, 15 bp, Homo sapiens
ccaccacaccccagc

SEQ ID NO: 60614 - DNA, 15 bp, Homo sapiens
caccacaccccagca

SEQ ID NO: 60615 - DNA, 15 bp, Homo sapiens
accacaccccagcat

SEQ ID NO: 60616 - DNA, 15 bp, Homo sapiens
ccacaccccagcatg

SEQ ID NO: 60617 - DNA, 15 bp, Homo sapiens
cacaccccagcatgg

SEQ ID NO: 60618 - DNA, 15 bp, Homo sapiens
acaccccagcatggg

SEQ ID NO: 60619 - DNA, 15 bp, Homo sapiens
caccccagcatgggt

SEQ ID NO: 60620 - DNA, 15 bp, Homo sapiens
accccagcatgggtg

SEQ ID NO: 60621 - DNA, 15 bp, Homo sapiens
ccccagcatgggtga

SEQ ID NO: 60622 - DNA, 15 bp, Homo sapiens
cccagcatgggtgac

SEQ ID NO: 60623 - DNA, 15 bp, Homo sapiens
catgggtgacagagc

SEQ ID NO: 60624 - DNA, 15 bp, Homo sapiens
atgggtgacagagca

SEQ ID NO: 60625 - DNA, 15 bp, Homo sapiens
tgggtgacagagcaa

SEQ ID NO: 60626 - DNA, 15 bp, Homo sapiens
gggtgacagagcaag

SEQ ID NO: 60627 - DNA, 15 bp, Homo sapiens
ggtgacagagcaaga

SEQ ID NO: 60628 - DNA, 15 bp, Homo sapiens
gtgacagagcaagac

SEQ ID NO: 60629 - DNA, 15 bp, Homo sapiens
tgacagagcaagact

SEQ ID NO: 60630 - DNA, 15 bp, Homo sapiens
gacagagcaagactc

SEQ ID NO: 60631 - DNA, 15 bp, Homo sapiens
acagagcaagactcc

SEQ ID NO: 60632 - DNA, 15 bp, Homo sapiens
cagagcaagactccg

SEQ ID NO: 60633 - DNA, 15 bp, Homo sapiens
agagcaagactccgt

SEQ ID NO: 60634 - DNA, 15 bp, Homo sapiens
gagcaagactccgtc

SEQ ID NO: 60635 - DNA, 15 bp, Homo sapiens
agcaagactccgtct

SEQ ID NO: 60636 - DNA, 15 bp, Homo sapiens
gcaagactccgtctc

SEQ ID NO: 60637 - DNA, 15 bp, Homo sapiens
caagactccgtctca

SEQ ID NO: 60638 - DNA, 15 bp, Homo sapiens
aagactccgtctcaa

SEQ ID NO: 60639 - DNA, 15 bp, Homo sapiens
aaaaaaaaaaaagtt

SEQ ID NO: 60640 - DNA, 15 bp, Homo sapiens
aaaaaaaaaaagttc

SEQ ID NO: 60641 - DNA, 15 bp, Homo sapiens
aaaaaaaaaagttca

SEQ ID NO: 60642 - DNA, 15 bp, Homo sapiens
aaaaaaaaagttcat

SEQ ID NO: 60643 - DNA, 15 bp, Homo sapiens
aaaaaaaagttcatt

SEQ ID NO: 60644 - DNA, 15 bp, Homo sapiens
aaaaaaagttcattc

SEQ ID NO: 60645 - DNA, 15 bp, Homo sapiens
aaaaaagttcattca

SEQ ID NO: 60646 - DNA, 15 bp, Homo sapiens
aaaaagttcattcat

SEQ ID NO: 60647 - DNA, 15 bp, Homo sapiens
aaaagttcattcatt

SEQ ID NO: 60648 - DNA, 15 bp, Homo sapiens
aaagttcattcattg

SEQ ID NO: 60649 - DNA, 15 bp, Homo sapiens
aagttcattcattgt

SEQ ID NO: 60650 - DNA, 15 bp, Homo sapiens
agttcattcattgta

SEQ ID NO: 60651 - DNA, 15 bp, Homo sapiens
gttcattcattgtac

SEQ ID NO: 60652 - DNA, 15 bp, Homo sapiens
ttcattcattgtaca

SEQ ID NO: 60653 - DNA, 15 bp, Homo sapiens
tcattcattgtacac

SEQ ID NO: 60654 - DNA, 15 bp, Homo sapiens
cattcattgtacact

SEQ ID NO: 60655 - DNA, 15 bp, Homo sapiens
attcattgtacactt

SEQ ID NO: 60656 - DNA, 15 bp, Homo sapiens
ttcattgtacactta

SEQ ID NO: 60657 - DNA, 15 bp, Homo sapiens
tcattgtacacttag

SEQ ID NO: 60658 - DNA, 15 bp, Homo sapiens
cattgtacacttaga

SEQ ID NO: 60659 - DNA, 15 bp, Homo sapiens
attgtacacttagaa

SEQ ID NO: 60660 - DNA, 15 bp, Homo sapiens
ttgtacacttagaaa

SEQ ID NO: 60661 - DNA, 15 bp, Homo sapiens
tgtacacttagaaat

SEQ ID NO: 60662 - DNA, 15 bp, Homo sapiens
gtacacttagaaata

SEQ ID NO: 60663 - DNA, 15 bp, Homo sapiens
tacacttagaaatag

SEQ ID NO: 60664 - DNA, 15 bp, Homo sapiens
acacttagaaatagt

SEQ ID NO: 60665 - DNA, 15 bp, Homo sapiens
cacttagaaatagtt

SEQ ID NO: 60666 - DNA, 15 bp, Homo sapiens
acttagaaatagtta

SEQ ID NO: 60667 - DNA, 15 bp, Homo sapiens
cttagaaatagttaa

SEQ ID NO: 60668 - DNA, 15 bp, Homo sapiens
ttagaaatagttaaa

SEQ ID NO: 60669 - DNA, 15 bp, Homo sapiens
tagaaatagttaaaa

SEQ ID NO: 60670 - DNA, 15 bp, Homo sapiens
agaaatagttaaaaa

SEQ ID NO: 60671 - DNA, 15 bp, Homo sapiens
gaaatagttaaaaag

SEQ ID NO: 60672 - DNA, 15 bp, Homo sapiens
aaatagttaaaaagg

SEQ ID NO: 60673 - DNA, 15 bp, Homo sapiens
aatagttaaaaaggt

SEQ ID NO: 60674 - DNA, 15 bp, Homo sapiens
atagttaaaaaggta

SEQ ID NO: 60675 - DNA, 15 bp, Homo sapiens
tagttaaaaaggtaa

SEQ ID NO: 60676 - DNA, 15 bp, Homo sapiens
agttaaaaaggtaaa

SEQ ID NO: 60677 - DNA, 15 bp, Homo sapiens
gttaaaaaggtaaac

SEQ ID NO: 60678 - DNA, 15 bp, Homo sapiens
ttaaaaaggtaaact

SEQ ID NO: 60679 - DNA, 15 bp, Homo sapiens
taaaaaggtaaactt

SEQ ID NO: 60680 - DNA, 15 bp, Homo sapiens
aaaaaggtaaacttt

SEQ ID NO: 60681 - DNA, 15 bp, Homo sapiens
aaaaggtaaactttg

SEQ ID NO: 60682 - DNA, 15 bp, Homo sapiens
aaaggtaaactttgt

SEQ ID NO: 60683 - DNA, 15 bp, Homo sapiens
aaggtaaactttgtt

SEQ ID NO: 60684 - DNA, 15 bp, Homo sapiens
aggtaaactttgttt

SEQ ID NO: 60685 - DNA, 15 bp, Homo sapiens
ggtaaactttgtttt

SEQ ID NO: 60686 - DNA, 15 bp, Homo sapiens
gtaaactttgttttg

SEQ ID NO: 60687 - DNA, 15 bp, Homo sapiens
taaactttgttttgt

SEQ ID NO: 60688 - DNA, 15 bp, Homo sapiens
aaactttgttttgtg

SEQ ID NO: 60689 - DNA, 15 bp, Homo sapiens
aactttgttttgtgt

SEQ ID NO: 60690 - DNA, 15 bp, Homo sapiens
actttgttttgtgtg

SEQ ID NO: 60691 - DNA, 15 bp, Homo sapiens
ctttgttttgtgtgt

SEQ ID NO: 60692 - DNA, 15 bp, Homo sapiens
tttgttttgtgtgtg

SEQ ID NO: 60693 - DNA, 15 bp, Homo sapiens
ttgttttgtgtgtgt

SEQ ID NO: 60694 - DNA, 15 bp, Homo sapiens
tgttttgtgtgtgtg

SEQ ID NO: 60695 - DNA, 15 bp, Homo sapiens
gttttgtgtgtgtgt

SEQ ID NO: 60696 - DNA, 15 bp, Homo sapiens
ttttgtgtgtgtgtg

SEQ ID NO: 60697 - DNA, 15 bp, Homo sapiens
tttgtgtgtgtgtgt

SEQ ID NO: 60698 - DNA, 15 bp, Homo sapiens
ttgtgtgtgtgtgta

SEQ ID NO: 60699 - DNA, 15 bp, Homo sapiens
tgtgtgtgtgtgtat

SEQ ID NO: 60700 - DNA, 15 bp, Homo sapiens
gtgtgtgtgtgtata

SEQ ID NO: 60701 - DNA, 15 bp, Homo sapiens
tgtgtgtgtgtatat

SEQ ID NO: 60702 - DNA, 15 bp, Homo sapiens
gtgtgtgtgtatata

SEQ ID NO: 60703 - DNA, 15 bp, Homo sapiens
tgtgtgtgtatatat

SEQ ID NO: 60704 - DNA, 15 bp, Homo sapiens
gtgtgtgtatatata

SEQ ID NO: 60705 - DNA, 15 bp, Homo sapiens
tgtgtgtatatatat

SEQ ID NO: 60706 - DNA, 15 bp, Homo sapiens
gtgtgtatatatata

SEQ ID NO: 60707 - DNA, 15 bp, Homo sapiens
tgtgtatatatatat

SEQ ID NO: 60708 - DNA, 15 bp, Homo sapiens
gtgtatatatatata

SEQ ID NO: 60709 - DNA, 15 bp, Homo sapiens
tgtatatatatatat

SEQ ID NO: 60710 - DNA, 15 bp, Homo sapiens
gtatatatatatata

SEQ ID NO: 60711 - DNA, 15 bp, Homo sapiens
tatatatatatatat

SEQ ID NO: 60712 - DNA, 15 bp, Homo sapiens
atatatatatatata

SEQ ID NO: 60713 - DNA, 15 bp, Homo sapiens
atatatatatatatg

SEQ ID NO: 60714 - DNA, 15 bp, Homo sapiens
tatatatatatatgt

SEQ ID NO: 60715 - DNA, 15 bp, Homo sapiens
atatatatatatgta

SEQ ID NO: 60716 - DNA, 15 bp, Homo sapiens
tatatatatatgtat

SEQ ID NO: 60717 - DNA, 15 bp, Homo sapiens
atatatatatgtatt

SEQ ID NO: 60718 - DNA, 15 bp, Homo sapiens
tatatatatgtattt

SEQ ID NO: 60719 - DNA, 15 bp, Homo sapiens
atatatatgtatttt

SEQ ID NO: 60720 - DNA, 15 bp, Homo sapiens
tatatatgtattttt

SEQ ID NO: 60721 - DNA, 15 bp, Homo sapiens
atatatgtatttttt

SEQ ID NO: 60722 - DNA, 15 bp, Homo sapiens
tatatgtattttttt

SEQ ID NO: 60723 - DNA, 15 bp, Homo sapiens
atatgtatttttttt

SEQ ID NO: 60724 - DNA, 15 bp, Homo sapiens
tatgtattttttttt

SEQ ID NO: 60725 - DNA, 15 bp, Homo sapiens
atgtatttttttttg

SEQ ID NO: 60726 - DNA, 15 bp, Homo sapiens
tgtatttttttttga

SEQ ID NO: 60727 - DNA, 15 bp, Homo sapiens
gtatttttttttgag

SEQ ID NO: 60728 - DNA, 15 bp, Homo sapiens
tatttttttttgaga

SEQ ID NO: 60729 - DNA, 15 bp, Homo sapiens
atttttttttgagac

SEQ ID NO: 60730 - DNA, 15 bp, Homo sapiens
ttttttttgagacat

SEQ ID NO: 60731 - DNA, 15 bp, Homo sapiens
tttttttgagacata

SEQ ID NO: 60732 - DNA, 15 bp, Homo sapiens
ttttttgagacatat

SEQ ID NO: 60733 - DNA, 15 bp, Homo sapiens
tttttgagacatata

SEQ ID NO: 60734 - DNA, 15 bp, Homo sapiens
ttttgagacatatat

SEQ ID NO: 60735 - DNA, 15 bp, Homo sapiens
tttgagacatatatg

SEQ ID NO: 60736 - DNA, 15 bp, Homo sapiens
ttgagacatatatgt

SEQ ID NO: 60737 - DNA, 15 bp, Homo sapiens
tgagacatatatgtg

SEQ ID NO: 60738 - DNA, 15 bp, Homo sapiens
gagacatatatgtgt

SEQ ID NO: 60739 - DNA, 15 bp, Homo sapiens
agacatatatgtgtc

SEQ ID NO: 60740 - DNA, 15 bp, Homo sapiens
gacatatatgtgtct

SEQ ID NO: 60741 - DNA, 15 bp, Homo sapiens
acatatatgtgtctg

SEQ ID NO: 60742 - DNA, 15 bp, Homo sapiens
catatatgtgtctgg

SEQ ID NO: 60743 - DNA, 15 bp, Homo sapiens
atatatgtgtctggt

SEQ ID NO: 60744 - DNA, 15 bp, Homo sapiens
tatatgtgtctggtt

SEQ ID NO: 60745 - DNA, 15 bp, Homo sapiens
atatgtgtctggttt

SEQ ID NO: 60746 - DNA, 15 bp, Homo sapiens
tatgtgtctggtttg

SEQ ID NO: 60747 - DNA, 15 bp, Homo sapiens
atgtgtctggtttgt

SEQ ID NO: 60748 - DNA, 15 bp, Homo sapiens
tgtgtctggtttgtt

SEQ ID NO: 60749 - DNA, 15 bp, Homo sapiens
gtgtctggtttgttc

SEQ ID NO: 60750 - DNA, 15 bp, Homo sapiens
tgtctggtttgttcg

SEQ ID NO: 60751 - DNA, 15 bp, Homo sapiens
gtctggtttgttcgc

SEQ ID NO: 60752 - DNA, 15 bp, Homo sapiens
tctggtttgttcgcc

SEQ ID NO: 60753 - DNA, 15 bp, Homo sapiens
ctggtttgttcgccc

SEQ ID NO: 60754 - DNA, 15 bp, Homo sapiens
tggtttgttcgccca

SEQ ID NO: 60755 - DNA, 15 bp, Homo sapiens
ggtttgttcgcccag

SEQ ID NO: 60756 - DNA, 15 bp, Homo sapiens
gtttgttcgcccagg

SEQ ID NO: 60757 - DNA, 15 bp, Homo sapiens
tttgttcgcccaggc

SEQ ID NO: 60758 - DNA, 15 bp, Homo sapiens
ttgttcgcccaggca

SEQ ID NO: 60759 - DNA, 15 bp, Homo sapiens
tgttcgcccaggcag

SEQ ID NO: 60760 - DNA, 15 bp, Homo sapiens
gttcgcccaggcagg

SEQ ID NO: 60761 - DNA, 15 bp, Homo sapiens
ttcgcccaggcagga

SEQ ID NO: 60762 - DNA, 15 bp, Homo sapiens
tcgcccaggcaggag

SEQ ID NO: 60763 - DNA, 15 bp, Homo sapiens
cgcccaggcaggagt

SEQ ID NO: 60764 - DNA, 15 bp, Homo sapiens
gcccaggcaggagtg

SEQ ID NO: 60765 - DNA, 15 bp, Homo sapiens
caggagtgcagtggc

SEQ ID NO: 60766 - DNA, 15 bp, Homo sapiens
aggagtgcagtggca

SEQ ID NO: 60767 - DNA, 15 bp, Homo sapiens
gcagtggcatgatca

SEQ ID NO: 60768 - DNA, 15 bp, Homo sapiens
cagtggcatgatcaa

SEQ ID NO: 60769 - DNA, 15 bp, Homo sapiens
agtggcatgatcaac

SEQ ID NO: 60770 - DNA, 15 bp, Homo sapiens
gtggcatgatcaacg

SEQ ID NO: 60771 - DNA, 15 bp, Homo sapiens
tggcatgatcaacgg

SEQ ID NO: 60772 - DNA, 15 bp, Homo sapiens
ggcatgatcaacggc

SEQ ID NO: 60773 - DNA, 15 bp, Homo sapiens
gcatgatcaacggct

SEQ ID NO: 60774 - DNA, 15 bp, Homo sapiens
catgatcaacggctc

SEQ ID NO: 60775 - DNA, 15 bp, Homo sapiens
atgatcaacggctca

SEQ ID NO: 60776 - DNA, 15 bp, Homo sapiens
tgatcaacggctcac

SEQ ID NO: 60777 - DNA, 15 bp, Homo sapiens
gatcaacggctcact

SEQ ID NO: 60778 - DNA, 15 bp, Homo sapiens
atcaacggctcactg

SEQ ID NO: 60779 - DNA, 15 bp, Homo sapiens
tcaacggctcactgc

SEQ ID NO: 60780 - DNA, 15 bp, Homo sapiens
caacggctcactgca

SEQ ID NO: 60781 - DNA, 15 bp, Homo sapiens
aacggctcactgcag

SEQ ID NO: 60782 - DNA, 15 bp, Homo sapiens
acggctcactgcagc

SEQ ID NO: 60783 - DNA, 15 bp, Homo sapiens
cggctcactgcagcc

SEQ ID NO: 60784 - DNA, 15 bp, Homo sapiens
actgcagcctcaact

SEQ ID NO: 60785 - DNA, 15 bp, Homo sapiens
ctgcagcctcaactt

SEQ ID NO: 60786 - DNA, 15 bp, Homo sapiens
tgcagcctcaacttc

SEQ ID NO: 60787 - DNA, 15 bp, Homo sapiens
gcagcctcaacttcc

SEQ ID NO: 60788 - DNA, 15 bp, Homo sapiens
cagcctcaacttcct

SEQ ID NO: 60789 - DNA, 15 bp, Homo sapiens
agcctcaacttccta

SEQ ID NO: 60790 - DNA, 15 bp, Homo sapiens
gcctcaacttcctag

SEQ ID NO: 60791 - DNA, 15 bp, Homo sapiens
cctcaacttcctagg

SEQ ID NO: 60792 - DNA, 15 bp, Homo sapiens
ctcaacttcctaggc

SEQ ID NO: 60793 - DNA, 15 bp, Homo sapiens
tcaacttcctaggct

SEQ ID NO: 60794 - DNA, 15 bp, Homo sapiens
caacttcctaggctc

SEQ ID NO: 60795 - DNA, 15 bp, Homo sapiens
aacttcctaggctca

SEQ ID NO: 60796 - DNA, 15 bp, Homo sapiens
acttcctaggctcaa

SEQ ID NO: 60797 - DNA, 15 bp, Homo sapiens
cttcctaggctcaag

SEQ ID NO: 60798 - DNA, 15 bp, Homo sapiens
ttcctaggctcaagt

SEQ ID NO: 60799 - DNA, 15 bp, Homo sapiens
tcctaggctcaagtg

SEQ ID NO: 60800 - DNA, 15 bp, Homo sapiens
cctaggctcaagtga

SEQ ID NO: 60801 - DNA, 15 bp, Homo sapiens
ctaggctcaagtgat

SEQ ID NO: 60802 - DNA, 15 bp, Homo sapiens
tcaagtgatcctcct

SEQ ID NO: 60803 - DNA, 15 bp, Homo sapiens
caagtgatcctcctg

SEQ ID NO: 60804 - DNA, 15 bp, Homo sapiens
aagtgatcctcctgc

SEQ ID NO: 60805 - DNA, 15 bp, Homo sapiens
agtgatcctcctgcc

SEQ ID NO: 60806 - DNA, 15 bp, Homo sapiens
gtgatcctcctgcct

SEQ ID NO: 60807 - DNA, 15 bp, Homo sapiens
tgatcctcctgcctc

SEQ ID NO: 60808 - DNA, 15 bp, Homo sapiens
gatcctcctgcctca

SEQ ID NO: 60809 - DNA, 15 bp, Homo sapiens
ctcccgagtagctag

SEQ ID NO: 60810 - DNA, 15 bp, Homo sapiens
tcccgagtagctagg

SEQ ID NO: 60811 - DNA, 15 bp, Homo sapiens
cccgagtagctagga

SEQ ID NO: 60812 - DNA, 15 bp, Homo sapiens
ccgagtagctaggat

SEQ ID NO: 60813 - DNA, 15 bp, Homo sapiens
cgagtagctaggatt

SEQ ID NO: 60814 - DNA, 15 bp, Homo sapiens
gagtagctaggatta

SEQ ID NO: 60815 - DNA, 15 bp, Homo sapiens
agtagctaggattac

SEQ ID NO: 60816 - DNA, 15 bp, Homo sapiens
gtagctaggattaca

SEQ ID NO: 60817 - DNA, 15 bp, Homo sapiens
tagctaggattacag

SEQ ID NO: 60818 - DNA, 15 bp, Homo sapiens
aggattacaggcaca

SEQ ID NO: 60819 - DNA, 15 bp, Homo sapiens
ggattacaggcacac

SEQ ID NO: 60820 - DNA, 15 bp, Homo sapiens
gattacaggcacaca

SEQ ID NO: 60821 - DNA, 15 bp, Homo sapiens
attacaggcacacac

SEQ ID NO: 60822 - DNA, 15 bp, Homo sapiens
ttacaggcacacacc

SEQ ID NO: 60823 - DNA, 15 bp, Homo sapiens
tacaggcacacacca

SEQ ID NO: 60824 - DNA, 15 bp, Homo sapiens
acaggcacacaccac

SEQ ID NO: 60825 - DNA, 15 bp, Homo sapiens
caggcacacaccacc

SEQ ID NO: 60826 - DNA, 15 bp, Homo sapiens
aggcacacaccacca

SEQ ID NO: 60827 - DNA, 15 bp, Homo sapiens
ggcacacaccaccat

SEQ ID NO: 60828 - DNA, 15 bp, Homo sapiens
gcacacaccaccatg

SEQ ID NO: 60829 - DNA, 15 bp, Homo sapiens
cacacaccaccatgc

SEQ ID NO: 60830 - DNA, 15 bp, Homo sapiens
acacaccaccatgcc

SEQ ID NO: 60831 - DNA, 15 bp, Homo sapiens
cacaccaccatgccc

SEQ ID NO: 60832 - DNA, 15 bp, Homo sapiens
acaccaccatgccca

SEQ ID NO: 60833 - DNA, 15 bp, Homo sapiens
cccagctaatttttt

SEQ ID NO: 60834 - DNA, 15 bp, Homo sapiens
ccagctaattttttt

SEQ ID NO: 60835 - DNA, 15 bp, Homo sapiens
cagctaatttttttt

SEQ ID NO: 60836 - DNA, 15 bp, Homo sapiens
agctaattttttttt

SEQ ID NO: 60837 - DNA, 15 bp, Homo sapiens
gctaatttttttttt

SEQ ID NO: 60838 - DNA, 15 bp, Homo sapiens
ctaattttttttttt

SEQ ID NO: 60839 - DNA, 15 bp, Homo sapiens
taatttttttttttt

SEQ ID NO: 60840 - DNA, 15 bp, Homo sapiens
tttttttttttgtag

SEQ ID NO: 60841 - DNA, 15 bp, Homo sapiens
ttttttttttgtaga

SEQ ID NO: 60842 - DNA, 15 bp, Homo sapiens
tttttttttgtagag

SEQ ID NO: 60843 - DNA, 15 bp, Homo sapiens
tttttgtagagacag

SEQ ID NO: 60844 - DNA, 15 bp, Homo sapiens
ttttgtagagacagg

SEQ ID NO: 60845 - DNA, 15 bp, Homo sapiens
tttgtagagacaggg

SEQ ID NO: 60846 - DNA, 15 bp, Homo sapiens
ttgtagagacagggt

SEQ ID NO: 60847 - DNA, 15 bp, Homo sapiens
tgtagagacagggtt

SEQ ID NO: 60848 - DNA, 15 bp, Homo sapiens
agacagggttttgct

SEQ ID NO: 60849 - DNA, 15 bp, Homo sapiens
gacagggttttgcta

SEQ ID NO: 60850 - DNA, 15 bp, Homo sapiens
acagggttttgctat

SEQ ID NO: 60851 - DNA, 15 bp, Homo sapiens
cagggttttgctatg

SEQ ID NO: 60852 - DNA, 15 bp, Homo sapiens
agggttttgctatgt

SEQ ID NO: 60853 - DNA, 15 bp, Homo sapiens
gggttttgctatgtt

SEQ ID NO: 60854 - DNA, 15 bp, Homo sapiens
ggttttgctatgttg

SEQ ID NO: 60855 - DNA, 15 bp, Homo sapiens
gttttgctatgttgc

SEQ ID NO: 60856 - DNA, 15 bp, Homo sapiens
ttttgctatgttgcc

SEQ ID NO: 60857 - DNA, 15 bp, Homo sapiens
tttgctatgttgccc

SEQ ID NO: 60858 - DNA, 15 bp, Homo sapiens
cccaggctggtctca

SEQ ID NO: 60859 - DNA, 15 bp, Homo sapiens
tctcaaactcctgag

SEQ ID NO: 60860 - DNA, 15 bp, Homo sapiens
ctcaaactcctgagc

SEQ ID NO: 60861 - DNA, 15 bp, Homo sapiens
tcaaactcctgagct

SEQ ID NO: 60862 - DNA, 15 bp, Homo sapiens
caaactcctgagctc

SEQ ID NO: 60863 - DNA, 15 bp, Homo sapiens
aaactcctgagctca

SEQ ID NO: 60864 - DNA, 15 bp, Homo sapiens
aactcctgagctcaa

SEQ ID NO: 60865 - DNA, 15 bp, Homo sapiens
actcctgagctcaag

SEQ ID NO: 60866 - DNA, 15 bp, Homo sapiens
ctcctgagctcaagc

SEQ ID NO: 60867 - DNA, 15 bp, Homo sapiens
tcctgagctcaagcg

SEQ ID NO: 60868 - DNA, 15 bp, Homo sapiens
cctgagctcaagcga

SEQ ID NO: 60869 - DNA, 15 bp, Homo sapiens
agctcaagcgatcca

SEQ ID NO: 60870 - DNA, 15 bp, Homo sapiens
gctcaagcgatccac

SEQ ID NO: 60871 - DNA, 15 bp, Homo sapiens
ctcaagcgatccacc

SEQ ID NO: 60872 - DNA, 15 bp, Homo sapiens
tcaagcgatccacct

SEQ ID NO: 60873 - DNA, 15 bp, Homo sapiens
caagcgatccacctg

SEQ ID NO: 60874 - DNA, 15 bp, Homo sapiens
aagcgatccacctgc

SEQ ID NO: 60875 - DNA, 15 bp, Homo sapiens
agcgatccacctgcc

SEQ ID NO: 60876 - DNA, 15 bp, Homo sapiens
cgatccacctgcctc

SEQ ID NO: 60877 - DNA, 15 bp, Homo sapiens
gatccacctgcctca

SEQ ID NO: 60878 - DNA, 15 bp, Homo sapiens
atccacctgcctcac

SEQ ID NO: 60879 - DNA, 15 bp, Homo sapiens
tccacctgcctcacc

SEQ ID NO: 60880 - DNA, 15 bp, Homo sapiens
ccacctgcctcacct

SEQ ID NO: 60881 - DNA, 15 bp, Homo sapiens
cacctgcctcacctc

SEQ ID NO: 60882 - DNA, 15 bp, Homo sapiens
acctgcctcacctcc

SEQ ID NO: 60883 - DNA, 15 bp, Homo sapiens
cctgcctcacctccc

SEQ ID NO: 60884 - DNA, 15 bp, Homo sapiens
ctgcctcacctccca

SEQ ID NO: 60885 - DNA, 15 bp, Homo sapiens
tgcctcacctcccaa

SEQ ID NO: 60886 - DNA, 15 bp, Homo sapiens
gcctcacctcccaaa

SEQ ID NO: 60887 - DNA, 15 bp, Homo sapiens
cctcacctcccaaag

SEQ ID NO: 60888 - DNA, 15 bp, Homo sapiens
ctcacctcccaaagt

SEQ ID NO: 60889 - DNA, 15 bp, Homo sapiens
tcacctcccaaagtg

SEQ ID NO: 60890 - DNA, 15 bp, Homo sapiens
gctgggattacaagt

SEQ ID NO: 60891 - DNA, 15 bp, Homo sapiens
ctgggattacaagtg

SEQ ID NO: 60892 - DNA, 15 bp, Homo sapiens
tgggattacaagtgt

SEQ ID NO: 60893 - DNA, 15 bp, Homo sapiens
gggattacaagtgta

SEQ ID NO: 60894 - DNA, 15 bp, Homo sapiens
ggattacaagtgtaa

SEQ ID NO: 60895 - DNA, 15 bp, Homo sapiens
gattacaagtgtaag

SEQ ID NO: 60896 - DNA, 15 bp, Homo sapiens
attacaagtgtaagc

SEQ ID NO: 60897 - DNA, 15 bp, Homo sapiens
ttacaagtgtaagcc

SEQ ID NO: 60898 - DNA, 15 bp, Homo sapiens
tacaagtgtaagcca

SEQ ID NO: 60899 - DNA, 15 bp, Homo sapiens
acaagtgtaagccac

SEQ ID NO: 60900 - DNA, 15 bp, Homo sapiens
caagtgtaagccacc

SEQ ID NO: 60901 - DNA, 15 bp, Homo sapiens
aagtgtaagccacca

SEQ ID NO: 60902 - DNA, 15 bp, Homo sapiens
agtgtaagccaccac

SEQ ID NO: 60903 - DNA, 15 bp, Homo sapiens
gtgtaagccaccaca

SEQ ID NO: 60904 - DNA, 15 bp, Homo sapiens
tgtaagccaccacac

SEQ ID NO: 60905 - DNA, 15 bp, Homo sapiens
gtaagccaccacacc

SEQ ID NO: 60906 - DNA, 15 bp, Homo sapiens
taagccaccacacct

SEQ ID NO: 60907 - DNA, 15 bp, Homo sapiens
aagccaccacacctg

SEQ ID NO: 60908 - DNA, 15 bp, Homo sapiens
agccaccacacctga

SEQ ID NO: 60909 - DNA, 15 bp, Homo sapiens
gccaccacacctgac

SEQ ID NO: 60910 - DNA, 15 bp, Homo sapiens
ccaccacacctgacc

SEQ ID NO: 60911 - DNA, 15 bp, Homo sapiens
caccacacctgacct

SEQ ID NO: 60912 - DNA, 15 bp, Homo sapiens
accacacctgacctg

SEQ ID NO: 60913 - DNA, 15 bp, Homo sapiens
ccacacctgacctgt

SEQ ID NO: 60914 - DNA, 15 bp, Homo sapiens
cacacctgacctgtt

SEQ ID NO: 60915 - DNA, 15 bp, Homo sapiens
acacctgacctgttt

SEQ ID NO: 60916 - DNA, 15 bp, Homo sapiens
cacctgacctgtttt

SEQ ID NO: 60917 - DNA, 15 bp, Homo sapiens
acctgacctgttttg

SEQ ID NO: 60918 - DNA, 15 bp, Homo sapiens
cctgacctgttttgt

SEQ ID NO: 60919 - DNA, 15 bp, Homo sapiens
ctgacctgttttgta

SEQ ID NO: 60920 - DNA, 15 bp, Homo sapiens
tgacctgttttgtat

SEQ ID NO: 60921 - DNA, 15 bp, Homo sapiens
gacctgttttgtata

SEQ ID NO: 60922 - DNA, 15 bp, Homo sapiens
acctgttttgtatat

SEQ ID NO: 60923 - DNA, 15 bp, Homo sapiens
cctgttttgtatatt

SEQ ID NO: 60924 - DNA, 15 bp, Homo sapiens
ctgttttgtatattt

SEQ ID NO: 60925 - DNA, 15 bp, Homo sapiens
tgttttgtatatttt

SEQ ID NO: 60926 - DNA, 15 bp, Homo sapiens
gttttgtatatttta

SEQ ID NO: 60927 - DNA, 15 bp, Homo sapiens
ttttgtatattttac

SEQ ID NO: 60928 - DNA, 15 bp, Homo sapiens
tttgtatattttacc

SEQ ID NO: 60929 - DNA, 15 bp, Homo sapiens
ttgtatattttacca

SEQ ID NO: 60930 - DNA, 15 bp, Homo sapiens
tgtatattttaccac

SEQ ID NO: 60931 - DNA, 15 bp, Homo sapiens
gtatattttaccaca

SEQ ID NO: 60932 - DNA, 15 bp, Homo sapiens
tatattttaccacaa

SEQ ID NO: 60933 - DNA, 15 bp, Homo sapiens
atattttaccacaat

SEQ ID NO: 60934 - DNA, 15 bp, Homo sapiens
tattttaccacaata

SEQ ID NO: 60935 - DNA, 15 bp, Homo sapiens
attttaccacaataa

SEQ ID NO: 60936 - DNA, 15 bp, Homo sapiens
ttttaccacaataaa

SEQ ID NO: 60937 - DNA, 15 bp, Homo sapiens
tttaccacaataaaa

SEQ ID NO: 60938 - DNA, 15 bp, Homo sapiens
ttaccacaataaaaa

SEQ ID NO: 60939 - DNA, 15 bp, Homo sapiens
taccacaataaaaag

SEQ ID NO: 60940 - DNA, 15 bp, Homo sapiens
accacaataaaaagc

SEQ ID NO: 60941 - DNA, 15 bp, Homo sapiens
ccacaataaaaagcc

SEQ ID NO: 60942 - DNA, 15 bp, Homo sapiens
cacaataaaaagcct

SEQ ID NO: 60943 - DNA, 15 bp, Homo sapiens
acaataaaaagcctt

SEQ ID NO: 60944 - DNA, 15 bp, Homo sapiens
caataaaaagccttt

SEQ ID NO: 60945 - DNA, 15 bp, Homo sapiens
aataaaaagccttta

SEQ ID NO: 60946 - DNA, 15 bp, Homo sapiens
ataaaaagcctttaa

SEQ ID NO: 60947 - DNA, 15 bp, Homo sapiens
taaaaagcctttaaa

SEQ ID NO: 60948 - DNA, 15 bp, Homo sapiens
aaaaagcctttaaaa

SEQ ID NO: 60949 - DNA, 15 bp, Homo sapiens
aaaagcctttaaaac

SEQ ID NO: 60950 - DNA, 15 bp, Homo sapiens
aaagcctttaaaacc

SEQ ID NO: 60951 - DNA, 15 bp, Homo sapiens
aagcctttaaaaccc

SEQ ID NO: 60952 - DNA, 15 bp, Homo sapiens
agcctttaaaacccc

SEQ ID NO: 60953 - DNA, 15 bp, Homo sapiens
gcctttaaaacccca

SEQ ID NO: 60954 - DNA, 15 bp, Homo sapiens
cctttaaaaccccaa

SEQ ID NO: 60955 - DNA, 15 bp, Homo sapiens
ctttaaaaccccaag

SEQ ID NO: 60956 - DNA, 15 bp, Homo sapiens
tttaaaaccccaagc

SEQ ID NO: 60957 - DNA, 15 bp, Homo sapiens
ttaaaaccccaagca

SEQ ID NO: 60958 - DNA, 15 bp, Homo sapiens
taaaaccccaagcag

SEQ ID NO: 60959 - DNA, 15 bp, Homo sapiens
aaaaccccaagcaga

SEQ ID NO: 60960 - DNA, 15 bp, Homo sapiens
aaaccccaagcagac

SEQ ID NO: 60961 - DNA, 15 bp, Homo sapiens
aaccccaagcagaca

SEQ ID NO: 60962 - DNA, 15 bp, Homo sapiens
accccaagcagacag

SEQ ID NO: 60963 - DNA, 15 bp, Homo sapiens
ccccaagcagacagt

SEQ ID NO: 60964 - DNA, 15 bp, Homo sapiens
cccaagcagacagtt

SEQ ID NO: 60965 - DNA, 15 bp, Homo sapiens
ccaagcagacagttc

SEQ ID NO: 60966 - DNA, 15 bp, Homo sapiens
caagcagacagttca

SEQ ID NO: 60967 - DNA, 15 bp, Homo sapiens
aagcagacagttcat

SEQ ID NO: 60968 - DNA, 15 bp, Homo sapiens
agcagacagttcatt

SEQ ID NO: 60969 - DNA, 15 bp, Homo sapiens
gcagacagttcattt

SEQ ID NO: 60970 - DNA, 15 bp, Homo sapiens
cagacagttcatttt

SEQ ID NO: 60971 - DNA, 15 bp, Homo sapiens
agacagttcattttc

SEQ ID NO: 60972 - DNA, 15 bp, Homo sapiens
gacagttcattttca

SEQ ID NO: 60973 - DNA, 15 bp, Homo sapiens
acagttcattttcat

SEQ ID NO: 60974 - DNA, 15 bp, Homo sapiens
cagttcattttcatt

SEQ ID NO: 60975 - DNA, 15 bp, Homo sapiens
agttcattttcattc

SEQ ID NO: 60976 - DNA, 15 bp, Homo sapiens
gttcattttcattca

SEQ ID NO: 60977 - DNA, 15 bp, Homo sapiens
ttcattttcattcag

SEQ ID NO: 60978 - DNA, 15 bp, Homo sapiens
tcattttcattcagg

SEQ ID NO: 60979 - DNA, 15 bp, Homo sapiens
cattttcattcaggc

SEQ ID NO: 60980 - DNA, 15 bp, Homo sapiens
attttcattcaggcc

SEQ ID NO: 60981 - DNA, 15 bp, Homo sapiens
ttttcattcaggccc

SEQ ID NO: 60982 - DNA, 15 bp, Homo sapiens
tttcattcaggccca

SEQ ID NO: 60983 - DNA, 15 bp, Homo sapiens
ttcattcaggcccaa

SEQ ID NO: 60984 - DNA, 15 bp, Homo sapiens
tcattcaggcccaac

SEQ ID NO: 60985 - DNA, 15 bp, Homo sapiens
cattcaggcccaact

SEQ ID NO: 60986 - DNA, 15 bp, Homo sapiens
attcaggcccaactc

SEQ ID NO: 60987 - DNA, 15 bp, Homo sapiens
ttcaggcccaactca

SEQ ID NO: 60988 - DNA, 15 bp, Homo sapiens
tcaggcccaactcag

SEQ ID NO: 60989 - DNA, 15 bp, Homo sapiens
caggcccaactcaga

SEQ ID NO: 60990 - DNA, 15 bp, Homo sapiens
aggcccaactcagaa

SEQ ID NO: 60991 - DNA, 15 bp, Homo sapiens
ggcccaactcagaat

SEQ ID NO: 60992 - DNA, 15 bp, Homo sapiens
gcccaactcagaatc

SEQ ID NO: 60993 - DNA, 15 bp, Homo sapiens
cccaactcagaatct

SEQ ID NO: 60994 - DNA, 15 bp, Homo sapiens
ccaactcagaatctg

SEQ ID NO: 60995 - DNA, 15 bp, Homo sapiens
caactcagaatctga

SEQ ID NO: 60996 - DNA, 15 bp, Homo sapiens
aactcagaatctgat

SEQ ID NO: 60997 - DNA, 15 bp, Homo sapiens
actcagaatctgatc

SEQ ID NO: 60998 - DNA, 15 bp, Homo sapiens
ctcagaatctgatca

SEQ ID NO: 60999 - DNA, 15 bp, Homo sapiens
tcagaatctgatcac

SEQ ID NO: 61000 - DNA, 15 bp, Homo sapiens
cagaatctgatcaca

SEQ ID NO: 61001 - DNA, 15 bp, Homo sapiens
agaatctgatcacag

SEQ ID NO: 61002 - DNA, 15 bp, Homo sapiens
gaatctgatcacagc

SEQ ID NO: 61003 - DNA, 15 bp, Homo sapiens
aatctgatcacagcg

SEQ ID NO: 61004 - DNA, 15 bp, Homo sapiens
atctgatcacagcgg

SEQ ID NO: 61005 - DNA, 15 bp, Homo sapiens
tctgatcacagcggg

SEQ ID NO: 61006 - DNA, 15 bp, Homo sapiens
ctgatcacagcgggg

SEQ ID NO: 61007 - DNA, 15 bp, Homo sapiens
tgatcacagcggggt

SEQ ID NO: 61008 - DNA, 15 bp, Homo sapiens
gatcacagcggggtt

SEQ ID NO: 61009 - DNA, 15 bp, Homo sapiens
atcacagcggggttt

SEQ ID NO: 61010 - DNA, 15 bp, Homo sapiens
tcacagcggggtttc

SEQ ID NO: 61011 - DNA, 15 bp, Homo sapiens
cacagcggggtttcc

SEQ ID NO: 61012 - DNA, 15 bp, Homo sapiens
acagcggggtttccc

SEQ ID NO: 61013 - DNA, 15 bp, Homo sapiens
cagcggggtttcccc

SEQ ID NO: 61014 - DNA, 15 bp, Homo sapiens
agcggggtttccccc

SEQ ID NO: 61015 - DNA, 15 bp, Homo sapiens
gcggggtttcccccc

SEQ ID NO: 61016 - DNA, 15 bp, Homo sapiens
cggggtttcccccct

SEQ ID NO: 61017 - DNA, 15 bp, Homo sapiens
ggggtttcccccctt

SEQ ID NO: 61018 - DNA, 15 bp, Homo sapiens
gggtttccccccttt

SEQ ID NO: 61019 - DNA, 15 bp, Homo sapiens
ggtttcccccctttc

SEQ ID NO: 61020 - DNA, 15 bp, Homo sapiens
gtttcccccctttct

SEQ ID NO: 61021 - DNA, 15 bp, Homo sapiens
tttcccccctttcta

SEQ ID NO: 61022 - DNA, 15 bp, Homo sapiens
ttcccccctttctag

SEQ ID NO: 61023 - DNA, 15 bp, Homo sapiens
tcccccctttctagc

SEQ ID NO: 61024 - DNA, 15 bp, Homo sapiens
cccccctttctagcg

SEQ ID NO: 61025 - DNA, 15 bp, Homo sapiens
ccccctttctagcga

SEQ ID NO: 61026 - DNA, 15 bp, Homo sapiens
cccctttctagcgag

SEQ ID NO: 61027 - DNA, 15 bp, Homo sapiens
ccctttctagcgagt

SEQ ID NO: 61028 - DNA, 15 bp, Homo sapiens
cctttctagcgagta

SEQ ID NO: 61029 - DNA, 15 bp, Homo sapiens
ctttctagcgagtag

SEQ ID NO: 61030 - DNA, 15 bp, Homo sapiens
tttctagcgagtagc

SEQ ID NO: 61031 - DNA, 15 bp, Homo sapiens
ttctagcgagtagct

SEQ ID NO: 61032 - DNA, 15 bp, Homo sapiens
tctagcgagtagctg

SEQ ID NO: 61033 - DNA, 15 bp, Homo sapiens
ctagcgagtagctga

SEQ ID NO: 61034 - DNA, 15 bp, Homo sapiens
tagcgagtagctgaa

SEQ ID NO: 61035 - DNA, 15 bp, Homo sapiens
agcgagtagctgaag

SEQ ID NO: 61036 - DNA, 15 bp, Homo sapiens
gcgagtagctgaaga

SEQ ID NO: 61037 - DNA, 15 bp, Homo sapiens
cgagtagctgaagaa

SEQ ID NO: 61038 - DNA, 15 bp, Homo sapiens
gagtagctgaagaac

SEQ ID NO: 61039 - DNA, 15 bp, Homo sapiens
agtagctgaagaact

SEQ ID NO: 61040 - DNA, 15 bp, Homo sapiens
gtagctgaagaactg

SEQ ID NO: 61041 - DNA, 15 bp, Homo sapiens
tagctgaagaactgt

SEQ ID NO: 61042 - DNA, 15 bp, Homo sapiens
agctgaagaactgtt

SEQ ID NO: 61043 - DNA, 15 bp, Homo sapiens
gctgaagaactgttt

SEQ ID NO: 61044 - DNA, 15 bp, Homo sapiens
ctgaagaactgtttt

SEQ ID NO: 61045 - DNA, 15 bp, Homo sapiens
tgaagaactgttttc

SEQ ID NO: 61046 - DNA, 15 bp, Homo sapiens
gaagaactgttttct

SEQ ID NO: 61047 - DNA, 15 bp, Homo sapiens
aagaactgttttctc

SEQ ID NO: 61048 - DNA, 15 bp, Homo sapiens
agaactgttttctct

SEQ ID NO: 61049 - DNA, 15 bp, Homo sapiens
gaactgttttctctc

SEQ ID NO: 61050 - DNA, 15 bp, Homo sapiens
aactgttttctctcc

SEQ ID NO: 61051 - DNA, 15 bp, Homo sapiens
actgttttctctcct

SEQ ID NO: 61052 - DNA, 15 bp, Homo sapiens
ctgttttctctcctt

SEQ ID NO: 61053 - DNA, 15 bp, Homo sapiens
tgttttctctccttg

SEQ ID NO: 61054 - DNA, 15 bp, Homo sapiens
gttttctctccttga

SEQ ID NO: 61055 - DNA, 15 bp, Homo sapiens
ttttctctccttgat

SEQ ID NO: 61056 - DNA, 15 bp, Homo sapiens
tttctctccttgatg

SEQ ID NO: 61057 - DNA, 15 bp, Homo sapiens
ttctctccttgatgg

SEQ ID NO: 61058 - DNA, 15 bp, Homo sapiens
tctctccttgatggt

SEQ ID NO: 61059 - DNA, 15 bp, Homo sapiens
ctctccttgatggta

SEQ ID NO: 61060 - DNA, 15 bp, Homo sapiens
tctccttgatggtat

SEQ ID NO: 61061 - DNA, 15 bp, Homo sapiens
ctccttgatggtata

SEQ ID NO: 61062 - DNA, 15 bp, Homo sapiens
tccttgatggtataa

SEQ ID NO: 61063 - DNA, 15 bp, Homo sapiens
ccttgatggtataac

SEQ ID NO: 61064 - DNA, 15 bp, Homo sapiens
cttgatggtataact

SEQ ID NO: 61065 - DNA, 15 bp, Homo sapiens
ttgatggtataactg

SEQ ID NO: 61066 - DNA, 15 bp, Homo sapiens
tgatggtataactgt

SEQ ID NO: 61067 - DNA, 15 bp, Homo sapiens
gatggtataactgtc

SEQ ID NO: 61068 - DNA, 15 bp, Homo sapiens
atggtataactgtct

SEQ ID NO: 61069 - DNA, 15 bp, Homo sapiens
tggtataactgtctc

SEQ ID NO: 61070 - DNA, 15 bp, Homo sapiens
ggtataactgtctct

SEQ ID NO: 61071 - DNA, 15 bp, Homo sapiens
gtataactgtctctg

SEQ ID NO: 61072 - DNA, 15 bp, Homo sapiens
tataactgtctctgt

SEQ ID NO: 61073 - DNA, 15 bp, Homo sapiens
ataactgtctctgtg

SEQ ID NO: 61074 - DNA, 15 bp, Homo sapiens
taactgtctctgtgg

SEQ ID NO: 61075 - DNA, 15 bp, Homo sapiens
aactgtctctgtggg

SEQ ID NO: 61076 - DNA, 15 bp, Homo sapiens
actgtctctgtgggt

SEQ ID NO: 61077 - DNA, 15 bp, Homo sapiens
ctgtctctgtgggtg

SEQ ID NO: 61078 - DNA, 15 bp, Homo sapiens
tgtctctgtgggtgt

SEQ ID NO: 61079 - DNA, 15 bp, Homo sapiens
gtctctgtgggtgtt

SEQ ID NO: 61080 - DNA, 15 bp, Homo sapiens
tctctgtgggtgttg

SEQ ID NO: 61081 - DNA, 15 bp, Homo sapiens
ctctgtgggtgttgc

SEQ ID NO: 61082 - DNA, 15 bp, Homo sapiens
tctgtgggtgttgct

SEQ ID NO: 61083 - DNA, 15 bp, Homo sapiens
ctgtgggtgttgctc

SEQ ID NO: 61084 - DNA, 15 bp, Homo sapiens
tgtgggtgttgctcc

SEQ ID NO: 61085 - DNA, 15 bp, Homo sapiens
gtgggtgttgctccc

SEQ ID NO: 61086 - DNA, 15 bp, Homo sapiens
tgggtgttgctcccc

SEQ ID NO: 61087 - DNA, 15 bp, Homo sapiens
gggtgttgctcccct

SEQ ID NO: 61088 - DNA, 15 bp, Homo sapiens
ggtgttgctcccctg

SEQ ID NO: 61089 - DNA, 15 bp, Homo sapiens
gtgttgctcccctgc

SEQ ID NO: 61090 - DNA, 15 bp, Homo sapiens
tgttgctcccctgcc

SEQ ID NO: 61091 - DNA, 15 bp, Homo sapiens
gttgctcccctgccg

SEQ ID NO: 61092 - DNA, 15 bp, Homo sapiens
ttgctcccctgccgc

SEQ ID NO: 61093 - DNA, 15 bp, Homo sapiens
tgctcccctgccgct

SEQ ID NO: 61094 - DNA, 15 bp, Homo sapiens
gctcccctgccgctc

SEQ ID NO: 61095 - DNA, 15 bp, Homo sapiens
ctcccctgccgctcc

SEQ ID NO: 61096 - DNA, 15 bp, Homo sapiens
tcccctgccgctcca

SEQ ID NO: 61097 - DNA, 15 bp, Homo sapiens
cccctgccgctccag

SEQ ID NO: 61098 - DNA, 15 bp, Homo sapiens
ccctgccgctccagt

SEQ ID NO: 61099 - DNA, 15 bp, Homo sapiens
cctgccgctccagtg

SEQ ID NO: 61100 - DNA, 15 bp, Homo sapiens
ctgccgctccagtgg

SEQ ID NO: 61101 - DNA, 15 bp, Homo sapiens
tgccgctccagtggt

SEQ ID NO: 61102 - DNA, 15 bp, Homo sapiens
gccgctccagtggtt

SEQ ID NO: 61103 - DNA, 15 bp, Homo sapiens
ccgctccagtggttt

SEQ ID NO: 61104 - DNA, 15 bp, Homo sapiens
cgctccagtggtttt

SEQ ID NO: 61105 - DNA, 15 bp, Homo sapiens
gctccagtggttttg

SEQ ID NO: 61106 - DNA, 15 bp, Homo sapiens
ctccagtggttttgt

SEQ ID NO: 61107 - DNA, 15 bp, Homo sapiens
tccagtggttttgtt

SEQ ID NO: 61108 - DNA, 15 bp, Homo sapiens
ccagtggttttgttt

SEQ ID NO: 61109 - DNA, 15 bp, Homo sapiens
cagtggttttgtttt

SEQ ID NO: 61110 - DNA, 15 bp, Homo sapiens
agtggttttgttttt

SEQ ID NO: 61111 - DNA, 15 bp, Homo sapiens
gtggttttgtttttg

SEQ ID NO: 61112 - DNA, 15 bp, Homo sapiens
tggttttgtttttgt

SEQ ID NO: 61113 - DNA, 15 bp, Homo sapiens
ggttttgtttttgtt

SEQ ID NO: 61114 - DNA, 15 bp, Homo sapiens
gttttgtttttgttt

SEQ ID NO: 61115 - DNA, 15 bp, Homo sapiens
ttgtttttgtttttt

SEQ ID NO: 61116 - DNA, 15 bp, Homo sapiens
tgtttttgttttttt

SEQ ID NO: 61117 - DNA, 15 bp, Homo sapiens
gtttttgtttttttg

SEQ ID NO: 61118 - DNA, 15 bp, Homo sapiens
tttttgtttttttga

SEQ ID NO: 61119 - DNA, 15 bp, Homo sapiens
ttttgtttttttgag

SEQ ID NO: 61120 - DNA, 15 bp, Homo sapiens
tttgtttttttgaga

SEQ ID NO: 61121 - DNA, 15 bp, Homo sapiens
ttgtttttttgagac

SEQ ID NO: 61122 - DNA, 15 bp, Homo sapiens
tgtttttttgagacg

SEQ ID NO: 61123 - DNA, 15 bp, Homo sapiens
gtttttttgagacgg

SEQ ID NO: 61124 - DNA, 15 bp, Homo sapiens
agacggagtcttgcg

SEQ ID NO: 61125 - DNA, 15 bp, Homo sapiens
gacggagtcttgcga

SEQ ID NO: 61126 - DNA, 15 bp, Homo sapiens
acggagtcttgcgat

SEQ ID NO: 61127 - DNA, 15 bp, Homo sapiens
cggagtcttgcgatc

SEQ ID NO: 61128 - DNA, 15 bp, Homo sapiens
ggagtcttgcgatct

SEQ ID NO: 61129 - DNA, 15 bp, Homo sapiens
gagtcttgcgatctc

SEQ ID NO: 61130 - DNA, 15 bp, Homo sapiens
agtcttgcgatctca

SEQ ID NO: 61131 - DNA, 15 bp, Homo sapiens
gtcttgcgatctcag

SEQ ID NO: 61132 - DNA, 15 bp, Homo sapiens
tcttgcgatctcagc

SEQ ID NO: 61133 - DNA, 15 bp, Homo sapiens
cttgcgatctcagct

SEQ ID NO: 61134 - DNA, 15 bp, Homo sapiens
ttgcgatctcagctc

SEQ ID NO: 61135 - DNA, 15 bp, Homo sapiens
tctcagctcactgcg

SEQ ID NO: 61136 - DNA, 15 bp, Homo sapiens
ctcagctcactgcga

SEQ ID NO: 61137 - DNA, 15 bp, Homo sapiens
tcagctcactgcgac

SEQ ID NO: 61138 - DNA, 15 bp, Homo sapiens
cagctcactgcgacc

SEQ ID NO: 61139 - DNA, 15 bp, Homo sapiens
agctcactgcgacct

SEQ ID NO: 61140 - DNA, 15 bp, Homo sapiens
gctcactgcgacctc

SEQ ID NO: 61141 - DNA, 15 bp, Homo sapiens
ctcactgcgacctct

SEQ ID NO: 61142 - DNA, 15 bp, Homo sapiens
tcactgcgacctctg

SEQ ID NO: 61143 - DNA, 15 bp, Homo sapiens
cactgcgacctctgc

SEQ ID NO: 61144 - DNA, 15 bp, Homo sapiens
actgcgacctctgcc

SEQ ID NO: 61145 - DNA, 15 bp, Homo sapiens
ctgcgacctctgcct

SEQ ID NO: 61146 - DNA, 15 bp, Homo sapiens
tgcgacctctgcctc

SEQ ID NO: 61147 - DNA, 15 bp, Homo sapiens
gcgacctctgcctcc

SEQ ID NO: 61148 - DNA, 15 bp, Homo sapiens
cgacctctgcctcct

SEQ ID NO: 61149 - DNA, 15 bp, Homo sapiens
gacctctgcctcctg

SEQ ID NO: 61150 - DNA, 15 bp, Homo sapiens
gcctcctgggttcag

SEQ ID NO: 61151 - DNA, 15 bp, Homo sapiens
cctcctgggttcagg

SEQ ID NO: 61152 - DNA, 15 bp, Homo sapiens
ctcctgggttcaggc

SEQ ID NO: 61153 - DNA, 15 bp, Homo sapiens
tcctgggttcaggcg

SEQ ID NO: 61154 - DNA, 15 bp, Homo sapiens
cctgggttcaggcga

SEQ ID NO: 61155 - DNA, 15 bp, Homo sapiens
ctgggttcaggcgat

SEQ ID NO: 61156 - DNA, 15 bp, Homo sapiens
tgggttcaggcgatt

SEQ ID NO: 61157 - DNA, 15 bp, Homo sapiens
gggttcaggcgattc

SEQ ID NO: 61158 - DNA, 15 bp, Homo sapiens
gttcaggcgattctt

SEQ ID NO: 61159 - DNA, 15 bp, Homo sapiens
ttcaggcgattcttc

SEQ ID NO: 61160 - DNA, 15 bp, Homo sapiens
tcaggcgattcttct

SEQ ID NO: 61161 - DNA, 15 bp, Homo sapiens
caggcgattcttctc

SEQ ID NO: 61162 - DNA, 15 bp, Homo sapiens
aggcgattcttctcc

SEQ ID NO: 61163 - DNA, 15 bp, Homo sapiens
ggcgattcttctccc

SEQ ID NO: 61164 - DNA, 15 bp, Homo sapiens
gcgattcttctccct

SEQ ID NO: 61165 - DNA, 15 bp, Homo sapiens
cgattcttctccctc

SEQ ID NO: 61166 - DNA, 15 bp, Homo sapiens
gattcttctccctca

SEQ ID NO: 61167 - DNA, 15 bp, Homo sapiens
attcttctccctcag

SEQ ID NO: 61168 - DNA, 15 bp, Homo sapiens
ttcttctccctcagc

SEQ ID NO: 61169 - DNA, 15 bp, Homo sapiens
tcttctccctcagcc

SEQ ID NO: 61170 - DNA, 15 bp, Homo sapiens
cttctccctcagcct

SEQ ID NO: 61171 - DNA, 15 bp, Homo sapiens
ttctccctcagcctt

SEQ ID NO: 61172 - DNA, 15 bp, Homo sapiens
tctccctcagccttc

SEQ ID NO: 61173 - DNA, 15 bp, Homo sapiens
ctccctcagccttcc

SEQ ID NO: 61174 - DNA, 15 bp, Homo sapiens
tccctcagccttcca

SEQ ID NO: 61175 - DNA, 15 bp, Homo sapiens
ccctcagccttccat

SEQ ID NO: 61176 - DNA, 15 bp, Homo sapiens
cctcagccttccatg

SEQ ID NO: 61177 - DNA, 15 bp, Homo sapiens
ctcagccttccatgt

SEQ ID NO: 61178 - DNA, 15 bp, Homo sapiens
tcagccttccatgta

SEQ ID NO: 61179 - DNA, 15 bp, Homo sapiens
cagccttccatgtag

SEQ ID NO: 61180 - DNA, 15 bp, Homo sapiens
agccttccatgtagc

SEQ ID NO: 61181 - DNA, 15 bp, Homo sapiens
gccttccatgtagct

SEQ ID NO: 61182 - DNA, 15 bp, Homo sapiens
ccttccatgtagctg

SEQ ID NO: 61183 - DNA, 15 bp, Homo sapiens
cttccatgtagctgg

SEQ ID NO: 61184 - DNA, 15 bp, Homo sapiens
ttccatgtagctggg

SEQ ID NO: 61185 - DNA, 15 bp, Homo sapiens
tccatgtagctggga

SEQ ID NO: 61186 - DNA, 15 bp, Homo sapiens
ccatgtagctgggac

SEQ ID NO: 61187 - DNA, 15 bp, Homo sapiens
catgtagctgggact

SEQ ID NO: 61188 - DNA, 15 bp, Homo sapiens
atgtagctgggactt

SEQ ID NO: 61189 - DNA, 15 bp, Homo sapiens
tgtagctgggactta

SEQ ID NO: 61190 - DNA, 15 bp, Homo sapiens
gtagctgggacttac

SEQ ID NO: 61191 - DNA, 15 bp, Homo sapiens
tagctgggacttaca

SEQ ID NO: 61192 - DNA, 15 bp, Homo sapiens
agctgggacttacag

SEQ ID NO: 61193 - DNA, 15 bp, Homo sapiens
gctgggacttacagg

SEQ ID NO: 61194 - DNA, 15 bp, Homo sapiens
ctgggacttacaggc

SEQ ID NO: 61195 - DNA, 15 bp, Homo sapiens
tgggacttacaggca

SEQ ID NO: 61196 - DNA, 15 bp, Homo sapiens
gggacttacaggcac

SEQ ID NO: 61197 - DNA, 15 bp, Homo sapiens
ggacttacaggcacc

SEQ ID NO: 61198 - DNA, 15 bp, Homo sapiens
gacttacaggcacct

SEQ ID NO: 61199 - DNA, 15 bp, Homo sapiens
acttacaggcacctg

SEQ ID NO: 61200 - DNA, 15 bp, Homo sapiens
cttacaggcacctgc

SEQ ID NO: 61201 - DNA, 15 bp, Homo sapiens
cctgccaccacgccc

SEQ ID NO: 61202 - DNA, 15 bp, Homo sapiens
ctgccaccacgcccg

SEQ ID NO: 61203 - DNA, 15 bp, Homo sapiens
caccacgcccggctc

SEQ ID NO: 61204 - DNA, 15 bp, Homo sapiens
accacgcccggctca

SEQ ID NO: 61205 - DNA, 15 bp, Homo sapiens
ccacgcccggctcat

SEQ ID NO: 61206 - DNA, 15 bp, Homo sapiens
cacgcccggctcatt

SEQ ID NO: 61207 - DNA, 15 bp, Homo sapiens
acgcccggctcattt

SEQ ID NO: 61208 - DNA, 15 bp, Homo sapiens
cgcccggctcatttt

SEQ ID NO: 61209 - DNA, 15 bp, Homo sapiens
gcccggctcattttt

SEQ ID NO: 61210 - DNA, 15 bp, Homo sapiens
cccggctcatttttg

SEQ ID NO: 61211 - DNA, 15 bp, Homo sapiens
ccggctcatttttgt

SEQ ID NO: 61212 - DNA, 15 bp, Homo sapiens
cggctcatttttgta

SEQ ID NO: 61213 - DNA, 15 bp, Homo sapiens
ggctcatttttgtat

SEQ ID NO: 61214 - DNA, 15 bp, Homo sapiens
gctcatttttgtatt

SEQ ID NO: 61215 - DNA, 15 bp, Homo sapiens
ctcatttttgtattt

SEQ ID NO: 61216 - DNA, 15 bp, Homo sapiens
tcatttttgtatttt

SEQ ID NO: 61217 - DNA, 15 bp, Homo sapiens
catttttgtattttt

SEQ ID NO: 61218 - DNA, 15 bp, Homo sapiens
ccatgttggccaggt

SEQ ID NO: 61219 - DNA, 15 bp, Homo sapiens
catgttggccaggtt

SEQ ID NO: 61220 - DNA, 15 bp, Homo sapiens
atgttggccaggttg

SEQ ID NO: 61221 - DNA, 15 bp, Homo sapiens
tgttggccaggttgg

SEQ ID NO: 61222 - DNA, 15 bp, Homo sapiens
gttggccaggttggg

SEQ ID NO: 61223 - DNA, 15 bp, Homo sapiens
ttggccaggttgggc

SEQ ID NO: 61224 - DNA, 15 bp, Homo sapiens
tggccaggttgggct

SEQ ID NO: 61225 - DNA, 15 bp, Homo sapiens
ggccaggttgggctc

SEQ ID NO: 61226 - DNA, 15 bp, Homo sapiens
gccaggttgggctcg

SEQ ID NO: 61227 - DNA, 15 bp, Homo sapiens
ccaggttgggctcga

SEQ ID NO: 61228 - DNA, 15 bp, Homo sapiens
caggttgggctcgaa

SEQ ID NO: 61229 - DNA, 15 bp, Homo sapiens
aggttgggctcgaac

SEQ ID NO: 61230 - DNA, 15 bp, Homo sapiens
ggttgggctcgaact

SEQ ID NO: 61231 - DNA, 15 bp, Homo sapiens
gttgggctcgaactc

SEQ ID NO: 61232 - DNA, 15 bp, Homo sapiens
ttgggctcgaactcc

SEQ ID NO: 61233 - DNA, 15 bp, Homo sapiens
tgggctcgaactcca

SEQ ID NO: 61234 - DNA, 15 bp, Homo sapiens
gggctcgaactccag

SEQ ID NO: 61235 - DNA, 15 bp, Homo sapiens
ggctcgaactccaga

SEQ ID NO: 61236 - DNA, 15 bp, Homo sapiens
gctcgaactccagac

SEQ ID NO: 61237 - DNA, 15 bp, Homo sapiens
ctcgaactccagacc

SEQ ID NO: 61238 - DNA, 15 bp, Homo sapiens
tcgaactccagacct

SEQ ID NO: 61239 - DNA, 15 bp, Homo sapiens
cgaactccagacctc

SEQ ID NO: 61240 - DNA, 15 bp, Homo sapiens
gaactccagacctca

SEQ ID NO: 61241 - DNA, 15 bp, Homo sapiens
aactccagacctcag

SEQ ID NO: 61242 - DNA, 15 bp, Homo sapiens
actccagacctcagg

SEQ ID NO: 61243 - DNA, 15 bp, Homo sapiens
ctccagacctcaggt

SEQ ID NO: 61244 - DNA, 15 bp, Homo sapiens
tccagacctcaggtg

SEQ ID NO: 61245 - DNA, 15 bp, Homo sapiens
ccagacctcaggtga

SEQ ID NO: 61246 - DNA, 15 bp, Homo sapiens
cagacctcaggtgat

SEQ ID NO: 61247 - DNA, 15 bp, Homo sapiens
agacctcaggtgatc

SEQ ID NO: 61248 - DNA, 15 bp, Homo sapiens
atccacctgcctcag

SEQ ID NO: 61249 - DNA, 15 bp, Homo sapiens
tccacctgcctcagc

SEQ ID NO: 61250 - DNA, 15 bp, Homo sapiens
ccacctgcctcagcc

SEQ ID NO: 61251 - DNA, 15 bp, Homo sapiens
cacctgcctcagcct

SEQ ID NO: 61252 - DNA, 15 bp, Homo sapiens
acctgcctcagcctc

SEQ ID NO: 61253 - DNA, 15 bp, Homo sapiens
gcctcagcctcccac

SEQ ID NO: 61254 - DNA, 15 bp, Homo sapiens
cctcagcctcccaca

SEQ ID NO: 61255 - DNA, 15 bp, Homo sapiens
ctcagcctcccacag

SEQ ID NO: 61256 - DNA, 15 bp, Homo sapiens
tcagcctcccacagt

SEQ ID NO: 61257 - DNA, 15 bp, Homo sapiens
cagcctcccacagtg

SEQ ID NO: 61258 - DNA, 15 bp, Homo sapiens
agcctcccacagtgc

SEQ ID NO: 61259 - DNA, 15 bp, Homo sapiens
gcctcccacagtgct

SEQ ID NO: 61260 - DNA, 15 bp, Homo sapiens
cctcccacagtgctg

SEQ ID NO: 61261 - DNA, 15 bp, Homo sapiens
ctcccacagtgctgg

SEQ ID NO: 61262 - DNA, 15 bp, Homo sapiens
tcccacagtgctggg

SEQ ID NO: 61263 - DNA, 15 bp, Homo sapiens
cccacagtgctggga

SEQ ID NO: 61264 - DNA, 15 bp, Homo sapiens
ccacagtgctgggat

SEQ ID NO: 61265 - DNA, 15 bp, Homo sapiens
cacagtgctgggatt

SEQ ID NO: 61266 - DNA, 15 bp, Homo sapiens
acagtgctgggatta

SEQ ID NO: 61267 - DNA, 15 bp, Homo sapiens
cagtgctgggattac

SEQ ID NO: 61268 - DNA, 15 bp, Homo sapiens
tacaggtgagagcca

SEQ ID NO: 61269 - DNA, 15 bp, Homo sapiens
acaggtgagagccac

SEQ ID NO: 61270 - DNA, 15 bp, Homo sapiens
caggtgagagccact

SEQ ID NO: 61271 - DNA, 15 bp, Homo sapiens
aggtgagagccactg

SEQ ID NO: 61272 - DNA, 15 bp, Homo sapiens
ggtgagagccactgc

SEQ ID NO: 61273 - DNA, 15 bp, Homo sapiens
gtgagagccactgca

SEQ ID NO: 61274 - DNA, 15 bp, Homo sapiens
tgagagccactgcac

SEQ ID NO: 61275 - DNA, 15 bp, Homo sapiens
gagagccactgcacc

SEQ ID NO: 61276 - DNA, 15 bp, Homo sapiens
agagccactgcaccc

SEQ ID NO: 61277 - DNA, 15 bp, Homo sapiens
gagccactgcaccca

SEQ ID NO: 61278 - DNA, 15 bp, Homo sapiens
agccactgcacccag

SEQ ID NO: 61279 - DNA, 15 bp, Homo sapiens
gccactgcacccagc

SEQ ID NO: 61280 - DNA, 15 bp, Homo sapiens
ccactgcacccagcc

SEQ ID NO: 61281 - DNA, 15 bp, Homo sapiens
cactgcacccagccg

SEQ ID NO: 61282 - DNA, 15 bp, Homo sapiens
actgcacccagccgg

SEQ ID NO: 61283 - DNA, 15 bp, Homo sapiens
ctgcacccagccggc

SEQ ID NO: 61284 - DNA, 15 bp, Homo sapiens
tgcacccagccggcc

SEQ ID NO: 61285 - DNA, 15 bp, Homo sapiens
gcacccagccggccc

SEQ ID NO: 61286 - DNA, 15 bp, Homo sapiens
cacccagccggcccc

SEQ ID NO: 61287 - DNA, 15 bp, Homo sapiens
acccagccggcccct

SEQ ID NO: 61288 - DNA, 15 bp, Homo sapiens
cccagccggcccctc

SEQ ID NO: 61289 - DNA, 15 bp, Homo sapiens
ccagccggcccctca

SEQ ID NO: 61290 - DNA, 15 bp, Homo sapiens
cagccggcccctcag

SEQ ID NO: 61291 - DNA, 15 bp, Homo sapiens
agccggcccctcagt

SEQ ID NO: 61292 - DNA, 15 bp, Homo sapiens
gccggcccctcagtc

SEQ ID NO: 61293 - DNA, 15 bp, Homo sapiens
ccggcccctcagtct

SEQ ID NO: 61294 - DNA, 15 bp, Homo sapiens
cggcccctcagtctt

SEQ ID NO: 61295 - DNA, 15 bp, Homo sapiens
ggcccctcagtcttt

SEQ ID NO: 61296 - DNA, 15 bp, Homo sapiens
gcccctcagtctttt

SEQ ID NO: 61297 - DNA, 15 bp, Homo sapiens
cccctcagtcttttc

SEQ ID NO: 61298 - DNA, 15 bp, Homo sapiens
ccctcagtcttttcc

SEQ ID NO: 61299 - DNA, 15 bp, Homo sapiens
cctcagtcttttcct

SEQ ID NO: 61300 - DNA, 15 bp, Homo sapiens
ctcagtcttttcctt

SEQ ID NO: 61301 - DNA, 15 bp, Homo sapiens
tcagtcttttccttc

SEQ ID NO: 61302 - DNA, 15 bp, Homo sapiens
cagtcttttccttct

SEQ ID NO: 61303 - DNA, 15 bp, Homo sapiens
agtcttttccttctc

SEQ ID NO: 61304 - DNA, 15 bp, Homo sapiens
gtcttttccttctca

SEQ ID NO: 61305 - DNA, 15 bp, Homo sapiens
tcttttccttctcaa

SEQ ID NO: 61306 - DNA, 15 bp, Homo sapiens
cttttccttctcaat

SEQ ID NO: 61307 - DNA, 15 bp, Homo sapiens
ttttccttctcaatc

SEQ ID NO: 61308 - DNA, 15 bp, Homo sapiens
tttccttctcaatca

SEQ ID NO: 61309 - DNA, 15 bp, Homo sapiens
ttccttctcaatcag

SEQ ID NO: 61310 - DNA, 15 bp, Homo sapiens
tccttctcaatcagt

SEQ ID NO: 61311 - DNA, 15 bp, Homo sapiens
ccttctcaatcagtg

SEQ ID NO: 61312 - DNA, 15 bp, Homo sapiens
cttctcaatcagtgg

SEQ ID NO: 61313 - DNA, 15 bp, Homo sapiens
ttctcaatcagtggc

SEQ ID NO: 61314 - DNA, 15 bp, Homo sapiens
tctcaatcagtggca

SEQ ID NO: 61315 - DNA, 15 bp, Homo sapiens
ctcaatcagtggcac

SEQ ID NO: 61316 - DNA, 15 bp, Homo sapiens
tcaatcagtggcacc

SEQ ID NO: 61317 - DNA, 15 bp, Homo sapiens
caatcagtggcacca

SEQ ID NO: 61318 - DNA, 15 bp, Homo sapiens
aatcagtggcaccac

SEQ ID NO: 61319 - DNA, 15 bp, Homo sapiens
atcagtggcaccacc

SEQ ID NO: 61320 - DNA, 15 bp, Homo sapiens
tcagtggcaccacca

SEQ ID NO: 61321 - DNA, 15 bp, Homo sapiens
cagtggcaccaccat

SEQ ID NO: 61322 - DNA, 15 bp, Homo sapiens
agtggcaccaccatc

SEQ ID NO: 61323 - DNA, 15 bp, Homo sapiens
gtggcaccaccatct

SEQ ID NO: 61324 - DNA, 15 bp, Homo sapiens
tggcaccaccatctt

SEQ ID NO: 61325 - DNA, 15 bp, Homo sapiens
ggcaccaccatcttc

SEQ ID NO: 61326 - DNA, 15 bp, Homo sapiens
gcaccaccatcttcc

SEQ ID NO: 61327 - DNA, 15 bp, Homo sapiens
caccaccatcttccc

SEQ ID NO: 61328 - DNA, 15 bp, Homo sapiens
accaccatcttccca

SEQ ID NO: 61329 - DNA, 15 bp, Homo sapiens
ccaccatcttcccag

SEQ ID NO: 61330 - DNA, 15 bp, Homo sapiens
caccatcttcccagg

SEQ ID NO: 61331 - DNA, 15 bp, Homo sapiens
accatcttcccaggc

SEQ ID NO: 61332 - DNA, 15 bp, Homo sapiens
ccatcttcccaggct

SEQ ID NO: 61333 - DNA, 15 bp, Homo sapiens
catcttcccaggctt

SEQ ID NO: 61334 - DNA, 15 bp, Homo sapiens
atcttcccaggcttt

SEQ ID NO: 61335 - DNA, 15 bp, Homo sapiens
tcttcccaggctttg

SEQ ID NO: 61336 - DNA, 15 bp, Homo sapiens
cttcccaggctttgg

SEQ ID NO: 61337 - DNA, 15 bp, Homo sapiens
ttcccaggctttgga

SEQ ID NO: 61338 - DNA, 15 bp, Homo sapiens
tcccaggctttggac

SEQ ID NO: 61339 - DNA, 15 bp, Homo sapiens
cccaggctttggaca

SEQ ID NO: 61340 - DNA, 15 bp, Homo sapiens
ccaggctttggacat

SEQ ID NO: 61341 - DNA, 15 bp, Homo sapiens
caggctttggacatg

SEQ ID NO: 61342 - DNA, 15 bp, Homo sapiens
aggctttggacatgg

SEQ ID NO: 61343 - DNA, 15 bp, Homo sapiens
ggctttggacatggt

SEQ ID NO: 61344 - DNA, 15 bp, Homo sapiens
gctttggacatggtc

SEQ ID NO: 61345 - DNA, 15 bp, Homo sapiens
ctttggacatggtcc

SEQ ID NO: 61346 - DNA, 15 bp, Homo sapiens
tttggacatggtccc

SEQ ID NO: 61347 - DNA, 15 bp, Homo sapiens
ttggacatggtccct

SEQ ID NO: 61348 - DNA, 15 bp, Homo sapiens
tggacatggtccctg

SEQ ID NO: 61349 - DNA, 15 bp, Homo sapiens
ggacatggtccctga

SEQ ID NO: 61350 - DNA, 15 bp, Homo sapiens
gacatggtccctgac

SEQ ID NO: 61351 - DNA, 15 bp, Homo sapiens
acatggtccctgact

SEQ ID NO: 61352 - DNA, 15 bp, Homo sapiens
catggtccctgactc

SEQ ID NO: 61353 - DNA, 15 bp, Homo sapiens
atggtccctgactca

SEQ ID NO: 61354 - DNA, 15 bp, Homo sapiens
tggtccctgactcac

SEQ ID NO: 61355 - DNA, 15 bp, Homo sapiens
ggtccctgactcacc

SEQ ID NO: 61356 - DNA, 15 bp, Homo sapiens
gtccctgactcaccc

SEQ ID NO: 61357 - DNA, 15 bp, Homo sapiens
tccctgactcaccct

SEQ ID NO: 61358 - DNA, 15 bp, Homo sapiens
ccctgactcaccctt

SEQ ID NO: 61359 - DNA, 15 bp, Homo sapiens
cctgactcacccttg

SEQ ID NO: 61360 - DNA, 15 bp, Homo sapiens
ctgactcacccttgc

SEQ ID NO: 61361 - DNA, 15 bp, Homo sapiens
tgactcacccttgcc

SEQ ID NO: 61362 - DNA, 15 bp, Homo sapiens
gactcacccttgccc

SEQ ID NO: 61363 - DNA, 15 bp, Homo sapiens
actcacccttgcccc

SEQ ID NO: 61364 - DNA, 15 bp, Homo sapiens
ctcacccttgcccct

SEQ ID NO: 61365 - DNA, 15 bp, Homo sapiens
tcacccttgcccctc

SEQ ID NO: 61366 - DNA, 15 bp, Homo sapiens
cacccttgcccctca

SEQ ID NO: 61367 - DNA, 15 bp, Homo sapiens
acccttgcccctcac

SEQ ID NO: 61368 - DNA, 15 bp, Homo sapiens
cccttgcccctcacc

SEQ ID NO: 61369 - DNA, 15 bp, Homo sapiens
ccttgcccctcaccc

SEQ ID NO: 61370 - DNA, 15 bp, Homo sapiens
cttgcccctcacccc

SEQ ID NO: 61371 - DNA, 15 bp, Homo sapiens
ttgcccctcaccccc

SEQ ID NO: 61372 - DNA, 15 bp, Homo sapiens
tgcccctcaccccca

SEQ ID NO: 61373 - DNA, 15 bp, Homo sapiens
gcccctcacccccac

SEQ ID NO: 61374 - DNA, 15 bp, Homo sapiens
cccctcacccccaca

SEQ ID NO: 61375 - DNA, 15 bp, Homo sapiens
ccctcacccccacac

SEQ ID NO: 61376 - DNA, 15 bp, Homo sapiens
cctcacccccacact

SEQ ID NO: 61377 - DNA, 15 bp, Homo sapiens
ctcacccccacacta

SEQ ID NO: 61378 - DNA, 15 bp, Homo sapiens
tcacccccacactaa

SEQ ID NO: 61379 - DNA, 15 bp, Homo sapiens
cacccccacactaat

SEQ ID NO: 61380 - DNA, 15 bp, Homo sapiens
acccccacactaatc

SEQ ID NO: 61381 - DNA, 15 bp, Homo sapiens
cccccacactaatcc

SEQ ID NO: 61382 - DNA, 15 bp, Homo sapiens
ccccacactaatcca

SEQ ID NO: 61383 - DNA, 15 bp, Homo sapiens
cccacactaatccac

SEQ ID NO: 61384 - DNA, 15 bp, Homo sapiens
ccacactaatccacc

SEQ ID NO: 61385 - DNA, 15 bp, Homo sapiens
cacactaatccacct

SEQ ID NO: 61386 - DNA, 15 bp, Homo sapiens
acactaatccacctg

SEQ ID NO: 61387 - DNA, 15 bp, Homo sapiens
cactaatccacctgc

SEQ ID NO: 61388 - DNA, 15 bp, Homo sapiens
actaatccacctgcg

SEQ ID NO: 61389 - DNA, 15 bp, Homo sapiens
ctaatccacctgcga

SEQ ID NO: 61390 - DNA, 15 bp, Homo sapiens
taatccacctgcgag

SEQ ID NO: 61391 - DNA, 15 bp, Homo sapiens
aatccacctgcgagc

SEQ ID NO: 61392 - DNA, 15 bp, Homo sapiens
atccacctgcgagct

SEQ ID NO: 61393 - DNA, 15 bp, Homo sapiens
tccacctgcgagctc

SEQ ID NO: 61394 - DNA, 15 bp, Homo sapiens
ccacctgcgagctct

SEQ ID NO: 61395 - DNA, 15 bp, Homo sapiens
cacctgcgagctctg

SEQ ID NO: 61396 - DNA, 15 bp, Homo sapiens
acctgcgagctctgt

SEQ ID NO: 61397 - DNA, 15 bp, Homo sapiens
cctgcgagctctgtt

SEQ ID NO: 61398 - DNA, 15 bp, Homo sapiens
ctgcgagctctgttg

SEQ ID NO: 61399 - DNA, 15 bp, Homo sapiens
tgcgagctctgttgc

SEQ ID NO: 61400 - DNA, 15 bp, Homo sapiens
gcgagctctgttgct

SEQ ID NO: 61401 - DNA, 15 bp, Homo sapiens
cgagctctgttgctt

SEQ ID NO: 61402 - DNA, 15 bp, Homo sapiens
gagctctgttgcttc

SEQ ID NO: 61403 - DNA, 15 bp, Homo sapiens
agctctgttgcttca

SEQ ID NO: 61404 - DNA, 15 bp, Homo sapiens
gctctgttgcttcac

SEQ ID NO: 61405 - DNA, 15 bp, Homo sapiens
ctctgttgcttcacc

SEQ ID NO: 61406 - DNA, 15 bp, Homo sapiens
tctgttgcttcacca

SEQ ID NO: 61407 - DNA, 15 bp, Homo sapiens
ctgttgcttcaccac

SEQ ID NO: 61408 - DNA, 15 bp, Homo sapiens
tgttgcttcaccacc

SEQ ID NO: 61409 - DNA, 15 bp, Homo sapiens
gttgcttcaccacct

SEQ ID NO: 61410 - DNA, 15 bp, Homo sapiens
ttgcttcaccaccta

SEQ ID NO: 61411 - DNA, 15 bp, Homo sapiens
tgcttcaccacctag

SEQ ID NO: 61412 - DNA, 15 bp, Homo sapiens
gcttcaccacctaga

SEQ ID NO: 61413 - DNA, 15 bp, Homo sapiens
cttcaccacctagac

SEQ ID NO: 61414 - DNA, 15 bp, Homo sapiens
ttcaccacctagacc

SEQ ID NO: 61415 - DNA, 15 bp, Homo sapiens
tcaccacctagacca

SEQ ID NO: 61416 - DNA, 15 bp, Homo sapiens
caccacctagaccag

SEQ ID NO: 61417 - DNA, 15 bp, Homo sapiens
accacctagaccagc

SEQ ID NO: 61418 - DNA, 15 bp, Homo sapiens
ccacctagaccagcc

SEQ ID NO: 61419 - DNA, 15 bp, Homo sapiens
cacctagaccagccc

SEQ ID NO: 61420 - DNA, 15 bp, Homo sapiens
acctagaccagcccc

SEQ ID NO: 61421 - DNA, 15 bp, Homo sapiens
cctagaccagcccca

SEQ ID NO: 61422 - DNA, 15 bp, Homo sapiens
ctagaccagccccaa

SEQ ID NO: 61423 - DNA, 15 bp, Homo sapiens
tagaccagccccaaa

SEQ ID NO: 61424 - DNA, 15 bp, Homo sapiens
agaccagccccaaat

SEQ ID NO: 61425 - DNA, 15 bp, Homo sapiens
gaccagccccaaatc

SEQ ID NO: 61426 - DNA, 15 bp, Homo sapiens
accagccccaaatcc

SEQ ID NO: 61427 - DNA, 15 bp, Homo sapiens
ccagccccaaatcct

SEQ ID NO: 61428 - DNA, 15 bp, Homo sapiens
cagccccaaatcctc

SEQ ID NO: 61429 - DNA, 15 bp, Homo sapiens
agccccaaatcctca

SEQ ID NO: 61430 - DNA, 15 bp, Homo sapiens
gccccaaatcctcaa

SEQ ID NO: 61431 - DNA, 15 bp, Homo sapiens
ccccaaatcctcaac

SEQ ID NO: 61432 - DNA, 15 bp, Homo sapiens
cccaaatcctcaact

SEQ ID NO: 61433 - DNA, 15 bp, Homo sapiens
ccaaatcctcaactg

SEQ ID NO: 61434 - DNA, 15 bp, Homo sapiens
caaatcctcaactgc

SEQ ID NO: 61435 - DNA, 15 bp, Homo sapiens
aaatcctcaactgcc

SEQ ID NO: 61436 - DNA, 15 bp, Homo sapiens
aatcctcaactgccc

SEQ ID NO: 61437 - DNA, 15 bp, Homo sapiens
atcctcaactgcccc

SEQ ID NO: 61438 - DNA, 15 bp, Homo sapiens
tcctcaactgccccc

SEQ ID NO: 61439 - DNA, 15 bp, Homo sapiens
cctcaactgccccca

SEQ ID NO: 61440 - DNA, 15 bp, Homo sapiens
ctcaactgcccccac

SEQ ID NO: 61441 - DNA, 15 bp, Homo sapiens
tcaactgcccccacc

SEQ ID NO: 61442 - DNA, 15 bp, Homo sapiens
caactgcccccaccc

SEQ ID NO: 61443 - DNA, 15 bp, Homo sapiens
aactgcccccaccct

SEQ ID NO: 61444 - DNA, 15 bp, Homo sapiens
actgcccccaccctg

SEQ ID NO: 61445 - DNA, 15 bp, Homo sapiens
ctgcccccaccctgg

SEQ ID NO: 61446 - DNA, 15 bp, Homo sapiens
tgcccccaccctggg

SEQ ID NO: 61447 - DNA, 15 bp, Homo sapiens
gcccccaccctgggc

SEQ ID NO: 61448 - DNA, 15 bp, Homo sapiens
cccccaccctgggcc

SEQ ID NO: 61449 - DNA, 15 bp, Homo sapiens
ccccaccctgggcca

SEQ ID NO: 61450 - DNA, 15 bp, Homo sapiens
cccaccctgggccac

SEQ ID NO: 61451 - DNA, 15 bp, Homo sapiens
ccaccctgggccaca

SEQ ID NO: 61452 - DNA, 15 bp, Homo sapiens
caccctgggccacac

SEQ ID NO: 61453 - DNA, 15 bp, Homo sapiens
accctgggccacacc

SEQ ID NO: 61454 - DNA, 15 bp, Homo sapiens
ccctgggccacacct

SEQ ID NO: 61455 - DNA, 15 bp, Homo sapiens
cctgggccacacctg

SEQ ID NO: 61456 - DNA, 15 bp, Homo sapiens
ctgggccacacctgg

SEQ ID NO: 61457 - DNA, 15 bp, Homo sapiens
tgggccacacctgga

SEQ ID NO: 61458 - DNA, 15 bp, Homo sapiens
gggccacacctggac

SEQ ID NO: 61459 - DNA, 15 bp, Homo sapiens
ggccacacctggacc

SEQ ID NO: 61460 - DNA, 15 bp, Homo sapiens
gccacacctggacca

SEQ ID NO: 61461 - DNA, 15 bp, Homo sapiens
ccacacctggaccac

SEQ ID NO: 61462 - DNA, 15 bp, Homo sapiens
cacacctggaccact

SEQ ID NO: 61463 - DNA, 15 bp, Homo sapiens
acacctggaccactg

SEQ ID NO: 61464 - DNA, 15 bp, Homo sapiens
cacctggaccactgc

SEQ ID NO: 61465 - DNA, 15 bp, Homo sapiens
acctggaccactgct

SEQ ID NO: 61466 - DNA, 15 bp, Homo sapiens
cctggaccactgcta

SEQ ID NO: 61467 - DNA, 15 bp, Homo sapiens
ctggaccactgctag

SEQ ID NO: 61468 - DNA, 15 bp, Homo sapiens
tggaccactgctaga

SEQ ID NO: 61469 - DNA, 15 bp, Homo sapiens
ggaccactgctagag

SEQ ID NO: 61470 - DNA, 15 bp, Homo sapiens
gaccactgctagagg

SEQ ID NO: 61471 - DNA, 15 bp, Homo sapiens
accactgctagaggc

SEQ ID NO: 61472 - DNA, 15 bp, Homo sapiens
ccactgctagaggcc

SEQ ID NO: 61473 - DNA, 15 bp, Homo sapiens
cactgctagaggcct

SEQ ID NO: 61474 - DNA, 15 bp, Homo sapiens
actgctagaggcctc

SEQ ID NO: 61475 - DNA, 15 bp, Homo sapiens
ctgctagaggcctct

SEQ ID NO: 61476 - DNA, 15 bp, Homo sapiens
tgctagaggcctctc

SEQ ID NO: 61477 - DNA, 15 bp, Homo sapiens
gctagaggcctctca

SEQ ID NO: 61478 - DNA, 15 bp, Homo sapiens
ctagaggcctctcat

SEQ ID NO: 61479 - DNA, 15 bp, Homo sapiens
tagaggcctctcatg

SEQ ID NO: 61480 - DNA, 15 bp, Homo sapiens
agaggcctctcatgg

SEQ ID NO: 61481 - DNA, 15 bp, Homo sapiens
gaggcctctcatggg

SEQ ID NO: 61482 - DNA, 15 bp, Homo sapiens
aggcctctcatgggc

SEQ ID NO: 61483 - DNA, 15 bp, Homo sapiens
ggcctctcatgggcc

SEQ ID NO: 61484 - DNA, 15 bp, Homo sapiens
gcctctcatgggccc

SEQ ID NO: 61485 - DNA, 15 bp, Homo sapiens
cctctcatgggccct

SEQ ID NO: 61486 - DNA, 15 bp, Homo sapiens
ctctcatgggccctc

SEQ ID NO: 61487 - DNA, 15 bp, Homo sapiens
tctcatgggccctcc

SEQ ID NO: 61488 - DNA, 15 bp, Homo sapiens
ctcatgggccctccc

SEQ ID NO: 61489 - DNA, 15 bp, Homo sapiens
tcatgggccctccct

SEQ ID NO: 61490 - DNA, 15 bp, Homo sapiens
catgggccctccctg

SEQ ID NO: 61491 - DNA, 15 bp, Homo sapiens
atgggccctccctgt

SEQ ID NO: 61492 - DNA, 15 bp, Homo sapiens
tgggccctccctgtt

SEQ ID NO: 61493 - DNA, 15 bp, Homo sapiens
gggccctccctgttt

SEQ ID NO: 61494 - DNA, 15 bp, Homo sapiens
ggccctccctgtttt

SEQ ID NO: 61495 - DNA, 15 bp, Homo sapiens
gccctccctgttttt

SEQ ID NO: 61496 - DNA, 15 bp, Homo sapiens
ccctccctgtttttc

SEQ ID NO: 61497 - DNA, 15 bp, Homo sapiens
cctccctgtttttct

SEQ ID NO: 61498 - DNA, 15 bp, Homo sapiens
ctccctgtttttctc

SEQ ID NO: 61499 - DNA, 15 bp, Homo sapiens
tccctgtttttctct

SEQ ID NO: 61500 - DNA, 15 bp, Homo sapiens
ccctgtttttctctt

SEQ ID NO: 61501 - DNA, 15 bp, Homo sapiens
cctgtttttctcttg

SEQ ID NO: 61502 - DNA, 15 bp, Homo sapiens
ctgtttttctcttgc

SEQ ID NO: 61503 - DNA, 15 bp, Homo sapiens
tgtttttctcttgca

SEQ ID NO: 61504 - DNA, 15 bp, Homo sapiens
gtttttctcttgcac

SEQ ID NO: 61505 - DNA, 15 bp, Homo sapiens
tttttctcttgcact

SEQ ID NO: 61506 - DNA, 15 bp, Homo sapiens
ttttctcttgcactc

SEQ ID NO: 61507 - DNA, 15 bp, Homo sapiens
tttctcttgcactcc

SEQ ID NO: 61508 - DNA, 15 bp, Homo sapiens
ttctcttgcactccc

SEQ ID NO: 61509 - DNA, 15 bp, Homo sapiens
tctcttgcactcccc

SEQ ID NO: 61510 - DNA, 15 bp, Homo sapiens
ctcttgcactccccg

SEQ ID NO: 61511 - DNA, 15 bp, Homo sapiens
tcttgcactccccgg

SEQ ID NO: 61512 - DNA, 15 bp, Homo sapiens
cttgcactccccggg

SEQ ID NO: 61513 - DNA, 15 bp, Homo sapiens
ttgcactccccgggc

SEQ ID NO: 61514 - DNA, 15 bp, Homo sapiens
tgcactccccgggct

SEQ ID NO: 61515 - DNA, 15 bp, Homo sapiens
gcactccccgggctt

SEQ ID NO: 61516 - DNA, 15 bp, Homo sapiens
cactccccgggcttt

SEQ ID NO: 61517 - DNA, 15 bp, Homo sapiens
actccccgggctttc

SEQ ID NO: 61518 - DNA, 15 bp, Homo sapiens
ctccccgggctttct

SEQ ID NO: 61519 - DNA, 15 bp, Homo sapiens
tccccgggctttctg

SEQ ID NO: 61520 - DNA, 15 bp, Homo sapiens
ccccgggctttctgg

SEQ ID NO: 61521 - DNA, 15 bp, Homo sapiens
cccgggctttctggc

SEQ ID NO: 61522 - DNA, 15 bp, Homo sapiens
ccgggctttctggca

SEQ ID NO: 61523 - DNA, 15 bp, Homo sapiens
cgggctttctggcac

SEQ ID NO: 61524 - DNA, 15 bp, Homo sapiens
gggctttctggcaca

SEQ ID NO: 61525 - DNA, 15 bp, Homo sapiens
ggctttctggcacaa

SEQ ID NO: 61526 - DNA, 15 bp, Homo sapiens
gctttctggcacaag

SEQ ID NO: 61527 - DNA, 15 bp, Homo sapiens
ctttctggcacaaga

SEQ ID NO: 61528 - DNA, 15 bp, Homo sapiens
ttctggcacaagatg

SEQ ID NO: 61529 - DNA, 15 bp, Homo sapiens
tctggcacaagatgc

SEQ ID NO: 61530 - DNA, 15 bp, Homo sapiens
ctggcacaagatgcc

SEQ ID NO: 61531 - DNA, 15 bp, Homo sapiens
tggcacaagatgccc

SEQ ID NO: 61532 - DNA, 15 bp, Homo sapiens
ggcacaagatgcccc

SEQ ID NO: 61533 - DNA, 15 bp, Homo sapiens
gcacaagatgcccca

SEQ ID NO: 61534 - DNA, 15 bp, Homo sapiens
cacaagatgccccag

SEQ ID NO: 61535 - DNA, 15 bp, Homo sapiens
acaagatgccccaga

SEQ ID NO: 61536 - DNA, 15 bp, Homo sapiens
caagatgccccagaa

SEQ ID NO: 61537 - DNA, 15 bp, Homo sapiens
aagatgccccagaag

SEQ ID NO: 61538 - DNA, 15 bp, Homo sapiens
agatgccccagaagc

SEQ ID NO: 61539 - DNA, 15 bp, Homo sapiens
gatgccccagaagca

SEQ ID NO: 61540 - DNA, 15 bp, Homo sapiens
atgccccagaagcag

SEQ ID NO: 61541 - DNA, 15 bp, Homo sapiens
tgccccagaagcaga

SEQ ID NO: 61542 - DNA, 15 bp, Homo sapiens
gccccagaagcagaa

SEQ ID NO: 61543 - DNA, 15 bp, Homo sapiens
ccccagaagcagaat

SEQ ID NO: 61544 - DNA, 15 bp, Homo sapiens
cccagaagcagaatc

SEQ ID NO: 61545 - DNA, 15 bp, Homo sapiens
ccagaagcagaatca

SEQ ID NO: 61546 - DNA, 15 bp, Homo sapiens
cagaagcagaatcac

SEQ ID NO: 61547 - DNA, 15 bp, Homo sapiens
agaagcagaatcaca

SEQ ID NO: 61548 - DNA, 15 bp, Homo sapiens
gaagcagaatcacat

SEQ ID NO: 61549 - DNA, 15 bp, Homo sapiens
aagcagaatcacata

SEQ ID NO: 61550 - DNA, 15 bp, Homo sapiens
agcagaatcacatat

SEQ ID NO: 61551 - DNA, 15 bp, Homo sapiens
gcagaatcacatatc

SEQ ID NO: 61552 - DNA, 15 bp, Homo sapiens
cagaatcacatatct

SEQ ID NO: 61553 - DNA, 15 bp, Homo sapiens
agaatcacatatctc

SEQ ID NO: 61554 - DNA, 15 bp, Homo sapiens
gaatcacatatctct

SEQ ID NO: 61555 - DNA, 15 bp, Homo sapiens
aatcacatatctctc

SEQ ID NO: 61556 - DNA, 15 bp, Homo sapiens
atcacatatctctcc

SEQ ID NO: 61557 - DNA, 15 bp, Homo sapiens
tcacatatctctcct

SEQ ID NO: 61558 - DNA, 15 bp, Homo sapiens
cacatatctctcctg

SEQ ID NO: 61559 - DNA, 15 bp, Homo sapiens
acatatctctcctgg

SEQ ID NO: 61560 - DNA, 15 bp, Homo sapiens
catatctctcctggg

SEQ ID NO: 61561 - DNA, 15 bp, Homo sapiens
atatctctcctggga

SEQ ID NO: 61562 - DNA, 15 bp, Homo sapiens
tatctctcctgggag

SEQ ID NO: 61563 - DNA, 15 bp, Homo sapiens
atctctcctgggagc

SEQ ID NO: 61564 - DNA, 15 bp, Homo sapiens
tctctcctgggagcc

SEQ ID NO: 61565 - DNA, 15 bp, Homo sapiens
ctctcctgggagcca

SEQ ID NO: 61566 - DNA, 15 bp, Homo sapiens
tctcctgggagccaa

SEQ ID NO: 61567 - DNA, 15 bp, Homo sapiens
ctcctgggagccaat

SEQ ID NO: 61568 - DNA, 15 bp, Homo sapiens
tcctgggagccaatc

SEQ ID NO: 61569 - DNA, 15 bp, Homo sapiens
cctgggagccaatct

SEQ ID NO: 61570 - DNA, 15 bp, Homo sapiens
ctgggagccaatcta

SEQ ID NO: 61571 - DNA, 15 bp, Homo sapiens
tgggagccaatctag

SEQ ID NO: 61572 - DNA, 15 bp, Homo sapiens
gggagccaatctagt

SEQ ID NO: 61573 - DNA, 15 bp, Homo sapiens
ggagccaatctagtg

SEQ ID NO: 61574 - DNA, 15 bp, Homo sapiens
gagccaatctagtgt

SEQ ID NO: 61575 - DNA, 15 bp, Homo sapiens
agccaatctagtgtg

SEQ ID NO: 61576 - DNA, 15 bp, Homo sapiens
gccaatctagtgtgt

SEQ ID NO: 61577 - DNA, 15 bp, Homo sapiens
ccaatctagtgtgtt

SEQ ID NO: 61578 - DNA, 15 bp, Homo sapiens
caatctagtgtgttt

SEQ ID NO: 61579 - DNA, 15 bp, Homo sapiens
aatctagtgtgttta

SEQ ID NO: 61580 - DNA, 15 bp, Homo sapiens
atctagtgtgtttac

SEQ ID NO: 61581 - DNA, 15 bp, Homo sapiens
tctagtgtgtttact

SEQ ID NO: 61582 - DNA, 15 bp, Homo sapiens
ctagtgtgtttactg

SEQ ID NO: 61583 - DNA, 15 bp, Homo sapiens
tagtgtgtttactgc

SEQ ID NO: 61584 - DNA, 15 bp, Homo sapiens
agtgtgtttactgcc

SEQ ID NO: 61585 - DNA, 15 bp, Homo sapiens
gtgtgtttactgccc

SEQ ID NO: 61586 - DNA, 15 bp, Homo sapiens
tgtgtttactgcccc

SEQ ID NO: 61587 - DNA, 15 bp, Homo sapiens
gtgtttactgcccct

SEQ ID NO: 61588 - DNA, 15 bp, Homo sapiens
tgtttactgcccctg

SEQ ID NO: 61589 - DNA, 15 bp, Homo sapiens
gtttactgcccctgg

SEQ ID NO: 61590 - DNA, 15 bp, Homo sapiens
tttactgcccctgga

SEQ ID NO: 61591 - DNA, 15 bp, Homo sapiens
ttactgcccctggag

SEQ ID NO: 61592 - DNA, 15 bp, Homo sapiens
tactgcccctggagt

SEQ ID NO: 61593 - DNA, 15 bp, Homo sapiens
actgcccctggagtg

SEQ ID NO: 61594 - DNA, 15 bp, Homo sapiens
ctgcccctggagtgt

SEQ ID NO: 61595 - DNA, 15 bp, Homo sapiens
tgcccctggagtgtt

SEQ ID NO: 61596 - DNA, 15 bp, Homo sapiens
gcccctggagtgtta

SEQ ID NO: 61597 - DNA, 15 bp, Homo sapiens
cccctggagtgttat

SEQ ID NO: 61598 - DNA, 15 bp, Homo sapiens
ccctggagtgttatt

SEQ ID NO: 61599 - DNA, 15 bp, Homo sapiens
cctggagtgttattg

SEQ ID NO: 61600 - DNA, 15 bp, Homo sapiens
ctggagtgttattgt

SEQ ID NO: 61601 - DNA, 15 bp, Homo sapiens
tggagtgttattgtt

SEQ ID NO: 61602 - DNA, 15 bp, Homo sapiens
ggagtgttattgttg

SEQ ID NO: 61603 - DNA, 15 bp, Homo sapiens
gagtgttattgttgg

SEQ ID NO: 61604 - DNA, 15 bp, Homo sapiens
agtgttattgttggc

SEQ ID NO: 61605 - DNA, 15 bp, Homo sapiens
gtgttattgttggcc

SEQ ID NO: 61606 - DNA, 15 bp, Homo sapiens
tgttattgttggcct

SEQ ID NO: 61607 - DNA, 15 bp, Homo sapiens
gttattgttggcctt

SEQ ID NO: 61608 - DNA, 15 bp, Homo sapiens
ttattgttggcctta

SEQ ID NO: 61609 - DNA, 15 bp, Homo sapiens
tattgttggccttag

SEQ ID NO: 61610 - DNA, 15 bp, Homo sapiens
attgttggccttaga

SEQ ID NO: 61611 - DNA, 15 bp, Homo sapiens
ttgttggccttagaa

SEQ ID NO: 61612 - DNA, 15 bp, Homo sapiens
tgttggccttagaat

SEQ ID NO: 61613 - DNA, 15 bp, Homo sapiens
gttggccttagaata

SEQ ID NO: 61614 - DNA, 15 bp, Homo sapiens
ttggccttagaatat

SEQ ID NO: 61615 - DNA, 15 bp, Homo sapiens
tggccttagaatatg

SEQ ID NO: 61616 - DNA, 15 bp, Homo sapiens
ggccttagaatatgt

SEQ ID NO: 61617 - DNA, 15 bp, Homo sapiens
gccttagaatatgtc

SEQ ID NO: 61618 - DNA, 15 bp, Homo sapiens
ccttagaatatgtcc

SEQ ID NO: 61619 - DNA, 15 bp, Homo sapiens
cttagaatatgtccc

SEQ ID NO: 61620 - DNA, 15 bp, Homo sapiens
ttagaatatgtccca

SEQ ID NO: 61621 - DNA, 15 bp, Homo sapiens
tagaatatgtcccac

SEQ ID NO: 61622 - DNA, 15 bp, Homo sapiens
agaatatgtcccact

SEQ ID NO: 61623 - DNA, 15 bp, Homo sapiens
gaatatgtcccacta

SEQ ID NO: 61624 - DNA, 15 bp, Homo sapiens
aatatgtcccactac

SEQ ID NO: 61625 - DNA, 15 bp, Homo sapiens
atatgtcccactaca

SEQ ID NO: 61626 - DNA, 15 bp, Homo sapiens
tatgtcccactacag

SEQ ID NO: 61627 - DNA, 15 bp, Homo sapiens
atgtcccactacagg

SEQ ID NO: 61628 - DNA, 15 bp, Homo sapiens
tgtcccactacaggt

SEQ ID NO: 61629 - DNA, 15 bp, Homo sapiens
gtcccactacaggtt

SEQ ID NO: 61630 - DNA, 15 bp, Homo sapiens
tcccactacaggttt

SEQ ID NO: 61631 - DNA, 15 bp, Homo sapiens
cccactacaggtttg

SEQ ID NO: 61632 - DNA, 15 bp, Homo sapiens
ccactacaggtttgc

SEQ ID NO: 61633 - DNA, 15 bp, Homo sapiens
cactacaggtttgca

SEQ ID NO: 61634 - DNA, 15 bp, Homo sapiens
actacaggtttgcag

SEQ ID NO: 61635 - DNA, 15 bp, Homo sapiens
ctacaggtttgcaga

SEQ ID NO: 61636 - DNA, 15 bp, Homo sapiens
tacaggtttgcagag

SEQ ID NO: 61637 - DNA, 15 bp, Homo sapiens
acaggtttgcagagc

SEQ ID NO: 61638 - DNA, 15 bp, Homo sapiens
caggtttgcagagca

SEQ ID NO: 61639 - DNA, 15 bp, Homo sapiens
aggtttgcagagcac

SEQ ID NO: 61640 - DNA, 15 bp, Homo sapiens
ggtttgcagagcact

SEQ ID NO: 61641 - DNA, 15 bp, Homo sapiens
gtttgcagagcactg

SEQ ID NO: 61642 - DNA, 15 bp, Homo sapiens
tttgcagagcactgt

SEQ ID NO: 61643 - DNA, 15 bp, Homo sapiens
ttgcagagcactgta

SEQ ID NO: 61644 - DNA, 15 bp, Homo sapiens
tgcagagcactgtag

SEQ ID NO: 61645 - DNA, 15 bp, Homo sapiens
gcagagcactgtagt

SEQ ID NO: 61646 - DNA, 15 bp, Homo sapiens
cagagcactgtagtc

SEQ ID NO: 61647 - DNA, 15 bp, Homo sapiens
agagcactgtagtca

SEQ ID NO: 61648 - DNA, 15 bp, Homo sapiens
gagcactgtagtcaa

SEQ ID NO: 61649 - DNA, 15 bp, Homo sapiens
agcactgtagtcaaa

SEQ ID NO: 61650 - DNA, 15 bp, Homo sapiens
gcactgtagtcaaaa

SEQ ID NO: 61651 - DNA, 15 bp, Homo sapiens
cactgtagtcaaaag

SEQ ID NO: 61652 - DNA, 15 bp, Homo sapiens
actgtagtcaaaagt

SEQ ID NO: 61653 - DNA, 15 bp, Homo sapiens
ctgtagtcaaaagtc

SEQ ID NO: 61654 - DNA, 15 bp, Homo sapiens
tgtagtcaaaagtca

SEQ ID NO: 61655 - DNA, 15 bp, Homo sapiens
gtagtcaaaagtcat

SEQ ID NO: 61656 - DNA, 15 bp, Homo sapiens
tagtcaaaagtcatt

SEQ ID NO: 61657 - DNA, 15 bp, Homo sapiens
agtcaaaagtcattt

SEQ ID NO: 61658 - DNA, 15 bp, Homo sapiens
gtcaaaagtcatttg

SEQ ID NO: 61659 - DNA, 15 bp, Homo sapiens
tcaaaagtcatttga

SEQ ID NO: 61660 - DNA, 15 bp, Homo sapiens
caaaagtcatttgaa

SEQ ID NO: 61661 - DNA, 15 bp, Homo sapiens
aaaagtcatttgaaa

SEQ ID NO: 61662 - DNA, 15 bp, Homo sapiens
aaagtcatttgaaat

SEQ ID NO: 61663 - DNA, 15 bp, Homo sapiens
aagtcatttgaaata

SEQ ID NO: 61664 - DNA, 15 bp, Homo sapiens
agtcatttgaaataa

SEQ ID NO: 61665 - DNA, 15 bp, Homo sapiens
gtcatttgaaataaa

SEQ ID NO: 61666 - DNA, 15 bp, Homo sapiens
tcatttgaaataaat

SEQ ID NO: 61667 - DNA, 15 bp, Homo sapiens
catttgaaataaatc

SEQ ID NO: 61668 - DNA, 15 bp, Homo sapiens
atttgaaataaatct

SEQ ID NO: 61669 - DNA, 15 bp, Homo sapiens
tttgaaataaatctt

SEQ ID NO: 61670 - DNA, 15 bp, Homo sapiens
ttgaaataaatcttt

SEQ ID NO: 61671 - DNA, 15 bp, Homo sapiens
tgaaataaatctttt

SEQ ID NO: 61672 - DNA, 15 bp, Homo sapiens
gaaataaatcttttc

SEQ ID NO: 61673 - DNA, 15 bp, Homo sapiens
aaataaatcttttct

SEQ ID NO: 61674 - DNA, 15 bp, Homo sapiens
aataaatcttttctc

SEQ ID NO: 61675 - DNA, 15 bp, Homo sapiens
ataaatcttttctct

SEQ ID NO: 61676 - DNA, 15 bp, Homo sapiens
taaatcttttctctg

SEQ ID NO: 61677 - DNA, 15 bp, Homo sapiens
aaatcttttctctgt

SEQ ID NO: 61678 - DNA, 15 bp, Homo sapiens
aatcttttctctgtg

SEQ ID NO: 61679 - DNA, 15 bp, Homo sapiens
atcttttctctgtgg

SEQ ID NO: 61680 - DNA, 15 bp, Homo sapiens
tcttttctctgtggt

SEQ ID NO: 61681 - DNA, 15 bp, Homo sapiens
cttttctctgtggta

SEQ ID NO: 61682 - DNA, 15 bp, Homo sapiens
ttttctctgtggtat

SEQ ID NO: 61683 - DNA, 15 bp, Homo sapiens
tttctctgtggtata

SEQ ID NO: 61684 - DNA, 15 bp, Homo sapiens
ttctctgtggtatat

SEQ ID NO: 61685 - DNA, 15 bp, Homo sapiens
tctctgtggtatatt

SEQ ID NO: 61686 - DNA, 15 bp, Homo sapiens
ctctgtggtatattg

SEQ ID NO: 61687 - DNA, 15 bp, Homo sapiens
tctgtggtatattgt

SEQ ID NO: 61688 - DNA, 15 bp, Homo sapiens
ctgtggtatattgtc

SEQ ID NO: 61689 - DNA, 15 bp, Homo sapiens
tgtggtatattgtca

SEQ ID NO: 61690 - DNA, 15 bp, Homo sapiens
gtggtatattgtcaa

SEQ ID NO: 61691 - DNA, 15 bp, Homo sapiens
tggtatattgtcaat

SEQ ID NO: 61692 - DNA, 15 bp, Homo sapiens
ggtatattgtcaatt

SEQ ID NO: 61693 - DNA, 15 bp, Homo sapiens
gtatattgtcaattt

SEQ ID NO: 61694 - DNA, 15 bp, Homo sapiens
tatattgtcaatttg

SEQ ID NO: 61695 - DNA, 15 bp, Homo sapiens
atattgtcaatttga

SEQ ID NO: 61696 - DNA, 15 bp, Homo sapiens
tattgtcaatttgat

SEQ ID NO: 61697 - DNA, 15 bp, Homo sapiens
attgtcaatttgata

SEQ ID NO: 61698 - DNA, 15 bp, Homo sapiens
ttgtcaatttgatat

SEQ ID NO: 61699 - DNA, 15 bp, Homo sapiens
tgtcaatttgatata

SEQ ID NO: 61700 - DNA, 15 bp, Homo sapiens
gtcaatttgatatag

SEQ ID NO: 61701 - DNA, 15 bp, Homo sapiens
tcaatttgatataga

SEQ ID NO: 61702 - DNA, 15 bp, Homo sapiens
caatttgatatagaa

SEQ ID NO: 61703 - DNA, 15 bp, Homo sapiens
aatttgatatagaat

SEQ ID NO: 61704 - DNA, 15 bp, Homo sapiens
atttgatatagaatt

SEQ ID NO: 61705 - DNA, 15 bp, Homo sapiens
tttgatatagaatta

SEQ ID NO: 61706 - DNA, 15 bp, Homo sapiens
ttgatatagaattaa

SEQ ID NO: 61707 - DNA, 15 bp, Homo sapiens
tgatatagaattaaa

SEQ ID NO: 61708 - DNA, 15 bp, Homo sapiens
gatatagaattaaat

SEQ ID NO: 61709 - DNA, 15 bp, Homo sapiens
atatagaattaaatt

SEQ ID NO: 61710 - DNA, 15 bp, Homo sapiens
tatagaattaaattt

SEQ ID NO: 61711 - DNA, 15 bp, Homo sapiens
atagaattaaatttg

SEQ ID NO: 61712 - DNA, 15 bp, Homo sapiens
tagaattaaatttgt

SEQ ID NO: 61713 - DNA, 15 bp, Homo sapiens
agaattaaatttgtt

SEQ ID NO: 61714 - DNA, 15 bp, Homo sapiens
gaattaaatttgttt

SEQ ID NO: 61715 - DNA, 15 bp, Homo sapiens
aattaaatttgtttc

SEQ ID NO: 61716 - DNA, 15 bp, Homo sapiens
attaaatttgtttct

SEQ ID NO: 61717 - DNA, 15 bp, Homo sapiens
ttaaatttgtttctt

SEQ ID NO: 61718 - DNA, 15 bp, Homo sapiens
taaatttgtttcttt

SEQ ID NO: 61719 - DNA, 15 bp, Homo sapiens
aaatttgtttctttt

SEQ ID NO: 61720 - DNA, 15 bp, Homo sapiens
aatttgtttcttttc

SEQ ID NO: 61721 - DNA, 15 bp, Homo sapiens
atttgtttcttttct

SEQ ID NO: 61722 - DNA, 15 bp, Homo sapiens
tttgtttcttttctt

SEQ ID NO: 61723 - DNA, 15 bp, Homo sapiens
ttgtttcttttcttt

SEQ ID NO: 61724 - DNA, 15 bp, Homo sapiens
tgtttcttttctttt

SEQ ID NO: 61725 - DNA, 15 bp, Homo sapiens
gtttcttttcttttt

SEQ ID NO: 61726 - DNA, 15 bp, Homo sapiens
tttcttttctttttt

SEQ ID NO: 61727 - DNA, 15 bp, Homo sapiens
ttcttttcttttttc

SEQ ID NO: 61728 - DNA, 15 bp, Homo sapiens
tcttttcttttttct

SEQ ID NO: 61729 - DNA, 15 bp, Homo sapiens
cttttcttttttctt

SEQ ID NO: 61730 - DNA, 15 bp, Homo sapiens
tttcttttttctttt

SEQ ID NO: 61731 - DNA, 15 bp, Homo sapiens
ttcttttttcttttc

SEQ ID NO: 61732 - DNA, 15 bp, Homo sapiens
tcttttttcttttct

SEQ ID NO: 61733 - DNA, 15 bp, Homo sapiens
cttttttcttttctt

SEQ ID NO: 61734 - DNA, 15 bp, Homo sapiens
ttttttcttttcttt

SEQ ID NO: 61735 - DNA, 15 bp, Homo sapiens
tttttcttttctttt

SEQ ID NO: 61736 - DNA, 15 bp, Homo sapiens
ttttcttttcttttt

SEQ ID NO: 61737 - DNA, 15 bp, Homo sapiens
ttcttttcttttttt

SEQ ID NO: 61738 - DNA, 15 bp, Homo sapiens
tcttttctttttttt

SEQ ID NO: 61739 - DNA, 15 bp, Homo sapiens
cttttcttttttttt

SEQ ID NO: 61740 - DNA, 15 bp, Homo sapiens
tttttttttttaaga

SEQ ID NO: 61741 - DNA, 15 bp, Homo sapiens
ttttttttttaagag

SEQ ID NO: 61742 - DNA, 15 bp, Homo sapiens
tttttttttaagaga

SEQ ID NO: 61743 - DNA, 15 bp, Homo sapiens
ttttttttaagagac

SEQ ID NO: 61744 - DNA, 15 bp, Homo sapiens
tttttttaagagaca

SEQ ID NO: 61745 - DNA, 15 bp, Homo sapiens
ttttttaagagacag

SEQ ID NO: 61746 - DNA, 15 bp, Homo sapiens
tttttaagagacagg

SEQ ID NO: 61747 - DNA, 15 bp, Homo sapiens
ttttaagagacaggg

SEQ ID NO: 61748 - DNA, 15 bp, Homo sapiens
tttaagagacagggt

SEQ ID NO: 61749 - DNA, 15 bp, Homo sapiens
ttaagagacagggtc

SEQ ID NO: 61750 - DNA, 15 bp, Homo sapiens
taagagacagggtct

SEQ ID NO: 61751 - DNA, 15 bp, Homo sapiens
aagagacagggtctt

SEQ ID NO: 61752 - DNA, 15 bp, Homo sapiens
agagacagggtcttg

SEQ ID NO: 61753 - DNA, 15 bp, Homo sapiens
gagacagggtcttgg

SEQ ID NO: 61754 - DNA, 15 bp, Homo sapiens
agacagggtcttggc

SEQ ID NO: 61755 - DNA, 15 bp, Homo sapiens
gacagggtcttggcc

SEQ ID NO: 61756 - DNA, 15 bp, Homo sapiens
acagggtcttggcca

SEQ ID NO: 61757 - DNA, 15 bp, Homo sapiens
cagggtcttggccag

SEQ ID NO: 61758 - DNA, 15 bp, Homo sapiens
agggtcttggccagg

SEQ ID NO: 61759 - DNA, 15 bp, Homo sapiens
gggtcttggccaggc

SEQ ID NO: 61760 - DNA, 15 bp, Homo sapiens
ggtcttggccaggcg

SEQ ID NO: 61761 - DNA, 15 bp, Homo sapiens
gtcttggccaggcgt

SEQ ID NO: 61762 - DNA, 15 bp, Homo sapiens
tcttggccaggcgtg

SEQ ID NO: 61763 - DNA, 15 bp, Homo sapiens
cttggccaggcgtgg

SEQ ID NO: 61764 - DNA, 15 bp, Homo sapiens
ttggccaggcgtggt

SEQ ID NO: 61765 - DNA, 15 bp, Homo sapiens
tggccaggcgtggtg

SEQ ID NO: 61766 - DNA, 15 bp, Homo sapiens
ggccaggcgtggtgt

SEQ ID NO: 61767 - DNA, 15 bp, Homo sapiens
gccaggcgtggtgtc

SEQ ID NO: 61768 - DNA, 15 bp, Homo sapiens
ccaggcgtggtgtct

SEQ ID NO: 61769 - DNA, 15 bp, Homo sapiens
caggcgtggtgtctc

SEQ ID NO: 61770 - DNA, 15 bp, Homo sapiens
aggcgtggtgtctca

SEQ ID NO: 61771 - DNA, 15 bp, Homo sapiens
ggcgtggtgtctcat

SEQ ID NO: 61772 - DNA, 15 bp, Homo sapiens
gcgtggtgtctcatg

SEQ ID NO: 61773 - DNA, 15 bp, Homo sapiens
cgtggtgtctcatgc

SEQ ID NO: 61774 - DNA, 15 bp, Homo sapiens
gtggtgtctcatgcc

SEQ ID NO: 61775 - DNA, 15 bp, Homo sapiens
tggtgtctcatgcct

SEQ ID NO: 61776 - DNA, 15 bp, Homo sapiens
ggtgtctcatgcctg

SEQ ID NO: 61777 - DNA, 15 bp, Homo sapiens
gtgtctcatgcctgt

SEQ ID NO: 61778 - DNA, 15 bp, Homo sapiens
tgtctcatgcctgta

SEQ ID NO: 61779 - DNA, 15 bp, Homo sapiens
gtctcatgcctgtaa

SEQ ID NO: 61780 - DNA, 15 bp, Homo sapiens
tctcatgcctgtaat

SEQ ID NO: 61781 - DNA, 15 bp, Homo sapiens
atgcctgtaatcccg

SEQ ID NO: 61782 - DNA, 15 bp, Homo sapiens
tgcctgtaatcccgg

SEQ ID NO: 61783 - DNA, 15 bp, Homo sapiens
cctgtaatcccggca

SEQ ID NO: 61784 - DNA, 15 bp, Homo sapiens
ctgtaatcccggcac

SEQ ID NO: 61785 - DNA, 15 bp, Homo sapiens
ccggcactttgggaa

SEQ ID NO: 61786 - DNA, 15 bp, Homo sapiens
cggcactttgggaag

SEQ ID NO: 61787 - DNA, 15 bp, Homo sapiens
ggcactttgggaagc

SEQ ID NO: 61788 - DNA, 15 bp, Homo sapiens
gcactttgggaagcc

SEQ ID NO: 61789 - DNA, 15 bp, Homo sapiens
cactttgggaagcca

SEQ ID NO: 61790 - DNA, 15 bp, Homo sapiens
actttgggaagccaa

SEQ ID NO: 61791 - DNA, 15 bp, Homo sapiens
ctttgggaagccaag

SEQ ID NO: 61792 - DNA, 15 bp, Homo sapiens
tttgggaagccaagg

SEQ ID NO: 61793 - DNA, 15 bp, Homo sapiens
ttgggaagccaaggt

SEQ ID NO: 61794 - DNA, 15 bp, Homo sapiens
tgggaagccaaggtg

SEQ ID NO: 61795 - DNA, 15 bp, Homo sapiens
gggaagccaaggtgg

SEQ ID NO: 61796 - DNA, 15 bp, Homo sapiens
ggaagccaaggtggg

SEQ ID NO: 61797 - DNA, 15 bp, Homo sapiens
gaagccaaggtgggt

SEQ ID NO: 61798 - DNA, 15 bp, Homo sapiens
aagccaaggtgggtg

SEQ ID NO: 61799 - DNA, 15 bp, Homo sapiens
agccaaggtgggtgg

SEQ ID NO: 61800 - DNA, 15 bp, Homo sapiens
gccaaggtgggtgga

SEQ ID NO: 61801 - DNA, 15 bp, Homo sapiens
ccaaggtgggtggat

SEQ ID NO: 61802 - DNA, 15 bp, Homo sapiens
caaggtgggtggatc

SEQ ID NO: 61803 - DNA, 15 bp, Homo sapiens
aaggtgggtggatcg

SEQ ID NO: 61804 - DNA, 15 bp, Homo sapiens
aggtgggtggatcgc

SEQ ID NO: 61805 - DNA, 15 bp, Homo sapiens
ggtgggtggatcgcc

SEQ ID NO: 61806 - DNA, 15 bp, Homo sapiens
gtgggtggatcgcct

SEQ ID NO: 61807 - DNA, 15 bp, Homo sapiens
tgggtggatcgcctg

SEQ ID NO: 61808 - DNA, 15 bp, Homo sapiens
gggtggatcgcctga

SEQ ID NO: 61809 - DNA, 15 bp, Homo sapiens
gcctgaggtcaggaa

SEQ ID NO: 61810 - DNA, 15 bp, Homo sapiens
cctgaggtcaggaat

SEQ ID NO: 61811 - DNA, 15 bp, Homo sapiens
ctgaggtcaggaatt

SEQ ID NO: 61812 - DNA, 15 bp, Homo sapiens
gaggtcaggaattca

SEQ ID NO: 61813 - DNA, 15 bp, Homo sapiens
aggtcaggaattcaa

SEQ ID NO: 61814 - DNA, 15 bp, Homo sapiens
ggtcaggaattcaag

SEQ ID NO: 61815 - DNA, 15 bp, Homo sapiens
gtcaggaattcaaga

SEQ ID NO: 61816 - DNA, 15 bp, Homo sapiens
tcaggaattcaagac

SEQ ID NO: 61817 - DNA, 15 bp, Homo sapiens
caggaattcaagacc

SEQ ID NO: 61818 - DNA, 15 bp, Homo sapiens
aggaattcaagacca

SEQ ID NO: 61819 - DNA, 15 bp, Homo sapiens
ggaattcaagaccaa

SEQ ID NO: 61820 - DNA, 15 bp, Homo sapiens
gaattcaagaccaac

SEQ ID NO: 61821 - DNA, 15 bp, Homo sapiens
aattcaagaccaacc

SEQ ID NO: 61822 - DNA, 15 bp, Homo sapiens
attcaagaccaacct

SEQ ID NO: 61823 - DNA, 15 bp, Homo sapiens
ttcaagaccaacctg

SEQ ID NO: 61824 - DNA, 15 bp, Homo sapiens
tcaagaccaacctgg

SEQ ID NO: 61825 - DNA, 15 bp, Homo sapiens
caagaccaacctggc

SEQ ID NO: 61826 - DNA, 15 bp, Homo sapiens
aagaccaacctggcc

SEQ ID NO: 61827 - DNA, 15 bp, Homo sapiens
agaccaacctggcca

SEQ ID NO: 61828 - DNA, 15 bp, Homo sapiens
gaccaacctggccag

SEQ ID NO: 61829 - DNA, 15 bp, Homo sapiens
accaacctggccagc

SEQ ID NO: 61830 - DNA, 15 bp, Homo sapiens
ccaacctggccagca

SEQ ID NO: 61831 - DNA, 15 bp, Homo sapiens
caacctggccagcat

SEQ ID NO: 61832 - DNA, 15 bp, Homo sapiens
aacctggccagcatg

SEQ ID NO: 61833 - DNA, 15 bp, Homo sapiens
acctggccagcatgg

SEQ ID NO: 61834 - DNA, 15 bp, Homo sapiens
cctggccagcatggt

SEQ ID NO: 61835 - DNA, 15 bp, Homo sapiens
ctggccagcatggtg

SEQ ID NO: 61836 - DNA, 15 bp, Homo sapiens
tggccagcatggtga

SEQ ID NO: 61837 - DNA, 15 bp, Homo sapiens
ggccagcatggtgaa

SEQ ID NO: 61838 - DNA, 15 bp, Homo sapiens
gccagcatggtgaaa

SEQ ID NO: 61839 - DNA, 15 bp, Homo sapiens
ccagcatggtgaaac

SEQ ID NO: 61840 - DNA, 15 bp, Homo sapiens
cagcatggtgaaacc

SEQ ID NO: 61841 - DNA, 15 bp, Homo sapiens
agcatggtgaaaccc

SEQ ID NO: 61842 - DNA, 15 bp, Homo sapiens
gcatggtgaaacccc

SEQ ID NO: 61843 - DNA, 15 bp, Homo sapiens
catggtgaaaccccg

SEQ ID NO: 61844 - DNA, 15 bp, Homo sapiens
gaaaccccgtctctg

SEQ ID NO: 61845 - DNA, 15 bp, Homo sapiens
aaaccccgtctctgc

SEQ ID NO: 61846 - DNA, 15 bp, Homo sapiens
aaccccgtctctgct

SEQ ID NO: 61847 - DNA, 15 bp, Homo sapiens
accccgtctctgcta

SEQ ID NO: 61848 - DNA, 15 bp, Homo sapiens
ccccgtctctgctaa

SEQ ID NO: 61849 - DNA, 15 bp, Homo sapiens
cccgtctctgctaaa

SEQ ID NO: 61850 - DNA, 15 bp, Homo sapiens
ccgtctctgctaaaa

SEQ ID NO: 61851 - DNA, 15 bp, Homo sapiens
cgtctctgctaaaaa

SEQ ID NO: 61852 - DNA, 15 bp, Homo sapiens
gtctctgctaaaaat

SEQ ID NO: 61853 - DNA, 15 bp, Homo sapiens
tctctgctaaaaata

SEQ ID NO: 61854 - DNA, 15 bp, Homo sapiens
ctctgctaaaaatac

SEQ ID NO: 61855 - DNA, 15 bp, Homo sapiens
tctgctaaaaataca

SEQ ID NO: 61856 - DNA, 15 bp, Homo sapiens
ctgctaaaaatacaa

SEQ ID NO: 61857 - DNA, 15 bp, Homo sapiens
tgctaaaaatacaaa

SEQ ID NO: 61858 - DNA, 15 bp, Homo sapiens
gctaaaaatacaaaa

SEQ ID NO: 61859 - DNA, 15 bp, Homo sapiens
aaaattagccgggcg

SEQ ID NO: 61860 - DNA, 15 bp, Homo sapiens
aaattagccgggcgt

SEQ ID NO: 61861 - DNA, 15 bp, Homo sapiens
aattagccgggcgtg

SEQ ID NO: 61862 - DNA, 15 bp, Homo sapiens
attagccgggcgtga

SEQ ID NO: 61863 - DNA, 15 bp, Homo sapiens
ttagccgggcgtgat

SEQ ID NO: 61864 - DNA, 15 bp, Homo sapiens
tagccgggcgtgatg

SEQ ID NO: 61865 - DNA, 15 bp, Homo sapiens
agccgggcgtgatgg

SEQ ID NO: 61866 - DNA, 15 bp, Homo sapiens
gccgggcgtgatggc

SEQ ID NO: 61867 - DNA, 15 bp, Homo sapiens
ccgggcgtgatggca

SEQ ID NO: 61868 - DNA, 15 bp, Homo sapiens
cgggcgtgatggcag

SEQ ID NO: 61869 - DNA, 15 bp, Homo sapiens
gggcgtgatggcagg

SEQ ID NO: 61870 - DNA, 15 bp, Homo sapiens
ggcgtgatggcaggt

SEQ ID NO: 61871 - DNA, 15 bp, Homo sapiens
gcgtgatggcaggta

SEQ ID NO: 61872 - DNA, 15 bp, Homo sapiens
cgtgatggcaggtac

SEQ ID NO: 61873 - DNA, 15 bp, Homo sapiens
gtgatggcaggtacc

SEQ ID NO: 61874 - DNA, 15 bp, Homo sapiens
tgatggcaggtacct

SEQ ID NO: 61875 - DNA, 15 bp, Homo sapiens
gatggcaggtacctg

SEQ ID NO: 61876 - DNA, 15 bp, Homo sapiens
atggcaggtacctgt

SEQ ID NO: 61877 - DNA, 15 bp, Homo sapiens
tggcaggtacctgta

SEQ ID NO: 61878 - DNA, 15 bp, Homo sapiens
ggcaggtacctgtaa

SEQ ID NO: 61879 - DNA, 15 bp, Homo sapiens
gcaggtacctgtaat

SEQ ID NO: 61880 - DNA, 15 bp, Homo sapiens
caggtacctgtaatc

SEQ ID NO: 61881 - DNA, 15 bp, Homo sapiens
aggtacctgtaatcc

SEQ ID NO: 61882 - DNA, 15 bp, Homo sapiens
ggtacctgtaatccc

SEQ ID NO: 61883 - DNA, 15 bp, Homo sapiens
gtacctgtaatccca

SEQ ID NO: 61884 - DNA, 15 bp, Homo sapiens
tacctgtaatcccag

SEQ ID NO: 61885 - DNA, 15 bp, Homo sapiens
gctactcgggaagct

SEQ ID NO: 61886 - DNA, 15 bp, Homo sapiens
ctactcgggaagctg

SEQ ID NO: 61887 - DNA, 15 bp, Homo sapiens
tactcgggaagctga

SEQ ID NO: 61888 - DNA, 15 bp, Homo sapiens
actcgggaagctgag

SEQ ID NO: 61889 - DNA, 15 bp, Homo sapiens
ctcgggaagctgagg

SEQ ID NO: 61890 - DNA, 15 bp, Homo sapiens
tcgggaagctgaggc

SEQ ID NO: 61891 - DNA, 15 bp, Homo sapiens
cgggaagctgaggca

SEQ ID NO: 61892 - DNA, 15 bp, Homo sapiens
ctgaggcaggagaag

SEQ ID NO: 61893 - DNA, 15 bp, Homo sapiens
tgaggcaggagaagg

SEQ ID NO: 61894 - DNA, 15 bp, Homo sapiens
gaggcaggagaaggc

SEQ ID NO: 61895 - DNA, 15 bp, Homo sapiens
aggcaggagaaggct

SEQ ID NO: 61896 - DNA, 15 bp, Homo sapiens
ggcaggagaaggctt

SEQ ID NO: 61897 - DNA, 15 bp, Homo sapiens
gcaggagaaggcttg

SEQ ID NO: 61898 - DNA, 15 bp, Homo sapiens
caggagaaggcttga

SEQ ID NO: 61899 - DNA, 15 bp, Homo sapiens
aggagaaggcttgaa

SEQ ID NO: 61900 - DNA, 15 bp, Homo sapiens
ggagaaggcttgaac

SEQ ID NO: 61901 - DNA, 15 bp, Homo sapiens
gagaaggcttgaact

SEQ ID NO: 61902 - DNA, 15 bp, Homo sapiens
agaaggcttgaactc

SEQ ID NO: 61903 - DNA, 15 bp, Homo sapiens
gaaggcttgaactca

SEQ ID NO: 61904 - DNA, 15 bp, Homo sapiens
aaggcttgaactcag

SEQ ID NO: 61905 - DNA, 15 bp, Homo sapiens
aggcttgaactcagg

SEQ ID NO: 61906 - DNA, 15 bp, Homo sapiens
ggcttgaactcagga

SEQ ID NO: 61907 - DNA, 15 bp, Homo sapiens
ttgaactcaggagtc

SEQ ID NO: 61908 - DNA, 15 bp, Homo sapiens
tgaactcaggagtcg

SEQ ID NO: 61909 - DNA, 15 bp, Homo sapiens
gaactcaggagtcgg

SEQ ID NO: 61910 - DNA, 15 bp, Homo sapiens
aactcaggagtcgga

SEQ ID NO: 61911 - DNA, 15 bp, Homo sapiens
actcaggagtcggag

SEQ ID NO: 61912 - DNA, 15 bp, Homo sapiens
ctcaggagtcggagg

SEQ ID NO: 61913 - DNA, 15 bp, Homo sapiens
tcaggagtcggaggt

SEQ ID NO: 61914 - DNA, 15 bp, Homo sapiens
caggagtcggaggtt

SEQ ID NO: 61915 - DNA, 15 bp, Homo sapiens
aggagtcggaggttg

SEQ ID NO: 61916 - DNA, 15 bp, Homo sapiens
ggagtcggaggttgc

SEQ ID NO: 61917 - DNA, 15 bp, Homo sapiens
gagtcggaggttgca

SEQ ID NO: 61918 - DNA, 15 bp, Homo sapiens
agtcggaggttgcag

SEQ ID NO: 61919 - DNA, 15 bp, Homo sapiens
gtcggaggttgcagt

SEQ ID NO: 61920 - DNA, 15 bp, Homo sapiens
tcggaggttgcagtg

SEQ ID NO: 61921 - DNA, 15 bp, Homo sapiens
ccaagatcacgccat

SEQ ID NO: 61922 - DNA, 15 bp, Homo sapiens
caagatcacgccatg

SEQ ID NO: 61923 - DNA, 15 bp, Homo sapiens
aagatcacgccatgg

SEQ ID NO: 61924 - DNA, 15 bp, Homo sapiens
agatcacgccatggc

SEQ ID NO: 61925 - DNA, 15 bp, Homo sapiens
gatcacgccatggca

SEQ ID NO: 61926 - DNA, 15 bp, Homo sapiens
atcacgccatggcac

SEQ ID NO: 61927 - DNA, 15 bp, Homo sapiens
tcacgccatggcact

SEQ ID NO: 61928 - DNA, 15 bp, Homo sapiens
cacgccatggcactc

SEQ ID NO: 61929 - DNA, 15 bp, Homo sapiens
acgccatggcactct

SEQ ID NO: 61930 - DNA, 15 bp, Homo sapiens
cgccatggcactcta

SEQ ID NO: 61931 - DNA, 15 bp, Homo sapiens
gccatggcactctag

SEQ ID NO: 61932 - DNA, 15 bp, Homo sapiens
ccatggcactctagc

SEQ ID NO: 61933 - DNA, 15 bp, Homo sapiens
catggcactctagca

SEQ ID NO: 61934 - DNA, 15 bp, Homo sapiens
atggcactctagcaa

SEQ ID NO: 61935 - DNA, 15 bp, Homo sapiens
tggcactctagcaag

SEQ ID NO: 61936 - DNA, 15 bp, Homo sapiens
ggcactctagcaaga

SEQ ID NO: 61937 - DNA, 15 bp, Homo sapiens
gcactctagcaagac

SEQ ID NO: 61938 - DNA, 15 bp, Homo sapiens
cactctagcaagact

SEQ ID NO: 61939 - DNA, 15 bp, Homo sapiens
actctagcaagactc

SEQ ID NO: 61940 - DNA, 15 bp, Homo sapiens
ctctagcaagactct

SEQ ID NO: 61941 - DNA, 15 bp, Homo sapiens
tctagcaagactctg

SEQ ID NO: 61942 - DNA, 15 bp, Homo sapiens
ctagcaagactctgt

SEQ ID NO: 61943 - DNA, 15 bp, Homo sapiens
tagcaagactctgtc

SEQ ID NO: 61944 - DNA, 15 bp, Homo sapiens
agcaagactctgtct

SEQ ID NO: 61945 - DNA, 15 bp, Homo sapiens
gcaagactctgtctc

SEQ ID NO: 61946 - DNA, 15 bp, Homo sapiens
caagactctgtctca

SEQ ID NO: 61947 - DNA, 15 bp, Homo sapiens
aagactctgtctcaa

SEQ ID NO: 61948 - DNA, 15 bp, Homo sapiens
caaaaaaaaaaaaag

SEQ ID NO: 61949 - DNA, 15 bp, Homo sapiens
aaaaaaaaaagagag

SEQ ID NO: 61950 - DNA, 15 bp, Homo sapiens
aaaaaaaaagagaga

SEQ ID NO: 61951 - DNA, 15 bp, Homo sapiens
aaaaaaaagagagag

SEQ ID NO: 61952 - DNA, 15 bp, Homo sapiens
aaaaaaagagagaga

SEQ ID NO: 61953 - DNA, 15 bp, Homo sapiens
aaaaaagagagagag

SEQ ID NO: 61954 - DNA, 15 bp, Homo sapiens
aaaaagagagagaga

SEQ ID NO: 61955 - DNA, 15 bp, Homo sapiens
aaaagagagagagag

SEQ ID NO: 61956 - DNA, 15 bp, Homo sapiens
aaagagagagagaga

SEQ ID NO: 61957 - DNA, 15 bp, Homo sapiens
aagagagagagagag

SEQ ID NO: 61958 - DNA, 15 bp, Homo sapiens
agagagagagagaga

SEQ ID NO: 61959 - DNA, 15 bp, Homo sapiens
gagagagagagagac

SEQ ID NO: 61960 - DNA, 15 bp, Homo sapiens
agagagagagagaca

SEQ ID NO: 61961 - DNA, 15 bp, Homo sapiens
gagagagagagacag

SEQ ID NO: 61962 - DNA, 15 bp, Homo sapiens
agagagagagacagg

SEQ ID NO: 61963 - DNA, 15 bp, Homo sapiens
gagagagagacaggg

SEQ ID NO: 61964 - DNA, 15 bp, Homo sapiens
agagagagacagggt

SEQ ID NO: 61965 - DNA, 15 bp, Homo sapiens
gagagagacagggtc

SEQ ID NO: 61966 - DNA, 15 bp, Homo sapiens
agagagacagggtct

SEQ ID NO: 61967 - DNA, 15 bp, Homo sapiens
gagagacagggtctt

SEQ ID NO: 61968 - DNA, 15 bp, Homo sapiens
gagacagggtcttgc

SEQ ID NO: 61969 - DNA, 15 bp, Homo sapiens
gacagggtcttgctc

SEQ ID NO: 61970 - DNA, 15 bp, Homo sapiens
tcttgctctgtcact

SEQ ID NO: 61971 - DNA, 15 bp, Homo sapiens
cttgctctgtcactc

SEQ ID NO: 61972 - DNA, 15 bp, Homo sapiens
ttgctctgtcactca

SEQ ID NO: 61973 - DNA, 15 bp, Homo sapiens
tgctctgtcactcag

SEQ ID NO: 61974 - DNA, 15 bp, Homo sapiens
gctctgtcactcagg

SEQ ID NO: 61975 - DNA, 15 bp, Homo sapiens
ctctgtcactcaggc

SEQ ID NO: 61976 - DNA, 15 bp, Homo sapiens
tctgtcactcaggct

SEQ ID NO: 61977 - DNA, 15 bp, Homo sapiens
ctgtcactcaggctg

SEQ ID NO: 61978 - DNA, 15 bp, Homo sapiens
tgtcactcaggctgg

SEQ ID NO: 61979 - DNA, 15 bp, Homo sapiens
gtcactcaggctgga

SEQ ID NO: 61980 - DNA, 15 bp, Homo sapiens
tcactcaggctggag

SEQ ID NO: 61981 - DNA, 15 bp, Homo sapiens
cactcaggctggagt

SEQ ID NO: 61982 - DNA, 15 bp, Homo sapiens
actcaggctggagtg

SEQ ID NO: 61983 - DNA, 15 bp, Homo sapiens
gagtgcagtgatgta

SEQ ID NO: 61984 - DNA, 15 bp, Homo sapiens
agtgcagtgatgtag

SEQ ID NO: 61985 - DNA, 15 bp, Homo sapiens
gtgcagtgatgtagt

SEQ ID NO: 61986 - DNA, 15 bp, Homo sapiens
tgcagtgatgtagtc

SEQ ID NO: 61987 - DNA, 15 bp, Homo sapiens
gcagtgatgtagtca

SEQ ID NO: 61988 - DNA, 15 bp, Homo sapiens
cagtgatgtagtcat

SEQ ID NO: 61989 - DNA, 15 bp, Homo sapiens
agtgatgtagtcatg

SEQ ID NO: 61990 - DNA, 15 bp, Homo sapiens
gtgatgtagtcatgg

SEQ ID NO: 61991 - DNA, 15 bp, Homo sapiens
tgatgtagtcatggc

SEQ ID NO: 61992 - DNA, 15 bp, Homo sapiens
gatgtagtcatggct

SEQ ID NO: 61993 - DNA, 15 bp, Homo sapiens
atgtagtcatggctc

SEQ ID NO: 61994 - DNA, 15 bp, Homo sapiens
tgtagtcatggctca

SEQ ID NO: 61995 - DNA, 15 bp, Homo sapiens
gtagtcatggctcac

SEQ ID NO: 61996 - DNA, 15 bp, Homo sapiens
tagtcatggctcact

SEQ ID NO: 61997 - DNA, 15 bp, Homo sapiens
agtcatggctcactg

SEQ ID NO: 61998 - DNA, 15 bp, Homo sapiens
gtcatggctcactgc

SEQ ID NO: 61999 - DNA, 15 bp, Homo sapiens
tcactgcagcctcat

SEQ ID NO: 62000 - DNA, 15 bp, Homo sapiens
cactgcagcctcata

SEQ ID NO: 62001 - DNA, 15 bp, Homo sapiens
actgcagcctcatac

SEQ ID NO: 62002 - DNA, 15 bp, Homo sapiens
ctgcagcctcatact

SEQ ID NO: 62003 - DNA, 15 bp, Homo sapiens
tgcagcctcatactc

SEQ ID NO: 62004 - DNA, 15 bp, Homo sapiens
gcagcctcatactcc

SEQ ID NO: 62005 - DNA, 15 bp, Homo sapiens
cagcctcatactcct

SEQ ID NO: 62006 - DNA, 15 bp, Homo sapiens
agcctcatactcctg

SEQ ID NO: 62007 - DNA, 15 bp, Homo sapiens
gcctcatactcctga

SEQ ID NO: 62008 - DNA, 15 bp, Homo sapiens
cctcatactcctgac

SEQ ID NO: 62009 - DNA, 15 bp, Homo sapiens
ctcatactcctgacc

SEQ ID NO: 62010 - DNA, 15 bp, Homo sapiens
tcatactcctgacct

SEQ ID NO: 62011 - DNA, 15 bp, Homo sapiens
catactcctgacctc

SEQ ID NO: 62012 - DNA, 15 bp, Homo sapiens
atactcctgacctca

SEQ ID NO: 62013 - DNA, 15 bp, Homo sapiens
tactcctgacctcag

SEQ ID NO: 62014 - DNA, 15 bp, Homo sapiens
gatcgacccgcctcg

SEQ ID NO: 62015 - DNA, 15 bp, Homo sapiens
atcgacccgcctcgg

SEQ ID NO: 62016 - DNA, 15 bp, Homo sapiens
tcgacccgcctcggc

SEQ ID NO: 62017 - DNA, 15 bp, Homo sapiens
cgacccgcctcggcc

SEQ ID NO: 62018 - DNA, 15 bp, Homo sapiens
gacccgcctcggcct

SEQ ID NO: 62019 - DNA, 15 bp, Homo sapiens
caaagtgctgggatc

SEQ ID NO: 62020 - DNA, 15 bp, Homo sapiens
aaagtgctgggatcg

SEQ ID NO: 62021 - DNA, 15 bp, Homo sapiens
aagtgctgggatcgt

SEQ ID NO: 62022 - DNA, 15 bp, Homo sapiens
agtgctgggatcgta

SEQ ID NO: 62023 - DNA, 15 bp, Homo sapiens
gtgctgggatcgtag

SEQ ID NO: 62024 - DNA, 15 bp, Homo sapiens
tgctgggatcgtagg

SEQ ID NO: 62025 - DNA, 15 bp, Homo sapiens
gctgggatcgtaggc

SEQ ID NO: 62026 - DNA, 15 bp, Homo sapiens
ctgggatcgtaggct

SEQ ID NO: 62027 - DNA, 15 bp, Homo sapiens
tgggatcgtaggctg

SEQ ID NO: 62028 - DNA, 15 bp, Homo sapiens
gggatcgtaggctga

SEQ ID NO: 62029 - DNA, 15 bp, Homo sapiens
ggatcgtaggctgaa

SEQ ID NO: 62030 - DNA, 15 bp, Homo sapiens
gatcgtaggctgaag

SEQ ID NO: 62031 - DNA, 15 bp, Homo sapiens
atcgtaggctgaagc

SEQ ID NO: 62032 - DNA, 15 bp, Homo sapiens
tcgtaggctgaagcc

SEQ ID NO: 62033 - DNA, 15 bp, Homo sapiens
cgtaggctgaagcca

SEQ ID NO: 62034 - DNA, 15 bp, Homo sapiens
gtaggctgaagccac

SEQ ID NO: 62035 - DNA, 15 bp, Homo sapiens
taggctgaagccacc

SEQ ID NO: 62036 - DNA, 15 bp, Homo sapiens
aggctgaagccacca

SEQ ID NO: 62037 - DNA, 15 bp, Homo sapiens
ggctgaagccaccat

SEQ ID NO: 62038 - DNA, 15 bp, Homo sapiens
gctgaagccaccatg

SEQ ID NO: 62039 - DNA, 15 bp, Homo sapiens
ctgaagccaccatgc

SEQ ID NO: 62040 - DNA, 15 bp, Homo sapiens
tgaagccaccatgcc

SEQ ID NO: 62041 - DNA, 15 bp, Homo sapiens
gaagccaccatgcct

SEQ ID NO: 62042 - DNA, 15 bp, Homo sapiens
aagccaccatgcctg

SEQ ID NO: 62043 - DNA, 15 bp, Homo sapiens
caccatgcctggccc

SEQ ID NO: 62044 - DNA, 15 bp, Homo sapiens
accatgcctggcccg

SEQ ID NO: 62045 - DNA, 15 bp, Homo sapiens
ccatgcctggcccga

SEQ ID NO: 62046 - DNA, 15 bp, Homo sapiens
catgcctggcccgaa

SEQ ID NO: 62047 - DNA, 15 bp, Homo sapiens
atgcctggcccgaac

SEQ ID NO: 62048 - DNA, 15 bp, Homo sapiens
tgcctggcccgaact

SEQ ID NO: 62049 - DNA, 15 bp, Homo sapiens
gcctggcccgaactc

SEQ ID NO: 62050 - DNA, 15 bp, Homo sapiens
cctggcccgaactca

SEQ ID NO: 62051 - DNA, 15 bp, Homo sapiens
ctggcccgaactcat

SEQ ID NO: 62052 - DNA, 15 bp, Homo sapiens
tggcccgaactcatt

SEQ ID NO: 62053 - DNA, 15 bp, Homo sapiens
ggcccgaactcattt

SEQ ID NO: 62054 - DNA, 15 bp, Homo sapiens
gcccgaactcatttg

SEQ ID NO: 62055 - DNA, 15 bp, Homo sapiens
cccgaactcatttgt

SEQ ID NO: 62056 - DNA, 15 bp, Homo sapiens
ccgaactcatttgtt

SEQ ID NO: 62057 - DNA, 15 bp, Homo sapiens
cgaactcatttgttt

SEQ ID NO: 62058 - DNA, 15 bp, Homo sapiens
gaactcatttgtttt

SEQ ID NO: 62059 - DNA, 15 bp, Homo sapiens
aactcatttgttttt

SEQ ID NO: 62060 - DNA, 15 bp, Homo sapiens
actcatttgttttta

SEQ ID NO: 62061 - DNA, 15 bp, Homo sapiens
ctcatttgtttttat

SEQ ID NO: 62062 - DNA, 15 bp, Homo sapiens
tcatttgtttttatt

SEQ ID NO: 62063 - DNA, 15 bp, Homo sapiens
catttgtttttattt

SEQ ID NO: 62064 - DNA, 15 bp, Homo sapiens
atttgtttttatttg

SEQ ID NO: 62065 - DNA, 15 bp, Homo sapiens
tttgtttttatttgc

SEQ ID NO: 62066 - DNA, 15 bp, Homo sapiens
ttgtttttatttgca

SEQ ID NO: 62067 - DNA, 15 bp, Homo sapiens
tgtttttatttgcat

SEQ ID NO: 62068 - DNA, 15 bp, Homo sapiens
gtttttatttgcatt

SEQ ID NO: 62069 - DNA, 15 bp, Homo sapiens
tttttatttgcatta

SEQ ID NO: 62070 - DNA, 15 bp, Homo sapiens
ttttatttgcattaa

SEQ ID NO: 62071 - DNA, 15 bp, Homo sapiens
tttatttgcattaag

SEQ ID NO: 62072 - DNA, 15 bp, Homo sapiens
ttatttgcattaagt

SEQ ID NO: 62073 - DNA, 15 bp, Homo sapiens
tatttgcattaagtg

SEQ ID NO: 62074 - DNA, 15 bp, Homo sapiens
atttgcattaagtgt

SEQ ID NO: 62075 - DNA, 15 bp, Homo sapiens
tttgcattaagtgta

SEQ ID NO: 62076 - DNA, 15 bp, Homo sapiens
ttgcattaagtgtaa

SEQ ID NO: 62077 - DNA, 15 bp, Homo sapiens
tgcattaagtgtaat

SEQ ID NO: 62078 - DNA, 15 bp, Homo sapiens
gcattaagtgtaata

SEQ ID NO: 62079 - DNA, 15 bp, Homo sapiens
cattaagtgtaataa

SEQ ID NO: 62080 - DNA, 15 bp, Homo sapiens
attaagtgtaataag

SEQ ID NO: 62081 - DNA, 15 bp, Homo sapiens
ttaagtgtaataagg

SEQ ID NO: 62082 - DNA, 15 bp, Homo sapiens
taagtgtaataaggt

SEQ ID NO: 62083 - DNA, 15 bp, Homo sapiens
aagtgtaataaggtt

SEQ ID NO: 62084 - DNA, 15 bp, Homo sapiens
agtgtaataaggttt

SEQ ID NO: 62085 - DNA, 15 bp, Homo sapiens
gtgtaataaggtttt

SEQ ID NO: 62086 - DNA, 15 bp, Homo sapiens
tgtaataaggttttg

SEQ ID NO: 62087 - DNA, 15 bp, Homo sapiens
gtaataaggttttgt

SEQ ID NO: 62088 - DNA, 15 bp, Homo sapiens
taataaggttttgtt

SEQ ID NO: 62089 - DNA, 15 bp, Homo sapiens
aataaggttttgtta

SEQ ID NO: 62090 - DNA, 15 bp, Homo sapiens
ataaggttttgttac

SEQ ID NO: 62091 - DNA, 15 bp, Homo sapiens
taaggttttgttact

SEQ ID NO: 62092 - DNA, 15 bp, Homo sapiens
aaggttttgttactt

SEQ ID NO: 62093 - DNA, 15 bp, Homo sapiens
aggttttgttacttt

SEQ ID NO: 62094 - DNA, 15 bp, Homo sapiens
ggttttgttactttt

SEQ ID NO: 62095 - DNA, 15 bp, Homo sapiens
gttttgttactttta

SEQ ID NO: 62096 - DNA, 15 bp, Homo sapiens
ttttgttacttttag

SEQ ID NO: 62097 - DNA, 15 bp, Homo sapiens
tttgttacttttagt

SEQ ID NO: 62098 - DNA, 15 bp, Homo sapiens
ttgttacttttagtt

SEQ ID NO: 62099 - DNA, 15 bp, Homo sapiens
tgttacttttagttt

SEQ ID NO: 62100 - DNA, 15 bp, Homo sapiens
gttacttttagtttg

SEQ ID NO: 62101 - DNA, 15 bp, Homo sapiens
ttacttttagtttga

SEQ ID NO: 62102 - DNA, 15 bp, Homo sapiens
tacttttagtttgaa

SEQ ID NO: 62103 - DNA, 15 bp, Homo sapiens
acttttagtttgaat

SEQ ID NO: 62104 - DNA, 15 bp, Homo sapiens
cttttagtttgaatt

SEQ ID NO: 62105 - DNA, 15 bp, Homo sapiens
ttttagtttgaattt

SEQ ID NO: 62106 - DNA, 15 bp, Homo sapiens
tttagtttgaatttt

SEQ ID NO: 62107 - DNA, 15 bp, Homo sapiens
ttagtttgaatttta

SEQ ID NO: 62108 - DNA, 15 bp, Homo sapiens
tagtttgaattttat

SEQ ID NO: 62109 - DNA, 15 bp, Homo sapiens
agtttgaattttatt

SEQ ID NO: 62110 - DNA, 15 bp, Homo sapiens
gtttgaattttattt

SEQ ID NO: 62111 - DNA, 15 bp, Homo sapiens
tttgaattttatttt

SEQ ID NO: 62112 - DNA, 15 bp, Homo sapiens
ttgaattttattttg

SEQ ID NO: 62113 - DNA, 15 bp, Homo sapiens
tgaattttattttgg

SEQ ID NO: 62114 - DNA, 15 bp, Homo sapiens
gaattttattttggg

SEQ ID NO: 62115 - DNA, 15 bp, Homo sapiens
aattttattttgggt

SEQ ID NO: 62116 - DNA, 15 bp, Homo sapiens
attttattttgggta

SEQ ID NO: 62117 - DNA, 15 bp, Homo sapiens
ttttattttgggtaa

SEQ ID NO: 62118 - DNA, 15 bp, Homo sapiens
tttattttgggtaat

SEQ ID NO: 62119 - DNA, 15 bp, Homo sapiens
ttattttgggtaata

SEQ ID NO: 62120 - DNA, 15 bp, Homo sapiens
tattttgggtaatat

SEQ ID NO: 62121 - DNA, 15 bp, Homo sapiens
attttgggtaatata

SEQ ID NO: 62122 - DNA, 15 bp, Homo sapiens
ttttgggtaatataa

SEQ ID NO: 62123 - DNA, 15 bp, Homo sapiens
tttgggtaatataaa

SEQ ID NO: 62124 - DNA, 15 bp, Homo sapiens
ttgggtaatataaac

SEQ ID NO: 62125 - DNA, 15 bp, Homo sapiens
tgggtaatataaaca

SEQ ID NO: 62126 - DNA, 15 bp, Homo sapiens
gggtaatataaacat

SEQ ID NO: 62127 - DNA, 15 bp, Homo sapiens
ggtaatataaacatt

SEQ ID NO: 62128 - DNA, 15 bp, Homo sapiens
gtaatataaacattt

SEQ ID NO: 62129 - DNA, 15 bp, Homo sapiens
taatataaacattta

SEQ ID NO: 62130 - DNA, 15 bp, Homo sapiens
aatataaacatttac

SEQ ID NO: 62131 - DNA, 15 bp, Homo sapiens
atataaacatttaca

SEQ ID NO: 62132 - DNA, 15 bp, Homo sapiens
tataaacatttacat

SEQ ID NO: 62133 - DNA, 15 bp, Homo sapiens
ataaacatttacatg

SEQ ID NO: 62134 - DNA, 15 bp, Homo sapiens
taaacatttacatga

SEQ ID NO: 62135 - DNA, 15 bp, Homo sapiens
aaacatttacatgat

SEQ ID NO: 62136 - DNA, 15 bp, Homo sapiens
aacatttacatgatt

SEQ ID NO: 62137 - DNA, 15 bp, Homo sapiens
acatttacatgattc

SEQ ID NO: 62138 - DNA, 15 bp, Homo sapiens
catttacatgattca

SEQ ID NO: 62139 - DNA, 15 bp, Homo sapiens
atttacatgattcag

SEQ ID NO: 62140 - DNA, 15 bp, Homo sapiens
tttacatgattcaga

SEQ ID NO: 62141 - DNA, 15 bp, Homo sapiens
ttacatgattcagaa

SEQ ID NO: 62142 - DNA, 15 bp, Homo sapiens
tacatgattcagaag

SEQ ID NO: 62143 - DNA, 15 bp, Homo sapiens
acatgattcagaagt

SEQ ID NO: 62144 - DNA, 15 bp, Homo sapiens
catgattcagaagtc

SEQ ID NO: 62145 - DNA, 15 bp, Homo sapiens
atgattcagaagtca

SEQ ID NO: 62146 - DNA, 15 bp, Homo sapiens
tgattcagaagtcag

SEQ ID NO: 62147 - DNA, 15 bp, Homo sapiens
gattcagaagtcaga

SEQ ID NO: 62148 - DNA, 15 bp, Homo sapiens
attcagaagtcagaa

SEQ ID NO: 62149 - DNA, 15 bp, Homo sapiens
ttcagaagtcagaat

SEQ ID NO: 62150 - DNA, 15 bp, Homo sapiens
tcagaagtcagaatt

SEQ ID NO: 62151 - DNA, 15 bp, Homo sapiens
cagaagtcagaatta

SEQ ID NO: 62152 - DNA, 15 bp, Homo sapiens
agaagtcagaattac

SEQ ID NO: 62153 - DNA, 15 bp, Homo sapiens
gaagtcagaattaca

SEQ ID NO: 62154 - DNA, 15 bp, Homo sapiens
aagtcagaattacac

SEQ ID NO: 62155 - DNA, 15 bp, Homo sapiens
agtcagaattacact

SEQ ID NO: 62156 - DNA, 15 bp, Homo sapiens
gtcagaattacactg

SEQ ID NO: 62157 - DNA, 15 bp, Homo sapiens
tcagaattacactga

SEQ ID NO: 62158 - DNA, 15 bp, Homo sapiens
cagaattacactgag

SEQ ID NO: 62159 - DNA, 15 bp, Homo sapiens
agaattacactgagg

SEQ ID NO: 62160 - DNA, 15 bp, Homo sapiens
gaattacactgaggc

SEQ ID NO: 62161 - DNA, 15 bp, Homo sapiens
aattacactgaggca

SEQ ID NO: 62162 - DNA, 15 bp, Homo sapiens
attacactgaggcat

SEQ ID NO: 62163 - DNA, 15 bp, Homo sapiens
ttacactgaggcatg

SEQ ID NO: 62164 - DNA, 15 bp, Homo sapiens
tacactgaggcatgt

SEQ ID NO: 62165 - DNA, 15 bp, Homo sapiens
acactgaggcatgtt

SEQ ID NO: 62166 - DNA, 15 bp, Homo sapiens
cactgaggcatgttc

SEQ ID NO: 62167 - DNA, 15 bp, Homo sapiens
actgaggcatgttca

SEQ ID NO: 62168 - DNA, 15 bp, Homo sapiens
ctgaggcatgttcag

SEQ ID NO: 62169 - DNA, 15 bp, Homo sapiens
tgaggcatgttcagc

SEQ ID NO: 62170 - DNA, 15 bp, Homo sapiens
gaggcatgttcagct

SEQ ID NO: 62171 - DNA, 15 bp, Homo sapiens
aggcatgttcagcta

SEQ ID NO: 62172 - DNA, 15 bp, Homo sapiens
ggcatgttcagctag

SEQ ID NO: 62173 - DNA, 15 bp, Homo sapiens
gcatgttcagctagg

SEQ ID NO: 62174 - DNA, 15 bp, Homo sapiens
catgttcagctaggc

SEQ ID NO: 62175 - DNA, 15 bp, Homo sapiens
atgttcagctaggcc

SEQ ID NO: 62176 - DNA, 15 bp, Homo sapiens
tgttcagctaggcct

SEQ ID NO: 62177 - DNA, 15 bp, Homo sapiens
gttcagctaggcctc

SEQ ID NO: 62178 - DNA, 15 bp, Homo sapiens
ttcagctaggcctca

SEQ ID NO: 62179 - DNA, 15 bp, Homo sapiens
tcagctaggcctcac

SEQ ID NO: 62180 - DNA, 15 bp, Homo sapiens
cagctaggcctcact

SEQ ID NO: 62181 - DNA, 15 bp, Homo sapiens
agctaggcctcactc

SEQ ID NO: 62182 - DNA, 15 bp, Homo sapiens
gctaggcctcactcc

SEQ ID NO: 62183 - DNA, 15 bp, Homo sapiens
ctaggcctcactcct

SEQ ID NO: 62184 - DNA, 15 bp, Homo sapiens
taggcctcactcctg

SEQ ID NO: 62185 - DNA, 15 bp, Homo sapiens
aggcctcactcctgt

SEQ ID NO: 62186 - DNA, 15 bp, Homo sapiens
ggcctcactcctgtg

SEQ ID NO: 62187 - DNA, 15 bp, Homo sapiens
gcctcactcctgtgc

SEQ ID NO: 62188 - DNA, 15 bp, Homo sapiens
cctcactcctgtgcc

SEQ ID NO: 62189 - DNA, 15 bp, Homo sapiens
ctcactcctgtgcct

SEQ ID NO: 62190 - DNA, 15 bp, Homo sapiens
tcactcctgtgcctg

SEQ ID NO: 62191 - DNA, 15 bp, Homo sapiens
cactcctgtgcctgt

SEQ ID NO: 62192 - DNA, 15 bp, Homo sapiens
actcctgtgcctgta

SEQ ID NO: 62193 - DNA, 15 bp, Homo sapiens
ctcctgtgcctgtac

SEQ ID NO: 62194 - DNA, 15 bp, Homo sapiens
tcctgtgcctgtacc

SEQ ID NO: 62195 - DNA, 15 bp, Homo sapiens
cctgtgcctgtaccc

SEQ ID NO: 62196 - DNA, 15 bp, Homo sapiens
ctgtgcctgtaccct

SEQ ID NO: 62197 - DNA, 15 bp, Homo sapiens
tgtgcctgtaccctt

SEQ ID NO: 62198 - DNA, 15 bp, Homo sapiens
gtgcctgtaccctta

SEQ ID NO: 62199 - DNA, 15 bp, Homo sapiens
tgcctgtacccttac

SEQ ID NO: 62200 - DNA, 15 bp, Homo sapiens
gcctgtacccttacc

SEQ ID NO: 62201 - DNA, 15 bp, Homo sapiens
cctgtacccttacct

SEQ ID NO: 62202 - DNA, 15 bp, Homo sapiens
ctgtacccttacctt

SEQ ID NO: 62203 - DNA, 15 bp, Homo sapiens
tgtacccttaccttt

SEQ ID NO: 62204 - DNA, 15 bp, Homo sapiens
gtacccttacctttt

SEQ ID NO: 62205 - DNA, 15 bp, Homo sapiens
tacccttaccttttt

SEQ ID NO: 62206 - DNA, 15 bp, Homo sapiens
acccttacctttttc

SEQ ID NO: 62207 - DNA, 15 bp, Homo sapiens
cccttacctttttcc

SEQ ID NO: 62208 - DNA, 15 bp, Homo sapiens
ccttacctttttccc

SEQ ID NO: 62209 - DNA, 15 bp, Homo sapiens
cttacctttttcccc

SEQ ID NO: 62210 - DNA, 15 bp, Homo sapiens
ttacctttttccccc

SEQ ID NO: 62211 - DNA, 15 bp, Homo sapiens
tacctttttccccct

SEQ ID NO: 62212 - DNA, 15 bp, Homo sapiens
acctttttcccccta

SEQ ID NO: 62213 - DNA, 15 bp, Homo sapiens
cctttttccccctac

SEQ ID NO: 62214 - DNA, 15 bp, Homo sapiens
ctttttccccctacc

SEQ ID NO: 62215 - DNA, 15 bp, Homo sapiens
tttttccccctaccc

SEQ ID NO: 62216 - DNA, 15 bp, Homo sapiens
ttttccccctacccc

SEQ ID NO: 62217 - DNA, 15 bp, Homo sapiens
tttccccctacccca

SEQ ID NO: 62218 - DNA, 15 bp, Homo sapiens
ttccccctaccccat

SEQ ID NO: 62219 - DNA, 15 bp, Homo sapiens
tccccctaccccatg

SEQ ID NO: 62220 - DNA, 15 bp, Homo sapiens
ccccctaccccatgc

SEQ ID NO: 62221 - DNA, 15 bp, Homo sapiens
cccctaccccatgca

SEQ ID NO: 62222 - DNA, 15 bp, Homo sapiens
ccctaccccatgcag

SEQ ID NO: 62223 - DNA, 15 bp, Homo sapiens
cctaccccatgcagg

SEQ ID NO: 62224 - DNA, 15 bp, Homo sapiens
ctaccccatgcaggg

SEQ ID NO: 62225 - DNA, 15 bp, Homo sapiens
taccccatgcaggga

SEQ ID NO: 62226 - DNA, 15 bp, Homo sapiens
accccatgcagggaa

SEQ ID NO: 62227 - DNA, 15 bp, Homo sapiens
ccccatgcagggaat

SEQ ID NO: 62228 - DNA, 15 bp, Homo sapiens
cccatgcagggaatc

SEQ ID NO: 62229 - DNA, 15 bp, Homo sapiens
ccatgcagggaatca

SEQ ID NO: 62230 - DNA, 15 bp, Homo sapiens
catgcagggaatcaa

SEQ ID NO: 62231 - DNA, 15 bp, Homo sapiens
atgcagggaatcaat

SEQ ID NO: 62232 - DNA, 15 bp, Homo sapiens
tgcagggaatcaatt

SEQ ID NO: 62233 - DNA, 15 bp, Homo sapiens
gcagggaatcaattt

SEQ ID NO: 62234 - DNA, 15 bp, Homo sapiens
cagggaatcaatttc

SEQ ID NO: 62235 - DNA, 15 bp, Homo sapiens
agggaatcaatttca

SEQ ID NO: 62236 - DNA, 15 bp, Homo sapiens
gggaatcaatttcat

SEQ ID NO: 62237 - DNA, 15 bp, Homo sapiens
ggaatcaatttcatt

SEQ ID NO: 62238 - DNA, 15 bp, Homo sapiens
gaatcaatttcatta

SEQ ID NO: 62239 - DNA, 15 bp, Homo sapiens
aatcaatttcattag

SEQ ID NO: 62240 - DNA, 15 bp, Homo sapiens
atcaatttcattagt

SEQ ID NO: 62241 - DNA, 15 bp, Homo sapiens
tcaatttcattagtt

SEQ ID NO: 62242 - DNA, 15 bp, Homo sapiens
caatttcattagttc

SEQ ID NO: 62243 - DNA, 15 bp, Homo sapiens
aatttcattagttcc

SEQ ID NO: 62244 - DNA, 15 bp, Homo sapiens
atttcattagttcct

SEQ ID NO: 62245 - DNA, 15 bp, Homo sapiens
tttcattagttcctg

SEQ ID NO: 62246 - DNA, 15 bp, Homo sapiens
ttcattagttcctgg

SEQ ID NO: 62247 - DNA, 15 bp, Homo sapiens
tcattagttcctggt

SEQ ID NO: 62248 - DNA, 15 bp, Homo sapiens
cattagttcctggtg

SEQ ID NO: 62249 - DNA, 15 bp, Homo sapiens
attagttcctggtgt

SEQ ID NO: 62250 - DNA, 15 bp, Homo sapiens
ttagttcctggtgtg

SEQ ID NO: 62251 - DNA, 15 bp, Homo sapiens
tagttcctggtgtgt

SEQ ID NO: 62252 - DNA, 15 bp, Homo sapiens
agttcctggtgtgtc

SEQ ID NO: 62253 - DNA, 15 bp, Homo sapiens
gttcctggtgtgtcc

SEQ ID NO: 62254 - DNA, 15 bp, Homo sapiens
ttcctggtgtgtcct

SEQ ID NO: 62255 - DNA, 15 bp, Homo sapiens
tcctggtgtgtcctt

SEQ ID NO: 62256 - DNA, 15 bp, Homo sapiens
cctggtgtgtccttc

SEQ ID NO: 62257 - DNA, 15 bp, Homo sapiens
ctggtgtgtccttcc

SEQ ID NO: 62258 - DNA, 15 bp, Homo sapiens
tggtgtgtccttcct

SEQ ID NO: 62259 - DNA, 15 bp, Homo sapiens
ggtgtgtccttcctt

SEQ ID NO: 62260 - DNA, 15 bp, Homo sapiens
gtgtgtccttcctta

SEQ ID NO: 62261 - DNA, 15 bp, Homo sapiens
tgtgtccttccttaa

SEQ ID NO: 62262 - DNA, 15 bp, Homo sapiens
gtgtccttccttaat

SEQ ID NO: 62263 - DNA, 15 bp, Homo sapiens
tgtccttccttaata

SEQ ID NO: 62264 - DNA, 15 bp, Homo sapiens
gtccttccttaatac

SEQ ID NO: 62265 - DNA, 15 bp, Homo sapiens
tccttccttaatacc

SEQ ID NO: 62266 - DNA, 15 bp, Homo sapiens
ccttccttaataccc

SEQ ID NO: 62267 - DNA, 15 bp, Homo sapiens
cttccttaatacccc

SEQ ID NO: 62268 - DNA, 15 bp, Homo sapiens
ttccttaataccccc

SEQ ID NO: 62269 - DNA, 15 bp, Homo sapiens
tccttaatacccccc

SEQ ID NO: 62270 - DNA, 15 bp, Homo sapiens
ccttaataccccccc

SEQ ID NO: 62271 - DNA, 15 bp, Homo sapiens
cttaataccccccct

SEQ ID NO: 62272 - DNA, 15 bp, Homo sapiens
ttaataccccccctt

SEQ ID NO: 62273 - DNA, 15 bp, Homo sapiens
taatacccccccttc

SEQ ID NO: 62274 - DNA, 15 bp, Homo sapiens
aatacccccccttct

SEQ ID NO: 62275 - DNA, 15 bp, Homo sapiens
atacccccccttctt

SEQ ID NO: 62276 - DNA, 15 bp, Homo sapiens
tacccccccttcttt

SEQ ID NO: 62277 - DNA, 15 bp, Homo sapiens
acccccccttctttc

SEQ ID NO: 62278 - DNA, 15 bp, Homo sapiens
cccccccttctttct

SEQ ID NO: 62279 - DNA, 15 bp, Homo sapiens
ccccccttctttctt

SEQ ID NO: 62280 - DNA, 15 bp, Homo sapiens
cccccttctttcttt

SEQ ID NO: 62281 - DNA, 15 bp, Homo sapiens
ccccttctttctttg

SEQ ID NO: 62282 - DNA, 15 bp, Homo sapiens
cccttctttctttgg

SEQ ID NO: 62283 - DNA, 15 bp, Homo sapiens
ccttctttctttggt

SEQ ID NO: 62284 - DNA, 15 bp, Homo sapiens
cttctttctttggta

SEQ ID NO: 62285 - DNA, 15 bp, Homo sapiens
ttctttctttggtag

SEQ ID NO: 62286 - DNA, 15 bp, Homo sapiens
tctttctttggtaga

SEQ ID NO: 62287 - DNA, 15 bp, Homo sapiens
ctttctttggtagaa

SEQ ID NO: 62288 - DNA, 15 bp, Homo sapiens
tttctttggtagaat

SEQ ID NO: 62289 - DNA, 15 bp, Homo sapiens
ttctttggtagaatg

SEQ ID NO: 62290 - DNA, 15 bp, Homo sapiens
tctttggtagaatgc

SEQ ID NO: 62291 - DNA, 15 bp, Homo sapiens
ctttggtagaatgca

SEQ ID NO: 62292 - DNA, 15 bp, Homo sapiens
tttggtagaatgcag

SEQ ID NO: 62293 - DNA, 15 bp, Homo sapiens
ttggtagaatgcagt

SEQ ID NO: 62294 - DNA, 15 bp, Homo sapiens
tggtagaatgcagta

SEQ ID NO: 62295 - DNA, 15 bp, Homo sapiens
ggtagaatgcagtag

SEQ ID NO: 62296 - DNA, 15 bp, Homo sapiens
gtagaatgcagtaga

SEQ ID NO: 62297 - DNA, 15 bp, Homo sapiens
tagaatgcagtagat

SEQ ID NO: 62298 - DNA, 15 bp, Homo sapiens
agaatgcagtagata

SEQ ID NO: 62299 - DNA, 15 bp, Homo sapiens
gaatgcagtagatat

SEQ ID NO: 62300 - DNA, 15 bp, Homo sapiens
aatgcagtagatatg

SEQ ID NO: 62301 - DNA, 15 bp, Homo sapiens
atgcagtagatatgt

SEQ ID NO: 62302 - DNA, 15 bp, Homo sapiens
tgcagtagatatgtt

SEQ ID NO: 62303 - DNA, 15 bp, Homo sapiens
gcagtagatatgttt

SEQ ID NO: 62304 - DNA, 15 bp, Homo sapiens
cagtagatatgtttg

SEQ ID NO: 62305 - DNA, 15 bp, Homo sapiens
agtagatatgtttgc

SEQ ID NO: 62306 - DNA, 15 bp, Homo sapiens
gtagatatgtttgcg

SEQ ID NO: 62307 - DNA, 15 bp, Homo sapiens
tagatatgtttgcgc

SEQ ID NO: 62308 - DNA, 15 bp, Homo sapiens
agatatgtttgcgct

SEQ ID NO: 62309 - DNA, 15 bp, Homo sapiens
gatatgtttgcgctt

SEQ ID NO: 62310 - DNA, 15 bp, Homo sapiens
atatgtttgcgcttt

SEQ ID NO: 62311 - DNA, 15 bp, Homo sapiens
tatgtttgcgctttg

SEQ ID NO: 62312 - DNA, 15 bp, Homo sapiens
atgtttgcgctttgc

SEQ ID NO: 62313 - DNA, 15 bp, Homo sapiens
tgtttgcgctttgct

SEQ ID NO: 62314 - DNA, 15 bp, Homo sapiens
gtttgcgctttgctc

SEQ ID NO: 62315 - DNA, 15 bp, Homo sapiens
tttgcgctttgctcc

SEQ ID NO: 62316 - DNA, 15 bp, Homo sapiens
ttgcgctttgctccc

SEQ ID NO: 62317 - DNA, 15 bp, Homo sapiens
tgcgctttgctccct

SEQ ID NO: 62318 - DNA, 15 bp, Homo sapiens
gcgctttgctccctt

SEQ ID NO: 62319 - DNA, 15 bp, Homo sapiens
cgctttgctcccttt

SEQ ID NO: 62320 - DNA, 15 bp, Homo sapiens
gctttgctccctttg

SEQ ID NO: 62321 - DNA, 15 bp, Homo sapiens
ctttgctccctttgc

SEQ ID NO: 62322 - DNA, 15 bp, Homo sapiens
tttgctccctttgct

SEQ ID NO: 62323 - DNA, 15 bp, Homo sapiens
ttgctccctttgctt

SEQ ID NO: 62324 - DNA, 15 bp, Homo sapiens
tgctccctttgcttc

SEQ ID NO: 62325 - DNA, 15 bp, Homo sapiens
gctccctttgcttca

SEQ ID NO: 62326 - DNA, 15 bp, Homo sapiens
ctccctttgcttcac

SEQ ID NO: 62327 - DNA, 15 bp, Homo sapiens
tccctttgcttcaca

SEQ ID NO: 62328 - DNA, 15 bp, Homo sapiens
ccctttgcttcacag

SEQ ID NO: 62329 - DNA, 15 bp, Homo sapiens
cctttgcttcacagt

SEQ ID NO: 62330 - DNA, 15 bp, Homo sapiens
ctttgcttcacagtg

SEQ ID NO: 62331 - DNA, 15 bp, Homo sapiens
tttgcttcacagtgg

SEQ ID NO: 62332 - DNA, 15 bp, Homo sapiens
ttgcttcacagtgga

SEQ ID NO: 62333 - DNA, 15 bp, Homo sapiens
tgcttcacagtggat

SEQ ID NO: 62334 - DNA, 15 bp, Homo sapiens
gcttcacagtggatc

SEQ ID NO: 62335 - DNA, 15 bp, Homo sapiens
cttcacagtggatcc

SEQ ID NO: 62336 - DNA, 15 bp, Homo sapiens
ttcacagtggatcct

SEQ ID NO: 62337 - DNA, 15 bp, Homo sapiens
tcacagtggatcctg

SEQ ID NO: 62338 - DNA, 15 bp, Homo sapiens
cacagtggatcctgg

SEQ ID NO: 62339 - DNA, 15 bp, Homo sapiens
acagtggatcctgga

SEQ ID NO: 62340 - DNA, 15 bp, Homo sapiens
cagtggatcctggaa

SEQ ID NO: 62341 - DNA, 15 bp, Homo sapiens
agtggatcctggaaa

SEQ ID NO: 62342 - DNA, 15 bp, Homo sapiens
gtggatcctggaaat

SEQ ID NO: 62343 - DNA, 15 bp, Homo sapiens
tggatcctggaaatg

SEQ ID NO: 62344 - DNA, 15 bp, Homo sapiens
ggatcctggaaatga

SEQ ID NO: 62345 - DNA, 15 bp, Homo sapiens
gatcctggaaatgac

SEQ ID NO: 62346 - DNA, 15 bp, Homo sapiens
atcctggaaatgact

SEQ ID NO: 62347 - DNA, 15 bp, Homo sapiens
tcctggaaatgactc

SEQ ID NO: 62348 - DNA, 15 bp, Homo sapiens
cctggaaatgactcc

SEQ ID NO: 62349 - DNA, 15 bp, Homo sapiens
ctggaaatgactcca

SEQ ID NO: 62350 - DNA, 15 bp, Homo sapiens
tggaaatgactccat

SEQ ID NO: 62351 - DNA, 15 bp, Homo sapiens
ggaaatgactccatc

SEQ ID NO: 62352 - DNA, 15 bp, Homo sapiens
gaaatgactccatcg

SEQ ID NO: 62353 - DNA, 15 bp, Homo sapiens
aaatgactccatcgc

SEQ ID NO: 62354 - DNA, 15 bp, Homo sapiens
aatgactccatcgca

SEQ ID NO: 62355 - DNA, 15 bp, Homo sapiens
atgactccatcgcag

SEQ ID NO: 62356 - DNA, 15 bp, Homo sapiens
tgactccatcgcagt

SEQ ID NO: 62357 - DNA, 15 bp, Homo sapiens
gactccatcgcagtt

SEQ ID NO: 62358 - DNA, 15 bp, Homo sapiens
actccatcgcagttc

SEQ ID NO: 62359 - DNA, 15 bp, Homo sapiens
ctccatcgcagttct

SEQ ID NO: 62360 - DNA, 15 bp, Homo sapiens
tccatcgcagttctt

SEQ ID NO: 62361 - DNA, 15 bp, Homo sapiens
ccatcgcagttctta

SEQ ID NO: 62362 - DNA, 15 bp, Homo sapiens
catcgcagttcttag

SEQ ID NO: 62363 - DNA, 15 bp, Homo sapiens
atcgcagttcttaga

SEQ ID NO: 62364 - DNA, 15 bp, Homo sapiens
tcgcagttcttagag

SEQ ID NO: 62365 - DNA, 15 bp, Homo sapiens
cgcagttcttagagc

SEQ ID NO: 62366 - DNA, 15 bp, Homo sapiens
gcagttcttagagct

SEQ ID NO: 62367 - DNA, 15 bp, Homo sapiens
cagttcttagagctc

SEQ ID NO: 62368 - DNA, 15 bp, Homo sapiens
agttcttagagctct

SEQ ID NO: 62369 - DNA, 15 bp, Homo sapiens
gttcttagagctctt

SEQ ID NO: 62370 - DNA, 15 bp, Homo sapiens
ttcttagagctcttg

SEQ ID NO: 62371 - DNA, 15 bp, Homo sapiens
tcttagagctcttgt

SEQ ID NO: 62372 - DNA, 15 bp, Homo sapiens
cttagagctcttgtt

SEQ ID NO: 62373 - DNA, 15 bp, Homo sapiens
ttagagctcttgttt

SEQ ID NO: 62374 - DNA, 15 bp, Homo sapiens
tagagctcttgttta

SEQ ID NO: 62375 - DNA, 15 bp, Homo sapiens
agagctcttgtttag

SEQ ID NO: 62376 - DNA, 15 bp, Homo sapiens
gagctcttgtttagt

SEQ ID NO: 62377 - DNA, 15 bp, Homo sapiens
agctcttgtttagtc

SEQ ID NO: 62378 - DNA, 15 bp, Homo sapiens
gctcttgtttagtcc

SEQ ID NO: 62379 - DNA, 15 bp, Homo sapiens
ctcttgtttagtccc

SEQ ID NO: 62380 - DNA, 15 bp, Homo sapiens
tcttgtttagtccct

SEQ ID NO: 62381 - DNA, 15 bp, Homo sapiens
cttgtttagtccctt

SEQ ID NO: 62382 - DNA, 15 bp, Homo sapiens
ttgtttagtcccttt

SEQ ID NO: 62383 - DNA, 15 bp, Homo sapiens
tgtttagtccctttg

SEQ ID NO: 62384 - DNA, 15 bp, Homo sapiens
gtttagtccctttgg

SEQ ID NO: 62385 - DNA, 15 bp, Homo sapiens
tttagtccctttgga

SEQ ID NO: 62386 - DNA, 15 bp, Homo sapiens
ttagtccctttggat

SEQ ID NO: 62387 - DNA, 15 bp, Homo sapiens
tagtccctttggatc

SEQ ID NO: 62388 - DNA, 15 bp, Homo sapiens
agtccctttggatct

SEQ ID NO: 62389 - DNA, 15 bp, Homo sapiens
gtccctttggatctg

SEQ ID NO: 62390 - DNA, 15 bp, Homo sapiens
tccctttggatctgc

SEQ ID NO: 62391 - DNA, 15 bp, Homo sapiens
ccctttggatctgca

SEQ ID NO: 62392 - DNA, 15 bp, Homo sapiens
cctttggatctgcac

SEQ ID NO: 62393 - DNA, 15 bp, Homo sapiens
ctttggatctgcaca

SEQ ID NO: 62394 - DNA, 15 bp, Homo sapiens
tttggatctgcacag

SEQ ID NO: 62395 - DNA, 15 bp, Homo sapiens
ttggatctgcacagt

SEQ ID NO: 62396 - DNA, 15 bp, Homo sapiens
tggatctgcacagta

SEQ ID NO: 62397 - DNA, 15 bp, Homo sapiens
ggatctgcacagtac

SEQ ID NO: 62398 - DNA, 15 bp, Homo sapiens
gatctgcacagtact

SEQ ID NO: 62399 - DNA, 15 bp, Homo sapiens
atctgcacagtactc

SEQ ID NO: 62400 - DNA, 15 bp, Homo sapiens
tctgcacagtactcc

SEQ ID NO: 62401 - DNA, 15 bp, Homo sapiens
ctgcacagtactcca

SEQ ID NO: 62402 - DNA, 15 bp, Homo sapiens
tgcacagtactccag

SEQ ID NO: 62403 - DNA, 15 bp, Homo sapiens
gcacagtactccagt

SEQ ID NO: 62404 - DNA, 15 bp, Homo sapiens
cacagtactccagtg

SEQ ID NO: 62405 - DNA, 15 bp, Homo sapiens
acagtactccagtgt

SEQ ID NO: 62406 - DNA, 15 bp, Homo sapiens
cagtactccagtgtg

SEQ ID NO: 62407 - DNA, 15 bp, Homo sapiens
agtactccagtgtgt

SEQ ID NO: 62408 - DNA, 15 bp, Homo sapiens
gtactccagtgtgtg

SEQ ID NO: 62409 - DNA, 15 bp, Homo sapiens
tactccagtgtgtgg

SEQ ID NO: 62410 - DNA, 15 bp, Homo sapiens
actccagtgtgtggg

SEQ ID NO: 62411 - DNA, 15 bp, Homo sapiens
ctccagtgtgtgggc

SEQ ID NO: 62412 - DNA, 15 bp, Homo sapiens
tccagtgtgtgggcg

SEQ ID NO: 62413 - DNA, 15 bp, Homo sapiens
ccagtgtgtgggcgc

SEQ ID NO: 62414 - DNA, 15 bp, Homo sapiens
cagtgtgtgggcgca

SEQ ID NO: 62415 - DNA, 15 bp, Homo sapiens
agtgtgtgggcgcac

SEQ ID NO: 62416 - DNA, 15 bp, Homo sapiens
gtgtgtgggcgcacc

SEQ ID NO: 62417 - DNA, 15 bp, Homo sapiens
tgtgtgggcgcacca

SEQ ID NO: 62418 - DNA, 15 bp, Homo sapiens
gtgtgggcgcaccat

SEQ ID NO: 62419 - DNA, 15 bp, Homo sapiens
tgtgggcgcaccata

SEQ ID NO: 62420 - DNA, 15 bp, Homo sapiens
gtgggcgcaccataa

SEQ ID NO: 62421 - DNA, 15 bp, Homo sapiens
tgggcgcaccataag

SEQ ID NO: 62422 - DNA, 15 bp, Homo sapiens
gggcgcaccataagt

SEQ ID NO: 62423 - DNA, 15 bp, Homo sapiens
ggcgcaccataagtt

SEQ ID NO: 62424 - DNA, 15 bp, Homo sapiens
gcgcaccataagttt

SEQ ID NO: 62425 - DNA, 15 bp, Homo sapiens
cgcaccataagttta

SEQ ID NO: 62426 - DNA, 15 bp, Homo sapiens
gcaccataagtttat

SEQ ID NO: 62427 - DNA, 15 bp, Homo sapiens
caccataagtttatt

SEQ ID NO: 62428 - DNA, 15 bp, Homo sapiens
accataagtttattc

SEQ ID NO: 62429 - DNA, 15 bp, Homo sapiens
ccataagtttattca

SEQ ID NO: 62430 - DNA, 15 bp, Homo sapiens
cataagtttattcag

SEQ ID NO: 62431 - DNA, 15 bp, Homo sapiens
ataagtttattcagc

SEQ ID NO: 62432 - DNA, 15 bp, Homo sapiens
taagtttattcagca

SEQ ID NO: 62433 - DNA, 15 bp, Homo sapiens
aagtttattcagcaa

SEQ ID NO: 62434 - DNA, 15 bp, Homo sapiens
agtttattcagcaag

SEQ ID NO: 62435 - DNA, 15 bp, Homo sapiens
gtttattcagcaagt

SEQ ID NO: 62436 - DNA, 15 bp, Homo sapiens
tttattcagcaagtg

SEQ ID NO: 62437 - DNA, 15 bp, Homo sapiens
ttattcagcaagtgc

SEQ ID NO: 62438 - DNA, 15 bp, Homo sapiens
tattcagcaagtgcc

SEQ ID NO: 62439 - DNA, 15 bp, Homo sapiens
attcagcaagtgccc

SEQ ID NO: 62440 - DNA, 15 bp, Homo sapiens
ttcagcaagtgccct

SEQ ID NO: 62441 - DNA, 15 bp, Homo sapiens
tcagcaagtgccctg

SEQ ID NO: 62442 - DNA, 15 bp, Homo sapiens
cagcaagtgccctgg

SEQ ID NO: 62443 - DNA, 15 bp, Homo sapiens
agcaagtgccctggt

SEQ ID NO: 62444 - DNA, 15 bp, Homo sapiens
gcaagtgccctggtg

SEQ ID NO: 62445 - DNA, 15 bp, Homo sapiens
caagtgccctggtga

SEQ ID NO: 62446 - DNA, 15 bp, Homo sapiens
aagtgccctggtgat

SEQ ID NO: 62447 - DNA, 15 bp, Homo sapiens
agtgccctggtgata

SEQ ID NO: 62448 - DNA, 15 bp, Homo sapiens
gtgccctggtgatag

SEQ ID NO: 62449 - DNA, 15 bp, Homo sapiens
tgccctggtgatagg

SEQ ID NO: 62450 - DNA, 15 bp, Homo sapiens
gccctggtgataggg

SEQ ID NO: 62451 - DNA, 15 bp, Homo sapiens
ccctggtgataggga

SEQ ID NO: 62452 - DNA, 15 bp, Homo sapiens
cctggtgatagggat

SEQ ID NO: 62453 - DNA, 15 bp, Homo sapiens
ctggtgatagggatc

SEQ ID NO: 62454 - DNA, 15 bp, Homo sapiens
tggtgatagggatcg

SEQ ID NO: 62455 - DNA, 15 bp, Homo sapiens
ggtgatagggatcgg

SEQ ID NO: 62456 - DNA, 15 bp, Homo sapiens
gtgatagggatcggg

SEQ ID NO: 62457 - DNA, 15 bp, Homo sapiens
tgatagggatcgggg

SEQ ID NO: 62458 - DNA, 15 bp, Homo sapiens
gatagggatcggggg

SEQ ID NO: 62459 - DNA, 15 bp, Homo sapiens
atagggatcgggggt

SEQ ID NO: 62460 - DNA, 15 bp, Homo sapiens
tagggatcgggggta

SEQ ID NO: 62461 - DNA, 15 bp, Homo sapiens
agggatcgggggtat

SEQ ID NO: 62462 - DNA, 15 bp, Homo sapiens
gggatcgggggtatt

SEQ ID NO: 62463 - DNA, 15 bp, Homo sapiens
ggatcgggggtattg

SEQ ID NO: 62464 - DNA, 15 bp, Homo sapiens
gatcgggggtattgg

SEQ ID NO: 62465 - DNA, 15 bp, Homo sapiens
atcgggggtattgga

SEQ ID NO: 62466 - DNA, 15 bp, Homo sapiens
tcgggggtattggaa

SEQ ID NO: 62467 - DNA, 15 bp, Homo sapiens
cgggggtattggaag

SEQ ID NO: 62468 - DNA, 15 bp, Homo sapiens
gggggtattggaagc

SEQ ID NO: 62469 - DNA, 15 bp, Homo sapiens
ggggtattggaagcc

SEQ ID NO: 62470 - DNA, 15 bp, Homo sapiens
gggtattggaagcct

SEQ ID NO: 62471 - DNA, 15 bp, Homo sapiens
ggtattggaagcctt

SEQ ID NO: 62472 - DNA, 15 bp, Homo sapiens
gtattggaagccttt

SEQ ID NO: 62473 - DNA, 15 bp, Homo sapiens
tattggaagcctttg

SEQ ID NO: 62474 - DNA, 15 bp, Homo sapiens
attggaagcctttgg

SEQ ID NO: 62475 - DNA, 15 bp, Homo sapiens
ttggaagcctttggc

SEQ ID NO: 62476 - DNA, 15 bp, Homo sapiens
tggaagcctttggct

SEQ ID NO: 62477 - DNA, 15 bp, Homo sapiens
ggaagcctttggctg

SEQ ID NO: 62478 - DNA, 15 bp, Homo sapiens
gaagcctttggctgg

SEQ ID NO: 62479 - DNA, 15 bp, Homo sapiens
aagcctttggctggt

SEQ ID NO: 62480 - DNA, 15 bp, Homo sapiens
agcctttggctggta

SEQ ID NO: 62481 - DNA, 15 bp, Homo sapiens
gcctttggctggtaa

SEQ ID NO: 62482 - DNA, 15 bp, Homo sapiens
cctttggctggtaaa

SEQ ID NO: 62483 - DNA, 15 bp, Homo sapiens
ctttggctggtaaaa

SEQ ID NO: 62484 - DNA, 15 bp, Homo sapiens
tttggctggtaaaaa

SEQ ID NO: 62485 - DNA, 15 bp, Homo sapiens
ttggctggtaaaaat

SEQ ID NO: 62486 - DNA, 15 bp, Homo sapiens
tggctggtaaaaata

SEQ ID NO: 62487 - DNA, 15 bp, Homo sapiens
ggctggtaaaaataa

SEQ ID NO: 62488 - DNA, 15 bp, Homo sapiens
gctggtaaaaataat

SEQ ID NO: 62489 - DNA, 15 bp, Homo sapiens
ctggtaaaaataatg

SEQ ID NO: 62490 - DNA, 15 bp, Homo sapiens
tggtaaaaataatgt

SEQ ID NO: 62491 - DNA, 15 bp, Homo sapiens
ggtaaaaataatgtt

SEQ ID NO: 62492 - DNA, 15 bp, Homo sapiens
gtaaaaataatgttg

SEQ ID NO: 62493 - DNA, 15 bp, Homo sapiens
taaaaataatgttgt

SEQ ID NO: 62494 - DNA, 15 bp, Homo sapiens
aaaaataatgttgta

SEQ ID NO: 62495 - DNA, 15 bp, Homo sapiens
aaaataatgttgtag

SEQ ID NO: 62496 - DNA, 15 bp, Homo sapiens
aaataatgttgtagc

SEQ ID NO: 62497 - DNA, 15 bp, Homo sapiens
aataatgttgtagca

SEQ ID NO: 62498 - DNA, 15 bp, Homo sapiens
ataatgttgtagcaa

SEQ ID NO: 62499 - DNA, 15 bp, Homo sapiens
taatgttgtagcaaa

SEQ ID NO: 62500 - DNA, 15 bp, Homo sapiens
aatgttgtagcaaat

SEQ ID NO: 62501 - DNA, 15 bp, Homo sapiens
atgttgtagcaaata

SEQ ID NO: 62502 - DNA, 15 bp, Homo sapiens
tgttgtagcaaataa

SEQ ID NO: 62503 - DNA, 15 bp, Homo sapiens
gttgtagcaaataac

SEQ ID NO: 62504 - DNA, 15 bp, Homo sapiens
ttgtagcaaataaca

SEQ ID NO: 62505 - DNA, 15 bp, Homo sapiens
tgtagcaaataacat

SEQ ID NO: 62506 - DNA, 15 bp, Homo sapiens
gtagcaaataacatc

SEQ ID NO: 62507 - DNA, 15 bp, Homo sapiens
tagcaaataacatca

SEQ ID NO: 62508 - DNA, 15 bp, Homo sapiens
agcaaataacatcat

SEQ ID NO: 62509 - DNA, 15 bp, Homo sapiens
gcaaataacatcatg

SEQ ID NO: 62510 - DNA, 15 bp, Homo sapiens
caaataacatcatgc

SEQ ID NO: 62511 - DNA, 15 bp, Homo sapiens
aaataacatcatgca

SEQ ID NO: 62512 - DNA, 15 bp, Homo sapiens
aataacatcatgcat

SEQ ID NO: 62513 - DNA, 15 bp, Homo sapiens
ataacatcatgcata

SEQ ID NO: 62514 - DNA, 15 bp, Homo sapiens
taacatcatgcatat

SEQ ID NO: 62515 - DNA, 15 bp, Homo sapiens
aacatcatgcatatg

SEQ ID NO: 62516 - DNA, 15 bp, Homo sapiens
acatcatgcatatgt

SEQ ID NO: 62517 - DNA, 15 bp, Homo sapiens
catcatgcatatgtt

SEQ ID NO: 62518 - DNA, 15 bp, Homo sapiens
atcatgcatatgttc

SEQ ID NO: 62519 - DNA, 15 bp, Homo sapiens
tcatgcatatgttct

SEQ ID NO: 62520 - DNA, 15 bp, Homo sapiens
catgcatatgttctt

SEQ ID NO: 62521 - DNA, 15 bp, Homo sapiens
atgcatatgttcttt

SEQ ID NO: 62522 - DNA, 15 bp, Homo sapiens
tgcatatgttctttg

SEQ ID NO: 62523 - DNA, 15 bp, Homo sapiens
gcatatgttctttga

SEQ ID NO: 62524 - DNA, 15 bp, Homo sapiens
catatgttctttgag

SEQ ID NO: 62525 - DNA, 15 bp, Homo sapiens
atatgttctttgaga

SEQ ID NO: 62526 - DNA, 15 bp, Homo sapiens
tatgttctttgagat

SEQ ID NO: 62527 - DNA, 15 bp, Homo sapiens
atgttctttgagatt

SEQ ID NO: 62528 - DNA, 15 bp, Homo sapiens
tgttctttgagattt

SEQ ID NO: 62529 - DNA, 15 bp, Homo sapiens
gttctttgagatttc

SEQ ID NO: 62530 - DNA, 15 bp, Homo sapiens
ttctttgagatttct

SEQ ID NO: 62531 - DNA, 15 bp, Homo sapiens
tctttgagatttctg

SEQ ID NO: 62532 - DNA, 15 bp, Homo sapiens
ctttgagatttctgg

SEQ ID NO: 62533 - DNA, 15 bp, Homo sapiens
tttgagatttctgga

SEQ ID NO: 62534 - DNA, 15 bp, Homo sapiens
ttgagatttctggag

SEQ ID NO: 62535 - DNA, 15 bp, Homo sapiens
tgagatttctggagg

SEQ ID NO: 62536 - DNA, 15 bp, Homo sapiens
gagatttctggaggt

SEQ ID NO: 62537 - DNA, 15 bp, Homo sapiens
agatttctggaggtg

SEQ ID NO: 62538 - DNA, 15 bp, Homo sapiens
gatttctggaggtgt

SEQ ID NO: 62539 - DNA, 15 bp, Homo sapiens
atttctggaggtgtc

SEQ ID NO: 62540 - DNA, 15 bp, Homo sapiens
tttctggaggtgtct

SEQ ID NO: 62541 - DNA, 15 bp, Homo sapiens
ttctggaggtgtctc

SEQ ID NO: 62542 - DNA, 15 bp, Homo sapiens
tctggaggtgtctct

SEQ ID NO: 62543 - DNA, 15 bp, Homo sapiens
ctggaggtgtctctt

SEQ ID NO: 62544 - DNA, 15 bp, Homo sapiens
tggaggtgtctcttt

SEQ ID NO: 62545 - DNA, 15 bp, Homo sapiens
ggaggtgtctcttta

SEQ ID NO: 62546 - DNA, 15 bp, Homo sapiens
gaggtgtctctttag

SEQ ID NO: 62547 - DNA, 15 bp, Homo sapiens
aggtgtctctttagc

SEQ ID NO: 62548 - DNA, 15 bp, Homo sapiens
ggtgtctctttagca

SEQ ID NO: 62549 - DNA, 15 bp, Homo sapiens
gtgtctctttagcat

SEQ ID NO: 62550 - DNA, 15 bp, Homo sapiens
tgtctctttagcata

SEQ ID NO: 62551 - DNA, 15 bp, Homo sapiens
gtctctttagcatag

SEQ ID NO: 62552 - DNA, 15 bp, Homo sapiens
tctctttagcataga

SEQ ID NO: 62553 - DNA, 15 bp, Homo sapiens
ctctttagcatagat

SEQ ID NO: 62554 - DNA, 15 bp, Homo sapiens
tctttagcatagatt

SEQ ID NO: 62555 - DNA, 15 bp, Homo sapiens
ctttagcatagattt

SEQ ID NO: 62556 - DNA, 15 bp, Homo sapiens
tttagcatagatttc

SEQ ID NO: 62557 - DNA, 15 bp, Homo sapiens
ttagcatagatttct

SEQ ID NO: 62558 - DNA, 15 bp, Homo sapiens
tagcatagatttcta

SEQ ID NO: 62559 - DNA, 15 bp, Homo sapiens
agcatagatttctag

SEQ ID NO: 62560 - DNA, 15 bp, Homo sapiens
gcatagatttctaga

SEQ ID NO: 62561 - DNA, 15 bp, Homo sapiens
catagatttctagaa

SEQ ID NO: 62562 - DNA, 15 bp, Homo sapiens
atagatttctagaag

SEQ ID NO: 62563 - DNA, 15 bp, Homo sapiens
tagatttctagaagg

SEQ ID NO: 62564 - DNA, 15 bp, Homo sapiens
agatttctagaaggc

SEQ ID NO: 62565 - DNA, 15 bp, Homo sapiens
gatttctagaaggca

SEQ ID NO: 62566 - DNA, 15 bp, Homo sapiens
atttctagaaggcat

SEQ ID NO: 62567 - DNA, 15 bp, Homo sapiens
tttctagaaggcatt

SEQ ID NO: 62568 - DNA, 15 bp, Homo sapiens
ttctagaaggcattc

SEQ ID NO: 62569 - DNA, 15 bp, Homo sapiens
tctagaaggcattcc

SEQ ID NO: 62570 - DNA, 15 bp, Homo sapiens
ctagaaggcattcct

SEQ ID NO: 62571 - DNA, 15 bp, Homo sapiens
tagaaggcattcctt

SEQ ID NO: 62572 - DNA, 15 bp, Homo sapiens
agaaggcattcctta

SEQ ID NO: 62573 - DNA, 15 bp, Homo sapiens
gaaggcattccttac

SEQ ID NO: 62574 - DNA, 15 bp, Homo sapiens
aaggcattccttacg

SEQ ID NO: 62575 - DNA, 15 bp, Homo sapiens
aggcattccttacgt

SEQ ID NO: 62576 - DNA, 15 bp, Homo sapiens
ggcattccttacgtc

SEQ ID NO: 62577 - DNA, 15 bp, Homo sapiens
gcattccttacgtca

SEQ ID NO: 62578 - DNA, 15 bp, Homo sapiens
cattccttacgtcac

SEQ ID NO: 62579 - DNA, 15 bp, Homo sapiens
attccttacgtcacg

SEQ ID NO: 62580 - DNA, 15 bp, Homo sapiens
ttccttacgtcacgt

SEQ ID NO: 62581 - DNA, 15 bp, Homo sapiens
tccttacgtcacgtt

SEQ ID NO: 62582 - DNA, 15 bp, Homo sapiens
ccttacgtcacgttt

SEQ ID NO: 62583 - DNA, 15 bp, Homo sapiens
cttacgtcacgttta

SEQ ID NO: 62584 - DNA, 15 bp, Homo sapiens
ttacgtcacgtttag

SEQ ID NO: 62585 - DNA, 15 bp, Homo sapiens
tacgtcacgtttagg

SEQ ID NO: 62586 - DNA, 15 bp, Homo sapiens
acgtcacgtttaggt

SEQ ID NO: 62587 - DNA, 15 bp, Homo sapiens
cgtcacgtttaggtt

SEQ ID NO: 62588 - DNA, 15 bp, Homo sapiens
gtcacgtttaggttt

SEQ ID NO: 62589 - DNA, 15 bp, Homo sapiens
tcacgtttaggttta

SEQ ID NO: 62590 - DNA, 15 bp, Homo sapiens
cacgtttaggtttat

SEQ ID NO: 62591 - DNA, 15 bp, Homo sapiens
acgtttaggtttata

SEQ ID NO: 62592 - DNA, 15 bp, Homo sapiens
cgtttaggtttatag

SEQ ID NO: 62593 - DNA, 15 bp, Homo sapiens
gtttaggtttatagt

SEQ ID NO: 62594 - DNA, 15 bp, Homo sapiens
tttaggtttatagtt

SEQ ID NO: 62595 - DNA, 15 bp, Homo sapiens
ttaggtttatagttt

SEQ ID NO: 62596 - DNA, 15 bp, Homo sapiens
taggtttatagtttg

SEQ ID NO: 62597 - DNA, 15 bp, Homo sapiens
aggtttatagtttga

SEQ ID NO: 62598 - DNA, 15 bp, Homo sapiens
ggtttatagtttgac

SEQ ID NO: 62599 - DNA, 15 bp, Homo sapiens
gtttatagtttgacc

SEQ ID NO: 62600 - DNA, 15 bp, Homo sapiens
tttatagtttgacct

SEQ ID NO: 62601 - DNA, 15 bp, Homo sapiens
ttatagtttgacctc

SEQ ID NO: 62602 - DNA, 15 bp, Homo sapiens
tatagtttgacctca

SEQ ID NO: 62603 - DNA, 15 bp, Homo sapiens
atagtttgacctcat

SEQ ID NO: 62604 - DNA, 15 bp, Homo sapiens
tagtttgacctcatg

SEQ ID NO: 62605 - DNA, 15 bp, Homo sapiens
agtttgacctcatgg

SEQ ID NO: 62606 - DNA, 15 bp, Homo sapiens
gtttgacctcatggt

SEQ ID NO: 62607 - DNA, 15 bp, Homo sapiens
tttgacctcatggtg

SEQ ID NO: 62608 - DNA, 15 bp, Homo sapiens
ttgacctcatggtga

SEQ ID NO: 62609 - DNA, 15 bp, Homo sapiens
tgacctcatggtgat

SEQ ID NO: 62610 - DNA, 15 bp, Homo sapiens
gacctcatggtgatt

SEQ ID NO: 62611 - DNA, 15 bp, Homo sapiens
acctcatggtgatta

SEQ ID NO: 62612 - DNA, 15 bp, Homo sapiens
cctcatggtgattaa

SEQ ID NO: 62613 - DNA, 15 bp, Homo sapiens
ctcatggtgattaag

SEQ ID NO: 62614 - DNA, 15 bp, Homo sapiens
tcatggtgattaagg

SEQ ID NO: 62615 - DNA, 15 bp, Homo sapiens
catggtgattaaggt

SEQ ID NO: 62616 - DNA, 15 bp, Homo sapiens
atggtgattaaggta

SEQ ID NO: 62617 - DNA, 15 bp, Homo sapiens
tggtgattaaggtat

SEQ ID NO: 62618 - DNA, 15 bp, Homo sapiens
ggtgattaaggtatt

SEQ ID NO: 62619 - DNA, 15 bp, Homo sapiens
gtgattaaggtattt

SEQ ID NO: 62620 - DNA, 15 bp, Homo sapiens
tgattaaggtatttg

SEQ ID NO: 62621 - DNA, 15 bp, Homo sapiens
gattaaggtatttgg

SEQ ID NO: 62622 - DNA, 15 bp, Homo sapiens
attaaggtatttggg

SEQ ID NO: 62623 - DNA, 15 bp, Homo sapiens
ttaaggtatttggga

SEQ ID NO: 62624 - DNA, 15 bp, Homo sapiens
taaggtatttgggaa

SEQ ID NO: 62625 - DNA, 15 bp, Homo sapiens
aaggtatttgggaaa

SEQ ID NO: 62626 - DNA, 15 bp, Homo sapiens
aggtatttgggaaat

SEQ ID NO: 62627 - DNA, 15 bp, Homo sapiens
ggtatttgggaaatg

SEQ ID NO: 62628 - DNA, 15 bp, Homo sapiens
gtatttgggaaatgc

SEQ ID NO: 62629 - DNA, 15 bp, Homo sapiens
tatttgggaaatgca

SEQ ID NO: 62630 - DNA, 15 bp, Homo sapiens
atttgggaaatgcaa

SEQ ID NO: 62631 - DNA, 15 bp, Homo sapiens
tttgggaaatgcaaa

SEQ ID NO: 62632 - DNA, 15 bp, Homo sapiens
ttgggaaatgcaaat

SEQ ID NO: 62633 - DNA, 15 bp, Homo sapiens
tgggaaatgcaaatg

SEQ ID NO: 62634 - DNA, 15 bp, Homo sapiens
gggaaatgcaaatga

SEQ ID NO: 62635 - DNA, 15 bp, Homo sapiens
ggaaatgcaaatgag

SEQ ID NO: 62636 - DNA, 15 bp, Homo sapiens
gaaatgcaaatgaga

SEQ ID NO: 62637 - DNA, 15 bp, Homo sapiens
aaatgcaaatgagag

SEQ ID NO: 62638 - DNA, 15 bp, Homo sapiens
aatgcaaatgagagt

SEQ ID NO: 62639 - DNA, 15 bp, Homo sapiens
atgcaaatgagagtt

SEQ ID NO: 62640 - DNA, 15 bp, Homo sapiens
tgcaaatgagagttt

SEQ ID NO: 62641 - DNA, 15 bp, Homo sapiens
gcaaatgagagtttc

SEQ ID NO: 62642 - DNA, 15 bp, Homo sapiens
caaatgagagtttcg

SEQ ID NO: 62643 - DNA, 15 bp, Homo sapiens
aaatgagagtttcga

SEQ ID NO: 62644 - DNA, 15 bp, Homo sapiens
aatgagagtttcgaa

SEQ ID NO: 62645 - DNA, 15 bp, Homo sapiens
atgagagtttcgaag

SEQ ID NO: 62646 - DNA, 15 bp, Homo sapiens
tgagagtttcgaaga

SEQ ID NO: 62647 - DNA, 15 bp, Homo sapiens
gagagtttcgaagaa

SEQ ID NO: 62648 - DNA, 15 bp, Homo sapiens
agagtttcgaagaag

SEQ ID NO: 62649 - DNA, 15 bp, Homo sapiens
gagtttcgaagaagc

SEQ ID NO: 62650 - DNA, 15 bp, Homo sapiens
agtttcgaagaagcc

SEQ ID NO: 62651 - DNA, 15 bp, Homo sapiens
gtttcgaagaagcca

SEQ ID NO: 62652 - DNA, 15 bp, Homo sapiens
tttcgaagaagccag

SEQ ID NO: 62653 - DNA, 15 bp, Homo sapiens
ttcgaagaagccaga

SEQ ID NO: 62654 - DNA, 15 bp, Homo sapiens
tcgaagaagccagat

SEQ ID NO: 62655 - DNA, 15 bp, Homo sapiens
cgaagaagccagatc

SEQ ID NO: 62656 - DNA, 15 bp, Homo sapiens
gaagaagccagatct

SEQ ID NO: 62657 - DNA, 15 bp, Homo sapiens
aagaagccagatctt

SEQ ID NO: 62658 - DNA, 15 bp, Homo sapiens
agaagccagatcttt

SEQ ID NO: 62659 - DNA, 15 bp, Homo sapiens
gaagccagatctttc

SEQ ID NO: 62660 - DNA, 15 bp, Homo sapiens
aagccagatctttcc

SEQ ID NO: 62661 - DNA, 15 bp, Homo sapiens
agccagatctttccc

SEQ ID NO: 62662 - DNA, 15 bp, Homo sapiens
gccagatctttccca

SEQ ID NO: 62663 - DNA, 15 bp, Homo sapiens
ccagatctttcccat

SEQ ID NO: 62664 - DNA, 15 bp, Homo sapiens
cagatctttcccatt

SEQ ID NO: 62665 - DNA, 15 bp, Homo sapiens
agatctttcccatta

SEQ ID NO: 62666 - DNA, 15 bp, Homo sapiens
gatctttcccattag

SEQ ID NO: 62667 - DNA, 15 bp, Homo sapiens
atctttcccattagt

SEQ ID NO: 62668 - DNA, 15 bp, Homo sapiens
tctttcccattagtt

SEQ ID NO: 62669 - DNA, 15 bp, Homo sapiens
ctttcccattagttc

SEQ ID NO: 62670 - DNA, 15 bp, Homo sapiens
tttcccattagttca

SEQ ID NO: 62671 - DNA, 15 bp, Homo sapiens
ttcccattagttcac

SEQ ID NO: 62672 - DNA, 15 bp, Homo sapiens
tcccattagttcact

SEQ ID NO: 62673 - DNA, 15 bp, Homo sapiens
cccattagttcactg

SEQ ID NO: 62674 - DNA, 15 bp, Homo sapiens
ccattagttcactgt

SEQ ID NO: 62675 - DNA, 15 bp, Homo sapiens
cattagttcactgtt

SEQ ID NO: 62676 - DNA, 15 bp, Homo sapiens
attagttcactgttt

SEQ ID NO: 62677 - DNA, 15 bp, Homo sapiens
ttagttcactgtttt

SEQ ID NO: 62678 - DNA, 15 bp, Homo sapiens
tagttcactgttttt

SEQ ID NO: 62679 - DNA, 15 bp, Homo sapiens
agttcactgtttttc

SEQ ID NO: 62680 - DNA, 15 bp, Homo sapiens
gttcactgtttttct

SEQ ID NO: 62681 - DNA, 15 bp, Homo sapiens
ttcactgtttttctc

SEQ ID NO: 62682 - DNA, 15 bp, Homo sapiens
tcactgtttttctct

SEQ ID NO: 62683 - DNA, 15 bp, Homo sapiens
cactgtttttctctg

SEQ ID NO: 62684 - DNA, 15 bp, Homo sapiens
actgtttttctctga

SEQ ID NO: 62685 - DNA, 15 bp, Homo sapiens
ctgtttttctctgac

SEQ ID NO: 62686 - DNA, 15 bp, Homo sapiens
tgtttttctctgaca

SEQ ID NO: 62687 - DNA, 15 bp, Homo sapiens
gtttttctctgacat

SEQ ID NO: 62688 - DNA, 15 bp, Homo sapiens
tttttctctgacatt

SEQ ID NO: 62689 - DNA, 15 bp, Homo sapiens
ttttctctgacatta

SEQ ID NO: 62690 - DNA, 15 bp, Homo sapiens
tttctctgacattag

SEQ ID NO: 62691 - DNA, 15 bp, Homo sapiens
ttctctgacattagg

SEQ ID NO: 62692 - DNA, 15 bp, Homo sapiens
tctctgacattagga

SEQ ID NO: 62693 - DNA, 15 bp, Homo sapiens
ctctgacattaggac

SEQ ID NO: 62694 - DNA, 15 bp, Homo sapiens
tctgacattaggacc

SEQ ID NO: 62695 - DNA, 15 bp, Homo sapiens
ctgacattaggaccg

SEQ ID NO: 62696 - DNA, 15 bp, Homo sapiens
tgacattaggaccgt

SEQ ID NO: 62697 - DNA, 15 bp, Homo sapiens
gacattaggaccgtc

SEQ ID NO: 62698 - DNA, 15 bp, Homo sapiens
acattaggaccgtcc

SEQ ID NO: 62699 - DNA, 15 bp, Homo sapiens
cattaggaccgtccg

SEQ ID NO: 62700 - DNA, 15 bp, Homo sapiens
attaggaccgtccgg

SEQ ID NO: 62701 - DNA, 15 bp, Homo sapiens
ttaggaccgtccggg

SEQ ID NO: 62702 - DNA, 15 bp, Homo sapiens
taggaccgtccgggt

SEQ ID NO: 62703 - DNA, 15 bp, Homo sapiens
aggaccgtccgggtt

SEQ ID NO: 62704 - DNA, 15 bp, Homo sapiens
ggaccgtccgggttc

SEQ ID NO: 62705 - DNA, 15 bp, Homo sapiens
gaccgtccgggttct

SEQ ID NO: 62706 - DNA, 15 bp, Homo sapiens
accgtccgggttcta

SEQ ID NO: 62707 - DNA, 15 bp, Homo sapiens
ccgtccgggttctag

SEQ ID NO: 62708 - DNA, 15 bp, Homo sapiens
cgtccgggttctagg

SEQ ID NO: 62709 - DNA, 15 bp, Homo sapiens
gtccgggttctaggg

SEQ ID NO: 62710 - DNA, 15 bp, Homo sapiens
tccgggttctaggga

SEQ ID NO: 62711 - DNA, 15 bp, Homo sapiens
ccgggttctagggag

SEQ ID NO: 62712 - DNA, 15 bp, Homo sapiens
cgggttctagggagc

SEQ ID NO: 62713 - DNA, 15 bp, Homo sapiens
gggttctagggagca

SEQ ID NO: 62714 - DNA, 15 bp, Homo sapiens
ggttctagggagcag

SEQ ID NO: 62715 - DNA, 15 bp, Homo sapiens
gttctagggagcagc

SEQ ID NO: 62716 - DNA, 15 bp, Homo sapiens
ttctagggagcagcc

SEQ ID NO: 62717 - DNA, 15 bp, Homo sapiens
tctagggagcagccc

SEQ ID NO: 62718 - DNA, 15 bp, Homo sapiens
ctagggagcagccct

SEQ ID NO: 62719 - DNA, 15 bp, Homo sapiens
tagggagcagccctg

SEQ ID NO: 62720 - DNA, 15 bp, Homo sapiens
agggagcagccctgg

SEQ ID NO: 62721 - DNA, 15 bp, Homo sapiens
gggagcagccctggc

SEQ ID NO: 62722 - DNA, 15 bp, Homo sapiens
ggagcagccctggcg

SEQ ID NO: 62723 - DNA, 15 bp, Homo sapiens
gagcagccctggcgt

SEQ ID NO: 62724 - DNA, 15 bp, Homo sapiens
agcagccctggcgtt

SEQ ID NO: 62725 - DNA, 15 bp, Homo sapiens
gcagccctggcgtta

SEQ ID NO: 62726 - DNA, 15 bp, Homo sapiens
cagccctggcgttag

SEQ ID NO: 62727 - DNA, 15 bp, Homo sapiens
agccctggcgttagg

SEQ ID NO: 62728 - DNA, 15 bp, Homo sapiens
gccctggcgttaggc

SEQ ID NO: 62729 - DNA, 15 bp, Homo sapiens
ccctggcgttaggca

SEQ ID NO: 62730 - DNA, 15 bp, Homo sapiens
cctggcgttaggcag

SEQ ID NO: 62731 - DNA, 15 bp, Homo sapiens
ctggcgttaggcagt

SEQ ID NO: 62732 - DNA, 15 bp, Homo sapiens
tggcgttaggcagtg

SEQ ID NO: 62733 - DNA, 15 bp, Homo sapiens
ggcgttaggcagtgc

SEQ ID NO: 62734 - DNA, 15 bp, Homo sapiens
gcgttaggcagtgcc

SEQ ID NO: 62735 - DNA, 15 bp, Homo sapiens
cgttaggcagtgcca

SEQ ID NO: 62736 - DNA, 15 bp, Homo sapiens
gttaggcagtgccat

SEQ ID NO: 62737 - DNA, 15 bp, Homo sapiens
ttaggcagtgccatg

SEQ ID NO: 62738 - DNA, 15 bp, Homo sapiens
taggcagtgccatga

SEQ ID NO: 62739 - DNA, 15 bp, Homo sapiens
aggcagtgccatgat

SEQ ID NO: 62740 - DNA, 15 bp, Homo sapiens
ggcagtgccatgatg

SEQ ID NO: 62741 - DNA, 15 bp, Homo sapiens
gcagtgccatgatgg

SEQ ID NO: 62742 - DNA, 15 bp, Homo sapiens
cagtgccatgatgga

SEQ ID NO: 62743 - DNA, 15 bp, Homo sapiens
agtgccatgatggat

SEQ ID NO: 62744 - DNA, 15 bp, Homo sapiens
gtgccatgatggatt

SEQ ID NO: 62745 - DNA, 15 bp, Homo sapiens
tgccatgatggattg

SEQ ID NO: 62746 - DNA, 15 bp, Homo sapiens
gccatgatggattgt

SEQ ID NO: 62747 - DNA, 15 bp, Homo sapiens
ccatgatggattgtg

SEQ ID NO: 62748 - DNA, 15 bp, Homo sapiens
catgatggattgtgt

SEQ ID NO: 62749 - DNA, 15 bp, Homo sapiens
atgatggattgtgta

SEQ ID NO: 62750 - DNA, 15 bp, Homo sapiens
tgatggattgtgtag

SEQ ID NO: 62751 - DNA, 15 bp, Homo sapiens
gatggattgtgtaga

SEQ ID NO: 62752 - DNA, 15 bp, Homo sapiens
atggattgtgtagaa

SEQ ID NO: 62753 - DNA, 15 bp, Homo sapiens
tggattgtgtagaag

SEQ ID NO: 62754 - DNA, 15 bp, Homo sapiens
ggattgtgtagaagt

SEQ ID NO: 62755 - DNA, 15 bp, Homo sapiens
gattgtgtagaagta

SEQ ID NO: 62756 - DNA, 15 bp, Homo sapiens
attgtgtagaagtag

SEQ ID NO: 62757 - DNA, 15 bp, Homo sapiens
ttgtgtagaagtagc

SEQ ID NO: 62758 - DNA, 15 bp, Homo sapiens
tgtgtagaagtagcg

SEQ ID NO: 62759 - DNA, 15 bp, Homo sapiens
gtgtagaagtagcga

SEQ ID NO: 62760 - DNA, 15 bp, Homo sapiens
tgtagaagtagcgat

SEQ ID NO: 62761 - DNA, 15 bp, Homo sapiens
gtagaagtagcgatt

SEQ ID NO: 62762 - DNA, 15 bp, Homo sapiens
tagaagtagcgattc

SEQ ID NO: 62763 - DNA, 15 bp, Homo sapiens
agaagtagcgattcc

SEQ ID NO: 62764 - DNA, 15 bp, Homo sapiens
gaagtagcgattccc

SEQ ID NO: 62765 - DNA, 15 bp, Homo sapiens
aagtagcgattccca

SEQ ID NO: 62766 - DNA, 15 bp, Homo sapiens
agtagcgattcccat

SEQ ID NO: 62767 - DNA, 15 bp, Homo sapiens
gtagcgattcccatc

SEQ ID NO: 62768 - DNA, 15 bp, Homo sapiens
tagcgattcccatct

SEQ ID NO: 62769 - DNA, 15 bp, Homo sapiens
agcgattcccatctg

SEQ ID NO: 62770 - DNA, 15 bp, Homo sapiens
gcgattcccatctgt

SEQ ID NO: 62771 - DNA, 15 bp, Homo sapiens
cgattcccatctgtc

SEQ ID NO: 62772 - DNA, 15 bp, Homo sapiens
gattcccatctgtct

SEQ ID NO: 62773 - DNA, 15 bp, Homo sapiens
attcccatctgtctg

SEQ ID NO: 62774 - DNA, 15 bp, Homo sapiens
ttcccatctgtctgc

SEQ ID NO: 62775 - DNA, 15 bp, Homo sapiens
tcccatctgtctgct

SEQ ID NO: 62776 - DNA, 15 bp, Homo sapiens
cccatctgtctgctt

SEQ ID NO: 62777 - DNA, 15 bp, Homo sapiens
ccatctgtctgcttt

SEQ ID NO: 62778 - DNA, 15 bp, Homo sapiens
catctgtctgctttc

SEQ ID NO: 62779 - DNA, 15 bp, Homo sapiens
atctgtctgctttct

SEQ ID NO: 62780 - DNA, 15 bp, Homo sapiens
tctgtctgctttctt

SEQ ID NO: 62781 - DNA, 15 bp, Homo sapiens
ctgtctgctttcttg

SEQ ID NO: 62782 - DNA, 15 bp, Homo sapiens
tgtctgctttcttgg

SEQ ID NO: 62783 - DNA, 15 bp, Homo sapiens
gtctgctttcttggc

SEQ ID NO: 62784 - DNA, 15 bp, Homo sapiens
tctgctttcttggcc

SEQ ID NO: 62785 - DNA, 15 bp, Homo sapiens
ctgctttcttggccc

SEQ ID NO: 62786 - DNA, 15 bp, Homo sapiens
tgctttcttggccca

SEQ ID NO: 62787 - DNA, 15 bp, Homo sapiens
gctttcttggcccac

SEQ ID NO: 62788 - DNA, 15 bp, Homo sapiens
ctttcttggcccact

SEQ ID NO: 62789 - DNA, 15 bp, Homo sapiens
tttcttggcccactc

SEQ ID NO: 62790 - DNA, 15 bp, Homo sapiens
ttcttggcccactct

SEQ ID NO: 62791 - DNA, 15 bp, Homo sapiens
tcttggcccactctg

SEQ ID NO: 62792 - DNA, 15 bp, Homo sapiens
cttggcccactctgc

SEQ ID NO: 62793 - DNA, 15 bp, Homo sapiens
ttggcccactctgct

SEQ ID NO: 62794 - DNA, 15 bp, Homo sapiens
tggcccactctgctg

SEQ ID NO: 62795 - DNA, 15 bp, Homo sapiens
ggcccactctgctgg

SEQ ID NO: 62796 - DNA, 15 bp, Homo sapiens
gcccactctgctggt

SEQ ID NO: 62797 - DNA, 15 bp, Homo sapiens
cccactctgctggtg

SEQ ID NO: 62798 - DNA, 15 bp, Homo sapiens
ccactctgctggtgg

SEQ ID NO: 62799 - DNA, 15 bp, Homo sapiens
cactctgctggtggc

SEQ ID NO: 62800 - DNA, 15 bp, Homo sapiens
actctgctggtggct

SEQ ID NO: 62801 - DNA, 15 bp, Homo sapiens
ctctgctggtggctc

SEQ ID NO: 62802 - DNA, 15 bp, Homo sapiens
tctgctggtggctcc

SEQ ID NO: 62803 - DNA, 15 bp, Homo sapiens
ctgctggtggctccc

SEQ ID NO: 62804 - DNA, 15 bp, Homo sapiens
tgctggtggctcccc

SEQ ID NO: 62805 - DNA, 15 bp, Homo sapiens
gctggtggctcccct

SEQ ID NO: 62806 - DNA, 15 bp, Homo sapiens
ctggtggctcccctt

SEQ ID NO: 62807 - DNA, 15 bp, Homo sapiens
tggtggctccccttc

SEQ ID NO: 62808 - DNA, 15 bp, Homo sapiens
ggtggctccccttcc

SEQ ID NO: 62809 - DNA, 15 bp, Homo sapiens
gtggctccccttccc

SEQ ID NO: 62810 - DNA, 15 bp, Homo sapiens
tggctccccttccct

SEQ ID NO: 62811 - DNA, 15 bp, Homo sapiens
ggctccccttccctc

SEQ ID NO: 62812 - DNA, 15 bp, Homo sapiens
gctccccttccctcc

SEQ ID NO: 62813 - DNA, 15 bp, Homo sapiens
ctccccttccctccc

SEQ ID NO: 62814 - DNA, 15 bp, Homo sapiens
tccccttccctccct

SEQ ID NO: 62815 - DNA, 15 bp, Homo sapiens
ccccttccctccctc

SEQ ID NO: 62816 - DNA, 15 bp, Homo sapiens
cccttccctccctcc

SEQ ID NO: 62817 - DNA, 15 bp, Homo sapiens
ccttccctccctcct

SEQ ID NO: 62818 - DNA, 15 bp, Homo sapiens
cttccctccctcctt

SEQ ID NO: 62819 - DNA, 15 bp, Homo sapiens
ttccctccctccttt

SEQ ID NO: 62820 - DNA, 15 bp, Homo sapiens
tccctccctccttta

SEQ ID NO: 62821 - DNA, 15 bp, Homo sapiens
ccctccctcctttat

SEQ ID NO: 62822 - DNA, 15 bp, Homo sapiens
cctccctcctttatg

SEQ ID NO: 62823 - DNA, 15 bp, Homo sapiens
ctccctcctttatgg

SEQ ID NO: 62824 - DNA, 15 bp, Homo sapiens
tccctcctttatggg

SEQ ID NO: 62825 - DNA, 15 bp, Homo sapiens
ccctcctttatgggg

SEQ ID NO: 62826 - DNA, 15 bp, Homo sapiens
cctcctttatgggga

SEQ ID NO: 62827 - DNA, 15 bp, Homo sapiens
ctcctttatggggag

SEQ ID NO: 62828 - DNA, 15 bp, Homo sapiens
tcctttatggggagc

SEQ ID NO: 62829 - DNA, 15 bp, Homo sapiens
cctttatggggagct

SEQ ID NO: 62830 - DNA, 15 bp, Homo sapiens
ctttatggggagctg

SEQ ID NO: 62831 - DNA, 15 bp, Homo sapiens
tttatggggagctgg

SEQ ID NO: 62832 - DNA, 15 bp, Homo sapiens
ttatggggagctggg

SEQ ID NO: 62833 - DNA, 15 bp, Homo sapiens
tatggggagctgggg

SEQ ID NO: 62834 - DNA, 15 bp, Homo sapiens
atggggagctgggga

SEQ ID NO: 62835 - DNA, 15 bp, Homo sapiens
tggggagctggggag

SEQ ID NO: 62836 - DNA, 15 bp, Homo sapiens
ggggagctggggagc

SEQ ID NO: 62837 - DNA, 15 bp, Homo sapiens
gggagctggggagct

SEQ ID NO: 62838 - DNA, 15 bp, Homo sapiens
ggagctggggagctg

SEQ ID NO: 62839 - DNA, 15 bp, Homo sapiens
gagctggggagctgc

SEQ ID NO: 62840 - DNA, 15 bp, Homo sapiens
agctggggagctgcc

SEQ ID NO: 62841 - DNA, 15 bp, Homo sapiens
gctggggagctgcct

SEQ ID NO: 62842 - DNA, 15 bp, Homo sapiens
ctggggagctgccta

SEQ ID NO: 62843 - DNA, 15 bp, Homo sapiens
tggggagctgcctag

SEQ ID NO: 62844 - DNA, 15 bp, Homo sapiens
ggggagctgcctagg

SEQ ID NO: 62845 - DNA, 15 bp, Homo sapiens
gggagctgcctaggg

SEQ ID NO: 62846 - DNA, 15 bp, Homo sapiens
ggagctgcctagggg

SEQ ID NO: 62847 - DNA, 15 bp, Homo sapiens
gagctgcctaggggt

SEQ ID NO: 62848 - DNA, 15 bp, Homo sapiens
agctgcctaggggtc

SEQ ID NO: 62849 - DNA, 15 bp, Homo sapiens
gctgcctaggggtcc

SEQ ID NO: 62850 - DNA, 15 bp, Homo sapiens
ctgcctaggggtcca

SEQ ID NO: 62851 - DNA, 15 bp, Homo sapiens
tgcctaggggtccat

SEQ ID NO: 62852 - DNA, 15 bp, Homo sapiens
gcctaggggtccatt

SEQ ID NO: 62853 - DNA, 15 bp, Homo sapiens
cctaggggtccattc

SEQ ID NO: 62854 - DNA, 15 bp, Homo sapiens
ctaggggtccattct

SEQ ID NO: 62855 - DNA, 15 bp, Homo sapiens
taggggtccattctc

SEQ ID NO: 62856 - DNA, 15 bp, Homo sapiens
aggggtccattctca

SEQ ID NO: 62857 - DNA, 15 bp, Homo sapiens
ggggtccattctcaa

SEQ ID NO: 62858 - DNA, 15 bp, Homo sapiens
gggtccattctcaaa

SEQ ID NO: 62859 - DNA, 15 bp, Homo sapiens
ggtccattctcaaag

SEQ ID NO: 62860 - DNA, 15 bp, Homo sapiens
gtccattctcaaagg

SEQ ID NO: 62861 - DNA, 15 bp, Homo sapiens
tccattctcaaaggc

SEQ ID NO: 62862 - DNA, 15 bp, Homo sapiens
ccattctcaaaggct

SEQ ID NO: 62863 - DNA, 15 bp, Homo sapiens
cattctcaaaggctg

SEQ ID NO: 62864 - DNA, 15 bp, Homo sapiens
attctcaaaggctga

SEQ ID NO: 62865 - DNA, 15 bp, Homo sapiens
ttctcaaaggctgat

SEQ ID NO: 62866 - DNA, 15 bp, Homo sapiens
tctcaaaggctgatc

SEQ ID NO: 62867 - DNA, 15 bp, Homo sapiens
ctcaaaggctgatct

SEQ ID NO: 62868 - DNA, 15 bp, Homo sapiens
tcaaaggctgatctc

SEQ ID NO: 62869 - DNA, 15 bp, Homo sapiens
caaaggctgatctct

SEQ ID NO: 62870 - DNA, 15 bp, Homo sapiens
aaaggctgatctctg

SEQ ID NO: 62871 - DNA, 15 bp, Homo sapiens
aaggctgatctctgg

SEQ ID NO: 62872 - DNA, 15 bp, Homo sapiens
aggctgatctctggt

SEQ ID NO: 62873 - DNA, 15 bp, Homo sapiens
ggctgatctctggtg

SEQ ID NO: 62874 - DNA, 15 bp, Homo sapiens
gctgatctctggtgg

SEQ ID NO: 62875 - DNA, 15 bp, Homo sapiens
ctgatctctggtggg

SEQ ID NO: 62876 - DNA, 15 bp, Homo sapiens
tgatctctggtgggc

SEQ ID NO: 62877 - DNA, 15 bp, Homo sapiens
gatctctggtgggca

SEQ ID NO: 62878 - DNA, 15 bp, Homo sapiens
atctctggtgggcaa

SEQ ID NO: 62879 - DNA, 15 bp, Homo sapiens
tctctggtgggcaac

SEQ ID NO: 62880 - DNA, 15 bp, Homo sapiens
ctctggtgggcaaca

SEQ ID NO: 62881 - DNA, 15 bp, Homo sapiens
tctggtgggcaacag

SEQ ID NO: 62882 - DNA, 15 bp, Homo sapiens
ctggtgggcaacagg

SEQ ID NO: 62883 - DNA, 15 bp, Homo sapiens
tggtgggcaacaggc

SEQ ID NO: 62884 - DNA, 15 bp, Homo sapiens
ggtgggcaacaggcc

SEQ ID NO: 62885 - DNA, 15 bp, Homo sapiens
gtgggcaacaggcca

SEQ ID NO: 62886 - DNA, 15 bp, Homo sapiens
tgggcaacaggccac

SEQ ID NO: 62887 - DNA, 15 bp, Homo sapiens
gggcaacaggccaca

SEQ ID NO: 62888 - DNA, 15 bp, Homo sapiens
ggcaacaggccacac

SEQ ID NO: 62889 - DNA, 15 bp, Homo sapiens
gcaacaggccacacc

SEQ ID NO: 62890 - DNA, 15 bp, Homo sapiens
caacaggccacacct

SEQ ID NO: 62891 - DNA, 15 bp, Homo sapiens
aacaggccacaccta

SEQ ID NO: 62892 - DNA, 15 bp, Homo sapiens
acaggccacacctag

SEQ ID NO: 62893 - DNA, 15 bp, Homo sapiens
caggccacacctagc

SEQ ID NO: 62894 - DNA, 15 bp, Homo sapiens
aggccacacctagct

SEQ ID NO: 62895 - DNA, 15 bp, Homo sapiens
ggccacacctagctt

SEQ ID NO: 62896 - DNA, 15 bp, Homo sapiens
gccacacctagcttt

SEQ ID NO: 62897 - DNA, 15 bp, Homo sapiens
ccacacctagctttc

SEQ ID NO: 62898 - DNA, 15 bp, Homo sapiens
cacacctagctttcc

SEQ ID NO: 62899 - DNA, 15 bp, Homo sapiens
acacctagctttcca

SEQ ID NO: 62900 - DNA, 15 bp, Homo sapiens
cacctagctttccag

SEQ ID NO: 62901 - DNA, 15 bp, Homo sapiens
acctagctttccagg

SEQ ID NO: 62902 - DNA, 15 bp, Homo sapiens
cctagctttccaggg

SEQ ID NO: 62903 - DNA, 15 bp, Homo sapiens
ctagctttccagggt

SEQ ID NO: 62904 - DNA, 15 bp, Homo sapiens
tagctttccagggtt

SEQ ID NO: 62905 - DNA, 15 bp, Homo sapiens
agctttccagggttc

SEQ ID NO: 62906 - DNA, 15 bp, Homo sapiens
gctttccagggttct

SEQ ID NO: 62907 - DNA, 15 bp, Homo sapiens
ctttccagggttctt

SEQ ID NO: 62908 - DNA, 15 bp, Homo sapiens
tttccagggttcttc

SEQ ID NO: 62909 - DNA, 15 bp, Homo sapiens
ttccagggttcttcg

SEQ ID NO: 62910 - DNA, 15 bp, Homo sapiens
tccagggttcttcgt

SEQ ID NO: 62911 - DNA, 15 bp, Homo sapiens
ccagggttcttcgtc

SEQ ID NO: 62912 - DNA, 15 bp, Homo sapiens
cagggttcttcgtca

SEQ ID NO: 62913 - DNA, 15 bp, Homo sapiens
agggttcttcgtcat

SEQ ID NO: 62914 - DNA, 15 bp, Homo sapiens
gggttcttcgtcatt

SEQ ID NO: 62915 - DNA, 15 bp, Homo sapiens
ggttcttcgtcattt

SEQ ID NO: 62916 - DNA, 15 bp, Homo sapiens
gttcttcgtcatttc

SEQ ID NO: 62917 - DNA, 15 bp, Homo sapiens
ttcttcgtcatttcc

SEQ ID NO: 62918 - DNA, 15 bp, Homo sapiens
tcttcgtcatttccc

SEQ ID NO: 62919 - DNA, 15 bp, Homo sapiens
cttcgtcatttccca

SEQ ID NO: 62920 - DNA, 15 bp, Homo sapiens
ttcgtcatttcccat

SEQ ID NO: 62921 - DNA, 15 bp, Homo sapiens
tcgtcatttcccatt

SEQ ID NO: 62922 - DNA, 15 bp, Homo sapiens
cgtcatttcccattg

SEQ ID NO: 62923 - DNA, 15 bp, Homo sapiens
gtcatttcccattga

SEQ ID NO: 62924 - DNA, 15 bp, Homo sapiens
tcatttcccattgag

SEQ ID NO: 62925 - DNA, 15 bp, Homo sapiens
catttcccattgaga

SEQ ID NO: 62926 - DNA, 15 bp, Homo sapiens
atttcccattgagag

SEQ ID NO: 62927 - DNA, 15 bp, Homo sapiens
tttcccattgagagc

SEQ ID NO: 62928 - DNA, 15 bp, Homo sapiens
ttcccattgagagct

SEQ ID NO: 62929 - DNA, 15 bp, Homo sapiens
tcccattgagagctg

SEQ ID NO: 62930 - DNA, 15 bp, Homo sapiens
cccattgagagctgt

SEQ ID NO: 62931 - DNA, 15 bp, Homo sapiens
ccattgagagctgta

SEQ ID NO: 62932 - DNA, 15 bp, Homo sapiens
cattgagagctgtaa

SEQ ID NO: 62933 - DNA, 15 bp, Homo sapiens
attgagagctgtaag

SEQ ID NO: 62934 - DNA, 15 bp, Homo sapiens
ttgagagctgtaaga

SEQ ID NO: 62935 - DNA, 15 bp, Homo sapiens
tgagagctgtaagac

SEQ ID NO: 62936 - DNA, 15 bp, Homo sapiens
gagagctgtaagact

SEQ ID NO: 62937 - DNA, 15 bp, Homo sapiens
agagctgtaagactc

SEQ ID NO: 62938 - DNA, 15 bp, Homo sapiens
gagctgtaagactca

SEQ ID NO: 62939 - DNA, 15 bp, Homo sapiens
agctgtaagactcag

SEQ ID NO: 62940 - DNA, 15 bp, Homo sapiens
gctgtaagactcaga

SEQ ID NO: 62941 - DNA, 15 bp, Homo sapiens
ctgtaagactcagag

SEQ ID NO: 62942 - DNA, 15 bp, Homo sapiens
tgtaagactcagaga

SEQ ID NO: 62943 - DNA, 15 bp, Homo sapiens
gtaagactcagagac

SEQ ID NO: 62944 - DNA, 15 bp, Homo sapiens
taagactcagagaca

SEQ ID NO: 62945 - DNA, 15 bp, Homo sapiens
aagactcagagacat

SEQ ID NO: 62946 - DNA, 15 bp, Homo sapiens
agactcagagacatg

SEQ ID NO: 62947 - DNA, 15 bp, Homo sapiens
gactcagagacatga

SEQ ID NO: 62948 - DNA, 15 bp, Homo sapiens
actcagagacatgaa

SEQ ID NO: 62949 - DNA, 15 bp, Homo sapiens
ctcagagacatgaaa

SEQ ID NO: 62950 - DNA, 15 bp, Homo sapiens
tcagagacatgaaaa

SEQ ID NO: 62951 - DNA, 15 bp, Homo sapiens
cagagacatgaaaag

SEQ ID NO: 62952 - DNA, 15 bp, Homo sapiens
agagacatgaaaagg

SEQ ID NO: 62953 - DNA, 15 bp, Homo sapiens
gagacatgaaaagga

SEQ ID NO: 62954 - DNA, 15 bp, Homo sapiens
agacatgaaaaggaa

SEQ ID NO: 62955 - DNA, 15 bp, Homo sapiens
gacatgaaaaggaag

SEQ ID NO: 62956 - DNA, 15 bp, Homo sapiens
acatgaaaaggaagc

SEQ ID NO: 62957 - DNA, 15 bp, Homo sapiens
catgaaaaggaagct

SEQ ID NO: 62958 - DNA, 15 bp, Homo sapiens
atgaaaaggaagctc

SEQ ID NO: 62959 - DNA, 15 bp, Homo sapiens
tgaaaaggaagctct

SEQ ID NO: 62960 - DNA, 15 bp, Homo sapiens
gaaaaggaagctctg

SEQ ID NO: 62961 - DNA, 15 bp, Homo sapiens
aaaaggaagctctgg

SEQ ID NO: 62962 - DNA, 15 bp, Homo sapiens
aaaggaagctctggc

SEQ ID NO: 62963 - DNA, 15 bp, Homo sapiens
aaggaagctctggct

SEQ ID NO: 62964 - DNA, 15 bp, Homo sapiens
aggaagctctggctg

SEQ ID NO: 62965 - DNA, 15 bp, Homo sapiens
ggaagctctggctgg

SEQ ID NO: 62966 - DNA, 15 bp, Homo sapiens
gaagctctggctggg

SEQ ID NO: 62967 - DNA, 15 bp, Homo sapiens
aagctctggctgggc

SEQ ID NO: 62968 - DNA, 15 bp, Homo sapiens
agctctggctgggca

SEQ ID NO: 62969 - DNA, 15 bp, Homo sapiens
gctctggctgggcac

SEQ ID NO: 62970 - DNA, 15 bp, Homo sapiens
ctctggctgggcacg

SEQ ID NO: 62971 - DNA, 15 bp, Homo sapiens
tctggctgggcacgg

SEQ ID NO: 62972 - DNA, 15 bp, Homo sapiens
ctggctgggcacggt

SEQ ID NO: 62973 - DNA, 15 bp, Homo sapiens
tggctgggcacggtg

SEQ ID NO: 62974 - DNA, 15 bp, Homo sapiens
ggctgggcacggtgg

SEQ ID NO: 62975 - DNA, 15 bp, Homo sapiens
tgggcacggtggctc

SEQ ID NO: 62976 - DNA, 15 bp, Homo sapiens
aggctgaggcgggtc

SEQ ID NO: 62977 - DNA, 15 bp, Homo sapiens
ggctgaggcgggtcg

SEQ ID NO: 62978 - DNA, 15 bp, Homo sapiens
gctgaggcgggtcga

SEQ ID NO: 62979 - DNA, 15 bp, Homo sapiens
ctgaggcgggtcgat

SEQ ID NO: 62980 - DNA, 15 bp, Homo sapiens
tgaggcgggtcgatc

SEQ ID NO: 62981 - DNA, 15 bp, Homo sapiens
gaggcgggtcgatca

SEQ ID NO: 62982 - DNA, 15 bp, Homo sapiens
aggcgggtcgatcac

SEQ ID NO: 62983 - DNA, 15 bp, Homo sapiens
ggcgggtcgatcacc

SEQ ID NO: 62984 - DNA, 15 bp, Homo sapiens
gcgggtcgatcacct

SEQ ID NO: 62985 - DNA, 15 bp, Homo sapiens
cgggtcgatcacctg

SEQ ID NO: 62986 - DNA, 15 bp, Homo sapiens
gggtcgatcacctga

SEQ ID NO: 62987 - DNA, 15 bp, Homo sapiens
ggtcgatcacctgag

SEQ ID NO: 62988 - DNA, 15 bp, Homo sapiens
gtcgatcacctgagg

SEQ ID NO: 62989 - DNA, 15 bp, Homo sapiens
tcgatcacctgaggt

SEQ ID NO: 62990 - DNA, 15 bp, Homo sapiens
cgatcacctgaggtc

SEQ ID NO: 62991 - DNA, 15 bp, Homo sapiens
tcgagaccagcctgc

SEQ ID NO: 62992 - DNA, 15 bp, Homo sapiens
cgagaccagcctgcc

SEQ ID NO: 62993 - DNA, 15 bp, Homo sapiens
gagaccagcctgccc

SEQ ID NO: 62994 - DNA, 15 bp, Homo sapiens
agaccagcctgccca

SEQ ID NO: 62995 - DNA, 15 bp, Homo sapiens
gaccagcctgcccaa

SEQ ID NO: 62996 - DNA, 15 bp, Homo sapiens
accagcctgcccaac

SEQ ID NO: 62997 - DNA, 15 bp, Homo sapiens
ccagcctgcccaaca

SEQ ID NO: 62998 - DNA, 15 bp, Homo sapiens
cagcctgcccaacat

SEQ ID NO: 62999 - DNA, 15 bp, Homo sapiens
agcctgcccaacatg

SEQ ID NO: 63000 - DNA, 15 bp, Homo sapiens
gcctgcccaacatgg

SEQ ID NO: 63001 - DNA, 15 bp, Homo sapiens
cctgcccaacatggt

SEQ ID NO: 63002 - DNA, 15 bp, Homo sapiens
ctgcccaacatggtg

SEQ ID NO: 63003 - DNA, 15 bp, Homo sapiens
tgcccaacatggtga

SEQ ID NO: 63004 - DNA, 15 bp, Homo sapiens
gcccaacatggtgaa

SEQ ID NO: 63005 - DNA, 15 bp, Homo sapiens
cccaacatggtgaaa

SEQ ID NO: 63006 - DNA, 15 bp, Homo sapiens
caacatggtgaaacc

SEQ ID NO: 63007 - DNA, 15 bp, Homo sapiens
aacatggtgaaaccc

SEQ ID NO: 63008 - DNA, 15 bp, Homo sapiens
acatggtgaaacccc

SEQ ID NO: 63009 - DNA, 15 bp, Homo sapiens
tgaaaccccgtctcc

SEQ ID NO: 63010 - DNA, 15 bp, Homo sapiens
gaaaccccgtctcca

SEQ ID NO: 63011 - DNA, 15 bp, Homo sapiens
aaaccccgtctccac

SEQ ID NO: 63012 - DNA, 15 bp, Homo sapiens
aaccccgtctccact

SEQ ID NO: 63013 - DNA, 15 bp, Homo sapiens
accccgtctccacta

SEQ ID NO: 63014 - DNA, 15 bp, Homo sapiens
ccccgtctccactaa

SEQ ID NO: 63015 - DNA, 15 bp, Homo sapiens
cccgtctccactaaa

SEQ ID NO: 63016 - DNA, 15 bp, Homo sapiens
ccgtctccactaaac

SEQ ID NO: 63017 - DNA, 15 bp, Homo sapiens
cgtctccactaaaca

SEQ ID NO: 63018 - DNA, 15 bp, Homo sapiens
gtctccactaaacat

SEQ ID NO: 63019 - DNA, 15 bp, Homo sapiens
tctccactaaacata

SEQ ID NO: 63020 - DNA, 15 bp, Homo sapiens
ctccactaaacatac

SEQ ID NO: 63021 - DNA, 15 bp, Homo sapiens
tccactaaacataca

SEQ ID NO: 63022 - DNA, 15 bp, Homo sapiens
ccactaaacatacaa

SEQ ID NO: 63023 - DNA, 15 bp, Homo sapiens
cactaaacatacaaa

SEQ ID NO: 63024 - DNA, 15 bp, Homo sapiens
actaaacatacaaaa

SEQ ID NO: 63025 - DNA, 15 bp, Homo sapiens
ctaaacatacaaaaa

SEQ ID NO: 63026 - DNA, 15 bp, Homo sapiens
taaacatacaaaaat

SEQ ID NO: 63027 - DNA, 15 bp, Homo sapiens
aaacatacaaaaatt

SEQ ID NO: 63028 - DNA, 15 bp, Homo sapiens
aacatacaaaaatta

SEQ ID NO: 63029 - DNA, 15 bp, Homo sapiens
acatacaaaaattag

SEQ ID NO: 63030 - DNA, 15 bp, Homo sapiens
catacaaaaattagc

SEQ ID NO: 63031 - DNA, 15 bp, Homo sapiens
tacaaaaattagcct

SEQ ID NO: 63032 - DNA, 15 bp, Homo sapiens
acaaaaattagcctg

SEQ ID NO: 63033 - DNA, 15 bp, Homo sapiens
caaaaattagcctgg

SEQ ID NO: 63034 - DNA, 15 bp, Homo sapiens
aaaaattagcctggc

SEQ ID NO: 63035 - DNA, 15 bp, Homo sapiens
aaaattagcctggcg

SEQ ID NO: 63036 - DNA, 15 bp, Homo sapiens
aaattagcctggcgt

SEQ ID NO: 63037 - DNA, 15 bp, Homo sapiens
aattagcctggcgtg

SEQ ID NO: 63038 - DNA, 15 bp, Homo sapiens
attagcctggcgtgg

SEQ ID NO: 63039 - DNA, 15 bp, Homo sapiens
ttagcctggcgtggt

SEQ ID NO: 63040 - DNA, 15 bp, Homo sapiens
tagcctggcgtggta

SEQ ID NO: 63041 - DNA, 15 bp, Homo sapiens
agcctggcgtggtag

SEQ ID NO: 63042 - DNA, 15 bp, Homo sapiens
gcctggcgtggtagc

SEQ ID NO: 63043 - DNA, 15 bp, Homo sapiens
cctggcgtggtagca

SEQ ID NO: 63044 - DNA, 15 bp, Homo sapiens
ctggcgtggtagcac

SEQ ID NO: 63045 - DNA, 15 bp, Homo sapiens
tggcgtggtagcaca

SEQ ID NO: 63046 - DNA, 15 bp, Homo sapiens
ggcgtggtagcacac

SEQ ID NO: 63047 - DNA, 15 bp, Homo sapiens
gcgtggtagcacacg

SEQ ID NO: 63048 - DNA, 15 bp, Homo sapiens
cgtggtagcacacgc

SEQ ID NO: 63049 - DNA, 15 bp, Homo sapiens
gtggtagcacacgcc

SEQ ID NO: 63050 - DNA, 15 bp, Homo sapiens
tggtagcacacgcct

SEQ ID NO: 63051 - DNA, 15 bp, Homo sapiens
ggtagcacacgcctg

SEQ ID NO: 63052 - DNA, 15 bp, Homo sapiens
gtagcacacgcctgt

SEQ ID NO: 63053 - DNA, 15 bp, Homo sapiens
tagcacacgcctgtg

SEQ ID NO: 63054 - DNA, 15 bp, Homo sapiens
agcacacgcctgtga

SEQ ID NO: 63055 - DNA, 15 bp, Homo sapiens
gcacacgcctgtgat

SEQ ID NO: 63056 - DNA, 15 bp, Homo sapiens
cacacgcctgtgatc

SEQ ID NO: 63057 - DNA, 15 bp, Homo sapiens
acacgcctgtgatcc

SEQ ID NO: 63058 - DNA, 15 bp, Homo sapiens
cacgcctgtgatccc

SEQ ID NO: 63059 - DNA, 15 bp, Homo sapiens
acgcctgtgatccca

SEQ ID NO: 63060 - DNA, 15 bp, Homo sapiens
cgcctgtgatcccag

SEQ ID NO: 63061 - DNA, 15 bp, Homo sapiens
gcctgtgatcccagc

SEQ ID NO: 63062 - DNA, 15 bp, Homo sapiens
cctgtgatcccagct

SEQ ID NO: 63063 - DNA, 15 bp, Homo sapiens
ctgtgatcccagcta

SEQ ID NO: 63064 - DNA, 15 bp, Homo sapiens
tgtgatcccagctac

SEQ ID NO: 63065 - DNA, 15 bp, Homo sapiens
gtgatcccagctact

SEQ ID NO: 63066 - DNA, 15 bp, Homo sapiens
tgatcccagctactc

SEQ ID NO: 63067 - DNA, 15 bp, Homo sapiens
gatcccagctactcc

SEQ ID NO: 63068 - DNA, 15 bp, Homo sapiens
tgaggcaggagaata

SEQ ID NO: 63069 - DNA, 15 bp, Homo sapiens
gaggcaggagaataa

SEQ ID NO: 63070 - DNA, 15 bp, Homo sapiens
aggcaggagaataac

SEQ ID NO: 63071 - DNA, 15 bp, Homo sapiens
ggcaggagaataact

SEQ ID NO: 63072 - DNA, 15 bp, Homo sapiens
gcaggagaataactt

SEQ ID NO: 63073 - DNA, 15 bp, Homo sapiens
caggagaataacttg

SEQ ID NO: 63074 - DNA, 15 bp, Homo sapiens
aggagaataacttga

SEQ ID NO: 63075 - DNA, 15 bp, Homo sapiens
ggagaataacttgaa

SEQ ID NO: 63076 - DNA, 15 bp, Homo sapiens
gagaataacttgaac

SEQ ID NO: 63077 - DNA, 15 bp, Homo sapiens
agaataacttgaacc

SEQ ID NO: 63078 - DNA, 15 bp, Homo sapiens
gaataacttgaaccc

SEQ ID NO: 63079 - DNA, 15 bp, Homo sapiens
aataacttgaacccg

SEQ ID NO: 63080 - DNA, 15 bp, Homo sapiens
ataacttgaacccgg

SEQ ID NO: 63081 - DNA, 15 bp, Homo sapiens
taacttgaacccggc

SEQ ID NO: 63082 - DNA, 15 bp, Homo sapiens
aacttgaacccggca

SEQ ID NO: 63083 - DNA, 15 bp, Homo sapiens
acttgaacccggcag

SEQ ID NO: 63084 - DNA, 15 bp, Homo sapiens
cttgaacccggcagg

SEQ ID NO: 63085 - DNA, 15 bp, Homo sapiens
ttgaacccggcaggc

SEQ ID NO: 63086 - DNA, 15 bp, Homo sapiens
tgaacccggcaggcg

SEQ ID NO: 63087 - DNA, 15 bp, Homo sapiens
gaacccggcaggcgg

SEQ ID NO: 63088 - DNA, 15 bp, Homo sapiens
aacccggcaggcgga

SEQ ID NO: 63089 - DNA, 15 bp, Homo sapiens
acccggcaggcggag

SEQ ID NO: 63090 - DNA, 15 bp, Homo sapiens
cccggcaggcggagg

SEQ ID NO: 63091 - DNA, 15 bp, Homo sapiens
ccggcaggcggaggt

SEQ ID NO: 63092 - DNA, 15 bp, Homo sapiens
cggcaggcggaggtt

SEQ ID NO: 63093 - DNA, 15 bp, Homo sapiens
ggcaggcggaggttg

SEQ ID NO: 63094 - DNA, 15 bp, Homo sapiens
gcaggcggaggttgc

SEQ ID NO: 63095 - DNA, 15 bp, Homo sapiens
caggcggaggttgcg

SEQ ID NO: 63096 - DNA, 15 bp, Homo sapiens
aggcggaggttgcga

SEQ ID NO: 63097 - DNA, 15 bp, Homo sapiens
ggcggaggttgcgat

SEQ ID NO: 63098 - DNA, 15 bp, Homo sapiens
gcggaggttgcgatg

SEQ ID NO: 63099 - DNA, 15 bp, Homo sapiens
cggaggttgcgatga

SEQ ID NO: 63100 - DNA, 15 bp, Homo sapiens
ggaggttgcgatgag

SEQ ID NO: 63101 - DNA, 15 bp, Homo sapiens
gaggttgcgatgagc

SEQ ID NO: 63102 - DNA, 15 bp, Homo sapiens
aggttgcgatgagcc

SEQ ID NO: 63103 - DNA, 15 bp, Homo sapiens
ggttgcgatgagccg

SEQ ID NO: 63104 - DNA, 15 bp, Homo sapiens
gttgcgatgagccga

SEQ ID NO: 63105 - DNA, 15 bp, Homo sapiens
ttgcgatgagccgat

SEQ ID NO: 63106 - DNA, 15 bp, Homo sapiens
tgcgatgagccgata

SEQ ID NO: 63107 - DNA, 15 bp, Homo sapiens
gcgatgagccgatat

SEQ ID NO: 63108 - DNA, 15 bp, Homo sapiens
cgatgagccgatatt

SEQ ID NO: 63109 - DNA, 15 bp, Homo sapiens
gatgagccgatatta

SEQ ID NO: 63110 - DNA, 15 bp, Homo sapiens
atgagccgatattat

SEQ ID NO: 63111 - DNA, 15 bp, Homo sapiens
tgagccgatattatg

SEQ ID NO: 63112 - DNA, 15 bp, Homo sapiens
gagccgatattatgc

SEQ ID NO: 63113 - DNA, 15 bp, Homo sapiens
agccgatattatgcc

SEQ ID NO: 63114 - DNA, 15 bp, Homo sapiens
gccgatattatgcca

SEQ ID NO: 63115 - DNA, 15 bp, Homo sapiens
ccgatattatgccat

SEQ ID NO: 63116 - DNA, 15 bp, Homo sapiens
cgatattatgccatc

SEQ ID NO: 63117 - DNA, 15 bp, Homo sapiens
gatattatgccatcg

SEQ ID NO: 63118 - DNA, 15 bp, Homo sapiens
atattatgccatcgg

SEQ ID NO: 63119 - DNA, 15 bp, Homo sapiens
tattatgccatcggc

SEQ ID NO: 63120 - DNA, 15 bp, Homo sapiens
attatgccatcggca

SEQ ID NO: 63121 - DNA, 15 bp, Homo sapiens
ttatgccatcggcaa

SEQ ID NO: 63122 - DNA, 15 bp, Homo sapiens
tatgccatcggcaac

SEQ ID NO: 63123 - DNA, 15 bp, Homo sapiens
atgccatcggcaaca

SEQ ID NO: 63124 - DNA, 15 bp, Homo sapiens
tgccatcggcaacag

SEQ ID NO: 63125 - DNA, 15 bp, Homo sapiens
gccatcggcaacaga

SEQ ID NO: 63126 - DNA, 15 bp, Homo sapiens
ccatcggcaacagag

SEQ ID NO: 63127 - DNA, 15 bp, Homo sapiens
catcggcaacagagc

SEQ ID NO: 63128 - DNA, 15 bp, Homo sapiens
atcggcaacagagcg

SEQ ID NO: 63129 - DNA, 15 bp, Homo sapiens
tcggcaacagagcga

SEQ ID NO: 63130 - DNA, 15 bp, Homo sapiens
cggcaacagagcgag

SEQ ID NO: 63131 - DNA, 15 bp, Homo sapiens
ggcaacagagcgaga

SEQ ID NO: 63132 - DNA, 15 bp, Homo sapiens
gcaacagagcgagac

SEQ ID NO: 63133 - DNA, 15 bp, Homo sapiens
caacagagcgagact

SEQ ID NO: 63134 - DNA, 15 bp, Homo sapiens
aacagagcgagactc

SEQ ID NO: 63135 - DNA, 15 bp, Homo sapiens
acagagcgagactcc

SEQ ID NO: 63136 - DNA, 15 bp, Homo sapiens
cagagcgagactcca

SEQ ID NO: 63137 - DNA, 15 bp, Homo sapiens
agagcgagactccat

SEQ ID NO: 63138 - DNA, 15 bp, Homo sapiens
gagcgagactccatc

SEQ ID NO: 63139 - DNA, 15 bp, Homo sapiens
agcgagactccatct

SEQ ID NO: 63140 - DNA, 15 bp, Homo sapiens
gcgagactccatctc

SEQ ID NO: 63141 - DNA, 15 bp, Homo sapiens
cgagactccatctca

SEQ ID NO: 63142 - DNA, 15 bp, Homo sapiens
tctcaaaaaaaaaac

SEQ ID NO: 63143 - DNA, 15 bp, Homo sapiens
ctcaaaaaaaaaaca

SEQ ID NO: 63144 - DNA, 15 bp, Homo sapiens
tcaaaaaaaaaacaa

SEQ ID NO: 63145 - DNA, 15 bp, Homo sapiens
caaaaaaaaaacaaa

SEQ ID NO: 63146 - DNA, 15 bp, Homo sapiens
aaaaaaaaaacaaaa

SEQ ID NO: 63147 - DNA, 15 bp, Homo sapiens
aaaaaaaaacaaaaa

SEQ ID NO: 63148 - DNA, 15 bp, Homo sapiens
aaaaaaaacaaaaaa

SEQ ID NO: 63149 - DNA, 15 bp, Homo sapiens
aaaaaaacaaaaaac

SEQ ID NO: 63150 - DNA, 15 bp, Homo sapiens
aaaaaacaaaaaaca

SEQ ID NO: 63151 - DNA, 15 bp, Homo sapiens
aaaaacaaaaaacaa

SEQ ID NO: 63152 - DNA, 15 bp, Homo sapiens
aaaacaaaaaacaaa

SEQ ID NO: 63153 - DNA, 15 bp, Homo sapiens
aaacaaaaaacaaaa

SEQ ID NO: 63154 - DNA, 15 bp, Homo sapiens
aacaaaaaacaaaac

SEQ ID NO: 63155 - DNA, 15 bp, Homo sapiens
acaaaaaacaaaaca

SEQ ID NO: 63156 - DNA, 15 bp, Homo sapiens
caaaaaacaaaacaa

SEQ ID NO: 63157 - DNA, 15 bp, Homo sapiens
aaaaaacaaaacaag

SEQ ID NO: 63158 - DNA, 15 bp, Homo sapiens
aaaaacaaaacaagg

SEQ ID NO: 63159 - DNA, 15 bp, Homo sapiens
aaaacaaaacaaggc

SEQ ID NO: 63160 - DNA, 15 bp, Homo sapiens
aaacaaaacaaggcg

SEQ ID NO: 63161 - DNA, 15 bp, Homo sapiens
aacaaaacaaggcga

SEQ ID NO: 63162 - DNA, 15 bp, Homo sapiens
acaaaacaaggcgag

SEQ ID NO: 63163 - DNA, 15 bp, Homo sapiens
caaaacaaggcgagc

SEQ ID NO: 63164 - DNA, 15 bp, Homo sapiens
aaaacaaggcgagct

SEQ ID NO: 63165 - DNA, 15 bp, Homo sapiens
aaacaaggcgagctc

SEQ ID NO: 63166 - DNA, 15 bp, Homo sapiens
aacaaggcgagctct

SEQ ID NO: 63167 - DNA, 15 bp, Homo sapiens
acaaggcgagctctg

SEQ ID NO: 63168 - DNA, 15 bp, Homo sapiens
caaggcgagctctgt

SEQ ID NO: 63169 - DNA, 15 bp, Homo sapiens
aaggcgagctctgtg

SEQ ID NO: 63170 - DNA, 15 bp, Homo sapiens
aggcgagctctgtgc

SEQ ID NO: 63171 - DNA, 15 bp, Homo sapiens
ggcgagctctgtgct

SEQ ID NO: 63172 - DNA, 15 bp, Homo sapiens
gcgagctctgtgctg

SEQ ID NO: 63173 - DNA, 15 bp, Homo sapiens
cgagctctgtgctgg

SEQ ID NO: 63174 - DNA, 15 bp, Homo sapiens
gagctctgtgctggg

SEQ ID NO: 63175 - DNA, 15 bp, Homo sapiens
agctctgtgctggga

SEQ ID NO: 63176 - DNA, 15 bp, Homo sapiens
gctctgtgctgggac

SEQ ID NO: 63177 - DNA, 15 bp, Homo sapiens
ctctgtgctgggaca

SEQ ID NO: 63178 - DNA, 15 bp, Homo sapiens
tctgtgctgggacag

SEQ ID NO: 63179 - DNA, 15 bp, Homo sapiens
ctgtgctgggacaga

SEQ ID NO: 63180 - DNA, 15 bp, Homo sapiens
tgtgctgggacagat

SEQ ID NO: 63181 - DNA, 15 bp, Homo sapiens
gtgctgggacagatt

SEQ ID NO: 63182 - DNA, 15 bp, Homo sapiens
tgctgggacagatta

SEQ ID NO: 63183 - DNA, 15 bp, Homo sapiens
gctgggacagattag

SEQ ID NO: 63184 - DNA, 15 bp, Homo sapiens
ctgggacagattagg

SEQ ID NO: 63185 - DNA, 15 bp, Homo sapiens
tgggacagattaggg

SEQ ID NO: 63186 - DNA, 15 bp, Homo sapiens
gggacagattaggga

SEQ ID NO: 63187 - DNA, 15 bp, Homo sapiens
ggacagattagggac

SEQ ID NO: 63188 - DNA, 15 bp, Homo sapiens
gacagattagggacc

SEQ ID NO: 63189 - DNA, 15 bp, Homo sapiens
acagattagggaccc

SEQ ID NO: 63190 - DNA, 15 bp, Homo sapiens
cagattagggacccc

SEQ ID NO: 63191 - DNA, 15 bp, Homo sapiens
agattagggacccct

SEQ ID NO: 63192 - DNA, 15 bp, Homo sapiens
gattagggacccctc

SEQ ID NO: 63193 - DNA, 15 bp, Homo sapiens
attagggacccctct

SEQ ID NO: 63194 - DNA, 15 bp, Homo sapiens
ttagggacccctctt

SEQ ID NO: 63195 - DNA, 15 bp, Homo sapiens
tagggacccctcttt

SEQ ID NO: 63196 - DNA, 15 bp, Homo sapiens
agggacccctcttta

SEQ ID NO: 63197 - DNA, 15 bp, Homo sapiens
gggacccctctttac

SEQ ID NO: 63198 - DNA, 15 bp, Homo sapiens
ggacccctctttaca

SEQ ID NO: 63199 - DNA, 15 bp, Homo sapiens
gacccctctttacag

SEQ ID NO: 63200 - DNA, 15 bp, Homo sapiens
acccctctttacagc

SEQ ID NO: 63201 - DNA, 15 bp, Homo sapiens
cccctctttacagca

SEQ ID NO: 63202 - DNA, 15 bp, Homo sapiens
ccctctttacagcaa

SEQ ID NO: 63203 - DNA, 15 bp, Homo sapiens
cctctttacagcaag

SEQ ID NO: 63204 - DNA, 15 bp, Homo sapiens
ctctttacagcaaga

SEQ ID NO: 63205 - DNA, 15 bp, Homo sapiens
tctttacagcaagaa

SEQ ID NO: 63206 - DNA, 15 bp, Homo sapiens
ctttacagcaagaaa

SEQ ID NO: 63207 - DNA, 15 bp, Homo sapiens
tttacagcaagaaag

SEQ ID NO: 63208 - DNA, 15 bp, Homo sapiens
ttacagcaagaaaga

SEQ ID NO: 63209 - DNA, 15 bp, Homo sapiens
tacagcaagaaagac

SEQ ID NO: 63210 - DNA, 15 bp, Homo sapiens
acagcaagaaagact

SEQ ID NO: 63211 - DNA, 15 bp, Homo sapiens
cagcaagaaagactg

SEQ ID NO: 63212 - DNA, 15 bp, Homo sapiens
agcaagaaagactgc

SEQ ID NO: 63213 - DNA, 15 bp, Homo sapiens
gcaagaaagactgct

SEQ ID NO: 63214 - DNA, 15 bp, Homo sapiens
caagaaagactgctc

SEQ ID NO: 63215 - DNA, 15 bp, Homo sapiens
aagaaagactgctct

SEQ ID NO: 63216 - DNA, 15 bp, Homo sapiens
agaaagactgctctg

SEQ ID NO: 63217 - DNA, 15 bp, Homo sapiens
gaaagactgctctgt

SEQ ID NO: 63218 - DNA, 15 bp, Homo sapiens
aaagactgctctgtg

SEQ ID NO: 63219 - DNA, 15 bp, Homo sapiens
aagactgctctgtgg

SEQ ID NO: 63220 - DNA, 15 bp, Homo sapiens
agactgctctgtggg

SEQ ID NO: 63221 - DNA, 15 bp, Homo sapiens
gactgctctgtgggt

SEQ ID NO: 63222 - DNA, 15 bp, Homo sapiens
actgctctgtgggtt

SEQ ID NO: 63223 - DNA, 15 bp, Homo sapiens
ctgctctgtgggttg

SEQ ID NO: 63224 - DNA, 15 bp, Homo sapiens
tgctctgtgggttgt

SEQ ID NO: 63225 - DNA, 15 bp, Homo sapiens
gctctgtgggttgta

SEQ ID NO: 63226 - DNA, 15 bp, Homo sapiens
ctctgtgggttgtag

SEQ ID NO: 63227 - DNA, 15 bp, Homo sapiens
tctgtgggttgtagg

SEQ ID NO: 63228 - DNA, 15 bp, Homo sapiens
ctgtgggttgtagga

SEQ ID NO: 63229 - DNA, 15 bp, Homo sapiens
tgtgggttgtaggat

SEQ ID NO: 63230 - DNA, 15 bp, Homo sapiens
gtgggttgtaggatg

SEQ ID NO: 63231 - DNA, 15 bp, Homo sapiens
tgggttgtaggatgc

SEQ ID NO: 63232 - DNA, 15 bp, Homo sapiens
gggttgtaggatgcc

SEQ ID NO: 63233 - DNA, 15 bp, Homo sapiens
ggttgtaggatgcct

SEQ ID NO: 63234 - DNA, 15 bp, Homo sapiens
gttgtaggatgcctt

SEQ ID NO: 63235 - DNA, 15 bp, Homo sapiens
ttgtaggatgccttt

SEQ ID NO: 63236 - DNA, 15 bp, Homo sapiens
tgtaggatgcctttg

SEQ ID NO: 63237 - DNA, 15 bp, Homo sapiens
gtaggatgcctttgt

SEQ ID NO: 63238 - DNA, 15 bp, Homo sapiens
taggatgcctttgtg

SEQ ID NO: 63239 - DNA, 15 bp, Homo sapiens
aggatgcctttgtgt

SEQ ID NO: 63240 - DNA, 15 bp, Homo sapiens
ggatgcctttgtgta

SEQ ID NO: 63241 - DNA, 15 bp, Homo sapiens
gatgcctttgtgtat

SEQ ID NO: 63242 - DNA, 15 bp, Homo sapiens
atgcctttgtgtatg

SEQ ID NO: 63243 - DNA, 15 bp, Homo sapiens
tgcctttgtgtatgc

SEQ ID NO: 63244 - DNA, 15 bp, Homo sapiens
gcctttgtgtatgca

SEQ ID NO: 63245 - DNA, 15 bp, Homo sapiens
cctttgtgtatgcag

SEQ ID NO: 63246 - DNA, 15 bp, Homo sapiens
ctttgtgtatgcagt

SEQ ID NO: 63247 - DNA, 15 bp, Homo sapiens
tttgtgtatgcagtg

SEQ ID NO: 63248 - DNA, 15 bp, Homo sapiens
ttgtgtatgcagtgg

SEQ ID NO: 63249 - DNA, 15 bp, Homo sapiens
tgtgtatgcagtggc

SEQ ID NO: 63250 - DNA, 15 bp, Homo sapiens
gtgtatgcagtggct

SEQ ID NO: 63251 - DNA, 15 bp, Homo sapiens
tgtatgcagtggctc

SEQ ID NO: 63252 - DNA, 15 bp, Homo sapiens
gtatgcagtggctct

SEQ ID NO: 63253 - DNA, 15 bp, Homo sapiens
tatgcagtggctcta

SEQ ID NO: 63254 - DNA, 15 bp, Homo sapiens
atgcagtggctctag

SEQ ID NO: 63255 - DNA, 15 bp, Homo sapiens
tgcagtggctctagg

SEQ ID NO: 63256 - DNA, 15 bp, Homo sapiens
gcagtggctctaggt

SEQ ID NO: 63257 - DNA, 15 bp, Homo sapiens
cagtggctctaggtg

SEQ ID NO: 63258 - DNA, 15 bp, Homo sapiens
agtggctctaggtga

SEQ ID NO: 63259 - DNA, 15 bp, Homo sapiens
gtggctctaggtgac

SEQ ID NO: 63260 - DNA, 15 bp, Homo sapiens
tggctctaggtgact

SEQ ID NO: 63261 - DNA, 15 bp, Homo sapiens
ggctctaggtgactc

SEQ ID NO: 63262 - DNA, 15 bp, Homo sapiens
gctctaggtgactct

SEQ ID NO: 63263 - DNA, 15 bp, Homo sapiens
ctctaggtgactctg

SEQ ID NO: 63264 - DNA, 15 bp, Homo sapiens
tctaggtgactctgg

SEQ ID NO: 63265 - DNA, 15 bp, Homo sapiens
ctaggtgactctggc

SEQ ID NO: 63266 - DNA, 15 bp, Homo sapiens
taggtgactctggca

SEQ ID NO: 63267 - DNA, 15 bp, Homo sapiens
aggtgactctggcag

SEQ ID NO: 63268 - DNA, 15 bp, Homo sapiens
ggtgactctggcagc

SEQ ID NO: 63269 - DNA, 15 bp, Homo sapiens
gtgactctggcagcc

SEQ ID NO: 63270 - DNA, 15 bp, Homo sapiens
tgactctggcagcca

SEQ ID NO: 63271 - DNA, 15 bp, Homo sapiens
gactctggcagccac

SEQ ID NO: 63272 - DNA, 15 bp, Homo sapiens
actctggcagccaca

SEQ ID NO: 63273 - DNA, 15 bp, Homo sapiens
ctctggcagccacac

SEQ ID NO: 63274 - DNA, 15 bp, Homo sapiens
tctggcagccacact

SEQ ID NO: 63275 - DNA, 15 bp, Homo sapiens
ctggcagccacactc

SEQ ID NO: 63276 - DNA, 15 bp, Homo sapiens
tggcagccacactct

SEQ ID NO: 63277 - DNA, 15 bp, Homo sapiens
ggcagccacactctg

SEQ ID NO: 63278 - DNA, 15 bp, Homo sapiens
gcagccacactctgg

SEQ ID NO: 63279 - DNA, 15 bp, Homo sapiens
cagccacactctggg

SEQ ID NO: 63280 - DNA, 15 bp, Homo sapiens
agccacactctgggc

SEQ ID NO: 63281 - DNA, 15 bp, Homo sapiens
gccacactctgggcc

SEQ ID NO: 63282 - DNA, 15 bp, Homo sapiens
ccacactctgggccc

SEQ ID NO: 63283 - DNA, 15 bp, Homo sapiens
cacactctgggccct

SEQ ID NO: 63284 - DNA, 15 bp, Homo sapiens
acactctgggcccta

SEQ ID NO: 63285 - DNA, 15 bp, Homo sapiens
cactctgggccctaa

SEQ ID NO: 63286 - DNA, 15 bp, Homo sapiens
actctgggccctaaa

SEQ ID NO: 63287 - DNA, 15 bp, Homo sapiens
ctctgggccctaaac

SEQ ID NO: 63288 - DNA, 15 bp, Homo sapiens
tctgggccctaaact

SEQ ID NO: 63289 - DNA, 15 bp, Homo sapiens
ctgggccctaaactt

SEQ ID NO: 63290 - DNA, 15 bp, Homo sapiens
tgggccctaaacttc

SEQ ID NO: 63291 - DNA, 15 bp, Homo sapiens
gggccctaaacttct

SEQ ID NO: 63292 - DNA, 15 bp, Homo sapiens
ggccctaaacttctg

SEQ ID NO: 63293 - DNA, 15 bp, Homo sapiens
gccctaaacttctgg

SEQ ID NO: 63294 - DNA, 15 bp, Homo sapiens
ccctaaacttctgga

SEQ ID NO: 63295 - DNA, 15 bp, Homo sapiens
cctaaacttctggag

SEQ ID NO: 63296 - DNA, 15 bp, Homo sapiens
ctaaacttctggagg

SEQ ID NO: 63297 - DNA, 15 bp, Homo sapiens
taaacttctggagga

SEQ ID NO: 63298 - DNA, 15 bp, Homo sapiens
aaacttctggaggaa

SEQ ID NO: 63299 - DNA, 15 bp, Homo sapiens
aacttctggaggaag

SEQ ID NO: 63300 - DNA, 15 bp, Homo sapiens
acttctggaggaaga

SEQ ID NO: 63301 - DNA, 15 bp, Homo sapiens
cttctggaggaagat

SEQ ID NO: 63302 - DNA, 15 bp, Homo sapiens
ttctggaggaagata

SEQ ID NO: 63303 - DNA, 15 bp, Homo sapiens
tctggaggaagatac

SEQ ID NO: 63304 - DNA, 15 bp, Homo sapiens
ctggaggaagataca

SEQ ID NO: 63305 - DNA, 15 bp, Homo sapiens
tggaggaagatacag

SEQ ID NO: 63306 - DNA, 15 bp, Homo sapiens
ggaggaagatacagg

SEQ ID NO: 63307 - DNA, 15 bp, Homo sapiens
gaggaagatacagga

SEQ ID NO: 63308 - DNA, 15 bp, Homo sapiens
aggaagatacaggat

SEQ ID NO: 63309 - DNA, 15 bp, Homo sapiens
ggaagatacaggata

SEQ ID NO: 63310 - DNA, 15 bp, Homo sapiens
gaagatacaggatag

SEQ ID NO: 63311 - DNA, 15 bp, Homo sapiens
aagatacaggatagg

SEQ ID NO: 63312 - DNA, 15 bp, Homo sapiens
agatacaggataggg

SEQ ID NO: 63313 - DNA, 15 bp, Homo sapiens
gatacaggataggga

SEQ ID NO: 63314 - DNA, 15 bp, Homo sapiens
atacaggatagggag

SEQ ID NO: 63315 - DNA, 15 bp, Homo sapiens
tacaggatagggagg

SEQ ID NO: 63316 - DNA, 15 bp, Homo sapiens
acaggatagggagga

SEQ ID NO: 63317 - DNA, 15 bp, Homo sapiens
caggatagggaggaa

SEQ ID NO: 63318 - DNA, 15 bp, Homo sapiens
aggatagggaggaac

SEQ ID NO: 63319 - DNA, 15 bp, Homo sapiens
ggatagggaggaact

SEQ ID NO: 63320 - DNA, 15 bp, Homo sapiens
gatagggaggaactc

SEQ ID NO: 63321 - DNA, 15 bp, Homo sapiens
atagggaggaactca

SEQ ID NO: 63322 - DNA, 15 bp, Homo sapiens
tagggaggaactcag

SEQ ID NO: 63323 - DNA, 15 bp, Homo sapiens
agggaggaactcagg

SEQ ID NO: 63324 - DNA, 15 bp, Homo sapiens
gggaggaactcaggg

SEQ ID NO: 63325 - DNA, 15 bp, Homo sapiens
ggaggaactcagggg

SEQ ID NO: 63326 - DNA, 15 bp, Homo sapiens
gaggaactcaggggt

SEQ ID NO: 63327 - DNA, 15 bp, Homo sapiens
aggaactcaggggtg

SEQ ID NO: 63328 - DNA, 15 bp, Homo sapiens
ggaactcaggggtga

SEQ ID NO: 63329 - DNA, 15 bp, Homo sapiens
gaactcaggggtgag

SEQ ID NO: 63330 - DNA, 15 bp, Homo sapiens
aactcaggggtgagt

SEQ ID NO: 63331 - DNA, 15 bp, Homo sapiens
actcaggggtgagtc

SEQ ID NO: 63332 - DNA, 15 bp, Homo sapiens
ctcaggggtgagtca

SEQ ID NO: 63333 - DNA, 15 bp, Homo sapiens
tcaggggtgagtcat

SEQ ID NO: 63334 - DNA, 15 bp, Homo sapiens
caggggtgagtcatg

SEQ ID NO: 63335 - DNA, 15 bp, Homo sapiens
aggggtgagtcatgg

SEQ ID NO: 63336 - DNA, 15 bp, Homo sapiens
ggggtgagtcatggt

SEQ ID NO: 63337 - DNA, 15 bp, Homo sapiens
gggtgagtcatggtg

SEQ ID NO: 63338 - DNA, 15 bp, Homo sapiens
ggtgagtcatggtgg

SEQ ID NO: 63339 - DNA, 15 bp, Homo sapiens
gtgagtcatggtggg

SEQ ID NO: 63340 - DNA, 15 bp, Homo sapiens
tgagtcatggtgggg

SEQ ID NO: 63341 - DNA, 15 bp, Homo sapiens
gagtcatggtgggga

SEQ ID NO: 63342 - DNA, 15 bp, Homo sapiens
agtcatggtggggac

SEQ ID NO: 63343 - DNA, 15 bp, Homo sapiens
gtcatggtggggaca

SEQ ID NO: 63344 - DNA, 15 bp, Homo sapiens
tcatggtggggacaa

SEQ ID NO: 63345 - DNA, 15 bp, Homo sapiens
catggtggggacaag

SEQ ID NO: 63346 - DNA, 15 bp, Homo sapiens
atggtggggacaaga

SEQ ID NO: 63347 - DNA, 15 bp, Homo sapiens
tggtggggacaagac

SEQ ID NO: 63348 - DNA, 15 bp, Homo sapiens
ggtggggacaagaca

SEQ ID NO: 63349 - DNA, 15 bp, Homo sapiens
gtggggacaagacat

SEQ ID NO: 63350 - DNA, 15 bp, Homo sapiens
tggggacaagacatt

SEQ ID NO: 63351 - DNA, 15 bp, Homo sapiens
ggggacaagacattc

SEQ ID NO: 63352 - DNA, 15 bp, Homo sapiens
gggacaagacattcc

SEQ ID NO: 63353 - DNA, 15 bp, Homo sapiens
ggacaagacattccc

SEQ ID NO: 63354 - DNA, 15 bp, Homo sapiens
gacaagacattccct

SEQ ID NO: 63355 - DNA, 15 bp, Homo sapiens
acaagacattccctc

SEQ ID NO: 63356 - DNA, 15 bp, Homo sapiens
caagacattccctca

SEQ ID NO: 63357 - DNA, 15 bp, Homo sapiens
aagacattccctcac

SEQ ID NO: 63358 - DNA, 15 bp, Homo sapiens
agacattccctcact

SEQ ID NO: 63359 - DNA, 15 bp, Homo sapiens
gacattccctcactc

SEQ ID NO: 63360 - DNA, 15 bp, Homo sapiens
acattccctcactct

SEQ ID NO: 63361 - DNA, 15 bp, Homo sapiens
cattccctcactcta

SEQ ID NO: 63362 - DNA, 15 bp, Homo sapiens
attccctcactctaa

SEQ ID NO: 63363 - DNA, 15 bp, Homo sapiens
ttccctcactctaag

SEQ ID NO: 63364 - DNA, 15 bp, Homo sapiens
tccctcactctaaga

SEQ ID NO: 63365 - DNA, 15 bp, Homo sapiens
ccctcactctaagac

SEQ ID NO: 63366 - DNA, 15 bp, Homo sapiens
cctcactctaagacc

SEQ ID NO: 63367 - DNA, 15 bp, Homo sapiens
ctcactctaagacct

SEQ ID NO: 63368 - DNA, 15 bp, Homo sapiens
tcactctaagacctt

SEQ ID NO: 63369 - DNA, 15 bp, Homo sapiens
cactctaagaccttg

SEQ ID NO: 63370 - DNA, 15 bp, Homo sapiens
actctaagaccttgt

SEQ ID NO: 63371 - DNA, 15 bp, Homo sapiens
ctctaagaccttgtc

SEQ ID NO: 63372 - DNA, 15 bp, Homo sapiens
tctaagaccttgtca

SEQ ID NO: 63373 - DNA, 15 bp, Homo sapiens
ctaagaccttgtcac

SEQ ID NO: 63374 - DNA, 15 bp, Homo sapiens
taagaccttgtcact

SEQ ID NO: 63375 - DNA, 15 bp, Homo sapiens
aagaccttgtcacta

SEQ ID NO: 63376 - DNA, 15 bp, Homo sapiens
agaccttgtcactag

SEQ ID NO: 63377 - DNA, 15 bp, Homo sapiens
gaccttgtcactaga

SEQ ID NO: 63378 - DNA, 15 bp, Homo sapiens
accttgtcactagat

SEQ ID NO: 63379 - DNA, 15 bp, Homo sapiens
ccttgtcactagatt

SEQ ID NO: 63380 - DNA, 15 bp, Homo sapiens
cttgtcactagattg

SEQ ID NO: 63381 - DNA, 15 bp, Homo sapiens
ttgtcactagattgg

SEQ ID NO: 63382 - DNA, 15 bp, Homo sapiens
tgtcactagattgga

SEQ ID NO: 63383 - DNA, 15 bp, Homo sapiens
gtcactagattggaa

SEQ ID NO: 63384 - DNA, 15 bp, Homo sapiens
tcactagattggaac

SEQ ID NO: 63385 - DNA, 15 bp, Homo sapiens
cactagattggaaca

SEQ ID NO: 63386 - DNA, 15 bp, Homo sapiens
actagattggaacat

SEQ ID NO: 63387 - DNA, 15 bp, Homo sapiens
ctagattggaacatc

SEQ ID NO: 63388 - DNA, 15 bp, Homo sapiens
tagattggaacatct

SEQ ID NO: 63389 - DNA, 15 bp, Homo sapiens
agattggaacatctc

SEQ ID NO: 63390 - DNA, 15 bp, Homo sapiens
gattggaacatctct

SEQ ID NO: 63391 - DNA, 15 bp, Homo sapiens
attggaacatctctt

SEQ ID NO: 63392 - DNA, 15 bp, Homo sapiens
ttggaacatctcttg

SEQ ID NO: 63393 - DNA, 15 bp, Homo sapiens
tggaacatctcttgc

SEQ ID NO: 63394 - DNA, 15 bp, Homo sapiens
ggaacatctcttgcc

SEQ ID NO: 63395 - DNA, 15 bp, Homo sapiens
gaacatctcttgcct

SEQ ID NO: 63396 - DNA, 15 bp, Homo sapiens
aacatctcttgcctc

SEQ ID NO: 63397 - DNA, 15 bp, Homo sapiens
acatctcttgcctcc

SEQ ID NO: 63398 - DNA, 15 bp, Homo sapiens
catctcttgcctccc

SEQ ID NO: 63399 - DNA, 15 bp, Homo sapiens
atctcttgcctccct

SEQ ID NO: 63400 - DNA, 15 bp, Homo sapiens
tctcttgcctcccta

SEQ ID NO: 63401 - DNA, 15 bp, Homo sapiens
ctcttgcctccctac

SEQ ID NO: 63402 - DNA, 15 bp, Homo sapiens
tcttgcctccctaca

SEQ ID NO: 63403 - DNA, 15 bp, Homo sapiens
cttgcctccctacac

SEQ ID NO: 63404 - DNA, 15 bp, Homo sapiens
ttgcctccctacacc

SEQ ID NO: 63405 - DNA, 15 bp, Homo sapiens
tgcctccctacacct

SEQ ID NO: 63406 - DNA, 15 bp, Homo sapiens
gcctccctacacctg

SEQ ID NO: 63407 - DNA, 15 bp, Homo sapiens
cctccctacacctga

SEQ ID NO: 63408 - DNA, 15 bp, Homo sapiens
ctccctacacctgac

SEQ ID NO: 63409 - DNA, 15 bp, Homo sapiens
tccctacacctgacc

SEQ ID NO: 63410 - DNA, 15 bp, Homo sapiens
ccctacacctgacct

SEQ ID NO: 63411 - DNA, 15 bp, Homo sapiens
cctacacctgacctg

SEQ ID NO: 63412 - DNA, 15 bp, Homo sapiens
ctacacctgacctga

SEQ ID NO: 63413 - DNA, 15 bp, Homo sapiens
tacacctgacctgat

SEQ ID NO: 63414 - DNA, 15 bp, Homo sapiens
acacctgacctgatg

SEQ ID NO: 63415 - DNA, 15 bp, Homo sapiens
cacctgacctgatgg

SEQ ID NO: 63416 - DNA, 15 bp, Homo sapiens
acctgacctgatggt

SEQ ID NO: 63417 - DNA, 15 bp, Homo sapiens
cctgacctgatggtt

SEQ ID NO: 63418 - DNA, 15 bp, Homo sapiens
ctgacctgatggttc

SEQ ID NO: 63419 - DNA, 15 bp, Homo sapiens
tgacctgatggttct

SEQ ID NO: 63420 - DNA, 15 bp, Homo sapiens
gacctgatggttctg

SEQ ID NO: 63421 - DNA, 15 bp, Homo sapiens
acctgatggttctgg

SEQ ID NO: 63422 - DNA, 15 bp, Homo sapiens
cctgatggttctgga

SEQ ID NO: 63423 - DNA, 15 bp, Homo sapiens
ctgatggttctggag

SEQ ID NO: 63424 - DNA, 15 bp, Homo sapiens
tgatggttctggaga

SEQ ID NO: 63425 - DNA, 15 bp, Homo sapiens
gatggttctggagag

SEQ ID NO: 63426 - DNA, 15 bp, Homo sapiens
atggttctggagaga

SEQ ID NO: 63427 - DNA, 15 bp, Homo sapiens
tggttctggagagat

SEQ ID NO: 63428 - DNA, 15 bp, Homo sapiens
ggttctggagagata

SEQ ID NO: 63429 - DNA, 15 bp, Homo sapiens
gttctggagagatac

SEQ ID NO: 63430 - DNA, 15 bp, Homo sapiens
ttctggagagatacg

SEQ ID NO: 63431 - DNA, 15 bp, Homo sapiens
tctggagagatacgt

SEQ ID NO: 63432 - DNA, 15 bp, Homo sapiens
ctggagagatacgtc

SEQ ID NO: 63433 - DNA, 15 bp, Homo sapiens
tggagagatacgtcc

SEQ ID NO: 63434 - DNA, 15 bp, Homo sapiens
ggagagatacgtcct

SEQ ID NO: 63435 - DNA, 15 bp, Homo sapiens
gagagatacgtcctt

SEQ ID NO: 63436 - DNA, 15 bp, Homo sapiens
agagatacgtccttg

SEQ ID NO: 63437 - DNA, 15 bp, Homo sapiens
gagatacgtccttgc

SEQ ID NO: 63438 - DNA, 15 bp, Homo sapiens
agatacgtccttgca

SEQ ID NO: 63439 - DNA, 15 bp, Homo sapiens
gatacgtccttgcag

SEQ ID NO: 63440 - DNA, 15 bp, Homo sapiens
atacgtccttgcagc

SEQ ID NO: 63441 - DNA, 15 bp, Homo sapiens
tacgtccttgcagct

SEQ ID NO: 63442 - DNA, 15 bp, Homo sapiens
acgtccttgcagctt

SEQ ID NO: 63443 - DNA, 15 bp, Homo sapiens
cgtccttgcagcttc

SEQ ID NO: 63444 - DNA, 15 bp, Homo sapiens
gtccttgcagcttct

SEQ ID NO: 63445 - DNA, 15 bp, Homo sapiens
tccttgcagcttctg

SEQ ID NO: 63446 - DNA, 15 bp, Homo sapiens
ccttgcagcttctga

SEQ ID NO: 63447 - DNA, 15 bp, Homo sapiens
cttgcagcttctgag

SEQ ID NO: 63448 - DNA, 15 bp, Homo sapiens
ttgcagcttctgagt

SEQ ID NO: 63449 - DNA, 15 bp, Homo sapiens
tgcagcttctgagtc

SEQ ID NO: 63450 - DNA, 15 bp, Homo sapiens
gcagcttctgagtcc

SEQ ID NO: 63451 - DNA, 15 bp, Homo sapiens
cagcttctgagtccc

SEQ ID NO: 63452 - DNA, 15 bp, Homo sapiens
agcttctgagtccca

SEQ ID NO: 63453 - DNA, 15 bp, Homo sapiens
gcttctgagtcccag

SEQ ID NO: 63454 - DNA, 15 bp, Homo sapiens
cttctgagtcccagc

SEQ ID NO: 63455 - DNA, 15 bp, Homo sapiens
ttctgagtcccagca

SEQ ID NO: 63456 - DNA, 15 bp, Homo sapiens
tctgagtcccagcac

SEQ ID NO: 63457 - DNA, 15 bp, Homo sapiens
ctgagtcccagcact

SEQ ID NO: 63458 - DNA, 15 bp, Homo sapiens
tgagtcccagcacta

SEQ ID NO: 63459 - DNA, 15 bp, Homo sapiens
gagtcccagcactaa

SEQ ID NO: 63460 - DNA, 15 bp, Homo sapiens
agtcccagcactaag

SEQ ID NO: 63461 - DNA, 15 bp, Homo sapiens
gtcccagcactaagc

SEQ ID NO: 63462 - DNA, 15 bp, Homo sapiens
tcccagcactaagca

SEQ ID NO: 63463 - DNA, 15 bp, Homo sapiens
cccagcactaagcag

SEQ ID NO: 63464 - DNA, 15 bp, Homo sapiens
ccagcactaagcagc

SEQ ID NO: 63465 - DNA, 15 bp, Homo sapiens
cagcactaagcagcc

SEQ ID NO: 63466 - DNA, 15 bp, Homo sapiens
agcactaagcagcct

SEQ ID NO: 63467 - DNA, 15 bp, Homo sapiens
gcactaagcagcctt

SEQ ID NO: 63468 - DNA, 15 bp, Homo sapiens
cactaagcagccttt

SEQ ID NO: 63469 - DNA, 15 bp, Homo sapiens
actaagcagcctttg

SEQ ID NO: 63470 - DNA, 15 bp, Homo sapiens
ctaagcagcctttgg

SEQ ID NO: 63471 - DNA, 15 bp, Homo sapiens
taagcagcctttggt

SEQ ID NO: 63472 - DNA, 15 bp, Homo sapiens
aagcagcctttggta

SEQ ID NO: 63473 - DNA, 15 bp, Homo sapiens
agcagcctttggtaa

SEQ ID NO: 63474 - DNA, 15 bp, Homo sapiens
gcagcctttggtaac

SEQ ID NO: 63475 - DNA, 15 bp, Homo sapiens
cagcctttggtaact

SEQ ID NO: 63476 - DNA, 15 bp, Homo sapiens
agcctttggtaactt

SEQ ID NO: 63477 - DNA, 15 bp, Homo sapiens
gcctttggtaacttc

SEQ ID NO: 63478 - DNA, 15 bp, Homo sapiens
cctttggtaacttcc

SEQ ID NO: 63479 - DNA, 15 bp, Homo sapiens
ctttggtaacttccc

SEQ ID NO: 63480 - DNA, 15 bp, Homo sapiens
tttggtaacttccct

SEQ ID NO: 63481 - DNA, 15 bp, Homo sapiens
ttggtaacttcccta

SEQ ID NO: 63482 - DNA, 15 bp, Homo sapiens
tggtaacttccctac

SEQ ID NO: 63483 - DNA, 15 bp, Homo sapiens
ggtaacttccctaca

SEQ ID NO: 63484 - DNA, 15 bp, Homo sapiens
gtaacttccctacat

SEQ ID NO: 63485 - DNA, 15 bp, Homo sapiens
taacttccctacatc

SEQ ID NO: 63486 - DNA, 15 bp, Homo sapiens
aacttccctacatca

SEQ ID NO: 63487 - DNA, 15 bp, Homo sapiens
acttccctacatcat

SEQ ID NO: 63488 - DNA, 15 bp, Homo sapiens
cttccctacatcatt

SEQ ID NO: 63489 - DNA, 15 bp, Homo sapiens
ttccctacatcattt

SEQ ID NO: 63490 - DNA, 15 bp, Homo sapiens
tccctacatcatttg

SEQ ID NO: 63491 - DNA, 15 bp, Homo sapiens
ccctacatcatttga

SEQ ID NO: 63492 - DNA, 15 bp, Homo sapiens
cctacatcatttgag

SEQ ID NO: 63493 - DNA, 15 bp, Homo sapiens
ctacatcatttgagt

SEQ ID NO: 63494 - DNA, 15 bp, Homo sapiens
tacatcatttgagtt

SEQ ID NO: 63495 - DNA, 15 bp, Homo sapiens
acatcatttgagttc

SEQ ID NO: 63496 - DNA, 15 bp, Homo sapiens
catcatttgagttct

SEQ ID NO: 63497 - DNA, 15 bp, Homo sapiens
atcatttgagttctg

SEQ ID NO: 63498 - DNA, 15 bp, Homo sapiens
tcatttgagttctgg

SEQ ID NO: 63499 - DNA, 15 bp, Homo sapiens
catttgagttctggt

SEQ ID NO: 63500 - DNA, 15 bp, Homo sapiens
atttgagttctggtt

SEQ ID NO: 63501 - DNA, 15 bp, Homo sapiens
tttgagttctggttt

SEQ ID NO: 63502 - DNA, 15 bp, Homo sapiens
ttgagttctggtttc

SEQ ID NO: 63503 - DNA, 15 bp, Homo sapiens
tgagttctggtttcc

SEQ ID NO: 63504 - DNA, 15 bp, Homo sapiens
gagttctggtttcct

SEQ ID NO: 63505 - DNA, 15 bp, Homo sapiens
agttctggtttccta

SEQ ID NO: 63506 - DNA, 15 bp, Homo sapiens
gttctggtttcctaa

SEQ ID NO: 63507 - DNA, 15 bp, Homo sapiens
ttctggtttcctaag

SEQ ID NO: 63508 - DNA, 15 bp, Homo sapiens
tctggtttcctaagg

SEQ ID NO: 63509 - DNA, 15 bp, Homo sapiens
ctggtttcctaagga

SEQ ID NO: 63510 - DNA, 15 bp, Homo sapiens
tggtttcctaaggat

SEQ ID NO: 63511 - DNA, 15 bp, Homo sapiens
ggtttcctaaggatg

SEQ ID NO: 63512 - DNA, 15 bp, Homo sapiens
gtttcctaaggatgc

SEQ ID NO: 63513 - DNA, 15 bp, Homo sapiens
tttcctaaggatgct

SEQ ID NO: 63514 - DNA, 15 bp, Homo sapiens
ttcctaaggatgctt

SEQ ID NO: 63515 - DNA, 15 bp, Homo sapiens
tcctaaggatgcttg

SEQ ID NO: 63516 - DNA, 15 bp, Homo sapiens
cctaaggatgcttgc

SEQ ID NO: 63517 - DNA, 15 bp, Homo sapiens
ctaaggatgcttgcc

SEQ ID NO: 63518 - DNA, 15 bp, Homo sapiens
taaggatgcttgcca

SEQ ID NO: 63519 - DNA, 15 bp, Homo sapiens
aaggatgcttgccag

SEQ ID NO: 63520 - DNA, 15 bp, Homo sapiens
aggatgcttgccagt

SEQ ID NO: 63521 - DNA, 15 bp, Homo sapiens
ggatgcttgccagtg

SEQ ID NO: 63522 - DNA, 15 bp, Homo sapiens
gatgcttgccagtga

SEQ ID NO: 63523 - DNA, 15 bp, Homo sapiens
atgcttgccagtgag

SEQ ID NO: 63524 - DNA, 15 bp, Homo sapiens
tgcttgccagtgagt

SEQ ID NO: 63525 - DNA, 15 bp, Homo sapiens
gcttgccagtgagtg

SEQ ID NO: 63526 - DNA, 15 bp, Homo sapiens
cttgccagtgagtgc

SEQ ID NO: 63527 - DNA, 15 bp, Homo sapiens
ttgccagtgagtgcc

SEQ ID NO: 63528 - DNA, 15 bp, Homo sapiens
tgccagtgagtgcca

SEQ ID NO: 63529 - DNA, 15 bp, Homo sapiens
gccagtgagtgccat

SEQ ID NO: 63530 - DNA, 15 bp, Homo sapiens
ccagtgagtgccatg

SEQ ID NO: 63531 - DNA, 15 bp, Homo sapiens
cagtgagtgccatgg

SEQ ID NO: 63532 - DNA, 15 bp, Homo sapiens
agtgagtgccatggt

SEQ ID NO: 63533 - DNA, 15 bp, Homo sapiens
gtgagtgccatggtg

SEQ ID NO: 63534 - DNA, 15 bp, Homo sapiens
tgagtgccatggtgc

SEQ ID NO: 63535 - DNA, 15 bp, Homo sapiens
gagtgccatggtgcc

SEQ ID NO: 63536 - DNA, 15 bp, Homo sapiens
agtgccatggtgccc

SEQ ID NO: 63537 - DNA, 15 bp, Homo sapiens
gtgccatggtgccct

SEQ ID NO: 63538 - DNA, 15 bp, Homo sapiens
tgccatggtgccctc

SEQ ID NO: 63539 - DNA, 15 bp, Homo sapiens
gccatggtgccctca

SEQ ID NO: 63540 - DNA, 15 bp, Homo sapiens
ccatggtgccctcat

SEQ ID NO: 63541 - DNA, 15 bp, Homo sapiens
catggtgccctcatt

SEQ ID NO: 63542 - DNA, 15 bp, Homo sapiens
atggtgccctcattg

SEQ ID NO: 63543 - DNA, 15 bp, Homo sapiens
tggtgccctcattgc

SEQ ID NO: 63544 - DNA, 15 bp, Homo sapiens
ggtgccctcattgca

SEQ ID NO: 63545 - DNA, 15 bp, Homo sapiens
gtgccctcattgcac

SEQ ID NO: 63546 - DNA, 15 bp, Homo sapiens
tgccctcattgcaca

SEQ ID NO: 63547 - DNA, 15 bp, Homo sapiens
gccctcattgcacag

SEQ ID NO: 63548 - DNA, 15 bp, Homo sapiens
ccctcattgcacagt

SEQ ID NO: 63549 - DNA, 15 bp, Homo sapiens
cctcattgcacagtc

SEQ ID NO: 63550 - DNA, 15 bp, Homo sapiens
ctcattgcacagtct

SEQ ID NO: 63551 - DNA, 15 bp, Homo sapiens
tcattgcacagtctg

SEQ ID NO: 63552 - DNA, 15 bp, Homo sapiens
cattgcacagtctgt

SEQ ID NO: 63553 - DNA, 15 bp, Homo sapiens
attgcacagtctgtg

SEQ ID NO: 63554 - DNA, 15 bp, Homo sapiens
ttgcacagtctgtgc

SEQ ID NO: 63555 - DNA, 15 bp, Homo sapiens
tgcacagtctgtgca

SEQ ID NO: 63556 - DNA, 15 bp, Homo sapiens
gcacagtctgtgcag

SEQ ID NO: 63557 - DNA, 15 bp, Homo sapiens
cacagtctgtgcagt

SEQ ID NO: 63558 - DNA, 15 bp, Homo sapiens
acagtctgtgcagtg

SEQ ID NO: 63559 - DNA, 15 bp, Homo sapiens
cagtctgtgcagtgt

SEQ ID NO: 63560 - DNA, 15 bp, Homo sapiens
agtctgtgcagtgta

SEQ ID NO: 63561 - DNA, 15 bp, Homo sapiens
gtctgtgcagtgtag

SEQ ID NO: 63562 - DNA, 15 bp, Homo sapiens
tctgtgcagtgtaga

SEQ ID NO: 63563 - DNA, 15 bp, Homo sapiens
ctgtgcagtgtagac

SEQ ID NO: 63564 - DNA, 15 bp, Homo sapiens
tgtgcagtgtagaca

SEQ ID NO: 63565 - DNA, 15 bp, Homo sapiens
gtgcagtgtagacaa

SEQ ID NO: 63566 - DNA, 15 bp, Homo sapiens
tgcagtgtagacaag

SEQ ID NO: 63567 - DNA, 15 bp, Homo sapiens
gcagtgtagacaaga

SEQ ID NO: 63568 - DNA, 15 bp, Homo sapiens
cagtgtagacaagag

SEQ ID NO: 63569 - DNA, 15 bp, Homo sapiens
agtgtagacaagagg

SEQ ID NO: 63570 - DNA, 15 bp, Homo sapiens
gtgtagacaagaggg

SEQ ID NO: 63571 - DNA, 15 bp, Homo sapiens
tgtagacaagagggg

SEQ ID NO: 63572 - DNA, 15 bp, Homo sapiens
gtagacaagagggga

SEQ ID NO: 63573 - DNA, 15 bp, Homo sapiens
tagacaagaggggaa

SEQ ID NO: 63574 - DNA, 15 bp, Homo sapiens
agacaagaggggaag

SEQ ID NO: 63575 - DNA, 15 bp, Homo sapiens
gacaagaggggaagt

SEQ ID NO: 63576 - DNA, 15 bp, Homo sapiens
acaagaggggaagtc

SEQ ID NO: 63577 - DNA, 15 bp, Homo sapiens
caagaggggaagtct

SEQ ID NO: 63578 - DNA, 15 bp, Homo sapiens
aagaggggaagtctc

SEQ ID NO: 63579 - DNA, 15 bp, Homo sapiens
agaggggaagtctct

SEQ ID NO: 63580 - DNA, 15 bp, Homo sapiens
gaggggaagtctctt

SEQ ID NO: 63581 - DNA, 15 bp, Homo sapiens
aggggaagtctcttg

SEQ ID NO: 63582 - DNA, 15 bp, Homo sapiens
ggggaagtctcttgg

SEQ ID NO: 63583 - DNA, 15 bp, Homo sapiens
gggaagtctcttggg

SEQ ID NO: 63584 - DNA, 15 bp, Homo sapiens
ggaagtctcttgggg

SEQ ID NO: 63585 - DNA, 15 bp, Homo sapiens
gaagtctcttggggt

SEQ ID NO: 63586 - DNA, 15 bp, Homo sapiens
aagtctcttggggta

SEQ ID NO: 63587 - DNA, 15 bp, Homo sapiens
agtctcttggggtag

SEQ ID NO: 63588 - DNA, 15 bp, Homo sapiens
gtctcttggggtaga

SEQ ID NO: 63589 - DNA, 15 bp, Homo sapiens
tctcttggggtagac

SEQ ID NO: 63590 - DNA, 15 bp, Homo sapiens
ctcttggggtagacc

SEQ ID NO: 63591 - DNA, 15 bp, Homo sapiens
tcttggggtagacca

SEQ ID NO: 63592 - DNA, 15 bp, Homo sapiens
cttggggtagaccag

SEQ ID NO: 63593 - DNA, 15 bp, Homo sapiens
ttggggtagaccagc

SEQ ID NO: 63594 - DNA, 15 bp, Homo sapiens
tggggtagaccagcc

SEQ ID NO: 63595 - DNA, 15 bp, Homo sapiens
ggggtagaccagccg

SEQ ID NO: 63596 - DNA, 15 bp, Homo sapiens
gggtagaccagccgc

SEQ ID NO: 63597 - DNA, 15 bp, Homo sapiens
ggtagaccagccgca

SEQ ID NO: 63598 - DNA, 15 bp, Homo sapiens
gtagaccagccgcaa

SEQ ID NO: 63599 - DNA, 15 bp, Homo sapiens
tagaccagccgcaag

SEQ ID NO: 63600 - DNA, 15 bp, Homo sapiens
agaccagccgcaagg

SEQ ID NO: 63601 - DNA, 15 bp, Homo sapiens
gaccagccgcaaggc

SEQ ID NO: 63602 - DNA, 15 bp, Homo sapiens
accagccgcaaggcg

SEQ ID NO: 63603 - DNA, 15 bp, Homo sapiens
ccagccgcaaggcgg

SEQ ID NO: 63604 - DNA, 15 bp, Homo sapiens
cagccgcaaggcggt

SEQ ID NO: 63605 - DNA, 15 bp, Homo sapiens
agccgcaaggcggtg

SEQ ID NO: 63606 - DNA, 15 bp, Homo sapiens
gccgcaaggcggtga

SEQ ID NO: 63607 - DNA, 15 bp, Homo sapiens
ccgcaaggcggtgac

SEQ ID NO: 63608 - DNA, 15 bp, Homo sapiens
cgcaaggcggtgact

SEQ ID NO: 63609 - DNA, 15 bp, Homo sapiens
gcaaggcggtgacta

SEQ ID NO: 63610 - DNA, 15 bp, Homo sapiens
caaggcggtgactag

SEQ ID NO: 63611 - DNA, 15 bp, Homo sapiens
aaggcggtgactagc

SEQ ID NO: 63612 - DNA, 15 bp, Homo sapiens
aggcggtgactagca

SEQ ID NO: 63613 - DNA, 15 bp, Homo sapiens
ggcggtgactagcac

SEQ ID NO: 63614 - DNA, 15 bp, Homo sapiens
gcggtgactagcact

SEQ ID NO: 63615 - DNA, 15 bp, Homo sapiens
cggtgactagcactg

SEQ ID NO: 63616 - DNA, 15 bp, Homo sapiens
ggtgactagcactga

SEQ ID NO: 63617 - DNA, 15 bp, Homo sapiens
gtgactagcactgat

SEQ ID NO: 63618 - DNA, 15 bp, Homo sapiens
tgactagcactgatg

SEQ ID NO: 63619 - DNA, 15 bp, Homo sapiens
gactagcactgatgt

SEQ ID NO: 63620 - DNA, 15 bp, Homo sapiens
actagcactgatgtg

SEQ ID NO: 63621 - DNA, 15 bp, Homo sapiens
ctagcactgatgtga

SEQ ID NO: 63622 - DNA, 15 bp, Homo sapiens
tagcactgatgtgaa

SEQ ID NO: 63623 - DNA, 15 bp, Homo sapiens
agcactgatgtgaac

SEQ ID NO: 63624 - DNA, 15 bp, Homo sapiens
gcactgatgtgaacc

SEQ ID NO: 63625 - DNA, 15 bp, Homo sapiens
cactgatgtgaacca

SEQ ID NO: 63626 - DNA, 15 bp, Homo sapiens
actgatgtgaaccac

SEQ ID NO: 63627 - DNA, 15 bp, Homo sapiens
ctgatgtgaaccaca

SEQ ID NO: 63628 - DNA, 15 bp, Homo sapiens
tgatgtgaaccacat

SEQ ID NO: 63629 - DNA, 15 bp, Homo sapiens
gatgtgaaccacatg

SEQ ID NO: 63630 - DNA, 15 bp, Homo sapiens
atgtgaaccacatgg

SEQ ID NO: 63631 - DNA, 15 bp, Homo sapiens
tgtgaaccacatggg

SEQ ID NO: 63632 - DNA, 15 bp, Homo sapiens
gtgaaccacatggga

SEQ ID NO: 63633 - DNA, 15 bp, Homo sapiens
tgaaccacatgggac

SEQ ID NO: 63634 - DNA, 15 bp, Homo sapiens
gaaccacatgggaca

SEQ ID NO: 63635 - DNA, 15 bp, Homo sapiens
aaccacatgggacag

SEQ ID NO: 63636 - DNA, 15 bp, Homo sapiens
accacatgggacagg

SEQ ID NO: 63637 - DNA, 15 bp, Homo sapiens
ccacatgggacaggg

SEQ ID NO: 63638 - DNA, 15 bp, Homo sapiens
cacatgggacagggg

SEQ ID NO: 63639 - DNA, 15 bp, Homo sapiens
acatgggacagggga

SEQ ID NO: 63640 - DNA, 15 bp, Homo sapiens
catgggacaggggag

SEQ ID NO: 63641 - DNA, 15 bp, Homo sapiens
atgggacaggggagt

SEQ ID NO: 63642 - DNA, 15 bp, Homo sapiens
tgggacaggggagtt

SEQ ID NO: 63643 - DNA, 15 bp, Homo sapiens
gggacaggggagttg

SEQ ID NO: 63644 - DNA, 15 bp, Homo sapiens
ggacaggggagttgt

SEQ ID NO: 63645 - DNA, 15 bp, Homo sapiens
gacaggggagttgtg

SEQ ID NO: 63646 - DNA, 15 bp, Homo sapiens
acaggggagttgtgg

SEQ ID NO: 63647 - DNA, 15 bp, Homo sapiens
caggggagttgtggg

SEQ ID NO: 63648 - DNA, 15 bp, Homo sapiens
aggggagttgtgggg

SEQ ID NO: 63649 - DNA, 15 bp, Homo sapiens
ggggagttgtggggc

SEQ ID NO: 63650 - DNA, 15 bp, Homo sapiens
gggagttgtggggct

SEQ ID NO: 63651 - DNA, 15 bp, Homo sapiens
ggagttgtggggctg

SEQ ID NO: 63652 - DNA, 15 bp, Homo sapiens
gagttgtggggctga

SEQ ID NO: 63653 - DNA, 15 bp, Homo sapiens
agttgtggggctgag

SEQ ID NO: 63654 - DNA, 15 bp, Homo sapiens
gttgtggggctgaga

SEQ ID NO: 63655 - DNA, 15 bp, Homo sapiens
ttgtggggctgagaa

SEQ ID NO: 63656 - DNA, 15 bp, Homo sapiens
tgtggggctgagaac

SEQ ID NO: 63657 - DNA, 15 bp, Homo sapiens
gtggggctgagaaca

SEQ ID NO: 63658 - DNA, 15 bp, Homo sapiens
tggggctgagaacac

SEQ ID NO: 63659 - DNA, 15 bp, Homo sapiens
ggggctgagaacacg

SEQ ID NO: 63660 - DNA, 15 bp, Homo sapiens
gggctgagaacacgg

SEQ ID NO: 63661 - DNA, 15 bp, Homo sapiens
ggctgagaacacgga

SEQ ID NO: 63662 - DNA, 15 bp, Homo sapiens
gctgagaacacggag

SEQ ID NO: 63663 - DNA, 15 bp, Homo sapiens
ctgagaacacggagg

SEQ ID NO: 63664 - DNA, 15 bp, Homo sapiens
tgagaacacggaggg

SEQ ID NO: 63665 - DNA, 15 bp, Homo sapiens
gagaacacggagggt

SEQ ID NO: 63666 - DNA, 15 bp, Homo sapiens
agaacacggagggtg

SEQ ID NO: 63667 - DNA, 15 bp, Homo sapiens
gaacacggagggtgg

SEQ ID NO: 63668 - DNA, 15 bp, Homo sapiens
aacacggagggtggg

SEQ ID NO: 63669 - DNA, 15 bp, Homo sapiens
acacggagggtggga

SEQ ID NO: 63670 - DNA, 15 bp, Homo sapiens
cacggagggtgggag

SEQ ID NO: 63671 - DNA, 15 bp, Homo sapiens
acggagggtgggagt

SEQ ID NO: 63672 - DNA, 15 bp, Homo sapiens
cggagggtgggagta

SEQ ID NO: 63673 - DNA, 15 bp, Homo sapiens
ggagggtgggagtag

SEQ ID NO: 63674 - DNA, 15 bp, Homo sapiens
gagggtgggagtagt

SEQ ID NO: 63675 - DNA, 15 bp, Homo sapiens
agggtgggagtagtc

SEQ ID NO: 63676 - DNA, 15 bp, Homo sapiens
gggtgggagtagtca

SEQ ID NO: 63677 - DNA, 15 bp, Homo sapiens
ggtgggagtagtcat

SEQ ID NO: 63678 - DNA, 15 bp, Homo sapiens
gtgggagtagtcatg

SEQ ID NO: 63679 - DNA, 15 bp, Homo sapiens
tgggagtagtcatgc

SEQ ID NO: 63680 - DNA, 15 bp, Homo sapiens
gggagtagtcatgct

SEQ ID NO: 63681 - DNA, 15 bp, Homo sapiens
ggagtagtcatgctc

SEQ ID NO: 63682 - DNA, 15 bp, Homo sapiens
gagtagtcatgctct

SEQ ID NO: 63683 - DNA, 15 bp, Homo sapiens
agtagtcatgctctt

SEQ ID NO: 63684 - DNA, 15 bp, Homo sapiens
gtagtcatgctcttt

SEQ ID NO: 63685 - DNA, 15 bp, Homo sapiens
tagtcatgctctttt

SEQ ID NO: 63686 - DNA, 15 bp, Homo sapiens
agtcatgctcttttc

SEQ ID NO: 63687 - DNA, 15 bp, Homo sapiens
gtcatgctcttttcc

SEQ ID NO: 63688 - DNA, 15 bp, Homo sapiens
tcatgctcttttcca

SEQ ID NO: 63689 - DNA, 15 bp, Homo sapiens
catgctcttttccag

SEQ ID NO: 63690 - DNA, 15 bp, Homo sapiens
atgctcttttccaga

SEQ ID NO: 63691 - DNA, 15 bp, Homo sapiens
tgctcttttccagaa

SEQ ID NO: 63692 - DNA, 15 bp, Homo sapiens
gctcttttccagaat

SEQ ID NO: 63693 - DNA, 15 bp, Homo sapiens
ctcttttccagaatg

SEQ ID NO: 63694 - DNA, 15 bp, Homo sapiens
tcttttccagaatga

SEQ ID NO: 63695 - DNA, 15 bp, Homo sapiens
cttttccagaatgaa

SEQ ID NO: 63696 - DNA, 15 bp, Homo sapiens
ttttccagaatgaac

SEQ ID NO: 63697 - DNA, 15 bp, Homo sapiens
tttccagaatgaact

SEQ ID NO: 63698 - DNA, 15 bp, Homo sapiens
ttccagaatgaactg

SEQ ID NO: 63699 - DNA, 15 bp, Homo sapiens
tccagaatgaactgc

SEQ ID NO: 63700 - DNA, 15 bp, Homo sapiens
ccagaatgaactgct

SEQ ID NO: 63701 - DNA, 15 bp, Homo sapiens
cagaatgaactgcta

SEQ ID NO: 63702 - DNA, 15 bp, Homo sapiens
agaatgaactgctaa

SEQ ID NO: 63703 - DNA, 15 bp, Homo sapiens
gaatgaactgctaac

SEQ ID NO: 63704 - DNA, 15 bp, Homo sapiens
aatgaactgctaacg

SEQ ID NO: 63705 - DNA, 15 bp, Homo sapiens
atgaactgctaacga

SEQ ID NO: 63706 - DNA, 15 bp, Homo sapiens
tgaactgctaacgaa

SEQ ID NO: 63707 - DNA, 15 bp, Homo sapiens
gaactgctaacgaag

SEQ ID NO: 63708 - DNA, 15 bp, Homo sapiens
aactgctaacgaagg

SEQ ID NO: 63709 - DNA, 15 bp, Homo sapiens
actgctaacgaaggg

SEQ ID NO: 63710 - DNA, 15 bp, Homo sapiens
ctgctaacgaaggga

SEQ ID NO: 63711 - DNA, 15 bp, Homo sapiens
tgctaacgaagggac

SEQ ID NO: 63712 - DNA, 15 bp, Homo sapiens
gctaacgaagggact

SEQ ID NO: 63713 - DNA, 15 bp, Homo sapiens
ctaacgaagggactc

SEQ ID NO: 63714 - DNA, 15 bp, Homo sapiens
taacgaagggactcg

SEQ ID NO: 63715 - DNA, 15 bp, Homo sapiens
aacgaagggactcgc

SEQ ID NO: 63716 - DNA, 15 bp, Homo sapiens
acgaagggactcgca

SEQ ID NO: 63717 - DNA, 15 bp, Homo sapiens
cgaagggactcgcag

SEQ ID NO: 63718 - DNA, 15 bp, Homo sapiens
gaagggactcgcagg

SEQ ID NO: 63719 - DNA, 15 bp, Homo sapiens
aagggactcgcaggt

SEQ ID NO: 63720 - DNA, 15 bp, Homo sapiens
agggactcgcaggtg

SEQ ID NO: 63721 - DNA, 15 bp, Homo sapiens
gggactcgcaggtgg

SEQ ID NO: 63722 - DNA, 15 bp, Homo sapiens
ggactcgcaggtggc

SEQ ID NO: 63723 - DNA, 15 bp, Homo sapiens
gactcgcaggtggct

SEQ ID NO: 63724 - DNA, 15 bp, Homo sapiens
actcgcaggtggctg

SEQ ID NO: 63725 - DNA, 15 bp, Homo sapiens
ctcgcaggtggctgc

SEQ ID NO: 63726 - DNA, 15 bp, Homo sapiens
tcgcaggtggctgct

SEQ ID NO: 63727 - DNA, 15 bp, Homo sapiens
cgcaggtggctgctg

SEQ ID NO: 63728 - DNA, 15 bp, Homo sapiens
gcaggtggctgctgc

SEQ ID NO: 63729 - DNA, 15 bp, Homo sapiens
caggtggctgctgct

SEQ ID NO: 63730 - DNA, 15 bp, Homo sapiens
aggtggctgctgctt

SEQ ID NO: 63731 - DNA, 15 bp, Homo sapiens
ggtggctgctgcttc

SEQ ID NO: 63732 - DNA, 15 bp, Homo sapiens
gtggctgctgcttct

SEQ ID NO: 63733 - DNA, 15 bp, Homo sapiens
tggctgctgcttctt

SEQ ID NO: 63734 - DNA, 15 bp, Homo sapiens
ggctgctgcttcttt

SEQ ID NO: 63735 - DNA, 15 bp, Homo sapiens
gctgctgcttctttc

SEQ ID NO: 63736 - DNA, 15 bp, Homo sapiens
ctgctgcttctttcc

SEQ ID NO: 63737 - DNA, 15 bp, Homo sapiens
tgctgcttctttcca

SEQ ID NO: 63738 - DNA, 15 bp, Homo sapiens
gctgcttctttccaa

SEQ ID NO: 63739 - DNA, 15 bp, Homo sapiens
ctgcttctttccaag

SEQ ID NO: 63740 - DNA, 15 bp, Homo sapiens
tgcttctttccaagc

SEQ ID NO: 63741 - DNA, 15 bp, Homo sapiens
gcttctttccaagct

SEQ ID NO: 63742 - DNA, 15 bp, Homo sapiens
cttctttccaagctg

SEQ ID NO: 63743 - DNA, 15 bp, Homo sapiens
ttctttccaagctgc

SEQ ID NO: 63744 - DNA, 15 bp, Homo sapiens
tctttccaagctgcc

SEQ ID NO: 63745 - DNA, 15 bp, Homo sapiens
ctttccaagctgccc

SEQ ID NO: 63746 - DNA, 15 bp, Homo sapiens
tttccaagctgcccc

SEQ ID NO: 63747 - DNA, 15 bp, Homo sapiens
ttccaagctgcccct

SEQ ID NO: 63748 - DNA, 15 bp, Homo sapiens
tccaagctgcccctg

SEQ ID NO: 63749 - DNA, 15 bp, Homo sapiens
ccaagctgcccctgt

SEQ ID NO: 63750 - DNA, 15 bp, Homo sapiens
caagctgcccctgtt

SEQ ID NO: 63751 - DNA, 15 bp, Homo sapiens
aagctgcccctgttg

SEQ ID NO: 63752 - DNA, 15 bp, Homo sapiens
agctgcccctgttgt

SEQ ID NO: 63753 - DNA, 15 bp, Homo sapiens
gctgcccctgttgtt

SEQ ID NO: 63754 - DNA, 15 bp, Homo sapiens
ctgcccctgttgttg

SEQ ID NO: 63755 - DNA, 15 bp, Homo sapiens
tgcccctgttgttgc

SEQ ID NO: 63756 - DNA, 15 bp, Homo sapiens
gcccctgttgttgca

SEQ ID NO: 63757 - DNA, 15 bp, Homo sapiens
cccctgttgttgcag

SEQ ID NO: 63758 - DNA, 15 bp, Homo sapiens
ccctgttgttgcaga

SEQ ID NO: 63759 - DNA, 15 bp, Homo sapiens
cctgttgttgcagag

SEQ ID NO: 63760 - DNA, 15 bp, Homo sapiens
ctgttgttgcagagg

SEQ ID NO: 63761 - DNA, 15 bp, Homo sapiens
tgttgttgcagaggc

SEQ ID NO: 63762 - DNA, 15 bp, Homo sapiens
gttgttgcagaggct

SEQ ID NO: 63763 - DNA, 15 bp, Homo sapiens
ttgttgcagaggctc

SEQ ID NO: 63764 - DNA, 15 bp, Homo sapiens
tgttgcagaggctct

SEQ ID NO: 63765 - DNA, 15 bp, Homo sapiens
gttgcagaggctctg

SEQ ID NO: 63766 - DNA, 15 bp, Homo sapiens
ttgcagaggctctgg

SEQ ID NO: 63767 - DNA, 15 bp, Homo sapiens
tgcagaggctctgga

SEQ ID NO: 63768 - DNA, 15 bp, Homo sapiens
gcagaggctctggag

SEQ ID NO: 63769 - DNA, 15 bp, Homo sapiens
cagaggctctggagt

SEQ ID NO: 63770 - DNA, 15 bp, Homo sapiens
agaggctctggagtc

SEQ ID NO: 63771 - DNA, 15 bp, Homo sapiens
gaggctctggagtcc

SEQ ID NO: 63772 - DNA, 15 bp, Homo sapiens
aggctctggagtcct

SEQ ID NO: 63773 - DNA, 15 bp, Homo sapiens
ggctctggagtccta

SEQ ID NO: 63774 - DNA, 15 bp, Homo sapiens
gctctggagtcctag

SEQ ID NO: 63775 - DNA, 15 bp, Homo sapiens
ctctggagtcctagg

SEQ ID NO: 63776 - DNA, 15 bp, Homo sapiens
tctggagtcctagga

SEQ ID NO: 63777 - DNA, 15 bp, Homo sapiens
ctggagtcctaggag

SEQ ID NO: 63778 - DNA, 15 bp, Homo sapiens
tggagtcctaggagg

SEQ ID NO: 63779 - DNA, 15 bp, Homo sapiens
ggagtcctaggaggt

SEQ ID NO: 63780 - DNA, 15 bp, Homo sapiens
gagtcctaggaggtt

SEQ ID NO: 63781 - DNA, 15 bp, Homo sapiens
agtcctaggaggttt

SEQ ID NO: 63782 - DNA, 15 bp, Homo sapiens
gtcctaggaggtttc

SEQ ID NO: 63783 - DNA, 15 bp, Homo sapiens
tcctaggaggtttca

SEQ ID NO: 63784 - DNA, 15 bp, Homo sapiens
cctaggaggtttcac

SEQ ID NO: 63785 - DNA, 15 bp, Homo sapiens
ctaggaggtttcacg

SEQ ID NO: 63786 - DNA, 15 bp, Homo sapiens
taggaggtttcacgg

SEQ ID NO: 63787 - DNA, 15 bp, Homo sapiens
aggaggtttcacggt

SEQ ID NO: 63788 - DNA, 15 bp, Homo sapiens
ggaggtttcacggtg

SEQ ID NO: 63789 - DNA, 15 bp, Homo sapiens
gaggtttcacggtgg

SEQ ID NO: 63790 - DNA, 15 bp, Homo sapiens
aggtttcacggtggc

SEQ ID NO: 63791 - DNA, 15 bp, Homo sapiens
ggtttcacggtggca

SEQ ID NO: 63792 - DNA, 15 bp, Homo sapiens
gtttcacggtggcat

SEQ ID NO: 63793 - DNA, 15 bp, Homo sapiens
tttcacggtggcata

SEQ ID NO: 63794 - DNA, 15 bp, Homo sapiens
ttcacggtggcatac

SEQ ID NO: 63795 - DNA, 15 bp, Homo sapiens
tcacggtggcatact

SEQ ID NO: 63796 - DNA, 15 bp, Homo sapiens
cacggtggcatactc

SEQ ID NO: 63797 - DNA, 15 bp, Homo sapiens
acggtggcatactcg

SEQ ID NO: 63798 - DNA, 15 bp, Homo sapiens
cggtggcatactcga

SEQ ID NO: 63799 - DNA, 15 bp, Homo sapiens
ggtggcatactcgac

SEQ ID NO: 63800 - DNA, 15 bp, Homo sapiens
gtggcatactcgaca

SEQ ID NO: 63801 - DNA, 15 bp, Homo sapiens
tggcatactcgacag

SEQ ID NO: 63802 - DNA, 15 bp, Homo sapiens
ggcatactcgacaga

SEQ ID NO: 63803 - DNA, 15 bp, Homo sapiens
gcatactcgacagag

SEQ ID NO: 63804 - DNA, 15 bp, Homo sapiens
catactcgacagagt

SEQ ID NO: 63805 - DNA, 15 bp, Homo sapiens
atactcgacagagta

SEQ ID NO: 63806 - DNA, 15 bp, Homo sapiens
tactcgacagagtac

SEQ ID NO: 63807 - DNA, 15 bp, Homo sapiens
actcgacagagtact

SEQ ID NO: 63808 - DNA, 15 bp, Homo sapiens
ctcgacagagtacta

SEQ ID NO: 63809 - DNA, 15 bp, Homo sapiens
tcgacagagtactag

SEQ ID NO: 63810 - DNA, 15 bp, Homo sapiens
cgacagagtactaga

SEQ ID NO: 63811 - DNA, 15 bp, Homo sapiens
gacagagtactagag

SEQ ID NO: 63812 - DNA, 15 bp, Homo sapiens
acagagtactagagc

SEQ ID NO: 63813 - DNA, 15 bp, Homo sapiens
cagagtactagagca

SEQ ID NO: 63814 - DNA, 15 bp, Homo sapiens
agagtactagagcat

SEQ ID NO: 63815 - DNA, 15 bp, Homo sapiens
gagtactagagcatc

SEQ ID NO: 63816 - DNA, 15 bp, Homo sapiens
agtactagagcatca

SEQ ID NO: 63817 - DNA, 15 bp, Homo sapiens
gtactagagcatcat

SEQ ID NO: 63818 - DNA, 15 bp, Homo sapiens
tactagagcatcatg

SEQ ID NO: 63819 - DNA, 15 bp, Homo sapiens
actagagcatcatgg

SEQ ID NO: 63820 - DNA, 15 bp, Homo sapiens
ctagagcatcatggc

SEQ ID NO: 63821 - DNA, 15 bp, Homo sapiens
tagagcatcatggcc

SEQ ID NO: 63822 - DNA, 15 bp, Homo sapiens
agagcatcatggcca

SEQ ID NO: 63823 - DNA, 15 bp, Homo sapiens
gagcatcatggccag

SEQ ID NO: 63824 - DNA, 15 bp, Homo sapiens
agcatcatggccaga

SEQ ID NO: 63825 - DNA, 15 bp, Homo sapiens
gcatcatggccagat

SEQ ID NO: 63826 - DNA, 15 bp, Homo sapiens
catcatggccagata

SEQ ID NO: 63827 - DNA, 15 bp, Homo sapiens
atcatggccagatag

SEQ ID NO: 63828 - DNA, 15 bp, Homo sapiens
tcatggccagatagt

SEQ ID NO: 63829 - DNA, 15 bp, Homo sapiens
catggccagatagtg

SEQ ID NO: 63830 - DNA, 15 bp, Homo sapiens
atggccagatagtga

SEQ ID NO: 63831 - DNA, 15 bp, Homo sapiens
tggccagatagtgat

SEQ ID NO: 63832 - DNA, 15 bp, Homo sapiens
ggccagatagtgatg

SEQ ID NO: 63833 - DNA, 15 bp, Homo sapiens
gccagatagtgatgc

SEQ ID NO: 63834 - DNA, 15 bp, Homo sapiens
ccagatagtgatgct

SEQ ID NO: 63835 - DNA, 15 bp, Homo sapiens
cagatagtgatgctg

SEQ ID NO: 63836 - DNA, 15 bp, Homo sapiens
agatagtgatgctgg

SEQ ID NO: 63837 - DNA, 15 bp, Homo sapiens
gatagtgatgctggg

SEQ ID NO: 63838 - DNA, 15 bp, Homo sapiens
atagtgatgctgggg

SEQ ID NO: 63839 - DNA, 15 bp, Homo sapiens
tagtgatgctggggt

SEQ ID NO: 63840 - DNA, 15 bp, Homo sapiens
agtgatgctggggtg

SEQ ID NO: 63841 - DNA, 15 bp, Homo sapiens
gtgatgctggggtgt

SEQ ID NO: 63842 - DNA, 15 bp, Homo sapiens
tgatgctggggtgtg

SEQ ID NO: 63843 - DNA, 15 bp, Homo sapiens
gatgctggggtgtgg

SEQ ID NO: 63844 - DNA, 15 bp, Homo sapiens
atgctggggtgtggg

SEQ ID NO: 63845 - DNA, 15 bp, Homo sapiens
tgctggggtgtgggg

SEQ ID NO: 63846 - DNA, 15 bp, Homo sapiens
gctggggtgtggggc

SEQ ID NO: 63847 - DNA, 15 bp, Homo sapiens
ctggggtgtggggcc

SEQ ID NO: 63848 - DNA, 15 bp, Homo sapiens
tggggtgtggggcct

SEQ ID NO: 63849 - DNA, 15 bp, Homo sapiens
ggggtgtggggcctc

SEQ ID NO: 63850 - DNA, 15 bp, Homo sapiens
gggtgtggggcctca

SEQ ID NO: 63851 - DNA, 15 bp, Homo sapiens
ggtgtggggcctcac

SEQ ID NO: 63852 - DNA, 15 bp, Homo sapiens
gtgtggggcctcacg

SEQ ID NO: 63853 - DNA, 15 bp, Homo sapiens
tgtggggcctcacgg

SEQ ID NO: 63854 - DNA, 15 bp, Homo sapiens
gtggggcctcacggt

SEQ ID NO: 63855 - DNA, 15 bp, Homo sapiens
tggggcctcacggtg

SEQ ID NO: 63856 - DNA, 15 bp, Homo sapiens
ggggcctcacggtgg

SEQ ID NO: 63857 - DNA, 15 bp, Homo sapiens
gggcctcacggtggc

SEQ ID NO: 63858 - DNA, 15 bp, Homo sapiens
ggcctcacggtggcc

SEQ ID NO: 63859 - DNA, 15 bp, Homo sapiens
gcctcacggtggcca

SEQ ID NO: 63860 - DNA, 15 bp, Homo sapiens
cctcacggtggccat

SEQ ID NO: 63861 - DNA, 15 bp, Homo sapiens
ctcacggtggccatt

SEQ ID NO: 63862 - DNA, 15 bp, Homo sapiens
tcacggtggccattt

SEQ ID NO: 63863 - DNA, 15 bp, Homo sapiens
cacggtggccatttc

SEQ ID NO: 63864 - DNA, 15 bp, Homo sapiens
acggtggccatttct

SEQ ID NO: 63865 - DNA, 15 bp, Homo sapiens
cggtggccatttctg

SEQ ID NO: 63866 - DNA, 15 bp, Homo sapiens
ggtggccatttctga

SEQ ID NO: 63867 - DNA, 15 bp, Homo sapiens
gtggccatttctgac

SEQ ID NO: 63868 - DNA, 15 bp, Homo sapiens
tggccatttctgacg

SEQ ID NO: 63869 - DNA, 15 bp, Homo sapiens
ggccatttctgacga

SEQ ID NO: 63870 - DNA, 15 bp, Homo sapiens
gccatttctgacgag

SEQ ID NO: 63871 - DNA, 15 bp, Homo sapiens
ccatttctgacgaga

SEQ ID NO: 63872 - DNA, 15 bp, Homo sapiens
catttctgacgagac

SEQ ID NO: 63873 - DNA, 15 bp, Homo sapiens
atttctgacgagacc

SEQ ID NO: 63874 - DNA, 15 bp, Homo sapiens
tttctgacgagaccc

SEQ ID NO: 63875 - DNA, 15 bp, Homo sapiens
ttctgacgagacccc

SEQ ID NO: 63876 - DNA, 15 bp, Homo sapiens
tctgacgagacccca

SEQ ID NO: 63877 - DNA, 15 bp, Homo sapiens
ctgacgagaccccac

SEQ ID NO: 63878 - DNA, 15 bp, Homo sapiens
tgacgagaccccacc

SEQ ID NO: 63879 - DNA, 15 bp, Homo sapiens
gacgagaccccaccg

SEQ ID NO: 63880 - DNA, 15 bp, Homo sapiens
acgagaccccaccgg

SEQ ID NO: 63881 - DNA, 15 bp, Homo sapiens
cgagaccccaccggg

SEQ ID NO: 63882 - DNA, 15 bp, Homo sapiens
gagaccccaccgggc

SEQ ID NO: 63883 - DNA, 15 bp, Homo sapiens
agaccccaccgggcc

SEQ ID NO: 63884 - DNA, 15 bp, Homo sapiens
gaccccaccgggcca

SEQ ID NO: 63885 - DNA, 15 bp, Homo sapiens
accccaccgggccaa

SEQ ID NO: 63886 - DNA, 15 bp, Homo sapiens
ccccaccgggccaaa

SEQ ID NO: 63887 - DNA, 15 bp, Homo sapiens
cccaccgggccaaag

SEQ ID NO: 63888 - DNA, 15 bp, Homo sapiens
ccaccgggccaaagt

SEQ ID NO: 63889 - DNA, 15 bp, Homo sapiens
caccgggccaaagtg

SEQ ID NO: 63890 - DNA, 15 bp, Homo sapiens
accgggccaaagtga

SEQ ID NO: 63891 - DNA, 15 bp, Homo sapiens
ccgggccaaagtgat

SEQ ID NO: 63892 - DNA, 15 bp, Homo sapiens
cgggccaaagtgatg

SEQ ID NO: 63893 - DNA, 15 bp, Homo sapiens
gggccaaagtgatgt

SEQ ID NO: 63894 - DNA, 15 bp, Homo sapiens
ggccaaagtgatgtg

SEQ ID NO: 63895 - DNA, 15 bp, Homo sapiens
gccaaagtgatgtgt

SEQ ID NO: 63896 - DNA, 15 bp, Homo sapiens
ccaaagtgatgtgta

SEQ ID NO: 63897 - DNA, 15 bp, Homo sapiens
caaagtgatgtgtag

SEQ ID NO: 63898 - DNA, 15 bp, Homo sapiens
aaagtgatgtgtaga

SEQ ID NO: 63899 - DNA, 15 bp, Homo sapiens
aagtgatgtgtagag

SEQ ID NO: 63900 - DNA, 15 bp, Homo sapiens
agtgatgtgtagaga

SEQ ID NO: 63901 - DNA, 15 bp, Homo sapiens
gtgatgtgtagagaa

SEQ ID NO: 63902 - DNA, 15 bp, Homo sapiens
tgatgtgtagagaag

SEQ ID NO: 63903 - DNA, 15 bp, Homo sapiens
gatgtgtagagaagg

SEQ ID NO: 63904 - DNA, 15 bp, Homo sapiens
atgtgtagagaagga

SEQ ID NO: 63905 - DNA, 15 bp, Homo sapiens
tgtgtagagaaggag

SEQ ID NO: 63906 - DNA, 15 bp, Homo sapiens
gtgtagagaaggagc

SEQ ID NO: 63907 - DNA, 15 bp, Homo sapiens
tgtagagaaggagct

SEQ ID NO: 63908 - DNA, 15 bp, Homo sapiens
gtagagaaggagctg

SEQ ID NO: 63909 - DNA, 15 bp, Homo sapiens
tagagaaggagctgc

SEQ ID NO: 63910 - DNA, 15 bp, Homo sapiens
agagaaggagctgct

SEQ ID NO: 63911 - DNA, 15 bp, Homo sapiens
gagaaggagctgctt

SEQ ID NO: 63912 - DNA, 15 bp, Homo sapiens
agaaggagctgcttc

SEQ ID NO: 63913 - DNA, 15 bp, Homo sapiens
gaaggagctgcttcg

SEQ ID NO: 63914 - DNA, 15 bp, Homo sapiens
aaggagctgcttcgg

SEQ ID NO: 63915 - DNA, 15 bp, Homo sapiens
aggagctgcttcggt

SEQ ID NO: 63916 - DNA, 15 bp, Homo sapiens
ggagctgcttcggtc

SEQ ID NO: 63917 - DNA, 15 bp, Homo sapiens
gagctgcttcggtca

SEQ ID NO: 63918 - DNA, 15 bp, Homo sapiens
agctgcttcggtcac

SEQ ID NO: 63919 - DNA, 15 bp, Homo sapiens
gctgcttcggtcacc

SEQ ID NO: 63920 - DNA, 15 bp, Homo sapiens
ctgcttcggtcacca

SEQ ID NO: 63921 - DNA, 15 bp, Homo sapiens
tgcttcggtcaccag

SEQ ID NO: 63922 - DNA, 15 bp, Homo sapiens
gcttcggtcaccaga

SEQ ID NO: 63923 - DNA, 15 bp, Homo sapiens
cttcggtcaccagaa

SEQ ID NO: 63924 - DNA, 15 bp, Homo sapiens
ttcggtcaccagaaa

SEQ ID NO: 63925 - DNA, 15 bp, Homo sapiens
tcggtcaccagaaaa

SEQ ID NO: 63926 - DNA, 15 bp, Homo sapiens
cggtcaccagaaaag

SEQ ID NO: 63927 - DNA, 15 bp, Homo sapiens
ggtcaccagaaaaga

SEQ ID NO: 63928 - DNA, 15 bp, Homo sapiens
gtcaccagaaaagaa

SEQ ID NO: 63929 - DNA, 15 bp, Homo sapiens
tcaccagaaaagaac

SEQ ID NO: 63930 - DNA, 15 bp, Homo sapiens
caccagaaaagaacg

SEQ ID NO: 63931 - DNA, 15 bp, Homo sapiens
accagaaaagaacgg

SEQ ID NO: 63932 - DNA, 15 bp, Homo sapiens
ccagaaaagaacggg

SEQ ID NO: 63933 - DNA, 15 bp, Homo sapiens
cagaaaagaacgggg

SEQ ID NO: 63934 - DNA, 15 bp, Homo sapiens
agaaaagaacgggga

SEQ ID NO: 63935 - DNA, 15 bp, Homo sapiens
gaaaagaacggggaa

SEQ ID NO: 63936 - DNA, 15 bp, Homo sapiens
aaaagaacggggaag

SEQ ID NO: 63937 - DNA, 15 bp, Homo sapiens
aaagaacggggaagc

SEQ ID NO: 63938 - DNA, 15 bp, Homo sapiens
aagaacggggaagcc

SEQ ID NO: 63939 - DNA, 15 bp, Homo sapiens
agaacggggaagcct

SEQ ID NO: 63940 - DNA, 15 bp, Homo sapiens
gaacggggaagcctc

SEQ ID NO: 63941 - DNA, 15 bp, Homo sapiens
aacggggaagcctcc

SEQ ID NO: 63942 - DNA, 15 bp, Homo sapiens
acggggaagcctccc

SEQ ID NO: 63943 - DNA, 15 bp, Homo sapiens
cggggaagcctccca

SEQ ID NO: 63944 - DNA, 15 bp, Homo sapiens
ggggaagcctcccac

SEQ ID NO: 63945 - DNA, 15 bp, Homo sapiens
gggaagcctcccaca

SEQ ID NO: 63946 - DNA, 15 bp, Homo sapiens
ggaagcctcccacac

SEQ ID NO: 63947 - DNA, 15 bp, Homo sapiens
gaagcctcccacact

SEQ ID NO: 63948 - DNA, 15 bp, Homo sapiens
aagcctcccacacta

SEQ ID NO: 63949 - DNA, 15 bp, Homo sapiens
agcctcccacactag

SEQ ID NO: 63950 - DNA, 15 bp, Homo sapiens
gcctcccacactaga

SEQ ID NO: 63951 - DNA, 15 bp, Homo sapiens
cctcccacactagaa

SEQ ID NO: 63952 - DNA, 15 bp, Homo sapiens
ctcccacactagaat

SEQ ID NO: 63953 - DNA, 15 bp, Homo sapiens
tcccacactagaata

SEQ ID NO: 63954 - DNA, 15 bp, Homo sapiens
cccacactagaatag

SEQ ID NO: 63955 - DNA, 15 bp, Homo sapiens
ccacactagaatagg

SEQ ID NO: 63956 - DNA, 15 bp, Homo sapiens
cacactagaataggt

SEQ ID NO: 63957 - DNA, 15 bp, Homo sapiens
acactagaataggta

SEQ ID NO: 63958 - DNA, 15 bp, Homo sapiens
cactagaataggtag

SEQ ID NO: 63959 - DNA, 15 bp, Homo sapiens
actagaataggtagg

SEQ ID NO: 63960 - DNA, 15 bp, Homo sapiens
ctagaataggtaggg

SEQ ID NO: 63961 - DNA, 15 bp, Homo sapiens
tagaataggtagggt

SEQ ID NO: 63962 - DNA, 15 bp, Homo sapiens
agaataggtagggtg

SEQ ID NO: 63963 - DNA, 15 bp, Homo sapiens
gaataggtagggtgc

SEQ ID NO: 63964 - DNA, 15 bp, Homo sapiens
aataggtagggtgct

SEQ ID NO: 63965 - DNA, 15 bp, Homo sapiens
ataggtagggtgctc

SEQ ID NO: 63966 - DNA, 15 bp, Homo sapiens
taggtagggtgctct

SEQ ID NO: 63967 - DNA, 15 bp, Homo sapiens
aggtagggtgctctt

SEQ ID NO: 63968 - DNA, 15 bp, Homo sapiens
ggtagggtgctcttc

SEQ ID NO: 63969 - DNA, 15 bp, Homo sapiens
gtagggtgctcttct

SEQ ID NO: 63970 - DNA, 15 bp, Homo sapiens
tagggtgctcttctc

SEQ ID NO: 63971 - DNA, 15 bp, Homo sapiens
agggtgctcttctcc

SEQ ID NO: 63972 - DNA, 15 bp, Homo sapiens
gggtgctcttctcca

SEQ ID NO: 63973 - DNA, 15 bp, Homo sapiens
ggtgctcttctccac

SEQ ID NO: 63974 - DNA, 15 bp, Homo sapiens
gtgctcttctccacc

SEQ ID NO: 63975 - DNA, 15 bp, Homo sapiens
tgctcttctccaccg

SEQ ID NO: 63976 - DNA, 15 bp, Homo sapiens
gctcttctccaccgg

SEQ ID NO: 63977 - DNA, 15 bp, Homo sapiens
ctcttctccaccggc

SEQ ID NO: 63978 - DNA, 15 bp, Homo sapiens
tcttctccaccggca

SEQ ID NO: 63979 - DNA, 15 bp, Homo sapiens
cttctccaccggcag

SEQ ID NO: 63980 - DNA, 15 bp, Homo sapiens
ttctccaccggcagg

SEQ ID NO: 63981 - DNA, 15 bp, Homo sapiens
tctccaccggcagga

SEQ ID NO: 63982 - DNA, 15 bp, Homo sapiens
ctccaccggcaggaa

SEQ ID NO: 63983 - DNA, 15 bp, Homo sapiens
tccaccggcaggaag

SEQ ID NO: 63984 - DNA, 15 bp, Homo sapiens
ccaccggcaggaagg

SEQ ID NO: 63985 - DNA, 15 bp, Homo sapiens
caccggcaggaaggg

SEQ ID NO: 63986 - DNA, 15 bp, Homo sapiens
accggcaggaagggg

SEQ ID NO: 63987 - DNA, 15 bp, Homo sapiens
ccggcaggaagggga

SEQ ID NO: 63988 - DNA, 15 bp, Homo sapiens
cggcaggaaggggat

SEQ ID NO: 63989 - DNA, 15 bp, Homo sapiens
ggcaggaaggggatg

SEQ ID NO: 63990 - DNA, 15 bp, Homo sapiens
gcaggaaggggatgt

SEQ ID NO: 63991 - DNA, 15 bp, Homo sapiens
caggaaggggatgta

SEQ ID NO: 63992 - DNA, 15 bp, Homo sapiens
aggaaggggatgtat

SEQ ID NO: 63993 - DNA, 15 bp, Homo sapiens
ggaaggggatgtatg

SEQ ID NO: 63994 - DNA, 15 bp, Homo sapiens
gaaggggatgtatgg

SEQ ID NO: 63995 - DNA, 15 bp, Homo sapiens
aaggggatgtatggc

SEQ ID NO: 63996 - DNA, 15 bp, Homo sapiens
aggggatgtatggct

SEQ ID NO: 63997 - DNA, 15 bp, Homo sapiens
ggggatgtatggctc

SEQ ID NO: 63998 - DNA, 15 bp, Homo sapiens
gggatgtatggctct

SEQ ID NO: 63999 - DNA, 15 bp, Homo sapiens
ggatgtatggctctg

SEQ ID NO: 64000 - DNA, 15 bp, Homo sapiens
gatgtatggctctgc

SEQ ID NO: 64001 - DNA, 15 bp, Homo sapiens
atgtatggctctgcc

SEQ ID NO: 64002 - DNA, 15 bp, Homo sapiens
tgtatggctctgcct

SEQ ID NO: 64003 - DNA, 15 bp, Homo sapiens
gtatggctctgcctg

SEQ ID NO: 64004 - DNA, 15 bp, Homo sapiens
tatggctctgcctgg

SEQ ID NO: 64005 - DNA, 15 bp, Homo sapiens
atggctctgcctgga

SEQ ID NO: 64006 - DNA, 15 bp, Homo sapiens
tggctctgcctggac

SEQ ID NO: 64007 - DNA, 15 bp, Homo sapiens
ggctctgcctggacc

SEQ ID NO: 64008 - DNA, 15 bp, Homo sapiens
gctctgcctggacca

SEQ ID NO: 64009 - DNA, 15 bp, Homo sapiens
ctctgcctggaccac

SEQ ID NO: 64010 - DNA, 15 bp, Homo sapiens
tctgcctggaccaca

SEQ ID NO: 64011 - DNA, 15 bp, Homo sapiens
ctgcctggaccacac

SEQ ID NO: 64012 - DNA, 15 bp, Homo sapiens
tgcctggaccacacc

SEQ ID NO: 64013 - DNA, 15 bp, Homo sapiens
gcctggaccacacct

SEQ ID NO: 64014 - DNA, 15 bp, Homo sapiens
cctggaccacacctt

SEQ ID NO: 64015 - DNA, 15 bp, Homo sapiens
ctggaccacaccttt

SEQ ID NO: 64016 - DNA, 15 bp, Homo sapiens
tggaccacacctttt

SEQ ID NO: 64017 - DNA, 15 bp, Homo sapiens
ggaccacaccttttt

SEQ ID NO: 64018 - DNA, 15 bp, Homo sapiens
gaccacacctttttc

SEQ ID NO: 64019 - DNA, 15 bp, Homo sapiens
accacacctttttcc

SEQ ID NO: 64020 - DNA, 15 bp, Homo sapiens
ccacacctttttcct

SEQ ID NO: 64021 - DNA, 15 bp, Homo sapiens
cacacctttttcctt

SEQ ID NO: 64022 - DNA, 15 bp, Homo sapiens
acacctttttccttg

SEQ ID NO: 64023 - DNA, 15 bp, Homo sapiens
cacctttttccttgc

SEQ ID NO: 64024 - DNA, 15 bp, Homo sapiens
acctttttccttgct

SEQ ID NO: 64025 - DNA, 15 bp, Homo sapiens
cctttttccttgctc

SEQ ID NO: 64026 - DNA, 15 bp, Homo sapiens
ctttttccttgctct

SEQ ID NO: 64027 - DNA, 15 bp, Homo sapiens
tttttccttgctctt

SEQ ID NO: 64028 - DNA, 15 bp, Homo sapiens
ttttccttgctcttc

SEQ ID NO: 64029 - DNA, 15 bp, Homo sapiens
tttccttgctcttcc

SEQ ID NO: 64030 - DNA, 15 bp, Homo sapiens
ttccttgctcttccc

SEQ ID NO: 64031 - DNA, 15 bp, Homo sapiens
tccttgctcttccct

SEQ ID NO: 64032 - DNA, 15 bp, Homo sapiens
ccttgctcttccctc

SEQ ID NO: 64033 - DNA, 15 bp, Homo sapiens
cttgctcttccctcc

SEQ ID NO: 64034 - DNA, 15 bp, Homo sapiens
ttgctcttccctccg

SEQ ID NO: 64035 - DNA, 15 bp, Homo sapiens
tgctcttccctccgc

SEQ ID NO: 64036 - DNA, 15 bp, Homo sapiens
gctcttccctccgca

SEQ ID NO: 64037 - DNA, 15 bp, Homo sapiens
ctcttccctccgcat

SEQ ID NO: 64038 - DNA, 15 bp, Homo sapiens
tcttccctccgcatc

SEQ ID NO: 64039 - DNA, 15 bp, Homo sapiens
cttccctccgcatct

SEQ ID NO: 64040 - DNA, 15 bp, Homo sapiens
ttccctccgcatctg

SEQ ID NO: 64041 - DNA, 15 bp, Homo sapiens
tccctccgcatctgc

SEQ ID NO: 64042 - DNA, 15 bp, Homo sapiens
ccctccgcatctgct

SEQ ID NO: 64043 - DNA, 15 bp, Homo sapiens
cctccgcatctgctg

SEQ ID NO: 64044 - DNA, 15 bp, Homo sapiens
ctccgcatctgctgt

SEQ ID NO: 64045 - DNA, 15 bp, Homo sapiens
tccgcatctgctgtg

SEQ ID NO: 64046 - DNA, 15 bp, Homo sapiens
ccgcatctgctgtgg

SEQ ID NO: 64047 - DNA, 15 bp, Homo sapiens
cgcatctgctgtggc

SEQ ID NO: 64048 - DNA, 15 bp, Homo sapiens
gcatctgctgtggcc

SEQ ID NO: 64049 - DNA, 15 bp, Homo sapiens
catctgctgtggccg

SEQ ID NO: 64050 - DNA, 15 bp, Homo sapiens
atctgctgtggccga

SEQ ID NO: 64051 - DNA, 15 bp, Homo sapiens
tctgctgtggccgag

SEQ ID NO: 64052 - DNA, 15 bp, Homo sapiens
ctgctgtggccgagg

SEQ ID NO: 64053 - DNA, 15 bp, Homo sapiens
tgctgtggccgaggc

SEQ ID NO: 64054 - DNA, 15 bp, Homo sapiens
gctgtggccgaggcc

SEQ ID NO: 64055 - DNA, 15 bp, Homo sapiens
ctgtggccgaggcca

SEQ ID NO: 64056 - DNA, 15 bp, Homo sapiens
tgtggccgaggccat

SEQ ID NO: 64057 - DNA, 15 bp, Homo sapiens
gtggccgaggccatt

SEQ ID NO: 64058 - DNA, 15 bp, Homo sapiens
tggccgaggccattc

SEQ ID NO: 64059 - DNA, 15 bp, Homo sapiens
ggccgaggccattcc

SEQ ID NO: 64060 - DNA, 15 bp, Homo sapiens
gccgaggccattcct

SEQ ID NO: 64061 - DNA, 15 bp, Homo sapiens
ccgaggccattcctc

SEQ ID NO: 64062 - DNA, 15 bp, Homo sapiens
cgaggccattcctca

SEQ ID NO: 64063 - DNA, 15 bp, Homo sapiens
gaggccattcctcat

SEQ ID NO: 64064 - DNA, 15 bp, Homo sapiens
aggccattcctcatc

SEQ ID NO: 64065 - DNA, 15 bp, Homo sapiens
ggccattcctcatca

SEQ ID NO: 64066 - DNA, 15 bp, Homo sapiens
gccattcctcatcag

SEQ ID NO: 64067 - DNA, 15 bp, Homo sapiens
ccattcctcatcagg

SEQ ID NO: 64068 - DNA, 15 bp, Homo sapiens
cattcctcatcaggg

SEQ ID NO: 64069 - DNA, 15 bp, Homo sapiens
attcctcatcaggga

SEQ ID NO: 64070 - DNA, 15 bp, Homo sapiens
ttcctcatcagggaa

SEQ ID NO: 64071 - DNA, 15 bp, Homo sapiens
tcctcatcagggaac

SEQ ID NO: 64072 - DNA, 15 bp, Homo sapiens
cctcatcagggaaca

SEQ ID NO: 64073 - DNA, 15 bp, Homo sapiens
ctcatcagggaacat

SEQ ID NO: 64074 - DNA, 15 bp, Homo sapiens
tcatcagggaacatg

SEQ ID NO: 64075 - DNA, 15 bp, Homo sapiens
catcagggaacatgt

SEQ ID NO: 64076 - DNA, 15 bp, Homo sapiens
atcagggaacatgtg

SEQ ID NO: 64077 - DNA, 15 bp, Homo sapiens
tcagggaacatgtgt

SEQ ID NO: 64078 - DNA, 15 bp, Homo sapiens
cagggaacatgtgtt

SEQ ID NO: 64079 - DNA, 15 bp, Homo sapiens
agggaacatgtgtta

SEQ ID NO: 64080 - DNA, 15 bp, Homo sapiens
gggaacatgtgttag

SEQ ID NO: 64081 - DNA, 15 bp, Homo sapiens
ggaacatgtgttaga

SEQ ID NO: 64082 - DNA, 15 bp, Homo sapiens
gaacatgtgttagag

SEQ ID NO: 64083 - DNA, 15 bp, Homo sapiens
aacatgtgttagagg

SEQ ID NO: 64084 - DNA, 15 bp, Homo sapiens
acatgtgttagaggc

SEQ ID NO: 64085 - DNA, 15 bp, Homo sapiens
catgtgttagaggct

SEQ ID NO: 64086 - DNA, 15 bp, Homo sapiens
atgtgttagaggctc

SEQ ID NO: 64087 - DNA, 15 bp, Homo sapiens
tgtgttagaggctca

SEQ ID NO: 64088 - DNA, 15 bp, Homo sapiens
gtgttagaggctcac

SEQ ID NO: 64089 - DNA, 15 bp, Homo sapiens
tgttagaggctcacg

SEQ ID NO: 64090 - DNA, 15 bp, Homo sapiens
gttagaggctcacgc

SEQ ID NO: 64091 - DNA, 15 bp, Homo sapiens
ttagaggctcacgcc

SEQ ID NO: 64092 - DNA, 15 bp, Homo sapiens
tagaggctcacgcca

SEQ ID NO: 64093 - DNA, 15 bp, Homo sapiens
agaggctcacgccac

SEQ ID NO: 64094 - DNA, 15 bp, Homo sapiens
gaggctcacgccacc

SEQ ID NO: 64095 - DNA, 15 bp, Homo sapiens
aggctcacgccacct

SEQ ID NO: 64096 - DNA, 15 bp, Homo sapiens
ggctcacgccacctg

SEQ ID NO: 64097 - DNA, 15 bp, Homo sapiens
gctcacgccacctgg

SEQ ID NO: 64098 - DNA, 15 bp, Homo sapiens
ctcacgccacctggg

SEQ ID NO: 64099 - DNA, 15 bp, Homo sapiens
tcacgccacctggga

SEQ ID NO: 64100 - DNA, 15 bp, Homo sapiens
cacgccacctgggac

SEQ ID NO: 64101 - DNA, 15 bp, Homo sapiens
acgccacctgggacc

SEQ ID NO: 64102 - DNA, 15 bp, Homo sapiens
cgccacctgggacca

SEQ ID NO: 64103 - DNA, 15 bp, Homo sapiens
gccacctgggaccac

SEQ ID NO: 64104 - DNA, 15 bp, Homo sapiens
ccacctgggaccact

SEQ ID NO: 64105 - DNA, 15 bp, Homo sapiens
cacctgggaccactt

SEQ ID NO: 64106 - DNA, 15 bp, Homo sapiens
acctgggaccacttg

SEQ ID NO: 64107 - DNA, 15 bp, Homo sapiens
cctgggaccacttgt

SEQ ID NO: 64108 - DNA, 15 bp, Homo sapiens
ctgggaccacttgtc

SEQ ID NO: 64109 - DNA, 15 bp, Homo sapiens
tgggaccacttgtct

SEQ ID NO: 64110 - DNA, 15 bp, Homo sapiens
gggaccacttgtctt

SEQ ID NO: 64111 - DNA, 15 bp, Homo sapiens
ggaccacttgtctta

SEQ ID NO: 64112 - DNA, 15 bp, Homo sapiens
gaccacttgtcttat

SEQ ID NO: 64113 - DNA, 15 bp, Homo sapiens
accacttgtcttatc

SEQ ID NO: 64114 - DNA, 15 bp, Homo sapiens
ccacttgtcttatca

SEQ ID NO: 64115 - DNA, 15 bp, Homo sapiens
cacttgtcttatcac

SEQ ID NO: 64116 - DNA, 15 bp, Homo sapiens
acttgtcttatcacc

SEQ ID NO: 64117 - DNA, 15 bp, Homo sapiens
cttgtcttatcaccc

SEQ ID NO: 64118 - DNA, 15 bp, Homo sapiens
ttgtcttatcacccc

SEQ ID NO: 64119 - DNA, 15 bp, Homo sapiens
tgtcttatcaccccc

SEQ ID NO: 64120 - DNA, 15 bp, Homo sapiens
gtcttatcaccccca

SEQ ID NO: 64121 - DNA, 15 bp, Homo sapiens
tcttatcacccccag

SEQ ID NO: 64122 - DNA, 15 bp, Homo sapiens
cttatcacccccagg

SEQ ID NO: 64123 - DNA, 15 bp, Homo sapiens
ttatcacccccagga

SEQ ID NO: 64124 - DNA, 15 bp, Homo sapiens
tatcacccccaggac

SEQ ID NO: 64125 - DNA, 15 bp, Homo sapiens
atcacccccaggacc

SEQ ID NO: 64126 - DNA, 15 bp, Homo sapiens
tcacccccaggaccc

SEQ ID NO: 64127 - DNA, 15 bp, Homo sapiens
cacccccaggaccct

SEQ ID NO: 64128 - DNA, 15 bp, Homo sapiens
acccccaggacccta

SEQ ID NO: 64129 - DNA, 15 bp, Homo sapiens
cccccaggaccctag

SEQ ID NO: 64130 - DNA, 15 bp, Homo sapiens
ccccaggaccctagg

SEQ ID NO: 64131 - DNA, 15 bp, Homo sapiens
cccaggaccctaggc

SEQ ID NO: 64132 - DNA, 15 bp, Homo sapiens
ccaggaccctaggcg

SEQ ID NO: 64133 - DNA, 15 bp, Homo sapiens
caggaccctaggcgg

SEQ ID NO: 64134 - DNA, 15 bp, Homo sapiens
aggaccctaggcggt

SEQ ID NO: 64135 - DNA, 15 bp, Homo sapiens
ggaccctaggcggta

SEQ ID NO: 64136 - DNA, 15 bp, Homo sapiens
gaccctaggcggtag

SEQ ID NO: 64137 - DNA, 15 bp, Homo sapiens
accctaggcggtagt

SEQ ID NO: 64138 - DNA, 15 bp, Homo sapiens
ccctaggcggtagtt

SEQ ID NO: 64139 - DNA, 15 bp, Homo sapiens
cctaggcggtagttt

SEQ ID NO: 64140 - DNA, 15 bp, Homo sapiens
ctaggcggtagtttc

SEQ ID NO: 64141 - DNA, 15 bp, Homo sapiens
taggcggtagtttcc

SEQ ID NO: 64142 - DNA, 15 bp, Homo sapiens
aggcggtagtttcct

SEQ ID NO: 64143 - DNA, 15 bp, Homo sapiens
ggcggtagtttcctg

SEQ ID NO: 64144 - DNA, 15 bp, Homo sapiens
gcggtagtttcctgt

SEQ ID NO: 64145 - DNA, 15 bp, Homo sapiens
cggtagtttcctgtg

SEQ ID NO: 64146 - DNA, 15 bp, Homo sapiens
ggtagtttcctgtgg

SEQ ID NO: 64147 - DNA, 15 bp, Homo sapiens
gtagtttcctgtggc

SEQ ID NO: 64148 - DNA, 15 bp, Homo sapiens
tagtttcctgtggcc

SEQ ID NO: 64149 - DNA, 15 bp, Homo sapiens
agtttcctgtggcct

SEQ ID NO: 64150 - DNA, 15 bp, Homo sapiens
gtttcctgtggcctg

SEQ ID NO: 64151 - DNA, 15 bp, Homo sapiens
tttcctgtggcctga

SEQ ID NO: 64152 - DNA, 15 bp, Homo sapiens
ttcctgtggcctgag

SEQ ID NO: 64153 - DNA, 15 bp, Homo sapiens
tcctgtggcctgagt

SEQ ID NO: 64154 - DNA, 15 bp, Homo sapiens
cctgtggcctgagtt

SEQ ID NO: 64155 - DNA, 15 bp, Homo sapiens
ctgtggcctgagtta

SEQ ID NO: 64156 - DNA, 15 bp, Homo sapiens
tgtggcctgagttag

SEQ ID NO: 64157 - DNA, 15 bp, Homo sapiens
gtggcctgagttagc

SEQ ID NO: 64158 - DNA, 15 bp, Homo sapiens
tggcctgagttagct

SEQ ID NO: 64159 - DNA, 15 bp, Homo sapiens
ggcctgagttagctg

SEQ ID NO: 64160 - DNA, 15 bp, Homo sapiens
gcctgagttagctga

SEQ ID NO: 64161 - DNA, 15 bp, Homo sapiens
cctgagttagctgat

SEQ ID NO: 64162 - DNA, 15 bp, Homo sapiens
ctgagttagctgata

SEQ ID NO: 64163 - DNA, 15 bp, Homo sapiens
tgagttagctgatat

SEQ ID NO: 64164 - DNA, 15 bp, Homo sapiens
gagttagctgatatt

SEQ ID NO: 64165 - DNA, 15 bp, Homo sapiens
agttagctgatattt

SEQ ID NO: 64166 - DNA, 15 bp, Homo sapiens
gttagctgatattta

SEQ ID NO: 64167 - DNA, 15 bp, Homo sapiens
ttagctgatatttat

SEQ ID NO: 64168 - DNA, 15 bp, Homo sapiens
tagctgatatttata

SEQ ID NO: 64169 - DNA, 15 bp, Homo sapiens
agctgatatttatat

SEQ ID NO: 64170 - DNA, 15 bp, Homo sapiens
gctgatatttatata

SEQ ID NO: 64171 - DNA, 15 bp, Homo sapiens
ctgatatttatatag

SEQ ID NO: 64172 - DNA, 15 bp, Homo sapiens
tgatatttatatagt

SEQ ID NO: 64173 - DNA, 15 bp, Homo sapiens
gatatttatatagtg

SEQ ID NO: 64174 - DNA, 15 bp, Homo sapiens
atatttatatagtgc

SEQ ID NO: 64175 - DNA, 15 bp, Homo sapiens
tatttatatagtgcc

SEQ ID NO: 64176 - DNA, 15 bp, Homo sapiens
atttatatagtgcca

SEQ ID NO: 64177 - DNA, 15 bp, Homo sapiens
tttatatagtgccat

SEQ ID NO: 64178 - DNA, 15 bp, Homo sapiens
ttatatagtgccatt

SEQ ID NO: 64179 - DNA, 15 bp, Homo sapiens
tatatagtgccattg

SEQ ID NO: 64180 - DNA, 15 bp, Homo sapiens
atatagtgccattgt

SEQ ID NO: 64181 - DNA, 15 bp, Homo sapiens
tatagtgccattgtg

SEQ ID NO: 64182 - DNA, 15 bp, Homo sapiens
atagtgccattgtgc

SEQ ID NO: 64183 - DNA, 15 bp, Homo sapiens
tagtgccattgtgcc

SEQ ID NO: 64184 - DNA, 15 bp, Homo sapiens
agtgccattgtgcct

SEQ ID NO: 64185 - DNA, 15 bp, Homo sapiens
gtgccattgtgcctt

SEQ ID NO: 64186 - DNA, 15 bp, Homo sapiens
tgccattgtgccttt

SEQ ID NO: 64187 - DNA, 15 bp, Homo sapiens
gccattgtgcctttt

SEQ ID NO: 64188 - DNA, 15 bp, Homo sapiens
ccattgtgccttttc

SEQ ID NO: 64189 - DNA, 15 bp, Homo sapiens
cattgtgccttttct

SEQ ID NO: 64190 - DNA, 15 bp, Homo sapiens
attgtgccttttctc

SEQ ID NO: 64191 - DNA, 15 bp, Homo sapiens
ttgtgccttttctcc

SEQ ID NO: 64192 - DNA, 15 bp, Homo sapiens
tgtgccttttctcct

SEQ ID NO: 64193 - DNA, 15 bp, Homo sapiens
gtgccttttctcctg

SEQ ID NO: 64194 - DNA, 15 bp, Homo sapiens
tgccttttctcctgt

SEQ ID NO: 64195 - DNA, 15 bp, Homo sapiens
gccttttctcctgtg

SEQ ID NO: 64196 - DNA, 15 bp, Homo sapiens
ccttttctcctgtga

SEQ ID NO: 64197 - DNA, 15 bp, Homo sapiens
cttttctcctgtgat

SEQ ID NO: 64198 - DNA, 15 bp, Homo sapiens
ttttctcctgtgatg

SEQ ID NO: 64199 - DNA, 15 bp, Homo sapiens
tttctcctgtgatgc

SEQ ID NO: 64200 - DNA, 15 bp, Homo sapiens
ttctcctgtgatgct

SEQ ID NO: 64201 - DNA, 15 bp, Homo sapiens
tctcctgtgatgctc

SEQ ID NO: 64202 - DNA, 15 bp, Homo sapiens
ctcctgtgatgctca

SEQ ID NO: 64203 - DNA, 15 bp, Homo sapiens
tcctgtgatgctcac

SEQ ID NO: 64204 - DNA, 15 bp, Homo sapiens
cctgtgatgctcaca

SEQ ID NO: 64205 - DNA, 15 bp, Homo sapiens
ctgtgatgctcacag

SEQ ID NO: 64206 - DNA, 15 bp, Homo sapiens
tgtgatgctcacagt

SEQ ID NO: 64207 - DNA, 15 bp, Homo sapiens
gtgatgctcacagta

SEQ ID NO: 64208 - DNA, 15 bp, Homo sapiens
tgatgctcacagtaa

SEQ ID NO: 64209 - DNA, 15 bp, Homo sapiens
gatgctcacagtaag

SEQ ID NO: 64210 - DNA, 15 bp, Homo sapiens
atgctcacagtaagg

SEQ ID NO: 64211 - DNA, 15 bp, Homo sapiens
tgctcacagtaagga

SEQ ID NO: 64212 - DNA, 15 bp, Homo sapiens
gctcacagtaaggat

SEQ ID NO: 64213 - DNA, 15 bp, Homo sapiens
ctcacagtaaggatg

SEQ ID NO: 64214 - DNA, 15 bp, Homo sapiens
tcacagtaaggatgc

SEQ ID NO: 64215 - DNA, 15 bp, Homo sapiens
cacagtaaggatgcc

SEQ ID NO: 64216 - DNA, 15 bp, Homo sapiens
acagtaaggatgcct

SEQ ID NO: 64217 - DNA, 15 bp, Homo sapiens
cagtaaggatgccta

SEQ ID NO: 64218 - DNA, 15 bp, Homo sapiens
agtaaggatgcctag

SEQ ID NO: 64219 - DNA, 15 bp, Homo sapiens
gtaaggatgcctaga

SEQ ID NO: 64220 - DNA, 15 bp, Homo sapiens
taaggatgcctagat

SEQ ID NO: 64221 - DNA, 15 bp, Homo sapiens
aaggatgcctagatg

SEQ ID NO: 64222 - DNA, 15 bp, Homo sapiens
aggatgcctagatgg

SEQ ID NO: 64223 - DNA, 15 bp, Homo sapiens
ggatgcctagatggg

SEQ ID NO: 64224 - DNA, 15 bp, Homo sapiens
gatgcctagatgggg

SEQ ID NO: 64225 - DNA, 15 bp, Homo sapiens
atgcctagatggggt

SEQ ID NO: 64226 - DNA, 15 bp, Homo sapiens
tgcctagatggggtt

SEQ ID NO: 64227 - DNA, 15 bp, Homo sapiens
gcctagatggggtta

SEQ ID NO: 64228 - DNA, 15 bp, Homo sapiens
cctagatggggttac

SEQ ID NO: 64229 - DNA, 15 bp, Homo sapiens
ctagatggggttacc

SEQ ID NO: 64230 - DNA, 15 bp, Homo sapiens
tagatggggttacct

SEQ ID NO: 64231 - DNA, 15 bp, Homo sapiens
agatggggttacctg

SEQ ID NO: 64232 - DNA, 15 bp, Homo sapiens
gatggggttacctgt

SEQ ID NO: 64233 - DNA, 15 bp, Homo sapiens
atggggttacctgtt

SEQ ID NO: 64234 - DNA, 15 bp, Homo sapiens
tggggttacctgttg

SEQ ID NO: 64235 - DNA, 15 bp, Homo sapiens
ggggttacctgttgt

SEQ ID NO: 64236 - DNA, 15 bp, Homo sapiens
gggttacctgttgtc

SEQ ID NO: 64237 - DNA, 15 bp, Homo sapiens
ggttacctgttgtca

SEQ ID NO: 64238 - DNA, 15 bp, Homo sapiens
gttacctgttgtcaa

SEQ ID NO: 64239 - DNA, 15 bp, Homo sapiens
ttacctgttgtcaag

SEQ ID NO: 64240 - DNA, 15 bp, Homo sapiens
tacctgttgtcaaga

SEQ ID NO: 64241 - DNA, 15 bp, Homo sapiens
acctgttgtcaagat

SEQ ID NO: 64242 - DNA, 15 bp, Homo sapiens
cctgttgtcaagata

SEQ ID NO: 64243 - DNA, 15 bp, Homo sapiens
ctgttgtcaagataa

SEQ ID NO: 64244 - DNA, 15 bp, Homo sapiens
tgttgtcaagataag

SEQ ID NO: 64245 - DNA, 15 bp, Homo sapiens
gttgtcaagataagg

SEQ ID NO: 64246 - DNA, 15 bp, Homo sapiens
ttgtcaagataagga

SEQ ID NO: 64247 - DNA, 15 bp, Homo sapiens
tgtcaagataaggaa

SEQ ID NO: 64248 - DNA, 15 bp, Homo sapiens
gtcaagataaggaaa

SEQ ID NO: 64249 - DNA, 15 bp, Homo sapiens
tcaagataaggaaac

SEQ ID NO: 64250 - DNA, 15 bp, Homo sapiens
caagataaggaaact

SEQ ID NO: 64251 - DNA, 15 bp, Homo sapiens
aagataaggaaactg

SEQ ID NO: 64252 - DNA, 15 bp, Homo sapiens
agataaggaaactga

SEQ ID NO: 64253 - DNA, 15 bp, Homo sapiens
gataaggaaactgaa

SEQ ID NO: 64254 - DNA, 15 bp, Homo sapiens
ataaggaaactgaag

SEQ ID NO: 64255 - DNA, 15 bp, Homo sapiens
taaggaaactgaagc

SEQ ID NO: 64256 - DNA, 15 bp, Homo sapiens
aaggaaactgaagca

SEQ ID NO: 64257 - DNA, 15 bp, Homo sapiens
aggaaactgaagcac

SEQ ID NO: 64258 - DNA, 15 bp, Homo sapiens
ggaaactgaagcaca

SEQ ID NO: 64259 - DNA, 15 bp, Homo sapiens
gaaactgaagcacag

SEQ ID NO: 64260 - DNA, 15 bp, Homo sapiens
aaactgaagcacaga

SEQ ID NO: 64261 - DNA, 15 bp, Homo sapiens
aactgaagcacagaa

SEQ ID NO: 64262 - DNA, 15 bp, Homo sapiens
actgaagcacagaat

SEQ ID NO: 64263 - DNA, 15 bp, Homo sapiens
ctgaagcacagaatg

SEQ ID NO: 64264 - DNA, 15 bp, Homo sapiens
tgaagcacagaatgc

SEQ ID NO: 64265 - DNA, 15 bp, Homo sapiens
gaagcacagaatgct

SEQ ID NO: 64266 - DNA, 15 bp, Homo sapiens
aagcacagaatgctg

SEQ ID NO: 64267 - DNA, 15 bp, Homo sapiens
agcacagaatgctga

SEQ ID NO: 64268 - DNA, 15 bp, Homo sapiens
gcacagaatgctgag

SEQ ID NO: 64269 - DNA, 15 bp, Homo sapiens
cacagaatgctgagg

SEQ ID NO: 64270 - DNA, 15 bp, Homo sapiens
acagaatgctgaggt

SEQ ID NO: 64271 - DNA, 15 bp, Homo sapiens
cagaatgctgaggtc

SEQ ID NO: 64272 - DNA, 15 bp, Homo sapiens
agaatgctgaggtca

SEQ ID NO: 64273 - DNA, 15 bp, Homo sapiens
gaatgctgaggtcat

SEQ ID NO: 64274 - DNA, 15 bp, Homo sapiens
aatgctgaggtcatt

SEQ ID NO: 64275 - DNA, 15 bp, Homo sapiens
atgctgaggtcattt

SEQ ID NO: 64276 - DNA, 15 bp, Homo sapiens
tgctgaggtcatttg

SEQ ID NO: 64277 - DNA, 15 bp, Homo sapiens
gctgaggtcatttgc

SEQ ID NO: 64278 - DNA, 15 bp, Homo sapiens
ctgaggtcatttgct

SEQ ID NO: 64279 - DNA, 15 bp, Homo sapiens
tgaggtcatttgctg

SEQ ID NO: 64280 - DNA, 15 bp, Homo sapiens
gaggtcatttgctgg

SEQ ID NO: 64281 - DNA, 15 bp, Homo sapiens
aggtcatttgctggg

SEQ ID NO: 64282 - DNA, 15 bp, Homo sapiens
ggtcatttgctgggt

SEQ ID NO: 64283 - DNA, 15 bp, Homo sapiens
gtcatttgctgggtt

SEQ ID NO: 64284 - DNA, 15 bp, Homo sapiens
tcatttgctgggttc

SEQ ID NO: 64285 - DNA, 15 bp, Homo sapiens
catttgctgggttca

SEQ ID NO: 64286 - DNA, 15 bp, Homo sapiens
atttgctgggttcat

SEQ ID NO: 64287 - DNA, 15 bp, Homo sapiens
tttgctgggttcatg

SEQ ID NO: 64288 - DNA, 15 bp, Homo sapiens
ttgctgggttcatgt

SEQ ID NO: 64289 - DNA, 15 bp, Homo sapiens
tgctgggttcatgtt

SEQ ID NO: 64290 - DNA, 15 bp, Homo sapiens
gctgggttcatgttt

SEQ ID NO: 64291 - DNA, 15 bp, Homo sapiens
ctgggttcatgtttg

SEQ ID NO: 64292 - DNA, 15 bp, Homo sapiens
tgggttcatgtttgg

SEQ ID NO: 64293 - DNA, 15 bp, Homo sapiens
gggttcatgtttgga

SEQ ID NO: 64294 - DNA, 15 bp, Homo sapiens
ggttcatgtttggaa

SEQ ID NO: 64295 - DNA, 15 bp, Homo sapiens
gttcatgtttggaaa

SEQ ID NO: 64296 - DNA, 15 bp, Homo sapiens
ttcatgtttggaaag

SEQ ID NO: 64297 - DNA, 15 bp, Homo sapiens
tcatgtttggaaagc

SEQ ID NO: 64298 - DNA, 15 bp, Homo sapiens
catgtttggaaagcg

SEQ ID NO: 64299 - DNA, 15 bp, Homo sapiens
atgtttggaaagcgg

SEQ ID NO: 64300 - DNA, 15 bp, Homo sapiens
tgtttggaaagcggc

SEQ ID NO: 64301 - DNA, 15 bp, Homo sapiens
gtttggaaagcggca

SEQ ID NO: 64302 - DNA, 15 bp, Homo sapiens
tttggaaagcggcaa

SEQ ID NO: 64303 - DNA, 15 bp, Homo sapiens
ttggaaagcggcaaa

SEQ ID NO: 64304 - DNA, 15 bp, Homo sapiens
tggaaagcggcaaag

SEQ ID NO: 64305 - DNA, 15 bp, Homo sapiens
ggaaagcggcaaagg

SEQ ID NO: 64306 - DNA, 15 bp, Homo sapiens
gaaagcggcaaagga

SEQ ID NO: 64307 - DNA, 15 bp, Homo sapiens
aaagcggcaaaggat

SEQ ID NO: 64308 - DNA, 15 bp, Homo sapiens
aagcggcaaaggatt

SEQ ID NO: 64309 - DNA, 15 bp, Homo sapiens
agcggcaaaggattt

SEQ ID NO: 64310 - DNA, 15 bp, Homo sapiens
gcggcaaaggatttc

SEQ ID NO: 64311 - DNA, 15 bp, Homo sapiens
cggcaaaggatttca

SEQ ID NO: 64312 - DNA, 15 bp, Homo sapiens
ggcaaaggatttcag

SEQ ID NO: 64313 - DNA, 15 bp, Homo sapiens
gcaaaggatttcagt

SEQ ID NO: 64314 - DNA, 15 bp, Homo sapiens
caaaggatttcagtg

SEQ ID NO: 64315 - DNA, 15 bp, Homo sapiens
aaaggatttcagtgc

SEQ ID NO: 64316 - DNA, 15 bp, Homo sapiens
aaggatttcagtgca

SEQ ID NO: 64317 - DNA, 15 bp, Homo sapiens
aggatttcagtgcag

SEQ ID NO: 64318 - DNA, 15 bp, Homo sapiens
ggatttcagtgcagg

SEQ ID NO: 64319 - DNA, 15 bp, Homo sapiens
gatttcagtgcaggt

SEQ ID NO: 64320 - DNA, 15 bp, Homo sapiens
atttcagtgcaggtt

SEQ ID NO: 64321 - DNA, 15 bp, Homo sapiens
tttcagtgcaggttg

SEQ ID NO: 64322 - DNA, 15 bp, Homo sapiens
ttcagtgcaggttgg

SEQ ID NO: 64323 - DNA, 15 bp, Homo sapiens
tcagtgcaggttggc

SEQ ID NO: 64324 - DNA, 15 bp, Homo sapiens
cagtgcaggttggct

SEQ ID NO: 64325 - DNA, 15 bp, Homo sapiens
agtgcaggttggctg

SEQ ID NO: 64326 - DNA, 15 bp, Homo sapiens
gtgcaggttggctgg

SEQ ID NO: 64327 - DNA, 15 bp, Homo sapiens
tgcaggttggctggc

SEQ ID NO: 64328 - DNA, 15 bp, Homo sapiens
gcaggttggctggct

SEQ ID NO: 64329 - DNA, 15 bp, Homo sapiens
caggttggctggctc

SEQ ID NO: 64330 - DNA, 15 bp, Homo sapiens
aggttggctggctcc

SEQ ID NO: 64331 - DNA, 15 bp, Homo sapiens
ggttggctggctcca

SEQ ID NO: 64332 - DNA, 15 bp, Homo sapiens
gttggctggctccaa

SEQ ID NO: 64333 - DNA, 15 bp, Homo sapiens
ttggctggctccaaa

SEQ ID NO: 64334 - DNA, 15 bp, Homo sapiens
tggctggctccaaac

SEQ ID NO: 64335 - DNA, 15 bp, Homo sapiens
ggctggctccaaacc

SEQ ID NO: 64336 - DNA, 15 bp, Homo sapiens
gctggctccaaacct

SEQ ID NO: 64337 - DNA, 15 bp, Homo sapiens
ctggctccaaacctg

SEQ ID NO: 64338 - DNA, 15 bp, Homo sapiens
tggctccaaacctgt

SEQ ID NO: 64339 - DNA, 15 bp, Homo sapiens
ggctccaaacctgtg

SEQ ID NO: 64340 - DNA, 15 bp, Homo sapiens
gctccaaacctgtgt

SEQ ID NO: 64341 - DNA, 15 bp, Homo sapiens
ctccaaacctgtgtg

SEQ ID NO: 64342 - DNA, 15 bp, Homo sapiens
tccaaacctgtgtgt

SEQ ID NO: 64343 - DNA, 15 bp, Homo sapiens
ccaaacctgtgtgtg

SEQ ID NO: 64344 - DNA, 15 bp, Homo sapiens
caaacctgtgtgtgc

SEQ ID NO: 64345 - DNA, 15 bp, Homo sapiens
aaacctgtgtgtgct

SEQ ID NO: 64346 - DNA, 15 bp, Homo sapiens
aacctgtgtgtgctt

SEQ ID NO: 64347 - DNA, 15 bp, Homo sapiens
acctgtgtgtgcttt

SEQ ID NO: 64348 - DNA, 15 bp, Homo sapiens
cctgtgtgtgctttc

SEQ ID NO: 64349 - DNA, 15 bp, Homo sapiens
ctgtgtgtgctttcc

SEQ ID NO: 64350 - DNA, 15 bp, Homo sapiens
tgtgtgtgctttcca

SEQ ID NO: 64351 - DNA, 15 bp, Homo sapiens
gtgtgtgctttccat

SEQ ID NO: 64352 - DNA, 15 bp, Homo sapiens
tgtgtgctttccatg

SEQ ID NO: 64353 - DNA, 15 bp, Homo sapiens
gtgtgctttccatga

SEQ ID NO: 64354 - DNA, 15 bp, Homo sapiens
tgtgctttccatgac

SEQ ID NO: 64355 - DNA, 15 bp, Homo sapiens
gtgctttccatgaca

SEQ ID NO: 64356 - DNA, 15 bp, Homo sapiens
tgctttccatgacac

SEQ ID NO: 64357 - DNA, 15 bp, Homo sapiens
gctttccatgacact

SEQ ID NO: 64358 - DNA, 15 bp, Homo sapiens
ctttccatgacactg

SEQ ID NO: 64359 - DNA, 15 bp, Homo sapiens
tttccatgacactgt

SEQ ID NO: 64360 - DNA, 15 bp, Homo sapiens
ttccatgacactgta

SEQ ID NO: 64361 - DNA, 15 bp, Homo sapiens
tccatgacactgtac

SEQ ID NO: 64362 - DNA, 15 bp, Homo sapiens
ccatgacactgtact

SEQ ID NO: 64363 - DNA, 15 bp, Homo sapiens
catgacactgtactg

SEQ ID NO: 64364 - DNA, 15 bp, Homo sapiens
atgacactgtactgt

SEQ ID NO: 64365 - DNA, 15 bp, Homo sapiens
tgacactgtactgtg

SEQ ID NO: 64366 - DNA, 15 bp, Homo sapiens
gacactgtactgtgt

SEQ ID NO: 64367 - DNA, 15 bp, Homo sapiens
acactgtactgtgtg

SEQ ID NO: 64368 - DNA, 15 bp, Homo sapiens
cactgtactgtgtgc

SEQ ID NO: 64369 - DNA, 15 bp, Homo sapiens
actgtactgtgtgcc

SEQ ID NO: 64370 - DNA, 15 bp, Homo sapiens
ctgtactgtgtgcct

SEQ ID NO: 64371 - DNA, 15 bp, Homo sapiens
tgtactgtgtgcctc

SEQ ID NO: 64372 - DNA, 15 bp, Homo sapiens
gtactgtgtgcctca

SEQ ID NO: 64373 - DNA, 15 bp, Homo sapiens
tactgtgtgcctcat

SEQ ID NO: 64374 - DNA, 15 bp, Homo sapiens
actgtgtgcctcatt

SEQ ID NO: 64375 - DNA, 15 bp, Homo sapiens
ctgtgtgcctcattg

SEQ ID NO: 64376 - DNA, 15 bp, Homo sapiens
tgtgtgcctcattga

SEQ ID NO: 64377 - DNA, 15 bp, Homo sapiens
gtgtgcctcattgag

SEQ ID NO: 64378 - DNA, 15 bp, Homo sapiens
tgtgcctcattgagc

SEQ ID NO: 64379 - DNA, 15 bp, Homo sapiens
gtgcctcattgagcc

SEQ ID NO: 64380 - DNA, 15 bp, Homo sapiens
tgcctcattgagcct

SEQ ID NO: 64381 - DNA, 15 bp, Homo sapiens
gcctcattgagcctc

SEQ ID NO: 64382 - DNA, 15 bp, Homo sapiens
cctcattgagcctca

SEQ ID NO: 64383 - DNA, 15 bp, Homo sapiens
ctcattgagcctcat

SEQ ID NO: 64384 - DNA, 15 bp, Homo sapiens
tcattgagcctcatt

SEQ ID NO: 64385 - DNA, 15 bp, Homo sapiens
cattgagcctcattc

SEQ ID NO: 64386 - DNA, 15 bp, Homo sapiens
attgagcctcattct

SEQ ID NO: 64387 - DNA, 15 bp, Homo sapiens
ttgagcctcattcta

SEQ ID NO: 64388 - DNA, 15 bp, Homo sapiens
tgagcctcattctag

SEQ ID NO: 64389 - DNA, 15 bp, Homo sapiens
gagcctcattctaga

SEQ ID NO: 64390 - DNA, 15 bp, Homo sapiens
agcctcattctagaa

SEQ ID NO: 64391 - DNA, 15 bp, Homo sapiens
gcctcattctagaaa

SEQ ID NO: 64392 - DNA, 15 bp, Homo sapiens
cctcattctagaaaa

SEQ ID NO: 64393 - DNA, 15 bp, Homo sapiens
ctcattctagaaaac

SEQ ID NO: 64394 - DNA, 15 bp, Homo sapiens
tcattctagaaaacc

SEQ ID NO: 64395 - DNA, 15 bp, Homo sapiens
cattctagaaaacca

SEQ ID NO: 64396 - DNA, 15 bp, Homo sapiens
attctagaaaaccaa

SEQ ID NO: 64397 - DNA, 15 bp, Homo sapiens
ttctagaaaaccaaa

SEQ ID NO: 64398 - DNA, 15 bp, Homo sapiens
tctagaaaaccaaaa

SEQ ID NO: 64399 - DNA, 15 bp, Homo sapiens
ctagaaaaccaaaaa

SEQ ID NO: 64400 - DNA, 15 bp, Homo sapiens
tagaaaaccaaaaac

SEQ ID NO: 64401 - DNA, 15 bp, Homo sapiens
agaaaaccaaaaaca

SEQ ID NO: 64402 - DNA, 15 bp, Homo sapiens
gaaaaccaaaaacac

SEQ ID NO: 64403 - DNA, 15 bp, Homo sapiens
aaaaccaaaaacaca

SEQ ID NO: 64404 - DNA, 15 bp, Homo sapiens
aaaccaaaaacacac

SEQ ID NO: 64405 - DNA, 15 bp, Homo sapiens
aaccaaaaacacacc

SEQ ID NO: 64406 - DNA, 15 bp, Homo sapiens
accaaaaacacaccc

SEQ ID NO: 64407 - DNA, 15 bp, Homo sapiens
ccaaaaacacaccca

SEQ ID NO: 64408 - DNA, 15 bp, Homo sapiens
caaaaacacacccaa

SEQ ID NO: 64409 - DNA, 15 bp, Homo sapiens
aaaaacacacccaag

SEQ ID NO: 64410 - DNA, 15 bp, Homo sapiens
aaaacacacccaagg

SEQ ID NO: 64411 - DNA, 15 bp, Homo sapiens
aaacacacccaaggc

SEQ ID NO: 64412 - DNA, 15 bp, Homo sapiens
aacacacccaaggcc

SEQ ID NO: 64413 - DNA, 15 bp, Homo sapiens
acacacccaaggccc

SEQ ID NO: 64414 - DNA, 15 bp, Homo sapiens
cacacccaaggcccg

SEQ ID NO: 64415 - DNA, 15 bp, Homo sapiens
acacccaaggcccgg

SEQ ID NO: 64416 - DNA, 15 bp, Homo sapiens
cacccaaggcccggc

SEQ ID NO: 64417 - DNA, 15 bp, Homo sapiens
acccaaggcccggcc

SEQ ID NO: 64418 - DNA, 15 bp, Homo sapiens
cccaaggcccggcct

SEQ ID NO: 64419 - DNA, 15 bp, Homo sapiens
ccaaggcccggcctt

SEQ ID NO: 64420 - DNA, 15 bp, Homo sapiens
caaggcccggccttc

SEQ ID NO: 64421 - DNA, 15 bp, Homo sapiens
aaggcccggccttca

SEQ ID NO: 64422 - DNA, 15 bp, Homo sapiens
aggcccggccttcac

SEQ ID NO: 64423 - DNA, 15 bp, Homo sapiens
ggcccggccttcaca

SEQ ID NO: 64424 - DNA, 15 bp, Homo sapiens
gcccggccttcacaa

SEQ ID NO: 64425 - DNA, 15 bp, Homo sapiens
cccggccttcacaaa

SEQ ID NO: 64426 - DNA, 15 bp, Homo sapiens
ccggccttcacaaag

SEQ ID NO: 64427 - DNA, 15 bp, Homo sapiens
cggccttcacaaagg

SEQ ID NO: 64428 - DNA, 15 bp, Homo sapiens
ggccttcacaaagga

SEQ ID NO: 64429 - DNA, 15 bp, Homo sapiens
gccttcacaaaggag

SEQ ID NO: 64430 - DNA, 15 bp, Homo sapiens
ccttcacaaaggaga

SEQ ID NO: 64431 - DNA, 15 bp, Homo sapiens
cttcacaaaggagac

SEQ ID NO: 64432 - DNA, 15 bp, Homo sapiens
ttcacaaaggagacc

SEQ ID NO: 64433 - DNA, 15 bp, Homo sapiens
tcacaaaggagaccc

SEQ ID NO: 64434 - DNA, 15 bp, Homo sapiens
cacaaaggagacccc

SEQ ID NO: 64435 - DNA, 15 bp, Homo sapiens
acaaaggagacccct

SEQ ID NO: 64436 - DNA, 15 bp, Homo sapiens
caaaggagacccctc

SEQ ID NO: 64437 - DNA, 15 bp, Homo sapiens
aaaggagacccctcc

SEQ ID NO: 64438 - DNA, 15 bp, Homo sapiens
aaggagacccctccc

SEQ ID NO: 64439 - DNA, 15 bp, Homo sapiens
aggagacccctcccc

SEQ ID NO: 64440 - DNA, 15 bp, Homo sapiens
ggagacccctccccc

SEQ ID NO: 64441 - DNA, 15 bp, Homo sapiens
gagacccctccccca

SEQ ID NO: 64442 - DNA, 15 bp, Homo sapiens
agacccctcccccat

SEQ ID NO: 64443 - DNA, 15 bp, Homo sapiens
gacccctcccccatt

SEQ ID NO: 64444 - DNA, 15 bp, Homo sapiens
acccctcccccattt

SEQ ID NO: 64445 - DNA, 15 bp, Homo sapiens
cccctcccccatttg

SEQ ID NO: 64446 - DNA, 15 bp, Homo sapiens
ccctcccccatttgg

SEQ ID NO: 64447 - DNA, 15 bp, Homo sapiens
cctcccccatttggc

SEQ ID NO: 64448 - DNA, 15 bp, Homo sapiens
ctcccccatttggct

SEQ ID NO: 64449 - DNA, 15 bp, Homo sapiens
tcccccatttggctc

SEQ ID NO: 64450 - DNA, 15 bp, Homo sapiens
cccccatttggctcc

SEQ ID NO: 64451 - DNA, 15 bp, Homo sapiens
ccccatttggctccc

SEQ ID NO: 64452 - DNA, 15 bp, Homo sapiens
cccatttggctccct

SEQ ID NO: 64453 - DNA, 15 bp, Homo sapiens
ccatttggctccctt

SEQ ID NO: 64454 - DNA, 15 bp, Homo sapiens
catttggctcccttt

SEQ ID NO: 64455 - DNA, 15 bp, Homo sapiens
atttggctccctttc

SEQ ID NO: 64456 - DNA, 15 bp, Homo sapiens
tttggctccctttcc

SEQ ID NO: 64457 - DNA, 15 bp, Homo sapiens
ttggctccctttcca

SEQ ID NO: 64458 - DNA, 15 bp, Homo sapiens
tggctccctttccag

SEQ ID NO: 64459 - DNA, 15 bp, Homo sapiens
ggctccctttccagc

SEQ ID NO: 64460 - DNA, 15 bp, Homo sapiens
gctccctttccagca

SEQ ID NO: 64461 - DNA, 15 bp, Homo sapiens
ctccctttccagcag

SEQ ID NO: 64462 - DNA, 15 bp, Homo sapiens
tccctttccagcagt

SEQ ID NO: 64463 - DNA, 15 bp, Homo sapiens
ccctttccagcagtc

SEQ ID NO: 64464 - DNA, 15 bp, Homo sapiens
cctttccagcagtcg

SEQ ID NO: 64465 - DNA, 15 bp, Homo sapiens
ctttccagcagtcga

SEQ ID NO: 64466 - DNA, 15 bp, Homo sapiens
tttccagcagtcgac

SEQ ID NO: 64467 - DNA, 15 bp, Homo sapiens
ttccagcagtcgacg

SEQ ID NO: 64468 - DNA, 15 bp, Homo sapiens
tccagcagtcgacgg

SEQ ID NO: 64469 - DNA, 15 bp, Homo sapiens
ccagcagtcgacggc

SEQ ID NO: 64470 - DNA, 15 bp, Homo sapiens
cagcagtcgacggcc

SEQ ID NO: 64471 - DNA, 15 bp, Homo sapiens
agcagtcgacggcct

SEQ ID NO: 64472 - DNA, 15 bp, Homo sapiens
gcagtcgacggcctc

SEQ ID NO: 64473 - DNA, 15 bp, Homo sapiens
cagtcgacggcctct

SEQ ID NO: 64474 - DNA, 15 bp, Homo sapiens
agtcgacggcctctt

SEQ ID NO: 64475 - DNA, 15 bp, Homo sapiens
gtcgacggcctcttg

SEQ ID NO: 64476 - DNA, 15 bp, Homo sapiens
tcgacggcctcttgt

SEQ ID NO: 64477 - DNA, 15 bp, Homo sapiens
cgacggcctcttgtc

SEQ ID NO: 64478 - DNA, 15 bp, Homo sapiens
gacggcctcttgtca

SEQ ID NO: 64479 - DNA, 15 bp, Homo sapiens
acggcctcttgtcag

SEQ ID NO: 64480 - DNA, 15 bp, Homo sapiens
cggcctcttgtcagc

SEQ ID NO: 64481 - DNA, 15 bp, Homo sapiens
ggcctcttgtcagcc

SEQ ID NO: 64482 - DNA, 15 bp, Homo sapiens
gcctcttgtcagcca

SEQ ID NO: 64483 - DNA, 15 bp, Homo sapiens
cctcttgtcagccat

SEQ ID NO: 64484 - DNA, 15 bp, Homo sapiens
ctcttgtcagccatc

SEQ ID NO: 64485 - DNA, 15 bp, Homo sapiens
tcttgtcagccatcg

SEQ ID NO: 64486 - DNA, 15 bp, Homo sapiens
cttgtcagccatcga

SEQ ID NO: 64487 - DNA, 15 bp, Homo sapiens
ttgtcagccatcgag

SEQ ID NO: 64488 - DNA, 15 bp, Homo sapiens
tgtcagccatcgagc

SEQ ID NO: 64489 - DNA, 15 bp, Homo sapiens
gtcagccatcgagcc

SEQ ID NO: 64490 - DNA, 15 bp, Homo sapiens
tcagccatcgagccc

SEQ ID NO: 64491 - DNA, 15 bp, Homo sapiens
cagccatcgagccca

SEQ ID NO: 64492 - DNA, 15 bp, Homo sapiens
agccatcgagcccag

SEQ ID NO: 64493 - DNA, 15 bp, Homo sapiens
gccatcgagcccaga

SEQ ID NO: 64494 - DNA, 15 bp, Homo sapiens
ccatcgagcccagag

SEQ ID NO: 64495 - DNA, 15 bp, Homo sapiens
catcgagcccagagt

SEQ ID NO: 64496 - DNA, 15 bp, Homo sapiens
atcgagcccagagtc

SEQ ID NO: 64497 - DNA, 15 bp, Homo sapiens
tcgagcccagagtcc

SEQ ID NO: 64498 - DNA, 15 bp, Homo sapiens
cgagcccagagtccc

SEQ ID NO: 64499 - DNA, 15 bp, Homo sapiens
gagcccagagtccct

SEQ ID NO: 64500 - DNA, 15 bp, Homo sapiens
agcccagagtccctt

SEQ ID NO: 64501 - DNA, 15 bp, Homo sapiens
gcccagagtcccttg

SEQ ID NO: 64502 - DNA, 15 bp, Homo sapiens
cccagagtcccttga

SEQ ID NO: 64503 - DNA, 15 bp, Homo sapiens
ccagagtcccttgaa

SEQ ID NO: 64504 - DNA, 15 bp, Homo sapiens
cagagtcccttgaag

SEQ ID NO: 64505 - DNA, 15 bp, Homo sapiens
agagtcccttgaagt

SEQ ID NO: 64506 - DNA, 15 bp, Homo sapiens
gagtcccttgaagtg

SEQ ID NO: 64507 - DNA, 15 bp, Homo sapiens
agtcccttgaagtgc

SEQ ID NO: 64508 - DNA, 15 bp, Homo sapiens
gtcccttgaagtgcg

SEQ ID NO: 64509 - DNA, 15 bp, Homo sapiens
tcccttgaagtgcga

SEQ ID NO: 64510 - DNA, 15 bp, Homo sapiens
cccttgaagtgcgac

SEQ ID NO: 64511 - DNA, 15 bp, Homo sapiens
ccttgaagtgcgact

SEQ ID NO: 64512 - DNA, 15 bp, Homo sapiens
cttgaagtgcgactc

SEQ ID NO: 64513 - DNA, 15 bp, Homo sapiens
ttgaagtgcgactca

SEQ ID NO: 64514 - DNA, 15 bp, Homo sapiens
tgaagtgcgactcat

SEQ ID NO: 64515 - DNA, 15 bp, Homo sapiens
gaagtgcgactcatg

SEQ ID NO: 64516 - DNA, 15 bp, Homo sapiens
aagtgcgactcatgc

SEQ ID NO: 64517 - DNA, 15 bp, Homo sapiens
agtgcgactcatgct

SEQ ID NO: 64518 - DNA, 15 bp, Homo sapiens
gtgcgactcatgctg

SEQ ID NO: 64519 - DNA, 15 bp, Homo sapiens
tgcgactcatgctgg

SEQ ID NO: 64520 - DNA, 15 bp, Homo sapiens
gcgactcatgctggg

SEQ ID NO: 64521 - DNA, 15 bp, Homo sapiens
cgactcatgctgggg

SEQ ID NO: 64522 - DNA, 15 bp, Homo sapiens
gactcatgctggggt

SEQ ID NO: 64523 - DNA, 15 bp, Homo sapiens
actcatgctggggtg

SEQ ID NO: 64524 - DNA, 15 bp, Homo sapiens
ctcatgctggggtgg

SEQ ID NO: 64525 - DNA, 15 bp, Homo sapiens
tcatgctggggtggt

SEQ ID NO: 64526 - DNA, 15 bp, Homo sapiens
catgctggggtggta

SEQ ID NO: 64527 - DNA, 15 bp, Homo sapiens
atgctggggtggtat

SEQ ID NO: 64528 - DNA, 15 bp, Homo sapiens
tgctggggtggtatg

SEQ ID NO: 64529 - DNA, 15 bp, Homo sapiens
gctggggtggtatgc

SEQ ID NO: 64530 - DNA, 15 bp, Homo sapiens
ctggggtggtatgct

SEQ ID NO: 64531 - DNA, 15 bp, Homo sapiens
tggggtggtatgctc

SEQ ID NO: 64532 - DNA, 15 bp, Homo sapiens
ggggtggtatgctca

SEQ ID NO: 64533 - DNA, 15 bp, Homo sapiens
gggtggtatgctcag

SEQ ID NO: 64534 - DNA, 15 bp, Homo sapiens
ggtggtatgctcagg

SEQ ID NO: 64535 - DNA, 15 bp, Homo sapiens
gtggtatgctcagga

SEQ ID NO: 64536 - DNA, 15 bp, Homo sapiens
tggtatgctcaggag

SEQ ID NO: 64537 - DNA, 15 bp, Homo sapiens
ggtatgctcaggagc

SEQ ID NO: 64538 - DNA, 15 bp, Homo sapiens
gtatgctcaggagcc

SEQ ID NO: 64539 - DNA, 15 bp, Homo sapiens
tatgctcaggagccg

SEQ ID NO: 64540 - DNA, 15 bp, Homo sapiens
atgctcaggagccgc

SEQ ID NO: 64541 - DNA, 15 bp, Homo sapiens
tgctcaggagccgca

SEQ ID NO: 64542 - DNA, 15 bp, Homo sapiens
gctcaggagccgcag

SEQ ID NO: 64543 - DNA, 15 bp, Homo sapiens
ctcaggagccgcagt

SEQ ID NO: 64544 - DNA, 15 bp, Homo sapiens
tcaggagccgcagtg

SEQ ID NO: 64545 - DNA, 15 bp, Homo sapiens
caggagccgcagtgt

SEQ ID NO: 64546 - DNA, 15 bp, Homo sapiens
aggagccgcagtgtt

SEQ ID NO: 64547 - DNA, 15 bp, Homo sapiens
ggagccgcagtgttt

SEQ ID NO: 64548 - DNA, 15 bp, Homo sapiens
gagccgcagtgtttc

SEQ ID NO: 64549 - DNA, 15 bp, Homo sapiens
agccgcagtgtttcc

SEQ ID NO: 64550 - DNA, 15 bp, Homo sapiens
gccgcagtgtttccg

SEQ ID NO: 64551 - DNA, 15 bp, Homo sapiens
ccgcagtgtttccgc

SEQ ID NO: 64552 - DNA, 15 bp, Homo sapiens
cgcagtgtttccgct

SEQ ID NO: 64553 - DNA, 15 bp, Homo sapiens
gcagtgtttccgctc

SEQ ID NO: 64554 - DNA, 15 bp, Homo sapiens
cagtgtttccgctca

SEQ ID NO: 64555 - DNA, 15 bp, Homo sapiens
agtgtttccgctcag

SEQ ID NO: 64556 - DNA, 15 bp, Homo sapiens
gtgtttccgctcaga

SEQ ID NO: 64557 - DNA, 15 bp, Homo sapiens
tgtttccgctcagag

SEQ ID NO: 64558 - DNA, 15 bp, Homo sapiens
gtttccgctcagagg

SEQ ID NO: 64559 - DNA, 15 bp, Homo sapiens
tttccgctcagagga

SEQ ID NO: 64560 - DNA, 15 bp, Homo sapiens
ttccgctcagaggaa

SEQ ID NO: 64561 - DNA, 15 bp, Homo sapiens
tccgctcagaggaaa

SEQ ID NO: 64562 - DNA, 15 bp, Homo sapiens
ccgctcagaggaaag

SEQ ID NO: 64563 - DNA, 15 bp, Homo sapiens
cgctcagaggaaagg

SEQ ID NO: 64564 - DNA, 15 bp, Homo sapiens
gctcagaggaaaggg

SEQ ID NO: 64565 - DNA, 15 bp, Homo sapiens
ctcagaggaaagggc

SEQ ID NO: 64566 - DNA, 15 bp, Homo sapiens
tcagaggaaagggct

SEQ ID NO: 64567 - DNA, 15 bp, Homo sapiens
cagaggaaagggctc

SEQ ID NO: 64568 - DNA, 15 bp, Homo sapiens
agaggaaagggctct

SEQ ID NO: 64569 - DNA, 15 bp, Homo sapiens
gaggaaagggctctg

SEQ ID NO: 64570 - DNA, 15 bp, Homo sapiens
aggaaagggctctga

SEQ ID NO: 64571 - DNA, 15 bp, Homo sapiens
ggaaagggctctgat

SEQ ID NO: 64572 - DNA, 15 bp, Homo sapiens
gaaagggctctgatt

SEQ ID NO: 64573 - DNA, 15 bp, Homo sapiens
aaagggctctgattc

SEQ ID NO: 64574 - DNA, 15 bp, Homo sapiens
aagggctctgattct

SEQ ID NO: 64575 - DNA, 15 bp, Homo sapiens
agggctctgattctc

SEQ ID NO: 64576 - DNA, 15 bp, Homo sapiens
gggctctgattctcc

SEQ ID NO: 64577 - DNA, 15 bp, Homo sapiens
ggctctgattctcct

SEQ ID NO: 64578 - DNA, 15 bp, Homo sapiens
gctctgattctcctg

SEQ ID NO: 64579 - DNA, 15 bp, Homo sapiens
ctctgattctcctgc

SEQ ID NO: 64580 - DNA, 15 bp, Homo sapiens
tctgattctcctgca

SEQ ID NO: 64581 - DNA, 15 bp, Homo sapiens
ctgattctcctgcag

SEQ ID NO: 64582 - DNA, 15 bp, Homo sapiens
tgattctcctgcagt

SEQ ID NO: 64583 - DNA, 15 bp, Homo sapiens
gattctcctgcagtg

SEQ ID NO: 64584 - DNA, 15 bp, Homo sapiens
attctcctgcagtgc

SEQ ID NO: 64585 - DNA, 15 bp, Homo sapiens
ttctcctgcagtgct

SEQ ID NO: 64586 - DNA, 15 bp, Homo sapiens
tctcctgcagtgcta

SEQ ID NO: 64587 - DNA, 15 bp, Homo sapiens
ctcctgcagtgctag

SEQ ID NO: 64588 - DNA, 15 bp, Homo sapiens
tcctgcagtgctagg

SEQ ID NO: 64589 - DNA, 15 bp, Homo sapiens
cctgcagtgctagga

SEQ ID NO: 64590 - DNA, 15 bp, Homo sapiens
ctgcagtgctaggag

SEQ ID NO: 64591 - DNA, 15 bp, Homo sapiens
tgcagtgctaggaga

SEQ ID NO: 64592 - DNA, 15 bp, Homo sapiens
gcagtgctaggagac

SEQ ID NO: 64593 - DNA, 15 bp, Homo sapiens
cagtgctaggagact

SEQ ID NO: 64594 - DNA, 15 bp, Homo sapiens
agtgctaggagactt

SEQ ID NO: 64595 - DNA, 15 bp, Homo sapiens
gtgctaggagacttg

SEQ ID NO: 64596 - DNA, 15 bp, Homo sapiens
tgctaggagacttgt

SEQ ID NO: 64597 - DNA, 15 bp, Homo sapiens
gctaggagacttgtg

SEQ ID NO: 64598 - DNA, 15 bp, Homo sapiens
ctaggagacttgtgg

SEQ ID NO: 64599 - DNA, 15 bp, Homo sapiens
taggagacttgtggg

SEQ ID NO: 64600 - DNA, 15 bp, Homo sapiens
aggagacttgtgggt

SEQ ID NO: 64601 - DNA, 15 bp, Homo sapiens
ggagacttgtgggtg

SEQ ID NO: 64602 - DNA, 15 bp, Homo sapiens
gagacttgtgggtgg

SEQ ID NO: 64603 - DNA, 15 bp, Homo sapiens
agacttgtgggtggc

SEQ ID NO: 64604 - DNA, 15 bp, Homo sapiens
gacttgtgggtggcc

SEQ ID NO: 64605 - DNA, 15 bp, Homo sapiens
acttgtgggtggcca

SEQ ID NO: 64606 - DNA, 15 bp, Homo sapiens
cttgtgggtggccac

SEQ ID NO: 64607 - DNA, 15 bp, Homo sapiens
ttgtgggtggccaca

SEQ ID NO: 64608 - DNA, 15 bp, Homo sapiens
tgtgggtggccacag

SEQ ID NO: 64609 - DNA, 15 bp, Homo sapiens
gtgggtggccacagt

SEQ ID NO: 64610 - DNA, 15 bp, Homo sapiens
tgggtggccacagtg

SEQ ID NO: 64611 - DNA, 15 bp, Homo sapiens
gggtggccacagtgc

SEQ ID NO: 64612 - DNA, 15 bp, Homo sapiens
ggtggccacagtgca

SEQ ID NO: 64613 - DNA, 15 bp, Homo sapiens
gtggccacagtgcag

SEQ ID NO: 64614 - DNA, 15 bp, Homo sapiens
tggccacagtgcagg

SEQ ID NO: 64615 - DNA, 15 bp, Homo sapiens
ggccacagtgcaggt

SEQ ID NO: 64616 - DNA, 15 bp, Homo sapiens
gccacagtgcaggtc

SEQ ID NO: 64617 - DNA, 15 bp, Homo sapiens
ccacagtgcaggtca

SEQ ID NO: 64618 - DNA, 15 bp, Homo sapiens
cacagtgcaggtcag

SEQ ID NO: 64619 - DNA, 15 bp, Homo sapiens
acagtgcaggtcagg

SEQ ID NO: 64620 - DNA, 15 bp, Homo sapiens
cagtgcaggtcaggc

SEQ ID NO: 64621 - DNA, 15 bp, Homo sapiens
agtgcaggtcaggca

SEQ ID NO: 64622 - DNA, 15 bp, Homo sapiens
gtgcaggtcaggcac

SEQ ID NO: 64623 - DNA, 15 bp, Homo sapiens
tgcaggtcaggcaca

SEQ ID NO: 64624 - DNA, 15 bp, Homo sapiens
gcaggtcaggcacac

SEQ ID NO: 64625 - DNA, 15 bp, Homo sapiens
caggtcaggcacacc

SEQ ID NO: 64626 - DNA, 15 bp, Homo sapiens
aggtcaggcacaccg

SEQ ID NO: 64627 - DNA, 15 bp, Homo sapiens
ggtcaggcacaccgg

SEQ ID NO: 64628 - DNA, 15 bp, Homo sapiens
gtcaggcacaccggc

SEQ ID NO: 64629 - DNA, 15 bp, Homo sapiens
tcaggcacaccggcc

SEQ ID NO: 64630 - DNA, 15 bp, Homo sapiens
caggcacaccggcca

SEQ ID NO: 64631 - DNA, 15 bp, Homo sapiens
aggcacaccggccag

SEQ ID NO: 64632 - DNA, 15 bp, Homo sapiens
ggcacaccggccagc

SEQ ID NO: 64633 - DNA, 15 bp, Homo sapiens
gcacaccggccagca

SEQ ID NO: 64634 - DNA, 15 bp, Homo sapiens
cacaccggccagcac

SEQ ID NO: 64635 - DNA, 15 bp, Homo sapiens
acaccggccagcacc

SEQ ID NO: 64636 - DNA, 15 bp, Homo sapiens
caccggccagcacca

SEQ ID NO: 64637 - DNA, 15 bp, Homo sapiens
accggccagcaccac

SEQ ID NO: 64638 - DNA, 15 bp, Homo sapiens
ccggccagcaccacc

SEQ ID NO: 64639 - DNA, 15 bp, Homo sapiens
cggccagcaccaccc

SEQ ID NO: 64640 - DNA, 15 bp, Homo sapiens
ggccagcaccaccca

SEQ ID NO: 64641 - DNA, 15 bp, Homo sapiens
gccagcaccacccac

SEQ ID NO: 64642 - DNA, 15 bp, Homo sapiens
ccagcaccacccaca

SEQ ID NO: 64643 - DNA, 15 bp, Homo sapiens
cagcaccacccacag

SEQ ID NO: 64644 - DNA, 15 bp, Homo sapiens
agcaccacccacagc

SEQ ID NO: 64645 - DNA, 15 bp, Homo sapiens
gcaccacccacagcc

SEQ ID NO: 64646 - DNA, 15 bp, Homo sapiens
caccacccacagccc

SEQ ID NO: 64647 - DNA, 15 bp, Homo sapiens
accacccacagccca

SEQ ID NO: 64648 - DNA, 15 bp, Homo sapiens
ccacccacagcccaa

SEQ ID NO: 64649 - DNA, 15 bp, Homo sapiens
cacccacagcccaaa

SEQ ID NO: 64650 - DNA, 15 bp, Homo sapiens
acccacagcccaaat

SEQ ID NO: 64651 - DNA, 15 bp, Homo sapiens
cccacagcccaaatt

SEQ ID NO: 64652 - DNA, 15 bp, Homo sapiens
ccacagcccaaattc

SEQ ID NO: 64653 - DNA, 15 bp, Homo sapiens
cacagcccaaattcc

SEQ ID NO: 64654 - DNA, 15 bp, Homo sapiens
acagcccaaattcct

SEQ ID NO: 64655 - DNA, 15 bp, Homo sapiens
cagcccaaattccta

SEQ ID NO: 64656 - DNA, 15 bp, Homo sapiens
agcccaaattcctaa

SEQ ID NO: 64657 - DNA, 15 bp, Homo sapiens
gcccaaattcctaaa

SEQ ID NO: 64658 - DNA, 15 bp, Homo sapiens
cccaaattcctaaag

SEQ ID NO: 64659 - DNA, 15 bp, Homo sapiens
ccaaattcctaaaga

SEQ ID NO: 64660 - DNA, 15 bp, Homo sapiens
caaattcctaaagaa

SEQ ID NO: 64661 - DNA, 15 bp, Homo sapiens
aaattcctaaagaaa

SEQ ID NO: 64662 - DNA, 15 bp, Homo sapiens
aattcctaaagaaat

SEQ ID NO: 64663 - DNA, 15 bp, Homo sapiens
attcctaaagaaata

SEQ ID NO: 64664 - DNA, 15 bp, Homo sapiens
ttcctaaagaaatat

SEQ ID NO: 64665 - DNA, 15 bp, Homo sapiens
tcctaaagaaatatt

SEQ ID NO: 64666 - DNA, 15 bp, Homo sapiens
cctaaagaaatattt

SEQ ID NO: 64667 - DNA, 15 bp, Homo sapiens
ctaaagaaatatttg

SEQ ID NO: 64668 - DNA, 15 bp, Homo sapiens
taaagaaatatttgg

SEQ ID NO: 64669 - DNA, 15 bp, Homo sapiens
aaagaaatatttggg

SEQ ID NO: 64670 - DNA, 15 bp, Homo sapiens
aagaaatatttgggt

SEQ ID NO: 64671 - DNA, 15 bp, Homo sapiens
agaaatatttgggtc

SEQ ID NO: 64672 - DNA, 15 bp, Homo sapiens
gaaatatttgggtcc

SEQ ID NO: 64673 - DNA, 15 bp, Homo sapiens
aaatatttgggtccc

SEQ ID NO: 64674 - DNA, 15 bp, Homo sapiens
aatatttgggtccca

SEQ ID NO: 64675 - DNA, 15 bp, Homo sapiens
atatttgggtcccag

SEQ ID NO: 64676 - DNA, 15 bp, Homo sapiens
tatttgggtcccagc

SEQ ID NO: 64677 - DNA, 15 bp, Homo sapiens
atttgggtcccagct

SEQ ID NO: 64678 - DNA, 15 bp, Homo sapiens
tttgggtcccagctt

SEQ ID NO: 64679 - DNA, 15 bp, Homo sapiens
ttgggtcccagcttg

SEQ ID NO: 64680 - DNA, 15 bp, Homo sapiens
tgggtcccagcttgg

SEQ ID NO: 64681 - DNA, 15 bp, Homo sapiens
gggtcccagcttggc

SEQ ID NO: 64682 - DNA, 15 bp, Homo sapiens
ggtcccagcttggcc

SEQ ID NO: 64683 - DNA, 15 bp, Homo sapiens
gtcccagcttggccc

SEQ ID NO: 64684 - DNA, 15 bp, Homo sapiens
tcccagcttggcccg

SEQ ID NO: 64685 - DNA, 15 bp, Homo sapiens
cccagcttggcccga

SEQ ID NO: 64686 - DNA, 15 bp, Homo sapiens
ccagcttggcccgag

SEQ ID NO: 64687 - DNA, 15 bp, Homo sapiens
cagcttggcccgagt

SEQ ID NO: 64688 - DNA, 15 bp, Homo sapiens
agcttggcccgagtc

SEQ ID NO: 64689 - DNA, 15 bp, Homo sapiens
gcttggcccgagtct

SEQ ID NO: 64690 - DNA, 15 bp, Homo sapiens
cttggcccgagtctc

SEQ ID NO: 64691 - DNA, 15 bp, Homo sapiens
ttggcccgagtctct

SEQ ID NO: 64692 - DNA, 15 bp, Homo sapiens
tggcccgagtctctg

SEQ ID NO: 64693 - DNA, 15 bp, Homo sapiens
ggcccgagtctctgt

SEQ ID NO: 64694 - DNA, 15 bp, Homo sapiens
gcccgagtctctgtt

SEQ ID NO: 64695 - DNA, 15 bp, Homo sapiens
cccgagtctctgttg

SEQ ID NO: 64696 - DNA, 15 bp, Homo sapiens
ccgagtctctgttgt

SEQ ID NO: 64697 - DNA, 15 bp, Homo sapiens
cgagtctctgttgtc

SEQ ID NO: 64698 - DNA, 15 bp, Homo sapiens
gagtctctgttgtcc

SEQ ID NO: 64699 - DNA, 15 bp, Homo sapiens
agtctctgttgtcct

SEQ ID NO: 64700 - DNA, 15 bp, Homo sapiens
gtctctgttgtcctg

SEQ ID NO: 64701 - DNA, 15 bp, Homo sapiens
tctctgttgtcctgg

SEQ ID NO: 64702 - DNA, 15 bp, Homo sapiens
ctctgttgtcctggg

SEQ ID NO: 64703 - DNA, 15 bp, Homo sapiens
tctgttgtcctgggg

SEQ ID NO: 64704 - DNA, 15 bp, Homo sapiens
ctgttgtcctgggga

SEQ ID NO: 64705 - DNA, 15 bp, Homo sapiens
tgttgtcctggggaa

SEQ ID NO: 64706 - DNA, 15 bp, Homo sapiens
gttgtcctggggaag

SEQ ID NO: 64707 - DNA, 15 bp, Homo sapiens
ttgtcctggggaagg

SEQ ID NO: 64708 - DNA, 15 bp, Homo sapiens
tgtcctggggaagga

SEQ ID NO: 64709 - DNA, 15 bp, Homo sapiens
gtcctggggaaggac

SEQ ID NO: 64710 - DNA, 15 bp, Homo sapiens
tcctggggaaggaca

SEQ ID NO: 64711 - DNA, 15 bp, Homo sapiens
cctggggaaggacat

SEQ ID NO: 64712 - DNA, 15 bp, Homo sapiens
ctggggaaggacatc

SEQ ID NO: 64713 - DNA, 15 bp, Homo sapiens
tggggaaggacatca

SEQ ID NO: 64714 - DNA, 15 bp, Homo sapiens
ggggaaggacatcaa

SEQ ID NO: 64715 - DNA, 15 bp, Homo sapiens
gggaaggacatcaag

SEQ ID NO: 64716 - DNA, 15 bp, Homo sapiens
ggaaggacatcaaga

SEQ ID NO: 64717 - DNA, 15 bp, Homo sapiens
gaaggacatcaagat

SEQ ID NO: 64718 - DNA, 15 bp, Homo sapiens
aaggacatcaagatc

SEQ ID NO: 64719 - DNA, 15 bp, Homo sapiens
aggacatcaagatct

SEQ ID NO: 64720 - DNA, 15 bp, Homo sapiens
ggacatcaagatctg

SEQ ID NO: 64721 - DNA, 15 bp, Homo sapiens
gacatcaagatctga

SEQ ID NO: 64722 - DNA, 15 bp, Homo sapiens
acatcaagatctgag

SEQ ID NO: 64723 - DNA, 15 bp, Homo sapiens
catcaagatctgagt

SEQ ID NO: 64724 - DNA, 15 bp, Homo sapiens
atcaagatctgagtg

SEQ ID NO: 64725 - DNA, 15 bp, Homo sapiens
tcaagatctgagtgt

SEQ ID NO: 64726 - DNA, 15 bp, Homo sapiens
caagatctgagtgta

SEQ ID NO: 64727 - DNA, 15 bp, Homo sapiens
aagatctgagtgtat

SEQ ID NO: 64728 - DNA, 15 bp, Homo sapiens
agatctgagtgtatg

SEQ ID NO: 64729 - DNA, 15 bp, Homo sapiens
gatctgagtgtatga

SEQ ID NO: 64730 - DNA, 15 bp, Homo sapiens
atctgagtgtatgat

SEQ ID NO: 64731 - DNA, 15 bp, Homo sapiens
tctgagtgtatgatg

SEQ ID NO: 64732 - DNA, 15 bp, Homo sapiens
ctgagtgtatgatgg

SEQ ID NO: 64733 - DNA, 15 bp, Homo sapiens
tgagtgtatgatggc

SEQ ID NO: 64734 - DNA, 15 bp, Homo sapiens
gagtgtatgatggcc

SEQ ID NO: 64735 - DNA, 15 bp, Homo sapiens
agtgtatgatggcct

SEQ ID NO: 64736 - DNA, 15 bp, Homo sapiens
gtgtatgatggcctg

SEQ ID NO: 64737 - DNA, 15 bp, Homo sapiens
tgtatgatggcctgg

SEQ ID NO: 64738 - DNA, 15 bp, Homo sapiens
gtatgatggcctggg

SEQ ID NO: 64739 - DNA, 15 bp, Homo sapiens
tatgatggcctgggg

SEQ ID NO: 64740 - DNA, 15 bp, Homo sapiens
atgatggcctggggc

SEQ ID NO: 64741 - DNA, 15 bp, Homo sapiens
tgatggcctggggcc

SEQ ID NO: 64742 - DNA, 15 bp, Homo sapiens
gatggcctggggcct

SEQ ID NO: 64743 - DNA, 15 bp, Homo sapiens
atggcctggggcctt

SEQ ID NO: 64744 - DNA, 15 bp, Homo sapiens
tggcctggggccttg

SEQ ID NO: 64745 - DNA, 15 bp, Homo sapiens
ggcctggggccttgc

SEQ ID NO: 64746 - DNA, 15 bp, Homo sapiens
gcctggggccttgca

SEQ ID NO: 64747 - DNA, 15 bp, Homo sapiens
cctggggccttgcat

SEQ ID NO: 64748 - DNA, 15 bp, Homo sapiens
ctggggccttgcatg

SEQ ID NO: 64749 - DNA, 15 bp, Homo sapiens
tggggccttgcatgt

SEQ ID NO: 64750 - DNA, 15 bp, Homo sapiens
ggggccttgcatgtg

SEQ ID NO: 64751 - DNA, 15 bp, Homo sapiens
gggccttgcatgtgg

SEQ ID NO: 64752 - DNA, 15 bp, Homo sapiens
ggccttgcatgtggt

SEQ ID NO: 64753 - DNA, 15 bp, Homo sapiens
gccttgcatgtggtg

SEQ ID NO: 64754 - DNA, 15 bp, Homo sapiens
ccttgcatgtggtgg

SEQ ID NO: 64755 - DNA, 15 bp, Homo sapiens
cttgcatgtggtggg

SEQ ID NO: 64756 - DNA, 15 bp, Homo sapiens
ttgcatgtggtgggg

SEQ ID NO: 64757 - DNA, 15 bp, Homo sapiens
tgcatgtggtggggg

SEQ ID NO: 64758 - DNA, 15 bp, Homo sapiens
gcatgtggtgggggt

SEQ ID NO: 64759 - DNA, 15 bp, Homo sapiens
catgtggtgggggtc

SEQ ID NO: 64760 - DNA, 15 bp, Homo sapiens
atgtggtgggggtcc

SEQ ID NO: 64761 - DNA, 15 bp, Homo sapiens
tgtggtgggggtcca

SEQ ID NO: 64762 - DNA, 15 bp, Homo sapiens
gtggtgggggtccaa

SEQ ID NO: 64763 - DNA, 15 bp, Homo sapiens
tggtgggggtccaag

SEQ ID NO: 64764 - DNA, 15 bp, Homo sapiens
ggtgggggtccaagc

SEQ ID NO: 64765 - DNA, 15 bp, Homo sapiens
gtgggggtccaagcc

SEQ ID NO: 64766 - DNA, 15 bp, Homo sapiens
tgggggtccaagcct

SEQ ID NO: 64767 - DNA, 15 bp, Homo sapiens
gggggtccaagcctg

SEQ ID NO: 64768 - DNA, 15 bp, Homo sapiens
ggggtccaagcctgc

SEQ ID NO: 64769 - DNA, 15 bp, Homo sapiens
gggtccaagcctgcc

SEQ ID NO: 64770 - DNA, 15 bp, Homo sapiens
ggtccaagcctgcct

SEQ ID NO: 64771 - DNA, 15 bp, Homo sapiens
gtccaagcctgcctc

SEQ ID NO: 64772 - DNA, 15 bp, Homo sapiens
tccaagcctgcctct

SEQ ID NO: 64773 - DNA, 15 bp, Homo sapiens
ccaagcctgcctctg

SEQ ID NO: 64774 - DNA, 15 bp, Homo sapiens
caagcctgcctctgc

SEQ ID NO: 64775 - DNA, 15 bp, Homo sapiens
aagcctgcctctgct

SEQ ID NO: 64776 - DNA, 15 bp, Homo sapiens
agcctgcctctgctc

SEQ ID NO: 64777 - DNA, 15 bp, Homo sapiens
gcctgcctctgctca

SEQ ID NO: 64778 - DNA, 15 bp, Homo sapiens
cctgcctctgctcac

SEQ ID NO: 64779 - DNA, 15 bp, Homo sapiens
ctgcctctgctcact

SEQ ID NO: 64780 - DNA, 15 bp, Homo sapiens
tgcctctgctcactt

SEQ ID NO: 64781 - DNA, 15 bp, Homo sapiens
gcctctgctcacttg

SEQ ID NO: 64782 - DNA, 15 bp, Homo sapiens
cctctgctcacttgt

SEQ ID NO: 64783 - DNA, 15 bp, Homo sapiens
ctctgctcacttgtt

SEQ ID NO: 64784 - DNA, 15 bp, Homo sapiens
tctgctcacttgttc

SEQ ID NO: 64785 - DNA, 15 bp, Homo sapiens
ctgctcacttgttct

SEQ ID NO: 64786 - DNA, 15 bp, Homo sapiens
tgctcacttgttctg

SEQ ID NO: 64787 - DNA, 15 bp, Homo sapiens
gctcacttgttctgc

SEQ ID NO: 64788 - DNA, 15 bp, Homo sapiens
ctcacttgttctgca

SEQ ID NO: 64789 - DNA, 15 bp, Homo sapiens
tcacttgttctgcag

SEQ ID NO: 64790 - DNA, 15 bp, Homo sapiens
cacttgttctgcaga

SEQ ID NO: 64791 - DNA, 15 bp, Homo sapiens
acttgttctgcagac

SEQ ID NO: 64792 - DNA, 15 bp, Homo sapiens
cttgttctgcagact

SEQ ID NO: 64793 - DNA, 15 bp, Homo sapiens
ttgttctgcagactg

SEQ ID NO: 64794 - DNA, 15 bp, Homo sapiens
tgttctgcagactgg

SEQ ID NO: 64795 - DNA, 15 bp, Homo sapiens
gttctgcagactggc

SEQ ID NO: 64796 - DNA, 15 bp, Homo sapiens
ttctgcagactggca

SEQ ID NO: 64797 - DNA, 15 bp, Homo sapiens
tctgcagactggcat

SEQ ID NO: 64798 - DNA, 15 bp, Homo sapiens
ctgcagactggcatg

SEQ ID NO: 64799 - DNA, 15 bp, Homo sapiens
tgcagactggcatgt

SEQ ID NO: 64800 - DNA, 15 bp, Homo sapiens
gcagactggcatgtt

SEQ ID NO: 64801 - DNA, 15 bp, Homo sapiens
cagactggcatgttc

SEQ ID NO: 64802 - DNA, 15 bp, Homo sapiens
agactggcatgttct

SEQ ID NO: 64803 - DNA, 15 bp, Homo sapiens
gactggcatgttctc

SEQ ID NO: 64804 - DNA, 15 bp, Homo sapiens
actggcatgttctct

SEQ ID NO: 64805 - DNA, 15 bp, Homo sapiens
ctggcatgttctctg

SEQ ID NO: 64806 - DNA, 15 bp, Homo sapiens
tggcatgttctctgt

SEQ ID NO: 64807 - DNA, 15 bp, Homo sapiens
ggcatgttctctgtg

SEQ ID NO: 64808 - DNA, 15 bp, Homo sapiens
gcatgttctctgtga

SEQ ID NO: 64809 - DNA, 15 bp, Homo sapiens
catgttctctgtgat

SEQ ID NO: 64810 - DNA, 15 bp, Homo sapiens
atgttctctgtgata

SEQ ID NO: 64811 - DNA, 15 bp, Homo sapiens
tgttctctgtgatac

SEQ ID NO: 64812 - DNA, 15 bp, Homo sapiens
gttctctgtgatact

SEQ ID NO: 64813 - DNA, 15 bp, Homo sapiens
ttctctgtgatactt

SEQ ID NO: 64814 - DNA, 15 bp, Homo sapiens
tctctgtgatactta

SEQ ID NO: 64815 - DNA, 15 bp, Homo sapiens
ctctgtgatacttac

SEQ ID NO: 64816 - DNA, 15 bp, Homo sapiens
tctgtgatacttaca

SEQ ID NO: 64817 - DNA, 15 bp, Homo sapiens
ctgtgatacttacat

SEQ ID NO: 64818 - DNA, 15 bp, Homo sapiens
tgtgatacttacata

SEQ ID NO: 64819 - DNA, 15 bp, Homo sapiens
gtgatacttacatac

SEQ ID NO: 64820 - DNA, 15 bp, Homo sapiens
tgatacttacatact

SEQ ID NO: 64821 - DNA, 15 bp, Homo sapiens
gatacttacatactt

SEQ ID NO: 64822 - DNA, 15 bp, Homo sapiens
atacttacatacttg

SEQ ID NO: 64823 - DNA, 15 bp, Homo sapiens
tacttacatacttgt

SEQ ID NO: 64824 - DNA, 15 bp, Homo sapiens
acttacatacttgtt

SEQ ID NO: 64825 - DNA, 15 bp, Homo sapiens
cttacatacttgttt

SEQ ID NO: 64826 - DNA, 15 bp, Homo sapiens
ttacatacttgttta

SEQ ID NO: 64827 - DNA, 15 bp, Homo sapiens
tacatacttgtttaa

SEQ ID NO: 64828 - DNA, 15 bp, Homo sapiens
acatacttgtttaac

SEQ ID NO: 64829 - DNA, 15 bp, Homo sapiens
catacttgtttaaca

SEQ ID NO: 64830 - DNA, 15 bp, Homo sapiens
atacttgtttaacac

SEQ ID NO: 64831 - DNA, 15 bp, Homo sapiens
tacttgtttaacact

SEQ ID NO: 64832 - DNA, 15 bp, Homo sapiens
acttgtttaacactt

SEQ ID NO: 64833 - DNA, 15 bp, Homo sapiens
cttgtttaacacttc

SEQ ID NO: 64834 - DNA, 15 bp, Homo sapiens
ttgtttaacacttca

SEQ ID NO: 64835 - DNA, 15 bp, Homo sapiens
tgtttaacacttcag

SEQ ID NO: 64836 - DNA, 15 bp, Homo sapiens
gtttaacacttcagg

SEQ ID NO: 64837 - DNA, 15 bp, Homo sapiens
tttaacacttcaggg

SEQ ID NO: 64838 - DNA, 15 bp, Homo sapiens
ttaacacttcaggga

SEQ ID NO: 64839 - DNA, 15 bp, Homo sapiens
taacacttcagggaa

SEQ ID NO: 64840 - DNA, 15 bp, Homo sapiens
aacacttcagggaag

SEQ ID NO: 64841 - DNA, 15 bp, Homo sapiens
acacttcagggaaga

SEQ ID NO: 64842 - DNA, 15 bp, Homo sapiens
cacttcagggaagaa

SEQ ID NO: 64843 - DNA, 15 bp, Homo sapiens
acttcagggaagaaa

SEQ ID NO: 64844 - DNA, 15 bp, Homo sapiens
cttcagggaagaaaa

SEQ ID NO: 64845 - DNA, 15 bp, Homo sapiens
ttcagggaagaaaag

SEQ ID NO: 64846 - DNA, 15 bp, Homo sapiens
tcagggaagaaaagt

SEQ ID NO: 64847 - DNA, 15 bp, Homo sapiens
cagggaagaaaagtc

SEQ ID NO: 64848 - DNA, 15 bp, Homo sapiens
agggaagaaaagtca

SEQ ID NO: 64849 - DNA, 15 bp, Homo sapiens
gggaagaaaagtcag

SEQ ID NO: 64850 - DNA, 15 bp, Homo sapiens
ggaagaaaagtcaga

SEQ ID NO: 64851 - DNA, 15 bp, Homo sapiens
gaagaaaagtcagaa

SEQ ID NO: 64852 - DNA, 15 bp, Homo sapiens
aagaaaagtcagaag

SEQ ID NO: 64853 - DNA, 15 bp, Homo sapiens
agaaaagtcagaaga

SEQ ID NO: 64854 - DNA, 15 bp, Homo sapiens
gaaaagtcagaagac

SEQ ID NO: 64855 - DNA, 15 bp, Homo sapiens
aaaagtcagaagacc

SEQ ID NO: 64856 - DNA, 15 bp, Homo sapiens
aaagtcagaagacca

SEQ ID NO: 64857 - DNA, 15 bp, Homo sapiens
aagtcagaagaccag

SEQ ID NO: 64858 - DNA, 15 bp, Homo sapiens
agtcagaagaccagg

SEQ ID NO: 64859 - DNA, 15 bp, Homo sapiens
gtcagaagaccagga

SEQ ID NO: 64860 - DNA, 15 bp, Homo sapiens
tcagaagaccaggac

SEQ ID NO: 64861 - DNA, 15 bp, Homo sapiens
cagaagaccaggacc

SEQ ID NO: 64862 - DNA, 15 bp, Homo sapiens
agaagaccaggacct

SEQ ID NO: 64863 - DNA, 15 bp, Homo sapiens
gaagaccaggacctc

SEQ ID NO: 64864 - DNA, 15 bp, Homo sapiens
aagaccaggacctcc

SEQ ID NO: 64865 - DNA, 15 bp, Homo sapiens
agaccaggacctcca

SEQ ID NO: 64866 - DNA, 15 bp, Homo sapiens
gaccaggacctccag

SEQ ID NO: 64867 - DNA, 15 bp, Homo sapiens
accaggacctccagg

SEQ ID NO: 64868 - DNA, 15 bp, Homo sapiens
ccaggacctccaggg

SEQ ID NO: 64869 - DNA, 15 bp, Homo sapiens
caggacctccagggc

SEQ ID NO: 64870 - DNA, 15 bp, Homo sapiens
aggacctccagggcc

SEQ ID NO: 64871 - DNA, 15 bp, Homo sapiens
ggacctccagggcct

SEQ ID NO: 64872 - DNA, 15 bp, Homo sapiens
gacctccagggcctc

SEQ ID NO: 64873 - DNA, 15 bp, Homo sapiens
acctccagggcctca

SEQ ID NO: 64874 - DNA, 15 bp, Homo sapiens
cctccagggcctcaa

SEQ ID NO: 64875 - DNA, 15 bp, Homo sapiens
ctccagggcctcaag

SEQ ID NO: 64876 - DNA, 15 bp, Homo sapiens
tccagggcctcaagg

SEQ ID NO: 64877 - DNA, 15 bp, Homo sapiens
ccagggcctcaagga

SEQ ID NO: 64878 - DNA, 15 bp, Homo sapiens
cagggcctcaaggac

SEQ ID NO: 64879 - DNA, 15 bp, Homo sapiens
agggcctcaaggaca

SEQ ID NO: 64880 - DNA, 15 bp, Homo sapiens
gggcctcaaggacaa

SEQ ID NO: 64881 - DNA, 15 bp, Homo sapiens
ggcctcaaggacaaa

SEQ ID NO: 64882 - DNA, 15 bp, Homo sapiens
gcctcaaggacaaac

SEQ ID NO: 64883 - DNA, 15 bp, Homo sapiens
cctcaaggacaaacc

SEQ ID NO: 64884 - DNA, 15 bp, Homo sapiens
ctcaaggacaaaccc

SEQ ID NO: 64885 - DNA, 15 bp, Homo sapiens
tcaaggacaaacccc

SEQ ID NO: 64886 - DNA, 15 bp, Homo sapiens
caaggacaaacccct

SEQ ID NO: 64887 - DNA, 15 bp, Homo sapiens
aaggacaaacccctc

SEQ ID NO: 64888 - DNA, 15 bp, Homo sapiens
aggacaaacccctca

SEQ ID NO: 64889 - DNA, 15 bp, Homo sapiens
ggacaaacccctcaa

SEQ ID NO: 64890 - DNA, 15 bp, Homo sapiens
gacaaacccctcaag

SEQ ID NO: 64891 - DNA, 15 bp, Homo sapiens
acaaacccctcaagt

SEQ ID NO: 64892 - DNA, 15 bp, Homo sapiens
caaacccctcaagtt

SEQ ID NO: 64893 - DNA, 15 bp, Homo sapiens
aaacccctcaagttt

SEQ ID NO: 64894 - DNA, 15 bp, Homo sapiens
aacccctcaagttta

SEQ ID NO: 64895 - DNA, 15 bp, Homo sapiens
acccctcaagtttaa

SEQ ID NO: 64896 - DNA, 15 bp, Homo sapiens
cccctcaagtttaaa

SEQ ID NO: 64897 - DNA, 15 bp, Homo sapiens
ccctcaagtttaaaa

SEQ ID NO: 64898 - DNA, 15 bp, Homo sapiens
cctcaagtttaaaaa

SEQ ID NO: 64899 - DNA, 15 bp, Homo sapiens
ctcaagtttaaaaag

SEQ ID NO: 64900 - DNA, 15 bp, Homo sapiens
tcaagtttaaaaagg

SEQ ID NO: 64901 - DNA, 15 bp, Homo sapiens
caagtttaaaaaggt

SEQ ID NO: 64902 - DNA, 15 bp, Homo sapiens
aagtttaaaaaggtg

SEQ ID NO: 64903 - DNA, 15 bp, Homo sapiens
agtttaaaaaggtga

SEQ ID NO: 64904 - DNA, 15 bp, Homo sapiens
gtttaaaaaggtgaa

SEQ ID NO: 64905 - DNA, 15 bp, Homo sapiens
tttaaaaaggtgaag

SEQ ID NO: 64906 - DNA, 15 bp, Homo sapiens
ttaaaaaggtgaaga

SEQ ID NO: 64907 - DNA, 15 bp, Homo sapiens
taaaaaggtgaagaa

SEQ ID NO: 64908 - DNA, 15 bp, Homo sapiens
aaaaaggtgaagaaa

SEQ ID NO: 64909 - DNA, 15 bp, Homo sapiens
aaaaggtgaagaaag

SEQ ID NO: 64910 - DNA, 15 bp, Homo sapiens
aaaggtgaagaaaga

SEQ ID NO: 64911 - DNA, 15 bp, Homo sapiens
aaggtgaagaaagat

SEQ ID NO: 64912 - DNA, 15 bp, Homo sapiens
aggtgaagaaagata

SEQ ID NO: 64913 - DNA, 15 bp, Homo sapiens
ggtgaagaaagataa

SEQ ID NO: 64914 - DNA, 15 bp, Homo sapiens
gtgaagaaagataag

SEQ ID NO: 64915 - DNA, 15 bp, Homo sapiens
tgaagaaagataaga

SEQ ID NO: 64916 - DNA, 15 bp, Homo sapiens
gaagaaagataagaa

SEQ ID NO: 64917 - DNA, 15 bp, Homo sapiens
aagaaagataagaaa

SEQ ID NO: 64918 - DNA, 15 bp, Homo sapiens
agaaagataagaaag

SEQ ID NO: 64919 - DNA, 15 bp, Homo sapiens
gaaagataagaaaga

SEQ ID NO: 64920 - DNA, 15 bp, Homo sapiens
aaagataagaaagaa

SEQ ID NO: 64921 - DNA, 15 bp, Homo sapiens
aagataagaaagaag

SEQ ID NO: 64922 - DNA, 15 bp, Homo sapiens
agataagaaagaaga

SEQ ID NO: 64923 - DNA, 15 bp, Homo sapiens
gataagaaagaagag

SEQ ID NO: 64924 - DNA, 15 bp, Homo sapiens
ataagaaagaagaga

SEQ ID NO: 64925 - DNA, 15 bp, Homo sapiens
taagaaagaagagaa

SEQ ID NO: 64926 - DNA, 15 bp, Homo sapiens
aagaaagaagagaaa

SEQ ID NO: 64927 - DNA, 15 bp, Homo sapiens
agaaagaagagaaag

SEQ ID NO: 64928 - DNA, 15 bp, Homo sapiens
gaaagaagagaaaga

SEQ ID NO: 64929 - DNA, 15 bp, Homo sapiens
aaagaagagaaagag

SEQ ID NO: 64930 - DNA, 15 bp, Homo sapiens
aagaagagaaagagg

SEQ ID NO: 64931 - DNA, 15 bp, Homo sapiens
agaagagaaagaggg

SEQ ID NO: 64932 - DNA, 15 bp, Homo sapiens
gaagagaaagagggc

SEQ ID NO: 64933 - DNA, 15 bp, Homo sapiens
aagagaaagagggca

SEQ ID NO: 64934 - DNA, 15 bp, Homo sapiens
agagaaagagggcaa

SEQ ID NO: 64935 - DNA, 15 bp, Homo sapiens
gagaaagagggcaag

SEQ ID NO: 64936 - DNA, 15 bp, Homo sapiens
agaaagagggcaagc

SEQ ID NO: 64937 - DNA, 15 bp, Homo sapiens
gaaagagggcaagca

SEQ ID NO: 64938 - DNA, 15 bp, Homo sapiens
aaagagggcaagcat

SEQ ID NO: 64939 - DNA, 15 bp, Homo sapiens
aagagggcaagcatg

SEQ ID NO: 64940 - DNA, 15 bp, Homo sapiens
agagggcaagcatga

SEQ ID NO: 64941 - DNA, 15 bp, Homo sapiens
gagggcaagcatgag

SEQ ID NO: 64942 - DNA, 15 bp, Homo sapiens
agggcaagcatgagc

SEQ ID NO: 64943 - DNA, 15 bp, Homo sapiens
gggcaagcatgagcc

SEQ ID NO: 64944 - DNA, 15 bp, Homo sapiens
ggcaagcatgagccc

SEQ ID NO: 64945 - DNA, 15 bp, Homo sapiens
gcaagcatgagcccg

SEQ ID NO: 64946 - DNA, 15 bp, Homo sapiens
caagcatgagcccgt

SEQ ID NO: 64947 - DNA, 15 bp, Homo sapiens
aagcatgagcccgtg

SEQ ID NO: 64948 - DNA, 15 bp, Homo sapiens
agcatgagcccgtgc

SEQ ID NO: 64949 - DNA, 15 bp, Homo sapiens
gcatgagcccgtgca

SEQ ID NO: 64950 - DNA, 15 bp, Homo sapiens
catgagcccgtgcag

SEQ ID NO: 64951 - DNA, 15 bp, Homo sapiens
atgagcccgtgcagc

SEQ ID NO: 64952 - DNA, 15 bp, Homo sapiens
tgagcccgtgcagcc

SEQ ID NO: 64953 - DNA, 15 bp, Homo sapiens
gagcccgtgcagcca

SEQ ID NO: 64954 - DNA, 15 bp, Homo sapiens
agcccgtgcagccat

SEQ ID NO: 64955 - DNA, 15 bp, Homo sapiens
gcccgtgcagccatc

SEQ ID NO: 64956 - DNA, 15 bp, Homo sapiens
cccgtgcagccatca

SEQ ID NO: 64957 - DNA, 15 bp, Homo sapiens
ccgtgcagccatcag

SEQ ID NO: 64958 - DNA, 15 bp, Homo sapiens
cgtgcagccatcagc

SEQ ID NO: 64959 - DNA, 15 bp, Homo sapiens
gtgcagccatcagcc

SEQ ID NO: 64960 - DNA, 15 bp, Homo sapiens
tgcagccatcagccc

SEQ ID NO: 64961 - DNA, 15 bp, Homo sapiens
gcagccatcagccca

SEQ ID NO: 64962 - DNA, 15 bp, Homo sapiens
cagccatcagcccac

SEQ ID NO: 64963 - DNA, 15 bp, Homo sapiens
agccatcagcccacc

SEQ ID NO: 64964 - DNA, 15 bp, Homo sapiens
gccatcagcccacca

SEQ ID NO: 64965 - DNA, 15 bp, Homo sapiens
ccatcagcccaccac

SEQ ID NO: 64966 - DNA, 15 bp, Homo sapiens
catcagcccaccact

SEQ ID NO: 64967 - DNA, 15 bp, Homo sapiens
atcagcccaccactc

SEQ ID NO: 64968 - DNA, 15 bp, Homo sapiens
tcagcccaccactct

SEQ ID NO: 64969 - DNA, 15 bp, Homo sapiens
cagcccaccactctg

SEQ ID NO: 64970 - DNA, 15 bp, Homo sapiens
agcccaccactctgc

SEQ ID NO: 64971 - DNA, 15 bp, Homo sapiens
gcccaccactctgct

SEQ ID NO: 64972 - DNA, 15 bp, Homo sapiens
cccaccactctgctg

SEQ ID NO: 64973 - DNA, 15 bp, Homo sapiens
ccaccactctgctga

SEQ ID NO: 64974 - DNA, 15 bp, Homo sapiens
caccactctgctgag

SEQ ID NO: 64975 - DNA, 15 bp, Homo sapiens
accactctgctgagc

SEQ ID NO: 64976 - DNA, 15 bp, Homo sapiens
ccactctgctgagcc

SEQ ID NO: 64977 - DNA, 15 bp, Homo sapiens
cactctgctgagccc

SEQ ID NO: 64978 - DNA, 15 bp, Homo sapiens
actctgctgagcccg

SEQ ID NO: 64979 - DNA, 15 bp, Homo sapiens
ctctgctgagcccgc

SEQ ID NO: 64980 - DNA, 15 bp, Homo sapiens
tctgctgagcccgca

SEQ ID NO: 64981 - DNA, 15 bp, Homo sapiens
ctgctgagcccgcag

SEQ ID NO: 64982 - DNA, 15 bp, Homo sapiens
tgctgagcccgcaga

SEQ ID NO: 64983 - DNA, 15 bp, Homo sapiens
gctgagcccgcagag

SEQ ID NO: 64984 - DNA, 15 bp, Homo sapiens
ctgagcccgcagagg

SEQ ID NO: 64985 - DNA, 15 bp, Homo sapiens
tgagcccgcagaggc

SEQ ID NO: 64986 - DNA, 15 bp, Homo sapiens
gagcccgcagaggca

SEQ ID NO: 64987 - DNA, 15 bp, Homo sapiens
agcccgcagaggcag

SEQ ID NO: 64988 - DNA, 15 bp, Homo sapiens
gcccgcagaggcagg

SEQ ID NO: 64989 - DNA, 15 bp, Homo sapiens
cccgcagaggcaggc

SEQ ID NO: 64990 - DNA, 15 bp, Homo sapiens
ccgcagaggcaggca

SEQ ID NO: 64991 - DNA, 15 bp, Homo sapiens
cgcagaggcaggcaa

SEQ ID NO: 64992 - DNA, 15 bp, Homo sapiens
gcagaggcaggcaaa

SEQ ID NO: 64993 - DNA, 15 bp, Homo sapiens
cagaggcaggcaaag

SEQ ID NO: 64994 - DNA, 15 bp, Homo sapiens
agaggcaggcaaagc

SEQ ID NO: 64995 - DNA, 15 bp, Homo sapiens
gaggcaggcaaagca

SEQ ID NO: 64996 - DNA, 15 bp, Homo sapiens
aggcaggcaaagcag

SEQ ID NO: 64997 - DNA, 15 bp, Homo sapiens
ggcaggcaaagcaga

SEQ ID NO: 64998 - DNA, 15 bp, Homo sapiens
gcaggcaaagcagag

SEQ ID NO: 64999 - DNA, 15 bp, Homo sapiens
caggcaaagcagaga

SEQ ID NO: 65000 - DNA, 15 bp, Homo sapiens
aggcaaagcagagac

SEQ ID NO: 65001 - DNA, 15 bp, Homo sapiens
ggcaaagcagagaca

SEQ ID NO: 65002 - DNA, 15 bp, Homo sapiens
gcaaagcagagacat

SEQ ID NO: 65003 - DNA, 15 bp, Homo sapiens
caaagcagagacatc

SEQ ID NO: 65004 - DNA, 15 bp, Homo sapiens
aaagcagagacatca

SEQ ID NO: 65005 - DNA, 15 bp, Homo sapiens
aagcagagacatcag

SEQ ID NO: 65006 - DNA, 15 bp, Homo sapiens
agcagagacatcaga

SEQ ID NO: 65007 - DNA, 15 bp, Homo sapiens
gcagagacatcagaa

SEQ ID NO: 65008 - DNA, 15 bp, Homo sapiens
cagagacatcagaag

SEQ ID NO: 65009 - DNA, 15 bp, Homo sapiens
agagacatcagaagg

SEQ ID NO: 65010 - DNA, 15 bp, Homo sapiens
gagacatcagaaggg

SEQ ID NO: 65011 - DNA, 15 bp, Homo sapiens
agacatcagaagggt

SEQ ID NO: 65012 - DNA, 15 bp, Homo sapiens
gacatcagaagggtc

SEQ ID NO: 65013 - DNA, 15 bp, Homo sapiens
acatcagaagggtca

SEQ ID NO: 65014 - DNA, 15 bp, Homo sapiens
catcagaagggtcag

SEQ ID NO: 65015 - DNA, 15 bp, Homo sapiens
atcagaagggtcagg

SEQ ID NO: 65016 - DNA, 15 bp, Homo sapiens
tcagaagggtcaggc

SEQ ID NO: 65017 - DNA, 15 bp, Homo sapiens
cagaagggtcaggct

SEQ ID NO: 65018 - DNA, 15 bp, Homo sapiens
agaagggtcaggctc

SEQ ID NO: 65019 - DNA, 15 bp, Homo sapiens
gaagggtcaggctcc

SEQ ID NO: 65020 - DNA, 15 bp, Homo sapiens
aagggtcaggctccg

SEQ ID NO: 65021 - DNA, 15 bp, Homo sapiens
agggtcaggctccgc

SEQ ID NO: 65022 - DNA, 15 bp, Homo sapiens
gggtcaggctccgcc

SEQ ID NO: 65023 - DNA, 15 bp, Homo sapiens
ggtcaggctccgccc

SEQ ID NO: 65024 - DNA, 15 bp, Homo sapiens
gtcaggctccgcccc

SEQ ID NO: 65025 - DNA, 15 bp, Homo sapiens
tcaggctccgccccg

SEQ ID NO: 65026 - DNA, 15 bp, Homo sapiens
caggctccgccccgg

SEQ ID NO: 65027 - DNA, 15 bp, Homo sapiens
aggctccgccccggc

SEQ ID NO: 65028 - DNA, 15 bp, Homo sapiens
ggctccgccccggct

SEQ ID NO: 65029 - DNA, 15 bp, Homo sapiens
gctccgccccggctg

SEQ ID NO: 65030 - DNA, 15 bp, Homo sapiens
ctccgccccggctgt

SEQ ID NO: 65031 - DNA, 15 bp, Homo sapiens
tccgccccggctgtg

SEQ ID NO: 65032 - DNA, 15 bp, Homo sapiens
ccgccccggctgtgc

SEQ ID NO: 65033 - DNA, 15 bp, Homo sapiens
cgccccggctgtgcc

SEQ ID NO: 65034 - DNA, 15 bp, Homo sapiens
gccccggctgtgccg

SEQ ID NO: 65035 - DNA, 15 bp, Homo sapiens
ccccggctgtgccgg

SEQ ID NO: 65036 - DNA, 15 bp, Homo sapiens
cccggctgtgccgga

SEQ ID NO: 65037 - DNA, 15 bp, Homo sapiens
ccggctgtgccggaa

SEQ ID NO: 65038 - DNA, 15 bp, Homo sapiens
cggctgtgccggaag

SEQ ID NO: 65039 - DNA, 15 bp, Homo sapiens
ggctgtgccggaagc

SEQ ID NO: 65040 - DNA, 15 bp, Homo sapiens
gctgtgccggaagct

SEQ ID NO: 65041 - DNA, 15 bp, Homo sapiens
ctgtgccggaagctt

SEQ ID NO: 65042 - DNA, 15 bp, Homo sapiens
tgtgccggaagcttc

SEQ ID NO: 65043 - DNA, 15 bp, Homo sapiens
gtgccggaagcttct

SEQ ID NO: 65044 - DNA, 15 bp, Homo sapiens
tgccggaagcttctg

SEQ ID NO: 65045 - DNA, 15 bp, Homo sapiens
gccggaagcttctgc

SEQ ID NO: 65046 - DNA, 15 bp, Homo sapiens
ccggaagcttctgcc

SEQ ID NO: 65047 - DNA, 15 bp, Homo sapiens
cggaagcttctgcct

SEQ ID NO: 65048 - DNA, 15 bp, Homo sapiens
ggaagcttctgcctc

SEQ ID NO: 65049 - DNA, 15 bp, Homo sapiens
gaagcttctgcctcc

SEQ ID NO: 65050 - DNA, 15 bp, Homo sapiens
aagcttctgcctccc

SEQ ID NO: 65051 - DNA, 15 bp, Homo sapiens
agcttctgcctcccc

SEQ ID NO: 65052 - DNA, 15 bp, Homo sapiens
gcttctgcctccccc

SEQ ID NO: 65053 - DNA, 15 bp, Homo sapiens
cttctgcctccccca

SEQ ID NO: 65054 - DNA, 15 bp, Homo sapiens
ttctgcctcccccaa

SEQ ID NO: 65055 - DNA, 15 bp, Homo sapiens
tctgcctcccccaaa

SEQ ID NO: 65056 - DNA, 15 bp, Homo sapiens
ctgcctcccccaaac

SEQ ID NO: 65057 - DNA, 15 bp, Homo sapiens
tgcctcccccaaaca

SEQ ID NO: 65058 - DNA, 15 bp, Homo sapiens
gcctcccccaaacag

SEQ ID NO: 65059 - DNA, 15 bp, Homo sapiens
cctcccccaaacagc

SEQ ID NO: 65060 - DNA, 15 bp, Homo sapiens
ctcccccaaacagcg

SEQ ID NO: 65061 - DNA, 15 bp, Homo sapiens
tcccccaaacagcgg

SEQ ID NO: 65062 - DNA, 15 bp, Homo sapiens
cccccaaacagcggc

SEQ ID NO: 65063 - DNA, 15 bp, Homo sapiens
ccccaaacagcggcg

SEQ ID NO: 65064 - DNA, 15 bp, Homo sapiens
cccaaacagcggcgc

SEQ ID NO: 65065 - DNA, 15 bp, Homo sapiens
ccaaacagcggcgct

SEQ ID NO: 65066 - DNA, 15 bp, Homo sapiens
caaacagcggcgctc

SEQ ID NO: 65067 - DNA, 15 bp, Homo sapiens
aaacagcggcgctcc

SEQ ID NO: 65068 - DNA, 15 bp, Homo sapiens
aacagcggcgctcca

SEQ ID NO: 65069 - DNA, 15 bp, Homo sapiens
acagcggcgctccat

SEQ ID NO: 65070 - DNA, 15 bp, Homo sapiens
cagcggcgctccatc

SEQ ID NO: 65071 - DNA, 15 bp, Homo sapiens
agcggcgctccatca

SEQ ID NO: 65072 - DNA, 15 bp, Homo sapiens
gcggcgctccatcat

SEQ ID NO: 65073 - DNA, 15 bp, Homo sapiens
cggcgctccatcatc

SEQ ID NO: 65074 - DNA, 15 bp, Homo sapiens
ggcgctccatcatcc

SEQ ID NO: 65075 - DNA, 15 bp, Homo sapiens
gcgctccatcatccg

SEQ ID NO: 65076 - DNA, 15 bp, Homo sapiens
cgctccatcatccgt

SEQ ID NO: 65077 - DNA, 15 bp, Homo sapiens
gctccatcatccgtg

SEQ ID NO: 65078 - DNA, 15 bp, Homo sapiens
ctccatcatccgtga

SEQ ID NO: 65079 - DNA, 15 bp, Homo sapiens
tccatcatccgtgac

SEQ ID NO: 65080 - DNA, 15 bp, Homo sapiens
ccatcatccgtgacc

SEQ ID NO: 65081 - DNA, 15 bp, Homo sapiens
catcatccgtgaccg

SEQ ID NO: 65082 - DNA, 15 bp, Homo sapiens
atcatccgtgaccgg

SEQ ID NO: 65083 - DNA, 15 bp, Homo sapiens
tcatccgtgaccggg

SEQ ID NO: 65084 - DNA, 15 bp, Homo sapiens
catccgtgaccgggg

SEQ ID NO: 65085 - DNA, 15 bp, Homo sapiens
atccgtgaccgggga

SEQ ID NO: 65086 - DNA, 15 bp, Homo sapiens
tccgtgaccggggac

SEQ ID NO: 65087 - DNA, 15 bp, Homo sapiens
ccgtgaccggggacc

SEQ ID NO: 65088 - DNA, 15 bp, Homo sapiens
cgtgaccggggaccc

SEQ ID NO: 65089 - DNA, 15 bp, Homo sapiens
gtgaccggggaccca

SEQ ID NO: 65090 - DNA, 15 bp, Homo sapiens
tgaccggggacccat

SEQ ID NO: 65091 - DNA, 15 bp, Homo sapiens
gaccggggacccatg

SEQ ID NO: 65092 - DNA, 15 bp, Homo sapiens
accggggacccatgt

SEQ ID NO: 65093 - DNA, 15 bp, Homo sapiens
ccggggacccatgta

SEQ ID NO: 65094 - DNA, 15 bp, Homo sapiens
cggggacccatgtat

SEQ ID NO: 65095 - DNA, 15 bp, Homo sapiens
ggggacccatgtatg

SEQ ID NO: 65096 - DNA, 15 bp, Homo sapiens
gggacccatgtatga

SEQ ID NO: 65097 - DNA, 15 bp, Homo sapiens
ggacccatgtatgat

SEQ ID NO: 65098 - DNA, 15 bp, Homo sapiens
gacccatgtatgatg

SEQ ID NO: 65099 - DNA, 15 bp, Homo sapiens
acccatgtatgatga

SEQ ID NO: 65100 - DNA, 15 bp, Homo sapiens
cccatgtatgatgac

SEQ ID NO: 65101 - DNA, 15 bp, Homo sapiens
ccatgtatgatgacc

SEQ ID NO: 65102 - DNA, 15 bp, Homo sapiens
catgtatgatgaccc

SEQ ID NO: 65103 - DNA, 15 bp, Homo sapiens
atgtatgatgacccc

SEQ ID NO: 65104 - DNA, 15 bp, Homo sapiens
tgtatgatgacccca

SEQ ID NO: 65105 - DNA, 15 bp, Homo sapiens
gtatgatgaccccac

SEQ ID NO: 65106 - DNA, 15 bp, Homo sapiens
tatgatgaccccacc

SEQ ID NO: 65107 - DNA, 15 bp, Homo sapiens
atgatgaccccaccc

SEQ ID NO: 65108 - DNA, 15 bp, Homo sapiens
tgatgaccccaccct

SEQ ID NO: 65109 - DNA, 15 bp, Homo sapiens
gatgaccccaccctg

SEQ ID NO: 65110 - DNA, 15 bp, Homo sapiens
atgaccccaccctgc

SEQ ID NO: 65111 - DNA, 15 bp, Homo sapiens
tgaccccaccctgcc

SEQ ID NO: 65112 - DNA, 15 bp, Homo sapiens
gaccccaccctgcct

SEQ ID NO: 65113 - DNA, 15 bp, Homo sapiens
accccaccctgcctg

SEQ ID NO: 65114 - DNA, 15 bp, Homo sapiens
ccccaccctgcctga

SEQ ID NO: 65115 - DNA, 15 bp, Homo sapiens
cccaccctgcctgaa

SEQ ID NO: 65116 - DNA, 15 bp, Homo sapiens
ccaccctgcctgaag

SEQ ID NO: 65117 - DNA, 15 bp, Homo sapiens
caccctgcctgaagg

SEQ ID NO: 65118 - DNA, 15 bp, Homo sapiens
accctgcctgaaggc

SEQ ID NO: 65119 - DNA, 15 bp, Homo sapiens
ccctgcctgaaggct

SEQ ID NO: 65120 - DNA, 15 bp, Homo sapiens
cctgcctgaaggctg

SEQ ID NO: 65121 - DNA, 15 bp, Homo sapiens
ctgcctgaaggctgg

SEQ ID NO: 65122 - DNA, 15 bp, Homo sapiens
tgcctgaaggctgga

SEQ ID NO: 65123 - DNA, 15 bp, Homo sapiens
gcctgaaggctggac

SEQ ID NO: 65124 - DNA, 15 bp, Homo sapiens
cctgaaggctggaca

SEQ ID NO: 65125 - DNA, 15 bp, Homo sapiens
ctgaaggctggacac

SEQ ID NO: 65126 - DNA, 15 bp, Homo sapiens
tgaaggctggacacg

SEQ ID NO: 65127 - DNA, 15 bp, Homo sapiens
gaaggctggacacgg

SEQ ID NO: 65128 - DNA, 15 bp, Homo sapiens
aaggctggacacgga

SEQ ID NO: 65129 - DNA, 15 bp, Homo sapiens
aggctggacacggaa

SEQ ID NO: 65130 - DNA, 15 bp, Homo sapiens
ggctggacacggaag

SEQ ID NO: 65131 - DNA, 15 bp, Homo sapiens
gctggacacggaagc

SEQ ID NO: 65132 - DNA, 15 bp, Homo sapiens
ctggacacggaagct

SEQ ID NO: 65133 - DNA, 15 bp, Homo sapiens
tggacacggaagctt

SEQ ID NO: 65134 - DNA, 15 bp, Homo sapiens
ggacacggaagctta

SEQ ID NO: 65135 - DNA, 15 bp, Homo sapiens
gacacggaagcttaa

SEQ ID NO: 65136 - DNA, 15 bp, Homo sapiens
acacggaagcttaag

SEQ ID NO: 65137 - DNA, 15 bp, Homo sapiens
cacggaagcttaagc

SEQ ID NO: 65138 - DNA, 15 bp, Homo sapiens
acggaagcttaagca

SEQ ID NO: 65139 - DNA, 15 bp, Homo sapiens
cggaagcttaagcaa

SEQ ID NO: 65140 - DNA, 15 bp, Homo sapiens
ggaagcttaagcaaa

SEQ ID NO: 65141 - DNA, 15 bp, Homo sapiens
gaagcttaagcaaag

SEQ ID NO: 65142 - DNA, 15 bp, Homo sapiens
aagcttaagcaaagg

SEQ ID NO: 65143 - DNA, 15 bp, Homo sapiens
agcttaagcaaagga

SEQ ID NO: 65144 - DNA, 15 bp, Homo sapiens
gcttaagcaaaggaa

SEQ ID NO: 65145 - DNA, 15 bp, Homo sapiens
cttaagcaaaggaaa

SEQ ID NO: 65146 - DNA, 15 bp, Homo sapiens
ttaagcaaaggaaat

SEQ ID NO: 65147 - DNA, 15 bp, Homo sapiens
taagcaaaggaaatc

SEQ ID NO: 65148 - DNA, 15 bp, Homo sapiens
aagcaaaggaaatct

SEQ ID NO: 65149 - DNA, 15 bp, Homo sapiens
agcaaaggaaatctg

SEQ ID NO: 65150 - DNA, 15 bp, Homo sapiens
gcaaaggaaatctgg

SEQ ID NO: 65151 - DNA, 15 bp, Homo sapiens
caaaggaaatctggc

SEQ ID NO: 65152 - DNA, 15 bp, Homo sapiens
aaaggaaatctggcc

SEQ ID NO: 65153 - DNA, 15 bp, Homo sapiens
aaggaaatctggccg

SEQ ID NO: 65154 - DNA, 15 bp, Homo sapiens
aggaaatctggccgc

SEQ ID NO: 65155 - DNA, 15 bp, Homo sapiens
ggaaatctggccgct

SEQ ID NO: 65156 - DNA, 15 bp, Homo sapiens
gaaatctggccgctc

SEQ ID NO: 65157 - DNA, 15 bp, Homo sapiens
aaatctggccgctct

SEQ ID NO: 65158 - DNA, 15 bp, Homo sapiens
aatctggccgctctg

SEQ ID NO: 65159 - DNA, 15 bp, Homo sapiens
atctggccgctctgc

SEQ ID NO: 65160 - DNA, 15 bp, Homo sapiens
tctggccgctctgct

SEQ ID NO: 65161 - DNA, 15 bp, Homo sapiens
ctggccgctctgctg

SEQ ID NO: 65162 - DNA, 15 bp, Homo sapiens
tggccgctctgctgg

SEQ ID NO: 65163 - DNA, 15 bp, Homo sapiens
ggccgctctgctggg

SEQ ID NO: 65164 - DNA, 15 bp, Homo sapiens
gccgctctgctggga

SEQ ID NO: 65165 - DNA, 15 bp, Homo sapiens
ccgctctgctgggaa

SEQ ID NO: 65166 - DNA, 15 bp, Homo sapiens
cgctctgctgggaag

SEQ ID NO: 65167 - DNA, 15 bp, Homo sapiens
gctctgctgggaagt

SEQ ID NO: 65168 - DNA, 15 bp, Homo sapiens
ctctgctgggaagta

SEQ ID NO: 65169 - DNA, 15 bp, Homo sapiens
tctgctgggaagtat

SEQ ID NO: 65170 - DNA, 15 bp, Homo sapiens
ctgctgggaagtatg

SEQ ID NO: 65171 - DNA, 15 bp, Homo sapiens
tgctgggaagtatga

SEQ ID NO: 65172 - DNA, 15 bp, Homo sapiens
gctgggaagtatgat

SEQ ID NO: 65173 - DNA, 15 bp, Homo sapiens
ctgggaagtatgatg

SEQ ID NO: 65174 - DNA, 15 bp, Homo sapiens
tgggaagtatgatgt

SEQ ID NO: 65175 - DNA, 15 bp, Homo sapiens
gggaagtatgatgtg

SEQ ID NO: 65176 - DNA, 15 bp, Homo sapiens
ggaagtatgatgtgt

SEQ ID NO: 65177 - DNA, 15 bp, Homo sapiens
gaagtatgatgtgta

SEQ ID NO: 65178 - DNA, 15 bp, Homo sapiens
aagtatgatgtgtat

SEQ ID NO: 65179 - DNA, 15 bp, Homo sapiens
agtatgatgtgtatt

SEQ ID NO: 65180 - DNA, 15 bp, Homo sapiens
gtatgatgtgtattt

SEQ ID NO: 65181 - DNA, 15 bp, Homo sapiens
tatgatgtgtatttg

SEQ ID NO: 65182 - DNA, 15 bp, Homo sapiens
atgatgtgtatttga

SEQ ID NO: 65183 - DNA, 15 bp, Homo sapiens
tgatgtgtatttgat

SEQ ID NO: 65184 - DNA, 15 bp, Homo sapiens
gatgtgtatttgatc

SEQ ID NO: 65185 - DNA, 15 bp, Homo sapiens
atgtgtatttgatca

SEQ ID NO: 65186 - DNA, 15 bp, Homo sapiens
tgtgtatttgatcaa

SEQ ID NO: 65187 - DNA, 15 bp, Homo sapiens
gtgtatttgatcaag

SEQ ID NO: 65188 - DNA, 15 bp, Homo sapiens
tgtatttgatcaagt

SEQ ID NO: 65189 - DNA, 15 bp, Homo sapiens
gtatttgatcaagta

SEQ ID NO: 65190 - DNA, 15 bp, Homo sapiens
tatttgatcaagtaa

SEQ ID NO: 65191 - DNA, 15 bp, Homo sapiens
atttgatcaagtaag

SEQ ID NO: 65192 - DNA, 15 bp, Homo sapiens
tttgatcaagtaagt

SEQ ID NO: 65193 - DNA, 15 bp, Homo sapiens
ttgatcaagtaagta

SEQ ID NO: 65194 - DNA, 15 bp, Homo sapiens
tgatcaagtaagtaa

SEQ ID NO: 65195 - DNA, 15 bp, Homo sapiens
gatcaagtaagtaag

SEQ ID NO: 65196 - DNA, 15 bp, Homo sapiens
atcaagtaagtaaga

SEQ ID NO: 65197 - DNA, 15 bp, Homo sapiens
tcaagtaagtaagag

SEQ ID NO: 65198 - DNA, 15 bp, Homo sapiens
caagtaagtaagagc

SEQ ID NO: 65199 - DNA, 15 bp, Homo sapiens
aagtaagtaagagca

SEQ ID NO: 65200 - DNA, 15 bp, Homo sapiens
agtaagtaagagcaa

SEQ ID NO: 65201 - DNA, 15 bp, Homo sapiens
gtaagtaagagcaac

SEQ ID NO: 65202 - DNA, 15 bp, Homo sapiens
taagtaagagcaact

SEQ ID NO: 65203 - DNA, 15 bp, Homo sapiens
aagtaagagcaactc

SEQ ID NO: 65204 - DNA, 15 bp, Homo sapiens
agtaagagcaactcc

SEQ ID NO: 65205 - DNA, 15 bp, Homo sapiens
gtaagagcaactcct

SEQ ID NO: 65206 - DNA, 15 bp, Homo sapiens
taagagcaactccta

SEQ ID NO: 65207 - DNA, 15 bp, Homo sapiens
aagagcaactcctat

SEQ ID NO: 65208 - DNA, 15 bp, Homo sapiens
agagcaactcctatc

SEQ ID NO: 65209 - DNA, 15 bp, Homo sapiens
gagcaactcctatct

SEQ ID NO: 65210 - DNA, 15 bp, Homo sapiens
agcaactcctatctc

SEQ ID NO: 65211 - DNA, 15 bp, Homo sapiens
gcaactcctatctct

SEQ ID NO: 65212 - DNA, 15 bp, Homo sapiens
caactcctatctcta

SEQ ID NO: 65213 - DNA, 15 bp, Homo sapiens
aactcctatctctac

SEQ ID NO: 65214 - DNA, 15 bp, Homo sapiens
actcctatctctaca

SEQ ID NO: 65215 - DNA, 15 bp, Homo sapiens
ctcctatctctacag

SEQ ID NO: 65216 - DNA, 15 bp, Homo sapiens
tcctatctctacagg

SEQ ID NO: 65217 - DNA, 15 bp, Homo sapiens
cctatctctacaggg

SEQ ID NO: 65218 - DNA, 15 bp, Homo sapiens
ctatctctacagggc

SEQ ID NO: 65219 - DNA, 15 bp, Homo sapiens
tatctctacagggca

SEQ ID NO: 65220 - DNA, 15 bp, Homo sapiens
atctctacagggcag

SEQ ID NO: 65221 - DNA, 15 bp, Homo sapiens
tctctacagggcagg

SEQ ID NO: 65222 - DNA, 15 bp, Homo sapiens
ctctacagggcaggg

SEQ ID NO: 65223 - DNA, 15 bp, Homo sapiens
tctacagggcaggga

SEQ ID NO: 65224 - DNA, 15 bp, Homo sapiens
ctacagggcagggag

SEQ ID NO: 65225 - DNA, 15 bp, Homo sapiens
tacagggcagggagg

SEQ ID NO: 65226 - DNA, 15 bp, Homo sapiens
acagggcagggaggg

SEQ ID NO: 65227 - DNA, 15 bp, Homo sapiens
cagggcagggagggc

SEQ ID NO: 65228 - DNA, 15 bp, Homo sapiens
agggcagggagggca

SEQ ID NO: 65229 - DNA, 15 bp, Homo sapiens
gggcagggagggcag

SEQ ID NO: 65230 - DNA, 15 bp, Homo sapiens
ggcagggagggcagg

SEQ ID NO: 65231 - DNA, 15 bp, Homo sapiens
gcagggagggcaggg

SEQ ID NO: 65232 - DNA, 15 bp, Homo sapiens
cagggagggcaggga

SEQ ID NO: 65233 - DNA, 15 bp, Homo sapiens
agggagggcagggac

SEQ ID NO: 65234 - DNA, 15 bp, Homo sapiens
gggagggcagggaca

SEQ ID NO: 65235 - DNA, 15 bp, Homo sapiens
ggagggcagggacaa

SEQ ID NO: 65236 - DNA, 15 bp, Homo sapiens
gagggcagggacaag

SEQ ID NO: 65237 - DNA, 15 bp, Homo sapiens
agggcagggacaagg

SEQ ID NO: 65238 - DNA, 15 bp, Homo sapiens
gggcagggacaagga

SEQ ID NO: 65239 - DNA, 15 bp, Homo sapiens
ggcagggacaaggat

SEQ ID NO: 65240 - DNA, 15 bp, Homo sapiens
gcagggacaaggatc

SEQ ID NO: 65241 - DNA, 15 bp, Homo sapiens
cagggacaaggatcc

SEQ ID NO: 65242 - DNA, 15 bp, Homo sapiens
agggacaaggatccc

SEQ ID NO: 65243 - DNA, 15 bp, Homo sapiens
gggacaaggatccct

SEQ ID NO: 65244 - DNA, 15 bp, Homo sapiens
ggacaaggatccctc

SEQ ID NO: 65245 - DNA, 15 bp, Homo sapiens
gacaaggatccctca

SEQ ID NO: 65246 - DNA, 15 bp, Homo sapiens
acaaggatccctcat

SEQ ID NO: 65247 - DNA, 15 bp, Homo sapiens
caaggatccctcatg

SEQ ID NO: 65248 - DNA, 15 bp, Homo sapiens
aaggatccctcatgg

SEQ ID NO: 65249 - DNA, 15 bp, Homo sapiens
aggatccctcatgga

SEQ ID NO: 65250 - DNA, 15 bp, Homo sapiens
ggatccctcatggag

SEQ ID NO: 65251 - DNA, 15 bp, Homo sapiens
gatccctcatggagc

SEQ ID NO: 65252 - DNA, 15 bp, Homo sapiens
atccctcatggagca

SEQ ID NO: 65253 - DNA, 15 bp, Homo sapiens
tccctcatggagcag

SEQ ID NO: 65254 - DNA, 15 bp, Homo sapiens
ccctcatggagcagg

SEQ ID NO: 65255 - DNA, 15 bp, Homo sapiens
cctcatggagcagga

SEQ ID NO: 65256 - DNA, 15 bp, Homo sapiens
ctcatggagcaggaa

SEQ ID NO: 65257 - DNA, 15 bp, Homo sapiens
tcatggagcaggaaa

SEQ ID NO: 65258 - DNA, 15 bp, Homo sapiens
catggagcaggaaaa

SEQ ID NO: 65259 - DNA, 15 bp, Homo sapiens
atggagcaggaaaat

SEQ ID NO: 65260 - DNA, 15 bp, Homo sapiens
tggagcaggaaaatg

SEQ ID NO: 65261 - DNA, 15 bp, Homo sapiens
ggagcaggaaaatgt

SEQ ID NO: 65262 - DNA, 15 bp, Homo sapiens
gagcaggaaaatgta

SEQ ID NO: 65263 - DNA, 15 bp, Homo sapiens
agcaggaaaatgtat

SEQ ID NO: 65264 - DNA, 15 bp, Homo sapiens
gcaggaaaatgtatg

SEQ ID NO: 65265 - DNA, 15 bp, Homo sapiens
caggaaaatgtatgt

SEQ ID NO: 65266 - DNA, 15 bp, Homo sapiens
aggaaaatgtatgtg

SEQ ID NO: 65267 - DNA, 15 bp, Homo sapiens
ggaaaatgtatgtgc

SEQ ID NO: 65268 - DNA, 15 bp, Homo sapiens
gaaaatgtatgtgcc

SEQ ID NO: 65269 - DNA, 15 bp, Homo sapiens
aaaatgtatgtgccc

SEQ ID NO: 65270 - DNA, 15 bp, Homo sapiens
aaatgtatgtgccca

SEQ ID NO: 65271 - DNA, 15 bp, Homo sapiens
aatgtatgtgcccag

SEQ ID NO: 65272 - DNA, 15 bp, Homo sapiens
atgtatgtgcccagg

SEQ ID NO: 65273 - DNA, 15 bp, Homo sapiens
tgtatgtgcccaggg

SEQ ID NO: 65274 - DNA, 15 bp, Homo sapiens
gtatgtgcccagggt

SEQ ID NO: 65275 - DNA, 15 bp, Homo sapiens
tatgtgcccagggtg

SEQ ID NO: 65276 - DNA, 15 bp, Homo sapiens
atgtgcccagggtgg

SEQ ID NO: 65277 - DNA, 15 bp, Homo sapiens
tgtgcccagggtggg

SEQ ID NO: 65278 - DNA, 15 bp, Homo sapiens
gtgcccagggtgggg

SEQ ID NO: 65279 - DNA, 15 bp, Homo sapiens
tgcccagggtggggt

SEQ ID NO: 65280 - DNA, 15 bp, Homo sapiens
gcccagggtggggtc

SEQ ID NO: 65281 - DNA, 15 bp, Homo sapiens
cccagggtggggtcg

SEQ ID NO: 65282 - DNA, 15 bp, Homo sapiens
ccagggtggggtcgg

SEQ ID NO: 65283 - DNA, 15 bp, Homo sapiens
cagggtggggtcggg

SEQ ID NO: 65284 - DNA, 15 bp, Homo sapiens
agggtggggtcgggg

SEQ ID NO: 65285 - DNA, 15 bp, Homo sapiens
gggtggggtcggggg

SEQ ID NO: 65286 - DNA, 15 bp, Homo sapiens
ggtggggtcgggggg

SEQ ID NO: 65287 - DNA, 15 bp, Homo sapiens
gtggggtcgggggga

SEQ ID NO: 65288 - DNA, 15 bp, Homo sapiens
tggggtcggggggaa

SEQ ID NO: 65289 - DNA, 15 bp, Homo sapiens
ggggtcggggggaac

SEQ ID NO: 65290 - DNA, 15 bp, Homo sapiens
gggtcggggggaaca

SEQ ID NO: 65291 - DNA, 15 bp, Homo sapiens
ggtcggggggaacat

SEQ ID NO: 65292 - DNA, 15 bp, Homo sapiens
gtcggggggaacata

SEQ ID NO: 65293 - DNA, 15 bp, Homo sapiens
tcggggggaacataa

SEQ ID NO: 65294 - DNA, 15 bp, Homo sapiens
cggggggaacataaa

SEQ ID NO: 65295 - DNA, 15 bp, Homo sapiens
ggggggaacataaac

SEQ ID NO: 65296 - DNA, 15 bp, Homo sapiens
gggggaacataaaca

SEQ ID NO: 65297 - DNA, 15 bp, Homo sapiens
ggggaacataaacaa

SEQ ID NO: 65298 - DNA, 15 bp, Homo sapiens
gggaacataaacaat

SEQ ID NO: 65299 - DNA, 15 bp, Homo sapiens
ggaacataaacaatg

SEQ ID NO: 65300 - DNA, 15 bp, Homo sapiens
gaacataaacaatga

SEQ ID NO: 65301 - DNA, 15 bp, Homo sapiens
aacataaacaatgaa

SEQ ID NO: 65302 - DNA, 15 bp, Homo sapiens
acataaacaatgaac

SEQ ID NO: 65303 - DNA, 15 bp, Homo sapiens
cataaacaatgaaca

SEQ ID NO: 65304 - DNA, 15 bp, Homo sapiens
ataaacaatgaacac

SEQ ID NO: 65305 - DNA, 15 bp, Homo sapiens
taaacaatgaacact

SEQ ID NO: 65306 - DNA, 15 bp, Homo sapiens
aaacaatgaacactg

SEQ ID NO: 65307 - DNA, 15 bp, Homo sapiens
aacaatgaacactga

SEQ ID NO: 65308 - DNA, 15 bp, Homo sapiens
acaatgaacactgag

SEQ ID NO: 65309 - DNA, 15 bp, Homo sapiens
caatgaacactgaga

SEQ ID NO: 65310 - DNA, 15 bp, Homo sapiens
aatgaacactgagac

SEQ ID NO: 65311 - DNA, 15 bp, Homo sapiens
atgaacactgagacc

SEQ ID NO: 65312 - DNA, 15 bp, Homo sapiens
tgaacactgagacca

SEQ ID NO: 65313 - DNA, 15 bp, Homo sapiens
gaacactgagaccag

SEQ ID NO: 65314 - DNA, 15 bp, Homo sapiens
aacactgagaccagg

SEQ ID NO: 65315 - DNA, 15 bp, Homo sapiens
acactgagaccaggt

SEQ ID NO: 65316 - DNA, 15 bp, Homo sapiens
cactgagaccaggtg

SEQ ID NO: 65317 - DNA, 15 bp, Homo sapiens
actgagaccaggtgt

SEQ ID NO: 65318 - DNA, 15 bp, Homo sapiens
ctgagaccaggtgtg

SEQ ID NO: 65319 - DNA, 15 bp, Homo sapiens
tgagaccaggtgtgc

SEQ ID NO: 65320 - DNA, 15 bp, Homo sapiens
gagaccaggtgtgct

SEQ ID NO: 65321 - DNA, 15 bp, Homo sapiens
agaccaggtgtgctt

SEQ ID NO: 65322 - DNA, 15 bp, Homo sapiens
gaccaggtgtgcttg

SEQ ID NO: 65323 - DNA, 15 bp, Homo sapiens
accaggtgtgcttga

SEQ ID NO: 65324 - DNA, 15 bp, Homo sapiens
ccaggtgtgcttgaa

SEQ ID NO: 65325 - DNA, 15 bp, Homo sapiens
caggtgtgcttgaaa

SEQ ID NO: 65326 - DNA, 15 bp, Homo sapiens
aggtgtgcttgaaat

SEQ ID NO: 65327 - DNA, 15 bp, Homo sapiens
ggtgtgcttgaaatg

SEQ ID NO: 65328 - DNA, 15 bp, Homo sapiens
gtgtgcttgaaatga

SEQ ID NO: 65329 - DNA, 15 bp, Homo sapiens
tgtgcttgaaatgac

SEQ ID NO: 65330 - DNA, 15 bp, Homo sapiens
gtgcttgaaatgacc

SEQ ID NO: 65331 - DNA, 15 bp, Homo sapiens
tgcttgaaatgaccg

SEQ ID NO: 65332 - DNA, 15 bp, Homo sapiens
gcttgaaatgaccgt

SEQ ID NO: 65333 - DNA, 15 bp, Homo sapiens
cttgaaatgaccgtg

SEQ ID NO: 65334 - DNA, 15 bp, Homo sapiens
ttgaaatgaccgtgt

SEQ ID NO: 65335 - DNA, 15 bp, Homo sapiens
tgaaatgaccgtgta

SEQ ID NO: 65336 - DNA, 15 bp, Homo sapiens
gaaatgaccgtgtac

SEQ ID NO: 65337 - DNA, 15 bp, Homo sapiens
aaatgaccgtgtaca

SEQ ID NO: 65338 - DNA, 15 bp, Homo sapiens
aatgaccgtgtacag

SEQ ID NO: 65339 - DNA, 15 bp, Homo sapiens
atgaccgtgtacaga

SEQ ID NO: 65340 - DNA, 15 bp, Homo sapiens
tgaccgtgtacagag

SEQ ID NO: 65341 - DNA, 15 bp, Homo sapiens
gaccgtgtacagagg

SEQ ID NO: 65342 - DNA, 15 bp, Homo sapiens
accgtgtacagaggt

SEQ ID NO: 65343 - DNA, 15 bp, Homo sapiens
ccgtgtacagaggtc

SEQ ID NO: 65344 - DNA, 15 bp, Homo sapiens
cgtgtacagaggtcg

SEQ ID NO: 65345 - DNA, 15 bp, Homo sapiens
gtgtacagaggtcgc

SEQ ID NO: 65346 - DNA, 15 bp, Homo sapiens
tgtacagaggtcgct

SEQ ID NO: 65347 - DNA, 15 bp, Homo sapiens
gtacagaggtcgctg

SEQ ID NO: 65348 - DNA, 15 bp, Homo sapiens
tacagaggtcgctgc

SEQ ID NO: 65349 - DNA, 15 bp, Homo sapiens
acagaggtcgctgcc

SEQ ID NO: 65350 - DNA, 15 bp, Homo sapiens
cagaggtcgctgccc

SEQ ID NO: 65351 - DNA, 15 bp, Homo sapiens
agaggtcgctgccct

SEQ ID NO: 65352 - DNA, 15 bp, Homo sapiens
gaggtcgctgccctg

SEQ ID NO: 65353 - DNA, 15 bp, Homo sapiens
aggtcgctgccctga

SEQ ID NO: 65354 - DNA, 15 bp, Homo sapiens
ggtcgctgccctgag

SEQ ID NO: 65355 - DNA, 15 bp, Homo sapiens
gtcgctgccctgagt

SEQ ID NO: 65356 - DNA, 15 bp, Homo sapiens
tcgctgccctgagtg

SEQ ID NO: 65357 - DNA, 15 bp, Homo sapiens
cgctgccctgagtgg

SEQ ID NO: 65358 - DNA, 15 bp, Homo sapiens
gctgccctgagtggg

SEQ ID NO: 65359 - DNA, 15 bp, Homo sapiens
ctgccctgagtggga

SEQ ID NO: 65360 - DNA, 15 bp, Homo sapiens
tgccctgagtgggaa

SEQ ID NO: 65361 - DNA, 15 bp, Homo sapiens
gccctgagtgggaag

SEQ ID NO: 65362 - DNA, 15 bp, Homo sapiens
ccctgagtgggaagt

SEQ ID NO: 65363 - DNA, 15 bp, Homo sapiens
cctgagtgggaagtt

SEQ ID NO: 65364 - DNA, 15 bp, Homo sapiens
ctgagtgggaagttc

SEQ ID NO: 65365 - DNA, 15 bp, Homo sapiens
tgagtgggaagttct

SEQ ID NO: 65366 - DNA, 15 bp, Homo sapiens
gagtgggaagttctc

SEQ ID NO: 65367 - DNA, 15 bp, Homo sapiens
agtgggaagttctca

SEQ ID NO: 65368 - DNA, 15 bp, Homo sapiens
gtgggaagttctcaa

SEQ ID NO: 65369 - DNA, 15 bp, Homo sapiens
tgggaagttctcaag

SEQ ID NO: 65370 - DNA, 15 bp, Homo sapiens
gggaagttctcaagg

SEQ ID NO: 65371 - DNA, 15 bp, Homo sapiens
ggaagttctcaaggt

SEQ ID NO: 65372 - DNA, 15 bp, Homo sapiens
gaagttctcaaggta

SEQ ID NO: 65373 - DNA, 15 bp, Homo sapiens
aagttctcaaggtag

SEQ ID NO: 65374 - DNA, 15 bp, Homo sapiens
agttctcaaggtagc

SEQ ID NO: 65375 - DNA, 15 bp, Homo sapiens
gttctcaaggtagca

SEQ ID NO: 65376 - DNA, 15 bp, Homo sapiens
ttctcaaggtagcag

SEQ ID NO: 65377 - DNA, 15 bp, Homo sapiens
tctcaaggtagcagg

SEQ ID NO: 65378 - DNA, 15 bp, Homo sapiens
ctcaaggtagcaggc

SEQ ID NO: 65379 - DNA, 15 bp, Homo sapiens
tcaaggtagcaggcc

SEQ ID NO: 65380 - DNA, 15 bp, Homo sapiens
caaggtagcaggccc

SEQ ID NO: 65381 - DNA, 15 bp, Homo sapiens
aaggtagcaggccct

SEQ ID NO: 65382 - DNA, 15 bp, Homo sapiens
aggtagcaggccctc

SEQ ID NO: 65383 - DNA, 15 bp, Homo sapiens
ggtagcaggccctct

SEQ ID NO: 65384 - DNA, 15 bp, Homo sapiens
gtagcaggccctcta

SEQ ID NO: 65385 - DNA, 15 bp, Homo sapiens
tagcaggccctctat

SEQ ID NO: 65386 - DNA, 15 bp, Homo sapiens
agcaggccctctatc

SEQ ID NO: 65387 - DNA, 15 bp, Homo sapiens
gcaggccctctatcc

SEQ ID NO: 65388 - DNA, 15 bp, Homo sapiens
caggccctctatcct

SEQ ID NO: 65389 - DNA, 15 bp, Homo sapiens
aggccctctatcctc

SEQ ID NO: 65390 - DNA, 15 bp, Homo sapiens
ggccctctatcctct

SEQ ID NO: 65391 - DNA, 15 bp, Homo sapiens
gccctctatcctctc

SEQ ID NO: 65392 - DNA, 15 bp, Homo sapiens
ccctctatcctctcc

SEQ ID NO: 65393 - DNA, 15 bp, Homo sapiens
cctctatcctctcca

SEQ ID NO: 65394 - DNA, 15 bp, Homo sapiens
ctctatcctctccac

SEQ ID NO: 65395 - DNA, 15 bp, Homo sapiens
tctatcctctccaca

SEQ ID NO: 65396 - DNA, 15 bp, Homo sapiens
ctatcctctccacac

SEQ ID NO: 65397 - DNA, 15 bp, Homo sapiens
tatcctctccacacc

SEQ ID NO: 65398 - DNA, 15 bp, Homo sapiens
atcctctccacacct

SEQ ID NO: 65399 - DNA, 15 bp, Homo sapiens
tcctctccacacctc

SEQ ID NO: 65400 - DNA, 15 bp, Homo sapiens
cctctccacacctca

SEQ ID NO: 65401 - DNA, 15 bp, Homo sapiens
ctctccacacctcaa

SEQ ID NO: 65402 - DNA, 15 bp, Homo sapiens
tctccacacctcaag

SEQ ID NO: 65403 - DNA, 15 bp, Homo sapiens
ctccacacctcaagt

SEQ ID NO: 65404 - DNA, 15 bp, Homo sapiens
tccacacctcaagtc

SEQ ID NO: 65405 - DNA, 15 bp, Homo sapiens
ccacacctcaagtct

SEQ ID NO: 65406 - DNA, 15 bp, Homo sapiens
cacacctcaagtctt

SEQ ID NO: 65407 - DNA, 15 bp, Homo sapiens
acacctcaagtcttt

SEQ ID NO: 65408 - DNA, 15 bp, Homo sapiens
cacctcaagtcttta

SEQ ID NO: 65409 - DNA, 15 bp, Homo sapiens
acctcaagtctttat

SEQ ID NO: 65410 - DNA, 15 bp, Homo sapiens
cctcaagtctttatc

SEQ ID NO: 65411 - DNA, 15 bp, Homo sapiens
ctcaagtctttatct

SEQ ID NO: 65412 - DNA, 15 bp, Homo sapiens
tcaagtctttatctg

SEQ ID NO: 65413 - DNA, 15 bp, Homo sapiens
caagtctttatctgg

SEQ ID NO: 65414 - DNA, 15 bp, Homo sapiens
aagtctttatctggg

SEQ ID NO: 65415 - DNA, 15 bp, Homo sapiens
agtctttatctgggg

SEQ ID NO: 65416 - DNA, 15 bp, Homo sapiens
gtctttatctgggga

SEQ ID NO: 65417 - DNA, 15 bp, Homo sapiens
tctttatctggggat

SEQ ID NO: 65418 - DNA, 15 bp, Homo sapiens
ctttatctggggatg

SEQ ID NO: 65419 - DNA, 15 bp, Homo sapiens
tttatctggggatgg

SEQ ID NO: 65420 - DNA, 15 bp, Homo sapiens
ttatctggggatgga

SEQ ID NO: 65421 - DNA, 15 bp, Homo sapiens
tatctggggatggaa

SEQ ID NO: 65422 - DNA, 15 bp, Homo sapiens
atctggggatggaat

SEQ ID NO: 65423 - DNA, 15 bp, Homo sapiens
tctggggatggaata

SEQ ID NO: 65424 - DNA, 15 bp, Homo sapiens
ctggggatggaatag

SEQ ID NO: 65425 - DNA, 15 bp, Homo sapiens
tggggatggaatagc

SEQ ID NO: 65426 - DNA, 15 bp, Homo sapiens
ggggatggaatagct

SEQ ID NO: 65427 - DNA, 15 bp, Homo sapiens
gggatggaatagctg

SEQ ID NO: 65428 - DNA, 15 bp, Homo sapiens
ggatggaatagctgc

SEQ ID NO: 65429 - DNA, 15 bp, Homo sapiens
gatggaatagctgcg

SEQ ID NO: 65430 - DNA, 15 bp, Homo sapiens
atggaatagctgcgg

SEQ ID NO: 65431 - DNA, 15 bp, Homo sapiens
tggaatagctgcgga

SEQ ID NO: 65432 - DNA, 15 bp, Homo sapiens
ggaatagctgcggaa

SEQ ID NO: 65433 - DNA, 15 bp, Homo sapiens
gaatagctgcggaag

SEQ ID NO: 65434 - DNA, 15 bp, Homo sapiens
aatagctgcggaagc

SEQ ID NO: 65435 - DNA, 15 bp, Homo sapiens
atagctgcggaagca

SEQ ID NO: 65436 - DNA, 15 bp, Homo sapiens
tagctgcggaagcag

SEQ ID NO: 65437 - DNA, 15 bp, Homo sapiens
agctgcggaagcaga

SEQ ID NO: 65438 - DNA, 15 bp, Homo sapiens
gctgcggaagcagag

SEQ ID NO: 65439 - DNA, 15 bp, Homo sapiens
ctgcggaagcagagg

SEQ ID NO: 65440 - DNA, 15 bp, Homo sapiens
tgcggaagcagagga

SEQ ID NO: 65441 - DNA, 15 bp, Homo sapiens
gcggaagcagaggaa

SEQ ID NO: 65442 - DNA, 15 bp, Homo sapiens
cggaagcagaggaac

SEQ ID NO: 65443 - DNA, 15 bp, Homo sapiens
ggaagcagaggaact

SEQ ID NO: 65444 - DNA, 15 bp, Homo sapiens
gaagcagaggaactt

SEQ ID NO: 65445 - DNA, 15 bp, Homo sapiens
aagcagaggaacttg

SEQ ID NO: 65446 - DNA, 15 bp, Homo sapiens
agcagaggaacttgc

SEQ ID NO: 65447 - DNA, 15 bp, Homo sapiens
gcagaggaacttgca

SEQ ID NO: 65448 - DNA, 15 bp, Homo sapiens
cagaggaacttgcag

SEQ ID NO: 65449 - DNA, 15 bp, Homo sapiens
agaggaacttgcaga

SEQ ID NO: 65450 - DNA, 15 bp, Homo sapiens
gaggaacttgcagag

SEQ ID NO: 65451 - DNA, 15 bp, Homo sapiens
aggaacttgcagagc

SEQ ID NO: 65452 - DNA, 15 bp, Homo sapiens
ggaacttgcagagct

SEQ ID NO: 65453 - DNA, 15 bp, Homo sapiens
gaacttgcagagcta

SEQ ID NO: 65454 - DNA, 15 bp, Homo sapiens
aacttgcagagctag

SEQ ID NO: 65455 - DNA, 15 bp, Homo sapiens
acttgcagagctagg

SEQ ID NO: 65456 - DNA, 15 bp, Homo sapiens
cttgcagagctaggg

SEQ ID NO: 65457 - DNA, 15 bp, Homo sapiens
ttgcagagctagggg

SEQ ID NO: 65458 - DNA, 15 bp, Homo sapiens
tgcagagctaggggt

SEQ ID NO: 65459 - DNA, 15 bp, Homo sapiens
gcagagctaggggtt

SEQ ID NO: 65460 - DNA, 15 bp, Homo sapiens
cagagctaggggttc

SEQ ID NO: 65461 - DNA, 15 bp, Homo sapiens
agagctaggggttca

SEQ ID NO: 65462 - DNA, 15 bp, Homo sapiens
gagctaggggttcag

SEQ ID NO: 65463 - DNA, 15 bp, Homo sapiens
agctaggggttcaga

SEQ ID NO: 65464 - DNA, 15 bp, Homo sapiens
gctaggggttcagag

SEQ ID NO: 65465 - DNA, 15 bp, Homo sapiens
ctaggggttcagagg

SEQ ID NO: 65466 - DNA, 15 bp, Homo sapiens
taggggttcagaggg

SEQ ID NO: 65467 - DNA, 15 bp, Homo sapiens
aggggttcagagggg

SEQ ID NO: 65468 - DNA, 15 bp, Homo sapiens
ggggttcagaggggt

SEQ ID NO: 65469 - DNA, 15 bp, Homo sapiens
gggttcagaggggtg

SEQ ID NO: 65470 - DNA, 15 bp, Homo sapiens
ggttcagaggggtga

SEQ ID NO: 65471 - DNA, 15 bp, Homo sapiens
gttcagaggggtgaa

SEQ ID NO: 65472 - DNA, 15 bp, Homo sapiens
ttcagaggggtgaag

SEQ ID NO: 65473 - DNA, 15 bp, Homo sapiens
tcagaggggtgaaga

SEQ ID NO: 65474 - DNA, 15 bp, Homo sapiens
cagaggggtgaagaa

SEQ ID NO: 65475 - DNA, 15 bp, Homo sapiens
agaggggtgaagaag

SEQ ID NO: 65476 - DNA, 15 bp, Homo sapiens
gaggggtgaagaagc

SEQ ID NO: 65477 - DNA, 15 bp, Homo sapiens
aggggtgaagaagca

SEQ ID NO: 65478 - DNA, 15 bp, Homo sapiens
ggggtgaagaagcat

SEQ ID NO: 65479 - DNA, 15 bp, Homo sapiens
gggtgaagaagcatg

SEQ ID NO: 65480 - DNA, 15 bp, Homo sapiens
ggtgaagaagcatgt

SEQ ID NO: 65481 - DNA, 15 bp, Homo sapiens
gtgaagaagcatgtt

SEQ ID NO: 65482 - DNA, 15 bp, Homo sapiens
tgaagaagcatgttt

SEQ ID NO: 65483 - DNA, 15 bp, Homo sapiens
gaagaagcatgtttc

SEQ ID NO: 65484 - DNA, 15 bp, Homo sapiens
aagaagcatgtttca

SEQ ID NO: 65485 - DNA, 15 bp, Homo sapiens
agaagcatgtttcag

SEQ ID NO: 65486 - DNA, 15 bp, Homo sapiens
gaagcatgtttcagt

SEQ ID NO: 65487 - DNA, 15 bp, Homo sapiens
aagcatgtttcagtt

SEQ ID NO: 65488 - DNA, 15 bp, Homo sapiens
agcatgtttcagttc

SEQ ID NO: 65489 - DNA, 15 bp, Homo sapiens
gcatgtttcagttct

SEQ ID NO: 65490 - DNA, 15 bp, Homo sapiens
catgtttcagttctg

SEQ ID NO: 65491 - DNA, 15 bp, Homo sapiens
atgtttcagttctgc

SEQ ID NO: 65492 - DNA, 15 bp, Homo sapiens
tgtttcagttctgcc

SEQ ID NO: 65493 - DNA, 15 bp, Homo sapiens
gtttcagttctgcct

SEQ ID NO: 65494 - DNA, 15 bp, Homo sapiens
tttcagttctgcctt

SEQ ID NO: 65495 - DNA, 15 bp, Homo sapiens
ttcagttctgccttt

SEQ ID NO: 65496 - DNA, 15 bp, Homo sapiens
tcagttctgcctttt

SEQ ID NO: 65497 - DNA, 15 bp, Homo sapiens
cagttctgcctttta

SEQ ID NO: 65498 - DNA, 15 bp, Homo sapiens
agttctgccttttaa

SEQ ID NO: 65499 - DNA, 15 bp, Homo sapiens
gttctgccttttaaa

SEQ ID NO: 65500 - DNA, 15 bp, Homo sapiens
ttctgccttttaaat

SEQ ID NO: 65501 - DNA, 15 bp, Homo sapiens
tctgccttttaaatg

SEQ ID NO: 65502 - DNA, 15 bp, Homo sapiens
ctgccttttaaatga

SEQ ID NO: 65503 - DNA, 15 bp, Homo sapiens
tgccttttaaatgat

SEQ ID NO: 65504 - DNA, 15 bp, Homo sapiens
gccttttaaatgatc

SEQ ID NO: 65505 - DNA, 15 bp, Homo sapiens
ccttttaaatgatcc

SEQ ID NO: 65506 - DNA, 15 bp, Homo sapiens
cttttaaatgatccc

SEQ ID NO: 65507 - DNA, 15 bp, Homo sapiens
ttttaaatgatccca

SEQ ID NO: 65508 - DNA, 15 bp, Homo sapiens
tttaaatgatcccaa

SEQ ID NO: 65509 - DNA, 15 bp, Homo sapiens
ttaaatgatcccaaa

SEQ ID NO: 65510 - DNA, 15 bp, Homo sapiens
taaatgatcccaaaa

SEQ ID NO: 65511 - DNA, 15 bp, Homo sapiens
aaatgatcccaaaaa

SEQ ID NO: 65512 - DNA, 15 bp, Homo sapiens
aatgatcccaaaaag

SEQ ID NO: 65513 - DNA, 15 bp, Homo sapiens
atgatcccaaaaagg

SEQ ID NO: 65514 - DNA, 15 bp, Homo sapiens
tgatcccaaaaaggt

SEQ ID NO: 65515 - DNA, 15 bp, Homo sapiens
gatcccaaaaaggtt

SEQ ID NO: 65516 - DNA, 15 bp, Homo sapiens
atcccaaaaaggtta

SEQ ID NO: 65517 - DNA, 15 bp, Homo sapiens
tcccaaaaaggttag

SEQ ID NO: 65518 - DNA, 15 bp, Homo sapiens
cccaaaaaggttagc

SEQ ID NO: 65519 - DNA, 15 bp, Homo sapiens
ccaaaaaggttagca

SEQ ID NO: 65520 - DNA, 15 bp, Homo sapiens
caaaaaggttagcag

SEQ ID NO: 65521 - DNA, 15 bp, Homo sapiens
aaaaaggttagcagt

SEQ ID NO: 65522 - DNA, 15 bp, Homo sapiens
aaaaggttagcagtt

SEQ ID NO: 65523 - DNA, 15 bp, Homo sapiens
aaaggttagcagttt

SEQ ID NO: 65524 - DNA, 15 bp, Homo sapiens
aaggttagcagtttt

SEQ ID NO: 65525 - DNA, 15 bp, Homo sapiens
aggttagcagttttc

SEQ ID NO: 65526 - DNA, 15 bp, Homo sapiens
ggttagcagttttca

SEQ ID NO: 65527 - DNA, 15 bp, Homo sapiens
gttagcagttttcaa

SEQ ID NO: 65528 - DNA, 15 bp, Homo sapiens
ttagcagttttcaaa

SEQ ID NO: 65529 - DNA, 15 bp, Homo sapiens
tagcagttttcaaat

SEQ ID NO: 65530 - DNA, 15 bp, Homo sapiens
agcagttttcaaatg

SEQ ID NO: 65531 - DNA, 15 bp, Homo sapiens
gcagttttcaaatga

SEQ ID NO: 65532 - DNA, 15 bp, Homo sapiens
cagttttcaaatgac

SEQ ID NO: 65533 - DNA, 15 bp, Homo sapiens
agttttcaaatgaca

SEQ ID NO: 65534 - DNA, 15 bp, Homo sapiens
gttttcaaatgacat

SEQ ID NO: 65535 - DNA, 15 bp, Homo sapiens
ttttcaaatgacatt

SEQ ID NO: 65536 - DNA, 15 bp, Homo sapiens
tttcaaatgacattt

SEQ ID NO: 65537 - DNA, 15 bp, Homo sapiens
ttcaaatgacatttg

SEQ ID NO: 65538 - DNA, 15 bp, Homo sapiens
tcaaatgacatttgc

SEQ ID NO: 65539 - DNA, 15 bp, Homo sapiens
caaatgacatttgca

SEQ ID NO: 65540 - DNA, 15 bp, Homo sapiens
aaatgacatttgcag

SEQ ID NO: 65541 - DNA, 15 bp, Homo sapiens
aatgacatttgcaga

SEQ ID NO: 65542 - DNA, 15 bp, Homo sapiens
atgacatttgcagac

SEQ ID NO: 65543 - DNA, 15 bp, Homo sapiens
tgacatttgcagaca

SEQ ID NO: 65544 - DNA, 15 bp, Homo sapiens
gacatttgcagacag

SEQ ID NO: 65545 - DNA, 15 bp, Homo sapiens
acatttgcagacagc

SEQ ID NO: 65546 - DNA, 15 bp, Homo sapiens
catttgcagacagcc

SEQ ID NO: 65547 - DNA, 15 bp, Homo sapiens
atttgcagacagcct

SEQ ID NO: 65548 - DNA, 15 bp, Homo sapiens
tttgcagacagcctc

SEQ ID NO: 65549 - DNA, 15 bp, Homo sapiens
ttgcagacagcctca

SEQ ID NO: 65550 - DNA, 15 bp, Homo sapiens
tgcagacagcctcat

SEQ ID NO: 65551 - DNA, 15 bp, Homo sapiens
gcagacagcctcatt

SEQ ID NO: 65552 - DNA, 15 bp, Homo sapiens
cagacagcctcattt

SEQ ID NO: 65553 - DNA, 15 bp, Homo sapiens
agacagcctcattta

SEQ ID NO: 65554 - DNA, 15 bp, Homo sapiens
gacagcctcatttaa

SEQ ID NO: 65555 - DNA, 15 bp, Homo sapiens
acagcctcatttaat

SEQ ID NO: 65556 - DNA, 15 bp, Homo sapiens
cagcctcatttaatt

SEQ ID NO: 65557 - DNA, 15 bp, Homo sapiens
agcctcatttaattc

SEQ ID NO: 65558 - DNA, 15 bp, Homo sapiens
gcctcatttaattcc

SEQ ID NO: 65559 - DNA, 15 bp, Homo sapiens
cctcatttaattcca

SEQ ID NO: 65560 - DNA, 15 bp, Homo sapiens
ctcatttaattccat

SEQ ID NO: 65561 - DNA, 15 bp, Homo sapiens
tcatttaattccatg

SEQ ID NO: 65562 - DNA, 15 bp, Homo sapiens
catttaattccatga

SEQ ID NO: 65563 - DNA, 15 bp, Homo sapiens
atttaattccatgag

SEQ ID NO: 65564 - DNA, 15 bp, Homo sapiens
tttaattccatgaga

SEQ ID NO: 65565 - DNA, 15 bp, Homo sapiens
ttaattccatgagaa

SEQ ID NO: 65566 - DNA, 15 bp, Homo sapiens
taattccatgagaag

SEQ ID NO: 65567 - DNA, 15 bp, Homo sapiens
aattccatgagaagg

SEQ ID NO: 65568 - DNA, 15 bp, Homo sapiens
attccatgagaaggg

SEQ ID NO: 65569 - DNA, 15 bp, Homo sapiens
ttccatgagaagggt

SEQ ID NO: 65570 - DNA, 15 bp, Homo sapiens
tccatgagaagggtg

SEQ ID NO: 65571 - DNA, 15 bp, Homo sapiens
ccatgagaagggtga

SEQ ID NO: 65572 - DNA, 15 bp, Homo sapiens
catgagaagggtgag

SEQ ID NO: 65573 - DNA, 15 bp, Homo sapiens
atgagaagggtgagc

SEQ ID NO: 65574 - DNA, 15 bp, Homo sapiens
tgagaagggtgagca

SEQ ID NO: 65575 - DNA, 15 bp, Homo sapiens
gagaagggtgagcaa

SEQ ID NO: 65576 - DNA, 15 bp, Homo sapiens
agaagggtgagcaaa

SEQ ID NO: 65577 - DNA, 15 bp, Homo sapiens
gaagggtgagcaaag

SEQ ID NO: 65578 - DNA, 15 bp, Homo sapiens
aagggtgagcaaagg

SEQ ID NO: 65579 - DNA, 15 bp, Homo sapiens
agggtgagcaaagga

SEQ ID NO: 65580 - DNA, 15 bp, Homo sapiens
gggtgagcaaaggat

SEQ ID NO: 65581 - DNA, 15 bp, Homo sapiens
ggtgagcaaaggatt

SEQ ID NO: 65582 - DNA, 15 bp, Homo sapiens
gtgagcaaaggatta

SEQ ID NO: 65583 - DNA, 15 bp, Homo sapiens
tgagcaaaggattat

SEQ ID NO: 65584 - DNA, 15 bp, Homo sapiens
gagcaaaggattatc

SEQ ID NO: 65585 - DNA, 15 bp, Homo sapiens
agcaaaggattatct

SEQ ID NO: 65586 - DNA, 15 bp, Homo sapiens
gcaaaggattatctt

SEQ ID NO: 65587 - DNA, 15 bp, Homo sapiens
caaaggattatcttg

SEQ ID NO: 65588 - DNA, 15 bp, Homo sapiens
aaaggattatcttgt

SEQ ID NO: 65589 - DNA, 15 bp, Homo sapiens
aaggattatcttgtt

SEQ ID NO: 65590 - DNA, 15 bp, Homo sapiens
aggattatcttgttg

SEQ ID NO: 65591 - DNA, 15 bp, Homo sapiens
ggattatcttgttga

SEQ ID NO: 65592 - DNA, 15 bp, Homo sapiens
gattatcttgttgaa

SEQ ID NO: 65593 - DNA, 15 bp, Homo sapiens
attatcttgttgaaa

SEQ ID NO: 65594 - DNA, 15 bp, Homo sapiens
ttatcttgttgaaac

SEQ ID NO: 65595 - DNA, 15 bp, Homo sapiens
tatcttgttgaaact

SEQ ID NO: 65596 - DNA, 15 bp, Homo sapiens
atcttgttgaaactg

SEQ ID NO: 65597 - DNA, 15 bp, Homo sapiens
tcttgttgaaactga

SEQ ID NO: 65598 - DNA, 15 bp, Homo sapiens
cttgttgaaactgat

SEQ ID NO: 65599 - DNA, 15 bp, Homo sapiens
ttgttgaaactgatt

SEQ ID NO: 65600 - DNA, 15 bp, Homo sapiens
tgttgaaactgattc

SEQ ID NO: 65601 - DNA, 15 bp, Homo sapiens
gttgaaactgattcc

SEQ ID NO: 65602 - DNA, 15 bp, Homo sapiens
ttgaaactgattcct

SEQ ID NO: 65603 - DNA, 15 bp, Homo sapiens
tgaaactgattcctg

SEQ ID NO: 65604 - DNA, 15 bp, Homo sapiens
gaaactgattcctgg

SEQ ID NO: 65605 - DNA, 15 bp, Homo sapiens
aaactgattcctgga

SEQ ID NO: 65606 - DNA, 15 bp, Homo sapiens
aactgattcctggag

SEQ ID NO: 65607 - DNA, 15 bp, Homo sapiens
actgattcctggaga

SEQ ID NO: 65608 - DNA, 15 bp, Homo sapiens
ctgattcctggagag

SEQ ID NO: 65609 - DNA, 15 bp, Homo sapiens
tgattcctggagaga

SEQ ID NO: 65610 - DNA, 15 bp, Homo sapiens
gattcctggagagac

SEQ ID NO: 65611 - DNA, 15 bp, Homo sapiens
attcctggagagact

SEQ ID NO: 65612 - DNA, 15 bp, Homo sapiens
ttcctggagagactg

SEQ ID NO: 65613 - DNA, 15 bp, Homo sapiens
tcctggagagactga

SEQ ID NO: 65614 - DNA, 15 bp, Homo sapiens
cctggagagactgag

SEQ ID NO: 65615 - DNA, 15 bp, Homo sapiens
ctggagagactgagc

SEQ ID NO: 65616 - DNA, 15 bp, Homo sapiens
tggagagactgagca

SEQ ID NO: 65617 - DNA, 15 bp, Homo sapiens
ggagagactgagcac

SEQ ID NO: 65618 - DNA, 15 bp, Homo sapiens
gagagactgagcacc

SEQ ID NO: 65619 - DNA, 15 bp, Homo sapiens
agagactgagcaccg

SEQ ID NO: 65620 - DNA, 15 bp, Homo sapiens
gagactgagcaccgt

SEQ ID NO: 65621 - DNA, 15 bp, Homo sapiens
agactgagcaccgta

SEQ ID NO: 65622 - DNA, 15 bp, Homo sapiens
gactgagcaccgtac

SEQ ID NO: 65623 - DNA, 15 bp, Homo sapiens
actgagcaccgtacc

SEQ ID NO: 65624 - DNA, 15 bp, Homo sapiens
ctgagcaccgtacct

SEQ ID NO: 65625 - DNA, 15 bp, Homo sapiens
tgagcaccgtacctg

SEQ ID NO: 65626 - DNA, 15 bp, Homo sapiens
gagcaccgtacctga

SEQ ID NO: 65627 - DNA, 15 bp, Homo sapiens
agcaccgtacctgag

SEQ ID NO: 65628 - DNA, 15 bp, Homo sapiens
gcaccgtacctgagt

SEQ ID NO: 65629 - DNA, 15 bp, Homo sapiens
caccgtacctgagtt

SEQ ID NO: 65630 - DNA, 15 bp, Homo sapiens
accgtacctgagttc

SEQ ID NO: 65631 - DNA, 15 bp, Homo sapiens
ccgtacctgagttca

SEQ ID NO: 65632 - DNA, 15 bp, Homo sapiens
cgtacctgagttcaa

SEQ ID NO: 65633 - DNA, 15 bp, Homo sapiens
gtacctgagttcaaa

SEQ ID NO: 65634 - DNA, 15 bp, Homo sapiens
tacctgagttcaaac

SEQ ID NO: 65635 - DNA, 15 bp, Homo sapiens
acctgagttcaaact

SEQ ID NO: 65636 - DNA, 15 bp, Homo sapiens
cctgagttcaaactt

SEQ ID NO: 65637 - DNA, 15 bp, Homo sapiens
ctgagttcaaacttg

SEQ ID NO: 65638 - DNA, 15 bp, Homo sapiens
tgagttcaaacttgg

SEQ ID NO: 65639 - DNA, 15 bp, Homo sapiens
gagttcaaacttggg

SEQ ID NO: 65640 - DNA, 15 bp, Homo sapiens
agttcaaacttggga

SEQ ID NO: 65641 - DNA, 15 bp, Homo sapiens
gttcaaacttgggaa

SEQ ID NO: 65642 - DNA, 15 bp, Homo sapiens
ttcaaacttgggaat

SEQ ID NO: 65643 - DNA, 15 bp, Homo sapiens
tcaaacttgggaatg

SEQ ID NO: 65644 - DNA, 15 bp, Homo sapiens
caaacttgggaatgt

SEQ ID NO: 65645 - DNA, 15 bp, Homo sapiens
aaacttgggaatgtt

SEQ ID NO: 65646 - DNA, 15 bp, Homo sapiens
aacttgggaatgttc

SEQ ID NO: 65647 - DNA, 15 bp, Homo sapiens
acttgggaatgttct

SEQ ID NO: 65648 - DNA, 15 bp, Homo sapiens
cttgggaatgttcta

SEQ ID NO: 65649 - DNA, 15 bp, Homo sapiens
ttgggaatgttctag

SEQ ID NO: 65650 - DNA, 15 bp, Homo sapiens
tgggaatgttctaga

SEQ ID NO: 65651 - DNA, 15 bp, Homo sapiens
gggaatgttctagat

SEQ ID NO: 65652 - DNA, 15 bp, Homo sapiens
ggaatgttctagatg

SEQ ID NO: 65653 - DNA, 15 bp, Homo sapiens
gaatgttctagatgg

SEQ ID NO: 65654 - DNA, 15 bp, Homo sapiens
aatgttctagatggt

SEQ ID NO: 65655 - DNA, 15 bp, Homo sapiens
atgttctagatggtg

SEQ ID NO: 65656 - DNA, 15 bp, Homo sapiens
tgttctagatggtga

SEQ ID NO: 65657 - DNA, 15 bp, Homo sapiens
gttctagatggtgac

SEQ ID NO: 65658 - DNA, 15 bp, Homo sapiens
ttctagatggtgact

SEQ ID NO: 65659 - DNA, 15 bp, Homo sapiens
tctagatggtgactc

SEQ ID NO: 65660 - DNA, 15 bp, Homo sapiens
ctagatggtgactca

SEQ ID NO: 65661 - DNA, 15 bp, Homo sapiens
tagatggtgactcag

SEQ ID NO: 65662 - DNA, 15 bp, Homo sapiens
agatggtgactcagg

SEQ ID NO: 65663 - DNA, 15 bp, Homo sapiens
gatggtgactcaggc

SEQ ID NO: 65664 - DNA, 15 bp, Homo sapiens
atggtgactcaggcc

SEQ ID NO: 65665 - DNA, 15 bp, Homo sapiens
tggtgactcaggccc

SEQ ID NO: 65666 - DNA, 15 bp, Homo sapiens
ggtgactcaggccca

SEQ ID NO: 65667 - DNA, 15 bp, Homo sapiens
gtgactcaggcccag

SEQ ID NO: 65668 - DNA, 15 bp, Homo sapiens
tgactcaggcccagg

SEQ ID NO: 65669 - DNA, 15 bp, Homo sapiens
gactcaggcccaggc

SEQ ID NO: 65670 - DNA, 15 bp, Homo sapiens
actcaggcccaggca

SEQ ID NO: 65671 - DNA, 15 bp, Homo sapiens
ctcaggcccaggcac

SEQ ID NO: 65672 - DNA, 15 bp, Homo sapiens
tcaggcccaggcacc

SEQ ID NO: 65673 - DNA, 15 bp, Homo sapiens
caggcccaggcacca

SEQ ID NO: 65674 - DNA, 15 bp, Homo sapiens
aggcccaggcaccaa

SEQ ID NO: 65675 - DNA, 15 bp, Homo sapiens
ggcccaggcaccaac

SEQ ID NO: 65676 - DNA, 15 bp, Homo sapiens
gcccaggcaccaacc

SEQ ID NO: 65677 - DNA, 15 bp, Homo sapiens
cccaggcaccaacca

SEQ ID NO: 65678 - DNA, 15 bp, Homo sapiens
ccaggcaccaaccag

SEQ ID NO: 65679 - DNA, 15 bp, Homo sapiens
caggcaccaaccagc

SEQ ID NO: 65680 - DNA, 15 bp, Homo sapiens
aggcaccaaccagca

SEQ ID NO: 65681 - DNA, 15 bp, Homo sapiens
ggcaccaaccagcag

SEQ ID NO: 65682 - DNA, 15 bp, Homo sapiens
gcaccaaccagcaga

SEQ ID NO: 65683 - DNA, 15 bp, Homo sapiens
caccaaccagcagaa

SEQ ID NO: 65684 - DNA, 15 bp, Homo sapiens
accaaccagcagaat

SEQ ID NO: 65685 - DNA, 15 bp, Homo sapiens
ccaaccagcagaatg

SEQ ID NO: 65686 - DNA, 15 bp, Homo sapiens
caaccagcagaatgg

SEQ ID NO: 65687 - DNA, 15 bp, Homo sapiens
aaccagcagaatggg

SEQ ID NO: 65688 - DNA, 15 bp, Homo sapiens
accagcagaatgggc

SEQ ID NO: 65689 - DNA, 15 bp, Homo sapiens
ccagcagaatgggcc

SEQ ID NO: 65690 - DNA, 15 bp, Homo sapiens
cagcagaatgggcct

SEQ ID NO: 65691 - DNA, 15 bp, Homo sapiens
agcagaatgggcctc

SEQ ID NO: 65692 - DNA, 15 bp, Homo sapiens
gcagaatgggcctca

SEQ ID NO: 65693 - DNA, 15 bp, Homo sapiens
cagaatgggcctcag

SEQ ID NO: 65694 - DNA, 15 bp, Homo sapiens
agaatgggcctcagc

SEQ ID NO: 65695 - DNA, 15 bp, Homo sapiens
gaatgggcctcagcc

SEQ ID NO: 65696 - DNA, 15 bp, Homo sapiens
aatgggcctcagcct

SEQ ID NO: 65697 - DNA, 15 bp, Homo sapiens
atgggcctcagcctg

SEQ ID NO: 65698 - DNA, 15 bp, Homo sapiens
tgggcctcagcctga

SEQ ID NO: 65699 - DNA, 15 bp, Homo sapiens
gggcctcagcctgac

SEQ ID NO: 65700 - DNA, 15 bp, Homo sapiens
ggcctcagcctgaca

SEQ ID NO: 65701 - DNA, 15 bp, Homo sapiens
gcctcagcctgacaa

SEQ ID NO: 65702 - DNA, 15 bp, Homo sapiens
cctcagcctgacaac

SEQ ID NO: 65703 - DNA, 15 bp, Homo sapiens
ctcagcctgacaacc

SEQ ID NO: 65704 - DNA, 15 bp, Homo sapiens
tcagcctgacaaccc

SEQ ID NO: 65705 - DNA, 15 bp, Homo sapiens
cagcctgacaaccct

SEQ ID NO: 65706 - DNA, 15 bp, Homo sapiens
agcctgacaaccctt

SEQ ID NO: 65707 - DNA, 15 bp, Homo sapiens
gcctgacaacccttc

SEQ ID NO: 65708 - DNA, 15 bp, Homo sapiens
cctgacaacccttct

SEQ ID NO: 65709 - DNA, 15 bp, Homo sapiens
ctgacaacccttctg

SEQ ID NO: 65710 - DNA, 15 bp, Homo sapiens
tgacaacccttctgt

SEQ ID NO: 65711 - DNA, 15 bp, Homo sapiens
gacaacccttctgta

SEQ ID NO: 65712 - DNA, 15 bp, Homo sapiens
acaacccttctgtac

SEQ ID NO: 65713 - DNA, 15 bp, Homo sapiens
caacccttctgtacc

SEQ ID NO: 65714 - DNA, 15 bp, Homo sapiens
aacccttctgtacca

SEQ ID NO: 65715 - DNA, 15 bp, Homo sapiens
acccttctgtaccag

SEQ ID NO: 65716 - DNA, 15 bp, Homo sapiens
cccttctgtaccagg

SEQ ID NO: 65717 - DNA, 15 bp, Homo sapiens
ccttctgtaccaggc

SEQ ID NO: 65718 - DNA, 15 bp, Homo sapiens
cttctgtaccaggcc

SEQ ID NO: 65719 - DNA, 15 bp, Homo sapiens
ttctgtaccaggcct

SEQ ID NO: 65720 - DNA, 15 bp, Homo sapiens
tctgtaccaggcctg

SEQ ID NO: 65721 - DNA, 15 bp, Homo sapiens
ctgtaccaggcctga

SEQ ID NO: 65722 - DNA, 15 bp, Homo sapiens
tgtaccaggcctgac

SEQ ID NO: 65723 - DNA, 15 bp, Homo sapiens
gtaccaggcctgact

SEQ ID NO: 65724 - DNA, 15 bp, Homo sapiens
taccaggcctgactc

SEQ ID NO: 65725 - DNA, 15 bp, Homo sapiens
accaggcctgactct

SEQ ID NO: 65726 - DNA, 15 bp, Homo sapiens
ccaggcctgactctt

SEQ ID NO: 65727 - DNA, 15 bp, Homo sapiens
caggcctgactcttt

SEQ ID NO: 65728 - DNA, 15 bp, Homo sapiens
aggcctgactctttg

SEQ ID NO: 65729 - DNA, 15 bp, Homo sapiens
ggcctgactctttgg

SEQ ID NO: 65730 - DNA, 15 bp, Homo sapiens
gcctgactctttggt

SEQ ID NO: 65731 - DNA, 15 bp, Homo sapiens
cctgactctttggtt

SEQ ID NO: 65732 - DNA, 15 bp, Homo sapiens
ctgactctttggttg

SEQ ID NO: 65733 - DNA, 15 bp, Homo sapiens
tgactctttggttgc

SEQ ID NO: 65734 - DNA, 15 bp, Homo sapiens
gactctttggttgct

SEQ ID NO: 65735 - DNA, 15 bp, Homo sapiens
actctttggttgctg

SEQ ID NO: 65736 - DNA, 15 bp, Homo sapiens
ctctttggttgctga

SEQ ID NO: 65737 - DNA, 15 bp, Homo sapiens
tctttggttgctgaa

SEQ ID NO: 65738 - DNA, 15 bp, Homo sapiens
ctttggttgctgaac

SEQ ID NO: 65739 - DNA, 15 bp, Homo sapiens
tttggttgctgaact

SEQ ID NO: 65740 - DNA, 15 bp, Homo sapiens
ttggttgctgaactt

SEQ ID NO: 65741 - DNA, 15 bp, Homo sapiens
tggttgctgaacttt

SEQ ID NO: 65742 - DNA, 15 bp, Homo sapiens
ggttgctgaactttg

SEQ ID NO: 65743 - DNA, 15 bp, Homo sapiens
gttgctgaactttgg

SEQ ID NO: 65744 - DNA, 15 bp, Homo sapiens
ttgctgaactttgga

SEQ ID NO: 65745 - DNA, 15 bp, Homo sapiens
tgctgaactttggag

SEQ ID NO: 65746 - DNA, 15 bp, Homo sapiens
gctgaactttggaga

SEQ ID NO: 65747 - DNA, 15 bp, Homo sapiens
ctgaactttggagag

SEQ ID NO: 65748 - DNA, 15 bp, Homo sapiens
tgaactttggagagg

SEQ ID NO: 65749 - DNA, 15 bp, Homo sapiens
gaactttggagaggc

SEQ ID NO: 65750 - DNA, 15 bp, Homo sapiens
aactttggagaggcc

SEQ ID NO: 65751 - DNA, 15 bp, Homo sapiens
actttggagaggcct

SEQ ID NO: 65752 - DNA, 15 bp, Homo sapiens
ctttggagaggcctg

SEQ ID NO: 65753 - DNA, 15 bp, Homo sapiens
tttggagaggcctgg

SEQ ID NO: 65754 - DNA, 15 bp, Homo sapiens
ttggagaggcctggg

SEQ ID NO: 65755 - DNA, 15 bp, Homo sapiens
tggagaggcctgggg

SEQ ID NO: 65756 - DNA, 15 bp, Homo sapiens
ggagaggcctggggg

SEQ ID NO: 65757 - DNA, 15 bp, Homo sapiens
gagaggcctgggggg

SEQ ID NO: 65758 - DNA, 15 bp, Homo sapiens
agaggcctggggggg

SEQ ID NO: 65759 - DNA, 15 bp, Homo sapiens
gaggcctgggggggt

SEQ ID NO: 65760 - DNA, 15 bp, Homo sapiens
aggcctgggggggtc

SEQ ID NO: 65761 - DNA, 15 bp, Homo sapiens
ggcctgggggggtca

SEQ ID NO: 65762 - DNA, 15 bp, Homo sapiens
gcctgggggggtcag

SEQ ID NO: 65763 - DNA, 15 bp, Homo sapiens
cctgggggggtcagc

SEQ ID NO: 65764 - DNA, 15 bp, Homo sapiens
ctgggggggtcagcg

SEQ ID NO: 65765 - DNA, 15 bp, Homo sapiens
tgggggggtcagcgg

SEQ ID NO: 65766 - DNA, 15 bp, Homo sapiens
gggggggtcagcggc

SEQ ID NO: 65767 - DNA, 15 bp, Homo sapiens
ggggggtcagcggca

SEQ ID NO: 65768 - DNA, 15 bp, Homo sapiens
gggggtcagcggcag

SEQ ID NO: 65769 - DNA, 15 bp, Homo sapiens
ggggtcagcggcagg

SEQ ID NO: 65770 - DNA, 15 bp, Homo sapiens
gggtcagcggcaggc

SEQ ID NO: 65771 - DNA, 15 bp, Homo sapiens
ggtcagcggcaggca

SEQ ID NO: 65772 - DNA, 15 bp, Homo sapiens
gtcagcggcaggcag

SEQ ID NO: 65773 - DNA, 15 bp, Homo sapiens
tcagcggcaggcaga

SEQ ID NO: 65774 - DNA, 15 bp, Homo sapiens
cagcggcaggcagac

SEQ ID NO: 65775 - DNA, 15 bp, Homo sapiens
agcggcaggcagacg

SEQ ID NO: 65776 - DNA, 15 bp, Homo sapiens
gcggcaggcagacga

SEQ ID NO: 65777 - DNA, 15 bp, Homo sapiens
cggcaggcagacgag

SEQ ID NO: 65778 - DNA, 15 bp, Homo sapiens
ggcaggcagacgagt

SEQ ID NO: 65779 - DNA, 15 bp, Homo sapiens
gcaggcagacgagtg

SEQ ID NO: 65780 - DNA, 15 bp, Homo sapiens
caggcagacgagtga

SEQ ID NO: 65781 - DNA, 15 bp, Homo sapiens
aggcagacgagtgag

SEQ ID NO: 65782 - DNA, 15 bp, Homo sapiens
ggcagacgagtgagt

SEQ ID NO: 65783 - DNA, 15 bp, Homo sapiens
gcagacgagtgagtg

SEQ ID NO: 65784 - DNA, 15 bp, Homo sapiens
cagacgagtgagtgg

SEQ ID NO: 65785 - DNA, 15 bp, Homo sapiens
agacgagtgagtggc

SEQ ID NO: 65786 - DNA, 15 bp, Homo sapiens
gacgagtgagtggct

SEQ ID NO: 65787 - DNA, 15 bp, Homo sapiens
acgagtgagtggctt

SEQ ID NO: 65788 - DNA, 15 bp, Homo sapiens
cgagtgagtggcttt

SEQ ID NO: 65789 - DNA, 15 bp, Homo sapiens
gagtgagtggctttg

SEQ ID NO: 65790 - DNA, 15 bp, Homo sapiens
agtgagtggctttgg

SEQ ID NO: 65791 - DNA, 15 bp, Homo sapiens
gtgagtggctttggt

SEQ ID NO: 65792 - DNA, 15 bp, Homo sapiens
tgagtggctttggtg

SEQ ID NO: 65793 - DNA, 15 bp, Homo sapiens
gagtggctttggtga

SEQ ID NO: 65794 - DNA, 15 bp, Homo sapiens
agtggctttggtgac

SEQ ID NO: 65795 - DNA, 15 bp, Homo sapiens
gtggctttggtgaca

SEQ ID NO: 65796 - DNA, 15 bp, Homo sapiens
tggctttggtgacag

SEQ ID NO: 65797 - DNA, 15 bp, Homo sapiens
ggctttggtgacagg

SEQ ID NO: 65798 - DNA, 15 bp, Homo sapiens
gctttggtgacaggt

SEQ ID NO: 65799 - DNA, 15 bp, Homo sapiens
ctttggtgacaggtc

SEQ ID NO: 65800 - DNA, 15 bp, Homo sapiens
tttggtgacaggtcc

SEQ ID NO: 65801 - DNA, 15 bp, Homo sapiens
ttggtgacaggtcct

SEQ ID NO: 65802 - DNA, 15 bp, Homo sapiens
tggtgacaggtcctc

SEQ ID NO: 65803 - DNA, 15 bp, Homo sapiens
ggtgacaggtcctca

SEQ ID NO: 65804 - DNA, 15 bp, Homo sapiens
gtgacaggtcctcag

SEQ ID NO: 65805 - DNA, 15 bp, Homo sapiens
tgacaggtcctcagg

SEQ ID NO: 65806 - DNA, 15 bp, Homo sapiens
gacaggtcctcaggg

SEQ ID NO: 65807 - DNA, 15 bp, Homo sapiens
acaggtcctcagggg

SEQ ID NO: 65808 - DNA, 15 bp, Homo sapiens
caggtcctcaggggc

SEQ ID NO: 65809 - DNA, 15 bp, Homo sapiens
aggtcctcaggggca

SEQ ID NO: 65810 - DNA, 15 bp, Homo sapiens
ggtcctcaggggcag

SEQ ID NO: 65811 - DNA, 15 bp, Homo sapiens
gtcctcaggggcagc

SEQ ID NO: 65812 - DNA, 15 bp, Homo sapiens
tcctcaggggcagcc

SEQ ID NO: 65813 - DNA, 15 bp, Homo sapiens
cctcaggggcagcca

SEQ ID NO: 65814 - DNA, 15 bp, Homo sapiens
ctcaggggcagccag

SEQ ID NO: 65815 - DNA, 15 bp, Homo sapiens
tcaggggcagccagg

SEQ ID NO: 65816 - DNA, 15 bp, Homo sapiens
caggggcagccaggc

SEQ ID NO: 65817 - DNA, 15 bp, Homo sapiens
aggggcagccaggca

SEQ ID NO: 65818 - DNA, 15 bp, Homo sapiens
ggggcagccaggcag

SEQ ID NO: 65819 - DNA, 15 bp, Homo sapiens
gggcagccaggcagt

SEQ ID NO: 65820 - DNA, 15 bp, Homo sapiens
ggcagccaggcagtg

SEQ ID NO: 65821 - DNA, 15 bp, Homo sapiens
gcagccaggcagtgt

SEQ ID NO: 65822 - DNA, 15 bp, Homo sapiens
cagccaggcagtgtg

SEQ ID NO: 65823 - DNA, 15 bp, Homo sapiens
agccaggcagtgtga

SEQ ID NO: 65824 - DNA, 15 bp, Homo sapiens
gccaggcagtgtgac

SEQ ID NO: 65825 - DNA, 15 bp, Homo sapiens
ccaggcagtgtgact

SEQ ID NO: 65826 - DNA, 15 bp, Homo sapiens
caggcagtgtgactc

SEQ ID NO: 65827 - DNA, 15 bp, Homo sapiens
aggcagtgtgactct

SEQ ID NO: 65828 - DNA, 15 bp, Homo sapiens
ggcagtgtgactctc

SEQ ID NO: 65829 - DNA, 15 bp, Homo sapiens
gcagtgtgactctcg

SEQ ID NO: 65830 - DNA, 15 bp, Homo sapiens
cagtgtgactctcgt

SEQ ID NO: 65831 - DNA, 15 bp, Homo sapiens
agtgtgactctcgtt

SEQ ID NO: 65832 - DNA, 15 bp, Homo sapiens
gtgtgactctcgttc

SEQ ID NO: 65833 - DNA, 15 bp, Homo sapiens
tgtgactctcgttca

SEQ ID NO: 65834 - DNA, 15 bp, Homo sapiens
gtgactctcgttcaa

SEQ ID NO: 65835 - DNA, 15 bp, Homo sapiens
tgactctcgttcaat

SEQ ID NO: 65836 - DNA, 15 bp, Homo sapiens
gactctcgttcaata

SEQ ID NO: 65837 - DNA, 15 bp, Homo sapiens
actctcgttcaatag

SEQ ID NO: 65838 - DNA, 15 bp, Homo sapiens
ctctcgttcaatagt

SEQ ID NO: 65839 - DNA, 15 bp, Homo sapiens
tctcgttcaatagta

SEQ ID NO: 65840 - DNA, 15 bp, Homo sapiens
ctcgttcaatagtaa

SEQ ID NO: 65841 - DNA, 15 bp, Homo sapiens
tcgttcaatagtaac

SEQ ID NO: 65842 - DNA, 15 bp, Homo sapiens
cgttcaatagtaacg

SEQ ID NO: 65843 - DNA, 15 bp, Homo sapiens
gttcaatagtaacgt

SEQ ID NO: 65844 - DNA, 15 bp, Homo sapiens
ttcaatagtaacgtt

SEQ ID NO: 65845 - DNA, 15 bp, Homo sapiens
tcaatagtaacgttt

SEQ ID NO: 65846 - DNA, 15 bp, Homo sapiens
caatagtaacgtttg

SEQ ID NO: 65847 - DNA, 15 bp, Homo sapiens
aatagtaacgtttgt

SEQ ID NO: 65848 - DNA, 15 bp, Homo sapiens
atagtaacgtttgtc

SEQ ID NO: 65849 - DNA, 15 bp, Homo sapiens
tagtaacgtttgtca

SEQ ID NO: 65850 - DNA, 15 bp, Homo sapiens
agtaacgtttgtcag

SEQ ID NO: 65851 - DNA, 15 bp, Homo sapiens
gtaacgtttgtcaga

SEQ ID NO: 65852 - DNA, 15 bp, Homo sapiens
taacgtttgtcagag

SEQ ID NO: 65853 - DNA, 15 bp, Homo sapiens
aacgtttgtcagagc

SEQ ID NO: 65854 - DNA, 15 bp, Homo sapiens
acgtttgtcagagcg

SEQ ID NO: 65855 - DNA, 15 bp, Homo sapiens
cgtttgtcagagcgt

SEQ ID NO: 65856 - DNA, 15 bp, Homo sapiens
gtttgtcagagcgtt

SEQ ID NO: 65857 - DNA, 15 bp, Homo sapiens
tttgtcagagcgttg

SEQ ID NO: 65858 - DNA, 15 bp, Homo sapiens
ttgtcagagcgttgt

SEQ ID NO: 65859 - DNA, 15 bp, Homo sapiens
tgtcagagcgttgtc

SEQ ID NO: 65860 - DNA, 15 bp, Homo sapiens
gtcagagcgttgtca

SEQ ID NO: 65861 - DNA, 15 bp, Homo sapiens
tcagagcgttgtcac

SEQ ID NO: 65862 - DNA, 15 bp, Homo sapiens
cagagcgttgtcacc

SEQ ID NO: 65863 - DNA, 15 bp, Homo sapiens
agagcgttgtcacca

SEQ ID NO: 65864 - DNA, 15 bp, Homo sapiens
gagcgttgtcaccac

SEQ ID NO: 65865 - DNA, 15 bp, Homo sapiens
agcgttgtcaccacc

SEQ ID NO: 65866 - DNA, 15 bp, Homo sapiens
gcgttgtcaccacca

SEQ ID NO: 65867 - DNA, 15 bp, Homo sapiens
cgttgtcaccaccat

SEQ ID NO: 65868 - DNA, 15 bp, Homo sapiens
gttgtcaccaccatc

SEQ ID NO: 65869 - DNA, 15 bp, Homo sapiens
ttgtcaccaccatcc

SEQ ID NO: 65870 - DNA, 15 bp, Homo sapiens
tgtcaccaccatccg

SEQ ID NO: 65871 - DNA, 15 bp, Homo sapiens
gtcaccaccatccgc

SEQ ID NO: 65872 - DNA, 15 bp, Homo sapiens
tcaccaccatccgct

SEQ ID NO: 65873 - DNA, 15 bp, Homo sapiens
caccaccatccgctc

SEQ ID NO: 65874 - DNA, 15 bp, Homo sapiens
accaccatccgctct

SEQ ID NO: 65875 - DNA, 15 bp, Homo sapiens
ccaccatccgctctg

SEQ ID NO: 65876 - DNA, 15 bp, Homo sapiens
caccatccgctctgc

SEQ ID NO: 65877 - DNA, 15 bp, Homo sapiens
accatccgctctgcc

SEQ ID NO: 65878 - DNA, 15 bp, Homo sapiens
ccatccgctctgccc

SEQ ID NO: 65879 - DNA, 15 bp, Homo sapiens
catccgctctgccct

SEQ ID NO: 65880 - DNA, 15 bp, Homo sapiens
atccgctctgcccta

SEQ ID NO: 65881 - DNA, 15 bp, Homo sapiens
tccgctctgccctat

SEQ ID NO: 65882 - DNA, 15 bp, Homo sapiens
ccgctctgccctatc

SEQ ID NO: 65883 - DNA, 15 bp, Homo sapiens
cgctctgccctatct

SEQ ID NO: 65884 - DNA, 15 bp, Homo sapiens
gctctgccctatctc

SEQ ID NO: 65885 - DNA, 15 bp, Homo sapiens
ctctgccctatctct

SEQ ID NO: 65886 - DNA, 15 bp, Homo sapiens
tctgccctatctctg

SEQ ID NO: 65887 - DNA, 15 bp, Homo sapiens
ctgccctatctctga

SEQ ID NO: 65888 - DNA, 15 bp, Homo sapiens
tgccctatctctgac

SEQ ID NO: 65889 - DNA, 15 bp, Homo sapiens
gccctatctctgaca

SEQ ID NO: 65890 - DNA, 15 bp, Homo sapiens
ccctatctctgacat

SEQ ID NO: 65891 - DNA, 15 bp, Homo sapiens
cctatctctgacatt

SEQ ID NO: 65892 - DNA, 15 bp, Homo sapiens
ctatctctgacattg

SEQ ID NO: 65893 - DNA, 15 bp, Homo sapiens
tatctctgacattgc

SEQ ID NO: 65894 - DNA, 15 bp, Homo sapiens
atctctgacattgct

SEQ ID NO: 65895 - DNA, 15 bp, Homo sapiens
tctctgacattgcta

SEQ ID NO: 65896 - DNA, 15 bp, Homo sapiens
ctctgacattgctat

SEQ ID NO: 65897 - DNA, 15 bp, Homo sapiens
tctgacattgctatg

SEQ ID NO: 65898 - DNA, 15 bp, Homo sapiens
ctgacattgctatgg

SEQ ID NO: 65899 - DNA, 15 bp, Homo sapiens
tgacattgctatgga

SEQ ID NO: 65900 - DNA, 15 bp, Homo sapiens
gacattgctatggag

SEQ ID NO: 65901 - DNA, 15 bp, Homo sapiens
acattgctatggaga

SEQ ID NO: 65902 - DNA, 15 bp, Homo sapiens
cattgctatggagag

SEQ ID NO: 65903 - DNA, 15 bp, Homo sapiens
attgctatggagagc

SEQ ID NO: 65904 - DNA, 15 bp, Homo sapiens
ttgctatggagagcc

SEQ ID NO: 65905 - DNA, 15 bp, Homo sapiens
tgctatggagagcct

SEQ ID NO: 65906 - DNA, 15 bp, Homo sapiens
gctatggagagcctc

SEQ ID NO: 65907 - DNA, 15 bp, Homo sapiens
ctatggagagcctct

SEQ ID NO: 65908 - DNA, 15 bp, Homo sapiens
tatggagagcctcta

SEQ ID NO: 65909 - DNA, 15 bp, Homo sapiens
atggagagcctctaa

SEQ ID NO: 65910 - DNA, 15 bp, Homo sapiens
tggagagcctctaat

SEQ ID NO: 65911 - DNA, 15 bp, Homo sapiens
ggagagcctctaatt

SEQ ID NO: 65912 - DNA, 15 bp, Homo sapiens
gagagcctctaattg

SEQ ID NO: 65913 - DNA, 15 bp, Homo sapiens
agagcctctaattgt

SEQ ID NO: 65914 - DNA, 15 bp, Homo sapiens
gagcctctaattgtt

SEQ ID NO: 65915 - DNA, 15 bp, Homo sapiens
agcctctaattgttc

SEQ ID NO: 65916 - DNA, 15 bp, Homo sapiens
gcctctaattgttcc

SEQ ID NO: 65917 - DNA, 15 bp, Homo sapiens
cctctaattgttcct

SEQ ID NO: 65918 - DNA, 15 bp, Homo sapiens
ctctaattgttcctt

SEQ ID NO: 65919 - DNA, 15 bp, Homo sapiens
tctaattgttccttg

SEQ ID NO: 65920 - DNA, 15 bp, Homo sapiens
ctaattgttccttgt

SEQ ID NO: 65921 - DNA, 15 bp, Homo sapiens
taattgttccttgtg

SEQ ID NO: 65922 - DNA, 15 bp, Homo sapiens
aattgttccttgtgt

SEQ ID NO: 65923 - DNA, 15 bp, Homo sapiens
attgttccttgtgtc

SEQ ID NO: 65924 - DNA, 15 bp, Homo sapiens
ttgttccttgtgtct

SEQ ID NO: 65925 - DNA, 15 bp, Homo sapiens
tgttccttgtgtctt

SEQ ID NO: 65926 - DNA, 15 bp, Homo sapiens
gttccttgtgtcttt

SEQ ID NO: 65927 - DNA, 15 bp, Homo sapiens
ttccttgtgtctttc

SEQ ID NO: 65928 - DNA, 15 bp, Homo sapiens
tccttgtgtctttct

SEQ ID NO: 65929 - DNA, 15 bp, Homo sapiens
ccttgtgtctttctg

SEQ ID NO: 65930 - DNA, 15 bp, Homo sapiens
cttgtgtctttctgt

SEQ ID NO: 65931 - DNA, 15 bp, Homo sapiens
ttgtgtctttctgtt

SEQ ID NO: 65932 - DNA, 15 bp, Homo sapiens
tgtgtctttctgttt

SEQ ID NO: 65933 - DNA, 15 bp, Homo sapiens
gtgtctttctgtttg

SEQ ID NO: 65934 - DNA, 15 bp, Homo sapiens
tgtctttctgtttgt

SEQ ID NO: 65935 - DNA, 15 bp, Homo sapiens
gtctttctgtttgtc

SEQ ID NO: 65936 - DNA, 15 bp, Homo sapiens
tctttctgtttgtcc

SEQ ID NO: 65937 - DNA, 15 bp, Homo sapiens
ctttctgtttgtccc

SEQ ID NO: 65938 - DNA, 15 bp, Homo sapiens
tttctgtttgtcccc

SEQ ID NO: 65939 - DNA, 15 bp, Homo sapiens
ttctgtttgtcccca

SEQ ID NO: 65940 - DNA, 15 bp, Homo sapiens
tctgtttgtccccac

SEQ ID NO: 65941 - DNA, 15 bp, Homo sapiens
ctgtttgtccccaca

SEQ ID NO: 65942 - DNA, 15 bp, Homo sapiens
tgtttgtccccacag

SEQ ID NO: 65943 - DNA, 15 bp, Homo sapiens
gtttgtccccacagt

SEQ ID NO: 65944 - DNA, 15 bp, Homo sapiens
tttgtccccacagtc

SEQ ID NO: 65945 - DNA, 15 bp, Homo sapiens
ttgtccccacagtcc

SEQ ID NO: 65946 - DNA, 15 bp, Homo sapiens
tgtccccacagtccc

SEQ ID NO: 65947 - DNA, 15 bp, Homo sapiens
gtccccacagtcccc

SEQ ID NO: 65948 - DNA, 15 bp, Homo sapiens
tccccacagtcccca

SEQ ID NO: 65949 - DNA, 15 bp, Homo sapiens
ccccacagtccccag

SEQ ID NO: 65950 - DNA, 15 bp, Homo sapiens
cccacagtccccagg

SEQ ID NO: 65951 - DNA, 15 bp, Homo sapiens
ccacagtccccaggg

SEQ ID NO: 65952 - DNA, 15 bp, Homo sapiens
cacagtccccaggga

SEQ ID NO: 65953 - DNA, 15 bp, Homo sapiens
acagtccccagggaa

SEQ ID NO: 65954 - DNA, 15 bp, Homo sapiens
cagtccccagggaaa

SEQ ID NO: 65955 - DNA, 15 bp, Homo sapiens
agtccccagggaaaa

SEQ ID NO: 65956 - DNA, 15 bp, Homo sapiens
gtccccagggaaaag

SEQ ID NO: 65957 - DNA, 15 bp, Homo sapiens
tccccagggaaaagc

SEQ ID NO: 65958 - DNA, 15 bp, Homo sapiens
ccccagggaaaagcc

SEQ ID NO: 65959 - DNA, 15 bp, Homo sapiens
cccagggaaaagcct

SEQ ID NO: 65960 - DNA, 15 bp, Homo sapiens
ccagggaaaagcctt

SEQ ID NO: 65961 - DNA, 15 bp, Homo sapiens
cagggaaaagccttt

SEQ ID NO: 65962 - DNA, 15 bp, Homo sapiens
agggaaaagcctttc

SEQ ID NO: 65963 - DNA, 15 bp, Homo sapiens
gggaaaagcctttcg

SEQ ID NO: 65964 - DNA, 15 bp, Homo sapiens
ggaaaagcctttcgc

SEQ ID NO: 65965 - DNA, 15 bp, Homo sapiens
gaaaagcctttcgct

SEQ ID NO: 65966 - DNA, 15 bp, Homo sapiens
aaaagcctttcgctc

SEQ ID NO: 65967 - DNA, 15 bp, Homo sapiens
aaagcctttcgctct

SEQ ID NO: 65968 - DNA, 15 bp, Homo sapiens
aagcctttcgctcta

SEQ ID NO: 65969 - DNA, 15 bp, Homo sapiens
agcctttcgctctaa

SEQ ID NO: 65970 - DNA, 15 bp, Homo sapiens
gcctttcgctctaaa

SEQ ID NO: 65971 - DNA, 15 bp, Homo sapiens
cctttcgctctaaag

SEQ ID NO: 65972 - DNA, 15 bp, Homo sapiens
ctttcgctctaaagt

SEQ ID NO: 65973 - DNA, 15 bp, Homo sapiens
tttcgctctaaagtg

SEQ ID NO: 65974 - DNA, 15 bp, Homo sapiens
ttcgctctaaagtgg

SEQ ID NO: 65975 - DNA, 15 bp, Homo sapiens
tcgctctaaagtgga

SEQ ID NO: 65976 - DNA, 15 bp, Homo sapiens
cgctctaaagtggag

SEQ ID NO: 65977 - DNA, 15 bp, Homo sapiens
gctctaaagtggagt

SEQ ID NO: 65978 - DNA, 15 bp, Homo sapiens
ctctaaagtggagtt

SEQ ID NO: 65979 - DNA, 15 bp, Homo sapiens
tctaaagtggagttg

SEQ ID NO: 65980 - DNA, 15 bp, Homo sapiens
ctaaagtggagttga

SEQ ID NO: 65981 - DNA, 15 bp, Homo sapiens
taaagtggagttgat

SEQ ID NO: 65982 - DNA, 15 bp, Homo sapiens
aaagtggagttgatt

SEQ ID NO: 65983 - DNA, 15 bp, Homo sapiens
aagtggagttgattg

SEQ ID NO: 65984 - DNA, 15 bp, Homo sapiens
agtggagttgattgc

SEQ ID NO: 65985 - DNA, 15 bp, Homo sapiens
gtggagttgattgcg

SEQ ID NO: 65986 - DNA, 15 bp, Homo sapiens
tggagttgattgcgt

SEQ ID NO: 65987 - DNA, 15 bp, Homo sapiens
ggagttgattgcgta

SEQ ID NO: 65988 - DNA, 15 bp, Homo sapiens
gagttgattgcgtac

SEQ ID NO: 65989 - DNA, 15 bp, Homo sapiens
agttgattgcgtact

SEQ ID NO: 65990 - DNA, 15 bp, Homo sapiens
gttgattgcgtactt

SEQ ID NO: 65991 - DNA, 15 bp, Homo sapiens
ttgattgcgtacttc

SEQ ID NO: 65992 - DNA, 15 bp, Homo sapiens
tgattgcgtacttcg

SEQ ID NO: 65993 - DNA, 15 bp, Homo sapiens
gattgcgtacttcga

SEQ ID NO: 65994 - DNA, 15 bp, Homo sapiens
attgcgtacttcgaa

SEQ ID NO: 65995 - DNA, 15 bp, Homo sapiens
ttgcgtacttcgaaa

SEQ ID NO: 65996 - DNA, 15 bp, Homo sapiens
tgcgtacttcgaaaa

SEQ ID NO: 65997 - DNA, 15 bp, Homo sapiens
gcgtacttcgaaaag

SEQ ID NO: 65998 - DNA, 15 bp, Homo sapiens
cgtacttcgaaaagg

SEQ ID NO: 65999 - DNA, 15 bp, Homo sapiens
gtacttcgaaaaggt

SEQ ID NO: 66000 - DNA, 15 bp, Homo sapiens
tacttcgaaaaggta

SEQ ID NO: 66001 - DNA, 15 bp, Homo sapiens
acttcgaaaaggtag

SEQ ID NO: 66002 - DNA, 15 bp, Homo sapiens
cttcgaaaaggtagg

SEQ ID NO: 66003 - DNA, 15 bp, Homo sapiens
ttcgaaaaggtaggc

SEQ ID NO: 66004 - DNA, 15 bp, Homo sapiens
tcgaaaaggtaggcg

SEQ ID NO: 66005 - DNA, 15 bp, Homo sapiens
cgaaaaggtaggcga

SEQ ID NO: 66006 - DNA, 15 bp, Homo sapiens
gaaaaggtaggcgac

SEQ ID NO: 66007 - DNA, 15 bp, Homo sapiens
aaaaggtaggcgaca

SEQ ID NO: 66008 - DNA, 15 bp, Homo sapiens
aaaggtaggcgacac

SEQ ID NO: 66009 - DNA, 15 bp, Homo sapiens
aaggtaggcgacaca

SEQ ID NO: 66010 - DNA, 15 bp, Homo sapiens
aggtaggcgacacat

SEQ ID NO: 66011 - DNA, 15 bp, Homo sapiens
ggtaggcgacacatc

SEQ ID NO: 66012 - DNA, 15 bp, Homo sapiens
gtaggcgacacatcc

SEQ ID NO: 66013 - DNA, 15 bp, Homo sapiens
taggcgacacatccc

SEQ ID NO: 66014 - DNA, 15 bp, Homo sapiens
aggcgacacatccct

SEQ ID NO: 66015 - DNA, 15 bp, Homo sapiens
ggcgacacatccctg

SEQ ID NO: 66016 - DNA, 15 bp, Homo sapiens
gcgacacatccctgg

SEQ ID NO: 66017 - DNA, 15 bp, Homo sapiens
cgacacatccctgga

SEQ ID NO: 66018 - DNA, 15 bp, Homo sapiens
gacacatccctggac

SEQ ID NO: 66019 - DNA, 15 bp, Homo sapiens
acacatccctggacc

SEQ ID NO: 66020 - DNA, 15 bp, Homo sapiens
cacatccctggaccc

SEQ ID NO: 66021 - DNA, 15 bp, Homo sapiens
acatccctggaccct

SEQ ID NO: 66022 - DNA, 15 bp, Homo sapiens
catccctggacccta

SEQ ID NO: 66023 - DNA, 15 bp, Homo sapiens
atccctggaccctaa

SEQ ID NO: 66024 - DNA, 15 bp, Homo sapiens
tccctggaccctaat

SEQ ID NO: 66025 - DNA, 15 bp, Homo sapiens
ccctggaccctaatg

SEQ ID NO: 66026 - DNA, 15 bp, Homo sapiens
cctggaccctaatga

SEQ ID NO: 66027 - DNA, 15 bp, Homo sapiens
ctggaccctaatgat

SEQ ID NO: 66028 - DNA, 15 bp, Homo sapiens
tggaccctaatgatt

SEQ ID NO: 66029 - DNA, 15 bp, Homo sapiens
ggaccctaatgattt

SEQ ID NO: 66030 - DNA, 15 bp, Homo sapiens
gaccctaatgatttt

SEQ ID NO: 66031 - DNA, 15 bp, Homo sapiens
accctaatgattttg

SEQ ID NO: 66032 - DNA, 15 bp, Homo sapiens
ccctaatgattttga

SEQ ID NO: 66033 - DNA, 15 bp, Homo sapiens
cctaatgattttgac

SEQ ID NO: 66034 - DNA, 15 bp, Homo sapiens
ctaatgattttgact

SEQ ID NO: 66035 - DNA, 15 bp, Homo sapiens
taatgattttgactt

SEQ ID NO: 66036 - DNA, 15 bp, Homo sapiens
aatgattttgacttc

SEQ ID NO: 66037 - DNA, 15 bp, Homo sapiens
atgattttgacttca

SEQ ID NO: 66038 - DNA, 15 bp, Homo sapiens
tgattttgacttcac

SEQ ID NO: 66039 - DNA, 15 bp, Homo sapiens
gattttgacttcacg

SEQ ID NO: 66040 - DNA, 15 bp, Homo sapiens
attttgacttcacgg

SEQ ID NO: 66041 - DNA, 15 bp, Homo sapiens
ttttgacttcacggt

SEQ ID NO: 66042 - DNA, 15 bp, Homo sapiens
tttgacttcacggta

SEQ ID NO: 66043 - DNA, 15 bp, Homo sapiens
ttgacttcacggtaa

SEQ ID NO: 66044 - DNA, 15 bp, Homo sapiens
tgacttcacggtaac

SEQ ID NO: 66045 - DNA, 15 bp, Homo sapiens
gacttcacggtaact

SEQ ID NO: 66046 - DNA, 15 bp, Homo sapiens
acttcacggtaactg

SEQ ID NO: 66047 - DNA, 15 bp, Homo sapiens
cttcacggtaactgg

SEQ ID NO: 66048 - DNA, 15 bp, Homo sapiens
ttcacggtaactggg

SEQ ID NO: 66049 - DNA, 15 bp, Homo sapiens
tcacggtaactggga

SEQ ID NO: 66050 - DNA, 15 bp, Homo sapiens
cacggtaactgggag

SEQ ID NO: 66051 - DNA, 15 bp, Homo sapiens
acggtaactgggaga

SEQ ID NO: 66052 - DNA, 15 bp, Homo sapiens
cggtaactgggagag

SEQ ID NO: 66053 - DNA, 15 bp, Homo sapiens
ggtaactgggagagg

SEQ ID NO: 66054 - DNA, 15 bp, Homo sapiens
gtaactgggagaggg

SEQ ID NO: 66055 - DNA, 15 bp, Homo sapiens
taactgggagaggga

SEQ ID NO: 66056 - DNA, 15 bp, Homo sapiens
aactgggagagggag

SEQ ID NO: 66057 - DNA, 15 bp, Homo sapiens
actgggagagggagc

SEQ ID NO: 66058 - DNA, 15 bp, Homo sapiens
ctgggagagggagcc

SEQ ID NO: 66059 - DNA, 15 bp, Homo sapiens
tgggagagggagccc

SEQ ID NO: 66060 - DNA, 15 bp, Homo sapiens
gggagagggagcccc

SEQ ID NO: 66061 - DNA, 15 bp, Homo sapiens
ggagagggagcccct

SEQ ID NO: 66062 - DNA, 15 bp, Homo sapiens
gagagggagcccctc

SEQ ID NO: 66063 - DNA, 15 bp, Homo sapiens
agagggagcccctcc

SEQ ID NO: 66064 - DNA, 15 bp, Homo sapiens
gagggagcccctccc

SEQ ID NO: 66065 - DNA, 15 bp, Homo sapiens
agggagcccctcccg

SEQ ID NO: 66066 - DNA, 15 bp, Homo sapiens
gggagcccctcccgg

SEQ ID NO: 66067 - DNA, 15 bp, Homo sapiens
ggagcccctcccggc

SEQ ID NO: 66068 - DNA, 15 bp, Homo sapiens
gagcccctcccggcg

SEQ ID NO: 66069 - DNA, 15 bp, Homo sapiens
agcccctcccggcga

SEQ ID NO: 66070 - DNA, 15 bp, Homo sapiens
gcccctcccggcgag

SEQ ID NO: 66071 - DNA, 15 bp, Homo sapiens
cccctcccggcgaga

SEQ ID NO: 66072 - DNA, 15 bp, Homo sapiens
ccctcccggcgagag

SEQ ID NO: 66073 - DNA, 15 bp, Homo sapiens
cctcccggcgagagc

SEQ ID NO: 66074 - DNA, 15 bp, Homo sapiens
ctcccggcgagagca

SEQ ID NO: 66075 - DNA, 15 bp, Homo sapiens
tcccggcgagagcag

SEQ ID NO: 66076 - DNA, 15 bp, Homo sapiens
cccggcgagagcaga

SEQ ID NO: 66077 - DNA, 15 bp, Homo sapiens
ccggcgagagcagaa

SEQ ID NO: 66078 - DNA, 15 bp, Homo sapiens
cggcgagagcagaaa

SEQ ID NO: 66079 - DNA, 15 bp, Homo sapiens
ggcgagagcagaaac

SEQ ID NO: 66080 - DNA, 15 bp, Homo sapiens
gcgagagcagaaacc

SEQ ID NO: 66081 - DNA, 15 bp, Homo sapiens
cgagagcagaaacca

SEQ ID NO: 66082 - DNA, 15 bp, Homo sapiens
gagagcagaaaccac

SEQ ID NO: 66083 - DNA, 15 bp, Homo sapiens
agagcagaaaccacc

SEQ ID NO: 66084 - DNA, 15 bp, Homo sapiens
gagcagaaaccacct

SEQ ID NO: 66085 - DNA, 15 bp, Homo sapiens
agcagaaaccaccta

SEQ ID NO: 66086 - DNA, 15 bp, Homo sapiens
gcagaaaccacctaa

SEQ ID NO: 66087 - DNA, 15 bp, Homo sapiens
cagaaaccacctaag

SEQ ID NO: 66088 - DNA, 15 bp, Homo sapiens
agaaaccacctaaga

SEQ ID NO: 66089 - DNA, 15 bp, Homo sapiens
gaaaccacctaagaa

SEQ ID NO: 66090 - DNA, 15 bp, Homo sapiens
aaaccacctaagaag

SEQ ID NO: 66091 - DNA, 15 bp, Homo sapiens
aaccacctaagaagc

SEQ ID NO: 66092 - DNA, 15 bp, Homo sapiens
accacctaagaagcc

SEQ ID NO: 66093 - DNA, 15 bp, Homo sapiens
ccacctaagaagccc

SEQ ID NO: 66094 - DNA, 15 bp, Homo sapiens
cacctaagaagccca

SEQ ID NO: 66095 - DNA, 15 bp, Homo sapiens
acctaagaagcccaa

SEQ ID NO: 66096 - DNA, 15 bp, Homo sapiens
cctaagaagcccaaa

SEQ ID NO: 66097 - DNA, 15 bp, Homo sapiens
ctaagaagcccaaat

SEQ ID NO: 66098 - DNA, 15 bp, Homo sapiens
taagaagcccaaatc

SEQ ID NO: 66099 - DNA, 15 bp, Homo sapiens
aagaagcccaaatct

SEQ ID NO: 66100 - DNA, 15 bp, Homo sapiens
agaagcccaaatctc

SEQ ID NO: 66101 - DNA, 15 bp, Homo sapiens
gaagcccaaatctcc

SEQ ID NO: 66102 - DNA, 15 bp, Homo sapiens
aagcccaaatctccc

SEQ ID NO: 66103 - DNA, 15 bp, Homo sapiens
agcccaaatctccca

SEQ ID NO: 66104 - DNA, 15 bp, Homo sapiens
gcccaaatctcccaa

SEQ ID NO: 66105 - DNA, 15 bp, Homo sapiens
cccaaatctcccaaa

SEQ ID NO: 66106 - DNA, 15 bp, Homo sapiens
ccaaatctcccaaag

SEQ ID NO: 66107 - DNA, 15 bp, Homo sapiens
caaatctcccaaagc

SEQ ID NO: 66108 - DNA, 15 bp, Homo sapiens
aaatctcccaaagct

SEQ ID NO: 66109 - DNA, 15 bp, Homo sapiens
aatctcccaaagctc

SEQ ID NO: 66110 - DNA, 15 bp, Homo sapiens
atctcccaaagctcc

SEQ ID NO: 66111 - DNA, 15 bp, Homo sapiens
tctcccaaagctcca

SEQ ID NO: 66112 - DNA, 15 bp, Homo sapiens
ctcccaaagctccag

SEQ ID NO: 66113 - DNA, 15 bp, Homo sapiens
tcccaaagctccagg

SEQ ID NO: 66114 - DNA, 15 bp, Homo sapiens
cccaaagctccagga

SEQ ID NO: 66115 - DNA, 15 bp, Homo sapiens
ccaaagctccaggaa

SEQ ID NO: 66116 - DNA, 15 bp, Homo sapiens
caaagctccaggaac

SEQ ID NO: 66117 - DNA, 15 bp, Homo sapiens
aaagctccaggaact

SEQ ID NO: 66118 - DNA, 15 bp, Homo sapiens
aagctccaggaactg

SEQ ID NO: 66119 - DNA, 15 bp, Homo sapiens
agctccaggaactgg

SEQ ID NO: 66120 - DNA, 15 bp, Homo sapiens
gctccaggaactggc

SEQ ID NO: 66121 - DNA, 15 bp, Homo sapiens
ctccaggaactggca

SEQ ID NO: 66122 - DNA, 15 bp, Homo sapiens
tccaggaactggcag

SEQ ID NO: 66123 - DNA, 15 bp, Homo sapiens
ccaggaactggcaga

SEQ ID NO: 66124 - DNA, 15 bp, Homo sapiens
caggaactggcagag

SEQ ID NO: 66125 - DNA, 15 bp, Homo sapiens
aggaactggcagagg

SEQ ID NO: 66126 - DNA, 15 bp, Homo sapiens
ggaactggcagaggc

SEQ ID NO: 66127 - DNA, 15 bp, Homo sapiens
gaactggcagaggcc

SEQ ID NO: 66128 - DNA, 15 bp, Homo sapiens
aactggcagaggccg

SEQ ID NO: 66129 - DNA, 15 bp, Homo sapiens
actggcagaggccgg

SEQ ID NO: 66130 - DNA, 15 bp, Homo sapiens
ctggcagaggccggg

SEQ ID NO: 66131 - DNA, 15 bp, Homo sapiens
tggcagaggccgggg

SEQ ID NO: 66132 - DNA, 15 bp, Homo sapiens
ggcagaggccgggga

SEQ ID NO: 66133 - DNA, 15 bp, Homo sapiens
gcagaggccggggac

SEQ ID NO: 66134 - DNA, 15 bp, Homo sapiens
cagaggccggggacg

SEQ ID NO: 66135 - DNA, 15 bp, Homo sapiens
agaggccggggacgc

SEQ ID NO: 66136 - DNA, 15 bp, Homo sapiens
gaggccggggacgcc

SEQ ID NO: 66137 - DNA, 15 bp, Homo sapiens
aggccggggacgccc

SEQ ID NO: 66138 - DNA, 15 bp, Homo sapiens
ggccggggacgcccc

SEQ ID NO: 66139 - DNA, 15 bp, Homo sapiens
gccggggacgcccca

SEQ ID NO: 66140 - DNA, 15 bp, Homo sapiens
ccggggacgccccaa

SEQ ID NO: 66141 - DNA, 15 bp, Homo sapiens
cggggacgccccaaa

SEQ ID NO: 66142 - DNA, 15 bp, Homo sapiens
ggggacgccccaaag

SEQ ID NO: 66143 - DNA, 15 bp, Homo sapiens
gggacgccccaaagg

SEQ ID NO: 66144 - DNA, 15 bp, Homo sapiens
ggacgccccaaaggg

SEQ ID NO: 66145 - DNA, 15 bp, Homo sapiens
gacgccccaaaggga

SEQ ID NO: 66146 - DNA, 15 bp, Homo sapiens
acgccccaaagggag

SEQ ID NO: 66147 - DNA, 15 bp, Homo sapiens
cgccccaaagggagc

SEQ ID NO: 66148 - DNA, 15 bp, Homo sapiens
gccccaaagggagcg

SEQ ID NO: 66149 - DNA, 15 bp, Homo sapiens
ccccaaagggagcgg

SEQ ID NO: 66150 - DNA, 15 bp, Homo sapiens
cccaaagggagcggc

SEQ ID NO: 66151 - DNA, 15 bp, Homo sapiens
ccaaagggagcggca

SEQ ID NO: 66152 - DNA, 15 bp, Homo sapiens
caaagggagcggcac

SEQ ID NO: 66153 - DNA, 15 bp, Homo sapiens
aaagggagcggcacc

SEQ ID NO: 66154 - DNA, 15 bp, Homo sapiens
aagggagcggcacca

SEQ ID NO: 66155 - DNA, 15 bp, Homo sapiens
agggagcggcaccac

SEQ ID NO: 66156 - DNA, 15 bp, Homo sapiens
gggagcggcaccacg

SEQ ID NO: 66157 - DNA, 15 bp, Homo sapiens
ggagcggcaccacga

SEQ ID NO: 66158 - DNA, 15 bp, Homo sapiens
gagcggcaccacgag

SEQ ID NO: 66159 - DNA, 15 bp, Homo sapiens
agcggcaccacgaga

SEQ ID NO: 66160 - DNA, 15 bp, Homo sapiens
gcggcaccacgagac

SEQ ID NO: 66161 - DNA, 15 bp, Homo sapiens
cggcaccacgagacc

SEQ ID NO: 66162 - DNA, 15 bp, Homo sapiens
ggcaccacgagaccc

SEQ ID NO: 66163 - DNA, 15 bp, Homo sapiens
gcaccacgagaccca

SEQ ID NO: 66164 - DNA, 15 bp, Homo sapiens
caccacgagacccaa

SEQ ID NO: 66165 - DNA, 15 bp, Homo sapiens
accacgagacccaag

SEQ ID NO: 66166 - DNA, 15 bp, Homo sapiens
ccacgagacccaagg

SEQ ID NO: 66167 - DNA, 15 bp, Homo sapiens
cacgagacccaaggc

SEQ ID NO: 66168 - DNA, 15 bp, Homo sapiens
acgagacccaaggcg

SEQ ID NO: 66169 - DNA, 15 bp, Homo sapiens
cgagacccaaggcgg

SEQ ID NO: 66170 - DNA, 15 bp, Homo sapiens
gagacccaaggcggc

SEQ ID NO: 66171 - DNA, 15 bp, Homo sapiens
agacccaaggcggcc

SEQ ID NO: 66172 - DNA, 15 bp, Homo sapiens
gacccaaggcggcca

SEQ ID NO: 66173 - DNA, 15 bp, Homo sapiens
acccaaggcggccac

SEQ ID NO: 66174 - DNA, 15 bp, Homo sapiens
cccaaggcggccacg

SEQ ID NO: 66175 - DNA, 15 bp, Homo sapiens
ccaaggcggccacgt

SEQ ID NO: 66176 - DNA, 15 bp, Homo sapiens
caaggcggccacgtc

SEQ ID NO: 66177 - DNA, 15 bp, Homo sapiens
aaggcggccacgtca

SEQ ID NO: 66178 - DNA, 15 bp, Homo sapiens
aggcggccacgtcag

SEQ ID NO: 66179 - DNA, 15 bp, Homo sapiens
ggcggccacgtcaga

SEQ ID NO: 66180 - DNA, 15 bp, Homo sapiens
gcggccacgtcagag

SEQ ID NO: 66181 - DNA, 15 bp, Homo sapiens
cggccacgtcagagg

SEQ ID NO: 66182 - DNA, 15 bp, Homo sapiens
ggccacgtcagaggg

SEQ ID NO: 66183 - DNA, 15 bp, Homo sapiens
gccacgtcagagggt

SEQ ID NO: 66184 - DNA, 15 bp, Homo sapiens
ccacgtcagagggtg

SEQ ID NO: 66185 - DNA, 15 bp, Homo sapiens
cacgtcagagggtgt

SEQ ID NO: 66186 - DNA, 15 bp, Homo sapiens
acgtcagagggtgtg

SEQ ID NO: 66187 - DNA, 15 bp, Homo sapiens
cgtcagagggtgtgc

SEQ ID NO: 66188 - DNA, 15 bp, Homo sapiens
gtcagagggtgtgca

SEQ ID NO: 66189 - DNA, 15 bp, Homo sapiens
tcagagggtgtgcag

SEQ ID NO: 66190 - DNA, 15 bp, Homo sapiens
cagagggtgtgcagg

SEQ ID NO: 66191 - DNA, 15 bp, Homo sapiens
agagggtgtgcaggt

SEQ ID NO: 66192 - DNA, 15 bp, Homo sapiens
gagggtgtgcaggtg

SEQ ID NO: 66193 - DNA, 15 bp, Homo sapiens
agggtgtgcaggtga

SEQ ID NO: 66194 - DNA, 15 bp, Homo sapiens
gggtgtgcaggtgaa

SEQ ID NO: 66195 - DNA, 15 bp, Homo sapiens
ggtgtgcaggtgaaa

SEQ ID NO: 66196 - DNA, 15 bp, Homo sapiens
gtgtgcaggtgaaaa

SEQ ID NO: 66197 - DNA, 15 bp, Homo sapiens
tgtgcaggtgaaaag

SEQ ID NO: 66198 - DNA, 15 bp, Homo sapiens
gtgcaggtgaaaagg

SEQ ID NO: 66199 - DNA, 15 bp, Homo sapiens
tgcaggtgaaaaggg

SEQ ID NO: 66200 - DNA, 15 bp, Homo sapiens
gcaggtgaaaagggt

SEQ ID NO: 66201 - DNA, 15 bp, Homo sapiens
caggtgaaaagggtc

SEQ ID NO: 66202 - DNA, 15 bp, Homo sapiens
aggtgaaaagggtcc

SEQ ID NO: 66203 - DNA, 15 bp, Homo sapiens
ggtgaaaagggtcct

SEQ ID NO: 66204 - DNA, 15 bp, Homo sapiens
gtgaaaagggtcctg

SEQ ID NO: 66205 - DNA, 15 bp, Homo sapiens
tgaaaagggtcctgg

SEQ ID NO: 66206 - DNA, 15 bp, Homo sapiens
gaaaagggtcctgga

SEQ ID NO: 66207 - DNA, 15 bp, Homo sapiens
aaaagggtcctggag

SEQ ID NO: 66208 - DNA, 15 bp, Homo sapiens
aaagggtcctggaga

SEQ ID NO: 66209 - DNA, 15 bp, Homo sapiens
aagggtcctggagaa

SEQ ID NO: 66210 - DNA, 15 bp, Homo sapiens
agggtcctggagaaa

SEQ ID NO: 66211 - DNA, 15 bp, Homo sapiens
gggtcctggagaaaa

SEQ ID NO: 66212 - DNA, 15 bp, Homo sapiens
ggtcctggagaaaag

SEQ ID NO: 66213 - DNA, 15 bp, Homo sapiens
gtcctggagaaaagt

SEQ ID NO: 66214 - DNA, 15 bp, Homo sapiens
tcctggagaaaagtc

SEQ ID NO: 66215 - DNA, 15 bp, Homo sapiens
cctggagaaaagtcc

SEQ ID NO: 66216 - DNA, 15 bp, Homo sapiens
ctggagaaaagtcct

SEQ ID NO: 66217 - DNA, 15 bp, Homo sapiens
tggagaaaagtcctg

SEQ ID NO: 66218 - DNA, 15 bp, Homo sapiens
ggagaaaagtcctgg

SEQ ID NO: 66219 - DNA, 15 bp, Homo sapiens
gagaaaagtcctggg

SEQ ID NO: 66220 - DNA, 15 bp, Homo sapiens
agaaaagtcctggga

SEQ ID NO: 66221 - DNA, 15 bp, Homo sapiens
gaaaagtcctgggaa

SEQ ID NO: 66222 - DNA, 15 bp, Homo sapiens
aaaagtcctgggaag

SEQ ID NO: 66223 - DNA, 15 bp, Homo sapiens
aaagtcctgggaagc

SEQ ID NO: 66224 - DNA, 15 bp, Homo sapiens
aagtcctgggaagct

SEQ ID NO: 66225 - DNA, 15 bp, Homo sapiens
agtcctgggaagctc

SEQ ID NO: 66226 - DNA, 15 bp, Homo sapiens
gtcctgggaagctcc

SEQ ID NO: 66227 - DNA, 15 bp, Homo sapiens
tcctgggaagctcct

SEQ ID NO: 66228 - DNA, 15 bp, Homo sapiens
cctgggaagctcctt

SEQ ID NO: 66229 - DNA, 15 bp, Homo sapiens
ctgggaagctccttg

SEQ ID NO: 66230 - DNA, 15 bp, Homo sapiens
tgggaagctccttgt

SEQ ID NO: 66231 - DNA, 15 bp, Homo sapiens
gggaagctccttgtc

SEQ ID NO: 66232 - DNA, 15 bp, Homo sapiens
ggaagctccttgtca

SEQ ID NO: 66233 - DNA, 15 bp, Homo sapiens
gaagctccttgtcaa

SEQ ID NO: 66234 - DNA, 15 bp, Homo sapiens
aagctccttgtcaag

SEQ ID NO: 66235 - DNA, 15 bp, Homo sapiens
agctccttgtcaaga

SEQ ID NO: 66236 - DNA, 15 bp, Homo sapiens
gctccttgtcaagat

SEQ ID NO: 66237 - DNA, 15 bp, Homo sapiens
ctccttgtcaagatg

SEQ ID NO: 66238 - DNA, 15 bp, Homo sapiens
tccttgtcaagatgc

SEQ ID NO: 66239 - DNA, 15 bp, Homo sapiens
ccttgtcaagatgcc

SEQ ID NO: 66240 - DNA, 15 bp, Homo sapiens
cttgtcaagatgcct

SEQ ID NO: 66241 - DNA, 15 bp, Homo sapiens
ttgtcaagatgcctt

SEQ ID NO: 66242 - DNA, 15 bp, Homo sapiens
tgtcaagatgccttt

SEQ ID NO: 66243 - DNA, 15 bp, Homo sapiens
gtcaagatgcctttt

SEQ ID NO: 66244 - DNA, 15 bp, Homo sapiens
tcaagatgccttttc

SEQ ID NO: 66245 - DNA, 15 bp, Homo sapiens
caagatgccttttca

SEQ ID NO: 66246 - DNA, 15 bp, Homo sapiens
aagatgccttttcaa

SEQ ID NO: 66247 - DNA, 15 bp, Homo sapiens
agatgccttttcaaa

SEQ ID NO: 66248 - DNA, 15 bp, Homo sapiens
gatgccttttcaaac

SEQ ID NO: 66249 - DNA, 15 bp, Homo sapiens
atgccttttcaaact

SEQ ID NO: 66250 - DNA, 15 bp, Homo sapiens
tgccttttcaaactt

SEQ ID NO: 66251 - DNA, 15 bp, Homo sapiens
gccttttcaaacttc

SEQ ID NO: 66252 - DNA, 15 bp, Homo sapiens
ccttttcaaacttcg

SEQ ID NO: 66253 - DNA, 15 bp, Homo sapiens
cttttcaaacttcgc

SEQ ID NO: 66254 - DNA, 15 bp, Homo sapiens
ttttcaaacttcgcc

SEQ ID NO: 66255 - DNA, 15 bp, Homo sapiens
tttcaaacttcgcca

SEQ ID NO: 66256 - DNA, 15 bp, Homo sapiens
ttcaaacttcgccag

SEQ ID NO: 66257 - DNA, 15 bp, Homo sapiens
tcaaacttcgccagg

SEQ ID NO: 66258 - DNA, 15 bp, Homo sapiens
caaacttcgccaggg

SEQ ID NO: 66259 - DNA, 15 bp, Homo sapiens
aaacttcgccagggg

SEQ ID NO: 66260 - DNA, 15 bp, Homo sapiens
aacttcgccaggggg

SEQ ID NO: 66261 - DNA, 15 bp, Homo sapiens
acttcgccagggggc

SEQ ID NO: 66262 - DNA, 15 bp, Homo sapiens
cttcgccagggggca

SEQ ID NO: 66263 - DNA, 15 bp, Homo sapiens
ttcgccagggggcaa

SEQ ID NO: 66264 - DNA, 15 bp, Homo sapiens
tcgccagggggcaag

SEQ ID NO: 66265 - DNA, 15 bp, Homo sapiens
cgccagggggcaagg

SEQ ID NO: 66266 - DNA, 15 bp, Homo sapiens
gccagggggcaaggc

SEQ ID NO: 66267 - DNA, 15 bp, Homo sapiens
ccagggggcaaggct

SEQ ID NO: 66268 - DNA, 15 bp, Homo sapiens
cagggggcaaggctg

SEQ ID NO: 66269 - DNA, 15 bp, Homo sapiens
agggggcaaggctga

SEQ ID NO: 66270 - DNA, 15 bp, Homo sapiens
gggggcaaggctgag

SEQ ID NO: 66271 - DNA, 15 bp, Homo sapiens
ggggcaaggctgagg

SEQ ID NO: 66272 - DNA, 15 bp, Homo sapiens
gggcaaggctgaggg

SEQ ID NO: 66273 - DNA, 15 bp, Homo sapiens
ggcaaggctgagggg

SEQ ID NO: 66274 - DNA, 15 bp, Homo sapiens
gcaaggctgaggggg

SEQ ID NO: 66275 - DNA, 15 bp, Homo sapiens
caaggctgagggggg

SEQ ID NO: 66276 - DNA, 15 bp, Homo sapiens
aaggctgaggggggt

SEQ ID NO: 66277 - DNA, 15 bp, Homo sapiens
aggctgaggggggtg

SEQ ID NO: 66278 - DNA, 15 bp, Homo sapiens
ggctgaggggggtgg

SEQ ID NO: 66279 - DNA, 15 bp, Homo sapiens
gctgaggggggtggg

SEQ ID NO: 66280 - DNA, 15 bp, Homo sapiens
ctgaggggggtgggg

SEQ ID NO: 66281 - DNA, 15 bp, Homo sapiens
tgaggggggtggggc

SEQ ID NO: 66282 - DNA, 15 bp, Homo sapiens
gaggggggtggggcc

SEQ ID NO: 66283 - DNA, 15 bp, Homo sapiens
aggggggtggggcca

SEQ ID NO: 66284 - DNA, 15 bp, Homo sapiens
ggggggtggggccac

SEQ ID NO: 66285 - DNA, 15 bp, Homo sapiens
gggggtggggccacc

SEQ ID NO: 66286 - DNA, 15 bp, Homo sapiens
ggggtggggccacca

SEQ ID NO: 66287 - DNA, 15 bp, Homo sapiens
gggtggggccaccac

SEQ ID NO: 66288 - DNA, 15 bp, Homo sapiens
ggtggggccaccaca

SEQ ID NO: 66289 - DNA, 15 bp, Homo sapiens
gtggggccaccacat

SEQ ID NO: 66290 - DNA, 15 bp, Homo sapiens
tggggccaccacatc

SEQ ID NO: 66291 - DNA, 15 bp, Homo sapiens
ggggccaccacatcc

SEQ ID NO: 66292 - DNA, 15 bp, Homo sapiens
gggccaccacatcca

SEQ ID NO: 66293 - DNA, 15 bp, Homo sapiens
ggccaccacatccac

SEQ ID NO: 66294 - DNA, 15 bp, Homo sapiens
gccaccacatccacc

SEQ ID NO: 66295 - DNA, 15 bp, Homo sapiens
ccaccacatccaccc

SEQ ID NO: 66296 - DNA, 15 bp, Homo sapiens
caccacatccaccca

SEQ ID NO: 66297 - DNA, 15 bp, Homo sapiens
accacatccacccag

SEQ ID NO: 66298 - DNA, 15 bp, Homo sapiens
ccacatccacccagg

SEQ ID NO: 66299 - DNA, 15 bp, Homo sapiens
cacatccacccaggt

SEQ ID NO: 66300 - DNA, 15 bp, Homo sapiens
acatccacccaggtc

SEQ ID NO: 66301 - DNA, 15 bp, Homo sapiens
catccacccaggtca

SEQ ID NO: 66302 - DNA, 15 bp, Homo sapiens
atccacccaggtcat

SEQ ID NO: 66303 - DNA, 15 bp, Homo sapiens
tccacccaggtcatg

SEQ ID NO: 66304 - DNA, 15 bp, Homo sapiens
ccacccaggtcatgg

SEQ ID NO: 66305 - DNA, 15 bp, Homo sapiens
cacccaggtcatggt

SEQ ID NO: 66306 - DNA, 15 bp, Homo sapiens
acccaggtcatggtg

SEQ ID NO: 66307 - DNA, 15 bp, Homo sapiens
cccaggtcatggtga

SEQ ID NO: 66308 - DNA, 15 bp, Homo sapiens
ccaggtcatggtgat

SEQ ID NO: 66309 - DNA, 15 bp, Homo sapiens
caggtcatggtgatc

SEQ ID NO: 66310 - DNA, 15 bp, Homo sapiens
aggtcatggtgatca

SEQ ID NO: 66311 - DNA, 15 bp, Homo sapiens
ggtcatggtgatcaa

SEQ ID NO: 66312 - DNA, 15 bp, Homo sapiens
gtcatggtgatcaaa

SEQ ID NO: 66313 - DNA, 15 bp, Homo sapiens
tcatggtgatcaaac

SEQ ID NO: 66314 - DNA, 15 bp, Homo sapiens
catggtgatcaaacg

SEQ ID NO: 66315 - DNA, 15 bp, Homo sapiens
atggtgatcaaacgc

SEQ ID NO: 66316 - DNA, 15 bp, Homo sapiens
tggtgatcaaacgcc

SEQ ID NO: 66317 - DNA, 15 bp, Homo sapiens
ggtgatcaaacgccc

SEQ ID NO: 66318 - DNA, 15 bp, Homo sapiens
gtgatcaaacgcccc

SEQ ID NO: 66319 - DNA, 15 bp, Homo sapiens
tgatcaaacgccccg

SEQ ID NO: 66320 - DNA, 15 bp, Homo sapiens
gatcaaacgccccgg

SEQ ID NO: 66321 - DNA, 15 bp, Homo sapiens
atcaaacgccccggc

SEQ ID NO: 66322 - DNA, 15 bp, Homo sapiens
tcaaacgccccggca

SEQ ID NO: 66323 - DNA, 15 bp, Homo sapiens
caaacgccccggcag

SEQ ID NO: 66324 - DNA, 15 bp, Homo sapiens
aaacgccccggcagg

SEQ ID NO: 66325 - DNA, 15 bp, Homo sapiens
aacgccccggcagga

SEQ ID NO: 66326 - DNA, 15 bp, Homo sapiens
acgccccggcaggaa

SEQ ID NO: 66327 - DNA, 15 bp, Homo sapiens
cgccccggcaggaag

SEQ ID NO: 66328 - DNA, 15 bp, Homo sapiens
gccccggcaggaagc

SEQ ID NO: 66329 - DNA, 15 bp, Homo sapiens
ccccggcaggaagcg

SEQ ID NO: 66330 - DNA, 15 bp, Homo sapiens
cccggcaggaagcga

SEQ ID NO: 66331 - DNA, 15 bp, Homo sapiens
ccggcaggaagcgaa

SEQ ID NO: 66332 - DNA, 15 bp, Homo sapiens
cggcaggaagcgaaa

SEQ ID NO: 66333 - DNA, 15 bp, Homo sapiens
ggcaggaagcgaaaa

SEQ ID NO: 66334 - DNA, 15 bp, Homo sapiens
gcaggaagcgaaaag

SEQ ID NO: 66335 - DNA, 15 bp, Homo sapiens
caggaagcgaaaagc

SEQ ID NO: 66336 - DNA, 15 bp, Homo sapiens
aggaagcgaaaagct

SEQ ID NO: 66337 - DNA, 15 bp, Homo sapiens
ggaagcgaaaagctg

SEQ ID NO: 66338 - DNA, 15 bp, Homo sapiens
gaagcgaaaagctga

SEQ ID NO: 66339 - DNA, 15 bp, Homo sapiens
aagcgaaaagctgag

SEQ ID NO: 66340 - DNA, 15 bp, Homo sapiens
agcgaaaagctgagg

SEQ ID NO: 66341 - DNA, 15 bp, Homo sapiens
gcgaaaagctgaggc

SEQ ID NO: 66342 - DNA, 15 bp, Homo sapiens
cgaaaagctgaggcc

SEQ ID NO: 66343 - DNA, 15 bp, Homo sapiens
gaaaagctgaggccg

SEQ ID NO: 66344 - DNA, 15 bp, Homo sapiens
aaaagctgaggccga

SEQ ID NO: 66345 - DNA, 15 bp, Homo sapiens
aaagctgaggccgac

SEQ ID NO: 66346 - DNA, 15 bp, Homo sapiens
aagctgaggccgacc

SEQ ID NO: 66347 - DNA, 15 bp, Homo sapiens
agctgaggccgaccc

SEQ ID NO: 66348 - DNA, 15 bp, Homo sapiens
gctgaggccgaccct

SEQ ID NO: 66349 - DNA, 15 bp, Homo sapiens
ctgaggccgaccctc

SEQ ID NO: 66350 - DNA, 15 bp, Homo sapiens
tgaggccgaccctca

SEQ ID NO: 66351 - DNA, 15 bp, Homo sapiens
gaggccgaccctcag

SEQ ID NO: 66352 - DNA, 15 bp, Homo sapiens
aggccgaccctcagg

SEQ ID NO: 66353 - DNA, 15 bp, Homo sapiens
ggccgaccctcaggc

SEQ ID NO: 66354 - DNA, 15 bp, Homo sapiens
gccgaccctcaggcc

SEQ ID NO: 66355 - DNA, 15 bp, Homo sapiens
ccgaccctcaggcca

SEQ ID NO: 66356 - DNA, 15 bp, Homo sapiens
cgaccctcaggccat

SEQ ID NO: 66357 - DNA, 15 bp, Homo sapiens
gaccctcaggccatt

SEQ ID NO: 66358 - DNA, 15 bp, Homo sapiens
accctcaggccattc

SEQ ID NO: 66359 - DNA, 15 bp, Homo sapiens
ccctcaggccattcc

SEQ ID NO: 66360 - DNA, 15 bp, Homo sapiens
cctcaggccattccc

SEQ ID NO: 66361 - DNA, 15 bp, Homo sapiens
ctcaggccattccca

SEQ ID NO: 66362 - DNA, 15 bp, Homo sapiens
tcaggccattcccaa

SEQ ID NO: 66363 - DNA, 15 bp, Homo sapiens
caggccattcccaag

SEQ ID NO: 66364 - DNA, 15 bp, Homo sapiens
aggccattcccaaga

SEQ ID NO: 66365 - DNA, 15 bp, Homo sapiens
ggccattcccaagaa

SEQ ID NO: 66366 - DNA, 15 bp, Homo sapiens
gccattcccaagaaa

SEQ ID NO: 66367 - DNA, 15 bp, Homo sapiens
ccattcccaagaaac

SEQ ID NO: 66368 - DNA, 15 bp, Homo sapiens
cattcccaagaaacg

SEQ ID NO: 66369 - DNA, 15 bp, Homo sapiens
attcccaagaaacgg

SEQ ID NO: 66370 - DNA, 15 bp, Homo sapiens
ttcccaagaaacggg

SEQ ID NO: 66371 - DNA, 15 bp, Homo sapiens
tcccaagaaacgggg

SEQ ID NO: 66372 - DNA, 15 bp, Homo sapiens
cccaagaaacggggc

SEQ ID NO: 66373 - DNA, 15 bp, Homo sapiens
ccaagaaacggggcc

SEQ ID NO: 66374 - DNA, 15 bp, Homo sapiens
caagaaacggggccg

SEQ ID NO: 66375 - DNA, 15 bp, Homo sapiens
aagaaacggggccga

SEQ ID NO: 66376 - DNA, 15 bp, Homo sapiens
agaaacggggccgaa

SEQ ID NO: 66377 - DNA, 15 bp, Homo sapiens
gaaacggggccgaaa

SEQ ID NO: 66378 - DNA, 15 bp, Homo sapiens
aaacggggccgaaag

SEQ ID NO: 66379 - DNA, 15 bp, Homo sapiens
aacggggccgaaagc

SEQ ID NO: 66380 - DNA, 15 bp, Homo sapiens
acggggccgaaagcc

SEQ ID NO: 66381 - DNA, 15 bp, Homo sapiens
cggggccgaaagccg

SEQ ID NO: 66382 - DNA, 15 bp, Homo sapiens
ggggccgaaagccgg

SEQ ID NO: 66383 - DNA, 15 bp, Homo sapiens
gggccgaaagccggg

SEQ ID NO: 66384 - DNA, 15 bp, Homo sapiens
ggccgaaagccgggg

SEQ ID NO: 66385 - DNA, 15 bp, Homo sapiens
gccgaaagccgggga

SEQ ID NO: 66386 - DNA, 15 bp, Homo sapiens
ccgaaagccggggag

SEQ ID NO: 66387 - DNA, 15 bp, Homo sapiens
cgaaagccggggagt

SEQ ID NO: 66388 - DNA, 15 bp, Homo sapiens
gaaagccggggagtg

SEQ ID NO: 66389 - DNA, 15 bp, Homo sapiens
aaagccggggagtgt

SEQ ID NO: 66390 - DNA, 15 bp, Homo sapiens
aagccggggagtgtg

SEQ ID NO: 66391 - DNA, 15 bp, Homo sapiens
agccggggagtgtgg

SEQ ID NO: 66392 - DNA, 15 bp, Homo sapiens
gccggggagtgtggt

SEQ ID NO: 66393 - DNA, 15 bp, Homo sapiens
ccggggagtgtggtg

SEQ ID NO: 66394 - DNA, 15 bp, Homo sapiens
cggggagtgtggtgg

SEQ ID NO: 66395 - DNA, 15 bp, Homo sapiens
ggggagtgtggtggc

SEQ ID NO: 66396 - DNA, 15 bp, Homo sapiens
gggagtgtggtggca

SEQ ID NO: 66397 - DNA, 15 bp, Homo sapiens
ggagtgtggtggcag

SEQ ID NO: 66398 - DNA, 15 bp, Homo sapiens
gagtgtggtggcagc

SEQ ID NO: 66399 - DNA, 15 bp, Homo sapiens
agtgtggtggcagcc

SEQ ID NO: 66400 - DNA, 15 bp, Homo sapiens
gtgtggtggcagccg

SEQ ID NO: 66401 - DNA, 15 bp, Homo sapiens
tgtggtggcagccgc

SEQ ID NO: 66402 - DNA, 15 bp, Homo sapiens
gtggtggcagccgct

SEQ ID NO: 66403 - DNA, 15 bp, Homo sapiens
tggtggcagccgctg

SEQ ID NO: 66404 - DNA, 15 bp, Homo sapiens
ggtggcagccgctgc

SEQ ID NO: 66405 - DNA, 15 bp, Homo sapiens
gtggcagccgctgcc

SEQ ID NO: 66406 - DNA, 15 bp, Homo sapiens
tggcagccgctgccg

SEQ ID NO: 66407 - DNA, 15 bp, Homo sapiens
ggcagccgctgccgc

SEQ ID NO: 66408 - DNA, 15 bp, Homo sapiens
gcagccgctgccgcc

SEQ ID NO: 66409 - DNA, 15 bp, Homo sapiens
cagccgctgccgccg

SEQ ID NO: 66410 - DNA, 15 bp, Homo sapiens
agccgctgccgccga

SEQ ID NO: 66411 - DNA, 15 bp, Homo sapiens
gccgctgccgccgag

SEQ ID NO: 66412 - DNA, 15 bp, Homo sapiens
ccgctgccgccgagg

SEQ ID NO: 66413 - DNA, 15 bp, Homo sapiens
cgctgccgccgaggc

SEQ ID NO: 66414 - DNA, 15 bp, Homo sapiens
gctgccgccgaggcc

SEQ ID NO: 66415 - DNA, 15 bp, Homo sapiens
ctgccgccgaggcca

SEQ ID NO: 66416 - DNA, 15 bp, Homo sapiens
tgccgccgaggccaa

SEQ ID NO: 66417 - DNA, 15 bp, Homo sapiens
gccgccgaggccaaa

SEQ ID NO: 66418 - DNA, 15 bp, Homo sapiens
ccgccgaggccaaaa

SEQ ID NO: 66419 - DNA, 15 bp, Homo sapiens
cgccgaggccaaaaa

SEQ ID NO: 66420 - DNA, 15 bp, Homo sapiens
gccgaggccaaaaag

SEQ ID NO: 66421 - DNA, 15 bp, Homo sapiens
ccgaggccaaaaaga

SEQ ID NO: 66422 - DNA, 15 bp, Homo sapiens
cgaggccaaaaagaa

SEQ ID NO: 66423 - DNA, 15 bp, Homo sapiens
gaggccaaaaagaaa

SEQ ID NO: 66424 - DNA, 15 bp, Homo sapiens
aggccaaaaagaaag

SEQ ID NO: 66425 - DNA, 15 bp, Homo sapiens
ggccaaaaagaaagc

SEQ ID NO: 66426 - DNA, 15 bp, Homo sapiens
gccaaaaagaaagcc

SEQ ID NO: 66427 - DNA, 15 bp, Homo sapiens
ccaaaaagaaagccg

SEQ ID NO: 66428 - DNA, 15 bp, Homo sapiens
caaaaagaaagccgt

SEQ ID NO: 66429 - DNA, 15 bp, Homo sapiens
aaaaagaaagccgtg

SEQ ID NO: 66430 - DNA, 15 bp, Homo sapiens
aaaagaaagccgtga

SEQ ID NO: 66431 - DNA, 15 bp, Homo sapiens
aaagaaagccgtgaa

SEQ ID NO: 66432 - DNA, 15 bp, Homo sapiens
aagaaagccgtgaag

SEQ ID NO: 66433 - DNA, 15 bp, Homo sapiens
agaaagccgtgaagg

SEQ ID NO: 66434 - DNA, 15 bp, Homo sapiens
gaaagccgtgaagga

SEQ ID NO: 66435 - DNA, 15 bp, Homo sapiens
aaagccgtgaaggag

SEQ ID NO: 66436 - DNA, 15 bp, Homo sapiens
aagccgtgaaggagt

SEQ ID NO: 66437 - DNA, 15 bp, Homo sapiens
agccgtgaaggagtc

SEQ ID NO: 66438 - DNA, 15 bp, Homo sapiens
gccgtgaaggagtct

SEQ ID NO: 66439 - DNA, 15 bp, Homo sapiens
ccgtgaaggagtctt

SEQ ID NO: 66440 - DNA, 15 bp, Homo sapiens
cgtgaaggagtcttc

SEQ ID NO: 66441 - DNA, 15 bp, Homo sapiens
gtgaaggagtcttct

SEQ ID NO: 66442 - DNA, 15 bp, Homo sapiens
tgaaggagtcttcta

SEQ ID NO: 66443 - DNA, 15 bp, Homo sapiens
gaaggagtcttctat

SEQ ID NO: 66444 - DNA, 15 bp, Homo sapiens
aaggagtcttctatc

SEQ ID NO: 66445 - DNA, 15 bp, Homo sapiens
aggagtcttctatcc

SEQ ID NO: 66446 - DNA, 15 bp, Homo sapiens
ggagtcttctatccg

SEQ ID NO: 66447 - DNA, 15 bp, Homo sapiens
gagtcttctatccga

SEQ ID NO: 66448 - DNA, 15 bp, Homo sapiens
agtcttctatccgat

SEQ ID NO: 66449 - DNA, 15 bp, Homo sapiens
gtcttctatccgatc

SEQ ID NO: 66450 - DNA, 15 bp, Homo sapiens
tcttctatccgatct

SEQ ID NO: 66451 - DNA, 15 bp, Homo sapiens
cttctatccgatctg

SEQ ID NO: 66452 - DNA, 15 bp, Homo sapiens
ttctatccgatctgt

SEQ ID NO: 66453 - DNA, 15 bp, Homo sapiens
tctatccgatctgtg

SEQ ID NO: 66454 - DNA, 15 bp, Homo sapiens
ctatccgatctgtgc

SEQ ID NO: 66455 - DNA, 15 bp, Homo sapiens
tatccgatctgtgca

SEQ ID NO: 66456 - DNA, 15 bp, Homo sapiens
atccgatctgtgcag

SEQ ID NO: 66457 - DNA, 15 bp, Homo sapiens
tccgatctgtgcagg

SEQ ID NO: 66458 - DNA, 15 bp, Homo sapiens
ccgatctgtgcagga

SEQ ID NO: 66459 - DNA, 15 bp, Homo sapiens
cgatctgtgcaggag

SEQ ID NO: 66460 - DNA, 15 bp, Homo sapiens
gatctgtgcaggaga

SEQ ID NO: 66461 - DNA, 15 bp, Homo sapiens
atctgtgcaggagac

SEQ ID NO: 66462 - DNA, 15 bp, Homo sapiens
tctgtgcaggagacc

SEQ ID NO: 66463 - DNA, 15 bp, Homo sapiens
ctgtgcaggagaccg

SEQ ID NO: 66464 - DNA, 15 bp, Homo sapiens
tgtgcaggagaccgt

SEQ ID NO: 66465 - DNA, 15 bp, Homo sapiens
gtgcaggagaccgta

SEQ ID NO: 66466 - DNA, 15 bp, Homo sapiens
tgcaggagaccgtac

SEQ ID NO: 66467 - DNA, 15 bp, Homo sapiens
gcaggagaccgtact

SEQ ID NO: 66468 - DNA, 15 bp, Homo sapiens
caggagaccgtactc

SEQ ID NO: 66469 - DNA, 15 bp, Homo sapiens
aggagaccgtactcc

SEQ ID NO: 66470 - DNA, 15 bp, Homo sapiens
ggagaccgtactccc

SEQ ID NO: 66471 - DNA, 15 bp, Homo sapiens
gagaccgtactcccc

SEQ ID NO: 66472 - DNA, 15 bp, Homo sapiens
agaccgtactcccca

SEQ ID NO: 66473 - DNA, 15 bp, Homo sapiens
gaccgtactccccat

SEQ ID NO: 66474 - DNA, 15 bp, Homo sapiens
accgtactccccatc

SEQ ID NO: 66475 - DNA, 15 bp, Homo sapiens
ccgtactccccatca

SEQ ID NO: 66476 - DNA, 15 bp, Homo sapiens
cgtactccccatcaa

SEQ ID NO: 66477 - DNA, 15 bp, Homo sapiens
gtactccccatcaag

SEQ ID NO: 66478 - DNA, 15 bp, Homo sapiens
tactccccatcaaga

SEQ ID NO: 66479 - DNA, 15 bp, Homo sapiens
actccccatcaagaa

SEQ ID NO: 66480 - DNA, 15 bp, Homo sapiens
ctccccatcaagaag

SEQ ID NO: 66481 - DNA, 15 bp, Homo sapiens
tccccatcaagaagc

SEQ ID NO: 66482 - DNA, 15 bp, Homo sapiens
ccccatcaagaagcg

SEQ ID NO: 66483 - DNA, 15 bp, Homo sapiens
cccatcaagaagcgc

SEQ ID NO: 66484 - DNA, 15 bp, Homo sapiens
ccatcaagaagcgca

SEQ ID NO: 66485 - DNA, 15 bp, Homo sapiens
catcaagaagcgcaa

SEQ ID NO: 66486 - DNA, 15 bp, Homo sapiens
atcaagaagcgcaag

SEQ ID NO: 66487 - DNA, 15 bp, Homo sapiens
tcaagaagcgcaaga

SEQ ID NO: 66488 - DNA, 15 bp, Homo sapiens
caagaagcgcaagac

SEQ ID NO: 66489 - DNA, 15 bp, Homo sapiens
aagaagcgcaagacc

SEQ ID NO: 66490 - DNA, 15 bp, Homo sapiens
agaagcgcaagaccc

SEQ ID NO: 66491 - DNA, 15 bp, Homo sapiens
gaagcgcaagacccg

SEQ ID NO: 66492 - DNA, 15 bp, Homo sapiens
aagcgcaagacccgg

SEQ ID NO: 66493 - DNA, 15 bp, Homo sapiens
agcgcaagacccggg

SEQ ID NO: 66494 - DNA, 15 bp, Homo sapiens
gcgcaagacccggga

SEQ ID NO: 66495 - DNA, 15 bp, Homo sapiens
cgcaagacccgggag

SEQ ID NO: 66496 - DNA, 15 bp, Homo sapiens
gcaagacccgggaga

SEQ ID NO: 66497 - DNA, 15 bp, Homo sapiens
caagacccgggagac

SEQ ID NO: 66498 - DNA, 15 bp, Homo sapiens
aagacccgggagacg

SEQ ID NO: 66499 - DNA, 15 bp, Homo sapiens
agacccgggagacgg

SEQ ID NO: 66500 - DNA, 15 bp, Homo sapiens
gacccgggagacggt

SEQ ID NO: 66501 - DNA, 15 bp, Homo sapiens
acccgggagacggtc

SEQ ID NO: 66502 - DNA, 15 bp, Homo sapiens
cccgggagacggtca

SEQ ID NO: 66503 - DNA, 15 bp, Homo sapiens
ccgggagacggtcag

SEQ ID NO: 66504 - DNA, 15 bp, Homo sapiens
cgggagacggtcagc

SEQ ID NO: 66505 - DNA, 15 bp, Homo sapiens
gggagacggtcagca

SEQ ID NO: 66506 - DNA, 15 bp, Homo sapiens
ggagacggtcagcat

SEQ ID NO: 66507 - DNA, 15 bp, Homo sapiens
gagacggtcagcatc

SEQ ID NO: 66508 - DNA, 15 bp, Homo sapiens
agacggtcagcatcg

SEQ ID NO: 66509 - DNA, 15 bp, Homo sapiens
gacggtcagcatcga

SEQ ID NO: 66510 - DNA, 15 bp, Homo sapiens
acggtcagcatcgag

SEQ ID NO: 66511 - DNA, 15 bp, Homo sapiens
cggtcagcatcgagg

SEQ ID NO: 66512 - DNA, 15 bp, Homo sapiens
ggtcagcatcgaggt

SEQ ID NO: 66513 - DNA, 15 bp, Homo sapiens
gtcagcatcgaggtc

SEQ ID NO: 66514 - DNA, 15 bp, Homo sapiens
tcagcatcgaggtca

SEQ ID NO: 66515 - DNA, 15 bp, Homo sapiens
cagcatcgaggtcaa

SEQ ID NO: 66516 - DNA, 15 bp, Homo sapiens
agcatcgaggtcaag

SEQ ID NO: 66517 - DNA, 15 bp, Homo sapiens
gcatcgaggtcaagg

SEQ ID NO: 66518 - DNA, 15 bp, Homo sapiens
catcgaggtcaagga

SEQ ID NO: 66519 - DNA, 15 bp, Homo sapiens
atcgaggtcaaggaa

SEQ ID NO: 66520 - DNA, 15 bp, Homo sapiens
tcgaggtcaaggaag

SEQ ID NO: 66521 - DNA, 15 bp, Homo sapiens
cgaggtcaaggaagt

SEQ ID NO: 66522 - DNA, 15 bp, Homo sapiens
gaggtcaaggaagtg

SEQ ID NO: 66523 - DNA, 15 bp, Homo sapiens
aggtcaaggaagtgg

SEQ ID NO: 66524 - DNA, 15 bp, Homo sapiens
ggtcaaggaagtggt

SEQ ID NO: 66525 - DNA, 15 bp, Homo sapiens
gtcaaggaagtggtg

SEQ ID NO: 66526 - DNA, 15 bp, Homo sapiens
tcaaggaagtggtga

SEQ ID NO: 66527 - DNA, 15 bp, Homo sapiens
caaggaagtggtgaa

SEQ ID NO: 66528 - DNA, 15 bp, Homo sapiens
aaggaagtggtgaag

SEQ ID NO: 66529 - DNA, 15 bp, Homo sapiens
aggaagtggtgaagc

SEQ ID NO: 66530 - DNA, 15 bp, Homo sapiens
ggaagtggtgaagcc

SEQ ID NO: 66531 - DNA, 15 bp, Homo sapiens
gaagtggtgaagccc

SEQ ID NO: 66532 - DNA, 15 bp, Homo sapiens
aagtggtgaagcccc

SEQ ID NO: 66533 - DNA, 15 bp, Homo sapiens
agtggtgaagcccct

SEQ ID NO: 66534 - DNA, 15 bp, Homo sapiens
gtggtgaagcccctg

SEQ ID NO: 66535 - DNA, 15 bp, Homo sapiens
tggtgaagcccctgc

SEQ ID NO: 66536 - DNA, 15 bp, Homo sapiens
ggtgaagcccctgct

SEQ ID NO: 66537 - DNA, 15 bp, Homo sapiens
gtgaagcccctgctg

SEQ ID NO: 66538 - DNA, 15 bp, Homo sapiens
tgaagcccctgctgg

SEQ ID NO: 66539 - DNA, 15 bp, Homo sapiens
gaagcccctgctggt

SEQ ID NO: 66540 - DNA, 15 bp, Homo sapiens
aagcccctgctggtg

SEQ ID NO: 66541 - DNA, 15 bp, Homo sapiens
agcccctgctggtgt

SEQ ID NO: 66542 - DNA, 15 bp, Homo sapiens
gcccctgctggtgtc

SEQ ID NO: 66543 - DNA, 15 bp, Homo sapiens
cccctgctggtgtcc

SEQ ID NO: 66544 - DNA, 15 bp, Homo sapiens
ccctgctggtgtcca

SEQ ID NO: 66545 - DNA, 15 bp, Homo sapiens
cctgctggtgtccac

SEQ ID NO: 66546 - DNA, 15 bp, Homo sapiens
ctgctggtgtccacc

SEQ ID NO: 66547 - DNA, 15 bp, Homo sapiens
tgctggtgtccaccc

SEQ ID NO: 66548 - DNA, 15 bp, Homo sapiens
gctggtgtccaccct

SEQ ID NO: 66549 - DNA, 15 bp, Homo sapiens
ctggtgtccaccctc

SEQ ID NO: 66550 - DNA, 15 bp, Homo sapiens
tggtgtccaccctcg

SEQ ID NO: 66551 - DNA, 15 bp, Homo sapiens
ggtgtccaccctcgg

SEQ ID NO: 66552 - DNA, 15 bp, Homo sapiens
gtgtccaccctcggt

SEQ ID NO: 66553 - DNA, 15 bp, Homo sapiens
tgtccaccctcggtg

SEQ ID NO: 66554 - DNA, 15 bp, Homo sapiens
gtccaccctcggtga

SEQ ID NO: 66555 - DNA, 15 bp, Homo sapiens
tccaccctcggtgag

SEQ ID NO: 66556 - DNA, 15 bp, Homo sapiens
ccaccctcggtgaga

SEQ ID NO: 66557 - DNA, 15 bp, Homo sapiens
caccctcggtgagaa

SEQ ID NO: 66558 - DNA, 15 bp, Homo sapiens
accctcggtgagaag

SEQ ID NO: 66559 - DNA, 15 bp, Homo sapiens
ccctcggtgagaaga

SEQ ID NO: 66560 - DNA, 15 bp, Homo sapiens
cctcggtgagaagag

SEQ ID NO: 66561 - DNA, 15 bp, Homo sapiens
ctcggtgagaagagc

SEQ ID NO: 66562 - DNA, 15 bp, Homo sapiens
tcggtgagaagagcg

SEQ ID NO: 66563 - DNA, 15 bp, Homo sapiens
cggtgagaagagcgg

SEQ ID NO: 66564 - DNA, 15 bp, Homo sapiens
ggtgagaagagcggg

SEQ ID NO: 66565 - DNA, 15 bp, Homo sapiens
gtgagaagagcggga

SEQ ID NO: 66566 - DNA, 15 bp, Homo sapiens
tgagaagagcgggaa

SEQ ID NO: 66567 - DNA, 15 bp, Homo sapiens
gagaagagcgggaaa

SEQ ID NO: 66568 - DNA, 15 bp, Homo sapiens
agaagagcgggaaag

SEQ ID NO: 66569 - DNA, 15 bp, Homo sapiens
gaagagcgggaaagg

SEQ ID NO: 66570 - DNA, 15 bp, Homo sapiens
aagagcgggaaagga

SEQ ID NO: 66571 - DNA, 15 bp, Homo sapiens
agagcgggaaaggac

SEQ ID NO: 66572 - DNA, 15 bp, Homo sapiens
gagcgggaaaggact

SEQ ID NO: 66573 - DNA, 15 bp, Homo sapiens
agcgggaaaggactg

SEQ ID NO: 66574 - DNA, 15 bp, Homo sapiens
gcgggaaaggactga

SEQ ID NO: 66575 - DNA, 15 bp, Homo sapiens
cgggaaaggactgaa

SEQ ID NO: 66576 - DNA, 15 bp, Homo sapiens
gggaaaggactgaag

SEQ ID NO: 66577 - DNA, 15 bp, Homo sapiens
ggaaaggactgaaga

SEQ ID NO: 66578 - DNA, 15 bp, Homo sapiens
gaaaggactgaagac

SEQ ID NO: 66579 - DNA, 15 bp, Homo sapiens
aaaggactgaagacc

SEQ ID NO: 66580 - DNA, 15 bp, Homo sapiens
aaggactgaagacct

SEQ ID NO: 66581 - DNA, 15 bp, Homo sapiens
aggactgaagacctg

SEQ ID NO: 66582 - DNA, 15 bp, Homo sapiens
ggactgaagacctgt

SEQ ID NO: 66583 - DNA, 15 bp, Homo sapiens
gactgaagacctgta

SEQ ID NO: 66584 - DNA, 15 bp, Homo sapiens
actgaagacctgtaa

SEQ ID NO: 66585 - DNA, 15 bp, Homo sapiens
ctgaagacctgtaag

SEQ ID NO: 66586 - DNA, 15 bp, Homo sapiens
tgaagacctgtaaga

SEQ ID NO: 66587 - DNA, 15 bp, Homo sapiens
gaagacctgtaagag

SEQ ID NO: 66588 - DNA, 15 bp, Homo sapiens
aagacctgtaagagc

SEQ ID NO: 66589 - DNA, 15 bp, Homo sapiens
agacctgtaagagcc

SEQ ID NO: 66590 - DNA, 15 bp, Homo sapiens
gacctgtaagagccc

SEQ ID NO: 66591 - DNA, 15 bp, Homo sapiens
acctgtaagagccct

SEQ ID NO: 66592 - DNA, 15 bp, Homo sapiens
cctgtaagagccctg

SEQ ID NO: 66593 - DNA, 15 bp, Homo sapiens
ctgtaagagccctgg

SEQ ID NO: 66594 - DNA, 15 bp, Homo sapiens
tgtaagagccctggg

SEQ ID NO: 66595 - DNA, 15 bp, Homo sapiens
gtaagagccctgggc

SEQ ID NO: 66596 - DNA, 15 bp, Homo sapiens
taagagccctgggcg

SEQ ID NO: 66597 - DNA, 15 bp, Homo sapiens
aagagccctgggcgg

SEQ ID NO: 66598 - DNA, 15 bp, Homo sapiens
agagccctgggcgga

SEQ ID NO: 66599 - DNA, 15 bp, Homo sapiens
gagccctgggcggaa

SEQ ID NO: 66600 - DNA, 15 bp, Homo sapiens
agccctgggcggaaa

SEQ ID NO: 66601 - DNA, 15 bp, Homo sapiens
gccctgggcggaaaa

SEQ ID NO: 66602 - DNA, 15 bp, Homo sapiens
ccctgggcggaaaag

SEQ ID NO: 66603 - DNA, 15 bp, Homo sapiens
cctgggcggaaaagc

SEQ ID NO: 66604 - DNA, 15 bp, Homo sapiens
ctgggcggaaaagca

SEQ ID NO: 66605 - DNA, 15 bp, Homo sapiens
tgggcggaaaagcaa

SEQ ID NO: 66606 - DNA, 15 bp, Homo sapiens
gggcggaaaagcaag

SEQ ID NO: 66607 - DNA, 15 bp, Homo sapiens
ggcggaaaagcaagg

SEQ ID NO: 66608 - DNA, 15 bp, Homo sapiens
gcggaaaagcaagga

SEQ ID NO: 66609 - DNA, 15 bp, Homo sapiens
cggaaaagcaaggag

SEQ ID NO: 66610 - DNA, 15 bp, Homo sapiens
ggaaaagcaaggaga

SEQ ID NO: 66611 - DNA, 15 bp, Homo sapiens
gaaaagcaaggagag

SEQ ID NO: 66612 - DNA, 15 bp, Homo sapiens
aaaagcaaggagagc

SEQ ID NO: 66613 - DNA, 15 bp, Homo sapiens
aaagcaaggagagca

SEQ ID NO: 66614 - DNA, 15 bp, Homo sapiens
aagcaaggagagcag

SEQ ID NO: 66615 - DNA, 15 bp, Homo sapiens
agcaaggagagcagc

SEQ ID NO: 66616 - DNA, 15 bp, Homo sapiens
gcaaggagagcagcc

SEQ ID NO: 66617 - DNA, 15 bp, Homo sapiens
caaggagagcagccc

SEQ ID NO: 66618 - DNA, 15 bp, Homo sapiens
aaggagagcagcccc

SEQ ID NO: 66619 - DNA, 15 bp, Homo sapiens
aggagagcagcccca

SEQ ID NO: 66620 - DNA, 15 bp, Homo sapiens
ggagagcagccccaa

SEQ ID NO: 66621 - DNA, 15 bp, Homo sapiens
gagagcagccccaag

SEQ ID NO: 66622 - DNA, 15 bp, Homo sapiens
agagcagccccaagg

SEQ ID NO: 66623 - DNA, 15 bp, Homo sapiens
gagcagccccaaggg

SEQ ID NO: 66624 - DNA, 15 bp, Homo sapiens
agcagccccaagggg

SEQ ID NO: 66625 - DNA, 15 bp, Homo sapiens
gcagccccaaggggc

SEQ ID NO: 66626 - DNA, 15 bp, Homo sapiens
cagccccaaggggcg

SEQ ID NO: 66627 - DNA, 15 bp, Homo sapiens
agccccaaggggcgc

SEQ ID NO: 66628 - DNA, 15 bp, Homo sapiens
gccccaaggggcgca

SEQ ID NO: 66629 - DNA, 15 bp, Homo sapiens
ccccaaggggcgcag

SEQ ID NO: 66630 - DNA, 15 bp, Homo sapiens
cccaaggggcgcagc

SEQ ID NO: 66631 - DNA, 15 bp, Homo sapiens
ccaaggggcgcagca

SEQ ID NO: 66632 - DNA, 15 bp, Homo sapiens
caaggggcgcagcag

SEQ ID NO: 66633 - DNA, 15 bp, Homo sapiens
aaggggcgcagcagc

SEQ ID NO: 66634 - DNA, 15 bp, Homo sapiens
aggggcgcagcagca

SEQ ID NO: 66635 - DNA, 15 bp, Homo sapiens
ggggcgcagcagcag

SEQ ID NO: 66636 - DNA, 15 bp, Homo sapiens
gggcgcagcagcagc

SEQ ID NO: 66637 - DNA, 15 bp, Homo sapiens
ggcgcagcagcagcg

SEQ ID NO: 66638 - DNA, 15 bp, Homo sapiens
gcgcagcagcagcgc

SEQ ID NO: 66639 - DNA, 15 bp, Homo sapiens
cgcagcagcagcgcc

SEQ ID NO: 66640 - DNA, 15 bp, Homo sapiens
gcagcagcagcgcct

SEQ ID NO: 66641 - DNA, 15 bp, Homo sapiens
cagcagcagcgcctc

SEQ ID NO: 66642 - DNA, 15 bp, Homo sapiens
agcagcagcgcctcc

SEQ ID NO: 66643 - DNA, 15 bp, Homo sapiens
gcagcagcgcctcct

SEQ ID NO: 66644 - DNA, 15 bp, Homo sapiens
cagcagcgcctcctc

SEQ ID NO: 66645 - DNA, 15 bp, Homo sapiens
agcagcgcctcctca

SEQ ID NO: 66646 - DNA, 15 bp, Homo sapiens
gcagcgcctcctcac

SEQ ID NO: 66647 - DNA, 15 bp, Homo sapiens
cagcgcctcctcacc

SEQ ID NO: 66648 - DNA, 15 bp, Homo sapiens
agcgcctcctcaccc

SEQ ID NO: 66649 - DNA, 15 bp, Homo sapiens
gcgcctcctcacccc

SEQ ID NO: 66650 - DNA, 15 bp, Homo sapiens
cgcctcctcaccccc

SEQ ID NO: 66651 - DNA, 15 bp, Homo sapiens
gcctcctcacccccc

SEQ ID NO: 66652 - DNA, 15 bp, Homo sapiens
cctcctcacccccca

SEQ ID NO: 66653 - DNA, 15 bp, Homo sapiens
ctcctcaccccccaa

SEQ ID NO: 66654 - DNA, 15 bp, Homo sapiens
tcctcaccccccaag

SEQ ID NO: 66655 - DNA, 15 bp, Homo sapiens
cctcaccccccaaga

SEQ ID NO: 66656 - DNA, 15 bp, Homo sapiens
ctcaccccccaagaa

SEQ ID NO: 66657 - DNA, 15 bp, Homo sapiens
tcaccccccaagaag

SEQ ID NO: 66658 - DNA, 15 bp, Homo sapiens
caccccccaagaagg

SEQ ID NO: 66659 - DNA, 15 bp, Homo sapiens
accccccaagaagga

SEQ ID NO: 66660 - DNA, 15 bp, Homo sapiens
ccccccaagaaggag

SEQ ID NO: 66661 - DNA, 15 bp, Homo sapiens
cccccaagaaggagc

SEQ ID NO: 66662 - DNA, 15 bp, Homo sapiens
ccccaagaaggagca

SEQ ID NO: 66663 - DNA, 15 bp, Homo sapiens
cccaagaaggagcac

SEQ ID NO: 66664 - DNA, 15 bp, Homo sapiens
ccaagaaggagcacc

SEQ ID NO: 66665 - DNA, 15 bp, Homo sapiens
caagaaggagcacca

SEQ ID NO: 66666 - DNA, 15 bp, Homo sapiens
aagaaggagcaccac

SEQ ID NO: 66667 - DNA, 15 bp, Homo sapiens
agaaggagcaccacc

SEQ ID NO: 66668 - DNA, 15 bp, Homo sapiens
gaaggagcaccacca

SEQ ID NO: 66669 - DNA, 15 bp, Homo sapiens
aaggagcaccaccac

SEQ ID NO: 66670 - DNA, 15 bp, Homo sapiens
aggagcaccaccacc

SEQ ID NO: 66671 - DNA, 15 bp, Homo sapiens
ggagcaccaccacca

SEQ ID NO: 66672 - DNA, 15 bp, Homo sapiens
gagcaccaccaccat

SEQ ID NO: 66673 - DNA, 15 bp, Homo sapiens
agcaccaccaccatc

SEQ ID NO: 66674 - DNA, 15 bp, Homo sapiens
gcaccaccaccatca

SEQ ID NO: 66675 - DNA, 15 bp, Homo sapiens
caccaccaccatcac

SEQ ID NO: 66676 - DNA, 15 bp, Homo sapiens
accaccaccatcacc

SEQ ID NO: 66677 - DNA, 15 bp, Homo sapiens
ccaccaccatcacca

SEQ ID NO: 66678 - DNA, 15 bp, Homo sapiens
caccaccatcaccac

SEQ ID NO: 66679 - DNA, 15 bp, Homo sapiens
accaccatcaccacc

SEQ ID NO: 66680 - DNA, 15 bp, Homo sapiens
ccaccatcaccacca

SEQ ID NO: 66681 - DNA, 15 bp, Homo sapiens
caccatcaccaccac

SEQ ID NO: 66682 - DNA, 15 bp, Homo sapiens
accatcaccaccact

SEQ ID NO: 66683 - DNA, 15 bp, Homo sapiens
ccatcaccaccactc

SEQ ID NO: 66684 - DNA, 15 bp, Homo sapiens
catcaccaccactca

SEQ ID NO: 66685 - DNA, 15 bp, Homo sapiens
atcaccaccactcag

SEQ ID NO: 66686 - DNA, 15 bp, Homo sapiens
tcaccaccactcaga

SEQ ID NO: 66687 - DNA, 15 bp, Homo sapiens
caccaccactcagag

SEQ ID NO: 66688 - DNA, 15 bp, Homo sapiens
accaccactcagagt

SEQ ID NO: 66689 - DNA, 15 bp, Homo sapiens
ccaccactcagagtc

SEQ ID NO: 66690 - DNA, 15 bp, Homo sapiens
caccactcagagtcc

SEQ ID NO: 66691 - DNA, 15 bp, Homo sapiens
accactcagagtccc

SEQ ID NO: 66692 - DNA, 15 bp, Homo sapiens
ccactcagagtcccc

SEQ ID NO: 66693 - DNA, 15 bp, Homo sapiens
cactcagagtcccca

SEQ ID NO: 66694 - DNA, 15 bp, Homo sapiens
actcagagtccccaa

SEQ ID NO: 66695 - DNA, 15 bp, Homo sapiens
ctcagagtccccaaa

SEQ ID NO: 66696 - DNA, 15 bp, Homo sapiens
tcagagtccccaaag

SEQ ID NO: 66697 - DNA, 15 bp, Homo sapiens
cagagtccccaaagg

SEQ ID NO: 66698 - DNA, 15 bp, Homo sapiens
agagtccccaaaggc

SEQ ID NO: 66699 - DNA, 15 bp, Homo sapiens
gagtccccaaaggcc

SEQ ID NO: 66700 - DNA, 15 bp, Homo sapiens
agtccccaaaggccc

SEQ ID NO: 66701 - DNA, 15 bp, Homo sapiens
gtccccaaaggcccc

SEQ ID NO: 66702 - DNA, 15 bp, Homo sapiens
tccccaaaggccccc

SEQ ID NO: 66703 - DNA, 15 bp, Homo sapiens
ccccaaaggcccccg

SEQ ID NO: 66704 - DNA, 15 bp, Homo sapiens
cccaaaggcccccgt

SEQ ID NO: 66705 - DNA, 15 bp, Homo sapiens
ccaaaggcccccgtg

SEQ ID NO: 66706 - DNA, 15 bp, Homo sapiens
caaaggcccccgtgc

SEQ ID NO: 66707 - DNA, 15 bp, Homo sapiens
aaaggcccccgtgcc

SEQ ID NO: 66708 - DNA, 15 bp, Homo sapiens
aaggcccccgtgcca

SEQ ID NO: 66709 - DNA, 15 bp, Homo sapiens
aggcccccgtgccac

SEQ ID NO: 66710 - DNA, 15 bp, Homo sapiens
ggcccccgtgccact

SEQ ID NO: 66711 - DNA, 15 bp, Homo sapiens
gcccccgtgccactg

SEQ ID NO: 66712 - DNA, 15 bp, Homo sapiens
cccccgtgccactgc

SEQ ID NO: 66713 - DNA, 15 bp, Homo sapiens
ccccgtgccactgct

SEQ ID NO: 66714 - DNA, 15 bp, Homo sapiens
cccgtgccactgctc

SEQ ID NO: 66715 - DNA, 15 bp, Homo sapiens
ccgtgccactgctcc

SEQ ID NO: 66716 - DNA, 15 bp, Homo sapiens
cgtgccactgctccc

SEQ ID NO: 66717 - DNA, 15 bp, Homo sapiens
gtgccactgctccca

SEQ ID NO: 66718 - DNA, 15 bp, Homo sapiens
tgccactgctcccac

SEQ ID NO: 66719 - DNA, 15 bp, Homo sapiens
gccactgctcccacc

SEQ ID NO: 66720 - DNA, 15 bp, Homo sapiens
ccactgctcccaccc

SEQ ID NO: 66721 - DNA, 15 bp, Homo sapiens
cactgctcccacccc

SEQ ID NO: 66722 - DNA, 15 bp, Homo sapiens
actgctcccacccct

SEQ ID NO: 66723 - DNA, 15 bp, Homo sapiens
ctgctcccacccctg

SEQ ID NO: 66724 - DNA, 15 bp, Homo sapiens
tgctcccacccctgc

SEQ ID NO: 66725 - DNA, 15 bp, Homo sapiens
gctcccacccctgcc

SEQ ID NO: 66726 - DNA, 15 bp, Homo sapiens
ctcccacccctgccc

SEQ ID NO: 66727 - DNA, 15 bp, Homo sapiens
tcccacccctgcccc

SEQ ID NO: 66728 - DNA, 15 bp, Homo sapiens
cccacccctgccccc

SEQ ID NO: 66729 - DNA, 15 bp, Homo sapiens
ccacccctgccccca

SEQ ID NO: 66730 - DNA, 15 bp, Homo sapiens
cacccctgcccccac

SEQ ID NO: 66731 - DNA, 15 bp, Homo sapiens
acccctgcccccacc

SEQ ID NO: 66732 - DNA, 15 bp, Homo sapiens
cccctgcccccacct

SEQ ID NO: 66733 - DNA, 15 bp, Homo sapiens
ccctgcccccacctc

SEQ ID NO: 66734 - DNA, 15 bp, Homo sapiens
cctgcccccacctcc

SEQ ID NO: 66735 - DNA, 15 bp, Homo sapiens
ctgcccccacctcca

SEQ ID NO: 66736 - DNA, 15 bp, Homo sapiens
tgcccccacctccac

SEQ ID NO: 66737 - DNA, 15 bp, Homo sapiens
gcccccacctccacc

SEQ ID NO: 66738 - DNA, 15 bp, Homo sapiens
cccccacctccacct

SEQ ID NO: 66739 - DNA, 15 bp, Homo sapiens
ccccacctccacctg

SEQ ID NO: 66740 - DNA, 15 bp, Homo sapiens
cccacctccacctga

SEQ ID NO: 66741 - DNA, 15 bp, Homo sapiens
ccacctccacctgag

SEQ ID NO: 66742 - DNA, 15 bp, Homo sapiens
cacctccacctgagc

SEQ ID NO: 66743 - DNA, 15 bp, Homo sapiens
acctccacctgagcc

SEQ ID NO: 66744 - DNA, 15 bp, Homo sapiens
cctccacctgagccc

SEQ ID NO: 66745 - DNA, 15 bp, Homo sapiens
ctccacctgagcccg

SEQ ID NO: 66746 - DNA, 15 bp, Homo sapiens
tccacctgagcccga

SEQ ID NO: 66747 - DNA, 15 bp, Homo sapiens
ccacctgagcccgag

SEQ ID NO: 66748 - DNA, 15 bp, Homo sapiens
cacctgagcccgaga

SEQ ID NO: 66749 - DNA, 15 bp, Homo sapiens
acctgagcccgagag

SEQ ID NO: 66750 - DNA, 15 bp, Homo sapiens
cctgagcccgagagc

SEQ ID NO: 66751 - DNA, 15 bp, Homo sapiens
ctgagcccgagagct

SEQ ID NO: 66752 - DNA, 15 bp, Homo sapiens
tgagcccgagagctc

SEQ ID NO: 66753 - DNA, 15 bp, Homo sapiens
gagcccgagagctcc

SEQ ID NO: 66754 - DNA, 15 bp, Homo sapiens
agcccgagagctccg

SEQ ID NO: 66755 - DNA, 15 bp, Homo sapiens
gcccgagagctccga

SEQ ID NO: 66756 - DNA, 15 bp, Homo sapiens
cccgagagctccgag

SEQ ID NO: 66757 - DNA, 15 bp, Homo sapiens
ccgagagctccgagg

SEQ ID NO: 66758 - DNA, 15 bp, Homo sapiens
cgagagctccgagga

SEQ ID NO: 66759 - DNA, 15 bp, Homo sapiens
gagagctccgaggac

SEQ ID NO: 66760 - DNA, 15 bp, Homo sapiens
agagctccgaggacc

SEQ ID NO: 66761 - DNA, 15 bp, Homo sapiens
gagctccgaggaccc

SEQ ID NO: 66762 - DNA, 15 bp, Homo sapiens
agctccgaggacccc

SEQ ID NO: 66763 - DNA, 15 bp, Homo sapiens
gctccgaggacccca

SEQ ID NO: 66764 - DNA, 15 bp, Homo sapiens
ctccgaggaccccac

SEQ ID NO: 66765 - DNA, 15 bp, Homo sapiens
tccgaggaccccacc

SEQ ID NO: 66766 - DNA, 15 bp, Homo sapiens
ccgaggaccccacca

SEQ ID NO: 66767 - DNA, 15 bp, Homo sapiens
cgaggaccccaccag

SEQ ID NO: 66768 - DNA, 15 bp, Homo sapiens
gaggaccccaccagc

SEQ ID NO: 66769 - DNA, 15 bp, Homo sapiens
aggaccccaccagcc

SEQ ID NO: 66770 - DNA, 15 bp, Homo sapiens
ggaccccaccagccc

SEQ ID NO: 66771 - DNA, 15 bp, Homo sapiens
gaccccaccagcccc

SEQ ID NO: 66772 - DNA, 15 bp, Homo sapiens
accccaccagccccc

SEQ ID NO: 66773 - DNA, 15 bp, Homo sapiens
ccccaccagcccccc

SEQ ID NO: 66774 - DNA, 15 bp, Homo sapiens
cccaccagcccccct

SEQ ID NO: 66775 - DNA, 15 bp, Homo sapiens
ccaccagcccccctg

SEQ ID NO: 66776 - DNA, 15 bp, Homo sapiens
caccagcccccctga

SEQ ID NO: 66777 - DNA, 15 bp, Homo sapiens
accagcccccctgag

SEQ ID NO: 66778 - DNA, 15 bp, Homo sapiens
ccagcccccctgagc

SEQ ID NO: 66779 - DNA, 15 bp, Homo sapiens
cagcccccctgagcc

SEQ ID NO: 66780 - DNA, 15 bp, Homo sapiens
agcccccctgagccc

SEQ ID NO: 66781 - DNA, 15 bp, Homo sapiens
gcccccctgagcccc

SEQ ID NO: 66782 - DNA, 15 bp, Homo sapiens
cccccctgagcccca

SEQ ID NO: 66783 - DNA, 15 bp, Homo sapiens
ccccctgagccccag

SEQ ID NO: 66784 - DNA, 15 bp, Homo sapiens
cccctgagccccagg

SEQ ID NO: 66785 - DNA, 15 bp, Homo sapiens
ccctgagccccagga

SEQ ID NO: 66786 - DNA, 15 bp, Homo sapiens
cctgagccccaggac

SEQ ID NO: 66787 - DNA, 15 bp, Homo sapiens
ctgagccccaggact

SEQ ID NO: 66788 - DNA, 15 bp, Homo sapiens
tgagccccaggactt

SEQ ID NO: 66789 - DNA, 15 bp, Homo sapiens
gagccccaggacttg

SEQ ID NO: 66790 - DNA, 15 bp, Homo sapiens
agccccaggacttga

SEQ ID NO: 66791 - DNA, 15 bp, Homo sapiens
gccccaggacttgag

SEQ ID NO: 66792 - DNA, 15 bp, Homo sapiens
ccccaggacttgagc

SEQ ID NO: 66793 - DNA, 15 bp, Homo sapiens
cccaggacttgagca

SEQ ID NO: 66794 - DNA, 15 bp, Homo sapiens
ccaggacttgagcag

SEQ ID NO: 66795 - DNA, 15 bp, Homo sapiens
caggacttgagcagc

SEQ ID NO: 66796 - DNA, 15 bp, Homo sapiens
aggacttgagcagca

SEQ ID NO: 66797 - DNA, 15 bp, Homo sapiens
ggacttgagcagcag

SEQ ID NO: 66798 - DNA, 15 bp, Homo sapiens
gacttgagcagcagc

SEQ ID NO: 66799 - DNA, 15 bp, Homo sapiens
acttgagcagcagcg

SEQ ID NO: 66800 - DNA, 15 bp, Homo sapiens
cttgagcagcagcgt

SEQ ID NO: 66801 - DNA, 15 bp, Homo sapiens
ttgagcagcagcgtc

SEQ ID NO: 66802 - DNA, 15 bp, Homo sapiens
tgagcagcagcgtct

SEQ ID NO: 66803 - DNA, 15 bp, Homo sapiens
gagcagcagcgtctg

SEQ ID NO: 66804 - DNA, 15 bp, Homo sapiens
agcagcagcgtctgc

SEQ ID NO: 66805 - DNA, 15 bp, Homo sapiens
gcagcagcgtctgca

SEQ ID NO: 66806 - DNA, 15 bp, Homo sapiens
cagcagcgtctgcaa

SEQ ID NO: 66807 - DNA, 15 bp, Homo sapiens
agcagcgtctgcaaa

SEQ ID NO: 66808 - DNA, 15 bp, Homo sapiens
gcagcgtctgcaaag

SEQ ID NO: 66809 - DNA, 15 bp, Homo sapiens
cagcgtctgcaaaga

SEQ ID NO: 66810 - DNA, 15 bp, Homo sapiens
agcgtctgcaaagag

SEQ ID NO: 66811 - DNA, 15 bp, Homo sapiens
gcgtctgcaaagagg

SEQ ID NO: 66812 - DNA, 15 bp, Homo sapiens
cgtctgcaaagagga

SEQ ID NO: 66813 - DNA, 15 bp, Homo sapiens
gtctgcaaagaggag

SEQ ID NO: 66814 - DNA, 15 bp, Homo sapiens
tctgcaaagaggaga

SEQ ID NO: 66815 - DNA, 15 bp, Homo sapiens
ctgcaaagaggagaa

SEQ ID NO: 66816 - DNA, 15 bp, Homo sapiens
tgcaaagaggagaag

SEQ ID NO: 66817 - DNA, 15 bp, Homo sapiens
gcaaagaggagaaga

SEQ ID NO: 66818 - DNA, 15 bp, Homo sapiens
caaagaggagaagat

SEQ ID NO: 66819 - DNA, 15 bp, Homo sapiens
aaagaggagaagatg

SEQ ID NO: 66820 - DNA, 15 bp, Homo sapiens
aagaggagaagatgc

SEQ ID NO: 66821 - DNA, 15 bp, Homo sapiens
agaggagaagatgcc

SEQ ID NO: 66822 - DNA, 15 bp, Homo sapiens
gaggagaagatgccc

SEQ ID NO: 66823 - DNA, 15 bp, Homo sapiens
aggagaagatgccca

SEQ ID NO: 66824 - DNA, 15 bp, Homo sapiens
ggagaagatgcccag

SEQ ID NO: 66825 - DNA, 15 bp, Homo sapiens
gagaagatgcccaga

SEQ ID NO: 66826 - DNA, 15 bp, Homo sapiens
agaagatgcccagag

SEQ ID NO: 66827 - DNA, 15 bp, Homo sapiens
gaagatgcccagagg

SEQ ID NO: 66828 - DNA, 15 bp, Homo sapiens
aagatgcccagagga

SEQ ID NO: 66829 - DNA, 15 bp, Homo sapiens
agatgcccagaggag

SEQ ID NO: 66830 - DNA, 15 bp, Homo sapiens
gatgcccagaggagg

SEQ ID NO: 66831 - DNA, 15 bp, Homo sapiens
atgcccagaggaggc

SEQ ID NO: 66832 - DNA, 15 bp, Homo sapiens
tgcccagaggaggct

SEQ ID NO: 66833 - DNA, 15 bp, Homo sapiens
gcccagaggaggctc

SEQ ID NO: 66834 - DNA, 15 bp, Homo sapiens
cccagaggaggctca

SEQ ID NO: 66835 - DNA, 15 bp, Homo sapiens
ccagaggaggctcac

SEQ ID NO: 66836 - DNA, 15 bp, Homo sapiens
cagaggaggctcact

SEQ ID NO: 66837 - DNA, 15 bp, Homo sapiens
agaggaggctcactg

SEQ ID NO: 66838 - DNA, 15 bp, Homo sapiens
gaggaggctcactgg

SEQ ID NO: 66839 - DNA, 15 bp, Homo sapiens
aggaggctcactgga

SEQ ID NO: 66840 - DNA, 15 bp, Homo sapiens
ggaggctcactggag

SEQ ID NO: 66841 - DNA, 15 bp, Homo sapiens
gaggctcactggaga

SEQ ID NO: 66842 - DNA, 15 bp, Homo sapiens
aggctcactggagag

SEQ ID NO: 66843 - DNA, 15 bp, Homo sapiens
ggctcactggagagc

SEQ ID NO: 66844 - DNA, 15 bp, Homo sapiens
gctcactggagagcg

SEQ ID NO: 66845 - DNA, 15 bp, Homo sapiens
ctcactggagagcga

SEQ ID NO: 66846 - DNA, 15 bp, Homo sapiens
tcactggagagcgac

SEQ ID NO: 66847 - DNA, 15 bp, Homo sapiens
cactggagagcgacg

SEQ ID NO: 66848 - DNA, 15 bp, Homo sapiens
actggagagcgacgg

SEQ ID NO: 66849 - DNA, 15 bp, Homo sapiens
ctggagagcgacggc

SEQ ID NO: 66850 - DNA, 15 bp, Homo sapiens
tggagagcgacggct

SEQ ID NO: 66851 - DNA, 15 bp, Homo sapiens
ggagagcgacggctg

SEQ ID NO: 66852 - DNA, 15 bp, Homo sapiens
gagagcgacggctgc

SEQ ID NO: 66853 - DNA, 15 bp, Homo sapiens
agagcgacggctgcc

SEQ ID NO: 66854 - DNA, 15 bp, Homo sapiens
gagcgacggctgccc

SEQ ID NO: 66855 - DNA, 15 bp, Homo sapiens
agcgacggctgcccc

SEQ ID NO: 66856 - DNA, 15 bp, Homo sapiens
gcgacggctgcccca

SEQ ID NO: 66857 - DNA, 15 bp, Homo sapiens
cgacggctgccccaa

SEQ ID NO: 66858 - DNA, 15 bp, Homo sapiens
gacggctgccccaag

SEQ ID NO: 66859 - DNA, 15 bp, Homo sapiens
acggctgccccaagg

SEQ ID NO: 66860 - DNA, 15 bp, Homo sapiens
cggctgccccaagga

SEQ ID NO: 66861 - DNA, 15 bp, Homo sapiens
ggctgccccaaggag

SEQ ID NO: 66862 - DNA, 15 bp, Homo sapiens
gctgccccaaggagc

SEQ ID NO: 66863 - DNA, 15 bp, Homo sapiens
ctgccccaaggagcc

SEQ ID NO: 66864 - DNA, 15 bp, Homo sapiens
tgccccaaggagcca

SEQ ID NO: 66865 - DNA, 15 bp, Homo sapiens
gccccaaggagccag

SEQ ID NO: 66866 - DNA, 15 bp, Homo sapiens
ccccaaggagccagc

SEQ ID NO: 66867 - DNA, 15 bp, Homo sapiens
cccaaggagccagct

SEQ ID NO: 66868 - DNA, 15 bp, Homo sapiens
ccaaggagccagcta

SEQ ID NO: 66869 - DNA, 15 bp, Homo sapiens
caaggagccagctaa

SEQ ID NO: 66870 - DNA, 15 bp, Homo sapiens
aaggagccagctaag

SEQ ID NO: 66871 - DNA, 15 bp, Homo sapiens
aggagccagctaaga

SEQ ID NO: 66872 - DNA, 15 bp, Homo sapiens
ggagccagctaagac

SEQ ID NO: 66873 - DNA, 15 bp, Homo sapiens
gagccagctaagact

SEQ ID NO: 66874 - DNA, 15 bp, Homo sapiens
agccagctaagactc

SEQ ID NO: 66875 - DNA, 15 bp, Homo sapiens
gccagctaagactca

SEQ ID NO: 66876 - DNA, 15 bp, Homo sapiens
ccagctaagactcag

SEQ ID NO: 66877 - DNA, 15 bp, Homo sapiens
cagctaagactcagc

SEQ ID NO: 66878 - DNA, 15 bp, Homo sapiens
agctaagactcagcc

SEQ ID NO: 66879 - DNA, 15 bp, Homo sapiens
gctaagactcagccc

SEQ ID NO: 66880 - DNA, 15 bp, Homo sapiens
ctaagactcagcccg

SEQ ID NO: 66881 - DNA, 15 bp, Homo sapiens
taagactcagcccgc

SEQ ID NO: 66882 - DNA, 15 bp, Homo sapiens
aagactcagcccgcg

SEQ ID NO: 66883 - DNA, 15 bp, Homo sapiens
agactcagcccgcgg

SEQ ID NO: 66884 - DNA, 15 bp, Homo sapiens
gactcagcccgcggt

SEQ ID NO: 66885 - DNA, 15 bp, Homo sapiens
actcagcccgcggtt

SEQ ID NO: 66886 - DNA, 15 bp, Homo sapiens
ctcagcccgcggttg

SEQ ID NO: 66887 - DNA, 15 bp, Homo sapiens
tcagcccgcggttgc

SEQ ID NO: 66888 - DNA, 15 bp, Homo sapiens
cagcccgcggttgcc

SEQ ID NO: 66889 - DNA, 15 bp, Homo sapiens
agcccgcggttgcca

SEQ ID NO: 66890 - DNA, 15 bp, Homo sapiens
gcccgcggttgccac

SEQ ID NO: 66891 - DNA, 15 bp, Homo sapiens
cccgcggttgccacc

SEQ ID NO: 66892 - DNA, 15 bp, Homo sapiens
ccgcggttgccaccg

SEQ ID NO: 66893 - DNA, 15 bp, Homo sapiens
cgcggttgccaccgc

SEQ ID NO: 66894 - DNA, 15 bp, Homo sapiens
gcggttgccaccgcc

SEQ ID NO: 66895 - DNA, 15 bp, Homo sapiens
cggttgccaccgccg

SEQ ID NO: 66896 - DNA, 15 bp, Homo sapiens
ggttgccaccgccgc

SEQ ID NO: 66897 - DNA, 15 bp, Homo sapiens
gttgccaccgccgcc

SEQ ID NO: 66898 - DNA, 15 bp, Homo sapiens
ttgccaccgccgcca

SEQ ID NO: 66899 - DNA, 15 bp, Homo sapiens
tgccaccgccgccac

SEQ ID NO: 66900 - DNA, 15 bp, Homo sapiens
gccaccgccgccacg

SEQ ID NO: 66901 - DNA, 15 bp, Homo sapiens
ccaccgccgccacgg

SEQ ID NO: 66902 - DNA, 15 bp, Homo sapiens
caccgccgccacggc

SEQ ID NO: 66903 - DNA, 15 bp, Homo sapiens
accgccgccacggcc

SEQ ID NO: 66904 - DNA, 15 bp, Homo sapiens
ccgccgccacggccg

SEQ ID NO: 66905 - DNA, 15 bp, Homo sapiens
cgccgccacggccgc

SEQ ID NO: 66906 - DNA, 15 bp, Homo sapiens
gccgccacggccgca

SEQ ID NO: 66907 - DNA, 15 bp, Homo sapiens
ccgccacggccgcag

SEQ ID NO: 66908 - DNA, 15 bp, Homo sapiens
cgccacggccgcaga

SEQ ID NO: 66909 - DNA, 15 bp, Homo sapiens
gccacggccgcagaa

SEQ ID NO: 66910 - DNA, 15 bp, Homo sapiens
ccacggccgcagaaa

SEQ ID NO: 66911 - DNA, 15 bp, Homo sapiens
cacggccgcagaaaa

SEQ ID NO: 66912 - DNA, 15 bp, Homo sapiens
acggccgcagaaaag

SEQ ID NO: 66913 - DNA, 15 bp, Homo sapiens
cggccgcagaaaagt

SEQ ID NO: 66914 - DNA, 15 bp, Homo sapiens
ggccgcagaaaagta

SEQ ID NO: 66915 - DNA, 15 bp, Homo sapiens
gccgcagaaaagtac

SEQ ID NO: 66916 - DNA, 15 bp, Homo sapiens
ccgcagaaaagtaca

SEQ ID NO: 66917 - DNA, 15 bp, Homo sapiens
cgcagaaaagtacaa

SEQ ID NO: 66918 - DNA, 15 bp, Homo sapiens
gcagaaaagtacaaa

SEQ ID NO: 66919 - DNA, 15 bp, Homo sapiens
cagaaaagtacaaac

SEQ ID NO: 66920 - DNA, 15 bp, Homo sapiens
agaaaagtacaaaca

SEQ ID NO: 66921 - DNA, 15 bp, Homo sapiens
gaaaagtacaaacac

SEQ ID NO: 66922 - DNA, 15 bp, Homo sapiens
aaaagtacaaacacc

SEQ ID NO: 66923 - DNA, 15 bp, Homo sapiens
aaagtacaaacaccg

SEQ ID NO: 66924 - DNA, 15 bp, Homo sapiens
aagtacaaacaccga

SEQ ID NO: 66925 - DNA, 15 bp, Homo sapiens
agtacaaacaccgag

SEQ ID NO: 66926 - DNA, 15 bp, Homo sapiens
gtacaaacaccgagg

SEQ ID NO: 66927 - DNA, 15 bp, Homo sapiens
tacaaacaccgaggg

SEQ ID NO: 66928 - DNA, 15 bp, Homo sapiens
acaaacaccgagggg

SEQ ID NO: 66929 - DNA, 15 bp, Homo sapiens
caaacaccgagggga

SEQ ID NO: 66930 - DNA, 15 bp, Homo sapiens
aaacaccgaggggag

SEQ ID NO: 66931 - DNA, 15 bp, Homo sapiens
aacaccgaggggagg

SEQ ID NO: 66932 - DNA, 15 bp, Homo sapiens
acaccgaggggaggg

SEQ ID NO: 66933 - DNA, 15 bp, Homo sapiens
caccgaggggaggga

SEQ ID NO: 66934 - DNA, 15 bp, Homo sapiens
accgaggggagggag

SEQ ID NO: 66935 - DNA, 15 bp, Homo sapiens
ccgaggggagggaga

SEQ ID NO: 66936 - DNA, 15 bp, Homo sapiens
cgaggggagggagag

SEQ ID NO: 66937 - DNA, 15 bp, Homo sapiens
gaggggagggagagc

SEQ ID NO: 66938 - DNA, 15 bp, Homo sapiens
aggggagggagagcg

SEQ ID NO: 66939 - DNA, 15 bp, Homo sapiens
ggggagggagagcgc

SEQ ID NO: 66940 - DNA, 15 bp, Homo sapiens
gggagggagagcgca

SEQ ID NO: 66941 - DNA, 15 bp, Homo sapiens
ggagggagagcgcaa

SEQ ID NO: 66942 - DNA, 15 bp, Homo sapiens
gagggagagcgcaaa

SEQ ID NO: 66943 - DNA, 15 bp, Homo sapiens
agggagagcgcaaag

SEQ ID NO: 66944 - DNA, 15 bp, Homo sapiens
gggagagcgcaaaga

SEQ ID NO: 66945 - DNA, 15 bp, Homo sapiens
ggagagcgcaaagac

SEQ ID NO: 66946 - DNA, 15 bp, Homo sapiens
gagagcgcaaagaca

SEQ ID NO: 66947 - DNA, 15 bp, Homo sapiens
agagcgcaaagacat

SEQ ID NO: 66948 - DNA, 15 bp, Homo sapiens
gagcgcaaagacatt

SEQ ID NO: 66949 - DNA, 15 bp, Homo sapiens
agcgcaaagacattg

SEQ ID NO: 66950 - DNA, 15 bp, Homo sapiens
gcgcaaagacattgt

SEQ ID NO: 66951 - DNA, 15 bp, Homo sapiens
cgcaaagacattgtt

SEQ ID NO: 66952 - DNA, 15 bp, Homo sapiens
gcaaagacattgttt

SEQ ID NO: 66953 - DNA, 15 bp, Homo sapiens
caaagacattgtttc

SEQ ID NO: 66954 - DNA, 15 bp, Homo sapiens
aaagacattgtttca

SEQ ID NO: 66955 - DNA, 15 bp, Homo sapiens
aagacattgtttcat

SEQ ID NO: 66956 - DNA, 15 bp, Homo sapiens
agacattgtttcatc

SEQ ID NO: 66957 - DNA, 15 bp, Homo sapiens
gacattgtttcatcc

SEQ ID NO: 66958 - DNA, 15 bp, Homo sapiens
acattgtttcatcct

SEQ ID NO: 66959 - DNA, 15 bp, Homo sapiens
cattgtttcatcctc

SEQ ID NO: 66960 - DNA, 15 bp, Homo sapiens
attgtttcatcctcc

SEQ ID NO: 66961 - DNA, 15 bp, Homo sapiens
ttgtttcatcctcca

SEQ ID NO: 66962 - DNA, 15 bp, Homo sapiens
tgtttcatcctccat

SEQ ID NO: 66963 - DNA, 15 bp, Homo sapiens
gtttcatcctccatg

SEQ ID NO: 66964 - DNA, 15 bp, Homo sapiens
tttcatcctccatgc

SEQ ID NO: 66965 - DNA, 15 bp, Homo sapiens
ttcatcctccatgcc

SEQ ID NO: 66966 - DNA, 15 bp, Homo sapiens
tcatcctccatgcca

SEQ ID NO: 66967 - DNA, 15 bp, Homo sapiens
catcctccatgccaa

SEQ ID NO: 66968 - DNA, 15 bp, Homo sapiens
atcctccatgccaag

SEQ ID NO: 66969 - DNA, 15 bp, Homo sapiens
tcctccatgccaagg

SEQ ID NO: 66970 - DNA, 15 bp, Homo sapiens
cctccatgccaaggc

SEQ ID NO: 66971 - DNA, 15 bp, Homo sapiens
ctccatgccaaggcc

SEQ ID NO: 66972 - DNA, 15 bp, Homo sapiens
tccatgccaaggcca

SEQ ID NO: 66973 - DNA, 15 bp, Homo sapiens
ccatgccaaggccaa

SEQ ID NO: 66974 - DNA, 15 bp, Homo sapiens
catgccaaggccaaa

SEQ ID NO: 66975 - DNA, 15 bp, Homo sapiens
atgccaaggccaaac

SEQ ID NO: 66976 - DNA, 15 bp, Homo sapiens
tgccaaggccaaaca

SEQ ID NO: 66977 - DNA, 15 bp, Homo sapiens
gccaaggccaaacag

SEQ ID NO: 66978 - DNA, 15 bp, Homo sapiens
ccaaggccaaacaga

SEQ ID NO: 66979 - DNA, 15 bp, Homo sapiens
caaggccaaacagag

SEQ ID NO: 66980 - DNA, 15 bp, Homo sapiens
aaggccaaacagaga

SEQ ID NO: 66981 - DNA, 15 bp, Homo sapiens
aggccaaacagagag

SEQ ID NO: 66982 - DNA, 15 bp, Homo sapiens
ggccaaacagagagg

SEQ ID NO: 66983 - DNA, 15 bp, Homo sapiens
gccaaacagagagga

SEQ ID NO: 66984 - DNA, 15 bp, Homo sapiens
ccaaacagagaggag

SEQ ID NO: 66985 - DNA, 15 bp, Homo sapiens
caaacagagaggagc

SEQ ID NO: 66986 - DNA, 15 bp, Homo sapiens
aaacagagaggagcc

SEQ ID NO: 66987 - DNA, 15 bp, Homo sapiens
aacagagaggagcct

SEQ ID NO: 66988 - DNA, 15 bp, Homo sapiens
acagagaggagcctg

SEQ ID NO: 66989 - DNA, 15 bp, Homo sapiens
cagagaggagcctgt

SEQ ID NO: 66990 - DNA, 15 bp, Homo sapiens
agagaggagcctgtg

SEQ ID NO: 66991 - DNA, 15 bp, Homo sapiens
gagaggagcctgtgg

SEQ ID NO: 66992 - DNA, 15 bp, Homo sapiens
agaggagcctgtgga

SEQ ID NO: 66993 - DNA, 15 bp, Homo sapiens
gaggagcctgtggac

SEQ ID NO: 66994 - DNA, 15 bp, Homo sapiens
aggagcctgtggaca

SEQ ID NO: 66995 - DNA, 15 bp, Homo sapiens
ggagcctgtggacag

SEQ ID NO: 66996 - DNA, 15 bp, Homo sapiens
gagcctgtggacagc

SEQ ID NO: 66997 - DNA, 15 bp, Homo sapiens
agcctgtggacagcc

SEQ ID NO: 66998 - DNA, 15 bp, Homo sapiens
gcctgtggacagccg

SEQ ID NO: 66999 - DNA, 15 bp, Homo sapiens
cctgtggacagccgg

SEQ ID NO: 67000 - DNA, 15 bp, Homo sapiens
ctgtggacagccgga

SEQ ID NO: 67001 - DNA, 15 bp, Homo sapiens
tgtggacagccggac

SEQ ID NO: 67002 - DNA, 15 bp, Homo sapiens
gtggacagccggacg

SEQ ID NO: 67003 - DNA, 15 bp, Homo sapiens
tggacagccggacgc

SEQ ID NO: 67004 - DNA, 15 bp, Homo sapiens
ggacagccggacgcc

SEQ ID NO: 67005 - DNA, 15 bp, Homo sapiens
gacagccggacgccc

SEQ ID NO: 67006 - DNA, 15 bp, Homo sapiens
acagccggacgcccg

SEQ ID NO: 67007 - DNA, 15 bp, Homo sapiens
cagccggacgcccgt

SEQ ID NO: 67008 - DNA, 15 bp, Homo sapiens
agccggacgcccgtg

SEQ ID NO: 67009 - DNA, 15 bp, Homo sapiens
gccggacgcccgtga

SEQ ID NO: 67010 - DNA, 15 bp, Homo sapiens
ccggacgcccgtgac

SEQ ID NO: 67011 - DNA, 15 bp, Homo sapiens
cggacgcccgtgacc

SEQ ID NO: 67012 - DNA, 15 bp, Homo sapiens
ggacgcccgtgaccg

SEQ ID NO: 67013 - DNA, 15 bp, Homo sapiens
gacgcccgtgaccga

SEQ ID NO: 67014 - DNA, 15 bp, Homo sapiens
acgcccgtgaccgag

SEQ ID NO: 67015 - DNA, 15 bp, Homo sapiens
cgcccgtgaccgaga

SEQ ID NO: 67016 - DNA, 15 bp, Homo sapiens
gcccgtgaccgagag

SEQ ID NO: 67017 - DNA, 15 bp, Homo sapiens
cccgtgaccgagaga

SEQ ID NO: 67018 - DNA, 15 bp, Homo sapiens
ccgtgaccgagagag

SEQ ID NO: 67019 - DNA, 15 bp, Homo sapiens
cgtgaccgagagagt

SEQ ID NO: 67020 - DNA, 15 bp, Homo sapiens
gtgaccgagagagtt

SEQ ID NO: 67021 - DNA, 15 bp, Homo sapiens
tgaccgagagagtta

SEQ ID NO: 67022 - DNA, 15 bp, Homo sapiens
gaccgagagagttag

SEQ ID NO: 67023 - DNA, 15 bp, Homo sapiens
accgagagagttagc

SEQ ID NO: 67024 - DNA, 15 bp, Homo sapiens
ccgagagagttagct

SEQ ID NO: 67025 - DNA, 15 bp, Homo sapiens
cgagagagttagctg

SEQ ID NO: 67026 - DNA, 15 bp, Homo sapiens
gagagagttagctga

SEQ ID NO: 67027 - DNA, 15 bp, Homo sapiens
agagagttagctgac

SEQ ID NO: 67028 - DNA, 15 bp, Homo sapiens
gagagttagctgact

SEQ ID NO: 67029 - DNA, 15 bp, Homo sapiens
agagttagctgactt

SEQ ID NO: 67030 - DNA, 15 bp, Homo sapiens
gagttagctgacttt

SEQ ID NO: 67031 - DNA, 15 bp, Homo sapiens
agttagctgacttta

SEQ ID NO: 67032 - DNA, 15 bp, Homo sapiens
gttagctgactttac

SEQ ID NO: 67033 - DNA, 15 bp, Homo sapiens
ttagctgactttaca

SEQ ID NO: 67034 - DNA, 15 bp, Homo sapiens
tagctgactttacac

SEQ ID NO: 67035 - DNA, 15 bp, Homo sapiens
agctgactttacacg

SEQ ID NO: 67036 - DNA, 15 bp, Homo sapiens
gctgactttacacgg

SEQ ID NO: 67037 - DNA, 15 bp, Homo sapiens
ctgactttacacgga

SEQ ID NO: 67038 - DNA, 15 bp, Homo sapiens
tgactttacacggag

SEQ ID NO: 67039 - DNA, 15 bp, Homo sapiens
gactttacacggagc

SEQ ID NO: 67040 - DNA, 15 bp, Homo sapiens
actttacacggagcg

SEQ ID NO: 67041 - DNA, 15 bp, Homo sapiens
ctttacacggagcgg

SEQ ID NO: 67042 - DNA, 15 bp, Homo sapiens
tttacacggagcgga

SEQ ID NO: 67043 - DNA, 15 bp, Homo sapiens
ttacacggagcggat

SEQ ID NO: 67044 - DNA, 15 bp, Homo sapiens
tacacggagcggatt

SEQ ID NO: 67045 - DNA, 15 bp, Homo sapiens
acacggagcggattg

SEQ ID NO: 67046 - DNA, 15 bp, Homo sapiens
cacggagcggattgc

SEQ ID NO: 67047 - DNA, 15 bp, Homo sapiens
acggagcggattgca

SEQ ID NO: 67048 - DNA, 15 bp, Homo sapiens
cggagcggattgcaa

SEQ ID NO: 67049 - DNA, 15 bp, Homo sapiens
ggagcggattgcaaa

SEQ ID NO: 67050 - DNA, 15 bp, Homo sapiens
gagcggattgcaaag

SEQ ID NO: 67051 - DNA, 15 bp, Homo sapiens
agcggattgcaaagc

SEQ ID NO: 67052 - DNA, 15 bp, Homo sapiens
gcggattgcaaagca

SEQ ID NO: 67053 - DNA, 15 bp, Homo sapiens
cggattgcaaagcaa

SEQ ID NO: 67054 - DNA, 15 bp, Homo sapiens
ggattgcaaagcaaa

SEQ ID NO: 67055 - DNA, 15 bp, Homo sapiens
gattgcaaagcaaac

SEQ ID NO: 67056 - DNA, 15 bp, Homo sapiens
attgcaaagcaaacc

SEQ ID NO: 67057 - DNA, 15 bp, Homo sapiens
ttgcaaagcaaacca

SEQ ID NO: 67058 - DNA, 15 bp, Homo sapiens
tgcaaagcaaaccaa

SEQ ID NO: 67059 - DNA, 15 bp, Homo sapiens
gcaaagcaaaccaac

SEQ ID NO: 67060 - DNA, 15 bp, Homo sapiens
caaagcaaaccaaca

SEQ ID NO: 67061 - DNA, 15 bp, Homo sapiens
aaagcaaaccaacaa

SEQ ID NO: 67062 - DNA, 15 bp, Homo sapiens
aagcaaaccaacaag

SEQ ID NO: 67063 - DNA, 15 bp, Homo sapiens
agcaaaccaacaaga

SEQ ID NO: 67064 - DNA, 15 bp, Homo sapiens
gcaaaccaacaagaa

SEQ ID NO: 67065 - DNA, 15 bp, Homo sapiens
caaaccaacaagaat

SEQ ID NO: 67066 - DNA, 15 bp, Homo sapiens
aaaccaacaagaata

SEQ ID NO: 67067 - DNA, 15 bp, Homo sapiens
aaccaacaagaataa

SEQ ID NO: 67068 - DNA, 15 bp, Homo sapiens
accaacaagaataaa

SEQ ID NO: 67069 - DNA, 15 bp, Homo sapiens
ccaacaagaataaag

SEQ ID NO: 67070 - DNA, 15 bp, Homo sapiens
caacaagaataaagg

SEQ ID NO: 67071 - DNA, 15 bp, Homo sapiens
aacaagaataaaggc

SEQ ID NO: 67072 - DNA, 15 bp, Homo sapiens
acaagaataaaggca

SEQ ID NO: 67073 - DNA, 15 bp, Homo sapiens
caagaataaaggcag

SEQ ID NO: 67074 - DNA, 15 bp, Homo sapiens
aagaataaaggcagc

SEQ ID NO: 67075 - DNA, 15 bp, Homo sapiens
agaataaaggcagct

SEQ ID NO: 67076 - DNA, 15 bp, Homo sapiens
gaataaaggcagctg

SEQ ID NO: 67077 - DNA, 15 bp, Homo sapiens
aataaaggcagctgt

SEQ ID NO: 67078 - DNA, 15 bp, Homo sapiens
ataaaggcagctgtt

SEQ ID NO: 67079 - DNA, 15 bp, Homo sapiens
taaaggcagctgttg

SEQ ID NO: 67080 - DNA, 15 bp, Homo sapiens
aaaggcagctgttgt

SEQ ID NO: 67081 - DNA, 15 bp, Homo sapiens
aaggcagctgttgtc

SEQ ID NO: 67082 - DNA, 15 bp, Homo sapiens
aggcagctgttgtct

SEQ ID NO: 67083 - DNA, 15 bp, Homo sapiens
ggcagctgttgtctc

SEQ ID NO: 67084 - DNA, 15 bp, Homo sapiens
gcagctgttgtctct

SEQ ID NO: 67085 - DNA, 15 bp, Homo sapiens
cagctgttgtctctt

SEQ ID NO: 67086 - DNA, 15 bp, Homo sapiens
agctgttgtctcttc

SEQ ID NO: 67087 - DNA, 15 bp, Homo sapiens
gctgttgtctcttct

SEQ ID NO: 67088 - DNA, 15 bp, Homo sapiens
ctgttgtctcttctc

SEQ ID NO: 67089 - DNA, 15 bp, Homo sapiens
tgttgtctcttctcc

SEQ ID NO: 67090 - DNA, 15 bp, Homo sapiens
gttgtctcttctcct

SEQ ID NO: 67091 - DNA, 15 bp, Homo sapiens
ttgtctcttctcctt

SEQ ID NO: 67092 - DNA, 15 bp, Homo sapiens
tgtctcttctcctta

SEQ ID NO: 67093 - DNA, 15 bp, Homo sapiens
gtctcttctccttat

SEQ ID NO: 67094 - DNA, 15 bp, Homo sapiens
tctcttctccttatg

SEQ ID NO: 67095 - DNA, 15 bp, Homo sapiens
ctcttctccttatgg

SEQ ID NO: 67096 - DNA, 15 bp, Homo sapiens
tcttctccttatggg

SEQ ID NO: 67097 - DNA, 15 bp, Homo sapiens
cttctccttatgggt

SEQ ID NO: 67098 - DNA, 15 bp, Homo sapiens
ttctccttatgggta

SEQ ID NO: 67099 - DNA, 15 bp, Homo sapiens
tctccttatgggtag

SEQ ID NO: 67100 - DNA, 15 bp, Homo sapiens
ctccttatgggtagg

SEQ ID NO: 67101 - DNA, 15 bp, Homo sapiens
tccttatgggtaggg

SEQ ID NO: 67102 - DNA, 15 bp, Homo sapiens
ccttatgggtagggc

SEQ ID NO: 67103 - DNA, 15 bp, Homo sapiens
cttatgggtagggct

SEQ ID NO: 67104 - DNA, 15 bp, Homo sapiens
ttatgggtagggctc

SEQ ID NO: 67105 - DNA, 15 bp, Homo sapiens
tatgggtagggctct

SEQ ID NO: 67106 - DNA, 15 bp, Homo sapiens
atgggtagggctctg

SEQ ID NO: 67107 - DNA, 15 bp, Homo sapiens
tgggtagggctctga

SEQ ID NO: 67108 - DNA, 15 bp, Homo sapiens
gggtagggctctgac

SEQ ID NO: 67109 - DNA, 15 bp, Homo sapiens
ggtagggctctgaca

SEQ ID NO: 67110 - DNA, 15 bp, Homo sapiens
gtagggctctgacaa

SEQ ID NO: 67111 - DNA, 15 bp, Homo sapiens
tagggctctgacaaa

SEQ ID NO: 67112 - DNA, 15 bp, Homo sapiens
agggctctgacaaag

SEQ ID NO: 67113 - DNA, 15 bp, Homo sapiens
gggctctgacaaagc

SEQ ID NO: 67114 - DNA, 15 bp, Homo sapiens
ggctctgacaaagct

SEQ ID NO: 67115 - DNA, 15 bp, Homo sapiens
gctctgacaaagctt

SEQ ID NO: 67116 - DNA, 15 bp, Homo sapiens
ctctgacaaagcttc

SEQ ID NO: 67117 - DNA, 15 bp, Homo sapiens
tctgacaaagcttcc

SEQ ID NO: 67118 - DNA, 15 bp, Homo sapiens
ctgacaaagcttccc

SEQ ID NO: 67119 - DNA, 15 bp, Homo sapiens
tgacaaagcttcccg

SEQ ID NO: 67120 - DNA, 15 bp, Homo sapiens
gacaaagcttcccga

SEQ ID NO: 67121 - DNA, 15 bp, Homo sapiens
acaaagcttcccgat

SEQ ID NO: 67122 - DNA, 15 bp, Homo sapiens
caaagcttcccgatt

SEQ ID NO: 67123 - DNA, 15 bp, Homo sapiens
aaagcttcccgatta

SEQ ID NO: 67124 - DNA, 15 bp, Homo sapiens
aagcttcccgattaa

SEQ ID NO: 67125 - DNA, 15 bp, Homo sapiens
agcttcccgattaac

SEQ ID NO: 67126 - DNA, 15 bp, Homo sapiens
gcttcccgattaact

SEQ ID NO: 67127 - DNA, 15 bp, Homo sapiens
cttcccgattaactg

SEQ ID NO: 67128 - DNA, 15 bp, Homo sapiens
ttcccgattaactga

SEQ ID NO: 67129 - DNA, 15 bp, Homo sapiens
tcccgattaactgaa

SEQ ID NO: 67130 - DNA, 15 bp, Homo sapiens
cccgattaactgaaa

SEQ ID NO: 67131 - DNA, 15 bp, Homo sapiens
ccgattaactgaaat

SEQ ID NO: 67132 - DNA, 15 bp, Homo sapiens
cgattaactgaaata

SEQ ID NO: 67133 - DNA, 15 bp, Homo sapiens
gattaactgaaataa

SEQ ID NO: 67134 - DNA, 15 bp, Homo sapiens
attaactgaaataaa

SEQ ID NO: 67135 - DNA, 15 bp, Homo sapiens
ttaactgaaataaaa

SEQ ID NO: 67136 - DNA, 15 bp, Homo sapiens
taactgaaataaaaa

SEQ ID NO: 67137 - DNA, 15 bp, Homo sapiens
aactgaaataaaaaa

SEQ ID NO: 67138 - DNA, 15 bp, Homo sapiens
actgaaataaaaaat

SEQ ID NO: 67139 - DNA, 15 bp, Homo sapiens
ctgaaataaaaaata

SEQ ID NO: 67140 - DNA, 15 bp, Homo sapiens
tgaaataaaaaatat

SEQ ID NO: 67141 - DNA, 15 bp, Homo sapiens
gaaataaaaaatatt

SEQ ID NO: 67142 - DNA, 15 bp, Homo sapiens
aaataaaaaatattt

SEQ ID NO: 67143 - DNA, 15 bp, Homo sapiens
aataaaaaatatttt

SEQ ID NO: 67144 - DNA, 15 bp, Homo sapiens
ataaaaaatattttt

SEQ ID NO: 67145 - DNA, 15 bp, Homo sapiens
taaaaaatatttttt

SEQ ID NO: 67146 - DNA, 15 bp, Homo sapiens
aaaaaatattttttt

SEQ ID NO: 67147 - DNA, 15 bp, Homo sapiens
aaaaatatttttttt

SEQ ID NO: 67148 - DNA, 15 bp, Homo sapiens
aaaatattttttttt

SEQ ID NO: 67149 - DNA, 15 bp, Homo sapiens
aaatatttttttttc

SEQ ID NO: 67150 - DNA, 15 bp, Homo sapiens
aatatttttttttct

SEQ ID NO: 67151 - DNA, 15 bp, Homo sapiens
atatttttttttctt

SEQ ID NO: 67152 - DNA, 15 bp, Homo sapiens
tatttttttttcttt

SEQ ID NO: 67153 - DNA, 15 bp, Homo sapiens
atttttttttctttc

SEQ ID NO: 67154 - DNA, 15 bp, Homo sapiens
tttttttttctttca

SEQ ID NO: 67155 - DNA, 15 bp, Homo sapiens
ttttttttctttcag

SEQ ID NO: 67156 - DNA, 15 bp, Homo sapiens
tttttttctttcagt

SEQ ID NO: 67157 - DNA, 15 bp, Homo sapiens
ttttttctttcagta

SEQ ID NO: 67158 - DNA, 15 bp, Homo sapiens
tttttctttcagtaa

SEQ ID NO: 67159 - DNA, 15 bp, Homo sapiens
ttttctttcagtaaa

SEQ ID NO: 67160 - DNA, 15 bp, Homo sapiens
tttctttcagtaaac

SEQ ID NO: 67161 - DNA, 15 bp, Homo sapiens
ttctttcagtaaact

SEQ ID NO: 67162 - DNA, 15 bp, Homo sapiens
tctttcagtaaactt

SEQ ID NO: 67163 - DNA, 15 bp, Homo sapiens
ctttcagtaaactta

SEQ ID NO: 67164 - DNA, 15 bp, Homo sapiens
tttcagtaaacttag

SEQ ID NO: 67165 - DNA, 15 bp, Homo sapiens
ttcagtaaacttaga

SEQ ID NO: 67166 - DNA, 15 bp, Homo sapiens
tcagtaaacttagag

SEQ ID NO: 67167 - DNA, 15 bp, Homo sapiens
cagtaaacttagagt

SEQ ID NO: 67168 - DNA, 15 bp, Homo sapiens
agtaaacttagagtt

SEQ ID NO: 67169 - DNA, 15 bp, Homo sapiens
gtaaacttagagttt

SEQ ID NO: 67170 - DNA, 15 bp, Homo sapiens
taaacttagagtttc

SEQ ID NO: 67171 - DNA, 15 bp, Homo sapiens
aaacttagagtttcg

SEQ ID NO: 67172 - DNA, 15 bp, Homo sapiens
aacttagagtttcgt

SEQ ID NO: 67173 - DNA, 15 bp, Homo sapiens
acttagagtttcgtg

SEQ ID NO: 67174 - DNA, 15 bp, Homo sapiens
cttagagtttcgtgg

SEQ ID NO: 67175 - DNA, 15 bp, Homo sapiens
ttagagtttcgtggc

SEQ ID NO: 67176 - DNA, 15 bp, Homo sapiens
tagagtttcgtggct

SEQ ID NO: 67177 - DNA, 15 bp, Homo sapiens
agagtttcgtggctt

SEQ ID NO: 67178 - DNA, 15 bp, Homo sapiens
gagtttcgtggcttc

SEQ ID NO: 67179 - DNA, 15 bp, Homo sapiens
agtttcgtggcttca

SEQ ID NO: 67180 - DNA, 15 bp, Homo sapiens
gtttcgtggcttcag

SEQ ID NO: 67181 - DNA, 15 bp, Homo sapiens
tttcgtggcttcagg

SEQ ID NO: 67182 - DNA, 15 bp, Homo sapiens
ttcgtggcttcaggg

SEQ ID NO: 67183 - DNA, 15 bp, Homo sapiens
tcgtggcttcagggt

SEQ ID NO: 67184 - DNA, 15 bp, Homo sapiens
cgtggcttcagggtg

SEQ ID NO: 67185 - DNA, 15 bp, Homo sapiens
gtggcttcagggtgg

SEQ ID NO: 67186 - DNA, 15 bp, Homo sapiens
tggcttcagggtggg

SEQ ID NO: 67187 - DNA, 15 bp, Homo sapiens
ggcttcagggtggga

SEQ ID NO: 67188 - DNA, 15 bp, Homo sapiens
gcttcagggtgggag

SEQ ID NO: 67189 - DNA, 15 bp, Homo sapiens
cttcagggtgggagt

SEQ ID NO: 67190 - DNA, 15 bp, Homo sapiens
ttcagggtgggagta

SEQ ID NO: 67191 - DNA, 15 bp, Homo sapiens
tcagggtgggagtag

SEQ ID NO: 67192 - DNA, 15 bp, Homo sapiens
cagggtgggagtagt

SEQ ID NO: 67193 - DNA, 15 bp, Homo sapiens
agggtgggagtagtt

SEQ ID NO: 67194 - DNA, 15 bp, Homo sapiens
gggtgggagtagttg

SEQ ID NO: 67195 - DNA, 15 bp, Homo sapiens
ggtgggagtagttgg

SEQ ID NO: 67196 - DNA, 15 bp, Homo sapiens
gtgggagtagttgga

SEQ ID NO: 67197 - DNA, 15 bp, Homo sapiens
tgggagtagttggag

SEQ ID NO: 67198 - DNA, 15 bp, Homo sapiens
gggagtagttggagc

SEQ ID NO: 67199 - DNA, 15 bp, Homo sapiens
ggagtagttggagca

SEQ ID NO: 67200 - DNA, 15 bp, Homo sapiens
gagtagttggagcat

SEQ ID NO: 67201 - DNA, 15 bp, Homo sapiens
agtagttggagcatt

SEQ ID NO: 67202 - DNA, 15 bp, Homo sapiens
gtagttggagcattg

SEQ ID NO: 67203 - DNA, 15 bp, Homo sapiens
tagttggagcattgg

SEQ ID NO: 67204 - DNA, 15 bp, Homo sapiens
agttggagcattggg

SEQ ID NO: 67205 - DNA, 15 bp, Homo sapiens
gttggagcattgggg

SEQ ID NO: 67206 - DNA, 15 bp, Homo sapiens
ttggagcattgggga

SEQ ID NO: 67207 - DNA, 15 bp, Homo sapiens
tggagcattggggat

SEQ ID NO: 67208 - DNA, 15 bp, Homo sapiens
ggagcattggggatg

SEQ ID NO: 67209 - DNA, 15 bp, Homo sapiens
gagcattggggatgt

SEQ ID NO: 67210 - DNA, 15 bp, Homo sapiens
agcattggggatgtt

SEQ ID NO: 67211 - DNA, 15 bp, Homo sapiens
gcattggggatgttt

SEQ ID NO: 67212 - DNA, 15 bp, Homo sapiens
cattggggatgtttt

SEQ ID NO: 67213 - DNA, 15 bp, Homo sapiens
attggggatgttttt

SEQ ID NO: 67214 - DNA, 15 bp, Homo sapiens
ttggggatgtttttc

SEQ ID NO: 67215 - DNA, 15 bp, Homo sapiens
tggggatgtttttct

SEQ ID NO: 67216 - DNA, 15 bp, Homo sapiens
ggggatgtttttctt

SEQ ID NO: 67217 - DNA, 15 bp, Homo sapiens
tcacttctttccctt

SEQ ID NO: 67218 - DNA, 15 bp, Homo sapiens
cacttctttcccttc

SEQ ID NO: 67219 - DNA, 15 bp, Homo sapiens
acttctttcccttcc

SEQ ID NO: 67220 - DNA, 15 bp, Homo sapiens
cttctttcccttcct

SEQ ID NO: 67221 - DNA, 15 bp, Homo sapiens
ttctttcccttcctc

SEQ ID NO: 67222 - DNA, 15 bp, Homo sapiens
tctttcccttcctcc

SEQ ID NO: 67223 - DNA, 15 bp, Homo sapiens
ctttcccttcctcca

SEQ ID NO: 67224 - DNA, 15 bp, Homo sapiens
tttcccttcctccat

SEQ ID NO: 67225 - DNA, 15 bp, Homo sapiens
ttcccttcctccatc

SEQ ID NO: 67226 - DNA, 15 bp, Homo sapiens
tcccttcctccatcc

SEQ ID NO: 67227 - DNA, 15 bp, Homo sapiens
cccttcctccatcct

SEQ ID NO: 67228 - DNA, 15 bp, Homo sapiens
ccttcctccatcctc

SEQ ID NO: 67229 - DNA, 15 bp, Homo sapiens
cttcctccatcctcc

SEQ ID NO: 67230 - DNA, 15 bp, Homo sapiens
ttcctccatcctcct

SEQ ID NO: 67231 - DNA, 15 bp, Homo sapiens
tcctccatcctcctc

SEQ ID NO: 67232 - DNA, 15 bp, Homo sapiens
cctccatcctcctcc

SEQ ID NO: 67233 - DNA, 15 bp, Homo sapiens
ctccatcctcctcct

SEQ ID NO: 67234 - DNA, 15 bp, Homo sapiens
tccatcctcctcctt

SEQ ID NO: 67235 - DNA, 15 bp, Homo sapiens
ccatcctcctccttc

SEQ ID NO: 67236 - DNA, 15 bp, Homo sapiens
catcctcctccttcc

SEQ ID NO: 67237 - DNA, 15 bp, Homo sapiens
atcctcctccttcct

SEQ ID NO: 67238 - DNA, 15 bp, Homo sapiens
tcctcctccttccta

SEQ ID NO: 67239 - DNA, 15 bp, Homo sapiens
cctcctccttcctag

SEQ ID NO: 67240 - DNA, 15 bp, Homo sapiens
ctcctccttcctagt

SEQ ID NO: 67241 - DNA, 15 bp, Homo sapiens
tcctccttcctagtt

SEQ ID NO: 67242 - DNA, 15 bp, Homo sapiens
cctccttcctagttc

SEQ ID NO: 67243 - DNA, 15 bp, Homo sapiens
ctccttcctagttca

SEQ ID NO: 67244 - DNA, 15 bp, Homo sapiens
tccttcctagttcat

SEQ ID NO: 67245 - DNA, 15 bp, Homo sapiens
ccttcctagttcatc

SEQ ID NO: 67246 - DNA, 15 bp, Homo sapiens
cttcctagttcatcc

SEQ ID NO: 67247 - DNA, 15 bp, Homo sapiens
ttcctagttcatccc

SEQ ID NO: 67248 - DNA, 15 bp, Homo sapiens
tcctagttcatccct

SEQ ID NO: 67249 - DNA, 15 bp, Homo sapiens
cctagttcatccctt

SEQ ID NO: 67250 - DNA, 15 bp, Homo sapiens
ctagttcatcccttc

SEQ ID NO: 67251 - DNA, 15 bp, Homo sapiens
tagttcatcccttct

SEQ ID NO: 67252 - DNA, 15 bp, Homo sapiens
agttcatcccttctc

SEQ ID NO: 67253 - DNA, 15 bp, Homo sapiens
gttcatcccttctct

SEQ ID NO: 67254 - DNA, 15 bp, Homo sapiens
ttcatcccttctctt

SEQ ID NO: 67255 - DNA, 15 bp, Homo sapiens
tcatcccttctcttc

SEQ ID NO: 67256 - DNA, 15 bp, Homo sapiens
catcccttctcttcc

SEQ ID NO: 67257 - DNA, 15 bp, Homo sapiens
atcccttctcttcca

SEQ ID NO: 67258 - DNA, 15 bp, Homo sapiens
tcccttctcttccag

SEQ ID NO: 67259 - DNA, 15 bp, Homo sapiens
cccttctcttccagg

SEQ ID NO: 67260 - DNA, 15 bp, Homo sapiens
ccttctcttccaggc

SEQ ID NO: 67261 - DNA, 15 bp, Homo sapiens
cttctcttccaggca

SEQ ID NO: 67262 - DNA, 15 bp, Homo sapiens
ttctcttccaggcag

SEQ ID NO: 67263 - DNA, 15 bp, Homo sapiens
tctcttccaggcagc

SEQ ID NO: 67264 - DNA, 15 bp, Homo sapiens
ctcttccaggcagcc

SEQ ID NO: 67265 - DNA, 15 bp, Homo sapiens
tcttccaggcagccg

SEQ ID NO: 67266 - DNA, 15 bp, Homo sapiens
cttccaggcagccgc

SEQ ID NO: 67267 - DNA, 15 bp, Homo sapiens
ttccaggcagccgcg

SEQ ID NO: 67268 - DNA, 15 bp, Homo sapiens
tccaggcagccgcgg

SEQ ID NO: 67269 - DNA, 15 bp, Homo sapiens
ccaggcagccgcggt

SEQ ID NO: 67270 - DNA, 15 bp, Homo sapiens
caggcagccgcggtg

SEQ ID NO: 67271 - DNA, 15 bp, Homo sapiens
aggcagccgcggtgc

SEQ ID NO: 67272 - DNA, 15 bp, Homo sapiens
ggcagccgcggtgcc

SEQ ID NO: 67273 - DNA, 15 bp, Homo sapiens
gcagccgcggtgccc

SEQ ID NO: 67274 - DNA, 15 bp, Homo sapiens
cagccgcggtgccca

SEQ ID NO: 67275 - DNA, 15 bp, Homo sapiens
agccgcggtgcccaa

SEQ ID NO: 67276 - DNA, 15 bp, Homo sapiens
gccgcggtgcccaac

SEQ ID NO: 67277 - DNA, 15 bp, Homo sapiens
ccgcggtgcccaacc

SEQ ID NO: 67278 - DNA, 15 bp, Homo sapiens
cgcggtgcccaacca

SEQ ID NO: 67279 - DNA, 15 bp, Homo sapiens
gcggtgcccaaccac

SEQ ID NO: 67280 - DNA, 15 bp, Homo sapiens
cggtgcccaaccaca

SEQ ID NO: 67281 - DNA, 15 bp, Homo sapiens
ggtgcccaaccacac

SEQ ID NO: 67282 - DNA, 15 bp, Homo sapiens
gtgcccaaccacact

SEQ ID NO: 67283 - DNA, 15 bp, Homo sapiens
tgcccaaccacactt

SEQ ID NO: 67284 - DNA, 15 bp, Homo sapiens
gcccaaccacacttg

SEQ ID NO: 67285 - DNA, 15 bp, Homo sapiens
cccaaccacacttgt

SEQ ID NO: 67286 - DNA, 15 bp, Homo sapiens
ccaaccacacttgtc

SEQ ID NO: 67287 - DNA, 15 bp, Homo sapiens
caaccacacttgtcg

SEQ ID NO: 67288 - DNA, 15 bp, Homo sapiens
aaccacacttgtcgg

SEQ ID NO: 67289 - DNA, 15 bp, Homo sapiens
accacacttgtcggc

SEQ ID NO: 67290 - DNA, 15 bp, Homo sapiens
ccacacttgtcggct

SEQ ID NO: 67291 - DNA, 15 bp, Homo sapiens
cacacttgtcggctc

SEQ ID NO: 67292 - DNA, 15 bp, Homo sapiens
acacttgtcggctcc

SEQ ID NO: 67293 - DNA, 15 bp, Homo sapiens
cacttgtcggctcca

SEQ ID NO: 67294 - DNA, 15 bp, Homo sapiens
acttgtcggctccag

SEQ ID NO: 67295 - DNA, 15 bp, Homo sapiens
cttgtcggctccagt

SEQ ID NO: 67296 - DNA, 15 bp, Homo sapiens
ttgtcggctccagtc

SEQ ID NO: 67297 - DNA, 15 bp, Homo sapiens
tgtcggctccagtcc

SEQ ID NO: 67298 - DNA, 15 bp, Homo sapiens
gtcggctccagtccc

SEQ ID NO: 67299 - DNA, 15 bp, Homo sapiens
tcggctccagtcccc

SEQ ID NO: 67300 - DNA, 15 bp, Homo sapiens
cggctccagtcccca

SEQ ID NO: 67301 - DNA, 15 bp, Homo sapiens
ggctccagtccccag

SEQ ID NO: 67302 - DNA, 15 bp, Homo sapiens
gctccagtccccaga

SEQ ID NO: 67303 - DNA, 15 bp, Homo sapiens
ctccagtccccagaa

SEQ ID NO: 67304 - DNA, 15 bp, Homo sapiens
tccagtccccagaac

SEQ ID NO: 67305 - DNA, 15 bp, Homo sapiens
ccagtccccagaact

SEQ ID NO: 67306 - DNA, 15 bp, Homo sapiens
cagtccccagaactc

SEQ ID NO: 67307 - DNA, 15 bp, Homo sapiens
agtccccagaactct

SEQ ID NO: 67308 - DNA, 15 bp, Homo sapiens
gtccccagaactctg

SEQ ID NO: 67309 - DNA, 15 bp, Homo sapiens
tccccagaactctgc

SEQ ID NO: 67310 - DNA, 15 bp, Homo sapiens
ccccagaactctgcc

SEQ ID NO: 67311 - DNA, 15 bp, Homo sapiens
cccagaactctgcct

SEQ ID NO: 67312 - DNA, 15 bp, Homo sapiens
ccagaactctgcctg

SEQ ID NO: 67313 - DNA, 15 bp, Homo sapiens
cagaactctgcctgc

SEQ ID NO: 67314 - DNA, 15 bp, Homo sapiens
agaactctgcctgcc

SEQ ID NO: 67315 - DNA, 15 bp, Homo sapiens
gaactctgcctgccc

SEQ ID NO: 67316 - DNA, 15 bp, Homo sapiens
aactctgcctgccct

SEQ ID NO: 67317 - DNA, 15 bp, Homo sapiens
actctgcctgccctt

SEQ ID NO: 67318 - DNA, 15 bp, Homo sapiens
ctctgcctgcccttt

SEQ ID NO: 67319 - DNA, 15 bp, Homo sapiens
tctgcctgccctttg

SEQ ID NO: 67320 - DNA, 15 bp, Homo sapiens
ctgcctgccctttgt

SEQ ID NO: 67321 - DNA, 15 bp, Homo sapiens
tgcctgccctttgtc

SEQ ID NO: 67322 - DNA, 15 bp, Homo sapiens
gcctgccctttgtcc

SEQ ID NO: 67323 - DNA, 15 bp, Homo sapiens
cctgccctttgtcct

SEQ ID NO: 67324 - DNA, 15 bp, Homo sapiens
ctgccctttgtcctc

SEQ ID NO: 67325 - DNA, 15 bp, Homo sapiens
tgccctttgtcctcc

SEQ ID NO: 67326 - DNA, 15 bp, Homo sapiens
gccctttgtcctcct

SEQ ID NO: 67327 - DNA, 15 bp, Homo sapiens
ccctttgtcctcctg

SEQ ID NO: 67328 - DNA, 15 bp, Homo sapiens
cctttgtcctcctgc

SEQ ID NO: 67329 - DNA, 15 bp, Homo sapiens
ctttgtcctcctgct

SEQ ID NO: 67330 - DNA, 15 bp, Homo sapiens
tttgtcctcctgctg

SEQ ID NO: 67331 - DNA, 15 bp, Homo sapiens
ttgtcctcctgctgc

SEQ ID NO: 67332 - DNA, 15 bp, Homo sapiens
tgtcctcctgctgcc

SEQ ID NO: 67333 - DNA, 15 bp, Homo sapiens
gtcctcctgctgcca

SEQ ID NO: 67334 - DNA, 15 bp, Homo sapiens
tcctcctgctgccag

SEQ ID NO: 67335 - DNA, 15 bp, Homo sapiens
cctcctgctgccagt

SEQ ID NO: 67336 - DNA, 15 bp, Homo sapiens
ctcctgctgccagta

SEQ ID NO: 67337 - DNA, 15 bp, Homo sapiens
tcctgctgccagtac

SEQ ID NO: 67338 - DNA, 15 bp, Homo sapiens
cctgctgccagtacc

SEQ ID NO: 67339 - DNA, 15 bp, Homo sapiens
ctgctgccagtacca

SEQ ID NO: 67340 - DNA, 15 bp, Homo sapiens
tgctgccagtaccag

SEQ ID NO: 67341 - DNA, 15 bp, Homo sapiens
gctgccagtaccagc

SEQ ID NO: 67342 - DNA, 15 bp, Homo sapiens
ctgccagtaccagcc

SEQ ID NO: 67343 - DNA, 15 bp, Homo sapiens
tgccagtaccagccc

SEQ ID NO: 67344 - DNA, 15 bp, Homo sapiens
gccagtaccagcccc

SEQ ID NO: 67345 - DNA, 15 bp, Homo sapiens
ccagtaccagcccca

SEQ ID NO: 67346 - DNA, 15 bp, Homo sapiens
cagtaccagccccac

SEQ ID NO: 67347 - DNA, 15 bp, Homo sapiens
agtaccagccccacc

SEQ ID NO: 67348 - DNA, 15 bp, Homo sapiens
gtaccagccccaccc

SEQ ID NO: 67349 - DNA, 15 bp, Homo sapiens
taccagccccaccct

SEQ ID NO: 67350 - DNA, 15 bp, Homo sapiens
accagccccaccctg

SEQ ID NO: 67351 - DNA, 15 bp, Homo sapiens
ccagccccaccctgt

SEQ ID NO: 67352 - DNA, 15 bp, Homo sapiens
cagccccaccctgtt

SEQ ID NO: 67353 - DNA, 15 bp, Homo sapiens
agccccaccctgttt

SEQ ID NO: 67354 - DNA, 15 bp, Homo sapiens
gccccaccctgtttt

SEQ ID NO: 67355 - DNA, 15 bp, Homo sapiens
ccccaccctgttttg

SEQ ID NO: 67356 - DNA, 15 bp, Homo sapiens
cccaccctgttttga

SEQ ID NO: 67357 - DNA, 15 bp, Homo sapiens
ccaccctgttttgag

SEQ ID NO: 67358 - DNA, 15 bp, Homo sapiens
caccctgttttgagc

SEQ ID NO: 67359 - DNA, 15 bp, Homo sapiens
accctgttttgagcc

SEQ ID NO: 67360 - DNA, 15 bp, Homo sapiens
ccctgttttgagccc

SEQ ID NO: 67361 - DNA, 15 bp, Homo sapiens
cctgttttgagccct

SEQ ID NO: 67362 - DNA, 15 bp, Homo sapiens
ctgttttgagccctg

SEQ ID NO: 67363 - DNA, 15 bp, Homo sapiens
tgttttgagccctga

SEQ ID NO: 67364 - DNA, 15 bp, Homo sapiens
gttttgagccctgag

SEQ ID NO: 67365 - DNA, 15 bp, Homo sapiens
ttttgagccctgagg

SEQ ID NO: 67366 - DNA, 15 bp, Homo sapiens
tttgagccctgagga

SEQ ID NO: 67367 - DNA, 15 bp, Homo sapiens
ttgagccctgaggag

SEQ ID NO: 67368 - DNA, 15 bp, Homo sapiens
tgagccctgaggagg

SEQ ID NO: 67369 - DNA, 15 bp, Homo sapiens
gagccctgaggaggc

SEQ ID NO: 67370 - DNA, 15 bp, Homo sapiens
agccctgaggaggcc

SEQ ID NO: 67371 - DNA, 15 bp, Homo sapiens
gccctgaggaggcct

SEQ ID NO: 67372 - DNA, 15 bp, Homo sapiens
ccctgaggaggcctt

SEQ ID NO: 67373 - DNA, 15 bp, Homo sapiens
cctgaggaggccttg

SEQ ID NO: 67374 - DNA, 15 bp, Homo sapiens
ctgaggaggccttgg

SEQ ID NO: 67375 - DNA, 15 bp, Homo sapiens
tgaggaggccttggg

SEQ ID NO: 67376 - DNA, 15 bp, Homo sapiens
gaggaggccttgggc

SEQ ID NO: 67377 - DNA, 15 bp, Homo sapiens
aggaggccttgggct

SEQ ID NO: 67378 - DNA, 15 bp, Homo sapiens
ggaggccttgggctc

SEQ ID NO: 67379 - DNA, 15 bp, Homo sapiens
gaggccttgggctct

SEQ ID NO: 67380 - DNA, 15 bp, Homo sapiens
aggccttgggctctg

SEQ ID NO: 67381 - DNA, 15 bp, Homo sapiens
ggccttgggctctgc

SEQ ID NO: 67382 - DNA, 15 bp, Homo sapiens
gccttgggctctgct

SEQ ID NO: 67383 - DNA, 15 bp, Homo sapiens
ccttgggctctgctg

SEQ ID NO: 67384 - DNA, 15 bp, Homo sapiens
cttgggctctgctga

SEQ ID NO: 67385 - DNA, 15 bp, Homo sapiens
ttgggctctgctgag

SEQ ID NO: 67386 - DNA, 15 bp, Homo sapiens
tgggctctgctgagt

SEQ ID NO: 67387 - DNA, 15 bp, Homo sapiens
gggctctgctgagtc

SEQ ID NO: 67388 - DNA, 15 bp, Homo sapiens
ggctctgctgagtcc

SEQ ID NO: 67389 - DNA, 15 bp, Homo sapiens
gctctgctgagtccg

SEQ ID NO: 67390 - DNA, 15 bp, Homo sapiens
ctctgctgagtccga

SEQ ID NO: 67391 - DNA, 15 bp, Homo sapiens
tctgctgagtccgac

SEQ ID NO: 67392 - DNA, 15 bp, Homo sapiens
ctgctgagtccgacc

SEQ ID NO: 67393 - DNA, 15 bp, Homo sapiens
tgctgagtccgacct

SEQ ID NO: 67394 - DNA, 15 bp, Homo sapiens
gctgagtccgacctg

SEQ ID NO: 67395 - DNA, 15 bp, Homo sapiens
ctgagtccgacctgg

SEQ ID NO: 67396 - DNA, 15 bp, Homo sapiens
tgagtccgacctggc

SEQ ID NO: 67397 - DNA, 15 bp, Homo sapiens
gagtccgacctggcc

SEQ ID NO: 67398 - DNA, 15 bp, Homo sapiens
agtccgacctggcct

SEQ ID NO: 67399 - DNA, 15 bp, Homo sapiens
gtccgacctggcctg

SEQ ID NO: 67400 - DNA, 15 bp, Homo sapiens
tccgacctggcctgt

SEQ ID NO: 67401 - DNA, 15 bp, Homo sapiens
ccgacctggcctgtc

SEQ ID NO: 67402 - DNA, 15 bp, Homo sapiens
cgacctggcctgtct

SEQ ID NO: 67403 - DNA, 15 bp, Homo sapiens
gacctggcctgtctg

SEQ ID NO: 67404 - DNA, 15 bp, Homo sapiens
acctggcctgtctgt

SEQ ID NO: 67405 - DNA, 15 bp, Homo sapiens
cctggcctgtctgtg

SEQ ID NO: 67406 - DNA, 15 bp, Homo sapiens
ctggcctgtctgtga

SEQ ID NO: 67407 - DNA, 15 bp, Homo sapiens
tggcctgtctgtgaa

SEQ ID NO: 67408 - DNA, 15 bp, Homo sapiens
ggcctgtctgtgaag

SEQ ID NO: 67409 - DNA, 15 bp, Homo sapiens
gcctgtctgtgaaga

SEQ ID NO: 67410 - DNA, 15 bp, Homo sapiens
cctgtctgtgaagag

SEQ ID NO: 67411 - DNA, 15 bp, Homo sapiens
ctgtctgtgaagagc

SEQ ID NO: 67412 - DNA, 15 bp, Homo sapiens
tgtctgtgaagagca

SEQ ID NO: 67413 - DNA, 15 bp, Homo sapiens
gtctgtgaagagcaa

SEQ ID NO: 67414 - DNA, 15 bp, Homo sapiens
tctgtgaagagcaag

SEQ ID NO: 67415 - DNA, 15 bp, Homo sapiens
ctgtgaagagcaaga

SEQ ID NO: 67416 - DNA, 15 bp, Homo sapiens
tgtgaagagcaagag

SEQ ID NO: 67417 - DNA, 15 bp, Homo sapiens
gtgaagagcaagaga

SEQ ID NO: 67418 - DNA, 15 bp, Homo sapiens
tgaagagcaagagag

SEQ ID NO: 67419 - DNA, 15 bp, Homo sapiens
gaagagcaagagagc

SEQ ID NO: 67420 - DNA, 15 bp, Homo sapiens
aagagcaagagagca

SEQ ID NO: 67421 - DNA, 15 bp, Homo sapiens
agagcaagagagcag

SEQ ID NO: 67422 - DNA, 15 bp, Homo sapiens
gagcaagagagcagc

SEQ ID NO: 67423 - DNA, 15 bp, Homo sapiens
agcaagagagcagca

SEQ ID NO: 67424 - DNA, 15 bp, Homo sapiens
gcaagagagcagcaa

SEQ ID NO: 67425 - DNA, 15 bp, Homo sapiens
caagagagcagcaag

SEQ ID NO: 67426 - DNA, 15 bp, Homo sapiens
aagagagcagcaagg

SEQ ID NO: 67427 - DNA, 15 bp, Homo sapiens
agagagcagcaaggt

SEQ ID NO: 67428 - DNA, 15 bp, Homo sapiens
gagagcagcaaggtc

SEQ ID NO: 67429 - DNA, 15 bp, Homo sapiens
agagcagcaaggtct

SEQ ID NO: 67430 - DNA, 15 bp, Homo sapiens
gagcagcaaggtctt

SEQ ID NO: 67431 - DNA, 15 bp, Homo sapiens
agcagcaaggtcttg

SEQ ID NO: 67432 - DNA, 15 bp, Homo sapiens
gcagcaaggtcttgc

SEQ ID NO: 67433 - DNA, 15 bp, Homo sapiens
cagcaaggtcttgct

SEQ ID NO: 67434 - DNA, 15 bp, Homo sapiens
agcaaggtcttgctc

SEQ ID NO: 67435 - DNA, 15 bp, Homo sapiens
gcaaggtcttgctct

SEQ ID NO: 67436 - DNA, 15 bp, Homo sapiens
caaggtcttgctctc

SEQ ID NO: 67437 - DNA, 15 bp, Homo sapiens
aaggtcttgctctcc

SEQ ID NO: 67438 - DNA, 15 bp, Homo sapiens
aggtcttgctctcct

SEQ ID NO: 67439 - DNA, 15 bp, Homo sapiens
ggtcttgctctccta

SEQ ID NO: 67440 - DNA, 15 bp, Homo sapiens
gtcttgctctcctag

SEQ ID NO: 67441 - DNA, 15 bp, Homo sapiens
tcttgctctcctagg

SEQ ID NO: 67442 - DNA, 15 bp, Homo sapiens
cttgctctcctaggt

SEQ ID NO: 67443 - DNA, 15 bp, Homo sapiens
ttgctctcctaggta

SEQ ID NO: 67444 - DNA, 15 bp, Homo sapiens
tgctctcctaggtag

SEQ ID NO: 67445 - DNA, 15 bp, Homo sapiens
gctctcctaggtagc

SEQ ID NO: 67446 - DNA, 15 bp, Homo sapiens
ctctcctaggtagcc

SEQ ID NO: 67447 - DNA, 15 bp, Homo sapiens
tctcctaggtagccc

SEQ ID NO: 67448 - DNA, 15 bp, Homo sapiens
ctcctaggtagcccc

SEQ ID NO: 67449 - DNA, 15 bp, Homo sapiens
tcctaggtagccccc

SEQ ID NO: 67450 - DNA, 15 bp, Homo sapiens
cctaggtagccccct

SEQ ID NO: 67451 - DNA, 15 bp, Homo sapiens
ctaggtagccccctc

SEQ ID NO: 67452 - DNA, 15 bp, Homo sapiens
taggtagccccctct

SEQ ID NO: 67453 - DNA, 15 bp, Homo sapiens
aggtagccccctctt

SEQ ID NO: 67454 - DNA, 15 bp, Homo sapiens
ggtagccccctcttc

SEQ ID NO: 67455 - DNA, 15 bp, Homo sapiens
gtagccccctcttcc

SEQ ID NO: 67456 - DNA, 15 bp, Homo sapiens
tagccccctcttccc

SEQ ID NO: 67457 - DNA, 15 bp, Homo sapiens
agccccctcttccct

SEQ ID NO: 67458 - DNA, 15 bp, Homo sapiens
gccccctcttccctg

SEQ ID NO: 67459 - DNA, 15 bp, Homo sapiens
ccccctcttccctgg

SEQ ID NO: 67460 - DNA, 15 bp, Homo sapiens
cccctcttccctggt

SEQ ID NO: 67461 - DNA, 15 bp, Homo sapiens
ccctcttccctggta

SEQ ID NO: 67462 - DNA, 15 bp, Homo sapiens
cctcttccctggtaa

SEQ ID NO: 67463 - DNA, 15 bp, Homo sapiens
ctcttccctggtaag

SEQ ID NO: 67464 - DNA, 15 bp, Homo sapiens
tcttccctggtaaga

SEQ ID NO: 67465 - DNA, 15 bp, Homo sapiens
cttccctggtaagaa

SEQ ID NO: 67466 - DNA, 15 bp, Homo sapiens
ttccctggtaagaaa

SEQ ID NO: 67467 - DNA, 15 bp, Homo sapiens
tccctggtaagaaaa

SEQ ID NO: 67468 - DNA, 15 bp, Homo sapiens
ccctggtaagaaaaa

SEQ ID NO: 67469 - DNA, 15 bp, Homo sapiens
cctggtaagaaaaag

SEQ ID NO: 67470 - DNA, 15 bp, Homo sapiens
ctggtaagaaaaagc

SEQ ID NO: 67471 - DNA, 15 bp, Homo sapiens
tggtaagaaaaagca

SEQ ID NO: 67472 - DNA, 15 bp, Homo sapiens
ggtaagaaaaagcaa

SEQ ID NO: 67473 - DNA, 15 bp, Homo sapiens
gtaagaaaaagcaaa

SEQ ID NO: 67474 - DNA, 15 bp, Homo sapiens
taagaaaaagcaaaa

SEQ ID NO: 67475 - DNA, 15 bp, Homo sapiens
aagaaaaagcaaaag

SEQ ID NO: 67476 - DNA, 15 bp, Homo sapiens
agaaaaagcaaaagg

SEQ ID NO: 67477 - DNA, 15 bp, Homo sapiens
gaaaaagcaaaaggc

SEQ ID NO: 67478 - DNA, 15 bp, Homo sapiens
aaaaagcaaaaggca

SEQ ID NO: 67479 - DNA, 15 bp, Homo sapiens
aaaagcaaaaggcat

SEQ ID NO: 67480 - DNA, 15 bp, Homo sapiens
aaagcaaaaggcatt

SEQ ID NO: 67481 - DNA, 15 bp, Homo sapiens
aagcaaaaggcattt

SEQ ID NO: 67482 - DNA, 15 bp, Homo sapiens
agcaaaaggcatttc

SEQ ID NO: 67483 - DNA, 15 bp, Homo sapiens
gcaaaaggcatttcc

SEQ ID NO: 67484 - DNA, 15 bp, Homo sapiens
caaaaggcatttccc

SEQ ID NO: 67485 - DNA, 15 bp, Homo sapiens
aaaaggcatttccca

SEQ ID NO: 67486 - DNA, 15 bp, Homo sapiens
aaaggcatttcccac

SEQ ID NO: 67487 - DNA, 15 bp, Homo sapiens
aaggcatttcccacc

SEQ ID NO: 67488 - DNA, 15 bp, Homo sapiens
aggcatttcccaccc

SEQ ID NO: 67489 - DNA, 15 bp, Homo sapiens
ggcatttcccaccct

SEQ ID NO: 67490 - DNA, 15 bp, Homo sapiens
gcatttcccaccctg

SEQ ID NO: 67491 - DNA, 15 bp, Homo sapiens
catttcccaccctga

SEQ ID NO: 67492 - DNA, 15 bp, Homo sapiens
atttcccaccctgaa

SEQ ID NO: 67493 - DNA, 15 bp, Homo sapiens
tttcccaccctgaac

SEQ ID NO: 67494 - DNA, 15 bp, Homo sapiens
ttcccaccctgaaca

SEQ ID NO: 67495 - DNA, 15 bp, Homo sapiens
tcccaccctgaacaa

SEQ ID NO: 67496 - DNA, 15 bp, Homo sapiens
cccaccctgaacaac

SEQ ID NO: 67497 - DNA, 15 bp, Homo sapiens
ccaccctgaacaacg

SEQ ID NO: 67498 - DNA, 15 bp, Homo sapiens
caccctgaacaacga

SEQ ID NO: 67499 - DNA, 15 bp, Homo sapiens
accctgaacaacgag

SEQ ID NO: 67500 - DNA, 15 bp, Homo sapiens
ccctgaacaacgagc

SEQ ID NO: 67501 - DNA, 15 bp, Homo sapiens
cctgaacaacgagcc

SEQ ID NO: 67502 - DNA, 15 bp, Homo sapiens
ctgaacaacgagcct

SEQ ID NO: 67503 - DNA, 15 bp, Homo sapiens
tgaacaacgagcctt

SEQ ID NO: 67504 - DNA, 15 bp, Homo sapiens
gaacaacgagccttt

SEQ ID NO: 67505 - DNA, 15 bp, Homo sapiens
aacaacgagcctttt

SEQ ID NO: 67506 - DNA, 15 bp, Homo sapiens
acaacgagccttttc

SEQ ID NO: 67507 - DNA, 15 bp, Homo sapiens
caacgagccttttca

SEQ ID NO: 67508 - DNA, 15 bp, Homo sapiens
aacgagccttttcac

SEQ ID NO: 67509 - DNA, 15 bp, Homo sapiens
acgagccttttcacc

SEQ ID NO: 67510 - DNA, 15 bp, Homo sapiens
cgagccttttcaccc

SEQ ID NO: 67511 - DNA, 15 bp, Homo sapiens
gagccttttcaccct

SEQ ID NO: 67512 - DNA, 15 bp, Homo sapiens
agccttttcaccctt

SEQ ID NO: 67513 - DNA, 15 bp, Homo sapiens
gccttttcacccttc

SEQ ID NO: 67514 - DNA, 15 bp, Homo sapiens
ccttttcacccttct

SEQ ID NO: 67515 - DNA, 15 bp, Homo sapiens
cttttcacccttcta

SEQ ID NO: 67516 - DNA, 15 bp, Homo sapiens
ttttcacccttctac

SEQ ID NO: 67517 - DNA, 15 bp, Homo sapiens
tttcacccttctact

SEQ ID NO: 67518 - DNA, 15 bp, Homo sapiens
ttcacccttctactc

SEQ ID NO: 67519 - DNA, 15 bp, Homo sapiens
tcacccttctactct

SEQ ID NO: 67520 - DNA, 15 bp, Homo sapiens
cacccttctactcta

SEQ ID NO: 67521 - DNA, 15 bp, Homo sapiens
acccttctactctag

SEQ ID NO: 67522 - DNA, 15 bp, Homo sapiens
cccttctactctaga

SEQ ID NO: 67523 - DNA, 15 bp, Homo sapiens
ccttctactctagag

SEQ ID NO: 67524 - DNA, 15 bp, Homo sapiens
cttctactctagaga

SEQ ID NO: 67525 - DNA, 15 bp, Homo sapiens
ttctactctagagaa

SEQ ID NO: 67526 - DNA, 15 bp, Homo sapiens
tctactctagagaag

SEQ ID NO: 67527 - DNA, 15 bp, Homo sapiens
ctactctagagaagt

SEQ ID NO: 67528 - DNA, 15 bp, Homo sapiens
tactctagagaagtg

SEQ ID NO: 67529 - DNA, 15 bp, Homo sapiens
actctagagaagtgg

SEQ ID NO: 67530 - DNA, 15 bp, Homo sapiens
ctctagagaagtgga

SEQ ID NO: 67531 - DNA, 15 bp, Homo sapiens
tctagagaagtggac

SEQ ID NO: 67532 - DNA, 15 bp, Homo sapiens
ctagagaagtggact

SEQ ID NO: 67533 - DNA, 15 bp, Homo sapiens
tagagaagtggactg

SEQ ID NO: 67534 - DNA, 15 bp, Homo sapiens
agagaagtggactgg

SEQ ID NO: 67535 - DNA, 15 bp, Homo sapiens
gagaagtggactgga

SEQ ID NO: 67536 - DNA, 15 bp, Homo sapiens
agaagtggactggag

SEQ ID NO: 67537 - DNA, 15 bp, Homo sapiens
gaagtggactggagg

SEQ ID NO: 67538 - DNA, 15 bp, Homo sapiens
aagtggactggagga

SEQ ID NO: 67539 - DNA, 15 bp, Homo sapiens
agtggactggaggag

SEQ ID NO: 67540 - DNA, 15 bp, Homo sapiens
gtggactggaggagc

SEQ ID NO: 67541 - DNA, 15 bp, Homo sapiens
tggactggaggagct

SEQ ID NO: 67542 - DNA, 15 bp, Homo sapiens
ggactggaggagctg

SEQ ID NO: 67543 - DNA, 15 bp, Homo sapiens
gactggaggagctgg

SEQ ID NO: 67544 - DNA, 15 bp, Homo sapiens
actggaggagctggg

SEQ ID NO: 67545 - DNA, 15 bp, Homo sapiens
ctggaggagctgggc

SEQ ID NO: 67546 - DNA, 15 bp, Homo sapiens
tggaggagctgggcc

SEQ ID NO: 67547 - DNA, 15 bp, Homo sapiens
ggaggagctgggccc

SEQ ID NO: 67548 - DNA, 15 bp, Homo sapiens
gaggagctgggcccg

SEQ ID NO: 67549 - DNA, 15 bp, Homo sapiens
aggagctgggcccga

SEQ ID NO: 67550 - DNA, 15 bp, Homo sapiens
ggagctgggcccgat

SEQ ID NO: 67551 - DNA, 15 bp, Homo sapiens
gagctgggcccgatt

SEQ ID NO: 67552 - DNA, 15 bp, Homo sapiens
agctgggcccgattt

SEQ ID NO: 67553 - DNA, 15 bp, Homo sapiens
gctgggcccgatttg

SEQ ID NO: 67554 - DNA, 15 bp, Homo sapiens
ctgggcccgatttgg

SEQ ID NO: 67555 - DNA, 15 bp, Homo sapiens
tgggcccgatttggt

SEQ ID NO: 67556 - DNA, 15 bp, Homo sapiens
gggcccgatttggta

SEQ ID NO: 67557 - DNA, 15 bp, Homo sapiens
ggcccgatttggtag

SEQ ID NO: 67558 - DNA, 15 bp, Homo sapiens
gcccgatttggtagt

SEQ ID NO: 67559 - DNA, 15 bp, Homo sapiens
cccgatttggtagtt

SEQ ID NO: 67560 - DNA, 15 bp, Homo sapiens
ccgatttggtagttg

SEQ ID NO: 67561 - DNA, 15 bp, Homo sapiens
cgatttggtagttga

SEQ ID NO: 67562 - DNA, 15 bp, Homo sapiens
gatttggtagttgag

SEQ ID NO: 67563 - DNA, 15 bp, Homo sapiens
atttggtagttgagg

SEQ ID NO: 67564 - DNA, 15 bp, Homo sapiens
tttggtagttgagga

SEQ ID NO: 67565 - DNA, 15 bp, Homo sapiens
ttggtagttgaggaa

SEQ ID NO: 67566 - DNA, 15 bp, Homo sapiens
tggtagttgaggaaa

SEQ ID NO: 67567 - DNA, 15 bp, Homo sapiens
ggtagttgaggaaag

SEQ ID NO: 67568 - DNA, 15 bp, Homo sapiens
gtagttgaggaaagc

SEQ ID NO: 67569 - DNA, 15 bp, Homo sapiens
tagttgaggaaagca

SEQ ID NO: 67570 - DNA, 15 bp, Homo sapiens
agttgaggaaagcac

SEQ ID NO: 67571 - DNA, 15 bp, Homo sapiens
gttgaggaaagcaca

SEQ ID NO: 67572 - DNA, 15 bp, Homo sapiens
ttgaggaaagcacag

SEQ ID NO: 67573 - DNA, 15 bp, Homo sapiens
tgaggaaagcacaga

SEQ ID NO: 67574 - DNA, 15 bp, Homo sapiens
gaggaaagcacagag

SEQ ID NO: 67575 - DNA, 15 bp, Homo sapiens
aggaaagcacagagg

SEQ ID NO: 67576 - DNA, 15 bp, Homo sapiens
ggaaagcacagaggc

SEQ ID NO: 67577 - DNA, 15 bp, Homo sapiens
gaaagcacagaggcc

SEQ ID NO: 67578 - DNA, 15 bp, Homo sapiens
aaagcacagaggcct

SEQ ID NO: 67579 - DNA, 15 bp, Homo sapiens
aagcacagaggcctc

SEQ ID NO: 67580 - DNA, 15 bp, Homo sapiens
agcacagaggcctcc

SEQ ID NO: 67581 - DNA, 15 bp, Homo sapiens
gcacagaggcctcct

SEQ ID NO: 67582 - DNA, 15 bp, Homo sapiens
cacagaggcctcctg

SEQ ID NO: 67583 - DNA, 15 bp, Homo sapiens
acagaggcctcctgt

SEQ ID NO: 67584 - DNA, 15 bp, Homo sapiens
cagaggcctcctgtg

SEQ ID NO: 67585 - DNA, 15 bp, Homo sapiens
agaggcctcctgtgg

SEQ ID NO: 67586 - DNA, 15 bp, Homo sapiens
gaggcctcctgtggc

SEQ ID NO: 67587 - DNA, 15 bp, Homo sapiens
aggcctcctgtggcc

SEQ ID NO: 67588 - DNA, 15 bp, Homo sapiens
ggcctcctgtggcct

SEQ ID NO: 67589 - DNA, 15 bp, Homo sapiens
gcctcctgtggcctg

SEQ ID NO: 67590 - DNA, 15 bp, Homo sapiens
cctcctgtggcctgc

SEQ ID NO: 67591 - DNA, 15 bp, Homo sapiens
ctcctgtggcctgcc

SEQ ID NO: 67592 - DNA, 15 bp, Homo sapiens
tcctgtggcctgcca

SEQ ID NO: 67593 - DNA, 15 bp, Homo sapiens
cctgtggcctgccag

SEQ ID NO: 67594 - DNA, 15 bp, Homo sapiens
ctgtggcctgccagt

SEQ ID NO: 67595 - DNA, 15 bp, Homo sapiens
tgtggcctgccagtc

SEQ ID NO: 67596 - DNA, 15 bp, Homo sapiens
gtggcctgccagtca

SEQ ID NO: 67597 - DNA, 15 bp, Homo sapiens
tggcctgccagtcat

SEQ ID NO: 67598 - DNA, 15 bp, Homo sapiens
ggcctgccagtcatc

SEQ ID NO: 67599 - DNA, 15 bp, Homo sapiens
gcctgccagtcatcg

SEQ ID NO: 67600 - DNA, 15 bp, Homo sapiens
cctgccagtcatcga

SEQ ID NO: 67601 - DNA, 15 bp, Homo sapiens
ctgccagtcatcgag

SEQ ID NO: 67602 - DNA, 15 bp, Homo sapiens
tgccagtcatcgagt

SEQ ID NO: 67603 - DNA, 15 bp, Homo sapiens
gccagtcatcgagtg

SEQ ID NO: 67604 - DNA, 15 bp, Homo sapiens
ccagtcatcgagtgg

SEQ ID NO: 67605 - DNA, 15 bp, Homo sapiens
cagtcatcgagtggc

SEQ ID NO: 67606 - DNA, 15 bp, Homo sapiens
agtcatcgagtggcc

SEQ ID NO: 67607 - DNA, 15 bp, Homo sapiens
gtcatcgagtggccc

SEQ ID NO: 67608 - DNA, 15 bp, Homo sapiens
tcatcgagtggccca

SEQ ID NO: 67609 - DNA, 15 bp, Homo sapiens
catcgagtggcccaa

SEQ ID NO: 67610 - DNA, 15 bp, Homo sapiens
atcgagtggcccaac

SEQ ID NO: 67611 - DNA, 15 bp, Homo sapiens
tcgagtggcccaaca

SEQ ID NO: 67612 - DNA, 15 bp, Homo sapiens
cgagtggcccaacag

SEQ ID NO: 67613 - DNA, 15 bp, Homo sapiens
gagtggcccaacagg

SEQ ID NO: 67614 - DNA, 15 bp, Homo sapiens
agtggcccaacaggg

SEQ ID NO: 67615 - DNA, 15 bp, Homo sapiens
gtggcccaacagggg

SEQ ID NO: 67616 - DNA, 15 bp, Homo sapiens
tggcccaacaggggc

SEQ ID NO: 67617 - DNA, 15 bp, Homo sapiens
ggcccaacaggggct

SEQ ID NO: 67618 - DNA, 15 bp, Homo sapiens
gcccaacaggggctc

SEQ ID NO: 67619 - DNA, 15 bp, Homo sapiens
cccaacaggggctcc

SEQ ID NO: 67620 - DNA, 15 bp, Homo sapiens
ccaacaggggctcca

SEQ ID NO: 67621 - DNA, 15 bp, Homo sapiens
caacaggggctccat

SEQ ID NO: 67622 - DNA, 15 bp, Homo sapiens
aacaggggctccatg

SEQ ID NO: 67623 - DNA, 15 bp, Homo sapiens
acaggggctccatgc

SEQ ID NO: 67624 - DNA, 15 bp, Homo sapiens
caggggctccatgcc

SEQ ID NO: 67625 - DNA, 15 bp, Homo sapiens
aggggctccatgcca

SEQ ID NO: 67626 - DNA, 15 bp, Homo sapiens
ggggctccatgccag

SEQ ID NO: 67627 - DNA, 15 bp, Homo sapiens
gggctccatgccagc

SEQ ID NO: 67628 - DNA, 15 bp, Homo sapiens
ggctccatgccagcc

SEQ ID NO: 67629 - DNA, 15 bp, Homo sapiens
gctccatgccagccg

SEQ ID NO: 67630 - DNA, 15 bp, Homo sapiens
ctccatgccagccga

SEQ ID NO: 67631 - DNA, 15 bp, Homo sapiens
tccatgccagccgac

SEQ ID NO: 67632 - DNA, 15 bp, Homo sapiens
ccatgccagccgacc

SEQ ID NO: 67633 - DNA, 15 bp, Homo sapiens
catgccagccgacct

SEQ ID NO: 67634 - DNA, 15 bp, Homo sapiens
atgccagccgacctt

SEQ ID NO: 67635 - DNA, 15 bp, Homo sapiens
tgccagccgaccttg

SEQ ID NO: 67636 - DNA, 15 bp, Homo sapiens
gccagccgaccttga

SEQ ID NO: 67637 - DNA, 15 bp, Homo sapiens
ccagccgaccttgac

SEQ ID NO: 67638 - DNA, 15 bp, Homo sapiens
cagccgaccttgacc

SEQ ID NO: 67639 - DNA, 15 bp, Homo sapiens
agccgaccttgacct

SEQ ID NO: 67640 - DNA, 15 bp, Homo sapiens
gccgaccttgacctc

SEQ ID NO: 67641 - DNA, 15 bp, Homo sapiens
ccgaccttgacctca

SEQ ID NO: 67642 - DNA, 15 bp, Homo sapiens
cgaccttgacctcac

SEQ ID NO: 67643 - DNA, 15 bp, Homo sapiens
gaccttgacctcact

SEQ ID NO: 67644 - DNA, 15 bp, Homo sapiens
accttgacctcactc

SEQ ID NO: 67645 - DNA, 15 bp, Homo sapiens
ccttgacctcactca

SEQ ID NO: 67646 - DNA, 15 bp, Homo sapiens
cttgacctcactcag

SEQ ID NO: 67647 - DNA, 15 bp, Homo sapiens
ttgacctcactcaga

SEQ ID NO: 67648 - DNA, 15 bp, Homo sapiens
tgacctcactcagaa

SEQ ID NO: 67649 - DNA, 15 bp, Homo sapiens
gacctcactcagaag

SEQ ID NO: 67650 - DNA, 15 bp, Homo sapiens
acctcactcagaagt

SEQ ID NO: 67651 - DNA, 15 bp, Homo sapiens
cctcactcagaagtc

SEQ ID NO: 67652 - DNA, 15 bp, Homo sapiens
ctcactcagaagtcc

SEQ ID NO: 67653 - DNA, 15 bp, Homo sapiens
tcactcagaagtcca

SEQ ID NO: 67654 - DNA, 15 bp, Homo sapiens
cactcagaagtccag

SEQ ID NO: 67655 - DNA, 15 bp, Homo sapiens
actcagaagtccaga

SEQ ID NO: 67656 - DNA, 15 bp, Homo sapiens
ctcagaagtccagag

SEQ ID NO: 67657 - DNA, 15 bp, Homo sapiens
tcagaagtccagagt

SEQ ID NO: 67658 - DNA, 15 bp, Homo sapiens
cagaagtccagagtc

SEQ ID NO: 67659 - DNA, 15 bp, Homo sapiens
agaagtccagagtct

SEQ ID NO: 67660 - DNA, 15 bp, Homo sapiens
gaagtccagagtcta

SEQ ID NO: 67661 - DNA, 15 bp, Homo sapiens
aagtccagagtctag

SEQ ID NO: 67662 - DNA, 15 bp, Homo sapiens
agtccagagtctagc

SEQ ID NO: 67663 - DNA, 15 bp, Homo sapiens
gtccagagtctagcg

SEQ ID NO: 67664 - DNA, 15 bp, Homo sapiens
tccagagtctagcgt

SEQ ID NO: 67665 - DNA, 15 bp, Homo sapiens
ccagagtctagcgta

SEQ ID NO: 67666 - DNA, 15 bp, Homo sapiens
cagagtctagcgtag

SEQ ID NO: 67667 - DNA, 15 bp, Homo sapiens
agagtctagcgtagt

SEQ ID NO: 67668 - DNA, 15 bp, Homo sapiens
gagtctagcgtagtg

SEQ ID NO: 67669 - DNA, 15 bp, Homo sapiens
agtctagcgtagtgc

SEQ ID NO: 67670 - DNA, 15 bp, Homo sapiens
gtctagcgtagtgca

SEQ ID NO: 67671 - DNA, 15 bp, Homo sapiens
tctagcgtagtgcag

SEQ ID NO: 67672 - DNA, 15 bp, Homo sapiens
ctagcgtagtgcagc

SEQ ID NO: 67673 - DNA, 15 bp, Homo sapiens
tagcgtagtgcagca

SEQ ID NO: 67674 - DNA, 15 bp, Homo sapiens
agcgtagtgcagcag

SEQ ID NO: 67675 - DNA, 15 bp, Homo sapiens
gcgtagtgcagcagg

SEQ ID NO: 67676 - DNA, 15 bp, Homo sapiens
cgtagtgcagcaggg

SEQ ID NO: 67677 - DNA, 15 bp, Homo sapiens
gtagtgcagcagggc

SEQ ID NO: 67678 - DNA, 15 bp, Homo sapiens
tagtgcagcagggca

SEQ ID NO: 67679 - DNA, 15 bp, Homo sapiens
agtgcagcagggcag

SEQ ID NO: 67680 - DNA, 15 bp, Homo sapiens
gtgcagcagggcagt

SEQ ID NO: 67681 - DNA, 15 bp, Homo sapiens
tgcagcagggcagta

SEQ ID NO: 67682 - DNA, 15 bp, Homo sapiens
gcagcagggcagtag

SEQ ID NO: 67683 - DNA, 15 bp, Homo sapiens
cagcagggcagtagc

SEQ ID NO: 67684 - DNA, 15 bp, Homo sapiens
agcagggcagtagcg

SEQ ID NO: 67685 - DNA, 15 bp, Homo sapiens
gcagggcagtagcgg

SEQ ID NO: 67686 - DNA, 15 bp, Homo sapiens
cagggcagtagcggt

SEQ ID NO: 67687 - DNA, 15 bp, Homo sapiens
agggcagtagcggta

SEQ ID NO: 67688 - DNA, 15 bp, Homo sapiens
gggcagtagcggtac

SEQ ID NO: 67689 - DNA, 15 bp, Homo sapiens
ggcagtagcggtacc

SEQ ID NO: 67690 - DNA, 15 bp, Homo sapiens
gcagtagcggtacca

SEQ ID NO: 67691 - DNA, 15 bp, Homo sapiens
cagtagcggtaccaa

SEQ ID NO: 67692 - DNA, 15 bp, Homo sapiens
agtagcggtaccaat

SEQ ID NO: 67693 - DNA, 15 bp, Homo sapiens
gtagcggtaccaatg

SEQ ID NO: 67694 - DNA, 15 bp, Homo sapiens
tagcggtaccaatgc

SEQ ID NO: 67695 - DNA, 15 bp, Homo sapiens
agcggtaccaatgca

SEQ ID NO: 67696 - DNA, 15 bp, Homo sapiens
gcggtaccaatgcag

SEQ ID NO: 67697 - DNA, 15 bp, Homo sapiens
cggtaccaatgcaga

SEQ ID NO: 67698 - DNA, 15 bp, Homo sapiens
ggtaccaatgcagaa

SEQ ID NO: 67699 - DNA, 15 bp, Homo sapiens
gtaccaatgcagaac

SEQ ID NO: 67700 - DNA, 15 bp, Homo sapiens
taccaatgcagaact

SEQ ID NO: 67701 - DNA, 15 bp, Homo sapiens
accaatgcagaactc

SEQ ID NO: 67702 - DNA, 15 bp, Homo sapiens
ccaatgcagaactcc

SEQ ID NO: 67703 - DNA, 15 bp, Homo sapiens
caatgcagaactccc

SEQ ID NO: 67704 - DNA, 15 bp, Homo sapiens
aatgcagaactccca

SEQ ID NO: 67705 - DNA, 15 bp, Homo sapiens
atgcagaactcccaa

SEQ ID NO: 67706 - DNA, 15 bp, Homo sapiens
tgcagaactcccaag

SEQ ID NO: 67707 - DNA, 15 bp, Homo sapiens
gcagaactcccaaga

SEQ ID NO: 67708 - DNA, 15 bp, Homo sapiens
cagaactcccaagac

SEQ ID NO: 67709 - DNA, 15 bp, Homo sapiens
agaactcccaagacc

SEQ ID NO: 67710 - DNA, 15 bp, Homo sapiens
gaactcccaagaccc

SEQ ID NO: 67711 - DNA, 15 bp, Homo sapiens
aactcccaagacccg

SEQ ID NO: 67712 - DNA, 15 bp, Homo sapiens
actcccaagacccga

SEQ ID NO: 67713 - DNA, 15 bp, Homo sapiens
ctcccaagacccgag

SEQ ID NO: 67714 - DNA, 15 bp, Homo sapiens
tcccaagacccgagc

SEQ ID NO: 67715 - DNA, 15 bp, Homo sapiens
cccaagacccgagct

SEQ ID NO: 67716 - DNA, 15 bp, Homo sapiens
ccaagacccgagctg

SEQ ID NO: 67717 - DNA, 15 bp, Homo sapiens
caagacccgagctgg

SEQ ID NO: 67718 - DNA, 15 bp, Homo sapiens
aagacccgagctggg

SEQ ID NO: 67719 - DNA, 15 bp, Homo sapiens
agacccgagctggga

SEQ ID NO: 67720 - DNA, 15 bp, Homo sapiens
gacccgagctgggac

SEQ ID NO: 67721 - DNA, 15 bp, Homo sapiens
acccgagctgggacc

SEQ ID NO: 67722 - DNA, 15 bp, Homo sapiens
cccgagctgggacca

SEQ ID NO: 67723 - DNA, 15 bp, Homo sapiens
ccgagctgggaccag

SEQ ID NO: 67724 - DNA, 15 bp, Homo sapiens
cgagctgggaccagt

SEQ ID NO: 67725 - DNA, 15 bp, Homo sapiens
gagctgggaccagta

SEQ ID NO: 67726 - DNA, 15 bp, Homo sapiens
agctgggaccagtac

SEQ ID NO: 67727 - DNA, 15 bp, Homo sapiens
gctgggaccagtacc

SEQ ID NO: 67728 - DNA, 15 bp, Homo sapiens
ctgggaccagtacct

SEQ ID NO: 67729 - DNA, 15 bp, Homo sapiens
tgggaccagtacctg

SEQ ID NO: 67730 - DNA, 15 bp, Homo sapiens
gggaccagtacctgg

SEQ ID NO: 67731 - DNA, 15 bp, Homo sapiens
ggaccagtacctggg

SEQ ID NO: 67732 - DNA, 15 bp, Homo sapiens
gaccagtacctgggt

SEQ ID NO: 67733 - DNA, 15 bp, Homo sapiens
accagtacctgggtc

SEQ ID NO: 67734 - DNA, 15 bp, Homo sapiens
ccagtacctgggtcc

SEQ ID NO: 67735 - DNA, 15 bp, Homo sapiens
cagtacctgggtccc

SEQ ID NO: 67736 - DNA, 15 bp, Homo sapiens
agtacctgggtcccc

SEQ ID NO: 67737 - DNA, 15 bp, Homo sapiens
gtacctgggtcccca

SEQ ID NO: 67738 - DNA, 15 bp, Homo sapiens
tacctgggtccccag

SEQ ID NO: 67739 - DNA, 15 bp, Homo sapiens
acctgggtccccagc

SEQ ID NO: 67740 - DNA, 15 bp, Homo sapiens
cctgggtccccagcc

SEQ ID NO: 67741 - DNA, 15 bp, Homo sapiens
ctgggtccccagccc

SEQ ID NO: 67742 - DNA, 15 bp, Homo sapiens
tgggtccccagccct

SEQ ID NO: 67743 - DNA, 15 bp, Homo sapiens
gggtccccagccctt

SEQ ID NO: 67744 - DNA, 15 bp, Homo sapiens
ggtccccagcccttc

SEQ ID NO: 67745 - DNA, 15 bp, Homo sapiens
gtccccagcccttcc

SEQ ID NO: 67746 - DNA, 15 bp, Homo sapiens
tccccagcccttcct

SEQ ID NO: 67747 - DNA, 15 bp, Homo sapiens
ccccagcccttcctc

SEQ ID NO: 67748 - DNA, 15 bp, Homo sapiens
cccagcccttcctct

SEQ ID NO: 67749 - DNA, 15 bp, Homo sapiens
ccagcccttcctctg

SEQ ID NO: 67750 - DNA, 15 bp, Homo sapiens
cagcccttcctctgc

SEQ ID NO: 67751 - DNA, 15 bp, Homo sapiens
agcccttcctctgct

SEQ ID NO: 67752 - DNA, 15 bp, Homo sapiens
gcccttcctctgctc

SEQ ID NO: 67753 - DNA, 15 bp, Homo sapiens
cccttcctctgctcc

SEQ ID NO: 67754 - DNA, 15 bp, Homo sapiens
ccttcctctgctccc

SEQ ID NO: 67755 - DNA, 15 bp, Homo sapiens
cttcctctgctcccc

SEQ ID NO: 67756 - DNA, 15 bp, Homo sapiens
ttcctctgctccccc

SEQ ID NO: 67757 - DNA, 15 bp, Homo sapiens
tcctctgctccccct

SEQ ID NO: 67758 - DNA, 15 bp, Homo sapiens
cctctgctccccctt

SEQ ID NO: 67759 - DNA, 15 bp, Homo sapiens
ctctgctcccccttt

SEQ ID NO: 67760 - DNA, 15 bp, Homo sapiens
tctgctccccctttt

SEQ ID NO: 67761 - DNA, 15 bp, Homo sapiens
ctgctcccccttttc

SEQ ID NO: 67762 - DNA, 15 bp, Homo sapiens
tgctcccccttttcc

SEQ ID NO: 67763 - DNA, 15 bp, Homo sapiens
gctcccccttttccc

SEQ ID NO: 67764 - DNA, 15 bp, Homo sapiens
ctcccccttttccct

SEQ ID NO: 67765 - DNA, 15 bp, Homo sapiens
tcccccttttccctc

SEQ ID NO: 67766 - DNA, 15 bp, Homo sapiens
cccccttttccctcg

SEQ ID NO: 67767 - DNA, 15 bp, Homo sapiens
ccccttttccctcgg

SEQ ID NO: 67768 - DNA, 15 bp, Homo sapiens
cccttttccctcgga

SEQ ID NO: 67769 - DNA, 15 bp, Homo sapiens
ccttttccctcggag

SEQ ID NO: 67770 - DNA, 15 bp, Homo sapiens
cttttccctcggagt

SEQ ID NO: 67771 - DNA, 15 bp, Homo sapiens
ttttccctcggagtt

SEQ ID NO: 67772 - DNA, 15 bp, Homo sapiens
tttccctcggagttc

SEQ ID NO: 67773 - DNA, 15 bp, Homo sapiens
ttccctcggagttct

SEQ ID NO: 67774 - DNA, 15 bp, Homo sapiens
tccctcggagttctt

SEQ ID NO: 67775 - DNA, 15 bp, Homo sapiens
ccctcggagttcttc

SEQ ID NO: 67776 - DNA, 15 bp, Homo sapiens
cctcggagttcttct

SEQ ID NO: 67777 - DNA, 15 bp, Homo sapiens
ctcggagttcttctt

SEQ ID NO: 67778 - DNA, 15 bp, Homo sapiens
tcggagttcttcttg

SEQ ID NO: 67779 - DNA, 15 bp, Homo sapiens
cggagttcttcttga

SEQ ID NO: 67780 - DNA, 15 bp, Homo sapiens
ggagttcttcttgaa

SEQ ID NO: 67781 - DNA, 15 bp, Homo sapiens
gagttcttcttgaat

SEQ ID NO: 67782 - DNA, 15 bp, Homo sapiens
agttcttcttgaatg

SEQ ID NO: 67783 - DNA, 15 bp, Homo sapiens
gttcttcttgaatgg

SEQ ID NO: 67784 - DNA, 15 bp, Homo sapiens
ttcttcttgaatggc

SEQ ID NO: 67785 - DNA, 15 bp, Homo sapiens
tcttcttgaatggca

SEQ ID NO: 67786 - DNA, 15 bp, Homo sapiens
cttcttgaatggcaa

SEQ ID NO: 67787 - DNA, 15 bp, Homo sapiens
ttcttgaatggcaat

SEQ ID NO: 67788 - DNA, 15 bp, Homo sapiens
tcttgaatggcaatg

SEQ ID NO: 67789 - DNA, 15 bp, Homo sapiens
cttgaatggcaatgt

SEQ ID NO: 67790 - DNA, 15 bp, Homo sapiens
ttgaatggcaatgtt

SEQ ID NO: 67791 - DNA, 15 bp, Homo sapiens
tgaatggcaatgttt

SEQ ID NO: 67792 - DNA, 15 bp, Homo sapiens
gaatggcaatgtttt

SEQ ID NO: 67793 - DNA, 15 bp, Homo sapiens
aatggcaatgttttg

SEQ ID NO: 67794 - DNA, 15 bp, Homo sapiens
atggcaatgttttgc

SEQ ID NO: 67795 - DNA, 15 bp, Homo sapiens
tggcaatgttttgct

SEQ ID NO: 67796 - DNA, 15 bp, Homo sapiens
ggcaatgttttgctt

SEQ ID NO: 67797 - DNA, 15 bp, Homo sapiens
gcaatgttttgcttt

SEQ ID NO: 67798 - DNA, 15 bp, Homo sapiens
caatgttttgctttt

SEQ ID NO: 67799 - DNA, 15 bp, Homo sapiens
aatgttttgcttttg

SEQ ID NO: 67800 - DNA, 15 bp, Homo sapiens
atgttttgcttttgc

SEQ ID NO: 67801 - DNA, 15 bp, Homo sapiens
tgttttgcttttgct

SEQ ID NO: 67802 - DNA, 15 bp, Homo sapiens
gttttgcttttgctc

SEQ ID NO: 67803 - DNA, 15 bp, Homo sapiens
ttttgcttttgctcg

SEQ ID NO: 67804 - DNA, 15 bp, Homo sapiens
tttgcttttgctcga

SEQ ID NO: 67805 - DNA, 15 bp, Homo sapiens
ttgcttttgctcgat

SEQ ID NO: 67806 - DNA, 15 bp, Homo sapiens
tgcttttgctcgatg

SEQ ID NO: 67807 - DNA, 15 bp, Homo sapiens
gcttttgctcgatgc

SEQ ID NO: 67808 - DNA, 15 bp, Homo sapiens
cttttgctcgatgca

SEQ ID NO: 67809 - DNA, 15 bp, Homo sapiens
ttttgctcgatgcag

SEQ ID NO: 67810 - DNA, 15 bp, Homo sapiens
tttgctcgatgcaga

SEQ ID NO: 67811 - DNA, 15 bp, Homo sapiens
ttgctcgatgcagac

SEQ ID NO: 67812 - DNA, 15 bp, Homo sapiens
tgctcgatgcagaca

SEQ ID NO: 67813 - DNA, 15 bp, Homo sapiens
gctcgatgcagacag

SEQ ID NO: 67814 - DNA, 15 bp, Homo sapiens
ctcgatgcagacagg

SEQ ID NO: 67815 - DNA, 15 bp, Homo sapiens
tcgatgcagacaggg

SEQ ID NO: 67816 - DNA, 15 bp, Homo sapiens
cgatgcagacagggg

SEQ ID NO: 67817 - DNA, 15 bp, Homo sapiens
gatgcagacaggggg

SEQ ID NO: 67818 - DNA, 15 bp, Homo sapiens
atgcagacagggggc

SEQ ID NO: 67819 - DNA, 15 bp, Homo sapiens
tgcagacagggggcc

SEQ ID NO: 67820 - DNA, 15 bp, Homo sapiens
gcagacagggggcca

SEQ ID NO: 67821 - DNA, 15 bp, Homo sapiens
cagacagggggccag

SEQ ID NO: 67822 - DNA, 15 bp, Homo sapiens
agacagggggccaga

SEQ ID NO: 67823 - DNA, 15 bp, Homo sapiens
gacagggggccagaa

SEQ ID NO: 67824 - DNA, 15 bp, Homo sapiens
acagggggccagaac

SEQ ID NO: 67825 - DNA, 15 bp, Homo sapiens
cagggggccagaaca

SEQ ID NO: 67826 - DNA, 15 bp, Homo sapiens
agggggccagaacac

SEQ ID NO: 67827 - DNA, 15 bp, Homo sapiens
gggggccagaacacc

SEQ ID NO: 67828 - DNA, 15 bp, Homo sapiens
ggggccagaacacca

SEQ ID NO: 67829 - DNA, 15 bp, Homo sapiens
gggccagaacaccac

SEQ ID NO: 67830 - DNA, 15 bp, Homo sapiens
ggccagaacaccaca

SEQ ID NO: 67831 - DNA, 15 bp, Homo sapiens
gccagaacaccacac

SEQ ID NO: 67832 - DNA, 15 bp, Homo sapiens
ccagaacaccacaca

SEQ ID NO: 67833 - DNA, 15 bp, Homo sapiens
cagaacaccacacat

SEQ ID NO: 67834 - DNA, 15 bp, Homo sapiens
agaacaccacacatt

SEQ ID NO: 67835 - DNA, 15 bp, Homo sapiens
gaacaccacacattt

SEQ ID NO: 67836 - DNA, 15 bp, Homo sapiens
aacaccacacatttc

SEQ ID NO: 67837 - DNA, 15 bp, Homo sapiens
acaccacacatttca

SEQ ID NO: 67838 - DNA, 15 bp, Homo sapiens
caccacacatttcac

SEQ ID NO: 67839 - DNA, 15 bp, Homo sapiens
accacacatttcact

SEQ ID NO: 67840 - DNA, 15 bp, Homo sapiens
ccacacatttcactg

SEQ ID NO: 67841 - DNA, 15 bp, Homo sapiens
cacacatttcactgt

SEQ ID NO: 67842 - DNA, 15 bp, Homo sapiens
acacatttcactgtc

SEQ ID NO: 67843 - DNA, 15 bp, Homo sapiens
cacatttcactgtct

SEQ ID NO: 67844 - DNA, 15 bp, Homo sapiens
acatttcactgtctg

SEQ ID NO: 67845 - DNA, 15 bp, Homo sapiens
catttcactgtctgt

SEQ ID NO: 67846 - DNA, 15 bp, Homo sapiens
atttcactgtctgtc

SEQ ID NO: 67847 - DNA, 15 bp, Homo sapiens
tttcactgtctgtct

SEQ ID NO: 67848 - DNA, 15 bp, Homo sapiens
ttcactgtctgtctg

SEQ ID NO: 67849 - DNA, 15 bp, Homo sapiens
tcactgtctgtctgg

SEQ ID NO: 67850 - DNA, 15 bp, Homo sapiens
cactgtctgtctggt

SEQ ID NO: 67851 - DNA, 15 bp, Homo sapiens
actgtctgtctggtc

SEQ ID NO: 67852 - DNA, 15 bp, Homo sapiens
ctgtctgtctggtcc

SEQ ID NO: 67853 - DNA, 15 bp, Homo sapiens
tgtctgtctggtcca

SEQ ID NO: 67854 - DNA, 15 bp, Homo sapiens
gtctgtctggtccat

SEQ ID NO: 67855 - DNA, 15 bp, Homo sapiens
tctgtctggtccata

SEQ ID NO: 67856 - DNA, 15 bp, Homo sapiens
ctgtctggtccatag

SEQ ID NO: 67857 - DNA, 15 bp, Homo sapiens
tgtctggtccatagc

SEQ ID NO: 67858 - DNA, 15 bp, Homo sapiens
gtctggtccatagct

SEQ ID NO: 67859 - DNA, 15 bp, Homo sapiens
tctggtccatagctg

SEQ ID NO: 67860 - DNA, 15 bp, Homo sapiens
ctggtccatagctgt

SEQ ID NO: 67861 - DNA, 15 bp, Homo sapiens
tggtccatagctgtg

SEQ ID NO: 67862 - DNA, 15 bp, Homo sapiens
ggtccatagctgtgg

SEQ ID NO: 67863 - DNA, 15 bp, Homo sapiens
gtccatagctgtggt

SEQ ID NO: 67864 - DNA, 15 bp, Homo sapiens
tccatagctgtggtg

SEQ ID NO: 67865 - DNA, 15 bp, Homo sapiens
ccatagctgtggtgt

SEQ ID NO: 67866 - DNA, 15 bp, Homo sapiens
catagctgtggtgta

SEQ ID NO: 67867 - DNA, 15 bp, Homo sapiens
atagctgtggtgtag

SEQ ID NO: 67868 - DNA, 15 bp, Homo sapiens
tagctgtggtgtagg

SEQ ID NO: 67869 - DNA, 15 bp, Homo sapiens
agctgtggtgtaggg

SEQ ID NO: 67870 - DNA, 15 bp, Homo sapiens
gctgtggtgtagggg

SEQ ID NO: 67871 - DNA, 15 bp, Homo sapiens
ctgtggtgtaggggc

SEQ ID NO: 67872 - DNA, 15 bp, Homo sapiens
tgtggtgtaggggct

SEQ ID NO: 67873 - DNA, 15 bp, Homo sapiens
gtggtgtaggggctt

SEQ ID NO: 67874 - DNA, 15 bp, Homo sapiens
tggtgtaggggctta

SEQ ID NO: 67875 - DNA, 15 bp, Homo sapiens
ggtgtaggggcttag

SEQ ID NO: 67876 - DNA, 15 bp, Homo sapiens
gtgtaggggcttaga

SEQ ID NO: 67877 - DNA, 15 bp, Homo sapiens
tgtaggggcttagag

SEQ ID NO: 67878 - DNA, 15 bp, Homo sapiens
gtaggggcttagagg

SEQ ID NO: 67879 - DNA, 15 bp, Homo sapiens
taggggcttagaggc

SEQ ID NO: 67880 - DNA, 15 bp, Homo sapiens
aggggcttagaggca

SEQ ID NO: 67881 - DNA, 15 bp, Homo sapiens
ggggcttagaggcat

SEQ ID NO: 67882 - DNA, 15 bp, Homo sapiens
gggcttagaggcatg

SEQ ID NO: 67883 - DNA, 15 bp, Homo sapiens
ggcttagaggcatgg

SEQ ID NO: 67884 - DNA, 15 bp, Homo sapiens
gcttagaggcatggg

SEQ ID NO: 67885 - DNA, 15 bp, Homo sapiens
cttagaggcatgggc

SEQ ID NO: 67886 - DNA, 15 bp, Homo sapiens
ttagaggcatgggct

SEQ ID NO: 67887 - DNA, 15 bp, Homo sapiens
tagaggcatgggctt

SEQ ID NO: 67888 - DNA, 15 bp, Homo sapiens
agaggcatgggcttg

SEQ ID NO: 67889 - DNA, 15 bp, Homo sapiens
gaggcatgggcttgc

SEQ ID NO: 67890 - DNA, 15 bp, Homo sapiens
aggcatgggcttgct

SEQ ID NO: 67891 - DNA, 15 bp, Homo sapiens
ggcatgggcttgctg

SEQ ID NO: 67892 - DNA, 15 bp, Homo sapiens
gcatgggcttgctgt

SEQ ID NO: 67893 - DNA, 15 bp, Homo sapiens
catgggcttgctgtg

SEQ ID NO: 67894 - DNA, 15 bp, Homo sapiens
atgggcttgctgtgg

SEQ ID NO: 67895 - DNA, 15 bp, Homo sapiens
tgggcttgctgtggg

SEQ ID NO: 67896 - DNA, 15 bp, Homo sapiens
gggcttgctgtgggt

SEQ ID NO: 67897 - DNA, 15 bp, Homo sapiens
ggcttgctgtgggtt

SEQ ID NO: 67898 - DNA, 15 bp, Homo sapiens
gcttgctgtgggttt

SEQ ID NO: 67899 - DNA, 15 bp, Homo sapiens
cttgctgtgggtttt

SEQ ID NO: 67900 - DNA, 15 bp, Homo sapiens
ttgctgtgggttttt

SEQ ID NO: 67901 - DNA, 15 bp, Homo sapiens
tgctgtgggttttta

SEQ ID NO: 67902 - DNA, 15 bp, Homo sapiens
gctgtgggtttttaa

SEQ ID NO: 67903 - DNA, 15 bp, Homo sapiens
ctgtgggtttttaat

SEQ ID NO: 67904 - DNA, 15 bp, Homo sapiens
tgtgggtttttaatt

SEQ ID NO: 67905 - DNA, 15 bp, Homo sapiens
gtgggtttttaattg

SEQ ID NO: 67906 - DNA, 15 bp, Homo sapiens
tgggtttttaattga

SEQ ID NO: 67907 - DNA, 15 bp, Homo sapiens
gggtttttaattgat

SEQ ID NO: 67908 - DNA, 15 bp, Homo sapiens
ggtttttaattgatc

SEQ ID NO: 67909 - DNA, 15 bp, Homo sapiens
gtttttaattgatca

SEQ ID NO: 67910 - DNA, 15 bp, Homo sapiens
tttttaattgatcag

SEQ ID NO: 67911 - DNA, 15 bp, Homo sapiens
ttttaattgatcagt

SEQ ID NO: 67912 - DNA, 15 bp, Homo sapiens
tttaattgatcagtt

SEQ ID NO: 67913 - DNA, 15 bp, Homo sapiens
ttaattgatcagttt

SEQ ID NO: 67914 - DNA, 15 bp, Homo sapiens
taattgatcagtttt

SEQ ID NO: 67915 - DNA, 15 bp, Homo sapiens
aattgatcagttttc

SEQ ID NO: 67916 - DNA, 15 bp, Homo sapiens
attgatcagttttca

SEQ ID NO: 67917 - DNA, 15 bp, Homo sapiens
ttgatcagttttcat

SEQ ID NO: 67918 - DNA, 15 bp, Homo sapiens
tgatcagttttcatg

SEQ ID NO: 67919 - DNA, 15 bp, Homo sapiens
gatcagttttcatgt

SEQ ID NO: 67920 - DNA, 15 bp, Homo sapiens
atcagttttcatgtg

SEQ ID NO: 67921 - DNA, 15 bp, Homo sapiens
tcagttttcatgtgg

SEQ ID NO: 67922 - DNA, 15 bp, Homo sapiens
cagttttcatgtggg

SEQ ID NO: 67923 - DNA, 15 bp, Homo sapiens
agttttcatgtggga

SEQ ID NO: 67924 - DNA, 15 bp, Homo sapiens
gttttcatgtgggat

SEQ ID NO: 67925 - DNA, 15 bp, Homo sapiens
ttttcatgtgggatc

SEQ ID NO: 67926 - DNA, 15 bp, Homo sapiens
tttcatgtgggatcc

SEQ ID NO: 67927 - DNA, 15 bp, Homo sapiens
ttcatgtgggatccc

SEQ ID NO: 67928 - DNA, 15 bp, Homo sapiens
tcatgtgggatccca

SEQ ID NO: 67929 - DNA, 15 bp, Homo sapiens
catgtgggatcccat

SEQ ID NO: 67930 - DNA, 15 bp, Homo sapiens
atgtgggatcccatc

SEQ ID NO: 67931 - DNA, 15 bp, Homo sapiens
tgtgggatcccatct

SEQ ID NO: 67932 - DNA, 15 bp, Homo sapiens
gtgggatcccatctt

SEQ ID NO: 67933 - DNA, 15 bp, Homo sapiens
tgggatcccatcttt

SEQ ID NO: 67934 - DNA, 15 bp, Homo sapiens
gggatcccatctttt

SEQ ID NO: 67935 - DNA, 15 bp, Homo sapiens
ggatcccatcttttt

SEQ ID NO: 67936 - DNA, 15 bp, Homo sapiens
gatcccatcttttta

SEQ ID NO: 67937 - DNA, 15 bp, Homo sapiens
atcccatctttttaa

SEQ ID NO: 67938 - DNA, 15 bp, Homo sapiens
tcccatctttttaac

SEQ ID NO: 67939 - DNA, 15 bp, Homo sapiens
cccatctttttaacc

SEQ ID NO: 67940 - DNA, 15 bp, Homo sapiens
ccatctttttaacct

SEQ ID NO: 67941 - DNA, 15 bp, Homo sapiens
catctttttaacctc

SEQ ID NO: 67942 - DNA, 15 bp, Homo sapiens
atctttttaacctct

SEQ ID NO: 67943 - DNA, 15 bp, Homo sapiens
tctttttaacctctg

SEQ ID NO: 67944 - DNA, 15 bp, Homo sapiens
ctttttaacctctgt

SEQ ID NO: 67945 - DNA, 15 bp, Homo sapiens
tttttaacctctgtt

SEQ ID NO: 67946 - DNA, 15 bp, Homo sapiens
ttttaacctctgttc

SEQ ID NO: 67947 - DNA, 15 bp, Homo sapiens
tttaacctctgttca

SEQ ID NO: 67948 - DNA, 15 bp, Homo sapiens
ttaacctctgttcag

SEQ ID NO: 67949 - DNA, 15 bp, Homo sapiens
taacctctgttcagg

SEQ ID NO: 67950 - DNA, 15 bp, Homo sapiens
aacctctgttcagga

SEQ ID NO: 67951 - DNA, 15 bp, Homo sapiens
acctctgttcaggaa

SEQ ID NO: 67952 - DNA, 15 bp, Homo sapiens
cctctgttcaggaag

SEQ ID NO: 67953 - DNA, 15 bp, Homo sapiens
ctctgttcaggaagt

SEQ ID NO: 67954 - DNA, 15 bp, Homo sapiens
tctgttcaggaagtc

SEQ ID NO: 67955 - DNA, 15 bp, Homo sapiens
ctgttcaggaagtcc

SEQ ID NO: 67956 - DNA, 15 bp, Homo sapiens
tgttcaggaagtcct

SEQ ID NO: 67957 - DNA, 15 bp, Homo sapiens
gttcaggaagtcctt

SEQ ID NO: 67958 - DNA, 15 bp, Homo sapiens
ttcaggaagtcctta

SEQ ID NO: 67959 - DNA, 15 bp, Homo sapiens
caggaagtccttatc

SEQ ID NO: 67960 - DNA, 15 bp, Homo sapiens
aggaagtccttatct

SEQ ID NO: 67961 - DNA, 15 bp, Homo sapiens
ggaagtccttatcta

SEQ ID NO: 67962 - DNA, 15 bp, Homo sapiens
gaagtccttatctag

SEQ ID NO: 67963 - DNA, 15 bp, Homo sapiens
aagtccttatctagc

SEQ ID NO: 67964 - DNA, 15 bp, Homo sapiens
agtccttatctagct

SEQ ID NO: 67965 - DNA, 15 bp, Homo sapiens
gtccttatctagctg

SEQ ID NO: 67966 - DNA, 15 bp, Homo sapiens
tccttatctagctgc

SEQ ID NO: 67967 - DNA, 15 bp, Homo sapiens
ccttatctagctgca

SEQ ID NO: 67968 - DNA, 15 bp, Homo sapiens
cttatctagctgcat

SEQ ID NO: 67969 - DNA, 15 bp, Homo sapiens
ttatctagctgcata

SEQ ID NO: 67970 - DNA, 15 bp, Homo sapiens
tatctagctgcatat

SEQ ID NO: 67971 - DNA, 15 bp, Homo sapiens
atctagctgcatatc

SEQ ID NO: 67972 - DNA, 15 bp, Homo sapiens
tctagctgcatatct

SEQ ID NO: 67973 - DNA, 15 bp, Homo sapiens
ctagctgcatatctt

SEQ ID NO: 67974 - DNA, 15 bp, Homo sapiens
tagctgcatatcttc

SEQ ID NO: 67975 - DNA, 15 bp, Homo sapiens
agctgcatatcttca

SEQ ID NO: 67976 - DNA, 15 bp, Homo sapiens
gctgcatatcttcat

SEQ ID NO: 67977 - DNA, 15 bp, Homo sapiens
ctgcatatcttcatc

SEQ ID NO: 67978 - DNA, 15 bp, Homo sapiens
tgcatatcttcatca

SEQ ID NO: 67979 - DNA, 15 bp, Homo sapiens
gcatatcttcatcat

SEQ ID NO: 67980 - DNA, 15 bp, Homo sapiens
catatcttcatcata

SEQ ID NO: 67981 - DNA, 15 bp, Homo sapiens
atatcttcatcatat

SEQ ID NO: 67982 - DNA, 15 bp, Homo sapiens
tatcttcatcatatt

SEQ ID NO: 67983 - DNA, 15 bp, Homo sapiens
atcttcatcatattg

SEQ ID NO: 67984 - DNA, 15 bp, Homo sapiens
tcttcatcatattgg

SEQ ID NO: 67985 - DNA, 15 bp, Homo sapiens
cttcatcatattggt

SEQ ID NO: 67986 - DNA, 15 bp, Homo sapiens
ttcatcatattggta

SEQ ID NO: 67987 - DNA, 15 bp, Homo sapiens
tcatcatattggtat

SEQ ID NO: 67988 - DNA, 15 bp, Homo sapiens
catcatattggtata

SEQ ID NO: 67989 - DNA, 15 bp, Homo sapiens
atcatattggtatat

SEQ ID NO: 67990 - DNA, 15 bp, Homo sapiens
tcatattggtatatc

SEQ ID NO: 67991 - DNA, 15 bp, Homo sapiens
catattggtatatcc

SEQ ID NO: 67992 - DNA, 15 bp, Homo sapiens
atattggtatatcct

SEQ ID NO: 67993 - DNA, 15 bp, Homo sapiens
tattggtatatcctt

SEQ ID NO: 67994 - DNA, 15 bp, Homo sapiens
attggtatatccttt

SEQ ID NO: 67995 - DNA, 15 bp, Homo sapiens
ttggtatatcctttt

SEQ ID NO: 67996 - DNA, 15 bp, Homo sapiens
tggtatatccttttc

SEQ ID NO: 67997 - DNA, 15 bp, Homo sapiens
ggtatatccttttct

SEQ ID NO: 67998 - DNA, 15 bp, Homo sapiens
gtatatccttttctg

SEQ ID NO: 67999 - DNA, 15 bp, Homo sapiens
tatatccttttctgt

SEQ ID NO: 68000 - DNA, 15 bp, Homo sapiens
atatccttttctgtg

SEQ ID NO: 68001 - DNA, 15 bp, Homo sapiens
tatccttttctgtgt

SEQ ID NO: 68002 - DNA, 15 bp, Homo sapiens
atccttttctgtgtt

SEQ ID NO: 68003 - DNA, 15 bp, Homo sapiens
tccttttctgtgttt

SEQ ID NO: 68004 - DNA, 15 bp, Homo sapiens
ccttttctgtgttta

SEQ ID NO: 68005 - DNA, 15 bp, Homo sapiens
cttttctgtgtttac

SEQ ID NO: 68006 - DNA, 15 bp, Homo sapiens
ttttctgtgtttaca

SEQ ID NO: 68007 - DNA, 15 bp, Homo sapiens
tttctgtgtttacag

SEQ ID NO: 68008 - DNA, 15 bp, Homo sapiens
ttctgtgtttacaga

SEQ ID NO: 68009 - DNA, 15 bp, Homo sapiens
tctgtgtttacagag

SEQ ID NO: 68010 - DNA, 15 bp, Homo sapiens
ctgtgtttacagaga

SEQ ID NO: 68011 - DNA, 15 bp, Homo sapiens
tgtgtttacagagat

SEQ ID NO: 68012 - DNA, 15 bp, Homo sapiens
gtgtttacagagatg

SEQ ID NO: 68013 - DNA, 15 bp, Homo sapiens
tgtttacagagatgt

SEQ ID NO: 68014 - DNA, 15 bp, Homo sapiens
gtttacagagatgtc

SEQ ID NO: 68015 - DNA, 15 bp, Homo sapiens
tttacagagatgtct

SEQ ID NO: 68016 - DNA, 15 bp, Homo sapiens
ttacagagatgtctc

SEQ ID NO: 68017 - DNA, 15 bp, Homo sapiens
tacagagatgtctct

SEQ ID NO: 68018 - DNA, 15 bp, Homo sapiens
acagagatgtctctt

SEQ ID NO: 68019 - DNA, 15 bp, Homo sapiens
cagagatgtctctta

SEQ ID NO: 68020 - DNA, 15 bp, Homo sapiens
agagatgtctcttat

SEQ ID NO: 68021 - DNA, 15 bp, Homo sapiens
gagatgtctcttata

SEQ ID NO: 68022 - DNA, 15 bp, Homo sapiens
agatgtctcttatat

SEQ ID NO: 68023 - DNA, 15 bp, Homo sapiens
gatgtctcttatatc

SEQ ID NO: 68024 - DNA, 15 bp, Homo sapiens
atgtctcttatatct

SEQ ID NO: 68025 - DNA, 15 bp, Homo sapiens
tgtctcttatatcta

SEQ ID NO: 68026 - DNA, 15 bp, Homo sapiens
gtctcttatatctaa

SEQ ID NO: 68027 - DNA, 15 bp, Homo sapiens
tctcttatatctaaa

SEQ ID NO: 68028 - DNA, 15 bp, Homo sapiens
ctcttatatctaaat

SEQ ID NO: 68029 - DNA, 15 bp, Homo sapiens
tcttatatctaaatc

SEQ ID NO: 68030 - DNA, 15 bp, Homo sapiens
cttatatctaaatct

SEQ ID NO: 68031 - DNA, 15 bp, Homo sapiens
ttatatctaaatctg

SEQ ID NO: 68032 - DNA, 15 bp, Homo sapiens
tatatctaaatctgt

SEQ ID NO: 68033 - DNA, 15 bp, Homo sapiens
atatctaaatctgtc

SEQ ID NO: 68034 - DNA, 15 bp, Homo sapiens
tatctaaatctgtcc

SEQ ID NO: 68035 - DNA, 15 bp, Homo sapiens
atctaaatctgtcca

SEQ ID NO: 68036 - DNA, 15 bp, Homo sapiens
tctaaatctgtccaa

SEQ ID NO: 68037 - DNA, 15 bp, Homo sapiens
ctaaatctgtccaac

SEQ ID NO: 68038 - DNA, 15 bp, Homo sapiens
taaatctgtccaact

SEQ ID NO: 68039 - DNA, 15 bp, Homo sapiens
aaatctgtccaactg

SEQ ID NO: 68040 - DNA, 15 bp, Homo sapiens
aatctgtccaactga

SEQ ID NO: 68041 - DNA, 15 bp, Homo sapiens
atctgtccaactgag

SEQ ID NO: 68042 - DNA, 15 bp, Homo sapiens
tctgtccaactgaga

SEQ ID NO: 68043 - DNA, 15 bp, Homo sapiens
ctgtccaactgagaa

SEQ ID NO: 68044 - DNA, 15 bp, Homo sapiens
tgtccaactgagaag

SEQ ID NO: 68045 - DNA, 15 bp, Homo sapiens
gtccaactgagaagt

SEQ ID NO: 68046 - DNA, 15 bp, Homo sapiens
tccaactgagaagta

SEQ ID NO: 68047 - DNA, 15 bp, Homo sapiens
ccaactgagaagtac

SEQ ID NO: 68048 - DNA, 15 bp, Homo sapiens
caactgagaagtacc

SEQ ID NO: 68049 - DNA, 15 bp, Homo sapiens
aactgagaagtacct

SEQ ID NO: 68050 - DNA, 15 bp, Homo sapiens
actgagaagtacctt

SEQ ID NO: 68051 - DNA, 15 bp, Homo sapiens
ctgagaagtacctta

SEQ ID NO: 68052 - DNA, 15 bp, Homo sapiens
tgagaagtaccttat

SEQ ID NO: 68053 - DNA, 15 bp, Homo sapiens
gagaagtaccttatc

SEQ ID NO: 68054 - DNA, 15 bp, Homo sapiens
agaagtaccttatca

SEQ ID NO: 68055 - DNA, 15 bp, Homo sapiens
gaagtaccttatcaa

SEQ ID NO: 68056 - DNA, 15 bp, Homo sapiens
aagtaccttatcaaa

SEQ ID NO: 68057 - DNA, 15 bp, Homo sapiens
agtaccttatcaaag

SEQ ID NO: 68058 - DNA, 15 bp, Homo sapiens
gtaccttatcaaagt

SEQ ID NO: 68059 - DNA, 15 bp, Homo sapiens
taccttatcaaagta

SEQ ID NO: 68060 - DNA, 15 bp, Homo sapiens
accttatcaaagtag

SEQ ID NO: 68061 - DNA, 15 bp, Homo sapiens
ccttatcaaagtagc

SEQ ID NO: 68062 - DNA, 15 bp, Homo sapiens
cttatcaaagtagca

SEQ ID NO: 68063 - DNA, 15 bp, Homo sapiens
ttatcaaagtagcaa

SEQ ID NO: 68064 - DNA, 15 bp, Homo sapiens
tatcaaagtagcaaa

SEQ ID NO: 68065 - DNA, 15 bp, Homo sapiens
atcaaagtagcaaat

SEQ ID NO: 68066 - DNA, 15 bp, Homo sapiens
tcaaagtagcaaatg

SEQ ID NO: 68067 - DNA, 15 bp, Homo sapiens
caaagtagcaaatga

SEQ ID NO: 68068 - DNA, 15 bp, Homo sapiens
aaagtagcaaatgag

SEQ ID NO: 68069 - DNA, 15 bp, Homo sapiens
aagtagcaaatgaga

SEQ ID NO: 68070 - DNA, 15 bp, Homo sapiens
agtagcaaatgagac

SEQ ID NO: 68071 - DNA, 15 bp, Homo sapiens
gtagcaaatgagaca

SEQ ID NO: 68072 - DNA, 15 bp, Homo sapiens
tagcaaatgagacag

SEQ ID NO: 68073 - DNA, 15 bp, Homo sapiens
agcaaatgagacagc

SEQ ID NO: 68074 - DNA, 15 bp, Homo sapiens
gcaaatgagacagca

SEQ ID NO: 68075 - DNA, 15 bp, Homo sapiens
caaatgagacagcag

SEQ ID NO: 68076 - DNA, 15 bp, Homo sapiens
aaatgagacagcagt

SEQ ID NO: 68077 - DNA, 15 bp, Homo sapiens
aatgagacagcagtc

SEQ ID NO: 68078 - DNA, 15 bp, Homo sapiens
atgagacagcagtct

SEQ ID NO: 68079 - DNA, 15 bp, Homo sapiens
tgagacagcagtctt

SEQ ID NO: 68080 - DNA, 15 bp, Homo sapiens
gagacagcagtctta

SEQ ID NO: 68081 - DNA, 15 bp, Homo sapiens
agacagcagtcttat

SEQ ID NO: 68082 - DNA, 15 bp, Homo sapiens
gacagcagtcttatg

SEQ ID NO: 68083 - DNA, 15 bp, Homo sapiens
acagcagtcttatgc

SEQ ID NO: 68084 - DNA, 15 bp, Homo sapiens
cagcagtcttatgct

SEQ ID NO: 68085 - DNA, 15 bp, Homo sapiens
agcagtcttatgctt

SEQ ID NO: 68086 - DNA, 15 bp, Homo sapiens
gcagtcttatgcttc

SEQ ID NO: 68087 - DNA, 15 bp, Homo sapiens
cagtcttatgcttcc

SEQ ID NO: 68088 - DNA, 15 bp, Homo sapiens
agtcttatgcttcca

SEQ ID NO: 68089 - DNA, 15 bp, Homo sapiens
gtcttatgcttccag

SEQ ID NO: 68090 - DNA, 15 bp, Homo sapiens
tcttatgcttccaga

SEQ ID NO: 68091 - DNA, 15 bp, Homo sapiens
cttatgcttccagaa

SEQ ID NO: 68092 - DNA, 15 bp, Homo sapiens
ttatgcttccagaaa

SEQ ID NO: 68093 - DNA, 15 bp, Homo sapiens
tatgcttccagaaac

SEQ ID NO: 68094 - DNA, 15 bp, Homo sapiens
atgcttccagaaaca

SEQ ID NO: 68095 - DNA, 15 bp, Homo sapiens
tgcttccagaaacac

SEQ ID NO: 68096 - DNA, 15 bp, Homo sapiens
gcttccagaaacacc

SEQ ID NO: 68097 - DNA, 15 bp, Homo sapiens
cttccagaaacaccc

SEQ ID NO: 68098 - DNA, 15 bp, Homo sapiens
ttccagaaacaccca

SEQ ID NO: 68099 - DNA, 15 bp, Homo sapiens
tccagaaacacccac

SEQ ID NO: 68100 - DNA, 15 bp, Homo sapiens
ccagaaacacccaca

SEQ ID NO: 68101 - DNA, 15 bp, Homo sapiens
cagaaacacccacag

SEQ ID NO: 68102 - DNA, 15 bp, Homo sapiens
agaaacacccacagg

SEQ ID NO: 68103 - DNA, 15 bp, Homo sapiens
gaaacacccacaggc

SEQ ID NO: 68104 - DNA, 15 bp, Homo sapiens
aaacacccacaggca

SEQ ID NO: 68105 - DNA, 15 bp, Homo sapiens
aacacccacaggcat

SEQ ID NO: 68106 - DNA, 15 bp, Homo sapiens
acacccacaggcatg

SEQ ID NO: 68107 - DNA, 15 bp, Homo sapiens
cacccacaggcatgt

SEQ ID NO: 68108 - DNA, 15 bp, Homo sapiens
acccacaggcatgtc

SEQ ID NO: 68109 - DNA, 15 bp, Homo sapiens
cccacaggcatgtcc

SEQ ID NO: 68110 - DNA, 15 bp, Homo sapiens
ccacaggcatgtccc

SEQ ID NO: 68111 - DNA, 15 bp, Homo sapiens
cacaggcatgtccca

SEQ ID NO: 68112 - DNA, 15 bp, Homo sapiens
acaggcatgtcccat

SEQ ID NO: 68113 - DNA, 15 bp, Homo sapiens
caggcatgtcccatg

SEQ ID NO: 68114 - DNA, 15 bp, Homo sapiens
aggcatgtcccatgt

SEQ ID NO: 68115 - DNA, 15 bp, Homo sapiens
ggcatgtcccatgtg

SEQ ID NO: 68116 - DNA, 15 bp, Homo sapiens
gcatgtcccatgtga

SEQ ID NO: 68117 - DNA, 15 bp, Homo sapiens
catgtcccatgtgag

SEQ ID NO: 68118 - DNA, 15 bp, Homo sapiens
atgtcccatgtgagc

SEQ ID NO: 68119 - DNA, 15 bp, Homo sapiens
tgtcccatgtgagct

SEQ ID NO: 68120 - DNA, 15 bp, Homo sapiens
gtcccatgtgagctg

SEQ ID NO: 68121 - DNA, 15 bp, Homo sapiens
tcccatgtgagctgc

SEQ ID NO: 68122 - DNA, 15 bp, Homo sapiens
cccatgtgagctgct

SEQ ID NO: 68123 - DNA, 15 bp, Homo sapiens
ccatgtgagctgctg

SEQ ID NO: 68124 - DNA, 15 bp, Homo sapiens
catgtgagctgctgc

SEQ ID NO: 68125 - DNA, 15 bp, Homo sapiens
atgtgagctgctgcc

SEQ ID NO: 68126 - DNA, 15 bp, Homo sapiens
tgtgagctgctgcca

SEQ ID NO: 68127 - DNA, 15 bp, Homo sapiens
gtgagctgctgccat

SEQ ID NO: 68128 - DNA, 15 bp, Homo sapiens
tgagctgctgccatg

SEQ ID NO: 68129 - DNA, 15 bp, Homo sapiens
gagctgctgccatga

SEQ ID NO: 68130 - DNA, 15 bp, Homo sapiens
agctgctgccatgaa

SEQ ID NO: 68131 - DNA, 15 bp, Homo sapiens
gctgctgccatgaac

SEQ ID NO: 68132 - DNA, 15 bp, Homo sapiens
ctgctgccatgaact

SEQ ID NO: 68133 - DNA, 15 bp, Homo sapiens
tgctgccatgaactg

SEQ ID NO: 68134 - DNA, 15 bp, Homo sapiens
gctgccatgaactgt

SEQ ID NO: 68135 - DNA, 15 bp, Homo sapiens
ctgccatgaactgtc

SEQ ID NO: 68136 - DNA, 15 bp, Homo sapiens
tgccatgaactgtca

SEQ ID NO: 68137 - DNA, 15 bp, Homo sapiens
gccatgaactgtcaa

SEQ ID NO: 68138 - DNA, 15 bp, Homo sapiens
ccatgaactgtcaag

SEQ ID NO: 68139 - DNA, 15 bp, Homo sapiens
catgaactgtcaagt

SEQ ID NO: 68140 - DNA, 15 bp, Homo sapiens
atgaactgtcaagtg

SEQ ID NO: 68141 - DNA, 15 bp, Homo sapiens
tgaactgtcaagtgt

SEQ ID NO: 68142 - DNA, 15 bp, Homo sapiens
gaactgtcaagtgtg

SEQ ID NO: 68143 - DNA, 15 bp, Homo sapiens
aactgtcaagtgtgt

SEQ ID NO: 68144 - DNA, 15 bp, Homo sapiens
actgtcaagtgtgtg

SEQ ID NO: 68145 - DNA, 15 bp, Homo sapiens
ctgtcaagtgtgtgt

SEQ ID NO: 68146 - DNA, 15 bp, Homo sapiens
tgtcaagtgtgtgtt

SEQ ID NO: 68147 - DNA, 15 bp, Homo sapiens
gtcaagtgtgtgttg

SEQ ID NO: 68148 - DNA, 15 bp, Homo sapiens
tcaagtgtgtgttgt

SEQ ID NO: 68149 - DNA, 15 bp, Homo sapiens
caagtgtgtgttgtc

SEQ ID NO: 68150 - DNA, 15 bp, Homo sapiens
aagtgtgtgttgtct

SEQ ID NO: 68151 - DNA, 15 bp, Homo sapiens
agtgtgtgttgtctt

SEQ ID NO: 68152 - DNA, 15 bp, Homo sapiens
gtgtgtgttgtcttg

SEQ ID NO: 68153 - DNA, 15 bp, Homo sapiens
tgtgtgttgtcttgt

SEQ ID NO: 68154 - DNA, 15 bp, Homo sapiens
gtgtgttgtcttgtg

SEQ ID NO: 68155 - DNA, 15 bp, Homo sapiens
tgtgttgtcttgtgt

SEQ ID NO: 68156 - DNA, 15 bp, Homo sapiens
gtgttgtcttgtgta

SEQ ID NO: 68157 - DNA, 15 bp, Homo sapiens
tgttgtcttgtgtat

SEQ ID NO: 68158 - DNA, 15 bp, Homo sapiens
gttgtcttgtgtatt

SEQ ID NO: 68159 - DNA, 15 bp, Homo sapiens
ttgtcttgtgtattt

SEQ ID NO: 68160 - DNA, 15 bp, Homo sapiens
tgtcttgtgtatttc

SEQ ID NO: 68161 - DNA, 15 bp, Homo sapiens
gtcttgtgtatttca

SEQ ID NO: 68162 - DNA, 15 bp, Homo sapiens
tcttgtgtatttcag

SEQ ID NO: 68163 - DNA, 15 bp, Homo sapiens
cttgtgtatttcagt

SEQ ID NO: 68164 - DNA, 15 bp, Homo sapiens
ttgtgtatttcagtt

SEQ ID NO: 68165 - DNA, 15 bp, Homo sapiens
tgtgtatttcagtta

SEQ ID NO: 68166 - DNA, 15 bp, Homo sapiens
gtgtatttcagttat

SEQ ID NO: 68167 - DNA, 15 bp, Homo sapiens
tgtatttcagttatt

SEQ ID NO: 68168 - DNA, 15 bp, Homo sapiens
gtatttcagttattg

SEQ ID NO: 68169 - DNA, 15 bp, Homo sapiens
tatttcagttattgt

SEQ ID NO: 68170 - DNA, 15 bp, Homo sapiens
atttcagttattgtc

SEQ ID NO: 68171 - DNA, 15 bp, Homo sapiens
tttcagttattgtcc

SEQ ID NO: 68172 - DNA, 15 bp, Homo sapiens
ttcagttattgtccc

SEQ ID NO: 68173 - DNA, 15 bp, Homo sapiens
tcagttattgtccct

SEQ ID NO: 68174 - DNA, 15 bp, Homo sapiens
cagttattgtccctg

SEQ ID NO: 68175 - DNA, 15 bp, Homo sapiens
agttattgtccctgg

SEQ ID NO: 68176 - DNA, 15 bp, Homo sapiens
gttattgtccctggc

SEQ ID NO: 68177 - DNA, 15 bp, Homo sapiens
ttattgtccctggct

SEQ ID NO: 68178 - DNA, 15 bp, Homo sapiens
tattgtccctggctt

SEQ ID NO: 68179 - DNA, 15 bp, Homo sapiens
attgtccctggcttc

SEQ ID NO: 68180 - DNA, 15 bp, Homo sapiens
ttgtccctggcttcc

SEQ ID NO: 68181 - DNA, 15 bp, Homo sapiens
tgtccctggcttcct

SEQ ID NO: 68182 - DNA, 15 bp, Homo sapiens
gtccctggcttcctt

SEQ ID NO: 68183 - DNA, 15 bp, Homo sapiens
tccctggcttcctta

SEQ ID NO: 68184 - DNA, 15 bp, Homo sapiens
ccctggcttccttac

SEQ ID NO: 68185 - DNA, 15 bp, Homo sapiens
cctggcttccttact

SEQ ID NO: 68186 - DNA, 15 bp, Homo sapiens
ctggcttccttacta

SEQ ID NO: 68187 - DNA, 15 bp, Homo sapiens
tggcttccttactat

SEQ ID NO: 68188 - DNA, 15 bp, Homo sapiens
ggcttccttactatg

SEQ ID NO: 68189 - DNA, 15 bp, Homo sapiens
gcttccttactatgg

SEQ ID NO: 68190 - DNA, 15 bp, Homo sapiens
cttccttactatggt

SEQ ID NO: 68191 - DNA, 15 bp, Homo sapiens
ttccttactatggtg

SEQ ID NO: 68192 - DNA, 15 bp, Homo sapiens
tccttactatggtgt

SEQ ID NO: 68193 - DNA, 15 bp, Homo sapiens
ccttactatggtgta

SEQ ID NO: 68194 - DNA, 15 bp, Homo sapiens
cttactatggtgtaa

SEQ ID NO: 68195 - DNA, 15 bp, Homo sapiens
ttactatggtgtaat

SEQ ID NO: 68196 - DNA, 15 bp, Homo sapiens
tactatggtgtaatc

SEQ ID NO: 68197 - DNA, 15 bp, Homo sapiens
actatggtgtaatca

SEQ ID NO: 68198 - DNA, 15 bp, Homo sapiens
ctatggtgtaatcat

SEQ ID NO: 68199 - DNA, 15 bp, Homo sapiens
tatggtgtaatcatg

SEQ ID NO: 68200 - DNA, 15 bp, Homo sapiens
atggtgtaatcatga

SEQ ID NO: 68201 - DNA, 15 bp, Homo sapiens
tggtgtaatcatgaa

SEQ ID NO: 68202 - DNA, 15 bp, Homo sapiens
ggtgtaatcatgaag

SEQ ID NO: 68203 - DNA, 15 bp, Homo sapiens
gtgtaatcatgaagg

SEQ ID NO: 68204 - DNA, 15 bp, Homo sapiens
tgtaatcatgaagga

SEQ ID NO: 68205 - DNA, 15 bp, Homo sapiens
gtaatcatgaaggag

SEQ ID NO: 68206 - DNA, 15 bp, Homo sapiens
taatcatgaaggagt

SEQ ID NO: 68207 - DNA, 15 bp, Homo sapiens
aatcatgaaggagtg

SEQ ID NO: 68208 - DNA, 15 bp, Homo sapiens
atcatgaaggagtga

SEQ ID NO: 68209 - DNA, 15 bp, Homo sapiens
tcatgaaggagtgaa

SEQ ID NO: 68210 - DNA, 15 bp, Homo sapiens
catgaaggagtgaaa

SEQ ID NO: 68211 - DNA, 15 bp, Homo sapiens
atgaaggagtgaaac

SEQ ID NO: 68212 - DNA, 15 bp, Homo sapiens
tgaaggagtgaaaca

SEQ ID NO: 68213 - DNA, 15 bp, Homo sapiens
gaaggagtgaaacat

SEQ ID NO: 68214 - DNA, 15 bp, Homo sapiens
aaggagtgaaacatc

SEQ ID NO: 68215 - DNA, 15 bp, Homo sapiens
aggagtgaaacatca

SEQ ID NO: 68216 - DNA, 15 bp, Homo sapiens
ggagtgaaacatcat

SEQ ID NO: 68217 - DNA, 15 bp, Homo sapiens
gagtgaaacatcata

SEQ ID NO: 68218 - DNA, 15 bp, Homo sapiens
agtgaaacatcatag

SEQ ID NO: 68219 - DNA, 15 bp, Homo sapiens
gtgaaacatcataga

SEQ ID NO: 68220 - DNA, 15 bp, Homo sapiens
tgaaacatcatagaa

SEQ ID NO: 68221 - DNA, 15 bp, Homo sapiens
gaaacatcatagaaa

SEQ ID NO: 68222 - DNA, 15 bp, Homo sapiens
aaacatcatagaaac

SEQ ID NO: 68223 - DNA, 15 bp, Homo sapiens
aacatcatagaaact

SEQ ID NO: 68224 - DNA, 15 bp, Homo sapiens
acatcatagaaactg

SEQ ID NO: 68225 - DNA, 15 bp, Homo sapiens
catcatagaaactgt

SEQ ID NO: 68226 - DNA, 15 bp, Homo sapiens
atcatagaaactgtc

SEQ ID NO: 68227 - DNA, 15 bp, Homo sapiens
tcatagaaactgtct

SEQ ID NO: 68228 - DNA, 15 bp, Homo sapiens
catagaaactgtcta

SEQ ID NO: 68229 - DNA, 15 bp, Homo sapiens
atagaaactgtctag

SEQ ID NO: 68230 - DNA, 15 bp, Homo sapiens
tagaaactgtctagc

SEQ ID NO: 68231 - DNA, 15 bp, Homo sapiens
agaaactgtctagca

SEQ ID NO: 68232 - DNA, 15 bp, Homo sapiens
gaaactgtctagcac

SEQ ID NO: 68233 - DNA, 15 bp, Homo sapiens
aaactgtctagcact

SEQ ID NO: 68234 - DNA, 15 bp, Homo sapiens
aactgtctagcactt

SEQ ID NO: 68235 - DNA, 15 bp, Homo sapiens
actgtctagcacttc

SEQ ID NO: 68236 - DNA, 15 bp, Homo sapiens
ctgtctagcacttcc

SEQ ID NO: 68237 - DNA, 15 bp, Homo sapiens
tgtctagcacttcct

SEQ ID NO: 68238 - DNA, 15 bp, Homo sapiens
gtctagcacttcctt

SEQ ID NO: 68239 - DNA, 15 bp, Homo sapiens
tctagcacttccttg

SEQ ID NO: 68240 - DNA, 15 bp, Homo sapiens
ctagcacttccttgc

SEQ ID NO: 68241 - DNA, 15 bp, Homo sapiens
tagcacttccttgcc

SEQ ID NO: 68242 - DNA, 15 bp, Homo sapiens
agcacttccttgcca

SEQ ID NO: 68243 - DNA, 15 bp, Homo sapiens
gcacttccttgccag

SEQ ID NO: 68244 - DNA, 15 bp, Homo sapiens
cacttccttgccagt

SEQ ID NO: 68245 - DNA, 15 bp, Homo sapiens
acttccttgccagtc

SEQ ID NO: 68246 - DNA, 15 bp, Homo sapiens
cttccttgccagtct

SEQ ID NO: 68247 - DNA, 15 bp, Homo sapiens
ttccttgccagtctt

SEQ ID NO: 68248 - DNA, 15 bp, Homo sapiens
tccttgccagtcttt

SEQ ID NO: 68249 - DNA, 15 bp, Homo sapiens
ccttgccagtcttta

SEQ ID NO: 68250 - DNA, 15 bp, Homo sapiens
cttgccagtctttag

SEQ ID NO: 68251 - DNA, 15 bp, Homo sapiens
ttgccagtctttagt

SEQ ID NO: 68252 - DNA, 15 bp, Homo sapiens
tgccagtctttagtg

SEQ ID NO: 68253 - DNA, 15 bp, Homo sapiens
gccagtctttagtga

SEQ ID NO: 68254 - DNA, 15 bp, Homo sapiens
ccagtctttagtgat

SEQ ID NO: 68255 - DNA, 15 bp, Homo sapiens
cagtctttagtgatc

SEQ ID NO: 68256 - DNA, 15 bp, Homo sapiens
agtctttagtgatca

SEQ ID NO: 68257 - DNA, 15 bp, Homo sapiens
gtctttagtgatcag

SEQ ID NO: 68258 - DNA, 15 bp, Homo sapiens
tctttagtgatcagg

SEQ ID NO: 68259 - DNA, 15 bp, Homo sapiens
ctttagtgatcagga

SEQ ID NO: 68260 - DNA, 15 bp, Homo sapiens
tttagtgatcaggaa

SEQ ID NO: 68261 - DNA, 15 bp, Homo sapiens
ttagtgatcaggaac

SEQ ID NO: 68262 - DNA, 15 bp, Homo sapiens
tagtgatcaggaacc

SEQ ID NO: 68263 - DNA, 15 bp, Homo sapiens
agtgatcaggaacca

SEQ ID NO: 68264 - DNA, 15 bp, Homo sapiens
gtgatcaggaaccat

SEQ ID NO: 68265 - DNA, 15 bp, Homo sapiens
tgatcaggaaccata

SEQ ID NO: 68266 - DNA, 15 bp, Homo sapiens
gatcaggaaccatag

SEQ ID NO: 68267 - DNA, 15 bp, Homo sapiens
atcaggaaccatagt

SEQ ID NO: 68268 - DNA, 15 bp, Homo sapiens
tcaggaaccatagtt

SEQ ID NO: 68269 - DNA, 15 bp, Homo sapiens
caggaaccatagttg

SEQ ID NO: 68270 - DNA, 15 bp, Homo sapiens
aggaaccatagttga

SEQ ID NO: 68271 - DNA, 15 bp, Homo sapiens
ggaaccatagttgac

SEQ ID NO: 68272 - DNA, 15 bp, Homo sapiens
gaaccatagttgaca

SEQ ID NO: 68273 - DNA, 15 bp, Homo sapiens
aaccatagttgacag

SEQ ID NO: 68274 - DNA, 15 bp, Homo sapiens
accatagttgacagt

SEQ ID NO: 68275 - DNA, 15 bp, Homo sapiens
ccatagttgacagtt

SEQ ID NO: 68276 - DNA, 15 bp, Homo sapiens
catagttgacagttc

SEQ ID NO: 68277 - DNA, 15 bp, Homo sapiens
atagttgacagttcc

SEQ ID NO: 68278 - DNA, 15 bp, Homo sapiens
tagttgacagttcca

SEQ ID NO: 68279 - DNA, 15 bp, Homo sapiens
agttgacagttccaa

SEQ ID NO: 68280 - DNA, 15 bp, Homo sapiens
gttgacagttccaat

SEQ ID NO: 68281 - DNA, 15 bp, Homo sapiens
ttgacagttccaatc

SEQ ID NO: 68282 - DNA, 15 bp, Homo sapiens
tgacagttccaatca

SEQ ID NO: 68283 - DNA, 15 bp, Homo sapiens
gacagttccaatcag

SEQ ID NO: 68284 - DNA, 15 bp, Homo sapiens
acagttccaatcagt

SEQ ID NO: 68285 - DNA, 15 bp, Homo sapiens
cagttccaatcagta

SEQ ID NO: 68286 - DNA, 15 bp, Homo sapiens
agttccaatcagtag

SEQ ID NO: 68287 - DNA, 15 bp, Homo sapiens
gttccaatcagtagc

SEQ ID NO: 68288 - DNA, 15 bp, Homo sapiens
ttccaatcagtagct

SEQ ID NO: 68289 - DNA, 15 bp, Homo sapiens
tccaatcagtagctt

SEQ ID NO: 68290 - DNA, 15 bp, Homo sapiens
ccaatcagtagctta

SEQ ID NO: 68291 - DNA, 15 bp, Homo sapiens
caatcagtagcttaa

SEQ ID NO: 68292 - DNA, 15 bp, Homo sapiens
aatcagtagcttaag

SEQ ID NO: 68293 - DNA, 15 bp, Homo sapiens
atcagtagcttaaga

SEQ ID NO: 68294 - DNA, 15 bp, Homo sapiens
tcagtagcttaagaa

SEQ ID NO: 68295 - DNA, 15 bp, Homo sapiens
cagtagcttaagaaa

SEQ ID NO: 68296 - DNA, 15 bp, Homo sapiens
agtagcttaagaaaa

SEQ ID NO: 68297 - DNA, 15 bp, Homo sapiens
gtagcttaagaaaaa

SEQ ID NO: 68298 - DNA, 15 bp, Homo sapiens
tagcttaagaaaaaa

SEQ ID NO: 68299 - DNA, 15 bp, Homo sapiens
agcttaagaaaaaac

SEQ ID NO: 68300 - DNA, 15 bp, Homo sapiens
gcttaagaaaaaacc

SEQ ID NO: 68301 - DNA, 15 bp, Homo sapiens
cttaagaaaaaaccg

SEQ ID NO: 68302 - DNA, 15 bp, Homo sapiens
ttaagaaaaaaccgt

SEQ ID NO: 68303 - DNA, 15 bp, Homo sapiens
taagaaaaaaccgtg

SEQ ID NO: 68304 - DNA, 15 bp, Homo sapiens
aagaaaaaaccgtgt

SEQ ID NO: 68305 - DNA, 15 bp, Homo sapiens
agaaaaaaccgtgtt

SEQ ID NO: 68306 - DNA, 15 bp, Homo sapiens
gaaaaaaccgtgttt

SEQ ID NO: 68307 - DNA, 15 bp, Homo sapiens
aaaaaaccgtgtttg

SEQ ID NO: 68308 - DNA, 15 bp, Homo sapiens
aaaaaccgtgtttgt

SEQ ID NO: 68309 - DNA, 15 bp, Homo sapiens
aaaaccgtgtttgtc

SEQ ID NO: 68310 - DNA, 15 bp, Homo sapiens
aaaccgtgtttgtct

SEQ ID NO: 68311 - DNA, 15 bp, Homo sapiens
aaccgtgtttgtctc

SEQ ID NO: 68312 - DNA, 15 bp, Homo sapiens
accgtgtttgtctct

SEQ ID NO: 68313 - DNA, 15 bp, Homo sapiens
ccgtgtttgtctctt

SEQ ID NO: 68314 - DNA, 15 bp, Homo sapiens
cgtgtttgtctcttc

SEQ ID NO: 68315 - DNA, 15 bp, Homo sapiens
gtgtttgtctcttct

SEQ ID NO: 68316 - DNA, 15 bp, Homo sapiens
tgtttgtctcttctg

SEQ ID NO: 68317 - DNA, 15 bp, Homo sapiens
gtttgtctcttctgg

SEQ ID NO: 68318 - DNA, 15 bp, Homo sapiens
tttgtctcttctgga

SEQ ID NO: 68319 - DNA, 15 bp, Homo sapiens
ttgtctcttctggaa

SEQ ID NO: 68320 - DNA, 15 bp, Homo sapiens
tgtctcttctggaat

SEQ ID NO: 68321 - DNA, 15 bp, Homo sapiens
gtctcttctggaatg

SEQ ID NO: 68322 - DNA, 15 bp, Homo sapiens
tctcttctggaatgg

SEQ ID NO: 68323 - DNA, 15 bp, Homo sapiens
ctcttctggaatggt

SEQ ID NO: 68324 - DNA, 15 bp, Homo sapiens
tcttctggaatggtt

SEQ ID NO: 68325 - DNA, 15 bp, Homo sapiens
cttctggaatggtta

SEQ ID NO: 68326 - DNA, 15 bp, Homo sapiens
ttctggaatggttag

SEQ ID NO: 68327 - DNA, 15 bp, Homo sapiens
tctggaatggttaga

SEQ ID NO: 68328 - DNA, 15 bp, Homo sapiens
ctggaatggttagaa

SEQ ID NO: 68329 - DNA, 15 bp, Homo sapiens
tggaatggttagaag

SEQ ID NO: 68330 - DNA, 15 bp, Homo sapiens
ggaatggttagaagt

SEQ ID NO: 68331 - DNA, 15 bp, Homo sapiens
gaatggttagaagtg

SEQ ID NO: 68332 - DNA, 15 bp, Homo sapiens
aatggttagaagtga

SEQ ID NO: 68333 - DNA, 15 bp, Homo sapiens
atggttagaagtgag

SEQ ID NO: 68334 - DNA, 15 bp, Homo sapiens
tggttagaagtgagg

SEQ ID NO: 68335 - DNA, 15 bp, Homo sapiens
ggttagaagtgaggg

SEQ ID NO: 68336 - DNA, 15 bp, Homo sapiens
gttagaagtgaggga

SEQ ID NO: 68337 - DNA, 15 bp, Homo sapiens
ttagaagtgagggag

SEQ ID NO: 68338 - DNA, 15 bp, Homo sapiens
tagaagtgagggagt

SEQ ID NO: 68339 - DNA, 15 bp, Homo sapiens
agaagtgagggagtt

SEQ ID NO: 68340 - DNA, 15 bp, Homo sapiens
gaagtgagggagttt

SEQ ID NO: 68341 - DNA, 15 bp, Homo sapiens
aagtgagggagtttg

SEQ ID NO: 68342 - DNA, 15 bp, Homo sapiens
agtgagggagtttgc

SEQ ID NO: 68343 - DNA, 15 bp, Homo sapiens
gtgagggagtttgcc

SEQ ID NO: 68344 - DNA, 15 bp, Homo sapiens
tgagggagtttgccc

SEQ ID NO: 68345 - DNA, 15 bp, Homo sapiens
gagggagtttgcccc

SEQ ID NO: 68346 - DNA, 15 bp, Homo sapiens
agggagtttgccccg

SEQ ID NO: 68347 - DNA, 15 bp, Homo sapiens
gggagtttgccccgt

SEQ ID NO: 68348 - DNA, 15 bp, Homo sapiens
ggagtttgccccgtt

SEQ ID NO: 68349 - DNA, 15 bp, Homo sapiens
gagtttgccccgttc

SEQ ID NO: 68350 - DNA, 15 bp, Homo sapiens
agtttgccccgttct

SEQ ID NO: 68351 - DNA, 15 bp, Homo sapiens
gtttgccccgttctg

SEQ ID NO: 68352 - DNA, 15 bp, Homo sapiens
tttgccccgttctgt

SEQ ID NO: 68353 - DNA, 15 bp, Homo sapiens
ttgccccgttctgtt

SEQ ID NO: 68354 - DNA, 15 bp, Homo sapiens
tgccccgttctgttt

SEQ ID NO: 68355 - DNA, 15 bp, Homo sapiens
gccccgttctgtttg

SEQ ID NO: 68356 - DNA, 15 bp, Homo sapiens
ccccgttctgtttgt

SEQ ID NO: 68357 - DNA, 15 bp, Homo sapiens
cccgttctgtttgta

SEQ ID NO: 68358 - DNA, 15 bp, Homo sapiens
ccgttctgtttgtag

SEQ ID NO: 68359 - DNA, 15 bp, Homo sapiens
cgttctgtttgtaga

SEQ ID NO: 68360 - DNA, 15 bp, Homo sapiens
gttctgtttgtagag

SEQ ID NO: 68361 - DNA, 15 bp, Homo sapiens
ttctgtttgtagagt

SEQ ID NO: 68362 - DNA, 15 bp, Homo sapiens
tctgtttgtagagtc

SEQ ID NO: 68363 - DNA, 15 bp, Homo sapiens
ctgtttgtagagtct

SEQ ID NO: 68364 - DNA, 15 bp, Homo sapiens
tgtttgtagagtctc

SEQ ID NO: 68365 - DNA, 15 bp, Homo sapiens
gtttgtagagtctca

SEQ ID NO: 68366 - DNA, 15 bp, Homo sapiens
tttgtagagtctcat

SEQ ID NO: 68367 - DNA, 15 bp, Homo sapiens
ttgtagagtctcata

SEQ ID NO: 68368 - DNA, 15 bp, Homo sapiens
tgtagagtctcatag

SEQ ID NO: 68369 - DNA, 15 bp, Homo sapiens
gtagagtctcatagt

SEQ ID NO: 68370 - DNA, 15 bp, Homo sapiens
tagagtctcatagtt

SEQ ID NO: 68371 - DNA, 15 bp, Homo sapiens
agagtctcatagttg

SEQ ID NO: 68372 - DNA, 15 bp, Homo sapiens
gagtctcatagttgg

SEQ ID NO: 68373 - DNA, 15 bp, Homo sapiens
agtctcatagttgga

SEQ ID NO: 68374 - DNA, 15 bp, Homo sapiens
gtctcatagttggac

SEQ ID NO: 68375 - DNA, 15 bp, Homo sapiens
tctcatagttggact

SEQ ID NO: 68376 - DNA, 15 bp, Homo sapiens
ctcatagttggactt

SEQ ID NO: 68377 - DNA, 15 bp, Homo sapiens
tcatagttggacttt

SEQ ID NO: 68378 - DNA, 15 bp, Homo sapiens
catagttggactttc

SEQ ID NO: 68379 - DNA, 15 bp, Homo sapiens
atagttggactttct

SEQ ID NO: 68380 - DNA, 15 bp, Homo sapiens
tagttggactttcta

SEQ ID NO: 68381 - DNA, 15 bp, Homo sapiens
agttggactttctag

SEQ ID NO: 68382 - DNA, 15 bp, Homo sapiens
gttggactttctagc

SEQ ID NO: 68383 - DNA, 15 bp, Homo sapiens
ttggactttctagca

SEQ ID NO: 68384 - DNA, 15 bp, Homo sapiens
tggactttctagcat

SEQ ID NO: 68385 - DNA, 15 bp, Homo sapiens
ggactttctagcata

SEQ ID NO: 68386 - DNA, 15 bp, Homo sapiens
gactttctagcatat

SEQ ID NO: 68387 - DNA, 15 bp, Homo sapiens
actttctagcatata

SEQ ID NO: 68388 - DNA, 15 bp, Homo sapiens
ctttctagcatatat

SEQ ID NO: 68389 - DNA, 15 bp, Homo sapiens
tttctagcatatatg

SEQ ID NO: 68390 - DNA, 15 bp, Homo sapiens
ttctagcatatatgt

SEQ ID NO: 68391 - DNA, 15 bp, Homo sapiens
tctagcatatatgtg

SEQ ID NO: 68392 - DNA, 15 bp, Homo sapiens
ctagcatatatgtgt

SEQ ID NO: 68393 - DNA, 15 bp, Homo sapiens
tagcatatatgtgtc

SEQ ID NO: 68394 - DNA, 15 bp, Homo sapiens
agcatatatgtgtcc

SEQ ID NO: 68395 - DNA, 15 bp, Homo sapiens
gcatatatgtgtcca

SEQ ID NO: 68396 - DNA, 15 bp, Homo sapiens
catatatgtgtccat

SEQ ID NO: 68397 - DNA, 15 bp, Homo sapiens
atatatgtgtccatt

SEQ ID NO: 68398 - DNA, 15 bp, Homo sapiens
tatatgtgtccattt

SEQ ID NO: 68399 - DNA, 15 bp, Homo sapiens
atatgtgtccatttc

SEQ ID NO: 68400 - DNA, 15 bp, Homo sapiens
tatgtgtccatttcc

SEQ ID NO: 68401 - DNA, 15 bp, Homo sapiens
atgtgtccatttcct

SEQ ID NO: 68402 - DNA, 15 bp, Homo sapiens
tgtgtccatttcctt

SEQ ID NO: 68403 - DNA, 15 bp, Homo sapiens
gtgtccatttcctta

SEQ ID NO: 68404 - DNA, 15 bp, Homo sapiens
tgtccatttccttat

SEQ ID NO: 68405 - DNA, 15 bp, Homo sapiens
gtccatttccttatg

SEQ ID NO: 68406 - DNA, 15 bp, Homo sapiens
tccatttccttatgc

SEQ ID NO: 68407 - DNA, 15 bp, Homo sapiens
ccatttccttatgct

SEQ ID NO: 68408 - DNA, 15 bp, Homo sapiens
catttccttatgctg

SEQ ID NO: 68409 - DNA, 15 bp, Homo sapiens
atttccttatgctgt

SEQ ID NO: 68410 - DNA, 15 bp, Homo sapiens
tttccttatgctgta

SEQ ID NO: 68411 - DNA, 15 bp, Homo sapiens
ttccttatgctgtaa

SEQ ID NO: 68412 - DNA, 15 bp, Homo sapiens
tccttatgctgtaaa

SEQ ID NO: 68413 - DNA, 15 bp, Homo sapiens
ccttatgctgtaaaa

SEQ ID NO: 68414 - DNA, 15 bp, Homo sapiens
cttatgctgtaaaag

SEQ ID NO: 68415 - DNA, 15 bp, Homo sapiens
ttatgctgtaaaagc

SEQ ID NO: 68416 - DNA, 15 bp, Homo sapiens
tatgctgtaaaagca

SEQ ID NO: 68417 - DNA, 15 bp, Homo sapiens
atgctgtaaaagcaa

SEQ ID NO: 68418 - DNA, 15 bp, Homo sapiens
tgctgtaaaagcaag

SEQ ID NO: 68419 - DNA, 15 bp, Homo sapiens
gctgtaaaagcaagt

SEQ ID NO: 68420 - DNA, 15 bp, Homo sapiens
ctgtaaaagcaagtc

SEQ ID NO: 68421 - DNA, 15 bp, Homo sapiens
tgtaaaagcaagtcc

SEQ ID NO: 68422 - DNA, 15 bp, Homo sapiens
gtaaaagcaagtcct

SEQ ID NO: 68423 - DNA, 15 bp, Homo sapiens
taaaagcaagtcctg

SEQ ID NO: 68424 - DNA, 15 bp, Homo sapiens
aaaagcaagtcctgc

SEQ ID NO: 68425 - DNA, 15 bp, Homo sapiens
aaagcaagtcctgca

SEQ ID NO: 68426 - DNA, 15 bp, Homo sapiens
aagcaagtcctgcaa

SEQ ID NO: 68427 - DNA, 15 bp, Homo sapiens
agcaagtcctgcaac

SEQ ID NO: 68428 - DNA, 15 bp, Homo sapiens
gcaagtcctgcaacc

SEQ ID NO: 68429 - DNA, 15 bp, Homo sapiens
caagtcctgcaacca

SEQ ID NO: 68430 - DNA, 15 bp, Homo sapiens
aagtcctgcaaccaa

SEQ ID NO: 68431 - DNA, 15 bp, Homo sapiens
agtcctgcaaccaaa

SEQ ID NO: 68432 - DNA, 15 bp, Homo sapiens
gtcctgcaaccaaac

SEQ ID NO: 68433 - DNA, 15 bp, Homo sapiens
tcctgcaaccaaact

SEQ ID NO: 68434 - DNA, 15 bp, Homo sapiens
cctgcaaccaaactc

SEQ ID NO: 68435 - DNA, 15 bp, Homo sapiens
ctgcaaccaaactcc

SEQ ID NO: 68436 - DNA, 15 bp, Homo sapiens
tgcaaccaaactccc

SEQ ID NO: 68437 - DNA, 15 bp, Homo sapiens
gcaaccaaactccca

SEQ ID NO: 68438 - DNA, 15 bp, Homo sapiens
caaccaaactcccat

SEQ ID NO: 68439 - DNA, 15 bp, Homo sapiens
aaccaaactcccatc

SEQ ID NO: 68440 - DNA, 15 bp, Homo sapiens
accaaactcccatca

SEQ ID NO: 68441 - DNA, 15 bp, Homo sapiens
ccaaactcccatcag

SEQ ID NO: 68442 - DNA, 15 bp, Homo sapiens
caaactcccatcagc

SEQ ID NO: 68443 - DNA, 15 bp, Homo sapiens
aaactcccatcagcc

SEQ ID NO: 68444 - DNA, 15 bp, Homo sapiens
aactcccatcagccc

SEQ ID NO: 68445 - DNA, 15 bp, Homo sapiens
actcccatcagccca

SEQ ID NO: 68446 - DNA, 15 bp, Homo sapiens
ctcccatcagcccaa

SEQ ID NO: 68447 - DNA, 15 bp, Homo sapiens
tcccatcagcccaat

SEQ ID NO: 68448 - DNA, 15 bp, Homo sapiens
cccatcagcccaatc

SEQ ID NO: 68449 - DNA, 15 bp, Homo sapiens
ccatcagcccaatcc

SEQ ID NO: 68450 - DNA, 15 bp, Homo sapiens
catcagcccaatccc

SEQ ID NO: 68451 - DNA, 15 bp, Homo sapiens
atcagcccaatccct

SEQ ID NO: 68452 - DNA, 15 bp, Homo sapiens
tcagcccaatccctg

SEQ ID NO: 68453 - DNA, 15 bp, Homo sapiens
cagcccaatccctga

SEQ ID NO: 68454 - DNA, 15 bp, Homo sapiens
agcccaatccctgat

SEQ ID NO: 68455 - DNA, 15 bp, Homo sapiens
gcccaatccctgatc

SEQ ID NO: 68456 - DNA, 15 bp, Homo sapiens
cccaatccctgatcc

SEQ ID NO: 68457 - DNA, 15 bp, Homo sapiens
ccaatccctgatccc

SEQ ID NO: 68458 - DNA, 15 bp, Homo sapiens
caatccctgatccct

SEQ ID NO: 68459 - DNA, 15 bp, Homo sapiens
aatccctgatccctg

SEQ ID NO: 68460 - DNA, 15 bp, Homo sapiens
atccctgatccctga

SEQ ID NO: 68461 - DNA, 15 bp, Homo sapiens
tccctgatccctgat

SEQ ID NO: 68462 - DNA, 15 bp, Homo sapiens
ccctgatccctgatc

SEQ ID NO: 68463 - DNA, 15 bp, Homo sapiens
cctgatccctgatcc

SEQ ID NO: 68464 - DNA, 15 bp, Homo sapiens
ctgatccctgatccc

SEQ ID NO: 68465 - DNA, 15 bp, Homo sapiens
tgatccctgatccct

SEQ ID NO: 68466 - DNA, 15 bp, Homo sapiens
gatccctgatccctt

SEQ ID NO: 68467 - DNA, 15 bp, Homo sapiens
atccctgatcccttc

SEQ ID NO: 68468 - DNA, 15 bp, Homo sapiens
tccctgatcccttcc

SEQ ID NO: 68469 - DNA, 15 bp, Homo sapiens
ccctgatcccttcca

SEQ ID NO: 68470 - DNA, 15 bp, Homo sapiens
cctgatcccttccac

SEQ ID NO: 68471 - DNA, 15 bp, Homo sapiens
ctgatcccttccacc

SEQ ID NO: 68472 - DNA, 15 bp, Homo sapiens
tgatcccttccacct

SEQ ID NO: 68473 - DNA, 15 bp, Homo sapiens
gatcccttccacctg

SEQ ID NO: 68474 - DNA, 15 bp, Homo sapiens
atcccttccacctgc

SEQ ID NO: 68475 - DNA, 15 bp, Homo sapiens
tcccttccacctgct

SEQ ID NO: 68476 - DNA, 15 bp, Homo sapiens
cccttccacctgctc

SEQ ID NO: 68477 - DNA, 15 bp, Homo sapiens
ccttccacctgctct

SEQ ID NO: 68478 - DNA, 15 bp, Homo sapiens
cttccacctgctctg

SEQ ID NO: 68479 - DNA, 15 bp, Homo sapiens
ttccacctgctctgc

SEQ ID NO: 68480 - DNA, 15 bp, Homo sapiens
tccacctgctctgct

SEQ ID NO: 68481 - DNA, 15 bp, Homo sapiens
ccacctgctctgctg

SEQ ID NO: 68482 - DNA, 15 bp, Homo sapiens
cacctgctctgctga

SEQ ID NO: 68483 - DNA, 15 bp, Homo sapiens
acctgctctgctgat

SEQ ID NO: 68484 - DNA, 15 bp, Homo sapiens
cctgctctgctgatg

SEQ ID NO: 68485 - DNA, 15 bp, Homo sapiens
ctgctctgctgatga

SEQ ID NO: 68486 - DNA, 15 bp, Homo sapiens
tgctctgctgatgac

SEQ ID NO: 68487 - DNA, 15 bp, Homo sapiens
gctctgctgatgacc

SEQ ID NO: 68488 - DNA, 15 bp, Homo sapiens
ctctgctgatgaccc

SEQ ID NO: 68489 - DNA, 15 bp, Homo sapiens
tctgctgatgacccc

SEQ ID NO: 68490 - DNA, 15 bp, Homo sapiens
ctgctgatgaccccc

SEQ ID NO: 68491 - DNA, 15 bp, Homo sapiens
tgctgatgacccccc

SEQ ID NO: 68492 - DNA, 15 bp, Homo sapiens
gctgatgaccccccc

SEQ ID NO: 68493 - DNA, 15 bp, Homo sapiens
ctgatgaccccccca

SEQ ID NO: 68494 - DNA, 15 bp, Homo sapiens
tgatgacccccccag

SEQ ID NO: 68495 - DNA, 15 bp, Homo sapiens
gatgacccccccagc

SEQ ID NO: 68496 - DNA, 15 bp, Homo sapiens
atgacccccccagct

SEQ ID NO: 68497 - DNA, 15 bp, Homo sapiens
tgacccccccagctt

SEQ ID NO: 68498 - DNA, 15 bp, Homo sapiens
gacccccccagcttc

SEQ ID NO: 68499 - DNA, 15 bp, Homo sapiens
acccccccagcttca

SEQ ID NO: 68500 - DNA, 15 bp, Homo sapiens
cccccccagcttcac

SEQ ID NO: 68501 - DNA, 15 bp, Homo sapiens
ccccccagcttcact

SEQ ID NO: 68502 - DNA, 15 bp, Homo sapiens
cccccagcttcactt

SEQ ID NO: 68503 - DNA, 15 bp, Homo sapiens
ccccagcttcacttc

SEQ ID NO: 68504 - DNA, 15 bp, Homo sapiens
cccagcttcacttct

SEQ ID NO: 68505 - DNA, 15 bp, Homo sapiens
ccagcttcacttctg

SEQ ID NO: 68506 - DNA, 15 bp, Homo sapiens
cagcttcacttctga

SEQ ID NO: 68507 - DNA, 15 bp, Homo sapiens
agcttcacttctgac

SEQ ID NO: 68508 - DNA, 15 bp, Homo sapiens
gcttcacttctgact

SEQ ID NO: 68509 - DNA, 15 bp, Homo sapiens
cttcacttctgactc

SEQ ID NO: 68510 - DNA, 15 bp, Homo sapiens
ttcacttctgactct

SEQ ID NO: 68511 - DNA, 15 bp, Homo sapiens
tcacttctgactctt

SEQ ID NO: 68512 - DNA, 15 bp, Homo sapiens
cacttctgactcttc

SEQ ID NO: 68513 - DNA, 15 bp, Homo sapiens
acttctgactcttcc

SEQ ID NO: 68514 - DNA, 15 bp, Homo sapiens
cttctgactcttccc

SEQ ID NO: 68515 - DNA, 15 bp, Homo sapiens
ttctgactcttcccc

SEQ ID NO: 68516 - DNA, 15 bp, Homo sapiens
tctgactcttcccca

SEQ ID NO: 68517 - DNA, 15 bp, Homo sapiens
ctgactcttccccag

SEQ ID NO: 68518 - DNA, 15 bp, Homo sapiens
tgactcttccccagg

SEQ ID NO: 68519 - DNA, 15 bp, Homo sapiens
gactcttccccagga

SEQ ID NO: 68520 - DNA, 15 bp, Homo sapiens
actcttccccaggaa

SEQ ID NO: 68521 - DNA, 15 bp, Homo sapiens
ctcttccccaggaag

SEQ ID NO: 68522 - DNA, 15 bp, Homo sapiens
tcttccccaggaagg

SEQ ID NO: 68523 - DNA, 15 bp, Homo sapiens
cttccccaggaaggg

SEQ ID NO: 68524 - DNA, 15 bp, Homo sapiens
ttccccaggaaggga

SEQ ID NO: 68525 - DNA, 15 bp, Homo sapiens
tccccaggaagggaa

SEQ ID NO: 68526 - DNA, 15 bp, Homo sapiens
ccccaggaagggaag

SEQ ID NO: 68527 - DNA, 15 bp, Homo sapiens
cccaggaagggaagg

SEQ ID NO: 68528 - DNA, 15 bp, Homo sapiens
ccaggaagggaaggg

SEQ ID NO: 68529 - DNA, 15 bp, Homo sapiens
caggaagggaagggg

SEQ ID NO: 68530 - DNA, 15 bp, Homo sapiens
aggaagggaaggggg

SEQ ID NO: 68531 - DNA, 15 bp, Homo sapiens
ggaagggaagggggg

SEQ ID NO: 68532 - DNA, 15 bp, Homo sapiens
gaagggaaggggggt

SEQ ID NO: 68533 - DNA, 15 bp, Homo sapiens
aagggaaggggggtc

SEQ ID NO: 68534 - DNA, 15 bp, Homo sapiens
agggaaggggggtca

SEQ ID NO: 68535 - DNA, 15 bp, Homo sapiens
gggaaggggggtcag

SEQ ID NO: 68536 - DNA, 15 bp, Homo sapiens
ggaaggggggtcaga

SEQ ID NO: 68537 - DNA, 15 bp, Homo sapiens
gaaggggggtcagaa

SEQ ID NO: 68538 - DNA, 15 bp, Homo sapiens
aaggggggtcagaag

SEQ ID NO: 68539 - DNA, 15 bp, Homo sapiens
aggggggtcagaaga

SEQ ID NO: 68540 - DNA, 15 bp, Homo sapiens
ggggggtcagaagag

SEQ ID NO: 68541 - DNA, 15 bp, Homo sapiens
gggggtcagaagaga

SEQ ID NO: 68542 - DNA, 15 bp, Homo sapiens
ggggtcagaagagag

SEQ ID NO: 68543 - DNA, 15 bp, Homo sapiens
gggtcagaagagagg

SEQ ID NO: 68544 - DNA, 15 bp, Homo sapiens
ggtcagaagagaggg

SEQ ID NO: 68545 - DNA, 15 bp, Homo sapiens
gtcagaagagagggt

SEQ ID NO: 68546 - DNA, 15 bp, Homo sapiens
tcagaagagagggtg

SEQ ID NO: 68547 - DNA, 15 bp, Homo sapiens
cagaagagagggtga

SEQ ID NO: 68548 - DNA, 15 bp, Homo sapiens
agaagagagggtgag

SEQ ID NO: 68549 - DNA, 15 bp, Homo sapiens
gaagagagggtgagt

SEQ ID NO: 68550 - DNA, 15 bp, Homo sapiens
aagagagggtgagtc

SEQ ID NO: 68551 - DNA, 15 bp, Homo sapiens
agagagggtgagtcc

SEQ ID NO: 68552 - DNA, 15 bp, Homo sapiens
gagagggtgagtcct

SEQ ID NO: 68553 - DNA, 15 bp, Homo sapiens
agagggtgagtcctc

SEQ ID NO: 68554 - DNA, 15 bp, Homo sapiens
gagggtgagtcctcc

SEQ ID NO: 68555 - DNA, 15 bp, Homo sapiens
agggtgagtcctcca

SEQ ID NO: 68556 - DNA, 15 bp, Homo sapiens
gggtgagtcctccag

SEQ ID NO: 68557 - DNA, 15 bp, Homo sapiens
ggtgagtcctccaga

SEQ ID NO: 68558 - DNA, 15 bp, Homo sapiens
gtgagtcctccagaa

SEQ ID NO: 68559 - DNA, 15 bp, Homo sapiens
tgagtcctccagaac

SEQ ID NO: 68560 - DNA, 15 bp, Homo sapiens
gagtcctccagaact

SEQ ID NO: 68561 - DNA, 15 bp, Homo sapiens
agtcctccagaactc

SEQ ID NO: 68562 - DNA, 15 bp, Homo sapiens
gtcctccagaactct

SEQ ID NO: 68563 - DNA, 15 bp, Homo sapiens
tcctccagaactctt

SEQ ID NO: 68564 - DNA, 15 bp, Homo sapiens
cctccagaactcttc

SEQ ID NO: 68565 - DNA, 15 bp, Homo sapiens
ctccagaactcttcc

SEQ ID NO: 68566 - DNA, 15 bp, Homo sapiens
tccagaactcttcct

SEQ ID NO: 68567 - DNA, 15 bp, Homo sapiens
ccagaactcttcctc

SEQ ID NO: 68568 - DNA, 15 bp, Homo sapiens
cagaactcttcctcc

SEQ ID NO: 68569 - DNA, 15 bp, Homo sapiens
agaactcttcctcca

SEQ ID NO: 68570 - DNA, 15 bp, Homo sapiens
gaactcttcctccaa

SEQ ID NO: 68571 - DNA, 15 bp, Homo sapiens
aactcttcctccaag

SEQ ID NO: 68572 - DNA, 15 bp, Homo sapiens
actcttcctccaagg

SEQ ID NO: 68573 - DNA, 15 bp, Homo sapiens
ctcttcctccaagga

SEQ ID NO: 68574 - DNA, 15 bp, Homo sapiens
tcttcctccaaggac

SEQ ID NO: 68575 - DNA, 15 bp, Homo sapiens
cttcctccaaggaca

SEQ ID NO: 68576 - DNA, 15 bp, Homo sapiens
ttcctccaaggacag

SEQ ID NO: 68577 - DNA, 15 bp, Homo sapiens
tcctccaaggacaga

SEQ ID NO: 68578 - DNA, 15 bp, Homo sapiens
cctccaaggacagaa

SEQ ID NO: 68579 - DNA, 15 bp, Homo sapiens
ctccaaggacagaag

SEQ ID NO: 68580 - DNA, 15 bp, Homo sapiens
tccaaggacagaagg

SEQ ID NO: 68581 - DNA, 15 bp, Homo sapiens
ccaaggacagaaggc

SEQ ID NO: 68582 - DNA, 15 bp, Homo sapiens
caaggacagaaggct

SEQ ID NO: 68583 - DNA, 15 bp, Homo sapiens
aaggacagaaggctc

SEQ ID NO: 68584 - DNA, 15 bp, Homo sapiens
aggacagaaggctcc

SEQ ID NO: 68585 - DNA, 15 bp, Homo sapiens
ggacagaaggctcct

SEQ ID NO: 68586 - DNA, 15 bp, Homo sapiens
gacagaaggctcctg

SEQ ID NO: 68587 - DNA, 15 bp, Homo sapiens
acagaaggctcctgc

SEQ ID NO: 68588 - DNA, 15 bp, Homo sapiens
cagaaggctcctgcc

SEQ ID NO: 68589 - DNA, 15 bp, Homo sapiens
agaaggctcctgccc

SEQ ID NO: 68590 - DNA, 15 bp, Homo sapiens
gaaggctcctgcccc

SEQ ID NO: 68591 - DNA, 15 bp, Homo sapiens
aaggctcctgccccc

SEQ ID NO: 68592 - DNA, 15 bp, Homo sapiens
aggctcctgccccca

SEQ ID NO: 68593 - DNA, 15 bp, Homo sapiens
ggctcctgcccccat

SEQ ID NO: 68594 - DNA, 15 bp, Homo sapiens
gctcctgcccccata

SEQ ID NO: 68595 - DNA, 15 bp, Homo sapiens
ctcctgcccccatag

SEQ ID NO: 68596 - DNA, 15 bp, Homo sapiens
tcctgcccccatagt

SEQ ID NO: 68597 - DNA, 15 bp, Homo sapiens
cctgcccccatagtg

SEQ ID NO: 68598 - DNA, 15 bp, Homo sapiens
ctgcccccatagtgg

SEQ ID NO: 68599 - DNA, 15 bp, Homo sapiens
tgcccccatagtggc

SEQ ID NO: 68600 - DNA, 15 bp, Homo sapiens
gcccccatagtggcc

SEQ ID NO: 68601 - DNA, 15 bp, Homo sapiens
cccccatagtggcct

SEQ ID NO: 68602 - DNA, 15 bp, Homo sapiens
ccccatagtggcctc

SEQ ID NO: 68603 - DNA, 15 bp, Homo sapiens
cccatagtggcctcg

SEQ ID NO: 68604 - DNA, 15 bp, Homo sapiens
ccatagtggcctcga

SEQ ID NO: 68605 - DNA, 15 bp, Homo sapiens
catagtggcctcgaa

SEQ ID NO: 68606 - DNA, 15 bp, Homo sapiens
atagtggcctcgaac

SEQ ID NO: 68607 - DNA, 15 bp, Homo sapiens
tagtggcctcgaact

SEQ ID NO: 68608 - DNA, 15 bp, Homo sapiens
agtggcctcgaactc

SEQ ID NO: 68609 - DNA, 15 bp, Homo sapiens
gtggcctcgaactcc

SEQ ID NO: 68610 - DNA, 15 bp, Homo sapiens
tggcctcgaactcct

SEQ ID NO: 68611 - DNA, 15 bp, Homo sapiens
ggcctcgaactcctg

SEQ ID NO: 68612 - DNA, 15 bp, Homo sapiens
gcctcgaactcctgg

SEQ ID NO: 68613 - DNA, 15 bp, Homo sapiens
cctcgaactcctggc

SEQ ID NO: 68614 - DNA, 15 bp, Homo sapiens
ctcgaactcctggca

SEQ ID NO: 68615 - DNA, 15 bp, Homo sapiens
tcgaactcctggcac

SEQ ID NO: 68616 - DNA, 15 bp, Homo sapiens
cgaactcctggcact

SEQ ID NO: 68617 - DNA, 15 bp, Homo sapiens
gaactcctggcacta

SEQ ID NO: 68618 - DNA, 15 bp, Homo sapiens
aactcctggcactac

SEQ ID NO: 68619 - DNA, 15 bp, Homo sapiens
actcctggcactacc

SEQ ID NO: 68620 - DNA, 15 bp, Homo sapiens
ctcctggcactacca

SEQ ID NO: 68621 - DNA, 15 bp, Homo sapiens
tcctggcactaccaa

SEQ ID NO: 68622 - DNA, 15 bp, Homo sapiens
cctggcactaccaaa

SEQ ID NO: 68623 - DNA, 15 bp, Homo sapiens
ctggcactaccaaag

SEQ ID NO: 68624 - DNA, 15 bp, Homo sapiens
tggcactaccaaagg

SEQ ID NO: 68625 - DNA, 15 bp, Homo sapiens
ggcactaccaaagga

SEQ ID NO: 68626 - DNA, 15 bp, Homo sapiens
gcactaccaaaggac

SEQ ID NO: 68627 - DNA, 15 bp, Homo sapiens
cactaccaaaggaca

SEQ ID NO: 68628 - DNA, 15 bp, Homo sapiens
actaccaaaggacac

SEQ ID NO: 68629 - DNA, 15 bp, Homo sapiens
ctaccaaaggacact

SEQ ID NO: 68630 - DNA, 15 bp, Homo sapiens
taccaaaggacactt

SEQ ID NO: 68631 - DNA, 15 bp, Homo sapiens
accaaaggacactta

SEQ ID NO: 68632 - DNA, 15 bp, Homo sapiens
ccaaaggacacttat

SEQ ID NO: 68633 - DNA, 15 bp, Homo sapiens
caaaggacacttatc

SEQ ID NO: 68634 - DNA, 15 bp, Homo sapiens
aaaggacacttatcc

SEQ ID NO: 68635 - DNA, 15 bp, Homo sapiens
aaggacacttatcca

SEQ ID NO: 68636 - DNA, 15 bp, Homo sapiens
aggacacttatccac

SEQ ID NO: 68637 - DNA, 15 bp, Homo sapiens
ggacacttatccacg

SEQ ID NO: 68638 - DNA, 15 bp, Homo sapiens
gacacttatccacga

SEQ ID NO: 68639 - DNA, 15 bp, Homo sapiens
acacttatccacgag

SEQ ID NO: 68640 - DNA, 15 bp, Homo sapiens
cacttatccacgaga

SEQ ID NO: 68641 - DNA, 15 bp, Homo sapiens
acttatccacgagag

SEQ ID NO: 68642 - DNA, 15 bp, Homo sapiens
cttatccacgagagc

SEQ ID NO: 68643 - DNA, 15 bp, Homo sapiens
ttatccacgagagcg

SEQ ID NO: 68644 - DNA, 15 bp, Homo sapiens
tatccacgagagcgc

SEQ ID NO: 68645 - DNA, 15 bp, Homo sapiens
atccacgagagcgca

SEQ ID NO: 68646 - DNA, 15 bp, Homo sapiens
tccacgagagcgcag

SEQ ID NO: 68647 - DNA, 15 bp, Homo sapiens
ccacgagagcgcagc

SEQ ID NO: 68648 - DNA, 15 bp, Homo sapiens
cacgagagcgcagca

SEQ ID NO: 68649 - DNA, 15 bp, Homo sapiens
acgagagcgcagcat

SEQ ID NO: 68650 - DNA, 15 bp, Homo sapiens
cgagagcgcagcatc

SEQ ID NO: 68651 - DNA, 15 bp, Homo sapiens
gagagcgcagcatcc

SEQ ID NO: 68652 - DNA, 15 bp, Homo sapiens
agagcgcagcatccg

SEQ ID NO: 68653 - DNA, 15 bp, Homo sapiens
gagcgcagcatccga

SEQ ID NO: 68654 - DNA, 15 bp, Homo sapiens
agcgcagcatccgac

SEQ ID NO: 68655 - DNA, 15 bp, Homo sapiens
gcgcagcatccgacc

SEQ ID NO: 68656 - DNA, 15 bp, Homo sapiens
cgcagcatccgacca

SEQ ID NO: 68657 - DNA, 15 bp, Homo sapiens
gcagcatccgaccag

SEQ ID NO: 68658 - DNA, 15 bp, Homo sapiens
cagcatccgaccagg

SEQ ID NO: 68659 - DNA, 15 bp, Homo sapiens
agcatccgaccaggt

SEQ ID NO: 68660 - DNA, 15 bp, Homo sapiens
gcatccgaccaggtt

SEQ ID NO: 68661 - DNA, 15 bp, Homo sapiens
catccgaccaggttg

SEQ ID NO: 68662 - DNA, 15 bp, Homo sapiens
atccgaccaggttgt

SEQ ID NO: 68663 - DNA, 15 bp, Homo sapiens
tccgaccaggttgtc

SEQ ID NO: 68664 - DNA, 15 bp, Homo sapiens
ccgaccaggttgtca

SEQ ID NO: 68665 - DNA, 15 bp, Homo sapiens
cgaccaggttgtcac

SEQ ID NO: 68666 - DNA, 15 bp, Homo sapiens
gaccaggttgtcact

SEQ ID NO: 68667 - DNA, 15 bp, Homo sapiens
accaggttgtcactg

SEQ ID NO: 68668 - DNA, 15 bp, Homo sapiens
ccaggttgtcactga

SEQ ID NO: 68669 - DNA, 15 bp, Homo sapiens
caggttgtcactgag

SEQ ID NO: 68670 - DNA, 15 bp, Homo sapiens
aggttgtcactgaga

SEQ ID NO: 68671 - DNA, 15 bp, Homo sapiens
ggttgtcactgagaa

SEQ ID NO: 68672 - DNA, 15 bp, Homo sapiens
gttgtcactgagaag

SEQ ID NO: 68673 - DNA, 15 bp, Homo sapiens
ttgtcactgagaaga

SEQ ID NO: 68674 - DNA, 15 bp, Homo sapiens
tgtcactgagaagat

SEQ ID NO: 68675 - DNA, 15 bp, Homo sapiens
gtcactgagaagatg

SEQ ID NO: 68676 - DNA, 15 bp, Homo sapiens
tcactgagaagatgt

SEQ ID NO: 68677 - DNA, 15 bp, Homo sapiens
cactgagaagatgtt

SEQ ID NO: 68678 - DNA, 15 bp, Homo sapiens
actgagaagatgttt

SEQ ID NO: 68679 - DNA, 15 bp, Homo sapiens
ctgagaagatgttta

SEQ ID NO: 68680 - DNA, 15 bp, Homo sapiens
tgagaagatgtttat

SEQ ID NO: 68681 - DNA, 15 bp, Homo sapiens
gagaagatgtttatt

SEQ ID NO: 68682 - DNA, 15 bp, Homo sapiens
agaagatgtttattt

SEQ ID NO: 68683 - DNA, 15 bp, Homo sapiens
gaagatgtttatttt

SEQ ID NO: 68684 - DNA, 15 bp, Homo sapiens
aagatgtttattttg

SEQ ID NO: 68685 - DNA, 15 bp, Homo sapiens
agatgtttattttgg

SEQ ID NO: 68686 - DNA, 15 bp, Homo sapiens
gatgtttattttggt

SEQ ID NO: 68687 - DNA, 15 bp, Homo sapiens
atgtttattttggtc

SEQ ID NO: 68688 - DNA, 15 bp, Homo sapiens
tgtttattttggtca

SEQ ID NO: 68689 - DNA, 15 bp, Homo sapiens
gtttattttggtcag

SEQ ID NO: 68690 - DNA, 15 bp, Homo sapiens
tttattttggtcagt

SEQ ID NO: 68691 - DNA, 15 bp, Homo sapiens
ttattttggtcagtt

SEQ ID NO: 68692 - DNA, 15 bp, Homo sapiens
tattttggtcagttg

SEQ ID NO: 68693 - DNA, 15 bp, Homo sapiens
attttggtcagttgg

SEQ ID NO: 68694 - DNA, 15 bp, Homo sapiens
ttttggtcagttggg

SEQ ID NO: 68695 - DNA, 15 bp, Homo sapiens
tttggtcagttgggt

SEQ ID NO: 68696 - DNA, 15 bp, Homo sapiens
ttggtcagttgggtt

SEQ ID NO: 68697 - DNA, 15 bp, Homo sapiens
tggtcagttgggttt

SEQ ID NO: 68698 - DNA, 15 bp, Homo sapiens
ggtcagttgggtttt

SEQ ID NO: 68699 - DNA, 15 bp, Homo sapiens
gtcagttgggttttt

SEQ ID NO: 68700 - DNA, 15 bp, Homo sapiens
tcagttgggttttta

SEQ ID NO: 68701 - DNA, 15 bp, Homo sapiens
cagttgggtttttat

SEQ ID NO: 68702 - DNA, 15 bp, Homo sapiens
agttgggtttttatg

SEQ ID NO: 68703 - DNA, 15 bp, Homo sapiens
gttgggtttttatgt

SEQ ID NO: 68704 - DNA, 15 bp, Homo sapiens
ttgggtttttatgta

SEQ ID NO: 68705 - DNA, 15 bp, Homo sapiens
tgggtttttatgtat

SEQ ID NO: 68706 - DNA, 15 bp, Homo sapiens
gggtttttatgtatt

SEQ ID NO: 68707 - DNA, 15 bp, Homo sapiens
ggtttttatgtatta

SEQ ID NO: 68708 - DNA, 15 bp, Homo sapiens
gtttttatgtattat

SEQ ID NO: 68709 - DNA, 15 bp, Homo sapiens
tttttatgtattata

SEQ ID NO: 68710 - DNA, 15 bp, Homo sapiens
ttttatgtattatac

SEQ ID NO: 68711 - DNA, 15 bp, Homo sapiens
tttatgtattatact

SEQ ID NO: 68712 - DNA, 15 bp, Homo sapiens
ttatgtattatactt

SEQ ID NO: 68713 - DNA, 15 bp, Homo sapiens
tatgtattatactta

SEQ ID NO: 68714 - DNA, 15 bp, Homo sapiens
atgtattatacttag

SEQ ID NO: 68715 - DNA, 15 bp, Homo sapiens
tgtattatacttagt

SEQ ID NO: 68716 - DNA, 15 bp, Homo sapiens
gtattatacttagtc

SEQ ID NO: 68717 - DNA, 15 bp, Homo sapiens
tattatacttagtca

SEQ ID NO: 68718 - DNA, 15 bp, Homo sapiens
attatacttagtcaa

SEQ ID NO: 68719 - DNA, 15 bp, Homo sapiens
ttatacttagtcaaa

SEQ ID NO: 68720 - DNA, 15 bp, Homo sapiens
tatacttagtcaaat

SEQ ID NO: 68721 - DNA, 15 bp, Homo sapiens
atacttagtcaaatg

SEQ ID NO: 68722 - DNA, 15 bp, Homo sapiens
tacttagtcaaatgt

SEQ ID NO: 68723 - DNA, 15 bp, Homo sapiens
acttagtcaaatgta

SEQ ID NO: 68724 - DNA, 15 bp, Homo sapiens
cttagtcaaatgtaa

SEQ ID NO: 68725 - DNA, 15 bp, Homo sapiens
ttagtcaaatgtaat

SEQ ID NO: 68726 - DNA, 15 bp, Homo sapiens
tagtcaaatgtaatg

SEQ ID NO: 68727 - DNA, 15 bp, Homo sapiens
agtcaaatgtaatgt

SEQ ID NO: 68728 - DNA, 15 bp, Homo sapiens
gtcaaatgtaatgtg

SEQ ID NO: 68729 - DNA, 15 bp, Homo sapiens
tcaaatgtaatgtgg

SEQ ID NO: 68730 - DNA, 15 bp, Homo sapiens
caaatgtaatgtggc

SEQ ID NO: 68731 - DNA, 15 bp, Homo sapiens
aaatgtaatgtggct

SEQ ID NO: 68732 - DNA, 15 bp, Homo sapiens
aatgtaatgtggctt

SEQ ID NO: 68733 - DNA, 15 bp, Homo sapiens
atgtaatgtggcttc

SEQ ID NO: 68734 - DNA, 15 bp, Homo sapiens
tgtaatgtggcttct

SEQ ID NO: 68735 - DNA, 15 bp, Homo sapiens
gtaatgtggcttctg

SEQ ID NO: 68736 - DNA, 15 bp, Homo sapiens
taatgtggcttctgg

SEQ ID NO: 68737 - DNA, 15 bp, Homo sapiens
aatgtggcttctgga

SEQ ID NO: 68738 - DNA, 15 bp, Homo sapiens
atgtggcttctggaa

SEQ ID NO: 68739 - DNA, 15 bp, Homo sapiens
tgtggcttctggaat

SEQ ID NO: 68740 - DNA, 15 bp, Homo sapiens
gtggcttctggaatc

SEQ ID NO: 68741 - DNA, 15 bp, Homo sapiens
tggcttctggaatca

SEQ ID NO: 68742 - DNA, 15 bp, Homo sapiens
ggcttctggaatcat

SEQ ID NO: 68743 - DNA, 15 bp, Homo sapiens
gcttctggaatcatt

SEQ ID NO: 68744 - DNA, 15 bp, Homo sapiens
cttctggaatcattg

SEQ ID NO: 68745 - DNA, 15 bp, Homo sapiens
ttctggaatcattgt

SEQ ID NO: 68746 - DNA, 15 bp, Homo sapiens
tctggaatcattgtc

SEQ ID NO: 68747 - DNA, 15 bp, Homo sapiens
ctggaatcattgtcc

SEQ ID NO: 68748 - DNA, 15 bp, Homo sapiens
tggaatcattgtcca

SEQ ID NO: 68749 - DNA, 15 bp, Homo sapiens
ggaatcattgtccag

SEQ ID NO: 68750 - DNA, 15 bp, Homo sapiens
gaatcattgtccaga

SEQ ID NO: 68751 - DNA, 15 bp, Homo sapiens
aatcattgtccagag

SEQ ID NO: 68752 - DNA, 15 bp, Homo sapiens
atcattgtccagagc

SEQ ID NO: 68753 - DNA, 15 bp, Homo sapiens
tcattgtccagagct

SEQ ID NO: 68754 - DNA, 15 bp, Homo sapiens
cattgtccagagctg

SEQ ID NO: 68755 - DNA, 15 bp, Homo sapiens
attgtccagagctgc

SEQ ID NO: 68756 - DNA, 15 bp, Homo sapiens
ttgtccagagctgct

SEQ ID NO: 68757 - DNA, 15 bp, Homo sapiens
tgtccagagctgctt

SEQ ID NO: 68758 - DNA, 15 bp, Homo sapiens
gtccagagctgcttc

SEQ ID NO: 68759 - DNA, 15 bp, Homo sapiens
tccagagctgcttcc

SEQ ID NO: 68760 - DNA, 15 bp, Homo sapiens
ccagagctgcttccc

SEQ ID NO: 68761 - DNA, 15 bp, Homo sapiens
cagagctgcttcccc

SEQ ID NO: 68762 - DNA, 15 bp, Homo sapiens
agagctgcttccccg

SEQ ID NO: 68763 - DNA, 15 bp, Homo sapiens
gagctgcttccccgt

SEQ ID NO: 68764 - DNA, 15 bp, Homo sapiens
agctgcttccccgtc

SEQ ID NO: 68765 - DNA, 15 bp, Homo sapiens
gctgcttccccgtca

SEQ ID NO: 68766 - DNA, 15 bp, Homo sapiens
ctgcttccccgtcac

SEQ ID NO: 68767 - DNA, 15 bp, Homo sapiens
tgcttccccgtcacc

SEQ ID NO: 68768 - DNA, 15 bp, Homo sapiens
gcttccccgtcacct

SEQ ID NO: 68769 - DNA, 15 bp, Homo sapiens
cttccccgtcacctg

SEQ ID NO: 68770 - DNA, 15 bp, Homo sapiens
ttccccgtcacctgg

SEQ ID NO: 68771 - DNA, 15 bp, Homo sapiens
tccccgtcacctggg

SEQ ID NO: 68772 - DNA, 15 bp, Homo sapiens
ccccgtcacctgggc

SEQ ID NO: 68773 - DNA, 15 bp, Homo sapiens
cccgtcacctgggcg

SEQ ID NO: 68774 - DNA, 15 bp, Homo sapiens
ccgtcacctgggcgt

SEQ ID NO: 68775 - DNA, 15 bp, Homo sapiens
cgtcacctgggcgtc

SEQ ID NO: 68776 - DNA, 15 bp, Homo sapiens
gtcacctgggcgtca

SEQ ID NO: 68777 - DNA, 15 bp, Homo sapiens
tcacctgggcgtcat

SEQ ID NO: 68778 - DNA, 15 bp, Homo sapiens
cacctgggcgtcatc

SEQ ID NO: 68779 - DNA, 15 bp, Homo sapiens
acctgggcgtcatct

SEQ ID NO: 68780 - DNA, 15 bp, Homo sapiens
cctgggcgtcatctg

SEQ ID NO: 68781 - DNA, 15 bp, Homo sapiens
ctgggcgtcatctgg

SEQ ID NO: 68782 - DNA, 15 bp, Homo sapiens
tgggcgtcatctggt

SEQ ID NO: 68783 - DNA, 15 bp, Homo sapiens
gggcgtcatctggtc

SEQ ID NO: 68784 - DNA, 15 bp, Homo sapiens
ggcgtcatctggtcc

SEQ ID NO: 68785 - DNA, 15 bp, Homo sapiens
gcgtcatctggtcct

SEQ ID NO: 68786 - DNA, 15 bp, Homo sapiens
cgtcatctggtcctg

SEQ ID NO: 68787 - DNA, 15 bp, Homo sapiens
gtcatctggtcctgg

SEQ ID NO: 68788 - DNA, 15 bp, Homo sapiens
tcatctggtcctggt

SEQ ID NO: 68789 - DNA, 15 bp, Homo sapiens
catctggtcctggta

SEQ ID NO: 68790 - DNA, 15 bp, Homo sapiens
atctggtcctggtaa

SEQ ID NO: 68791 - DNA, 15 bp, Homo sapiens
tctggtcctggtaag

SEQ ID NO: 68792 - DNA, 15 bp, Homo sapiens
ctggtcctggtaaga

SEQ ID NO: 68793 - DNA, 15 bp, Homo sapiens
tggtcctggtaagag

SEQ ID NO: 68794 - DNA, 15 bp, Homo sapiens
ggtcctggtaagagg

SEQ ID NO: 68795 - DNA, 15 bp, Homo sapiens
gtcctggtaagagga

SEQ ID NO: 68796 - DNA, 15 bp, Homo sapiens
tcctggtaagaggag

SEQ ID NO: 68797 - DNA, 15 bp, Homo sapiens
cctggtaagaggagt

SEQ ID NO: 68798 - DNA, 15 bp, Homo sapiens
ctggtaagaggagtg

SEQ ID NO: 68799 - DNA, 15 bp, Homo sapiens
tggtaagaggagtgc

SEQ ID NO: 68800 - DNA, 15 bp, Homo sapiens
ggtaagaggagtgcg

SEQ ID NO: 68801 - DNA, 15 bp, Homo sapiens
gtaagaggagtgcgt

SEQ ID NO: 68802 - DNA, 15 bp, Homo sapiens
taagaggagtgcgtg

SEQ ID NO: 68803 - DNA, 15 bp, Homo sapiens
aagaggagtgcgtgg

SEQ ID NO: 68804 - DNA, 15 bp, Homo sapiens
agaggagtgcgtggc

SEQ ID NO: 68805 - DNA, 15 bp, Homo sapiens
gaggagtgcgtggcc

SEQ ID NO: 68806 - DNA, 15 bp, Homo sapiens
aggagtgcgtggccc

SEQ ID NO: 68807 - DNA, 15 bp, Homo sapiens
ggagtgcgtggccca

SEQ ID NO: 68808 - DNA, 15 bp, Homo sapiens
gagtgcgtggcccac

SEQ ID NO: 68809 - DNA, 15 bp, Homo sapiens
agtgcgtggcccacc

SEQ ID NO: 68810 - DNA, 15 bp, Homo sapiens
gtgcgtggcccacca

SEQ ID NO: 68811 - DNA, 15 bp, Homo sapiens
tgcgtggcccaccag

SEQ ID NO: 68812 - DNA, 15 bp, Homo sapiens
gcgtggcccaccagg

SEQ ID NO: 68813 - DNA, 15 bp, Homo sapiens
cgtggcccaccaggc

SEQ ID NO: 68814 - DNA, 15 bp, Homo sapiens
gtggcccaccaggcc

SEQ ID NO: 68815 - DNA, 15 bp, Homo sapiens
tggcccaccaggccc

SEQ ID NO: 68816 - DNA, 15 bp, Homo sapiens
ggcccaccaggcccc

SEQ ID NO: 68817 - DNA, 15 bp, Homo sapiens
gcccaccaggccccc

SEQ ID NO: 68818 - DNA, 15 bp, Homo sapiens
cccaccaggcccccc

SEQ ID NO: 68819 - DNA, 15 bp, Homo sapiens
ccaccaggcccccct

SEQ ID NO: 68820 - DNA, 15 bp, Homo sapiens
caccaggcccccctg

SEQ ID NO: 68821 - DNA, 15 bp, Homo sapiens
accaggcccccctgt

SEQ ID NO: 68822 - DNA, 15 bp, Homo sapiens
ccaggcccccctgtc

SEQ ID NO: 68823 - DNA, 15 bp, Homo sapiens
caggcccccctgtca

SEQ ID NO: 68824 - DNA, 15 bp, Homo sapiens
aggcccccctgtcac

SEQ ID NO: 68825 - DNA, 15 bp, Homo sapiens
ggcccccctgtcacc

SEQ ID NO: 68826 - DNA, 15 bp, Homo sapiens
gcccccctgtcaccc

SEQ ID NO: 68827 - DNA, 15 bp, Homo sapiens
cccccctgtcaccca

SEQ ID NO: 68828 - DNA, 15 bp, Homo sapiens
ccccctgtcacccat

SEQ ID NO: 68829 - DNA, 15 bp, Homo sapiens
cccctgtcacccatg

SEQ ID NO: 68830 - DNA, 15 bp, Homo sapiens
ccctgtcacccatga

SEQ ID NO: 68831 - DNA, 15 bp, Homo sapiens
cctgtcacccatgac

SEQ ID NO: 68832 - DNA, 15 bp, Homo sapiens
ctgtcacccatgaca

SEQ ID NO: 68833 - DNA, 15 bp, Homo sapiens
tgtcacccatgacag

SEQ ID NO: 68834 - DNA, 15 bp, Homo sapiens
gtcacccatgacagt

SEQ ID NO: 68835 - DNA, 15 bp, Homo sapiens
tcacccatgacagtt

SEQ ID NO: 68836 - DNA, 15 bp, Homo sapiens
cacccatgacagttc

SEQ ID NO: 68837 - DNA, 15 bp, Homo sapiens
acccatgacagttca

SEQ ID NO: 68838 - DNA, 15 bp, Homo sapiens
cccatgacagttcat

SEQ ID NO: 68839 - DNA, 15 bp, Homo sapiens
ccatgacagttcatt

SEQ ID NO: 68840 - DNA, 15 bp, Homo sapiens
catgacagttcattc

SEQ ID NO: 68841 - DNA, 15 bp, Homo sapiens
atgacagttcattca

SEQ ID NO: 68842 - DNA, 15 bp, Homo sapiens
tgacagttcattcag

SEQ ID NO: 68843 - DNA, 15 bp, Homo sapiens
gacagttcattcagg

SEQ ID NO: 68844 - DNA, 15 bp, Homo sapiens
acagttcattcaggg

SEQ ID NO: 68845 - DNA, 15 bp, Homo sapiens
cagttcattcagggc

SEQ ID NO: 68846 - DNA, 15 bp, Homo sapiens
agttcattcagggcc

SEQ ID NO: 68847 - DNA, 15 bp, Homo sapiens
gttcattcagggccg

SEQ ID NO: 68848 - DNA, 15 bp, Homo sapiens
ttcattcagggccga

SEQ ID NO: 68849 - DNA, 15 bp, Homo sapiens
tcattcagggccgat

SEQ ID NO: 68850 - DNA, 15 bp, Homo sapiens
cattcagggccgatg

SEQ ID NO: 68851 - DNA, 15 bp, Homo sapiens
attcagggccgatgg

SEQ ID NO: 68852 - DNA, 15 bp, Homo sapiens
ttcagggccgatggg

SEQ ID NO: 68853 - DNA, 15 bp, Homo sapiens
tcagggccgatgggg

SEQ ID NO: 68854 - DNA, 15 bp, Homo sapiens
cagggccgatggggc

SEQ ID NO: 68855 - DNA, 15 bp, Homo sapiens
agggccgatggggca

SEQ ID NO: 68856 - DNA, 15 bp, Homo sapiens
gggccgatggggcag

SEQ ID NO: 68857 - DNA, 15 bp, Homo sapiens
ggccgatggggcagt

SEQ ID NO: 68858 - DNA, 15 bp, Homo sapiens
gccgatggggcagtc

SEQ ID NO: 68859 - DNA, 15 bp, Homo sapiens
ccgatggggcagtcg

SEQ ID NO: 68860 - DNA, 15 bp, Homo sapiens
cgatggggcagtcgt

SEQ ID NO: 68861 - DNA, 15 bp, Homo sapiens
gatggggcagtcgtg

SEQ ID NO: 68862 - DNA, 15 bp, Homo sapiens
atggggcagtcgtgg

SEQ ID NO: 68863 - DNA, 15 bp, Homo sapiens
tggggcagtcgtggt

SEQ ID NO: 68864 - DNA, 15 bp, Homo sapiens
ggggcagtcgtggtt

SEQ ID NO: 68865 - DNA, 15 bp, Homo sapiens
gggcagtcgtggttg

SEQ ID NO: 68866 - DNA, 15 bp, Homo sapiens
ggcagtcgtggttgg

SEQ ID NO: 68867 - DNA, 15 bp, Homo sapiens
gcagtcgtggttggg

SEQ ID NO: 68868 - DNA, 15 bp, Homo sapiens
cagtcgtggttggga

SEQ ID NO: 68869 - DNA, 15 bp, Homo sapiens
agtcgtggttgggaa

SEQ ID NO: 68870 - DNA, 15 bp, Homo sapiens
gtcgtggttgggaac

SEQ ID NO: 68871 - DNA, 15 bp, Homo sapiens
tcgtggttgggaaca

SEQ ID NO: 68872 - DNA, 15 bp, Homo sapiens
cgtggttgggaacac

SEQ ID NO: 68873 - DNA, 15 bp, Homo sapiens
gtggttgggaacaca

SEQ ID NO: 68874 - DNA, 15 bp, Homo sapiens
tggttgggaacacag

SEQ ID NO: 68875 - DNA, 15 bp, Homo sapiens
ggttgggaacacagc

SEQ ID NO: 68876 - DNA, 15 bp, Homo sapiens
gttgggaacacagca

SEQ ID NO: 68877 - DNA, 15 bp, Homo sapiens
ttgggaacacagcat

SEQ ID NO: 68878 - DNA, 15 bp, Homo sapiens
tgggaacacagcatt

SEQ ID NO: 68879 - DNA, 15 bp, Homo sapiens
gggaacacagcattt

SEQ ID NO: 68880 - DNA, 15 bp, Homo sapiens
ggaacacagcatttc

SEQ ID NO: 68881 - DNA, 15 bp, Homo sapiens
gaacacagcatttca

SEQ ID NO: 68882 - DNA, 15 bp, Homo sapiens
aacacagcatttcaa

SEQ ID NO: 68883 - DNA, 15 bp, Homo sapiens
acacagcatttcaag

SEQ ID NO: 68884 - DNA, 15 bp, Homo sapiens
cacagcatttcaagc

SEQ ID NO: 68885 - DNA, 15 bp, Homo sapiens
acagcatttcaagcg

SEQ ID NO: 68886 - DNA, 15 bp, Homo sapiens
cagcatttcaagcgt

SEQ ID NO: 68887 - DNA, 15 bp, Homo sapiens
agcatttcaagcgtc

SEQ ID NO: 68888 - DNA, 15 bp, Homo sapiens
gcatttcaagcgtca

SEQ ID NO: 68889 - DNA, 15 bp, Homo sapiens
catttcaagcgtcac

SEQ ID NO: 68890 - DNA, 15 bp, Homo sapiens
atttcaagcgtcact

SEQ ID NO: 68891 - DNA, 15 bp, Homo sapiens
tttcaagcgtcactt

SEQ ID NO: 68892 - DNA, 15 bp, Homo sapiens
ttcaagcgtcacttt

SEQ ID NO: 68893 - DNA, 15 bp, Homo sapiens
tcaagcgtcacttta

SEQ ID NO: 68894 - DNA, 15 bp, Homo sapiens
caagcgtcactttat

SEQ ID NO: 68895 - DNA, 15 bp, Homo sapiens
aagcgtcactttatt

SEQ ID NO: 68896 - DNA, 15 bp, Homo sapiens
agcgtcactttattt

SEQ ID NO: 68897 - DNA, 15 bp, Homo sapiens
gcgtcactttatttc

SEQ ID NO: 68898 - DNA, 15 bp, Homo sapiens
cgtcactttatttca

SEQ ID NO: 68899 - DNA, 15 bp, Homo sapiens
gtcactttatttcat

SEQ ID NO: 68900 - DNA, 15 bp, Homo sapiens
tcactttatttcatt

SEQ ID NO: 68901 - DNA, 15 bp, Homo sapiens
cactttatttcattc

SEQ ID NO: 68902 - DNA, 15 bp, Homo sapiens
actttatttcattcg

SEQ ID NO: 68903 - DNA, 15 bp, Homo sapiens
ctttatttcattcgg

SEQ ID NO: 68904 - DNA, 15 bp, Homo sapiens
tttatttcattcggg

SEQ ID NO: 68905 - DNA, 15 bp, Homo sapiens
ttatttcattcgggc

SEQ ID NO: 68906 - DNA, 15 bp, Homo sapiens
tatttcattcgggcc

SEQ ID NO: 68907 - DNA, 15 bp, Homo sapiens
atttcattcgggccc

SEQ ID NO: 68908 - DNA, 15 bp, Homo sapiens
tttcattcgggcccc

SEQ ID NO: 68909 - DNA, 15 bp, Homo sapiens
ttcattcgggcccca

SEQ ID NO: 68910 - DNA, 15 bp, Homo sapiens
tcattcgggccccac

SEQ ID NO: 68911 - DNA, 15 bp, Homo sapiens
cattcgggccccacc

SEQ ID NO: 68912 - DNA, 15 bp, Homo sapiens
attcgggccccacct

SEQ ID NO: 68913 - DNA, 15 bp, Homo sapiens
ttcgggccccacctg

SEQ ID NO: 68914 - DNA, 15 bp, Homo sapiens
tcgggccccacctgc

SEQ ID NO: 68915 - DNA, 15 bp, Homo sapiens
cgggccccacctgca

SEQ ID NO: 68916 - DNA, 15 bp, Homo sapiens
gggccccacctgcag

SEQ ID NO: 68917 - DNA, 15 bp, Homo sapiens
ggccccacctgcagc

SEQ ID NO: 68918 - DNA, 15 bp, Homo sapiens
gccccacctgcagct

SEQ ID NO: 68919 - DNA, 15 bp, Homo sapiens
ccccacctgcagctc

SEQ ID NO: 68920 - DNA, 15 bp, Homo sapiens
cccacctgcagctcc

SEQ ID NO: 68921 - DNA, 15 bp, Homo sapiens
ccacctgcagctccc

SEQ ID NO: 68922 - DNA, 15 bp, Homo sapiens
cacctgcagctccct

SEQ ID NO: 68923 - DNA, 15 bp, Homo sapiens
acctgcagctccctc

SEQ ID NO: 68924 - DNA, 15 bp, Homo sapiens
cctgcagctccctca

SEQ ID NO: 68925 - DNA, 15 bp, Homo sapiens
ctgcagctccctcaa

SEQ ID NO: 68926 - DNA, 15 bp, Homo sapiens
tgcagctccctcaaa

SEQ ID NO: 68927 - DNA, 15 bp, Homo sapiens
gcagctccctcaaag

SEQ ID NO: 68928 - DNA, 15 bp, Homo sapiens
cagctccctcaaaga

SEQ ID NO: 68929 - DNA, 15 bp, Homo sapiens
agctccctcaaagag

SEQ ID NO: 68930 - DNA, 15 bp, Homo sapiens
gctccctcaaagagg

SEQ ID NO: 68931 - DNA, 15 bp, Homo sapiens
ctccctcaaagaggc

SEQ ID NO: 68932 - DNA, 15 bp, Homo sapiens
tccctcaaagaggca

SEQ ID NO: 68933 - DNA, 15 bp, Homo sapiens
ccctcaaagaggcag

SEQ ID NO: 68934 - DNA, 15 bp, Homo sapiens
cctcaaagaggcagt

SEQ ID NO: 68935 - DNA, 15 bp, Homo sapiens
ctcaaagaggcagtt

SEQ ID NO: 68936 - DNA, 15 bp, Homo sapiens
tcaaagaggcagttg

SEQ ID NO: 68937 - DNA, 15 bp, Homo sapiens
caaagaggcagttgc

SEQ ID NO: 68938 - DNA, 15 bp, Homo sapiens
aaagaggcagttgcc

SEQ ID NO: 68939 - DNA, 15 bp, Homo sapiens
aagaggcagttgccc

SEQ ID NO: 68940 - DNA, 15 bp, Homo sapiens
agaggcagttgccca

SEQ ID NO: 68941 - DNA, 15 bp, Homo sapiens
gaggcagttgcccag

SEQ ID NO: 68942 - DNA, 15 bp, Homo sapiens
aggcagttgcccagc

SEQ ID NO: 68943 - DNA, 15 bp, Homo sapiens
ggcagttgcccagcc

SEQ ID NO: 68944 - DNA, 15 bp, Homo sapiens
gcagttgcccagcct

SEQ ID NO: 68945 - DNA, 15 bp, Homo sapiens
cagttgcccagcctc

SEQ ID NO: 68946 - DNA, 15 bp, Homo sapiens
agttgcccagcctct

SEQ ID NO: 68947 - DNA, 15 bp, Homo sapiens
gttgcccagcctctt

SEQ ID NO: 68948 - DNA, 15 bp, Homo sapiens
ttgcccagcctcttt

SEQ ID NO: 68949 - DNA, 15 bp, Homo sapiens
tgcccagcctctttc

SEQ ID NO: 68950 - DNA, 15 bp, Homo sapiens
gcccagcctctttcc

SEQ ID NO: 68951 - DNA, 15 bp, Homo sapiens
cccagcctctttccc

SEQ ID NO: 68952 - DNA, 15 bp, Homo sapiens
ccagcctctttccct

SEQ ID NO: 68953 - DNA, 15 bp, Homo sapiens
cagcctctttccctt

SEQ ID NO: 68954 - DNA, 15 bp, Homo sapiens
agcctctttcccttc

SEQ ID NO: 68955 - DNA, 15 bp, Homo sapiens
gcctctttcccttcc

SEQ ID NO: 68956 - DNA, 15 bp, Homo sapiens
cctctttcccttcca

SEQ ID NO: 68957 - DNA, 15 bp, Homo sapiens
ctctttcccttccag

SEQ ID NO: 68958 - DNA, 15 bp, Homo sapiens
tctttcccttccagt

SEQ ID NO: 68959 - DNA, 15 bp, Homo sapiens
ctttcccttccagtt

SEQ ID NO: 68960 - DNA, 15 bp, Homo sapiens
tttcccttccagttt

SEQ ID NO: 68961 - DNA, 15 bp, Homo sapiens
ttcccttccagttta

SEQ ID NO: 68962 - DNA, 15 bp, Homo sapiens
tcccttccagtttat

SEQ ID NO: 68963 - DNA, 15 bp, Homo sapiens
cccttccagtttatt

SEQ ID NO: 68964 - DNA, 15 bp, Homo sapiens
ccttccagtttattc

SEQ ID NO: 68965 - DNA, 15 bp, Homo sapiens
cttccagtttattcc

SEQ ID NO: 68966 - DNA, 15 bp, Homo sapiens
ttccagtttattcca

SEQ ID NO: 68967 - DNA, 15 bp, Homo sapiens
tccagtttattccag

SEQ ID NO: 68968 - DNA, 15 bp, Homo sapiens
ccagtttattccaga

SEQ ID NO: 68969 - DNA, 15 bp, Homo sapiens
cagtttattccagag

SEQ ID NO: 68970 - DNA, 15 bp, Homo sapiens
agtttattccagagc

SEQ ID NO: 68971 - DNA, 15 bp, Homo sapiens
gtttattccagagct

SEQ ID NO: 68972 - DNA, 15 bp, Homo sapiens
tttattccagagctg

SEQ ID NO: 68973 - DNA, 15 bp, Homo sapiens
ttattccagagctgc

SEQ ID NO: 68974 - DNA, 15 bp, Homo sapiens
tattccagagctgcc

SEQ ID NO: 68975 - DNA, 15 bp, Homo sapiens
attccagagctgcca

SEQ ID NO: 68976 - DNA, 15 bp, Homo sapiens
ttccagagctgccag

SEQ ID NO: 68977 - DNA, 15 bp, Homo sapiens
tccagagctgccagt

SEQ ID NO: 68978 - DNA, 15 bp, Homo sapiens
ccagagctgccagtg

SEQ ID NO: 68979 - DNA, 15 bp, Homo sapiens
cagagctgccagtgg

SEQ ID NO: 68980 - DNA, 15 bp, Homo sapiens
agagctgccagtggg

SEQ ID NO: 68981 - DNA, 15 bp, Homo sapiens
gagctgccagtgggg

SEQ ID NO: 68982 - DNA, 15 bp, Homo sapiens
agctgccagtggggc

SEQ ID NO: 68983 - DNA, 15 bp, Homo sapiens
gctgccagtggggcc

SEQ ID NO: 68984 - DNA, 15 bp, Homo sapiens
ctgccagtggggcct

SEQ ID NO: 68985 - DNA, 15 bp, Homo sapiens
tgccagtggggcctg

SEQ ID NO: 68986 - DNA, 15 bp, Homo sapiens
gccagtggggcctga

SEQ ID NO: 68987 - DNA, 15 bp, Homo sapiens
ccagtggggcctgag

SEQ ID NO: 68988 - DNA, 15 bp, Homo sapiens
cagtggggcctgagg

SEQ ID NO: 68989 - DNA, 15 bp, Homo sapiens
agtggggcctgaggc

SEQ ID NO: 68990 - DNA, 15 bp, Homo sapiens
gtggggcctgaggct

SEQ ID NO: 68991 - DNA, 15 bp, Homo sapiens
tggggcctgaggctc

SEQ ID NO: 68992 - DNA, 15 bp, Homo sapiens
ggggcctgaggctcc

SEQ ID NO: 68993 - DNA, 15 bp, Homo sapiens
gggcctgaggctcct

SEQ ID NO: 68994 - DNA, 15 bp, Homo sapiens
ggcctgaggctcctt

SEQ ID NO: 68995 - DNA, 15 bp, Homo sapiens
gcctgaggctcctta

SEQ ID NO: 68996 - DNA, 15 bp, Homo sapiens
cctgaggctccttag

SEQ ID NO: 68997 - DNA, 15 bp, Homo sapiens
ctgaggctccttagg

SEQ ID NO: 68998 - DNA, 15 bp, Homo sapiens
tgaggctccttaggg

SEQ ID NO: 68999 - DNA, 15 bp, Homo sapiens
gaggctccttagggt

SEQ ID NO: 69000 - DNA, 15 bp, Homo sapiens
aggctccttagggtt

SEQ ID NO: 69001 - DNA, 15 bp, Homo sapiens
ggctccttagggttt

SEQ ID NO: 69002 - DNA, 15 bp, Homo sapiens
gctccttagggtttt

SEQ ID NO: 69003 - DNA, 15 bp, Homo sapiens
ctccttagggttttc

SEQ ID NO: 69004 - DNA, 15 bp, Homo sapiens
tccttagggttttct

SEQ ID NO: 69005 - DNA, 15 bp, Homo sapiens
ccttagggttttctc

SEQ ID NO: 69006 - DNA, 15 bp, Homo sapiens
cttagggttttctct

SEQ ID NO: 69007 - DNA, 15 bp, Homo sapiens
ttagggttttctctc

SEQ ID NO: 69008 - DNA, 15 bp, Homo sapiens
tagggttttctctct

SEQ ID NO: 69009 - DNA, 15 bp, Homo sapiens
agggttttctctcta

SEQ ID NO: 69010 - DNA, 15 bp, Homo sapiens
gggttttctctctat

SEQ ID NO: 69011 - DNA, 15 bp, Homo sapiens
ggttttctctctatt

SEQ ID NO: 69012 - DNA, 15 bp, Homo sapiens
gttttctctctattt

SEQ ID NO: 69013 - DNA, 15 bp, Homo sapiens
ttttctctctatttc

SEQ ID NO: 69014 - DNA, 15 bp, Homo sapiens
tttctctctatttcc

SEQ ID NO: 69015 - DNA, 15 bp, Homo sapiens
ttctctctatttccc

SEQ ID NO: 69016 - DNA, 15 bp, Homo sapiens
tctctctatttcccc

SEQ ID NO: 69017 - DNA, 15 bp, Homo sapiens
ctctctatttccccc

SEQ ID NO: 69018 - DNA, 15 bp, Homo sapiens
tctctatttccccct

SEQ ID NO: 69019 - DNA, 15 bp, Homo sapiens
ctctatttccccctt

SEQ ID NO: 69020 - DNA, 15 bp, Homo sapiens
tctatttcccccttt

SEQ ID NO: 69021 - DNA, 15 bp, Homo sapiens
ctatttccccctttc

SEQ ID NO: 69022 - DNA, 15 bp, Homo sapiens
tatttccccctttct

SEQ ID NO: 69023 - DNA, 15 bp, Homo sapiens
atttccccctttctt

SEQ ID NO: 69024 - DNA, 15 bp, Homo sapiens
tttccccctttcttc

SEQ ID NO: 69025 - DNA, 15 bp, Homo sapiens
ttccccctttcttcc

SEQ ID NO: 69026 - DNA, 15 bp, Homo sapiens
tccccctttcttcct

SEQ ID NO: 69027 - DNA, 15 bp, Homo sapiens
ccccctttcttcctc

SEQ ID NO: 69028 - DNA, 15 bp, Homo sapiens
cccctttcttcctca

SEQ ID NO: 69029 - DNA, 15 bp, Homo sapiens
ccctttcttcctcat

SEQ ID NO: 69030 - DNA, 15 bp, Homo sapiens
cctttcttcctcatt

SEQ ID NO: 69031 - DNA, 15 bp, Homo sapiens
ctttcttcctcattc

SEQ ID NO: 69032 - DNA, 15 bp, Homo sapiens
tttcttcctcattcc

SEQ ID NO: 69033 - DNA, 15 bp, Homo sapiens
ttcttcctcattccc

SEQ ID NO: 69034 - DNA, 15 bp, Homo sapiens
tcttcctcattccct

SEQ ID NO: 69035 - DNA, 15 bp, Homo sapiens
cttcctcattccctc

SEQ ID NO: 69036 - DNA, 15 bp, Homo sapiens
ttcctcattccctcg

SEQ ID NO: 69037 - DNA, 15 bp, Homo sapiens
tcctcattccctcgt

SEQ ID NO: 69038 - DNA, 15 bp, Homo sapiens
cctcattccctcgtc

SEQ ID NO: 69039 - DNA, 15 bp, Homo sapiens
ctcattccctcgtct

SEQ ID NO: 69040 - DNA, 15 bp, Homo sapiens
tcattccctcgtctt

SEQ ID NO: 69041 - DNA, 15 bp, Homo sapiens
cattccctcgtcttt

SEQ ID NO: 69042 - DNA, 15 bp, Homo sapiens
attccctcgtctttc

SEQ ID NO: 69043 - DNA, 15 bp, Homo sapiens
ttccctcgtctttcc

SEQ ID NO: 69044 - DNA, 15 bp, Homo sapiens
tccctcgtctttccc

SEQ ID NO: 69045 - DNA, 15 bp, Homo sapiens
ccctcgtctttccca

SEQ ID NO: 69046 - DNA, 15 bp, Homo sapiens
cctcgtctttcccaa

SEQ ID NO: 69047 - DNA, 15 bp, Homo sapiens
ctcgtctttcccaaa

SEQ ID NO: 69048 - DNA, 15 bp, Homo sapiens
tcgtctttcccaaag

SEQ ID NO: 69049 - DNA, 15 bp, Homo sapiens
cgtctttcccaaagg

SEQ ID NO: 69050 - DNA, 15 bp, Homo sapiens
gtctttcccaaaggc

SEQ ID NO: 69051 - DNA, 15 bp, Homo sapiens
tctttcccaaaggca

SEQ ID NO: 69052 - DNA, 15 bp, Homo sapiens
ctttcccaaaggcat

SEQ ID NO: 69053 - DNA, 15 bp, Homo sapiens
tttcccaaaggcatc

SEQ ID NO: 69054 - DNA, 15 bp, Homo sapiens
ttcccaaaggcatca

SEQ ID NO: 69055 - DNA, 15 bp, Homo sapiens
tcccaaaggcatcac

SEQ ID NO: 69056 - DNA, 15 bp, Homo sapiens
cccaaaggcatcacg

SEQ ID NO: 69057 - DNA, 15 bp, Homo sapiens
ccaaaggcatcacga

SEQ ID NO: 69058 - DNA, 15 bp, Homo sapiens
caaaggcatcacgag

SEQ ID NO: 69059 - DNA, 15 bp, Homo sapiens
aaaggcatcacgagt

SEQ ID NO: 69060 - DNA, 15 bp, Homo sapiens
aaggcatcacgagtc

SEQ ID NO: 69061 - DNA, 15 bp, Homo sapiens
aggcatcacgagtca

SEQ ID NO: 69062 - DNA, 15 bp, Homo sapiens
ggcatcacgagtcag

SEQ ID NO: 69063 - DNA, 15 bp, Homo sapiens
gcatcacgagtcagt

SEQ ID NO: 69064 - DNA, 15 bp, Homo sapiens
catcacgagtcagtc

SEQ ID NO: 69065 - DNA, 15 bp, Homo sapiens
atcacgagtcagtcg

SEQ ID NO: 69066 - DNA, 15 bp, Homo sapiens
tcacgagtcagtcgc

SEQ ID NO: 69067 - DNA, 15 bp, Homo sapiens
cacgagtcagtcgcc

SEQ ID NO: 69068 - DNA, 15 bp, Homo sapiens
acgagtcagtcgcct

SEQ ID NO: 69069 - DNA, 15 bp, Homo sapiens
cgagtcagtcgcctt

SEQ ID NO: 69070 - DNA, 15 bp, Homo sapiens
gagtcagtcgccttt

SEQ ID NO: 69071 - DNA, 15 bp, Homo sapiens
agtcagtcgcctttc

SEQ ID NO: 69072 - DNA, 15 bp, Homo sapiens
gtcagtcgcctttca

SEQ ID NO: 69073 - DNA, 15 bp, Homo sapiens
tcagtcgcctttcag

SEQ ID NO: 69074 - DNA, 15 bp, Homo sapiens
cagtcgcctttcagc

SEQ ID NO: 69075 - DNA, 15 bp, Homo sapiens
agtcgcctttcagca

SEQ ID NO: 69076 - DNA, 15 bp, Homo sapiens
gtcgcctttcagcag

SEQ ID NO: 69077 - DNA, 15 bp, Homo sapiens
tcgcctttcagcagg

SEQ ID NO: 69078 - DNA, 15 bp, Homo sapiens
cgcctttcagcaggc

SEQ ID NO: 69079 - DNA, 15 bp, Homo sapiens
gcctttcagcaggca

SEQ ID NO: 69080 - DNA, 15 bp, Homo sapiens
cctttcagcaggcag

SEQ ID NO: 69081 - DNA, 15 bp, Homo sapiens
ctttcagcaggcagc

SEQ ID NO: 69082 - DNA, 15 bp, Homo sapiens
tttcagcaggcagcc

SEQ ID NO: 69083 - DNA, 15 bp, Homo sapiens
ttcagcaggcagcct

SEQ ID NO: 69084 - DNA, 15 bp, Homo sapiens
tcagcaggcagcctt

SEQ ID NO: 69085 - DNA, 15 bp, Homo sapiens
cagcaggcagccttg

SEQ ID NO: 69086 - DNA, 15 bp, Homo sapiens
agcaggcagccttgg

SEQ ID NO: 69087 - DNA, 15 bp, Homo sapiens
gcaggcagccttggc

SEQ ID NO: 69088 - DNA, 15 bp, Homo sapiens
caggcagccttggcg

SEQ ID NO: 69089 - DNA, 15 bp, Homo sapiens
aggcagccttggcgg

SEQ ID NO: 69090 - DNA, 15 bp, Homo sapiens
ggcagccttggcggt

SEQ ID NO: 69091 - DNA, 15 bp, Homo sapiens
gcagccttggcggtt

SEQ ID NO: 69092 - DNA, 15 bp, Homo sapiens
cagccttggcggttt

SEQ ID NO: 69093 - DNA, 15 bp, Homo sapiens
agccttggcggttta

SEQ ID NO: 69094 - DNA, 15 bp, Homo sapiens
gccttggcggtttat

SEQ ID NO: 69095 - DNA, 15 bp, Homo sapiens
ccttggcggtttatc

SEQ ID NO: 69096 - DNA, 15 bp, Homo sapiens
cttggcggtttatcg

SEQ ID NO: 69097 - DNA, 15 bp, Homo sapiens
ttggcggtttatcgc

SEQ ID NO: 69098 - DNA, 15 bp, Homo sapiens
tggcggtttatcgcc

SEQ ID NO: 69099 - DNA, 15 bp, Homo sapiens
ggcggtttatcgccc

SEQ ID NO: 69100 - DNA, 15 bp, Homo sapiens
gcggtttatcgccct

SEQ ID NO: 69101 - DNA, 15 bp, Homo sapiens
cggtttatcgccctg

SEQ ID NO: 69102 - DNA, 15 bp, Homo sapiens
ggtttatcgccctgg

SEQ ID NO: 69103 - DNA, 15 bp, Homo sapiens
gtttatcgccctggc

SEQ ID NO: 69104 - DNA, 15 bp, Homo sapiens
tttatcgccctggca

SEQ ID NO: 69105 - DNA, 15 bp, Homo sapiens
ttatcgccctggcag

SEQ ID NO: 69106 - DNA, 15 bp, Homo sapiens
tatcgccctggcagg

SEQ ID NO: 69107 - DNA, 15 bp, Homo sapiens
atcgccctggcaggc

SEQ ID NO: 69108 - DNA, 15 bp, Homo sapiens
tcgccctggcaggca

SEQ ID NO: 69109 - DNA, 15 bp, Homo sapiens
cgccctggcaggcag

SEQ ID NO: 69110 - DNA, 15 bp, Homo sapiens
gccctggcaggcagg

SEQ ID NO: 69111 - DNA, 15 bp, Homo sapiens
ccctggcaggcaggg

SEQ ID NO: 69112 - DNA, 15 bp, Homo sapiens
cctggcaggcagggg

SEQ ID NO: 69113 - DNA, 15 bp, Homo sapiens
ctggcaggcaggggc

SEQ ID NO: 69114 - DNA, 15 bp, Homo sapiens
tggcaggcaggggcc

SEQ ID NO: 69115 - DNA, 15 bp, Homo sapiens
ggcaggcaggggccc

SEQ ID NO: 69116 - DNA, 15 bp, Homo sapiens
gcaggcaggggccct

SEQ ID NO: 69117 - DNA, 15 bp, Homo sapiens
caggcaggggccctg

SEQ ID NO: 69118 - DNA, 15 bp, Homo sapiens
aggcaggggccctgc

SEQ ID NO: 69119 - DNA, 15 bp, Homo sapiens
ggcaggggccctgca

SEQ ID NO: 69120 - DNA, 15 bp, Homo sapiens
gcaggggccctgcag

SEQ ID NO: 69121 - DNA, 15 bp, Homo sapiens
caggggccctgcagc

SEQ ID NO: 69122 - DNA, 15 bp, Homo sapiens
aggggccctgcagct

SEQ ID NO: 69123 - DNA, 15 bp, Homo sapiens
ggggccctgcagctc

SEQ ID NO: 69124 - DNA, 15 bp, Homo sapiens
gggccctgcagctct

SEQ ID NO: 69125 - DNA, 15 bp, Homo sapiens
ggccctgcagctctc

SEQ ID NO: 69126 - DNA, 15 bp, Homo sapiens
gccctgcagctctca

SEQ ID NO: 69127 - DNA, 15 bp, Homo sapiens
ccctgcagctctcat

SEQ ID NO: 69128 - DNA, 15 bp, Homo sapiens
cctgcagctctcatg

SEQ ID NO: 69129 - DNA, 15 bp, Homo sapiens
ctgcagctctcatgc

SEQ ID NO: 69130 - DNA, 15 bp, Homo sapiens
tgcagctctcatgct

SEQ ID NO: 69131 - DNA, 15 bp, Homo sapiens
gcagctctcatgctg

SEQ ID NO: 69132 - DNA, 15 bp, Homo sapiens
cagctctcatgctgc

SEQ ID NO: 69133 - DNA, 15 bp, Homo sapiens
agctctcatgctgcc

SEQ ID NO: 69134 - DNA, 15 bp, Homo sapiens
gctctcatgctgccc

SEQ ID NO: 69135 - DNA, 15 bp, Homo sapiens
ctctcatgctgcccc

SEQ ID NO: 69136 - DNA, 15 bp, Homo sapiens
tctcatgctgcccct

SEQ ID NO: 69137 - DNA, 15 bp, Homo sapiens
ctcatgctgcccctg

SEQ ID NO: 69138 - DNA, 15 bp, Homo sapiens
tcatgctgcccctgc

SEQ ID NO: 69139 - DNA, 15 bp, Homo sapiens
catgctgcccctgcc

SEQ ID NO: 69140 - DNA, 15 bp, Homo sapiens
atgctgcccctgcct

SEQ ID NO: 69141 - DNA, 15 bp, Homo sapiens
tgctgcccctgcctt

SEQ ID NO: 69142 - DNA, 15 bp, Homo sapiens
gctgcccctgccttg

SEQ ID NO: 69143 - DNA, 15 bp, Homo sapiens
ctgcccctgccttgg

SEQ ID NO: 69144 - DNA, 15 bp, Homo sapiens
tgcccctgccttggg

SEQ ID NO: 69145 - DNA, 15 bp, Homo sapiens
gcccctgccttgggg

SEQ ID NO: 69146 - DNA, 15 bp, Homo sapiens
cccctgccttggggt

SEQ ID NO: 69147 - DNA, 15 bp, Homo sapiens
ccctgccttggggtc

SEQ ID NO: 69148 - DNA, 15 bp, Homo sapiens
cctgccttggggtca

SEQ ID NO: 69149 - DNA, 15 bp, Homo sapiens
ctgccttggggtcag

SEQ ID NO: 69150 - DNA, 15 bp, Homo sapiens
tgccttggggtcagg

SEQ ID NO: 69151 - DNA, 15 bp, Homo sapiens
gccttggggtcaggt

SEQ ID NO: 69152 - DNA, 15 bp, Homo sapiens
ccttggggtcaggtt

SEQ ID NO: 69153 - DNA, 15 bp, Homo sapiens
cttggggtcaggttg

SEQ ID NO: 69154 - DNA, 15 bp, Homo sapiens
ttggggtcaggttga

SEQ ID NO: 69155 - DNA, 15 bp, Homo sapiens
tggggtcaggttgac

SEQ ID NO: 69156 - DNA, 15 bp, Homo sapiens
ggggtcaggttgaca

SEQ ID NO: 69157 - DNA, 15 bp, Homo sapiens
gggtcaggttgacag

SEQ ID NO: 69158 - DNA, 15 bp, Homo sapiens
ggtcaggttgacagg

SEQ ID NO: 69159 - DNA, 15 bp, Homo sapiens
gtcaggttgacagga

SEQ ID NO: 69160 - DNA, 15 bp, Homo sapiens
tcaggttgacaggag

SEQ ID NO: 69161 - DNA, 15 bp, Homo sapiens
caggttgacaggagg

SEQ ID NO: 69162 - DNA, 15 bp, Homo sapiens
aggttgacaggaggt

SEQ ID NO: 69163 - DNA, 15 bp, Homo sapiens
ggttgacaggaggtt

SEQ ID NO: 69164 - DNA, 15 bp, Homo sapiens
gttgacaggaggttg

SEQ ID NO: 69165 - DNA, 15 bp, Homo sapiens
ttgacaggaggttgg

SEQ ID NO: 69166 - DNA, 15 bp, Homo sapiens
tgacaggaggttgga

SEQ ID NO: 69167 - DNA, 15 bp, Homo sapiens
gacaggaggttggag

SEQ ID NO: 69168 - DNA, 15 bp, Homo sapiens
acaggaggttggagg

SEQ ID NO: 69169 - DNA, 15 bp, Homo sapiens
caggaggttggaggg

SEQ ID NO: 69170 - DNA, 15 bp, Homo sapiens
aggaggttggaggga

SEQ ID NO: 69171 - DNA, 15 bp, Homo sapiens
ggaggttggagggaa

SEQ ID NO: 69172 - DNA, 15 bp, Homo sapiens
gaggttggagggaaa

SEQ ID NO: 69173 - DNA, 15 bp, Homo sapiens
aggttggagggaaag

SEQ ID NO: 69174 - DNA, 15 bp, Homo sapiens
ggttggagggaaagc

SEQ ID NO: 69175 - DNA, 15 bp, Homo sapiens
gttggagggaaagcc

SEQ ID NO: 69176 - DNA, 15 bp, Homo sapiens
ttggagggaaagcct

SEQ ID NO: 69177 - DNA, 15 bp, Homo sapiens
tggagggaaagcctt

SEQ ID NO: 69178 - DNA, 15 bp, Homo sapiens
ggagggaaagcctta

SEQ ID NO: 69179 - DNA, 15 bp, Homo sapiens
gagggaaagccttaa

SEQ ID NO: 69180 - DNA, 15 bp, Homo sapiens
agggaaagccttaag

SEQ ID NO: 69181 - DNA, 15 bp, Homo sapiens
gggaaagccttaagc

SEQ ID NO: 69182 - DNA, 15 bp, Homo sapiens
ggaaagccttaagct

SEQ ID NO: 69183 - DNA, 15 bp, Homo sapiens
gaaagccttaagctg

SEQ ID NO: 69184 - DNA, 15 bp, Homo sapiens
aaagccttaagctgc

SEQ ID NO: 69185 - DNA, 15 bp, Homo sapiens
aagccttaagctgca

SEQ ID NO: 69186 - DNA, 15 bp, Homo sapiens
agccttaagctgcag

SEQ ID NO: 69187 - DNA, 15 bp, Homo sapiens
gccttaagctgcagg

SEQ ID NO: 69188 - DNA, 15 bp, Homo sapiens
ccttaagctgcagga

SEQ ID NO: 69189 - DNA, 15 bp, Homo sapiens
cttaagctgcaggat

SEQ ID NO: 69190 - DNA, 15 bp, Homo sapiens
ttaagctgcaggatt

SEQ ID NO: 69191 - DNA, 15 bp, Homo sapiens
taagctgcaggattc

SEQ ID NO: 69192 - DNA, 15 bp, Homo sapiens
aagctgcaggattct

SEQ ID NO: 69193 - DNA, 15 bp, Homo sapiens
agctgcaggattctc

SEQ ID NO: 69194 - DNA, 15 bp, Homo sapiens
gctgcaggattctca

SEQ ID NO: 69195 - DNA, 15 bp, Homo sapiens
ctgcaggattctcac

SEQ ID NO: 69196 - DNA, 15 bp, Homo sapiens
tgcaggattctcacc

SEQ ID NO: 69197 - DNA, 15 bp, Homo sapiens
gcaggattctcacca

SEQ ID NO: 69198 - DNA, 15 bp, Homo sapiens
caggattctcaccag

SEQ ID NO: 69199 - DNA, 15 bp, Homo sapiens
aggattctcaccagc

SEQ ID NO: 69200 - DNA, 15 bp, Homo sapiens
ggattctcaccagct

SEQ ID NO: 69201 - DNA, 15 bp, Homo sapiens
gattctcaccagctg

SEQ ID NO: 69202 - DNA, 15 bp, Homo sapiens
attctcaccagctgt

SEQ ID NO: 69203 - DNA, 15 bp, Homo sapiens
ttctcaccagctgtg

SEQ ID NO: 69204 - DNA, 15 bp, Homo sapiens
tctcaccagctgtgt

SEQ ID NO: 69205 - DNA, 15 bp, Homo sapiens
ctcaccagctgtgtc

SEQ ID NO: 69206 - DNA, 15 bp, Homo sapiens
tcaccagctgtgtcc

SEQ ID NO: 69207 - DNA, 15 bp, Homo sapiens
caccagctgtgtccg

SEQ ID NO: 69208 - DNA, 15 bp, Homo sapiens
accagctgtgtccgg

SEQ ID NO: 69209 - DNA, 15 bp, Homo sapiens
ccagctgtgtccggc

SEQ ID NO: 69210 - DNA, 15 bp, Homo sapiens
cagctgtgtccggcc

SEQ ID NO: 69211 - DNA, 15 bp, Homo sapiens
agctgtgtccggccc

SEQ ID NO: 69212 - DNA, 15 bp, Homo sapiens
gctgtgtccggccca

SEQ ID NO: 69213 - DNA, 15 bp, Homo sapiens
ctgtgtccggcccag

SEQ ID NO: 69214 - DNA, 15 bp, Homo sapiens
tgtgtccggcccagt

SEQ ID NO: 69215 - DNA, 15 bp, Homo sapiens
gtgtccggcccagtt

SEQ ID NO: 69216 - DNA, 15 bp, Homo sapiens
tgtccggcccagttt

SEQ ID NO: 69217 - DNA, 15 bp, Homo sapiens
gtccggcccagtttt

SEQ ID NO: 69218 - DNA, 15 bp, Homo sapiens
tccggcccagttttg

SEQ ID NO: 69219 - DNA, 15 bp, Homo sapiens
ccggcccagttttgg

SEQ ID NO: 69220 - DNA, 15 bp, Homo sapiens
cggcccagttttggg

SEQ ID NO: 69221 - DNA, 15 bp, Homo sapiens
ggcccagttttgggg

SEQ ID NO: 69222 - DNA, 15 bp, Homo sapiens
gcccagttttggggt

SEQ ID NO: 69223 - DNA, 15 bp, Homo sapiens
cccagttttggggtg

SEQ ID NO: 69224 - DNA, 15 bp, Homo sapiens
ccagttttggggtgt

SEQ ID NO: 69225 - DNA, 15 bp, Homo sapiens
cagttttggggtgtg

SEQ ID NO: 69226 - DNA, 15 bp, Homo sapiens
agttttggggtgtga

SEQ ID NO: 69227 - DNA, 15 bp, Homo sapiens
gttttggggtgtgac

SEQ ID NO: 69228 - DNA, 15 bp, Homo sapiens
ttttggggtgtgacc

SEQ ID NO: 69229 - DNA, 15 bp, Homo sapiens
tttggggtgtgacct

SEQ ID NO: 69230 - DNA, 15 bp, Homo sapiens
ttggggtgtgacctc

SEQ ID NO: 69231 - DNA, 15 bp, Homo sapiens
tggggtgtgacctca

SEQ ID NO: 69232 - DNA, 15 bp, Homo sapiens
ggggtgtgacctcaa

SEQ ID NO: 69233 - DNA, 15 bp, Homo sapiens
gggtgtgacctcaat

SEQ ID NO: 69234 - DNA, 15 bp, Homo sapiens
ggtgtgacctcaatt

SEQ ID NO: 69235 - DNA, 15 bp, Homo sapiens
gtgtgacctcaattt

SEQ ID NO: 69236 - DNA, 15 bp, Homo sapiens
tgtgacctcaatttc

SEQ ID NO: 69237 - DNA, 15 bp, Homo sapiens
gtgacctcaatttca

SEQ ID NO: 69238 - DNA, 15 bp, Homo sapiens
tgacctcaatttcaa

SEQ ID NO: 69239 - DNA, 15 bp, Homo sapiens
gacctcaatttcaat

SEQ ID NO: 69240 - DNA, 15 bp, Homo sapiens
acctcaatttcaatt

SEQ ID NO: 69241 - DNA, 15 bp, Homo sapiens
cctcaatttcaattt

SEQ ID NO: 69242 - DNA, 15 bp, Homo sapiens
ctcaatttcaatttt

SEQ ID NO: 69243 - DNA, 15 bp, Homo sapiens
tcaatttcaattttg

SEQ ID NO: 69244 - DNA, 15 bp, Homo sapiens
caatttcaattttgt

SEQ ID NO: 69245 - DNA, 15 bp, Homo sapiens
aatttcaattttgtc

SEQ ID NO: 69246 - DNA, 15 bp, Homo sapiens
atttcaattttgtct

SEQ ID NO: 69247 - DNA, 15 bp, Homo sapiens
tttcaattttgtctg

SEQ ID NO: 69248 - DNA, 15 bp, Homo sapiens
ttcaattttgtctgt

SEQ ID NO: 69249 - DNA, 15 bp, Homo sapiens
tcaattttgtctgta

SEQ ID NO: 69250 - DNA, 15 bp, Homo sapiens
caattttgtctgtac

SEQ ID NO: 69251 - DNA, 15 bp, Homo sapiens
aattttgtctgtact

SEQ ID NO: 69252 - DNA, 15 bp, Homo sapiens
attttgtctgtactt

SEQ ID NO: 69253 - DNA, 15 bp, Homo sapiens
ttttgtctgtacttg

SEQ ID NO: 69254 - DNA, 15 bp, Homo sapiens
tttgtctgtacttga

SEQ ID NO: 69255 - DNA, 15 bp, Homo sapiens
ttgtctgtacttgaa

SEQ ID NO: 69256 - DNA, 15 bp, Homo sapiens
tgtctgtacttgaac

SEQ ID NO: 69257 - DNA, 15 bp, Homo sapiens
gtctgtacttgaaca

SEQ ID NO: 69258 - DNA, 15 bp, Homo sapiens
tctgtacttgaacat

SEQ ID NO: 69259 - DNA, 15 bp, Homo sapiens
ctgtacttgaacatt

SEQ ID NO: 69260 - DNA, 15 bp, Homo sapiens
tgtacttgaacatta

SEQ ID NO: 69261 - DNA, 15 bp, Homo sapiens
gtacttgaacattat

SEQ ID NO: 69262 - DNA, 15 bp, Homo sapiens
tacttgaacattatg

SEQ ID NO: 69263 - DNA, 15 bp, Homo sapiens
acttgaacattatga

SEQ ID NO: 69264 - DNA, 15 bp, Homo sapiens
cttgaacattatgaa

SEQ ID NO: 69265 - DNA, 15 bp, Homo sapiens
ttgaacattatgaag

SEQ ID NO: 69266 - DNA, 15 bp, Homo sapiens
tgaacattatgaaga

SEQ ID NO: 69267 - DNA, 15 bp, Homo sapiens
gaacattatgaagat

SEQ ID NO: 69268 - DNA, 15 bp, Homo sapiens
aacattatgaagatg

SEQ ID NO: 69269 - DNA, 15 bp, Homo sapiens
acattatgaagatgg

SEQ ID NO: 69270 - DNA, 15 bp, Homo sapiens
cattatgaagatggg

SEQ ID NO: 69271 - DNA, 15 bp, Homo sapiens
attatgaagatgggg

SEQ ID NO: 69272 - DNA, 15 bp, Homo sapiens
ttatgaagatggggg

SEQ ID NO: 69273 - DNA, 15 bp, Homo sapiens
tatgaagatgggggc

SEQ ID NO: 69274 - DNA, 15 bp, Homo sapiens
atgaagatgggggcc

SEQ ID NO: 69275 - DNA, 15 bp, Homo sapiens
tgaagatgggggcct

SEQ ID NO: 69276 - DNA, 15 bp, Homo sapiens
gaagatgggggcctc

SEQ ID NO: 69277 - DNA, 15 bp, Homo sapiens
aagatgggggcctct

SEQ ID NO: 69278 - DNA, 15 bp, Homo sapiens
agatgggggcctctt

SEQ ID NO: 69279 - DNA, 15 bp, Homo sapiens
gatgggggcctcttt

SEQ ID NO: 69280 - DNA, 15 bp, Homo sapiens
atgggggcctctttc

SEQ ID NO: 69281 - DNA, 15 bp, Homo sapiens
tgggggcctctttca

SEQ ID NO: 69282 - DNA, 15 bp, Homo sapiens
gggggcctctttcag

SEQ ID NO: 69283 - DNA, 15 bp, Homo sapiens
ggggcctctttcagt

SEQ ID NO: 69284 - DNA, 15 bp, Homo sapiens
gggcctctttcagtg

SEQ ID NO: 69285 - DNA, 15 bp, Homo sapiens
ggcctctttcagtga

SEQ ID NO: 69286 - DNA, 15 bp, Homo sapiens
gcctctttcagtgaa

SEQ ID NO: 69287 - DNA, 15 bp, Homo sapiens
cctctttcagtgaat

SEQ ID NO: 69288 - DNA, 15 bp, Homo sapiens
ctctttcagtgaatt

SEQ ID NO: 69289 - DNA, 15 bp, Homo sapiens
tctttcagtgaattt

SEQ ID NO: 69290 - DNA, 15 bp, Homo sapiens
ctttcagtgaatttg

SEQ ID NO: 69291 - DNA, 15 bp, Homo sapiens
tttcagtgaatttgt

SEQ ID NO: 69292 - DNA, 15 bp, Homo sapiens
ttcagtgaatttgtg

SEQ ID NO: 69293 - DNA, 15 bp, Homo sapiens
tcagtgaatttgtga

SEQ ID NO: 69294 - DNA, 15 bp, Homo sapiens
cagtgaatttgtgaa

SEQ ID NO: 69295 - DNA, 15 bp, Homo sapiens
agtgaatttgtgaac

SEQ ID NO: 69296 - DNA, 15 bp, Homo sapiens
gtgaatttgtgaaca

SEQ ID NO: 69297 - DNA, 15 bp, Homo sapiens
tgaatttgtgaacag

SEQ ID NO: 69298 - DNA, 15 bp, Homo sapiens
gaatttgtgaacagc

SEQ ID NO: 69299 - DNA, 15 bp, Homo sapiens
aatttgtgaacagca

SEQ ID NO: 69300 - DNA, 15 bp, Homo sapiens
atttgtgaacagcag

SEQ ID NO: 69301 - DNA, 15 bp, Homo sapiens
tttgtgaacagcaga

SEQ ID NO: 69302 - DNA, 15 bp, Homo sapiens
ttgtgaacagcagaa

SEQ ID NO: 69303 - DNA, 15 bp, Homo sapiens
tgtgaacagcagaat

SEQ ID NO: 69304 - DNA, 15 bp, Homo sapiens
gtgaacagcagaatt

SEQ ID NO: 69305 - DNA, 15 bp, Homo sapiens
tgaacagcagaattg

SEQ ID NO: 69306 - DNA, 15 bp, Homo sapiens
gaacagcagaattga

SEQ ID NO: 69307 - DNA, 15 bp, Homo sapiens
aacagcagaattgac

SEQ ID NO: 69308 - DNA, 15 bp, Homo sapiens
acagcagaattgacc

SEQ ID NO: 69309 - DNA, 15 bp, Homo sapiens
cagcagaattgaccg

SEQ ID NO: 69310 - DNA, 15 bp, Homo sapiens
agcagaattgaccga

SEQ ID NO: 69311 - DNA, 15 bp, Homo sapiens
gcagaattgaccgac

SEQ ID NO: 69312 - DNA, 15 bp, Homo sapiens
cagaattgaccgaca

SEQ ID NO: 69313 - DNA, 15 bp, Homo sapiens
agaattgaccgacag

SEQ ID NO: 69314 - DNA, 15 bp, Homo sapiens
gaattgaccgacagc

SEQ ID NO: 69315 - DNA, 15 bp, Homo sapiens
aattgaccgacagct

SEQ ID NO: 69316 - DNA, 15 bp, Homo sapiens
attgaccgacagctt

SEQ ID NO: 69317 - DNA, 15 bp, Homo sapiens
ttgaccgacagcttt

SEQ ID NO: 69318 - DNA, 15 bp, Homo sapiens
tgaccgacagctttc

SEQ ID NO: 69319 - DNA, 15 bp, Homo sapiens
gaccgacagctttcc

SEQ ID NO: 69320 - DNA, 15 bp, Homo sapiens
accgacagctttcca

SEQ ID NO: 69321 - DNA, 15 bp, Homo sapiens
ccgacagctttccag

SEQ ID NO: 69322 - DNA, 15 bp, Homo sapiens
cgacagctttccagt

SEQ ID NO: 69323 - DNA, 15 bp, Homo sapiens
gacagctttccagta

SEQ ID NO: 69324 - DNA, 15 bp, Homo sapiens
acagctttccagtac

SEQ ID NO: 69325 - DNA, 15 bp, Homo sapiens
cagctttccagtacc

SEQ ID NO: 69326 - DNA, 15 bp, Homo sapiens
agctttccagtaccc

SEQ ID NO: 69327 - DNA, 15 bp, Homo sapiens
gctttccagtaccca

SEQ ID NO: 69328 - DNA, 15 bp, Homo sapiens
ctttccagtacccat

SEQ ID NO: 69329 - DNA, 15 bp, Homo sapiens
tttccagtacccatg

SEQ ID NO: 69330 - DNA, 15 bp, Homo sapiens
ttccagtacccatgg

SEQ ID NO: 69331 - DNA, 15 bp, Homo sapiens
tccagtacccatggg

SEQ ID NO: 69332 - DNA, 15 bp, Homo sapiens
ccagtacccatgggg

SEQ ID NO: 69333 - DNA, 15 bp, Homo sapiens
cagtacccatggggc

SEQ ID NO: 69334 - DNA, 15 bp, Homo sapiens
agtacccatggggct

SEQ ID NO: 69335 - DNA, 15 bp, Homo sapiens
gtacccatggggcta

SEQ ID NO: 69336 - DNA, 15 bp, Homo sapiens
tacccatggggctag

SEQ ID NO: 69337 - DNA, 15 bp, Homo sapiens
acccatggggctagg

SEQ ID NO: 69338 - DNA, 15 bp, Homo sapiens
cccatggggctaggt

SEQ ID NO: 69339 - DNA, 15 bp, Homo sapiens
ccatggggctaggtc

SEQ ID NO: 69340 - DNA, 15 bp, Homo sapiens
catggggctaggtca

SEQ ID NO: 69341 - DNA, 15 bp, Homo sapiens
atggggctaggtcat

SEQ ID NO: 69342 - DNA, 15 bp, Homo sapiens
tggggctaggtcatt

SEQ ID NO: 69343 - DNA, 15 bp, Homo sapiens
ggggctaggtcatta

SEQ ID NO: 69344 - DNA, 15 bp, Homo sapiens
gggctaggtcattaa

SEQ ID NO: 69345 - DNA, 15 bp, Homo sapiens
ggctaggtcattaag

SEQ ID NO: 69346 - DNA, 15 bp, Homo sapiens
gctaggtcattaagg

SEQ ID NO: 69347 - DNA, 15 bp, Homo sapiens
ctaggtcattaaggc

SEQ ID NO: 69348 - DNA, 15 bp, Homo sapiens
taggtcattaaggcc

SEQ ID NO: 69349 - DNA, 15 bp, Homo sapiens
aggtcattaaggcca

SEQ ID NO: 69350 - DNA, 15 bp, Homo sapiens
ggtcattaaggccac

SEQ ID NO: 69351 - DNA, 15 bp, Homo sapiens
gtcattaaggccaca

SEQ ID NO: 69352 - DNA, 15 bp, Homo sapiens
tcattaaggccacat

SEQ ID NO: 69353 - DNA, 15 bp, Homo sapiens
cattaaggccacatc

SEQ ID NO: 69354 - DNA, 15 bp, Homo sapiens
attaaggccacatcc

SEQ ID NO: 69355 - DNA, 15 bp, Homo sapiens
ttaaggccacatcca

SEQ ID NO: 69356 - DNA, 15 bp, Homo sapiens
taaggccacatccac

SEQ ID NO: 69357 - DNA, 15 bp, Homo sapiens
aaggccacatccaca

SEQ ID NO: 69358 - DNA, 15 bp, Homo sapiens
aggccacatccacag

SEQ ID NO: 69359 - DNA, 15 bp, Homo sapiens
ggccacatccacagt

SEQ ID NO: 69360 - DNA, 15 bp, Homo sapiens
gccacatccacagtc

SEQ ID NO: 69361 - DNA, 15 bp, Homo sapiens
ccacatccacagtct

SEQ ID NO: 69362 - DNA, 15 bp, Homo sapiens
cacatccacagtctc

SEQ ID NO: 69363 - DNA, 15 bp, Homo sapiens
acatccacagtctcc

SEQ ID NO: 69364 - DNA, 15 bp, Homo sapiens
catccacagtctccc

SEQ ID NO: 69365 - DNA, 15 bp, Homo sapiens
atccacagtctcccc

SEQ ID NO: 69366 - DNA, 15 bp, Homo sapiens
tccacagtctccccc

SEQ ID NO: 69367 - DNA, 15 bp, Homo sapiens
ccacagtctccccca

SEQ ID NO: 69368 - DNA, 15 bp, Homo sapiens
cacagtctcccccac

SEQ ID NO: 69369 - DNA, 15 bp, Homo sapiens
acagtctcccccacc

SEQ ID NO: 69370 - DNA, 15 bp, Homo sapiens
cagtctcccccaccc

SEQ ID NO: 69371 - DNA, 15 bp, Homo sapiens
agtctcccccaccct

SEQ ID NO: 69372 - DNA, 15 bp, Homo sapiens
gtctcccccaccctt

SEQ ID NO: 69373 - DNA, 15 bp, Homo sapiens
tctcccccacccttg

SEQ ID NO: 69374 - DNA, 15 bp, Homo sapiens
ctcccccacccttgt

SEQ ID NO: 69375 - DNA, 15 bp, Homo sapiens
tcccccacccttgtt

SEQ ID NO: 69376 - DNA, 15 bp, Homo sapiens
cccccacccttgttc

SEQ ID NO: 69377 - DNA, 15 bp, Homo sapiens
ccccacccttgttcc

SEQ ID NO: 69378 - DNA, 15 bp, Homo sapiens
cccacccttgttcca

SEQ ID NO: 69379 - DNA, 15 bp, Homo sapiens
ccacccttgttccag

SEQ ID NO: 69380 - DNA, 15 bp, Homo sapiens
cacccttgttccagt

SEQ ID NO: 69381 - DNA, 15 bp, Homo sapiens
acccttgttccagtt

SEQ ID NO: 69382 - DNA, 15 bp, Homo sapiens
cccttgttccagttg

SEQ ID NO: 69383 - DNA, 15 bp, Homo sapiens
ccttgttccagttgt

SEQ ID NO: 69384 - DNA, 15 bp, Homo sapiens
cttgttccagttgtt

SEQ ID NO: 69385 - DNA, 15 bp, Homo sapiens
ttgttccagttgtta

SEQ ID NO: 69386 - DNA, 15 bp, Homo sapiens
tgttccagttgttag

SEQ ID NO: 69387 - DNA, 15 bp, Homo sapiens
gttccagttgttagt

SEQ ID NO: 69388 - DNA, 15 bp, Homo sapiens
ttccagttgttagtt

SEQ ID NO: 69389 - DNA, 15 bp, Homo sapiens
tccagttgttagtta

SEQ ID NO: 69390 - DNA, 15 bp, Homo sapiens
ccagttgttagttac

SEQ ID NO: 69391 - DNA, 15 bp, Homo sapiens
cagttgttagttact

SEQ ID NO: 69392 - DNA, 15 bp, Homo sapiens
agttgttagttacta

SEQ ID NO: 69393 - DNA, 15 bp, Homo sapiens
gttgttagttactac

SEQ ID NO: 69394 - DNA, 15 bp, Homo sapiens
ttgttagttactacc

SEQ ID NO: 69395 - DNA, 15 bp, Homo sapiens
tgttagttactacct

SEQ ID NO: 69396 - DNA, 15 bp, Homo sapiens
gttagttactacctc

SEQ ID NO: 69397 - DNA, 15 bp, Homo sapiens
ttagttactacctcc

SEQ ID NO: 69398 - DNA, 15 bp, Homo sapiens
tagttactacctcct

SEQ ID NO: 69399 - DNA, 15 bp, Homo sapiens
agttactacctcctc

SEQ ID NO: 69400 - DNA, 15 bp, Homo sapiens
gttactacctcctct

SEQ ID NO: 69401 - DNA, 15 bp, Homo sapiens
ttactacctcctctc

SEQ ID NO: 69402 - DNA, 15 bp, Homo sapiens
tactacctcctctcc

SEQ ID NO: 69403 - DNA, 15 bp, Homo sapiens
actacctcctctcct

SEQ ID NO: 69404 - DNA, 15 bp, Homo sapiens
ctacctcctctcctg

SEQ ID NO: 69405 - DNA, 15 bp, Homo sapiens
tacctcctctcctga

SEQ ID NO: 69406 - DNA, 15 bp, Homo sapiens
acctcctctcctgac

SEQ ID NO: 69407 - DNA, 15 bp, Homo sapiens
cctcctctcctgaca

SEQ ID NO: 69408 - DNA, 15 bp, Homo sapiens
ctcctctcctgacaa

SEQ ID NO: 69409 - DNA, 15 bp, Homo sapiens
tcctctcctgacaat

SEQ ID NO: 69410 - DNA, 15 bp, Homo sapiens
cctctcctgacaata

SEQ ID NO: 69411 - DNA, 15 bp, Homo sapiens
ctctcctgacaatac

SEQ ID NO: 69412 - DNA, 15 bp, Homo sapiens
tctcctgacaatact

SEQ ID NO: 69413 - DNA, 15 bp, Homo sapiens
ctcctgacaatactg

SEQ ID NO: 69414 - DNA, 15 bp, Homo sapiens
tcctgacaatactgt

SEQ ID NO: 69415 - DNA, 15 bp, Homo sapiens
cctgacaatactgta

SEQ ID NO: 69416 - DNA, 15 bp, Homo sapiens
ctgacaatactgtat

SEQ ID NO: 69417 - DNA, 15 bp, Homo sapiens
tgacaatactgtatg

SEQ ID NO: 69418 - DNA, 15 bp, Homo sapiens
gacaatactgtatgt

SEQ ID NO: 69419 - DNA, 15 bp, Homo sapiens
acaatactgtatgtc

SEQ ID NO: 69420 - DNA, 15 bp, Homo sapiens
caatactgtatgtcg

SEQ ID NO: 69421 - DNA, 15 bp, Homo sapiens
aatactgtatgtcgt

SEQ ID NO: 69422 - DNA, 15 bp, Homo sapiens
atactgtatgtcgtc

SEQ ID NO: 69423 - DNA, 15 bp, Homo sapiens
tactgtatgtcgtcg

SEQ ID NO: 69424 - DNA, 15 bp, Homo sapiens
actgtatgtcgtcga

SEQ ID NO: 69425 - DNA, 15 bp, Homo sapiens
ctgtatgtcgtcgag

SEQ ID NO: 69426 - DNA, 15 bp, Homo sapiens
tgtatgtcgtcgagc

SEQ ID NO: 69427 - DNA, 15 bp, Homo sapiens
gtatgtcgtcgagct

SEQ ID NO: 69428 - DNA, 15 bp, Homo sapiens
tatgtcgtcgagctc

SEQ ID NO: 69429 - DNA, 15 bp, Homo sapiens
atgtcgtcgagctcc

SEQ ID NO: 69430 - DNA, 15 bp, Homo sapiens
tgtcgtcgagctccc

SEQ ID NO: 69431 - DNA, 15 bp, Homo sapiens
gtcgtcgagctcccc

SEQ ID NO: 69432 - DNA, 15 bp, Homo sapiens
tcgtcgagctccccc

SEQ ID NO: 69433 - DNA, 15 bp, Homo sapiens
cgtcgagctcccccc

SEQ ID NO: 69434 - DNA, 15 bp, Homo sapiens
gtcgagctcccccca

SEQ ID NO: 69435 - DNA, 15 bp, Homo sapiens
tcgagctccccccag

SEQ ID NO: 69436 - DNA, 15 bp, Homo sapiens
cgagctccccccagg

SEQ ID NO: 69437 - DNA, 15 bp, Homo sapiens
gagctccccccaggt

SEQ ID NO: 69438 - DNA, 15 bp, Homo sapiens
agctccccccaggtc

SEQ ID NO: 69439 - DNA, 15 bp, Homo sapiens
gctccccccaggtct

SEQ ID NO: 69440 - DNA, 15 bp, Homo sapiens
ctccccccaggtcta

SEQ ID NO: 69441 - DNA, 15 bp, Homo sapiens
tccccccaggtctac

SEQ ID NO: 69442 - DNA, 15 bp, Homo sapiens
ccccccaggtctacc

SEQ ID NO: 69443 - DNA, 15 bp, Homo sapiens
cccccaggtctaccc

SEQ ID NO: 69444 - DNA, 15 bp, Homo sapiens
ccccaggtctacccc

SEQ ID NO: 69445 - DNA, 15 bp, Homo sapiens
cccaggtctacccct

SEQ ID NO: 69446 - DNA, 15 bp, Homo sapiens
ccaggtctacccctc

SEQ ID NO: 69447 - DNA, 15 bp, Homo sapiens
caggtctacccctcc

SEQ ID NO: 69448 - DNA, 15 bp, Homo sapiens
aggtctacccctccc

SEQ ID NO: 69449 - DNA, 15 bp, Homo sapiens
ggtctacccctcccg

SEQ ID NO: 69450 - DNA, 15 bp, Homo sapiens
gtctacccctcccgg

SEQ ID NO: 69451 - DNA, 15 bp, Homo sapiens
tctacccctcccggc

SEQ ID NO: 69452 - DNA, 15 bp, Homo sapiens
ctacccctcccggcc

SEQ ID NO: 69453 - DNA, 15 bp, Homo sapiens
tacccctcccggccc

SEQ ID NO: 69454 - DNA, 15 bp, Homo sapiens
acccctcccggccct

SEQ ID NO: 69455 - DNA, 15 bp, Homo sapiens
cccctcccggccctg

SEQ ID NO: 69456 - DNA, 15 bp, Homo sapiens
ccctcccggccctgc

SEQ ID NO: 69457 - DNA, 15 bp, Homo sapiens
cctcccggccctgcc

SEQ ID NO: 69458 - DNA, 15 bp, Homo sapiens
ctcccggccctgcct

SEQ ID NO: 69459 - DNA, 15 bp, Homo sapiens
tcccggccctgcctg

SEQ ID NO: 69460 - DNA, 15 bp, Homo sapiens
cccggccctgcctgc

SEQ ID NO: 69461 - DNA, 15 bp, Homo sapiens
ccggccctgcctgct

SEQ ID NO: 69462 - DNA, 15 bp, Homo sapiens
cggccctgcctgctg

SEQ ID NO: 69463 - DNA, 15 bp, Homo sapiens
ggccctgcctgctgg

SEQ ID NO: 69464 - DNA, 15 bp, Homo sapiens
gccctgcctgctggt

SEQ ID NO: 69465 - DNA, 15 bp, Homo sapiens
ccctgcctgctggtg

SEQ ID NO: 69466 - DNA, 15 bp, Homo sapiens
cctgcctgctggtgg

SEQ ID NO: 69467 - DNA, 15 bp, Homo sapiens
ctgcctgctggtggg

SEQ ID NO: 69468 - DNA, 15 bp, Homo sapiens
tgcctgctggtgggc

SEQ ID NO: 69469 - DNA, 15 bp, Homo sapiens
gcctgctggtgggct

SEQ ID NO: 69470 - DNA, 15 bp, Homo sapiens
cctgctggtgggctt

SEQ ID NO: 69471 - DNA, 15 bp, Homo sapiens
ctgctggtgggcttg

SEQ ID NO: 69472 - DNA, 15 bp, Homo sapiens
tgctggtgggcttgt

SEQ ID NO: 69473 - DNA, 15 bp, Homo sapiens
gctggtgggcttgtc

SEQ ID NO: 69474 - DNA, 15 bp, Homo sapiens
ctggtgggcttgtca

SEQ ID NO: 69475 - DNA, 15 bp, Homo sapiens
tggtgggcttgtcat

SEQ ID NO: 69476 - DNA, 15 bp, Homo sapiens
ggtgggcttgtcata

SEQ ID NO: 69477 - DNA, 15 bp, Homo sapiens
gtgggcttgtcatag

SEQ ID NO: 69478 - DNA, 15 bp, Homo sapiens
tgggcttgtcatagc

SEQ ID NO: 69479 - DNA, 15 bp, Homo sapiens
gggcttgtcatagcc

SEQ ID NO: 69480 - DNA, 15 bp, Homo sapiens
ggcttgtcatagcca

SEQ ID NO: 69481 - DNA, 15 bp, Homo sapiens
gcttgtcatagccag

SEQ ID NO: 69482 - DNA, 15 bp, Homo sapiens
cttgtcatagccagt

SEQ ID NO: 69483 - DNA, 15 bp, Homo sapiens
ttgtcatagccagtg

SEQ ID NO: 69484 - DNA, 15 bp, Homo sapiens
tgtcatagccagtgg

SEQ ID NO: 69485 - DNA, 15 bp, Homo sapiens
gtcatagccagtggg

SEQ ID NO: 69486 - DNA, 15 bp, Homo sapiens
tcatagccagtggga

SEQ ID NO: 69487 - DNA, 15 bp, Homo sapiens
catagccagtgggat

SEQ ID NO: 69488 - DNA, 15 bp, Homo sapiens
atagccagtgggatt

SEQ ID NO: 69489 - DNA, 15 bp, Homo sapiens
tagccagtgggattg

SEQ ID NO: 69490 - DNA, 15 bp, Homo sapiens
agccagtgggattgc

SEQ ID NO: 69491 - DNA, 15 bp, Homo sapiens
gccagtgggattgcc

SEQ ID NO: 69492 - DNA, 15 bp, Homo sapiens
ccagtgggattgccg

SEQ ID NO: 69493 - DNA, 15 bp, Homo sapiens
cagtgggattgccgg

SEQ ID NO: 69494 - DNA, 15 bp, Homo sapiens
agtgggattgccggt

SEQ ID NO: 69495 - DNA, 15 bp, Homo sapiens
gtgggattgccggtc

SEQ ID NO: 69496 - DNA, 15 bp, Homo sapiens
tgggattgccggtct

SEQ ID NO: 69497 - DNA, 15 bp, Homo sapiens
gggattgccggtctt

SEQ ID NO: 69498 - DNA, 15 bp, Homo sapiens
ggattgccggtcttg

SEQ ID NO: 69499 - DNA, 15 bp, Homo sapiens
gattgccggtcttga

SEQ ID NO: 69500 - DNA, 15 bp, Homo sapiens
attgccggtcttgac

SEQ ID NO: 69501 - DNA, 15 bp, Homo sapiens
ttgccggtcttgaca

SEQ ID NO: 69502 - DNA, 15 bp, Homo sapiens
tgccggtcttgacag

SEQ ID NO: 69503 - DNA, 15 bp, Homo sapiens
gccggtcttgacagc

SEQ ID NO: 69504 - DNA, 15 bp, Homo sapiens
ccggtcttgacagct

SEQ ID NO: 69505 - DNA, 15 bp, Homo sapiens
cggtcttgacagctc

SEQ ID NO: 69506 - DNA, 15 bp, Homo sapiens
ggtcttgacagctca

SEQ ID NO: 69507 - DNA, 15 bp, Homo sapiens
gtcttgacagctcag

SEQ ID NO: 69508 - DNA, 15 bp, Homo sapiens
tcttgacagctcagt

SEQ ID NO: 69509 - DNA, 15 bp, Homo sapiens
cttgacagctcagtg

SEQ ID NO: 69510 - DNA, 15 bp, Homo sapiens
ttgacagctcagtga

SEQ ID NO: 69511 - DNA, 15 bp, Homo sapiens
tgacagctcagtgag

SEQ ID NO: 69512 - DNA, 15 bp, Homo sapiens
gacagctcagtgagc

SEQ ID NO: 69513 - DNA, 15 bp, Homo sapiens
acagctcagtgagct

SEQ ID NO: 69514 - DNA, 15 bp, Homo sapiens
cagctcagtgagctg

SEQ ID NO: 69515 - DNA, 15 bp, Homo sapiens
agctcagtgagctgg

SEQ ID NO: 69516 - DNA, 15 bp, Homo sapiens
gctcagtgagctgga

SEQ ID NO: 69517 - DNA, 15 bp, Homo sapiens
ctcagtgagctggag

SEQ ID NO: 69518 - DNA, 15 bp, Homo sapiens
tcagtgagctggaga

SEQ ID NO: 69519 - DNA, 15 bp, Homo sapiens
cagtgagctggagat

SEQ ID NO: 69520 - DNA, 15 bp, Homo sapiens
agtgagctggagata

SEQ ID NO: 69521 - DNA, 15 bp, Homo sapiens
gtgagctggagatac

SEQ ID NO: 69522 - DNA, 15 bp, Homo sapiens
tgagctggagatact

SEQ ID NO: 69523 - DNA, 15 bp, Homo sapiens
gagctggagatactt

SEQ ID NO: 69524 - DNA, 15 bp, Homo sapiens
agctggagatacttg

SEQ ID NO: 69525 - DNA, 15 bp, Homo sapiens
gctggagatacttgg

SEQ ID NO: 69526 - DNA, 15 bp, Homo sapiens
ctggagatacttggt

SEQ ID NO: 69527 - DNA, 15 bp, Homo sapiens
tggagatacttggtc

SEQ ID NO: 69528 - DNA, 15 bp, Homo sapiens
ggagatacttggtca

SEQ ID NO: 69529 - DNA, 15 bp, Homo sapiens
gagatacttggtcac

SEQ ID NO: 69530 - DNA, 15 bp, Homo sapiens
agatacttggtcaca

SEQ ID NO: 69531 - DNA, 15 bp, Homo sapiens
gatacttggtcacag

SEQ ID NO: 69532 - DNA, 15 bp, Homo sapiens
atacttggtcacagc

SEQ ID NO: 69533 - DNA, 15 bp, Homo sapiens
tacttggtcacagcc

SEQ ID NO: 69534 - DNA, 15 bp, Homo sapiens
acttggtcacagcca

SEQ ID NO: 69535 - DNA, 15 bp, Homo sapiens
cttggtcacagccag

SEQ ID NO: 69536 - DNA, 15 bp, Homo sapiens
ttggtcacagccagg

SEQ ID NO: 69537 - DNA, 15 bp, Homo sapiens
tggtcacagccaggc

SEQ ID NO: 69538 - DNA, 15 bp, Homo sapiens
ggtcacagccaggcg

SEQ ID NO: 69539 - DNA, 15 bp, Homo sapiens
gtcacagccaggcgc

SEQ ID NO: 69540 - DNA, 15 bp, Homo sapiens
tcacagccaggcgct

SEQ ID NO: 69541 - DNA, 15 bp, Homo sapiens
cacagccaggcgcta

SEQ ID NO: 69542 - DNA, 15 bp, Homo sapiens
acagccaggcgctag

SEQ ID NO: 69543 - DNA, 15 bp, Homo sapiens
cagccaggcgctagc

SEQ ID NO: 69544 - DNA, 15 bp, Homo sapiens
agccaggcgctagca

SEQ ID NO: 69545 - DNA, 15 bp, Homo sapiens
gccaggcgctagcac

SEQ ID NO: 69546 - DNA, 15 bp, Homo sapiens
ccaggcgctagcaca

SEQ ID NO: 69547 - DNA, 15 bp, Homo sapiens
caggcgctagcacag

SEQ ID NO: 69548 - DNA, 15 bp, Homo sapiens
aggcgctagcacagc

SEQ ID NO: 69549 - DNA, 15 bp, Homo sapiens
ggcgctagcacagct

SEQ ID NO: 69550 - DNA, 15 bp, Homo sapiens
gcgctagcacagctc

SEQ ID NO: 69551 - DNA, 15 bp, Homo sapiens
cgctagcacagctcc

SEQ ID NO: 69552 - DNA, 15 bp, Homo sapiens
gctagcacagctccc

SEQ ID NO: 69553 - DNA, 15 bp, Homo sapiens
ctagcacagctccct

SEQ ID NO: 69554 - DNA, 15 bp, Homo sapiens
tagcacagctccctt

SEQ ID NO: 69555 - DNA, 15 bp, Homo sapiens
agcacagctcccttc

SEQ ID NO: 69556 - DNA, 15 bp, Homo sapiens
gcacagctcccttct

SEQ ID NO: 69557 - DNA, 15 bp, Homo sapiens
cacagctcccttctg

SEQ ID NO: 69558 - DNA, 15 bp, Homo sapiens
acagctcccttctgt

SEQ ID NO: 69559 - DNA, 15 bp, Homo sapiens
cagctcccttctgtt

SEQ ID NO: 69560 - DNA, 15 bp, Homo sapiens
agctcccttctgttg

SEQ ID NO: 69561 - DNA, 15 bp, Homo sapiens
gctcccttctgttga

SEQ ID NO: 69562 - DNA, 15 bp, Homo sapiens
ctcccttctgttgat

SEQ ID NO: 69563 - DNA, 15 bp, Homo sapiens
tcccttctgttgatg

SEQ ID NO: 69564 - DNA, 15 bp, Homo sapiens
cccttctgttgatgc

SEQ ID NO: 69565 - DNA, 15 bp, Homo sapiens
ccttctgttgatgct

SEQ ID NO: 69566 - DNA, 15 bp, Homo sapiens
cttctgttgatgctg

SEQ ID NO: 69567 - DNA, 15 bp, Homo sapiens
ttctgttgatgctgt

SEQ ID NO: 69568 - DNA, 15 bp, Homo sapiens
tctgttgatgctgta

SEQ ID NO: 69569 - DNA, 15 bp, Homo sapiens
ctgttgatgctgtat

SEQ ID NO: 69570 - DNA, 15 bp, Homo sapiens
tgttgatgctgtatt

SEQ ID NO: 69571 - DNA, 15 bp, Homo sapiens
gttgatgctgtattc

SEQ ID NO: 69572 - DNA, 15 bp, Homo sapiens
ttgatgctgtattcc

SEQ ID NO: 69573 - DNA, 15 bp, Homo sapiens
tgatgctgtattccc

SEQ ID NO: 69574 - DNA, 15 bp, Homo sapiens
gatgctgtattccca

SEQ ID NO: 69575 - DNA, 15 bp, Homo sapiens
atgctgtattcccat

SEQ ID NO: 69576 - DNA, 15 bp, Homo sapiens
tgctgtattcccata

SEQ ID NO: 69577 - DNA, 15 bp, Homo sapiens
gctgtattcccatat

SEQ ID NO: 69578 - DNA, 15 bp, Homo sapiens
ctgtattcccatatc

SEQ ID NO: 69579 - DNA, 15 bp, Homo sapiens
tgtattcccatatca

SEQ ID NO: 69580 - DNA, 15 bp, Homo sapiens
gtattcccatatcaa

SEQ ID NO: 69581 - DNA, 15 bp, Homo sapiens
tattcccatatcaaa

SEQ ID NO: 69582 - DNA, 15 bp, Homo sapiens
attcccatatcaaaa

SEQ ID NO: 69583 - DNA, 15 bp, Homo sapiens
ttcccatatcaaaag

SEQ ID NO: 69584 - DNA, 15 bp, Homo sapiens
tcccatatcaaaaga

SEQ ID NO: 69585 - DNA, 15 bp, Homo sapiens
cccatatcaaaagac

SEQ ID NO: 69586 - DNA, 15 bp, Homo sapiens
ccatatcaaaagaca

SEQ ID NO: 69587 - DNA, 15 bp, Homo sapiens
catatcaaaagacac

SEQ ID NO: 69588 - DNA, 15 bp, Homo sapiens
atatcaaaagacaca

SEQ ID NO: 69589 - DNA, 15 bp, Homo sapiens
tatcaaaagacacag

SEQ ID NO: 69590 - DNA, 15 bp, Homo sapiens
atcaaaagacacagg

SEQ ID NO: 69591 - DNA, 15 bp, Homo sapiens
tcaaaagacacaggg

SEQ ID NO: 69592 - DNA, 15 bp, Homo sapiens
caaaagacacagggg

SEQ ID NO: 69593 - DNA, 15 bp, Homo sapiens
aaaagacacagggga

SEQ ID NO: 69594 - DNA, 15 bp, Homo sapiens
aaagacacaggggac

SEQ ID NO: 69595 - DNA, 15 bp, Homo sapiens
aagacacaggggaca

SEQ ID NO: 69596 - DNA, 15 bp, Homo sapiens
agacacaggggacac

SEQ ID NO: 69597 - DNA, 15 bp, Homo sapiens
gacacaggggacacc

SEQ ID NO: 69598 - DNA, 15 bp, Homo sapiens
acacaggggacaccc

SEQ ID NO: 69599 - DNA, 15 bp, Homo sapiens
cacaggggacaccca

SEQ ID NO: 69600 - DNA, 15 bp, Homo sapiens
acaggggacacccag

SEQ ID NO: 69601 - DNA, 15 bp, Homo sapiens
caggggacacccaga

SEQ ID NO: 69602 - DNA, 15 bp, Homo sapiens
aggggacacccagaa

SEQ ID NO: 69603 - DNA, 15 bp, Homo sapiens
ggggacacccagaaa

SEQ ID NO: 69604 - DNA, 15 bp, Homo sapiens
gggacacccagaaac

SEQ ID NO: 69605 - DNA, 15 bp, Homo sapiens
ggacacccagaaacg

SEQ ID NO: 69606 - DNA, 15 bp, Homo sapiens
gacacccagaaacgc

SEQ ID NO: 69607 - DNA, 15 bp, Homo sapiens
acacccagaaacgcc

SEQ ID NO: 69608 - DNA, 15 bp, Homo sapiens
cacccagaaacgcca

SEQ ID NO: 69609 - DNA, 15 bp, Homo sapiens
acccagaaacgccac

SEQ ID NO: 69610 - DNA, 15 bp, Homo sapiens
cccagaaacgccaca

SEQ ID NO: 69611 - DNA, 15 bp, Homo sapiens
ccagaaacgccacat

SEQ ID NO: 69612 - DNA, 15 bp, Homo sapiens
cagaaacgccacatc

SEQ ID NO: 69613 - DNA, 15 bp, Homo sapiens
agaaacgccacatcc

SEQ ID NO: 69614 - DNA, 15 bp, Homo sapiens
gaaacgccacatccc

SEQ ID NO: 69615 - DNA, 15 bp, Homo sapiens
aaacgccacatcccc

SEQ ID NO: 69616 - DNA, 15 bp, Homo sapiens
aacgccacatccccc

SEQ ID NO: 69617 - DNA, 15 bp, Homo sapiens
acgccacatccccca

SEQ ID NO: 69618 - DNA, 15 bp, Homo sapiens
cgccacatcccccaa

SEQ ID NO: 69619 - DNA, 15 bp, Homo sapiens
gccacatcccccaat

SEQ ID NO: 69620 - DNA, 15 bp, Homo sapiens
ccacatcccccaatc

SEQ ID NO: 69621 - DNA, 15 bp, Homo sapiens
cacatcccccaatcc

SEQ ID NO: 69622 - DNA, 15 bp, Homo sapiens
acatcccccaatcca

SEQ ID NO: 69623 - DNA, 15 bp, Homo sapiens
catcccccaatccat

SEQ ID NO: 69624 - DNA, 15 bp, Homo sapiens
atcccccaatccatc

SEQ ID NO: 69625 - DNA, 15 bp, Homo sapiens
tcccccaatccatca

SEQ ID NO: 69626 - DNA, 15 bp, Homo sapiens
cccccaatccatcag

SEQ ID NO: 69627 - DNA, 15 bp, Homo sapiens
ccccaatccatcagt

SEQ ID NO: 69628 - DNA, 15 bp, Homo sapiens
cccaatccatcagtg

SEQ ID NO: 69629 - DNA, 15 bp, Homo sapiens
ccaatccatcagtgc

SEQ ID NO: 69630 - DNA, 15 bp, Homo sapiens
caatccatcagtgcc

SEQ ID NO: 69631 - DNA, 15 bp, Homo sapiens
aatccatcagtgcca

SEQ ID NO: 69632 - DNA, 15 bp, Homo sapiens
atccatcagtgccaa

SEQ ID NO: 69633 - DNA, 15 bp, Homo sapiens
tccatcagtgccaaa

SEQ ID NO: 69634 - DNA, 15 bp, Homo sapiens
ccatcagtgccaaac

SEQ ID NO: 69635 - DNA, 15 bp, Homo sapiens
catcagtgccaaact

SEQ ID NO: 69636 - DNA, 15 bp, Homo sapiens
atcagtgccaaacta

SEQ ID NO: 69637 - DNA, 15 bp, Homo sapiens
tcagtgccaaactag

SEQ ID NO: 69638 - DNA, 15 bp, Homo sapiens
cagtgccaaactagc

SEQ ID NO: 69639 - DNA, 15 bp, Homo sapiens
agtgccaaactagcc

SEQ ID NO: 69640 - DNA, 15 bp, Homo sapiens
gtgccaaactagcca

SEQ ID NO: 69641 - DNA, 15 bp, Homo sapiens
tgccaaactagccaa

SEQ ID NO: 69642 - DNA, 15 bp, Homo sapiens
gccaaactagccaac

SEQ ID NO: 69643 - DNA, 15 bp, Homo sapiens
ccaaactagccaacg

SEQ ID NO: 69644 - DNA, 15 bp, Homo sapiens
caaactagccaacgg

SEQ ID NO: 69645 - DNA, 15 bp, Homo sapiens
aaactagccaacggc

SEQ ID NO: 69646 - DNA, 15 bp, Homo sapiens
aactagccaacggcc

SEQ ID NO: 69647 - DNA, 15 bp, Homo sapiens
actagccaacggccc

SEQ ID NO: 69648 - DNA, 15 bp, Homo sapiens
ctagccaacggcccc

SEQ ID NO: 69649 - DNA, 15 bp, Homo sapiens
tagccaacggcccca

SEQ ID NO: 69650 - DNA, 15 bp, Homo sapiens
agccaacggccccag

SEQ ID NO: 69651 - DNA, 15 bp, Homo sapiens
gccaacggccccagc

SEQ ID NO: 69652 - DNA, 15 bp, Homo sapiens
ccaacggccccagct

SEQ ID NO: 69653 - DNA, 15 bp, Homo sapiens
caacggccccagctt

SEQ ID NO: 69654 - DNA, 15 bp, Homo sapiens
aacggccccagcttc

SEQ ID NO: 69655 - DNA, 15 bp, Homo sapiens
acggccccagcttct

SEQ ID NO: 69656 - DNA, 15 bp, Homo sapiens
cggccccagcttctc

SEQ ID NO: 69657 - DNA, 15 bp, Homo sapiens
ggccccagcttctca

SEQ ID NO: 69658 - DNA, 15 bp, Homo sapiens
gccccagcttctcag

SEQ ID NO: 69659 - DNA, 15 bp, Homo sapiens
ccccagcttctcagc

SEQ ID NO: 69660 - DNA, 15 bp, Homo sapiens
cccagcttctcagct

SEQ ID NO: 69661 - DNA, 15 bp, Homo sapiens
ccagcttctcagctc

SEQ ID NO: 69662 - DNA, 15 bp, Homo sapiens
cagcttctcagctcg

SEQ ID NO: 69663 - DNA, 15 bp, Homo sapiens
agcttctcagctcgc

SEQ ID NO: 69664 - DNA, 15 bp, Homo sapiens
gcttctcagctcgct

SEQ ID NO: 69665 - DNA, 15 bp, Homo sapiens
cttctcagctcgctg

SEQ ID NO: 69666 - DNA, 15 bp, Homo sapiens
ttctcagctcgctgg

SEQ ID NO: 69667 - DNA, 15 bp, Homo sapiens
tctcagctcgctgga

SEQ ID NO: 69668 - DNA, 15 bp, Homo sapiens
ctcagctcgctggat

SEQ ID NO: 69669 - DNA, 15 bp, Homo sapiens
tcagctcgctggatg

SEQ ID NO: 69670 - DNA, 15 bp, Homo sapiens
cagctcgctggatgg

SEQ ID NO: 69671 - DNA, 15 bp, Homo sapiens
agctcgctggatggc

SEQ ID NO: 69672 - DNA, 15 bp, Homo sapiens
gctcgctggatggcg

SEQ ID NO: 69673 - DNA, 15 bp, Homo sapiens
ctcgctggatggcgg

SEQ ID NO: 69674 - DNA, 15 bp, Homo sapiens
tcgctggatggcgga

SEQ ID NO: 69675 - DNA, 15 bp, Homo sapiens
cgctggatggcggaa

SEQ ID NO: 69676 - DNA, 15 bp, Homo sapiens
gctggatggcggaag

SEQ ID NO: 69677 - DNA, 15 bp, Homo sapiens
ctggatggcggaagc

SEQ ID NO: 69678 - DNA, 15 bp, Homo sapiens
tggatggcggaagct

SEQ ID NO: 69679 - DNA, 15 bp, Homo sapiens
ggatggcggaagctg

SEQ ID NO: 69680 - DNA, 15 bp, Homo sapiens
gatggcggaagctgc

SEQ ID NO: 69681 - DNA, 15 bp, Homo sapiens
atggcggaagctgct

SEQ ID NO: 69682 - DNA, 15 bp, Homo sapiens
tggcggaagctgcta

SEQ ID NO: 69683 - DNA, 15 bp, Homo sapiens
ggcggaagctgctac

SEQ ID NO: 69684 - DNA, 15 bp, Homo sapiens
gcggaagctgctact

SEQ ID NO: 69685 - DNA, 15 bp, Homo sapiens
cggaagctgctactc

SEQ ID NO: 69686 - DNA, 15 bp, Homo sapiens
ggaagctgctactcg

SEQ ID NO: 69687 - DNA, 15 bp, Homo sapiens
gaagctgctactcgt

SEQ ID NO: 69688 - DNA, 15 bp, Homo sapiens
aagctgctactcgtg

SEQ ID NO: 69689 - DNA, 15 bp, Homo sapiens
agctgctactcgtga

SEQ ID NO: 69690 - DNA, 15 bp, Homo sapiens
gctgctactcgtgag

SEQ ID NO: 69691 - DNA, 15 bp, Homo sapiens
ctgctactcgtgagc

SEQ ID NO: 69692 - DNA, 15 bp, Homo sapiens
tgctactcgtgagcg

SEQ ID NO: 69693 - DNA, 15 bp, Homo sapiens
gctactcgtgagcgc

SEQ ID NO: 69694 - DNA, 15 bp, Homo sapiens
ctactcgtgagcgcc

SEQ ID NO: 69695 - DNA, 15 bp, Homo sapiens
tactcgtgagcgcca

SEQ ID NO: 69696 - DNA, 15 bp, Homo sapiens
actcgtgagcgccag

SEQ ID NO: 69697 - DNA, 15 bp, Homo sapiens
ctcgtgagcgccagt

SEQ ID NO: 69698 - DNA, 15 bp, Homo sapiens
tcgtgagcgccagtg

SEQ ID NO: 69699 - DNA, 15 bp, Homo sapiens
cgtgagcgccagtgc

SEQ ID NO: 69700 - DNA, 15 bp, Homo sapiens
gtgagcgccagtgcg

SEQ ID NO: 69701 - DNA, 15 bp, Homo sapiens
tgagcgccagtgcgg

SEQ ID NO: 69702 - DNA, 15 bp, Homo sapiens
gagcgccagtgcggg

SEQ ID NO: 69703 - DNA, 15 bp, Homo sapiens
agcgccagtgcgggt

SEQ ID NO: 69704 - DNA, 15 bp, Homo sapiens
gcgccagtgcgggtg

SEQ ID NO: 69705 - DNA, 15 bp, Homo sapiens
cgccagtgcgggtgc

SEQ ID NO: 69706 - DNA, 15 bp, Homo sapiens
gccagtgcgggtgca

SEQ ID NO: 69707 - DNA, 15 bp, Homo sapiens
ccagtgcgggtgcag

SEQ ID NO: 69708 - DNA, 15 bp, Homo sapiens
cagtgcgggtgcaga

SEQ ID NO: 69709 - DNA, 15 bp, Homo sapiens
agtgcgggtgcagac

SEQ ID NO: 69710 - DNA, 15 bp, Homo sapiens
gtgcgggtgcagaca

SEQ ID NO: 69711 - DNA, 15 bp, Homo sapiens
tgcgggtgcagacaa

SEQ ID NO: 69712 - DNA, 15 bp, Homo sapiens
gcgggtgcagacaat

SEQ ID NO: 69713 - DNA, 15 bp, Homo sapiens
cgggtgcagacaatc

SEQ ID NO: 69714 - DNA, 15 bp, Homo sapiens
gggtgcagacaatct

SEQ ID NO: 69715 - DNA, 15 bp, Homo sapiens
ggtgcagacaatctt

SEQ ID NO: 69716 - DNA, 15 bp, Homo sapiens
gtgcagacaatcttc

SEQ ID NO: 69717 - DNA, 15 bp, Homo sapiens
tgcagacaatcttct

SEQ ID NO: 69718 - DNA, 15 bp, Homo sapiens
gcagacaatcttctg

SEQ ID NO: 69719 - DNA, 15 bp, Homo sapiens
cagacaatcttctgt

SEQ ID NO: 69720 - DNA, 15 bp, Homo sapiens
agacaatcttctgtt

SEQ ID NO: 69721 - DNA, 15 bp, Homo sapiens
gacaatcttctgttg

SEQ ID NO: 69722 - DNA, 15 bp, Homo sapiens
acaatcttctgttgg

SEQ ID NO: 69723 - DNA, 15 bp, Homo sapiens
caatcttctgttggg

SEQ ID NO: 69724 - DNA, 15 bp, Homo sapiens
aatcttctgttgggt

SEQ ID NO: 69725 - DNA, 15 bp, Homo sapiens
atcttctgttgggtg

SEQ ID NO: 69726 - DNA, 15 bp, Homo sapiens
tcttctgttgggtgg

SEQ ID NO: 69727 - DNA, 15 bp, Homo sapiens
cttctgttgggtggc

SEQ ID NO: 69728 - DNA, 15 bp, Homo sapiens
ttctgttgggtggca

SEQ ID NO: 69729 - DNA, 15 bp, Homo sapiens
tctgttgggtggcat

SEQ ID NO: 69730 - DNA, 15 bp, Homo sapiens
ctgttgggtggcatc

SEQ ID NO: 69731 - DNA, 15 bp, Homo sapiens
tgttgggtggcatca

SEQ ID NO: 69732 - DNA, 15 bp, Homo sapiens
gttgggtggcatcat

SEQ ID NO: 69733 - DNA, 15 bp, Homo sapiens
ttgggtggcatcatt

SEQ ID NO: 69734 - DNA, 15 bp, Homo sapiens
tgggtggcatcattc

SEQ ID NO: 69735 - DNA, 15 bp, Homo sapiens
gggtggcatcattcc

SEQ ID NO: 69736 - DNA, 15 bp, Homo sapiens
ggtggcatcattcca

SEQ ID NO: 69737 - DNA, 15 bp, Homo sapiens
gtggcatcattccag

SEQ ID NO: 69738 - DNA, 15 bp, Homo sapiens
tggcatcattccagg

SEQ ID NO: 69739 - DNA, 15 bp, Homo sapiens
ggcatcattccaggc

SEQ ID NO: 69740 - DNA, 15 bp, Homo sapiens
gcatcattccaggcc

SEQ ID NO: 69741 - DNA, 15 bp, Homo sapiens
catcattccaggccc

SEQ ID NO: 69742 - DNA, 15 bp, Homo sapiens
atcattccaggcccg

SEQ ID NO: 69743 - DNA, 15 bp, Homo sapiens
tcattccaggcccga

SEQ ID NO: 69744 - DNA, 15 bp, Homo sapiens
cattccaggcccgaa

SEQ ID NO: 69745 - DNA, 15 bp, Homo sapiens
attccaggcccgaag

SEQ ID NO: 69746 - DNA, 15 bp, Homo sapiens
ttccaggcccgaagc

SEQ ID NO: 69747 - DNA, 15 bp, Homo sapiens
tccaggcccgaagca

SEQ ID NO: 69748 - DNA, 15 bp, Homo sapiens
ccaggcccgaagcat

SEQ ID NO: 69749 - DNA, 15 bp, Homo sapiens
caggcccgaagcatg

SEQ ID NO: 69750 - DNA, 15 bp, Homo sapiens
aggcccgaagcatga

SEQ ID NO: 69751 - DNA, 15 bp, Homo sapiens
ggcccgaagcatgaa

SEQ ID NO: 69752 - DNA, 15 bp, Homo sapiens
gcccgaagcatgaac

SEQ ID NO: 69753 - DNA, 15 bp, Homo sapiens
cccgaagcatgaaca

SEQ ID NO: 69754 - DNA, 15 bp, Homo sapiens
ccgaagcatgaacag

SEQ ID NO: 69755 - DNA, 15 bp, Homo sapiens
cgaagcatgaacagt

SEQ ID NO: 69756 - DNA, 15 bp, Homo sapiens
gaagcatgaacagtg

SEQ ID NO: 69757 - DNA, 15 bp, Homo sapiens
aagcatgaacagtgc

SEQ ID NO: 69758 - DNA, 15 bp, Homo sapiens
agcatgaacagtgca

SEQ ID NO: 69759 - DNA, 15 bp, Homo sapiens
gcatgaacagtgcac

SEQ ID NO: 69760 - DNA, 15 bp, Homo sapiens
catgaacagtgcacc

SEQ ID NO: 69761 - DNA, 15 bp, Homo sapiens
atgaacagtgcacct

SEQ ID NO: 69762 - DNA, 15 bp, Homo sapiens
tgaacagtgcacctg

SEQ ID NO: 69763 - DNA, 15 bp, Homo sapiens
gaacagtgcacctgg

SEQ ID NO: 69764 - DNA, 15 bp, Homo sapiens
aacagtgcacctggg

SEQ ID NO: 69765 - DNA, 15 bp, Homo sapiens
acagtgcacctggga

SEQ ID NO: 69766 - DNA, 15 bp, Homo sapiens
cagtgcacctgggac

SEQ ID NO: 69767 - DNA, 15 bp, Homo sapiens
agtgcacctgggaca

SEQ ID NO: 69768 - DNA, 15 bp, Homo sapiens
gtgcacctgggacag

SEQ ID NO: 69769 - DNA, 15 bp, Homo sapiens
tgcacctgggacagg

SEQ ID NO: 69770 - DNA, 15 bp, Homo sapiens
gcacctgggacaggg

SEQ ID NO: 69771 - DNA, 15 bp, Homo sapiens
cacctgggacaggga

SEQ ID NO: 69772 - DNA, 15 bp, Homo sapiens
acctgggacagggag

SEQ ID NO: 69773 - DNA, 15 bp, Homo sapiens
cctgggacagggagc

SEQ ID NO: 69774 - DNA, 15 bp, Homo sapiens
ctgggacagggagca

SEQ ID NO: 69775 - DNA, 15 bp, Homo sapiens
tgggacagggagcag

SEQ ID NO: 69776 - DNA, 15 bp, Homo sapiens
gggacagggagcagc

SEQ ID NO: 69777 - DNA, 15 bp, Homo sapiens
ggacagggagcagcc

SEQ ID NO: 69778 - DNA, 15 bp, Homo sapiens
gacagggagcagccc

SEQ ID NO: 69779 - DNA, 15 bp, Homo sapiens
acagggagcagcccc

SEQ ID NO: 69780 - DNA, 15 bp, Homo sapiens
cagggagcagcccca

SEQ ID NO: 69781 - DNA, 15 bp, Homo sapiens
agggagcagccccaa

SEQ ID NO: 69782 - DNA, 15 bp, Homo sapiens
gggagcagccccaaa

SEQ ID NO: 69783 - DNA, 15 bp, Homo sapiens
ggagcagccccaaat

SEQ ID NO: 69784 - DNA, 15 bp, Homo sapiens
gagcagccccaaatt

SEQ ID NO: 69785 - DNA, 15 bp, Homo sapiens
agcagccccaaattg

SEQ ID NO: 69786 - DNA, 15 bp, Homo sapiens
gcagccccaaattgt

SEQ ID NO: 69787 - DNA, 15 bp, Homo sapiens
cagccccaaattgtc

SEQ ID NO: 69788 - DNA, 15 bp, Homo sapiens
agccccaaattgtca

SEQ ID NO: 69789 - DNA, 15 bp, Homo sapiens
gccccaaattgtcac

SEQ ID NO: 69790 - DNA, 15 bp, Homo sapiens
ccccaaattgtcacc

SEQ ID NO: 69791 - DNA, 15 bp, Homo sapiens
cccaaattgtcacct

SEQ ID NO: 69792 - DNA, 15 bp, Homo sapiens
ccaaattgtcacctg

SEQ ID NO: 69793 - DNA, 15 bp, Homo sapiens
caaattgtcacctgc

SEQ ID NO: 69794 - DNA, 15 bp, Homo sapiens
aaattgtcacctgct

SEQ ID NO: 69795 - DNA, 15 bp, Homo sapiens
aattgtcacctgctt

SEQ ID NO: 69796 - DNA, 15 bp, Homo sapiens
attgtcacctgcttc

SEQ ID NO: 69797 - DNA, 15 bp, Homo sapiens
ttgtcacctgcttct

SEQ ID NO: 69798 - DNA, 15 bp, Homo sapiens
tgtcacctgcttctc

SEQ ID NO: 69799 - DNA, 15 bp, Homo sapiens
gtcacctgcttctct

SEQ ID NO: 69800 - DNA, 15 bp, Homo sapiens
tcacctgcttctctg

SEQ ID NO: 69801 - DNA, 15 bp, Homo sapiens
cacctgcttctctgc

SEQ ID NO: 69802 - DNA, 15 bp, Homo sapiens
acctgcttctctgcc

SEQ ID NO: 69803 - DNA, 15 bp, Homo sapiens
cctgcttctctgccc

SEQ ID NO: 69804 - DNA, 15 bp, Homo sapiens
ctgcttctctgccca

SEQ ID NO: 69805 - DNA, 15 bp, Homo sapiens
tgcttctctgcccag

SEQ ID NO: 69806 - DNA, 15 bp, Homo sapiens
gcttctctgcccagc

SEQ ID NO: 69807 - DNA, 15 bp, Homo sapiens
cttctctgcccagct

SEQ ID NO: 69808 - DNA, 15 bp, Homo sapiens
ttctctgcccagctt

SEQ ID NO: 69809 - DNA, 15 bp, Homo sapiens
tctctgcccagcttt

SEQ ID NO: 69810 - DNA, 15 bp, Homo sapiens
ctctgcccagctttt

SEQ ID NO: 69811 - DNA, 15 bp, Homo sapiens
tctgcccagcttttc

SEQ ID NO: 69812 - DNA, 15 bp, Homo sapiens
ctgcccagcttttca

SEQ ID NO: 69813 - DNA, 15 bp, Homo sapiens
tgcccagcttttcat

SEQ ID NO: 69814 - DNA, 15 bp, Homo sapiens
gcccagcttttcatt

SEQ ID NO: 69815 - DNA, 15 bp, Homo sapiens
cccagcttttcattg

SEQ ID NO: 69816 - DNA, 15 bp, Homo sapiens
ccagcttttcattgc

SEQ ID NO: 69817 - DNA, 15 bp, Homo sapiens
cagcttttcattgct

SEQ ID NO: 69818 - DNA, 15 bp, Homo sapiens
agcttttcattgctg

SEQ ID NO: 69819 - DNA, 15 bp, Homo sapiens
gcttttcattgctgt

SEQ ID NO: 69820 - DNA, 15 bp, Homo sapiens
cttttcattgctgtg

SEQ ID NO: 69821 - DNA, 15 bp, Homo sapiens
ttttcattgctgtga

SEQ ID NO: 69822 - DNA, 15 bp, Homo sapiens
tttcattgctgtgac

SEQ ID NO: 69823 - DNA, 15 bp, Homo sapiens
ttcattgctgtgaca

SEQ ID NO: 69824 - DNA, 15 bp, Homo sapiens
tcattgctgtgacag

SEQ ID NO: 69825 - DNA, 15 bp, Homo sapiens
cattgctgtgacagt

SEQ ID NO: 69826 - DNA, 15 bp, Homo sapiens
attgctgtgacagtg

SEQ ID NO: 69827 - DNA, 15 bp, Homo sapiens
ttgctgtgacagtga

SEQ ID NO: 69828 - DNA, 15 bp, Homo sapiens
tgctgtgacagtgat

SEQ ID NO: 69829 - DNA, 15 bp, Homo sapiens
gctgtgacagtgatg

SEQ ID NO: 69830 - DNA, 15 bp, Homo sapiens
ctgtgacagtgatgg

SEQ ID NO: 69831 - DNA, 15 bp, Homo sapiens
tgtgacagtgatggc

SEQ ID NO: 69832 - DNA, 15 bp, Homo sapiens
gtgacagtgatggcg

SEQ ID NO: 69833 - DNA, 15 bp, Homo sapiens
tgacagtgatggcga

SEQ ID NO: 69834 - DNA, 15 bp, Homo sapiens
gacagtgatggcgaa

SEQ ID NO: 69835 - DNA, 15 bp, Homo sapiens
acagtgatggcgaaa

SEQ ID NO: 69836 - DNA, 15 bp, Homo sapiens
cagtgatggcgaaag

SEQ ID NO: 69837 - DNA, 15 bp, Homo sapiens
agtgatggcgaaaga

SEQ ID NO: 69838 - DNA, 15 bp, Homo sapiens
gtgatggcgaaagag

SEQ ID NO: 69839 - DNA, 15 bp, Homo sapiens
tgatggcgaaagagg

SEQ ID NO: 69840 - DNA, 15 bp, Homo sapiens
gatggcgaaagaggg

SEQ ID NO: 69841 - DNA, 15 bp, Homo sapiens
atggcgaaagagggt

SEQ ID NO: 69842 - DNA, 15 bp, Homo sapiens
tggcgaaagagggta

SEQ ID NO: 69843 - DNA, 15 bp, Homo sapiens
ggcgaaagagggtaa

SEQ ID NO: 69844 - DNA, 15 bp, Homo sapiens
gcgaaagagggtaat

SEQ ID NO: 69845 - DNA, 15 bp, Homo sapiens
cgaaagagggtaata

SEQ ID NO: 69846 - DNA, 15 bp, Homo sapiens
gaaagagggtaataa

SEQ ID NO: 69847 - DNA, 15 bp, Homo sapiens
aaagagggtaataac

SEQ ID NO: 69848 - DNA, 15 bp, Homo sapiens
aagagggtaataacc

SEQ ID NO: 69849 - DNA, 15 bp, Homo sapiens
agagggtaataacca

SEQ ID NO: 69850 - DNA, 15 bp, Homo sapiens
gagggtaataaccag

SEQ ID NO: 69851 - DNA, 15 bp, Homo sapiens
agggtaataaccaga

SEQ ID NO: 69852 - DNA, 15 bp, Homo sapiens
gggtaataaccagac

SEQ ID NO: 69853 - DNA, 15 bp, Homo sapiens
ggtaataaccagaca

SEQ ID NO: 69854 - DNA, 15 bp, Homo sapiens
gtaataaccagacac

SEQ ID NO: 69855 - DNA, 15 bp, Homo sapiens
taataaccagacaca

SEQ ID NO: 69856 - DNA, 15 bp, Homo sapiens
aataaccagacacaa

SEQ ID NO: 69857 - DNA, 15 bp, Homo sapiens
ataaccagacacaaa

SEQ ID NO: 69858 - DNA, 15 bp, Homo sapiens
taaccagacacaaac

SEQ ID NO: 69859 - DNA, 15 bp, Homo sapiens
aaccagacacaaact

SEQ ID NO: 69860 - DNA, 15 bp, Homo sapiens
accagacacaaactg

SEQ ID NO: 69861 - DNA, 15 bp, Homo sapiens
ccagacacaaactgc

SEQ ID NO: 69862 - DNA, 15 bp, Homo sapiens
cagacacaaactgcc

SEQ ID NO: 69863 - DNA, 15 bp, Homo sapiens
agacacaaactgcca

SEQ ID NO: 69864 - DNA, 15 bp, Homo sapiens
gacacaaactgccaa

SEQ ID NO: 69865 - DNA, 15 bp, Homo sapiens
acacaaactgccaag

SEQ ID NO: 69866 - DNA, 15 bp, Homo sapiens
cacaaactgccaagt

SEQ ID NO: 69867 - DNA, 15 bp, Homo sapiens
acaaactgccaagtt

SEQ ID NO: 69868 - DNA, 15 bp, Homo sapiens
caaactgccaagttg

SEQ ID NO: 69869 - DNA, 15 bp, Homo sapiens
aaactgccaagttgg

SEQ ID NO: 69870 - DNA, 15 bp, Homo sapiens
aactgccaagttggg

SEQ ID NO: 69871 - DNA, 15 bp, Homo sapiens
actgccaagttgggt

SEQ ID NO: 69872 - DNA, 15 bp, Homo sapiens
ctgccaagttgggtg

SEQ ID NO: 69873 - DNA, 15 bp, Homo sapiens
tgccaagttgggtgg

SEQ ID NO: 69874 - DNA, 15 bp, Homo sapiens
gccaagttgggtgga

SEQ ID NO: 69875 - DNA, 15 bp, Homo sapiens
ccaagttgggtggag

SEQ ID NO: 69876 - DNA, 15 bp, Homo sapiens
caagttgggtggaga

SEQ ID NO: 69877 - DNA, 15 bp, Homo sapiens
aagttgggtggagaa

SEQ ID NO: 69878 - DNA, 15 bp, Homo sapiens
agttgggtggagaaa

SEQ ID NO: 69879 - DNA, 15 bp, Homo sapiens
gttgggtggagaaag

SEQ ID NO: 69880 - DNA, 15 bp, Homo sapiens
ttgggtggagaaagg

SEQ ID NO: 69881 - DNA, 15 bp, Homo sapiens
tgggtggagaaagga

SEQ ID NO: 69882 - DNA, 15 bp, Homo sapiens
gggtggagaaaggag

SEQ ID NO: 69883 - DNA, 15 bp, Homo sapiens
ggtggagaaaggagt

SEQ ID NO: 69884 - DNA, 15 bp, Homo sapiens
gtggagaaaggagtt

SEQ ID NO: 69885 - DNA, 15 bp, Homo sapiens
tggagaaaggagttt

SEQ ID NO: 69886 - DNA, 15 bp, Homo sapiens
ggagaaaggagtttc

SEQ ID NO: 69887 - DNA, 15 bp, Homo sapiens
gagaaaggagtttct

SEQ ID NO: 69888 - DNA, 15 bp, Homo sapiens
agaaaggagtttctt

SEQ ID NO: 69889 - DNA, 15 bp, Homo sapiens
gaaaggagtttcttt

SEQ ID NO: 69890 - DNA, 15 bp, Homo sapiens
aaaggagtttcttta

SEQ ID NO: 69891 - DNA, 15 bp, Homo sapiens
aaggagtttctttag

SEQ ID NO: 69892 - DNA, 15 bp, Homo sapiens
aggagtttctttagc

SEQ ID NO: 69893 - DNA, 15 bp, Homo sapiens
ggagtttctttagct

SEQ ID NO: 69894 - DNA, 15 bp, Homo sapiens
gagtttctttagctg

SEQ ID NO: 69895 - DNA, 15 bp, Homo sapiens
agtttctttagctga

SEQ ID NO: 69896 - DNA, 15 bp, Homo sapiens
gtttctttagctgac

SEQ ID NO: 69897 - DNA, 15 bp, Homo sapiens
tttctttagctgaca

SEQ ID NO: 69898 - DNA, 15 bp, Homo sapiens
ttctttagctgacag

SEQ ID NO: 69899 - DNA, 15 bp, Homo sapiens
tctttagctgacaga

SEQ ID NO: 69900 - DNA, 15 bp, Homo sapiens
ctttagctgacagaa

SEQ ID NO: 69901 - DNA, 15 bp, Homo sapiens
tttagctgacagaat

SEQ ID NO: 69902 - DNA, 15 bp, Homo sapiens
ttagctgacagaatc

SEQ ID NO: 69903 - DNA, 15 bp, Homo sapiens
tagctgacagaatct

SEQ ID NO: 69904 - DNA, 15 bp, Homo sapiens
agctgacagaatctc

SEQ ID NO: 69905 - DNA, 15 bp, Homo sapiens
gctgacagaatctct

SEQ ID NO: 69906 - DNA, 15 bp, Homo sapiens
ctgacagaatctctg

SEQ ID NO: 69907 - DNA, 15 bp, Homo sapiens
tgacagaatctctga

SEQ ID NO: 69908 - DNA, 15 bp, Homo sapiens
gacagaatctctgaa

SEQ ID NO: 69909 - DNA, 15 bp, Homo sapiens
acagaatctctgaat

SEQ ID NO: 69910 - DNA, 15 bp, Homo sapiens
cagaatctctgaatt

SEQ ID NO: 69911 - DNA, 15 bp, Homo sapiens
agaatctctgaattt

SEQ ID NO: 69912 - DNA, 15 bp, Homo sapiens
gaatctctgaatttt

SEQ ID NO: 69913 - DNA, 15 bp, Homo sapiens
aatctctgaatttta

SEQ ID NO: 69914 - DNA, 15 bp, Homo sapiens
atctctgaattttaa

SEQ ID NO: 69915 - DNA, 15 bp, Homo sapiens
tctctgaattttaaa

SEQ ID NO: 69916 - DNA, 15 bp, Homo sapiens
ctctgaattttaaat

SEQ ID NO: 69917 - DNA, 15 bp, Homo sapiens
tctgaattttaaatc

SEQ ID NO: 69918 - DNA, 15 bp, Homo sapiens
ctgaattttaaatca

SEQ ID NO: 69919 - DNA, 15 bp, Homo sapiens
tgaattttaaatcac

SEQ ID NO: 69920 - DNA, 15 bp, Homo sapiens
gaattttaaatcact

SEQ ID NO: 69921 - DNA, 15 bp, Homo sapiens
aattttaaatcactt

SEQ ID NO: 69922 - DNA, 15 bp, Homo sapiens
attttaaatcactta

SEQ ID NO: 69923 - DNA, 15 bp, Homo sapiens
ttttaaatcacttag

SEQ ID NO: 69924 - DNA, 15 bp, Homo sapiens
tttaaatcacttagt

SEQ ID NO: 69925 - DNA, 15 bp, Homo sapiens
ttaaatcacttagta

SEQ ID NO: 69926 - DNA, 15 bp, Homo sapiens
taaatcacttagtaa

SEQ ID NO: 69927 - DNA, 15 bp, Homo sapiens
aaatcacttagtaag

SEQ ID NO: 69928 - DNA, 15 bp, Homo sapiens
aatcacttagtaagc

SEQ ID NO: 69929 - DNA, 15 bp, Homo sapiens
atcacttagtaagcg

SEQ ID NO: 69930 - DNA, 15 bp, Homo sapiens
tcacttagtaagcgg

SEQ ID NO: 69931 - DNA, 15 bp, Homo sapiens
cacttagtaagcggc

SEQ ID NO: 69932 - DNA, 15 bp, Homo sapiens
acttagtaagcggct

SEQ ID NO: 69933 - DNA, 15 bp, Homo sapiens
cttagtaagcggctc

SEQ ID NO: 69934 - DNA, 15 bp, Homo sapiens
ttagtaagcggctca

SEQ ID NO: 69935 - DNA, 15 bp, Homo sapiens
tagtaagcggctcaa

SEQ ID NO: 69936 - DNA, 15 bp, Homo sapiens
agtaagcggctcaag

SEQ ID NO: 69937 - DNA, 15 bp, Homo sapiens
gtaagcggctcaagc

SEQ ID NO: 69938 - DNA, 15 bp, Homo sapiens
taagcggctcaagcc

SEQ ID NO: 69939 - DNA, 15 bp, Homo sapiens
aagcggctcaagccc

SEQ ID NO: 69940 - DNA, 15 bp, Homo sapiens
agcggctcaagccca

SEQ ID NO: 69941 - DNA, 15 bp, Homo sapiens
gcggctcaagcccag

SEQ ID NO: 69942 - DNA, 15 bp, Homo sapiens
cggctcaagcccagg

SEQ ID NO: 69943 - DNA, 15 bp, Homo sapiens
ggctcaagcccagga

SEQ ID NO: 69944 - DNA, 15 bp, Homo sapiens
gctcaagcccaggag

SEQ ID NO: 69945 - DNA, 15 bp, Homo sapiens
ctcaagcccaggagg

SEQ ID NO: 69946 - DNA, 15 bp, Homo sapiens
tcaagcccaggaggg

SEQ ID NO: 69947 - DNA, 15 bp, Homo sapiens
caagcccaggaggga

SEQ ID NO: 69948 - DNA, 15 bp, Homo sapiens
aagcccaggagggag

SEQ ID NO: 69949 - DNA, 15 bp, Homo sapiens
agcccaggagggagc

SEQ ID NO: 69950 - DNA, 15 bp, Homo sapiens
gcccaggagggagca

SEQ ID NO: 69951 - DNA, 15 bp, Homo sapiens
cccaggagggagcag

SEQ ID NO: 69952 - DNA, 15 bp, Homo sapiens
ccaggagggagcaga

SEQ ID NO: 69953 - DNA, 15 bp, Homo sapiens
caggagggagcagag

SEQ ID NO: 69954 - DNA, 15 bp, Homo sapiens
aggagggagcagagg

SEQ ID NO: 69955 - DNA, 15 bp, Homo sapiens
ggagggagcagaggg

SEQ ID NO: 69956 - DNA, 15 bp, Homo sapiens
gagggagcagaggga

SEQ ID NO: 69957 - DNA, 15 bp, Homo sapiens
agggagcagagggat

SEQ ID NO: 69958 - DNA, 15 bp, Homo sapiens
gggagcagagggata

SEQ ID NO: 69959 - DNA, 15 bp, Homo sapiens
ggagcagagggatac

SEQ ID NO: 69960 - DNA, 15 bp, Homo sapiens
gagcagagggatacg

SEQ ID NO: 69961 - DNA, 15 bp, Homo sapiens
agcagagggatacga

SEQ ID NO: 69962 - DNA, 15 bp, Homo sapiens
gcagagggatacgag

SEQ ID NO: 69963 - DNA, 15 bp, Homo sapiens
cagagggatacgagc

SEQ ID NO: 69964 - DNA, 15 bp, Homo sapiens
agagggatacgagcg

SEQ ID NO: 69965 - DNA, 15 bp, Homo sapiens
gagggatacgagcgg

SEQ ID NO: 69966 - DNA, 15 bp, Homo sapiens
agggatacgagcgga

SEQ ID NO: 69967 - DNA, 15 bp, Homo sapiens
gggatacgagcggag

SEQ ID NO: 69968 - DNA, 15 bp, Homo sapiens
ggatacgagcggagt

SEQ ID NO: 69969 - DNA, 15 bp, Homo sapiens
gatacgagcggagtc

SEQ ID NO: 69970 - DNA, 15 bp, Homo sapiens
atacgagcggagtcc

SEQ ID NO: 69971 - DNA, 15 bp, Homo sapiens
tacgagcggagtccc

SEQ ID NO: 69972 - DNA, 15 bp, Homo sapiens
acgagcggagtcccc

SEQ ID NO: 69973 - DNA, 15 bp, Homo sapiens
cgagcggagtcccct

SEQ ID NO: 69974 - DNA, 15 bp, Homo sapiens
gagcggagtcccctg

SEQ ID NO: 69975 - DNA, 15 bp, Homo sapiens
agcggagtcccctgc

SEQ ID NO: 69976 - DNA, 15 bp, Homo sapiens
gcggagtcccctgcg

SEQ ID NO: 69977 - DNA, 15 bp, Homo sapiens
cggagtcccctgcgc

SEQ ID NO: 69978 - DNA, 15 bp, Homo sapiens
ggagtcccctgcgcg

SEQ ID NO: 69979 - DNA, 15 bp, Homo sapiens
gagtcccctgcgcgg

SEQ ID NO: 69980 - DNA, 15 bp, Homo sapiens
agtcccctgcgcggg

SEQ ID NO: 69981 - DNA, 15 bp, Homo sapiens
gtcccctgcgcggga

SEQ ID NO: 69982 - DNA, 15 bp, Homo sapiens
tcccctgcgcgggac

SEQ ID NO: 69983 - DNA, 15 bp, Homo sapiens
cccctgcgcgggacc

SEQ ID NO: 69984 - DNA, 15 bp, Homo sapiens
ccctgcgcgggacca

SEQ ID NO: 69985 - DNA, 15 bp, Homo sapiens
cctgcgcgggaccat

SEQ ID NO: 69986 - DNA, 15 bp, Homo sapiens
ctgcgcgggaccatc

SEQ ID NO: 69987 - DNA, 15 bp, Homo sapiens
tgcgcgggaccatct

SEQ ID NO: 69988 - DNA, 15 bp, Homo sapiens
gcgcgggaccatctg

SEQ ID NO: 69989 - DNA, 15 bp, Homo sapiens
cgcgggaccatctgg

SEQ ID NO: 69990 - DNA, 15 bp, Homo sapiens
gcgggaccatctgga

SEQ ID NO: 69991 - DNA, 15 bp, Homo sapiens
cgggaccatctggaa

SEQ ID NO: 69992 - DNA, 15 bp, Homo sapiens
gggaccatctggaat

SEQ ID NO: 69993 - DNA, 15 bp, Homo sapiens
ggaccatctggaatt

SEQ ID NO: 69994 - DNA, 15 bp, Homo sapiens
gaccatctggaattg

SEQ ID NO: 69995 - DNA, 15 bp, Homo sapiens
accatctggaattgg

SEQ ID NO: 69996 - DNA, 15 bp, Homo sapiens
ccatctggaattggt

SEQ ID NO: 69997 - DNA, 15 bp, Homo sapiens
catctggaattggtt

SEQ ID NO: 69998 - DNA, 15 bp, Homo sapiens
atctggaattggttt

SEQ ID NO: 69999 - DNA, 15 bp, Homo sapiens
tctggaattggttta

SEQ ID NO: 70000 - DNA, 15 bp, Homo sapiens
ctggaattggtttag

SEQ ID NO: 70001 - DNA, 15 bp, Homo sapiens
tggaattggtttagc

SEQ ID NO: 70002 - DNA, 15 bp, Homo sapiens
ggaattggtttagcc

SEQ ID NO: 70003 - DNA, 15 bp, Homo sapiens
gaattggtttagccc

SEQ ID NO: 70004 - DNA, 15 bp, Homo sapiens
aattggtttagccca

SEQ ID NO: 70005 - DNA, 15 bp, Homo sapiens
attggtttagcccaa

SEQ ID NO: 70006 - DNA, 15 bp, Homo sapiens
ttggtttagcccaag

SEQ ID NO: 70007 - DNA, 15 bp, Homo sapiens
tggtttagcccaagt

SEQ ID NO: 70008 - DNA, 15 bp, Homo sapiens
ggtttagcccaagtg

SEQ ID NO: 70009 - DNA, 15 bp, Homo sapiens
gtttagcccaagtgg

SEQ ID NO: 70010 - DNA, 15 bp, Homo sapiens
tttagcccaagtgga

SEQ ID NO: 70011 - DNA, 15 bp, Homo sapiens
ttagcccaagtggag

SEQ ID NO: 70012 - DNA, 15 bp, Homo sapiens
tagcccaagtggagc

SEQ ID NO: 70013 - DNA, 15 bp, Homo sapiens
agcccaagtggagcc

SEQ ID NO: 70014 - DNA, 15 bp, Homo sapiens
gcccaagtggagcct

SEQ ID NO: 70015 - DNA, 15 bp, Homo sapiens
cccaagtggagcctg

SEQ ID NO: 70016 - DNA, 15 bp, Homo sapiens
ccaagtggagcctga

SEQ ID NO: 70017 - DNA, 15 bp, Homo sapiens
caagtggagcctgac

SEQ ID NO: 70018 - DNA, 15 bp, Homo sapiens
aagtggagcctgaca

SEQ ID NO: 70019 - DNA, 15 bp, Homo sapiens
agtggagcctgacag

SEQ ID NO: 70020 - DNA, 15 bp, Homo sapiens
gtggagcctgacagc

SEQ ID NO: 70021 - DNA, 15 bp, Homo sapiens
tggagcctgacagcc

SEQ ID NO: 70022 - DNA, 15 bp, Homo sapiens
ggagcctgacagcca

SEQ ID NO: 70023 - DNA, 15 bp, Homo sapiens
gagcctgacagccag

SEQ ID NO: 70024 - DNA, 15 bp, Homo sapiens
agcctgacagccaga

SEQ ID NO: 70025 - DNA, 15 bp, Homo sapiens
gcctgacagccagaa

SEQ ID NO: 70026 - DNA, 15 bp, Homo sapiens
cctgacagccagaac

SEQ ID NO: 70027 - DNA, 15 bp, Homo sapiens
ctgacagccagaact

SEQ ID NO: 70028 - DNA, 15 bp, Homo sapiens
tgacagccagaactc

SEQ ID NO: 70029 - DNA, 15 bp, Homo sapiens
gacagccagaactct

SEQ ID NO: 70030 - DNA, 15 bp, Homo sapiens
acagccagaactctg

SEQ ID NO: 70031 - DNA, 15 bp, Homo sapiens
cagccagaactctgt

SEQ ID NO: 70032 - DNA, 15 bp, Homo sapiens
agccagaactctgtg

SEQ ID NO: 70033 - DNA, 15 bp, Homo sapiens
gccagaactctgtgt

SEQ ID NO: 70034 - DNA, 15 bp, Homo sapiens
ccagaactctgtgtc

SEQ ID NO: 70035 - DNA, 15 bp, Homo sapiens
cagaactctgtgtcc

SEQ ID NO: 70036 - DNA, 15 bp, Homo sapiens
agaactctgtgtccc

SEQ ID NO: 70037 - DNA, 15 bp, Homo sapiens
gaactctgtgtcccc

SEQ ID NO: 70038 - DNA, 15 bp, Homo sapiens
aactctgtgtccccc

SEQ ID NO: 70039 - DNA, 15 bp, Homo sapiens
actctgtgtcccccg

SEQ ID NO: 70040 - DNA, 15 bp, Homo sapiens
ctctgtgtcccccgt

SEQ ID NO: 70041 - DNA, 15 bp, Homo sapiens
tctgtgtcccccgtc

SEQ ID NO: 70042 - DNA, 15 bp, Homo sapiens
ctgtgtcccccgtct

SEQ ID NO: 70043 - DNA, 15 bp, Homo sapiens
tgtgtcccccgtcta

SEQ ID NO: 70044 - DNA, 15 bp, Homo sapiens
gtgtcccccgtctaa

SEQ ID NO: 70045 - DNA, 15 bp, Homo sapiens
tgtcccccgtctaac

SEQ ID NO: 70046 - DNA, 15 bp, Homo sapiens
gtcccccgtctaacc

SEQ ID NO: 70047 - DNA, 15 bp, Homo sapiens
tcccccgtctaacca

SEQ ID NO: 70048 - DNA, 15 bp, Homo sapiens
cccccgtctaaccac

SEQ ID NO: 70049 - DNA, 15 bp, Homo sapiens
ccccgtctaaccaca

SEQ ID NO: 70050 - DNA, 15 bp, Homo sapiens
cccgtctaaccacag

SEQ ID NO: 70051 - DNA, 15 bp, Homo sapiens
ccgtctaaccacagc

SEQ ID NO: 70052 - DNA, 15 bp, Homo sapiens
cgtctaaccacagct

SEQ ID NO: 70053 - DNA, 15 bp, Homo sapiens
gtctaaccacagctc

SEQ ID NO: 70054 - DNA, 15 bp, Homo sapiens
tctaaccacagctcc

SEQ ID NO: 70055 - DNA, 15 bp, Homo sapiens
ctaaccacagctcct

SEQ ID NO: 70056 - DNA, 15 bp, Homo sapiens
taaccacagctcctt

SEQ ID NO: 70057 - DNA, 15 bp, Homo sapiens
aaccacagctccttt

SEQ ID NO: 70058 - DNA, 15 bp, Homo sapiens
accacagctcctttt

SEQ ID NO: 70059 - DNA, 15 bp, Homo sapiens
ccacagctccttttc

SEQ ID NO: 70060 - DNA, 15 bp, Homo sapiens
cacagctccttttcc

SEQ ID NO: 70061 - DNA, 15 bp, Homo sapiens
acagctccttttcca

SEQ ID NO: 70062 - DNA, 15 bp, Homo sapiens
cagctccttttccag

SEQ ID NO: 70063 - DNA, 15 bp, Homo sapiens
agctccttttccaga

SEQ ID NO: 70064 - DNA, 15 bp, Homo sapiens
gctccttttccagag

SEQ ID NO: 70065 - DNA, 15 bp, Homo sapiens
ctccttttccagagc

SEQ ID NO: 70066 - DNA, 15 bp, Homo sapiens
tccttttccagagca

SEQ ID NO: 70067 - DNA, 15 bp, Homo sapiens
ccttttccagagcat

SEQ ID NO: 70068 - DNA, 15 bp, Homo sapiens
cttttccagagcatt

SEQ ID NO: 70069 - DNA, 15 bp, Homo sapiens
ttttccagagcattc

SEQ ID NO: 70070 - DNA, 15 bp, Homo sapiens
tttccagagcattcc

SEQ ID NO: 70071 - DNA, 15 bp, Homo sapiens
ttccagagcattcca

SEQ ID NO: 70072 - DNA, 15 bp, Homo sapiens
tccagagcattccag

SEQ ID NO: 70073 - DNA, 15 bp, Homo sapiens
ccagagcattccagt

SEQ ID NO: 70074 - DNA, 15 bp, Homo sapiens
cagagcattccagtc

SEQ ID NO: 70075 - DNA, 15 bp, Homo sapiens
agagcattccagtca

SEQ ID NO: 70076 - DNA, 15 bp, Homo sapiens
gagcattccagtcag

SEQ ID NO: 70077 - DNA, 15 bp, Homo sapiens
agcattccagtcagg

SEQ ID NO: 70078 - DNA, 15 bp, Homo sapiens
gcattccagtcaggc

SEQ ID NO: 70079 - DNA, 15 bp, Homo sapiens
cattccagtcaggct

SEQ ID NO: 70080 - DNA, 15 bp, Homo sapiens
attccagtcaggctc

SEQ ID NO: 70081 - DNA, 15 bp, Homo sapiens
ttccagtcaggctct

SEQ ID NO: 70082 - DNA, 15 bp, Homo sapiens
tccagtcaggctctc

SEQ ID NO: 70083 - DNA, 15 bp, Homo sapiens
ccagtcaggctctct

SEQ ID NO: 70084 - DNA, 15 bp, Homo sapiens
cagtcaggctctctg

SEQ ID NO: 70085 - DNA, 15 bp, Homo sapiens
agtcaggctctctgg

SEQ ID NO: 70086 - DNA, 15 bp, Homo sapiens
gtcaggctctctggg

SEQ ID NO: 70087 - DNA, 15 bp, Homo sapiens
tcaggctctctgggc

SEQ ID NO: 70088 - DNA, 15 bp, Homo sapiens
caggctctctgggct

SEQ ID NO: 70089 - DNA, 15 bp, Homo sapiens
aggctctctgggctg

SEQ ID NO: 70090 - DNA, 15 bp, Homo sapiens
ggctctctgggctga

SEQ ID NO: 70091 - DNA, 15 bp, Homo sapiens
gctctctgggctgac

SEQ ID NO: 70092 - DNA, 15 bp, Homo sapiens
ctctctgggctgact

SEQ ID NO: 70093 - DNA, 15 bp, Homo sapiens
tctctgggctgactg

SEQ ID NO: 70094 - DNA, 15 bp, Homo sapiens
ctctgggctgactgg

SEQ ID NO: 70095 - DNA, 15 bp, Homo sapiens
tctgggctgactggg

SEQ ID NO: 70096 - DNA, 15 bp, Homo sapiens
ctgggctgactgggc

SEQ ID NO: 70097 - DNA, 15 bp, Homo sapiens
tgggctgactgggcc

SEQ ID NO: 70098 - DNA, 15 bp, Homo sapiens
gggctgactgggcca

SEQ ID NO: 70099 - DNA, 15 bp, Homo sapiens
ggctgactgggccag

SEQ ID NO: 70100 - DNA, 15 bp, Homo sapiens
gctgactgggccagg

SEQ ID NO: 70101 - DNA, 15 bp, Homo sapiens
ctgactgggccaggg

SEQ ID NO: 70102 - DNA, 15 bp, Homo sapiens
tgactgggccagggg

SEQ ID NO: 70103 - DNA, 15 bp, Homo sapiens
gactgggccagggga

SEQ ID NO: 70104 - DNA, 15 bp, Homo sapiens
actgggccaggggag

SEQ ID NO: 70105 - DNA, 15 bp, Homo sapiens
ctgggccaggggagg

SEQ ID NO: 70106 - DNA, 15 bp, Homo sapiens
tgggccaggggaggt

SEQ ID NO: 70107 - DNA, 15 bp, Homo sapiens
gggccaggggaggtt

SEQ ID NO: 70108 - DNA, 15 bp, Homo sapiens
ggccaggggaggtta

SEQ ID NO: 70109 - DNA, 15 bp, Homo sapiens
gccaggggaggttac

SEQ ID NO: 70110 - DNA, 15 bp, Homo sapiens
ccaggggaggttaca

SEQ ID NO: 70111 - DNA, 15 bp, Homo sapiens
caggggaggttacag

SEQ ID NO: 70112 - DNA, 15 bp, Homo sapiens
aggggaggttacagg

SEQ ID NO: 70113 - DNA, 15 bp, Homo sapiens
ggggaggttacaggt

SEQ ID NO: 70114 - DNA, 15 bp, Homo sapiens
gggaggttacaggta

SEQ ID NO: 70115 - DNA, 15 bp, Homo sapiens
ggaggttacaggtac

SEQ ID NO: 70116 - DNA, 15 bp, Homo sapiens
gaggttacaggtacc

SEQ ID NO: 70117 - DNA, 15 bp, Homo sapiens
aggttacaggtacca

SEQ ID NO: 70118 - DNA, 15 bp, Homo sapiens
ggttacaggtaccag

SEQ ID NO: 70119 - DNA, 15 bp, Homo sapiens
gttacaggtaccagt

SEQ ID NO: 70120 - DNA, 15 bp, Homo sapiens
ttacaggtaccagtt

SEQ ID NO: 70121 - DNA, 15 bp, Homo sapiens
tacaggtaccagttc

SEQ ID NO: 70122 - DNA, 15 bp, Homo sapiens
acaggtaccagttct

SEQ ID NO: 70123 - DNA, 15 bp, Homo sapiens
caggtaccagttctt

SEQ ID NO: 70124 - DNA, 15 bp, Homo sapiens
aggtaccagttcttt

SEQ ID NO: 70125 - DNA, 15 bp, Homo sapiens
ggtaccagttcttta

SEQ ID NO: 70126 - DNA, 15 bp, Homo sapiens
gtaccagttctttaa

SEQ ID NO: 70127 - DNA, 15 bp, Homo sapiens
taccagttctttaag

SEQ ID NO: 70128 - DNA, 15 bp, Homo sapiens
accagttctttaaga

SEQ ID NO: 70129 - DNA, 15 bp, Homo sapiens
ccagttctttaagaa

SEQ ID NO: 70130 - DNA, 15 bp, Homo sapiens
cagttctttaagaag

SEQ ID NO: 70131 - DNA, 15 bp, Homo sapiens
agttctttaagaaga

SEQ ID NO: 70132 - DNA, 15 bp, Homo sapiens
gttctttaagaagat

SEQ ID NO: 70133 - DNA, 15 bp, Homo sapiens
ttctttaagaagatc

SEQ ID NO: 70134 - DNA, 15 bp, Homo sapiens
tctttaagaagatct

SEQ ID NO: 70135 - DNA, 15 bp, Homo sapiens
ctttaagaagatctt

SEQ ID NO: 70136 - DNA, 15 bp, Homo sapiens
tttaagaagatcttt

SEQ ID NO: 70137 - DNA, 15 bp, Homo sapiens
ttaagaagatctttg

SEQ ID NO: 70138 - DNA, 15 bp, Homo sapiens
taagaagatctttgg

SEQ ID NO: 70139 - DNA, 15 bp, Homo sapiens
aagaagatctttggg

SEQ ID NO: 70140 - DNA, 15 bp, Homo sapiens
agaagatctttgggc

SEQ ID NO: 70141 - DNA, 15 bp, Homo sapiens
gaagatctttgggca

SEQ ID NO: 70142 - DNA, 15 bp, Homo sapiens
aagatctttgggcat

SEQ ID NO: 70143 - DNA, 15 bp, Homo sapiens
agatctttgggcata

SEQ ID NO: 70144 - DNA, 15 bp, Homo sapiens
gatctttgggcatat

SEQ ID NO: 70145 - DNA, 15 bp, Homo sapiens
atctttgggcatata

SEQ ID NO: 70146 - DNA, 15 bp, Homo sapiens
tctttgggcatatac

SEQ ID NO: 70147 - DNA, 15 bp, Homo sapiens
ctttgggcatataca

SEQ ID NO: 70148 - DNA, 15 bp, Homo sapiens
tttgggcatatacat

SEQ ID NO: 70149 - DNA, 15 bp, Homo sapiens
ttgggcatatacatt

SEQ ID NO: 70150 - DNA, 15 bp, Homo sapiens
tgggcatatacattt

SEQ ID NO: 70151 - DNA, 15 bp, Homo sapiens
gggcatatacatttt

SEQ ID NO: 70152 - DNA, 15 bp, Homo sapiens
ggcatatacattttt

SEQ ID NO: 70153 - DNA, 15 bp, Homo sapiens
gcatatacattttta

SEQ ID NO: 70154 - DNA, 15 bp, Homo sapiens
catatacatttttag

SEQ ID NO: 70155 - DNA, 15 bp, Homo sapiens
atatacatttttagc

SEQ ID NO: 70156 - DNA, 15 bp, Homo sapiens
tatacatttttagcc

SEQ ID NO: 70157 - DNA, 15 bp, Homo sapiens
atacatttttagcct

SEQ ID NO: 70158 - DNA, 15 bp, Homo sapiens
tacatttttagcctg

SEQ ID NO: 70159 - DNA, 15 bp, Homo sapiens
acatttttagcctgt

SEQ ID NO: 70160 - DNA, 15 bp, Homo sapiens
catttttagcctgtg

SEQ ID NO: 70161 - DNA, 15 bp, Homo sapiens
atttttagcctgtgt

SEQ ID NO: 70162 - DNA, 15 bp, Homo sapiens
tttttagcctgtgtc

SEQ ID NO: 70163 - DNA, 15 bp, Homo sapiens
ttttagcctgtgtca

SEQ ID NO: 70164 - DNA, 15 bp, Homo sapiens
tttagcctgtgtcat

SEQ ID NO: 70165 - DNA, 15 bp, Homo sapiens
ttagcctgtgtcatt

SEQ ID NO: 70166 - DNA, 15 bp, Homo sapiens
tagcctgtgtcattg

SEQ ID NO: 70167 - DNA, 15 bp, Homo sapiens
agcctgtgtcattgc

SEQ ID NO: 70168 - DNA, 15 bp, Homo sapiens
gcctgtgtcattgcc

SEQ ID NO: 70169 - DNA, 15 bp, Homo sapiens
cctgtgtcattgccc

SEQ ID NO: 70170 - DNA, 15 bp, Homo sapiens
ctgtgtcattgcccc

SEQ ID NO: 70171 - DNA, 15 bp, Homo sapiens
tgtgtcattgcccca

SEQ ID NO: 70172 - DNA, 15 bp, Homo sapiens
gtgtcattgccccaa

SEQ ID NO: 70173 - DNA, 15 bp, Homo sapiens
tgtcattgccccaaa

SEQ ID NO: 70174 - DNA, 15 bp, Homo sapiens
gtcattgccccaaat

SEQ ID NO: 70175 - DNA, 15 bp, Homo sapiens
tcattgccccaaatg

SEQ ID NO: 70176 - DNA, 15 bp, Homo sapiens
cattgccccaaatgg

SEQ ID NO: 70177 - DNA, 15 bp, Homo sapiens
attgccccaaatgga

SEQ ID NO: 70178 - DNA, 15 bp, Homo sapiens
ttgccccaaatggat

SEQ ID NO: 70179 - DNA, 15 bp, Homo sapiens
tgccccaaatggatt

SEQ ID NO: 70180 - DNA, 15 bp, Homo sapiens
gccccaaatggattc

SEQ ID NO: 70181 - DNA, 15 bp, Homo sapiens
ccccaaatggattcc

SEQ ID NO: 70182 - DNA, 15 bp, Homo sapiens
cccaaatggattcct

SEQ ID NO: 70183 - DNA, 15 bp, Homo sapiens
ccaaatggattcctg

SEQ ID NO: 70184 - DNA, 15 bp, Homo sapiens
caaatggattcctgt

SEQ ID NO: 70185 - DNA, 15 bp, Homo sapiens
aaatggattcctgtt

SEQ ID NO: 70186 - DNA, 15 bp, Homo sapiens
aatggattcctgttt

SEQ ID NO: 70187 - DNA, 15 bp, Homo sapiens
atggattcctgtttc

SEQ ID NO: 70188 - DNA, 15 bp, Homo sapiens
tggattcctgtttca

SEQ ID NO: 70189 - DNA, 15 bp, Homo sapiens
ggattcctgtttcaa

SEQ ID NO: 70190 - DNA, 15 bp, Homo sapiens
gattcctgtttcaag

SEQ ID NO: 70191 - DNA, 15 bp, Homo sapiens
attcctgtttcaagt

SEQ ID NO: 70192 - DNA, 15 bp, Homo sapiens
ttcctgtttcaagtt

SEQ ID NO: 70193 - DNA, 15 bp, Homo sapiens
tcctgtttcaagttc

SEQ ID NO: 70194 - DNA, 15 bp, Homo sapiens
cctgtttcaagttca

SEQ ID NO: 70195 - DNA, 15 bp, Homo sapiens
ctgtttcaagttcac

SEQ ID NO: 70196 - DNA, 15 bp, Homo sapiens
tgtttcaagttcaca

SEQ ID NO: 70197 - DNA, 15 bp, Homo sapiens
gtttcaagttcacac

SEQ ID NO: 70198 - DNA, 15 bp, Homo sapiens
tttcaagttcacacc

SEQ ID NO: 70199 - DNA, 15 bp, Homo sapiens
ttcaagttcacacct

SEQ ID NO: 70200 - DNA, 15 bp, Homo sapiens
tcaagttcacacctg

SEQ ID NO: 70201 - DNA, 15 bp, Homo sapiens
caagttcacacctgc

SEQ ID NO: 70202 - DNA, 15 bp, Homo sapiens
aagttcacacctgca

SEQ ID NO: 70203 - DNA, 15 bp, Homo sapiens
agttcacacctgcag

SEQ ID NO: 70204 - DNA, 15 bp, Homo sapiens
gttcacacctgcaga

SEQ ID NO: 70205 - DNA, 15 bp, Homo sapiens
ttcacacctgcagat

SEQ ID NO: 70206 - DNA, 15 bp, Homo sapiens
tcacacctgcagatt

SEQ ID NO: 70207 - DNA, 15 bp, Homo sapiens
cacacctgcagattc

SEQ ID NO: 70208 - DNA, 15 bp, Homo sapiens
acacctgcagattct

SEQ ID NO: 70209 - DNA, 15 bp, Homo sapiens
cacctgcagattcta

SEQ ID NO: 70210 - DNA, 15 bp, Homo sapiens
acctgcagattctag

SEQ ID NO: 70211 - DNA, 15 bp, Homo sapiens
cctgcagattctagg

SEQ ID NO: 70212 - DNA, 15 bp, Homo sapiens
ctgcagattctagga

SEQ ID NO: 70213 - DNA, 15 bp, Homo sapiens
tgcagattctaggac

SEQ ID NO: 70214 - DNA, 15 bp, Homo sapiens
gcagattctaggacc

SEQ ID NO: 70215 - DNA, 15 bp, Homo sapiens
cagattctaggacct

SEQ ID NO: 70216 - DNA, 15 bp, Homo sapiens
agattctaggacctg

SEQ ID NO: 70217 - DNA, 15 bp, Homo sapiens
gattctaggacctgt

SEQ ID NO: 70218 - DNA, 15 bp, Homo sapiens
attctaggacctgtg

SEQ ID NO: 70219 - DNA, 15 bp, Homo sapiens
ttctaggacctgtgt

SEQ ID NO: 70220 - DNA, 15 bp, Homo sapiens
tctaggacctgtgtc

SEQ ID NO: 70221 - DNA, 15 bp, Homo sapiens
ctaggacctgtgtcc

SEQ ID NO: 70222 - DNA, 15 bp, Homo sapiens
taggacctgtgtcct

SEQ ID NO: 70223 - DNA, 15 bp, Homo sapiens
aggacctgtgtccta

SEQ ID NO: 70224 - DNA, 15 bp, Homo sapiens
ggacctgtgtcctag

SEQ ID NO: 70225 - DNA, 15 bp, Homo sapiens
gacctgtgtcctaga

SEQ ID NO: 70226 - DNA, 15 bp, Homo sapiens
acctgtgtcctagac

SEQ ID NO: 70227 - DNA, 15 bp, Homo sapiens
cctgtgtcctagact

SEQ ID NO: 70228 - DNA, 15 bp, Homo sapiens
ctgtgtcctagactt

SEQ ID NO: 70229 - DNA, 15 bp, Homo sapiens
tgtgtcctagacttc

SEQ ID NO: 70230 - DNA, 15 bp, Homo sapiens
gtgtcctagacttca

SEQ ID NO: 70231 - DNA, 15 bp, Homo sapiens
tgtcctagacttcag

SEQ ID NO: 70232 - DNA, 15 bp, Homo sapiens
gtcctagacttcagg

SEQ ID NO: 70233 - DNA, 15 bp, Homo sapiens
tcctagacttcaggg

SEQ ID NO: 70234 - DNA, 15 bp, Homo sapiens
cctagacttcaggga

SEQ ID NO: 70235 - DNA, 15 bp, Homo sapiens
ctagacttcagggag

SEQ ID NO: 70236 - DNA, 15 bp, Homo sapiens
tagacttcagggagt

SEQ ID NO: 70237 - DNA, 15 bp, Homo sapiens
agacttcagggagtc

SEQ ID NO: 70238 - DNA, 15 bp, Homo sapiens
gacttcagggagtca

SEQ ID NO: 70239 - DNA, 15 bp, Homo sapiens
acttcagggagtcag

SEQ ID NO: 70240 - DNA, 15 bp, Homo sapiens
cttcagggagtcagc

SEQ ID NO: 70241 - DNA, 15 bp, Homo sapiens
ttcagggagtcagct

SEQ ID NO: 70242 - DNA, 15 bp, Homo sapiens
tcagggagtcagctg

SEQ ID NO: 70243 - DNA, 15 bp, Homo sapiens
cagggagtcagctgt

SEQ ID NO: 70244 - DNA, 15 bp, Homo sapiens
agggagtcagctgtt

SEQ ID NO: 70245 - DNA, 15 bp, Homo sapiens
gggagtcagctgttt

SEQ ID NO: 70246 - DNA, 15 bp, Homo sapiens
ggagtcagctgtttc

SEQ ID NO: 70247 - DNA, 15 bp, Homo sapiens
gagtcagctgtttct

SEQ ID NO: 70248 - DNA, 15 bp, Homo sapiens
agtcagctgtttcta

SEQ ID NO: 70249 - DNA, 15 bp, Homo sapiens
gtcagctgtttctag

SEQ ID NO: 70250 - DNA, 15 bp, Homo sapiens
tcagctgtttctaga

SEQ ID NO: 70251 - DNA, 15 bp, Homo sapiens
cagctgtttctagag

SEQ ID NO: 70252 - DNA, 15 bp, Homo sapiens
agctgtttctagagt

SEQ ID NO: 70253 - DNA, 15 bp, Homo sapiens
gctgtttctagagtt

SEQ ID NO: 70254 - DNA, 15 bp, Homo sapiens
ctgtttctagagttc

SEQ ID NO: 70255 - DNA, 15 bp, Homo sapiens
tgtttctagagttcc

SEQ ID NO: 70256 - DNA, 15 bp, Homo sapiens
gtttctagagttcct

SEQ ID NO: 70257 - DNA, 15 bp, Homo sapiens
tttctagagttccta

SEQ ID NO: 70258 - DNA, 15 bp, Homo sapiens
ttctagagttcctac

SEQ ID NO: 70259 - DNA, 15 bp, Homo sapiens
tctagagttcctacc

SEQ ID NO: 70260 - DNA, 15 bp, Homo sapiens
ctagagttcctacca

SEQ ID NO: 70261 - DNA, 15 bp, Homo sapiens
tagagttcctaccat

SEQ ID NO: 70262 - DNA, 15 bp, Homo sapiens
agagttcctaccatg

SEQ ID NO: 70263 - DNA, 15 bp, Homo sapiens
gagttcctaccatgg

SEQ ID NO: 70264 - DNA, 15 bp, Homo sapiens
agttcctaccatgga

SEQ ID NO: 70265 - DNA, 15 bp, Homo sapiens
gttcctaccatggag

SEQ ID NO: 70266 - DNA, 15 bp, Homo sapiens
ttcctaccatggagt

SEQ ID NO: 70267 - DNA, 15 bp, Homo sapiens
tcctaccatggagtg

SEQ ID NO: 70268 - DNA, 15 bp, Homo sapiens
cctaccatggagtgg

SEQ ID NO: 70269 - DNA, 15 bp, Homo sapiens
ctaccatggagtggg

SEQ ID NO: 70270 - DNA, 15 bp, Homo sapiens
taccatggagtgggt

SEQ ID NO: 70271 - DNA, 15 bp, Homo sapiens
accatggagtgggtc

SEQ ID NO: 70272 - DNA, 15 bp, Homo sapiens
ccatggagtgggtct

SEQ ID NO: 70273 - DNA, 15 bp, Homo sapiens
catggagtgggtctg

SEQ ID NO: 70274 - DNA, 15 bp, Homo sapiens
atggagtgggtctgg

SEQ ID NO: 70275 - DNA, 15 bp, Homo sapiens
tggagtgggtctgga

SEQ ID NO: 70276 - DNA, 15 bp, Homo sapiens
ggagtgggtctggag

SEQ ID NO: 70277 - DNA, 15 bp, Homo sapiens
gagtgggtctggagg

SEQ ID NO: 70278 - DNA, 15 bp, Homo sapiens
agtgggtctggagga

SEQ ID NO: 70279 - DNA, 15 bp, Homo sapiens
gtgggtctggaggac

SEQ ID NO: 70280 - DNA, 15 bp, Homo sapiens
tgggtctggaggacc

SEQ ID NO: 70281 - DNA, 15 bp, Homo sapiens
gggtctggaggacct

SEQ ID NO: 70282 - DNA, 15 bp, Homo sapiens
ggtctggaggacctg

SEQ ID NO: 70283 - DNA, 15 bp, Homo sapiens
gtctggaggacctgc

SEQ ID NO: 70284 - DNA, 15 bp, Homo sapiens
tctggaggacctgcc

SEQ ID NO: 70285 - DNA, 15 bp, Homo sapiens
ctggaggacctgccc

SEQ ID NO: 70286 - DNA, 15 bp, Homo sapiens
tggaggacctgcccg

SEQ ID NO: 70287 - DNA, 15 bp, Homo sapiens
ggaggacctgcccgg

SEQ ID NO: 70288 - DNA, 15 bp, Homo sapiens
gaggacctgcccggt

SEQ ID NO: 70289 - DNA, 15 bp, Homo sapiens
aggacctgcccggtg

SEQ ID NO: 70290 - DNA, 15 bp, Homo sapiens
ggacctgcccggtgg

SEQ ID NO: 70291 - DNA, 15 bp, Homo sapiens
gacctgcccggtggg

SEQ ID NO: 70292 - DNA, 15 bp, Homo sapiens
acctgcccggtgggg

SEQ ID NO: 70293 - DNA, 15 bp, Homo sapiens
cctgcccggtggggg

SEQ ID NO: 70294 - DNA, 15 bp, Homo sapiens
ctgcccggtgggggg

SEQ ID NO: 70295 - DNA, 15 bp, Homo sapiens
tgcccggtggggggg

SEQ ID NO: 70296 - DNA, 15 bp, Homo sapiens
gcccggtgggggggc

SEQ ID NO: 70297 - DNA, 15 bp, Homo sapiens
cccggtgggggggca

SEQ ID NO: 70298 - DNA, 15 bp, Homo sapiens
ccggtgggggggcag

SEQ ID NO: 70299 - DNA, 15 bp, Homo sapiens
cggtgggggggcaga

SEQ ID NO: 70300 - DNA, 15 bp, Homo sapiens
ggtgggggggcagag

SEQ ID NO: 70301 - DNA, 15 bp, Homo sapiens
gtgggggggcagagc

SEQ ID NO: 70302 - DNA, 15 bp, Homo sapiens
tgggggggcagagcc

SEQ ID NO: 70303 - DNA, 15 bp, Homo sapiens
gggggggcagagccc

SEQ ID NO: 70304 - DNA, 15 bp, Homo sapiens
ggggggcagagccct

SEQ ID NO: 70305 - DNA, 15 bp, Homo sapiens
gggggcagagccctg

SEQ ID NO: 70306 - DNA, 15 bp, Homo sapiens
ggggcagagccctgc

SEQ ID NO: 70307 - DNA, 15 bp, Homo sapiens
gggcagagccctgct

SEQ ID NO: 70308 - DNA, 15 bp, Homo sapiens
ggcagagccctgctc

SEQ ID NO: 70309 - DNA, 15 bp, Homo sapiens
gcagagccctgctcc

SEQ ID NO: 70310 - DNA, 15 bp, Homo sapiens
cagagccctgctccc

SEQ ID NO: 70311 - DNA, 15 bp, Homo sapiens
agagccctgctccct

SEQ ID NO: 70312 - DNA, 15 bp, Homo sapiens
gagccctgctccctc

SEQ ID NO: 70313 - DNA, 15 bp, Homo sapiens
agccctgctccctcc

SEQ ID NO: 70314 - DNA, 15 bp, Homo sapiens
gccctgctccctccg

SEQ ID NO: 70315 - DNA, 15 bp, Homo sapiens
ccctgctccctccgg

SEQ ID NO: 70316 - DNA, 15 bp, Homo sapiens
cctgctccctccggg

SEQ ID NO: 70317 - DNA, 15 bp, Homo sapiens
ctgctccctccgggt

SEQ ID NO: 70318 - DNA, 15 bp, Homo sapiens
tgctccctccgggtc

SEQ ID NO: 70319 - DNA, 15 bp, Homo sapiens
gctccctccgggtct

SEQ ID NO: 70320 - DNA, 15 bp, Homo sapiens
ctccctccgggtctt

SEQ ID NO: 70321 - DNA, 15 bp, Homo sapiens
tccctccgggtcttc

SEQ ID NO: 70322 - DNA, 15 bp, Homo sapiens
ccctccgggtcttcc

SEQ ID NO: 70323 - DNA, 15 bp, Homo sapiens
cctccgggtcttcct

SEQ ID NO: 70324 - DNA, 15 bp, Homo sapiens
ctccgggtcttccta

SEQ ID NO: 70325 - DNA, 15 bp, Homo sapiens
tccgggtcttcctac

SEQ ID NO: 70326 - DNA, 15 bp, Homo sapiens
ccgggtcttcctact

SEQ ID NO: 70327 - DNA, 15 bp, Homo sapiens
cgggtcttcctactc

SEQ ID NO: 70328 - DNA, 15 bp, Homo sapiens
gggtcttcctactct

SEQ ID NO: 70329 - DNA, 15 bp, Homo sapiens
ggtcttcctactctt

SEQ ID NO: 70330 - DNA, 15 bp, Homo sapiens
gtcttcctactcttc

SEQ ID NO: 70331 - DNA, 15 bp, Homo sapiens
tcttcctactcttct

SEQ ID NO: 70332 - DNA, 15 bp, Homo sapiens
cttcctactcttctc

SEQ ID NO: 70333 - DNA, 15 bp, Homo sapiens
ttcctactcttctct

SEQ ID NO: 70334 - DNA, 15 bp, Homo sapiens
tcctactcttctctc

SEQ ID NO: 70335 - DNA, 15 bp, Homo sapiens
cctactcttctctct

SEQ ID NO: 70336 - DNA, 15 bp, Homo sapiens
ctactcttctctctg

SEQ ID NO: 70337 - DNA, 15 bp, Homo sapiens
tactcttctctctgc

SEQ ID NO: 70338 - DNA, 15 bp, Homo sapiens
actcttctctctgct

SEQ ID NO: 70339 - DNA, 15 bp, Homo sapiens
ctcttctctctgctc

SEQ ID NO: 70340 - DNA, 15 bp, Homo sapiens
tcttctctctgctct

SEQ ID NO: 70341 - DNA, 15 bp, Homo sapiens
cttctctctgctctg

SEQ ID NO: 70342 - DNA, 15 bp, Homo sapiens
ttctctctgctctga

SEQ ID NO: 70343 - DNA, 15 bp, Homo sapiens
tctctctgctctgac

SEQ ID NO: 70344 - DNA, 15 bp, Homo sapiens
ctctctgctctgacg

SEQ ID NO: 70345 - DNA, 15 bp, Homo sapiens
tctctgctctgacgg

SEQ ID NO: 70346 - DNA, 15 bp, Homo sapiens
ctctgctctgacggg

SEQ ID NO: 70347 - DNA, 15 bp, Homo sapiens
tctgctctgacggga

SEQ ID NO: 70348 - DNA, 15 bp, Homo sapiens
ctgctctgacgggat

SEQ ID NO: 70349 - DNA, 15 bp, Homo sapiens
tgctctgacgggatt

SEQ ID NO: 70350 - DNA, 15 bp, Homo sapiens
gctctgacgggattt

SEQ ID NO: 70351 - DNA, 15 bp, Homo sapiens
ctctgacgggatttg

SEQ ID NO: 70352 - DNA, 15 bp, Homo sapiens
tctgacgggatttgt

SEQ ID NO: 70353 - DNA, 15 bp, Homo sapiens
ctgacgggatttgtt

SEQ ID NO: 70354 - DNA, 15 bp, Homo sapiens
tgacgggatttgttg

SEQ ID NO: 70355 - DNA, 15 bp, Homo sapiens
gacgggatttgttga

SEQ ID NO: 70356 - DNA, 15 bp, Homo sapiens
acgggatttgttgat

SEQ ID NO: 70357 - DNA, 15 bp, Homo sapiens
cgggatttgttgatt

SEQ ID NO: 70358 - DNA, 15 bp, Homo sapiens
gggatttgttgattc

SEQ ID NO: 70359 - DNA, 15 bp, Homo sapiens
ggatttgttgattct

SEQ ID NO: 70360 - DNA, 15 bp, Homo sapiens
gatttgttgattctc

SEQ ID NO: 70361 - DNA, 15 bp, Homo sapiens
atttgttgattctct

SEQ ID NO: 70362 - DNA, 15 bp, Homo sapiens
tttgttgattctctc

SEQ ID NO: 70363 - DNA, 15 bp, Homo sapiens
ttgttgattctctcc

SEQ ID NO: 70364 - DNA, 15 bp, Homo sapiens
tgttgattctctcca

SEQ ID NO: 70365 - DNA, 15 bp, Homo sapiens
gttgattctctccat

SEQ ID NO: 70366 - DNA, 15 bp, Homo sapiens
ttgattctctccatt

SEQ ID NO: 70367 - DNA, 15 bp, Homo sapiens
tgattctctccattt

SEQ ID NO: 70368 - DNA, 15 bp, Homo sapiens
gattctctccatttt

SEQ ID NO: 70369 - DNA, 15 bp, Homo sapiens
attctctccattttg

SEQ ID NO: 70370 - DNA, 15 bp, Homo sapiens
ttctctccattttgg

SEQ ID NO: 70371 - DNA, 15 bp, Homo sapiens
tctctccattttggt

SEQ ID NO: 70372 - DNA, 15 bp, Homo sapiens
ctctccattttggtg

SEQ ID NO: 70373 - DNA, 15 bp, Homo sapiens
tctccattttggtgt

SEQ ID NO: 70374 - DNA, 15 bp, Homo sapiens
ctccattttggtgtc

SEQ ID NO: 70375 - DNA, 15 bp, Homo sapiens
tccattttggtgtct

SEQ ID NO: 70376 - DNA, 15 bp, Homo sapiens
ccattttggtgtctt

SEQ ID NO: 70377 - DNA, 15 bp, Homo sapiens
cattttggtgtcttt

SEQ ID NO: 70378 - DNA, 15 bp, Homo sapiens
attttggtgtctttc

SEQ ID NO: 70379 - DNA, 15 bp, Homo sapiens
ttttggtgtctttct

SEQ ID NO: 70380 - DNA, 15 bp, Homo sapiens
tttggtgtctttctc

SEQ ID NO: 70381 - DNA, 15 bp, Homo sapiens
ttggtgtctttctct

SEQ ID NO: 70382 - DNA, 15 bp, Homo sapiens
tggtgtctttctctt

SEQ ID NO: 70383 - DNA, 15 bp, Homo sapiens
ggtgtctttctcttt

SEQ ID NO: 70384 - DNA, 15 bp, Homo sapiens
gtgtctttctctttt

SEQ ID NO: 70385 - DNA, 15 bp, Homo sapiens
tgtctttctctttta

SEQ ID NO: 70386 - DNA, 15 bp, Homo sapiens
gtctttctcttttag

SEQ ID NO: 70387 - DNA, 15 bp, Homo sapiens
tctttctcttttaga

SEQ ID NO: 70388 - DNA, 15 bp, Homo sapiens
ctttctcttttagat

SEQ ID NO: 70389 - DNA, 15 bp, Homo sapiens
tttctcttttagata

SEQ ID NO: 70390 - DNA, 15 bp, Homo sapiens
ttctcttttagatat

SEQ ID NO: 70391 - DNA, 15 bp, Homo sapiens
tctcttttagatatt

SEQ ID NO: 70392 - DNA, 15 bp, Homo sapiens
ctcttttagatattg

SEQ ID NO: 70393 - DNA, 15 bp, Homo sapiens
tcttttagatattgt

SEQ ID NO: 70394 - DNA, 15 bp, Homo sapiens
cttttagatattgta

SEQ ID NO: 70395 - DNA, 15 bp, Homo sapiens
ttttagatattgtat

SEQ ID NO: 70396 - DNA, 15 bp, Homo sapiens
tttagatattgtatc

SEQ ID NO: 70397 - DNA, 15 bp, Homo sapiens
ttagatattgtatca

SEQ ID NO: 70398 - DNA, 15 bp, Homo sapiens
tagatattgtatcaa

SEQ ID NO: 70399 - DNA, 15 bp, Homo sapiens
agatattgtatcaat

SEQ ID NO: 70400 - DNA, 15 bp, Homo sapiens
gatattgtatcaatc

SEQ ID NO: 70401 - DNA, 15 bp, Homo sapiens
atattgtatcaatct

SEQ ID NO: 70402 - DNA, 15 bp, Homo sapiens
tattgtatcaatctt

SEQ ID NO: 70403 - DNA, 15 bp, Homo sapiens
attgtatcaatcttt

SEQ ID NO: 70404 - DNA, 15 bp, Homo sapiens
ttgtatcaatcttta

SEQ ID NO: 70405 - DNA, 15 bp, Homo sapiens
tgtatcaatctttag

SEQ ID NO: 70406 - DNA, 15 bp, Homo sapiens
gtatcaatctttaga

SEQ ID NO: 70407 - DNA, 15 bp, Homo sapiens
tatcaatctttagaa

SEQ ID NO: 70408 - DNA, 15 bp, Homo sapiens
atcaatctttagaaa

SEQ ID NO: 70409 - DNA, 15 bp, Homo sapiens
tcaatctttagaaaa

SEQ ID NO: 70410 - DNA, 15 bp, Homo sapiens
caatctttagaaaag

SEQ ID NO: 70411 - DNA, 15 bp, Homo sapiens
aatctttagaaaagg

SEQ ID NO: 70412 - DNA, 15 bp, Homo sapiens
atctttagaaaaggc

SEQ ID NO: 70413 - DNA, 15 bp, Homo sapiens
tctttagaaaaggca

SEQ ID NO: 70414 - DNA, 15 bp, Homo sapiens
ctttagaaaaggcat

SEQ ID NO: 70415 - DNA, 15 bp, Homo sapiens
tttagaaaaggcata

SEQ ID NO: 70416 - DNA, 15 bp, Homo sapiens
ttagaaaaggcatag

SEQ ID NO: 70417 - DNA, 15 bp, Homo sapiens
tagaaaaggcatagt

SEQ ID NO: 70418 - DNA, 15 bp, Homo sapiens
agaaaaggcatagtc

SEQ ID NO: 70419 - DNA, 15 bp, Homo sapiens
gaaaaggcatagtct

SEQ ID NO: 70420 - DNA, 15 bp, Homo sapiens
aaaaggcatagtcta

SEQ ID NO: 70421 - DNA, 15 bp, Homo sapiens
aaaggcatagtctac

SEQ ID NO: 70422 - DNA, 15 bp, Homo sapiens
aaggcatagtctact

SEQ ID NO: 70423 - DNA, 15 bp, Homo sapiens
aggcatagtctactt

SEQ ID NO: 70424 - DNA, 15 bp, Homo sapiens
ggcatagtctacttg

SEQ ID NO: 70425 - DNA, 15 bp, Homo sapiens
gcatagtctacttgt

SEQ ID NO: 70426 - DNA, 15 bp, Homo sapiens
catagtctacttgtt

SEQ ID NO: 70427 - DNA, 15 bp, Homo sapiens
atagtctacttgtta

SEQ ID NO: 70428 - DNA, 15 bp, Homo sapiens
tagtctacttgttat

SEQ ID NO: 70429 - DNA, 15 bp, Homo sapiens
agtctacttgttata

SEQ ID NO: 70430 - DNA, 15 bp, Homo sapiens
gtctacttgttataa

SEQ ID NO: 70431 - DNA, 15 bp, Homo sapiens
tctacttgttataaa

SEQ ID NO: 70432 - DNA, 15 bp, Homo sapiens
ctacttgttataaat

SEQ ID NO: 70433 - DNA, 15 bp, Homo sapiens
tacttgttataaatc

SEQ ID NO: 70434 - DNA, 15 bp, Homo sapiens
acttgttataaatcg

SEQ ID NO: 70435 - DNA, 15 bp, Homo sapiens
cttgttataaatcgt

SEQ ID NO: 70436 - DNA, 15 bp, Homo sapiens
ttgttataaatcgtt

SEQ ID NO: 70437 - DNA, 15 bp, Homo sapiens
tgttataaatcgtta

SEQ ID NO: 70438 - DNA, 15 bp, Homo sapiens
gttataaatcgttag

SEQ ID NO: 70439 - DNA, 15 bp, Homo sapiens
ttataaatcgttagg

SEQ ID NO: 70440 - DNA, 15 bp, Homo sapiens
tataaatcgttagga

SEQ ID NO: 70441 - DNA, 15 bp, Homo sapiens
ataaatcgttaggat

SEQ ID NO: 70442 - DNA, 15 bp, Homo sapiens
taaatcgttaggata

SEQ ID NO: 70443 - DNA, 15 bp, Homo sapiens
aaatcgttaggatac

SEQ ID NO: 70444 - DNA, 15 bp, Homo sapiens
aatcgttaggatact

SEQ ID NO: 70445 - DNA, 15 bp, Homo sapiens
atcgttaggatactg

SEQ ID NO: 70446 - DNA, 15 bp, Homo sapiens
tcgttaggatactgc

SEQ ID NO: 70447 - DNA, 15 bp, Homo sapiens
cgttaggatactgcc

SEQ ID NO: 70448 - DNA, 15 bp, Homo sapiens
gttaggatactgcct

SEQ ID NO: 70449 - DNA, 15 bp, Homo sapiens
ttaggatactgcctc

SEQ ID NO: 70450 - DNA, 15 bp, Homo sapiens
taggatactgcctcc

SEQ ID NO: 70451 - DNA, 15 bp, Homo sapiens
aggatactgcctccc

SEQ ID NO: 70452 - DNA, 15 bp, Homo sapiens
ggatactgcctcccc

SEQ ID NO: 70453 - DNA, 15 bp, Homo sapiens
gatactgcctccccc

SEQ ID NO: 70454 - DNA, 15 bp, Homo sapiens
atactgcctccccca

SEQ ID NO: 70455 - DNA, 15 bp, Homo sapiens
tactgcctcccccag

SEQ ID NO: 70456 - DNA, 15 bp, Homo sapiens
actgcctcccccagg

SEQ ID NO: 70457 - DNA, 15 bp, Homo sapiens
ctgcctcccccaggg

SEQ ID NO: 70458 - DNA, 15 bp, Homo sapiens
tgcctcccccagggt

SEQ ID NO: 70459 - DNA, 15 bp, Homo sapiens
gcctcccccagggtc

SEQ ID NO: 70460 - DNA, 15 bp, Homo sapiens
cctcccccagggtct

SEQ ID NO: 70461 - DNA, 15 bp, Homo sapiens
ctcccccagggtcta

SEQ ID NO: 70462 - DNA, 15 bp, Homo sapiens
tcccccagggtctaa

SEQ ID NO: 70463 - DNA, 15 bp, Homo sapiens
cccccagggtctaaa

SEQ ID NO: 70464 - DNA, 15 bp, Homo sapiens
ccccagggtctaaaa

SEQ ID NO: 70465 - DNA, 15 bp, Homo sapiens
cccagggtctaaaat

SEQ ID NO: 70466 - DNA, 15 bp, Homo sapiens
ccagggtctaaaatt

SEQ ID NO: 70467 - DNA, 15 bp, Homo sapiens
cagggtctaaaatta

SEQ ID NO: 70468 - DNA, 15 bp, Homo sapiens
agggtctaaaattac

SEQ ID NO: 70469 - DNA, 15 bp, Homo sapiens
gggtctaaaattaca

SEQ ID NO: 70470 - DNA, 15 bp, Homo sapiens
ggtctaaaattacat

SEQ ID NO: 70471 - DNA, 15 bp, Homo sapiens
gtctaaaattacata

SEQ ID NO: 70472 - DNA, 15 bp, Homo sapiens
tctaaaattacatat

SEQ ID NO: 70473 - DNA, 15 bp, Homo sapiens
ctaaaattacatatt

SEQ ID NO: 70474 - DNA, 15 bp, Homo sapiens
taaaattacatatta

SEQ ID NO: 70475 - DNA, 15 bp, Homo sapiens
aaaattacatattag

SEQ ID NO: 70476 - DNA, 15 bp, Homo sapiens
aaattacatattaga

SEQ ID NO: 70477 - DNA, 15 bp, Homo sapiens
aattacatattagag

SEQ ID NO: 70478 - DNA, 15 bp, Homo sapiens
attacatattagagg

SEQ ID NO: 70479 - DNA, 15 bp, Homo sapiens
ttacatattagaggg

SEQ ID NO: 70480 - DNA, 15 bp, Homo sapiens
tacatattagagggg

SEQ ID NO: 70481 - DNA, 15 bp, Homo sapiens
acatattagagggga

SEQ ID NO: 70482 - DNA, 15 bp, Homo sapiens
catattagaggggaa

SEQ ID NO: 70483 - DNA, 15 bp, Homo sapiens
atattagaggggaaa

SEQ ID NO: 70484 - DNA, 15 bp, Homo sapiens
tattagaggggaaaa

SEQ ID NO: 70485 - DNA, 15 bp, Homo sapiens
attagaggggaaaag

SEQ ID NO: 70486 - DNA, 15 bp, Homo sapiens
ttagaggggaaaagc

SEQ ID NO: 70487 - DNA, 15 bp, Homo sapiens
tagaggggaaaagct

SEQ ID NO: 70488 - DNA, 15 bp, Homo sapiens
agaggggaaaagctg

SEQ ID NO: 70489 - DNA, 15 bp, Homo sapiens
gaggggaaaagctga

SEQ ID NO: 70490 - DNA, 15 bp, Homo sapiens
aggggaaaagctgaa

SEQ ID NO: 70491 - DNA, 15 bp, Homo sapiens
ggggaaaagctgaac

SEQ ID NO: 70492 - DNA, 15 bp, Homo sapiens
gggaaaagctgaaca

SEQ ID NO: 70493 - DNA, 15 bp, Homo sapiens
ggaaaagctgaacac

SEQ ID NO: 70494 - DNA, 15 bp, Homo sapiens
gaaaagctgaacact

SEQ ID NO: 70495 - DNA, 15 bp, Homo sapiens
aaaagctgaacactg

SEQ ID NO: 70496 - DNA, 15 bp, Homo sapiens
aaagctgaacactga

SEQ ID NO: 70497 - DNA, 15 bp, Homo sapiens
aagctgaacactgaa

SEQ ID NO: 70498 - DNA, 15 bp, Homo sapiens
agctgaacactgaag

SEQ ID NO: 70499 - DNA, 15 bp, Homo sapiens
gctgaacactgaagt

SEQ ID NO: 70500 - DNA, 15 bp, Homo sapiens
ctgaacactgaagtc

SEQ ID NO: 70501 - DNA, 15 bp, Homo sapiens
tgaacactgaagtca

SEQ ID NO: 70502 - DNA, 15 bp, Homo sapiens
gaacactgaagtcag

SEQ ID NO: 70503 - DNA, 15 bp, Homo sapiens
aacactgaagtcagt

SEQ ID NO: 70504 - DNA, 15 bp, Homo sapiens
acactgaagtcagtt

SEQ ID NO: 70505 - DNA, 15 bp, Homo sapiens
cactgaagtcagttc

SEQ ID NO: 70506 - DNA, 15 bp, Homo sapiens
actgaagtcagttct

SEQ ID NO: 70507 - DNA, 15 bp, Homo sapiens
ctgaagtcagttctc

SEQ ID NO: 70508 - DNA, 15 bp, Homo sapiens
tgaagtcagttctca

SEQ ID NO: 70509 - DNA, 15 bp, Homo sapiens
gaagtcagttctcaa

SEQ ID NO: 70510 - DNA, 15 bp, Homo sapiens
aagtcagttctcaac

SEQ ID NO: 70511 - DNA, 15 bp, Homo sapiens
agtcagttctcaaca

SEQ ID NO: 70512 - DNA, 15 bp, Homo sapiens
gtcagttctcaacaa

SEQ ID NO: 70513 - DNA, 15 bp, Homo sapiens
tcagttctcaacaat

SEQ ID NO: 70514 - DNA, 15 bp, Homo sapiens
cagttctcaacaatt

SEQ ID NO: 70515 - DNA, 15 bp, Homo sapiens
agttctcaacaattt

SEQ ID NO: 70516 - DNA, 15 bp, Homo sapiens
gttctcaacaattta

SEQ ID NO: 70517 - DNA, 15 bp, Homo sapiens
ttctcaacaatttag

SEQ ID NO: 70518 - DNA, 15 bp, Homo sapiens
tctcaacaatttaga

SEQ ID NO: 70519 - DNA, 15 bp, Homo sapiens
ctcaacaatttagaa

SEQ ID NO: 70520 - DNA, 15 bp, Homo sapiens
tcaacaatttagaag

SEQ ID NO: 70521 - DNA, 15 bp, Homo sapiens
caacaatttagaagg

SEQ ID NO: 70522 - DNA, 15 bp, Homo sapiens
aacaatttagaagga

SEQ ID NO: 70523 - DNA, 15 bp, Homo sapiens
acaatttagaaggaa

SEQ ID NO: 70524 - DNA, 15 bp, Homo sapiens
caatttagaaggaaa

SEQ ID NO: 70525 - DNA, 15 bp, Homo sapiens
aatttagaaggaaaa

SEQ ID NO: 70526 - DNA, 15 bp, Homo sapiens
atttagaaggaaaac

SEQ ID NO: 70527 - DNA, 15 bp, Homo sapiens
tttagaaggaaaacc

SEQ ID NO: 70528 - DNA, 15 bp, Homo sapiens
ttagaaggaaaacct

SEQ ID NO: 70529 - DNA, 15 bp, Homo sapiens
tagaaggaaaaccta

SEQ ID NO: 70530 - DNA, 15 bp, Homo sapiens
agaaggaaaacctag

SEQ ID NO: 70531 - DNA, 15 bp, Homo sapiens
gaaggaaaacctaga

SEQ ID NO: 70532 - DNA, 15 bp, Homo sapiens
aaggaaaacctagaa

SEQ ID NO: 70533 - DNA, 15 bp, Homo sapiens
aggaaaacctagaaa

SEQ ID NO: 70534 - DNA, 15 bp, Homo sapiens
ggaaaacctagaaaa

SEQ ID NO: 70535 - DNA, 15 bp, Homo sapiens
gaaaacctagaaaac

SEQ ID NO: 70536 - DNA, 15 bp, Homo sapiens
aaaacctagaaaaca

SEQ ID NO: 70537 - DNA, 15 bp, Homo sapiens
aaacctagaaaacat

SEQ ID NO: 70538 - DNA, 15 bp, Homo sapiens
aacctagaaaacatt

SEQ ID NO: 70539 - DNA, 15 bp, Homo sapiens
acctagaaaacattt

SEQ ID NO: 70540 - DNA, 15 bp, Homo sapiens
cctagaaaacatttg

SEQ ID NO: 70541 - DNA, 15 bp, Homo sapiens
ctagaaaacatttgg

SEQ ID NO: 70542 - DNA, 15 bp, Homo sapiens
tagaaaacatttggc

SEQ ID NO: 70543 - DNA, 15 bp, Homo sapiens
agaaaacatttggca

SEQ ID NO: 70544 - DNA, 15 bp, Homo sapiens
gaaaacatttggcag

SEQ ID NO: 70545 - DNA, 15 bp, Homo sapiens
aaaacatttggcaga

SEQ ID NO: 70546 - DNA, 15 bp, Homo sapiens
aaacatttggcagaa

SEQ ID NO: 70547 - DNA, 15 bp, Homo sapiens
aacatttggcagaaa

SEQ ID NO: 70548 - DNA, 15 bp, Homo sapiens
acatttggcagaaaa

SEQ ID NO: 70549 - DNA, 15 bp, Homo sapiens
catttggcagaaaat

SEQ ID NO: 70550 - DNA, 15 bp, Homo sapiens
atttggcagaaaatt

SEQ ID NO: 70551 - DNA, 15 bp, Homo sapiens
tttggcagaaaatta

SEQ ID NO: 70552 - DNA, 15 bp, Homo sapiens
ttggcagaaaattac

SEQ ID NO: 70553 - DNA, 15 bp, Homo sapiens
tggcagaaaattaca

SEQ ID NO: 70554 - DNA, 15 bp, Homo sapiens
ggcagaaaattacat

SEQ ID NO: 70555 - DNA, 15 bp, Homo sapiens
gcagaaaattacatt

SEQ ID NO: 70556 - DNA, 15 bp, Homo sapiens
cagaaaattacattt

SEQ ID NO: 70557 - DNA, 15 bp, Homo sapiens
agaaaattacatttc

SEQ ID NO: 70558 - DNA, 15 bp, Homo sapiens
gaaaattacatttcg

SEQ ID NO: 70559 - DNA, 15 bp, Homo sapiens
aaaattacatttcga

SEQ ID NO: 70560 - DNA, 15 bp, Homo sapiens
aaattacatttcgat

SEQ ID NO: 70561 - DNA, 15 bp, Homo sapiens
aattacatttcgatg

SEQ ID NO: 70562 - DNA, 15 bp, Homo sapiens
attacatttcgatgt

SEQ ID NO: 70563 - DNA, 15 bp, Homo sapiens
ttacatttcgatgtt

SEQ ID NO: 70564 - DNA, 15 bp, Homo sapiens
tacatttcgatgttt

SEQ ID NO: 70565 - DNA, 15 bp, Homo sapiens
acatttcgatgtttt

SEQ ID NO: 70566 - DNA, 15 bp, Homo sapiens
catttcgatgttttt

SEQ ID NO: 70567 - DNA, 15 bp, Homo sapiens
atttcgatgtttttg

SEQ ID NO: 70568 - DNA, 15 bp, Homo sapiens
tttcgatgtttttga

SEQ ID NO: 70569 - DNA, 15 bp, Homo sapiens
ttcgatgtttttgaa

SEQ ID NO: 70570 - DNA, 15 bp, Homo sapiens
tcgatgtttttgaat

SEQ ID NO: 70571 - DNA, 15 bp, Homo sapiens
cgatgtttttgaatg

SEQ ID NO: 70572 - DNA, 15 bp, Homo sapiens
gatgtttttgaatga

SEQ ID NO: 70573 - DNA, 15 bp, Homo sapiens
atgtttttgaatgaa

SEQ ID NO: 70574 - DNA, 15 bp, Homo sapiens
tgtttttgaatgaat

SEQ ID NO: 70575 - DNA, 15 bp, Homo sapiens
gtttttgaatgaata

SEQ ID NO: 70576 - DNA, 15 bp, Homo sapiens
tttttgaatgaatac

SEQ ID NO: 70577 - DNA, 15 bp, Homo sapiens
ttttgaatgaatacg

SEQ ID NO: 70578 - DNA, 15 bp, Homo sapiens
tttgaatgaatacga

SEQ ID NO: 70579 - DNA, 15 bp, Homo sapiens
ttgaatgaatacgag

SEQ ID NO: 70580 - DNA, 15 bp, Homo sapiens
tgaatgaatacgagc

SEQ ID NO: 70581 - DNA, 15 bp, Homo sapiens
gaatgaatacgagca

SEQ ID NO: 70582 - DNA, 15 bp, Homo sapiens
aatgaatacgagcaa

SEQ ID NO: 70583 - DNA, 15 bp, Homo sapiens
atgaatacgagcaag

SEQ ID NO: 70584 - DNA, 15 bp, Homo sapiens
tgaatacgagcaagc

SEQ ID NO: 70585 - DNA, 15 bp, Homo sapiens
gaatacgagcaagct

SEQ ID NO: 70586 - DNA, 15 bp, Homo sapiens
aatacgagcaagctt

SEQ ID NO: 70587 - DNA, 15 bp, Homo sapiens
atacgagcaagcttt

SEQ ID NO: 70588 - DNA, 15 bp, Homo sapiens
tacgagcaagctttt

SEQ ID NO: 70589 - DNA, 15 bp, Homo sapiens
acgagcaagctttta

SEQ ID NO: 70590 - DNA, 15 bp, Homo sapiens
cgagcaagcttttac

SEQ ID NO: 70591 - DNA, 15 bp, Homo sapiens
gagcaagcttttaca

SEQ ID NO: 70592 - DNA, 15 bp, Homo sapiens
agcaagcttttacaa

SEQ ID NO: 70593 - DNA, 15 bp, Homo sapiens
gcaagcttttacaac

SEQ ID NO: 70594 - DNA, 15 bp, Homo sapiens
caagcttttacaaca

SEQ ID NO: 70595 - DNA, 15 bp, Homo sapiens
aagcttttacaacag

SEQ ID NO: 70596 - DNA, 15 bp, Homo sapiens
agcttttacaacagt

SEQ ID NO: 70597 - DNA, 15 bp, Homo sapiens
gcttttacaacagtg

SEQ ID NO: 70598 - DNA, 15 bp, Homo sapiens
cttttacaacagtgc

SEQ ID NO: 70599 - DNA, 15 bp, Homo sapiens
ttttacaacagtgct

SEQ ID NO: 70600 - DNA, 15 bp, Homo sapiens
tttacaacagtgctg

SEQ ID NO: 70601 - DNA, 15 bp, Homo sapiens
ttacaacagtgctga

SEQ ID NO: 70602 - DNA, 15 bp, Homo sapiens
tacaacagtgctgat

SEQ ID NO: 70603 - DNA, 15 bp, Homo sapiens
acaacagtgctgatc

SEQ ID NO: 70604 - DNA, 15 bp, Homo sapiens
caacagtgctgatct

SEQ ID NO: 70605 - DNA, 15 bp, Homo sapiens
aacagtgctgatcta

SEQ ID NO: 70606 - DNA, 15 bp, Homo sapiens
acagtgctgatctaa

SEQ ID NO: 70607 - DNA, 15 bp, Homo sapiens
cagtgctgatctaaa

SEQ ID NO: 70608 - DNA, 15 bp, Homo sapiens
agtgctgatctaaaa

SEQ ID NO: 70609 - DNA, 15 bp, Homo sapiens
gtgctgatctaaaaa

SEQ ID NO: 70610 - DNA, 15 bp, Homo sapiens
tgctgatctaaaaat

SEQ ID NO: 70611 - DNA, 15 bp, Homo sapiens
gctgatctaaaaata

SEQ ID NO: 70612 - DNA, 15 bp, Homo sapiens
ctgatctaaaaatac

SEQ ID NO: 70613 - DNA, 15 bp, Homo sapiens
tgatctaaaaatact

SEQ ID NO: 70614 - DNA, 15 bp, Homo sapiens
gatctaaaaatactt

SEQ ID NO: 70615 - DNA, 15 bp, Homo sapiens
atctaaaaatactta

SEQ ID NO: 70616 - DNA, 15 bp, Homo sapiens
tctaaaaatacttag

SEQ ID NO: 70617 - DNA, 15 bp, Homo sapiens
ctaaaaatacttagc

SEQ ID NO: 70618 - DNA, 15 bp, Homo sapiens
taaaaatacttagca

SEQ ID NO: 70619 - DNA, 15 bp, Homo sapiens
aaaaatacttagcac

SEQ ID NO: 70620 - DNA, 15 bp, Homo sapiens
aaaatacttagcact

SEQ ID NO: 70621 - DNA, 15 bp, Homo sapiens
aaatacttagcactt

SEQ ID NO: 70622 - DNA, 15 bp, Homo sapiens
aatacttagcacttg

SEQ ID NO: 70623 - DNA, 15 bp, Homo sapiens
atacttagcacttgg

SEQ ID NO: 70624 - DNA, 15 bp, Homo sapiens
tacttagcacttggc

SEQ ID NO: 70625 - DNA, 15 bp, Homo sapiens
acttagcacttggcc

SEQ ID NO: 70626 - DNA, 15 bp, Homo sapiens
cttagcacttggcct

SEQ ID NO: 70627 - DNA, 15 bp, Homo sapiens
ttagcacttggcctg

SEQ ID NO: 70628 - DNA, 15 bp, Homo sapiens
tagcacttggcctga

SEQ ID NO: 70629 - DNA, 15 bp, Homo sapiens
agcacttggcctgag

SEQ ID NO: 70630 - DNA, 15 bp, Homo sapiens
gcacttggcctgaga

SEQ ID NO: 70631 - DNA, 15 bp, Homo sapiens
cacttggcctgagat

SEQ ID NO: 70632 - DNA, 15 bp, Homo sapiens
acttggcctgagatg

SEQ ID NO: 70633 - DNA, 15 bp, Homo sapiens
cttggcctgagatgc

SEQ ID NO: 70634 - DNA, 15 bp, Homo sapiens
ttggcctgagatgcc

SEQ ID NO: 70635 - DNA, 15 bp, Homo sapiens
tggcctgagatgcct

SEQ ID NO: 70636 - DNA, 15 bp, Homo sapiens
ggcctgagatgcctg

SEQ ID NO: 70637 - DNA, 15 bp, Homo sapiens
gcctgagatgcctgg

SEQ ID NO: 70638 - DNA, 15 bp, Homo sapiens
cctgagatgcctggt

SEQ ID NO: 70639 - DNA, 15 bp, Homo sapiens
ctgagatgcctggtg

SEQ ID NO: 70640 - DNA, 15 bp, Homo sapiens
tgagatgcctggtga

SEQ ID NO: 70641 - DNA, 15 bp, Homo sapiens
gagatgcctggtgag

SEQ ID NO: 70642 - DNA, 15 bp, Homo sapiens
agatgcctggtgagc

SEQ ID NO: 70643 - DNA, 15 bp, Homo sapiens
gatgcctggtgagca

SEQ ID NO: 70644 - DNA, 15 bp, Homo sapiens
atgcctggtgagcat

SEQ ID NO: 70645 - DNA, 15 bp, Homo sapiens
tgcctggtgagcatt

SEQ ID NO: 70646 - DNA, 15 bp, Homo sapiens
gcctggtgagcatta

SEQ ID NO: 70647 - DNA, 15 bp, Homo sapiens
cctggtgagcattac

SEQ ID NO: 70648 - DNA, 15 bp, Homo sapiens
ctggtgagcattaca

SEQ ID NO: 70649 - DNA, 15 bp, Homo sapiens
tggtgagcattacag

SEQ ID NO: 70650 - DNA, 15 bp, Homo sapiens
ggtgagcattacagg

SEQ ID NO: 70651 - DNA, 15 bp, Homo sapiens
gtgagcattacaggc

SEQ ID NO: 70652 - DNA, 15 bp, Homo sapiens
tgagcattacaggca

SEQ ID NO: 70653 - DNA, 15 bp, Homo sapiens
gagcattacaggcaa

SEQ ID NO: 70654 - DNA, 15 bp, Homo sapiens
agcattacaggcaag

SEQ ID NO: 70655 - DNA, 15 bp, Homo sapiens
gcattacaggcaagg

SEQ ID NO: 70656 - DNA, 15 bp, Homo sapiens
cattacaggcaaggg

SEQ ID NO: 70657 - DNA, 15 bp, Homo sapiens
attacaggcaagggg

SEQ ID NO: 70658 - DNA, 15 bp, Homo sapiens
ttacaggcaagggga

SEQ ID NO: 70659 - DNA, 15 bp, Homo sapiens
tacaggcaaggggaa

SEQ ID NO: 70660 - DNA, 15 bp, Homo sapiens
acaggcaaggggaat

SEQ ID NO: 70661 - DNA, 15 bp, Homo sapiens
caggcaaggggaatc

SEQ ID NO: 70662 - DNA, 15 bp, Homo sapiens
aggcaaggggaatct

SEQ ID NO: 70663 - DNA, 15 bp, Homo sapiens
ggcaaggggaatctg

SEQ ID NO: 70664 - DNA, 15 bp, Homo sapiens
gcaaggggaatctgg

SEQ ID NO: 70665 - DNA, 15 bp, Homo sapiens
caaggggaatctgga

SEQ ID NO: 70666 - DNA, 15 bp, Homo sapiens
aaggggaatctggag

SEQ ID NO: 70667 - DNA, 15 bp, Homo sapiens
aggggaatctggagg

SEQ ID NO: 70668 - DNA, 15 bp, Homo sapiens
ggggaatctggaggt

SEQ ID NO: 70669 - DNA, 15 bp, Homo sapiens
gggaatctggaggta

SEQ ID NO: 70670 - DNA, 15 bp, Homo sapiens
ggaatctggaggtag

SEQ ID NO: 70671 - DNA, 15 bp, Homo sapiens
gaatctggaggtagc

SEQ ID NO: 70672 - DNA, 15 bp, Homo sapiens
aatctggaggtagcc

SEQ ID NO: 70673 - DNA, 15 bp, Homo sapiens
atctggaggtagccg

SEQ ID NO: 70674 - DNA, 15 bp, Homo sapiens
tctggaggtagccga

SEQ ID NO: 70675 - DNA, 15 bp, Homo sapiens
ctggaggtagccgac

SEQ ID NO: 70676 - DNA, 15 bp, Homo sapiens
tggaggtagccgacc

SEQ ID NO: 70677 - DNA, 15 bp, Homo sapiens
ggaggtagccgacct

SEQ ID NO: 70678 - DNA, 15 bp, Homo sapiens
gaggtagccgacctg

SEQ ID NO: 70679 - DNA, 15 bp, Homo sapiens
aggtagccgacctga

SEQ ID NO: 70680 - DNA, 15 bp, Homo sapiens
ggtagccgacctgag

SEQ ID NO: 70681 - DNA, 15 bp, Homo sapiens
gtagccgacctgagg

SEQ ID NO: 70682 - DNA, 15 bp, Homo sapiens
tagccgacctgagga

SEQ ID NO: 70683 - DNA, 15 bp, Homo sapiens
agccgacctgaggac

SEQ ID NO: 70684 - DNA, 15 bp, Homo sapiens
gccgacctgaggaca

SEQ ID NO: 70685 - DNA, 15 bp, Homo sapiens
ccgacctgaggacat

SEQ ID NO: 70686 - DNA, 15 bp, Homo sapiens
cgacctgaggacatg

SEQ ID NO: 70687 - DNA, 15 bp, Homo sapiens
gacctgaggacatgg

SEQ ID NO: 70688 - DNA, 15 bp, Homo sapiens
acctgaggacatggc

SEQ ID NO: 70689 - DNA, 15 bp, Homo sapiens
cctgaggacatggct

SEQ ID NO: 70690 - DNA, 15 bp, Homo sapiens
ctgaggacatggctt

SEQ ID NO: 70691 - DNA, 15 bp, Homo sapiens
tgaggacatggcttc

SEQ ID NO: 70692 - DNA, 15 bp, Homo sapiens
gaggacatggcttct

SEQ ID NO: 70693 - DNA, 15 bp, Homo sapiens
aggacatggcttctg

SEQ ID NO: 70694 - DNA, 15 bp, Homo sapiens
ggacatggcttctga

SEQ ID NO: 70695 - DNA, 15 bp, Homo sapiens
gacatggcttctgaa

SEQ ID NO: 70696 - DNA, 15 bp, Homo sapiens
acatggcttctgaac

SEQ ID NO: 70697 - DNA, 15 bp, Homo sapiens
catggcttctgaacc

SEQ ID NO: 70698 - DNA, 15 bp, Homo sapiens
atggcttctgaacct

SEQ ID NO: 70699 - DNA, 15 bp, Homo sapiens
tggcttctgaacctg

SEQ ID NO: 70700 - DNA, 15 bp, Homo sapiens
ggcttctgaacctgt

SEQ ID NO: 70701 - DNA, 15 bp, Homo sapiens
gcttctgaacctgtc

SEQ ID NO: 70702 - DNA, 15 bp, Homo sapiens
cttctgaacctgtct

SEQ ID NO: 70703 - DNA, 15 bp, Homo sapiens
ttctgaacctgtctt

SEQ ID NO: 70704 - DNA, 15 bp, Homo sapiens
tctgaacctgtcttt

SEQ ID NO: 70705 - DNA, 15 bp, Homo sapiens
ctgaacctgtctttt

SEQ ID NO: 70706 - DNA, 15 bp, Homo sapiens
tgaacctgtcttttg

SEQ ID NO: 70707 - DNA, 15 bp, Homo sapiens
gaacctgtcttttgg

SEQ ID NO: 70708 - DNA, 15 bp, Homo sapiens
aacctgtcttttggg

SEQ ID NO: 70709 - DNA, 15 bp, Homo sapiens
acctgtcttttggga

SEQ ID NO: 70710 - DNA, 15 bp, Homo sapiens
cctgtcttttgggag

SEQ ID NO: 70711 - DNA, 15 bp, Homo sapiens
ctgtcttttgggagt

SEQ ID NO: 70712 - DNA, 15 bp, Homo sapiens
tgtcttttgggagtg

SEQ ID NO: 70713 - DNA, 15 bp, Homo sapiens
gtcttttgggagtgg

SEQ ID NO: 70714 - DNA, 15 bp, Homo sapiens
tcttttgggagtggt

SEQ ID NO: 70715 - DNA, 15 bp, Homo sapiens
cttttgggagtggta

SEQ ID NO: 70716 - DNA, 15 bp, Homo sapiens
ttttgggagtggtat

SEQ ID NO: 70717 - DNA, 15 bp, Homo sapiens
tttgggagtggtatg

SEQ ID NO: 70718 - DNA, 15 bp, Homo sapiens
ttgggagtggtatgg

SEQ ID NO: 70719 - DNA, 15 bp, Homo sapiens
tgggagtggtatgga

SEQ ID NO: 70720 - DNA, 15 bp, Homo sapiens
gggagtggtatggaa

SEQ ID NO: 70721 - DNA, 15 bp, Homo sapiens
ggagtggtatggaag

SEQ ID NO: 70722 - DNA, 15 bp, Homo sapiens
gagtggtatggaagg

SEQ ID NO: 70723 - DNA, 15 bp, Homo sapiens
agtggtatggaaggt

SEQ ID NO: 70724 - DNA, 15 bp, Homo sapiens
gtggtatggaaggtg

SEQ ID NO: 70725 - DNA, 15 bp, Homo sapiens
tggtatggaaggtgg

SEQ ID NO: 70726 - DNA, 15 bp, Homo sapiens
ggtatggaaggtgga

SEQ ID NO: 70727 - DNA, 15 bp, Homo sapiens
gtatggaaggtggag

SEQ ID NO: 70728 - DNA, 15 bp, Homo sapiens
tatggaaggtggagc

SEQ ID NO: 70729 - DNA, 15 bp, Homo sapiens
atggaaggtggagcg

SEQ ID NO: 70730 - DNA, 15 bp, Homo sapiens
tggaaggtggagcgt

SEQ ID NO: 70731 - DNA, 15 bp, Homo sapiens
ggaaggtggagcgtt

SEQ ID NO: 70732 - DNA, 15 bp, Homo sapiens
gaaggtggagcgttc

SEQ ID NO: 70733 - DNA, 15 bp, Homo sapiens
aaggtggagcgttca

SEQ ID NO: 70734 - DNA, 15 bp, Homo sapiens
aggtggagcgttcac

SEQ ID NO: 70735 - DNA, 15 bp, Homo sapiens
ggtggagcgttcacc

SEQ ID NO: 70736 - DNA, 15 bp, Homo sapiens
gtggagcgttcacca

SEQ ID NO: 70737 - DNA, 15 bp, Homo sapiens
tggagcgttcaccag

SEQ ID NO: 70738 - DNA, 15 bp, Homo sapiens
ggagcgttcaccagt

SEQ ID NO: 70739 - DNA, 15 bp, Homo sapiens
gagcgttcaccagtg

SEQ ID NO: 70740 - DNA, 15 bp, Homo sapiens
agcgttcaccagtga

SEQ ID NO: 70741 - DNA, 15 bp, Homo sapiens
gcgttcaccagtgac

SEQ ID NO: 70742 - DNA, 15 bp, Homo sapiens
cgttcaccagtgacc

SEQ ID NO: 70743 - DNA, 15 bp, Homo sapiens
gttcaccagtgacct

SEQ ID NO: 70744 - DNA, 15 bp, Homo sapiens
ttcaccagtgacctg

SEQ ID NO: 70745 - DNA, 15 bp, Homo sapiens
tcaccagtgacctgg

SEQ ID NO: 70746 - DNA, 15 bp, Homo sapiens
caccagtgacctgga

SEQ ID NO: 70747 - DNA, 15 bp, Homo sapiens
accagtgacctggaa

SEQ ID NO: 70748 - DNA, 15 bp, Homo sapiens
ccagtgacctggaag

SEQ ID NO: 70749 - DNA, 15 bp, Homo sapiens
cagtgacctggaagg

SEQ ID NO: 70750 - DNA, 15 bp, Homo sapiens
agtgacctggaaggc

SEQ ID NO: 70751 - DNA, 15 bp, Homo sapiens
gtgacctggaaggcc

SEQ ID NO: 70752 - DNA, 15 bp, Homo sapiens
tgacctggaaggccc

SEQ ID NO: 70753 - DNA, 15 bp, Homo sapiens
gacctggaaggccca

SEQ ID NO: 70754 - DNA, 15 bp, Homo sapiens
acctggaaggcccag

SEQ ID NO: 70755 - DNA, 15 bp, Homo sapiens
cctggaaggcccagc

SEQ ID NO: 70756 - DNA, 15 bp, Homo sapiens
ctggaaggcccagca

SEQ ID NO: 70757 - DNA, 15 bp, Homo sapiens
tggaaggcccagcac

SEQ ID NO: 70758 - DNA, 15 bp, Homo sapiens
ggaaggcccagcacc

SEQ ID NO: 70759 - DNA, 15 bp, Homo sapiens
gaaggcccagcacca

SEQ ID NO: 70760 - DNA, 15 bp, Homo sapiens
aaggcccagcaccac

SEQ ID NO: 70761 - DNA, 15 bp, Homo sapiens
aggcccagcaccacc

SEQ ID NO: 70762 - DNA, 15 bp, Homo sapiens
ggcccagcaccaccc

SEQ ID NO: 70763 - DNA, 15 bp, Homo sapiens
gcccagcaccaccct

SEQ ID NO: 70764 - DNA, 15 bp, Homo sapiens
cccagcaccaccctc

SEQ ID NO: 70765 - DNA, 15 bp, Homo sapiens
ccagcaccaccctcc

SEQ ID NO: 70766 - DNA, 15 bp, Homo sapiens
cagcaccaccctcct

SEQ ID NO: 70767 - DNA, 15 bp, Homo sapiens
agcaccaccctcctt

SEQ ID NO: 70768 - DNA, 15 bp, Homo sapiens
gcaccaccctccttc

SEQ ID NO: 70769 - DNA, 15 bp, Homo sapiens
caccaccctccttcc

SEQ ID NO: 70770 - DNA, 15 bp, Homo sapiens
accaccctccttccc

SEQ ID NO: 70771 - DNA, 15 bp, Homo sapiens
ccaccctccttccca

SEQ ID NO: 70772 - DNA, 15 bp, Homo sapiens
caccctccttcccac

SEQ ID NO: 70773 - DNA, 15 bp, Homo sapiens
accctccttcccact

SEQ ID NO: 70774 - DNA, 15 bp, Homo sapiens
ccctccttcccactc

SEQ ID NO: 70775 - DNA, 15 bp, Homo sapiens
cctccttcccactct

SEQ ID NO: 70776 - DNA, 15 bp, Homo sapiens
ctccttcccactctt

SEQ ID NO: 70777 - DNA, 15 bp, Homo sapiens
tccttcccactcttc

SEQ ID NO: 70778 - DNA, 15 bp, Homo sapiens
ccttcccactcttct

SEQ ID NO: 70779 - DNA, 15 bp, Homo sapiens
cttcccactcttctc

SEQ ID NO: 70780 - DNA, 15 bp, Homo sapiens
ttcccactcttctca

SEQ ID NO: 70781 - DNA, 15 bp, Homo sapiens
tcccactcttctcat

SEQ ID NO: 70782 - DNA, 15 bp, Homo sapiens
cccactcttctcatc

SEQ ID NO: 70783 - DNA, 15 bp, Homo sapiens
ccactcttctcatct

SEQ ID NO: 70784 - DNA, 15 bp, Homo sapiens
cactcttctcatctt

SEQ ID NO: 70785 - DNA, 15 bp, Homo sapiens
actcttctcatcttg

SEQ ID NO: 70786 - DNA, 15 bp, Homo sapiens
ctcttctcatcttga

SEQ ID NO: 70787 - DNA, 15 bp, Homo sapiens
tcttctcatcttgac

SEQ ID NO: 70788 - DNA, 15 bp, Homo sapiens
cttctcatcttgaca

SEQ ID NO: 70789 - DNA, 15 bp, Homo sapiens
ttctcatcttgacag

SEQ ID NO: 70790 - DNA, 15 bp, Homo sapiens
tctcatcttgacaga

SEQ ID NO: 70791 - DNA, 15 bp, Homo sapiens
ctcatcttgacagag

SEQ ID NO: 70792 - DNA, 15 bp, Homo sapiens
tcatcttgacagagc

SEQ ID NO: 70793 - DNA, 15 bp, Homo sapiens
catcttgacagagcc

SEQ ID NO: 70794 - DNA, 15 bp, Homo sapiens
atcttgacagagcct

SEQ ID NO: 70795 - DNA, 15 bp, Homo sapiens
tcttgacagagcctg

SEQ ID NO: 70796 - DNA, 15 bp, Homo sapiens
cttgacagagcctgc

SEQ ID NO: 70797 - DNA, 15 bp, Homo sapiens
ttgacagagcctgcc

SEQ ID NO: 70798 - DNA, 15 bp, Homo sapiens
tgacagagcctgccc

SEQ ID NO: 70799 - DNA, 15 bp, Homo sapiens
gacagagcctgcccc

SEQ ID NO: 70800 - DNA, 15 bp, Homo sapiens
acagagcctgcccca

SEQ ID NO: 70801 - DNA, 15 bp, Homo sapiens
cagagcctgccccag

SEQ ID NO: 70802 - DNA, 15 bp, Homo sapiens
agagcctgccccagc

SEQ ID NO: 70803 - DNA, 15 bp, Homo sapiens
gagcctgccccagcg

SEQ ID NO: 70804 - DNA, 15 bp, Homo sapiens
agcctgccccagcgc

SEQ ID NO: 70805 - DNA, 15 bp, Homo sapiens
gcctgccccagcgct

SEQ ID NO: 70806 - DNA, 15 bp, Homo sapiens
cctgccccagcgctg

SEQ ID NO: 70807 - DNA, 15 bp, Homo sapiens
ctgccccagcgctga

SEQ ID NO: 70808 - DNA, 15 bp, Homo sapiens
tgccccagcgctgac

SEQ ID NO: 70809 - DNA, 15 bp, Homo sapiens
gccccagcgctgacg

SEQ ID NO: 70810 - DNA, 15 bp, Homo sapiens
ccccagcgctgacgt

SEQ ID NO: 70811 - DNA, 15 bp, Homo sapiens
cccagcgctgacgtg

SEQ ID NO: 70812 - DNA, 15 bp, Homo sapiens
ccagcgctgacgtgt

SEQ ID NO: 70813 - DNA, 15 bp, Homo sapiens
cagcgctgacgtgtc

SEQ ID NO: 70814 - DNA, 15 bp, Homo sapiens
agcgctgacgtgtca

SEQ ID NO: 70815 - DNA, 15 bp, Homo sapiens
gcgctgacgtgtcag

SEQ ID NO: 70816 - DNA, 15 bp, Homo sapiens
cgctgacgtgtcagg

SEQ ID NO: 70817 - DNA, 15 bp, Homo sapiens
gctgacgtgtcagga

SEQ ID NO: 70818 - DNA, 15 bp, Homo sapiens
ctgacgtgtcaggaa

SEQ ID NO: 70819 - DNA, 15 bp, Homo sapiens
tgacgtgtcaggaaa

SEQ ID NO: 70820 - DNA, 15 bp, Homo sapiens
gacgtgtcaggaaaa

SEQ ID NO: 70821 - DNA, 15 bp, Homo sapiens
acgtgtcaggaaaac

SEQ ID NO: 70822 - DNA, 15 bp, Homo sapiens
cgtgtcaggaaaaca

SEQ ID NO: 70823 - DNA, 15 bp, Homo sapiens
gtgtcaggaaaacac

SEQ ID NO: 70824 - DNA, 15 bp, Homo sapiens
tgtcaggaaaacacc

SEQ ID NO: 70825 - DNA, 15 bp, Homo sapiens
gtcaggaaaacaccc

SEQ ID NO: 70826 - DNA, 15 bp, Homo sapiens
tcaggaaaacaccca

SEQ ID NO: 70827 - DNA, 15 bp, Homo sapiens
caggaaaacacccag

SEQ ID NO: 70828 - DNA, 15 bp, Homo sapiens
aggaaaacacccagg

SEQ ID NO: 70829 - DNA, 15 bp, Homo sapiens
ggaaaacacccaggg

SEQ ID NO: 70830 - DNA, 15 bp, Homo sapiens
gaaaacacccaggga

SEQ ID NO: 70831 - DNA, 15 bp, Homo sapiens
aaaacacccagggaa

SEQ ID NO: 70832 - DNA, 15 bp, Homo sapiens
aaacacccagggaac

SEQ ID NO: 70833 - DNA, 15 bp, Homo sapiens
aacacccagggaact

SEQ ID NO: 70834 - DNA, 15 bp, Homo sapiens
acacccagggaacta

SEQ ID NO: 70835 - DNA, 15 bp, Homo sapiens
cacccagggaactag

SEQ ID NO: 70836 - DNA, 15 bp, Homo sapiens
acccagggaactagg

SEQ ID NO: 70837 - DNA, 15 bp, Homo sapiens
cccagggaactagga

SEQ ID NO: 70838 - DNA, 15 bp, Homo sapiens
ccagggaactaggaa

SEQ ID NO: 70839 - DNA, 15 bp, Homo sapiens
cagggaactaggaag

SEQ ID NO: 70840 - DNA, 15 bp, Homo sapiens
agggaactaggaagg

SEQ ID NO: 70841 - DNA, 15 bp, Homo sapiens
gggaactaggaaggc

SEQ ID NO: 70842 - DNA, 15 bp, Homo sapiens
ggaactaggaaggca

SEQ ID NO: 70843 - DNA, 15 bp, Homo sapiens
gaactaggaaggcac

SEQ ID NO: 70844 - DNA, 15 bp, Homo sapiens
aactaggaaggcact

SEQ ID NO: 70845 - DNA, 15 bp, Homo sapiens
actaggaaggcactt

SEQ ID NO: 70846 - DNA, 15 bp, Homo sapiens
ctaggaaggcacttc

SEQ ID NO: 70847 - DNA, 15 bp, Homo sapiens
taggaaggcacttct

SEQ ID NO: 70848 - DNA, 15 bp, Homo sapiens
aggaaggcacttctg

SEQ ID NO: 70849 - DNA, 15 bp, Homo sapiens
ggaaggcacttctgc

SEQ ID NO: 70850 - DNA, 15 bp, Homo sapiens
gaaggcacttctgcc

SEQ ID NO: 70851 - DNA, 15 bp, Homo sapiens
aaggcacttctgcct

SEQ ID NO: 70852 - DNA, 15 bp, Homo sapiens
aggcacttctgcctg

SEQ ID NO: 70853 - DNA, 15 bp, Homo sapiens
ggcacttctgcctga

SEQ ID NO: 70854 - DNA, 15 bp, Homo sapiens
gcacttctgcctgag

SEQ ID NO: 70855 - DNA, 15 bp, Homo sapiens
cacttctgcctgagg

SEQ ID NO: 70856 - DNA, 15 bp, Homo sapiens
acttctgcctgaggg

SEQ ID NO: 70857 - DNA, 15 bp, Homo sapiens
cttctgcctgagggg

SEQ ID NO: 70858 - DNA, 15 bp, Homo sapiens
ttctgcctgaggggc

SEQ ID NO: 70859 - DNA, 15 bp, Homo sapiens
tctgcctgaggggca

SEQ ID NO: 70860 - DNA, 15 bp, Homo sapiens
ctgcctgaggggcag

SEQ ID NO: 70861 - DNA, 15 bp, Homo sapiens
tgcctgaggggcagc

SEQ ID NO: 70862 - DNA, 15 bp, Homo sapiens
gcctgaggggcagcc

SEQ ID NO: 70863 - DNA, 15 bp, Homo sapiens
cctgaggggcagcct

SEQ ID NO: 70864 - DNA, 15 bp, Homo sapiens
ctgaggggcagcctg

SEQ ID NO: 70865 - DNA, 15 bp, Homo sapiens
tgaggggcagcctgc

SEQ ID NO: 70866 - DNA, 15 bp, Homo sapiens
gaggggcagcctgcc

SEQ ID NO: 70867 - DNA, 15 bp, Homo sapiens
aggggcagcctgcct

SEQ ID NO: 70868 - DNA, 15 bp, Homo sapiens
ggggcagcctgcctt

SEQ ID NO: 70869 - DNA, 15 bp, Homo sapiens
gggcagcctgccttg

SEQ ID NO: 70870 - DNA, 15 bp, Homo sapiens
ggcagcctgccttgc

SEQ ID NO: 70871 - DNA, 15 bp, Homo sapiens
gcagcctgccttgcc

SEQ ID NO: 70872 - DNA, 15 bp, Homo sapiens
cagcctgccttgccc

SEQ ID NO: 70873 - DNA, 15 bp, Homo sapiens
agcctgccttgccca

SEQ ID NO: 70874 - DNA, 15 bp, Homo sapiens
gcctgccttgcccac

SEQ ID NO: 70875 - DNA, 15 bp, Homo sapiens
cctgccttgcccact

SEQ ID NO: 70876 - DNA, 15 bp, Homo sapiens
ctgccttgcccactc

SEQ ID NO: 70877 - DNA, 15 bp, Homo sapiens
tgccttgcccactcc

SEQ ID NO: 70878 - DNA, 15 bp, Homo sapiens
gccttgcccactcct

SEQ ID NO: 70879 - DNA, 15 bp, Homo sapiens
ccttgcccactcctg

SEQ ID NO: 70880 - DNA, 15 bp, Homo sapiens
cttgcccactcctgc

SEQ ID NO: 70881 - DNA, 15 bp, Homo sapiens
ttgcccactcctgct

SEQ ID NO: 70882 - DNA, 15 bp, Homo sapiens
tgcccactcctgctc

SEQ ID NO: 70883 - DNA, 15 bp, Homo sapiens
gcccactcctgctct

SEQ ID NO: 70884 - DNA, 15 bp, Homo sapiens
cccactcctgctctg

SEQ ID NO: 70885 - DNA, 15 bp, Homo sapiens
ccactcctgctctgc

SEQ ID NO: 70886 - DNA, 15 bp, Homo sapiens
cactcctgctctgct

SEQ ID NO: 70887 - DNA, 15 bp, Homo sapiens
actcctgctctgctc

SEQ ID NO: 70888 - DNA, 15 bp, Homo sapiens
ctcctgctctgctcg

SEQ ID NO: 70889 - DNA, 15 bp, Homo sapiens
tcctgctctgctcgc

SEQ ID NO: 70890 - DNA, 15 bp, Homo sapiens
cctgctctgctcgcc

SEQ ID NO: 70891 - DNA, 15 bp, Homo sapiens
ctgctctgctcgcct

SEQ ID NO: 70892 - DNA, 15 bp, Homo sapiens
tgctctgctcgcctc

SEQ ID NO: 70893 - DNA, 15 bp, Homo sapiens
gctctgctcgcctcg

SEQ ID NO: 70894 - DNA, 15 bp, Homo sapiens
ctctgctcgcctcgg

SEQ ID NO: 70895 - DNA, 15 bp, Homo sapiens
tctgctcgcctcgga

SEQ ID NO: 70896 - DNA, 15 bp, Homo sapiens
ctgctcgcctcggat

SEQ ID NO: 70897 - DNA, 15 bp, Homo sapiens
tgctcgcctcggatc

SEQ ID NO: 70898 - DNA, 15 bp, Homo sapiens
gctcgcctcggatca

SEQ ID NO: 70899 - DNA, 15 bp, Homo sapiens
ctcgcctcggatcag

SEQ ID NO: 70900 - DNA, 15 bp, Homo sapiens
tcgcctcggatcagc

SEQ ID NO: 70901 - DNA, 15 bp, Homo sapiens
cgcctcggatcagct

SEQ ID NO: 70902 - DNA, 15 bp, Homo sapiens
gcctcggatcagctg

SEQ ID NO: 70903 - DNA, 15 bp, Homo sapiens
cctcggatcagctga

SEQ ID NO: 70904 - DNA, 15 bp, Homo sapiens
ctcggatcagctgag

SEQ ID NO: 70905 - DNA, 15 bp, Homo sapiens
tcggatcagctgagc

SEQ ID NO: 70906 - DNA, 15 bp, Homo sapiens
cggatcagctgagcc

SEQ ID NO: 70907 - DNA, 15 bp, Homo sapiens
ggatcagctgagcct

SEQ ID NO: 70908 - DNA, 15 bp, Homo sapiens
gatcagctgagcctt

SEQ ID NO: 70909 - DNA, 15 bp, Homo sapiens
atcagctgagccttc

SEQ ID NO: 70910 - DNA, 15 bp, Homo sapiens
tcagctgagccttct

SEQ ID NO: 70911 - DNA, 15 bp, Homo sapiens
cagctgagccttctg

SEQ ID NO: 70912 - DNA, 15 bp, Homo sapiens
agctgagccttctga

SEQ ID NO: 70913 - DNA, 15 bp, Homo sapiens
gctgagccttctgag

SEQ ID NO: 70914 - DNA, 15 bp, Homo sapiens
ctgagccttctgagc

SEQ ID NO: 70915 - DNA, 15 bp, Homo sapiens
tgagccttctgagct

SEQ ID NO: 70916 - DNA, 15 bp, Homo sapiens
gagccttctgagctg

SEQ ID NO: 70917 - DNA, 15 bp, Homo sapiens
agccttctgagctgg

SEQ ID NO: 70918 - DNA, 15 bp, Homo sapiens
gccttctgagctggc

SEQ ID NO: 70919 - DNA, 15 bp, Homo sapiens
ccttctgagctggcc

SEQ ID NO: 70920 - DNA, 15 bp, Homo sapiens
cttctgagctggcct

SEQ ID NO: 70921 - DNA, 15 bp, Homo sapiens
ttctgagctggcctc

SEQ ID NO: 70922 - DNA, 15 bp, Homo sapiens
tctgagctggcctct

SEQ ID NO: 70923 - DNA, 15 bp, Homo sapiens
ctgagctggcctctc

SEQ ID NO: 70924 - DNA, 15 bp, Homo sapiens
tgagctggcctctca

SEQ ID NO: 70925 - DNA, 15 bp, Homo sapiens
gagctggcctctcac

SEQ ID NO: 70926 - DNA, 15 bp, Homo sapiens
agctggcctctcact

SEQ ID NO: 70927 - DNA, 15 bp, Homo sapiens
gctggcctctcactg

SEQ ID NO: 70928 - DNA, 15 bp, Homo sapiens
ctggcctctcactgc

SEQ ID NO: 70929 - DNA, 15 bp, Homo sapiens
tggcctctcactgcc

SEQ ID NO: 70930 - DNA, 15 bp, Homo sapiens
ggcctctcactgcct

SEQ ID NO: 70931 - DNA, 15 bp, Homo sapiens
gcctctcactgcctc

SEQ ID NO: 70932 - DNA, 15 bp, Homo sapiens
cctctcactgcctcc

SEQ ID NO: 70933 - DNA, 15 bp, Homo sapiens
ctctcactgcctccc

SEQ ID NO: 70934 - DNA, 15 bp, Homo sapiens
tctcactgcctcccc

SEQ ID NO: 70935 - DNA, 15 bp, Homo sapiens
ctcactgcctcccca

SEQ ID NO: 70936 - DNA, 15 bp, Homo sapiens
tcactgcctccccaa

SEQ ID NO: 70937 - DNA, 15 bp, Homo sapiens
cactgcctccccaag

SEQ ID NO: 70938 - DNA, 15 bp, Homo sapiens
actgcctccccaagg

SEQ ID NO: 70939 - DNA, 15 bp, Homo sapiens
ctgcctccccaaggc

SEQ ID NO: 70940 - DNA, 15 bp, Homo sapiens
tgcctccccaaggcc

SEQ ID NO: 70941 - DNA, 15 bp, Homo sapiens
gcctccccaaggccc

SEQ ID NO: 70942 - DNA, 15 bp, Homo sapiens
cctccccaaggcccc

SEQ ID NO: 70943 - DNA, 15 bp, Homo sapiens
ctccccaaggccccc

SEQ ID NO: 70944 - DNA, 15 bp, Homo sapiens
tccccaaggccccct

SEQ ID NO: 70945 - DNA, 15 bp, Homo sapiens
ccccaaggccccctg

SEQ ID NO: 70946 - DNA, 15 bp, Homo sapiens
cccaaggccccctgc

SEQ ID NO: 70947 - DNA, 15 bp, Homo sapiens
ccaaggccccctgcc

SEQ ID NO: 70948 - DNA, 15 bp, Homo sapiens
caaggccccctgcct

SEQ ID NO: 70949 - DNA, 15 bp, Homo sapiens
aaggccccctgcctg

SEQ ID NO: 70950 - DNA, 15 bp, Homo sapiens
aggccccctgcctgc

SEQ ID NO: 70951 - DNA, 15 bp, Homo sapiens
ggccccctgcctgcc

SEQ ID NO: 70952 - DNA, 15 bp, Homo sapiens
gccccctgcctgccc

SEQ ID NO: 70953 - DNA, 15 bp, Homo sapiens
ccccctgcctgccct

SEQ ID NO: 70954 - DNA, 15 bp, Homo sapiens
cccctgcctgccctg

SEQ ID NO: 70955 - DNA, 15 bp, Homo sapiens
ccctgcctgccctgt

SEQ ID NO: 70956 - DNA, 15 bp, Homo sapiens
cctgcctgccctgtc

SEQ ID NO: 70957 - DNA, 15 bp, Homo sapiens
ctgcctgccctgtca

SEQ ID NO: 70958 - DNA, 15 bp, Homo sapiens
tgcctgccctgtcag

SEQ ID NO: 70959 - DNA, 15 bp, Homo sapiens
gcctgccctgtcagg

SEQ ID NO: 70960 - DNA, 15 bp, Homo sapiens
cctgccctgtcagga

SEQ ID NO: 70961 - DNA, 15 bp, Homo sapiens
ctgccctgtcaggag

SEQ ID NO: 70962 - DNA, 15 bp, Homo sapiens
tgccctgtcaggagg

SEQ ID NO: 70963 - DNA, 15 bp, Homo sapiens
gccctgtcaggaggc

SEQ ID NO: 70964 - DNA, 15 bp, Homo sapiens
ccctgtcaggaggca

SEQ ID NO: 70965 - DNA, 15 bp, Homo sapiens
cctgtcaggaggcag

SEQ ID NO: 70966 - DNA, 15 bp, Homo sapiens
ctgtcaggaggcaga

SEQ ID NO: 70967 - DNA, 15 bp, Homo sapiens
tgtcaggaggcagaa

SEQ ID NO: 70968 - DNA, 15 bp, Homo sapiens
gtcaggaggcagaag

SEQ ID NO: 70969 - DNA, 15 bp, Homo sapiens
tcaggaggcagaagg

SEQ ID NO: 70970 - DNA, 15 bp, Homo sapiens
caggaggcagaagga

SEQ ID NO: 70971 - DNA, 15 bp, Homo sapiens
aggaggcagaaggaa

SEQ ID NO: 70972 - DNA, 15 bp, Homo sapiens
ggaggcagaaggaag

SEQ ID NO: 70973 - DNA, 15 bp, Homo sapiens
gaggcagaaggaagc

SEQ ID NO: 70974 - DNA, 15 bp, Homo sapiens
aggcagaaggaagca

SEQ ID NO: 70975 - DNA, 15 bp, Homo sapiens
ggcagaaggaagcag

SEQ ID NO: 70976 - DNA, 15 bp, Homo sapiens
gcagaaggaagcagg

SEQ ID NO: 70977 - DNA, 15 bp, Homo sapiens
cagaaggaagcaggt

SEQ ID NO: 70978 - DNA, 15 bp, Homo sapiens
agaaggaagcaggtg

SEQ ID NO: 70979 - DNA, 15 bp, Homo sapiens
gaaggaagcaggtgt

SEQ ID NO: 70980 - DNA, 15 bp, Homo sapiens
aaggaagcaggtgtg

SEQ ID NO: 70981 - DNA, 15 bp, Homo sapiens
aggaagcaggtgtga

SEQ ID NO: 70982 - DNA, 15 bp, Homo sapiens
ggaagcaggtgtgag

SEQ ID NO: 70983 - DNA, 15 bp, Homo sapiens
gaagcaggtgtgagg

SEQ ID NO: 70984 - DNA, 15 bp, Homo sapiens
aagcaggtgtgaggg

SEQ ID NO: 70985 - DNA, 15 bp, Homo sapiens
agcaggtgtgagggc

SEQ ID NO: 70986 - DNA, 15 bp, Homo sapiens
gcaggtgtgagggca

SEQ ID NO: 70987 - DNA, 15 bp, Homo sapiens
caggtgtgagggcag

SEQ ID NO: 70988 - DNA, 15 bp, Homo sapiens
aggtgtgagggcagt

SEQ ID NO: 70989 - DNA, 15 bp, Homo sapiens
ggtgtgagggcagtg

SEQ ID NO: 70990 - DNA, 15 bp, Homo sapiens
gtgtgagggcagtgc

SEQ ID NO: 70991 - DNA, 15 bp, Homo sapiens
tgtgagggcagtgca

SEQ ID NO: 70992 - DNA, 15 bp, Homo sapiens
gtgagggcagtgcaa

SEQ ID NO: 70993 - DNA, 15 bp, Homo sapiens
tgagggcagtgcaag

SEQ ID NO: 70994 - DNA, 15 bp, Homo sapiens
gagggcagtgcaagg

SEQ ID NO: 70995 - DNA, 15 bp, Homo sapiens
agggcagtgcaagga

SEQ ID NO: 70996 - DNA, 15 bp, Homo sapiens
gggcagtgcaaggag

SEQ ID NO: 70997 - DNA, 15 bp, Homo sapiens
ggcagtgcaaggagg

SEQ ID NO: 70998 - DNA, 15 bp, Homo sapiens
gcagtgcaaggaggg

SEQ ID NO: 70999 - DNA, 15 bp, Homo sapiens
cagtgcaaggaggga

SEQ ID NO: 71000 - DNA, 15 bp, Homo sapiens
agtgcaaggagggag

SEQ ID NO: 71001 - DNA, 15 bp, Homo sapiens
gtgcaaggagggagc

SEQ ID NO: 71002 - DNA, 15 bp, Homo sapiens
tgcaaggagggagca

SEQ ID NO: 71003 - DNA, 15 bp, Homo sapiens
gcaaggagggagcac

SEQ ID NO: 71004 - DNA, 15 bp, Homo sapiens
caaggagggagcaca

SEQ ID NO: 71005 - DNA, 15 bp, Homo sapiens
aaggagggagcacaa

SEQ ID NO: 71006 - DNA, 15 bp, Homo sapiens
aggagggagcacaac

SEQ ID NO: 71007 - DNA, 15 bp, Homo sapiens
ggagggagcacaacc

SEQ ID NO: 71008 - DNA, 15 bp, Homo sapiens
gagggagcacaaccc

SEQ ID NO: 71009 - DNA, 15 bp, Homo sapiens
agggagcacaacccc

SEQ ID NO: 71010 - DNA, 15 bp, Homo sapiens
gggagcacaaccccc

SEQ ID NO: 71011 - DNA, 15 bp, Homo sapiens
ggagcacaaccccca

SEQ ID NO: 71012 - DNA, 15 bp, Homo sapiens
gagcacaacccccag

SEQ ID NO: 71013 - DNA, 15 bp, Homo sapiens
agcacaacccccagc

SEQ ID NO: 71014 - DNA, 15 bp, Homo sapiens
gcacaacccccagct

SEQ ID NO: 71015 - DNA, 15 bp, Homo sapiens
cacaacccccagctc

SEQ ID NO: 71016 - DNA, 15 bp, Homo sapiens
acaacccccagctcc

SEQ ID NO: 71017 - DNA, 15 bp, Homo sapiens
caacccccagctccc

SEQ ID NO: 71018 - DNA, 15 bp, Homo sapiens
aacccccagctcccg

SEQ ID NO: 71019 - DNA, 15 bp, Homo sapiens
acccccagctcccgc

SEQ ID NO: 71020 - DNA, 15 bp, Homo sapiens
cccccagctcccgct

SEQ ID NO: 71021 - DNA, 15 bp, Homo sapiens
ccccagctcccgctc

SEQ ID NO: 71022 - DNA, 15 bp, Homo sapiens
cccagctcccgctcc

SEQ ID NO: 71023 - DNA, 15 bp, Homo sapiens
ccagctcccgctccg

SEQ ID NO: 71024 - DNA, 15 bp, Homo sapiens
cagctcccgctccgg

SEQ ID NO: 71025 - DNA, 15 bp, Homo sapiens
agctcccgctccggg

SEQ ID NO: 71026 - DNA, 15 bp, Homo sapiens
gctcccgctccgggc

SEQ ID NO: 71027 - DNA, 15 bp, Homo sapiens
ctcccgctccgggct

SEQ ID NO: 71028 - DNA, 15 bp, Homo sapiens
tcccgctccgggctc

SEQ ID NO: 71029 - DNA, 15 bp, Homo sapiens
cccgctccgggctcc

SEQ ID NO: 71030 - DNA, 15 bp, Homo sapiens
ccgctccgggctccg

SEQ ID NO: 71031 - DNA, 15 bp, Homo sapiens
cgctccgggctccga

SEQ ID NO: 71032 - DNA, 15 bp, Homo sapiens
gctccgggctccgac

SEQ ID NO: 71033 - DNA, 15 bp, Homo sapiens
ctccgggctccgact

SEQ ID NO: 71034 - DNA, 15 bp, Homo sapiens
tccgggctccgactt

SEQ ID NO: 71035 - DNA, 15 bp, Homo sapiens
ccgggctccgacttg

SEQ ID NO: 71036 - DNA, 15 bp, Homo sapiens
cgggctccgacttgt

SEQ ID NO: 71037 - DNA, 15 bp, Homo sapiens
gggctccgacttgtg

SEQ ID NO: 71038 - DNA, 15 bp, Homo sapiens
ggctccgacttgtgc

SEQ ID NO: 71039 - DNA, 15 bp, Homo sapiens
gctccgacttgtgca

SEQ ID NO: 71040 - DNA, 15 bp, Homo sapiens
ctccgacttgtgcac

SEQ ID NO: 71041 - DNA, 15 bp, Homo sapiens
tccgacttgtgcaca

SEQ ID NO: 71042 - DNA, 15 bp, Homo sapiens
ccgacttgtgcacag

SEQ ID NO: 71043 - DNA, 15 bp, Homo sapiens
cgacttgtgcacagg

SEQ ID NO: 71044 - DNA, 15 bp, Homo sapiens
gacttgtgcacaggc

SEQ ID NO: 71045 - DNA, 15 bp, Homo sapiens
acttgtgcacaggca

SEQ ID NO: 71046 - DNA, 15 bp, Homo sapiens
cttgtgcacaggcag

SEQ ID NO: 71047 - DNA, 15 bp, Homo sapiens
ttgtgcacaggcaga

SEQ ID NO: 71048 - DNA, 15 bp, Homo sapiens
tgtgcacaggcagag

SEQ ID NO: 71049 - DNA, 15 bp, Homo sapiens
gtgcacaggcagagc

SEQ ID NO: 71050 - DNA, 15 bp, Homo sapiens
tgcacaggcagagcc

SEQ ID NO: 71051 - DNA, 15 bp, Homo sapiens
gcacaggcagagccc

SEQ ID NO: 71052 - DNA, 15 bp, Homo sapiens
cacaggcagagccca

SEQ ID NO: 71053 - DNA, 15 bp, Homo sapiens
acaggcagagcccag

SEQ ID NO: 71054 - DNA, 15 bp, Homo sapiens
caggcagagcccaga

SEQ ID NO: 71055 - DNA, 15 bp, Homo sapiens
aggcagagcccagac

SEQ ID NO: 71056 - DNA, 15 bp, Homo sapiens
ggcagagcccagacc

SEQ ID NO: 71057 - DNA, 15 bp, Homo sapiens
gcagagcccagaccc

SEQ ID NO: 71058 - DNA, 15 bp, Homo sapiens
cagagcccagaccct

SEQ ID NO: 71059 - DNA, 15 bp, Homo sapiens
agagcccagaccctg

SEQ ID NO: 71060 - DNA, 15 bp, Homo sapiens
gagcccagaccctgg

SEQ ID NO: 71061 - DNA, 15 bp, Homo sapiens
agcccagaccctgga

SEQ ID NO: 71062 - DNA, 15 bp, Homo sapiens
gcccagaccctggag

SEQ ID NO: 71063 - DNA, 15 bp, Homo sapiens
cccagaccctggagg

SEQ ID NO: 71064 - DNA, 15 bp, Homo sapiens
ccagaccctggagga

SEQ ID NO: 71065 - DNA, 15 bp, Homo sapiens
cagaccctggaggaa

SEQ ID NO: 71066 - DNA, 15 bp, Homo sapiens
agaccctggaggaaa

SEQ ID NO: 71067 - DNA, 15 bp, Homo sapiens
gaccctggaggaaat

SEQ ID NO: 71068 - DNA, 15 bp, Homo sapiens
accctggaggaaatc

SEQ ID NO: 71069 - DNA, 15 bp, Homo sapiens
ccctggaggaaatcc

SEQ ID NO: 71070 - DNA, 15 bp, Homo sapiens
cctggaggaaatcct

SEQ ID NO: 71071 - DNA, 15 bp, Homo sapiens
ctggaggaaatccta

SEQ ID NO: 71072 - DNA, 15 bp, Homo sapiens
tggaggaaatcctac

SEQ ID NO: 71073 - DNA, 15 bp, Homo sapiens
ggaggaaatcctacc

SEQ ID NO: 71074 - DNA, 15 bp, Homo sapiens
gaggaaatcctacct

SEQ ID NO: 71075 - DNA, 15 bp, Homo sapiens
aggaaatcctacctt

SEQ ID NO: 71076 - DNA, 15 bp, Homo sapiens
ggaaatcctaccttt

SEQ ID NO: 71077 - DNA, 15 bp, Homo sapiens
gaaatcctacctttg

SEQ ID NO: 71078 - DNA, 15 bp, Homo sapiens
aaatcctacctttga

SEQ ID NO: 71079 - DNA, 15 bp, Homo sapiens
aatcctacctttgaa

SEQ ID NO: 71080 - DNA, 15 bp, Homo sapiens
atcctacctttgaat

SEQ ID NO: 71081 - DNA, 15 bp, Homo sapiens
tcctacctttgaatt

SEQ ID NO: 71082 - DNA, 15 bp, Homo sapiens
cctacctttgaattc

SEQ ID NO: 71083 - DNA, 15 bp, Homo sapiens
ctacctttgaattca

SEQ ID NO: 71084 - DNA, 15 bp, Homo sapiens
tacctttgaattcaa

SEQ ID NO: 71085 - DNA, 15 bp, Homo sapiens
acctttgaattcaag

SEQ ID NO: 71086 - DNA, 15 bp, Homo sapiens
cctttgaattcaaga

SEQ ID NO: 71087 - DNA, 15 bp, Homo sapiens
ctttgaattcaagaa

SEQ ID NO: 71088 - DNA, 15 bp, Homo sapiens
tttgaattcaagaac

SEQ ID NO: 71089 - DNA, 15 bp, Homo sapiens
ttgaattcaagaaca

SEQ ID NO: 71090 - DNA, 15 bp, Homo sapiens
tgaattcaagaacat

SEQ ID NO: 71091 - DNA, 15 bp, Homo sapiens
gaattcaagaacatt

SEQ ID NO: 71092 - DNA, 15 bp, Homo sapiens
aattcaagaacattt

SEQ ID NO: 71093 - DNA, 15 bp, Homo sapiens
attcaagaacatttg

SEQ ID NO: 71094 - DNA, 15 bp, Homo sapiens
ttcaagaacatttgg

SEQ ID NO: 71095 - DNA, 15 bp, Homo sapiens
tcaagaacatttggg

SEQ ID NO: 71096 - DNA, 15 bp, Homo sapiens
caagaacatttgggg

SEQ ID NO: 71097 - DNA, 15 bp, Homo sapiens
aagaacatttgggga

SEQ ID NO: 71098 - DNA, 15 bp, Homo sapiens
agaacatttggggaa

SEQ ID NO: 71099 - DNA, 15 bp, Homo sapiens
gaacatttggggaat

SEQ ID NO: 71100 - DNA, 15 bp, Homo sapiens
aacatttggggaatt

SEQ ID NO: 71101 - DNA, 15 bp, Homo sapiens
acatttggggaattt

SEQ ID NO: 71102 - DNA, 15 bp, Homo sapiens
catttggggaatttg

SEQ ID NO: 71103 - DNA, 15 bp, Homo sapiens
atttggggaatttgg

SEQ ID NO: 71104 - DNA, 15 bp, Homo sapiens
tttggggaatttgga

SEQ ID NO: 71105 - DNA, 15 bp, Homo sapiens
ttggggaatttggaa

SEQ ID NO: 71106 - DNA, 15 bp, Homo sapiens
tggggaatttggaaa

SEQ ID NO: 71107 - DNA, 15 bp, Homo sapiens
ggggaatttggaaat

SEQ ID NO: 71108 - DNA, 15 bp, Homo sapiens
gggaatttggaaatc

SEQ ID NO: 71109 - DNA, 15 bp, Homo sapiens
ggaatttggaaatct

SEQ ID NO: 71110 - DNA, 15 bp, Homo sapiens
gaatttggaaatctc

SEQ ID NO: 71111 - DNA, 15 bp, Homo sapiens
aatttggaaatctct

SEQ ID NO: 71112 - DNA, 15 bp, Homo sapiens
atttggaaatctctt

SEQ ID NO: 71113 - DNA, 15 bp, Homo sapiens
tttggaaatctcttt

SEQ ID NO: 71114 - DNA, 15 bp, Homo sapiens
ttggaaatctctttg

SEQ ID NO: 71115 - DNA, 15 bp, Homo sapiens
tggaaatctctttgc

SEQ ID NO: 71116 - DNA, 15 bp, Homo sapiens
ggaaatctctttgcc

SEQ ID NO: 71117 - DNA, 15 bp, Homo sapiens
gaaatctctttgccc

SEQ ID NO: 71118 - DNA, 15 bp, Homo sapiens
aaatctctttgcccc

SEQ ID NO: 71119 - DNA, 15 bp, Homo sapiens
aatctctttgccccc

SEQ ID NO: 71120 - DNA, 15 bp, Homo sapiens
atctctttgccccca

SEQ ID NO: 71121 - DNA, 15 bp, Homo sapiens
tctctttgcccccaa

SEQ ID NO: 71122 - DNA, 15 bp, Homo sapiens
ctctttgcccccaaa

SEQ ID NO: 71123 - DNA, 15 bp, Homo sapiens
tctttgcccccaaac

SEQ ID NO: 71124 - DNA, 15 bp, Homo sapiens
ctttgcccccaaacc

SEQ ID NO: 71125 - DNA, 15 bp, Homo sapiens
tttgcccccaaaccc

SEQ ID NO: 71126 - DNA, 15 bp, Homo sapiens
ttgcccccaaacccc

SEQ ID NO: 71127 - DNA, 15 bp, Homo sapiens
tgcccccaaaccccc

SEQ ID NO: 71128 - DNA, 15 bp, Homo sapiens
gcccccaaaccccca

SEQ ID NO: 71129 - DNA, 15 bp, Homo sapiens
cccccaaacccccat

SEQ ID NO: 71130 - DNA, 15 bp, Homo sapiens
ccccaaacccccatt

SEQ ID NO: 71131 - DNA, 15 bp, Homo sapiens
cccaaacccccattc

SEQ ID NO: 71132 - DNA, 15 bp, Homo sapiens
ccaaacccccattct

SEQ ID NO: 71133 - DNA, 15 bp, Homo sapiens
caaacccccattctg

SEQ ID NO: 71134 - DNA, 15 bp, Homo sapiens
aaacccccattctgt

SEQ ID NO: 71135 - DNA, 15 bp, Homo sapiens
aacccccattctgtc

SEQ ID NO: 71136 - DNA, 15 bp, Homo sapiens
acccccattctgtcc

SEQ ID NO: 71137 - DNA, 15 bp, Homo sapiens
cccccattctgtcct

SEQ ID NO: 71138 - DNA, 15 bp, Homo sapiens
ccccattctgtccta

SEQ ID NO: 71139 - DNA, 15 bp, Homo sapiens
cccattctgtcctac

SEQ ID NO: 71140 - DNA, 15 bp, Homo sapiens
ccattctgtcctacc

SEQ ID NO: 71141 - DNA, 15 bp, Homo sapiens
cattctgtcctacct

SEQ ID NO: 71142 - DNA, 15 bp, Homo sapiens
attctgtcctacctt

SEQ ID NO: 71143 - DNA, 15 bp, Homo sapiens
ttctgtcctaccttt

SEQ ID NO: 71144 - DNA, 15 bp, Homo sapiens
tctgtcctaccttta

SEQ ID NO: 71145 - DNA, 15 bp, Homo sapiens
ctgtcctacctttaa

SEQ ID NO: 71146 - DNA, 15 bp, Homo sapiens
tgtcctacctttaat

SEQ ID NO: 71147 - DNA, 15 bp, Homo sapiens
gtcctacctttaatc

SEQ ID NO: 71148 - DNA, 15 bp, Homo sapiens
tcctacctttaatca

SEQ ID NO: 71149 - DNA, 15 bp, Homo sapiens
cctacctttaatcag

SEQ ID NO: 71150 - DNA, 15 bp, Homo sapiens
ctacctttaatcagg

SEQ ID NO: 71151 - DNA, 15 bp, Homo sapiens
tacctttaatcaggt

SEQ ID NO: 71152 - DNA, 15 bp, Homo sapiens
acctttaatcaggtc

SEQ ID NO: 71153 - DNA, 15 bp, Homo sapiens
cctttaatcaggtcc

SEQ ID NO: 71154 - DNA, 15 bp, Homo sapiens
ctttaatcaggtcct

SEQ ID NO: 71155 - DNA, 15 bp, Homo sapiens
tttaatcaggtcctg

SEQ ID NO: 71156 - DNA, 15 bp, Homo sapiens
ttaatcaggtcctgc

SEQ ID NO: 71157 - DNA, 15 bp, Homo sapiens
taatcaggtcctgct

SEQ ID NO: 71158 - DNA, 15 bp, Homo sapiens
aatcaggtcctgctc

SEQ ID NO: 71159 - DNA, 15 bp, Homo sapiens
atcaggtcctgctca

SEQ ID NO: 71160 - DNA, 15 bp, Homo sapiens
tcaggtcctgctcag

SEQ ID NO: 71161 - DNA, 15 bp, Homo sapiens
caggtcctgctcagc

SEQ ID NO: 71162 - DNA, 15 bp, Homo sapiens
aggtcctgctcagca

SEQ ID NO: 71163 - DNA, 15 bp, Homo sapiens
ggtcctgctcagcag

SEQ ID NO: 71164 - DNA, 15 bp, Homo sapiens
gtcctgctcagcagt

SEQ ID NO: 71165 - DNA, 15 bp, Homo sapiens
tcctgctcagcagtg

SEQ ID NO: 71166 - DNA, 15 bp, Homo sapiens
cctgctcagcagtga

SEQ ID NO: 71167 - DNA, 15 bp, Homo sapiens
ctgctcagcagtgag

SEQ ID NO: 71168 - DNA, 15 bp, Homo sapiens
tgctcagcagtgaga

SEQ ID NO: 71169 - DNA, 15 bp, Homo sapiens
gctcagcagtgagag

SEQ ID NO: 71170 - DNA, 15 bp, Homo sapiens
ctcagcagtgagagc

SEQ ID NO: 71171 - DNA, 15 bp, Homo sapiens
tcagcagtgagagca

SEQ ID NO: 71172 - DNA, 15 bp, Homo sapiens
cagcagtgagagcag

SEQ ID NO: 71173 - DNA, 15 bp, Homo sapiens
agcagtgagagcaga

SEQ ID NO: 71174 - DNA, 15 bp, Homo sapiens
gcagtgagagcagat

SEQ ID NO: 71175 - DNA, 15 bp, Homo sapiens
cagtgagagcagatg

SEQ ID NO: 71176 - DNA, 15 bp, Homo sapiens
agtgagagcagatga

SEQ ID NO: 71177 - DNA, 15 bp, Homo sapiens
gtgagagcagatgag

SEQ ID NO: 71178 - DNA, 15 bp, Homo sapiens
tgagagcagatgagg

SEQ ID NO: 71179 - DNA, 15 bp, Homo sapiens
gagagcagatgaggt

SEQ ID NO: 71180 - DNA, 15 bp, Homo sapiens
agagcagatgaggtg

SEQ ID NO: 71181 - DNA, 15 bp, Homo sapiens
gagcagatgaggtga

SEQ ID NO: 71182 - DNA, 15 bp, Homo sapiens
agcagatgaggtgaa

SEQ ID NO: 71183 - DNA, 15 bp, Homo sapiens
gcagatgaggtgaaa

SEQ ID NO: 71184 - DNA, 15 bp, Homo sapiens
cagatgaggtgaaaa

SEQ ID NO: 71185 - DNA, 15 bp, Homo sapiens
agatgaggtgaaaag

SEQ ID NO: 71186 - DNA, 15 bp, Homo sapiens
gatgaggtgaaaagg

SEQ ID NO: 71187 - DNA, 15 bp, Homo sapiens
atgaggtgaaaaggc

SEQ ID NO: 71188 - DNA, 15 bp, Homo sapiens
tgaggtgaaaaggcc

SEQ ID NO: 71189 - DNA, 15 bp, Homo sapiens
gaggtgaaaaggcca

SEQ ID NO: 71190 - DNA, 15 bp, Homo sapiens
aggtgaaaaggccaa

SEQ ID NO: 71191 - DNA, 15 bp, Homo sapiens
ggtgaaaaggccaag

SEQ ID NO: 71192 - DNA, 15 bp, Homo sapiens
gtgaaaaggccaaga

SEQ ID NO: 71193 - DNA, 15 bp, Homo sapiens
tgaaaaggccaagag

SEQ ID NO: 71194 - DNA, 15 bp, Homo sapiens
gaaaaggccaagagg

SEQ ID NO: 71195 - DNA, 15 bp, Homo sapiens
aaaaggccaagaggt

SEQ ID NO: 71196 - DNA, 15 bp, Homo sapiens
aaaggccaagaggtt

SEQ ID NO: 71197 - DNA, 15 bp, Homo sapiens
aaggccaagaggttt

SEQ ID NO: 71198 - DNA, 15 bp, Homo sapiens
aggccaagaggtttg

SEQ ID NO: 71199 - DNA, 15 bp, Homo sapiens
ggccaagaggtttgg

SEQ ID NO: 71200 - DNA, 15 bp, Homo sapiens
gccaagaggtttggc

SEQ ID NO: 71201 - DNA, 15 bp, Homo sapiens
ccaagaggtttggct

SEQ ID NO: 71202 - DNA, 15 bp, Homo sapiens
caagaggtttggctc

SEQ ID NO: 71203 - DNA, 15 bp, Homo sapiens
aagaggtttggctcc

SEQ ID NO: 71204 - DNA, 15 bp, Homo sapiens
agaggtttggctcct

SEQ ID NO: 71205 - DNA, 15 bp, Homo sapiens
gaggtttggctcctg

SEQ ID NO: 71206 - DNA, 15 bp, Homo sapiens
aggtttggctcctgc

SEQ ID NO: 71207 - DNA, 15 bp, Homo sapiens
ggtttggctcctgcc

SEQ ID NO: 71208 - DNA, 15 bp, Homo sapiens
gtttggctcctgccc

SEQ ID NO: 71209 - DNA, 15 bp, Homo sapiens
tttggctcctgccca

SEQ ID NO: 71210 - DNA, 15 bp, Homo sapiens
ttggctcctgcccac

SEQ ID NO: 71211 - DNA, 15 bp, Homo sapiens
tggctcctgcccact

SEQ ID NO: 71212 - DNA, 15 bp, Homo sapiens
ggctcctgcccactg

SEQ ID NO: 71213 - DNA, 15 bp, Homo sapiens
gctcctgcccactga

SEQ ID NO: 71214 - DNA, 15 bp, Homo sapiens
ctcctgcccactgat

SEQ ID NO: 71215 - DNA, 15 bp, Homo sapiens
tcctgcccactgata

SEQ ID NO: 71216 - DNA, 15 bp, Homo sapiens
cctgcccactgatag

SEQ ID NO: 71217 - DNA, 15 bp, Homo sapiens
ctgcccactgatagc

SEQ ID NO: 71218 - DNA, 15 bp, Homo sapiens
tgcccactgatagcc

SEQ ID NO: 71219 - DNA, 15 bp, Homo sapiens
gcccactgatagccc

SEQ ID NO: 71220 - DNA, 15 bp, Homo sapiens
cccactgatagcccc

SEQ ID NO: 71221 - DNA, 15 bp, Homo sapiens
ccactgatagcccct

SEQ ID NO: 71222 - DNA, 15 bp, Homo sapiens
cactgatagcccctc

SEQ ID NO: 71223 - DNA, 15 bp, Homo sapiens
actgatagcccctct

SEQ ID NO: 71224 - DNA, 15 bp, Homo sapiens
ctgatagcccctctc

SEQ ID NO: 71225 - DNA, 15 bp, Homo sapiens
tgatagcccctctcc

SEQ ID NO: 71226 - DNA, 15 bp, Homo sapiens
gatagcccctctccc

SEQ ID NO: 71227 - DNA, 15 bp, Homo sapiens
atagcccctctcccc

SEQ ID NO: 71228 - DNA, 15 bp, Homo sapiens
tagcccctctccccg

SEQ ID NO: 71229 - DNA, 15 bp, Homo sapiens
agcccctctccccgc

SEQ ID NO: 71230 - DNA, 15 bp, Homo sapiens
gcccctctccccgca

SEQ ID NO: 71231 - DNA, 15 bp, Homo sapiens
cccctctccccgcag

SEQ ID NO: 71232 - DNA, 15 bp, Homo sapiens
ccctctccccgcagt

SEQ ID NO: 71233 - DNA, 15 bp, Homo sapiens
cctctccccgcagtg

SEQ ID NO: 71234 - DNA, 15 bp, Homo sapiens
ctctccccgcagtgt

SEQ ID NO: 71235 - DNA, 15 bp, Homo sapiens
tctccccgcagtgtt

SEQ ID NO: 71236 - DNA, 15 bp, Homo sapiens
ctccccgcagtgttt

SEQ ID NO: 71237 - DNA, 15 bp, Homo sapiens
tccccgcagtgtttg

SEQ ID NO: 71238 - DNA, 15 bp, Homo sapiens
ccccgcagtgtttgt

SEQ ID NO: 71239 - DNA, 15 bp, Homo sapiens
cccgcagtgtttgtg

SEQ ID NO: 71240 - DNA, 15 bp, Homo sapiens
ccgcagtgtttgtgt

SEQ ID NO: 71241 - DNA, 15 bp, Homo sapiens
cgcagtgtttgtgtg

SEQ ID NO: 71242 - DNA, 15 bp, Homo sapiens
gcagtgtttgtgtgt

SEQ ID NO: 71243 - DNA, 15 bp, Homo sapiens
cagtgtttgtgtgtc

SEQ ID NO: 71244 - DNA, 15 bp, Homo sapiens
agtgtttgtgtgtca

SEQ ID NO: 71245 - DNA, 15 bp, Homo sapiens
gtgtttgtgtgtcaa

SEQ ID NO: 71246 - DNA, 15 bp, Homo sapiens
tgtttgtgtgtcaag

SEQ ID NO: 71247 - DNA, 15 bp, Homo sapiens
gtttgtgtgtcaagt

SEQ ID NO: 71248 - DNA, 15 bp, Homo sapiens
tttgtgtgtcaagtg

SEQ ID NO: 71249 - DNA, 15 bp, Homo sapiens
ttgtgtgtcaagtgg

SEQ ID NO: 71250 - DNA, 15 bp, Homo sapiens
tgtgtgtcaagtggc

SEQ ID NO: 71251 - DNA, 15 bp, Homo sapiens
gtgtgtcaagtggca

SEQ ID NO: 71252 - DNA, 15 bp, Homo sapiens
tgtgtcaagtggcaa

SEQ ID NO: 71253 - DNA, 15 bp, Homo sapiens
gtgtcaagtggcaaa

SEQ ID NO: 71254 - DNA, 15 bp, Homo sapiens
tgtcaagtggcaaag

SEQ ID NO: 71255 - DNA, 15 bp, Homo sapiens
gtcaagtggcaaagc

SEQ ID NO: 71256 - DNA, 15 bp, Homo sapiens
tcaagtggcaaagct

SEQ ID NO: 71257 - DNA, 15 bp, Homo sapiens
caagtggcaaagctg

SEQ ID NO: 71258 - DNA, 15 bp, Homo sapiens
aagtggcaaagctgt

SEQ ID NO: 71259 - DNA, 15 bp, Homo sapiens
agtggcaaagctgtt

SEQ ID NO: 71260 - DNA, 15 bp, Homo sapiens
gtggcaaagctgttc

SEQ ID NO: 71261 - DNA, 15 bp, Homo sapiens
tggcaaagctgttct

SEQ ID NO: 71262 - DNA, 15 bp, Homo sapiens
ggcaaagctgttctt

SEQ ID NO: 71263 - DNA, 15 bp, Homo sapiens
gcaaagctgttcttc

SEQ ID NO: 71264 - DNA, 15 bp, Homo sapiens
caaagctgttcttcc

SEQ ID NO: 71265 - DNA, 15 bp, Homo sapiens
aaagctgttcttcct

SEQ ID NO: 71266 - DNA, 15 bp, Homo sapiens
aagctgttcttcctg

SEQ ID NO: 71267 - DNA, 15 bp, Homo sapiens
agctgttcttcctgg

SEQ ID NO: 71268 - DNA, 15 bp, Homo sapiens
gctgttcttcctggt

SEQ ID NO: 71269 - DNA, 15 bp, Homo sapiens
ctgttcttcctggtg

SEQ ID NO: 71270 - DNA, 15 bp, Homo sapiens
tgttcttcctggtga

SEQ ID NO: 71271 - DNA, 15 bp, Homo sapiens
gttcttcctggtgac

SEQ ID NO: 71272 - DNA, 15 bp, Homo sapiens
ttcttcctggtgacc

SEQ ID NO: 71273 - DNA, 15 bp, Homo sapiens
tcttcctggtgaccc

SEQ ID NO: 71274 - DNA, 15 bp, Homo sapiens
cttcctggtgaccct

SEQ ID NO: 71275 - DNA, 15 bp, Homo sapiens
ttcctggtgaccctg

SEQ ID NO: 71276 - DNA, 15 bp, Homo sapiens
tcctggtgaccctga

SEQ ID NO: 71277 - DNA, 15 bp, Homo sapiens
cctggtgaccctgat

SEQ ID NO: 71278 - DNA, 15 bp, Homo sapiens
ctggtgaccctgatt

SEQ ID NO: 71279 - DNA, 15 bp, Homo sapiens
tggtgaccctgatta

SEQ ID NO: 71280 - DNA, 15 bp, Homo sapiens
ggtgaccctgattat

SEQ ID NO: 71281 - DNA, 15 bp, Homo sapiens
gtgaccctgattata

SEQ ID NO: 71282 - DNA, 15 bp, Homo sapiens
tgaccctgattatat

SEQ ID NO: 71283 - DNA, 15 bp, Homo sapiens
gaccctgattatatc

SEQ ID NO: 71284 - DNA, 15 bp, Homo sapiens
accctgattatatcc

SEQ ID NO: 71285 - DNA, 15 bp, Homo sapiens
ccctgattatatcca

SEQ ID NO: 71286 - DNA, 15 bp, Homo sapiens
cctgattatatccag

SEQ ID NO: 71287 - DNA, 15 bp, Homo sapiens
ctgattatatccagt

SEQ ID NO: 71288 - DNA, 15 bp, Homo sapiens
tgattatatccagta

SEQ ID NO: 71289 - DNA, 15 bp, Homo sapiens
gattatatccagtaa

SEQ ID NO: 71290 - DNA, 15 bp, Homo sapiens
attatatccagtaac

SEQ ID NO: 71291 - DNA, 15 bp, Homo sapiens
ttatatccagtaaca

SEQ ID NO: 71292 - DNA, 15 bp, Homo sapiens
tatatccagtaacac

SEQ ID NO: 71293 - DNA, 15 bp, Homo sapiens
atatccagtaacaca

SEQ ID NO: 71294 - DNA, 15 bp, Homo sapiens
tatccagtaacacat

SEQ ID NO: 71295 - DNA, 15 bp, Homo sapiens
atccagtaacacata

SEQ ID NO: 71296 - DNA, 15 bp, Homo sapiens
tccagtaacacatag

SEQ ID NO: 71297 - DNA, 15 bp, Homo sapiens
ccagtaacacataga

SEQ ID NO: 71298 - DNA, 15 bp, Homo sapiens
cagtaacacatagac

SEQ ID NO: 71299 - DNA, 15 bp, Homo sapiens
agtaacacatagact

SEQ ID NO: 71300 - DNA, 15 bp, Homo sapiens
gtaacacatagactg

SEQ ID NO: 71301 - DNA, 15 bp, Homo sapiens
taacacatagactgt

SEQ ID NO: 71302 - DNA, 15 bp, Homo sapiens
aacacatagactgtg

SEQ ID NO: 71303 - DNA, 15 bp, Homo sapiens
acacatagactgtgc

SEQ ID NO: 71304 - DNA, 15 bp, Homo sapiens
cacatagactgtgcg

SEQ ID NO: 71305 - DNA, 15 bp, Homo sapiens
acatagactgtgcgc

SEQ ID NO: 71306 - DNA, 15 bp, Homo sapiens
catagactgtgcgca

SEQ ID NO: 71307 - DNA, 15 bp, Homo sapiens
atagactgtgcgcat

SEQ ID NO: 71308 - DNA, 15 bp, Homo sapiens
tagactgtgcgcata

SEQ ID NO: 71309 - DNA, 15 bp, Homo sapiens
agactgtgcgcatag

SEQ ID NO: 71310 - DNA, 15 bp, Homo sapiens
gactgtgcgcatagg

SEQ ID NO: 71311 - DNA, 15 bp, Homo sapiens
actgtgcgcataggc

SEQ ID NO: 71312 - DNA, 15 bp, Homo sapiens
ctgtgcgcataggcc

SEQ ID NO: 71313 - DNA, 15 bp, Homo sapiens
tgtgcgcataggcct

SEQ ID NO: 71314 - DNA, 15 bp, Homo sapiens
gtgcgcataggcctg

SEQ ID NO: 71315 - DNA, 15 bp, Homo sapiens
tgcgcataggcctgc

SEQ ID NO: 71316 - DNA, 15 bp, Homo sapiens
gcgcataggcctgct

SEQ ID NO: 71317 - DNA, 15 bp, Homo sapiens
cgcataggcctgctt

SEQ ID NO: 71318 - DNA, 15 bp, Homo sapiens
gcataggcctgcttt

SEQ ID NO: 71319 - DNA, 15 bp, Homo sapiens
cataggcctgctttg

SEQ ID NO: 71320 - DNA, 15 bp, Homo sapiens
ataggcctgctttgt

SEQ ID NO: 71321 - DNA, 15 bp, Homo sapiens
taggcctgctttgtc

SEQ ID NO: 71322 - DNA, 15 bp, Homo sapiens
aggcctgctttgtct

SEQ ID NO: 71323 - DNA, 15 bp, Homo sapiens
ggcctgctttgtctc

SEQ ID NO: 71324 - DNA, 15 bp, Homo sapiens
gcctgctttgtctcc

SEQ ID NO: 71325 - DNA, 15 bp, Homo sapiens
cctgctttgtctcct

SEQ ID NO: 71326 - DNA, 15 bp, Homo sapiens
ctgctttgtctcctc

SEQ ID NO: 71327 - DNA, 15 bp, Homo sapiens
tgctttgtctcctct

SEQ ID NO: 71328 - DNA, 15 bp, Homo sapiens
gctttgtctcctcta

SEQ ID NO: 71329 - DNA, 15 bp, Homo sapiens
ctttgtctcctctat

SEQ ID NO: 71330 - DNA, 15 bp, Homo sapiens
tttgtctcctctatc

SEQ ID NO: 71331 - DNA, 15 bp, Homo sapiens
ttgtctcctctatcc

SEQ ID NO: 71332 - DNA, 15 bp, Homo sapiens
tgtctcctctatcct

SEQ ID NO: 71333 - DNA, 15 bp, Homo sapiens
gtctcctctatcctg

SEQ ID NO: 71334 - DNA, 15 bp, Homo sapiens
tctcctctatcctgg

SEQ ID NO: 71335 - DNA, 15 bp, Homo sapiens
ctcctctatcctggg

SEQ ID NO: 71336 - DNA, 15 bp, Homo sapiens
tcctctatcctgggc

SEQ ID NO: 71337 - DNA, 15 bp, Homo sapiens
cctctatcctgggct

SEQ ID NO: 71338 - DNA, 15 bp, Homo sapiens
ctctatcctgggctt

SEQ ID NO: 71339 - DNA, 15 bp, Homo sapiens
tctatcctgggcttt

SEQ ID NO: 71340 - DNA, 15 bp, Homo sapiens
ctatcctgggctttt

SEQ ID NO: 71341 - DNA, 15 bp, Homo sapiens
tatcctgggcttttg

SEQ ID NO: 71342 - DNA, 15 bp, Homo sapiens
atcctgggcttttgt

SEQ ID NO: 71343 - DNA, 15 bp, Homo sapiens
tcctgggcttttgtt

SEQ ID NO: 71344 - DNA, 15 bp, Homo sapiens
cctgggcttttgttt

SEQ ID NO: 71345 - DNA, 15 bp, Homo sapiens
ctgggcttttgtttt

SEQ ID NO: 71346 - DNA, 15 bp, Homo sapiens
tgggcttttgttttg

SEQ ID NO: 71347 - DNA, 15 bp, Homo sapiens
gggcttttgttttgc

SEQ ID NO: 71348 - DNA, 15 bp, Homo sapiens
ggcttttgttttgct

SEQ ID NO: 71349 - DNA, 15 bp, Homo sapiens
gcttttgttttgctt

SEQ ID NO: 71350 - DNA, 15 bp, Homo sapiens
cttttgttttgcttt

SEQ ID NO: 71351 - DNA, 15 bp, Homo sapiens
ttttgttttgctttt

SEQ ID NO: 71352 - DNA, 15 bp, Homo sapiens
tttgttttgcttttt

SEQ ID NO: 71353 - DNA, 15 bp, Homo sapiens
ttgttttgcttttta

SEQ ID NO: 71354 - DNA, 15 bp, Homo sapiens
tgttttgctttttag

SEQ ID NO: 71355 - DNA, 15 bp, Homo sapiens
gttttgctttttagt

SEQ ID NO: 71356 - DNA, 15 bp, Homo sapiens
ttttgctttttagtt

SEQ ID NO: 71357 - DNA, 15 bp, Homo sapiens
tttgctttttagttt

SEQ ID NO: 71358 - DNA, 15 bp, Homo sapiens
ttgctttttagtttt

SEQ ID NO: 71359 - DNA, 15 bp, Homo sapiens
tgctttttagttttg

SEQ ID NO: 71360 - DNA, 15 bp, Homo sapiens
gctttttagttttgc

SEQ ID NO: 71361 - DNA, 15 bp, Homo sapiens
ctttttagttttgct

SEQ ID NO: 71362 - DNA, 15 bp, Homo sapiens
tttttagttttgctt

SEQ ID NO: 71363 - DNA, 15 bp, Homo sapiens
ttttagttttgcttt

SEQ ID NO: 71364 - DNA, 15 bp, Homo sapiens
tttagttttgctttt

SEQ ID NO: 71365 - DNA, 15 bp, Homo sapiens
ttagttttgctttta

SEQ ID NO: 71366 - DNA, 15 bp, Homo sapiens
tagttttgcttttag

SEQ ID NO: 71367 - DNA, 15 bp, Homo sapiens
agttttgcttttagt

SEQ ID NO: 71368 - DNA, 15 bp, Homo sapiens
gttttgcttttagtt

SEQ ID NO: 71369 - DNA, 15 bp, Homo sapiens
ttttgcttttagttt

SEQ ID NO: 71370 - DNA, 15 bp, Homo sapiens
tttgcttttagtttt

SEQ ID NO: 71371 - DNA, 15 bp, Homo sapiens
ttgcttttagttttt

SEQ ID NO: 71372 - DNA, 15 bp, Homo sapiens
tgcttttagtttttc

SEQ ID NO: 71373 - DNA, 15 bp, Homo sapiens
gcttttagtttttct

SEQ ID NO: 71374 - DNA, 15 bp, Homo sapiens
cttttagtttttctg

SEQ ID NO: 71375 - DNA, 15 bp, Homo sapiens
ttttagtttttctgt

SEQ ID NO: 71376 - DNA, 15 bp, Homo sapiens
tttagtttttctgtc

SEQ ID NO: 71377 - DNA, 15 bp, Homo sapiens
ttagtttttctgtcc

SEQ ID NO: 71378 - DNA, 15 bp, Homo sapiens
tagtttttctgtccc

SEQ ID NO: 71379 - DNA, 15 bp, Homo sapiens
agtttttctgtccct

SEQ ID NO: 71380 - DNA, 15 bp, Homo sapiens
gtttttctgtccctt

SEQ ID NO: 71381 - DNA, 15 bp, Homo sapiens
tttttctgtcccttt

SEQ ID NO: 71382 - DNA, 15 bp, Homo sapiens
ttttctgtccctttt

SEQ ID NO: 71383 - DNA, 15 bp, Homo sapiens
tttctgtccctttta

SEQ ID NO: 71384 - DNA, 15 bp, Homo sapiens
ttctgtcccttttat

SEQ ID NO: 71385 - DNA, 15 bp, Homo sapiens
tctgtcccttttatt

SEQ ID NO: 71386 - DNA, 15 bp, Homo sapiens
ctgtcccttttattt

SEQ ID NO: 71387 - DNA, 15 bp, Homo sapiens
tgtcccttttattta

SEQ ID NO: 71388 - DNA, 15 bp, Homo sapiens
gtcccttttatttaa

SEQ ID NO: 71389 - DNA, 15 bp, Homo sapiens
tcccttttatttaac

SEQ ID NO: 71390 - DNA, 15 bp, Homo sapiens
cccttttatttaacg

SEQ ID NO: 71391 - DNA, 15 bp, Homo sapiens
ccttttatttaacgc

SEQ ID NO: 71392 - DNA, 15 bp, Homo sapiens
cttttatttaacgca

SEQ ID NO: 71393 - DNA, 15 bp, Homo sapiens
ttttatttaacgcac

SEQ ID NO: 71394 - DNA, 15 bp, Homo sapiens
tttatttaacgcacc

SEQ ID NO: 71395 - DNA, 15 bp, Homo sapiens
ttatttaacgcaccg

SEQ ID NO: 71396 - DNA, 15 bp, Homo sapiens
tatttaacgcaccga

SEQ ID NO: 71397 - DNA, 15 bp, Homo sapiens
atttaacgcaccgac

SEQ ID NO: 71398 - DNA, 15 bp, Homo sapiens
tttaacgcaccgact

SEQ ID NO: 71399 - DNA, 15 bp, Homo sapiens
ttaacgcaccgacta

SEQ ID NO: 71400 - DNA, 15 bp, Homo sapiens
taacgcaccgactag

SEQ ID NO: 71401 - DNA, 15 bp, Homo sapiens
aacgcaccgactaga

SEQ ID NO: 71402 - DNA, 15 bp, Homo sapiens
acgcaccgactagac

SEQ ID NO: 71403 - DNA, 15 bp, Homo sapiens
cgcaccgactagaca

SEQ ID NO: 71404 - DNA, 15 bp, Homo sapiens
gcaccgactagacac

SEQ ID NO: 71405 - DNA, 15 bp, Homo sapiens
caccgactagacaca

SEQ ID NO: 71406 - DNA, 15 bp, Homo sapiens
accgactagacacac

SEQ ID NO: 71407 - DNA, 15 bp, Homo sapiens
ccgactagacacaca

SEQ ID NO: 71408 - DNA, 15 bp, Homo sapiens
cgactagacacacaa

SEQ ID NO: 71409 - DNA, 15 bp, Homo sapiens
gactagacacacaaa

SEQ ID NO: 71410 - DNA, 15 bp, Homo sapiens
actagacacacaaag

SEQ ID NO: 71411 - DNA, 15 bp, Homo sapiens
ctagacacacaaagc

SEQ ID NO: 71412 - DNA, 15 bp, Homo sapiens
tagacacacaaagca

SEQ ID NO: 71413 - DNA, 15 bp, Homo sapiens
agacacacaaagcag

SEQ ID NO: 71414 - DNA, 15 bp, Homo sapiens
gacacacaaagcagt

SEQ ID NO: 71415 - DNA, 15 bp, Homo sapiens
acacacaaagcagtt

SEQ ID NO: 71416 - DNA, 15 bp, Homo sapiens
cacacaaagcagttg

SEQ ID NO: 71417 - DNA, 15 bp, Homo sapiens
acacaaagcagttga

SEQ ID NO: 71418 - DNA, 15 bp, Homo sapiens
cacaaagcagttgaa

SEQ ID NO: 71419 - DNA, 15 bp, Homo sapiens
acaaagcagttgaat

SEQ ID NO: 71420 - DNA, 15 bp, Homo sapiens
caaagcagttgaatt

SEQ ID NO: 71421 - DNA, 15 bp, Homo sapiens
aaagcagttgaattt

SEQ ID NO: 71422 - DNA, 15 bp, Homo sapiens
aagcagttgaatttt

SEQ ID NO: 71423 - DNA, 15 bp, Homo sapiens
agcagttgaattttt

SEQ ID NO: 71424 - DNA, 15 bp, Homo sapiens
gcagttgaattttta

SEQ ID NO: 71425 - DNA, 15 bp, Homo sapiens
cagttgaatttttat

SEQ ID NO: 71426 - DNA, 15 bp, Homo sapiens
agttgaatttttata

SEQ ID NO: 71427 - DNA, 15 bp, Homo sapiens
gttgaatttttatat

SEQ ID NO: 71428 - DNA, 15 bp, Homo sapiens
ttgaatttttatata

SEQ ID NO: 71429 - DNA, 15 bp, Homo sapiens
tgaatttttatatat

SEQ ID NO: 71430 - DNA, 15 bp, Homo sapiens
gaatttttatatata

SEQ ID NO: 71431 - DNA, 15 bp, Homo sapiens
aatttttatatatat

SEQ ID NO: 71432 - DNA, 15 bp, Homo sapiens
atttttatatatata

SEQ ID NO: 71433 - DNA, 15 bp, Homo sapiens
tttttatatatatat

SEQ ID NO: 71434 - DNA, 15 bp, Homo sapiens
ttttatatatatatc

SEQ ID NO: 71435 - DNA, 15 bp, Homo sapiens
tttatatatatatct

SEQ ID NO: 71436 - DNA, 15 bp, Homo sapiens
ttatatatatatctg

SEQ ID NO: 71437 - DNA, 15 bp, Homo sapiens
tatatatatatctgt

SEQ ID NO: 71438 - DNA, 15 bp, Homo sapiens
atatatatatctgta

SEQ ID NO: 71439 - DNA, 15 bp, Homo sapiens
tatatatatctgtat

SEQ ID NO: 71440 - DNA, 15 bp, Homo sapiens
atatatatctgtata

SEQ ID NO: 71441 - DNA, 15 bp, Homo sapiens
tatatatctgtatat

SEQ ID NO: 71442 - DNA, 15 bp, Homo sapiens
atatatctgtatatt

SEQ ID NO: 71443 - DNA, 15 bp, Homo sapiens
tatatctgtatattg

SEQ ID NO: 71444 - DNA, 15 bp, Homo sapiens
atatctgtatattgc

SEQ ID NO: 71445 - DNA, 15 bp, Homo sapiens
tatctgtatattgca

SEQ ID NO: 71446 - DNA, 15 bp, Homo sapiens
atctgtatattgcac

SEQ ID NO: 71447 - DNA, 15 bp, Homo sapiens
tctgtatattgcaca

SEQ ID NO: 71448 - DNA, 15 bp, Homo sapiens
ctgtatattgcacaa

SEQ ID NO: 71449 - DNA, 15 bp, Homo sapiens
tgtatattgcacaat

SEQ ID NO: 71450 - DNA, 15 bp, Homo sapiens
gtatattgcacaatt

SEQ ID NO: 71451 - DNA, 15 bp, Homo sapiens
tatattgcacaatta

SEQ ID NO: 71452 - DNA, 15 bp, Homo sapiens
atattgcacaattat

SEQ ID NO: 71453 - DNA, 15 bp, Homo sapiens
tattgcacaattata

SEQ ID NO: 71454 - DNA, 15 bp, Homo sapiens
attgcacaattataa

SEQ ID NO: 71455 - DNA, 15 bp, Homo sapiens
ttgcacaattataaa

SEQ ID NO: 71456 - DNA, 15 bp, Homo sapiens
tgcacaattataaac

SEQ ID NO: 71457 - DNA, 15 bp, Homo sapiens
gcacaattataaact

SEQ ID NO: 71458 - DNA, 15 bp, Homo sapiens
cacaattataaactc

SEQ ID NO: 71459 - DNA, 15 bp, Homo sapiens
acaattataaactca

SEQ ID NO: 71460 - DNA, 15 bp, Homo sapiens
caattataaactcat

SEQ ID NO: 71461 - DNA, 15 bp, Homo sapiens
aattataaactcatt

SEQ ID NO: 71462 - DNA, 15 bp, Homo sapiens
attataaactcattt

SEQ ID NO: 71463 - DNA, 15 bp, Homo sapiens
ttataaactcatttt

SEQ ID NO: 71464 - DNA, 15 bp, Homo sapiens
tataaactcattttg

SEQ ID NO: 71465 - DNA, 15 bp, Homo sapiens
ataaactcattttgc

SEQ ID NO: 71466 - DNA, 15 bp, Homo sapiens
taaactcattttgct

SEQ ID NO: 71467 - DNA, 15 bp, Homo sapiens
aaactcattttgctt

SEQ ID NO: 71468 - DNA, 15 bp, Homo sapiens
aactcattttgcttg

SEQ ID NO: 71469 - DNA, 15 bp, Homo sapiens
actcattttgcttgt

SEQ ID NO: 71470 - DNA, 15 bp, Homo sapiens
ctcattttgcttgtg

SEQ ID NO: 71471 - DNA, 15 bp, Homo sapiens
tcattttgcttgtgg

SEQ ID NO: 71472 - DNA, 15 bp, Homo sapiens
cattttgcttgtggc

SEQ ID NO: 71473 - DNA, 15 bp, Homo sapiens
attttgcttgtggct

SEQ ID NO: 71474 - DNA, 15 bp, Homo sapiens
ttttgcttgtggctc

SEQ ID NO: 71475 - DNA, 15 bp, Homo sapiens
tttgcttgtggctcc

SEQ ID NO: 71476 - DNA, 15 bp, Homo sapiens
ttgcttgtggctcca

SEQ ID NO: 71477 - DNA, 15 bp, Homo sapiens
tgcttgtggctccac

SEQ ID NO: 71478 - DNA, 15 bp, Homo sapiens
gcttgtggctccaca

SEQ ID NO: 71479 - DNA, 15 bp, Homo sapiens
cttgtggctccacac

SEQ ID NO: 71480 - DNA, 15 bp, Homo sapiens
ttgtggctccacaca

SEQ ID NO: 71481 - DNA, 15 bp, Homo sapiens
tgtggctccacacac

SEQ ID NO: 71482 - DNA, 15 bp, Homo sapiens
gtggctccacacaca

SEQ ID NO: 71483 - DNA, 15 bp, Homo sapiens
tggctccacacacac

SEQ ID NO: 71484 - DNA, 15 bp, Homo sapiens
ggctccacacacaca

SEQ ID NO: 71485 - DNA, 15 bp, Homo sapiens
gctccacacacacaa

SEQ ID NO: 71486 - DNA, 15 bp, Homo sapiens
ctccacacacacaaa

SEQ ID NO: 71487 - DNA, 15 bp, Homo sapiens
tccacacacacaaaa

SEQ ID NO: 71488 - DNA, 15 bp, Homo sapiens
ccacacacacaaaaa

SEQ ID NO: 71489 - DNA, 15 bp, Homo sapiens
cacacacacaaaaaa

SEQ ID NO: 71490 - DNA, 15 bp, Homo sapiens
acacacacaaaaaaa

SEQ ID NO: 71491 - DNA, 15 bp, Homo sapiens
cacacacaaaaaaag

SEQ ID NO: 71492 - DNA, 15 bp, Homo sapiens
acacacaaaaaaaga

SEQ ID NO: 71493 - DNA, 15 bp, Homo sapiens
cacacaaaaaaagac

SEQ ID NO: 71494 - DNA, 15 bp, Homo sapiens
acacaaaaaaagacc

SEQ ID NO: 71495 - DNA, 15 bp, Homo sapiens
cacaaaaaaagacct

SEQ ID NO: 71496 - DNA, 15 bp, Homo sapiens
acaaaaaaagacctg

SEQ ID NO: 71497 - DNA, 15 bp, Homo sapiens
caaaaaaagacctgt

SEQ ID NO: 71498 - DNA, 15 bp, Homo sapiens
aaaaaaagacctgtt

SEQ ID NO: 71499 - DNA, 15 bp, Homo sapiens
aaaaaagacctgtta

SEQ ID NO: 71500 - DNA, 15 bp, Homo sapiens
aaaaagacctgttaa

SEQ ID NO: 71501 - DNA, 15 bp, Homo sapiens
aaaagacctgttaaa

SEQ ID NO: 71502 - DNA, 15 bp, Homo sapiens
aaagacctgttaaaa

SEQ ID NO: 71503 - DNA, 15 bp, Homo sapiens
aagacctgttaaaat

SEQ ID NO: 71504 - DNA, 15 bp, Homo sapiens
agacctgttaaaatt

SEQ ID NO: 71505 - DNA, 15 bp, Homo sapiens
gacctgttaaaatta

SEQ ID NO: 71506 - DNA, 15 bp, Homo sapiens
acctgttaaaattat

SEQ ID NO: 71507 - DNA, 15 bp, Homo sapiens
cctgttaaaattata

SEQ ID NO: 71508 - DNA, 15 bp, Homo sapiens
ctgttaaaattatac

SEQ ID NO: 71509 - DNA, 15 bp, Homo sapiens
tgttaaaattatacc

SEQ ID NO: 71510 - DNA, 15 bp, Homo sapiens
gttaaaattatacct

SEQ ID NO: 71511 - DNA, 15 bp, Homo sapiens
ttaaaattatacctg

SEQ ID NO: 71512 - DNA, 15 bp, Homo sapiens
taaaattatacctgt

SEQ ID NO: 71513 - DNA, 15 bp, Homo sapiens
aaaattatacctgtt

SEQ ID NO: 71514 - DNA, 15 bp, Homo sapiens
aaattatacctgttg

SEQ ID NO: 71515 - DNA, 15 bp, Homo sapiens
aattatacctgttgc

SEQ ID NO: 71516 - DNA, 15 bp, Homo sapiens
attatacctgttgct

SEQ ID NO: 71517 - DNA, 15 bp, Homo sapiens
ttatacctgttgctt

SEQ ID NO: 71518 - DNA, 15 bp, Homo sapiens
tatacctgttgctta

SEQ ID NO: 71519 - DNA, 15 bp, Homo sapiens
atacctgttgcttaa

SEQ ID NO: 71520 - DNA, 15 bp, Homo sapiens
tacctgttgcttaat

SEQ ID NO: 71521 - DNA, 15 bp, Homo sapiens
acctgttgcttaatt

SEQ ID NO: 71522 - DNA, 15 bp, Homo sapiens
cctgttgcttaatta

SEQ ID NO: 71523 - DNA, 15 bp, Homo sapiens
ctgttgcttaattac

SEQ ID NO: 71524 - DNA, 15 bp, Homo sapiens
tgttgcttaattaca

SEQ ID NO: 71525 - DNA, 15 bp, Homo sapiens
gttgcttaattacaa

SEQ ID NO: 71526 - DNA, 15 bp, Homo sapiens
ttgcttaattacaat

SEQ ID NO: 71527 - DNA, 15 bp, Homo sapiens
tgcttaattacaata

SEQ ID NO: 71528 - DNA, 15 bp, Homo sapiens
gcttaattacaatat

SEQ ID NO: 71529 - DNA, 15 bp, Homo sapiens
cttaattacaatatt

SEQ ID NO: 71530 - DNA, 15 bp, Homo sapiens
ttaattacaatattt

SEQ ID NO: 71531 - DNA, 15 bp, Homo sapiens
taattacaatatttc

SEQ ID NO: 71532 - DNA, 15 bp, Homo sapiens
aattacaatatttct

SEQ ID NO: 71533 - DNA, 15 bp, Homo sapiens
attacaatatttctg

SEQ ID NO: 71534 - DNA, 15 bp, Homo sapiens
ttacaatatttctga

SEQ ID NO: 71535 - DNA, 15 bp, Homo sapiens
tacaatatttctgat

SEQ ID NO: 71536 - DNA, 15 bp, Homo sapiens
acaatatttctgata

SEQ ID NO: 71537 - DNA, 15 bp, Homo sapiens
caatatttctgataa

SEQ ID NO: 71538 - DNA, 15 bp, Homo sapiens
aatatttctgataac

SEQ ID NO: 71539 - DNA, 15 bp, Homo sapiens
atatttctgataacc

SEQ ID NO: 71540 - DNA, 15 bp, Homo sapiens
tatttctgataacca

SEQ ID NO: 71541 - DNA, 15 bp, Homo sapiens
atttctgataaccat

SEQ ID NO: 71542 - DNA, 15 bp, Homo sapiens
tttctgataaccata

SEQ ID NO: 71543 - DNA, 15 bp, Homo sapiens
ttctgataaccatag

SEQ ID NO: 71544 - DNA, 15 bp, Homo sapiens
tctgataaccatagc

SEQ ID NO: 71545 - DNA, 15 bp, Homo sapiens
ctgataaccatagca

SEQ ID NO: 71546 - DNA, 15 bp, Homo sapiens
tgataaccatagcat

SEQ ID NO: 71547 - DNA, 15 bp, Homo sapiens
gataaccatagcata

SEQ ID NO: 71548 - DNA, 15 bp, Homo sapiens
ataaccatagcatag

SEQ ID NO: 71549 - DNA, 15 bp, Homo sapiens
taaccatagcatagg

SEQ ID NO: 71550 - DNA, 15 bp, Homo sapiens
aaccatagcatagga

SEQ ID NO: 71551 - DNA, 15 bp, Homo sapiens
accatagcataggac

SEQ ID NO: 71552 - DNA, 15 bp, Homo sapiens
ccatagcataggaca

SEQ ID NO: 71553 - DNA, 15 bp, Homo sapiens
catagcataggacaa

SEQ ID NO: 71554 - DNA, 15 bp, Homo sapiens
atagcataggacaag

SEQ ID NO: 71555 - DNA, 15 bp, Homo sapiens
tagcataggacaagg

SEQ ID NO: 71556 - DNA, 15 bp, Homo sapiens
agcataggacaaggg

SEQ ID NO: 71557 - DNA, 15 bp, Homo sapiens
gcataggacaaggga

SEQ ID NO: 71558 - DNA, 15 bp, Homo sapiens
cataggacaagggaa

SEQ ID NO: 71559 - DNA, 15 bp, Homo sapiens
ataggacaagggaaa

SEQ ID NO: 71560 - DNA, 15 bp, Homo sapiens
taggacaagggaaaa

SEQ ID NO: 71561 - DNA, 15 bp, Homo sapiens
aggacaagggaaaat

SEQ ID NO: 71562 - DNA, 15 bp, Homo sapiens
ggacaagggaaaata

SEQ ID NO: 71563 - DNA, 15 bp, Homo sapiens
gacaagggaaaataa

SEQ ID NO: 71564 - DNA, 15 bp, Homo sapiens
acaagggaaaataaa

SEQ ID NO: 71565 - DNA, 15 bp, Homo sapiens
caagggaaaataaaa

SEQ ID NO: 71566 - DNA, 15 bp, Homo sapiens
aagggaaaataaaaa

SEQ ID NO: 71567 - DNA, 15 bp, Homo sapiens
agggaaaataaaaaa

SEQ ID NO: 71568 - DNA, 15 bp, Homo sapiens
gggaaaataaaaaaa

SEQ ID NO: 71569 - DNA, 15 bp, Homo sapiens
ggaaaataaaaaaag

SEQ ID NO: 71570 - DNA, 15 bp, Homo sapiens
gaaaataaaaaaaga

SEQ ID NO: 71571 - DNA, 15 bp, Homo sapiens
aaaataaaaaaagaa

SEQ ID NO: 71572 - DNA, 15 bp, Homo sapiens
aaataaaaaaagaaa

SEQ ID NO: 71573 - DNA, 15 bp, Homo sapiens
aataaaaaaagaaaa

SEQ ID NO: 71574 - DNA, 15 bp, Homo sapiens
ataaaaaaagaaaaa

SEQ ID NO: 71575 - DNA, 15 bp, Homo sapiens
taaaaaaagaaaaaa

SEQ ID NO: 71576 - DNA, 15 bp, Homo sapiens
aaaaaagaaaaaaaa

SEQ ID NO: 71577 - DNA, 15 bp, Homo sapiens
aaaaagaaaaaaaag

SEQ ID NO: 71578 - DNA, 15 bp, Homo sapiens
aaaagaaaaaaaaga

SEQ ID NO: 71579 - DNA, 15 bp, Homo sapiens
aaagaaaaaaaagaa

SEQ ID NO: 71580 - DNA, 15 bp, Homo sapiens
aagaaaaaaaagaaa

SEQ ID NO: 71581 - DNA, 15 bp, Homo sapiens
agaaaaaaaagaaaa

SEQ ID NO: 71582 - DNA, 15 bp, Homo sapiens
gaaaaaaaagaaaaa

SEQ ID NO: 71583 - DNA, 15 bp, Homo sapiens
aaaagaaaaaaaaac

SEQ ID NO: 71584 - DNA, 15 bp, Homo sapiens
aaagaaaaaaaaacg

SEQ ID NO: 71585 - DNA, 15 bp, Homo sapiens
aagaaaaaaaaacga

SEQ ID NO: 71586 - DNA, 15 bp, Homo sapiens
agaaaaaaaaacgac

SEQ ID NO: 71587 - DNA, 15 bp, Homo sapiens
gaaaaaaaaacgaca

SEQ ID NO: 71588 - DNA, 15 bp, Homo sapiens
aaaaaaaaacgacaa

SEQ ID NO: 71589 - DNA, 15 bp, Homo sapiens
aaaaaaaacgacaaa

SEQ ID NO: 71590 - DNA, 15 bp, Homo sapiens
aaaaaaacgacaaat

SEQ ID NO: 71591 - DNA, 15 bp, Homo sapiens
aaaaaacgacaaatc

SEQ ID NO: 71592 - DNA, 15 bp, Homo sapiens
aaaaacgacaaatct

SEQ ID NO: 71593 - DNA, 15 bp, Homo sapiens
aaaacgacaaatctg

SEQ ID NO: 71594 - DNA, 15 bp, Homo sapiens
aaacgacaaatctgt

SEQ ID NO: 71595 - DNA, 15 bp, Homo sapiens
aacgacaaatctgtc

SEQ ID NO: 71596 - DNA, 15 bp, Homo sapiens
acgacaaatctgtct

SEQ ID NO: 71597 - DNA, 15 bp, Homo sapiens
cgacaaatctgtctg

SEQ ID NO: 71598 - DNA, 15 bp, Homo sapiens
gacaaatctgtctgc

SEQ ID NO: 71599 - DNA, 15 bp, Homo sapiens
acaaatctgtctgct

SEQ ID NO: 71600 - DNA, 15 bp, Homo sapiens
caaatctgtctgctg

SEQ ID NO: 71601 - DNA, 15 bp, Homo sapiens
aaatctgtctgctgg

SEQ ID NO: 71602 - DNA, 15 bp, Homo sapiens
aatctgtctgctggt

SEQ ID NO: 71603 - DNA, 15 bp, Homo sapiens
atctgtctgctggtc

SEQ ID NO: 71604 - DNA, 15 bp, Homo sapiens
tctgtctgctggtca

SEQ ID NO: 71605 - DNA, 15 bp, Homo sapiens
ctgtctgctggtcac

SEQ ID NO: 71606 - DNA, 15 bp, Homo sapiens
tgtctgctggtcact

SEQ ID NO: 71607 - DNA, 15 bp, Homo sapiens
gtctgctggtcactt

SEQ ID NO: 71608 - DNA, 15 bp, Homo sapiens
tctgctggtcacttc

SEQ ID NO: 71609 - DNA, 15 bp, Homo sapiens
ctgctggtcacttct

SEQ ID NO: 71610 - DNA, 15 bp, Homo sapiens
tgctggtcacttctt

SEQ ID NO: 71611 - DNA, 15 bp, Homo sapiens
gctggtcacttcttc

SEQ ID NO: 71612 - DNA, 15 bp, Homo sapiens
ctggtcacttcttct

SEQ ID NO: 71613 - DNA, 15 bp, Homo sapiens
tggtcacttcttctg

SEQ ID NO: 71614 - DNA, 15 bp, Homo sapiens
ggtcacttcttctgt

SEQ ID NO: 71615 - DNA, 15 bp, Homo sapiens
gtcacttcttctgtc

SEQ ID NO: 71616 - DNA, 15 bp, Homo sapiens
tcacttcttctgtcc

SEQ ID NO: 71617 - DNA, 15 bp, Homo sapiens
cacttcttctgtcca

SEQ ID NO: 71618 - DNA, 15 bp, Homo sapiens
acttcttctgtccaa

SEQ ID NO: 71619 - DNA, 15 bp, Homo sapiens
cttcttctgtccaag

SEQ ID NO: 71620 - DNA, 15 bp, Homo sapiens
ttcttctgtccaagc

SEQ ID NO: 71621 - DNA, 15 bp, Homo sapiens
tcttctgtccaagca

SEQ ID NO: 71622 - DNA, 15 bp, Homo sapiens
cttctgtccaagcag

SEQ ID NO: 71623 - DNA, 15 bp, Homo sapiens
ttctgtccaagcaga

SEQ ID NO: 71624 - DNA, 15 bp, Homo sapiens
tctgtccaagcagat

SEQ ID NO: 71625 - DNA, 15 bp, Homo sapiens
ctgtccaagcagatt

SEQ ID NO: 71626 - DNA, 15 bp, Homo sapiens
tgtccaagcagattc

SEQ ID NO: 71627 - DNA, 15 bp, Homo sapiens
gtccaagcagattcg

SEQ ID NO: 71628 - DNA, 15 bp, Homo sapiens
tccaagcagattcgt

SEQ ID NO: 71629 - DNA, 15 bp, Homo sapiens
ccaagcagattcgtg

SEQ ID NO: 71630 - DNA, 15 bp, Homo sapiens
caagcagattcgtgg

SEQ ID NO: 71631 - DNA, 15 bp, Homo sapiens
aagcagattcgtggt

SEQ ID NO: 71632 - DNA, 15 bp, Homo sapiens
agcagattcgtggtc

SEQ ID NO: 71633 - DNA, 15 bp, Homo sapiens
gcagattcgtggtct

SEQ ID NO: 71634 - DNA, 15 bp, Homo sapiens
cagattcgtggtctt

SEQ ID NO: 71635 - DNA, 15 bp, Homo sapiens
agattcgtggtcttt

SEQ ID NO: 71636 - DNA, 15 bp, Homo sapiens
gattcgtggtctttt

SEQ ID NO: 71637 - DNA, 15 bp, Homo sapiens
attcgtggtcttttc

SEQ ID NO: 71638 - DNA, 15 bp, Homo sapiens
ttcgtggtcttttcc

SEQ ID NO: 71639 - DNA, 15 bp, Homo sapiens
tcgtggtcttttcct

SEQ ID NO: 71640 - DNA, 15 bp, Homo sapiens
cgtggtcttttcctc

SEQ ID NO: 71641 - DNA, 15 bp, Homo sapiens
gtggtcttttcctcg

SEQ ID NO: 71642 - DNA, 15 bp, Homo sapiens
tggtcttttcctcgc

SEQ ID NO: 71643 - DNA, 15 bp, Homo sapiens
ggtcttttcctcgct

SEQ ID NO: 71644 - DNA, 15 bp, Homo sapiens
gtcttttcctcgctt

SEQ ID NO: 71645 - DNA, 15 bp, Homo sapiens
tcttttcctcgcttc

SEQ ID NO: 71646 - DNA, 15 bp, Homo sapiens
cttttcctcgcttct

SEQ ID NO: 71647 - DNA, 15 bp, Homo sapiens
ttttcctcgcttctt

SEQ ID NO: 71648 - DNA, 15 bp, Homo sapiens
tttcctcgcttcttt

SEQ ID NO: 71649 - DNA, 15 bp, Homo sapiens
ttcctcgcttctttc

SEQ ID NO: 71650 - DNA, 15 bp, Homo sapiens
tcctcgcttctttca

SEQ ID NO: 71651 - DNA, 15 bp, Homo sapiens
cctcgcttctttcaa

SEQ ID NO: 71652 - DNA, 15 bp, Homo sapiens
ctcgcttctttcaag

SEQ ID NO: 71653 - DNA, 15 bp, Homo sapiens
tcgcttctttcaagg

SEQ ID NO: 71654 - DNA, 15 bp, Homo sapiens
cgcttctttcaaggg

SEQ ID NO: 71655 - DNA, 15 bp, Homo sapiens
gcttctttcaagggc

SEQ ID NO: 71656 - DNA, 15 bp, Homo sapiens
cttctttcaagggct

SEQ ID NO: 71657 - DNA, 15 bp, Homo sapiens
ttctttcaagggctt

SEQ ID NO: 71658 - DNA, 15 bp, Homo sapiens
tctttcaagggcttt

SEQ ID NO: 71659 - DNA, 15 bp, Homo sapiens
ctttcaagggctttc

SEQ ID NO: 71660 - DNA, 15 bp, Homo sapiens
tttcaagggctttcc

SEQ ID NO: 71661 - DNA, 15 bp, Homo sapiens
ttcaagggctttcct

SEQ ID NO: 71662 - DNA, 15 bp, Homo sapiens
tcaagggctttcctg

SEQ ID NO: 71663 - DNA, 15 bp, Homo sapiens
caagggctttcctgt

SEQ ID NO: 71664 - DNA, 15 bp, Homo sapiens
aagggctttcctgtg

SEQ ID NO: 71665 - DNA, 15 bp, Homo sapiens
agggctttcctgtgc

SEQ ID NO: 71666 - DNA, 15 bp, Homo sapiens
gggctttcctgtgcc

SEQ ID NO: 71667 - DNA, 15 bp, Homo sapiens
ggctttcctgtgcca

SEQ ID NO: 71668 - DNA, 15 bp, Homo sapiens
gctttcctgtgccag

SEQ ID NO: 71669 - DNA, 15 bp, Homo sapiens
ctttcctgtgccagg

SEQ ID NO: 71670 - DNA, 15 bp, Homo sapiens
tttcctgtgccaggt

SEQ ID NO: 71671 - DNA, 15 bp, Homo sapiens
ttcctgtgccaggtg

SEQ ID NO: 71672 - DNA, 15 bp, Homo sapiens
tcctgtgccaggtga

SEQ ID NO: 71673 - DNA, 15 bp, Homo sapiens
cctgtgccaggtgaa

SEQ ID NO: 71674 - DNA, 15 bp, Homo sapiens
ctgtgccaggtgaag

SEQ ID NO: 71675 - DNA, 15 bp, Homo sapiens
tgtgccaggtgaagg

SEQ ID NO: 71676 - DNA, 15 bp, Homo sapiens
gtgccaggtgaagga

SEQ ID NO: 71677 - DNA, 15 bp, Homo sapiens
tgccaggtgaaggag

SEQ ID NO: 71678 - DNA, 15 bp, Homo sapiens
gccaggtgaaggagg

SEQ ID NO: 71679 - DNA, 15 bp, Homo sapiens
ccaggtgaaggaggc

SEQ ID NO: 71680 - DNA, 15 bp, Homo sapiens
caggtgaaggaggct

SEQ ID NO: 71681 - DNA, 15 bp, Homo sapiens
aggtgaaggaggctc

SEQ ID NO: 71682 - DNA, 15 bp, Homo sapiens
ggtgaaggaggctcc

SEQ ID NO: 71683 - DNA, 15 bp, Homo sapiens
gtgaaggaggctcca

SEQ ID NO: 71684 - DNA, 15 bp, Homo sapiens
tgaaggaggctccag

SEQ ID NO: 71685 - DNA, 15 bp, Homo sapiens
gaaggaggctccagg

SEQ ID NO: 71686 - DNA, 15 bp, Homo sapiens
aaggaggctccaggc

SEQ ID NO: 71687 - DNA, 15 bp, Homo sapiens
aggaggctccaggca

SEQ ID NO: 71688 - DNA, 15 bp, Homo sapiens
ggaggctccaggcag

SEQ ID NO: 71689 - DNA, 15 bp, Homo sapiens
gaggctccaggcagc

SEQ ID NO: 71690 - DNA, 15 bp, Homo sapiens
aggctccaggcagca

SEQ ID NO: 71691 - DNA, 15 bp, Homo sapiens
ggctccaggcagcac

SEQ ID NO: 71692 - DNA, 15 bp, Homo sapiens
gctccaggcagcacc

SEQ ID NO: 71693 - DNA, 15 bp, Homo sapiens
ctccaggcagcaccc

SEQ ID NO: 71694 - DNA, 15 bp, Homo sapiens
tccaggcagcaccca

SEQ ID NO: 71695 - DNA, 15 bp, Homo sapiens
ccaggcagcacccag

SEQ ID NO: 71696 - DNA, 15 bp, Homo sapiens
caggcagcacccagg

SEQ ID NO: 71697 - DNA, 15 bp, Homo sapiens
aggcagcacccaggt

SEQ ID NO: 71698 - DNA, 15 bp, Homo sapiens
ggcagcacccaggtt

SEQ ID NO: 71699 - DNA, 15 bp, Homo sapiens
gcagcacccaggttt

SEQ ID NO: 71700 - DNA, 15 bp, Homo sapiens
cagcacccaggtttt

SEQ ID NO: 71701 - DNA, 15 bp, Homo sapiens
agcacccaggttttg

SEQ ID NO: 71702 - DNA, 15 bp, Homo sapiens
gcacccaggttttgc

SEQ ID NO: 71703 - DNA, 15 bp, Homo sapiens
cacccaggttttgca

SEQ ID NO: 71704 - DNA, 15 bp, Homo sapiens
acccaggttttgcac

SEQ ID NO: 71705 - DNA, 15 bp, Homo sapiens
cccaggttttgcact

SEQ ID NO: 71706 - DNA, 15 bp, Homo sapiens
ccaggttttgcactc

SEQ ID NO: 71707 - DNA, 15 bp, Homo sapiens
caggttttgcactct

SEQ ID NO: 71708 - DNA, 15 bp, Homo sapiens
aggttttgcactctt

SEQ ID NO: 71709 - DNA, 15 bp, Homo sapiens
ggttttgcactcttg

SEQ ID NO: 71710 - DNA, 15 bp, Homo sapiens
gttttgcactcttgt

SEQ ID NO: 71711 - DNA, 15 bp, Homo sapiens
ttttgcactcttgtt

SEQ ID NO: 71712 - DNA, 15 bp, Homo sapiens
tttgcactcttgttt

SEQ ID NO: 71713 - DNA, 15 bp, Homo sapiens
ttgcactcttgtttc

SEQ ID NO: 71714 - DNA, 15 bp, Homo sapiens
tgcactcttgtttct

SEQ ID NO: 71715 - DNA, 15 bp, Homo sapiens
gcactcttgtttctc

SEQ ID NO: 71716 - DNA, 15 bp, Homo sapiens
cactcttgtttctcc

SEQ ID NO: 71717 - DNA, 15 bp, Homo sapiens
actcttgtttctccc

SEQ ID NO: 71718 - DNA, 15 bp, Homo sapiens
ctcttgtttctcccg

SEQ ID NO: 71719 - DNA, 15 bp, Homo sapiens
tcttgtttctcccgt

SEQ ID NO: 71720 - DNA, 15 bp, Homo sapiens
cttgtttctcccgtg

SEQ ID NO: 71721 - DNA, 15 bp, Homo sapiens
ttgtttctcccgtgc

SEQ ID NO: 71722 - DNA, 15 bp, Homo sapiens
tgtttctcccgtgct

SEQ ID NO: 71723 - DNA, 15 bp, Homo sapiens
gtttctcccgtgctt

SEQ ID NO: 71724 - DNA, 15 bp, Homo sapiens
tttctcccgtgcttg

SEQ ID NO: 71725 - DNA, 15 bp, Homo sapiens
ttctcccgtgcttgt

SEQ ID NO: 71726 - DNA, 15 bp, Homo sapiens
tctcccgtgcttgtg

SEQ ID NO: 71727 - DNA, 15 bp, Homo sapiens
ctcccgtgcttgtga

SEQ ID NO: 71728 - DNA, 15 bp, Homo sapiens
tcccgtgcttgtgaa

SEQ ID NO: 71729 - DNA, 15 bp, Homo sapiens
cccgtgcttgtgaaa

SEQ ID NO: 71730 - DNA, 15 bp, Homo sapiens
ccgtgcttgtgaaag

SEQ ID NO: 71731 - DNA, 15 bp, Homo sapiens
cgtgcttgtgaaaga

SEQ ID NO: 71732 - DNA, 15 bp, Homo sapiens
gtgcttgtgaaagag

SEQ ID NO: 71733 - DNA, 15 bp, Homo sapiens
tgcttgtgaaagagg

SEQ ID NO: 71734 - DNA, 15 bp, Homo sapiens
gcttgtgaaagaggt

SEQ ID NO: 71735 - DNA, 15 bp, Homo sapiens
cttgtgaaagaggtc

SEQ ID NO: 71736 - DNA, 15 bp, Homo sapiens
ttgtgaaagaggtcc

SEQ ID NO: 71737 - DNA, 15 bp, Homo sapiens
tgtgaaagaggtccc

SEQ ID NO: 71738 - DNA, 15 bp, Homo sapiens
gtgaaagaggtccca

SEQ ID NO: 71739 - DNA, 15 bp, Homo sapiens
tgaaagaggtcccaa

SEQ ID NO: 71740 - DNA, 15 bp, Homo sapiens
gaaagaggtcccaag

SEQ ID NO: 71741 - DNA, 15 bp, Homo sapiens
aaagaggtcccaagg

SEQ ID NO: 71742 - DNA, 15 bp, Homo sapiens
aagaggtcccaaggt

SEQ ID NO: 71743 - DNA, 15 bp, Homo sapiens
agaggtcccaaggtt

SEQ ID NO: 71744 - DNA, 15 bp, Homo sapiens
gaggtcccaaggttc

SEQ ID NO: 71745 - DNA, 15 bp, Homo sapiens
aggtcccaaggttct

SEQ ID NO: 71746 - DNA, 15 bp, Homo sapiens
ggtcccaaggttctg

SEQ ID NO: 71747 - DNA, 15 bp, Homo sapiens
gtcccaaggttctgg

SEQ ID NO: 71748 - DNA, 15 bp, Homo sapiens
tcccaaggttctggg

SEQ ID NO: 71749 - DNA, 15 bp, Homo sapiens
cccaaggttctgggt

SEQ ID NO: 71750 - DNA, 15 bp, Homo sapiens
ccaaggttctgggtg

SEQ ID NO: 71751 - DNA, 15 bp, Homo sapiens
caaggttctgggtgc

SEQ ID NO: 71752 - DNA, 15 bp, Homo sapiens
aaggttctgggtgca

SEQ ID NO: 71753 - DNA, 15 bp, Homo sapiens
aggttctgggtgcag

SEQ ID NO: 71754 - DNA, 15 bp, Homo sapiens
ggttctgggtgcagg

SEQ ID NO: 71755 - DNA, 15 bp, Homo sapiens
gttctgggtgcagga

SEQ ID NO: 71756 - DNA, 15 bp, Homo sapiens
ttctgggtgcaggag

SEQ ID NO: 71757 - DNA, 15 bp, Homo sapiens
tctgggtgcaggagc

SEQ ID NO: 71758 - DNA, 15 bp, Homo sapiens
ctgggtgcaggagcg

SEQ ID NO: 71759 - DNA, 15 bp, Homo sapiens
tgggtgcaggagcgc

SEQ ID NO: 71760 - DNA, 15 bp, Homo sapiens
gggtgcaggagcgct

SEQ ID NO: 71761 - DNA, 15 bp, Homo sapiens
ggtgcaggagcgctc

SEQ ID NO: 71762 - DNA, 15 bp, Homo sapiens
gtgcaggagcgctcc

SEQ ID NO: 71763 - DNA, 15 bp, Homo sapiens
tgcaggagcgctccc

SEQ ID NO: 71764 - DNA, 15 bp, Homo sapiens
gcaggagcgctccct

SEQ ID NO: 71765 - DNA, 15 bp, Homo sapiens
caggagcgctccctt

SEQ ID NO: 71766 - DNA, 15 bp, Homo sapiens
aggagcgctcccttg

SEQ ID NO: 71767 - DNA, 15 bp, Homo sapiens
ggagcgctcccttga

SEQ ID NO: 71768 - DNA, 15 bp, Homo sapiens
gagcgctcccttgac

SEQ ID NO: 71769 - DNA, 15 bp, Homo sapiens
agcgctcccttgacc

SEQ ID NO: 71770 - DNA, 15 bp, Homo sapiens
gcgctcccttgacct

SEQ ID NO: 71771 - DNA, 15 bp, Homo sapiens
cgctcccttgacctg

SEQ ID NO: 71772 - DNA, 15 bp, Homo sapiens
gctcccttgacctgc

SEQ ID NO: 71773 - DNA, 15 bp, Homo sapiens
ctcccttgacctgct

SEQ ID NO: 71774 - DNA, 15 bp, Homo sapiens
tcccttgacctgctg

SEQ ID NO: 71775 - DNA, 15 bp, Homo sapiens
cccttgacctgctga

SEQ ID NO: 71776 - DNA, 15 bp, Homo sapiens
ccttgacctgctgaa

SEQ ID NO: 71777 - DNA, 15 bp, Homo sapiens
cttgacctgctgaag

SEQ ID NO: 71778 - DNA, 15 bp, Homo sapiens
ttgacctgctgaagt

SEQ ID NO: 71779 - DNA, 15 bp, Homo sapiens
tgacctgctgaagtc

SEQ ID NO: 71780 - DNA, 15 bp, Homo sapiens
gacctgctgaagtcc

SEQ ID NO: 71781 - DNA, 15 bp, Homo sapiens
acctgctgaagtccg

SEQ ID NO: 71782 - DNA, 15 bp, Homo sapiens
cctgctgaagtccgg

SEQ ID NO: 71783 - DNA, 15 bp, Homo sapiens
ctgctgaagtccgga

SEQ ID NO: 71784 - DNA, 15 bp, Homo sapiens
tgctgaagtccggaa

SEQ ID NO: 71785 - DNA, 15 bp, Homo sapiens
gctgaagtccggaac

SEQ ID NO: 71786 - DNA, 15 bp, Homo sapiens
ctgaagtccggaacg

SEQ ID NO: 71787 - DNA, 15 bp, Homo sapiens
tgaagtccggaacgt

SEQ ID NO: 71788 - DNA, 15 bp, Homo sapiens
gaagtccggaacgta

SEQ ID NO: 71789 - DNA, 15 bp, Homo sapiens
aagtccggaacgtag

SEQ ID NO: 71790 - DNA, 15 bp, Homo sapiens
agtccggaacgtagt

SEQ ID NO: 71791 - DNA, 15 bp, Homo sapiens
gtccggaacgtagtc

SEQ ID NO: 71792 - DNA, 15 bp, Homo sapiens
tccggaacgtagtcg

SEQ ID NO: 71793 - DNA, 15 bp, Homo sapiens
ccggaacgtagtcgg

SEQ ID NO: 71794 - DNA, 15 bp, Homo sapiens
cggaacgtagtcggc

SEQ ID NO: 71795 - DNA, 15 bp, Homo sapiens
ggaacgtagtcggca

SEQ ID NO: 71796 - DNA, 15 bp, Homo sapiens
gaacgtagtcggcac

SEQ ID NO: 71797 - DNA, 15 bp, Homo sapiens
aacgtagtcggcaca

SEQ ID NO: 71798 - DNA, 15 bp, Homo sapiens
acgtagtcggcacag

SEQ ID NO: 71799 - DNA, 15 bp, Homo sapiens
cgtagtcggcacagc

SEQ ID NO: 71800 - DNA, 15 bp, Homo sapiens
gtagtcggcacagcc

SEQ ID NO: 71801 - DNA, 15 bp, Homo sapiens
tagtcggcacagcct

SEQ ID NO: 71802 - DNA, 15 bp, Homo sapiens
agtcggcacagcctg

SEQ ID NO: 71803 - DNA, 15 bp, Homo sapiens
gtcggcacagcctgg

SEQ ID NO: 71804 - DNA, 15 bp, Homo sapiens
tcggcacagcctggt

SEQ ID NO: 71805 - DNA, 15 bp, Homo sapiens
cggcacagcctggtc

SEQ ID NO: 71806 - DNA, 15 bp, Homo sapiens
ggcacagcctggtcg

SEQ ID NO: 71807 - DNA, 15 bp, Homo sapiens
gcacagcctggtcgc

SEQ ID NO: 71808 - DNA, 15 bp, Homo sapiens
cacagcctggtcgcc

SEQ ID NO: 71809 - DNA, 15 bp, Homo sapiens
acagcctggtcgcct

SEQ ID NO: 71810 - DNA, 15 bp, Homo sapiens
cagcctggtcgcctt

SEQ ID NO: 71811 - DNA, 15 bp, Homo sapiens
agcctggtcgccttc

SEQ ID NO: 71812 - DNA, 15 bp, Homo sapiens
gcctggtcgccttcc

SEQ ID NO: 71813 - DNA, 15 bp, Homo sapiens
cctggtcgccttcca

SEQ ID NO: 71814 - DNA, 15 bp, Homo sapiens
ctggtcgccttccac

SEQ ID NO: 71815 - DNA, 15 bp, Homo sapiens
tggtcgccttccacc

SEQ ID NO: 71816 - DNA, 15 bp, Homo sapiens
ggtcgccttccacct

SEQ ID NO: 71817 - DNA, 15 bp, Homo sapiens
gtcgccttccacctc

SEQ ID NO: 71818 - DNA, 15 bp, Homo sapiens
tcgccttccacctct

SEQ ID NO: 71819 - DNA, 15 bp, Homo sapiens
cgccttccacctctg

SEQ ID NO: 71820 - DNA, 15 bp, Homo sapiens
gccttccacctctgg

SEQ ID NO: 71821 - DNA, 15 bp, Homo sapiens
ccttccacctctggg

SEQ ID NO: 71822 - DNA, 15 bp, Homo sapiens
cttccacctctggga

SEQ ID NO: 71823 - DNA, 15 bp, Homo sapiens
ttccacctctgggag

SEQ ID NO: 71824 - DNA, 15 bp, Homo sapiens
tccacctctgggagc

SEQ ID NO: 71825 - DNA, 15 bp, Homo sapiens
ccacctctgggagct

SEQ ID NO: 71826 - DNA, 15 bp, Homo sapiens
cacctctgggagctg

SEQ ID NO: 71827 - DNA, 15 bp, Homo sapiens
acctctgggagctgg

SEQ ID NO: 71828 - DNA, 15 bp, Homo sapiens
cctctgggagctgga

SEQ ID NO: 71829 - DNA, 15 bp, Homo sapiens
ctctgggagctggag

SEQ ID NO: 71830 - DNA, 15 bp, Homo sapiens
tctgggagctggagt

SEQ ID NO: 71831 - DNA, 15 bp, Homo sapiens
ctgggagctggagtc

SEQ ID NO: 71832 - DNA, 15 bp, Homo sapiens
tgggagctggagtcc

SEQ ID NO: 71833 - DNA, 15 bp, Homo sapiens
gggagctggagtcca

SEQ ID NO: 71834 - DNA, 15 bp, Homo sapiens
ggagctggagtccac

SEQ ID NO: 71835 - DNA, 15 bp, Homo sapiens
gagctggagtccact

SEQ ID NO: 71836 - DNA, 15 bp, Homo sapiens
agctggagtccactg

SEQ ID NO: 71837 - DNA, 15 bp, Homo sapiens
gctggagtccactgg

SEQ ID NO: 71838 - DNA, 15 bp, Homo sapiens
ctggagtccactggg

SEQ ID NO: 71839 - DNA, 15 bp, Homo sapiens
tggagtccactgggg

SEQ ID NO: 71840 - DNA, 15 bp, Homo sapiens
ggagtccactggggt

SEQ ID NO: 71841 - DNA, 15 bp, Homo sapiens
gagtccactggggtg

SEQ ID NO: 71842 - DNA, 15 bp, Homo sapiens
agtccactggggtgg

SEQ ID NO: 71843 - DNA, 15 bp, Homo sapiens
gtccactggggtggc

SEQ ID NO: 71844 - DNA, 15 bp, Homo sapiens
tccactggggtggcc

SEQ ID NO: 71845 - DNA, 15 bp, Homo sapiens
ccactggggtggcct

SEQ ID NO: 71846 - DNA, 15 bp, Homo sapiens
cactggggtggcctg

SEQ ID NO: 71847 - DNA, 15 bp, Homo sapiens
actggggtggcctga

SEQ ID NO: 71848 - DNA, 15 bp, Homo sapiens
ctggggtggcctgac

SEQ ID NO: 71849 - DNA, 15 bp, Homo sapiens
tggggtggcctgact

SEQ ID NO: 71850 - DNA, 15 bp, Homo sapiens
ggggtggcctgactc

SEQ ID NO: 71851 - DNA, 15 bp, Homo sapiens
gggtggcctgactcc

SEQ ID NO: 71852 - DNA, 15 bp, Homo sapiens
ggtggcctgactccc

SEQ ID NO: 71853 - DNA, 15 bp, Homo sapiens
gtggcctgactcccc

SEQ ID NO: 71854 - DNA, 15 bp, Homo sapiens
tggcctgactccccc

SEQ ID NO: 71855 - DNA, 15 bp, Homo sapiens
ggcctgactccccca

SEQ ID NO: 71856 - DNA, 15 bp, Homo sapiens
gcctgactcccccag

SEQ ID NO: 71857 - DNA, 15 bp, Homo sapiens
cctgactcccccagt

SEQ ID NO: 71858 - DNA, 15 bp, Homo sapiens
ctgactcccccagtc

SEQ ID NO: 71859 - DNA, 15 bp, Homo sapiens
tgactcccccagtcc

SEQ ID NO: 71860 - DNA, 15 bp, Homo sapiens
gactcccccagtccc

SEQ ID NO: 71861 - DNA, 15 bp, Homo sapiens
actcccccagtcccc

SEQ ID NO: 71862 - DNA, 15 bp, Homo sapiens
ctcccccagtcccct

SEQ ID NO: 71863 - DNA, 15 bp, Homo sapiens
tcccccagtcccctt

SEQ ID NO: 71864 - DNA, 15 bp, Homo sapiens
cccccagtccccttc

SEQ ID NO: 71865 - DNA, 15 bp, Homo sapiens
ccccagtccccttcc

SEQ ID NO: 71866 - DNA, 15 bp, Homo sapiens
cccagtccccttccc

SEQ ID NO: 71867 - DNA, 15 bp, Homo sapiens
ccagtccccttcccg

SEQ ID NO: 71868 - DNA, 15 bp, Homo sapiens
cagtccccttcccgt

SEQ ID NO: 71869 - DNA, 15 bp, Homo sapiens
agtccccttcccgtg

SEQ ID NO: 71870 - DNA, 15 bp, Homo sapiens
gtccccttcccgtga

SEQ ID NO: 71871 - DNA, 15 bp, Homo sapiens
tccccttcccgtgac

SEQ ID NO: 71872 - DNA, 15 bp, Homo sapiens
ccccttcccgtgacc

SEQ ID NO: 71873 - DNA, 15 bp, Homo sapiens
cccttcccgtgacct

SEQ ID NO: 71874 - DNA, 15 bp, Homo sapiens
ccttcccgtgacctg

SEQ ID NO: 71875 - DNA, 15 bp, Homo sapiens
cttcccgtgacctgg

SEQ ID NO: 71876 - DNA, 15 bp, Homo sapiens
ttcccgtgacctggt

SEQ ID NO: 71877 - DNA, 15 bp, Homo sapiens
tcccgtgacctggtc

SEQ ID NO: 71878 - DNA, 15 bp, Homo sapiens
cccgtgacctggtca

SEQ ID NO: 71879 - DNA, 15 bp, Homo sapiens
ccgtgacctggtcag

SEQ ID NO: 71880 - DNA, 15 bp, Homo sapiens
cgtgacctggtcagg

SEQ ID NO: 71881 - DNA, 15 bp, Homo sapiens
gtgacctggtcaggg

SEQ ID NO: 71882 - DNA, 15 bp, Homo sapiens
tgacctggtcagggt

SEQ ID NO: 71883 - DNA, 15 bp, Homo sapiens
gacctggtcagggtg

SEQ ID NO: 71884 - DNA, 15 bp, Homo sapiens
acctggtcagggtga

SEQ ID NO: 71885 - DNA, 15 bp, Homo sapiens
cctggtcagggtgag

SEQ ID NO: 71886 - DNA, 15 bp, Homo sapiens
ctggtcagggtgagc

SEQ ID NO: 71887 - DNA, 15 bp, Homo sapiens
tggtcagggtgagcc

SEQ ID NO: 71888 - DNA, 15 bp, Homo sapiens
ggtcagggtgagccc

SEQ ID NO: 71889 - DNA, 15 bp, Homo sapiens
gtcagggtgagccca

SEQ ID NO: 71890 - DNA, 15 bp, Homo sapiens
tcagggtgagcccat

SEQ ID NO: 71891 - DNA, 15 bp, Homo sapiens
cagggtgagcccatg

SEQ ID NO: 71892 - DNA, 15 bp, Homo sapiens
agggtgagcccatgt

SEQ ID NO: 71893 - DNA, 15 bp, Homo sapiens
gggtgagcccatgtg

SEQ ID NO: 71894 - DNA, 15 bp, Homo sapiens
ggtgagcccatgtgg

SEQ ID NO: 71895 - DNA, 15 bp, Homo sapiens
gtgagcccatgtgga

SEQ ID NO: 71896 - DNA, 15 bp, Homo sapiens
tgagcccatgtggag

SEQ ID NO: 71897 - DNA, 15 bp, Homo sapiens
gagcccatgtggagt

SEQ ID NO: 71898 - DNA, 15 bp, Homo sapiens
agcccatgtggagtc

SEQ ID NO: 71899 - DNA, 15 bp, Homo sapiens
gcccatgtggagtca

SEQ ID NO: 71900 - DNA, 15 bp, Homo sapiens
cccatgtggagtcag

SEQ ID NO: 71901 - DNA, 15 bp, Homo sapiens
ccatgtggagtcagc

SEQ ID NO: 71902 - DNA, 15 bp, Homo sapiens
catgtggagtcagcc

SEQ ID NO: 71903 - DNA, 15 bp, Homo sapiens
atgtggagtcagcct

SEQ ID NO: 71904 - DNA, 15 bp, Homo sapiens
tgtggagtcagcctc

SEQ ID NO: 71905 - DNA, 15 bp, Homo sapiens
gtggagtcagcctcg

SEQ ID NO: 71906 - DNA, 15 bp, Homo sapiens
tggagtcagcctcgc

SEQ ID NO: 71907 - DNA, 15 bp, Homo sapiens
ggagtcagcctcgca

SEQ ID NO: 71908 - DNA, 15 bp, Homo sapiens
gagtcagcctcgcag

SEQ ID NO: 71909 - DNA, 15 bp, Homo sapiens
agtcagcctcgcagg

SEQ ID NO: 71910 - DNA, 15 bp, Homo sapiens
gtcagcctcgcaggc

SEQ ID NO: 71911 - DNA, 15 bp, Homo sapiens
tcagcctcgcaggcc

SEQ ID NO: 71912 - DNA, 15 bp, Homo sapiens
cagcctcgcaggcct

SEQ ID NO: 71913 - DNA, 15 bp, Homo sapiens
agcctcgcaggcctc

SEQ ID NO: 71914 - DNA, 15 bp, Homo sapiens
gcctcgcaggcctcc

SEQ ID NO: 71915 - DNA, 15 bp, Homo sapiens
cctcgcaggcctccc

SEQ ID NO: 71916 - DNA, 15 bp, Homo sapiens
ctcgcaggcctccct

SEQ ID NO: 71917 - DNA, 15 bp, Homo sapiens
tcgcaggcctccctg

SEQ ID NO: 71918 - DNA, 15 bp, Homo sapiens
cgcaggcctccctgc

SEQ ID NO: 71919 - DNA, 15 bp, Homo sapiens
gcaggcctccctgcc

SEQ ID NO: 71920 - DNA, 15 bp, Homo sapiens
caggcctccctgcca

SEQ ID NO: 71921 - DNA, 15 bp, Homo sapiens
aggcctccctgccag

SEQ ID NO: 71922 - DNA, 15 bp, Homo sapiens
ggcctccctgccagt

SEQ ID NO: 71923 - DNA, 15 bp, Homo sapiens
gcctccctgccagta

SEQ ID NO: 71924 - DNA, 15 bp, Homo sapiens
cctccctgccagtag

SEQ ID NO: 71925 - DNA, 15 bp, Homo sapiens
ctccctgccagtagg

SEQ ID NO: 71926 - DNA, 15 bp, Homo sapiens
tccctgccagtaggg

SEQ ID NO: 71927 - DNA, 15 bp, Homo sapiens
ccctgccagtagggt

SEQ ID NO: 71928 - DNA, 15 bp, Homo sapiens
cctgccagtagggtc

SEQ ID NO: 71929 - DNA, 15 bp, Homo sapiens
ctgccagtagggtcc

SEQ ID NO: 71930 - DNA, 15 bp, Homo sapiens
tgccagtagggtccg

SEQ ID NO: 71931 - DNA, 15 bp, Homo sapiens
gccagtagggtccga

SEQ ID NO: 71932 - DNA, 15 bp, Homo sapiens
ccagtagggtccgag

SEQ ID NO: 71933 - DNA, 15 bp, Homo sapiens
cagtagggtccgagt

SEQ ID NO: 71934 - DNA, 15 bp, Homo sapiens
agtagggtccgagtg

SEQ ID NO: 71935 - DNA, 15 bp, Homo sapiens
gtagggtccgagtgt

SEQ ID NO: 71936 - DNA, 15 bp, Homo sapiens
tagggtccgagtgtg

SEQ ID NO: 71937 - DNA, 15 bp, Homo sapiens
agggtccgagtgtgt

SEQ ID NO: 71938 - DNA, 15 bp, Homo sapiens
gggtccgagtgtgtt

SEQ ID NO: 71939 - DNA, 15 bp, Homo sapiens
ggtccgagtgtgttt

SEQ ID NO: 71940 - DNA, 15 bp, Homo sapiens
gtccgagtgtgtttc

SEQ ID NO: 71941 - DNA, 15 bp, Homo sapiens
tccgagtgtgtttca

SEQ ID NO: 71942 - DNA, 15 bp, Homo sapiens
ccgagtgtgtttcat

SEQ ID NO: 71943 - DNA, 15 bp, Homo sapiens
cgagtgtgtttcatc

SEQ ID NO: 71944 - DNA, 15 bp, Homo sapiens
gagtgtgtttcatcc

SEQ ID NO: 71945 - DNA, 15 bp, Homo sapiens
agtgtgtttcatcct

SEQ ID NO: 71946 - DNA, 15 bp, Homo sapiens
gtgtgtttcatcctt

SEQ ID NO: 71947 - DNA, 15 bp, Homo sapiens
tgtgtttcatccttc

SEQ ID NO: 71948 - DNA, 15 bp, Homo sapiens
gtgtttcatccttcc

SEQ ID NO: 71949 - DNA, 15 bp, Homo sapiens
tgtttcatccttccc

SEQ ID NO: 71950 - DNA, 15 bp, Homo sapiens
gtttcatccttccca

SEQ ID NO: 71951 - DNA, 15 bp, Homo sapiens
tttcatccttcccac

SEQ ID NO: 71952 - DNA, 15 bp, Homo sapiens
ttcatccttcccact

SEQ ID NO: 71953 - DNA, 15 bp, Homo sapiens
tcatccttcccactc

SEQ ID NO: 71954 - DNA, 15 bp, Homo sapiens
catccttcccactct

SEQ ID NO: 71955 - DNA, 15 bp, Homo sapiens
atccttcccactctg

SEQ ID NO: 71956 - DNA, 15 bp, Homo sapiens
tccttcccactctgt

SEQ ID NO: 71957 - DNA, 15 bp, Homo sapiens
ccttcccactctgtc

SEQ ID NO: 71958 - DNA, 15 bp, Homo sapiens
cttcccactctgtcg

SEQ ID NO: 71959 - DNA, 15 bp, Homo sapiens
ttcccactctgtcga

SEQ ID NO: 71960 - DNA, 15 bp, Homo sapiens
tcccactctgtcgag

SEQ ID NO: 71961 - DNA, 15 bp, Homo sapiens
cccactctgtcgagc

SEQ ID NO: 71962 - DNA, 15 bp, Homo sapiens
ccactctgtcgagcc

SEQ ID NO: 71963 - DNA, 15 bp, Homo sapiens
cactctgtcgagcct

SEQ ID NO: 71964 - DNA, 15 bp, Homo sapiens
actctgtcgagcctg

SEQ ID NO: 71965 - DNA, 15 bp, Homo sapiens
ctctgtcgagcctgg

SEQ ID NO: 71966 - DNA, 15 bp, Homo sapiens
tctgtcgagcctggg

SEQ ID NO: 71967 - DNA, 15 bp, Homo sapiens
ctgtcgagcctgggg

SEQ ID NO: 71968 - DNA, 15 bp, Homo sapiens
tgtcgagcctggggg

SEQ ID NO: 71969 - DNA, 15 bp, Homo sapiens
gtcgagcctgggggc

SEQ ID NO: 71970 - DNA, 15 bp, Homo sapiens
tcgagcctgggggct

SEQ ID NO: 71971 - DNA, 15 bp, Homo sapiens
cgagcctgggggctg

SEQ ID NO: 71972 - DNA, 15 bp, Homo sapiens
gagcctgggggctgg

SEQ ID NO: 71973 - DNA, 15 bp, Homo sapiens
agcctgggggctgga

SEQ ID NO: 71974 - DNA, 15 bp, Homo sapiens
gcctgggggctggag

SEQ ID NO: 71975 - DNA, 15 bp, Homo sapiens
cctgggggctggagc

SEQ ID NO: 71976 - DNA, 15 bp, Homo sapiens
ctgggggctggagcg

SEQ ID NO: 71977 - DNA, 15 bp, Homo sapiens
tgggggctggagcgg

SEQ ID NO: 71978 - DNA, 15 bp, Homo sapiens
gggggctggagcgga

SEQ ID NO: 71979 - DNA, 15 bp, Homo sapiens
ggggctggagcggag

SEQ ID NO: 71980 - DNA, 15 bp, Homo sapiens
gggctggagcggaga

SEQ ID NO: 71981 - DNA, 15 bp, Homo sapiens
ggctggagcggagac

SEQ ID NO: 71982 - DNA, 15 bp, Homo sapiens
gctggagcggagacg

SEQ ID NO: 71983 - DNA, 15 bp, Homo sapiens
ctggagcggagacgg

SEQ ID NO: 71984 - DNA, 15 bp, Homo sapiens
tggagcggagacggg

SEQ ID NO: 71985 - DNA, 15 bp, Homo sapiens
ggagcggagacggga

SEQ ID NO: 71986 - DNA, 15 bp, Homo sapiens
gagcggagacgggag

SEQ ID NO: 71987 - DNA, 15 bp, Homo sapiens
agcggagacgggagg

SEQ ID NO: 71988 - DNA, 15 bp, Homo sapiens
gcggagacgggaggc

SEQ ID NO: 71989 - DNA, 15 bp, Homo sapiens
cggagacgggaggcc

SEQ ID NO: 71990 - DNA, 15 bp, Homo sapiens
ggagacgggaggcct

SEQ ID NO: 71991 - DNA, 15 bp, Homo sapiens
gagacgggaggcctg

SEQ ID NO: 71992 - DNA, 15 bp, Homo sapiens
agacgggaggcctgg

SEQ ID NO: 71993 - DNA, 15 bp, Homo sapiens
gacgggaggcctggc

SEQ ID NO: 71994 - DNA, 15 bp, Homo sapiens
acgggaggcctggcc

SEQ ID NO: 71995 - DNA, 15 bp, Homo sapiens
cgggaggcctggcct

SEQ ID NO: 71996 - DNA, 15 bp, Homo sapiens
gggaggcctggcctg

SEQ ID NO: 71997 - DNA, 15 bp, Homo sapiens
ggaggcctggcctgt

SEQ ID NO: 71998 - DNA, 15 bp, Homo sapiens
gaggcctggcctgtc

SEQ ID NO: 71999 - DNA, 15 bp, Homo sapiens
aggcctggcctgtct

SEQ ID NO: 72000 - DNA, 15 bp, Homo sapiens
ggcctggcctgtctc

SEQ ID NO: 72001 - DNA, 15 bp, Homo sapiens
gcctggcctgtctcg

SEQ ID NO: 72002 - DNA, 15 bp, Homo sapiens
cctggcctgtctcgg

SEQ ID NO: 72003 - DNA, 15 bp, Homo sapiens
ctggcctgtctcgga

SEQ ID NO: 72004 - DNA, 15 bp, Homo sapiens
tggcctgtctcggaa

SEQ ID NO: 72005 - DNA, 15 bp, Homo sapiens
ggcctgtctcggaac

SEQ ID NO: 72006 - DNA, 15 bp, Homo sapiens
gcctgtctcggaacc

SEQ ID NO: 72007 - DNA, 15 bp, Homo sapiens
cctgtctcggaacct

SEQ ID NO: 72008 - DNA, 15 bp, Homo sapiens
ctgtctcggaacctg

SEQ ID NO: 72009 - DNA, 15 bp, Homo sapiens
tgtctcggaacctgt

SEQ ID NO: 72010 - DNA, 15 bp, Homo sapiens
gtctcggaacctgtg

SEQ ID NO: 72011 - DNA, 15 bp, Homo sapiens
tctcggaacctgtga

SEQ ID NO: 72012 - DNA, 15 bp, Homo sapiens
ctcggaacctgtgag

SEQ ID NO: 72013 - DNA, 15 bp, Homo sapiens
tcggaacctgtgagc

SEQ ID NO: 72014 - DNA, 15 bp, Homo sapiens
cggaacctgtgagct

SEQ ID NO: 72015 - DNA, 15 bp, Homo sapiens
ggaacctgtgagctg

SEQ ID NO: 72016 - DNA, 15 bp, Homo sapiens
gaacctgtgagctgc

SEQ ID NO: 72017 - DNA, 15 bp, Homo sapiens
aacctgtgagctgca

SEQ ID NO: 72018 - DNA, 15 bp, Homo sapiens
acctgtgagctgcac

SEQ ID NO: 72019 - DNA, 15 bp, Homo sapiens
cctgtgagctgcacc

SEQ ID NO: 72020 - DNA, 15 bp, Homo sapiens
ctgtgagctgcacca

SEQ ID NO: 72021 - DNA, 15 bp, Homo sapiens
tgtgagctgcaccag

SEQ ID NO: 72022 - DNA, 15 bp, Homo sapiens
gtgagctgcaccagg

SEQ ID NO: 72023 - DNA, 15 bp, Homo sapiens
tgagctgcaccaggt

SEQ ID NO: 72024 - DNA, 15 bp, Homo sapiens
gagctgcaccaggta

SEQ ID NO: 72025 - DNA, 15 bp, Homo sapiens
agctgcaccaggtag

SEQ ID NO: 72026 - DNA, 15 bp, Homo sapiens
gctgcaccaggtaga

SEQ ID NO: 72027 - DNA, 15 bp, Homo sapiens
ctgcaccaggtagaa

SEQ ID NO: 72028 - DNA, 15 bp, Homo sapiens
tgcaccaggtagaac

SEQ ID NO: 72029 - DNA, 15 bp, Homo sapiens
gcaccaggtagaacg

SEQ ID NO: 72030 - DNA, 15 bp, Homo sapiens
caccaggtagaacgc

SEQ ID NO: 72031 - DNA, 15 bp, Homo sapiens
accaggtagaacgcc

SEQ ID NO: 72032 - DNA, 15 bp, Homo sapiens
ccaggtagaacgcca

SEQ ID NO: 72033 - DNA, 15 bp, Homo sapiens
caggtagaacgccag

SEQ ID NO: 72034 - DNA, 15 bp, Homo sapiens
aggtagaacgccagg

SEQ ID NO: 72035 - DNA, 15 bp, Homo sapiens
ggtagaacgccaggg

SEQ ID NO: 72036 - DNA, 15 bp, Homo sapiens
gtagaacgccaggga

SEQ ID NO: 72037 - DNA, 15 bp, Homo sapiens
tagaacgccagggac

SEQ ID NO: 72038 - DNA, 15 bp, Homo sapiens
agaacgccagggacc

SEQ ID NO: 72039 - DNA, 15 bp, Homo sapiens
gaacgccagggaccc

SEQ ID NO: 72040 - DNA, 15 bp, Homo sapiens
aacgccagggacccc

SEQ ID NO: 72041 - DNA, 15 bp, Homo sapiens
acgccagggacccca

SEQ ID NO: 72042 - DNA, 15 bp, Homo sapiens
cgccagggaccccag

SEQ ID NO: 72043 - DNA, 15 bp, Homo sapiens
gccagggaccccaga

SEQ ID NO: 72044 - DNA, 15 bp, Homo sapiens
ccagggaccccagaa

SEQ ID NO: 72045 - DNA, 15 bp, Homo sapiens
cagggaccccagaat

SEQ ID NO: 72046 - DNA, 15 bp, Homo sapiens
agggaccccagaatc

SEQ ID NO: 72047 - DNA, 15 bp, Homo sapiens
gggaccccagaatca

SEQ ID NO: 72048 - DNA, 15 bp, Homo sapiens
ggaccccagaatcat

SEQ ID NO: 72049 - DNA, 15 bp, Homo sapiens
gaccccagaatcatg

SEQ ID NO: 72050 - DNA, 15 bp, Homo sapiens
accccagaatcatgt

SEQ ID NO: 72051 - DNA, 15 bp, Homo sapiens
ccccagaatcatgtg

SEQ ID NO: 72052 - DNA, 15 bp, Homo sapiens
cccagaatcatgtgc

SEQ ID NO: 72053 - DNA, 15 bp, Homo sapiens
ccagaatcatgtgcg

SEQ ID NO: 72054 - DNA, 15 bp, Homo sapiens
cagaatcatgtgcgt

SEQ ID NO: 72055 - DNA, 15 bp, Homo sapiens
agaatcatgtgcgtc

SEQ ID NO: 72056 - DNA, 15 bp, Homo sapiens
gaatcatgtgcgtca

SEQ ID NO: 72057 - DNA, 15 bp, Homo sapiens
aatcatgtgcgtcag

SEQ ID NO: 72058 - DNA, 15 bp, Homo sapiens
atcatgtgcgtcagt

SEQ ID NO: 72059 - DNA, 15 bp, Homo sapiens
tcatgtgcgtcagtc

SEQ ID NO: 72060 - DNA, 15 bp, Homo sapiens
catgtgcgtcagtcc

SEQ ID NO: 72061 - DNA, 15 bp, Homo sapiens
atgtgcgtcagtcca

SEQ ID NO: 72062 - DNA, 15 bp, Homo sapiens
tgtgcgtcagtccaa

SEQ ID NO: 72063 - DNA, 15 bp, Homo sapiens
gtgcgtcagtccaag

SEQ ID NO: 72064 - DNA, 15 bp, Homo sapiens
tgcgtcagtccaagg

SEQ ID NO: 72065 - DNA, 15 bp, Homo sapiens
gcgtcagtccaaggg

SEQ ID NO: 72066 - DNA, 15 bp, Homo sapiens
cgtcagtccaagggg

SEQ ID NO: 72067 - DNA, 15 bp, Homo sapiens
gtcagtccaaggggt

SEQ ID NO: 72068 - DNA, 15 bp, Homo sapiens
tcagtccaaggggtc

SEQ ID NO: 72069 - DNA, 15 bp, Homo sapiens
cagtccaaggggtcc

SEQ ID NO: 72070 - DNA, 15 bp, Homo sapiens
agtccaaggggtccc

SEQ ID NO: 72071 - DNA, 15 bp, Homo sapiens
gtccaaggggtcccc

SEQ ID NO: 72072 - DNA, 15 bp, Homo sapiens
tccaaggggtcccct

SEQ ID NO: 72073 - DNA, 15 bp, Homo sapiens
ccaaggggtcccctc

SEQ ID NO: 72074 - DNA, 15 bp, Homo sapiens
caaggggtcccctcc

SEQ ID NO: 72075 - DNA, 15 bp, Homo sapiens
aaggggtcccctcca

SEQ ID NO: 72076 - DNA, 15 bp, Homo sapiens
aggggtcccctccag

SEQ ID NO: 72077 - DNA, 15 bp, Homo sapiens
ggggtcccctccagg

SEQ ID NO: 72078 - DNA, 15 bp, Homo sapiens
gggtcccctccagga

SEQ ID NO: 72079 - DNA, 15 bp, Homo sapiens
ggtcccctccaggag

SEQ ID NO: 72080 - DNA, 15 bp, Homo sapiens
gtcccctccaggagt

SEQ ID NO: 72081 - DNA, 15 bp, Homo sapiens
tcccctccaggagta

SEQ ID NO: 72082 - DNA, 15 bp, Homo sapiens
cccctccaggagtag

SEQ ID NO: 72083 - DNA, 15 bp, Homo sapiens
ccctccaggagtagt

SEQ ID NO: 72084 - DNA, 15 bp, Homo sapiens
cctccaggagtagtg

SEQ ID NO: 72085 - DNA, 15 bp, Homo sapiens
ctccaggagtagtga

SEQ ID NO: 72086 - DNA, 15 bp, Homo sapiens
tccaggagtagtgaa

SEQ ID NO: 72087 - DNA, 15 bp, Homo sapiens
ccaggagtagtgaag

SEQ ID NO: 72088 - DNA, 15 bp, Homo sapiens
caggagtagtgaaga

SEQ ID NO: 72089 - DNA, 15 bp, Homo sapiens
aggagtagtgaagac

SEQ ID NO: 72090 - DNA, 15 bp, Homo sapiens
ggagtagtgaagact

SEQ ID NO: 72091 - DNA, 15 bp, Homo sapiens
gagtagtgaagactc

SEQ ID NO: 72092 - DNA, 15 bp, Homo sapiens
agtagtgaagactcc

SEQ ID NO: 72093 - DNA, 15 bp, Homo sapiens
gtagtgaagactcca

SEQ ID NO: 72094 - DNA, 15 bp, Homo sapiens
tagtgaagactccag

SEQ ID NO: 72095 - DNA, 15 bp, Homo sapiens
agtgaagactccaga

SEQ ID NO: 72096 - DNA, 15 bp, Homo sapiens
gtgaagactccagaa

SEQ ID NO: 72097 - DNA, 15 bp, Homo sapiens
tgaagactccagaaa

SEQ ID NO: 72098 - DNA, 15 bp, Homo sapiens
gaagactccagaaat

SEQ ID NO: 72099 - DNA, 15 bp, Homo sapiens
aagactccagaaatg

SEQ ID NO: 72100 - DNA, 15 bp, Homo sapiens
agactccagaaatgt

SEQ ID NO: 72101 - DNA, 15 bp, Homo sapiens
gactccagaaatgtc

SEQ ID NO: 72102 - DNA, 15 bp, Homo sapiens
actccagaaatgtcc

SEQ ID NO: 72103 - DNA, 15 bp, Homo sapiens
ctccagaaatgtccc

SEQ ID NO: 72104 - DNA, 15 bp, Homo sapiens
tccagaaatgtccct

SEQ ID NO: 72105 - DNA, 15 bp, Homo sapiens
ccagaaatgtccctt

SEQ ID NO: 72106 - DNA, 15 bp, Homo sapiens
cagaaatgtcccttt

SEQ ID NO: 72107 - DNA, 15 bp, Homo sapiens
agaaatgtccctttc

SEQ ID NO: 72108 - DNA, 15 bp, Homo sapiens
gaaatgtccctttct

SEQ ID NO: 72109 - DNA, 15 bp, Homo sapiens
aaatgtccctttctt

SEQ ID NO: 72110 - DNA, 15 bp, Homo sapiens
aatgtccctttcttc

SEQ ID NO: 72111 - DNA, 15 bp, Homo sapiens
atgtccctttcttct

SEQ ID NO: 72112 - DNA, 15 bp, Homo sapiens
tgtccctttcttctc

SEQ ID NO: 72113 - DNA, 15 bp, Homo sapiens
gtccctttcttctcc

SEQ ID NO: 72114 - DNA, 15 bp, Homo sapiens
tccctttcttctccc

SEQ ID NO: 72115 - DNA, 15 bp, Homo sapiens
ccctttcttctcccc

SEQ ID NO: 72116 - DNA, 15 bp, Homo sapiens
cctttcttctccccc

SEQ ID NO: 72117 - DNA, 15 bp, Homo sapiens
ctttcttctccccca

SEQ ID NO: 72118 - DNA, 15 bp, Homo sapiens
tttcttctcccccat

SEQ ID NO: 72119 - DNA, 15 bp, Homo sapiens
ttcttctcccccatc

SEQ ID NO: 72120 - DNA, 15 bp, Homo sapiens
tcttctcccccatcc

SEQ ID NO: 72121 - DNA, 15 bp, Homo sapiens
cttctcccccatcct

SEQ ID NO: 72122 - DNA, 15 bp, Homo sapiens
ttctcccccatccta

SEQ ID NO: 72123 - DNA, 15 bp, Homo sapiens
tctcccccatcctac

SEQ ID NO: 72124 - DNA, 15 bp, Homo sapiens
ctcccccatcctacg

SEQ ID NO: 72125 - DNA, 15 bp, Homo sapiens
tcccccatcctacga

SEQ ID NO: 72126 - DNA, 15 bp, Homo sapiens
cccccatcctacgag

SEQ ID NO: 72127 - DNA, 15 bp, Homo sapiens
ccccatcctacgagt

SEQ ID NO: 72128 - DNA, 15 bp, Homo sapiens
cccatcctacgagta

SEQ ID NO: 72129 - DNA, 15 bp, Homo sapiens
ccatcctacgagtaa

SEQ ID NO: 72130 - DNA, 15 bp, Homo sapiens
catcctacgagtaat

SEQ ID NO: 72131 - DNA, 15 bp, Homo sapiens
atcctacgagtaatt

SEQ ID NO: 72132 - DNA, 15 bp, Homo sapiens
tcctacgagtaattg

SEQ ID NO: 72133 - DNA, 15 bp, Homo sapiens
cctacgagtaattgc

SEQ ID NO: 72134 - DNA, 15 bp, Homo sapiens
ctacgagtaattgca

SEQ ID NO: 72135 - DNA, 15 bp, Homo sapiens
tacgagtaattgcat

SEQ ID NO: 72136 - DNA, 15 bp, Homo sapiens
acgagtaattgcatt

SEQ ID NO: 72137 - DNA, 15 bp, Homo sapiens
cgagtaattgcattt

SEQ ID NO: 72138 - DNA, 15 bp, Homo sapiens
gagtaattgcatttg

SEQ ID NO: 72139 - DNA, 15 bp, Homo sapiens
agtaattgcatttgc

SEQ ID NO: 72140 - DNA, 15 bp, Homo sapiens
gtaattgcatttgct

SEQ ID NO: 72141 - DNA, 15 bp, Homo sapiens
taattgcatttgctt

SEQ ID NO: 72142 - DNA, 15 bp, Homo sapiens
aattgcatttgcttt

SEQ ID NO: 72143 - DNA, 15 bp, Homo sapiens
attgcatttgctttt

SEQ ID NO: 72144 - DNA, 15 bp, Homo sapiens
ttgcatttgcttttg

SEQ ID NO: 72145 - DNA, 15 bp, Homo sapiens
tgcatttgcttttgt

SEQ ID NO: 72146 - DNA, 15 bp, Homo sapiens
gcatttgcttttgta

SEQ ID NO: 72147 - DNA, 15 bp, Homo sapiens
catttgcttttgtaa

SEQ ID NO: 72148 - DNA, 15 bp, Homo sapiens
atttgcttttgtaat

SEQ ID NO: 72149 - DNA, 15 bp, Homo sapiens
tttgcttttgtaatt

SEQ ID NO: 72150 - DNA, 15 bp, Homo sapiens
ttgcttttgtaattc

SEQ ID NO: 72151 - DNA, 15 bp, Homo sapiens
tgcttttgtaattct

SEQ ID NO: 72152 - DNA, 15 bp, Homo sapiens
gcttttgtaattctt

SEQ ID NO: 72153 - DNA, 15 bp, Homo sapiens
cttttgtaattctta

SEQ ID NO: 72154 - DNA, 15 bp, Homo sapiens
ttttgtaattcttaa

SEQ ID NO: 72155 - DNA, 15 bp, Homo sapiens
tttgtaattcttaat

SEQ ID NO: 72156 - DNA, 15 bp, Homo sapiens
ttgtaattcttaatg

SEQ ID NO: 72157 - DNA, 15 bp, Homo sapiens
tgtaattcttaatga

SEQ ID NO: 72158 - DNA, 15 bp, Homo sapiens
gtaattcttaatgag

SEQ ID NO: 72159 - DNA, 15 bp, Homo sapiens
taattcttaatgagc

SEQ ID NO: 72160 - DNA, 15 bp, Homo sapiens
aattcttaatgagca

SEQ ID NO: 72161 - DNA, 15 bp, Homo sapiens
attcttaatgagcaa

SEQ ID NO: 72162 - DNA, 15 bp, Homo sapiens
ttcttaatgagcaat

SEQ ID NO: 72163 - DNA, 15 bp, Homo sapiens
tcttaatgagcaata

SEQ ID NO: 72164 - DNA, 15 bp, Homo sapiens
cttaatgagcaatat

SEQ ID NO: 72165 - DNA, 15 bp, Homo sapiens
ttaatgagcaatatc

SEQ ID NO: 72166 - DNA, 15 bp, Homo sapiens
taatgagcaatatct

SEQ ID NO: 72167 - DNA, 15 bp, Homo sapiens
aatgagcaatatctg

SEQ ID NO: 72168 - DNA, 15 bp, Homo sapiens
atgagcaatatctgc

SEQ ID NO: 72169 - DNA, 15 bp, Homo sapiens
tgagcaatatctgct

SEQ ID NO: 72170 - DNA, 15 bp, Homo sapiens
gagcaatatctgcta

SEQ ID NO: 72171 - DNA, 15 bp, Homo sapiens
agcaatatctgctag

SEQ ID NO: 72172 - DNA, 15 bp, Homo sapiens
gcaatatctgctaga

SEQ ID NO: 72173 - DNA, 15 bp, Homo sapiens
caatatctgctagag

SEQ ID NO: 72174 - DNA, 15 bp, Homo sapiens
aatatctgctagaga

SEQ ID NO: 72175 - DNA, 15 bp, Homo sapiens
atatctgctagagag

SEQ ID NO: 72176 - DNA, 15 bp, Homo sapiens
tatctgctagagagt

SEQ ID NO: 72177 - DNA, 15 bp, Homo sapiens
atctgctagagagtt

SEQ ID NO: 72178 - DNA, 15 bp, Homo sapiens
tctgctagagagttt

SEQ ID NO: 72179 - DNA, 15 bp, Homo sapiens
ctgctagagagttta

SEQ ID NO: 72180 - DNA, 15 bp, Homo sapiens
tgctagagagtttag

SEQ ID NO: 72181 - DNA, 15 bp, Homo sapiens
gctagagagtttagc

SEQ ID NO: 72182 - DNA, 15 bp, Homo sapiens
ctagagagtttagct

SEQ ID NO: 72183 - DNA, 15 bp, Homo sapiens
tagagagtttagctg

SEQ ID NO: 72184 - DNA, 15 bp, Homo sapiens
agagagtttagctgt

SEQ ID NO: 72185 - DNA, 15 bp, Homo sapiens
gagagtttagctgta

SEQ ID NO: 72186 - DNA, 15 bp, Homo sapiens
agagtttagctgtaa

SEQ ID NO: 72187 - DNA, 15 bp, Homo sapiens
gagtttagctgtaac

SEQ ID NO: 72188 - DNA, 15 bp, Homo sapiens
agtttagctgtaaca

SEQ ID NO: 72189 - DNA, 15 bp, Homo sapiens
gtttagctgtaacag

SEQ ID NO: 72190 - DNA, 15 bp, Homo sapiens
tttagctgtaacagt

SEQ ID NO: 72191 - DNA, 15 bp, Homo sapiens
ttagctgtaacagtt

SEQ ID NO: 72192 - DNA, 15 bp, Homo sapiens
tagctgtaacagttc

SEQ ID NO: 72193 - DNA, 15 bp, Homo sapiens
agctgtaacagttct

SEQ ID NO: 72194 - DNA, 15 bp, Homo sapiens
gctgtaacagttctt

SEQ ID NO: 72195 - DNA, 15 bp, Homo sapiens
ctgtaacagttcttt

SEQ ID NO: 72196 - DNA, 15 bp, Homo sapiens
tgtaacagttctttt

SEQ ID NO: 72197 - DNA, 15 bp, Homo sapiens
gtaacagttcttttt

SEQ ID NO: 72198 - DNA, 15 bp, Homo sapiens
taacagttctttttg

SEQ ID NO: 72199 - DNA, 15 bp, Homo sapiens
aacagttctttttga

SEQ ID NO: 72200 - DNA, 15 bp, Homo sapiens
acagttctttttgat

SEQ ID NO: 72201 - DNA, 15 bp, Homo sapiens
cagttctttttgatc

SEQ ID NO: 72202 - DNA, 15 bp, Homo sapiens
agttctttttgatca

SEQ ID NO: 72203 - DNA, 15 bp, Homo sapiens
gttctttttgatcat

SEQ ID NO: 72204 - DNA, 15 bp, Homo sapiens
ttctttttgatcatc

SEQ ID NO: 72205 - DNA, 15 bp, Homo sapiens
tctttttgatcatct

SEQ ID NO: 72206 - DNA, 15 bp, Homo sapiens
ctttttgatcatctt

SEQ ID NO: 72207 - DNA, 15 bp, Homo sapiens
tttttgatcatcttt

SEQ ID NO: 72208 - DNA, 15 bp, Homo sapiens
ttttgatcatctttt

SEQ ID NO: 72209 - DNA, 15 bp, Homo sapiens
tttgatcatcttttt

SEQ ID NO: 72210 - DNA, 15 bp, Homo sapiens
ttgatcatctttttt

SEQ ID NO: 72211 - DNA, 15 bp, Homo sapiens
tgatcatcttttttt

SEQ ID NO: 72212 - DNA, 15 bp, Homo sapiens
gatcatcttttttta

SEQ ID NO: 72213 - DNA, 15 bp, Homo sapiens
atcatctttttttaa

SEQ ID NO: 72214 - DNA, 15 bp, Homo sapiens
tcatctttttttaat

SEQ ID NO: 72215 - DNA, 15 bp, Homo sapiens
catctttttttaata

SEQ ID NO: 72216 - DNA, 15 bp, Homo sapiens
atctttttttaataa

SEQ ID NO: 72217 - DNA, 15 bp, Homo sapiens
tctttttttaataat

SEQ ID NO: 72218 - DNA, 15 bp, Homo sapiens
ctttttttaataatt

SEQ ID NO: 72219 - DNA, 15 bp, Homo sapiens
tttttttaataatta

SEQ ID NO: 72220 - DNA, 15 bp, Homo sapiens
ttttttaataattag

SEQ ID NO: 72221 - DNA, 15 bp, Homo sapiens
tttttaataattaga

SEQ ID NO: 72222 - DNA, 15 bp, Homo sapiens
ttttaataattagaa

SEQ ID NO: 72223 - DNA, 15 bp, Homo sapiens
tttaataattagaaa

SEQ ID NO: 72224 - DNA, 15 bp, Homo sapiens
ttaataattagaaac

SEQ ID NO: 72225 - DNA, 15 bp, Homo sapiens
taataattagaaaca

SEQ ID NO: 72226 - DNA, 15 bp, Homo sapiens
aataattagaaacac

SEQ ID NO: 72227 - DNA, 15 bp, Homo sapiens
ataattagaaacacc

SEQ ID NO: 72228 - DNA, 15 bp, Homo sapiens
taattagaaacacca

SEQ ID NO: 72229 - DNA, 15 bp, Homo sapiens
aattagaaacaccaa

SEQ ID NO: 72230 - DNA, 15 bp, Homo sapiens
attagaaacaccaaa

SEQ ID NO: 72231 - DNA, 15 bp, Homo sapiens
ttagaaacaccaaaa

SEQ ID NO: 72232 - DNA, 15 bp, Homo sapiens
tagaaacaccaaaaa

SEQ ID NO: 72233 - DNA, 15 bp, Homo sapiens
agaaacaccaaaaaa

SEQ ID NO: 72234 - DNA, 15 bp, Homo sapiens
gaaacaccaaaaaaa

SEQ ID NO: 72235 - DNA, 15 bp, Homo sapiens
aaacaccaaaaaaat

SEQ ID NO: 72236 - DNA, 15 bp, Homo sapiens
aacaccaaaaaaatc

SEQ ID NO: 72237 - DNA, 15 bp, Homo sapiens
acaccaaaaaaatcc

SEQ ID NO: 72238 - DNA, 15 bp, Homo sapiens
caccaaaaaaatcca

SEQ ID NO: 72239 - DNA, 15 bp, Homo sapiens
accaaaaaaatccag

SEQ ID NO: 72240 - DNA, 15 bp, Homo sapiens
ccaaaaaaatccaga

SEQ ID NO: 72241 - DNA, 15 bp, Homo sapiens
caaaaaaatccagaa

SEQ ID NO: 72242 - DNA, 15 bp, Homo sapiens
aaaaaaatccagaaa

SEQ ID NO: 72243 - DNA, 15 bp, Homo sapiens
aaaaaatccagaaac

SEQ ID NO: 72244 - DNA, 15 bp, Homo sapiens
aaaaatccagaaact

SEQ ID NO: 72245 - DNA, 15 bp, Homo sapiens
aaaatccagaaactt

SEQ ID NO: 72246 - DNA, 15 bp, Homo sapiens
aaatccagaaacttg

SEQ ID NO: 72247 - DNA, 15 bp, Homo sapiens
aatccagaaacttgt

SEQ ID NO: 72248 - DNA, 15 bp, Homo sapiens
atccagaaacttgtt

SEQ ID NO: 72249 - DNA, 15 bp, Homo sapiens
tccagaaacttgttc

SEQ ID NO: 72250 - DNA, 15 bp, Homo sapiens
ccagaaacttgttct

SEQ ID NO: 72251 - DNA, 15 bp, Homo sapiens
cagaaacttgttctt

SEQ ID NO: 72252 - DNA, 15 bp, Homo sapiens
agaaacttgttcttc

SEQ ID NO: 72253 - DNA, 15 bp, Homo sapiens
gaaacttgttcttcc

SEQ ID NO: 72254 - DNA, 15 bp, Homo sapiens
aaacttgttcttcca

SEQ ID NO: 72255 - DNA, 15 bp, Homo sapiens
aacttgttcttccaa

SEQ ID NO: 72256 - DNA, 15 bp, Homo sapiens
acttgttcttccaaa

SEQ ID NO: 72257 - DNA, 15 bp, Homo sapiens
cttgttcttccaaag

SEQ ID NO: 72258 - DNA, 15 bp, Homo sapiens
ttgttcttccaaagc

SEQ ID NO: 72259 - DNA, 15 bp, Homo sapiens
tgttcttccaaagca

SEQ ID NO: 72260 - DNA, 15 bp, Homo sapiens
gttcttccaaagcag

SEQ ID NO: 72261 - DNA, 15 bp, Homo sapiens
ttcttccaaagcaga

SEQ ID NO: 72262 - DNA, 15 bp, Homo sapiens
tcttccaaagcagag

SEQ ID NO: 72263 - DNA, 15 bp, Homo sapiens
cttccaaagcagaga

SEQ ID NO: 72264 - DNA, 15 bp, Homo sapiens
ttccaaagcagagag

SEQ ID NO: 72265 - DNA, 15 bp, Homo sapiens
tccaaagcagagagc

SEQ ID NO: 72266 - DNA, 15 bp, Homo sapiens
ccaaagcagagagca

SEQ ID NO: 72267 - DNA, 15 bp, Homo sapiens
caaagcagagagcat

SEQ ID NO: 72268 - DNA, 15 bp, Homo sapiens
aaagcagagagcatt

SEQ ID NO: 72269 - DNA, 15 bp, Homo sapiens
aagcagagagcatta

SEQ ID NO: 72270 - DNA, 15 bp, Homo sapiens
agcagagagcattat

SEQ ID NO: 72271 - DNA, 15 bp, Homo sapiens
gcagagagcattata

SEQ ID NO: 72272 - DNA, 15 bp, Homo sapiens
cagagagcattataa

SEQ ID NO: 72273 - DNA, 15 bp, Homo sapiens
agagagcattataat

SEQ ID NO: 72274 - DNA, 15 bp, Homo sapiens
gagagcattataatc

SEQ ID NO: 72275 - DNA, 15 bp, Homo sapiens
agagcattataatca

SEQ ID NO: 72276 - DNA, 15 bp, Homo sapiens
gagcattataatcac

SEQ ID NO: 72277 - DNA, 15 bp, Homo sapiens
agcattataatcacc

SEQ ID NO: 72278 - DNA, 15 bp, Homo sapiens
gcattataatcacca

SEQ ID NO: 72279 - DNA, 15 bp, Homo sapiens
cattataatcaccag

SEQ ID NO: 72280 - DNA, 15 bp, Homo sapiens
attataatcaccagg

SEQ ID NO: 72281 - DNA, 15 bp, Homo sapiens
ttataatcaccaggg

SEQ ID NO: 72282 - DNA, 15 bp, Homo sapiens
tataatcaccagggc

SEQ ID NO: 72283 - DNA, 15 bp, Homo sapiens
ataatcaccagggcc

SEQ ID NO: 72284 - DNA, 15 bp, Homo sapiens
taatcaccagggcca

SEQ ID NO: 72285 - DNA, 15 bp, Homo sapiens
aatcaccagggccaa

SEQ ID NO: 72286 - DNA, 15 bp, Homo sapiens
atcaccagggccaaa

SEQ ID NO: 72287 - DNA, 15 bp, Homo sapiens
tcaccagggccaaaa

SEQ ID NO: 72288 - DNA, 15 bp, Homo sapiens
caccagggccaaaag

SEQ ID NO: 72289 - DNA, 15 bp, Homo sapiens
accagggccaaaagc

SEQ ID NO: 72290 - DNA, 15 bp, Homo sapiens
ccagggccaaaagct

SEQ ID NO: 72291 - DNA, 15 bp, Homo sapiens
cagggccaaaagctt

SEQ ID NO: 72292 - DNA, 15 bp, Homo sapiens
agggccaaaagcttc

SEQ ID NO: 72293 - DNA, 15 bp, Homo sapiens
gggccaaaagcttcc

SEQ ID NO: 72294 - DNA, 15 bp, Homo sapiens
ggccaaaagcttccc

SEQ ID NO: 72295 - DNA, 15 bp, Homo sapiens
gccaaaagcttccct

SEQ ID NO: 72296 - DNA, 15 bp, Homo sapiens
ccaaaagcttccctc

SEQ ID NO: 72297 - DNA, 15 bp, Homo sapiens
caaaagcttccctcc

SEQ ID NO: 72298 - DNA, 15 bp, Homo sapiens
aaaagcttccctccc

SEQ ID NO: 72299 - DNA, 15 bp, Homo sapiens
aaagcttccctccct

SEQ ID NO: 72300 - DNA, 15 bp, Homo sapiens
aagcttccctccctg

SEQ ID NO: 72301 - DNA, 15 bp, Homo sapiens
agcttccctccctgc

SEQ ID NO: 72302 - DNA, 15 bp, Homo sapiens
gcttccctccctgct

SEQ ID NO: 72303 - DNA, 15 bp, Homo sapiens
cttccctccctgctg

SEQ ID NO: 72304 - DNA, 15 bp, Homo sapiens
ttccctccctgctgt

SEQ ID NO: 72305 - DNA, 15 bp, Homo sapiens
tccctccctgctgtc

SEQ ID NO: 72306 - DNA, 15 bp, Homo sapiens
ccctccctgctgtca

SEQ ID NO: 72307 - DNA, 15 bp, Homo sapiens
cctccctgctgtcat

SEQ ID NO: 72308 - DNA, 15 bp, Homo sapiens
ctccctgctgtcatt

SEQ ID NO: 72309 - DNA, 15 bp, Homo sapiens
tccctgctgtcattg

SEQ ID NO: 72310 - DNA, 15 bp, Homo sapiens
ccctgctgtcattgc

SEQ ID NO: 72311 - DNA, 15 bp, Homo sapiens
cctgctgtcattgct

SEQ ID NO: 72312 - DNA, 15 bp, Homo sapiens
ctgctgtcattgctt

SEQ ID NO: 72313 - DNA, 15 bp, Homo sapiens
tgctgtcattgcttc

SEQ ID NO: 72314 - DNA, 15 bp, Homo sapiens
gctgtcattgcttct

SEQ ID NO: 72315 - DNA, 15 bp, Homo sapiens
ctgtcattgcttctt

SEQ ID NO: 72316 - DNA, 15 bp, Homo sapiens
tgtcattgcttcttc

SEQ ID NO: 72317 - DNA, 15 bp, Homo sapiens
gtcattgcttcttct

SEQ ID NO: 72318 - DNA, 15 bp, Homo sapiens
tcattgcttcttctg

SEQ ID NO: 72319 - DNA, 15 bp, Homo sapiens
cattgcttcttctga

SEQ ID NO: 72320 - DNA, 15 bp, Homo sapiens
attgcttcttctgag

SEQ ID NO: 72321 - DNA, 15 bp, Homo sapiens
ttgcttcttctgagg

SEQ ID NO: 72322 - DNA, 15 bp, Homo sapiens
tgcttcttctgaggc

SEQ ID NO: 72323 - DNA, 15 bp, Homo sapiens
gcttcttctgaggcc

SEQ ID NO: 72324 - DNA, 15 bp, Homo sapiens
cttcttctgaggcct

SEQ ID NO: 72325 - DNA, 15 bp, Homo sapiens
ttcttctgaggcctg

SEQ ID NO: 72326 - DNA, 15 bp, Homo sapiens
tcttctgaggcctga

SEQ ID NO: 72327 - DNA, 15 bp, Homo sapiens
cttctgaggcctgaa

SEQ ID NO: 72328 - DNA, 15 bp, Homo sapiens
ttctgaggcctgaat

SEQ ID NO: 72329 - DNA, 15 bp, Homo sapiens
tctgaggcctgaatc

SEQ ID NO: 72330 - DNA, 15 bp, Homo sapiens
ctgaggcctgaatcc

SEQ ID NO: 72331 - DNA, 15 bp, Homo sapiens
tgaggcctgaatcca

SEQ ID NO: 72332 - DNA, 15 bp, Homo sapiens
gaggcctgaatccaa

SEQ ID NO: 72333 - DNA, 15 bp, Homo sapiens
aggcctgaatccaaa

SEQ ID NO: 72334 - DNA, 15 bp, Homo sapiens
ggcctgaatccaaaa

SEQ ID NO: 72335 - DNA, 15 bp, Homo sapiens
gcctgaatccaaaag

SEQ ID NO: 72336 - DNA, 15 bp, Homo sapiens
cctgaatccaaaaga

SEQ ID NO: 72337 - DNA, 15 bp, Homo sapiens
ctgaatccaaaagaa

SEQ ID NO: 72338 - DNA, 15 bp, Homo sapiens
tgaatccaaaagaaa

SEQ ID NO: 72339 - DNA, 15 bp, Homo sapiens
gaatccaaaagaaaa

SEQ ID NO: 72340 - DNA, 15 bp, Homo sapiens
aatccaaaagaaaaa

SEQ ID NO: 72341 - DNA, 15 bp, Homo sapiens
atccaaaagaaaaac

SEQ ID NO: 72342 - DNA, 15 bp, Homo sapiens
tccaaaagaaaaaca

SEQ ID NO: 72343 - DNA, 15 bp, Homo sapiens
ccaaaagaaaaacag

SEQ ID NO: 72344 - DNA, 15 bp, Homo sapiens
caaaagaaaaacagc

SEQ ID NO: 72345 - DNA, 15 bp, Homo sapiens
aaaagaaaaacagcc

SEQ ID NO: 72346 - DNA, 15 bp, Homo sapiens
aaagaaaaacagcca

SEQ ID NO: 72347 - DNA, 15 bp, Homo sapiens
aagaaaaacagccat

SEQ ID NO: 72348 - DNA, 15 bp, Homo sapiens
agaaaaacagccata

SEQ ID NO: 72349 - DNA, 15 bp, Homo sapiens
gaaaaacagccatag

SEQ ID NO: 72350 - DNA, 15 bp, Homo sapiens
aaaaacagccatagg

SEQ ID NO: 72351 - DNA, 15 bp, Homo sapiens
aaaacagccataggc

SEQ ID NO: 72352 - DNA, 15 bp, Homo sapiens
aaacagccataggcc

SEQ ID NO: 72353 - DNA, 15 bp, Homo sapiens
aacagccataggccc

SEQ ID NO: 72354 - DNA, 15 bp, Homo sapiens
acagccataggccct

SEQ ID NO: 72355 - DNA, 15 bp, Homo sapiens
cagccataggccctt

SEQ ID NO: 72356 - DNA, 15 bp, Homo sapiens
agccataggcccttt

SEQ ID NO: 72357 - DNA, 15 bp, Homo sapiens
gccataggccctttc

SEQ ID NO: 72358 - DNA, 15 bp, Homo sapiens
ccataggccctttca

SEQ ID NO: 72359 - DNA, 15 bp, Homo sapiens
cataggccctttcag

SEQ ID NO: 72360 - DNA, 15 bp, Homo sapiens
ataggccctttcagt

SEQ ID NO: 72361 - DNA, 15 bp, Homo sapiens
taggccctttcagtg

SEQ ID NO: 72362 - DNA, 15 bp, Homo sapiens
aggccctttcagtgg

SEQ ID NO: 72363 - DNA, 15 bp, Homo sapiens
ggccctttcagtggc

SEQ ID NO: 72364 - DNA, 15 bp, Homo sapiens
gccctttcagtggcc

SEQ ID NO: 72365 - DNA, 15 bp, Homo sapiens
ccctttcagtggccg

SEQ ID NO: 72366 - DNA, 15 bp, Homo sapiens
cctttcagtggccgg

SEQ ID NO: 72367 - DNA, 15 bp, Homo sapiens
ctttcagtggccggg

SEQ ID NO: 72368 - DNA, 15 bp, Homo sapiens
tttcagtggccgggc

SEQ ID NO: 72369 - DNA, 15 bp, Homo sapiens
ttcagtggccgggct

SEQ ID NO: 72370 - DNA, 15 bp, Homo sapiens
tcagtggccgggcta

SEQ ID NO: 72371 - DNA, 15 bp, Homo sapiens
cagtggccgggctac

SEQ ID NO: 72372 - DNA, 15 bp, Homo sapiens
agtggccgggctacc

SEQ ID NO: 72373 - DNA, 15 bp, Homo sapiens
gtggccgggctaccc

SEQ ID NO: 72374 - DNA, 15 bp, Homo sapiens
tggccgggctacccg

SEQ ID NO: 72375 - DNA, 15 bp, Homo sapiens
ggccgggctacccgt

SEQ ID NO: 72376 - DNA, 15 bp, Homo sapiens
gccgggctacccgtg

SEQ ID NO: 72377 - DNA, 15 bp, Homo sapiens
ccgggctacccgtga

SEQ ID NO: 72378 - DNA, 15 bp, Homo sapiens
cgggctacccgtgag

SEQ ID NO: 72379 - DNA, 15 bp, Homo sapiens
gggctacccgtgagc

SEQ ID NO: 72380 - DNA, 15 bp, Homo sapiens
ggctacccgtgagcc

SEQ ID NO: 72381 - DNA, 15 bp, Homo sapiens
gctacccgtgagccc

SEQ ID NO: 72382 - DNA, 15 bp, Homo sapiens
ctacccgtgagccct

SEQ ID NO: 72383 - DNA, 15 bp, Homo sapiens
tacccgtgagccctt

SEQ ID NO: 72384 - DNA, 15 bp, Homo sapiens
acccgtgagcccttc

SEQ ID NO: 72385 - DNA, 15 bp, Homo sapiens
cccgtgagcccttcg

SEQ ID NO: 72386 - DNA, 15 bp, Homo sapiens
ccgtgagcccttcgg

SEQ ID NO: 72387 - DNA, 15 bp, Homo sapiens
cgtgagcccttcgga

SEQ ID NO: 72388 - DNA, 15 bp, Homo sapiens
gtgagcccttcggag

SEQ ID NO: 72389 - DNA, 15 bp, Homo sapiens
tgagcccttcggagg

SEQ ID NO: 72390 - DNA, 15 bp, Homo sapiens
gagcccttcggagga

SEQ ID NO: 72391 - DNA, 15 bp, Homo sapiens
agcccttcggaggac

SEQ ID NO: 72392 - DNA, 15 bp, Homo sapiens
gcccttcggaggacc

SEQ ID NO: 72393 - DNA, 15 bp, Homo sapiens
cccttcggaggacca

SEQ ID NO: 72394 - DNA, 15 bp, Homo sapiens
ccttcggaggaccag

SEQ ID NO: 72395 - DNA, 15 bp, Homo sapiens
cttcggaggaccagg

SEQ ID NO: 72396 - DNA, 15 bp, Homo sapiens
ttcggaggaccaggg

SEQ ID NO: 72397 - DNA, 15 bp, Homo sapiens
tcggaggaccagggc

SEQ ID NO: 72398 - DNA, 15 bp, Homo sapiens
cggaggaccagggct

SEQ ID NO: 72399 - DNA, 15 bp, Homo sapiens
ggaggaccagggctg

SEQ ID NO: 72400 - DNA, 15 bp, Homo sapiens
gaggaccagggctgg

SEQ ID NO: 72401 - DNA, 15 bp, Homo sapiens
aggaccagggctggg

SEQ ID NO: 72402 - DNA, 15 bp, Homo sapiens
ggaccagggctgggg

SEQ ID NO: 72403 - DNA, 15 bp, Homo sapiens
gaccagggctggggc

SEQ ID NO: 72404 - DNA, 15 bp, Homo sapiens
accagggctggggca

SEQ ID NO: 72405 - DNA, 15 bp, Homo sapiens
ccagggctggggcag

SEQ ID NO: 72406 - DNA, 15 bp, Homo sapiens
cagggctggggcagc

SEQ ID NO: 72407 - DNA, 15 bp, Homo sapiens
agggctggggcagcc

SEQ ID NO: 72408 - DNA, 15 bp, Homo sapiens
gggctggggcagcct

SEQ ID NO: 72409 - DNA, 15 bp, Homo sapiens
ggctggggcagcctc

SEQ ID NO: 72410 - DNA, 15 bp, Homo sapiens
gctggggcagcctct

SEQ ID NO: 72411 - DNA, 15 bp, Homo sapiens
ctggggcagcctctg

SEQ ID NO: 72412 - DNA, 15 bp, Homo sapiens
tggggcagcctctgg

SEQ ID NO: 72413 - DNA, 15 bp, Homo sapiens
ggggcagcctctggg

SEQ ID NO: 72414 - DNA, 15 bp, Homo sapiens
gggcagcctctgggc

SEQ ID NO: 72415 - DNA, 15 bp, Homo sapiens
ggcagcctctgggcc

SEQ ID NO: 72416 - DNA, 15 bp, Homo sapiens
gcagcctctgggccc

SEQ ID NO: 72417 - DNA, 15 bp, Homo sapiens
cagcctctgggccca

SEQ ID NO: 72418 - DNA, 15 bp, Homo sapiens
agcctctgggcccac

SEQ ID NO: 72419 - DNA, 15 bp, Homo sapiens
gcctctgggcccaca

SEQ ID NO: 72420 - DNA, 15 bp, Homo sapiens
cctctgggcccacat

SEQ ID NO: 72421 - DNA, 15 bp, Homo sapiens
ctctgggcccacatc

SEQ ID NO: 72422 - DNA, 15 bp, Homo sapiens
tctgggcccacatcc

SEQ ID NO: 72423 - DNA, 15 bp, Homo sapiens
ctgggcccacatccg

SEQ ID NO: 72424 - DNA, 15 bp, Homo sapiens
tgggcccacatccgg

SEQ ID NO: 72425 - DNA, 15 bp, Homo sapiens
gggcccacatccggg

SEQ ID NO: 72426 - DNA, 15 bp, Homo sapiens
ggcccacatccgggg

SEQ ID NO: 72427 - DNA, 15 bp, Homo sapiens
gcccacatccggggc

SEQ ID NO: 72428 - DNA, 15 bp, Homo sapiens
cccacatccggggcc

SEQ ID NO: 72429 - DNA, 15 bp, Homo sapiens
ccacatccggggcca

SEQ ID NO: 72430 - DNA, 15 bp, Homo sapiens
cacatccggggccag

SEQ ID NO: 72431 - DNA, 15 bp, Homo sapiens
acatccggggccagc

SEQ ID NO: 72432 - DNA, 15 bp, Homo sapiens
catccggggccagct

SEQ ID NO: 72433 - DNA, 15 bp, Homo sapiens
atccggggccagctc

SEQ ID NO: 72434 - DNA, 15 bp, Homo sapiens
tccggggccagctcc

SEQ ID NO: 72435 - DNA, 15 bp, Homo sapiens
ccggggccagctccg

SEQ ID NO: 72436 - DNA, 15 bp, Homo sapiens
cggggccagctccgg

SEQ ID NO: 72437 - DNA, 15 bp, Homo sapiens
ggggccagctccggc

SEQ ID NO: 72438 - DNA, 15 bp, Homo sapiens
gggccagctccggcg

SEQ ID NO: 72439 - DNA, 15 bp, Homo sapiens
ggccagctccggcgt

SEQ ID NO: 72440 - DNA, 15 bp, Homo sapiens
gccagctccggcgtg

SEQ ID NO: 72441 - DNA, 15 bp, Homo sapiens
ccagctccggcgtgt

SEQ ID NO: 72442 - DNA, 15 bp, Homo sapiens
cagctccggcgtgtg

SEQ ID NO: 72443 - DNA, 15 bp, Homo sapiens
agctccggcgtgtgt

SEQ ID NO: 72444 - DNA, 15 bp, Homo sapiens
gctccggcgtgtgtt

SEQ ID NO: 72445 - DNA, 15 bp, Homo sapiens
ctccggcgtgtgttc

SEQ ID NO: 72446 - DNA, 15 bp, Homo sapiens
tccggcgtgtgttca

SEQ ID NO: 72447 - DNA, 15 bp, Homo sapiens
ccggcgtgtgttcag

SEQ ID NO: 72448 - DNA, 15 bp, Homo sapiens
cggcgtgtgttcagt

SEQ ID NO: 72449 - DNA, 15 bp, Homo sapiens
ggcgtgtgttcagtg

SEQ ID NO: 72450 - DNA, 15 bp, Homo sapiens
gcgtgtgttcagtgt

SEQ ID NO: 72451 - DNA, 15 bp, Homo sapiens
cgtgtgttcagtgtt

SEQ ID NO: 72452 - DNA, 15 bp, Homo sapiens
gtgtgttcagtgtta

SEQ ID NO: 72453 - DNA, 15 bp, Homo sapiens
tgtgttcagtgttag

SEQ ID NO: 72454 - DNA, 15 bp, Homo sapiens
gtgttcagtgttagc

SEQ ID NO: 72455 - DNA, 15 bp, Homo sapiens
tgttcagtgttagca

SEQ ID NO: 72456 - DNA, 15 bp, Homo sapiens
gttcagtgttagcag

SEQ ID NO: 72457 - DNA, 15 bp, Homo sapiens
ttcagtgttagcagt

SEQ ID NO: 72458 - DNA, 15 bp, Homo sapiens
tcagtgttagcagtg

SEQ ID NO: 72459 - DNA, 15 bp, Homo sapiens
cagtgttagcagtgg

SEQ ID NO: 72460 - DNA, 15 bp, Homo sapiens
agtgttagcagtggg

SEQ ID NO: 72461 - DNA, 15 bp, Homo sapiens
gtgttagcagtgggt

SEQ ID NO: 72462 - DNA, 15 bp, Homo sapiens
tgttagcagtgggtc

SEQ ID NO: 72463 - DNA, 15 bp, Homo sapiens
gttagcagtgggtca

SEQ ID NO: 72464 - DNA, 15 bp, Homo sapiens
ttagcagtgggtcat

SEQ ID NO: 72465 - DNA, 15 bp, Homo sapiens
tagcagtgggtcatg

SEQ ID NO: 72466 - DNA, 15 bp, Homo sapiens
agcagtgggtcatga

SEQ ID NO: 72467 - DNA, 15 bp, Homo sapiens
gcagtgggtcatgat

SEQ ID NO: 72468 - DNA, 15 bp, Homo sapiens
cagtgggtcatgatg

SEQ ID NO: 72469 - DNA, 15 bp, Homo sapiens
agtgggtcatgatgc

SEQ ID NO: 72470 - DNA, 15 bp, Homo sapiens
gtgggtcatgatgct

SEQ ID NO: 72471 - DNA, 15 bp, Homo sapiens
tgggtcatgatgctc

SEQ ID NO: 72472 - DNA, 15 bp, Homo sapiens
gggtcatgatgctct

SEQ ID NO: 72473 - DNA, 15 bp, Homo sapiens
ggtcatgatgctctt

SEQ ID NO: 72474 - DNA, 15 bp, Homo sapiens
gtcatgatgctcttt

SEQ ID NO: 72475 - DNA, 15 bp, Homo sapiens
tcatgatgctctttc

SEQ ID NO: 72476 - DNA, 15 bp, Homo sapiens
catgatgctctttcc

SEQ ID NO: 72477 - DNA, 15 bp, Homo sapiens
atgatgctctttccc

SEQ ID NO: 72478 - DNA, 15 bp, Homo sapiens
tgatgctctttccca

SEQ ID NO: 72479 - DNA, 15 bp, Homo sapiens
gatgctctttcccac

SEQ ID NO: 72480 - DNA, 15 bp, Homo sapiens
atgctctttcccacc

SEQ ID NO: 72481 - DNA, 15 bp, Homo sapiens
tgctctttcccaccc

SEQ ID NO: 72482 - DNA, 15 bp, Homo sapiens
gctctttcccaccca

SEQ ID NO: 72483 - DNA, 15 bp, Homo sapiens
ctctttcccacccag

SEQ ID NO: 72484 - DNA, 15 bp, Homo sapiens
tctttcccacccagc

SEQ ID NO: 72485 - DNA, 15 bp, Homo sapiens
ctttcccacccagcc

SEQ ID NO: 72486 - DNA, 15 bp, Homo sapiens
tttcccacccagcct

SEQ ID NO: 72487 - DNA, 15 bp, Homo sapiens
ttcccacccagcctg

SEQ ID NO: 72488 - DNA, 15 bp, Homo sapiens
tcccacccagcctgg

SEQ ID NO: 72489 - DNA, 15 bp, Homo sapiens
cccacccagcctggg

SEQ ID NO: 72490 - DNA, 15 bp, Homo sapiens
ccacccagcctggga

SEQ ID NO: 72491 - DNA, 15 bp, Homo sapiens
cacccagcctgggat

SEQ ID NO: 72492 - DNA, 15 bp, Homo sapiens
acccagcctgggata

SEQ ID NO: 72493 - DNA, 15 bp, Homo sapiens
cccagcctgggatag

SEQ ID NO: 72494 - DNA, 15 bp, Homo sapiens
ccagcctgggatagg

SEQ ID NO: 72495 - DNA, 15 bp, Homo sapiens
cagcctgggataggg

SEQ ID NO: 72496 - DNA, 15 bp, Homo sapiens
agcctgggatagggg

SEQ ID NO: 72497 - DNA, 15 bp, Homo sapiens
gcctgggataggggc

SEQ ID NO: 72498 - DNA, 15 bp, Homo sapiens
cctgggataggggca

SEQ ID NO: 72499 - DNA, 15 bp, Homo sapiens
ctgggataggggcag

SEQ ID NO: 72500 - DNA, 15 bp, Homo sapiens
tgggataggggcaga

SEQ ID NO: 72501 - DNA, 15 bp, Homo sapiens
gggataggggcagag

SEQ ID NO: 72502 - DNA, 15 bp, Homo sapiens
ggataggggcagagg

SEQ ID NO: 72503 - DNA, 15 bp, Homo sapiens
gataggggcagagga

SEQ ID NO: 72504 - DNA, 15 bp, Homo sapiens
ataggggcagaggag

SEQ ID NO: 72505 - DNA, 15 bp, Homo sapiens
taggggcagaggagg

SEQ ID NO: 72506 - DNA, 15 bp, Homo sapiens
aggggcagaggaggc

SEQ ID NO: 72507 - DNA, 15 bp, Homo sapiens
ggggcagaggaggcg

SEQ ID NO: 72508 - DNA, 15 bp, Homo sapiens
gggcagaggaggcga

SEQ ID NO: 72509 - DNA, 15 bp, Homo sapiens
ggcagaggaggcgag

SEQ ID NO: 72510 - DNA, 15 bp, Homo sapiens
gcagaggaggcgagg

SEQ ID NO: 72511 - DNA, 15 bp, Homo sapiens
cagaggaggcgagga

SEQ ID NO: 72512 - DNA, 15 bp, Homo sapiens
agaggaggcgaggag

SEQ ID NO: 72513 - DNA, 15 bp, Homo sapiens
aggaggcgaggaggc

SEQ ID NO: 72514 - DNA, 15 bp, Homo sapiens
ggaggcgaggaggcc

SEQ ID NO: 72515 - DNA, 15 bp, Homo sapiens
gaggcgaggaggccg

SEQ ID NO: 72516 - DNA, 15 bp, Homo sapiens
aggcgaggaggccgt

SEQ ID NO: 72517 - DNA, 15 bp, Homo sapiens
ggcgaggaggccgtt

SEQ ID NO: 72518 - DNA, 15 bp, Homo sapiens
gcgaggaggccgttg

SEQ ID NO: 72519 - DNA, 15 bp, Homo sapiens
cgaggaggccgttgc

SEQ ID NO: 72520 - DNA, 15 bp, Homo sapiens
gaggaggccgttgcc

SEQ ID NO: 72521 - DNA, 15 bp, Homo sapiens
aggaggccgttgccg

SEQ ID NO: 72522 - DNA, 15 bp, Homo sapiens
ggaggccgttgccgc

SEQ ID NO: 72523 - DNA, 15 bp, Homo sapiens
gaggccgttgccgct

SEQ ID NO: 72524 - DNA, 15 bp, Homo sapiens
aggccgttgccgctg

SEQ ID NO: 72525 - DNA, 15 bp, Homo sapiens
ggccgttgccgctga

SEQ ID NO: 72526 - DNA, 15 bp, Homo sapiens
gccgttgccgctgat

SEQ ID NO: 72527 - DNA, 15 bp, Homo sapiens
ccgttgccgctgatg

SEQ ID NO: 72528 - DNA, 15 bp, Homo sapiens
cgttgccgctgatgt

SEQ ID NO: 72529 - DNA, 15 bp, Homo sapiens
gttgccgctgatgtt

SEQ ID NO: 72530 - DNA, 15 bp, Homo sapiens
ttgccgctgatgttt

SEQ ID NO: 72531 - DNA, 15 bp, Homo sapiens
tgccgctgatgtttg

SEQ ID NO: 72532 - DNA, 15 bp, Homo sapiens
gccgctgatgtttgg

SEQ ID NO: 72533 - DNA, 15 bp, Homo sapiens
ccgctgatgtttggc

SEQ ID NO: 72534 - DNA, 15 bp, Homo sapiens
cgctgatgtttggcc

SEQ ID NO: 72535 - DNA, 15 bp, Homo sapiens
gctgatgtttggccg

SEQ ID NO: 72536 - DNA, 15 bp, Homo sapiens
ctgatgtttggccgt

SEQ ID NO: 72537 - DNA, 15 bp, Homo sapiens
tgatgtttggccgtg

SEQ ID NO: 72538 - DNA, 15 bp, Homo sapiens
gatgtttggccgtga

SEQ ID NO: 72539 - DNA, 15 bp, Homo sapiens
atgtttggccgtgaa

SEQ ID NO: 72540 - DNA, 15 bp, Homo sapiens
tgtttggccgtgaac

SEQ ID NO: 72541 - DNA, 15 bp, Homo sapiens
gtttggccgtgaaca

SEQ ID NO: 72542 - DNA, 15 bp, Homo sapiens
tttggccgtgaacag

SEQ ID NO: 72543 - DNA, 15 bp, Homo sapiens
ttggccgtgaacagg

SEQ ID NO: 72544 - DNA, 15 bp, Homo sapiens
tggccgtgaacaggt

SEQ ID NO: 72545 - DNA, 15 bp, Homo sapiens
ggccgtgaacaggtg

SEQ ID NO: 72546 - DNA, 15 bp, Homo sapiens
gccgtgaacaggtgg

SEQ ID NO: 72547 - DNA, 15 bp, Homo sapiens
ccgtgaacaggtggg

SEQ ID NO: 72548 - DNA, 15 bp, Homo sapiens
cgtgaacaggtgggt

SEQ ID NO: 72549 - DNA, 15 bp, Homo sapiens
gtgaacaggtgggtg

SEQ ID NO: 72550 - DNA, 15 bp, Homo sapiens
tgaacaggtgggtgt

SEQ ID NO: 72551 - DNA, 15 bp, Homo sapiens
gaacaggtgggtgtc

SEQ ID NO: 72552 - DNA, 15 bp, Homo sapiens
aacaggtgggtgtct

SEQ ID NO: 72553 - DNA, 15 bp, Homo sapiens
acaggtgggtgtctg

SEQ ID NO: 72554 - DNA, 15 bp, Homo sapiens
caggtgggtgtctgc

SEQ ID NO: 72555 - DNA, 15 bp, Homo sapiens
aggtgggtgtctgcg

SEQ ID NO: 72556 - DNA, 15 bp, Homo sapiens
ggtgggtgtctgcgt

SEQ ID NO: 72557 - DNA, 15 bp, Homo sapiens
gtgggtgtctgcgtg

SEQ ID NO: 72558 - DNA, 15 bp, Homo sapiens
tgggtgtctgcgtgc

SEQ ID NO: 72559 - DNA, 15 bp, Homo sapiens
gggtgtctgcgtgcg

SEQ ID NO: 72560 - DNA, 15 bp, Homo sapiens
ggtgtctgcgtgcgt

SEQ ID NO: 72561 - DNA, 15 bp, Homo sapiens
gtgtctgcgtgcgtc

SEQ ID NO: 72562 - DNA, 15 bp, Homo sapiens
tgtctgcgtgcgtcc

SEQ ID NO: 72563 - DNA, 15 bp, Homo sapiens
gtctgcgtgcgtcca

SEQ ID NO: 72564 - DNA, 15 bp, Homo sapiens
tctgcgtgcgtccac

SEQ ID NO: 72565 - DNA, 15 bp, Homo sapiens
ctgcgtgcgtccacg

SEQ ID NO: 72566 - DNA, 15 bp, Homo sapiens
tgcgtgcgtccacgt

SEQ ID NO: 72567 - DNA, 15 bp, Homo sapiens
gcgtgcgtccacgtg

SEQ ID NO: 72568 - DNA, 15 bp, Homo sapiens
cgtgcgtccacgtgc

SEQ ID NO: 72569 - DNA, 15 bp, Homo sapiens
gtgcgtccacgtgcg

SEQ ID NO: 72570 - DNA, 15 bp, Homo sapiens
tgcgtccacgtgcgt

SEQ ID NO: 72571 - DNA, 15 bp, Homo sapiens
gcgtccacgtgcgtg

SEQ ID NO: 72572 - DNA, 15 bp, Homo sapiens
cgtccacgtgcgtgt

SEQ ID NO: 72573 - DNA, 15 bp, Homo sapiens
gtccacgtgcgtgtt

SEQ ID NO: 72574 - DNA, 15 bp, Homo sapiens
tccacgtgcgtgttt

SEQ ID NO: 72575 - DNA, 15 bp, Homo sapiens
ccacgtgcgtgtttt

SEQ ID NO: 72576 - DNA, 15 bp, Homo sapiens
cacgtgcgtgttttc

SEQ ID NO: 72577 - DNA, 15 bp, Homo sapiens
acgtgcgtgttttct

SEQ ID NO: 72578 - DNA, 15 bp, Homo sapiens
cgtgcgtgttttctg

SEQ ID NO: 72579 - DNA, 15 bp, Homo sapiens
gtgcgtgttttctga

SEQ ID NO: 72580 - DNA, 15 bp, Homo sapiens
tgcgtgttttctgac

SEQ ID NO: 72581 - DNA, 15 bp, Homo sapiens
gcgtgttttctgact

SEQ ID NO: 72582 - DNA, 15 bp, Homo sapiens
cgtgttttctgactg

SEQ ID NO: 72583 - DNA, 15 bp, Homo sapiens
gtgttttctgactga

SEQ ID NO: 72584 - DNA, 15 bp, Homo sapiens
tgttttctgactgac

SEQ ID NO: 72585 - DNA, 15 bp, Homo sapiens
gttttctgactgaca

SEQ ID NO: 72586 - DNA, 15 bp, Homo sapiens
ttttctgactgacat

SEQ ID NO: 72587 - DNA, 15 bp, Homo sapiens
tttctgactgacatg

SEQ ID NO: 72588 - DNA, 15 bp, Homo sapiens
ttctgactgacatga

SEQ ID NO: 72589 - DNA, 15 bp, Homo sapiens
tctgactgacatgaa

SEQ ID NO: 72590 - DNA, 15 bp, Homo sapiens
ctgactgacatgaaa

SEQ ID NO: 72591 - DNA, 15 bp, Homo sapiens
tgactgacatgaaat

SEQ ID NO: 72592 - DNA, 15 bp, Homo sapiens
gactgacatgaaatc

SEQ ID NO: 72593 - DNA, 15 bp, Homo sapiens
actgacatgaaatcg

SEQ ID NO: 72594 - DNA, 15 bp, Homo sapiens
ctgacatgaaatcga

SEQ ID NO: 72595 - DNA, 15 bp, Homo sapiens
tgacatgaaatcgac

SEQ ID NO: 72596 - DNA, 15 bp, Homo sapiens
gacatgaaatcgacg

SEQ ID NO: 72597 - DNA, 15 bp, Homo sapiens
acatgaaatcgacgc

SEQ ID NO: 72598 - DNA, 15 bp, Homo sapiens
catgaaatcgacgcc

SEQ ID NO: 72599 - DNA, 15 bp, Homo sapiens
atgaaatcgacgccc

SEQ ID NO: 72600 - DNA, 15 bp, Homo sapiens
tgaaatcgacgcccg

SEQ ID NO: 72601 - DNA, 15 bp, Homo sapiens
gaaatcgacgcccga

SEQ ID NO: 72602 - DNA, 15 bp, Homo sapiens
aaatcgacgcccgag

SEQ ID NO: 72603 - DNA, 15 bp, Homo sapiens
aatcgacgcccgagt

SEQ ID NO: 72604 - DNA, 15 bp, Homo sapiens
atcgacgcccgagtt

SEQ ID NO: 72605 - DNA, 15 bp, Homo sapiens
tcgacgcccgagtta

SEQ ID NO: 72606 - DNA, 15 bp, Homo sapiens
cgacgcccgagttag

SEQ ID NO: 72607 - DNA, 15 bp, Homo sapiens
gacgcccgagttagc

SEQ ID NO: 72608 - DNA, 15 bp, Homo sapiens
acgcccgagttagcc

SEQ ID NO: 72609 - DNA, 15 bp, Homo sapiens
cgcccgagttagcct

SEQ ID NO: 72610 - DNA, 15 bp, Homo sapiens
gcccgagttagcctc

SEQ ID NO: 72611 - DNA, 15 bp, Homo sapiens
cccgagttagcctca

SEQ ID NO: 72612 - DNA, 15 bp, Homo sapiens
ccgagttagcctcac

SEQ ID NO: 72613 - DNA, 15 bp, Homo sapiens
cgagttagcctcacc

SEQ ID NO: 72614 - DNA, 15 bp, Homo sapiens
gagttagcctcaccc

SEQ ID NO: 72615 - DNA, 15 bp, Homo sapiens
agttagcctcacccg

SEQ ID NO: 72616 - DNA, 15 bp, Homo sapiens
gttagcctcacccgg

SEQ ID NO: 72617 - DNA, 15 bp, Homo sapiens
ttagcctcacccggt

SEQ ID NO: 72618 - DNA, 15 bp, Homo sapiens
tagcctcacccggtg

SEQ ID NO: 72619 - DNA, 15 bp, Homo sapiens
agcctcacccggtga

SEQ ID NO: 72620 - DNA, 15 bp, Homo sapiens
gcctcacccggtgac

SEQ ID NO: 72621 - DNA, 15 bp, Homo sapiens
cctcacccggtgacc

SEQ ID NO: 72622 - DNA, 15 bp, Homo sapiens
ctcacccggtgacct

SEQ ID NO: 72623 - DNA, 15 bp, Homo sapiens
tcacccggtgacctc

SEQ ID NO: 72624 - DNA, 15 bp, Homo sapiens
cacccggtgacctct

SEQ ID NO: 72625 - DNA, 15 bp, Homo sapiens
acccggtgacctcta

SEQ ID NO: 72626 - DNA, 15 bp, Homo sapiens
cccggtgacctctag

SEQ ID NO: 72627 - DNA, 15 bp, Homo sapiens
ccggtgacctctagc

SEQ ID NO: 72628 - DNA, 15 bp, Homo sapiens
cggtgacctctagcc

SEQ ID NO: 72629 - DNA, 15 bp, Homo sapiens
ggtgacctctagccc

SEQ ID NO: 72630 - DNA, 15 bp, Homo sapiens
gtgacctctagccct

SEQ ID NO: 72631 - DNA, 15 bp, Homo sapiens
tgacctctagccctg

SEQ ID NO: 72632 - DNA, 15 bp, Homo sapiens
gacctctagccctgc

SEQ ID NO: 72633 - DNA, 15 bp, Homo sapiens
acctctagccctgcc

SEQ ID NO: 72634 - DNA, 15 bp, Homo sapiens
cctctagccctgccc

SEQ ID NO: 72635 - DNA, 15 bp, Homo sapiens
ctctagccctgcccg

SEQ ID NO: 72636 - DNA, 15 bp, Homo sapiens
tctagccctgcccgg

SEQ ID NO: 72637 - DNA, 15 bp, Homo sapiens
ctagccctgcccgga

SEQ ID NO: 72638 - DNA, 15 bp, Homo sapiens
tagccctgcccggat

SEQ ID NO: 72639 - DNA, 15 bp, Homo sapiens
agccctgcccggatg

SEQ ID NO: 72640 - DNA, 15 bp, Homo sapiens
gccctgcccggatgg

SEQ ID NO: 72641 - DNA, 15 bp, Homo sapiens
ccctgcccggatgga

SEQ ID NO: 72642 - DNA, 15 bp, Homo sapiens
cctgcccggatggag

SEQ ID NO: 72643 - DNA, 15 bp, Homo sapiens
ctgcccggatggagc

SEQ ID NO: 72644 - DNA, 15 bp, Homo sapiens
tgcccggatggagcg

SEQ ID NO: 72645 - DNA, 15 bp, Homo sapiens
gcccggatggagcgg

SEQ ID NO: 72646 - DNA, 15 bp, Homo sapiens
cccggatggagcggg

SEQ ID NO: 72647 - DNA, 15 bp, Homo sapiens
ccggatggagcgggg

SEQ ID NO: 72648 - DNA, 15 bp, Homo sapiens
cggatggagcggggc

SEQ ID NO: 72649 - DNA, 15 bp, Homo sapiens
ggatggagcggggcc

SEQ ID NO: 72650 - DNA, 15 bp, Homo sapiens
gatggagcggggccc

SEQ ID NO: 72651 - DNA, 15 bp, Homo sapiens
atggagcggggccca

SEQ ID NO: 72652 - DNA, 15 bp, Homo sapiens
tggagcggggcccac

SEQ ID NO: 72653 - DNA, 15 bp, Homo sapiens
ggagcggggcccacc

SEQ ID NO: 72654 - DNA, 15 bp, Homo sapiens
gagcggggcccaccc

SEQ ID NO: 72655 - DNA, 15 bp, Homo sapiens
agcggggcccacccg

SEQ ID NO: 72656 - DNA, 15 bp, Homo sapiens
gcggggcccacccgg

SEQ ID NO: 72657 - DNA, 15 bp, Homo sapiens
cggggcccacccggt

SEQ ID NO: 72658 - DNA, 15 bp, Homo sapiens
ggggcccacccggtt

SEQ ID NO: 72659 - DNA, 15 bp, Homo sapiens
gggcccacccggttc

SEQ ID NO: 72660 - DNA, 15 bp, Homo sapiens
ggcccacccggttca

SEQ ID NO: 72661 - DNA, 15 bp, Homo sapiens
gcccacccggttcag

SEQ ID NO: 72662 - DNA, 15 bp, Homo sapiens
cccacccggttcagt

SEQ ID NO: 72663 - DNA, 15 bp, Homo sapiens
ccacccggttcagtg

SEQ ID NO: 72664 - DNA, 15 bp, Homo sapiens
cacccggttcagtgt

SEQ ID NO: 72665 - DNA, 15 bp, Homo sapiens
acccggttcagtgtt

SEQ ID NO: 72666 - DNA, 15 bp, Homo sapiens
cccggttcagtgttt

SEQ ID NO: 72667 - DNA, 15 bp, Homo sapiens
ccggttcagtgtttc

SEQ ID NO: 72668 - DNA, 15 bp, Homo sapiens
cggttcagtgtttct

SEQ ID NO: 72669 - DNA, 15 bp, Homo sapiens
ggttcagtgtttctg

SEQ ID NO: 72670 - DNA, 15 bp, Homo sapiens
gttcagtgtttctgg

SEQ ID NO: 72671 - DNA, 15 bp, Homo sapiens
ttcagtgtttctggg

SEQ ID NO: 72672 - DNA, 15 bp, Homo sapiens
tcagtgtttctgggg

SEQ ID NO: 72673 - DNA, 15 bp, Homo sapiens
cagtgtttctgggga

SEQ ID NO: 72674 - DNA, 15 bp, Homo sapiens
agtgtttctggggag

SEQ ID NO: 72675 - DNA, 15 bp, Homo sapiens
gtgtttctggggagc

SEQ ID NO: 72676 - DNA, 15 bp, Homo sapiens
tgtttctggggagct

SEQ ID NO: 72677 - DNA, 15 bp, Homo sapiens
gtttctggggagctg

SEQ ID NO: 72678 - DNA, 15 bp, Homo sapiens
tttctggggagctgg

SEQ ID NO: 72679 - DNA, 15 bp, Homo sapiens
ttctggggagctgga

SEQ ID NO: 72680 - DNA, 15 bp, Homo sapiens
tctggggagctggac

SEQ ID NO: 72681 - DNA, 15 bp, Homo sapiens
ctggggagctggaca

SEQ ID NO: 72682 - DNA, 15 bp, Homo sapiens
tggggagctggacag

SEQ ID NO: 72683 - DNA, 15 bp, Homo sapiens
ggggagctggacagt

SEQ ID NO: 72684 - DNA, 15 bp, Homo sapiens
gggagctggacagtg

SEQ ID NO: 72685 - DNA, 15 bp, Homo sapiens
ggagctggacagtgg

SEQ ID NO: 72686 - DNA, 15 bp, Homo sapiens
gagctggacagtgga

SEQ ID NO: 72687 - DNA, 15 bp, Homo sapiens
agctggacagtggag

SEQ ID NO: 72688 - DNA, 15 bp, Homo sapiens
gctggacagtggagt

SEQ ID NO: 72689 - DNA, 15 bp, Homo sapiens
ctggacagtggagtg

SEQ ID NO: 72690 - DNA, 15 bp, Homo sapiens
tggacagtggagtgc

SEQ ID NO: 72691 - DNA, 15 bp, Homo sapiens
ggacagtggagtgca

SEQ ID NO: 72692 - DNA, 15 bp, Homo sapiens
gacagtggagtgcaa

SEQ ID NO: 72693 - DNA, 15 bp, Homo sapiens
acagtggagtgcaaa

SEQ ID NO: 72694 - DNA, 15 bp, Homo sapiens
cagtggagtgcaaaa

SEQ ID NO: 72695 - DNA, 15 bp, Homo sapiens
agtggagtgcaaaag

SEQ ID NO: 72696 - DNA, 15 bp, Homo sapiens
gtggagtgcaaaagg

SEQ ID NO: 72697 - DNA, 15 bp, Homo sapiens
tggagtgcaaaaggc

SEQ ID NO: 72698 - DNA, 15 bp, Homo sapiens
ggagtgcaaaaggct

SEQ ID NO: 72699 - DNA, 15 bp, Homo sapiens
gagtgcaaaaggctt

SEQ ID NO: 72700 - DNA, 15 bp, Homo sapiens
agtgcaaaaggcttg

SEQ ID NO: 72701 - DNA, 15 bp, Homo sapiens
gtgcaaaaggcttgc

SEQ ID NO: 72702 - DNA, 15 bp, Homo sapiens
tgcaaaaggcttgca

SEQ ID NO: 72703 - DNA, 15 bp, Homo sapiens
gcaaaaggcttgcag

SEQ ID NO: 72704 - DNA, 15 bp, Homo sapiens
caaaaggcttgcaga

SEQ ID NO: 72705 - DNA, 15 bp, Homo sapiens
aaaaggcttgcagaa

SEQ ID NO: 72706 - DNA, 15 bp, Homo sapiens
aaaggcttgcagaac

SEQ ID NO: 72707 - DNA, 15 bp, Homo sapiens
aaggcttgcagaact

SEQ ID NO: 72708 - DNA, 15 bp, Homo sapiens
aggcttgcagaactt

SEQ ID NO: 72709 - DNA, 15 bp, Homo sapiens
ggcttgcagaacttg

SEQ ID NO: 72710 - DNA, 15 bp, Homo sapiens
gcttgcagaacttga

SEQ ID NO: 72711 - DNA, 15 bp, Homo sapiens
cttgcagaacttgaa

SEQ ID NO: 72712 - DNA, 15 bp, Homo sapiens
ttgcagaacttgaag

SEQ ID NO: 72713 - DNA, 15 bp, Homo sapiens
tgcagaacttgaagc

SEQ ID NO: 72714 - DNA, 15 bp, Homo sapiens
gcagaacttgaagcc

SEQ ID NO: 72715 - DNA, 15 bp, Homo sapiens
cagaacttgaagcct

SEQ ID NO: 72716 - DNA, 15 bp, Homo sapiens
agaacttgaagcctg

SEQ ID NO: 72717 - DNA, 15 bp, Homo sapiens
gaacttgaagcctgc

SEQ ID NO: 72718 - DNA, 15 bp, Homo sapiens
aacttgaagcctgct

SEQ ID NO: 72719 - DNA, 15 bp, Homo sapiens
acttgaagcctgctc

SEQ ID NO: 72720 - DNA, 15 bp, Homo sapiens
cttgaagcctgctcc

SEQ ID NO: 72721 - DNA, 15 bp, Homo sapiens
ttgaagcctgctcct

SEQ ID NO: 72722 - DNA, 15 bp, Homo sapiens
tgaagcctgctcctt

SEQ ID NO: 72723 - DNA, 15 bp, Homo sapiens
gaagcctgctccttc

SEQ ID NO: 72724 - DNA, 15 bp, Homo sapiens
aagcctgctccttcc

SEQ ID NO: 72725 - DNA, 15 bp, Homo sapiens
agcctgctccttccc

SEQ ID NO: 72726 - DNA, 15 bp, Homo sapiens
gcctgctccttccct

SEQ ID NO: 72727 - DNA, 15 bp, Homo sapiens
cctgctccttccctt

SEQ ID NO: 72728 - DNA, 15 bp, Homo sapiens
ctgctccttcccttg

SEQ ID NO: 72729 - DNA, 15 bp, Homo sapiens
tgctccttcccttgc

SEQ ID NO: 72730 - DNA, 15 bp, Homo sapiens
gctccttcccttgct

SEQ ID NO: 72731 - DNA, 15 bp, Homo sapiens
ctccttcccttgcta

SEQ ID NO: 72732 - DNA, 15 bp, Homo sapiens
tccttcccttgctac

SEQ ID NO: 72733 - DNA, 15 bp, Homo sapiens
ccttcccttgctacc

SEQ ID NO: 72734 - DNA, 15 bp, Homo sapiens
cttcccttgctacca

SEQ ID NO: 72735 - DNA, 15 bp, Homo sapiens
ttcccttgctaccac

SEQ ID NO: 72736 - DNA, 15 bp, Homo sapiens
tcccttgctaccacg

SEQ ID NO: 72737 - DNA, 15 bp, Homo sapiens
cccttgctaccacgg

SEQ ID NO: 72738 - DNA, 15 bp, Homo sapiens
ccttgctaccacggc

SEQ ID NO: 72739 - DNA, 15 bp, Homo sapiens
cttgctaccacggcc

SEQ ID NO: 72740 - DNA, 15 bp, Homo sapiens
ttgctaccacggcct

SEQ ID NO: 72741 - DNA, 15 bp, Homo sapiens
tgctaccacggcctc

SEQ ID NO: 72742 - DNA, 15 bp, Homo sapiens
gctaccacggcctcc

SEQ ID NO: 72743 - DNA, 15 bp, Homo sapiens
ctaccacggcctcct

SEQ ID NO: 72744 - DNA, 15 bp, Homo sapiens
taccacggcctcctt

SEQ ID NO: 72745 - DNA, 15 bp, Homo sapiens
accacggcctccttt

SEQ ID NO: 72746 - DNA, 15 bp, Homo sapiens
ccacggcctcctttc

SEQ ID NO: 72747 - DNA, 15 bp, Homo sapiens
cacggcctcctttcc

SEQ ID NO: 72748 - DNA, 15 bp, Homo sapiens
acggcctcctttccg

SEQ ID NO: 72749 - DNA, 15 bp, Homo sapiens
cggcctcctttccgt

SEQ ID NO: 72750 - DNA, 15 bp, Homo sapiens
ggcctcctttccgtt

SEQ ID NO: 72751 - DNA, 15 bp, Homo sapiens
gcctcctttccgttt

SEQ ID NO: 72752 - DNA, 15 bp, Homo sapiens
cctcctttccgtttg

SEQ ID NO: 72753 - DNA, 15 bp, Homo sapiens
ctcctttccgtttga

SEQ ID NO: 72754 - DNA, 15 bp, Homo sapiens
tcctttccgtttgat

SEQ ID NO: 72755 - DNA, 15 bp, Homo sapiens
cctttccgtttgatt

SEQ ID NO: 72756 - DNA, 15 bp, Homo sapiens
ctttccgtttgattt

SEQ ID NO: 72757 - DNA, 15 bp, Homo sapiens
tttccgtttgatttg

SEQ ID NO: 72758 - DNA, 15 bp, Homo sapiens
ttccgtttgatttgt

SEQ ID NO: 72759 - DNA, 15 bp, Homo sapiens
tccgtttgatttgtc

SEQ ID NO: 72760 - DNA, 15 bp, Homo sapiens
ccgtttgatttgtca

SEQ ID NO: 72761 - DNA, 15 bp, Homo sapiens
cgtttgatttgtcac

SEQ ID NO: 72762 - DNA, 15 bp, Homo sapiens
gtttgatttgtcact

SEQ ID NO: 72763 - DNA, 15 bp, Homo sapiens
tttgatttgtcactg

SEQ ID NO: 72764 - DNA, 15 bp, Homo sapiens
ttgatttgtcactgc

SEQ ID NO: 72765 - DNA, 15 bp, Homo sapiens
tgatttgtcactgct

SEQ ID NO: 72766 - DNA, 15 bp, Homo sapiens
gatttgtcactgctt

SEQ ID NO: 72767 - DNA, 15 bp, Homo sapiens
atttgtcactgcttc

SEQ ID NO: 72768 - DNA, 15 bp, Homo sapiens
tttgtcactgcttca

SEQ ID NO: 72769 - DNA, 15 bp, Homo sapiens
ttgtcactgcttcaa

SEQ ID NO: 72770 - DNA, 15 bp, Homo sapiens
tgtcactgcttcaat

SEQ ID NO: 72771 - DNA, 15 bp, Homo sapiens
gtcactgcttcaatc

SEQ ID NO: 72772 - DNA, 15 bp, Homo sapiens
tcactgcttcaatca

SEQ ID NO: 72773 - DNA, 15 bp, Homo sapiens
cactgcttcaatcaa

SEQ ID NO: 72774 - DNA, 15 bp, Homo sapiens
actgcttcaatcaat

SEQ ID NO: 72775 - DNA, 15 bp, Homo sapiens
ctgcttcaatcaata

SEQ ID NO: 72776 - DNA, 15 bp, Homo sapiens
tgcttcaatcaataa

SEQ ID NO: 72777 - DNA, 15 bp, Homo sapiens
gcttcaatcaataac

SEQ ID NO: 72778 - DNA, 15 bp, Homo sapiens
cttcaatcaataaca

SEQ ID NO: 72779 - DNA, 15 bp, Homo sapiens
ttcaatcaataacag

SEQ ID NO: 72780 - DNA, 15 bp, Homo sapiens
tcaatcaataacagc

SEQ ID NO: 72781 - DNA, 15 bp, Homo sapiens
caatcaataacagcc

SEQ ID NO: 72782 - DNA, 15 bp, Homo sapiens
aatcaataacagccg

SEQ ID NO: 72783 - DNA, 15 bp, Homo sapiens
atcaataacagccgc

SEQ ID NO: 72784 - DNA, 15 bp, Homo sapiens
tcaataacagccgct

SEQ ID NO: 72785 - DNA, 15 bp, Homo sapiens
caataacagccgctc

SEQ ID NO: 72786 - DNA, 15 bp, Homo sapiens
aataacagccgctcc

SEQ ID NO: 72787 - DNA, 15 bp, Homo sapiens
ataacagccgctcca

SEQ ID NO: 72788 - DNA, 15 bp, Homo sapiens
taacagccgctccag

SEQ ID NO: 72789 - DNA, 15 bp, Homo sapiens
aacagccgctccaga

SEQ ID NO: 72790 - DNA, 15 bp, Homo sapiens
acagccgctccagag

SEQ ID NO: 72791 - DNA, 15 bp, Homo sapiens
cagccgctccagagt

SEQ ID NO: 72792 - DNA, 15 bp, Homo sapiens
agccgctccagagtc

SEQ ID NO: 72793 - DNA, 15 bp, Homo sapiens
gccgctccagagtca

SEQ ID NO: 72794 - DNA, 15 bp, Homo sapiens
ccgctccagagtcag

SEQ ID NO: 72795 - DNA, 15 bp, Homo sapiens
cgctccagagtcagt

SEQ ID NO: 72796 - DNA, 15 bp, Homo sapiens
gctccagagtcagta

SEQ ID NO: 72797 - DNA, 15 bp, Homo sapiens
ctccagagtcagtag

SEQ ID NO: 72798 - DNA, 15 bp, Homo sapiens
tccagagtcagtagt

SEQ ID NO: 72799 - DNA, 15 bp, Homo sapiens
ccagagtcagtagtc

SEQ ID NO: 72800 - DNA, 15 bp, Homo sapiens
cagagtcagtagtca

SEQ ID NO: 72801 - DNA, 15 bp, Homo sapiens
agagtcagtagtcaa

SEQ ID NO: 72802 - DNA, 15 bp, Homo sapiens
gagtcagtagtcaat

SEQ ID NO: 72803 - DNA, 15 bp, Homo sapiens
agtcagtagtcaatg

SEQ ID NO: 72804 - DNA, 15 bp, Homo sapiens
gtcagtagtcaatga

SEQ ID NO: 72805 - DNA, 15 bp, Homo sapiens
tcagtagtcaatgaa

SEQ ID NO: 72806 - DNA, 15 bp, Homo sapiens
cagtagtcaatgaat

SEQ ID NO: 72807 - DNA, 15 bp, Homo sapiens
agtagtcaatgaata

SEQ ID NO: 72808 - DNA, 15 bp, Homo sapiens
gtagtcaatgaatat

SEQ ID NO: 72809 - DNA, 15 bp, Homo sapiens
tagtcaatgaatata

SEQ ID NO: 72810 - DNA, 15 bp, Homo sapiens
agtcaatgaatatat

SEQ ID NO: 72811 - DNA, 15 bp, Homo sapiens
gtcaatgaatatatg

SEQ ID NO: 72812 - DNA, 15 bp, Homo sapiens
tcaatgaatatatga

SEQ ID NO: 72813 - DNA, 15 bp, Homo sapiens
caatgaatatatgac

SEQ ID NO: 72814 - DNA, 15 bp, Homo sapiens
aatgaatatatgacc

SEQ ID NO: 72815 - DNA, 15 bp, Homo sapiens
atgaatatatgacca

SEQ ID NO: 72816 - DNA, 15 bp, Homo sapiens
tgaatatatgaccaa

SEQ ID NO: 72817 - DNA, 15 bp, Homo sapiens
gaatatatgaccaaa

SEQ ID NO: 72818 - DNA, 15 bp, Homo sapiens
aatatatgaccaaat

SEQ ID NO: 72819 - DNA, 15 bp, Homo sapiens
atatatgaccaaata

SEQ ID NO: 72820 - DNA, 15 bp, Homo sapiens
tatatgaccaaatat

SEQ ID NO: 72821 - DNA, 15 bp, Homo sapiens
atatgaccaaatatc

SEQ ID NO: 72822 - DNA, 15 bp, Homo sapiens
tatgaccaaatatca

SEQ ID NO: 72823 - DNA, 15 bp, Homo sapiens
atgaccaaatatcac

SEQ ID NO: 72824 - DNA, 15 bp, Homo sapiens
tgaccaaatatcacc

SEQ ID NO: 72825 - DNA, 15 bp, Homo sapiens
gaccaaatatcacca

SEQ ID NO: 72826 - DNA, 15 bp, Homo sapiens
accaaatatcaccag

SEQ ID NO: 72827 - DNA, 15 bp, Homo sapiens
ccaaatatcaccagg

SEQ ID NO: 72828 - DNA, 15 bp, Homo sapiens
caaatatcaccagga

SEQ ID NO: 72829 - DNA, 15 bp, Homo sapiens
aaatatcaccaggac

SEQ ID NO: 72830 - DNA, 15 bp, Homo sapiens
aatatcaccaggact

SEQ ID NO: 72831 - DNA, 15 bp, Homo sapiens
atatcaccaggactg

SEQ ID NO: 72832 - DNA, 15 bp, Homo sapiens
tatcaccaggactgt

SEQ ID NO: 72833 - DNA, 15 bp, Homo sapiens
atcaccaggactgtt

SEQ ID NO: 72834 - DNA, 15 bp, Homo sapiens
tcaccaggactgtta

SEQ ID NO: 72835 - DNA, 15 bp, Homo sapiens
caccaggactgttac

SEQ ID NO: 72836 - DNA, 15 bp, Homo sapiens
accaggactgttact

SEQ ID NO: 72837 - DNA, 15 bp, Homo sapiens
ccaggactgttactc

SEQ ID NO: 72838 - DNA, 15 bp, Homo sapiens
caggactgttactca

SEQ ID NO: 72839 - DNA, 15 bp, Homo sapiens
aggactgttactcaa

SEQ ID NO: 72840 - DNA, 15 bp, Homo sapiens
ggactgttactcaat

SEQ ID NO: 72841 - DNA, 15 bp, Homo sapiens
gactgttactcaatg

SEQ ID NO: 72842 - DNA, 15 bp, Homo sapiens
actgttactcaatgt

SEQ ID NO: 72843 - DNA, 15 bp, Homo sapiens
ctgttactcaatgtg

SEQ ID NO: 72844 - DNA, 15 bp, Homo sapiens
tgttactcaatgtgt

SEQ ID NO: 72845 - DNA, 15 bp, Homo sapiens
gttactcaatgtgtg

SEQ ID NO: 72846 - DNA, 15 bp, Homo sapiens
ttactcaatgtgtgc

SEQ ID NO: 72847 - DNA, 15 bp, Homo sapiens
tactcaatgtgtgcc

SEQ ID NO: 72848 - DNA, 15 bp, Homo sapiens
actcaatgtgtgccg

SEQ ID NO: 72849 - DNA, 15 bp, Homo sapiens
ctcaatgtgtgccga

SEQ ID NO: 72850 - DNA, 15 bp, Homo sapiens
tcaatgtgtgccgag

SEQ ID NO: 72851 - DNA, 15 bp, Homo sapiens
caatgtgtgccgagc

SEQ ID NO: 72852 - DNA, 15 bp, Homo sapiens
aatgtgtgccgagcc

SEQ ID NO: 72853 - DNA, 15 bp, Homo sapiens
atgtgtgccgagccc

SEQ ID NO: 72854 - DNA, 15 bp, Homo sapiens
tgtgtgccgagccct

SEQ ID NO: 72855 - DNA, 15 bp, Homo sapiens
gtgtgccgagccctt

SEQ ID NO: 72856 - DNA, 15 bp, Homo sapiens
tgtgccgagcccttg

SEQ ID NO: 72857 - DNA, 15 bp, Homo sapiens
gtgccgagcccttgc

SEQ ID NO: 72858 - DNA, 15 bp, Homo sapiens
tgccgagcccttgcc

SEQ ID NO: 72859 - DNA, 15 bp, Homo sapiens
gccgagcccttgccc

SEQ ID NO: 72860 - DNA, 15 bp, Homo sapiens
ccgagcccttgccca

SEQ ID NO: 72861 - DNA, 15 bp, Homo sapiens
cgagcccttgcccat

SEQ ID NO: 72862 - DNA, 15 bp, Homo sapiens
gagcccttgcccatg

SEQ ID NO: 72863 - DNA, 15 bp, Homo sapiens
agcccttgcccatgc

SEQ ID NO: 72864 - DNA, 15 bp, Homo sapiens
gcccttgcccatgct

SEQ ID NO: 72865 - DNA, 15 bp, Homo sapiens
cccttgcccatgctg

SEQ ID NO: 72866 - DNA, 15 bp, Homo sapiens
ccttgcccatgctgg

SEQ ID NO: 72867 - DNA, 15 bp, Homo sapiens
cttgcccatgctggg

SEQ ID NO: 72868 - DNA, 15 bp, Homo sapiens
ttgcccatgctgggc

SEQ ID NO: 72869 - DNA, 15 bp, Homo sapiens
tgcccatgctgggct

SEQ ID NO: 72870 - DNA, 15 bp, Homo sapiens
gcccatgctgggctc

SEQ ID NO: 72871 - DNA, 15 bp, Homo sapiens
cccatgctgggctcc

SEQ ID NO: 72872 - DNA, 15 bp, Homo sapiens
ccatgctgggctccc

SEQ ID NO: 72873 - DNA, 15 bp, Homo sapiens
catgctgggctcccg

SEQ ID NO: 72874 - DNA, 15 bp, Homo sapiens
atgctgggctcccgt

SEQ ID NO: 72875 - DNA, 15 bp, Homo sapiens
tgctgggctcccgtg

SEQ ID NO: 72876 - DNA, 15 bp, Homo sapiens
gctgggctcccgtgt

SEQ ID NO: 72877 - DNA, 15 bp, Homo sapiens
ctgggctcccgtgta

SEQ ID NO: 72878 - DNA, 15 bp, Homo sapiens
tgggctcccgtgtat

SEQ ID NO: 72879 - DNA, 15 bp, Homo sapiens
gggctcccgtgtatc

SEQ ID NO: 72880 - DNA, 15 bp, Homo sapiens
ggctcccgtgtatct

SEQ ID NO: 72881 - DNA, 15 bp, Homo sapiens
gctcccgtgtatctg

SEQ ID NO: 72882 - DNA, 15 bp, Homo sapiens
ctcccgtgtatctgg

SEQ ID NO: 72883 - DNA, 15 bp, Homo sapiens
tcccgtgtatctgga

SEQ ID NO: 72884 - DNA, 15 bp, Homo sapiens
cccgtgtatctggac

SEQ ID NO: 72885 - DNA, 15 bp, Homo sapiens
ccgtgtatctggaca

SEQ ID NO: 72886 - DNA, 15 bp, Homo sapiens
cgtgtatctggacac

SEQ ID NO: 72887 - DNA, 15 bp, Homo sapiens
gtgtatctggacact

SEQ ID NO: 72888 - DNA, 15 bp, Homo sapiens
tgtatctggacactg

SEQ ID NO: 72889 - DNA, 15 bp, Homo sapiens
gtatctggacactgt

SEQ ID NO: 72890 - DNA, 15 bp, Homo sapiens
tatctggacactgta

SEQ ID NO: 72891 - DNA, 15 bp, Homo sapiens
atctggacactgtaa

SEQ ID NO: 72892 - DNA, 15 bp, Homo sapiens
tctggacactgtaac

SEQ ID NO: 72893 - DNA, 15 bp, Homo sapiens
ctggacactgtaacg

SEQ ID NO: 72894 - DNA, 15 bp, Homo sapiens
tggacactgtaacgt

SEQ ID NO: 72895 - DNA, 15 bp, Homo sapiens
ggacactgtaacgtg

SEQ ID NO: 72896 - DNA, 15 bp, Homo sapiens
gacactgtaacgtgt

SEQ ID NO: 72897 - DNA, 15 bp, Homo sapiens
acactgtaacgtgtg

SEQ ID NO: 72898 - DNA, 15 bp, Homo sapiens
cactgtaacgtgtgc

SEQ ID NO: 72899 - DNA, 15 bp, Homo sapiens
actgtaacgtgtgct

SEQ ID NO: 72900 - DNA, 15 bp, Homo sapiens
ctgtaacgtgtgctg

SEQ ID NO: 72901 - DNA, 15 bp, Homo sapiens
tgtaacgtgtgctgt

SEQ ID NO: 72902 - DNA, 15 bp, Homo sapiens
gtaacgtgtgctgtg

SEQ ID NO: 72903 - DNA, 15 bp, Homo sapiens
taacgtgtgctgtgt

SEQ ID NO: 72904 - DNA, 15 bp, Homo sapiens
aacgtgtgctgtgtt

SEQ ID NO: 72905 - DNA, 15 bp, Homo sapiens
acgtgtgctgtgttt

SEQ ID NO: 72906 - DNA, 15 bp, Homo sapiens
cgtgtgctgtgtttg

SEQ ID NO: 72907 - DNA, 15 bp, Homo sapiens
gtgtgctgtgtttgc

SEQ ID NO: 72908 - DNA, 15 bp, Homo sapiens
tgtgctgtgtttgct

SEQ ID NO: 72909 - DNA, 15 bp, Homo sapiens
gtgctgtgtttgctc

SEQ ID NO: 72910 - DNA, 15 bp, Homo sapiens
tgctgtgtttgctcc

SEQ ID NO: 72911 - DNA, 15 bp, Homo sapiens
gctgtgtttgctccc

SEQ ID NO: 72912 - DNA, 15 bp, Homo sapiens
ctgtgtttgctcccc

SEQ ID NO: 72913 - DNA, 15 bp, Homo sapiens
tgtgtttgctcccct

SEQ ID NO: 72914 - DNA, 15 bp, Homo sapiens
gtgtttgctcccctt

SEQ ID NO: 72915 - DNA, 15 bp, Homo sapiens
tgtttgctccccttc

SEQ ID NO: 72916 - DNA, 15 bp, Homo sapiens
gtttgctccccttcc

SEQ ID NO: 72917 - DNA, 15 bp, Homo sapiens
tttgctccccttccc

SEQ ID NO: 72918 - DNA, 15 bp, Homo sapiens
ttgctccccttcccc

SEQ ID NO: 72919 - DNA, 15 bp, Homo sapiens
tgctccccttcccct

SEQ ID NO: 72920 - DNA, 15 bp, Homo sapiens
gctccccttcccctt

SEQ ID NO: 72921 - DNA, 15 bp, Homo sapiens
ctccccttccccttc

SEQ ID NO: 72922 - DNA, 15 bp, Homo sapiens
tccccttccccttcc

SEQ ID NO: 72923 - DNA, 15 bp, Homo sapiens
ccccttccccttcct

SEQ ID NO: 72924 - DNA, 15 bp, Homo sapiens
cccttccccttcctt

SEQ ID NO: 72925 - DNA, 15 bp, Homo sapiens
ccttccccttccttc

SEQ ID NO: 72926 - DNA, 15 bp, Homo sapiens
cttccccttccttct

SEQ ID NO: 72927 - DNA, 15 bp, Homo sapiens
ttccccttccttctt

SEQ ID NO: 72928 - DNA, 15 bp, Homo sapiens
tccccttccttcttt

SEQ ID NO: 72929 - DNA, 15 bp, Homo sapiens
ccccttccttctttg

SEQ ID NO: 72930 - DNA, 15 bp, Homo sapiens
cccttccttctttgc

SEQ ID NO: 72931 - DNA, 15 bp, Homo sapiens
ccttccttctttgcc

SEQ ID NO: 72932 - DNA, 15 bp, Homo sapiens
cttccttctttgccc

SEQ ID NO: 72933 - DNA, 15 bp, Homo sapiens
ttccttctttgccct

SEQ ID NO: 72934 - DNA, 15 bp, Homo sapiens
tccttctttgccctt

SEQ ID NO: 72935 - DNA, 15 bp, Homo sapiens
ccttctttgcccttt

SEQ ID NO: 72936 - DNA, 15 bp, Homo sapiens
cttctttgcccttta

SEQ ID NO: 72937 - DNA, 15 bp, Homo sapiens
ttctttgccctttac

SEQ ID NO: 72938 - DNA, 15 bp, Homo sapiens
tctttgccctttact

SEQ ID NO: 72939 - DNA, 15 bp, Homo sapiens
ctttgccctttactt

SEQ ID NO: 72940 - DNA, 15 bp, Homo sapiens
tttgccctttacttg

SEQ ID NO: 72941 - DNA, 15 bp, Homo sapiens
ttgccctttacttgt

SEQ ID NO: 72942 - DNA, 15 bp, Homo sapiens
tgccctttacttgtc

SEQ ID NO: 72943 - DNA, 15 bp, Homo sapiens
gccctttacttgtct

SEQ ID NO: 72944 - DNA, 15 bp, Homo sapiens
ccctttacttgtctt

SEQ ID NO: 72945 - DNA, 15 bp, Homo sapiens
cctttacttgtcttt

SEQ ID NO: 72946 - DNA, 15 bp, Homo sapiens
ctttacttgtctttc

SEQ ID NO: 72947 - DNA, 15 bp, Homo sapiens
tttacttgtctttct

SEQ ID NO: 72948 - DNA, 15 bp, Homo sapiens
ttacttgtctttctg

SEQ ID NO: 72949 - DNA, 15 bp, Homo sapiens
tacttgtctttctgg

SEQ ID NO: 72950 - DNA, 15 bp, Homo sapiens
acttgtctttctggg

SEQ ID NO: 72951 - DNA, 15 bp, Homo sapiens
cttgtctttctgggg

SEQ ID NO: 72952 - DNA, 15 bp, Homo sapiens
ttgtctttctggggt

SEQ ID NO: 72953 - DNA, 15 bp, Homo sapiens
tgtctttctggggtt

SEQ ID NO: 72954 - DNA, 15 bp, Homo sapiens
gtctttctggggttt

SEQ ID NO: 72955 - DNA, 15 bp, Homo sapiens
tctttctggggtttt

SEQ ID NO: 72956 - DNA, 15 bp, Homo sapiens
ctttctggggttttt

SEQ ID NO: 72957 - DNA, 15 bp, Homo sapiens
tttctggggtttttc

SEQ ID NO: 72958 - DNA, 15 bp, Homo sapiens
ttctggggtttttct

SEQ ID NO: 72959 - DNA, 15 bp, Homo sapiens
tctggggtttttctg

SEQ ID NO: 72960 - DNA, 15 bp, Homo sapiens
ctggggtttttctgt

SEQ ID NO: 72961 - DNA, 15 bp, Homo sapiens
tggggtttttctgtt

SEQ ID NO: 72962 - DNA, 15 bp, Homo sapiens
ggggtttttctgttt

SEQ ID NO: 72963 - DNA, 15 bp, Homo sapiens
gggtttttctgtttg

SEQ ID NO: 72964 - DNA, 15 bp, Homo sapiens
ggtttttctgtttgg

SEQ ID NO: 72965 - DNA, 15 bp, Homo sapiens
gtttttctgtttggg

SEQ ID NO: 72966 - DNA, 15 bp, Homo sapiens
tttttctgtttgggt

SEQ ID NO: 72967 - DNA, 15 bp, Homo sapiens
ttttctgtttgggtt

SEQ ID NO: 72968 - DNA, 15 bp, Homo sapiens
tttctgtttgggttt

SEQ ID NO: 72969 - DNA, 15 bp, Homo sapiens
ttctgtttgggtttg

SEQ ID NO: 72970 - DNA, 15 bp, Homo sapiens
tctgtttgggtttgg

SEQ ID NO: 72971 - DNA, 15 bp, Homo sapiens
ctgtttgggtttggt

SEQ ID NO: 72972 - DNA, 15 bp, Homo sapiens
tgtttgggtttggtt

SEQ ID NO: 72973 - DNA, 15 bp, Homo sapiens
gtttgggtttggttt

SEQ ID NO: 72974 - DNA, 15 bp, Homo sapiens
tttgggtttggtttg

SEQ ID NO: 72975 - DNA, 15 bp, Homo sapiens
ttgggtttggtttgg

SEQ ID NO: 72976 - DNA, 15 bp, Homo sapiens
tgggtttggtttggt

SEQ ID NO: 72977 - DNA, 15 bp, Homo sapiens
gggtttggtttggtt

SEQ ID NO: 72978 - DNA, 15 bp, Homo sapiens
ggtttggtttggttt

SEQ ID NO: 72979 - DNA, 15 bp, Homo sapiens
gtttggtttggtttt

SEQ ID NO: 72980 - DNA, 15 bp, Homo sapiens
tttggtttggttttt

SEQ ID NO: 72981 - DNA, 15 bp, Homo sapiens
ttggtttggttttta

SEQ ID NO: 72982 - DNA, 15 bp, Homo sapiens
tggtttggtttttat

SEQ ID NO: 72983 - DNA, 15 bp, Homo sapiens
ggtttggtttttatt

SEQ ID NO: 72984 - DNA, 15 bp, Homo sapiens
gtttggtttttattt

SEQ ID NO: 72985 - DNA, 15 bp, Homo sapiens
tttggtttttatttc

SEQ ID NO: 72986 - DNA, 15 bp, Homo sapiens
ttggtttttatttct

SEQ ID NO: 72987 - DNA, 15 bp, Homo sapiens
tggtttttatttctc

SEQ ID NO: 72988 - DNA, 15 bp, Homo sapiens
ggtttttatttctcc

SEQ ID NO: 72989 - DNA, 15 bp, Homo sapiens
gtttttatttctcct

SEQ ID NO: 72990 - DNA, 15 bp, Homo sapiens
tttttatttctcctt

SEQ ID NO: 72991 - DNA, 15 bp, Homo sapiens
ttttatttctccttt

SEQ ID NO: 72992 - DNA, 15 bp, Homo sapiens
tttatttctcctttt

SEQ ID NO: 72993 - DNA, 15 bp, Homo sapiens
ttatttctccttttg

SEQ ID NO: 72994 - DNA, 15 bp, Homo sapiens
tatttctccttttgt

SEQ ID NO: 72995 - DNA, 15 bp, Homo sapiens
atttctccttttgtg

SEQ ID NO: 72996 - DNA, 15 bp, Homo sapiens
tttctccttttgtgt

SEQ ID NO: 72997 - DNA, 15 bp, Homo sapiens
ttctccttttgtgtt

SEQ ID NO: 72998 - DNA, 15 bp, Homo sapiens
tctccttttgtgttc

SEQ ID NO: 72999 - DNA, 15 bp, Homo sapiens
ctccttttgtgttcc

SEQ ID NO: 73000 - DNA, 15 bp, Homo sapiens
tccttttgtgttcca

SEQ ID NO: 73001 - DNA, 15 bp, Homo sapiens
ccttttgtgttccaa

SEQ ID NO: 73002 - DNA, 15 bp, Homo sapiens
cttttgtgttccaaa

SEQ ID NO: 73003 - DNA, 15 bp, Homo sapiens
ttttgtgttccaaac

SEQ ID NO: 73004 - DNA, 15 bp, Homo sapiens
tttgtgttccaaaca

SEQ ID NO: 73005 - DNA, 15 bp, Homo sapiens
ttgtgttccaaacat

SEQ ID NO: 73006 - DNA, 15 bp, Homo sapiens
tgtgttccaaacatg

SEQ ID NO: 73007 - DNA, 15 bp, Homo sapiens
gtgttccaaacatga

SEQ ID NO: 73008 - DNA, 15 bp, Homo sapiens
tgttccaaacatgag

SEQ ID NO: 73009 - DNA, 15 bp, Homo sapiens
gttccaaacatgagg

SEQ ID NO: 73010 - DNA, 15 bp, Homo sapiens
ttccaaacatgaggt

SEQ ID NO: 73011 - DNA, 15 bp, Homo sapiens
tccaaacatgaggtt

SEQ ID NO: 73012 - DNA, 15 bp, Homo sapiens
ccaaacatgaggttc

SEQ ID NO: 73013 - DNA, 15 bp, Homo sapiens
caaacatgaggttct

SEQ ID NO: 73014 - DNA, 15 bp, Homo sapiens
aaacatgaggttctc

SEQ ID NO: 73015 - DNA, 15 bp, Homo sapiens
aacatgaggttctct

SEQ ID NO: 73016 - DNA, 15 bp, Homo sapiens
acatgaggttctctc

SEQ ID NO: 73017 - DNA, 15 bp, Homo sapiens
catgaggttctctct

SEQ ID NO: 73018 - DNA, 15 bp, Homo sapiens
atgaggttctctcta

SEQ ID NO: 73019 - DNA, 15 bp, Homo sapiens
tgaggttctctctac

SEQ ID NO: 73020 - DNA, 15 bp, Homo sapiens
gaggttctctctact

SEQ ID NO: 73021 - DNA, 15 bp, Homo sapiens
aggttctctctactg

SEQ ID NO: 73022 - DNA, 15 bp, Homo sapiens
ggttctctctactgg

SEQ ID NO: 73023 - DNA, 15 bp, Homo sapiens
gttctctctactggt

SEQ ID NO: 73024 - DNA, 15 bp, Homo sapiens
ttctctctactggtc

SEQ ID NO: 73025 - DNA, 15 bp, Homo sapiens
tctctctactggtcc

SEQ ID NO: 73026 - DNA, 15 bp, Homo sapiens
ctctctactggtcct

SEQ ID NO: 73027 - DNA, 15 bp, Homo sapiens
tctctactggtcctc

SEQ ID NO: 73028 - DNA, 15 bp, Homo sapiens
ctctactggtcctct

SEQ ID NO: 73029 - DNA, 15 bp, Homo sapiens
tctactggtcctctt

SEQ ID NO: 73030 - DNA, 15 bp, Homo sapiens
ctactggtcctctta

SEQ ID NO: 73031 - DNA, 15 bp, Homo sapiens
tactggtcctcttaa

SEQ ID NO: 73032 - DNA, 15 bp, Homo sapiens
actggtcctcttaac

SEQ ID NO: 73033 - DNA, 15 bp, Homo sapiens
ctggtcctcttaact

SEQ ID NO: 73034 - DNA, 15 bp, Homo sapiens
tggtcctcttaactg

SEQ ID NO: 73035 - DNA, 15 bp, Homo sapiens
ggtcctcttaactgt

SEQ ID NO: 73036 - DNA, 15 bp, Homo sapiens
gtcctcttaactgtg

SEQ ID NO: 73037 - DNA, 15 bp, Homo sapiens
tcctcttaactgtgg

SEQ ID NO: 73038 - DNA, 15 bp, Homo sapiens
cctcttaactgtggt

SEQ ID NO: 73039 - DNA, 15 bp, Homo sapiens
ctcttaactgtggtg

SEQ ID NO: 73040 - DNA, 15 bp, Homo sapiens
tcttaactgtggtgt

SEQ ID NO: 73041 - DNA, 15 bp, Homo sapiens
cttaactgtggtgtt

SEQ ID NO: 73042 - DNA, 15 bp, Homo sapiens
ttaactgtggtgttg

SEQ ID NO: 73043 - DNA, 15 bp, Homo sapiens
taactgtggtgttga

SEQ ID NO: 73044 - DNA, 15 bp, Homo sapiens
aactgtggtgttgag

SEQ ID NO: 73045 - DNA, 15 bp, Homo sapiens
actgtggtgttgagg

SEQ ID NO: 73046 - DNA, 15 bp, Homo sapiens
ctgtggtgttgaggc

SEQ ID NO: 73047 - DNA, 15 bp, Homo sapiens
tgtggtgttgaggct

SEQ ID NO: 73048 - DNA, 15 bp, Homo sapiens
gtggtgttgaggctt

SEQ ID NO: 73049 - DNA, 15 bp, Homo sapiens
tggtgttgaggctta

SEQ ID NO: 73050 - DNA, 15 bp, Homo sapiens
ggtgttgaggcttat

SEQ ID NO: 73051 - DNA, 15 bp, Homo sapiens
gtgttgaggcttata

SEQ ID NO: 73052 - DNA, 15 bp, Homo sapiens
tgttgaggcttatat

SEQ ID NO: 73053 - DNA, 15 bp, Homo sapiens
gttgaggcttatatt

SEQ ID NO: 73054 - DNA, 15 bp, Homo sapiens
ttgaggcttatattt

SEQ ID NO: 73055 - DNA, 15 bp, Homo sapiens
tgaggcttatatttg

SEQ ID NO: 73056 - DNA, 15 bp, Homo sapiens
gaggcttatatttgt

SEQ ID NO: 73057 - DNA, 15 bp, Homo sapiens
aggcttatatttgtg

SEQ ID NO: 73058 - DNA, 15 bp, Homo sapiens
ggcttatatttgtgt

SEQ ID NO: 73059 - DNA, 15 bp, Homo sapiens
gcttatatttgtgta

SEQ ID NO: 73060 - DNA, 15 bp, Homo sapiens
cttatatttgtgtaa

SEQ ID NO: 73061 - DNA, 15 bp, Homo sapiens
ttatatttgtgtaat

SEQ ID NO: 73062 - DNA, 15 bp, Homo sapiens
tatatttgtgtaatt

SEQ ID NO: 73063 - DNA, 15 bp, Homo sapiens
atatttgtgtaattt

SEQ ID NO: 73064 - DNA, 15 bp, Homo sapiens
tatttgtgtaatttt

SEQ ID NO: 73065 - DNA, 15 bp, Homo sapiens
atttgtgtaattttt

SEQ ID NO: 73066 - DNA, 15 bp, Homo sapiens
tttgtgtaatttttg

SEQ ID NO: 73067 - DNA, 15 bp, Homo sapiens
ttgtgtaatttttgg

SEQ ID NO: 73068 - DNA, 15 bp, Homo sapiens
tgtgtaatttttggt

SEQ ID NO: 73069 - DNA, 15 bp, Homo sapiens
gtgtaatttttggtg

SEQ ID NO: 73070 - DNA, 15 bp, Homo sapiens
tgtaatttttggtgg

SEQ ID NO: 73071 - DNA, 15 bp, Homo sapiens
gtaatttttggtggg

SEQ ID NO: 73072 - DNA, 15 bp, Homo sapiens
taatttttggtgggt

SEQ ID NO: 73073 - DNA, 15 bp, Homo sapiens
aatttttggtgggtg

SEQ ID NO: 73074 - DNA, 15 bp, Homo sapiens
atttttggtgggtga

SEQ ID NO: 73075 - DNA, 15 bp, Homo sapiens
tttttggtgggtgaa

SEQ ID NO: 73076 - DNA, 15 bp, Homo sapiens
ttttggtgggtgaaa

SEQ ID NO: 73077 - DNA, 15 bp, Homo sapiens
tttggtgggtgaaag

SEQ ID NO: 73078 - DNA, 15 bp, Homo sapiens
ttggtgggtgaaagg

SEQ ID NO: 73079 - DNA, 15 bp, Homo sapiens
tggtgggtgaaagga

SEQ ID NO: 73080 - DNA, 15 bp, Homo sapiens
ggtgggtgaaaggaa

SEQ ID NO: 73081 - DNA, 15 bp, Homo sapiens
gtgggtgaaaggaat

SEQ ID NO: 73082 - DNA, 15 bp, Homo sapiens
tgggtgaaaggaatt

SEQ ID NO: 73083 - DNA, 15 bp, Homo sapiens
gggtgaaaggaattt

SEQ ID NO: 73084 - DNA, 15 bp, Homo sapiens
ggtgaaaggaatttt

SEQ ID NO: 73085 - DNA, 15 bp, Homo sapiens
gtgaaaggaattttg

SEQ ID NO: 73086 - DNA, 15 bp, Homo sapiens
tgaaaggaattttgc

SEQ ID NO: 73087 - DNA, 15 bp, Homo sapiens
gaaaggaattttgct

SEQ ID NO: 73088 - DNA, 15 bp, Homo sapiens
aaaggaattttgcta

SEQ ID NO: 73089 - DNA, 15 bp, Homo sapiens
aaggaattttgctaa

SEQ ID NO: 73090 - DNA, 15 bp, Homo sapiens
aggaattttgctaag

SEQ ID NO: 73091 - DNA, 15 bp, Homo sapiens
ggaattttgctaagt

SEQ ID NO: 73092 - DNA, 15 bp, Homo sapiens
gaattttgctaagta

SEQ ID NO: 73093 - DNA, 15 bp, Homo sapiens
aattttgctaagtaa

SEQ ID NO: 73094 - DNA, 15 bp, Homo sapiens
attttgctaagtaaa

SEQ ID NO: 73095 - DNA, 15 bp, Homo sapiens
ttttgctaagtaaat

SEQ ID NO: 73096 - DNA, 15 bp, Homo sapiens
tttgctaagtaaatc

SEQ ID NO: 73097 - DNA, 15 bp, Homo sapiens
ttgctaagtaaatct

SEQ ID NO: 73098 - DNA, 15 bp, Homo sapiens
tgctaagtaaatctc

SEQ ID NO: 73099 - DNA, 15 bp, Homo sapiens
gctaagtaaatctct

SEQ ID NO: 73100 - DNA, 15 bp, Homo sapiens
ctaagtaaatctctt

SEQ ID NO: 73101 - DNA, 15 bp, Homo sapiens
taagtaaatctcttc

SEQ ID NO: 73102 - DNA, 15 bp, Homo sapiens
aagtaaatctcttct

SEQ ID NO: 73103 - DNA, 15 bp, Homo sapiens
agtaaatctcttctg

SEQ ID NO: 73104 - DNA, 15 bp, Homo sapiens
gtaaatctcttctgt

SEQ ID NO: 73105 - DNA, 15 bp, Homo sapiens
taaatctcttctgtg

SEQ ID NO: 73106 - DNA, 15 bp, Homo sapiens
aaatctcttctgtgt

SEQ ID NO: 73107 - DNA, 15 bp, Homo sapiens
aatctcttctgtgtt

SEQ ID NO: 73108 - DNA, 15 bp, Homo sapiens
atctcttctgtgttt

SEQ ID NO: 73109 - DNA, 15 bp, Homo sapiens
tctcttctgtgtttg

SEQ ID NO: 73110 - DNA, 15 bp, Homo sapiens
ctcttctgtgtttga

SEQ ID NO: 73111 - DNA, 15 bp, Homo sapiens
tcttctgtgtttgaa

SEQ ID NO: 73112 - DNA, 15 bp, Homo sapiens
cttctgtgtttgaac

SEQ ID NO: 73113 - DNA, 15 bp, Homo sapiens
ttctgtgtttgaact

SEQ ID NO: 73114 - DNA, 15 bp, Homo sapiens
tctgtgtttgaactg

SEQ ID NO: 73115 - DNA, 15 bp, Homo sapiens
ctgtgtttgaactga

SEQ ID NO: 73116 - DNA, 15 bp, Homo sapiens
tgtgtttgaactgaa

SEQ ID NO: 73117 - DNA, 15 bp, Homo sapiens
gtgtttgaactgaag

SEQ ID NO: 73118 - DNA, 15 bp, Homo sapiens
tgtttgaactgaagt

SEQ ID NO: 73119 - DNA, 15 bp, Homo sapiens
gtttgaactgaagtc

SEQ ID NO: 73120 - DNA, 15 bp, Homo sapiens
tttgaactgaagtct

SEQ ID NO: 73121 - DNA, 15 bp, Homo sapiens
ttgaactgaagtctg

SEQ ID NO: 73122 - DNA, 15 bp, Homo sapiens
tgaactgaagtctgt

SEQ ID NO: 73123 - DNA, 15 bp, Homo sapiens
gaactgaagtctgta

SEQ ID NO: 73124 - DNA, 15 bp, Homo sapiens
aactgaagtctgtat

SEQ ID NO: 73125 - DNA, 15 bp, Homo sapiens
actgaagtctgtatt

SEQ ID NO: 73126 - DNA, 15 bp, Homo sapiens
ctgaagtctgtattg

SEQ ID NO: 73127 - DNA, 15 bp, Homo sapiens
tgaagtctgtattgt

SEQ ID NO: 73128 - DNA, 15 bp, Homo sapiens
gaagtctgtattgta

SEQ ID NO: 73129 - DNA, 15 bp, Homo sapiens
aagtctgtattgtaa

SEQ ID NO: 73130 - DNA, 15 bp, Homo sapiens
agtctgtattgtaac

SEQ ID NO: 73131 - DNA, 15 bp, Homo sapiens
gtctgtattgtaact

SEQ ID NO: 73132 - DNA, 15 bp, Homo sapiens
tctgtattgtaacta

SEQ ID NO: 73133 - DNA, 15 bp, Homo sapiens
ctgtattgtaactat

SEQ ID NO: 73134 - DNA, 15 bp, Homo sapiens
tgtattgtaactatg

SEQ ID NO: 73135 - DNA, 15 bp, Homo sapiens
gtattgtaactatgt

SEQ ID NO: 73136 - DNA, 15 bp, Homo sapiens
tattgtaactatgtt

SEQ ID NO: 73137 - DNA, 15 bp, Homo sapiens
attgtaactatgttt

SEQ ID NO: 73138 - DNA, 15 bp, Homo sapiens
ttgtaactatgttta

SEQ ID NO: 73139 - DNA, 15 bp, Homo sapiens
tgtaactatgtttaa

SEQ ID NO: 73140 - DNA, 15 bp, Homo sapiens
gtaactatgtttaaa

SEQ ID NO: 73141 - DNA, 15 bp, Homo sapiens
taactatgtttaaag

SEQ ID NO: 73142 - DNA, 15 bp, Homo sapiens
aactatgtttaaagt

SEQ ID NO: 73143 - DNA, 15 bp, Homo sapiens
actatgtttaaagta

SEQ ID NO: 73144 - DNA, 15 bp, Homo sapiens
ctatgtttaaagtaa

SEQ ID NO: 73145 - DNA, 15 bp, Homo sapiens
tatgtttaaagtaat

SEQ ID NO: 73146 - DNA, 15 bp, Homo sapiens
atgtttaaagtaatt

SEQ ID NO: 73147 - DNA, 15 bp, Homo sapiens
tgtttaaagtaattg

SEQ ID NO: 73148 - DNA, 15 bp, Homo sapiens
gtttaaagtaattgt

SEQ ID NO: 73149 - DNA, 15 bp, Homo sapiens
tttaaagtaattgtt

SEQ ID NO: 73150 - DNA, 15 bp, Homo sapiens
ttaaagtaattgttc

SEQ ID NO: 73151 - DNA, 15 bp, Homo sapiens
taaagtaattgttcc

SEQ ID NO: 73152 - DNA, 15 bp, Homo sapiens
aaagtaattgttcca

SEQ ID NO: 73153 - DNA, 15 bp, Homo sapiens
aagtaattgttccag

SEQ ID NO: 73154 - DNA, 15 bp, Homo sapiens
agtaattgttccaga

SEQ ID NO: 73155 - DNA, 15 bp, Homo sapiens
gtaattgttccagag

SEQ ID NO: 73156 - DNA, 15 bp, Homo sapiens
taattgttccagaga

SEQ ID NO: 73157 - DNA, 15 bp, Homo sapiens
aattgttccagagac

SEQ ID NO: 73158 - DNA, 15 bp, Homo sapiens
attgttccagagaca

SEQ ID NO: 73159 - DNA, 15 bp, Homo sapiens
ttgttccagagacaa

SEQ ID NO: 73160 - DNA, 15 bp, Homo sapiens
tgttccagagacaaa

SEQ ID NO: 73161 - DNA, 15 bp, Homo sapiens
gttccagagacaaat

SEQ ID NO: 73162 - DNA, 15 bp, Homo sapiens
ttccagagacaaata

SEQ ID NO: 73163 - DNA, 15 bp, Homo sapiens
tccagagacaaatat

SEQ ID NO: 73164 - DNA, 15 bp, Homo sapiens
ccagagacaaatatt

SEQ ID NO: 73165 - DNA, 15 bp, Homo sapiens
cagagacaaatattt

SEQ ID NO: 73166 - DNA, 15 bp, Homo sapiens
agagacaaatatttc

SEQ ID NO: 73167 - DNA, 15 bp, Homo sapiens
gagacaaatatttct

SEQ ID NO: 73168 - DNA, 15 bp, Homo sapiens
agacaaatatttcta

SEQ ID NO: 73169 - DNA, 15 bp, Homo sapiens
gacaaatatttctag

SEQ ID NO: 73170 - DNA, 15 bp, Homo sapiens
acaaatatttctaga

SEQ ID NO: 73171 - DNA, 15 bp, Homo sapiens
caaatatttctagac

SEQ ID NO: 73172 - DNA, 15 bp, Homo sapiens
aaatatttctagaca

SEQ ID NO: 73173 - DNA, 15 bp, Homo sapiens
aatatttctagacac

SEQ ID NO: 73174 - DNA, 15 bp, Homo sapiens
atatttctagacact

SEQ ID NO: 73175 - DNA, 15 bp, Homo sapiens
tatttctagacactt

SEQ ID NO: 73176 - DNA, 15 bp, Homo sapiens
atttctagacacttt

SEQ ID NO: 73177 - DNA, 15 bp, Homo sapiens
tttctagacactttt

SEQ ID NO: 73178 - DNA, 15 bp, Homo sapiens
ttctagacacttttt

SEQ ID NO: 73179 - DNA, 15 bp, Homo sapiens
tctagacactttttc

SEQ ID NO: 73180 - DNA, 15 bp, Homo sapiens
ctagacactttttct

SEQ ID NO: 73181 - DNA, 15 bp, Homo sapiens
tagacactttttctt

SEQ ID NO: 73182 - DNA, 15 bp, Homo sapiens
agacactttttcttt

SEQ ID NO: 73183 - DNA, 15 bp, Homo sapiens
gacactttttcttta

SEQ ID NO: 73184 - DNA, 15 bp, Homo sapiens
acactttttctttac

SEQ ID NO: 73185 - DNA, 15 bp, Homo sapiens
cactttttctttaca

SEQ ID NO: 73186 - DNA, 15 bp, Homo sapiens
actttttctttacaa

SEQ ID NO: 73187 - DNA, 15 bp, Homo sapiens
ctttttctttacaaa

SEQ ID NO: 73188 - DNA, 15 bp, Homo sapiens
tttttctttacaaac

SEQ ID NO: 73189 - DNA, 15 bp, Homo sapiens
ttttctttacaaaca

SEQ ID NO: 73190 - DNA, 15 bp, Homo sapiens
tttctttacaaacaa

SEQ ID NO: 73191 - DNA, 15 bp, Homo sapiens
ttctttacaaacaaa

SEQ ID NO: 73192 - DNA, 15 bp, Homo sapiens
tctttacaaacaaaa

SEQ ID NO: 73193 - DNA, 15 bp, Homo sapiens
ctttacaaacaaaag

SEQ ID NO: 73194 - DNA, 15 bp, Homo sapiens
tttacaaacaaaagc

SEQ ID NO: 73195 - DNA, 15 bp, Homo sapiens
ttacaaacaaaagca

SEQ ID NO: 73196 - DNA, 15 bp, Homo sapiens
tacaaacaaaagcat

SEQ ID NO: 73197 - DNA, 15 bp, Homo sapiens
acaaacaaaagcatt

SEQ ID NO: 73198 - DNA, 15 bp, Homo sapiens
caaacaaaagcattc

SEQ ID NO: 73199 - DNA, 15 bp, Homo sapiens
aaacaaaagcattcg

SEQ ID NO: 73200 - DNA, 15 bp, Homo sapiens
aacaaaagcattcgg

SEQ ID NO: 73201 - DNA, 15 bp, Homo sapiens
acaaaagcattcgga

SEQ ID NO: 73202 - DNA, 15 bp, Homo sapiens
caaaagcattcggag

SEQ ID NO: 73203 - DNA, 15 bp, Homo sapiens
aaaagcattcggagg

SEQ ID NO: 73204 - DNA, 15 bp, Homo sapiens
aaagcattcggaggg

SEQ ID NO: 73205 - DNA, 15 bp, Homo sapiens
aagcattcggaggga

SEQ ID NO: 73206 - DNA, 15 bp, Homo sapiens
agcattcggagggag

SEQ ID NO: 73207 - DNA, 15 bp, Homo sapiens
gcattcggagggagg

SEQ ID NO: 73208 - DNA, 15 bp, Homo sapiens
cattcggagggaggg

SEQ ID NO: 73209 - DNA, 15 bp, Homo sapiens
attcggagggagggg

SEQ ID NO: 73210 - DNA, 15 bp, Homo sapiens
ttcggagggaggggg

SEQ ID NO: 73211 - DNA, 15 bp, Homo sapiens
cggagggagggggat

SEQ ID NO: 73212 - DNA, 15 bp, Homo sapiens
ggagggagggggatg

SEQ ID NO: 73213 - DNA, 15 bp, Homo sapiens
gagggagggggatgg

SEQ ID NO: 73214 - DNA, 15 bp, Homo sapiens
agggagggggatggt

SEQ ID NO: 73215 - DNA, 15 bp, Homo sapiens
gggagggggatggtg

SEQ ID NO: 73216 - DNA, 15 bp, Homo sapiens
ggagggggatggtga

SEQ ID NO: 73217 - DNA, 15 bp, Homo sapiens
gagggggatggtgac

SEQ ID NO: 73218 - DNA, 15 bp, Homo sapiens
agggggatggtgact

SEQ ID NO: 73219 - DNA, 15 bp, Homo sapiens
gggggatggtgactg

SEQ ID NO: 73220 - DNA, 15 bp, Homo sapiens
ggggatggtgactga

SEQ ID NO: 73221 - DNA, 15 bp, Homo sapiens
gggatggtgactgag

SEQ ID NO: 73222 - DNA, 15 bp, Homo sapiens
ggatggtgactgaga

SEQ ID NO: 73223 - DNA, 15 bp, Homo sapiens
gatggtgactgagat

SEQ ID NO: 73224 - DNA, 15 bp, Homo sapiens
atggtgactgagatg

SEQ ID NO: 73225 - DNA, 15 bp, Homo sapiens
tggtgactgagatga

SEQ ID NO: 73226 - DNA, 15 bp, Homo sapiens
ggtgactgagatgag

SEQ ID NO: 73227 - DNA, 15 bp, Homo sapiens
gtgactgagatgaga

SEQ ID NO: 73228 - DNA, 15 bp, Homo sapiens
tgactgagatgagag

SEQ ID NO: 73229 - DNA, 15 bp, Homo sapiens
gactgagatgagagg

SEQ ID NO: 73230 - DNA, 15 bp, Homo sapiens
actgagatgagaggg

SEQ ID NO: 73231 - DNA, 15 bp, Homo sapiens
ctgagatgagagggg

SEQ ID NO: 73232 - DNA, 15 bp, Homo sapiens
tgagatgagagggga

SEQ ID NO: 73233 - DNA, 15 bp, Homo sapiens
gagatgagaggggag

SEQ ID NO: 73234 - DNA, 15 bp, Homo sapiens
agatgagaggggaga

SEQ ID NO: 73235 - DNA, 15 bp, Homo sapiens
gatgagaggggagag

SEQ ID NO: 73236 - DNA, 15 bp, Homo sapiens
atgagaggggagagc

SEQ ID NO: 73237 - DNA, 15 bp, Homo sapiens
tgagaggggagagct

SEQ ID NO: 73238 - DNA, 15 bp, Homo sapiens
gagaggggagagctg

SEQ ID NO: 73239 - DNA, 15 bp, Homo sapiens
agaggggagagctga

SEQ ID NO: 73240 - DNA, 15 bp, Homo sapiens
gaggggagagctgaa

SEQ ID NO: 73241 - DNA, 15 bp, Homo sapiens
aggggagagctgaac

SEQ ID NO: 73242 - DNA, 15 bp, Homo sapiens
ggggagagctgaaca

SEQ ID NO: 73243 - DNA, 15 bp, Homo sapiens
gggagagctgaacag

SEQ ID NO: 73244 - DNA, 15 bp, Homo sapiens
ggagagctgaacaga

SEQ ID NO: 73245 - DNA, 15 bp, Homo sapiens
gagagctgaacagat

SEQ ID NO: 73246 - DNA, 15 bp, Homo sapiens
agagctgaacagatg

SEQ ID NO: 73247 - DNA, 15 bp, Homo sapiens
gagctgaacagatga

SEQ ID NO: 73248 - DNA, 15 bp, Homo sapiens
agctgaacagatgac

SEQ ID NO: 73249 - DNA, 15 bp, Homo sapiens
gctgaacagatgacc

SEQ ID NO: 73250 - DNA, 15 bp, Homo sapiens
ctgaacagatgaccc

SEQ ID NO: 73251 - DNA, 15 bp, Homo sapiens
tgaacagatgacccc

SEQ ID NO: 73252 - DNA, 15 bp, Homo sapiens
gaacagatgacccct

SEQ ID NO: 73253 - DNA, 15 bp, Homo sapiens
aacagatgacccctg

SEQ ID NO: 73254 - DNA, 15 bp, Homo sapiens
acagatgacccctgc

SEQ ID NO: 73255 - DNA, 15 bp, Homo sapiens
cagatgacccctgcc

SEQ ID NO: 73256 - DNA, 15 bp, Homo sapiens
agatgacccctgccc

SEQ ID NO: 73257 - DNA, 15 bp, Homo sapiens
gatgacccctgccca

SEQ ID NO: 73258 - DNA, 15 bp, Homo sapiens
atgacccctgcccag

SEQ ID NO: 73259 - DNA, 15 bp, Homo sapiens
tgacccctgcccaga

SEQ ID NO: 73260 - DNA, 15 bp, Homo sapiens
gacccctgcccagat

SEQ ID NO: 73261 - DNA, 15 bp, Homo sapiens
acccctgcccagatc

SEQ ID NO: 73262 - DNA, 15 bp, Homo sapiens
cccctgcccagatca

SEQ ID NO: 73263 - DNA, 15 bp, Homo sapiens
ccctgcccagatcag

SEQ ID NO: 73264 - DNA, 15 bp, Homo sapiens
cctgcccagatcagc

SEQ ID NO: 73265 - DNA, 15 bp, Homo sapiens
ctgcccagatcagcc

SEQ ID NO: 73266 - DNA, 15 bp, Homo sapiens
tgcccagatcagcca

SEQ ID NO: 73267 - DNA, 15 bp, Homo sapiens
gcccagatcagccag

SEQ ID NO: 73268 - DNA, 15 bp, Homo sapiens
cccagatcagccaga

SEQ ID NO: 73269 - DNA, 15 bp, Homo sapiens
ccagatcagccagaa

SEQ ID NO: 73270 - DNA, 15 bp, Homo sapiens
cagatcagccagaag

SEQ ID NO: 73271 - DNA, 15 bp, Homo sapiens
agatcagccagaagc

SEQ ID NO: 73272 - DNA, 15 bp, Homo sapiens
gatcagccagaagcc

SEQ ID NO: 73273 - DNA, 15 bp, Homo sapiens
atcagccagaagcca

SEQ ID NO: 73274 - DNA, 15 bp, Homo sapiens
tcagccagaagccac

SEQ ID NO: 73275 - DNA, 15 bp, Homo sapiens
cagccagaagccacc

SEQ ID NO: 73276 - DNA, 15 bp, Homo sapiens
agccagaagccaccc

SEQ ID NO: 73277 - DNA, 15 bp, Homo sapiens
gccagaagccaccca

SEQ ID NO: 73278 - DNA, 15 bp, Homo sapiens
ccagaagccacccaa

SEQ ID NO: 73279 - DNA, 15 bp, Homo sapiens
cagaagccacccaaa

SEQ ID NO: 73280 - DNA, 15 bp, Homo sapiens
agaagccacccaaag

SEQ ID NO: 73281 - DNA, 15 bp, Homo sapiens
gaagccacccaaagc

SEQ ID NO: 73282 - DNA, 15 bp, Homo sapiens
aagccacccaaagca

SEQ ID NO: 73283 - DNA, 15 bp, Homo sapiens
agccacccaaagcag

SEQ ID NO: 73284 - DNA, 15 bp, Homo sapiens
gccacccaaagcagt

SEQ ID NO: 73285 - DNA, 15 bp, Homo sapiens
ccacccaaagcagtg

SEQ ID NO: 73286 - DNA, 15 bp, Homo sapiens
cacccaaagcagtgg

SEQ ID NO: 73287 - DNA, 15 bp, Homo sapiens
acccaaagcagtgga

SEQ ID NO: 73288 - DNA, 15 bp, Homo sapiens
cccaaagcagtggag

SEQ ID NO: 73289 - DNA, 15 bp, Homo sapiens
ccaaagcagtggagc

SEQ ID NO: 73290 - DNA, 15 bp, Homo sapiens
caaagcagtggagcc

SEQ ID NO: 73291 - DNA, 15 bp, Homo sapiens
aaagcagtggagccc

SEQ ID NO: 73292 - DNA, 15 bp, Homo sapiens
aagcagtggagccca

SEQ ID NO: 73293 - DNA, 15 bp, Homo sapiens
agcagtggagcccag

SEQ ID NO: 73294 - DNA, 15 bp, Homo sapiens
gcagtggagcccagg

SEQ ID NO: 73295 - DNA, 15 bp, Homo sapiens
cagtggagcccagga

SEQ ID NO: 73296 - DNA, 15 bp, Homo sapiens
agtggagcccaggag

SEQ ID NO: 73297 - DNA, 15 bp, Homo sapiens
gtggagcccaggagt

SEQ ID NO: 73298 - DNA, 15 bp, Homo sapiens
tggagcccaggagtc

SEQ ID NO: 73299 - DNA, 15 bp, Homo sapiens
ggagcccaggagtcc

SEQ ID NO: 73300 - DNA, 15 bp, Homo sapiens
gagcccaggagtccc

SEQ ID NO: 73301 - DNA, 15 bp, Homo sapiens
agcccaggagtccca

SEQ ID NO: 73302 - DNA, 15 bp, Homo sapiens
gcccaggagtcccac

SEQ ID NO: 73303 - DNA, 15 bp, Homo sapiens
cccaggagtcccact

SEQ ID NO: 73304 - DNA, 15 bp, Homo sapiens
ccaggagtcccactc

SEQ ID NO: 73305 - DNA, 15 bp, Homo sapiens
caggagtcccactcc

SEQ ID NO: 73306 - DNA, 15 bp, Homo sapiens
aggagtcccactcca

SEQ ID NO: 73307 - DNA, 15 bp, Homo sapiens
ggagtcccactccaa

SEQ ID NO: 73308 - DNA, 15 bp, Homo sapiens
gagtcccactccaag

SEQ ID NO: 73309 - DNA, 15 bp, Homo sapiens
agtcccactccaagc

SEQ ID NO: 73310 - DNA, 15 bp, Homo sapiens
gtcccactccaagcc

SEQ ID NO: 73311 - DNA, 15 bp, Homo sapiens
tcccactccaagcca

SEQ ID NO: 73312 - DNA, 15 bp, Homo sapiens
cccactccaagccag

SEQ ID NO: 73313 - DNA, 15 bp, Homo sapiens
ccactccaagccagc

SEQ ID NO: 73314 - DNA, 15 bp, Homo sapiens
cactccaagccagca

SEQ ID NO: 73315 - DNA, 15 bp, Homo sapiens
actccaagccagcaa

SEQ ID NO: 73316 - DNA, 15 bp, Homo sapiens
ctccaagccagcaag

SEQ ID NO: 73317 - DNA, 15 bp, Homo sapiens
tccaagccagcaagc

SEQ ID NO: 73318 - DNA, 15 bp, Homo sapiens
ccaagccagcaagcc

SEQ ID NO: 73319 - DNA, 15 bp, Homo sapiens
caagccagcaagccg

SEQ ID NO: 73320 - DNA, 15 bp, Homo sapiens
aagccagcaagccga

SEQ ID NO: 73321 - DNA, 15 bp, Homo sapiens
agccagcaagccgaa

SEQ ID NO: 73322 - DNA, 15 bp, Homo sapiens
gccagcaagccgaat

SEQ ID NO: 73323 - DNA, 15 bp, Homo sapiens
ccagcaagccgaata

SEQ ID NO: 73324 - DNA, 15 bp, Homo sapiens
cagcaagccgaatag

SEQ ID NO: 73325 - DNA, 15 bp, Homo sapiens
agcaagccgaatagc

SEQ ID NO: 73326 - DNA, 15 bp, Homo sapiens
gcaagccgaatagct

SEQ ID NO: 73327 - DNA, 15 bp, Homo sapiens
caagccgaatagctg

SEQ ID NO: 73328 - DNA, 15 bp, Homo sapiens
aagccgaatagctga

SEQ ID NO: 73329 - DNA, 15 bp, Homo sapiens
agccgaatagctgat

SEQ ID NO: 73330 - DNA, 15 bp, Homo sapiens
gccgaatagctgatg

SEQ ID NO: 73331 - DNA, 15 bp, Homo sapiens
ccgaatagctgatgt

SEQ ID NO: 73332 - DNA, 15 bp, Homo sapiens
cgaatagctgatgtg

SEQ ID NO: 73333 - DNA, 15 bp, Homo sapiens
gaatagctgatgtgt

SEQ ID NO: 73334 - DNA, 15 bp, Homo sapiens
aatagctgatgtgtt

SEQ ID NO: 73335 - DNA, 15 bp, Homo sapiens
atagctgatgtgttg

SEQ ID NO: 73336 - DNA, 15 bp, Homo sapiens
tagctgatgtgttgc

SEQ ID NO: 73337 - DNA, 15 bp, Homo sapiens
agctgatgtgttgcc

SEQ ID NO: 73338 - DNA, 15 bp, Homo sapiens
gctgatgtgttgcca

SEQ ID NO: 73339 - DNA, 15 bp, Homo sapiens
ctgatgtgttgccac

SEQ ID NO: 73340 - DNA, 15 bp, Homo sapiens
tgatgtgttgccact

SEQ ID NO: 73341 - DNA, 15 bp, Homo sapiens
gatgtgttgccactt

SEQ ID NO: 73342 - DNA, 15 bp, Homo sapiens
atgtgttgccacttt

SEQ ID NO: 73343 - DNA, 15 bp, Homo sapiens
tgtgttgccactttc

SEQ ID NO: 73344 - DNA, 15 bp, Homo sapiens
gtgttgccactttcc

SEQ ID NO: 73345 - DNA, 15 bp, Homo sapiens
tgttgccactttcca

SEQ ID NO: 73346 - DNA, 15 bp, Homo sapiens
gttgccactttccaa

SEQ ID NO: 73347 - DNA, 15 bp, Homo sapiens
ttgccactttccaag

SEQ ID NO: 73348 - DNA, 15 bp, Homo sapiens
tgccactttccaagt

SEQ ID NO: 73349 - DNA, 15 bp, Homo sapiens
gccactttccaagtc

SEQ ID NO: 73350 - DNA, 15 bp, Homo sapiens
ccactttccaagtca

SEQ ID NO: 73351 - DNA, 15 bp, Homo sapiens
cactttccaagtcac

SEQ ID NO: 73352 - DNA, 15 bp, Homo sapiens
actttccaagtcact

SEQ ID NO: 73353 - DNA, 15 bp, Homo sapiens
ctttccaagtcactg

SEQ ID NO: 73354 - DNA, 15 bp, Homo sapiens
tttccaagtcactgc

SEQ ID NO: 73355 - DNA, 15 bp, Homo sapiens
ttccaagtcactgca

SEQ ID NO: 73356 - DNA, 15 bp, Homo sapiens
tccaagtcactgcaa

SEQ ID NO: 73357 - DNA, 15 bp, Homo sapiens
ccaagtcactgcaaa

SEQ ID NO: 73358 - DNA, 15 bp, Homo sapiens
caagtcactgcaaaa

SEQ ID NO: 73359 - DNA, 15 bp, Homo sapiens
aagtcactgcaaaac

SEQ ID NO: 73360 - DNA, 15 bp, Homo sapiens
agtcactgcaaaacc

SEQ ID NO: 73361 - DNA, 15 bp, Homo sapiens
gtcactgcaaaacca

SEQ ID NO: 73362 - DNA, 15 bp, Homo sapiens
tcactgcaaaaccag

SEQ ID NO: 73363 - DNA, 15 bp, Homo sapiens
cactgcaaaaccagg

SEQ ID NO: 73364 - DNA, 15 bp, Homo sapiens
actgcaaaaccaggt

SEQ ID NO: 73365 - DNA, 15 bp, Homo sapiens
ctgcaaaaccaggtt

SEQ ID NO: 73366 - DNA, 15 bp, Homo sapiens
tgcaaaaccaggttt

SEQ ID NO: 73367 - DNA, 15 bp, Homo sapiens
gcaaaaccaggtttt

SEQ ID NO: 73368 - DNA, 15 bp, Homo sapiens
caaaaccaggttttg

SEQ ID NO: 73369 - DNA, 15 bp, Homo sapiens
aaaaccaggttttgt

SEQ ID NO: 73370 - DNA, 15 bp, Homo sapiens
aaaccaggttttgtt

SEQ ID NO: 73371 - DNA, 15 bp, Homo sapiens
aaccaggttttgttc

SEQ ID NO: 73372 - DNA, 15 bp, Homo sapiens
accaggttttgttcc

SEQ ID NO: 73373 - DNA, 15 bp, Homo sapiens
ccaggttttgttccg

SEQ ID NO: 73374 - DNA, 15 bp, Homo sapiens
caggttttgttccgc

SEQ ID NO: 73375 - DNA, 15 bp, Homo sapiens
aggttttgttccgcc

SEQ ID NO: 73376 - DNA, 15 bp, Homo sapiens
ggttttgttccgccc

SEQ ID NO: 73377 - DNA, 15 bp, Homo sapiens
gttttgttccgccca

SEQ ID NO: 73378 - DNA, 15 bp, Homo sapiens
ttttgttccgcccag

SEQ ID NO: 73379 - DNA, 15 bp, Homo sapiens
tttgttccgcccagt

SEQ ID NO: 73380 - DNA, 15 bp, Homo sapiens
ttgttccgcccagtg

SEQ ID NO: 73381 - DNA, 15 bp, Homo sapiens
tgttccgcccagtgg

SEQ ID NO: 73382 - DNA, 15 bp, Homo sapiens
gttccgcccagtgga

SEQ ID NO: 73383 - DNA, 15 bp, Homo sapiens
ttccgcccagtggat

SEQ ID NO: 73384 - DNA, 15 bp, Homo sapiens
tccgcccagtggatt

SEQ ID NO: 73385 - DNA, 15 bp, Homo sapiens
ccgcccagtggattc

SEQ ID NO: 73386 - DNA, 15 bp, Homo sapiens
cgcccagtggattct

SEQ ID NO: 73387 - DNA, 15 bp, Homo sapiens
gcccagtggattctt

SEQ ID NO: 73388 - DNA, 15 bp, Homo sapiens
cccagtggattcttg

SEQ ID NO: 73389 - DNA, 15 bp, Homo sapiens
ccagtggattcttgt

SEQ ID NO: 73390 - DNA, 15 bp, Homo sapiens
cagtggattcttgtt

SEQ ID NO: 73391 - DNA, 15 bp, Homo sapiens
agtggattcttgttt

SEQ ID NO: 73392 - DNA, 15 bp, Homo sapiens
gtggattcttgtttt

SEQ ID NO: 73393 - DNA, 15 bp, Homo sapiens
tggattcttgttttg

SEQ ID NO: 73394 - DNA, 15 bp, Homo sapiens
ggattcttgttttgc

SEQ ID NO: 73395 - DNA, 15 bp, Homo sapiens
gattcttgttttgct

SEQ ID NO: 73396 - DNA, 15 bp, Homo sapiens
attcttgttttgctt

SEQ ID NO: 73397 - DNA, 15 bp, Homo sapiens
ttcttgttttgcttc

SEQ ID NO: 73398 - DNA, 15 bp, Homo sapiens
tcttgttttgcttcc

SEQ ID NO: 73399 - DNA, 15 bp, Homo sapiens
cttgttttgcttccc

SEQ ID NO: 73400 - DNA, 15 bp, Homo sapiens
ttgttttgcttcccc

SEQ ID NO: 73401 - DNA, 15 bp, Homo sapiens
tgttttgcttcccct

SEQ ID NO: 73402 - DNA, 15 bp, Homo sapiens
gttttgcttcccctc

SEQ ID NO: 73403 - DNA, 15 bp, Homo sapiens
ttttgcttcccctcc

SEQ ID NO: 73404 - DNA, 15 bp, Homo sapiens
tttgcttcccctccc

SEQ ID NO: 73405 - DNA, 15 bp, Homo sapiens
ttgcttcccctcccc

SEQ ID NO: 73406 - DNA, 15 bp, Homo sapiens
tgcttcccctccccc

SEQ ID NO: 73407 - DNA, 15 bp, Homo sapiens
gcttcccctcccccc

SEQ ID NO: 73408 - DNA, 15 bp, Homo sapiens
cttcccctccccccg

SEQ ID NO: 73409 - DNA, 15 bp, Homo sapiens
ttcccctccccccga

SEQ ID NO: 73410 - DNA, 15 bp, Homo sapiens
tcccctccccccgag

SEQ ID NO: 73411 - DNA, 15 bp, Homo sapiens
cccctccccccgaga

SEQ ID NO: 73412 - DNA, 15 bp, Homo sapiens
ccctccccccgagat

SEQ ID NO: 73413 - DNA, 15 bp, Homo sapiens
cctccccccgagatt

SEQ ID NO: 73414 - DNA, 15 bp, Homo sapiens
ctccccccgagatta

SEQ ID NO: 73415 - DNA, 15 bp, Homo sapiens
tccccccgagattat

SEQ ID NO: 73416 - DNA, 15 bp, Homo sapiens
ccccccgagattatt

SEQ ID NO: 73417 - DNA, 15 bp, Homo sapiens
cccccgagattatta

SEQ ID NO: 73418 - DNA, 15 bp, Homo sapiens
ccccgagattattac

SEQ ID NO: 73419 - DNA, 15 bp, Homo sapiens
cccgagattattacc

SEQ ID NO: 73420 - DNA, 15 bp, Homo sapiens
ccgagattattacca

SEQ ID NO: 73421 - DNA, 15 bp, Homo sapiens
cgagattattaccac

SEQ ID NO: 73422 - DNA, 15 bp, Homo sapiens
gagattattaccacc

SEQ ID NO: 73423 - DNA, 15 bp, Homo sapiens
agattattaccacca

SEQ ID NO: 73424 - DNA, 15 bp, Homo sapiens
gattattaccaccat

SEQ ID NO: 73425 - DNA, 15 bp, Homo sapiens
attattaccaccatc

SEQ ID NO: 73426 - DNA, 15 bp, Homo sapiens
ttattaccaccatcc

SEQ ID NO: 73427 - DNA, 15 bp, Homo sapiens
tattaccaccatccc

SEQ ID NO: 73428 - DNA, 15 bp, Homo sapiens
attaccaccatcccg

SEQ ID NO: 73429 - DNA, 15 bp, Homo sapiens
ttaccaccatcccgt

SEQ ID NO: 73430 - DNA, 15 bp, Homo sapiens
taccaccatcccgtg

SEQ ID NO: 73431 - DNA, 15 bp, Homo sapiens
accaccatcccgtgc

SEQ ID NO: 73432 - DNA, 15 bp, Homo sapiens
ccaccatcccgtgct

SEQ ID NO: 73433 - DNA, 15 bp, Homo sapiens
caccatcccgtgctt

SEQ ID NO: 73434 - DNA, 15 bp, Homo sapiens
accatcccgtgcttt

SEQ ID NO: 73435 - DNA, 15 bp, Homo sapiens
ccatcccgtgctttt

SEQ ID NO: 73436 - DNA, 15 bp, Homo sapiens
catcccgtgctttta

SEQ ID NO: 73437 - DNA, 15 bp, Homo sapiens
atcccgtgcttttaa

SEQ ID NO: 73438 - DNA, 15 bp, Homo sapiens
tcccgtgcttttaag

SEQ ID NO: 73439 - DNA, 15 bp, Homo sapiens
cccgtgcttttaagg

SEQ ID NO: 73440 - DNA, 15 bp, Homo sapiens
ccgtgcttttaagga

SEQ ID NO: 73441 - DNA, 15 bp, Homo sapiens
cgtgcttttaaggaa

SEQ ID NO: 73442 - DNA, 15 bp, Homo sapiens
gtgcttttaaggaaa

SEQ ID NO: 73443 - DNA, 15 bp, Homo sapiens
tgcttttaaggaaag

SEQ ID NO: 73444 - DNA, 15 bp, Homo sapiens
gcttttaaggaaagg

SEQ ID NO: 73445 - DNA, 15 bp, Homo sapiens
cttttaaggaaaggc

SEQ ID NO: 73446 - DNA, 15 bp, Homo sapiens
ttttaaggaaaggca

SEQ ID NO: 73447 - DNA, 15 bp, Homo sapiens
tttaaggaaaggcaa

SEQ ID NO: 73448 - DNA, 15 bp, Homo sapiens
ttaaggaaaggcaag

SEQ ID NO: 73449 - DNA, 15 bp, Homo sapiens
taaggaaaggcaaga

SEQ ID NO: 73450 - DNA, 15 bp, Homo sapiens
aaggaaaggcaagat

SEQ ID NO: 73451 - DNA, 15 bp, Homo sapiens
aggaaaggcaagatt

SEQ ID NO: 73452 - DNA, 15 bp, Homo sapiens
ggaaaggcaagattg

SEQ ID NO: 73453 - DNA, 15 bp, Homo sapiens
gaaaggcaagattga

SEQ ID NO: 73454 - DNA, 15 bp, Homo sapiens
aaaggcaagattgat

SEQ ID NO: 73455 - DNA, 15 bp, Homo sapiens
aaggcaagattgatg

SEQ ID NO: 73456 - DNA, 15 bp, Homo sapiens
aggcaagattgatgt

SEQ ID NO: 73457 - DNA, 15 bp, Homo sapiens
ggcaagattgatgtt

SEQ ID NO: 73458 - DNA, 15 bp, Homo sapiens
gcaagattgatgttt

SEQ ID NO: 73459 - DNA, 15 bp, Homo sapiens
caagattgatgtttc

SEQ ID NO: 73460 - DNA, 15 bp, Homo sapiens
aagattgatgtttcc

SEQ ID NO: 73461 - DNA, 15 bp, Homo sapiens
agattgatgtttcct

SEQ ID NO: 73462 - DNA, 15 bp, Homo sapiens
gattgatgtttcctt

SEQ ID NO: 73463 - DNA, 15 bp, Homo sapiens
attgatgtttccttg

SEQ ID NO: 73464 - DNA, 15 bp, Homo sapiens
ttgatgtttccttga

SEQ ID NO: 73465 - DNA, 15 bp, Homo sapiens
tgatgtttccttgag

SEQ ID NO: 73466 - DNA, 15 bp, Homo sapiens
gatgtttccttgagg

SEQ ID NO: 73467 - DNA, 15 bp, Homo sapiens
atgtttccttgaggg

SEQ ID NO: 73468 - DNA, 15 bp, Homo sapiens
tgtttccttgagggg

SEQ ID NO: 73469 - DNA, 15 bp, Homo sapiens
gtttccttgagggga

SEQ ID NO: 73470 - DNA, 15 bp, Homo sapiens
tttccttgaggggag

SEQ ID NO: 73471 - DNA, 15 bp, Homo sapiens
ttccttgaggggagc

SEQ ID NO: 73472 - DNA, 15 bp, Homo sapiens
tccttgaggggagcc

SEQ ID NO: 73473 - DNA, 15 bp, Homo sapiens
ccttgaggggagcca

SEQ ID NO: 73474 - DNA, 15 bp, Homo sapiens
cttgaggggagccag

SEQ ID NO: 73475 - DNA, 15 bp, Homo sapiens
ttgaggggagccagg

SEQ ID NO: 73476 - DNA, 15 bp, Homo sapiens
tgaggggagccagga

SEQ ID NO: 73477 - DNA, 15 bp, Homo sapiens
gaggggagccaggag

SEQ ID NO: 73478 - DNA, 15 bp, Homo sapiens
aggggagccaggagg

SEQ ID NO: 73479 - DNA, 15 bp, Homo sapiens
ggggagccaggaggg

SEQ ID NO: 73480 - DNA, 15 bp, Homo sapiens
gggagccaggagggg

SEQ ID NO: 73481 - DNA, 15 bp, Homo sapiens
ggagccaggagggga

SEQ ID NO: 73482 - DNA, 15 bp, Homo sapiens
gagccaggaggggat

SEQ ID NO: 73483 - DNA, 15 bp, Homo sapiens
agccaggaggggatg

SEQ ID NO: 73484 - DNA, 15 bp, Homo sapiens
gccaggaggggatgt

SEQ ID NO: 73485 - DNA, 15 bp, Homo sapiens
ccaggaggggatgtg

SEQ ID NO: 73486 - DNA, 15 bp, Homo sapiens
caggaggggatgtgt

SEQ ID NO: 73487 - DNA, 15 bp, Homo sapiens
aggaggggatgtgtg

SEQ ID NO: 73488 - DNA, 15 bp, Homo sapiens
ggaggggatgtgtgt

SEQ ID NO: 73489 - DNA, 15 bp, Homo sapiens
gaggggatgtgtgtg

SEQ ID NO: 73490 - DNA, 15 bp, Homo sapiens
aggggatgtgtgtgt

SEQ ID NO: 73491 - DNA, 15 bp, Homo sapiens
ggggatgtgtgtgtg

SEQ ID NO: 73492 - DNA, 15 bp, Homo sapiens
gggatgtgtgtgtgc

SEQ ID NO: 73493 - DNA, 15 bp, Homo sapiens
ggatgtgtgtgtgca

SEQ ID NO: 73494 - DNA, 15 bp, Homo sapiens
gatgtgtgtgtgcag

SEQ ID NO: 73495 - DNA, 15 bp, Homo sapiens
atgtgtgtgtgcaga

SEQ ID NO: 73496 - DNA, 15 bp, Homo sapiens
tgtgtgtgtgcagag

SEQ ID NO: 73497 - DNA, 15 bp, Homo sapiens
gtgtgtgtgcagagc

SEQ ID NO: 73498 - DNA, 15 bp, Homo sapiens
tgtgtgtgcagagct

SEQ ID NO: 73499 - DNA, 15 bp, Homo sapiens
gtgtgtgcagagctg

SEQ ID NO: 73500 - DNA, 15 bp, Homo sapiens
tgtgtgcagagctga

SEQ ID NO: 73501 - DNA, 15 bp, Homo sapiens
gtgtgcagagctgaa

SEQ ID NO: 73502 - DNA, 15 bp, Homo sapiens
tgtgcagagctgaag

SEQ ID NO: 73503 - DNA, 15 bp, Homo sapiens
gtgcagagctgaaga

SEQ ID NO: 73504 - DNA, 15 bp, Homo sapiens
tgcagagctgaagag

SEQ ID NO: 73505 - DNA, 15 bp, Homo sapiens
gcagagctgaagagc

SEQ ID NO: 73506 - DNA, 15 bp, Homo sapiens
cagagctgaagagct

SEQ ID NO: 73507 - DNA, 15 bp, Homo sapiens
agagctgaagagctg

SEQ ID NO: 73508 - DNA, 15 bp, Homo sapiens
gagctgaagagctgg

SEQ ID NO: 73509 - DNA, 15 bp, Homo sapiens
agctgaagagctggg

SEQ ID NO: 73510 - DNA, 15 bp, Homo sapiens
gctgaagagctgggg

SEQ ID NO: 73511 - DNA, 15 bp, Homo sapiens
ctgaagagctgggga

SEQ ID NO: 73512 - DNA, 15 bp, Homo sapiens
tgaagagctggggag

SEQ ID NO: 73513 - DNA, 15 bp, Homo sapiens
gaagagctggggaga

SEQ ID NO: 73514 - DNA, 15 bp, Homo sapiens
aagagctggggagaa

SEQ ID NO: 73515 - DNA, 15 bp, Homo sapiens
agagctggggagaat

SEQ ID NO: 73516 - DNA, 15 bp, Homo sapiens
gagctggggagaatg

SEQ ID NO: 73517 - DNA, 15 bp, Homo sapiens
agctggggagaatgg

SEQ ID NO: 73518 - DNA, 15 bp, Homo sapiens
gctggggagaatggg

SEQ ID NO: 73519 - DNA, 15 bp, Homo sapiens
ctggggagaatgggg

SEQ ID NO: 73520 - DNA, 15 bp, Homo sapiens
tggggagaatggggc

SEQ ID NO: 73521 - DNA, 15 bp, Homo sapiens
ggggagaatggggct

SEQ ID NO: 73522 - DNA, 15 bp, Homo sapiens
gggagaatggggctg

SEQ ID NO: 73523 - DNA, 15 bp, Homo sapiens
ggagaatggggctgg

SEQ ID NO: 73524 - DNA, 15 bp, Homo sapiens
gagaatggggctggg

SEQ ID NO: 73525 - DNA, 15 bp, Homo sapiens
agaatggggctgggc

SEQ ID NO: 73526 - DNA, 15 bp, Homo sapiens
gaatggggctgggcc

SEQ ID NO: 73527 - DNA, 15 bp, Homo sapiens
aatggggctgggccc

SEQ ID NO: 73528 - DNA, 15 bp, Homo sapiens
atggggctgggccca

SEQ ID NO: 73529 - DNA, 15 bp, Homo sapiens
tggggctgggcccac

SEQ ID NO: 73530 - DNA, 15 bp, Homo sapiens
ggggctgggcccacc

SEQ ID NO: 73531 - DNA, 15 bp, Homo sapiens
gggctgggcccaccc

SEQ ID NO: 73532 - DNA, 15 bp, Homo sapiens
ggctgggcccaccca

SEQ ID NO: 73533 - DNA, 15 bp, Homo sapiens
gctgggcccacccaa

SEQ ID NO: 73534 - DNA, 15 bp, Homo sapiens
ctgggcccacccaag

SEQ ID NO: 73535 - DNA, 15 bp, Homo sapiens
tgggcccacccaagc

SEQ ID NO: 73536 - DNA, 15 bp, Homo sapiens
gggcccacccaagca

SEQ ID NO: 73537 - DNA, 15 bp, Homo sapiens
ggcccacccaagcag

SEQ ID NO: 73538 - DNA, 15 bp, Homo sapiens
gcccacccaagcagg

SEQ ID NO: 73539 - DNA, 15 bp, Homo sapiens
cccacccaagcagga

SEQ ID NO: 73540 - DNA, 15 bp, Homo sapiens
ccacccaagcaggag

SEQ ID NO: 73541 - DNA, 15 bp, Homo sapiens
cacccaagcaggagg

SEQ ID NO: 73542 - DNA, 15 bp, Homo sapiens
acccaagcaggaggc

SEQ ID NO: 73543 - DNA, 15 bp, Homo sapiens
cccaagcaggaggct

SEQ ID NO: 73544 - DNA, 15 bp, Homo sapiens
ccaagcaggaggctg

SEQ ID NO: 73545 - DNA, 15 bp, Homo sapiens
caagcaggaggctgg

SEQ ID NO: 73546 - DNA, 15 bp, Homo sapiens
aagcaggaggctggg

SEQ ID NO: 73547 - DNA, 15 bp, Homo sapiens
agcaggaggctggga

SEQ ID NO: 73548 - DNA, 15 bp, Homo sapiens
gcaggaggctgggac

SEQ ID NO: 73549 - DNA, 15 bp, Homo sapiens
caggaggctgggacg

SEQ ID NO: 73550 - DNA, 15 bp, Homo sapiens
aggaggctgggacgc

SEQ ID NO: 73551 - DNA, 15 bp, Homo sapiens
ggaggctgggacgct

SEQ ID NO: 73552 - DNA, 15 bp, Homo sapiens
gaggctgggacgctc

SEQ ID NO: 73553 - DNA, 15 bp, Homo sapiens
aggctgggacgctct

SEQ ID NO: 73554 - DNA, 15 bp, Homo sapiens
ggctgggacgctctg

SEQ ID NO: 73555 - DNA, 15 bp, Homo sapiens
gctgggacgctctgc

SEQ ID NO: 73556 - DNA, 15 bp, Homo sapiens
ctgggacgctctgct

SEQ ID NO: 73557 - DNA, 15 bp, Homo sapiens
tgggacgctctgctg

SEQ ID NO: 73558 - DNA, 15 bp, Homo sapiens
gggacgctctgctgt

SEQ ID NO: 73559 - DNA, 15 bp, Homo sapiens
ggacgctctgctgtg

SEQ ID NO: 73560 - DNA, 15 bp, Homo sapiens
gacgctctgctgtgg

SEQ ID NO: 73561 - DNA, 15 bp, Homo sapiens
acgctctgctgtggg

SEQ ID NO: 73562 - DNA, 15 bp, Homo sapiens
cgctctgctgtgggc

SEQ ID NO: 73563 - DNA, 15 bp, Homo sapiens
gctctgctgtgggca

SEQ ID NO: 73564 - DNA, 15 bp, Homo sapiens
ctctgctgtgggcac

SEQ ID NO: 73565 - DNA, 15 bp, Homo sapiens
tctgctgtgggcaca

SEQ ID NO: 73566 - DNA, 15 bp, Homo sapiens
ctgctgtgggcacag

SEQ ID NO: 73567 - DNA, 15 bp, Homo sapiens
tgctgtgggcacagg

SEQ ID NO: 73568 - DNA, 15 bp, Homo sapiens
gctgtgggcacaggt

SEQ ID NO: 73569 - DNA, 15 bp, Homo sapiens
ctgtgggcacaggtc

SEQ ID NO: 73570 - DNA, 15 bp, Homo sapiens
tgtgggcacaggtca

SEQ ID NO: 73571 - DNA, 15 bp, Homo sapiens
gtgggcacaggtcag

SEQ ID NO: 73572 - DNA, 15 bp, Homo sapiens
tgggcacaggtcagg

SEQ ID NO: 73573 - DNA, 15 bp, Homo sapiens
gggcacaggtcaggc

SEQ ID NO: 73574 - DNA, 15 bp, Homo sapiens
ggcacaggtcaggct

SEQ ID NO: 73575 - DNA, 15 bp, Homo sapiens
gcacaggtcaggcta

SEQ ID NO: 73576 - DNA, 15 bp, Homo sapiens
cacaggtcaggctaa

SEQ ID NO: 73577 - DNA, 15 bp, Homo sapiens
acaggtcaggctaat

SEQ ID NO: 73578 - DNA, 15 bp, Homo sapiens
caggtcaggctaatg

SEQ ID NO: 73579 - DNA, 15 bp, Homo sapiens
aggtcaggctaatgt

SEQ ID NO: 73580 - DNA, 15 bp, Homo sapiens
ggtcaggctaatgtt

SEQ ID NO: 73581 - DNA, 15 bp, Homo sapiens
gtcaggctaatgttg

SEQ ID NO: 73582 - DNA, 15 bp, Homo sapiens
tcaggctaatgttgg

SEQ ID NO: 73583 - DNA, 15 bp, Homo sapiens
caggctaatgttggc

SEQ ID NO: 73584 - DNA, 15 bp, Homo sapiens
aggctaatgttggca

SEQ ID NO: 73585 - DNA, 15 bp, Homo sapiens
ggctaatgttggcag

SEQ ID NO: 73586 - DNA, 15 bp, Homo sapiens
gctaatgttggcaga

SEQ ID NO: 73587 - DNA, 15 bp, Homo sapiens
ctaatgttggcagat

SEQ ID NO: 73588 - DNA, 15 bp, Homo sapiens
taatgttggcagatg

SEQ ID NO: 73589 - DNA, 15 bp, Homo sapiens
aatgttggcagatgc

SEQ ID NO: 73590 - DNA, 15 bp, Homo sapiens
atgttggcagatgca

SEQ ID NO: 73591 - DNA, 15 bp, Homo sapiens
tgttggcagatgcag

SEQ ID NO: 73592 - DNA, 15 bp, Homo sapiens
gttggcagatgcagc

SEQ ID NO: 73593 - DNA, 15 bp, Homo sapiens
ttggcagatgcagct

SEQ ID NO: 73594 - DNA, 15 bp, Homo sapiens
tggcagatgcagctc

SEQ ID NO: 73595 - DNA, 15 bp, Homo sapiens
ggcagatgcagctct

SEQ ID NO: 73596 - DNA, 15 bp, Homo sapiens
gcagatgcagctctt

SEQ ID NO: 73597 - DNA, 15 bp, Homo sapiens
cagatgcagctcttc

SEQ ID NO: 73598 - DNA, 15 bp, Homo sapiens
agatgcagctcttcc

SEQ ID NO: 73599 - DNA, 15 bp, Homo sapiens
gatgcagctcttcct

SEQ ID NO: 73600 - DNA, 15 bp, Homo sapiens
atgcagctcttcctg

SEQ ID NO: 73601 - DNA, 15 bp, Homo sapiens
tgcagctcttcctgg

SEQ ID NO: 73602 - DNA, 15 bp, Homo sapiens
gcagctcttcctgga

SEQ ID NO: 73603 - DNA, 15 bp, Homo sapiens
cagctcttcctggac

SEQ ID NO: 73604 - DNA, 15 bp, Homo sapiens
agctcttcctggaca

SEQ ID NO: 73605 - DNA, 15 bp, Homo sapiens
gctcttcctggacag

SEQ ID NO: 73606 - DNA, 15 bp, Homo sapiens
ctcttcctggacagg

SEQ ID NO: 73607 - DNA, 15 bp, Homo sapiens
tcttcctggacaggc

SEQ ID NO: 73608 - DNA, 15 bp, Homo sapiens
cttcctggacaggcc

SEQ ID NO: 73609 - DNA, 15 bp, Homo sapiens
ttcctggacaggcca

SEQ ID NO: 73610 - DNA, 15 bp, Homo sapiens
tcctggacaggccag

SEQ ID NO: 73611 - DNA, 15 bp, Homo sapiens
cctggacaggccagg

SEQ ID NO: 73612 - DNA, 15 bp, Homo sapiens
ctggacaggccaggt

SEQ ID NO: 73613 - DNA, 15 bp, Homo sapiens
tggacaggccaggtg

SEQ ID NO: 73614 - DNA, 15 bp, Homo sapiens
ggacaggccaggtgg

SEQ ID NO: 73615 - DNA, 15 bp, Homo sapiens
gacaggccaggtggt

SEQ ID NO: 73616 - DNA, 15 bp, Homo sapiens
acaggccaggtggtg

SEQ ID NO: 73617 - DNA, 15 bp, Homo sapiens
caggccaggtggtgg

SEQ ID NO: 73618 - DNA, 15 bp, Homo sapiens
aggccaggtggtggg

SEQ ID NO: 73619 - DNA, 15 bp, Homo sapiens
ggccaggtggtgggc

SEQ ID NO: 73620 - DNA, 15 bp, Homo sapiens
gccaggtggtgggca

SEQ ID NO: 73621 - DNA, 15 bp, Homo sapiens
ccaggtggtgggcat

SEQ ID NO: 73622 - DNA, 15 bp, Homo sapiens
caggtggtgggcatt

SEQ ID NO: 73623 - DNA, 15 bp, Homo sapiens
aggtggtgggcattc

SEQ ID NO: 73624 - DNA, 15 bp, Homo sapiens
ggtggtgggcattct

SEQ ID NO: 73625 - DNA, 15 bp, Homo sapiens
gtggtgggcattctc

SEQ ID NO: 73626 - DNA, 15 bp, Homo sapiens
tggtgggcattctct

SEQ ID NO: 73627 - DNA, 15 bp, Homo sapiens
ggtgggcattctctc

SEQ ID NO: 73628 - DNA, 15 bp, Homo sapiens
gtgggcattctctct

SEQ ID NO: 73629 - DNA, 15 bp, Homo sapiens
tgggcattctctctc

SEQ ID NO: 73630 - DNA, 15 bp, Homo sapiens
gggcattctctctcc

SEQ ID NO: 73631 - DNA, 15 bp, Homo sapiens
ggcattctctctcca

SEQ ID NO: 73632 - DNA, 15 bp, Homo sapiens
gcattctctctccaa

SEQ ID NO: 73633 - DNA, 15 bp, Homo sapiens
cattctctctccaag

SEQ ID NO: 73634 - DNA, 15 bp, Homo sapiens
attctctctccaagg

SEQ ID NO: 73635 - DNA, 15 bp, Homo sapiens
ttctctctccaaggt

SEQ ID NO: 73636 - DNA, 15 bp, Homo sapiens
tctctctccaaggtg

SEQ ID NO: 73637 - DNA, 15 bp, Homo sapiens
ctctctccaaggtgt

SEQ ID NO: 73638 - DNA, 15 bp, Homo sapiens
tctctccaaggtgtg

SEQ ID NO: 73639 - DNA, 15 bp, Homo sapiens
ctctccaaggtgtgc

SEQ ID NO: 73640 - DNA, 15 bp, Homo sapiens
tctccaaggtgtgcc

SEQ ID NO: 73641 - DNA, 15 bp, Homo sapiens
ctccaaggtgtgccc

SEQ ID NO: 73642 - DNA, 15 bp, Homo sapiens
tccaaggtgtgcccc

SEQ ID NO: 73643 - DNA, 15 bp, Homo sapiens
ccaaggtgtgccccg

SEQ ID NO: 73644 - DNA, 15 bp, Homo sapiens
caaggtgtgccccgt

SEQ ID NO: 73645 - DNA, 15 bp, Homo sapiens
aaggtgtgccccgtg

SEQ ID NO: 73646 - DNA, 15 bp, Homo sapiens
aggtgtgccccgtgg

SEQ ID NO: 73647 - DNA, 15 bp, Homo sapiens
ggtgtgccccgtggg

SEQ ID NO: 73648 - DNA, 15 bp, Homo sapiens
gtgtgccccgtgggc

SEQ ID NO: 73649 - DNA, 15 bp, Homo sapiens
tgtgccccgtgggca

SEQ ID NO: 73650 - DNA, 15 bp, Homo sapiens
gtgccccgtgggcat

SEQ ID NO: 73651 - DNA, 15 bp, Homo sapiens
tgccccgtgggcatt

SEQ ID NO: 73652 - DNA, 15 bp, Homo sapiens
gccccgtgggcatta

SEQ ID NO: 73653 - DNA, 15 bp, Homo sapiens
ccccgtgggcattac

SEQ ID NO: 73654 - DNA, 15 bp, Homo sapiens
cccgtgggcattact

SEQ ID NO: 73655 - DNA, 15 bp, Homo sapiens
ccgtgggcattactg

SEQ ID NO: 73656 - DNA, 15 bp, Homo sapiens
cgtgggcattactgt

SEQ ID NO: 73657 - DNA, 15 bp, Homo sapiens
gtgggcattactgtt

SEQ ID NO: 73658 - DNA, 15 bp, Homo sapiens
tgggcattactgttt

SEQ ID NO: 73659 - DNA, 15 bp, Homo sapiens
gggcattactgttta

SEQ ID NO: 73660 - DNA, 15 bp, Homo sapiens
ggcattactgtttaa

SEQ ID NO: 73661 - DNA, 15 bp, Homo sapiens
gcattactgtttaag

SEQ ID NO: 73662 - DNA, 15 bp, Homo sapiens
cattactgtttaaga

SEQ ID NO: 73663 - DNA, 15 bp, Homo sapiens
attactgtttaagac

SEQ ID NO: 73664 - DNA, 15 bp, Homo sapiens
ttactgtttaagaca

SEQ ID NO: 73665 - DNA, 15 bp, Homo sapiens
tactgtttaagacac

SEQ ID NO: 73666 - DNA, 15 bp, Homo sapiens
actgtttaagacact

SEQ ID NO: 73667 - DNA, 15 bp, Homo sapiens
ctgtttaagacactt

SEQ ID NO: 73668 - DNA, 15 bp, Homo sapiens
tgtttaagacacttc

SEQ ID NO: 73669 - DNA, 15 bp, Homo sapiens
gtttaagacacttcc

SEQ ID NO: 73670 - DNA, 15 bp, Homo sapiens
tttaagacacttccg

SEQ ID NO: 73671 - DNA, 15 bp, Homo sapiens
ttaagacacttccgt

SEQ ID NO: 73672 - DNA, 15 bp, Homo sapiens
taagacacttccgtc

SEQ ID NO: 73673 - DNA, 15 bp, Homo sapiens
aagacacttccgtca

SEQ ID NO: 73674 - DNA, 15 bp, Homo sapiens
agacacttccgtcac

SEQ ID NO: 73675 - DNA, 15 bp, Homo sapiens
gacacttccgtcaca

SEQ ID NO: 73676 - DNA, 15 bp, Homo sapiens
acacttccgtcacat

SEQ ID NO: 73677 - DNA, 15 bp, Homo sapiens
cacttccgtcacatc

SEQ ID NO: 73678 - DNA, 15 bp, Homo sapiens
acttccgtcacatcc

SEQ ID NO: 73679 - DNA, 15 bp, Homo sapiens
cttccgtcacatccc

SEQ ID NO: 73680 - DNA, 15 bp, Homo sapiens
ttccgtcacatccca

SEQ ID NO: 73681 - DNA, 15 bp, Homo sapiens
tccgtcacatcccac

SEQ ID NO: 73682 - DNA, 15 bp, Homo sapiens
ccgtcacatcccacc

SEQ ID NO: 73683 - DNA, 15 bp, Homo sapiens
cgtcacatcccaccc

SEQ ID NO: 73684 - DNA, 15 bp, Homo sapiens
gtcacatcccacccc

SEQ ID NO: 73685 - DNA, 15 bp, Homo sapiens
tcacatcccacccca

SEQ ID NO: 73686 - DNA, 15 bp, Homo sapiens
cacatcccaccccat

SEQ ID NO: 73687 - DNA, 15 bp, Homo sapiens
acatcccaccccatc

SEQ ID NO: 73688 - DNA, 15 bp, Homo sapiens
catcccaccccatcc

SEQ ID NO: 73689 - DNA, 15 bp, Homo sapiens
atcccaccccatcct

SEQ ID NO: 73690 - DNA, 15 bp, Homo sapiens
tcccaccccatcctc

SEQ ID NO: 73691 - DNA, 15 bp, Homo sapiens
cccaccccatcctcc

SEQ ID NO: 73692 - DNA, 15 bp, Homo sapiens
ccaccccatcctcca

SEQ ID NO: 73693 - DNA, 15 bp, Homo sapiens
caccccatcctccag

SEQ ID NO: 73694 - DNA, 15 bp, Homo sapiens
accccatcctccagg

SEQ ID NO: 73695 - DNA, 15 bp, Homo sapiens
ccccatcctccaggg

SEQ ID NO: 73696 - DNA, 15 bp, Homo sapiens
cccatcctccagggc

SEQ ID NO: 73697 - DNA, 15 bp, Homo sapiens
ccatcctccagggct

SEQ ID NO: 73698 - DNA, 15 bp, Homo sapiens
catcctccagggctc

SEQ ID NO: 73699 - DNA, 15 bp, Homo sapiens
atcctccagggctca

SEQ ID NO: 73700 - DNA, 15 bp, Homo sapiens
tcctccagggctcaa

SEQ ID NO: 73701 - DNA, 15 bp, Homo sapiens
cctccagggctcaac

SEQ ID NO: 73702 - DNA, 15 bp, Homo sapiens
ctccagggctcaaca

SEQ ID NO: 73703 - DNA, 15 bp, Homo sapiens
tccagggctcaacac

SEQ ID NO: 73704 - DNA, 15 bp, Homo sapiens
ccagggctcaacact

SEQ ID NO: 73705 - DNA, 15 bp, Homo sapiens
cagggctcaacactg

SEQ ID NO: 73706 - DNA, 15 bp, Homo sapiens
agggctcaacactgt

SEQ ID NO: 73707 - DNA, 15 bp, Homo sapiens
gggctcaacactgtg

SEQ ID NO: 73708 - DNA, 15 bp, Homo sapiens
ggctcaacactgtga

SEQ ID NO: 73709 - DNA, 15 bp, Homo sapiens
gctcaacactgtgac

SEQ ID NO: 73710 - DNA, 15 bp, Homo sapiens
ctcaacactgtgaca

SEQ ID NO: 73711 - DNA, 15 bp, Homo sapiens
tcaacactgtgacat

SEQ ID NO: 73712 - DNA, 15 bp, Homo sapiens
caacactgtgacatc

SEQ ID NO: 73713 - DNA, 15 bp, Homo sapiens
aacactgtgacatct

SEQ ID NO: 73714 - DNA, 15 bp, Homo sapiens
acactgtgacatctc

SEQ ID NO: 73715 - DNA, 15 bp, Homo sapiens
cactgtgacatctct

SEQ ID NO: 73716 - DNA, 15 bp, Homo sapiens
actgtgacatctcta

SEQ ID NO: 73717 - DNA, 15 bp, Homo sapiens
ctgtgacatctctat

SEQ ID NO: 73718 - DNA, 15 bp, Homo sapiens
tgtgacatctctatt

SEQ ID NO: 73719 - DNA, 15 bp, Homo sapiens
gtgacatctctattc

SEQ ID NO: 73720 - DNA, 15 bp, Homo sapiens
tgacatctctattcc

SEQ ID NO: 73721 - DNA, 15 bp, Homo sapiens
gacatctctattccc

SEQ ID NO: 73722 - DNA, 15 bp, Homo sapiens
acatctctattcccc

SEQ ID NO: 73723 - DNA, 15 bp, Homo sapiens
catctctattcccca

SEQ ID NO: 73724 - DNA, 15 bp, Homo sapiens
atctctattccccac

SEQ ID NO: 73725 - DNA, 15 bp, Homo sapiens
tctctattccccacc

SEQ ID NO: 73726 - DNA, 15 bp, Homo sapiens
ctctattccccaccc

SEQ ID NO: 73727 - DNA, 15 bp, Homo sapiens
tctattccccaccct

SEQ ID NO: 73728 - DNA, 15 bp, Homo sapiens
ctattccccaccctc

SEQ ID NO: 73729 - DNA, 15 bp, Homo sapiens
tattccccaccctcc

SEQ ID NO: 73730 - DNA, 15 bp, Homo sapiens
attccccaccctccc

SEQ ID NO: 73731 - DNA, 15 bp, Homo sapiens
ttccccaccctcccc

SEQ ID NO: 73732 - DNA, 15 bp, Homo sapiens
tccccaccctcccct

SEQ ID NO: 73733 - DNA, 15 bp, Homo sapiens
ccccaccctcccctt

SEQ ID NO: 73734 - DNA, 15 bp, Homo sapiens
cccaccctccccttc

SEQ ID NO: 73735 - DNA, 15 bp, Homo sapiens
ccaccctccccttcc

SEQ ID NO: 73736 - DNA, 15 bp, Homo sapiens
caccctccccttccc

SEQ ID NO: 73737 - DNA, 15 bp, Homo sapiens
accctccccttccca

SEQ ID NO: 73738 - DNA, 15 bp, Homo sapiens
ccctccccttcccag

SEQ ID NO: 73739 - DNA, 15 bp, Homo sapiens
cctccccttcccagg

SEQ ID NO: 73740 - DNA, 15 bp, Homo sapiens
ctccccttcccaggg

SEQ ID NO: 73741 - DNA, 15 bp, Homo sapiens
tccccttcccagggc

SEQ ID NO: 73742 - DNA, 15 bp, Homo sapiens
ccccttcccagggca

SEQ ID NO: 73743 - DNA, 15 bp, Homo sapiens
cccttcccagggcaa

SEQ ID NO: 73744 - DNA, 15 bp, Homo sapiens
ccttcccagggcaat

SEQ ID NO: 73745 - DNA, 15 bp, Homo sapiens
cttcccagggcaata

SEQ ID NO: 73746 - DNA, 15 bp, Homo sapiens
ttcccagggcaataa

SEQ ID NO: 73747 - DNA, 15 bp, Homo sapiens
tcccagggcaataaa

SEQ ID NO: 73748 - DNA, 15 bp, Homo sapiens
cccagggcaataaaa

SEQ ID NO: 73749 - DNA, 15 bp, Homo sapiens
ccagggcaataaaat

SEQ ID NO: 73750 - DNA, 15 bp, Homo sapiens
cagggcaataaaatg

SEQ ID NO: 73751 - DNA, 15 bp, Homo sapiens
agggcaataaaatga

SEQ ID NO: 73752 - DNA, 15 bp, Homo sapiens
gggcaataaaatgac

SEQ ID NO: 73753 - DNA, 15 bp, Homo sapiens
ggcaataaaatgacc

SEQ ID NO: 73754 - DNA, 15 bp, Homo sapiens
gcaataaaatgacca

SEQ ID NO: 73755 - DNA, 15 bp, Homo sapiens
caataaaatgaccat

SEQ ID NO: 73756 - DNA, 15 bp, Homo sapiens
aataaaatgaccatg

SEQ ID NO: 73757 - DNA, 15 bp, Homo sapiens
ataaaatgaccatgg

SEQ ID NO: 73758 - DNA, 15 bp, Homo sapiens
taaaatgaccatgga

SEQ ID NO: 73759 - DNA, 15 bp, Homo sapiens
aaaatgaccatggag

SEQ ID NO: 73760 - DNA, 15 bp, Homo sapiens
aaatgaccatggagg

SEQ ID NO: 73761 - DNA, 15 bp, Homo sapiens
aatgaccatggaggg

SEQ ID NO: 73762 - DNA, 15 bp, Homo sapiens
atgaccatggagggg

SEQ ID NO: 73763 - DNA, 15 bp, Homo sapiens
tgaccatggaggggg

SEQ ID NO: 73764 - DNA, 15 bp, Homo sapiens
gaccatggagggggc

SEQ ID NO: 73765 - DNA, 15 bp, Homo sapiens
accatggagggggct

SEQ ID NO: 73766 - DNA, 15 bp, Homo sapiens
ccatggagggggctt

SEQ ID NO: 73767 - DNA, 15 bp, Homo sapiens
catggagggggcttg

SEQ ID NO: 73768 - DNA, 15 bp, Homo sapiens
atggagggggcttgc

SEQ ID NO: 73769 - DNA, 15 bp, Homo sapiens
tggagggggcttgca

SEQ ID NO: 73770 - DNA, 15 bp, Homo sapiens
ggagggggcttgcac

SEQ ID NO: 73771 - DNA, 15 bp, Homo sapiens
gagggggcttgcact

SEQ ID NO: 73772 - DNA, 15 bp, Homo sapiens
agggggcttgcactc

SEQ ID NO: 73773 - DNA, 15 bp, Homo sapiens
gggggcttgcactct

SEQ ID NO: 73774 - DNA, 15 bp, Homo sapiens
ggggcttgcactctc

SEQ ID NO: 73775 - DNA, 15 bp, Homo sapiens
gggcttgcactctct

SEQ ID NO: 73776 - DNA, 15 bp, Homo sapiens
ggcttgcactctctt

SEQ ID NO: 73777 - DNA, 15 bp, Homo sapiens
gcttgcactctcttg

SEQ ID NO: 73778 - DNA, 15 bp, Homo sapiens
cttgcactctcttgg

SEQ ID NO: 73779 - DNA, 15 bp, Homo sapiens
ttgcactctcttggc

SEQ ID NO: 73780 - DNA, 15 bp, Homo sapiens
tgcactctcttggct

SEQ ID NO: 73781 - DNA, 15 bp, Homo sapiens
gcactctcttggctg

SEQ ID NO: 73782 - DNA, 15 bp, Homo sapiens
cactctcttggctgt

SEQ ID NO: 73783 - DNA, 15 bp, Homo sapiens
actctcttggctgtc

SEQ ID NO: 73784 - DNA, 15 bp, Homo sapiens
ctctcttggctgtca

SEQ ID NO: 73785 - DNA, 15 bp, Homo sapiens
tctcttggctgtcac

SEQ ID NO: 73786 - DNA, 15 bp, Homo sapiens
ctcttggctgtcacc

SEQ ID NO: 73787 - DNA, 15 bp, Homo sapiens
tcttggctgtcaccc

SEQ ID NO: 73788 - DNA, 15 bp, Homo sapiens
cttggctgtcacccg

SEQ ID NO: 73789 - DNA, 15 bp, Homo sapiens
ttggctgtcacccga

SEQ ID NO: 73790 - DNA, 15 bp, Homo sapiens
tggctgtcacccgat

SEQ ID NO: 73791 - DNA, 15 bp, Homo sapiens
ggctgtcacccgatc

SEQ ID NO: 73792 - DNA, 15 bp, Homo sapiens
gctgtcacccgatcg

SEQ ID NO: 73793 - DNA, 15 bp, Homo sapiens
ctgtcacccgatcgc

SEQ ID NO: 73794 - DNA, 15 bp, Homo sapiens
tgtcacccgatcgcc

SEQ ID NO: 73795 - DNA, 15 bp, Homo sapiens
gtcacccgatcgcca

SEQ ID NO: 73796 - DNA, 15 bp, Homo sapiens
tcacccgatcgccag

SEQ ID NO: 73797 - DNA, 15 bp, Homo sapiens
cacccgatcgccagc

SEQ ID NO: 73798 - DNA, 15 bp, Homo sapiens
acccgatcgccagca

SEQ ID NO: 73799 - DNA, 15 bp, Homo sapiens
cccgatcgccagcaa

SEQ ID NO: 73800 - DNA, 15 bp, Homo sapiens
ccgatcgccagcaaa

SEQ ID NO: 73801 - DNA, 15 bp, Homo sapiens
cgatcgccagcaaaa

SEQ ID NO: 73802 - DNA, 15 bp, Homo sapiens
gatcgccagcaaaac

SEQ ID NO: 73803 - DNA, 15 bp, Homo sapiens
atcgccagcaaaact

SEQ ID NO: 73804 - DNA, 15 bp, Homo sapiens
tcgccagcaaaactt

SEQ ID NO: 73805 - DNA, 15 bp, Homo sapiens
cgccagcaaaactta

SEQ ID NO: 73806 - DNA, 15 bp, Homo sapiens
gccagcaaaacttag

SEQ ID NO: 73807 - DNA, 15 bp, Homo sapiens
ccagcaaaacttaga

SEQ ID NO: 73808 - DNA, 15 bp, Homo sapiens
cagcaaaacttagat

SEQ ID NO: 73809 - DNA, 15 bp, Homo sapiens
agcaaaacttagatg

SEQ ID NO: 73810 - DNA, 15 bp, Homo sapiens
gcaaaacttagatgt

SEQ ID NO: 73811 - DNA, 15 bp, Homo sapiens
caaaacttagatgtg

SEQ ID NO: 73812 - DNA, 15 bp, Homo sapiens
aaaacttagatgtga

SEQ ID NO: 73813 - DNA, 15 bp, Homo sapiens
aaacttagatgtgag

SEQ ID NO: 73814 - DNA, 15 bp, Homo sapiens
aacttagatgtgaga

SEQ ID NO: 73815 - DNA, 15 bp, Homo sapiens
acttagatgtgagaa

SEQ ID NO: 73816 - DNA, 15 bp, Homo sapiens
cttagatgtgagaaa

SEQ ID NO: 73817 - DNA, 15 bp, Homo sapiens
ttagatgtgagaaaa

SEQ ID NO: 73818 - DNA, 15 bp, Homo sapiens
tagatgtgagaaaac

SEQ ID NO: 73819 - DNA, 15 bp, Homo sapiens
agatgtgagaaaacc

SEQ ID NO: 73820 - DNA, 15 bp, Homo sapiens
gatgtgagaaaaccc

SEQ ID NO: 73821 - DNA, 15 bp, Homo sapiens
atgtgagaaaacccc

SEQ ID NO: 73822 - DNA, 15 bp, Homo sapiens
tgtgagaaaacccct

SEQ ID NO: 73823 - DNA, 15 bp, Homo sapiens
gtgagaaaacccctt

SEQ ID NO: 73824 - DNA, 15 bp, Homo sapiens
tgagaaaaccccttc

SEQ ID NO: 73825 - DNA, 15 bp, Homo sapiens
gagaaaaccccttcc

SEQ ID NO: 73826 - DNA, 15 bp, Homo sapiens
agaaaaccccttccc

SEQ ID NO: 73827 - DNA, 15 bp, Homo sapiens
gaaaaccccttccca

SEQ ID NO: 73828 - DNA, 15 bp, Homo sapiens
aaaaccccttcccat

SEQ ID NO: 73829 - DNA, 15 bp, Homo sapiens
aaaccccttcccatt

SEQ ID NO: 73830 - DNA, 15 bp, Homo sapiens
aaccccttcccattc

SEQ ID NO: 73831 - DNA, 15 bp, Homo sapiens
accccttcccattcc

SEQ ID NO: 73832 - DNA, 15 bp, Homo sapiens
ccccttcccattcca

SEQ ID NO: 73833 - DNA, 15 bp, Homo sapiens
cccttcccattccat

SEQ ID NO: 73834 - DNA, 15 bp, Homo sapiens
ccttcccattccatg

SEQ ID NO: 73835 - DNA, 15 bp, Homo sapiens
cttcccattccatgg

SEQ ID NO: 73836 - DNA, 15 bp, Homo sapiens
ttcccattccatggc

SEQ ID NO: 73837 - DNA, 15 bp, Homo sapiens
tcccattccatggcg

SEQ ID NO: 73838 - DNA, 15 bp, Homo sapiens
cccattccatggcga

SEQ ID NO: 73839 - DNA, 15 bp, Homo sapiens
ccattccatggcgaa

SEQ ID NO: 73840 - DNA, 15 bp, Homo sapiens
cattccatggcgaaa

SEQ ID NO: 73841 - DNA, 15 bp, Homo sapiens
attccatggcgaaaa

SEQ ID NO: 73842 - DNA, 15 bp, Homo sapiens
ttccatggcgaaaac

SEQ ID NO: 73843 - DNA, 15 bp, Homo sapiens
tccatggcgaaaaca

SEQ ID NO: 73844 - DNA, 15 bp, Homo sapiens
ccatggcgaaaacat

SEQ ID NO: 73845 - DNA, 15 bp, Homo sapiens
catggcgaaaacatc

SEQ ID NO: 73846 - DNA, 15 bp, Homo sapiens
atggcgaaaacatct

SEQ ID NO: 73847 - DNA, 15 bp, Homo sapiens
tggcgaaaacatctc

SEQ ID NO: 73848 - DNA, 15 bp, Homo sapiens
ggcgaaaacatctcc

SEQ ID NO: 73849 - DNA, 15 bp, Homo sapiens
gcgaaaacatctcct

SEQ ID NO: 73850 - DNA, 15 bp, Homo sapiens
cgaaaacatctcctt

SEQ ID NO: 73851 - DNA, 15 bp, Homo sapiens
gaaaacatctcctta

SEQ ID NO: 73852 - DNA, 15 bp, Homo sapiens
aaaacatctccttag

SEQ ID NO: 73853 - DNA, 15 bp, Homo sapiens
aaacatctccttaga

SEQ ID NO: 73854 - DNA, 15 bp, Homo sapiens
aacatctccttagaa

SEQ ID NO: 73855 - DNA, 15 bp, Homo sapiens
acatctccttagaaa

SEQ ID NO: 73856 - DNA, 15 bp, Homo sapiens
catctccttagaaaa

SEQ ID NO: 73857 - DNA, 15 bp, Homo sapiens
atctccttagaaaag

SEQ ID NO: 73858 - DNA, 15 bp, Homo sapiens
tctccttagaaaagc

SEQ ID NO: 73859 - DNA, 15 bp, Homo sapiens
ctccttagaaaagcc

SEQ ID NO: 73860 - DNA, 15 bp, Homo sapiens
tccttagaaaagcca

SEQ ID NO: 73861 - DNA, 15 bp, Homo sapiens
ccttagaaaagccat

SEQ ID NO: 73862 - DNA, 15 bp, Homo sapiens
cttagaaaagccatt

SEQ ID NO: 73863 - DNA, 15 bp, Homo sapiens
ttagaaaagccatta

SEQ ID NO: 73864 - DNA, 15 bp, Homo sapiens
tagaaaagccattac

SEQ ID NO: 73865 - DNA, 15 bp, Homo sapiens
agaaaagccattacc

SEQ ID NO: 73866 - DNA, 15 bp, Homo sapiens
gaaaagccattaccc

SEQ ID NO: 73867 - DNA, 15 bp, Homo sapiens
aaaagccattaccct

SEQ ID NO: 73868 - DNA, 15 bp, Homo sapiens
aaagccattaccctc

SEQ ID NO: 73869 - DNA, 15 bp, Homo sapiens
aagccattaccctca

SEQ ID NO: 73870 - DNA, 15 bp, Homo sapiens
agccattaccctcat

SEQ ID NO: 73871 - DNA, 15 bp, Homo sapiens
gccattaccctcatt

SEQ ID NO: 73872 - DNA, 15 bp, Homo sapiens
ccattaccctcatta

SEQ ID NO: 73873 - DNA, 15 bp, Homo sapiens
cattaccctcattag

SEQ ID NO: 73874 - DNA, 15 bp, Homo sapiens
attaccctcattagg

SEQ ID NO: 73875 - DNA, 15 bp, Homo sapiens
ttaccctcattaggc

SEQ ID NO: 73876 - DNA, 15 bp, Homo sapiens
taccctcattaggca

SEQ ID NO: 73877 - DNA, 15 bp, Homo sapiens
accctcattaggcat

SEQ ID NO: 73878 - DNA, 15 bp, Homo sapiens
ccctcattaggcatg

SEQ ID NO: 73879 - DNA, 15 bp, Homo sapiens
cctcattaggcatgg

SEQ ID NO: 73880 - DNA, 15 bp, Homo sapiens
ctcattaggcatggt

SEQ ID NO: 73881 - DNA, 15 bp, Homo sapiens
tcattaggcatggtt

SEQ ID NO: 73882 - DNA, 15 bp, Homo sapiens
cattaggcatggttt

SEQ ID NO: 73883 - DNA, 15 bp, Homo sapiens
attaggcatggtttt

SEQ ID NO: 73884 - DNA, 15 bp, Homo sapiens
ttaggcatggttttg

SEQ ID NO: 73885 - DNA, 15 bp, Homo sapiens
taggcatggttttgg

SEQ ID NO: 73886 - DNA, 15 bp, Homo sapiens
aggcatggttttggg

SEQ ID NO: 73887 - DNA, 15 bp, Homo sapiens
ggcatggttttgggc

SEQ ID NO: 73888 - DNA, 15 bp, Homo sapiens
gcatggttttgggct

SEQ ID NO: 73889 - DNA, 15 bp, Homo sapiens
catggttttgggctc

SEQ ID NO: 73890 - DNA, 15 bp, Homo sapiens
atggttttgggctcc

SEQ ID NO: 73891 - DNA, 15 bp, Homo sapiens
tggttttgggctccc

SEQ ID NO: 73892 - DNA, 15 bp, Homo sapiens
ggttttgggctccca

SEQ ID NO: 73893 - DNA, 15 bp, Homo sapiens
gttttgggctcccaa

SEQ ID NO: 73894 - DNA, 15 bp, Homo sapiens
ttttgggctcccaaa

SEQ ID NO: 73895 - DNA, 15 bp, Homo sapiens
tttgggctcccaaaa

SEQ ID NO: 73896 - DNA, 15 bp, Homo sapiens
ttgggctcccaaaac

SEQ ID NO: 73897 - DNA, 15 bp, Homo sapiens
tgggctcccaaaaca

SEQ ID NO: 73898 - DNA, 15 bp, Homo sapiens
gggctcccaaaacac

SEQ ID NO: 73899 - DNA, 15 bp, Homo sapiens
ggctcccaaaacacc

SEQ ID NO: 73900 - DNA, 15 bp, Homo sapiens
gctcccaaaacacct

SEQ ID NO: 73901 - DNA, 15 bp, Homo sapiens
ctcccaaaacacctg

SEQ ID NO: 73902 - DNA, 15 bp, Homo sapiens
tcccaaaacacctga

SEQ ID NO: 73903 - DNA, 15 bp, Homo sapiens
cccaaaacacctgac

SEQ ID NO: 73904 - DNA, 15 bp, Homo sapiens
ccaaaacacctgaca

SEQ ID NO: 73905 - DNA, 15 bp, Homo sapiens
caaaacacctgacag

SEQ ID NO: 73906 - DNA, 15 bp, Homo sapiens
aaaacacctgacagc

SEQ ID NO: 73907 - DNA, 15 bp, Homo sapiens
aaacacctgacagcc

SEQ ID NO: 73908 - DNA, 15 bp, Homo sapiens
aacacctgacagccc

SEQ ID NO: 73909 - DNA, 15 bp, Homo sapiens
acacctgacagcccc

SEQ ID NO: 73910 - DNA, 15 bp, Homo sapiens
cacctgacagcccct

SEQ ID NO: 73911 - DNA, 15 bp, Homo sapiens
acctgacagcccctc

SEQ ID NO: 73912 - DNA, 15 bp, Homo sapiens
cctgacagcccctcc

SEQ ID NO: 73913 - DNA, 15 bp, Homo sapiens
ctgacagcccctccc

SEQ ID NO: 73914 - DNA, 15 bp, Homo sapiens
tgacagcccctccct

SEQ ID NO: 73915 - DNA, 15 bp, Homo sapiens
gacagcccctccctc

SEQ ID NO: 73916 - DNA, 15 bp, Homo sapiens
acagcccctccctcc

SEQ ID NO: 73917 - DNA, 15 bp, Homo sapiens
cagcccctccctcct

SEQ ID NO: 73918 - DNA, 15 bp, Homo sapiens
agcccctccctcctc

SEQ ID NO: 73919 - DNA, 15 bp, Homo sapiens
gcccctccctcctct

SEQ ID NO: 73920 - DNA, 15 bp, Homo sapiens
cccctccctcctctg

SEQ ID NO: 73921 - DNA, 15 bp, Homo sapiens
ccctccctcctctga

SEQ ID NO: 73922 - DNA, 15 bp, Homo sapiens
cctccctcctctgag

SEQ ID NO: 73923 - DNA, 15 bp, Homo sapiens
ctccctcctctgaga

SEQ ID NO: 73924 - DNA, 15 bp, Homo sapiens
tccctcctctgagag

SEQ ID NO: 73925 - DNA, 15 bp, Homo sapiens
ccctcctctgagagg

SEQ ID NO: 73926 - DNA, 15 bp, Homo sapiens
cctcctctgagaggc

SEQ ID NO: 73927 - DNA, 15 bp, Homo sapiens
ctcctctgagaggcg

SEQ ID NO: 73928 - DNA, 15 bp, Homo sapiens
tcctctgagaggcgg

SEQ ID NO: 73929 - DNA, 15 bp, Homo sapiens
cctctgagaggcgga

SEQ ID NO: 73930 - DNA, 15 bp, Homo sapiens
ctctgagaggcggag

SEQ ID NO: 73931 - DNA, 15 bp, Homo sapiens
tctgagaggcggaga

SEQ ID NO: 73932 - DNA, 15 bp, Homo sapiens
ctgagaggcggagag

SEQ ID NO: 73933 - DNA, 15 bp, Homo sapiens
tgagaggcggagagt

SEQ ID NO: 73934 - DNA, 15 bp, Homo sapiens
gagaggcggagagtg

SEQ ID NO: 73935 - DNA, 15 bp, Homo sapiens
agaggcggagagtgc

SEQ ID NO: 73936 - DNA, 15 bp, Homo sapiens
gaggcggagagtgct

SEQ ID NO: 73937 - DNA, 15 bp, Homo sapiens
aggcggagagtgctg

SEQ ID NO: 73938 - DNA, 15 bp, Homo sapiens
ggcggagagtgctga

SEQ ID NO: 73939 - DNA, 15 bp, Homo sapiens
gcggagagtgctgac

SEQ ID NO: 73940 - DNA, 15 bp, Homo sapiens
cggagagtgctgact

SEQ ID NO: 73941 - DNA, 15 bp, Homo sapiens
ggagagtgctgactg

SEQ ID NO: 73942 - DNA, 15 bp, Homo sapiens
gagagtgctgactgt

SEQ ID NO: 73943 - DNA, 15 bp, Homo sapiens
agagtgctgactgta

SEQ ID NO: 73944 - DNA, 15 bp, Homo sapiens
gagtgctgactgtag

SEQ ID NO: 73945 - DNA, 15 bp, Homo sapiens
agtgctgactgtagt

SEQ ID NO: 73946 - DNA, 15 bp, Homo sapiens
gtgctgactgtagtg

SEQ ID NO: 73947 - DNA, 15 bp, Homo sapiens
tgctgactgtagtga

SEQ ID NO: 73948 - DNA, 15 bp, Homo sapiens
gctgactgtagtgac

SEQ ID NO: 73949 - DNA, 15 bp, Homo sapiens
ctgactgtagtgacc

SEQ ID NO: 73950 - DNA, 15 bp, Homo sapiens
tgactgtagtgacca

SEQ ID NO: 73951 - DNA, 15 bp, Homo sapiens
gactgtagtgaccat

SEQ ID NO: 73952 - DNA, 15 bp, Homo sapiens
actgtagtgaccatt

SEQ ID NO: 73953 - DNA, 15 bp, Homo sapiens
ctgtagtgaccattg

SEQ ID NO: 73954 - DNA, 15 bp, Homo sapiens
tgtagtgaccattgc

SEQ ID NO: 73955 - DNA, 15 bp, Homo sapiens
gtagtgaccattgca

SEQ ID NO: 73956 - DNA, 15 bp, Homo sapiens
tagtgaccattgcat

SEQ ID NO: 73957 - DNA, 15 bp, Homo sapiens
agtgaccattgcatg

SEQ ID NO: 73958 - DNA, 15 bp, Homo sapiens
gtgaccattgcatgc

SEQ ID NO: 73959 - DNA, 15 bp, Homo sapiens
tgaccattgcatgcc

SEQ ID NO: 73960 - DNA, 15 bp, Homo sapiens
gaccattgcatgccg

SEQ ID NO: 73961 - DNA, 15 bp, Homo sapiens
accattgcatgccgg

SEQ ID NO: 73962 - DNA, 15 bp, Homo sapiens
ccattgcatgccggg

SEQ ID NO: 73963 - DNA, 15 bp, Homo sapiens
cattgcatgccgggt

SEQ ID NO: 73964 - DNA, 15 bp, Homo sapiens
attgcatgccgggtg

SEQ ID NO: 73965 - DNA, 15 bp, Homo sapiens
ttgcatgccgggtgc

SEQ ID NO: 73966 - DNA, 15 bp, Homo sapiens
tgcatgccgggtgca

SEQ ID NO: 73967 - DNA, 15 bp, Homo sapiens
gcatgccgggtgcag

SEQ ID NO: 73968 - DNA, 15 bp, Homo sapiens
catgccgggtgcagc

SEQ ID NO: 73969 - DNA, 15 bp, Homo sapiens
atgccgggtgcagca

SEQ ID NO: 73970 - DNA, 15 bp, Homo sapiens
tgccgggtgcagcat

SEQ ID NO: 73971 - DNA, 15 bp, Homo sapiens
gccgggtgcagcatc

SEQ ID NO: 73972 - DNA, 15 bp, Homo sapiens
ccgggtgcagcatct

SEQ ID NO: 73973 - DNA, 15 bp, Homo sapiens
cgggtgcagcatctg

SEQ ID NO: 73974 - DNA, 15 bp, Homo sapiens
gggtgcagcatctgg

SEQ ID NO: 73975 - DNA, 15 bp, Homo sapiens
ggtgcagcatctgga

SEQ ID NO: 73976 - DNA, 15 bp, Homo sapiens
gtgcagcatctggaa

SEQ ID NO: 73977 - DNA, 15 bp, Homo sapiens
tgcagcatctggaag

SEQ ID NO: 73978 - DNA, 15 bp, Homo sapiens
gcagcatctggaaga

SEQ ID NO: 73979 - DNA, 15 bp, Homo sapiens
cagcatctggaagag

SEQ ID NO: 73980 - DNA, 15 bp, Homo sapiens
agcatctggaagagc

SEQ ID NO: 73981 - DNA, 15 bp, Homo sapiens
gcatctggaagagct

SEQ ID NO: 73982 - DNA, 15 bp, Homo sapiens
catctggaagagcta

SEQ ID NO: 73983 - DNA, 15 bp, Homo sapiens
atctggaagagctag

SEQ ID NO: 73984 - DNA, 15 bp, Homo sapiens
tctggaagagctagg

SEQ ID NO: 73985 - DNA, 15 bp, Homo sapiens
ctggaagagctaggc

SEQ ID NO: 73986 - DNA, 15 bp, Homo sapiens
tggaagagctaggca

SEQ ID NO: 73987 - DNA, 15 bp, Homo sapiens
ggaagagctaggcag

SEQ ID NO: 73988 - DNA, 15 bp, Homo sapiens
gaagagctaggcagg

SEQ ID NO: 73989 - DNA, 15 bp, Homo sapiens
aagagctaggcaggg

SEQ ID NO: 73990 - DNA, 15 bp, Homo sapiens
agagctaggcagggt

SEQ ID NO: 73991 - DNA, 15 bp, Homo sapiens
gagctaggcagggtg

SEQ ID NO: 73992 - DNA, 15 bp, Homo sapiens
agctaggcagggtgt

SEQ ID NO: 73993 - DNA, 15 bp, Homo sapiens
gctaggcagggtgtc

SEQ ID NO: 73994 - DNA, 15 bp, Homo sapiens
ctaggcagggtgtct

SEQ ID NO: 73995 - DNA, 15 bp, Homo sapiens
taggcagggtgtctg

SEQ ID NO: 73996 - DNA, 15 bp, Homo sapiens
aggcagggtgtctgc

SEQ ID NO: 73997 - DNA, 15 bp, Homo sapiens
ggcagggtgtctgcc

SEQ ID NO: 73998 - DNA, 15 bp, Homo sapiens
gcagggtgtctgccc

SEQ ID NO: 73999 - DNA, 15 bp, Homo sapiens
cagggtgtctgcccc

SEQ ID NO: 74000 - DNA, 15 bp, Homo sapiens
agggtgtctgccccc

SEQ ID NO: 74001 - DNA, 15 bp, Homo sapiens
gggtgtctgccccct

SEQ ID NO: 74002 - DNA, 15 bp, Homo sapiens
ggtgtctgccccctc

SEQ ID NO: 74003 - DNA, 15 bp, Homo sapiens
gtgtctgccccctcc

SEQ ID NO: 74004 - DNA, 15 bp, Homo sapiens
tgtctgccccctcct

SEQ ID NO: 74005 - DNA, 15 bp, Homo sapiens
gtctgccccctcctg

SEQ ID NO: 74006 - DNA, 15 bp, Homo sapiens
tctgccccctcctga

SEQ ID NO: 74007 - DNA, 15 bp, Homo sapiens
ctgccccctcctgag

SEQ ID NO: 74008 - DNA, 15 bp, Homo sapiens
tgccccctcctgagt

SEQ ID NO: 74009 - DNA, 15 bp, Homo sapiens
gccccctcctgagtt

SEQ ID NO: 74010 - DNA, 15 bp, Homo sapiens
ccccctcctgagttg

SEQ ID NO: 74011 - DNA, 15 bp, Homo sapiens
cccctcctgagttga

SEQ ID NO: 74012 - DNA, 15 bp, Homo sapiens
ccctcctgagttgaa

SEQ ID NO: 74013 - DNA, 15 bp, Homo sapiens
cctcctgagttgaag

SEQ ID NO: 74014 - DNA, 15 bp, Homo sapiens
ctcctgagttgaagt

SEQ ID NO: 74015 - DNA, 15 bp, Homo sapiens
tcctgagttgaagtc

SEQ ID NO: 74016 - DNA, 15 bp, Homo sapiens
cctgagttgaagtca

SEQ ID NO: 74017 - DNA, 15 bp, Homo sapiens
ctgagttgaagtcat

SEQ ID NO: 74018 - DNA, 15 bp, Homo sapiens
tgagttgaagtcatg

SEQ ID NO: 74019 - DNA, 15 bp, Homo sapiens
gagttgaagtcatgc

SEQ ID NO: 74020 - DNA, 15 bp, Homo sapiens
agttgaagtcatgct

SEQ ID NO: 74021 - DNA, 15 bp, Homo sapiens
gttgaagtcatgctc

SEQ ID NO: 74022 - DNA, 15 bp, Homo sapiens
ttgaagtcatgctcc

SEQ ID NO: 74023 - DNA, 15 bp, Homo sapiens
tgaagtcatgctccc

SEQ ID NO: 74024 - DNA, 15 bp, Homo sapiens
gaagtcatgctcccc

SEQ ID NO: 74025 - DNA, 15 bp, Homo sapiens
aagtcatgctcccct

SEQ ID NO: 74026 - DNA, 15 bp, Homo sapiens
agtcatgctcccctg

SEQ ID NO: 74027 - DNA, 15 bp, Homo sapiens
gtcatgctcccctgt

SEQ ID NO: 74028 - DNA, 15 bp, Homo sapiens
tcatgctcccctgtg

SEQ ID NO: 74029 - DNA, 15 bp, Homo sapiens
catgctcccctgtgc

SEQ ID NO: 74030 - DNA, 15 bp, Homo sapiens
atgctcccctgtgcc

SEQ ID NO: 74031 - DNA, 15 bp, Homo sapiens
tgctcccctgtgcca

SEQ ID NO: 74032 - DNA, 15 bp, Homo sapiens
gctcccctgtgccag

SEQ ID NO: 74033 - DNA, 15 bp, Homo sapiens
ctcccctgtgccagc

SEQ ID NO: 74034 - DNA, 15 bp, Homo sapiens
tcccctgtgccagcc

SEQ ID NO: 74035 - DNA, 15 bp, Homo sapiens
cccctgtgccagccc

SEQ ID NO: 74036 - DNA, 15 bp, Homo sapiens
ccctgtgccagccca

SEQ ID NO: 74037 - DNA, 15 bp, Homo sapiens
cctgtgccagcccag

SEQ ID NO: 74038 - DNA, 15 bp, Homo sapiens
ctgtgccagcccaga

SEQ ID NO: 74039 - DNA, 15 bp, Homo sapiens
tgtgccagcccagag

SEQ ID NO: 74040 - DNA, 15 bp, Homo sapiens
gtgccagcccagagg

SEQ ID NO: 74041 - DNA, 15 bp, Homo sapiens
tgccagcccagaggc

SEQ ID NO: 74042 - DNA, 15 bp, Homo sapiens
gccagcccagaggcc

SEQ ID NO: 74043 - DNA, 15 bp, Homo sapiens
ccagcccagaggccg

SEQ ID NO: 74044 - DNA, 15 bp, Homo sapiens
cagcccagaggccga

SEQ ID NO: 74045 - DNA, 15 bp, Homo sapiens
agcccagaggccgag

SEQ ID NO: 74046 - DNA, 15 bp, Homo sapiens
gcccagaggccgaga

SEQ ID NO: 74047 - DNA, 15 bp, Homo sapiens
cccagaggccgagag

SEQ ID NO: 74048 - DNA, 15 bp, Homo sapiens
ccagaggccgagagc

SEQ ID NO: 74049 - DNA, 15 bp, Homo sapiens
cagaggccgagagct

SEQ ID NO: 74050 - DNA, 15 bp, Homo sapiens
agaggccgagagcta

SEQ ID NO: 74051 - DNA, 15 bp, Homo sapiens
gaggccgagagctat

SEQ ID NO: 74052 - DNA, 15 bp, Homo sapiens
aggccgagagctatg

SEQ ID NO: 74053 - DNA, 15 bp, Homo sapiens
ggccgagagctatgg

SEQ ID NO: 74054 - DNA, 15 bp, Homo sapiens
gccgagagctatgga

SEQ ID NO: 74055 - DNA, 15 bp, Homo sapiens
ccgagagctatggac

SEQ ID NO: 74056 - DNA, 15 bp, Homo sapiens
cgagagctatggaca

SEQ ID NO: 74057 - DNA, 15 bp, Homo sapiens
gagagctatggacag

SEQ ID NO: 74058 - DNA, 15 bp, Homo sapiens
agagctatggacagc

SEQ ID NO: 74059 - DNA, 15 bp, Homo sapiens
gagctatggacagca

SEQ ID NO: 74060 - DNA, 15 bp, Homo sapiens
agctatggacagcat

SEQ ID NO: 74061 - DNA, 15 bp, Homo sapiens
gctatggacagcatt

SEQ ID NO: 74062 - DNA, 15 bp, Homo sapiens
ctatggacagcattg

SEQ ID NO: 74063 - DNA, 15 bp, Homo sapiens
tatggacagcattgc

SEQ ID NO: 74064 - DNA, 15 bp, Homo sapiens
atggacagcattgcc

SEQ ID NO: 74065 - DNA, 15 bp, Homo sapiens
tggacagcattgcca

SEQ ID NO: 74066 - DNA, 15 bp, Homo sapiens
ggacagcattgccag

SEQ ID NO: 74067 - DNA, 15 bp, Homo sapiens
gacagcattgccagt

SEQ ID NO: 74068 - DNA, 15 bp, Homo sapiens
acagcattgccagta

SEQ ID NO: 74069 - DNA, 15 bp, Homo sapiens
cagcattgccagtaa

SEQ ID NO: 74070 - DNA, 15 bp, Homo sapiens
agcattgccagtaac

SEQ ID NO: 74071 - DNA, 15 bp, Homo sapiens
gcattgccagtaaca

SEQ ID NO: 74072 - DNA, 15 bp, Homo sapiens
cattgccagtaacac

SEQ ID NO: 74073 - DNA, 15 bp, Homo sapiens
attgccagtaacaca

SEQ ID NO: 74074 - DNA, 15 bp, Homo sapiens
ttgccagtaacacag

SEQ ID NO: 74075 - DNA, 15 bp, Homo sapiens
tgccagtaacacagg

SEQ ID NO: 74076 - DNA, 15 bp, Homo sapiens
gccagtaacacaggc

SEQ ID NO: 74077 - DNA, 15 bp, Homo sapiens
ccagtaacacaggcc

SEQ ID NO: 74078 - DNA, 15 bp, Homo sapiens
cagtaacacaggcca

SEQ ID NO: 74079 - DNA, 15 bp, Homo sapiens
agtaacacaggccac

SEQ ID NO: 74080 - DNA, 15 bp, Homo sapiens
gtaacacaggccacc

SEQ ID NO: 74081 - DNA, 15 bp, Homo sapiens
taacacaggccaccc

SEQ ID NO: 74082 - DNA, 15 bp, Homo sapiens
aacacaggccaccct

SEQ ID NO: 74083 - DNA, 15 bp, Homo sapiens
acacaggccaccctg

SEQ ID NO: 74084 - DNA, 15 bp, Homo sapiens
cacaggccaccctgt

SEQ ID NO: 74085 - DNA, 15 bp, Homo sapiens
acaggccaccctgtg

SEQ ID NO: 74086 - DNA, 15 bp, Homo sapiens
caggccaccctgtgc

SEQ ID NO: 74087 - DNA, 15 bp, Homo sapiens
aggccaccctgtgca

SEQ ID NO: 74088 - DNA, 15 bp, Homo sapiens
ggccaccctgtgcag

SEQ ID NO: 74089 - DNA, 15 bp, Homo sapiens
gccaccctgtgcaga

SEQ ID NO: 74090 - DNA, 15 bp, Homo sapiens
ccaccctgtgcagaa

SEQ ID NO: 74091 - DNA, 15 bp, Homo sapiens
caccctgtgcagaag

SEQ ID NO: 74092 - DNA, 15 bp, Homo sapiens
accctgtgcagaagg

SEQ ID NO: 74093 - DNA, 15 bp, Homo sapiens
ccctgtgcagaaggg

SEQ ID NO: 74094 - DNA, 15 bp, Homo sapiens
cctgtgcagaaggga

SEQ ID NO: 74095 - DNA, 15 bp, Homo sapiens
ctgtgcagaagggag

SEQ ID NO: 74096 - DNA, 15 bp, Homo sapiens
tgtgcagaagggagc

SEQ ID NO: 74097 - DNA, 15 bp, Homo sapiens
gtgcagaagggagct

SEQ ID NO: 74098 - DNA, 15 bp, Homo sapiens
tgcagaagggagctg

SEQ ID NO: 74099 - DNA, 15 bp, Homo sapiens
gcagaagggagctgg

SEQ ID NO: 74100 - DNA, 15 bp, Homo sapiens
cagaagggagctggc

SEQ ID NO: 74101 - DNA, 15 bp, Homo sapiens
agaagggagctggct

SEQ ID NO: 74102 - DNA, 15 bp, Homo sapiens
gaagggagctggctc

SEQ ID NO: 74103 - DNA, 15 bp, Homo sapiens
aagggagctggctcc

SEQ ID NO: 74104 - DNA, 15 bp, Homo sapiens
agggagctggctcca

SEQ ID NO: 74105 - DNA, 15 bp, Homo sapiens
gggagctggctccag

SEQ ID NO: 74106 - DNA, 15 bp, Homo sapiens
ggagctggctccagc

SEQ ID NO: 74107 - DNA, 15 bp, Homo sapiens
gagctggctccagcc

SEQ ID NO: 74108 - DNA, 15 bp, Homo sapiens
agctggctccagcct

SEQ ID NO: 74109 - DNA, 15 bp, Homo sapiens
gctggctccagcctg

SEQ ID NO: 74110 - DNA, 15 bp, Homo sapiens
ctggctccagcctgg

SEQ ID NO: 74111 - DNA, 15 bp, Homo sapiens
tggctccagcctgga

SEQ ID NO: 74112 - DNA, 15 bp, Homo sapiens
ggctccagcctggaa

SEQ ID NO: 74113 - DNA, 15 bp, Homo sapiens
gctccagcctggaaa

SEQ ID NO: 74114 - DNA, 15 bp, Homo sapiens
ctccagcctggaaac

SEQ ID NO: 74115 - DNA, 15 bp, Homo sapiens
tccagcctggaaacc

SEQ ID NO: 74116 - DNA, 15 bp, Homo sapiens
ccagcctggaaacct

SEQ ID NO: 74117 - DNA, 15 bp, Homo sapiens
cagcctggaaacctg

SEQ ID NO: 74118 - DNA, 15 bp, Homo sapiens
agcctggaaacctgt

SEQ ID NO: 74119 - DNA, 15 bp, Homo sapiens
gcctggaaacctgtc

SEQ ID NO: 74120 - DNA, 15 bp, Homo sapiens
cctggaaacctgtct

SEQ ID NO: 74121 - DNA, 15 bp, Homo sapiens
ctggaaacctgtctg

SEQ ID NO: 74122 - DNA, 15 bp, Homo sapiens
tggaaacctgtctga

SEQ ID NO: 74123 - DNA, 15 bp, Homo sapiens
ggaaacctgtctgag

SEQ ID NO: 74124 - DNA, 15 bp, Homo sapiens
gaaacctgtctgagg

SEQ ID NO: 74125 - DNA, 15 bp, Homo sapiens
aaacctgtctgaggt

SEQ ID NO: 74126 - DNA, 15 bp, Homo sapiens
aacctgtctgaggtt

SEQ ID NO: 74127 - DNA, 15 bp, Homo sapiens
acctgtctgaggttg

SEQ ID NO: 74128 - DNA, 15 bp, Homo sapiens
cctgtctgaggttgg

SEQ ID NO: 74129 - DNA, 15 bp, Homo sapiens
ctgtctgaggttggg

SEQ ID NO: 74130 - DNA, 15 bp, Homo sapiens
tgtctgaggttggga

SEQ ID NO: 74131 - DNA, 15 bp, Homo sapiens
gtctgaggttgggag

SEQ ID NO: 74132 - DNA, 15 bp, Homo sapiens
tctgaggttgggaga

SEQ ID NO: 74133 - DNA, 15 bp, Homo sapiens
ctgaggttgggagag

SEQ ID NO: 74134 - DNA, 15 bp, Homo sapiens
tgaggttgggagagg

SEQ ID NO: 74135 - DNA, 15 bp, Homo sapiens
gaggttgggagaggt

SEQ ID NO: 74136 - DNA, 15 bp, Homo sapiens
aggttgggagaggtg

SEQ ID NO: 74137 - DNA, 15 bp, Homo sapiens
ggttgggagaggtgc

SEQ ID NO: 74138 - DNA, 15 bp, Homo sapiens
gttgggagaggtgca

SEQ ID NO: 74139 - DNA, 15 bp, Homo sapiens
ttgggagaggtgcac

SEQ ID NO: 74140 - DNA, 15 bp, Homo sapiens
tgggagaggtgcact

SEQ ID NO: 74141 - DNA, 15 bp, Homo sapiens
gggagaggtgcactt

SEQ ID NO: 74142 - DNA, 15 bp, Homo sapiens
ggagaggtgcacttg

SEQ ID NO: 74143 - DNA, 15 bp, Homo sapiens
gagaggtgcacttgg

SEQ ID NO: 74144 - DNA, 15 bp, Homo sapiens
agaggtgcacttggg

SEQ ID NO: 74145 - DNA, 15 bp, Homo sapiens
gaggtgcacttgggg

SEQ ID NO: 74146 - DNA, 15 bp, Homo sapiens
aggtgcacttggggc

SEQ ID NO: 74147 - DNA, 15 bp, Homo sapiens
ggtgcacttggggca

SEQ ID NO: 74148 - DNA, 15 bp, Homo sapiens
gtgcacttggggcac

SEQ ID NO: 74149 - DNA, 15 bp, Homo sapiens
tgcacttggggcaca

SEQ ID NO: 74150 - DNA, 15 bp, Homo sapiens
gcacttggggcacag

SEQ ID NO: 74151 - DNA, 15 bp, Homo sapiens
cacttggggcacagg

SEQ ID NO: 74152 - DNA, 15 bp, Homo sapiens
acttggggcacaggg

SEQ ID NO: 74153 - DNA, 15 bp, Homo sapiens
cttggggcacaggga

SEQ ID NO: 74154 - DNA, 15 bp, Homo sapiens
ttggggcacagggag

SEQ ID NO: 74155 - DNA, 15 bp, Homo sapiens
tggggcacagggaga

SEQ ID NO: 74156 - DNA, 15 bp, Homo sapiens
ggggcacagggagag

SEQ ID NO: 74157 - DNA, 15 bp, Homo sapiens
gggcacagggagagg

SEQ ID NO: 74158 - DNA, 15 bp, Homo sapiens
ggcacagggagaggc

SEQ ID NO: 74159 - DNA, 15 bp, Homo sapiens
gcacagggagaggcc

SEQ ID NO: 74160 - DNA, 15 bp, Homo sapiens
cacagggagaggccg

SEQ ID NO: 74161 - DNA, 15 bp, Homo sapiens
acagggagaggccgg

SEQ ID NO: 74162 - DNA, 15 bp, Homo sapiens
agggagaggccggga

SEQ ID NO: 74163 - DNA, 15 bp, Homo sapiens
gggagaggccgggac

SEQ ID NO: 74164 - DNA, 15 bp, Homo sapiens
ggagaggccgggaca

SEQ ID NO: 74165 - DNA, 15 bp, Homo sapiens
gagaggccgggacac

SEQ ID NO: 74166 - DNA, 15 bp, Homo sapiens
agaggccgggacaca

SEQ ID NO: 74167 - DNA, 15 bp, Homo sapiens
gaggccgggacacac

SEQ ID NO: 74168 - DNA, 15 bp, Homo sapiens
aggccgggacacact

SEQ ID NO: 74169 - DNA, 15 bp, Homo sapiens
ggccgggacacactt

SEQ ID NO: 74170 - DNA, 15 bp, Homo sapiens
gccgggacacactta

SEQ ID NO: 74171 - DNA, 15 bp, Homo sapiens
ccgggacacacttag

SEQ ID NO: 74172 - DNA, 15 bp, Homo sapiens
cgggacacacttagc

SEQ ID NO: 74173 - DNA, 15 bp, Homo sapiens
gggacacacttagct

SEQ ID NO: 74174 - DNA, 15 bp, Homo sapiens
ggacacacttagctg

SEQ ID NO: 74175 - DNA, 15 bp, Homo sapiens
gacacacttagctgg

SEQ ID NO: 74176 - DNA, 15 bp, Homo sapiens
acacacttagctgga

SEQ ID NO: 74177 - DNA, 15 bp, Homo sapiens
cacacttagctggag

SEQ ID NO: 74178 - DNA, 15 bp, Homo sapiens
acacttagctggaga

SEQ ID NO: 74179 - DNA, 15 bp, Homo sapiens
cacttagctggagat

SEQ ID NO: 74180 - DNA, 15 bp, Homo sapiens
acttagctggagatg

SEQ ID NO: 74181 - DNA, 15 bp, Homo sapiens
cttagctggagatgt

SEQ ID NO: 74182 - DNA, 15 bp, Homo sapiens
ttagctggagatgtc

SEQ ID NO: 74183 - DNA, 15 bp, Homo sapiens
tagctggagatgtct

SEQ ID NO: 74184 - DNA, 15 bp, Homo sapiens
agctggagatgtctc

SEQ ID NO: 74185 - DNA, 15 bp, Homo sapiens
gctggagatgtctct

SEQ ID NO: 74186 - DNA, 15 bp, Homo sapiens
ctggagatgtctcta

SEQ ID NO: 74187 - DNA, 15 bp, Homo sapiens
tggagatgtctctaa

SEQ ID NO: 74188 - DNA, 15 bp, Homo sapiens
ggagatgtctctaaa

SEQ ID NO: 74189 - DNA, 15 bp, Homo sapiens
gagatgtctctaaaa

SEQ ID NO: 74190 - DNA, 15 bp, Homo sapiens
agatgtctctaaaag

SEQ ID NO: 74191 - DNA, 15 bp, Homo sapiens
gatgtctctaaaagc

SEQ ID NO: 74192 - DNA, 15 bp, Homo sapiens
atgtctctaaaagcc

SEQ ID NO: 74193 - DNA, 15 bp, Homo sapiens
tgtctctaaaagccc

SEQ ID NO: 74194 - DNA, 15 bp, Homo sapiens
gtctctaaaagccct

SEQ ID NO: 74195 - DNA, 15 bp, Homo sapiens
tctctaaaagccctg

SEQ ID NO: 74196 - DNA, 15 bp, Homo sapiens
ctctaaaagccctgt

SEQ ID NO: 74197 - DNA, 15 bp, Homo sapiens
tctaaaagccctgta

SEQ ID NO: 74198 - DNA, 15 bp, Homo sapiens
ctaaaagccctgtat

SEQ ID NO: 74199 - DNA, 15 bp, Homo sapiens
taaaagccctgtatc

SEQ ID NO: 74200 - DNA, 15 bp, Homo sapiens
aaaagccctgtatcg

SEQ ID NO: 74201 - DNA, 15 bp, Homo sapiens
aaagccctgtatcgt

SEQ ID NO: 74202 - DNA, 15 bp, Homo sapiens
aagccctgtatcgta

SEQ ID NO: 74203 - DNA, 15 bp, Homo sapiens
agccctgtatcgtat

SEQ ID NO: 74204 - DNA, 15 bp, Homo sapiens
gccctgtatcgtatt

SEQ ID NO: 74205 - DNA, 15 bp, Homo sapiens
ccctgtatcgtattc

SEQ ID NO: 74206 - DNA, 15 bp, Homo sapiens
cctgtatcgtattca

SEQ ID NO: 74207 - DNA, 15 bp, Homo sapiens
ctgtatcgtattcac

SEQ ID NO: 74208 - DNA, 15 bp, Homo sapiens
tgtatcgtattcacc

SEQ ID NO: 74209 - DNA, 15 bp, Homo sapiens
gtatcgtattcacct

SEQ ID NO: 74210 - DNA, 15 bp, Homo sapiens
tatcgtattcacctt

SEQ ID NO: 74211 - DNA, 15 bp, Homo sapiens
atcgtattcaccttc

SEQ ID NO: 74212 - DNA, 15 bp, Homo sapiens
tcgtattcaccttca

SEQ ID NO: 74213 - DNA, 15 bp, Homo sapiens
cgtattcaccttcag

SEQ ID NO: 74214 - DNA, 15 bp, Homo sapiens
gtattcaccttcagt

SEQ ID NO: 74215 - DNA, 15 bp, Homo sapiens
tattcaccttcagtt

SEQ ID NO: 74216 - DNA, 15 bp, Homo sapiens
attcaccttcagttt

SEQ ID NO: 74217 - DNA, 15 bp, Homo sapiens
ttcaccttcagtttt

SEQ ID NO: 74218 - DNA, 15 bp, Homo sapiens
tcaccttcagttttt

SEQ ID NO: 74219 - DNA, 15 bp, Homo sapiens
caccttcagtttttg

SEQ ID NO: 74220 - DNA, 15 bp, Homo sapiens
accttcagtttttgt

SEQ ID NO: 74221 - DNA, 15 bp, Homo sapiens
ccttcagtttttgtg

SEQ ID NO: 74222 - DNA, 15 bp, Homo sapiens
cttcagtttttgtgt

SEQ ID NO: 74223 - DNA, 15 bp, Homo sapiens
ttcagtttttgtgtt

SEQ ID NO: 74224 - DNA, 15 bp, Homo sapiens
tcagtttttgtgttt

SEQ ID NO: 74225 - DNA, 15 bp, Homo sapiens
cagtttttgtgtttt

SEQ ID NO: 74226 - DNA, 15 bp, Homo sapiens
agtttttgtgttttg

SEQ ID NO: 74227 - DNA, 15 bp, Homo sapiens
gtttttgtgttttgg

SEQ ID NO: 74228 - DNA, 15 bp, Homo sapiens
tttttgtgttttggg

SEQ ID NO: 74229 - DNA, 15 bp, Homo sapiens
ttttgtgttttggga

SEQ ID NO: 74230 - DNA, 15 bp, Homo sapiens
tttgtgttttgggac

SEQ ID NO: 74231 - DNA, 15 bp, Homo sapiens
ttgtgttttgggaca

SEQ ID NO: 74232 - DNA, 15 bp, Homo sapiens
tgtgttttgggacaa

SEQ ID NO: 74233 - DNA, 15 bp, Homo sapiens
gtgttttgggacaat

SEQ ID NO: 74234 - DNA, 15 bp, Homo sapiens
tgttttgggacaatt

SEQ ID NO: 74235 - DNA, 15 bp, Homo sapiens
gttttgggacaatta

SEQ ID NO: 74236 - DNA, 15 bp, Homo sapiens
ttttgggacaattac

SEQ ID NO: 74237 - DNA, 15 bp, Homo sapiens
tttgggacaattact

SEQ ID NO: 74238 - DNA, 15 bp, Homo sapiens
ttgggacaattactt

SEQ ID NO: 74239 - DNA, 15 bp, Homo sapiens
tgggacaattacttt

SEQ ID NO: 74240 - DNA, 15 bp, Homo sapiens
gggacaattacttta

SEQ ID NO: 74241 - DNA, 15 bp, Homo sapiens
ggacaattactttag

SEQ ID NO: 74242 - DNA, 15 bp, Homo sapiens
gacaattactttaga

SEQ ID NO: 74243 - DNA, 15 bp, Homo sapiens
acaattactttagaa

SEQ ID NO: 74244 - DNA, 15 bp, Homo sapiens
caattactttagaaa

SEQ ID NO: 74245 - DNA, 15 bp, Homo sapiens
aattactttagaaaa

SEQ ID NO: 74246 - DNA, 15 bp, Homo sapiens
attactttagaaaat

SEQ ID NO: 74247 - DNA, 15 bp, Homo sapiens
ttactttagaaaata

SEQ ID NO: 74248 - DNA, 15 bp, Homo sapiens
tactttagaaaataa

SEQ ID NO: 74249 - DNA, 15 bp, Homo sapiens
actttagaaaataag

SEQ ID NO: 74250 - DNA, 15 bp, Homo sapiens
ctttagaaaataagt

SEQ ID NO: 74251 - DNA, 15 bp, Homo sapiens
tttagaaaataagta

SEQ ID NO: 74252 - DNA, 15 bp, Homo sapiens
ttagaaaataagtag

SEQ ID NO: 74253 - DNA, 15 bp, Homo sapiens
tagaaaataagtagg

SEQ ID NO: 74254 - DNA, 15 bp, Homo sapiens
agaaaataagtaggt

SEQ ID NO: 74255 - DNA, 15 bp, Homo sapiens
gaaaataagtaggtc

SEQ ID NO: 74256 - DNA, 15 bp, Homo sapiens
aaaataagtaggtcg

SEQ ID NO: 74257 - DNA, 15 bp, Homo sapiens
aaataagtaggtcgt

SEQ ID NO: 74258 - DNA, 15 bp, Homo sapiens
aataagtaggtcgtt

SEQ ID NO: 74259 - DNA, 15 bp, Homo sapiens
ataagtaggtcgttt

SEQ ID NO: 74260 - DNA, 15 bp, Homo sapiens
taagtaggtcgtttt

SEQ ID NO: 74261 - DNA, 15 bp, Homo sapiens
aagtaggtcgtttta

SEQ ID NO: 74262 - DNA, 15 bp, Homo sapiens
agtaggtcgttttaa

SEQ ID NO: 74263 - DNA, 15 bp, Homo sapiens
gtaggtcgttttaaa

SEQ ID NO: 74264 - DNA, 15 bp, Homo sapiens
taggtcgttttaaaa

SEQ ID NO: 74265 - DNA, 15 bp, Homo sapiens
aggtcgttttaaaaa

SEQ ID NO: 74266 - DNA, 15 bp, Homo sapiens
ggtcgttttaaaaac

SEQ ID NO: 74267 - DNA, 15 bp, Homo sapiens
gtcgttttaaaaaca

SEQ ID NO: 74268 - DNA, 15 bp, Homo sapiens
tcgttttaaaaacaa

SEQ ID NO: 74269 - DNA, 15 bp, Homo sapiens
cgttttaaaaacaaa

SEQ ID NO: 74270 - DNA, 15 bp, Homo sapiens
gttttaaaaacaaaa

SEQ ID NO: 74271 - DNA, 15 bp, Homo sapiens
ttttaaaaacaaaaa

SEQ ID NO: 74272 - DNA, 15 bp, Homo sapiens
tttaaaaacaaaaat

SEQ ID NO: 74273 - DNA, 15 bp, Homo sapiens
ttaaaaacaaaaatt

SEQ ID NO: 74274 - DNA, 15 bp, Homo sapiens
taaaaacaaaaatta

SEQ ID NO: 74275 - DNA, 15 bp, Homo sapiens
aaaaacaaaaattat

SEQ ID NO: 74276 - DNA, 15 bp, Homo sapiens
aaaacaaaaattatt

SEQ ID NO: 74277 - DNA, 15 bp, Homo sapiens
aaacaaaaattattg

SEQ ID NO: 74278 - DNA, 15 bp, Homo sapiens
aacaaaaattattga

SEQ ID NO: 74279 - DNA, 15 bp, Homo sapiens
acaaaaattattgat

SEQ ID NO: 74280 - DNA, 15 bp, Homo sapiens
caaaaattattgatt

SEQ ID NO: 74281 - DNA, 15 bp, Homo sapiens
aaaaattattgattg

SEQ ID NO: 74282 - DNA, 15 bp, Homo sapiens
aaaattattgattgc

SEQ ID NO: 74283 - DNA, 15 bp, Homo sapiens
aaattattgattgct

SEQ ID NO: 74284 - DNA, 15 bp, Homo sapiens
aattattgattgctt

SEQ ID NO: 74285 - DNA, 15 bp, Homo sapiens
attattgattgcttt

SEQ ID NO: 74286 - DNA, 15 bp, Homo sapiens
ttattgattgctttt

SEQ ID NO: 74287 - DNA, 15 bp, Homo sapiens
tattgattgcttttt

SEQ ID NO: 74288 - DNA, 15 bp, Homo sapiens
attgattgctttttt

SEQ ID NO: 74289 - DNA, 15 bp, Homo sapiens
ttgattgcttttttg

SEQ ID NO: 74290 - DNA, 15 bp, Homo sapiens
tgattgcttttttgt

SEQ ID NO: 74291 - DNA, 15 bp, Homo sapiens
gattgcttttttgta

SEQ ID NO: 74292 - DNA, 15 bp, Homo sapiens
attgcttttttgtag

SEQ ID NO: 74293 - DNA, 15 bp, Homo sapiens
ttgcttttttgtagt

SEQ ID NO: 74294 - DNA, 15 bp, Homo sapiens
tgcttttttgtagtg

SEQ ID NO: 74295 - DNA, 15 bp, Homo sapiens
gcttttttgtagtgt

SEQ ID NO: 74296 - DNA, 15 bp, Homo sapiens
cttttttgtagtgtt

SEQ ID NO: 74297 - DNA, 15 bp, Homo sapiens
ttttttgtagtgttc

SEQ ID NO: 74298 - DNA, 15 bp, Homo sapiens
tttttgtagtgttca

SEQ ID NO: 74299 - DNA, 15 bp, Homo sapiens
ttttgtagtgttcag

SEQ ID NO: 74300 - DNA, 15 bp, Homo sapiens
tttgtagtgttcaga

SEQ ID NO: 74301 - DNA, 15 bp, Homo sapiens
ttgtagtgttcagaa

SEQ ID NO: 74302 - DNA, 15 bp, Homo sapiens
tgtagtgttcagaaa

SEQ ID NO: 74303 - DNA, 15 bp, Homo sapiens
gtagtgttcagaaaa

SEQ ID NO: 74304 - DNA, 15 bp, Homo sapiens
tagtgttcagaaaaa

SEQ ID NO: 74305 - DNA, 15 bp, Homo sapiens
agtgttcagaaaaaa

SEQ ID NO: 74306 - DNA, 15 bp, Homo sapiens
gtgttcagaaaaaag

SEQ ID NO: 74307 - DNA, 15 bp, Homo sapiens
tgttcagaaaaaagg

SEQ ID NO: 74308 - DNA, 15 bp, Homo sapiens
gttcagaaaaaaggt

SEQ ID NO: 74309 - DNA, 15 bp, Homo sapiens
ttcagaaaaaaggtt

SEQ ID NO: 74310 - DNA, 15 bp, Homo sapiens
tcagaaaaaaggttc

SEQ ID NO: 74311 - DNA, 15 bp, Homo sapiens
cagaaaaaaggttct

SEQ ID NO: 74312 - DNA, 15 bp, Homo sapiens
agaaaaaaggttctt

SEQ ID NO: 74313 - DNA, 15 bp, Homo sapiens
gaaaaaaggttcttt

SEQ ID NO: 74314 - DNA, 15 bp, Homo sapiens
aaaaaaggttctttg

SEQ ID NO: 74315 - DNA, 15 bp, Homo sapiens
aaaaaggttctttgt

SEQ ID NO: 74316 - DNA, 15 bp, Homo sapiens
aaaaggttctttgtg

SEQ ID NO: 74317 - DNA, 15 bp, Homo sapiens
aaaggttctttgtgt

SEQ ID NO: 74318 - DNA, 15 bp, Homo sapiens
aaggttctttgtgta

SEQ ID NO: 74319 - DNA, 15 bp, Homo sapiens
aggttctttgtgtat

SEQ ID NO: 74320 - DNA, 15 bp, Homo sapiens
ggttctttgtgtata

SEQ ID NO: 74321 - DNA, 15 bp, Homo sapiens
gttctttgtgtatag

SEQ ID NO: 74322 - DNA, 15 bp, Homo sapiens
ttctttgtgtatagc

SEQ ID NO: 74323 - DNA, 15 bp, Homo sapiens
tctttgtgtatagcc

SEQ ID NO: 74324 - DNA, 15 bp, Homo sapiens
ctttgtgtatagcca

SEQ ID NO: 74325 - DNA, 15 bp, Homo sapiens
tttgtgtatagccaa

SEQ ID NO: 74326 - DNA, 15 bp, Homo sapiens
ttgtgtatagccaaa

SEQ ID NO: 74327 - DNA, 15 bp, Homo sapiens
tgtgtatagccaaat

SEQ ID NO: 74328 - DNA, 15 bp, Homo sapiens
gtgtatagccaaatg

SEQ ID NO: 74329 - DNA, 15 bp, Homo sapiens
tgtatagccaaatga

SEQ ID NO: 74330 - DNA, 15 bp, Homo sapiens
gtatagccaaatgac

SEQ ID NO: 74331 - DNA, 15 bp, Homo sapiens
tatagccaaatgact

SEQ ID NO: 74332 - DNA, 15 bp, Homo sapiens
atagccaaatgactg

SEQ ID NO: 74333 - DNA, 15 bp, Homo sapiens
tagccaaatgactga

SEQ ID NO: 74334 - DNA, 15 bp, Homo sapiens
agccaaatgactgaa

SEQ ID NO: 74335 - DNA, 15 bp, Homo sapiens
gccaaatgactgaaa

SEQ ID NO: 74336 - DNA, 15 bp, Homo sapiens
ccaaatgactgaaag

SEQ ID NO: 74337 - DNA, 15 bp, Homo sapiens
caaatgactgaaagc

SEQ ID NO: 74338 - DNA, 15 bp, Homo sapiens
aaatgactgaaagca

SEQ ID NO: 74339 - DNA, 15 bp, Homo sapiens
aatgactgaaagcac

SEQ ID NO: 74340 - DNA, 15 bp, Homo sapiens
atgactgaaagcact

SEQ ID NO: 74341 - DNA, 15 bp, Homo sapiens
tgactgaaagcactg

SEQ ID NO: 74342 - DNA, 15 bp, Homo sapiens
gactgaaagcactga

SEQ ID NO: 74343 - DNA, 15 bp, Homo sapiens
actgaaagcactgat

SEQ ID NO: 74344 - DNA, 15 bp, Homo sapiens
ctgaaagcactgata

SEQ ID NO: 74345 - DNA, 15 bp, Homo sapiens
tgaaagcactgatat

SEQ ID NO: 74346 - DNA, 15 bp, Homo sapiens
gaaagcactgatata

SEQ ID NO: 74347 - DNA, 15 bp, Homo sapiens
aaagcactgatatat

SEQ ID NO: 74348 - DNA, 15 bp, Homo sapiens
aagcactgatatatt

SEQ ID NO: 74349 - DNA, 15 bp, Homo sapiens
agcactgatatattt

SEQ ID NO: 74350 - DNA, 15 bp, Homo sapiens
gcactgatatattta

SEQ ID NO: 74351 - DNA, 15 bp, Homo sapiens
cactgatatatttaa

SEQ ID NO: 74352 - DNA, 15 bp, Homo sapiens
actgatatatttaaa

SEQ ID NO: 74353 - DNA, 15 bp, Homo sapiens
ctgatatatttaaaa

SEQ ID NO: 74354 - DNA, 15 bp, Homo sapiens
tgatatatttaaaaa

SEQ ID NO: 74355 - DNA, 15 bp, Homo sapiens
gatatatttaaaaac

SEQ ID NO: 74356 - DNA, 15 bp, Homo sapiens
atatatttaaaaaca

SEQ ID NO: 74357 - DNA, 15 bp, Homo sapiens
tatatttaaaaacaa

SEQ ID NO: 74358 - DNA, 15 bp, Homo sapiens
atatttaaaaacaaa

SEQ ID NO: 74359 - DNA, 15 bp, Homo sapiens
tatttaaaaacaaaa

SEQ ID NO: 74360 - DNA, 15 bp, Homo sapiens
atttaaaaacaaaag

SEQ ID NO: 74361 - DNA, 15 bp, Homo sapiens
tttaaaaacaaaagg

SEQ ID NO: 74362 - DNA, 15 bp, Homo sapiens
ttaaaaacaaaaggc

SEQ ID NO: 74363 - DNA, 15 bp, Homo sapiens
taaaaacaaaaggca

SEQ ID NO: 74364 - DNA, 15 bp, Homo sapiens
aaaaacaaaaggcaa

SEQ ID NO: 74365 - DNA, 15 bp, Homo sapiens
aaaacaaaaggcaat

SEQ ID NO: 74366 - DNA, 15 bp, Homo sapiens
aaacaaaaggcaatt

SEQ ID NO: 74367 - DNA, 15 bp, Homo sapiens
aacaaaaggcaattt

SEQ ID NO: 74368 - DNA, 15 bp, Homo sapiens
acaaaaggcaattta

SEQ ID NO: 74369 - DNA, 15 bp, Homo sapiens
caaaaggcaatttat

SEQ ID NO: 74370 - DNA, 15 bp, Homo sapiens
aaaaggcaatttatt

SEQ ID NO: 74371 - DNA, 15 bp, Homo sapiens
aaaggcaatttatta

SEQ ID NO: 74372 - DNA, 15 bp, Homo sapiens
aaggcaatttattaa

SEQ ID NO: 74373 - DNA, 15 bp, Homo sapiens
aggcaatttattaag

SEQ ID NO: 74374 - DNA, 15 bp, Homo sapiens
ggcaatttattaagg

SEQ ID NO: 74375 - DNA, 15 bp, Homo sapiens
gcaatttattaagga

SEQ ID NO: 74376 - DNA, 15 bp, Homo sapiens
caatttattaaggaa

SEQ ID NO: 74377 - DNA, 15 bp, Homo sapiens
aatttattaaggaaa

SEQ ID NO: 74378 - DNA, 15 bp, Homo sapiens
atttattaaggaaat

SEQ ID NO: 74379 - DNA, 15 bp, Homo sapiens
tttattaaggaaatt

SEQ ID NO: 74380 - DNA, 15 bp, Homo sapiens
ttattaaggaaattt

SEQ ID NO: 74381 - DNA, 15 bp, Homo sapiens
tattaaggaaatttg

SEQ ID NO: 74382 - DNA, 15 bp, Homo sapiens
attaaggaaatttgt

SEQ ID NO: 74383 - DNA, 15 bp, Homo sapiens
ttaaggaaatttgta

SEQ ID NO: 74384 - DNA, 15 bp, Homo sapiens
taaggaaatttgtac

SEQ ID NO: 74385 - DNA, 15 bp, Homo sapiens
aaggaaatttgtacc

SEQ ID NO: 74386 - DNA, 15 bp, Homo sapiens
aggaaatttgtacca

SEQ ID NO: 74387 - DNA, 15 bp, Homo sapiens
ggaaatttgtaccat

SEQ ID NO: 74388 - DNA, 15 bp, Homo sapiens
gaaatttgtaccatt

SEQ ID NO: 74389 - DNA, 15 bp, Homo sapiens
aaatttgtaccattt

SEQ ID NO: 74390 - DNA, 15 bp, Homo sapiens
aatttgtaccatttc

SEQ ID NO: 74391 - DNA, 15 bp, Homo sapiens
atttgtaccatttca

SEQ ID NO: 74392 - DNA, 15 bp, Homo sapiens
tttgtaccatttcag

SEQ ID NO: 74393 - DNA, 15 bp, Homo sapiens
ttgtaccatttcagt

SEQ ID NO: 74394 - DNA, 15 bp, Homo sapiens
tgtaccatttcagta

SEQ ID NO: 74395 - DNA, 15 bp, Homo sapiens
gtaccatttcagtaa

SEQ ID NO: 74396 - DNA, 15 bp, Homo sapiens
taccatttcagtaaa

SEQ ID NO: 74397 - DNA, 15 bp, Homo sapiens
accatttcagtaaac

SEQ ID NO: 74398 - DNA, 15 bp, Homo sapiens
ccatttcagtaaacc

SEQ ID NO: 74399 - DNA, 15 bp, Homo sapiens
catttcagtaaacct

SEQ ID NO: 74400 - DNA, 15 bp, Homo sapiens
atttcagtaaacctg

SEQ ID NO: 74401 - DNA, 15 bp, Homo sapiens
tttcagtaaacctgt

SEQ ID NO: 74402 - DNA, 15 bp, Homo sapiens
ttcagtaaacctgtc

SEQ ID NO: 74403 - DNA, 15 bp, Homo sapiens
tcagtaaacctgtct

SEQ ID NO: 74404 - DNA, 15 bp, Homo sapiens
cagtaaacctgtctg

SEQ ID NO: 74405 - DNA, 15 bp, Homo sapiens
agtaaacctgtctga

SEQ ID NO: 74406 - DNA, 15 bp, Homo sapiens
gtaaacctgtctgaa

SEQ ID NO: 74407 - DNA, 15 bp, Homo sapiens
taaacctgtctgaat

SEQ ID NO: 74408 - DNA, 15 bp, Homo sapiens
aaacctgtctgaatg

SEQ ID NO: 74409 - DNA, 15 bp, Homo sapiens
aacctgtctgaatgt

SEQ ID NO: 74410 - DNA, 15 bp, Homo sapiens
acctgtctgaatgta

SEQ ID NO: 74411 - DNA, 15 bp, Homo sapiens
cctgtctgaatgtac

SEQ ID NO: 74412 - DNA, 15 bp, Homo sapiens
ctgtctgaatgtacc

SEQ ID NO: 74413 - DNA, 15 bp, Homo sapiens
tgtctgaatgtacct

SEQ ID NO: 74414 - DNA, 15 bp, Homo sapiens
gtctgaatgtacctg

SEQ ID NO: 74415 - DNA, 15 bp, Homo sapiens
tctgaatgtacctgt

SEQ ID NO: 74416 - DNA, 15 bp, Homo sapiens
ctgaatgtacctgta

SEQ ID NO: 74417 - DNA, 15 bp, Homo sapiens
tgaatgtacctgtat

SEQ ID NO: 74418 - DNA, 15 bp, Homo sapiens
gaatgtacctgtata

SEQ ID NO: 74419 - DNA, 15 bp, Homo sapiens
aatgtacctgtatac

SEQ ID NO: 74420 - DNA, 15 bp, Homo sapiens
atgtacctgtatacg

SEQ ID NO: 74421 - DNA, 15 bp, Homo sapiens
tgtacctgtatacgt

SEQ ID NO: 74422 - DNA, 15 bp, Homo sapiens
gtacctgtatacgtt

SEQ ID NO: 74423 - DNA, 15 bp, Homo sapiens
tacctgtatacgttt

SEQ ID NO: 74424 - DNA, 15 bp, Homo sapiens
acctgtatacgtttc

SEQ ID NO: 74425 - DNA, 15 bp, Homo sapiens
cctgtatacgtttca

SEQ ID NO: 74426 - DNA, 15 bp, Homo sapiens
ctgtatacgtttcaa

SEQ ID NO: 74427 - DNA, 15 bp, Homo sapiens
tgtatacgtttcaaa

SEQ ID NO: 74428 - DNA, 15 bp, Homo sapiens
gtatacgtttcaaaa

SEQ ID NO: 74429 - DNA, 15 bp, Homo sapiens
tatacgtttcaaaaa

SEQ ID NO: 74430 - DNA, 15 bp, Homo sapiens
atacgtttcaaaaac

SEQ ID NO: 74431 - DNA, 15 bp, Homo sapiens
tacgtttcaaaaaca

SEQ ID NO: 74432 - DNA, 15 bp, Homo sapiens
acgtttcaaaaacac

SEQ ID NO: 74433 - DNA, 15 bp, Homo sapiens
cgtttcaaaaacacc

SEQ ID NO: 74434 - DNA, 15 bp, Homo sapiens
gtttcaaaaacaccc

SEQ ID NO: 74435 - DNA, 15 bp, Homo sapiens
tttcaaaaacacccc

SEQ ID NO: 74436 - DNA, 15 bp, Homo sapiens
ttcaaaaacaccccc

SEQ ID NO: 74437 - DNA, 15 bp, Homo sapiens
tcaaaaacacccccc

SEQ ID NO: 74438 - DNA, 15 bp, Homo sapiens
caaaaacaccccccc

SEQ ID NO: 74439 - DNA, 15 bp, Homo sapiens
aaaaacacccccccc

SEQ ID NO: 74440 - DNA, 15 bp, Homo sapiens
aaaacaccccccccc

SEQ ID NO: 74441 - DNA, 15 bp, Homo sapiens
aaacacccccccccc

SEQ ID NO: 74442 - DNA, 15 bp, Homo sapiens
aacacccccccccca

SEQ ID NO: 74443 - DNA, 15 bp, Homo sapiens
acaccccccccccac

SEQ ID NO: 74444 - DNA, 15 bp, Homo sapiens
caccccccccccact

SEQ ID NO: 74445 - DNA, 15 bp, Homo sapiens
accccccccccactg

SEQ ID NO: 74446 - DNA, 15 bp, Homo sapiens
ccccccccccactga

SEQ ID NO: 74447 - DNA, 15 bp, Homo sapiens
cccccccccactgaa

SEQ ID NO: 74448 - DNA, 15 bp, Homo sapiens
ccccccccactgaat

SEQ ID NO: 74449 - DNA, 15 bp, Homo sapiens
cccccccactgaatc

SEQ ID NO: 74450 - DNA, 15 bp, Homo sapiens
ccccccactgaatcc

SEQ ID NO: 74451 - DNA, 15 bp, Homo sapiens
cccccactgaatccc

SEQ ID NO: 74452 - DNA, 15 bp, Homo sapiens
ccccactgaatccct

SEQ ID NO: 74453 - DNA, 15 bp, Homo sapiens
cccactgaatccctg

SEQ ID NO: 74454 - DNA, 15 bp, Homo sapiens
ccactgaatccctgt

SEQ ID NO: 74455 - DNA, 15 bp, Homo sapiens
cactgaatccctgta

SEQ ID NO: 74456 - DNA, 15 bp, Homo sapiens
actgaatccctgtaa

SEQ ID NO: 74457 - DNA, 15 bp, Homo sapiens
ctgaatccctgtaac

SEQ ID NO: 74458 - DNA, 15 bp, Homo sapiens
tgaatccctgtaacc

SEQ ID NO: 74459 - DNA, 15 bp, Homo sapiens
gaatccctgtaacct

SEQ ID NO: 74460 - DNA, 15 bp, Homo sapiens
aatccctgtaaccta

SEQ ID NO: 74461 - DNA, 15 bp, Homo sapiens
atccctgtaacctat

SEQ ID NO: 74462 - DNA, 15 bp, Homo sapiens
tccctgtaacctatt

SEQ ID NO: 74463 - DNA, 15 bp, Homo sapiens
ccctgtaacctattt

SEQ ID NO: 74464 - DNA, 15 bp, Homo sapiens
cctgtaacctattta

SEQ ID NO: 74465 - DNA, 15 bp, Homo sapiens
ctgtaacctatttat

SEQ ID NO: 74466 - DNA, 15 bp, Homo sapiens
tgtaacctatttatt

SEQ ID NO: 74467 - DNA, 15 bp, Homo sapiens
gtaacctatttatta

SEQ ID NO: 74468 - DNA, 15 bp, Homo sapiens
taacctatttattat

SEQ ID NO: 74469 - DNA, 15 bp, Homo sapiens
aacctatttattata

SEQ ID NO: 74470 - DNA, 15 bp, Homo sapiens
acctatttattatat

SEQ ID NO: 74471 - DNA, 15 bp, Homo sapiens
cctatttattatata

SEQ ID NO: 74472 - DNA, 15 bp, Homo sapiens
ctatttattatataa

SEQ ID NO: 74473 - DNA, 15 bp, Homo sapiens
tatttattatataaa

SEQ ID NO: 74474 - DNA, 15 bp, Homo sapiens
atttattatataaag

SEQ ID NO: 74475 - DNA, 15 bp, Homo sapiens
tttattatataaaga

SEQ ID NO: 74476 - DNA, 15 bp, Homo sapiens
ttattatataaagag

SEQ ID NO: 74477 - DNA, 15 bp, Homo sapiens
tattatataaagagt

SEQ ID NO: 74478 - DNA, 15 bp, Homo sapiens
attatataaagagtt

SEQ ID NO: 74479 - DNA, 15 bp, Homo sapiens
ttatataaagagttt

SEQ ID NO: 74480 - DNA, 15 bp, Homo sapiens
tatataaagagtttg

SEQ ID NO: 74481 - DNA, 15 bp, Homo sapiens
atataaagagtttgc

SEQ ID NO: 74482 - DNA, 15 bp, Homo sapiens
tataaagagtttgcc

SEQ ID NO: 74483 - DNA, 15 bp, Homo sapiens
ataaagagtttgcct

SEQ ID NO: 74484 - DNA, 15 bp, Homo sapiens
taaagagtttgcctt

SEQ ID NO: 74485 - DNA, 15 bp, Homo sapiens
aaagagtttgcctta

SEQ ID NO: 74486 - DNA, 15 bp, Homo sapiens
aagagtttgccttat

SEQ ID NO: 74487 - DNA, 15 bp, Homo sapiens
agagtttgccttata

SEQ ID NO: 74488 - DNA, 15 bp, Homo sapiens
gagtttgccttataa

SEQ ID NO: 74489 - DNA, 15 bp, Homo sapiens
agtttgccttataaa

SEQ ID NO: 74490 - DNA, 15 bp, Homo sapiens
gtttgccttataaat

SEQ ID NO: 74491 - DNA, 15 bp, Homo sapiens
tttgccttataaatt

SEQ ID NO: 74492 - DNA, 15 bp, Homo sapiens
ttgccttataaattt

SEQ ID NO: 74493 - DNA, 15 bp, Homo sapiens
tgccttataaattta

SEQ ID NO: 74494 - DNA, 15 bp, Homo sapiens
gccttataaatttac

SEQ ID NO: 74495 - DNA, 15 bp, Homo sapiens
ccttataaatttaca

SEQ ID NO: 74496 - DNA, 15 bp, Homo sapiens
cttataaatttacat

SEQ ID NO: 74497 - DNA, 15 bp, Homo sapiens
ttataaatttacata

SEQ ID NO: 74498 - DNA, 15 bp, Homo sapiens
tataaatttacataa

SEQ ID NO: 74499 - DNA, 15 bp, Homo sapiens
ataaatttacataaa

SEQ ID NO: 74500 - DNA, 15 bp, Homo sapiens
taaatttacataaaa

SEQ ID NO: 74501 - DNA, 15 bp, Homo sapiens
aaatttacataaaaa

SEQ ID NO: 74502 - DNA, 15 bp, Homo sapiens
aatttacataaaaat

SEQ ID NO: 74503 - DNA, 15 bp, Homo sapiens
atttacataaaaatg

SEQ ID NO: 74504 - DNA, 15 bp, Homo sapiens
tttacataaaaatgt

SEQ ID NO: 74505 - DNA, 15 bp, Homo sapiens
ttacataaaaatgtc

SEQ ID NO: 74506 - DNA, 15 bp, Homo sapiens
tacataaaaatgtcc

SEQ ID NO: 74507 - DNA, 15 bp, Homo sapiens
acataaaaatgtccg

SEQ ID NO: 74508 - DNA, 15 bp, Homo sapiens
cataaaaatgtccgt

SEQ ID NO: 74509 - DNA, 15 bp, Homo sapiens
ataaaaatgtccgtt

SEQ ID NO: 74510 - DNA, 15 bp, Homo sapiens
taaaaatgtccgttt

SEQ ID NO: 74511 - DNA, 15 bp, Homo sapiens
aaaaatgtccgtttg

SEQ ID NO: 74512 - DNA, 15 bp, Homo sapiens
aaaatgtccgtttgt

SEQ ID NO: 74513 - DNA, 15 bp, Homo sapiens
aaatgtccgtttgtg

SEQ ID NO: 74514 - DNA, 15 bp, Homo sapiens
aatgtccgtttgtgt

SEQ ID NO: 74515 - DNA, 15 bp, Homo sapiens
atgtccgtttgtgtc

SEQ ID NO: 74516 - DNA, 15 bp, Homo sapiens
tgtccgtttgtgtct

SEQ ID NO: 74517 - DNA, 15 bp, Homo sapiens
gtccgtttgtgtctt

SEQ ID NO: 74518 - DNA, 15 bp, Homo sapiens
tccgtttgtgtcttt

SEQ ID NO: 74519 - DNA, 15 bp, Homo sapiens
ccgtttgtgtctttt

SEQ ID NO: 74520 - DNA, 15 bp, Homo sapiens
cgtttgtgtcttttg

SEQ ID NO: 74521 - DNA, 15 bp, Homo sapiens
gtttgtgtcttttgt

SEQ ID NO: 74522 - DNA, 15 bp, Homo sapiens
tttgtgtcttttgtt

SEQ ID NO: 74523 - DNA, 15 bp, Homo sapiens
ttgtgtcttttgttg

SEQ ID NO: 74524 - DNA, 15 bp, Homo sapiens
tgtgtcttttgttgt

SEQ ID NO: 74525 - DNA, 15 bp, Homo sapiens
gtgtcttttgttgta

SEQ ID NO: 74526 - DNA, 15 bp, Homo sapiens
tgtcttttgttgtaa

SEQ ID NO: 74527 - DNA, 15 bp, Homo sapiens
gtcttttgttgtaaa

SEQ ID NO: 74528 - DNA, 15 bp, Homo sapiens
tcttttgttgtaaaa

SEQ ID NO: 74529 - DNA, 15 bp, Homo sapiens
cttttgttgtaaaaa

SEQ ID NO: 74530 - DNA, 15 bp, Homo sapiens
ttttgttgtaaaaat

SEQ ID NO: 74531 - DNA, 15 bp, Homo sapiens
tttgttgtaaaaatc

SEQ ID NO: 74532 - DNA, 15 bp, Homo sapiens
ttgttgtaaaaatca

SEQ ID NO: 74533 - DNA, 15 bp, Homo sapiens
tgttgtaaaaatcaa

SEQ ID NO: 74534 - DNA, 15 bp, Homo sapiens
gttgtaaaaatcaag

SEQ ID NO: 74535 - DNA, 15 bp, Homo sapiens
ttgtaaaaatcaagt

SEQ ID NO: 74536 - DNA, 15 bp, Homo sapiens
tgtaaaaatcaagtg

SEQ ID NO: 74537 - DNA, 15 bp, Homo sapiens
gtaaaaatcaagtga

SEQ ID NO: 74538 - DNA, 15 bp, Homo sapiens
taaaaatcaagtgat

SEQ ID NO: 74539 - DNA, 15 bp, Homo sapiens
aaaaatcaagtgatt

SEQ ID NO: 74540 - DNA, 15 bp, Homo sapiens
aaaatcaagtgattt

SEQ ID NO: 74541 - DNA, 15 bp, Homo sapiens
aaatcaagtgatttt

SEQ ID NO: 74542 - DNA, 15 bp, Homo sapiens
aatcaagtgattttt

SEQ ID NO: 74543 - DNA, 15 bp, Homo sapiens
atcaagtgatttttt

SEQ ID NO: 74544 - DNA, 15 bp, Homo sapiens
tcaagtgattttttc

SEQ ID NO: 74545 - DNA, 15 bp, Homo sapiens
caagtgattttttca

SEQ ID NO: 74546 - DNA, 15 bp, Homo sapiens
aagtgattttttcat

SEQ ID NO: 74547 - DNA, 15 bp, Homo sapiens
agtgattttttcata

SEQ ID NO: 74548 - DNA, 15 bp, Homo sapiens
gtgattttttcataa

SEQ ID NO: 74549 - DNA, 15 bp, Homo sapiens
tgattttttcataag

SEQ ID NO: 74550 - DNA, 15 bp, Homo sapiens
gattttttcataagg

SEQ ID NO: 74551 - DNA, 15 bp, Homo sapiens
attttttcataaggt

SEQ ID NO: 74552 - DNA, 15 bp, Homo sapiens
ttttttcataaggtt

SEQ ID NO: 74553 - DNA, 15 bp, Homo sapiens
tttttcataaggttc

SEQ ID NO: 74554 - DNA, 15 bp, Homo sapiens
ttttcataaggttct

SEQ ID NO: 74555 - DNA, 15 bp, Homo sapiens
tttcataaggttctt

SEQ ID NO: 74556 - DNA, 15 bp, Homo sapiens
ttcataaggttcttt

SEQ ID NO: 74557 - DNA, 15 bp, Homo sapiens
tcataaggttctttt

SEQ ID NO: 74558 - DNA, 15 bp, Homo sapiens
cataaggttctttta

SEQ ID NO: 74559 - DNA, 15 bp, Homo sapiens
ataaggttcttttac

SEQ ID NO: 74560 - DNA, 15 bp, Homo sapiens
taaggttcttttact

SEQ ID NO: 74561 - DNA, 15 bp, Homo sapiens
aaggttcttttacta

SEQ ID NO: 74562 - DNA, 15 bp, Homo sapiens
aggttcttttactat

SEQ ID NO: 74563 - DNA, 15 bp, Homo sapiens
ggttcttttactatt

SEQ ID NO: 74564 - DNA, 15 bp, Homo sapiens
gttcttttactattg

SEQ ID NO: 74565 - DNA, 15 bp, Homo sapiens
ttcttttactattgg

SEQ ID NO: 74566 - DNA, 15 bp, Homo sapiens
tcttttactattgga

SEQ ID NO: 74567 - DNA, 15 bp, Homo sapiens
cttttactattggaa

SEQ ID NO: 74568 - DNA, 15 bp, Homo sapiens
ttttactattggaaa

SEQ ID NO: 74569 - DNA, 15 bp, Homo sapiens
tttactattggaaaa

SEQ ID NO: 74570 - DNA, 15 bp, Homo sapiens
ttactattggaaaag

SEQ ID NO: 74571 - DNA, 15 bp, Homo sapiens
tactattggaaaaga

SEQ ID NO: 74572 - DNA, 15 bp, Homo sapiens
actattggaaaagat

SEQ ID NO: 74573 - DNA, 15 bp, Homo sapiens
ctattggaaaagatg

SEQ ID NO: 74574 - DNA, 15 bp, Homo sapiens
tattggaaaagatgg

SEQ ID NO: 74575 - DNA, 15 bp, Homo sapiens
attggaaaagatggg

SEQ ID NO: 74576 - DNA, 15 bp, Homo sapiens
ttggaaaagatgggc

SEQ ID NO: 74577 - DNA, 15 bp, Homo sapiens
tggaaaagatgggca

SEQ ID NO: 74578 - DNA, 15 bp, Homo sapiens
ggaaaagatgggcag

SEQ ID NO: 74579 - DNA, 15 bp, Homo sapiens
gaaaagatgggcagc

SEQ ID NO: 74580 - DNA, 15 bp, Homo sapiens
aaaagatgggcagca

SEQ ID NO: 74581 - DNA, 15 bp, Homo sapiens
aaagatgggcagcac

SEQ ID NO: 74582 - DNA, 15 bp, Homo sapiens
aagatgggcagcacg

SEQ ID NO: 74583 - DNA, 15 bp, Homo sapiens
agatgggcagcacgc

SEQ ID NO: 74584 - DNA, 15 bp, Homo sapiens
gatgggcagcacgca

SEQ ID NO: 74585 - DNA, 15 bp, Homo sapiens
atgggcagcacgcag

SEQ ID NO: 74586 - DNA, 15 bp, Homo sapiens
tgggcagcacgcagt

SEQ ID NO: 74587 - DNA, 15 bp, Homo sapiens
gggcagcacgcagtt

SEQ ID NO: 74588 - DNA, 15 bp, Homo sapiens
ggcagcacgcagttt

SEQ ID NO: 74589 - DNA, 15 bp, Homo sapiens
gcagcacgcagtttt

SEQ ID NO: 74590 - DNA, 15 bp, Homo sapiens
cagcacgcagtttta

SEQ ID NO: 74591 - DNA, 15 bp, Homo sapiens
agcacgcagttttat

SEQ ID NO: 74592 - DNA, 15 bp, Homo sapiens
gcacgcagttttatt

SEQ ID NO: 74593 - DNA, 15 bp, Homo sapiens
cacgcagttttattt

SEQ ID NO: 74594 - DNA, 15 bp, Homo sapiens
acgcagttttatttt

SEQ ID NO: 74595 - DNA, 15 bp, Homo sapiens
cgcagttttatttta

SEQ ID NO: 74596 - DNA, 15 bp, Homo sapiens
gcagttttattttat

SEQ ID NO: 74597 - DNA, 15 bp, Homo sapiens
cagttttattttatt

SEQ ID NO: 74598 - DNA, 15 bp, Homo sapiens
agttttattttattt

SEQ ID NO: 74599 - DNA, 15 bp, Homo sapiens
gttttattttatttt

SEQ ID NO: 74600 - DNA, 15 bp, Homo sapiens
ttttattttattttt

SEQ ID NO: 74601 - DNA, 15 bp, Homo sapiens
tttattttatttttg

SEQ ID NO: 74602 - DNA, 15 bp, Homo sapiens
ttattttatttttgt

SEQ ID NO: 74603 - DNA, 15 bp, Homo sapiens
tattttatttttgta

SEQ ID NO: 74604 - DNA, 15 bp, Homo sapiens
attttatttttgtaa

SEQ ID NO: 74605 - DNA, 15 bp, Homo sapiens
ttttatttttgtaag

SEQ ID NO: 74606 - DNA, 15 bp, Homo sapiens
tttatttttgtaagt

SEQ ID NO: 74607 - DNA, 15 bp, Homo sapiens
ttatttttgtaagtt

SEQ ID NO: 74608 - DNA, 15 bp, Homo sapiens
tatttttgtaagttt

SEQ ID NO: 74609 - DNA, 15 bp, Homo sapiens
atttttgtaagtttt

SEQ ID NO: 74610 - DNA, 15 bp, Homo sapiens
tttttgtaagttttt

SEQ ID NO: 74611 - DNA, 15 bp, Homo sapiens
ttttgtaagtttttt

SEQ ID NO: 74612 - DNA, 15 bp, Homo sapiens
tttgtaagtttttta

SEQ ID NO: 74613 - DNA, 15 bp, Homo sapiens
ttgtaagttttttaa

SEQ ID NO: 74614 - DNA, 15 bp, Homo sapiens
tgtaagttttttaat

SEQ ID NO: 74615 - DNA, 15 bp, Homo sapiens
gtaagttttttaata

SEQ ID NO: 74616 - DNA, 15 bp, Homo sapiens
taagttttttaatac

SEQ ID NO: 74617 - DNA, 15 bp, Homo sapiens
aagttttttaataca

SEQ ID NO: 74618 - DNA, 15 bp, Homo sapiens
agttttttaatacat

SEQ ID NO: 74619 - DNA, 15 bp, Homo sapiens
gttttttaatacatg

SEQ ID NO: 74620 - DNA, 15 bp, Homo sapiens
ttttttaatacatgt

SEQ ID NO: 74621 - DNA, 15 bp, Homo sapiens
tttttaatacatgtg

SEQ ID NO: 74622 - DNA, 15 bp, Homo sapiens
ttttaatacatgtga

SEQ ID NO: 74623 - DNA, 15 bp, Homo sapiens
tttaatacatgtgaa

SEQ ID NO: 74624 - DNA, 15 bp, Homo sapiens
ttaatacatgtgaaa

SEQ ID NO: 74625 - DNA, 15 bp, Homo sapiens
taatacatgtgaaag

SEQ ID NO: 74626 - DNA, 15 bp, Homo sapiens
aatacatgtgaaagc

SEQ ID NO: 74627 - DNA, 15 bp, Homo sapiens
atacatgtgaaagca

SEQ ID NO: 74628 - DNA, 15 bp, Homo sapiens
tacatgtgaaagcaa

SEQ ID NO: 74629 - DNA, 15 bp, Homo sapiens
acatgtgaaagcaaa

SEQ ID NO: 74630 - DNA, 15 bp, Homo sapiens
catgtgaaagcaaag

SEQ ID NO: 74631 - DNA, 15 bp, Homo sapiens
atgtgaaagcaaaga

SEQ ID NO: 74632 - DNA, 15 bp, Homo sapiens
tgtgaaagcaaagaa

SEQ ID NO: 74633 - DNA, 15 bp, Homo sapiens
gtgaaagcaaagaat

SEQ ID NO: 74634 - DNA, 15 bp, Homo sapiens
tgaaagcaaagaata

SEQ ID NO: 74635 - DNA, 15 bp, Homo sapiens
gaaagcaaagaatac

SEQ ID NO: 74636 - DNA, 15 bp, Homo sapiens
aaagcaaagaatact

SEQ ID NO: 74637 - DNA, 15 bp, Homo sapiens
aagcaaagaatactc

SEQ ID NO: 74638 - DNA, 15 bp, Homo sapiens
agcaaagaatactca

SEQ ID NO: 74639 - DNA, 15 bp, Homo sapiens
gcaaagaatactcag

SEQ ID NO: 74640 - DNA, 15 bp, Homo sapiens
caaagaatactcagc

SEQ ID NO: 74641 - DNA, 15 bp, Homo sapiens
aaagaatactcagca

SEQ ID NO: 74642 - DNA, 15 bp, Homo sapiens
aagaatactcagcat

SEQ ID NO: 74643 - DNA, 15 bp, Homo sapiens
agaatactcagcatg

SEQ ID NO: 74644 - DNA, 15 bp, Homo sapiens
gaatactcagcatgc

SEQ ID NO: 74645 - DNA, 15 bp, Homo sapiens
aatactcagcatgcc

SEQ ID NO: 74646 - DNA, 15 bp, Homo sapiens
atactcagcatgcct

SEQ ID NO: 74647 - DNA, 15 bp, Homo sapiens
tactcagcatgcctt

SEQ ID NO: 74648 - DNA, 15 bp, Homo sapiens
actcagcatgccttt

SEQ ID NO: 74649 - DNA, 15 bp, Homo sapiens
ctcagcatgcctttc

SEQ ID NO: 74650 - DNA, 15 bp, Homo sapiens
tcagcatgcctttct

SEQ ID NO: 74651 - DNA, 15 bp, Homo sapiens
cagcatgcctttcta

SEQ ID NO: 74652 - DNA, 15 bp, Homo sapiens
agcatgcctttctaa

SEQ ID NO: 74653 - DNA, 15 bp, Homo sapiens
gcatgcctttctaag

SEQ ID NO: 74654 - DNA, 15 bp, Homo sapiens
catgcctttctaagt

SEQ ID NO: 74655 - DNA, 15 bp, Homo sapiens
atgcctttctaagtg

SEQ ID NO: 74656 - DNA, 15 bp, Homo sapiens
tgcctttctaagtga

SEQ ID NO: 74657 - DNA, 15 bp, Homo sapiens
gcctttctaagtgac

SEQ ID NO: 74658 - DNA, 15 bp, Homo sapiens
cctttctaagtgacg

SEQ ID NO: 74659 - DNA, 15 bp, Homo sapiens
ctttctaagtgacgc

SEQ ID NO: 74660 - DNA, 15 bp, Homo sapiens
tttctaagtgacgcg

SEQ ID NO: 74661 - DNA, 15 bp, Homo sapiens
ttctaagtgacgcgt

SEQ ID NO: 74662 - DNA, 15 bp, Homo sapiens
tctaagtgacgcgtt

SEQ ID NO: 74663 - DNA, 15 bp, Homo sapiens
ctaagtgacgcgttt

SEQ ID NO: 74664 - DNA, 15 bp, Homo sapiens
taagtgacgcgtttg

SEQ ID NO: 74665 - DNA, 15 bp, Homo sapiens
aagtgacgcgtttgc

SEQ ID NO: 74666 - DNA, 15 bp, Homo sapiens
agtgacgcgtttgca

SEQ ID NO: 74667 - DNA, 15 bp, Homo sapiens
gtgacgcgtttgcac

SEQ ID NO: 74668 - DNA, 15 bp, Homo sapiens
tgacgcgtttgcacc

SEQ ID NO: 74669 - DNA, 15 bp, Homo sapiens
gacgcgtttgcacct

SEQ ID NO: 74670 - DNA, 15 bp, Homo sapiens
acgcgtttgcacctt

SEQ ID NO: 74671 - DNA, 15 bp, Homo sapiens
cgcgtttgcaccttt

SEQ ID NO: 74672 - DNA, 15 bp, Homo sapiens
gcgtttgcacctttt

SEQ ID NO: 74673 - DNA, 15 bp, Homo sapiens
cgtttgcaccttttg

SEQ ID NO: 74674 - DNA, 15 bp, Homo sapiens
gtttgcaccttttgt

SEQ ID NO: 74675 - DNA, 15 bp, Homo sapiens
tttgcaccttttgtt

SEQ ID NO: 74676 - DNA, 15 bp, Homo sapiens
ttgcaccttttgttg

SEQ ID NO: 74677 - DNA, 15 bp, Homo sapiens
tgcaccttttgttgg

SEQ ID NO: 74678 - DNA, 15 bp, Homo sapiens
gcaccttttgttggg

SEQ ID NO: 74679 - DNA, 15 bp, Homo sapiens
caccttttgttggga

SEQ ID NO: 74680 - DNA, 15 bp, Homo sapiens
accttttgttgggaa

SEQ ID NO: 74681 - DNA, 15 bp, Homo sapiens
ccttttgttgggaag

SEQ ID NO: 74682 - DNA, 15 bp, Homo sapiens
cttttgttgggaagt

SEQ ID NO: 74683 - DNA, 15 bp, Homo sapiens
ttttgttgggaagta

SEQ ID NO: 74684 - DNA, 15 bp, Homo sapiens
tttgttgggaagtac

SEQ ID NO: 74685 - DNA, 15 bp, Homo sapiens
ttgttgggaagtact

SEQ ID NO: 74686 - DNA, 15 bp, Homo sapiens
tgttgggaagtactg

SEQ ID NO: 74687 - DNA, 15 bp, Homo sapiens
gttgggaagtactgt

SEQ ID NO: 74688 - DNA, 15 bp, Homo sapiens
ttgggaagtactgta

SEQ ID NO: 74689 - DNA, 15 bp, Homo sapiens
tgggaagtactgtat

SEQ ID NO: 74690 - DNA, 15 bp, Homo sapiens
gggaagtactgtatc

SEQ ID NO: 74691 - DNA, 15 bp, Homo sapiens
ggaagtactgtatcc

SEQ ID NO: 74692 - DNA, 15 bp, Homo sapiens
gaagtactgtatcct

SEQ ID NO: 74693 - DNA, 15 bp, Homo sapiens
aagtactgtatcctg

SEQ ID NO: 74694 - DNA, 15 bp, Homo sapiens
agtactgtatcctgt

SEQ ID NO: 74695 - DNA, 15 bp, Homo sapiens
gtactgtatcctgtg

SEQ ID NO: 74696 - DNA, 15 bp, Homo sapiens
tactgtatcctgtgc

SEQ ID NO: 74697 - DNA, 15 bp, Homo sapiens
actgtatcctgtgct

SEQ ID NO: 74698 - DNA, 15 bp, Homo sapiens
ctgtatcctgtgctg

SEQ ID NO: 74699 - DNA, 15 bp, Homo sapiens
tgtatcctgtgctgt

SEQ ID NO: 74700 - DNA, 15 bp, Homo sapiens
gtatcctgtgctgtt

SEQ ID NO: 74701 - DNA, 15 bp, Homo sapiens
tatcctgtgctgtta

SEQ ID NO: 74702 - DNA, 15 bp, Homo sapiens
atcctgtgctgttag

SEQ ID NO: 74703 - DNA, 15 bp, Homo sapiens
tcctgtgctgttagc

SEQ ID NO: 74704 - DNA, 15 bp, Homo sapiens
cctgtgctgttagca

SEQ ID NO: 74705 - DNA, 15 bp, Homo sapiens
ctgtgctgttagcat

SEQ ID NO: 74706 - DNA, 15 bp, Homo sapiens
tgtgctgttagcatt

SEQ ID NO: 74707 - DNA, 15 bp, Homo sapiens
gtgctgttagcattc

SEQ ID NO: 74708 - DNA, 15 bp, Homo sapiens
tgctgttagcattct

SEQ ID NO: 74709 - DNA, 15 bp, Homo sapiens
gctgttagcattctc

SEQ ID NO: 74710 - DNA, 15 bp, Homo sapiens
ctgttagcattctcg

SEQ ID NO: 74711 - DNA, 15 bp, Homo sapiens
tgttagcattctcga

SEQ ID NO: 74712 - DNA, 15 bp, Homo sapiens
gttagcattctcgat

SEQ ID NO: 74713 - DNA, 15 bp, Homo sapiens
ttagcattctcgata

SEQ ID NO: 74714 - DNA, 15 bp, Homo sapiens
tagcattctcgataa

SEQ ID NO: 74715 - DNA, 15 bp, Homo sapiens
agcattctcgataaa

SEQ ID NO: 74716 - DNA, 15 bp, Homo sapiens
gcattctcgataaat

SEQ ID NO: 74717 - DNA, 15 bp, Homo sapiens
cattctcgataaatc

SEQ ID NO: 74718 - DNA, 15 bp, Homo sapiens
attctcgataaatct

SEQ ID NO: 74719 - DNA, 15 bp, Homo sapiens
ttctcgataaatctc

SEQ ID NO: 74720 - DNA, 15 bp, Homo sapiens
tctcgataaatctct

SEQ ID NO: 74721 - DNA, 15 bp, Homo sapiens
ctcgataaatctctc

SEQ ID NO: 74722 - DNA, 15 bp, Homo sapiens
tcgataaatctctct

SEQ ID NO: 74723 - DNA, 15 bp, Homo sapiens
cgataaatctctctg

SEQ ID NO: 74724 - DNA, 15 bp, Homo sapiens
gataaatctctctgt

SEQ ID NO: 74725 - DNA, 15 bp, Homo sapiens
ataaatctctctgtg

SEQ ID NO: 74726 - DNA, 15 bp, Homo sapiens
taaatctctctgtga

SEQ ID NO: 74727 - DNA, 15 bp, Homo sapiens
aaatctctctgtgaa

SEQ ID NO: 74728 - DNA, 15 bp, Homo sapiens
aatctctctgtgaaa

SEQ ID NO: 74729 - DNA, 15 bp, Homo sapiens
atctctctgtgaaag

SEQ ID NO: 74730 - DNA, 15 bp, Homo sapiens
tctctctgtgaaagt

SEQ ID NO: 74731 - DNA, 15 bp, Homo sapiens
ctctctgtgaaagtg

SEQ ID NO: 74732 - DNA, 15 bp, Homo sapiens
tctctgtgaaagtga

SEQ ID NO: 74733 - DNA, 15 bp, Homo sapiens
ctctgtgaaagtgac

SEQ ID NO: 74734 - DNA, 15 bp, Homo sapiens
tctgtgaaagtgact

SEQ ID NO: 74735 - DNA, 15 bp, Homo sapiens
ctgtgaaagtgactc

SEQ ID NO: 74736 - DNA, 15 bp, Homo sapiens
tgtgaaagtgactca

SEQ ID NO: 74737 - DNA, 15 bp, Homo sapiens
gtgaaagtgactcaa

SEQ ID NO: 74738 - DNA, 15 bp, Homo sapiens
tgaaagtgactcaag

SEQ ID NO: 74739 - DNA, 15 bp, Homo sapiens
gaaagtgactcaagg

SEQ ID NO: 74740 - DNA, 15 bp, Homo sapiens
aaagtgactcaaggt

SEQ ID NO: 74741 - DNA, 15 bp, Homo sapiens
aagtgactcaaggtc

SEQ ID NO: 74742 - DNA, 15 bp, Homo sapiens
agtgactcaaggtct

SEQ ID NO: 74743 - DNA, 15 bp, Homo sapiens
gtgactcaaggtctg

SEQ ID NO: 74744 - DNA, 15 bp, Homo sapiens
tgactcaaggtctgg

SEQ ID NO: 74745 - DNA, 15 bp, Homo sapiens
gactcaaggtctggg

SEQ ID NO: 74746 - DNA, 15 bp, Homo sapiens
actcaaggtctgggc

SEQ ID NO: 74747 - DNA, 15 bp, Homo sapiens
ctcaaggtctgggct

SEQ ID NO: 74748 - DNA, 15 bp, Homo sapiens
tcaaggtctgggctt

SEQ ID NO: 74749 - DNA, 15 bp, Homo sapiens
caaggtctgggcttt

SEQ ID NO: 74750 - DNA, 15 bp, Homo sapiens
aaggtctgggctttc

SEQ ID NO: 74751 - DNA, 15 bp, Homo sapiens
aggtctgggctttca

SEQ ID NO: 74752 - DNA, 15 bp, Homo sapiens
ggtctgggctttcat

SEQ ID NO: 74753 - DNA, 15 bp, Homo sapiens
gtctgggctttcatt

SEQ ID NO: 74754 - DNA, 15 bp, Homo sapiens
tctgggctttcatta

SEQ ID NO: 74755 - DNA, 15 bp, Homo sapiens
ctgggctttcattat

SEQ ID NO: 74756 - DNA, 15 bp, Homo sapiens
tgggctttcattata

SEQ ID NO: 74757 - DNA, 15 bp, Homo sapiens
gggctttcattataa

SEQ ID NO: 74758 - DNA, 15 bp, Homo sapiens
ggctttcattataag

SEQ ID NO: 74759 - DNA, 15 bp, Homo sapiens
gctttcattataaga

SEQ ID NO: 74760 - DNA, 15 bp, Homo sapiens
ctttcattataagac

SEQ ID NO: 74761 - DNA, 15 bp, Homo sapiens
tttcattataagaca

SEQ ID NO: 74762 - DNA, 15 bp, Homo sapiens
ttcattataagacag

SEQ ID NO: 74763 - DNA, 15 bp, Homo sapiens
tcattataagacaga

SEQ ID NO: 74764 - DNA, 15 bp, Homo sapiens
cattataagacagaa

SEQ ID NO: 74765 - DNA, 15 bp, Homo sapiens
attataagacagaag

SEQ ID NO: 74766 - DNA, 15 bp, Homo sapiens
ttataagacagaagt

SEQ ID NO: 74767 - DNA, 15 bp, Homo sapiens
tataagacagaagtc

SEQ ID NO: 74768 - DNA, 15 bp, Homo sapiens
ataagacagaagtcc

SEQ ID NO: 74769 - DNA, 15 bp, Homo sapiens
taagacagaagtccc

SEQ ID NO: 74770 - DNA, 15 bp, Homo sapiens
aagacagaagtcccc

SEQ ID NO: 74771 - DNA, 15 bp, Homo sapiens
agacagaagtccccc

SEQ ID NO: 74772 - DNA, 15 bp, Homo sapiens
gacagaagtccccct

SEQ ID NO: 74773 - DNA, 15 bp, Homo sapiens
acagaagtccccctc

SEQ ID NO: 74774 - DNA, 15 bp, Homo sapiens
cagaagtccccctcc

SEQ ID NO: 74775 - DNA, 15 bp, Homo sapiens
agaagtccccctcca

SEQ ID NO: 74776 - DNA, 15 bp, Homo sapiens
gaagtccccctccag

SEQ ID NO: 74777 - DNA, 15 bp, Homo sapiens
aagtccccctccagc

SEQ ID NO: 74778 - DNA, 15 bp, Homo sapiens
agtccccctccagct

SEQ ID NO: 74779 - DNA, 15 bp, Homo sapiens
gtccccctccagctc

SEQ ID NO: 74780 - DNA, 15 bp, Homo sapiens
tccccctccagctca

SEQ ID NO: 74781 - DNA, 15 bp, Homo sapiens
ccccctccagctcac

SEQ ID NO: 74782 - DNA, 15 bp, Homo sapiens
cccctccagctcaca

SEQ ID NO: 74783 - DNA, 15 bp, Homo sapiens
ccctccagctcacat

SEQ ID NO: 74784 - DNA, 15 bp, Homo sapiens
cctccagctcacatg

SEQ ID NO: 74785 - DNA, 15 bp, Homo sapiens
ctccagctcacatga

SEQ ID NO: 74786 - DNA, 15 bp, Homo sapiens
tccagctcacatgac

SEQ ID NO: 74787 - DNA, 15 bp, Homo sapiens
ccagctcacatgaca

SEQ ID NO: 74788 - DNA, 15 bp, Homo sapiens
cagctcacatgacag

SEQ ID NO: 74789 - DNA, 15 bp, Homo sapiens
agctcacatgacagc

SEQ ID NO: 74790 - DNA, 15 bp, Homo sapiens
gctcacatgacagca

SEQ ID NO: 74791 - DNA, 15 bp, Homo sapiens
ctcacatgacagcat

SEQ ID NO: 74792 - DNA, 15 bp, Homo sapiens
tcacatgacagcatg

SEQ ID NO: 74793 - DNA, 15 bp, Homo sapiens
cacatgacagcatgg

SEQ ID NO: 74794 - DNA, 15 bp, Homo sapiens
acatgacagcatggt

SEQ ID NO: 74795 - DNA, 15 bp, Homo sapiens
catgacagcatggtg

SEQ ID NO: 74796 - DNA, 15 bp, Homo sapiens
atgacagcatggtgc

SEQ ID NO: 74797 - DNA, 15 bp, Homo sapiens
tgacagcatggtgct

SEQ ID NO: 74798 - DNA, 15 bp, Homo sapiens
gacagcatggtgctg

SEQ ID NO: 74799 - DNA, 15 bp, Homo sapiens
acagcatggtgctgc

SEQ ID NO: 74800 - DNA, 15 bp, Homo sapiens
cagcatggtgctgcg

SEQ ID NO: 74801 - DNA, 15 bp, Homo sapiens
agcatggtgctgcgt

SEQ ID NO: 74802 - DNA, 15 bp, Homo sapiens
gcatggtgctgcgtt

SEQ ID NO: 74803 - DNA, 15 bp, Homo sapiens
catggtgctgcgttt

SEQ ID NO: 74804 - DNA, 15 bp, Homo sapiens
atggtgctgcgtttc

SEQ ID NO: 74805 - DNA, 15 bp, Homo sapiens
tggtgctgcgtttcc

SEQ ID NO: 74806 - DNA, 15 bp, Homo sapiens
ggtgctgcgtttcct

SEQ ID NO: 74807 - DNA, 15 bp, Homo sapiens
gtgctgcgtttcctc

SEQ ID NO: 74808 - DNA, 15 bp, Homo sapiens
tgctgcgtttcctca

SEQ ID NO: 74809 - DNA, 15 bp, Homo sapiens
gctgcgtttcctcat

SEQ ID NO: 74810 - DNA, 15 bp, Homo sapiens
ctgcgtttcctcatt

SEQ ID NO: 74811 - DNA, 15 bp, Homo sapiens
tgcgtttcctcattg

SEQ ID NO: 74812 - DNA, 15 bp, Homo sapiens
gcgtttcctcattgg

SEQ ID NO: 74813 - DNA, 15 bp, Homo sapiens
cgtttcctcattgga

SEQ ID NO: 74814 - DNA, 15 bp, Homo sapiens
gtttcctcattggat

SEQ ID NO: 74815 - DNA, 15 bp, Homo sapiens
tttcctcattggatc

SEQ ID NO: 74816 - DNA, 15 bp, Homo sapiens
ttcctcattggatct

SEQ ID NO: 74817 - DNA, 15 bp, Homo sapiens
tcctcattggatctg

SEQ ID NO: 74818 - DNA, 15 bp, Homo sapiens
cctcattggatctgg

SEQ ID NO: 74819 - DNA, 15 bp, Homo sapiens
ctcattggatctggc

SEQ ID NO: 74820 - DNA, 15 bp, Homo sapiens
tcattggatctggct

SEQ ID NO: 74821 - DNA, 15 bp, Homo sapiens
cattggatctggctg

SEQ ID NO: 74822 - DNA, 15 bp, Homo sapiens
attggatctggctgt

SEQ ID NO: 74823 - DNA, 15 bp, Homo sapiens
ttggatctggctgtc

SEQ ID NO: 74824 - DNA, 15 bp, Homo sapiens
tggatctggctgtcc

SEQ ID NO: 74825 - DNA, 15 bp, Homo sapiens
ggatctggctgtccc

SEQ ID NO: 74826 - DNA, 15 bp, Homo sapiens
gatctggctgtccct

SEQ ID NO: 74827 - DNA, 15 bp, Homo sapiens
atctggctgtccctg

SEQ ID NO: 74828 - DNA, 15 bp, Homo sapiens
tctggctgtccctgg

SEQ ID NO: 74829 - DNA, 15 bp, Homo sapiens
ctggctgtccctgga

SEQ ID NO: 74830 - DNA, 15 bp, Homo sapiens
tggctgtccctggac

SEQ ID NO: 74831 - DNA, 15 bp, Homo sapiens
ggctgtccctggaca

SEQ ID NO: 74832 - DNA, 15 bp, Homo sapiens
gctgtccctggacac

SEQ ID NO: 74833 - DNA, 15 bp, Homo sapiens
ctgtccctggacaca

SEQ ID NO: 74834 - DNA, 15 bp, Homo sapiens
tgtccctggacacag

SEQ ID NO: 74835 - DNA, 15 bp, Homo sapiens
gtccctggacacagg

SEQ ID NO: 74836 - DNA, 15 bp, Homo sapiens
tccctggacacaggt

SEQ ID NO: 74837 - DNA, 15 bp, Homo sapiens
ccctggacacaggta

SEQ ID NO: 74838 - DNA, 15 bp, Homo sapiens
cctggacacaggtag

SEQ ID NO: 74839 - DNA, 15 bp, Homo sapiens
ctggacacaggtagc

SEQ ID NO: 74840 - DNA, 15 bp, Homo sapiens
tggacacaggtagct

SEQ ID NO: 74841 - DNA, 15 bp, Homo sapiens
ggacacaggtagctg

SEQ ID NO: 74842 - DNA, 15 bp, Homo sapiens
gacacaggtagctgc

SEQ ID NO: 74843 - DNA, 15 bp, Homo sapiens
acacaggtagctgcc

SEQ ID NO: 74844 - DNA, 15 bp, Homo sapiens
cacaggtagctgcct

SEQ ID NO: 74845 - DNA, 15 bp, Homo sapiens
acaggtagctgcctt

SEQ ID NO: 74846 - DNA, 15 bp, Homo sapiens
caggtagctgccttc

SEQ ID NO: 74847 - DNA, 15 bp, Homo sapiens
aggtagctgccttca

SEQ ID NO: 74848 - DNA, 15 bp, Homo sapiens
ggtagctgccttcag

SEQ ID NO: 74849 - DNA, 15 bp, Homo sapiens
gtagctgccttcagg

SEQ ID NO: 74850 - DNA, 15 bp, Homo sapiens
tagctgccttcaggc

SEQ ID NO: 74851 - DNA, 15 bp, Homo sapiens
agctgccttcaggcc

SEQ ID NO: 74852 - DNA, 15 bp, Homo sapiens
gctgccttcaggcct

SEQ ID NO: 74853 - DNA, 15 bp, Homo sapiens
ctgccttcaggcctg

SEQ ID NO: 74854 - DNA, 15 bp, Homo sapiens
tgccttcaggcctgc

SEQ ID NO: 74855 - DNA, 15 bp, Homo sapiens
gccttcaggcctgcc

SEQ ID NO: 74856 - DNA, 15 bp, Homo sapiens
ccttcaggcctgcca

SEQ ID NO: 74857 - DNA, 15 bp, Homo sapiens
cttcaggcctgccac

SEQ ID NO: 74858 - DNA, 15 bp, Homo sapiens
ttcaggcctgccacg

SEQ ID NO: 74859 - DNA, 15 bp, Homo sapiens
tcaggcctgccacga

SEQ ID NO: 74860 - DNA, 15 bp, Homo sapiens
caggcctgccacgag

SEQ ID NO: 74861 - DNA, 15 bp, Homo sapiens
aggcctgccacgagc

SEQ ID NO: 74862 - DNA, 15 bp, Homo sapiens
ggcctgccacgagcg

SEQ ID NO: 74863 - DNA, 15 bp, Homo sapiens
gcctgccacgagcgg

SEQ ID NO: 74864 - DNA, 15 bp, Homo sapiens
cctgccacgagcggc

SEQ ID NO: 74865 - DNA, 15 bp, Homo sapiens
ctgccacgagcggcc

SEQ ID NO: 74866 - DNA, 15 bp, Homo sapiens
tgccacgagcggcca

SEQ ID NO: 74867 - DNA, 15 bp, Homo sapiens
gccacgagcggccaa

SEQ ID NO: 74868 - DNA, 15 bp, Homo sapiens
ccacgagcggccaag

SEQ ID NO: 74869 - DNA, 15 bp, Homo sapiens
cacgagcggccaagg

SEQ ID NO: 74870 - DNA, 15 bp, Homo sapiens
acgagcggccaaggg

SEQ ID NO: 74871 - DNA, 15 bp, Homo sapiens
cgagcggccaaggga

SEQ ID NO: 74872 - DNA, 15 bp, Homo sapiens
gagcggccaagggaa

SEQ ID NO: 74873 - DNA, 15 bp, Homo sapiens
agcggccaagggaag

SEQ ID NO: 74874 - DNA, 15 bp, Homo sapiens
gcggccaagggaagc

SEQ ID NO: 74875 - DNA, 15 bp, Homo sapiens
cggccaagggaagcc

SEQ ID NO: 74876 - DNA, 15 bp, Homo sapiens
ggccaagggaagcct

SEQ ID NO: 74877 - DNA, 15 bp, Homo sapiens
gccaagggaagcctc

SEQ ID NO: 74878 - DNA, 15 bp, Homo sapiens
ccaagggaagcctcc

SEQ ID NO: 74879 - DNA, 15 bp, Homo sapiens
caagggaagcctcct

SEQ ID NO: 74880 - DNA, 15 bp, Homo sapiens
aagggaagcctcctc

SEQ ID NO: 74881 - DNA, 15 bp, Homo sapiens
agggaagcctcctcc

SEQ ID NO: 74882 - DNA, 15 bp, Homo sapiens
gggaagcctcctcca

SEQ ID NO: 74883 - DNA, 15 bp, Homo sapiens
ggaagcctcctccat

SEQ ID NO: 74884 - DNA, 15 bp, Homo sapiens
gaagcctcctccata

SEQ ID NO: 74885 - DNA, 15 bp, Homo sapiens
aagcctcctccatat

SEQ ID NO: 74886 - DNA, 15 bp, Homo sapiens
agcctcctccatatg

SEQ ID NO: 74887 - DNA, 15 bp, Homo sapiens
gcctcctccatatgc

SEQ ID NO: 74888 - DNA, 15 bp, Homo sapiens
cctcctccatatgct

SEQ ID NO: 74889 - DNA, 15 bp, Homo sapiens
ctcctccatatgctg

SEQ ID NO: 74890 - DNA, 15 bp, Homo sapiens
tcctccatatgctgg

SEQ ID NO: 74891 - DNA, 15 bp, Homo sapiens
cctccatatgctggc

SEQ ID NO: 74892 - DNA, 15 bp, Homo sapiens
ctccatatgctggcc

SEQ ID NO: 74893 - DNA, 15 bp, Homo sapiens
tccatatgctggcct

SEQ ID NO: 74894 - DNA, 15 bp, Homo sapiens
ccatatgctggcctc

SEQ ID NO: 74895 - DNA, 15 bp, Homo sapiens
catatgctggcctcg

SEQ ID NO: 74896 - DNA, 15 bp, Homo sapiens
atatgctggcctcgc

SEQ ID NO: 74897 - DNA, 15 bp, Homo sapiens
tatgctggcctcgct

SEQ ID NO: 74898 - DNA, 15 bp, Homo sapiens
atgctggcctcgctg

SEQ ID NO: 74899 - DNA, 15 bp, Homo sapiens
tgctggcctcgctgg

SEQ ID NO: 74900 - DNA, 15 bp, Homo sapiens
gctggcctcgctggc

SEQ ID NO: 74901 - DNA, 15 bp, Homo sapiens
ctggcctcgctggcc

SEQ ID NO: 74902 - DNA, 15 bp, Homo sapiens
tggcctcgctggccc

SEQ ID NO: 74903 - DNA, 15 bp, Homo sapiens
ggcctcgctggcccc

SEQ ID NO: 74904 - DNA, 15 bp, Homo sapiens
gcctcgctggcccct

SEQ ID NO: 74905 - DNA, 15 bp, Homo sapiens
cctcgctggcccctc

SEQ ID NO: 74906 - DNA, 15 bp, Homo sapiens
ctcgctggcccctca

SEQ ID NO: 74907 - DNA, 15 bp, Homo sapiens
tcgctggcccctcag

SEQ ID NO: 74908 - DNA, 15 bp, Homo sapiens
cgctggcccctcagc

SEQ ID NO: 74909 - DNA, 15 bp, Homo sapiens
gctggcccctcagct

SEQ ID NO: 74910 - DNA, 15 bp, Homo sapiens
ctggcccctcagctt

SEQ ID NO: 74911 - DNA, 15 bp, Homo sapiens
tggcccctcagcttc

SEQ ID NO: 74912 - DNA, 15 bp, Homo sapiens
ggcccctcagcttct

SEQ ID NO: 74913 - DNA, 15 bp, Homo sapiens
gcccctcagcttctt

SEQ ID NO: 74914 - DNA, 15 bp, Homo sapiens
cccctcagcttcttc

SEQ ID NO: 74915 - DNA, 15 bp, Homo sapiens
ccctcagcttcttcc

SEQ ID NO: 74916 - DNA, 15 bp, Homo sapiens
cctcagcttcttcca

SEQ ID NO: 74917 - DNA, 15 bp, Homo sapiens
ctcagcttcttccaa

SEQ ID NO: 74918 - DNA, 15 bp, Homo sapiens
tcagcttcttccaag

SEQ ID NO: 74919 - DNA, 15 bp, Homo sapiens
cagcttcttccaagc

SEQ ID NO: 74920 - DNA, 15 bp, Homo sapiens
agcttcttccaagcc

SEQ ID NO: 74921 - DNA, 15 bp, Homo sapiens
gcttcttccaagcca

SEQ ID NO: 74922 - DNA, 15 bp, Homo sapiens
cttcttccaagccag

SEQ ID NO: 74923 - DNA, 15 bp, Homo sapiens
ttcttccaagccagt

SEQ ID NO: 74924 - DNA, 15 bp, Homo sapiens
tcttccaagccagtg

SEQ ID NO: 74925 - DNA, 15 bp, Homo sapiens
cttccaagccagtgc

SEQ ID NO: 74926 - DNA, 15 bp, Homo sapiens
ttccaagccagtgct

SEQ ID NO: 74927 - DNA, 15 bp, Homo sapiens
tccaagccagtgctc

SEQ ID NO: 74928 - DNA, 15 bp, Homo sapiens
ccaagccagtgctct

SEQ ID NO: 74929 - DNA, 15 bp, Homo sapiens
caagccagtgctctc

SEQ ID NO: 74930 - DNA, 15 bp, Homo sapiens
aagccagtgctctcc

SEQ ID NO: 74931 - DNA, 15 bp, Homo sapiens
agccagtgctctcca

SEQ ID NO: 74932 - DNA, 15 bp, Homo sapiens
gccagtgctctccag

SEQ ID NO: 74933 - DNA, 15 bp, Homo sapiens
ccagtgctctccagg

SEQ ID NO: 74934 - DNA, 15 bp, Homo sapiens
cagtgctctccaggc

SEQ ID NO: 74935 - DNA, 15 bp, Homo sapiens
agtgctctccaggca

SEQ ID NO: 74936 - DNA, 15 bp, Homo sapiens
gtgctctccaggcac

SEQ ID NO: 74937 - DNA, 15 bp, Homo sapiens
tgctctccaggcaca

SEQ ID NO: 74938 - DNA, 15 bp, Homo sapiens
gctctccaggcacac

SEQ ID NO: 74939 - DNA, 15 bp, Homo sapiens
ctctccaggcacact

SEQ ID NO: 74940 - DNA, 15 bp, Homo sapiens
tctccaggcacactg

SEQ ID NO: 74941 - DNA, 15 bp, Homo sapiens
ctccaggcacactgc

SEQ ID NO: 74942 - DNA, 15 bp, Homo sapiens
tccaggcacactgct

SEQ ID NO: 74943 - DNA, 15 bp, Homo sapiens
ccaggcacactgctc

SEQ ID NO: 74944 - DNA, 15 bp, Homo sapiens
caggcacactgctcc

SEQ ID NO: 74945 - DNA, 15 bp, Homo sapiens
aggcacactgctcca

SEQ ID NO: 74946 - DNA, 15 bp, Homo sapiens
ggcacactgctccag

SEQ ID NO: 74947 - DNA, 15 bp, Homo sapiens
gcacactgctccagc

SEQ ID NO: 74948 - DNA, 15 bp, Homo sapiens
cacactgctccagcg

SEQ ID NO: 74949 - DNA, 15 bp, Homo sapiens
acactgctccagcgt

SEQ ID NO: 74950 - DNA, 15 bp, Homo sapiens
cactgctccagcgtg

SEQ ID NO: 74951 - DNA, 15 bp, Homo sapiens
actgctccagcgtgt

SEQ ID NO: 74952 - DNA, 15 bp, Homo sapiens
ctgctccagcgtgtg

SEQ ID NO: 74953 - DNA, 15 bp, Homo sapiens
tgctccagcgtgtga

SEQ ID NO: 74954 - DNA, 15 bp, Homo sapiens
gctccagcgtgtgac

SEQ ID NO: 74955 - DNA, 15 bp, Homo sapiens
ctccagcgtgtgacg

SEQ ID NO: 74956 - DNA, 15 bp, Homo sapiens
tccagcgtgtgacgg

SEQ ID NO: 74957 - DNA, 15 bp, Homo sapiens
ccagcgtgtgacggg

SEQ ID NO: 74958 - DNA, 15 bp, Homo sapiens
cagcgtgtgacggga

SEQ ID NO: 74959 - DNA, 15 bp, Homo sapiens
agcgtgtgacgggaa

SEQ ID NO: 74960 - DNA, 15 bp, Homo sapiens
gcgtgtgacgggaag

SEQ ID NO: 74961 - DNA, 15 bp, Homo sapiens
cgtgtgacgggaagg

SEQ ID NO: 74962 - DNA, 15 bp, Homo sapiens
gtgtgacgggaaggg

SEQ ID NO: 74963 - DNA, 15 bp, Homo sapiens
tgtgacgggaagggc

SEQ ID NO: 74964 - DNA, 15 bp, Homo sapiens
gtgacgggaagggcc

SEQ ID NO: 74965 - DNA, 15 bp, Homo sapiens
tgacgggaagggcct

SEQ ID NO: 74966 - DNA, 15 bp, Homo sapiens
gacgggaagggcctg

SEQ ID NO: 74967 - DNA, 15 bp, Homo sapiens
acgggaagggcctgg

SEQ ID NO: 74968 - DNA, 15 bp, Homo sapiens
cgggaagggcctggc

SEQ ID NO: 74969 - DNA, 15 bp, Homo sapiens
gggaagggcctggca

SEQ ID NO: 74970 - DNA, 15 bp, Homo sapiens
ggaagggcctggcat

SEQ ID NO: 74971 - DNA, 15 bp, Homo sapiens
gaagggcctggcatg

SEQ ID NO: 74972 - DNA, 15 bp, Homo sapiens
aagggcctggcatga

SEQ ID NO: 74973 - DNA, 15 bp, Homo sapiens
agggcctggcatgag

SEQ ID NO: 74974 - DNA, 15 bp, Homo sapiens
gggcctggcatgagt

SEQ ID NO: 74975 - DNA, 15 bp, Homo sapiens
ggcctggcatgagtc

SEQ ID NO: 74976 - DNA, 15 bp, Homo sapiens
gcctggcatgagtca

SEQ ID NO: 74977 - DNA, 15 bp, Homo sapiens
cctggcatgagtcag

SEQ ID NO: 74978 - DNA, 15 bp, Homo sapiens
ctggcatgagtcagc

SEQ ID NO: 74979 - DNA, 15 bp, Homo sapiens
tggcatgagtcagcc

SEQ ID NO: 74980 - DNA, 15 bp, Homo sapiens
ggcatgagtcagcct

SEQ ID NO: 74981 - DNA, 15 bp, Homo sapiens
gcatgagtcagcctg

SEQ ID NO: 74982 - DNA, 15 bp, Homo sapiens
catgagtcagcctgc

SEQ ID NO: 74983 - DNA, 15 bp, Homo sapiens
atgagtcagcctgca

SEQ ID NO: 74984 - DNA, 15 bp, Homo sapiens
tgagtcagcctgcag

SEQ ID NO: 74985 - DNA, 15 bp, Homo sapiens
ttggctctcaggagc

SEQ ID NO: 74986 - DNA, 15 bp, Homo sapiens
tggctctcaggagca

SEQ ID NO: 74987 - DNA, 15 bp, Homo sapiens
ggctctcaggagcag

SEQ ID NO: 74988 - DNA, 15 bp, Homo sapiens
gctctcaggagcagc

SEQ ID NO: 74989 - DNA, 15 bp, Homo sapiens
ctctcaggagcagcc

SEQ ID NO: 74990 - DNA, 15 bp, Homo sapiens
tctcaggagcagcct

SEQ ID NO: 74991 - DNA, 15 bp, Homo sapiens
ctcaggagcagcctc

SEQ ID NO: 74992 - DNA, 15 bp, Homo sapiens
tcaggagcagcctca

SEQ ID NO: 74993 - DNA, 15 bp, Homo sapiens
caggagcagcctcac

SEQ ID NO: 74994 - DNA, 15 bp, Homo sapiens
aggagcagcctcacc

SEQ ID NO: 74995 - DNA, 15 bp, Homo sapiens
ggagcagcctcacca

SEQ ID NO: 74996 - DNA, 15 bp, Homo sapiens
gagcagcctcaccag

SEQ ID NO: 74997 - DNA, 15 bp, Homo sapiens
agcagcctcaccagg

SEQ ID NO: 74998 - DNA, 15 bp, Homo sapiens
gcagcctcaccaggt

SEQ ID NO: 74999 - DNA, 15 bp, Homo sapiens
cagcctcaccaggtt

SEQ ID NO: 75000 - DNA, 15 bp, Homo sapiens
agcctcaccaggttg

SEQ ID NO: 75001 - DNA, 15 bp, Homo sapiens
gcctcaccaggttgg

SEQ ID NO: 75002 - DNA, 15 bp, Homo sapiens
cctcaccaggttggt

SEQ ID NO: 75003 - DNA, 15 bp, Homo sapiens
ctcaccaggttggta

SEQ ID NO: 75004 - DNA, 15 bp, Homo sapiens
tcaccaggttggtaa

SEQ ID NO: 75005 - DNA, 15 bp, Homo sapiens
caccaggttggtaag

SEQ ID NO: 75006 - DNA, 15 bp, Homo sapiens
accaggttggtaagg

SEQ ID NO: 75007 - DNA, 15 bp, Homo sapiens
ccaggttggtaaggg

SEQ ID NO: 75008 - DNA, 15 bp, Homo sapiens
caggttggtaagggg

SEQ ID NO: 75009 - DNA, 15 bp, Homo sapiens
aggttggtaaggggc

SEQ ID NO: 75010 - DNA, 15 bp, Homo sapiens
ggttggtaaggggct

SEQ ID NO: 75011 - DNA, 15 bp, Homo sapiens
gttggtaaggggctg

SEQ ID NO: 75012 - DNA, 15 bp, Homo sapiens
ttggtaaggggctgg

SEQ ID NO: 75013 - DNA, 15 bp, Homo sapiens
tggtaaggggctgga

SEQ ID NO: 75014 - DNA, 15 bp, Homo sapiens
ggtaaggggctggag

SEQ ID NO: 75015 - DNA, 15 bp, Homo sapiens
gtaaggggctggagg

SEQ ID NO: 75016 - DNA, 15 bp, Homo sapiens
taaggggctggagga

SEQ ID NO: 75017 - DNA, 15 bp, Homo sapiens
aaggggctggaggag

SEQ ID NO: 75018 - DNA, 15 bp, Homo sapiens
aggggctggaggaga

SEQ ID NO: 75019 - DNA, 15 bp, Homo sapiens
ggggctggaggagac

SEQ ID NO: 75020 - DNA, 15 bp, Homo sapiens
gggctggaggagaca

SEQ ID NO: 75021 - DNA, 15 bp, Homo sapiens
ggctggaggagacaa

SEQ ID NO: 75022 - DNA, 15 bp, Homo sapiens
gctggaggagacaac

SEQ ID NO: 75023 - DNA, 15 bp, Homo sapiens
ctggaggagacaact

SEQ ID NO: 75024 - DNA, 15 bp, Homo sapiens
tggaggagacaactg

SEQ ID NO: 75025 - DNA, 15 bp, Homo sapiens
ggaggagacaactgc

SEQ ID NO: 75026 - DNA, 15 bp, Homo sapiens
gaggagacaactgct

SEQ ID NO: 75027 - DNA, 15 bp, Homo sapiens
aggagacaactgctc

SEQ ID NO: 75028 - DNA, 15 bp, Homo sapiens
ggagacaactgctca

SEQ ID NO: 75029 - DNA, 15 bp, Homo sapiens
gagacaactgctcaa

SEQ ID NO: 75030 - DNA, 15 bp, Homo sapiens
agacaactgctcaaa

SEQ ID NO: 75031 - DNA, 15 bp, Homo sapiens
gacaactgctcaaag

SEQ ID NO: 75032 - DNA, 15 bp, Homo sapiens
acaactgctcaaagg

SEQ ID NO: 75033 - DNA, 15 bp, Homo sapiens
caactgctcaaagga

SEQ ID NO: 75034 - DNA, 15 bp, Homo sapiens
aactgctcaaaggag

SEQ ID NO: 75035 - DNA, 15 bp, Homo sapiens
actgctcaaaggagt

SEQ ID NO: 75036 - DNA, 15 bp, Homo sapiens
ctgctcaaaggagtc

SEQ ID NO: 75037 - DNA, 15 bp, Homo sapiens
tgctcaaaggagtcc

SEQ ID NO: 75038 - DNA, 15 bp, Homo sapiens
gctcaaaggagtcca

SEQ ID NO: 75039 - DNA, 15 bp, Homo sapiens
ctcaaaggagtccag

SEQ ID NO: 75040 - DNA, 15 bp, Homo sapiens
tcaaaggagtccagc

SEQ ID NO: 75041 - DNA, 15 bp, Homo sapiens
caaaggagtccagct

SEQ ID NO: 75042 - DNA, 15 bp, Homo sapiens
aaaggagtccagctt

SEQ ID NO: 75043 - DNA, 15 bp, Homo sapiens
aaggagtccagcttc

SEQ ID NO: 75044 - DNA, 15 bp, Homo sapiens
aggagtccagcttca

SEQ ID NO: 75045 - DNA, 15 bp, Homo sapiens
ggagtccagcttcac

SEQ ID NO: 75046 - DNA, 15 bp, Homo sapiens
gagtccagcttcaca

SEQ ID NO: 75047 - DNA, 15 bp, Homo sapiens
agtccagcttcacat

SEQ ID NO: 75048 - DNA, 15 bp, Homo sapiens
gtccagcttcacatg

SEQ ID NO: 75049 - DNA, 15 bp, Homo sapiens
tccagcttcacatgc

SEQ ID NO: 75050 - DNA, 15 bp, Homo sapiens
ccagcttcacatgca

SEQ ID NO: 75051 - DNA, 15 bp, Homo sapiens
cagcttcacatgcac

SEQ ID NO: 75052 - DNA, 15 bp, Homo sapiens
agcttcacatgcaca

SEQ ID NO: 75053 - DNA, 15 bp, Homo sapiens
gcttcacatgcacat

SEQ ID NO: 75054 - DNA, 15 bp, Homo sapiens
cttcacatgcacatg

SEQ ID NO: 75055 - DNA, 15 bp, Homo sapiens
ttcacatgcacatgc

SEQ ID NO: 75056 - DNA, 15 bp, Homo sapiens
tcacatgcacatgct

SEQ ID NO: 75057 - DNA, 15 bp, Homo sapiens
cacatgcacatgcta

SEQ ID NO: 75058 - DNA, 15 bp, Homo sapiens
acatgcacatgctag

SEQ ID NO: 75059 - DNA, 15 bp, Homo sapiens
catgcacatgctaga

SEQ ID NO: 75060 - DNA, 15 bp, Homo sapiens
atgcacatgctagaa

SEQ ID NO: 75061 - DNA, 15 bp, Homo sapiens
tgcacatgctagaag

SEQ ID NO: 75062 - DNA, 15 bp, Homo sapiens
gcacatgctagaagg

SEQ ID NO: 75063 - DNA, 15 bp, Homo sapiens
cacatgctagaaggt

SEQ ID NO: 75064 - DNA, 15 bp, Homo sapiens
acatgctagaaggta

SEQ ID NO: 75065 - DNA, 15 bp, Homo sapiens
catgctagaaggtac

SEQ ID NO: 75066 - DNA, 15 bp, Homo sapiens
atgctagaaggtacc

SEQ ID NO: 75067 - DNA, 15 bp, Homo sapiens
tgctagaaggtaccc

SEQ ID NO: 75068 - DNA, 15 bp, Homo sapiens
gctagaaggtaccct

SEQ ID NO: 75069 - DNA, 15 bp, Homo sapiens
ctagaaggtaccctc

SEQ ID NO: 75070 - DNA, 15 bp, Homo sapiens
tagaaggtaccctcg

SEQ ID NO: 75071 - DNA, 15 bp, Homo sapiens
agaaggtaccctcgg

SEQ ID NO: 75072 - DNA, 15 bp, Homo sapiens
gaaggtaccctcgga

SEQ ID NO: 75073 - DNA, 15 bp, Homo sapiens
aaggtaccctcggaa

SEQ ID NO: 75074 - DNA, 15 bp, Homo sapiens
aggtaccctcggaag

SEQ ID NO: 75075 - DNA, 15 bp, Homo sapiens
ggtaccctcggaagg

SEQ ID NO: 75076 - DNA, 15 bp, Homo sapiens
gtaccctcggaaggc

SEQ ID NO: 75077 - DNA, 15 bp, Homo sapiens
taccctcggaaggcc

SEQ ID NO: 75078 - DNA, 15 bp, Homo sapiens
accctcggaaggcct

SEQ ID NO: 75079 - DNA, 15 bp, Homo sapiens
ccctcggaaggcctg

SEQ ID NO: 75080 - DNA, 15 bp, Homo sapiens
cctcggaaggcctgg

SEQ ID NO: 75081 - DNA, 15 bp, Homo sapiens
ctcggaaggcctggc

SEQ ID NO: 75082 - DNA, 15 bp, Homo sapiens
tcggaaggcctggcc

SEQ ID NO: 75083 - DNA, 15 bp, Homo sapiens
cggaaggcctggcct

SEQ ID NO: 75084 - DNA, 15 bp, Homo sapiens
ggaaggcctggcctt

SEQ ID NO: 75085 - DNA, 15 bp, Homo sapiens
gaaggcctggccttc

SEQ ID NO: 75086 - DNA, 15 bp, Homo sapiens
aaggcctggccttca

SEQ ID NO: 75087 - DNA, 15 bp, Homo sapiens
aggcctggccttcaa

SEQ ID NO: 75088 - DNA, 15 bp, Homo sapiens
ggcctggccttcaaa

SEQ ID NO: 75089 - DNA, 15 bp, Homo sapiens
gcctggccttcaaag

SEQ ID NO: 75090 - DNA, 15 bp, Homo sapiens
cctggccttcaaagg

SEQ ID NO: 75091 - DNA, 15 bp, Homo sapiens
ctggccttcaaaggt

SEQ ID NO: 75092 - DNA, 15 bp, Homo sapiens
tggccttcaaaggta

SEQ ID NO: 75093 - DNA, 15 bp, Homo sapiens
ggccttcaaaggtag

SEQ ID NO: 75094 - DNA, 15 bp, Homo sapiens
gccttcaaaggtaga

SEQ ID NO: 75095 - DNA, 15 bp, Homo sapiens
ccttcaaaggtagat

SEQ ID NO: 75096 - DNA, 15 bp, Homo sapiens
cttcaaaggtagatc

SEQ ID NO: 75097 - DNA, 15 bp, Homo sapiens
ttcaaaggtagatcc

SEQ ID NO: 75098 - DNA, 15 bp, Homo sapiens
tcaaaggtagatccc

SEQ ID NO: 75099 - DNA, 15 bp, Homo sapiens
caaaggtagatccca

SEQ ID NO: 75100 - DNA, 15 bp, Homo sapiens
aaaggtagatcccag

SEQ ID NO: 75101 - DNA, 15 bp, Homo sapiens
aaggtagatcccagg

SEQ ID NO: 75102 - DNA, 15 bp, Homo sapiens
aggtagatcccaggg

SEQ ID NO: 75103 - DNA, 15 bp, Homo sapiens
ggtagatcccagggt

SEQ ID NO: 75104 - DNA, 15 bp, Homo sapiens
gtagatcccagggtt

SEQ ID NO: 75105 - DNA, 15 bp, Homo sapiens
tagatcccagggttg

SEQ ID NO: 75106 - DNA, 15 bp, Homo sapiens
agatcccagggttga

SEQ ID NO: 75107 - DNA, 15 bp, Homo sapiens
gatcccagggttgaa

SEQ ID NO: 75108 - DNA, 15 bp, Homo sapiens
atcccagggttgaaa

SEQ ID NO: 75109 - DNA, 15 bp, Homo sapiens
tcccagggttgaaaa

SEQ ID NO: 75110 - DNA, 15 bp, Homo sapiens
cccagggttgaaaag

SEQ ID NO: 75111 - DNA, 15 bp, Homo sapiens
ccagggttgaaaagt

SEQ ID NO: 75112 - DNA, 15 bp, Homo sapiens
cagggttgaaaagtc

SEQ ID NO: 75113 - DNA, 15 bp, Homo sapiens
agggttgaaaagtca

SEQ ID NO: 75114 - DNA, 15 bp, Homo sapiens
gggttgaaaagtcaa

SEQ ID NO: 75115 - DNA, 15 bp, Homo sapiens
ggttgaaaagtcaac

SEQ ID NO: 75116 - DNA, 15 bp, Homo sapiens
gttgaaaagtcaact

SEQ ID NO: 75117 - DNA, 15 bp, Homo sapiens
ttgaaaagtcaactt

SEQ ID NO: 75118 - DNA, 15 bp, Homo sapiens
tgaaaagtcaacttg

SEQ ID NO: 75119 - DNA, 15 bp, Homo sapiens
gaaaagtcaacttgt

SEQ ID NO: 75120 - DNA, 15 bp, Homo sapiens
aaaagtcaacttgta

SEQ ID NO: 75121 - DNA, 15 bp, Homo sapiens
aaagtcaacttgtat

SEQ ID NO: 75122 - DNA, 15 bp, Homo sapiens
aagtcaacttgtatg

SEQ ID NO: 75123 - DNA, 15 bp, Homo sapiens
agtcaacttgtatgc

SEQ ID NO: 75124 - DNA, 15 bp, Homo sapiens
gtcaacttgtatgca

SEQ ID NO: 75125 - DNA, 15 bp, Homo sapiens
tcaacttgtatgcat

SEQ ID NO: 75126 - DNA, 15 bp, Homo sapiens
caacttgtatgcatt

SEQ ID NO: 75127 - DNA, 15 bp, Homo sapiens
aacttgtatgcattg

SEQ ID NO: 75128 - DNA, 15 bp, Homo sapiens
acttgtatgcattga

SEQ ID NO: 75129 - DNA, 15 bp, Homo sapiens
cttgtatgcattgag

SEQ ID NO: 75130 - DNA, 15 bp, Homo sapiens
ttgtatgcattgagc

SEQ ID NO: 75131 - DNA, 15 bp, Homo sapiens
tgtatgcattgagca

SEQ ID NO: 75132 - DNA, 15 bp, Homo sapiens
gtatgcattgagcat

SEQ ID NO: 75133 - DNA, 15 bp, Homo sapiens
tatgcattgagcatc

SEQ ID NO: 75134 - DNA, 15 bp, Homo sapiens
atgcattgagcatct

SEQ ID NO: 75135 - DNA, 15 bp, Homo sapiens
tgcattgagcatctc

SEQ ID NO: 75136 - DNA, 15 bp, Homo sapiens
gcattgagcatctcg

SEQ ID NO: 75137 - DNA, 15 bp, Homo sapiens
cattgagcatctcgt

SEQ ID NO: 75138 - DNA, 15 bp, Homo sapiens
attgagcatctcgta

SEQ ID NO: 75139 - DNA, 15 bp, Homo sapiens
ttgagcatctcgtat

SEQ ID NO: 75140 - DNA, 15 bp, Homo sapiens
tgagcatctcgtatg

SEQ ID NO: 75141 - DNA, 15 bp, Homo sapiens
gagcatctcgtatgc

SEQ ID NO: 75142 - DNA, 15 bp, Homo sapiens
agcatctcgtatgcc

SEQ ID NO: 75143 - DNA, 15 bp, Homo sapiens
gcatctcgtatgcca

SEQ ID NO: 75144 - DNA, 15 bp, Homo sapiens
catctcgtatgccag

SEQ ID NO: 75145 - DNA, 15 bp, Homo sapiens
atctcgtatgccagc

SEQ ID NO: 75146 - DNA, 15 bp, Homo sapiens
tctcgtatgccagcc

SEQ ID NO: 75147 - DNA, 15 bp, Homo sapiens
ctcgtatgccagccc

SEQ ID NO: 75148 - DNA, 15 bp, Homo sapiens
tcgtatgccagccct

SEQ ID NO: 75149 - DNA, 15 bp, Homo sapiens
cgtatgccagccctg

SEQ ID NO: 75150 - DNA, 15 bp, Homo sapiens
gtatgccagccctgt

SEQ ID NO: 75151 - DNA, 15 bp, Homo sapiens
tatgccagccctgtt

SEQ ID NO: 75152 - DNA, 15 bp, Homo sapiens
atgccagccctgttc

SEQ ID NO: 75153 - DNA, 15 bp, Homo sapiens
tgccagccctgttcc

SEQ ID NO: 75154 - DNA, 15 bp, Homo sapiens
gccagccctgttccg

SEQ ID NO: 75155 - DNA, 15 bp, Homo sapiens
ccagccctgttccgt

SEQ ID NO: 75156 - DNA, 15 bp, Homo sapiens
cagccctgttccgtg

SEQ ID NO: 75157 - DNA, 15 bp, Homo sapiens
agccctgttccgtga

SEQ ID NO: 75158 - DNA, 15 bp, Homo sapiens
gccctgttccgtgag

SEQ ID NO: 75159 - DNA, 15 bp, Homo sapiens
ccctgttccgtgagc

SEQ ID NO: 75160 - DNA, 15 bp, Homo sapiens
cctgttccgtgagct

SEQ ID NO: 75161 - DNA, 15 bp, Homo sapiens
ctgttccgtgagctg

SEQ ID NO: 75162 - DNA, 15 bp, Homo sapiens
tgttccgtgagctga

SEQ ID NO: 75163 - DNA, 15 bp, Homo sapiens
gttccgtgagctgat

SEQ ID NO: 75164 - DNA, 15 bp, Homo sapiens
ttccgtgagctgatg

SEQ ID NO: 75165 - DNA, 15 bp, Homo sapiens
tccgtgagctgatgg

SEQ ID NO: 75166 - DNA, 15 bp, Homo sapiens
ccgtgagctgatggg

SEQ ID NO: 75167 - DNA, 15 bp, Homo sapiens
cgtgagctgatgggc

SEQ ID NO: 75168 - DNA, 15 bp, Homo sapiens
gtgagctgatgggcc

SEQ ID NO: 75169 - DNA, 15 bp, Homo sapiens
tgagctgatgggcct

SEQ ID NO: 75170 - DNA, 15 bp, Homo sapiens
gagctgatgggcctt

SEQ ID NO: 75171 - DNA, 15 bp, Homo sapiens
agctgatgggccttt

SEQ ID NO: 75172 - DNA, 15 bp, Homo sapiens
gctgatgggcctttg

SEQ ID NO: 75173 - DNA, 15 bp, Homo sapiens
ctgatgggcctttgt

SEQ ID NO: 75174 - DNA, 15 bp, Homo sapiens
tgatgggcctttgtg

SEQ ID NO: 75175 - DNA, 15 bp, Homo sapiens
gatgggcctttgtgt

SEQ ID NO: 75176 - DNA, 15 bp, Homo sapiens
atgggcctttgtgtg

SEQ ID NO: 75177 - DNA, 15 bp, Homo sapiens
tgggcctttgtgtgt

SEQ ID NO: 75178 - DNA, 15 bp, Homo sapiens
gggcctttgtgtgta

SEQ ID NO: 75179 - DNA, 15 bp, Homo sapiens
ggcctttgtgtgtaa

SEQ ID NO: 75180 - DNA, 15 bp, Homo sapiens
gcctttgtgtgtaag

SEQ ID NO: 75181 - DNA, 15 bp, Homo sapiens
cctttgtgtgtaagt

SEQ ID NO: 75182 - DNA, 15 bp, Homo sapiens
ctttgtgtgtaagta

SEQ ID NO: 75183 - DNA, 15 bp, Homo sapiens
tttgtgtgtaagtag

SEQ ID NO: 75184 - DNA, 15 bp, Homo sapiens
ttgtgtgtaagtagg

SEQ ID NO: 75185 - DNA, 15 bp, Homo sapiens
tgtgtgtaagtagga

SEQ ID NO: 75186 - DNA, 15 bp, Homo sapiens
gtgtgtaagtaggac

SEQ ID NO: 75187 - DNA, 15 bp, Homo sapiens
tgtgtaagtaggacc

SEQ ID NO: 75188 - DNA, 15 bp, Homo sapiens
gtgtaagtaggacca

SEQ ID NO: 75189 - DNA, 15 bp, Homo sapiens
tgtaagtaggaccaa

SEQ ID NO: 75190 - DNA, 15 bp, Homo sapiens
gtaagtaggaccaag

SEQ ID NO: 75191 - DNA, 15 bp, Homo sapiens
taagtaggaccaagt

SEQ ID NO: 75192 - DNA, 15 bp, Homo sapiens
aagtaggaccaagtg

SEQ ID NO: 75193 - DNA, 15 bp, Homo sapiens
agtaggaccaagtgc

SEQ ID NO: 75194 - DNA, 15 bp, Homo sapiens
gtaggaccaagtgcc

SEQ ID NO: 75195 - DNA, 15 bp, Homo sapiens
taggaccaagtgccc

SEQ ID NO: 75196 - DNA, 15 bp, Homo sapiens
aggaccaagtgcccc

SEQ ID NO: 75197 - DNA, 15 bp, Homo sapiens
ggaccaagtgccccc

SEQ ID NO: 75198 - DNA, 15 bp, Homo sapiens
gaccaagtgcccccg

SEQ ID NO: 75199 - DNA, 15 bp, Homo sapiens
accaagtgcccccgt

SEQ ID NO: 75200 - DNA, 15 bp, Homo sapiens
ccaagtgcccccgtg

SEQ ID NO: 75201 - DNA, 15 bp, Homo sapiens
caagtgcccccgtgg

SEQ ID NO: 75202 - DNA, 15 bp, Homo sapiens
aagtgcccccgtgga

SEQ ID NO: 75203 - DNA, 15 bp, Homo sapiens
agtgcccccgtggag

SEQ ID NO: 75204 - DNA, 15 bp, Homo sapiens
gtgcccccgtggagg

SEQ ID NO: 75205 - DNA, 15 bp, Homo sapiens
tgcccccgtggaggt

SEQ ID NO: 75206 - DNA, 15 bp, Homo sapiens
gcccccgtggaggtt

SEQ ID NO: 75207 - DNA, 15 bp, Homo sapiens
cccccgtggaggtta

SEQ ID NO: 75208 - DNA, 15 bp, Homo sapiens
ccccgtggaggttag

SEQ ID NO: 75209 - DNA, 15 bp, Homo sapiens
cccgtggaggttagc

SEQ ID NO: 75210 - DNA, 15 bp, Homo sapiens
ccgtggaggttagca

SEQ ID NO: 75211 - DNA, 15 bp, Homo sapiens
cgtggaggttagcat

SEQ ID NO: 75212 - DNA, 15 bp, Homo sapiens
gtggaggttagcatg

SEQ ID NO: 75213 - DNA, 15 bp, Homo sapiens
tggaggttagcatgg

SEQ ID NO: 75214 - DNA, 15 bp, Homo sapiens
ggaggttagcatggg

SEQ ID NO: 75215 - DNA, 15 bp, Homo sapiens
gaggttagcatgggt

SEQ ID NO: 75216 - DNA, 15 bp, Homo sapiens
aggttagcatgggtg

SEQ ID NO: 75217 - DNA, 15 bp, Homo sapiens
ggttagcatgggtgt

SEQ ID NO: 75218 - DNA, 15 bp, Homo sapiens
gttagcatgggtgtg

SEQ ID NO: 75219 - DNA, 15 bp, Homo sapiens
ttagcatgggtgtgc

SEQ ID NO: 75220 - DNA, 15 bp, Homo sapiens
tagcatgggtgtgca

SEQ ID NO: 75221 - DNA, 15 bp, Homo sapiens
agcatgggtgtgcag

SEQ ID NO: 75222 - DNA, 15 bp, Homo sapiens
gcatgggtgtgcagt

SEQ ID NO: 75223 - DNA, 15 bp, Homo sapiens
catgggtgtgcagtc

SEQ ID NO: 75224 - DNA, 15 bp, Homo sapiens
atgggtgtgcagtca

SEQ ID NO: 75225 - DNA, 15 bp, Homo sapiens
tgggtgtgcagtcat

SEQ ID NO: 75226 - DNA, 15 bp, Homo sapiens
gggtgtgcagtcatt

SEQ ID NO: 75227 - DNA, 15 bp, Homo sapiens
ggtgtgcagtcattt

SEQ ID NO: 75228 - DNA, 15 bp, Homo sapiens
gtgtgcagtcatttc

SEQ ID NO: 75229 - DNA, 15 bp, Homo sapiens
tgtgcagtcatttca

SEQ ID NO: 75230 - DNA, 15 bp, Homo sapiens
gtgcagtcatttcag

SEQ ID NO: 75231 - DNA, 15 bp, Homo sapiens
tgcagtcatttcaga

SEQ ID NO: 75232 - DNA, 15 bp, Homo sapiens
gcagtcatttcagat

SEQ ID NO: 75233 - DNA, 15 bp, Homo sapiens
cagtcatttcagata

SEQ ID NO: 75234 - DNA, 15 bp, Homo sapiens
agtcatttcagatac

SEQ ID NO: 75235 - DNA, 15 bp, Homo sapiens
gtcatttcagatact

SEQ ID NO: 75236 - DNA, 15 bp, Homo sapiens
tcatttcagatactt

SEQ ID NO: 75237 - DNA, 15 bp, Homo sapiens
catttcagatacttg

SEQ ID NO: 75238 - DNA, 15 bp, Homo sapiens
atttcagatacttga

SEQ ID NO: 75239 - DNA, 15 bp, Homo sapiens
tttcagatacttgag

SEQ ID NO: 75240 - DNA, 15 bp, Homo sapiens
ttcagatacttgagt

SEQ ID NO: 75241 - DNA, 15 bp, Homo sapiens
tcagatacttgagtt

SEQ ID NO: 75242 - DNA, 15 bp, Homo sapiens
cagatacttgagttg

SEQ ID NO: 75243 - DNA, 15 bp, Homo sapiens
agatacttgagttgg

SEQ ID NO: 75244 - DNA, 15 bp, Homo sapiens
gatacttgagttggt

SEQ ID NO: 75245 - DNA, 15 bp, Homo sapiens
atacttgagttggta

SEQ ID NO: 75246 - DNA, 15 bp, Homo sapiens
tacttgagttggtac

SEQ ID NO: 75247 - DNA, 15 bp, Homo sapiens
acttgagttggtaca

SEQ ID NO: 75248 - DNA, 15 bp, Homo sapiens
cttgagttggtacat

SEQ ID NO: 75249 - DNA, 15 bp, Homo sapiens
ttgagttggtacatc

SEQ ID NO: 75250 - DNA, 15 bp, Homo sapiens
tgagttggtacatct

SEQ ID NO: 75251 - DNA, 15 bp, Homo sapiens
gagttggtacatctc

SEQ ID NO: 75252 - DNA, 15 bp, Homo sapiens
agttggtacatctca

SEQ ID NO: 75253 - DNA, 15 bp, Homo sapiens
gttggtacatctcag

SEQ ID NO: 75254 - DNA, 15 bp, Homo sapiens
ttggtacatctcagt

SEQ ID NO: 75255 - DNA, 15 bp, Homo sapiens
tggtacatctcagta

SEQ ID NO: 75256 - DNA, 15 bp, Homo sapiens
ggtacatctcagtaa

SEQ ID NO: 75257 - DNA, 15 bp, Homo sapiens
gtacatctcagtaaa

SEQ ID NO: 75258 - DNA, 15 bp, Homo sapiens
tacatctcagtaaag

SEQ ID NO: 75259 - DNA, 15 bp, Homo sapiens
acatctcagtaaagt

SEQ ID NO: 75260 - DNA, 15 bp, Homo sapiens
catctcagtaaagtc

SEQ ID NO: 75261 - DNA, 15 bp, Homo sapiens
atctcagtaaagtct

SEQ ID NO: 75262 - DNA, 15 bp, Homo sapiens
tctcagtaaagtctg

SEQ ID NO: 75263 - DNA, 15 bp, Homo sapiens
ctcagtaaagtctgt

SEQ ID NO: 75264 - DNA, 15 bp, Homo sapiens
tcagtaaagtctgtc

SEQ ID NO: 75265 - DNA, 15 bp, Homo sapiens
cagtaaagtctgtcc

SEQ ID NO: 75266 - DNA, 15 bp, Homo sapiens
agtaaagtctgtccc

SEQ ID NO: 75267 - DNA, 15 bp, Homo sapiens
gtaaagtctgtcccg

SEQ ID NO: 75268 - DNA, 15 bp, Homo sapiens
taaagtctgtcccgt

SEQ ID NO: 75269 - DNA, 15 bp, Homo sapiens
aaagtctgtcccgtg

SEQ ID NO: 75270 - DNA, 15 bp, Homo sapiens
aagtctgtcccgtga

SEQ ID NO: 75271 - DNA, 15 bp, Homo sapiens
agtctgtcccgtgag

SEQ ID NO: 75272 - DNA, 15 bp, Homo sapiens
gtctgtcccgtgaga

SEQ ID NO: 75273 - DNA, 15 bp, Homo sapiens
tctgtcccgtgagaa

SEQ ID NO: 75274 - DNA, 15 bp, Homo sapiens
ctgtcccgtgagaag

SEQ ID NO: 75275 - DNA, 15 bp, Homo sapiens
tgtcccgtgagaagc

SEQ ID NO: 75276 - DNA, 15 bp, Homo sapiens
gtcccgtgagaagcc

SEQ ID NO: 75277 - DNA, 15 bp, Homo sapiens
tcccgtgagaagcca

SEQ ID NO: 75278 - DNA, 15 bp, Homo sapiens
cccgtgagaagccat

SEQ ID NO: 75279 - DNA, 15 bp, Homo sapiens
ccgtgagaagccatg

SEQ ID NO: 75280 - DNA, 15 bp, Homo sapiens
cgtgagaagccatgg

SEQ ID NO: 75281 - DNA, 15 bp, Homo sapiens
gtgagaagccatggg

SEQ ID NO: 75282 - DNA, 15 bp, Homo sapiens
tgagaagccatgggt

SEQ ID NO: 75283 - DNA, 15 bp, Homo sapiens
gagaagccatgggtt

SEQ ID NO: 75284 - DNA, 15 bp, Homo sapiens
agaagccatgggttt

SEQ ID NO: 75285 - DNA, 15 bp, Homo sapiens
gaagccatgggtttc

SEQ ID NO: 75286 - DNA, 15 bp, Homo sapiens
aagccatgggtttca

SEQ ID NO: 75287 - DNA, 15 bp, Homo sapiens
agccatgggtttcat

SEQ ID NO: 75288 - DNA, 15 bp, Homo sapiens
gccatgggtttcatg

SEQ ID NO: 75289 - DNA, 15 bp, Homo sapiens
ccatgggtttcatgg

SEQ ID NO: 75290 - DNA, 15 bp, Homo sapiens
catgggtttcatggt

SEQ ID NO: 75291 - DNA, 15 bp, Homo sapiens
atgggtttcatggta

SEQ ID NO: 75292 - DNA, 15 bp, Homo sapiens
tgggtttcatggtat

SEQ ID NO: 75293 - DNA, 15 bp, Homo sapiens
gggtttcatggtatg

SEQ ID NO: 75294 - DNA, 15 bp, Homo sapiens
ggtttcatggtatgg

SEQ ID NO: 75295 - DNA, 15 bp, Homo sapiens
gtttcatggtatggt

SEQ ID NO: 75296 - DNA, 15 bp, Homo sapiens
tttcatggtatggtt

SEQ ID NO: 75297 - DNA, 15 bp, Homo sapiens
ttcatggtatggttg

SEQ ID NO: 75298 - DNA, 15 bp, Homo sapiens
tcatggtatggttgg

SEQ ID NO: 75299 - DNA, 15 bp, Homo sapiens
catggtatggttggc

SEQ ID NO: 75300 - DNA, 15 bp, Homo sapiens
atggtatggttggca

SEQ ID NO: 75301 - DNA, 15 bp, Homo sapiens
tggtatggttggcat

SEQ ID NO: 75302 - DNA, 15 bp, Homo sapiens
ggtatggttggcatc

SEQ ID NO: 75303 - DNA, 15 bp, Homo sapiens
gtatggttggcatct

SEQ ID NO: 75304 - DNA, 15 bp, Homo sapiens
tatggttggcatctt

SEQ ID NO: 75305 - DNA, 15 bp, Homo sapiens
atggttggcatcttc

SEQ ID NO: 75306 - DNA, 15 bp, Homo sapiens
tggttggcatcttcc

SEQ ID NO: 75307 - DNA, 15 bp, Homo sapiens
ggttggcatcttcct

SEQ ID NO: 75308 - DNA, 15 bp, Homo sapiens
gttggcatcttcctt

SEQ ID NO: 75309 - DNA, 15 bp, Homo sapiens
ttggcatcttccttg

SEQ ID NO: 75310 - DNA, 15 bp, Homo sapiens
tggcatcttccttgg

SEQ ID NO: 75311 - DNA, 15 bp, Homo sapiens
ggcatcttccttggg

SEQ ID NO: 75312 - DNA, 15 bp, Homo sapiens
gcatcttccttggga

SEQ ID NO: 75313 - DNA, 15 bp, Homo sapiens
catcttccttgggag

SEQ ID NO: 75314 - DNA, 15 bp, Homo sapiens
atcttccttgggagt

SEQ ID NO: 75315 - DNA, 15 bp, Homo sapiens
tcttccttgggagtg

SEQ ID NO: 75316 - DNA, 15 bp, Homo sapiens
cttccttgggagtgg

SEQ ID NO: 75317 - DNA, 15 bp, Homo sapiens
ttccttgggagtggc

SEQ ID NO: 75318 - DNA, 15 bp, Homo sapiens
tccttgggagtggcc

SEQ ID NO: 75319 - DNA, 15 bp, Homo sapiens
ccttgggagtggcca

SEQ ID NO: 75320 - DNA, 15 bp, Homo sapiens
cttgggagtggccac

SEQ ID NO: 75321 - DNA, 15 bp, Homo sapiens
ttgggagtggccaca

SEQ ID NO: 75322 - DNA, 15 bp, Homo sapiens
tgggagtggccacag

SEQ ID NO: 75323 - DNA, 15 bp, Homo sapiens
gggagtggccacagt

SEQ ID NO: 75324 - DNA, 15 bp, Homo sapiens
ggagtggccacagtg

SEQ ID NO: 75325 - DNA, 15 bp, Homo sapiens
gagtggccacagtgg

SEQ ID NO: 75326 - DNA, 15 bp, Homo sapiens
agtggccacagtggt

SEQ ID NO: 75327 - DNA, 15 bp, Homo sapiens
gtggccacagtggtg

SEQ ID NO: 75328 - DNA, 15 bp, Homo sapiens
tggccacagtggtgg

SEQ ID NO: 75329 - DNA, 15 bp, Homo sapiens
ggccacagtggtggt

SEQ ID NO: 75330 - DNA, 15 bp, Homo sapiens
gccacagtggtggtg

SEQ ID NO: 75331 - DNA, 15 bp, Homo sapiens
ccacagtggtggtgg

SEQ ID NO: 75332 - DNA, 15 bp, Homo sapiens
cacagtggtggtggc

SEQ ID NO: 75333 - DNA, 15 bp, Homo sapiens
acagtggtggtggct

SEQ ID NO: 75334 - DNA, 15 bp, Homo sapiens
cagtggtggtggctt

SEQ ID NO: 75335 - DNA, 15 bp, Homo sapiens
agtggtggtggcttc

SEQ ID NO: 75336 - DNA, 15 bp, Homo sapiens
gtggtggtggcttca

SEQ ID NO: 75337 - DNA, 15 bp, Homo sapiens
tggtggtggcttcag

SEQ ID NO: 75338 - DNA, 15 bp, Homo sapiens
ggtggtggcttcagg

SEQ ID NO: 75339 - DNA, 15 bp, Homo sapiens
gtggtggcttcagga

SEQ ID NO: 75340 - DNA, 15 bp, Homo sapiens
tggtggcttcaggaa

SEQ ID NO: 75341 - DNA, 15 bp, Homo sapiens
ggtggcttcaggaaa

SEQ ID NO: 75342 - DNA, 15 bp, Homo sapiens
gtggcttcaggaaag

SEQ ID NO: 75343 - DNA, 15 bp, Homo sapiens
tggcttcaggaaaga

SEQ ID NO: 75344 - DNA, 15 bp, Homo sapiens
ggcttcaggaaagag

SEQ ID NO: 75345 - DNA, 15 bp, Homo sapiens
gcttcaggaaagaga

SEQ ID NO: 75346 - DNA, 15 bp, Homo sapiens
cttcaggaaagagac

SEQ ID NO: 75347 - DNA, 15 bp, Homo sapiens
ttcaggaaagagact

SEQ ID NO: 75348 - DNA, 15 bp, Homo sapiens
tcaggaaagagactc

SEQ ID NO: 75349 - DNA, 15 bp, Homo sapiens
caggaaagagactcc

SEQ ID NO: 75350 - DNA, 15 bp, Homo sapiens
aggaaagagactcca

SEQ ID NO: 75351 - DNA, 15 bp, Homo sapiens
ggaaagagactccaa

SEQ ID NO: 75352 - DNA, 15 bp, Homo sapiens
gaaagagactccaac

SEQ ID NO: 75353 - DNA, 15 bp, Homo sapiens
aaagagactccaaca

SEQ ID NO: 75354 - DNA, 15 bp, Homo sapiens
aagagactccaacag

SEQ ID NO: 75355 - DNA, 15 bp, Homo sapiens
agagactccaacagg

SEQ ID NO: 75356 - DNA, 15 bp, Homo sapiens
gagactccaacaggg

SEQ ID NO: 75357 - DNA, 15 bp, Homo sapiens
agactccaacagggg

SEQ ID NO: 75358 - DNA, 15 bp, Homo sapiens
gactccaacaggggc

SEQ ID NO: 75359 - DNA, 15 bp, Homo sapiens
actccaacaggggcc

SEQ ID NO: 75360 - DNA, 15 bp, Homo sapiens
ctccaacaggggcca

SEQ ID NO: 75361 - DNA, 15 bp, Homo sapiens
tccaacaggggccag

SEQ ID NO: 75362 - DNA, 15 bp, Homo sapiens
ccaacaggggccagc

SEQ ID NO: 75363 - DNA, 15 bp, Homo sapiens
caacaggggccagct

SEQ ID NO: 75364 - DNA, 15 bp, Homo sapiens
aacaggggccagctg

SEQ ID NO: 75365 - DNA, 15 bp, Homo sapiens
acaggggccagctgt

SEQ ID NO: 75366 - DNA, 15 bp, Homo sapiens
caggggccagctgtg

SEQ ID NO: 75367 - DNA, 15 bp, Homo sapiens
aggggccagctgtgg

SEQ ID NO: 75368 - DNA, 15 bp, Homo sapiens
ggggccagctgtggg

SEQ ID NO: 75369 - DNA, 15 bp, Homo sapiens
gggccagctgtgggc

SEQ ID NO: 75370 - DNA, 15 bp, Homo sapiens
ggccagctgtgggcc

SEQ ID NO: 75371 - DNA, 15 bp, Homo sapiens
gccagctgtgggcct

SEQ ID NO: 75372 - DNA, 15 bp, Homo sapiens
ccagctgtgggcctt

SEQ ID NO: 75373 - DNA, 15 bp, Homo sapiens
cagctgtgggccttg

SEQ ID NO: 75374 - DNA, 15 bp, Homo sapiens
agctgtgggccttgg

SEQ ID NO: 75375 - DNA, 15 bp, Homo sapiens
gctgtgggccttggg

SEQ ID NO: 75376 - DNA, 15 bp, Homo sapiens
ctgtgggccttgggc

SEQ ID NO: 75377 - DNA, 15 bp, Homo sapiens
tgtgggccttgggca

SEQ ID NO: 75378 - DNA, 15 bp, Homo sapiens
gtgggccttgggcac

SEQ ID NO: 75379 - DNA, 15 bp, Homo sapiens
tgggccttgggcact

SEQ ID NO: 75380 - DNA, 15 bp, Homo sapiens
gggccttgggcactt

SEQ ID NO: 75381 - DNA, 15 bp, Homo sapiens
ggccttgggcacttc

SEQ ID NO: 75382 - DNA, 15 bp, Homo sapiens
gccttgggcacttct

SEQ ID NO: 75383 - DNA, 15 bp, Homo sapiens
ccttgggcacttctc

SEQ ID NO: 75384 - DNA, 15 bp, Homo sapiens
cttgggcacttctcg

SEQ ID NO: 75385 - DNA, 15 bp, Homo sapiens
ttgggcacttctcgt

SEQ ID NO: 75386 - DNA, 15 bp, Homo sapiens
tgggcacttctcgtt

SEQ ID NO: 75387 - DNA, 15 bp, Homo sapiens
gggcacttctcgttt

SEQ ID NO: 75388 - DNA, 15 bp, Homo sapiens
ggcacttctcgtttc

SEQ ID NO: 75389 - DNA, 15 bp, Homo sapiens
gcacttctcgtttct

SEQ ID NO: 75390 - DNA, 15 bp, Homo sapiens
cacttctcgtttcta

SEQ ID NO: 75391 - DNA, 15 bp, Homo sapiens
acttctcgtttctag

SEQ ID NO: 75392 - DNA, 15 bp, Homo sapiens
cttctcgtttctagg

SEQ ID NO: 75393 - DNA, 15 bp, Homo sapiens
ttctcgtttctagga

SEQ ID NO: 75394 - DNA, 15 bp, Homo sapiens
tctcgtttctaggaa

SEQ ID NO: 75395 - DNA, 15 bp, Homo sapiens
ctcgtttctaggaaa

SEQ ID NO: 75396 - DNA, 15 bp, Homo sapiens
tcgtttctaggaaaa

SEQ ID NO: 75397 - DNA, 15 bp, Homo sapiens
cgtttctaggaaaag

SEQ ID NO: 75398 - DNA, 15 bp, Homo sapiens
gtttctaggaaaagt

SEQ ID NO: 75399 - DNA, 15 bp, Homo sapiens
tttctaggaaaagtc

SEQ ID NO: 75400 - DNA, 15 bp, Homo sapiens
ttctaggaaaagtcc

SEQ ID NO: 75401 - DNA, 15 bp, Homo sapiens
tctaggaaaagtcct

SEQ ID NO: 75402 - DNA, 15 bp, Homo sapiens
ctaggaaaagtccta

SEQ ID NO: 75403 - DNA, 15 bp, Homo sapiens
taggaaaagtcctaa

SEQ ID NO: 75404 - DNA, 15 bp, Homo sapiens
aggaaaagtcctaag

SEQ ID NO: 75405 - DNA, 15 bp, Homo sapiens
ggaaaagtcctaagt

SEQ ID NO: 75406 - DNA, 15 bp, Homo sapiens
gaaaagtcctaagtc

SEQ ID NO: 75407 - DNA, 15 bp, Homo sapiens
aaaagtcctaagtct

SEQ ID NO: 75408 - DNA, 15 bp, Homo sapiens
aaagtcctaagtctg

SEQ ID NO: 75409 - DNA, 15 bp, Homo sapiens
aagtcctaagtctgt

SEQ ID NO: 75410 - DNA, 15 bp, Homo sapiens
agtcctaagtctgta

SEQ ID NO: 75411 - DNA, 15 bp, Homo sapiens
gtcctaagtctgtag

SEQ ID NO: 75412 - DNA, 15 bp, Homo sapiens
tcctaagtctgtagg

SEQ ID NO: 75413 - DNA, 15 bp, Homo sapiens
cctaagtctgtaggg

SEQ ID NO: 75414 - DNA, 15 bp, Homo sapiens
ctaagtctgtagggc

SEQ ID NO: 75415 - DNA, 15 bp, Homo sapiens
taagtctgtagggct

SEQ ID NO: 75416 - DNA, 15 bp, Homo sapiens
aagtctgtagggcta

SEQ ID NO: 75417 - DNA, 15 bp, Homo sapiens
agtctgtagggctag

SEQ ID NO: 75418 - DNA, 15 bp, Homo sapiens
gtctgtagggctagg

SEQ ID NO: 75419 - DNA, 15 bp, Homo sapiens
tctgtagggctaggg

SEQ ID NO: 75420 - DNA, 15 bp, Homo sapiens
ctgtagggctagggg

SEQ ID NO: 75421 - DNA, 15 bp, Homo sapiens
tgtagggctaggggt

SEQ ID NO: 75422 - DNA, 15 bp, Homo sapiens
gtagggctaggggtg

SEQ ID NO: 75423 - DNA, 15 bp, Homo sapiens
tagggctaggggtgg

SEQ ID NO: 75424 - DNA, 15 bp, Homo sapiens
agggctaggggtggg

SEQ ID NO: 75425 - DNA, 15 bp, Homo sapiens
gggctaggggtgggg

SEQ ID NO: 75426 - DNA, 15 bp, Homo sapiens
ggctaggggtgggga

SEQ ID NO: 75427 - DNA, 15 bp, Homo sapiens
gctaggggtggggaa

SEQ ID NO: 75428 - DNA, 15 bp, Homo sapiens
ctaggggtggggaac

SEQ ID NO: 75429 - DNA, 15 bp, Homo sapiens
taggggtggggaacc

SEQ ID NO: 75430 - DNA, 15 bp, Homo sapiens
aggggtggggaaccc

SEQ ID NO: 75431 - DNA, 15 bp, Homo sapiens
ggggtggggaacccc

SEQ ID NO: 75432 - DNA, 15 bp, Homo sapiens
gggtggggaacccct

SEQ ID NO: 75433 - DNA, 15 bp, Homo sapiens
ggtggggaacccctt

SEQ ID NO: 75434 - DNA, 15 bp, Homo sapiens
gtggggaaccccttc

SEQ ID NO: 75435 - DNA, 15 bp, Homo sapiens
tggggaaccccttcg

SEQ ID NO: 75436 - DNA, 15 bp, Homo sapiens
ggggaaccccttcgc

SEQ ID NO: 75437 - DNA, 15 bp, Homo sapiens
gggaaccccttcgct

SEQ ID NO: 75438 - DNA, 15 bp, Homo sapiens
ggaaccccttcgctg

SEQ ID NO: 75439 - DNA, 15 bp, Homo sapiens
gaaccccttcgctgt

SEQ ID NO: 75440 - DNA, 15 bp, Homo sapiens
aaccccttcgctgtc

SEQ ID NO: 75441 - DNA, 15 bp, Homo sapiens
accccttcgctgtca

SEQ ID NO: 75442 - DNA, 15 bp, Homo sapiens
ccccttcgctgtcag

SEQ ID NO: 75443 - DNA, 15 bp, Homo sapiens
cccttcgctgtcagg

SEQ ID NO: 75444 - DNA, 15 bp, Homo sapiens
ccttcgctgtcagga

SEQ ID NO: 75445 - DNA, 15 bp, Homo sapiens
cttcgctgtcaggat

SEQ ID NO: 75446 - DNA, 15 bp, Homo sapiens
ttcgctgtcaggatc

SEQ ID NO: 75447 - DNA, 15 bp, Homo sapiens
tcgctgtcaggatca

SEQ ID NO: 75448 - DNA, 15 bp, Homo sapiens
cgctgtcaggatcaa

SEQ ID NO: 75449 - DNA, 15 bp, Homo sapiens
gctgtcaggatcaag

SEQ ID NO: 75450 - DNA, 15 bp, Homo sapiens
ctgtcaggatcaaga

SEQ ID NO: 75451 - DNA, 15 bp, Homo sapiens
tgtcaggatcaagag

SEQ ID NO: 75452 - DNA, 15 bp, Homo sapiens
gtcaggatcaagagg

SEQ ID NO: 75453 - DNA, 15 bp, Homo sapiens
tcaggatcaagaggg

SEQ ID NO: 75454 - DNA, 15 bp, Homo sapiens
caggatcaagagggc

SEQ ID NO: 75455 - DNA, 15 bp, Homo sapiens
aggatcaagagggca

SEQ ID NO: 75456 - DNA, 15 bp, Homo sapiens
ggatcaagagggcaa

SEQ ID NO: 75457 - DNA, 15 bp, Homo sapiens
gatcaagagggcaag

SEQ ID NO: 75458 - DNA, 15 bp, Homo sapiens
atcaagagggcaagg

SEQ ID NO: 75459 - DNA, 15 bp, Homo sapiens
tcaagagggcaaggg

SEQ ID NO: 75460 - DNA, 15 bp, Homo sapiens
caagagggcaagggg

SEQ ID NO: 75461 - DNA, 15 bp, Homo sapiens
aagagggcaagggga

SEQ ID NO: 75462 - DNA, 15 bp, Homo sapiens
agagggcaaggggaa

SEQ ID NO: 75463 - DNA, 15 bp, Homo sapiens
gagggcaaggggaac

SEQ ID NO: 75464 - DNA, 15 bp, Homo sapiens
agggcaaggggaact

SEQ ID NO: 75465 - DNA, 15 bp, Homo sapiens
gggcaaggggaactg

SEQ ID NO: 75466 - DNA, 15 bp, Homo sapiens
ggcaaggggaactgt

SEQ ID NO: 75467 - DNA, 15 bp, Homo sapiens
gcaaggggaactgtc

SEQ ID NO: 75468 - DNA, 15 bp, Homo sapiens
caaggggaactgtcg

SEQ ID NO: 75469 - DNA, 15 bp, Homo sapiens
aaggggaactgtcgc

SEQ ID NO: 75470 - DNA, 15 bp, Homo sapiens
aggggaactgtcgct

SEQ ID NO: 75471 - DNA, 15 bp, Homo sapiens
ggggaactgtcgctg

SEQ ID NO: 75472 - DNA, 15 bp, Homo sapiens
gggaactgtcgctgg

SEQ ID NO: 75473 - DNA, 15 bp, Homo sapiens
ggaactgtcgctgga

SEQ ID NO: 75474 - DNA, 15 bp, Homo sapiens
gaactgtcgctggag

SEQ ID NO: 75475 - DNA, 15 bp, Homo sapiens
aactgtcgctggagg

SEQ ID NO: 75476 - DNA, 15 bp, Homo sapiens
actgtcgctggagga

SEQ ID NO: 75477 - DNA, 15 bp, Homo sapiens
ctgtcgctggaggag

SEQ ID NO: 75478 - DNA, 15 bp, Homo sapiens
tgtcgctggaggaga

SEQ ID NO: 75479 - DNA, 15 bp, Homo sapiens
gtcgctggaggagac

SEQ ID NO: 75480 - DNA, 15 bp, Homo sapiens
tcgctggaggagaca

SEQ ID NO: 75481 - DNA, 15 bp, Homo sapiens
cgctggaggagacat

SEQ ID NO: 75482 - DNA, 15 bp, Homo sapiens
gctggaggagacatc

SEQ ID NO: 75483 - DNA, 15 bp, Homo sapiens
ctggaggagacatcc

SEQ ID NO: 75484 - DNA, 15 bp, Homo sapiens
tggaggagacatcca

SEQ ID NO: 75485 - DNA, 15 bp, Homo sapiens
ggaggagacatccag

SEQ ID NO: 75486 - DNA, 15 bp, Homo sapiens
gaggagacatccagc

SEQ ID NO: 75487 - DNA, 15 bp, Homo sapiens
aggagacatccagct

SEQ ID NO: 75488 - DNA, 15 bp, Homo sapiens
ggagacatccagctg

SEQ ID NO: 75489 - DNA, 15 bp, Homo sapiens
gagacatccagctgg

SEQ ID NO: 75490 - DNA, 15 bp, Homo sapiens
agacatccagctgga

SEQ ID NO: 75491 - DNA, 15 bp, Homo sapiens
gacatccagctggag

SEQ ID NO: 75492 - DNA, 15 bp, Homo sapiens
acatccagctggaga

SEQ ID NO: 75493 - DNA, 15 bp, Homo sapiens
catccagctggagaa

SEQ ID NO: 75494 - DNA, 15 bp, Homo sapiens
atccagctggagaaa

SEQ ID NO: 75495 - DNA, 15 bp, Homo sapiens
tccagctggagaaac

SEQ ID NO: 75496 - DNA, 15 bp, Homo sapiens
ccagctggagaaaca

SEQ ID NO: 75497 - DNA, 15 bp, Homo sapiens
cagctggagaaacaa

SEQ ID NO: 75498 - DNA, 15 bp, Homo sapiens
agctggagaaacaaa

SEQ ID NO: 75499 - DNA, 15 bp, Homo sapiens
gctggagaaacaaaa

SEQ ID NO: 75500 - DNA, 15 bp, Homo sapiens
ctggagaaacaaaag

SEQ ID NO: 75501 - DNA, 15 bp, Homo sapiens
tggagaaacaaaaga

SEQ ID NO: 75502 - DNA, 15 bp, Homo sapiens
ggagaaacaaaagag

SEQ ID NO: 75503 - DNA, 15 bp, Homo sapiens
gagaaacaaaagagt

SEQ ID NO: 75504 - DNA, 15 bp, Homo sapiens
agaaacaaaagagta

SEQ ID NO: 75505 - DNA, 15 bp, Homo sapiens
gaaacaaaagagtaa

SEQ ID NO: 75506 - DNA, 15 bp, Homo sapiens
aaacaaaagagtaag

SEQ ID NO: 75507 - DNA, 15 bp, Homo sapiens
aacaaaagagtaagt

SEQ ID NO: 75508 - DNA, 15 bp, Homo sapiens
acaaaagagtaagtc

SEQ ID NO: 75509 - DNA, 15 bp, Homo sapiens
caaaagagtaagtct

SEQ ID NO: 75510 - DNA, 15 bp, Homo sapiens
aaaagagtaagtctg

SEQ ID NO: 75511 - DNA, 15 bp, Homo sapiens
aaagagtaagtctgc

SEQ ID NO: 75512 - DNA, 15 bp, Homo sapiens
aagagtaagtctgcg

SEQ ID NO: 75513 - DNA, 15 bp, Homo sapiens
agagtaagtctgcgt

SEQ ID NO: 75514 - DNA, 15 bp, Homo sapiens
gagtaagtctgcgtt

SEQ ID NO: 75515 - DNA, 15 bp, Homo sapiens
agtaagtctgcgttg

SEQ ID NO: 75516 - DNA, 15 bp, Homo sapiens
gtaagtctgcgttgc

SEQ ID NO: 75517 - DNA, 15 bp, Homo sapiens
taagtctgcgttgct

SEQ ID NO: 75518 - DNA, 15 bp, Homo sapiens
aagtctgcgttgctg

SEQ ID NO: 75519 - DNA, 15 bp, Homo sapiens
agtctgcgttgctgc

SEQ ID NO: 75520 - DNA, 15 bp, Homo sapiens
gtctgcgttgctgct

SEQ ID NO: 75521 - DNA, 15 bp, Homo sapiens
tctgcgttgctgctt

SEQ ID NO: 75522 - DNA, 15 bp, Homo sapiens
ctgcgttgctgcttg

SEQ ID NO: 75523 - DNA, 15 bp, Homo sapiens
tgcgttgctgcttgt

SEQ ID NO: 75524 - DNA, 15 bp, Homo sapiens
gcgttgctgcttgtg

SEQ ID NO: 75525 - DNA, 15 bp, Homo sapiens
cgttgctgcttgtgg

SEQ ID NO: 75526 - DNA, 15 bp, Homo sapiens
gttgctgcttgtggg

SEQ ID NO: 75527 - DNA, 15 bp, Homo sapiens
ttgctgcttgtgggg

SEQ ID NO: 75528 - DNA, 15 bp, Homo sapiens
tgctgcttgtggggt

SEQ ID NO: 75529 - DNA, 15 bp, Homo sapiens
gctgcttgtggggtc

SEQ ID NO: 75530 - DNA, 15 bp, Homo sapiens
ctgcttgtggggtct

SEQ ID NO: 75531 - DNA, 15 bp, Homo sapiens
tgcttgtggggtctt

SEQ ID NO: 75532 - DNA, 15 bp, Homo sapiens
gcttgtggggtcttc

SEQ ID NO: 75533 - DNA, 15 bp, Homo sapiens
cttgtggggtcttcc

SEQ ID NO: 75534 - DNA, 15 bp, Homo sapiens
ttgtggggtcttccc

SEQ ID NO: 75535 - DNA, 15 bp, Homo sapiens
tgtggggtcttcccc

SEQ ID NO: 75536 - DNA, 15 bp, Homo sapiens
gtggggtcttcccca

SEQ ID NO: 75537 - DNA, 15 bp, Homo sapiens
tggggtcttccccat

SEQ ID NO: 75538 - DNA, 15 bp, Homo sapiens
ggggtcttccccatc

SEQ ID NO: 75539 - DNA, 15 bp, Homo sapiens
gggtcttccccatct

SEQ ID NO: 75540 - DNA, 15 bp, Homo sapiens
ggtcttccccatctc

SEQ ID NO: 75541 - DNA, 15 bp, Homo sapiens
gtcttccccatctca

SEQ ID NO: 75542 - DNA, 15 bp, Homo sapiens
tcttccccatctcag

SEQ ID NO: 75543 - DNA, 15 bp, Homo sapiens
cttccccatctcagg

SEQ ID NO: 75544 - DNA, 15 bp, Homo sapiens
ttccccatctcaggg

SEQ ID NO: 75545 - DNA, 15 bp, Homo sapiens
tccccatctcagggc

SEQ ID NO: 75546 - DNA, 15 bp, Homo sapiens
ccccatctcagggcg

SEQ ID NO: 75547 - DNA, 15 bp, Homo sapiens
cccatctcagggcgg

SEQ ID NO: 75548 - DNA, 15 bp, Homo sapiens
ccatctcagggcggg

SEQ ID NO: 75549 - DNA, 15 bp, Homo sapiens
catctcagggcgggg

SEQ ID NO: 75550 - DNA, 15 bp, Homo sapiens
atctcagggcgggga

SEQ ID NO: 75551 - DNA, 15 bp, Homo sapiens
tctcagggcggggac

SEQ ID NO: 75552 - DNA, 15 bp, Homo sapiens
ctcagggcggggacc

SEQ ID NO: 75553 - DNA, 15 bp, Homo sapiens
tcagggcggggaccg

SEQ ID NO: 75554 - DNA, 15 bp, Homo sapiens
cagggcggggaccgg

SEQ ID NO: 75555 - DNA, 15 bp, Homo sapiens
agggcggggaccggg

SEQ ID NO: 75556 - DNA, 15 bp, Homo sapiens
gggcggggaccgggg

SEQ ID NO: 75557 - DNA, 15 bp, Homo sapiens
ggcggggaccggggg

SEQ ID NO: 75558 - DNA, 15 bp, Homo sapiens
gcggggaccgggggt

SEQ ID NO: 75559 - DNA, 15 bp, Homo sapiens
cggggaccgggggtg

SEQ ID NO: 75560 - DNA, 15 bp, Homo sapiens
ggggaccgggggtgg

SEQ ID NO: 75561 - DNA, 15 bp, Homo sapiens
gggaccgggggtggc

SEQ ID NO: 75562 - DNA, 15 bp, Homo sapiens
ggaccgggggtggcg

SEQ ID NO: 75563 - DNA, 15 bp, Homo sapiens
gaccgggggtggcgg

SEQ ID NO: 75564 - DNA, 15 bp, Homo sapiens
accgggggtggcggt

SEQ ID NO: 75565 - DNA, 15 bp, Homo sapiens
ccgggggtggcggtc

SEQ ID NO: 75566 - DNA, 15 bp, Homo sapiens
cgggggtggcggtcc

SEQ ID NO: 75567 - DNA, 15 bp, Homo sapiens
gggggtggcggtcca

SEQ ID NO: 75568 - DNA, 15 bp, Homo sapiens
ggggtggcggtccag

SEQ ID NO: 75569 - DNA, 15 bp, Homo sapiens
gggtggcggtccaga

SEQ ID NO: 75570 - DNA, 15 bp, Homo sapiens
ggtggcggtccagac

SEQ ID NO: 75571 - DNA, 15 bp, Homo sapiens
gtggcggtccagaca

SEQ ID NO: 75572 - DNA, 15 bp, Homo sapiens
tggcggtccagacaa

SEQ ID NO: 75573 - DNA, 15 bp, Homo sapiens
ggcggtccagacaag

SEQ ID NO: 75574 - DNA, 15 bp, Homo sapiens
gcggtccagacaagt

SEQ ID NO: 75575 - DNA, 15 bp, Homo sapiens
cggtccagacaagta

SEQ ID NO: 75576 - DNA, 15 bp, Homo sapiens
ggtccagacaagtaa

SEQ ID NO: 75577 - DNA, 15 bp, Homo sapiens
gtccagacaagtaat

SEQ ID NO: 75578 - DNA, 15 bp, Homo sapiens
tccagacaagtaatc

SEQ ID NO: 75579 - DNA, 15 bp, Homo sapiens
ccagacaagtaatca

SEQ ID NO: 75580 - DNA, 15 bp, Homo sapiens
cagacaagtaatcaa

SEQ ID NO: 75581 - DNA, 15 bp, Homo sapiens
agacaagtaatcaag

SEQ ID NO: 75582 - DNA, 15 bp, Homo sapiens
gacaagtaatcaagg

SEQ ID NO: 75583 - DNA, 15 bp, Homo sapiens
acaagtaatcaagga

SEQ ID NO: 75584 - DNA, 15 bp, Homo sapiens
caagtaatcaaggac

SEQ ID NO: 75585 - DNA, 15 bp, Homo sapiens
aagtaatcaaggacg

SEQ ID NO: 75586 - DNA, 15 bp, Homo sapiens
agtaatcaaggacga

SEQ ID NO: 75587 - DNA, 15 bp, Homo sapiens
gtaatcaaggacgat

SEQ ID NO: 75588 - DNA, 15 bp, Homo sapiens
taatcaaggacgatg

SEQ ID NO: 75589 - DNA, 15 bp, Homo sapiens
aatcaaggacgatgc

SEQ ID NO: 75590 - DNA, 15 bp, Homo sapiens
atcaaggacgatgcc

SEQ ID NO: 75591 - DNA, 15 bp, Homo sapiens
tcaaggacgatgccc

SEQ ID NO: 75592 - DNA, 15 bp, Homo sapiens
caaggacgatgccca

SEQ ID NO: 75593 - DNA, 15 bp, Homo sapiens
aaggacgatgcccag

SEQ ID NO: 75594 - DNA, 15 bp, Homo sapiens
aggacgatgcccagg

SEQ ID NO: 75595 - DNA, 15 bp, Homo sapiens
ggacgatgcccagga

SEQ ID NO: 75596 - DNA, 15 bp, Homo sapiens
gacgatgcccaggag

SEQ ID NO: 75597 - DNA, 15 bp, Homo sapiens
acgatgcccaggagg

SEQ ID NO: 75598 - DNA, 15 bp, Homo sapiens
cgatgcccaggaggg

SEQ ID NO: 75599 - DNA, 15 bp, Homo sapiens
gatgcccaggagggg

SEQ ID NO: 75600 - DNA, 15 bp, Homo sapiens
atgcccaggagggga

SEQ ID NO: 75601 - DNA, 15 bp, Homo sapiens
tgcccaggaggggac

SEQ ID NO: 75602 - DNA, 15 bp, Homo sapiens
gcccaggaggggaca

SEQ ID NO: 75603 - DNA, 15 bp, Homo sapiens
cccaggaggggacag

SEQ ID NO: 75604 - DNA, 15 bp, Homo sapiens
ccaggaggggacagg

SEQ ID NO: 75605 - DNA, 15 bp, Homo sapiens
caggaggggacaggt

SEQ ID NO: 75606 - DNA, 15 bp, Homo sapiens
aggaggggacaggta

SEQ ID NO: 75607 - DNA, 15 bp, Homo sapiens
ggaggggacaggtac

SEQ ID NO: 75608 - DNA, 15 bp, Homo sapiens
gaggggacaggtacg

SEQ ID NO: 75609 - DNA, 15 bp, Homo sapiens
aggggacaggtacgg

SEQ ID NO: 75610 - DNA, 15 bp, Homo sapiens
ggggacaggtacggg

SEQ ID NO: 75611 - DNA, 15 bp, Homo sapiens
gggacaggtacgggg

SEQ ID NO: 75612 - DNA, 15 bp, Homo sapiens
ggacaggtacggggt

SEQ ID NO: 75613 - DNA, 15 bp, Homo sapiens
gacaggtacggggtg

SEQ ID NO: 75614 - DNA, 15 bp, Homo sapiens
acaggtacggggtgg

SEQ ID NO: 75615 - DNA, 15 bp, Homo sapiens
caggtacggggtggc

SEQ ID NO: 75616 - DNA, 15 bp, Homo sapiens
aggtacggggtggca

SEQ ID NO: 75617 - DNA, 15 bp, Homo sapiens
ggtacggggtggcag

SEQ ID NO: 75618 - DNA, 15 bp, Homo sapiens
gtacggggtggcagg

SEQ ID NO: 75619 - DNA, 15 bp, Homo sapiens
tacggggtggcagga

SEQ ID NO: 75620 - DNA, 15 bp, Homo sapiens
acggggtggcaggag

SEQ ID NO: 75621 - DNA, 15 bp, Homo sapiens
cggggtggcaggagc

SEQ ID NO: 75622 - DNA, 15 bp, Homo sapiens
ggggtggcaggagct

SEQ ID NO: 75623 - DNA, 15 bp, Homo sapiens
gggtggcaggagctc

SEQ ID NO: 75624 - DNA, 15 bp, Homo sapiens
ggtggcaggagctct

SEQ ID NO: 75625 - DNA, 15 bp, Homo sapiens
gtggcaggagctctg

SEQ ID NO: 75626 - DNA, 15 bp, Homo sapiens
tggcaggagctctgc

SEQ ID NO: 75627 - DNA, 15 bp, Homo sapiens
ggcaggagctctgcc

SEQ ID NO: 75628 - DNA, 15 bp, Homo sapiens
gcaggagctctgccg

SEQ ID NO: 75629 - DNA, 15 bp, Homo sapiens
caggagctctgccgg

SEQ ID NO: 75630 - DNA, 15 bp, Homo sapiens
aggagctctgccggc

SEQ ID NO: 75631 - DNA, 15 bp, Homo sapiens
ggagctctgccggcg

SEQ ID NO: 75632 - DNA, 15 bp, Homo sapiens
gagctctgccggcgg

SEQ ID NO: 75633 - DNA, 15 bp, Homo sapiens
agctctgccggcggg

SEQ ID NO: 75634 - DNA, 15 bp, Homo sapiens
gctctgccggcgggc

SEQ ID NO: 75635 - DNA, 15 bp, Homo sapiens
ctctgccggcgggct

SEQ ID NO: 75636 - DNA, 15 bp, Homo sapiens
tctgccggcgggctc

SEQ ID NO: 75637 - DNA, 15 bp, Homo sapiens
ctgccggcgggctca

SEQ ID NO: 75638 - DNA, 15 bp, Homo sapiens
tgccggcgggctcag

SEQ ID NO: 75639 - DNA, 15 bp, Homo sapiens
gccggcgggctcagg

SEQ ID NO: 75640 - DNA, 15 bp, Homo sapiens
ccggcgggctcagga

SEQ ID NO: 75641 - DNA, 15 bp, Homo sapiens
cggcgggctcaggaa

SEQ ID NO: 75642 - DNA, 15 bp, Homo sapiens
ggcgggctcaggaag

SEQ ID NO: 75643 - DNA, 15 bp, Homo sapiens
gcgggctcaggaagc

SEQ ID NO: 75644 - DNA, 15 bp, Homo sapiens
cgggctcaggaagcc

SEQ ID NO: 75645 - DNA, 15 bp, Homo sapiens
gggctcaggaagcct

SEQ ID NO: 75646 - DNA, 15 bp, Homo sapiens
ggctcaggaagcctt

SEQ ID NO: 75647 - DNA, 15 bp, Homo sapiens
gctcaggaagccttc

SEQ ID NO: 75648 - DNA, 15 bp, Homo sapiens
ctcaggaagccttca

SEQ ID NO: 75649 - DNA, 15 bp, Homo sapiens
tcaggaagccttcac

SEQ ID NO: 75650 - DNA, 15 bp, Homo sapiens
caggaagccttcacc

SEQ ID NO: 75651 - DNA, 15 bp, Homo sapiens
aggaagccttcacca

SEQ ID NO: 75652 - DNA, 15 bp, Homo sapiens
ggaagccttcaccac

SEQ ID NO: 75653 - DNA, 15 bp, Homo sapiens
gaagccttcaccaca

SEQ ID NO: 75654 - DNA, 15 bp, Homo sapiens
aagccttcaccacag

SEQ ID NO: 75655 - DNA, 15 bp, Homo sapiens
agccttcaccacagc

SEQ ID NO: 75656 - DNA, 15 bp, Homo sapiens
gccttcaccacagct

SEQ ID NO: 75657 - DNA, 15 bp, Homo sapiens
ccttcaccacagctg

SEQ ID NO: 75658 - DNA, 15 bp, Homo sapiens
cttcaccacagctgc

SEQ ID NO: 75659 - DNA, 15 bp, Homo sapiens
ttcaccacagctgcc

SEQ ID NO: 75660 - DNA, 15 bp, Homo sapiens
tcaccacagctgcct

SEQ ID NO: 75661 - DNA, 15 bp, Homo sapiens
caccacagctgcctg

SEQ ID NO: 75662 - DNA, 15 bp, Homo sapiens
accacagctgcctga

SEQ ID NO: 75663 - DNA, 15 bp, Homo sapiens
ccacagctgcctgag

SEQ ID NO: 75664 - DNA, 15 bp, Homo sapiens
cacagctgcctgagc

SEQ ID NO: 75665 - DNA, 15 bp, Homo sapiens
acagctgcctgagct

SEQ ID NO: 75666 - DNA, 15 bp, Homo sapiens
cagctgcctgagctc

SEQ ID NO: 75667 - DNA, 15 bp, Homo sapiens
agctgcctgagctca

SEQ ID NO: 75668 - DNA, 15 bp, Homo sapiens
gctgcctgagctcac

SEQ ID NO: 75669 - DNA, 15 bp, Homo sapiens
ctgcctgagctcacc

SEQ ID NO: 75670 - DNA, 15 bp, Homo sapiens
tgcctgagctcaccc

SEQ ID NO: 75671 - DNA, 15 bp, Homo sapiens
gcctgagctcaccct

SEQ ID NO: 75672 - DNA, 15 bp, Homo sapiens
cctgagctcaccctt

SEQ ID NO: 75673 - DNA, 15 bp, Homo sapiens
ctgagctcacccttg

SEQ ID NO: 75674 - DNA, 15 bp, Homo sapiens
tgagctcacccttgc

SEQ ID NO: 75675 - DNA, 15 bp, Homo sapiens
gagctcacccttgcc

SEQ ID NO: 75676 - DNA, 15 bp, Homo sapiens
agctcacccttgcca

SEQ ID NO: 75677 - DNA, 15 bp, Homo sapiens
gctcacccttgccaa

SEQ ID NO: 75678 - DNA, 15 bp, Homo sapiens
ctcacccttgccaaa

SEQ ID NO: 75679 - DNA, 15 bp, Homo sapiens
tcacccttgccaaat

SEQ ID NO: 75680 - DNA, 15 bp, Homo sapiens
cacccttgccaaatg

SEQ ID NO: 75681 - DNA, 15 bp, Homo sapiens
acccttgccaaatga

SEQ ID NO: 75682 - DNA, 15 bp, Homo sapiens
cccttgccaaatgag

SEQ ID NO: 75683 - DNA, 15 bp, Homo sapiens
ccttgccaaatgagg

SEQ ID NO: 75684 - DNA, 15 bp, Homo sapiens
cttgccaaatgaggg

SEQ ID NO: 75685 - DNA, 15 bp, Homo sapiens
ttgccaaatgagggc

SEQ ID NO: 75686 - DNA, 15 bp, Homo sapiens
tgccaaatgagggct

SEQ ID NO: 75687 - DNA, 15 bp, Homo sapiens
gccaaatgagggctg

SEQ ID NO: 75688 - DNA, 15 bp, Homo sapiens
ccaaatgagggctgg

SEQ ID NO: 75689 - DNA, 15 bp, Homo sapiens
caaatgagggctggg

SEQ ID NO: 75690 - DNA, 15 bp, Homo sapiens
aaatgagggctgggg

SEQ ID NO: 75691 - DNA, 15 bp, Homo sapiens
aatgagggctggggc

SEQ ID NO: 75692 - DNA, 15 bp, Homo sapiens
atgagggctggggca

SEQ ID NO: 75693 - DNA, 15 bp, Homo sapiens
tgagggctggggcag

SEQ ID NO: 75694 - DNA, 15 bp, Homo sapiens
gagggctggggcagc

SEQ ID NO: 75695 - DNA, 15 bp, Homo sapiens
agggctggggcagca

SEQ ID NO: 75696 - DNA, 15 bp, Homo sapiens
gggctggggcagcag

SEQ ID NO: 75697 - DNA, 15 bp, Homo sapiens
ggctggggcagcagc

SEQ ID NO: 75698 - DNA, 15 bp, Homo sapiens
gctggggcagcagca

SEQ ID NO: 75699 - DNA, 15 bp, Homo sapiens
ctggggcagcagcaa

SEQ ID NO: 75700 - DNA, 15 bp, Homo sapiens
tggggcagcagcaac

SEQ ID NO: 75701 - DNA, 15 bp, Homo sapiens
ggggcagcagcaacg

SEQ ID NO: 75702 - DNA, 15 bp, Homo sapiens
gggcagcagcaacgc

SEQ ID NO: 75703 - DNA, 15 bp, Homo sapiens
ggcagcagcaacgca

SEQ ID NO: 75704 - DNA, 15 bp, Homo sapiens
gcagcagcaacgcat

SEQ ID NO: 75705 - DNA, 15 bp, Homo sapiens
cagcagcaacgcata

SEQ ID NO: 75706 - DNA, 15 bp, Homo sapiens
agcagcaacgcatac

SEQ ID NO: 75707 - DNA, 15 bp, Homo sapiens
gcagcaacgcataca

SEQ ID NO: 75708 - DNA, 15 bp, Homo sapiens
cagcaacgcatacac

SEQ ID NO: 75709 - DNA, 15 bp, Homo sapiens
agcaacgcatacact

SEQ ID NO: 75710 - DNA, 15 bp, Homo sapiens
gcaacgcatacactc

SEQ ID NO: 75711 - DNA, 15 bp, Homo sapiens
caacgcatacactca

SEQ ID NO: 75712 - DNA, 15 bp, Homo sapiens
aacgcatacactcac

SEQ ID NO: 75713 - DNA, 15 bp, Homo sapiens
acgcatacactcacg

SEQ ID NO: 75714 - DNA, 15 bp, Homo sapiens
cgcatacactcacgg

SEQ ID NO: 75715 - DNA, 15 bp, Homo sapiens
gcatacactcacggc

SEQ ID NO: 75716 - DNA, 15 bp, Homo sapiens
catacactcacggct

SEQ ID NO: 75717 - DNA, 15 bp, Homo sapiens
atacactcacggctg

SEQ ID NO: 75718 - DNA, 15 bp, Homo sapiens
tacactcacggctgt

SEQ ID NO: 75719 - DNA, 15 bp, Homo sapiens
acactcacggctgtg

SEQ ID NO: 75720 - DNA, 15 bp, Homo sapiens
cactcacggctgtgg

SEQ ID NO: 75721 - DNA, 15 bp, Homo sapiens
actcacggctgtggc

SEQ ID NO: 75722 - DNA, 15 bp, Homo sapiens
ctcacggctgtggcg

SEQ ID NO: 75723 - DNA, 15 bp, Homo sapiens
tcacggctgtggcgg

SEQ ID NO: 75724 - DNA, 15 bp, Homo sapiens
cacggctgtggcggg

SEQ ID NO: 75725 - DNA, 15 bp, Homo sapiens
acggctgtggcgggc

SEQ ID NO: 75726 - DNA, 15 bp, Homo sapiens
cggctgtggcgggca

SEQ ID NO: 75727 - DNA, 15 bp, Homo sapiens
ggctgtggcgggcag

SEQ ID NO: 75728 - DNA, 15 bp, Homo sapiens
gctgtggcgggcagc

SEQ ID NO: 75729 - DNA, 15 bp, Homo sapiens
ctgtggcgggcagcg

SEQ ID NO: 75730 - DNA, 15 bp, Homo sapiens
tgtggcgggcagcgt

SEQ ID NO: 75731 - DNA, 15 bp, Homo sapiens
gtggcgggcagcgtt

SEQ ID NO: 75732 - DNA, 15 bp, Homo sapiens
tggcgggcagcgttc

SEQ ID NO: 75733 - DNA, 15 bp, Homo sapiens
ggcgggcagcgttct

SEQ ID NO: 75734 - DNA, 15 bp, Homo sapiens
gcgggcagcgttctc

SEQ ID NO: 75735 - DNA, 15 bp, Homo sapiens
cgggcagcgttctcg

SEQ ID NO: 75736 - DNA, 15 bp, Homo sapiens
gggcagcgttctcgg

SEQ ID NO: 75737 - DNA, 15 bp, Homo sapiens
ggcagcgttctcggc

SEQ ID NO: 75738 - DNA, 15 bp, Homo sapiens
gcagcgttctcggca

SEQ ID NO: 75739 - DNA, 15 bp, Homo sapiens
cagcgttctcggcat

SEQ ID NO: 75740 - DNA, 15 bp, Homo sapiens
agcgttctcggcata

SEQ ID NO: 75741 - DNA, 15 bp, Homo sapiens
gcgttctcggcatat

SEQ ID NO: 75742 - DNA, 15 bp, Homo sapiens
cgttctcggcatatt

SEQ ID NO: 75743 - DNA, 15 bp, Homo sapiens
gttctcggcatattt

SEQ ID NO: 75744 - DNA, 15 bp, Homo sapiens
ttctcggcatatttc

SEQ ID NO: 75745 - DNA, 15 bp, Homo sapiens
tctcggcatatttca

SEQ ID NO: 75746 - DNA, 15 bp, Homo sapiens
ctcggcatatttcag

SEQ ID NO: 75747 - DNA, 15 bp, Homo sapiens
tcggcatatttcagg

SEQ ID NO: 75748 - DNA, 15 bp, Homo sapiens
cggcatatttcagga

SEQ ID NO: 75749 - DNA, 15 bp, Homo sapiens
ggcatatttcaggac

SEQ ID NO: 75750 - DNA, 15 bp, Homo sapiens
gcatatttcaggaca

SEQ ID NO: 75751 - DNA, 15 bp, Homo sapiens
catatttcaggacac

SEQ ID NO: 75752 - DNA, 15 bp, Homo sapiens
atatttcaggacacc

SEQ ID NO: 75753 - DNA, 15 bp, Homo sapiens
tatttcaggacacct

SEQ ID NO: 75754 - DNA, 15 bp, Homo sapiens
atttcaggacaccta

SEQ ID NO: 75755 - DNA, 15 bp, Homo sapiens
tttcaggacacctaa

SEQ ID NO: 75756 - DNA, 15 bp, Homo sapiens
ttcaggacacctaag

SEQ ID NO: 75757 - DNA, 15 bp, Homo sapiens
tcaggacacctaagg

SEQ ID NO: 75758 - DNA, 15 bp, Homo sapiens
caggacacctaagga

SEQ ID NO: 75759 - DNA, 15 bp, Homo sapiens
aggacacctaaggag

SEQ ID NO: 75760 - DNA, 15 bp, Homo sapiens
ggacacctaaggaga

SEQ ID NO: 75761 - DNA, 15 bp, Homo sapiens
gacacctaaggagac

SEQ ID NO: 75762 - DNA, 15 bp, Homo sapiens
acacctaaggagact

SEQ ID NO: 75763 - DNA, 15 bp, Homo sapiens
cacctaaggagactg

SEQ ID NO: 75764 - DNA, 15 bp, Homo sapiens
acctaaggagactga

SEQ ID NO: 75765 - DNA, 15 bp, Homo sapiens
cctaaggagactgaa

SEQ ID NO: 75766 - DNA, 15 bp, Homo sapiens
ctaaggagactgaat

SEQ ID NO: 75767 - DNA, 15 bp, Homo sapiens
taaggagactgaatg

SEQ ID NO: 75768 - DNA, 15 bp, Homo sapiens
aaggagactgaatgg

SEQ ID NO: 75769 - DNA, 15 bp, Homo sapiens
aggagactgaatggc

SEQ ID NO: 75770 - DNA, 15 bp, Homo sapiens
ggagactgaatggct

SEQ ID NO: 75771 - DNA, 15 bp, Homo sapiens
gagactgaatggctc

SEQ ID NO: 75772 - DNA, 15 bp, Homo sapiens
agactgaatggctca

SEQ ID NO: 75773 - DNA, 15 bp, Homo sapiens
gactgaatggctcaa

SEQ ID NO: 75774 - DNA, 15 bp, Homo sapiens
actgaatggctcaag

SEQ ID NO: 75775 - DNA, 15 bp, Homo sapiens
ctgaatggctcaagg

SEQ ID NO: 75776 - DNA, 15 bp, Homo sapiens
tgaatggctcaaggc

SEQ ID NO: 75777 - DNA, 15 bp, Homo sapiens
gaatggctcaaggct

SEQ ID NO: 75778 - DNA, 15 bp, Homo sapiens
aatggctcaaggctg

SEQ ID NO: 75779 - DNA, 15 bp, Homo sapiens
atggctcaaggctgc

SEQ ID NO: 75780 - DNA, 15 bp, Homo sapiens
tggctcaaggctgct

SEQ ID NO: 75781 - DNA, 15 bp, Homo sapiens
ggctcaaggctgctg

SEQ ID NO: 75782 - DNA, 15 bp, Homo sapiens
gctcaaggctgctgc

SEQ ID NO: 75783 - DNA, 15 bp, Homo sapiens
ctcaaggctgctgcc

SEQ ID NO: 75784 - DNA, 15 bp, Homo sapiens
tcaaggctgctgccg

SEQ ID NO: 75785 - DNA, 15 bp, Homo sapiens
caaggctgctgccgt

SEQ ID NO: 75786 - DNA, 15 bp, Homo sapiens
aaggctgctgccgtg

SEQ ID NO: 75787 - DNA, 15 bp, Homo sapiens
aggctgctgccgtgt

SEQ ID NO: 75788 - DNA, 15 bp, Homo sapiens
ggctgctgccgtgtg

SEQ ID NO: 75789 - DNA, 15 bp, Homo sapiens
gctgctgccgtgtgc

SEQ ID NO: 75790 - DNA, 15 bp, Homo sapiens
ctgctgccgtgtgca

SEQ ID NO: 75791 - DNA, 15 bp, Homo sapiens
tgctgccgtgtgcag

SEQ ID NO: 75792 - DNA, 15 bp, Homo sapiens
gctgccgtgtgcagg

SEQ ID NO: 75793 - DNA, 15 bp, Homo sapiens
ctgccgtgtgcaggg

SEQ ID NO: 75794 - DNA, 15 bp, Homo sapiens
tgccgtgtgcagggg

SEQ ID NO: 75795 - DNA, 15 bp, Homo sapiens
gccgtgtgcaggggg

SEQ ID NO: 75796 - DNA, 15 bp, Homo sapiens
ccgtgtgcagggggc

SEQ ID NO: 75797 - DNA, 15 bp, Homo sapiens
cgtgtgcagggggct

SEQ ID NO: 75798 - DNA, 15 bp, Homo sapiens
gtgtgcagggggcta

SEQ ID NO: 75799 - DNA, 15 bp, Homo sapiens
tgtgcagggggctag

SEQ ID NO: 75800 - DNA, 15 bp, Homo sapiens
gtgcagggggctaga

SEQ ID NO: 75801 - DNA, 15 bp, Homo sapiens
tgcagggggctagac

SEQ ID NO: 75802 - DNA, 15 bp, Homo sapiens
gcagggggctagacg

SEQ ID NO: 75803 - DNA, 15 bp, Homo sapiens
cagggggctagacgt

SEQ ID NO: 75804 - DNA, 15 bp, Homo sapiens
agggggctagacgtg

SEQ ID NO: 75805 - DNA, 15 bp, Homo sapiens
gggggctagacgtgg

SEQ ID NO: 75806 - DNA, 15 bp, Homo sapiens
ggggctagacgtggg

SEQ ID NO: 75807 - DNA, 15 bp, Homo sapiens
gggctagacgtgggg

SEQ ID NO: 75808 - DNA, 15 bp, Homo sapiens
ggctagacgtggggc

SEQ ID NO: 75809 - DNA, 15 bp, Homo sapiens
gctagacgtggggcg

SEQ ID NO: 75810 - DNA, 15 bp, Homo sapiens
ctagacgtggggcgg

SEQ ID NO: 75811 - DNA, 15 bp, Homo sapiens
tagacgtggggcggg

SEQ ID NO: 75812 - DNA, 15 bp, Homo sapiens
agacgtggggcgggc

SEQ ID NO: 75813 - DNA, 15 bp, Homo sapiens
gacgtggggcgggca

SEQ ID NO: 75814 - DNA, 15 bp, Homo sapiens
acgtggggcgggcag

SEQ ID NO: 75815 - DNA, 15 bp, Homo sapiens
cgtggggcgggcagg

SEQ ID NO: 75816 - DNA, 15 bp, Homo sapiens
gtggggcgggcaggc

SEQ ID NO: 75817 - DNA, 15 bp, Homo sapiens
tggggcgggcaggca

SEQ ID NO: 75818 - DNA, 15 bp, Homo sapiens
ggggcgggcaggcag

SEQ ID NO: 75819 - DNA, 15 bp, Homo sapiens
gggcgggcaggcagg

SEQ ID NO: 75820 - DNA, 15 bp, Homo sapiens
ggcgggcaggcaggg

SEQ ID NO: 75821 - DNA, 15 bp, Homo sapiens
gcgggcaggcagggc

SEQ ID NO: 75822 - DNA, 15 bp, Homo sapiens
cgggcaggcagggct

SEQ ID NO: 75823 - DNA, 15 bp, Homo sapiens
gggcaggcagggctc

SEQ ID NO: 75824 - DNA, 15 bp, Homo sapiens
ggcaggcagggctcc

SEQ ID NO: 75825 - DNA, 15 bp, Homo sapiens
gcaggcagggctcct

SEQ ID NO: 75826 - DNA, 15 bp, Homo sapiens
caggcagggctcctg

SEQ ID NO: 75827 - DNA, 15 bp, Homo sapiens
aggcagggctcctgg

SEQ ID NO: 75828 - DNA, 15 bp, Homo sapiens
ggcagggctcctggt

SEQ ID NO: 75829 - DNA, 15 bp, Homo sapiens
gcagggctcctggta

SEQ ID NO: 75830 - DNA, 15 bp, Homo sapiens
cagggctcctggtaa

SEQ ID NO: 75831 - DNA, 15 bp, Homo sapiens
agggctcctggtaac

SEQ ID NO: 75832 - DNA, 15 bp, Homo sapiens
gggctcctggtaaca

SEQ ID NO: 75833 - DNA, 15 bp, Homo sapiens
ggctcctggtaacag

SEQ ID NO: 75834 - DNA, 15 bp, Homo sapiens
gctcctggtaacagc

SEQ ID NO: 75835 - DNA, 15 bp, Homo sapiens
ctcctggtaacagcc

SEQ ID NO: 75836 - DNA, 15 bp, Homo sapiens
tcctggtaacagccc

SEQ ID NO: 75837 - DNA, 15 bp, Homo sapiens
cctggtaacagccct

SEQ ID NO: 75838 - DNA, 15 bp, Homo sapiens
ctggtaacagccctg

SEQ ID NO: 75839 - DNA, 15 bp, Homo sapiens
tggtaacagccctgc

SEQ ID NO: 75840 - DNA, 15 bp, Homo sapiens
ggtaacagccctgca

SEQ ID NO: 75841 - DNA, 15 bp, Homo sapiens
gtaacagccctgcag

SEQ ID NO: 75842 - DNA, 15 bp, Homo sapiens
taacagccctgcagg

SEQ ID NO: 75843 - DNA, 15 bp, Homo sapiens
aacagccctgcaggc

SEQ ID NO: 75844 - DNA, 15 bp, Homo sapiens
acagccctgcaggcc

SEQ ID NO: 75845 - DNA, 15 bp, Homo sapiens
cagccctgcaggccg

SEQ ID NO: 75846 - DNA, 15 bp, Homo sapiens
agccctgcaggccgc

SEQ ID NO: 75847 - DNA, 15 bp, Homo sapiens
gccctgcaggccgca

SEQ ID NO: 75848 - DNA, 15 bp, Homo sapiens
ccctgcaggccgcag

SEQ ID NO: 75849 - DNA, 15 bp, Homo sapiens
cctgcaggccgcagt

SEQ ID NO: 75850 - DNA, 15 bp, Homo sapiens
ctgcaggccgcagtg

SEQ ID NO: 75851 - DNA, 15 bp, Homo sapiens
tgcaggccgcagtgg

SEQ ID NO: 75852 - DNA, 15 bp, Homo sapiens
gcaggccgcagtgga

SEQ ID NO: 75853 - DNA, 15 bp, Homo sapiens
caggccgcagtggag

SEQ ID NO: 75854 - DNA, 15 bp, Homo sapiens
aggccgcagtggaga
